United States Patent 10,706,955 (BIOINFORMATIC PROCESSES FOR DETERMINATION OF PEPTIDE BINDING) - sequence listing, part 55

SEQ ID NO: 2102208 - protein, 16 aa, Staphylococcus
YGGSGALRQQIETGAP

SEQ ID NO: 2102209 - protein, 31 aa, Staphylococcus
YGHTGEDVNTYAHGPSENKFAGNNDNTDSAK

SEQ ID NO: 2102210 - protein, 31 aa, Staphylococcus
YGHTGEDVNTYAYGPGADKFRGNIDNTDSAK

SEQ ID NO: 2102211 - protein, 41 aa, Staphylococcus
YGHTGEDVNTYAYGPGEDKFLGNKDNTDSAKNIFAFLANNA

SEQ ID NO: 2102212 - protein, 19 aa, Staphylococcus
YGHTGEDVNTYAYGPGSDF

SEQ ID NO: 2102213 - protein, 41 aa, Staphylococcus
YGHTGEDVNTYAYGPGSNQFKGNKENTDSAKNIFDFFANDV

SEQ ID NO: 2102214 - protein, 10 aa, Staphylococcus
YGKDSDYKKV

SEQ ID NO: 2102215 - protein, 30 aa, Staphylococcus
YGKEDKAKALNDELDKKIADTKKRTAKTDK

SEQ ID NO: 2102216 - protein, 5 aa, Staphylococcus
YGKNA

SEQ ID NO: 2102217 - protein, 15 aa, Staphylococcus
YGKPLNKPSGTAHGN

SEQ ID NO: 2102218 - protein, 8 aa, Staphylococcus
YGKPTNSL

SEQ ID NO: 2102219 - protein, 13 aa, Staphylococcus
YGNNDSKAKNIKG

SEQ ID NO: 2102220 - protein, 6 aa, Staphylococcus
YGNNVD

SEQ ID NO: 2102221 - protein, 13 aa, Staphylococcus
YGNRDKKGSNIKG

SEQ ID NO: 2102222 - protein, 13 aa, Staphylococcus
YGNSDTKGKNIKG

SEQ ID NO: 2102223 - protein, 9 aa, Staphylococcus
YGPYNTDTR

SEQ ID NO: 2102224 - protein, 22 aa, Staphylococcus
YGPYNTNTRTIPASEVSSYAFI

SEQ ID NO: 2102225 - protein, 14 aa, Staphylococcus
YGQPIEKPFESAQG

SEQ ID NO: 2102226 - protein, 13 aa, Staphylococcus
YGQPNYYSPTSAW

SEQ ID NO: 2102227 - protein, 12 aa, Staphylococcus
YGQSGKNETPEY

SEQ ID NO: 2102228 - protein, 11 aa, Staphylococcus
YGSEKVDAALE

SEQ ID NO: 2102229 - protein, 11 aa, Staphylococcus
YGSNVTPEDIN

SEQ ID NO: 2102230 - protein, 5 aa, Staphylococcus
YGTDA

SEQ ID NO: 2102231 - protein, 17 aa, Staphylococcus
YGTRTISKGSARHYNYI

SEQ ID NO: 2102232 - protein, 17 aa, Staphylococcus
YGVNEDGSNSKKLVDDY

SEQ ID NO: 2102233 - protein, 16 aa, Staphylococcus
YGVNEDGSSNKKLVKD

SEQ ID NO: 2102234 - protein, 17 aa, Staphylococcus
YGVNKDGSSNKKLVDDY

SEQ ID NO: 2102235 - protein, 26 aa, Staphylococcus
YGYNTQSYNTPQRTGGLGASYSATSH

SEQ ID NO: 2102236 - protein, 12 aa, Staphylococcus
YHGKGKGKKQPA

SEQ ID NO: 2102237 - protein, 5 aa, Staphylococcus
YHQDY

SEQ ID NO: 2102238 - protein, 6 aa, Staphylococcus
YHSTTM

SEQ ID NO: 2102239 - protein, 27 aa, Staphylococcus
YHTTETNTTSTSTSTQSISTSSGNLYT

SEQ ID NO: 2102240 - protein, 7 aa, Staphylococcus
YIAEKDP

SEQ ID NO: 2102241 - protein, 4 aa, Staphylococcus
YIDK

SEQ ID NO: 2102242 - protein, 8 aa, Staphylococcus
YIDTGKAD

SEQ ID NO: 2102243 - protein, 5 aa, Staphylococcus
YIDTN

SEQ ID NO: 2102244 - protein, 5 aa, Staphylococcus
YIEDK

SEQ ID NO: 2102245 - protein, 8 aa, Staphylococcus
YINEKNPD

SEQ ID NO: 2102246 - protein, 12 aa, Staphylococcus
YKAEDNGGTIEI

SEQ ID NO: 2102247 - protein, 29 aa, Staphylococcus
YKARGEKQDGSDAKTIKDTVEVPKNPKRA

SEQ ID NO: 2102248 - protein, 6 aa, Staphylococcus
YKASKI

SEQ ID NO: 2102249 - protein, 7 aa, Staphylococcus
YKDEGKL

SEQ ID NO: 2102250 - protein, 4 aa, Staphylococcus
YKDG

SEQ ID NO: 2102251 - protein, 10 aa, Staphylococcus
YKDGDGFKDY

SEQ ID NO: 2102252 - protein, 12 aa, Staphylococcus
YKDIKDIPKGST

SEQ ID NO: 2102253 - protein, 8 aa, Staphylococcus
YKDKPENT

SEQ ID NO: 2102254 - protein, 13 aa, Staphylococcus
YKDNKGKSHLEKT

SEQ ID NO: 2102255 - protein, 9 aa, Staphylococcus
YKDRDIKKA

SEQ ID NO: 2102256 - protein, 13 aa, Staphylococcus
YKDRKGKSHLEKT

SEQ ID NO: 2102257 - protein, 21 aa, Staphylococcus
YKEANDTVNRHQLEGTGSIQN

SEQ ID NO: 2102258 - protein, 25 aa, Staphylococcus
YKEGDGYASYEKVTKADRKALSDTV

SEQ ID NO: 2102259 - protein, 8 aa, Staphylococcus
YKEQHKEL

SEQ ID NO: 2102260 - protein, 8 aa, Staphylococcus
YKERNAKP

SEQ ID NO: 2102261 - protein, 17 aa, Staphylococcus
YKESRRAHPLNEKGQRS

SEQ ID NO: 2102262 - protein, 5 aa, Staphylococcus
YKGKV

SEQ ID NO: 2102263 - protein, 7 aa, Staphylococcus
YKGQKAV

SEQ ID NO: 2102264 - protein, 27 aa, Staphylococcus
YKGQNKVDINQEGNELSVHETNEKVDK

SEQ ID NO: 2102265 - protein, 8 aa, Staphylococcus
YKGQYSDG

SEQ ID NO: 2102266 - protein, 30 aa, Staphylococcus
YKHPEKYPNHLSKEEQRRQRHREERARQKD

SEQ ID NO: 2102267 - protein, 9 aa, Staphylococcus
YKKDDSGMI

SEQ ID NO: 2102268 - protein, 8 aa, Staphylococcus
YKKEGKSQ

SEQ ID NO: 2102269 - protein, 12 aa, Staphylococcus
YKKEIKKDKAIQ

SEQ ID NO: 2102270 - protein, 7 aa, Staphylococcus
YKKGNRG

SEQ ID NO: 2102271 - protein, 9 aa, Staphylococcus
YKKQEETNK

SEQ ID NO: 2102272 - protein, 17 aa, Staphylococcus
YKNAKRSGYATGHKPRR

SEQ ID NO: 2102273 - protein, 24 aa, Staphylococcus
YKNATKISKDTKDVADVNAYDKDL

SEQ ID NO: 2102274 - protein, 4 aa, Staphylococcus
YKNG

SEQ ID NO: 2102275 - protein, 5 aa, Staphylococcus
YKNGT

SEQ ID NO: 2102276 - protein, 9 aa, Staphylococcus
YKNHKANNI

SEQ ID NO: 2102277 - protein, 12 aa, Staphylococcus
YKNIKDIPEGST

SEQ ID NO: 2102278 - protein, 11 aa, Staphylococcus
YKNKKKIDNVK

SEQ ID NO: 2102279 - protein, 12 aa, Staphylococcus
YKNLKDIPDGST

SEQ ID NO: 2102280 - protein, 12 aa, Staphylococcus
YKNLKDIPEGST

SEQ ID NO: 2102281 - protein, 39 aa, Staphylococcus
YKNNDGYKDYSAVTKEDRKALSDAVNSLGEPLSKMAVVT

SEQ ID NO: 2102282 - protein, 9 aa, Staphylococcus
YKNNGDGTI

SEQ ID NO: 2102283 - protein, 10 aa, Staphylococcus
YKPDAPKLDD

SEQ ID NO: 2102284 - protein, 16 aa, Staphylococcus
YKPEGAINAGGYDNAK

SEQ ID NO: 2102285 - protein, 11 aa, Staphylococcus
YKQPSKSVSAF

SEQ ID NO: 2102286 - protein, 8 aa, Staphylococcus
YKRADGVR

SEQ ID NO: 2102287 - protein, 8 aa, Staphylococcus
YKSSKGPD

SEQ ID NO: 2102288 - protein, 14 aa, Staphylococcus
YKTTGYDDKGNSKK

SEQ ID NO: 2102289 - protein, 14 aa, Staphylococcus
YKVDTDAKKEFDHN

SEQ ID NO: 2102290 - protein, 5 aa, Staphylococcus
YKYGT

SEQ ID NO: 2102291 - protein, 14 aa, Staphylococcus
YKYTKESKGSSLDD

SEQ ID NO: 2102292 - protein, 5 aa, Staphylococcus
YLDKN

SEQ ID NO: 2102293 - protein, 12 aa, Staphylococcus
YLDSNVDASWFT

SEQ ID NO: 2102294 - protein, 12 aa, Staphylococcus
YLGGSDHSDPHG

SEQ ID NO: 2102295 - protein, 9 aa, Staphylococcus
YLPKDTKDN

SEQ ID NO: 2102296 - protein, 5 aa, Staphylococcus
YLSKS

SEQ ID NO: 2102297 - protein, 5 aa, Staphylococcus
YLSNH

SEQ ID NO: 2102298 - protein, 7 aa, Staphylococcus
YLSNPSD

SEQ ID NO: 2102299 - protein, 5 aa, Staphylococcus
YLTND

SEQ ID NO: 2102300 - protein, 9 aa, Staphylococcus
YNDNNSDTL

SEQ ID NO: 2102301 - protein, 8 aa, Staphylococcus
YNDNTKAY

SEQ ID NO: 2102302 - protein, 10 aa, Staphylococcus
YNDTNGPTYK

SEQ ID NO: 2102303 - protein, 7 aa, Staphylococcus
YNEKTGV

SEQ ID NO: 2102304 - protein, 7 aa, Staphylococcus
YNEQTGV

SEQ ID NO: 2102305 - protein, 18 aa, Staphylococcus
YNEQTNTWEDRKIFIAEA

SEQ ID NO: 2102306 - protein, 9 aa, Staphylococcus
YNETEIEER

SEQ ID NO: 2102307 - protein, 18 aa, Staphylococcus
YNGEAKTWKDVNSSWPDK

SEQ ID NO: 2102308 - protein, 12 aa, Staphylococcus
YNGGGEQKSIDT

SEQ ID NO: 2102309 - protein, 6 aa, Staphylococcus
YNGGPY

SEQ ID NO: 2102310 - protein, 9 aa, Staphylococcus
YNGNTSRGW

SEQ ID NO: 2102311 - protein, 36 aa, Staphylococcus
YNGSDSLSSSKDSDSSSEDDSSSDDSSSSEEVTRDN

SEQ ID NO: 2102312 - protein, 30 aa, Staphylococcus
YNIKGNSNIYETPWGSSSQIKATVPSKGDV

SEQ ID NO: 2102313 - protein, 12 aa, Staphylococcus
YNIKSELTKQGY

SEQ ID NO: 2102314 - protein, 28 aa, Staphylococcus
YNIPTKQAPELKLKGDGDLKGSSIGSKD

SEQ ID NO: 2102315 - protein, 28 aa, Staphylococcus
YNIPTKQAPELKLQGDGDLKGSSIGSKD

SEQ ID NO: 2102316 - protein, 31 aa, Staphylococcus
YNKEDKAKDLNKKLDDKIADVKTKAKKVNKS

SEQ ID NO: 2102317 - protein, 29 aa, Staphylococcus
YNKEDKAKDMNTKLDQKISDMKKQTKDLD

SEQ ID NO: 2102318 - protein, 10 aa, Staphylococcus
YNKPDGPTFK

SEQ ID NO: 2102319 - protein, 18 aa, Staphylococcus
YNLKGNKSYIQTPYPTYN

SEQ ID NO: 2102320 - protein, 18 aa, Staphylococcus
YNNDYSKSSQEKDQLRKA

SEQ ID NO: 2102321 - protein, 9 aa, Staphylococcus
YNNSKSIAY

SEQ ID NO: 2102322 - protein, 9 aa, Staphylococcus
YNPGQPTRE

SEQ ID NO: 2102323 - protein, 8 aa, Staphylococcus
YNPNNQEK

SEQ ID NO: 2102324 - protein, 11 aa, Staphylococcus
YNQANGPTYQK

SEQ ID NO: 2102325 - protein, 8 aa, Staphylococcus
YNQAPDNT

SEQ ID NO: 2102326 - protein, 13 aa, Staphylococcus
YNQKKKTDKVKEI

SEQ ID NO: 2102327 - protein, 9 aa, Staphylococcus
YNQKSPTQL

SEQ ID NO: 2102328 - protein, 5 aa, Staphylococcus
YNQKY

SEQ ID NO: 2102329 - protein, 4 aa, Staphylococcus
YNQN

SEQ ID NO: 2102330 - protein, 7 aa, Staphylococcus
YNQQTGV

SEQ ID NO: 2102331 - protein, 8 aa, Staphylococcus
YNRAPKAS

SEQ ID NO: 2102332 - protein, 23 aa, Staphylococcus
YNRNESRGAHYKPEFPDRNDDEW

SEQ ID NO: 2102333 - protein, 23 aa, Staphylococcus
YNRNESRGAHYKPEFPDRNDEEW

SEQ ID NO: 2102334 - protein, 22 aa, Staphylococcus
YNRNESRGAHYKPEFPERNDEE

SEQ ID NO: 2102335 - protein, 7 aa, Staphylococcus
YNRPYGY

SEQ ID NO: 2102336 - protein, 4 aa, Staphylococcus
YNSA

SEQ ID NO: 2102337 - protein, 10 aa, Staphylococcus
YNSDKEPQVA

SEQ ID NO: 2102338 - protein, 8 aa, Staphylococcus
YNSGKKYG

SEQ ID NO: 2102339 - protein, 6 aa, Staphylococcus
YNSTTD

SEQ ID NO: 2102340 - protein, 5 aa, Staphylococcus
YNSVS

SEQ ID NO: 2102341 - protein, 9 aa, Staphylococcus
YNTAPGEVG

SEQ ID NO: 2102342 - protein, 14 aa, Staphylococcus
YNTDKIKKAPTDVK

SEQ ID NO: 2102343 - protein, 6 aa, Staphylococcus
YNTGEK

SEQ ID NO: 2102344 - protein, 6 aa, Staphylococcus
YNTGHY

SEQ ID NO: 2102345 - protein, 6 aa, Staphylococcus
YNTGKT

SEQ ID NO: 2102346 - protein, 9 aa, Staphylococcus
YNTPPGTVD

SEQ ID NO: 2102347 - protein, 15 aa, Staphylococcus
YNTSVDSIKQNNNLD

SEQ ID NO: 2102348 - protein, 15 aa, Staphylococcus
YNTSVENIKQNNNLN

SEQ ID NO: 2102349 - protein, 5 aa, Staphylococcus
YNTTY

SEQ ID NO: 2102350 - protein, 11 aa, Staphylococcus
YNVKPGTKAYT

SEQ ID NO: 2102351 - protein, 10 aa, Staphylococcus
YNVKQGSNGL

SEQ ID NO: 2102352 - protein, 4 aa, Staphylococcus
YNYP

SEQ ID NO: 2102353 - protein, 4 aa, Staphylococcus
YPAG

SEQ ID NO: 2102354 - protein, 5 aa, Staphylococcus
YPAGT

SEQ ID NO: 2102355 - protein, 6 aa, Staphylococcus
YPAGTD

SEQ ID NO: 2102356 - protein, 11 aa, Staphylococcus
YPENKKAEDIT

SEQ ID NO: 2102357 - protein, 5 aa, Staphylococcus
YPEPV

SEQ ID NO: 2102358 - protein, 9 aa, Staphylococcus
YPGAPKGQF

SEQ ID NO: 2102359 - protein, 8 aa, Staphylococcus
YPGVPKGQ

SEQ ID NO: 2102360 - protein, 4 aa, Staphylococcus
YPIP

SEQ ID NO: 2102361 - protein, 24 aa, Staphylococcus
YPITNGDADTAIAQAKKDGFNTDE

SEQ ID NO: 2102362 - protein, 6 aa, Staphylococcus
YPKLEP

SEQ ID NO: 2102363 - protein, 12 aa, Staphylococcus
YPKSGTAISPRP

SEQ ID NO: 2102364 - protein, 12 aa, Staphylococcus
YPNAGQKAANWA

SEQ ID NO: 2102365 - protein, 16 aa, Staphylococcus
YPNGMDPHTYEPSQKQ

SEQ ID NO: 2102366 - protein, 16 aa, Staphylococcus
YPNGVDPHTYDPSQKQ

SEQ ID NO: 2102367 - protein, 8 aa, Staphylococcus
YPSKATDK

SEQ ID NO: 2102368 - protein, 10 aa, Staphylococcus
YPTKDTQNRL

SEQ ID NO: 2102369 - protein, 10 aa, Staphylococcus
YPTKKEQQRL

SEQ ID NO: 2102370 - protein, 9 aa, Staphylococcus
YPTQQEQAR

SEQ ID NO: 2102371 - protein, 12 aa, Staphylococcus
YQADGEGQEPAV

SEQ ID NO: 2102372 - protein, 22 aa, Staphylococcus
YQDGGKQIGQFSTDGKSYSNIG

SEQ ID NO: 2102373 - protein, 7 aa, Staphylococcus
YQDGGRQ

SEQ ID NO: 2102374 - protein, 39 aa, Staphylococcus
YQDSKDVKRELRSGDAYDSELDKKYGDNDTDEINKGGKV

SEQ ID NO: 2102375 - protein, 9 aa, Staphylococcus
YQDTSDSMK

SEQ ID NO: 2102376 - protein, 19 aa, Staphylococcus
YQEDGNARSSDLSSGKADV

SEQ ID NO: 2102377 - protein, 10 aa, Staphylococcus
YQHRDNKEVT

SEQ ID NO: 2102378 - protein, 10 aa, Staphylococcus
YQNKTGKNEK

SEQ ID NO: 2102379 - protein, 7 aa, Staphylococcus
YQPKKDG

SEQ ID NO: 2102380 - protein, 169 aa, Staphylococcus
YQQDDNNYSPSASSEEVQKEGYDVNATPSAEDKAKNPNAAKAEDNNNTQNAQNNNQNTQAQDTTSADEVSSAQGNETSNTVASEDNTTNNTSASLQNNQNTQSASTYNQSSGEESNVQSQNATSNTQQPQTAQAPEVNNTQDNAGGSSEGNTTEAPDTSDNGDGAHAQD

SEQ ID NO: 2102381 - protein, 17 aa, Staphylococcus
YQQPLSKKQADKTEGLY

SEQ ID NO: 2102382 - protein, 8 aa, Staphylococcus
YQRGSGRK

SEQ ID NO: 2102383 - protein, 18 aa, Staphylococcus
YQSQQNGSSKVKEINTAD

SEQ ID NO: 2102384 - protein, 8 aa, Staphylococcus
YRASEGKI

SEQ ID NO: 2102385 - protein, 18 aa, Staphylococcus
YREENAEPVKCNTTDMEA

SEQ ID NO: 2102386 - protein, 6 aa, Staphylococcus
YREQLE

SEQ ID NO: 2102387 - protein, 7 aa, Staphylococcus
YREQLED

SEQ ID NO: 2102388 - protein, 7 aa, Staphylococcus
YREQMED

SEQ ID NO: 2102389 - protein, 9 aa, Staphylococcus
YRGSGEVEN

SEQ ID NO: 2102390 - protein, 7 aa, Staphylococcus
YRKPSDF

SEQ ID NO: 2102391 - protein, 18 aa, Staphylococcus
YRLSDSRPLPPIYGGPEG

SEQ ID NO: 2102392 - protein, 11 aa, Staphylococcus
YRNMSPSSVRG

SEQ ID NO: 2102393 - protein, 8 aa, Staphylococcus
YRNQDGEI

SEQ ID NO: 2102394 - protein, 9 aa, Staphylococcus
YRNTPTFKA

SEQ ID NO: 2102395 - protein, 19 aa, Staphylococcus
YRPQRKSIYTEPGSSNTKE

SEQ ID NO: 2102396 - protein, 7 aa, Staphylococcus
YRQQIED

SEQ ID NO: 2102397 - protein, 8 aa, Staphylococcus
YRRGAYQD

SEQ ID NO: 2102398 - protein, 7 aa, Staphylococcus
YRSNRGA

SEQ ID NO: 2102399 - protein, 7 aa, Staphylococcus
YRSYPTQ

SEQ ID NO: 2102400 - protein, 11 aa, Staphylococcus
YSAQQAKSNGL

SEQ ID NO: 2102401 - protein, 4 aa, Staphylococcus
YSDA

SEQ ID NO: 2102402 - protein, 16 aa, Staphylococcus
YSDADQPKKDAYNDAV

SEQ ID NO: 2102403 - protein, 7 aa, Staphylococcus
YSDCSDA

SEQ ID NO: 2102404 - protein, 52 aa, Staphylococcus
YSDKATQTHKDYTSSKKDSTSQASQNEDSKKDTSTTQDQLDTNKDNPQLPTE

SEQ ID NO: 2102405 - protein, 9 aa, Staphylococcus
YSDKGDLLT

SEQ ID NO: 2102406 - protein, 70 aa, Staphylococcus
YSEDAKKQKDKYDNQNEANDTQEENKKVENQHSNTSTANPQLPTQSQLEDKTDPKQSFEDGLKQSNNRST

SEQ ID NO: 2102407 - protein, 48 aa, Staphylococcus
YSEDAKKTQSNYEQKSKHQKHTSQSSQNNNPQLPTEDELKHKSKPVQS

SEQ ID NO: 2102408 - protein, 74 aa, Staphylococcus
YSEDAKNNKKQYDAQKDDLSNGNSKSKKNNSEKQASNTNANPQLPSESQLAKKEKPAQSFENDINQSNIRSTAT

SEQ ID NO: 2102409 - protein, 71 aa, Staphylococcus
YSEDATKTQKQYQTSKDKHTQDEKQQDTTPNNTKQQDVNPQLPTPDELKHKTKPAQSFEGDFKQSNTRATG

SEQ ID NO: 2102410 - protein, 17 aa, Staphylococcus
YSEGTLREKLGLNQKIH

SEQ ID NO: 2102411 - protein, 10 aa, Staphylococcus
YSENDIEERH

SEQ ID NO: 2102412 - protein, 18 aa, Staphylococcus
YSGESTRPALNGRQKADI

SEQ ID NO: 2102413 - protein, 9 aa, Staphylococcus
YSGGPFSVS

SEQ ID NO: 2102414 - protein, 4 aa, Staphylococcus
YSGL

SEQ ID NO: 2102415 - protein, 27 aa, Staphylococcus
YSGQVNAKNDHSTNQNKLEIKDKNKAF

SEQ ID NO: 2102416 - protein, 10 aa, Staphylococcus
YSGYGKSNVA

SEQ ID NO: 2102417 - protein, 9 aa, Staphylococcus
YSIQDNGQR

SEQ ID NO: 2102418 - protein, 5 aa, Staphylococcus
YSKDN

SEQ ID NO: 2102419 - protein, 16 aa, Staphylococcus
YSKDVSNTARNHSEDM

SEQ ID NO: 2102420 - protein, 5 aa, Staphylococcus
YSNDE

SEQ ID NO: 2102421 - protein, 26 aa, Staphylococcus
YSNGPFSTDTRTISASQASAYNYIHL

SEQ ID NO: 2102422 - protein, 7 aa, Staphylococcus
YSNGRAG

SEQ ID NO: 2102423 - protein, 7 aa, Staphylococcus
YSNKHKD

SEQ ID NO: 2102424 - protein, 8 aa, Staphylococcus
YSNTGRTL

SEQ ID NO: 2102425 - protein, 15 aa, Staphylococcus
YSRNQQGEDIGPKYR

SEQ ID NO: 2102426 - protein, 12 aa, Staphylococcus
YSSEDNQKTGKK

SEQ ID NO: 2102427 - protein, 4 aa, Staphylococcus
YSSN

SEQ ID NO: 2102428 - protein, 15 aa, Staphylococcus
YSSPIYSYNENGSEH

SEQ ID NO: 2102429 - protein, 4 aa, Staphylococcus
YSTA

SEQ ID NO: 2102430 - protein, 8 aa, Staphylococcus
YSTDGRIA

SEQ ID NO: 2102431 - protein, 4 aa, Staphylococcus
YSTE

SEQ ID NO: 2102432 - protein, 27 aa, Staphylococcus
YSTPNGGYSLTKADQSNNDAVDSDAQL

SEQ ID NO: 2102433 - protein, 12 aa, Staphylococcus
YSWDTQSNDIAK

SEQ ID NO: 2102434 - protein, 13 aa, Staphylococcus
YSYTKSSKKQMTD

SEQ ID NO: 2102435 - protein, 18 aa, Staphylococcus
YTAKASEKDKNDKDNEIT

SEQ ID NO: 2102436 - protein, 16 aa, Staphylococcus
YTDKKKTDKVNEIKEA

SEQ ID NO: 2102437 - protein, 22 aa, Staphylococcus
YTEDGREMSNTTMTRNRDGSVS

SEQ ID NO: 2102438 - protein, 6 aa, Staphylococcus
YTEDHE

SEQ ID NO: 2102439 - protein, 13 aa, Staphylococcus
YTENKNNRSLPEM

SEQ ID NO: 2102440 - protein, 10 aa, Staphylococcus
YTGEATHPSL

SEQ ID NO: 2102441 - protein, 15 aa, Staphylococcus
YTGESSDPDKNGIHH

SEQ ID NO: 2102442 - protein, 7 aa, Staphylococcus
YTGESTH

SEQ ID NO: 2102443 - protein, 10 aa, Staphylococcus
YTGESTHKGL

SEQ ID NO: 2102444 - protein, 17 aa, Staphylococcus
YTGESTRPGLNGRQRSD

SEQ ID NO: 2102445 - protein, 78 aa, Staphylococcus
YTGGADTAQSTTDYTDSYNQASTQSVSANNQASTSNVKAVSAPVQKTSSYSNYSARTTSYSAPKTTSYSTASTGGSVK

SEQ ID NO: 2102446 - protein, 26 aa, Staphylococcus
YTGGAYVTDTRTISASEVSSYNYIHL

SEQ ID NO: 2102447 - protein, 4 aa, Staphylococcus
YTIK

SEQ ID NO: 2102448 - protein, 8 aa, Staphylococcus
YTKSQNNG

SEQ ID NO: 2102449 - protein, 24 aa, Staphylococcus
YTNGPYNSDYRTIPASEVSLYAYI

SEQ ID NO: 2102450 - protein, 24 aa, Staphylococcus
YTNGPYNTNYRTIPASEVSSYAFI

SEQ ID NO: 2102451 - protein, 14 aa, Staphylococcus
YTNKQRNDKVNEIK

SEQ ID NO: 2102452 - protein, 34 aa, Staphylococcus
YTNNERTDKVNEIKKADLKKSITYEAGATSDNKF

SEQ ID NO: 2102453 - protein, 80 aa, Staphylococcus
YTNTAGTQNYNYNTQYSQNYQPQTQAYHANNGGGLGASYSTSDRNVKVTTTQAPSSHASNTSGGSAFSGKSGSSSNLYTA

SEQ ID NO: 2102454 - protein, 24 aa, Staphylococcus
YTPGQNGDALRSMSNPERFGQPSH

SEQ ID NO: 2102455 - protein, 22 aa, Staphylococcus
YTPGTEGDGLRSLKDPERYNQP

SEQ ID NO: 2102456 - protein, 13 aa, Staphylococcus
YTPTVGSIAQTDI

SEQ ID NO: 2102457 - protein, 4 aa, Staphylococcus
YTPV

SEQ ID NO: 2102458 - protein, 11 aa, Staphylococcus
YTQATDTNQKG

SEQ ID NO: 2102459 - protein, 14 aa, Staphylococcus
YTQSIGTETSGSDF

SEQ ID NO: 2102460 - protein, 13 aa, Staphylococcus
YTRNGDGYFEKDG

SEQ ID NO: 2102461 - protein, 4 aa, Staphylococcus
YTSG

SEQ ID NO: 2102462 - protein, 16 aa, Staphylococcus
YTSLQEAKKAHPNASF

SEQ ID NO: 2102463 - protein, 7 aa, Staphylococcus
YTSSPGI

SEQ ID NO: 2102464 - protein, 7 aa, Staphylococcus
YTTDGRI

SEQ ID NO: 2102465 - protein, 15 aa, Staphylococcus
YTTQNSQGQVEDVTQ

SEQ ID NO: 2102466 - protein, 10 aa, Staphylococcus
YTTYDPSFTQ

SEQ ID NO: 2102467 - protein, 14 aa, Staphylococcus
YTVDNSVKSGDTFT

SEQ ID NO: 2102468 - protein, 17 aa, Staphylococcus
YTVKPKETTVSLEEKVS

SEQ ID NO: 2102469 - protein, 17 aa, Staphylococcus
YVDDHDTKVDKWLKGID

SEQ ID NO: 2102470 - protein, 17 aa, Staphylococcus
YVDDNDNKVDEWLEGID

SEQ ID NO: 2102471 - protein, 18 aa, Staphylococcus
YVHTTTRKSDNGGPKRKY

SEQ ID NO: 2102472 - protein, 20 aa, Staphylococcus
YVNADPELKSAYNSKYDQAK

SEQ ID NO: 2102473 - protein, 6 aa, Staphylococcus
YVNNDG

SEQ ID NO: 2102474 - protein, 5 aa, Staphylococcus
YVPDR

SEQ ID NO: 2102475 - protein, 20 aa, Staphylococcus
YVSSYKNDLTKTDKLGTSMS

SEQ ID NO: 2102476 - protein, 8 aa, Staphylococcus
YWGGTDHV

SEQ ID NO: 2102477 - protein, 8 aa, Staphylococcus
YYDNPKGS

SEQ ID NO: 2102478 - protein, 4 aa, Staphylococcus
YYQQ

SEQ ID NO: 2102479 - protein, 11 aa, Staphylococcus
YYSPELDQNVD

SEQ ID NO: 2102480 - protein, 8 aa, Staphylococcus
YYSQTPEI

SEQ ID NO: 2102481 - protein, 13 aa, Staphylococcus
YYSRTDKEAKQII

SEQ ID NO: 2102482 - protein, 20 aa, Staphylococcus
DTPEAVILSGFDPIRREIAR

SEQ ID NO: 2102483 - protein, 36 aa, Staphylococcus; identical to SEQ ID NO: 1713109

SEQ ID NO: 2102484 - protein, 20 aa, Staphylococcus
IFDVCINQKLGINGENMVYL

SEQ ID NO: 2102485 - protein, 22 aa, Staphylococcus
ITNEIKERLLLAGESTNADVVI

SEQ ID NO: 2102486 - protein, 24 aa, Staphylococcus
KVPMKIFPAVHYSMGGLYVDYDQM

SEQ ID NO: 2102487 - protein, 20 aa, Staphylococcus
MYVHCTLLPYIKAAGEMKTK

SEQ ID NO: 2102488 - protein, 17 aa, Staphylococcus
ALMTRGLAEISRLGEKL

SEQ ID NO: 2102489 - protein, 19 aa, Staphylococcus
KGQSEPIVLVIFTNKDNKS

SEQ ID NO: 2102490 - protein, 18 aa, Staphylococcus
LFSLVPVKRSHSVCAQGG

SEQ ID NO: 2102491 - protein, 25 aa, Staphylococcus
LIDPFCGSGTIAIEACLIAQNIAPG

SEQ ID NO: 2102492 - protein, 19 aa, Staphylococcus
LKDKIALFCDINKESVIEC

SEQ ID NO: 2102493 - protein, 24 aa, Staphylococcus
PNDEMKGRIIGREGRNIRTLETLT

SEQ ID NO: 2102494 - protein, 18 aa, Staphylococcus
RQLWNMLVLARVITIGAY

SEQ ID NO: 2102495 - protein, 17 aa, Staphylococcus
SRNDVAFVYPKGQSEPI

SEQ ID NO: 2102496 - protein, 20 aa, Staphylococcus
DFFIACQFHPEFLSRPNRPQ

SEQ ID NO: 2102497 - protein, 19 aa, Staphylococcus
ESVIECRDASSLYEIPLQL

SEQ ID NO: 2102498 - protein, 20 aa, Staphylococcus
ITLKALIEASMTYSDNTANN

SEQ ID NO: 2102499 - protein, 22 aa, Staphylococcus
LGADPMTFLGLGGIGDLIVTCT

SEQ ID NO: 2102500 - protein, 19 aa, Staphylococcus
LMVEGASIDKSGHPNDITG

SEQ ID NO: 2102501 - protein, 30 aa, Staphylococcus
NNPAEQGRFLKFFVDEGLIKIKKGVKIEDA

SEQ ID NO: 2102502 - protein, 23 aa, Staphylococcus
VPYFGICLGMQLATVEFARNVLG

SEQ ID NO: 2102503 - protein, 20 aa, Staphylococcus
VRYEIELNYYSPKSKKDTST

SEQ ID NO: 2102504 - protein, 18 aa, Staphylococcus
AALMTRGLAEISRLGEKL

SEQ ID NO: 2102505 - protein, 25 aa, Staphylococcus
AAYTIATRMADDWSKSDEDKLAKKI

SEQ ID NO: 2102506 - protein, 25 aa, Staphylococcus
AGKYQFLQSTWDSVAPSEYQGVSPT

SEQ ID NO: 2102507 - protein, 18 aa, Staphylococcus
AGLGTRFLPATKAMPKEM

SEQ ID NO: 2102508 - protein, 20 aa, Staphylococcus
AKKRGFRGAGSYWADHLGLT

SEQ ID NO: 2102509 - protein, 23 aa, Staphylococcus
ALKNKKLDVAVGYSTDGRIAAYD

SEQ ID NO: 2102510 - protein, 21 aa, Staphylococcus
ASGDLPDFIVYYLDNSGRPEM

SEQ ID NO: 2102511 - protein, 17 aa, Staphylococcus
AVASGIVAGMGFGDNAK

SEQ ID NO: 2102512 - protein, 32 aa, Staphylococcus
AVSFKPGQLNADRYYGHVAFVEKVNSDGSIII

SEQ ID NO: 2102513 - protein, 19 aa, Staphylococcus
CVITVTALSQLISTPLSSY

SEQ ID NO: 2102514 - protein, 20 aa, Staphylococcus
DNAKVGLAVPKYVQDVDSIS

SEQ ID NO: 2102515 - protein, 18 aa, Staphylococcus
DNFYIISIEIVFFSLIQE

SEQ ID NO: 2102516 - protein, 18 aa, Staphylococcus
DNHIKHLLVETSVDKKSM

SEQ ID NO: 2102517 - protein, 26 aa, Staphylococcus
DPDIILRLPHGMPDEVKKMFQKEFKQ

SEQ ID NO: 2102518 - protein, 25 aa, Staphylococcus
DVDGILVPGGFGFRASEGKISAIKY

SEQ ID NO: 2102519 - protein, 18 aa, Staphylococcus
DVKMLKDPDNIYGNNNQH

SEQ ID NO: 2102520 - protein, 18 aa, Staphylococcus
DVLLGGGSKYFGKENGNL

SEQ ID NO: 2102521 - protein, 22 aa, Staphylococcus
DYAKLIRYGIDGNNNIYQGSWK

SEQ ID NO: 2102522 - protein, 24 aa, Staphylococcus
DYGMKRVKYVKSLMDEGLMHKAFY

SEQ ID NO: 2102523 - protein, 18 aa, Staphylococcus
EAHPAAYTIATRMADDWS

SEQ ID NO: 2102524 - protein, 24 aa, Staphylococcus
EAKYKDAWPLSASVVNFRADHTRI

SEQ ID NO: 2102525 - protein, 24 aa, Staphylococcus
EDEEKRRADAKGKPKTWIADRKLK

SEQ ID NO: 2102526 - protein, 17 aa, Staphylococcus
EHAQEFVTPLAFQAISR

SEQ ID NO: 2102527 - protein, 20 aa, Staphylococcus
EKNDKGFFLMVEGASIDKSG

SEQ ID NO: 2102528 - protein, 23 aa, Staphylococcus
EKNKEGIGYFGYNFYQQNKDKLK

SEQ ID NO: 2102529 - protein, 24 aa, Staphylococcus
ENSDSFHASGIFPTTDKSYYDKFK

SEQ ID NO: 2102530 - protein, 20 aa, Staphylococcus
ESGGDLKAVNPSSGAAGKYQ

SEQ ID NO: 2102531 - protein, 24 aa, Staphylococcus
ESIPLMKADHIFVVQSDPTAKDAG

SEQ ID NO: 2102532 - protein, 22 aa, Staphylococcus
ESNVKGLGVISYRKINANQAET

SEQ ID NO: 2102533 - protein, 25 aa, Staphylococcus
FIDPFCGSGTIAIEACLIAQNIAPG

SEQ ID NO: 2102534 - protein, 23 aa, Staphylococcus
FKQNDIWKHFKAVKEDRVYDLEE

SEQ ID NO: 2102535 - protein, 25 aa, Staphylococcus
FSKAFDIKPGYIWEINTEKQGTPSQ

SEQ ID NO: 2102536 - protein, 27 aa, Staphylococcus
FYPQGQCTWYVYNRLQQFNLYVDGSMG

SEQ ID NO: 2102537 - protein, 21 aa, Staphylococcus
GADPMTFLGLGGIGDLIVTCT

SEQ ID NO: 2102538 - protein, 17 aa, Staphylococcus
GKITIGLVGKYVSLQDA

SEQ ID NO: 2102539 - protein, 18 aa, Staphylococcus
GVALKFEASVAGGIPIVN

SEQ ID NO: 2102540 - protein, 20 aa, Staphylococcus
GYAGEILSDLGFKRNKALQK

SEQ ID NO: 2102541 - protein, 28 aa, Staphylococcus
HPDLVKILGRLNYRTSYGQNVLKHSIEV

SEQ ID NO: 2102542 - protein, 17 aa, Staphylococcus
HTGWTTYGHTGEDVNTY

SEQ ID NO: 2102543 - protein, 18 aa, Staphylococcus
IDAARKVVITSYLSFNQV

SEQ ID NO: 2102544 - protein, 22 aa, Staphylococcus
IDPHAWLSLDNGIQYVKNIQEQ

SEQ ID NO: 2102545 - protein, 20 aa, Staphylococcus
IENFKFFVQYGNFKDFKDYK

SEQ ID NO: 2102546 - protein, 18 aa, Staphylococcus
IESLPFLEAIRQIRSDLG

SEQ ID NO: 2102547 - protein, 26 aa, Staphylococcus
IIHLLDRMGVMFSRTKEGLLDFRRFG

SEQ ID NO: 2102548 - protein, 26 aa, Staphylococcus
IIHLLDRMGVMFSRTNEGLLDFRRFG

SEQ ID NO: 2102549 - protein, 18 aa, Staphylococcus
ILGSLLILSACSNNDEKD

SEQ ID NO: 2102550 - protein, 17 aa, Staphylococcus
ILIGAIVGGAATLADKS

SEQ ID NO: 2102551 - protein, 18 aa, Staphylococcus
ILSDLGFKRNKALQKEVD

SEQ ID NO: 2102552 - protein, 17 aa, Staphylococcus
ILTKGPVLFGFFGHSSI

SEQ ID NO: 2102553 - protein, 17 aa, Staphylococcus
IPAAGLGTRFLPATKAM

SEQ ID NO: 2102554 - protein, 22 aa, Staphylococcus
IPRDTISYIPKVGYYDKITHAH

SEQ ID NO: 2102555 - protein, 21 aa, Staphylococcus
ISTPLSSYAMDTQVHQHKNKK

SEQ ID NO: 2102556 - protein, 23 aa, Staphylococcus
ITNEIKERLLLAGESTNADVVIT

SEQ ID NO: 2102557 - protein, 19 aa, Staphylococcus
IYQGSWKTPGMTYEDATKS

SEQ ID NO: 2102558 - protein, 23 aa, Staphylococcus
KNIKGMTIGLAMNSVYYYQKEKD

SEQ ID NO: 2102559 - protein, 17 aa, Staphylococcus
KNLEDFYDKEGFRDQEF

SEQ ID NO: 2102560 - protein, 17 aa, Staphylococcus
KNYDFIIIRGQYGSEYV

SEQ ID NO: 2102561 - protein, 18 aa, Staphylococcus
KPEFPDRNDDEWLKTTLA

SEQ ID NO: 2102562 - protein, 25 aa, Staphylococcus
KQKKHPKVLILMGVPGSYLVATDKS

SEQ ID NO: 2102563 - protein, 21 aa, Staphylococcus
LEVREDIYGALQISFKNPEDR

SEQ ID NO: 2102564 - protein, 17 aa, Staphylococcus
LNGLNNFFIYPGQKLRV

SEQ ID NO: 2102565 - protein, 18 aa, Staphylococcus
LQQFNLYVDGSMGNGGDW

SEQ ID NO: 2102566 - protein, 22 aa, Staphylococcus
MSYKSGYGGWSIPKSTKHPEDV

SEQ ID NO: 2102567 - protein, 20 aa, Staphylococcus
MYYERSEPVAEAFGDLDPKI

SEQ ID NO: 2102568 - protein, 19 aa, Staphylococcus
NFTKSIAIEYGRENIRANA

SEQ ID NO: 2102569 - protein, 18 aa, Staphylococcus
NNMKFGVYSYSMYENADD

SEQ ID NO: 2102570 - protein, 22 aa, Staphylococcus
NSIIKQYRLTELDGEEMPILDE

SEQ ID NO: 2102571 - protein, 18 aa, Staphylococcus
PDEVKKMFQKEFKQNDIW

SEQ ID NO: 2102572 - protein, 18 aa, Staphylococcus
PEAVQDAAAVKLYNTAGA

SEQ ID NO: 2102573 - protein, 24 aa, Staphylococcus
PIKETLAASLVRLANWKGDTPFID

SEQ ID NO: 2102574 - protein, 18 aa, Staphylococcus
PILDEAFFNKSYDDNQGD

SEQ ID NO: 2102575 - protein, 24 aa, Staphylococcus
PKQSEYFDNLFFVGGSVNPGGGMP

SEQ ID NO: 2102576 - protein, 22 aa, Staphylococcus
QQSIWKKICVNGTANALCTILE

SEQ ID NO: 2102577 - protein, 21 aa, Staphylococcus
RADINLPFERGAAIDLAGRDV

SEQ ID NO: 2102578 - protein, 18 aa, Staphylococcus
RGAHYKPEFPDRNDDEWL

SEQ ID NO: 2102579 - protein, 18 aa, Staphylococcus
RGAHYKPEFPERNDEEWL

SEQ ID NO: 2102580 - protein, 18 aa, Staphylococcus
RRLERLEALSESYDGVEK

SEQ ID NO: 2102581 - protein, 17 aa, Staphylococcus
SKLKPDLIIADSNRHKG

SEQ ID NO: 2102582 - protein, 19 aa, Staphylococcus
SLAILLMLLTGCSQSSKHT

SEQ ID NO: 2102583 - protein, 20 aa, Staphylococcus
SLAVGLGVVAGNAGHDAHAS

SEQ ID NO: 2102584 - protein, 26 aa, Staphylococcus
SNYDRAVELYYYIKGGTVDYGAAHAA

SEQ ID NO: 2102585 - protein, 22 aa, Staphylococcus
SREGKLLGEYGIKGRDYNLDKK

SEQ ID NO: 2102586 - protein, 20 aa, Staphylococcus
SRKYFHGRISAVNYNMNNQE

SEQ ID NO: 2102587 - protein, 17 aa, Staphylococcus
SWKTPGMTYEDATKSLV

SEQ ID NO: 2102588 - protein, 20 aa, Staphylococcus
TALACIVILAGCSGNSNKST

SEQ ID NO: 2102589 - protein, 28 aa, Staphylococcus
TDYSFQSDGQYWTWSYGQGSTNAPAQET

SEQ ID NO: 2102590 - protein, 22 aa, Staphylococcus
TLAVGLGVTGFAAGNSADASEQ

SEQ ID NO: 2102591 - protein, 30 aa, Staphylococcus
TRLVIVMLILCGLLFPLTVTAVGQIIFPHQ

SEQ ID NO: 2102592 - protein, 22 aa, Staphylococcus
TSSKEWKHLTAVKNNQVSTDLD

SEQ ID NO: 2102593 - protein, 24 aa, Staphylococcus
TWIADRKLKGLVFQSKNDVSPEMN

SEQ ID NO: 2102594 - protein, 17 aa, Staphylococcus
VGIVPLINNQAYWFITI

SEQ ID NO: 2102595 - protein, 18 aa, Staphylococcus
VLYWKDTIEEIRRNNPEL

SEQ ID NO: 2102596 - protein, 19 aa, Staphylococcus
VNVNSHLQAIAQRESGGDL

SEQ ID NO: 2102597 - protein, 23 aa, Staphylococcus
VTKYEGWEFLGIVKDEDNAARGI

SEQ ID NO: 2102598 - protein, 19 aa, Staphylococcus
WKGDTPFIDPFCGSGTIAI

SEQ ID NO: 2102599 - protein, 20 aa, Staphylococcus
YKDLYFAGASTHPGAGVPIV

SEQ ID NO: 2102600 - protein, 17 aa, Staphylococcus
YRIVPTTVALTMTLDKL

SEQ ID NO: 2102601 - protein, 23 aa, Staphylococcus
YYDSLGFANTYAFMVTKETAKKY

SEQ ID NO: 2102602 - protein, 18 aa, Staphylococcus
YYERSEPVAEAFGDLDPK

SEQ ID NO: 2102603 - protein, 27 aa, Staphylococcus
AAAKAGFQDIQFDYVRFPEGFENEADS

SEQ ID NO: 2102604 - protein, 19 aa, Staphylococcus
AADQLGFKIKLIGKGTYEN

SEQ ID NO: 2102605 - protein, 27 aa, Staphylococcus
AAGGTEELWEKIVLPESGGDPNASNGQ

SEQ ID NO: 2102606 - protein, 26 aa, Staphylococcus
AAGGTEEMWEKIVLPESGGNPNASNG

SEQ ID NO: 2102607 - protein, 21 aa, Staphylococcus
AAGIIRLGYLGKFKKIPAPDN

SEQ ID NO: 2102608 - protein, 26 aa, Staphylococcus
AAGKFQFLQSTWDSVAPEQYKGQSPA

SEQ ID NO: 2102609 - protein, 19 aa, Staphylococcus
AAGLGTRFLPATKAMPKEM

SEQ ID NO: 2102610 - protein, 17 aa, Staphylococcus
AAGYAVSGHEAHASETT

SEQ ID NO: 2102611 - protein, 19 aa, Staphylococcus
AAHAEKYGHERYGKTYEGV

SEQ ID NO: 2102612 - protein, 21 aa, Staphylococcus
AAIICLIIIVVACSQKKKETT

SEQ ID NO: 2102613 - protein, 20 aa, Staphylococcus
AAKELGYKIKLIGKGTYENG

SEQ ID NO: 2102614 - protein, 19 aa, Staphylococcus
AAKKYGINEIYLISHALIE

SEQ ID NO: 2102615 - protein, 17 aa, Staphylococcus
AAKQALNTYANLNHAQV

SEQ ID NO: 2102616 - protein, 24 aa, Staphylococcus
AAKVIKEGYGFDVKQSQIDKINEE

SEQ ID NO: 2102617 - protein, 19 aa, Staphylococcus
AAKYLGYTYDILRERNQDG

SEQ ID NO: 2102618 - protein, 27 aa, Staphylococcus
AARNIVQPPANNQVALKNLPNFPQSLT

SEQ ID NO: 2102619 - protein, 19 aa, Staphylococcus
AAVIVTALLITGIAVSGVI

SEQ ID NO: 2102620 - protein, 20 aa, Staphylococcus
ACGYIAKGRMEEPLQIVKII

SEQ ID NO: 2102621 - protein, 26 aa, Staphylococcus
ADAIINKPIRTVQEVQDALRQVNQVN

SEQ ID NO: 2102622 - protein, 23 aa, Staphylococcus
ADAMKRDGWTFASHSYGHINFEQ

SEQ ID NO: 2102623 - protein, 22 aa, Staphylococcus
ADDWKPKVKEMIPSYGESLITD

SEQ ID NO: 2102624 - protein, 17 aa, Staphylococcus
ADERKMETHYNKIDSTS

SEQ ID NO: 2102625 - protein, 18 aa, Staphylococcus
ADGHSIWTATEASLIQDG

SEQ ID NO: 2102626 - protein, 17 aa, Staphylococcus
ADGSILISEMNYANGPY

SEQ ID NO: 2102627 - protein, 18 aa, Staphylococcus
ADGSIVVSEMNWQGVGQK

SEQ ID NO: 2102628 - protein, 21 aa, Staphylococcus
ADITARGKIPIIAGGTGLYIQ

SEQ ID NO: 2102629 - protein, 20 aa, Staphylococcus
ADLFEKGVIFSNGLNGPKAR

SEQ ID NO: 2102630 - protein, 17 aa, Staphylococcus
ADLKHIRSYAIGVGPDY

SEQ ID NO: 2102631 - protein, 19 aa, Staphylococcus
ADLKKSITYEAGATSDNKF

SEQ ID NO: 2102632 - protein, 19 aa, Staphylococcus
ADLVVPLIKAYLGISSDIF

SEQ ID NO: 2102633 - protein, 19 aa, Staphylococcus
ADPELKSAYNSKYDQAKAI

SEQ ID NO: 2102634 - protein, 24 aa, Staphylococcus
ADPESIRFDPLYKQIMYTSEGDRS

SEQ ID NO: 2102635 - protein, 22 aa, Staphylococcus
ADPIYGHVAFVEKVNSDGSIVI

SEQ ID NO: 2102636 - protein, 22 aa, Staphylococcus
ADQIYGHVAFVEKVNDDGSIVI

SEQ ID NO: 2102637 - protein, 19 aa, Staphylococcus
ADTDYYYRDGLNYPSDQQA

SEQ ID NO: 2102638 - protein, 17 aa, Staphylococcus
ADTKLKEKIDFDTKGAK

SEQ ID NO: 2102639 - protein, 19 aa, Staphylococcus
ADVILGGGSKYFGKENGNL

SEQ ID NO: 2102640 - protein, 29 aa, Staphylococcus
ADYYKNSLDFFKPAPFKEQKNSTPSLWEQ

SEQ ID NO: 2102641 - protein, 19 aa, Staphylococcus
AEAKALYLQGYNTAKDNLD

SEQ ID NO: 2102642 - protein, 20 aa, Staphylococcus
AEAQRLIKQLGYTRNGDGYF

SEQ ID NO: 2102643 - protein, 17 aa, Staphylococcus
AEISSIRQNDGYLWTIN

SEQ ID NO: 2102644 - protein, 21 aa, Staphylococcus
AEKMANLDGTVTFEESDYTNP

SEQ ID NO: 2102645 - protein, 21 aa, Staphylococcus
AENGHTVLMWGKNEDSVKELN

SEQ ID NO: 2102646 - protein, 24 aa, Staphylococcus
AENKEDWDEPVFIKGADLEGQDLQ

SEQ ID NO: 2102647 - protein, 19 aa, Staphylococcus
AENSFKDITGWKKVSKESI

SEQ ID NO: 2102648 - protein, 20 aa, Staphylococcus
AEQNKSAFAFSKKVDDKTIK

SEQ ID NO: 2102649 - protein, 24 aa, Staphylococcus
AETGQPISTYWWNADHWANNASAD

SEQ ID NO: 2102650 - protein, 27 aa, Staphylococcus
AETGQPISTYWWNAENWADNARADGYT

SEQ ID NO: 2102651 - protein, 21 aa, Staphylococcus
AFDNYLKGTMRVHNDDTKENI

SEQ ID NO: 2102652 - protein, 25 aa, Staphylococcus
AFGQKAVSYPVQFVTGSINNLFSND

SEQ ID NO: 2102653 - protein, 21 aa, Staphylococcus
AFGQTGRFGGFLNKDLGIQHA

SEQ ID NO: 2102654 - protein, 28 aa, Staphylococcus
AFIIEITPRFDGCHMHKLIQYYNEDDLL

SEQ ID NO: 2102655 - protein, 18 aa, Staphylococcus
AFNLAWKLSNVIQGKADK

SEQ ID NO: 2102656 - protein, 31 aa, Staphylococcus
AFSAARSVYVGKELFLYGTVDNRTGWIAAKD

SEQ ID NO: 2102657 - protein, 19 aa, Staphylococcus
AFSGHQAFAADIVTKNNAQ

SEQ ID NO: 2102658 - protein, 25 aa, Staphylococcus
AGAHDIYGHVAFVEKVNKDGSIVIS

SEQ ID NO: 2102659 - protein, 23 aa, Staphylococcus
AGALGRKTKQGFYKKDKEKKQRL

SEQ ID NO: 2102660 - protein, 18 aa, Staphylococcus
AGARGHHIVVGTAEDVAD

SEQ ID NO: 2102661 - protein, 24 aa, Staphylococcus
AGASSYYGHVAFVERVNDDGSIVI

SEQ ID NO: 2102662 - protein, 28 aa, Staphylococcus
AGAYRDWKPGQKIHLIGHSMGGQTVRLL

SEQ ID NO: 2102663 - protein, 19 aa, Staphylococcus
AGGIKYLGGKIVAVNEQVD

SEQ ID NO: 2102664 - protein, 23 aa, Staphylococcus
AGGQIALSFAQYIKTLNLAQPSN

SEQ ID NO: 2102665 - protein, 25 aa, Staphylococcus
AGGTEELWEKIVLPESGGNPHAKNG

SEQ ID NO: 2102666 - protein, 24 aa, Staphylococcus
AGGTEELWNAIVMPESGGNVNASN

SEQ ID NO: 2102667 - protein, 19 aa, Staphylococcus
AGIATFAFAQHDADAAENN

SEQ ID NO: 2102668 - protein, 22 aa, Staphylococcus
AGIKAAQWAKAHYKDSDKTYLV

SEQ ID NO: 2102669 - protein, 25 aa, Staphylococcus
AGKYQFLQSTWDSVAPAQYKGVSPA

SEQ ID NO: 2102670 - protein, 25 aa, Staphylococcus
AGKYQFLQSTWDSVAPDEYKGVSPA

SEQ ID NO: 2102671 - protein, 26 aa, Staphylococcus
AGKYQFLQTTWDSVAPAEYQGKPASE

SEQ ID NO: 2102672 - protein, 26 aa, Staphylococcus
AGLERCIQQKIPVIIVSRSFNGIVSP

SEQ ID NO: 2102673 - protein, 17 aa, Staphylococcus
AGNKKVLFYSYENFMLN

SEQ ID NO: 2102674 - protein, 19 aa, Staphylococcus
AGNVCGMMPHPERALEKIL

SEQ ID NO: 2102675 - protein, 27 aa, Staphylococcus
AGQNTLYKMRWNPDHPATHQYATDINW

SEQ ID NO: 2102676 - protein, 17 aa, Staphylococcus
AGRGYRRVVPSPQPINI

SEQ ID NO: 2102677 - protein, 20 aa, Staphylococcus
AGSVPFEITQEADFQTEIDF

SEQ ID NO: 2102678 - protein, 25 aa, Staphylococcus
AGYNPSFLLTHEFKNGIKYKNITFN

SEQ ID NO: 2102679 - protein, 19 aa, Staphylococcus
AGYPFKKDVVVKWIDSSEV

SEQ ID NO: 2102680 - protein, 23 aa, Staphylococcus
AGYRVGKKPAKRAVMQSTSGTYG

SEQ ID NO: 2102681 - protein, 24 aa, Staphylococcus
AHPSESYVGQFLSQLGFKEALNKD

SEQ ID NO: 2102682 - protein, 23 aa, Staphylococcus
AIAKVGKGKAAFIGDSSLVEDSS

SEQ ID NO: 2102683 - protein, 23 aa, Staphylococcus
AIDLRGKELFKSLVKEIDLIKSR

SEQ ID NO: 2102684 - protein, 18 aa, Staphylococcus
AIGSTWGTANNWANAAKA

SEQ ID NO: 2102685 - protein, 26 aa, Staphylococcus
AIGTSSILVASLFFIGSGGADAAEAS

SEQ ID NO: 2102686 - protein, 26 aa, Staphylococcus
AIHQHAGKPFIDYVICSNDAFDEQIL

SEQ ID NO: 2102687 - protein, 19 aa, Staphylococcus
AIHTTGVGGLQIIKVYKSN

SEQ ID NO: 2102688 - protein, 24 aa, Staphylococcus
AIILSICLAFLLFIATNQNALAKV

SEQ ID NO: 2102689 - protein, 24 aa, Staphylococcus
AILSSALVLTACGQSEDHSKKDDD

SEQ ID NO: 2102690 - protein, 18 aa, Staphylococcus
AILTIIFIYGCSKQPSSI

SEQ ID NO: 2102691 - protein, 18 aa, Staphylococcus
AIPVVFANNLFKSSEKAF

SEQ ID NO: 2102692 - protein, 21 aa, Staphylococcus
AIQAGREIRVVVSPEEIDDLK

SEQ ID NO: 2102693 - protein, 23 aa, Staphylococcus
AISKLGKGKAVFIGDSSLVEDRS

SEQ ID NO: 2102694 - protein, 24 aa, Staphylococcus
AISKVGKGKAAFIGDSSLVEDSTP

SEQ ID NO: 2102695 - protein, 24 aa, Staphylococcus
AISKVGKGKAAFIGDTSLVEDSSP

SEQ ID NO: 2102696 - protein, 20 aa, Staphylococcus
AISVIISIISAMGDKSHKQR

SEQ ID NO: 2102697 - protein, 24 aa, Staphylococcus
AITLKDFGIDDCLILEKEEIGSSF

SEQ ID NO: 2102698 - protein, 26 aa, Staphylococcus
AIVNFVKRGGSVIFISDHYNADRNLN

SEQ ID NO: 2102699 - protein, 30 aa, Staphylococcus
AIYLYGSVNGVNGWISKSFLTTPSTSNTTK

SEQ ID NO: 2102700 - protein, 21 aa, Staphylococcus
AKAEDLFHLDLAYAPPFSTTK

SEQ ID NO: 2102701 - protein, 21 aa, Staphylococcus
AKAKPDIIFASFRQAHTKTLD

SEQ ID NO: 2102702 - protein, 18 aa, Staphylococcus
AKARITVRANIARLVGGA

SEQ ID NO: 2102703 - protein, 18 aa, Staphylococcus
AKARITVRANISRLVGGS

SEQ ID NO: 2102704 - protein, 17 aa, Staphylococcus
AKATGLKPNTKYYYKVG

SEQ ID NO: 2102705 - protein, 22 aa, Staphylococcus
AKAVKFSIERAKAMNKDTTVET

SEQ ID NO: 2102706 - protein, 20 aa, Staphylococcus
AKDKYGRIDVIFNNAGVDHG

SEQ ID NO: 2102707 - protein, 18 aa, Staphylococcus
AKELYPKVRMYYERSEPV

SEQ ID NO: 2102708 - protein, 22 aa, Staphylococcus
AKGDDPIVFLGGAKSDLRDEIQ

SEQ ID NO: 2102709 - protein, 27 aa, Staphylococcus
AKGSFSTLIGVGGDRVTIIATQSPGTY

SEQ ID NO: 2102710 - protein, 18 aa, Staphylococcus
AKHLPAKTNKTRQLKKDY

SEQ ID NO: 2102711 - protein, 20 aa, Staphylococcus
AKKALGNDVIKDVKAIKDNK

SEQ ID NO: 2102712 - protein, 18 aa, Staphylococcus
AKKITVAALKKAKNDKEL

SEQ ID NO: 2102713 - protein, 22 aa, Staphylococcus
AKKRGFRGAGSYWADHLGYTDI

SEQ ID NO: 2102714 - protein, 26 aa, Staphylococcus
AKKYKFTLKKGVKWQNGDPLTVNDWI

SEQ ID NO: 2102715 - protein, 24 aa, Staphylococcus
AKLNAAKEKLRAVNQVLNSNPTVD

SEQ ID NO: 2102716 - protein, 24 aa, Staphylococcus
AKMRDIHSANNWGIKTNHIDIDVT

SEQ ID NO: 2102717 - protein, 20 aa, Staphylococcus
AKNAHKYGFIVRYPKGKEKI

SEQ ID NO: 2102718 - protein, 20 aa, Staphylococcus
AKNEGINNINLIQSSTSTKT

SEQ ID NO: 2102719 - protein, 20 aa, Staphylococcus
AKNFKHKPDFAVTNGGGIRA

SEQ ID NO: 2102720 - protein, 27 aa, Staphylococcus
AKNGYSLKTYFEKPFVVIKQKQQNGVT

SEQ ID NO: 2102721 - protein, 18 aa, Staphylococcus
AKNIFDFFGQDVTSNQNQ

SEQ ID NO: 2102722 - protein, 17 aa, Staphylococcus
AKPDLILAHESQKSTDG

SEQ ID NO: 2102723 - protein, 18 aa, Staphylococcus
AKPDVIYISGRTANQKNL

SEQ ID NO: 2102724 - protein, 18 aa, Staphylococcus
AKPDVIYISSRAATQKNL

SEQ ID NO: 2102725 - protein, 22 aa, Staphylococcus
AKPIVKITLGLITASISLGTIS

SEQ ID NO: 2102726 - protein, 18 aa, Staphylococcus
AKPLEKLLSKKLDIPVKV

SEQ ID NO: 2102727 - protein, 17 aa, Staphylococcus
AKPLEKLLSKKLGIPVK

SEQ ID NO: 2102728 - protein, 22 aa, Staphylococcus
AKPLKFNNMESVTKEQQNKKGL

SEQ ID NO: 2102729 - protein, 18 aa, Staphylococcus
AKPLKFYNMESLNKDQQE

SEQ ID NO: 2102730 - protein, 18 aa, Staphylococcus
AKPLKFYNMESLNKEQSK

SEQ ID NO: 2102731 - protein, 20 aa, Staphylococcus
AKPLKFYNMESLNKSQQQDY

SEQ ID NO: 2102732 - protein, 17 aa, Staphylococcus
AKPQYSLSFIGEQQPQE

SEQ ID NO: 2102733 - protein, 20 aa, Staphylococcus
AKQVLKNDVIKDVTAVKNNN

SEQ ID NO: 2102734 - protein, 24 aa, Staphylococcus
AKSAKKAIKNYISPLIEKQIKDIN

SEQ ID NO: 2102735 - protein, 21 aa, Staphylococcus
AKSDIDRKLSEQIENINQHQT

SEQ ID NO: 2102736 - protein, 25 aa, Staphylococcus
AKSGAKYANRTFVISKQRTEGNNTY

SEQ ID NO: 2102737 - protein, 18 aa, Staphylococcus
AKSGKKIYVYNWGEYIDP

SEQ ID NO: 2102738 - protein, 25 aa, Staphylococcus
AKSGNSLRFTYLGNITLNKHIRQNN

SEQ ID NO: 2102739 - protein, 17 aa, Staphylococcus
AKSIITVDHVTITEQNN

SEQ ID NO: 2102740 - protein, 21 aa, Staphylococcus
AKSKPNVIFASFRQAHTKTID

SEQ ID NO: 2102741 - protein, 25 aa, Staphylococcus
AKSPVKVNATYTIKPGVKLYTVPWG

SEQ ID NO: 2102742 - protein, 19 aa, Staphylococcus
AKTALKEAANKLYGDNSAE

SEQ ID NO: 2102743 - protein, 21 aa, Staphylococcus
AKVFADAGVNVVLGMHPHVIE

SEQ ID NO: 2102744 - protein, 20 aa, Staphylococcus
AKVPTLDEILSRYGTKANYY

SEQ ID NO: 2102745 - protein, 17 aa, Staphylococcus
AKYKFSKPYTYSSGVLV

SEQ ID NO: 2102746 - protein, 17 aa, Staphylococcus
AKYLEVVAYHYGISIQT

SEQ ID NO: 2102747 - protein, 24 aa, Staphylococcus
AKYNRNRIGNAIFKHYRKEYEYKK

SEQ ID NO: 2102748 - protein, 18 aa, Staphylococcus
ALAGKSSGGSNLYTAGQC

SEQ ID NO: 2102749 - protein, 23 aa, Staphylococcus
ALAKVHQTICTFSKANKVSALEK

SEQ ID NO: 2102750 - protein, 18 aa, Staphylococcus
ALANEGAHVLALDISDEL

SEQ ID NO: 2102751 - protein, 29 aa, Staphylococcus
ALAQKPNFNLFGIKGTYQGQSVSFNTLEA

SEQ ID NO: 2102752 - protein, 18 aa, Staphylococcus
ALDTARNGLTVDKTPLEN

SEQ ID NO: 2102753 - protein, 18 aa, Staphylococcus
ALESLFKMSKDGKVKPLL

SEQ ID NO: 2102754 - protein, 26 aa, Staphylococcus
ALGEGVKFAKASGWDSVSKAIIGGAK

SEQ ID NO: 2102755 - protein, 18 aa, Staphylococcus
ALILFLGIREKKRHTHRL

SEQ ID NO: 2102756 - protein, 23 aa, Staphylococcus
ALILLVFAIRAIHVDPVKSDAKS

SEQ ID NO: 2102757 - protein, 18 aa, Staphylococcus
ALIQDLFMNDYLRVYTNN

SEQ ID NO: 2102758 - protein, 26 aa, Staphylococcus
ALKDNGVNEFLLWNAGNEYTEGANYN

SEQ ID NO: 2102759 - protein, 22 aa, Staphylococcus
ALKEAKRLGFAEADPTDDVDGV

SEQ ID NO: 2102760 - protein, 23 aa, Staphylococcus
ALKNKKLDVAVGYSTDGRIAAYN

SEQ ID NO: 2102761 - protein, 24 aa, Staphylococcus
ALKNKKLDVAVGYSTDGRIAAYNL

SEQ ID NO: 2102762 - protein, 20 aa, Staphylococcus
ALLFRHFFATSLHKQFMRNS

SEQ ID NO: 2102763 - protein, 21 aa, Staphylococcus
ALLKAKPDLILAHESQKSSSG

SEQ ID NO: 2102764 - protein, 17 aa, Staphylococcus
ALMTRGLAEISRLGEEL

SEQ ID NO: 2102765 - protein, 25 aa, Staphylococcus
ALNESFSDVFGYFVDDEDFLMGEDV

SEQ ID NO: 2102766 - protein, 22 aa, Staphylococcus
ALNKEKELFTFLNQDGATQSEV

SEQ ID NO: 2102767 - protein, 27 aa, Staphylococcus
ALPDGEIKARTSLITRNITYTTQNSQG

SEQ ID NO: 2102768 - protein, 19 aa, Staphylococcus
ALQKNGVKVIYVKDAQSID

SEQ ID NO: 2102769 - protein, 22 aa, Staphylococcus
ALRSMSNPERFGQPSHMDDYVN

SEQ ID NO: 2102770 - protein, 24 aa, Staphylococcus
ALTLSGLCTSSFIEASGNGNTYTE

SEQ ID NO: 2102771 - protein, 19 aa, Staphylococcus
ALVAICLVLAGCSNSDSGD

SEQ ID NO: 2102772 - protein, 17 aa, Staphylococcus
AMEHLRDSIKDHQQTLN

SEQ ID NO: 2102773 - protein, 24 aa, Staphylococcus
AMGLDDLRAHIVFEDMWTPEDIEH

SEQ ID NO: 2102774 - protein, 18 aa, Staphylococcus
AMHALRQSIQDNPSIKAG

SEQ ID NO: 2102775 - protein, 19 aa, Staphylococcus
AMHNLKQGIANKNDILGSE

SEQ ID NO: 2102776 - protein, 17 aa, Staphylococcus
AMLVLCLVLAGCSNSSN

SEQ ID NO: 2102777 - protein, 19 aa, Staphylococcus
AMNGYRRGAYNDMTKDMSQ

SEQ ID NO: 2102778 - protein, 19 aa, Staphylococcus
AMSALKQGIADKDQTIADG

SEQ ID NO: 2102779 - protein, 21 aa, Staphylococcus
ANAAKAAGYTVNHHAKAGSIL

SEQ ID NO: 2102780 - protein, 24 aa, Staphylococcus
ANAMKRDGWTFASHSWGHIDFANS

SEQ ID NO: 2102781 - protein, 22 aa, Staphylococcus
ANAVSSYDGYWLASYQAEEPTR

SEQ ID NO: 2102782 - protein, 22 aa, Staphylococcus
ANAVSSYDGYWLASYQAQEPTR

SEQ ID NO: 2102783 - protein, 27 aa, Staphylococcus
ANCLKEYDFREALARYDKLRVKHTAKV

SEQ ID NO: 2102784 - protein, 19 aa, Staphylococcus
ANDEAKAAEKDQVSTTTNS

SEQ ID NO: 2102785 - protein, 19 aa, Staphylococcus
ANEKEWRENDGLVSVISSQ

SEQ ID NO: 2102786 - protein, 18 aa, Staphylococcus
ANENLGLNPSHHGETDKA

SEQ ID NO: 2102787 - protein, 18 aa, Staphylococcus
ANENLGLNPSHNGEKDEK

SEQ ID NO: 2102788 - protein, 19 aa, Staphylococcus
ANENLGLNPSHNGETDEEK

SEQ ID NO: 2102789 - protein, 18 aa, Staphylococcus
ANGLNGNLIYPGQSLTIP

SEQ ID NO: 2102790 - protein, 17 aa, Staphylococcus
ANIATVYNWNPKAKQLT

SEQ ID NO: 2102791 - protein, 23 aa, Staphylococcus
ANIEGAQKIYTLFKPELNKKDKK

SEQ ID NO: 2102792 - protein, 23 aa, Staphylococcus
ANIKEVEKHFSLMATSKKGKKVN

SEQ ID NO: 2102793 - protein, 17 aa, Staphylococcus
ANIYVFKKGKYVILAYK

SEQ ID NO: 2102794 - protein, 23 aa, Staphylococcus
ANKANPGTFTIVSVNQKGEASVL

SEQ ID NO: 2102795 - protein, 17 aa, Staphylococcus
ANKGTPFALPNTPWKPL

SEQ ID NO: 2102796 - protein, 17 aa, Staphylococcus
ANLPSVRGQMVDIEFTH

SEQ ID NO: 2102797 - protein, 24 aa, Staphylococcus
ANNVKRLIFVTSIGIYNEVPGNFG

SEQ ID NO: 2102798 - protein, 19 aa, Staphylococcus
ANSSIKESHSESVQENENQ

SEQ ID NO: 2102799 - protein, 19 aa, Staphylococcus
ANTPIHMYHYGKPTGKYKN

SEQ ID NO: 2102800 - protein, 18 aa, Staphylococcus
APAIIALTIAGTAITTHQ

SEQ ID NO: 2102801 - protein, 18 aa, Staphylococcus
APEGMTFYSASPARGPFA

SEQ ID NO: 2102802 - protein, 27 aa, Staphylococcus
APIKETLAAALIRLANWNGNTPLIDPF

SEQ ID NO: 2102803 - protein, 26 aa, Staphylococcus
APIKETLAASLIRLANWTGDTPLVDP

SEQ ID NO: 2102804 - protein, 22 aa, Staphylococcus
APLEAAKQALQQSINQPTNTTG

SEQ ID NO: 2102805 - protein, 19 aa, Staphylococcus
APLTLKLKVVDVNQPTGDQ

SEQ ID NO: 2102806 - protein, 26 aa, Staphylococcus
APNFNLFGIKGAYKGESSEFNTLEAT

SEQ ID NO: 2102807 - protein, 25 aa, Staphylococcus
APPDELKPQFDLVKQMSEALGFINI

SEQ ID NO: 2102808 - protein, 30 aa, Staphylococcus
APSNLAIMGRYVLKPDIFDYLERQEIGRGG

SEQ ID NO: 2102809 - protein, 34 aa, Staphylococcus
APSNLAIMGRYVLKPEIFDYLSTQDKGSGGEIQL

SEQ ID NO: 2102810 - protein, 29 aa, Staphylococcus
APSNLAIMGRYVLTPEIFDYLKTQKKGAS

SEQ ID NO: 2102811 - protein, 21 aa, Staphylococcus
APTDYLSWGAGPAGNERFINV

SEQ ID NO: 2102812 - protein, 25 aa, Staphylococcus
APTDYLSWGAGPYGNNRFINVEIVH

SEQ ID NO: 2102813 - protein, 27 aa, Staphylococcus
APYHGTNAVNVARSLTRDNVNQSEALK

SEQ ID NO: 2102814 - protein, 17 aa, Staphylococcus
AQDSLKILKTHAEQPYS

SEQ ID NO: 2102815 - protein, 29 aa, Staphylococcus
AQFLLDESFLKSLDKGTVSFNGYQVVSND

SEQ ID NO: 2102816 - protein, 24 aa, Staphylococcus
AQGNYHYTWKGNWSPNQLNQNQGY

SEQ ID NO: 2102817 - protein, 18 aa, Staphylococcus
AQIGKGISTYWWNANNWD

SEQ ID NO: 2102818 - protein, 21 aa, Staphylococcus
AQKIYELFKPILNKKDKKLSE

SEQ ID NO: 2102819 - protein, 18 aa, Staphylococcus
AQKYDINEIYLISHALLE

SEQ ID NO: 2102820 - protein, 17 aa, Staphylococcus
AQLPSVRGNMKKIEFQY

SEQ ID NO: 2102821 - protein, 18 aa, Staphylococcus
AQPKRLLTADGIQTPFQS

SEQ ID NO: 2102822 - protein, 21 aa, Staphylococcus
AQRVLGWKPKHDDIHEIIETA

SEQ ID NO: 2102823 - protein, 17 aa, Staphylococcus
AQSVGKKAIKRVQYNSV

SEQ ID NO: 2102824 - protein, 19 aa, Staphylococcus
AQVPLAWGAHRAANIIAEQ

SEQ ID NO: 2102825 - protein, 20 aa, Staphylococcus
AQWLAKHAANYGFIIRYPKN

SEQ ID NO: 2102826 - protein, 20 aa, Staphylococcus
ARAGIEDIIIVTGKHKRAIE

SEQ ID NO: 2102827 - protein, 17 aa, Staphylococcus
ARDGSRKPYTFHATKVV

SEQ ID NO: 2102828 - protein, 22 aa, Staphylococcus
AREDIYGALRISFKSPEDRESG

SEQ ID NO: 2102829 - protein, 18 aa, Staphylococcus
AREKLRDIEQVLNGNPTV

SEQ ID NO: 2102830 - protein, 18 aa, Staphylococcus
ARGLKDYPIDITTIVTVA

SEQ ID NO: 2102831 - protein, 22 aa, Staphylococcus
ARGLREFPIDITAIVTVADDGG

SEQ ID NO: 2102832 - protein, 21 aa, Staphylococcus
ARGLREFPIDITAIVTVADNG

SEQ ID NO: 2102833 - protein, 20 aa, Staphylococcus
ARGPFATLIGVSDDKVAVIG

SEQ ID NO: 2102834 - protein, 22 aa, Staphylococcus
ARIKEIIYHKLATIEALENIKQ

SEQ ID NO: 2102835 - protein, 19 aa, Staphylococcus
ARKDLTKMMTFKGEPDFTI

SEQ ID NO: 2102836 - protein, 22 aa, Staphylococcus
ARNVNPIGYYQMMAEPGSSGGA

SEQ ID NO: 2102837 - protein, 23 aa, Staphylococcus
ARQHLVPDKAPLEAAKQALQQSI

SEQ ID NO: 2102838 - protein, 17 aa, Staphylococcus
ARRDLSKMMTFKGDPDF

SEQ ID NO: 2102839 - protein, 20 aa, Staphylococcus
ARTLYNRAPKASFYINDYEQ

SEQ ID NO: 2102840 - protein, 22 aa, Staphylococcus
ARTTYGPGHNAVVVVSDALPDG

SEQ ID NO: 2102841 - protein, 22 aa, Staphylococcus
ARYIHNNVLPKGGYDKFTNKIS

SEQ ID NO: 2102842 - protein, 26 aa, Staphylococcus
ASAKKGGSLGYVIKGQMVDKFDKALF

SEQ ID NO: 2102843 - protein, 22 aa, Staphylococcus
ASDDAFHASGIFPETDKRYYDK

SEQ ID NO: 2102844 - protein, 17 aa, Staphylococcus
ASDISFIMVHGQDHLMT

SEQ ID NO: 2102845 - protein, 17 aa, Staphylococcus
ASEWLLKQSKRHKRFNF

SEQ ID NO: 2102846 - protein, 21 aa, Staphylococcus
ASGDLPDFIVYYLDDSGRPEM

SEQ ID NO: 2102847 - protein, 17 aa, Staphylococcus
ASGYAPEHTFFAYDKAK

SEQ ID NO: 2102848 - protein, 17 aa, Staphylococcus
ASGYAPEHTFFSYDKSH

SEQ ID NO: 2102849 - protein, 22 aa, Staphylococcus
ASILVGATLFLGHHEAEAAEKQ

SEQ ID NO: 2102850 - protein, 24 aa, Staphylococcus
ASILVGATLIFGHADNEAKAAEEN

SEQ ID NO: 2102851 - protein, 19 aa, Staphylococcus
ASLASLVIGTGLFASTAQA

SEQ ID NO: 2102852 - protein, 18 aa, Staphylococcus
ASLDVIRYVTAHHPRLPI

SEQ ID NO: 2102853 - protein, 17 aa, Staphylococcus
ASLEKSVDKLEKENKSL

SEQ ID NO: 2102854 - protein, 18 aa, Staphylococcus
ASMSEAYVSITDAKSTIS

SEQ ID NO: 2102855 - protein, 28 aa, Staphylococcus
ASRTGNPIKLNIGFDIQDGYGNEETLKS

SEQ ID NO: 2102856 - protein, 18 aa, Staphylococcus
ASSAFDLSFEAYQDSKDV

SEQ ID NO: 2102857 - protein, 19 aa, Staphylococcus
ASSIAFSLSQVAHAEQMVN

SEQ ID NO: 2102858 - protein, 18 aa, Staphylococcus
ASSQYWYKYNGYTASGGN

SEQ ID NO: 2102859 - protein, 24 aa, Staphylococcus
ASVIECRDADSLYEIPLQLSKQDM

SEQ ID NO: 2102860 - protein, 19 aa, Staphylococcus
ATAGIATVGFAHHDAHAAE

SEQ ID NO: 2102861 - protein, 18 aa, Staphylococcus
ATDINWANLNAKSLKYLY

SEQ ID NO: 2102862 - protein, 29 aa, Staphylococcus
ATDINWANLNAQVIKGFYDKMGEVGKYFE

SEQ ID NO: 2102863 - protein, 20 aa, Staphylococcus
ATEFPRIQMFMRSYTGSANW

SEQ ID NO: 2102864 - protein, 18 aa, Staphylococcus
ATENLGLNPSHDGETKPE

SEQ ID NO: 2102865 - protein, 25 aa, Staphylococcus
ATHGNPRALKAFPSAVNQNNYPNGG

SEQ ID NO: 2102866 - protein, 35 aa, Staphylococcus
ATHPSLFGRQKADLNMFLPFILTGNVIGKANEKEW

SEQ ID NO: 2102867 - protein, 18 aa, Staphylococcus
ATIILIISILTLSSCSQN

SEQ ID NO: 2102868 - protein, 23 aa, Staphylococcus
ATKGKKGNAVFISHESLGYLSNR

SEQ ID NO: 2102869 - protein, 28 aa, Staphylococcus
ATNPYFYQIEVVRAYTFDDFARSVNNQA

SEQ ID NO: 2102870 - protein, 24 aa, Staphylococcus
ATRIKGFYDSMGKLGKYFDVDTYK

SEQ ID NO: 2102871 - protein, 24 aa, Staphylococcus
ATSEKKLAKEWMKFLKSDKAKKIL

SEQ ID NO: 2102872 - protein, 26 aa, Staphylococcus
ATSKMKKFKIGQAVDADGVQVKLTKI

SEQ ID NO: 2102873 - protein, 19 aa, Staphylococcus
ATSRPGGKIQTYRRDGYTI

SEQ ID NO: 2102874 - protein, 25 aa, Staphylococcus
ATTRAALPKYSPKVNSSINNYIRKN

SEQ ID NO: 2102875 - protein, 19 aa, Staphylococcus
AVAKEMGYKVKFKETQWDS

SEQ ID NO: 2102876 - protein, 18 aa, Staphylococcus
AVASGIVAGMGFGDNAKA

SEQ ID NO: 2102877 - protein, 21 aa, Staphylococcus
AVIASTVLVAGCTTDKGEIKD

SEQ ID NO: 2102878 - protein, 25 aa, Staphylococcus
AVILSICLVGLIFLATNQNALAKVH

SEQ ID NO: 2102879 - protein, 25 aa, Staphylococcus
AVKELSKILNIRGRVIPSTNTSVRL

SEQ ID NO: 2102880 - protein, 18 aa, Staphylococcus
AVKFSIERAKAMNKETTV

SEQ ID NO: 2102881 - protein, 17 aa, Staphylococcus
AVKIGWEAIVPPRTPER

SEQ ID NO: 2102882 - protein, 22 aa, Staphylococcus
AVKNDLHFKKYVENNTLPDGYK

SEQ ID NO: 2102883 - protein, 25 aa, Staphylococcus
AVLHPTYVGALVKFGHKPIAVPKFV

SEQ ID NO: 2102884 - protein, 17 aa, Staphylococcus
AVPAARNIVQPPANNQV

SEQ ID NO: 2102885 - protein, 24 aa, Staphylococcus
AVSKVGKGKAAFIGDSSLVEDSTP

SEQ ID NO: 2102886 - protein, 21 aa, Staphylococcus
AVTHHRYHYGSSPAPNKYKSV

SEQ ID NO: 2102887 - protein, 23 aa, Staphylococcus
AYAHELNEILSICNEHELYVSGK

SEQ ID NO: 2102888 - protein, 17 aa, Staphylococcus
AYDEKGWLNESGAKYPV

SEQ ID NO: 2102889 - protein, 20 aa, Staphylococcus
AYEKGQCTYYAFDKVKKDGN

SEQ ID NO: 2102890 - protein, 22 aa, Staphylococcus
AYEPWHLRYVGPQLAKTINEKN

SEQ ID NO: 2102891 - protein, 17 aa, Staphylococcus
AYKVYKNGEVQYKSGNF

SEQ ID NO: 2102892 - protein, 17 aa, Staphylococcus
AYNIAFDNSGYNFNFNS

SEQ ID NO: 2102893 - protein, 36 aa, Staphylococcus
AYNITFVKDGFKYNFTSDGQSWSWNYTYVGGADTVA

SEQ ID NO: 2102894 - protein, 24 aa, Staphylococcus
AYTIATRISDNWSKDDEEKLAKKI

SEQ ID NO: 2102895 - protein, 21 aa, Staphylococcus
AYTLGEPFKIYKLNKQSDGNF

SEQ ID NO: 2102896 - protein, 17 aa, Staphylococcus
CDYLTGFEGELSNDITK

SEQ ID NO: 2102897 - protein, 28 aa, Staphylococcus
CGALVIGLLCLGISHLFSGHEKAKSGKK

SEQ ID NO: 2102898 - protein, 17 aa, Staphylococcus
CIITTMVVLSSLLLVFS

SEQ ID NO: 2102899 - protein, 22 aa, Staphylococcus
CLLSTSLLIPSFSINDVSAESL

SEQ ID NO: 2102900 - protein, 19 aa, Staphylococcus
CPTGDLLILIGGNNWHIES

SEQ ID NO: 2102901 - protein, 17 aa, Staphylococcus
CTILECRLSNLNESDYA

SEQ ID NO: 2102902 - protein, 17 aa, Staphylococcus
CTILECRLSTLNESEYA

SEQ ID NO: 2102903 - protein, 17 aa, Staphylococcus
CTYYVFDKVGGKIGSTW

SEQ ID NO: 2102904 - protein, 17 aa, Staphylococcus
CTYYVYDKVGGKIGSTW

SEQ ID NO: 2102905 - protein, 22 aa, Staphylococcus
DAEKNKSAFAFSKKVDDKTVQK

SEQ ID NO: 2102906 - protein, 24 aa, Staphylococcus
DAEMKRQDEAYAREEAQRQKQEAA

SEQ ID NO: 2102907 - protein, 17 aa, Staphylococcus
DAIKVYKVNDPSAMVNS

SEQ ID NO: 2102908 - protein, 22 aa, Staphylococcus
DAKKVRPANEVSINKEQASKKA

SEQ ID NO: 2102909 - protein, 20 aa, Staphylococcus
DAKNSFSDINGWKSVSKESI

SEQ ID NO: 2102910 - protein, 31 aa, Staphylococcus
DAKNSFSNIEGWKPVDKEGIIKKNPDILIST

SEQ ID NO: 2102911 - protein, 23 aa, Staphylococcus
DAKRVVVLEYSFIDALAALDVKP

SEQ ID NO: 2102912 - protein, 23 aa, Staphylococcus
DALKYTNVYLFSKFVSESDQYDI

SEQ ID NO: 2102913 - protein, 23 aa, Staphylococcus
DALYRDIDAAFKMQNDKQRSAKY

SEQ ID NO: 2102914 - protein, 23 aa, Staphylococcus
DAMEKRLTQHYGAPSSTLEQSFE

SEQ ID NO: 2102915 - protein, 30 aa, Staphylococcus
DAMTYSALVASGFPKHRVLGQSGVLDSARY

SEQ ID NO: 2102916 - protein, 30 aa, Staphylococcus
DANAIVKCNLWLRTADRLKIVVGRFNAKTF

SEQ ID NO: 2102917 - protein, 17 aa, Staphylococcus
DANYFQHVPYLKTESKE

SEQ ID NO: 2102918 - protein, 19 aa, Staphylococcus
DAPLLKCVYQNHKVYKEML

SEQ ID NO: 2102919 - protein, 37 aa, Staphylococcus
DAQNDFSSAARYIAHLPQGASAVWQDNADNWKNNVGN

SEQ ID NO: 2102920 - protein, 24 aa, Staphylococcus
DASKDFIEDLGLPKSVVDGTKLKG

SEQ ID NO: 2102921 - protein, 18 aa, Staphylococcus
DAYENLLFDCLKGDATNF

SEQ ID NO: 2102922 - protein, 17 aa, Staphylococcus
DCFKTNIPDIYALGDVI

SEQ ID NO: 2102923 - protein, 19 aa, Staphylococcus
DCQAIVKKAIVERLRRAYQ

SEQ ID NO: 2102924 - protein, 19 aa, Staphylococcus
DDFVYAWRKVVDPKTASEF

SEQ ID NO: 2102925 - protein, 20 aa, Staphylococcus
DDGKLVYDITLQKGKEQRDI

SEQ ID NO: 2102926 - protein, 18 aa, Staphylococcus
DDIDGWKSVSKESIVKHN

SEQ ID NO: 2102927 - protein, 17 aa, Staphylococcus
DDIEMLQDLVLAATNEA

SEQ ID NO: 2102928 - protein, 25 aa, Staphylococcus
DDINPSVLAHYWGGDKLNIRQDLEE

SEQ ID NO: 2102929 - protein, 17 aa, Staphylococcus
DDKRPAYSNQVANAEDI

SEQ ID NO: 2102930 - protein, 19 aa, Staphylococcus
DDLKSYRLARDIKDQIEEE

SEQ ID NO: 2102931 - protein, 18 aa, Staphylococcus
DDNQRAGVDANYYAKQVY

SEQ ID NO: 2102932 - protein, 26 aa, Staphylococcus
DDSKHKLQYKKRYAISNHDVSSAIQQ

SEQ ID NO: 2102933 - protein, 19 aa, Staphylococcus
DDVKMVGHSGDWIVNYRNK

SEQ ID NO: 2102934 - protein, 24 aa, Staphylococcus
DDVTANDFVYAWRKVVNPKTGSEY

SEQ ID NO: 2102935 - protein, 17 aa, Staphylococcus
DDYKEQKKLSAYQKQLL

SEQ ID NO: 2102936 - protein, 20 aa, Staphylococcus
DEAAIVKCNLWLRTADRIKI

SEQ ID NO: 2102937 - protein, 26 aa, Staphylococcus
DEAGKFLWETLRNNFYYSAKNVPKAS

SEQ ID NO: 2102938 - protein, 22 aa, Staphylococcus
DEEKATAIAKVNSELAKVQQQI

SEQ ID NO: 2102939 - protein, 24 aa, Staphylococcus
DEFPPIRTGNDYRIDTTRTDNNVY

SEQ ID NO: 2102940 - protein, 25 aa, Staphylococcus
DEFQLRARLFVDQIVSFVNNSPYDH

SEQ ID NO: 2102941 - protein, 21 aa, Staphylococcus
DEILSRYGKNANYYIETKSPD

SEQ ID NO: 2102942 - protein, 23 aa, Staphylococcus
DEISRPGPRIDEGLKQLRDAIYK

SEQ ID NO: 2102943 - protein, 17 aa, Staphylococcus
DELSLGMDTQWMNRAGD

SEQ ID NO: 2102944 - protein, 18 aa, Staphylococcus
DELTEFESAYAPPFSSPK

SEQ ID NO: 2102945 - protein, 22 aa, Staphylococcus
DELTEFEVAYAPPYSHPKDLIN

SEQ ID NO: 2102946 - protein, 23 aa, Staphylococcus
DELTEFEVAYAPPYSHPKDLINM

SEQ ID NO: 2102947 - protein, 19 aa, Staphylococcus
DEMKRLAGDKKVLFYSYEN

SEQ ID NO: 2102948 - protein, 21 aa, Staphylococcus
DENYFKSIEIFYNSFKDLENV

SEQ ID NO: 2102949 - protein, 19 aa, Staphylococcus
DERVIKHYGSLVPLTELEE

SEQ ID NO: 2102950 - protein, 25 aa, Staphylococcus
DESAIVKCNLWLRTADRVKIVVGRF

SEQ ID NO: 2102951 - protein, 24 aa, Staphylococcus
DESTRYPNIFLIGATVENDHAKLC

SEQ ID NO: 2102952 - protein, 23 aa, Staphylococcus
DETTLKYYVCTSEDMSEWKEYDY

SEQ ID NO: 2102953 - protein, 26 aa, Staphylococcus
DEVAEAFTATIPYKGHLIVMKDDYTD

SEQ ID NO: 2102954 - protein, 17 aa, Staphylococcus
DEVDPEYNAKDKAQQEQ

SEQ ID NO: 2102955 - protein, 17 aa, Staphylococcus
DEVKKMFQKEFKQNDIW

SEQ ID NO: 2102956 - protein, 20 aa, Staphylococcus
DEVMYWKDVIEEIRRNNPEL

SEQ ID NO: 2102957 - protein, 23 aa, Staphylococcus
DFEEMKKWIPLMMEGRENNGGVM

SEQ ID NO: 2102958 - protein, 20 aa, Staphylococcus
DFENGLLHLSKSVFPTDNFL

SEQ ID NO: 2102959 - protein, 21 aa, Staphylococcus
DFFRQRLGDEVLENLIEPLMG

SEQ ID NO: 2102960 - protein, 20 aa, Staphylococcus
DFFVACQFHPEFLSRPNRPQ

SEQ ID NO: 2102961 - protein, 20 aa, Staphylococcus
DFIEAPLFFNSEEQIALCHA

SEQ ID NO: 2102962 - protein, 24 aa, Staphylococcus
DFLDHRVIKHYGSLVPLTELSDSL

SEQ ID NO: 2102963 - protein, 20 aa, Staphylococcus
DFSTASLLVSHFSNDPKTNI

SEQ ID NO: 2102964 - protein, 34 aa, Staphylococcus
DFYCFPDHKWLYGPEGLGFLFVRKNIQKDLDIIF

SEQ ID NO: 2102965 - protein, 17 aa, Staphylococcus
DGAREIIGLSLNKLGYS

SEQ ID NO: 2102966 - protein, 20 aa, Staphylococcus
DGDAAMRFIRSRKEEGAGGD

SEQ ID NO: 2102967 - protein, 19 aa, Staphylococcus
DGEVTGVRFFEIKDDKKPI

SEQ ID NO: 2102968 - protein, 18 aa, Staphylococcus
DGFKEQDNGTLLKNLTTW

SEQ ID NO: 2102969 - protein, 19 aa, Staphylococcus
DGFLACGYIAKGRMEEPLQ

SEQ ID NO: 2102970 - protein, 24 aa, Staphylococcus
DGFLACGYVAKGRMEEPLEILNVI

SEQ ID NO: 2102971 - protein, 20 aa, Staphylococcus
DGGLKFVKGDNIDLNNPRTY

SEQ ID NO: 2102972 - protein, 17 aa, Staphylococcus
DGKHVLTTLTYKNNKVI

SEQ ID NO: 2102973 - protein, 19 aa, Staphylococcus
DGKIKPYLVKSYEQPSDDT

SEQ ID NO: 2102974 - protein, 20 aa, Staphylococcus
DGKPHILYRANPMVENGGED

SEQ ID NO: 2102975 - protein, 17 aa, Staphylococcus
DGLRSLKDPERYNQPAH

SEQ ID NO: 2102976 - protein, 20 aa, Staphylococcus
DGLSELLNQLFSNNKMKQTS

SEQ ID NO: 2102977 - protein, 26 aa, Staphylococcus
DGLSSGEKQTMYAIENNQYEVEDAEQ

SEQ ID NO: 2102978 - protein, 19 aa, Staphylococcus
DGMGPAYNSAYRYYADNPN

SEQ ID NO: 2102979 - protein, 36 aa, Staphylococcus
DGNPTIYKSSWKNIAPSYRSATRHLSQTYATDPNYA

SEQ ID NO: 2102980 - protein, 26 aa, Staphylococcus
DGQGTVWTHYAISKYLGGTDHSDPHA

SEQ ID NO: 2102981 - protein, 19 aa, Staphylococcus
DGQHFSWNYTAAGSNASAQ

SEQ ID NO: 2102982 - protein, 19 aa, Staphylococcus
DGQRINIKKGKKVQLAQQI

SEQ ID NO: 2102983 - protein, 19 aa, Staphylococcus
DGQTWSWNYTTAGAQSASS

SEQ ID NO: 2102984 - protein, 20 aa, Staphylococcus
DGRIHPGRIEDMVDKARKEV

SEQ ID NO: 2102985 - protein, 19 aa, Staphylococcus
DGRIHPGRIEDMVEKARKE

SEQ ID NO: 2102986 - protein, 20 aa, Staphylococcus
DGRIHPGRIEDMVEKARKEV

SEQ ID NO: 2102987 - protein, 19 aa, Staphylococcus
DGSINVYKNVPYDWRDSRT

SEQ ID NO: 2102988 - protein, 17 aa, Staphylococcus
DGSSTVGPIIEKLNEKF

SEQ ID NO: 2102989 - protein, 27 aa, Staphylococcus
DGSTDRISISNAITYEPIRKSIYADGN

SEQ ID NO: 2102990 - protein, 22 aa, Staphylococcus
DGTTCTVGGCTSADGKSVPDEH

SEQ ID NO: 2102991 - protein, 23 aa, Staphylococcus
DGVSLYKISGFRSYETQVNLYNQ

SEQ ID NO: 2102992 - protein, 20 aa, Staphylococcus
DGYDGVLIPGGFSFGDYLRS

SEQ ID NO: 2102993 - protein, 22 aa, Staphylococcus
DGYKPKELTVQFVPSQNADTLE

SEQ ID NO: 2102994 - protein, 24 aa, Staphylococcus
DGYLACGYVAKGRMEEPLQIVKVL

SEQ ID NO: 2102995 - protein, 24 aa, Staphylococcus
DGYLACGYVAKGRMEEPLQIVSVI

SEQ ID NO: 2102996 - protein, 24 aa, Staphylococcus
DGYLACGYVAKGRMEEPLQIVSVV

SEQ ID NO: 2102997 - protein, 20 aa, Staphylococcus
DHAKKLAALVNEESKAKQWI

SEQ ID NO: 2102998 - protein, 17 aa, Staphylococcus
DHAQEFVTPLAFQAIGR

SEQ ID NO: 2102999 - protein, 18 aa, Staphylococcus
DHVNVGLAVPKYVQNIDS

SEQ ID NO: 2103000 - protein, 25 aa, Staphylococcus
DIARKYFLERTFRKPSEFYNPIALY

SEQ ID NO: 2103001 - protein, 18 aa, Staphylococcus
DIDMNAFQHFAFLDQYKK

SEQ ID NO: 2103002 - protein, 18 aa, Staphylococcus
DIDMNAFQHFAFLNEYKK

SEQ ID NO: 2103003 - protein, 18 aa, Staphylococcus
DIDREKEKQLAIIERRAQ

SEQ ID NO: 2103004 - protein, 22 aa, Staphylococcus
DIDRLSLMSTFPEFKEREEQYG

SEQ ID NO: 2103005 - protein, 25 aa, Staphylococcus
DIETLRKWVPLMMEGRVDDGKMAAS

SEQ ID NO: 2103006 - protein, 19 aa, Staphylococcus
DIGYFCVDNLPPVLLPKFV

SEQ ID NO: 2103007 - protein, 34 aa, Staphylococcus
DIKKARKNGSKWIILNLHKPMYSKSYHALTDEDI

SEQ ID NO: 2103008 - protein, 23 aa, Staphylococcus
DIKMLKDPEKIYGKDDEHINLVF

SEQ ID NO: 2103009 - protein, 25 aa, Staphylococcus
DIKPFLKTRLISPIGKLRAGLDLVI

SEQ ID NO: 2103010 - protein, 37 aa, Staphylococcus
DIKPFLKTRLISPLGKLRAGLDLVIPPIKIENDISVG

SEQ ID NO: 2103011 - protein, 17 aa, Staphylococcus
DILSMIDLTAYKASKIS

SEQ ID NO: 2103012 - protein, 24 aa, Staphylococcus
DINPAVLSHYWGGDKMNIRQDLEE

SEQ ID NO: 2103013 - protein, 24 aa, Staphylococcus
DINPSVLAHYWGGDKMNIRQDLEE

SEQ ID NO: 2103014 - protein, 26 aa, Staphylococcus
DIPAMNGAAGFHLDKVLKQNGTGNGI

SEQ ID NO: 2103015 - protein, 17 aa, Staphylococcus
DITAAFDKIETGYQEKD

SEQ ID NO: 2103016 - protein, 18 aa, Staphylococcus
DITRIASSNAEMWKDILL

SEQ ID NO: 2103017 - protein, 18 aa, Staphylococcus
DITRIASSNAEMWKDITL

SEQ ID NO: 2103018 - protein, 18 aa, Staphylococcus
DITRIASSNAEMWRDITI

SEQ ID NO: 2103019 - protein, 29 aa, Staphylococcus
DITRIASSNPIMWRDITIENKNTILRILK

SEQ ID NO: 2103020 - protein, 32 aa, Staphylococcus
DIYKPTWKSEAYSYRSATMHLATTYATDSQYA

SEQ ID NO: 2103021 - protein, 20 aa, Staphylococcus
DKAKVSLAVPKYMDDVDSID

SEQ ID NO: 2103022 - protein, 18 aa, Staphylococcus
DKATELNTAMSQLQDGIA

SEQ ID NO: 2103023 - protein, 20 aa, Staphylococcus
DKAVALFLKECEDYEIDFQK

SEQ ID NO: 2103024 - protein, 26 aa, Staphylococcus
DKENKNALLFEWSRLNEMLDNQLYLV

SEQ ID NO: 2103025 - protein, 17 aa, Staphylococcus
DKFRAGASGSLMVNGNY

SEQ ID NO: 2103026 - protein, 17 aa, Staphylococcus
DKGELPFQSEADLKRIK

SEQ ID NO: 2103027 - protein, 17 aa, Staphylococcus
DKIEPLISKQIEDLNQS

SEQ ID NO: 2103028 - protein, 28 aa, Staphylococcus
DKILGVDLRGTFLMTKFLLPLMMDEGGS

SEQ ID NO: 2103029 - protein, 20 aa, Staphylococcus
DKIMGVDMRGTFLVTKFLLP

SEQ ID NO: 2103030 - protein, 25 aa, Staphylococcus
DKIYYKRGFNAKAYVEQHKPDYKDI

SEQ ID NO: 2103031 - protein, 23 aa, Staphylococcus
DKKAGEYHKKFQVKGIDDDVSYS

SEQ ID NO: 2103032 - protein, 20 aa, Staphylococcus
DKKDMPSLDKYNHTIHSDDQ

SEQ ID NO: 2103033 - protein, 21 aa, Staphylococcus
DKKWLTEQFLDNEIDKLDITT

SEQ ID NO: 2103034 - protein, 21 aa, Staphylococcus
DKLDEVISIVGKNAKHNLTKS

SEQ ID NO: 2103035 - protein, 24 aa, Staphylococcus
DKLDPHAWLSLDNGIQYVKNIQQA

SEQ ID NO: 2103036 - protein, 17 aa, Staphylococcus
DKLKLGVDSSWLNREGD

SEQ ID NO: 2103037 - protein, 23 aa, Staphylococcus
DKLNSIIKHYDLTQFDKKQMPDL

SEQ ID NO: 2103038 - protein, 17 aa, Staphylococcus
DKNKAFQALKLLPNDKN

SEQ ID NO: 2103039 - protein, 19 aa, Staphylococcus
DKQLKVIAKQSAKFDRAEG

SEQ ID NO: 2103040 - protein, 19 aa, Staphylococcus
DKTKMAGYISVPDAEIKEP

SEQ ID NO: 2103041 - protein, 27 aa, Staphylococcus
DLASSPHFNLFGIKGAYEGQSATFNTL

SEQ ID NO: 2103042 - protein, 18 aa, Staphylococcus
DLEKSGSVNTRYRNEVYQ

SEQ ID NO: 2103043 - protein, 20 aa, Staphylococcus
DLGIKALDSHTLKIDLEKPI

SEQ ID NO: 2103044 - protein, 20 aa, Staphylococcus
DLKDKIALFCDIDKESVIEC

SEQ ID NO: 2103045 - protein, 17 aa, Staphylococcus
DLKSYRLARDIKNQIEE

SEQ ID NO: 2103046 - protein, 17 aa, Staphylococcus
DLKSYRLARDIKTQIED

SEQ ID NO: 2103047 - protein, 19 aa, Staphylococcus
DLLGRLNFKLVKNAKGVKV

SEQ ID NO: 2103048 - protein, 24 aa, Staphylococcus
DLLKKDYKDALAIPNPSESGTALD

SEQ ID NO: 2103049 - protein, 24 aa, Staphylococcus
DLNQARTNLTLDRQPTLTTLQNAT

SEQ ID NO: 2103050 - protein, 19 aa, Staphylococcus
DLQKRGEVISEVMQEPTKS

SEQ ID NO: 2103051 - protein, 17 aa, Staphylococcus
DLRKELVKYYKSGLTLD

SEQ ID NO: 2103052 - protein, 20 aa, Staphylococcus
DLSDEWRNKIAKAFINVSKK

SEQ ID NO: 2103053 - protein, 25 aa, Staphylococcus
DLSDKTRIALAFFADKKGEYLITKE

SEQ ID NO: 2103054 - protein, 19 aa, Staphylococcus
DLTHKITVDGHVDTSKVGK

SEQ ID NO: 2103055 - protein, 21 aa, Staphylococcus
DLVGLDIAVSVIKGLQQDPDE

SEQ ID NO: 2103056 - protein, 18 aa, Staphylococcus
DLYHKYGKDSDYKKVAKQ

SEQ ID NO: 2103057 - protein, 21 aa, Staphylococcus
DMRGTFLVTKFLLPLMMEQGG

SEQ ID NO: 2103058 - protein, 25 aa, Staphylococcus
DNADNWKNNVGNFTKTAVVTLPNGQ

SEQ ID NO: 2103059 - protein, 22 aa, Staphylococcus
DNAELFYRHEVQDFSRRKDGKW

SEQ ID NO: 2103060 - protein, 18 aa, Staphylococcus
DNDPVVNGILWQEILNKP

SEQ ID NO: 2103061 - protein, 17 aa, Staphylococcus
DNDVMREFIKFTLEDKG

SEQ ID NO: 2103062 - protein, 32 aa, Staphylococcus
DNDWEITGIPSSLRIENAAGRTNNNSERNLEL

SEQ ID NO: 2103063 - protein, 17 aa, Staphylococcus
DNKAFQEFMKFTLEDKG

SEQ ID NO: 2103064 - protein, 22 aa, Staphylococcus
DNKGNPGLDVFVVRENTSDRSA

SEQ ID NO: 2103065 - protein, 24 aa, Staphylococcus
DNKLNVYTTVFAFQSFIEQIGGKY

SEQ ID NO: 2103066 - protein, 19 aa, Staphylococcus
DNNALKVVMHFEAQEAEAF

SEQ ID NO: 2103067 - protein, 24 aa, Staphylococcus
DNNMVFPGQVITVGGSASQSSSSN

SEQ ID NO: 2103068 - protein, 21 aa, Staphylococcus
DNPSIKAGQNYLDASNSNQND

SEQ ID NO: 2103069 - protein, 25 aa, Staphylococcus
DNPTYLPRFVFGHYMKSYLSKFDEQ

SEQ ID NO: 2103070 - protein, 25 aa, Staphylococcus
DNTKTHWSSYRFIQKSSNGTELQTK

SEQ ID NO: 2103071 - protein, 18 aa, Staphylococcus
DNVAIALGVAQAVGVEKD

SEQ ID NO: 2103072 - protein, 19 aa, Staphylococcus
DNVNRIIKYFHALNSTIAN

SEQ ID NO: 2103073 - protein, 24 aa, Staphylococcus
DNVNRVKVQFLPNNDIMTDTRRVA

SEQ ID NO: 2103074 - protein, 23 aa, Staphylococcus
DPASVPRNYDIIGSATPTSTSNS

SEQ ID NO: 2103075 - protein, 20 aa, Staphylococcus
DPESPWHDCNTKINLIGKNN

SEQ ID NO: 2103076 - protein, 31 aa, Staphylococcus
DPHQLKILYMHGGSWVAGPFKEHYQMMDQLA

SEQ ID NO: 2103077 - protein, 17 aa, Staphylococcus
DPISILFLGIDDNEGRE

SEQ ID NO: 2103078 - protein, 28 aa, Staphylococcus
DPMSYAKTPSLYVGGFYDPSLPTNRYRG

SEQ ID NO: 2103079 - protein, 20 aa, Staphylococcus
DPSYPIGYHFDLHLGTTEYE

SEQ ID NO: 2103080 - protein, 21 aa, Staphylococcus
DQADAAYEWQMGQYGNEGNRK

SEQ ID NO: 2103081 - protein, 26 aa, Staphylococcus
DQGPAFPFAECGAMSQAYIGYQLQES

SEQ ID NO: 2103082 - protein, 17 aa, Staphylococcus
DQLEKALSIGIIDKKIE

SEQ ID NO: 2103083 - protein, 19 aa, Staphylococcus
DQLIILTAIDYVYVNYNTD

SEQ ID NO: 2103084 - protein, 23 aa, Staphylococcus
DQLKSDLLFHKSLQIEQRDSSSY

SEQ ID NO: 2103085 - protein, 22 aa, Staphylococcus
DQLRKASLTTFDPATGEVKQAQ

SEQ ID NO: 2103086 - protein, 29 aa, Staphylococcus
DQQGNYHYTWKGNWSPDRLNHTNDSNHSQ

SEQ ID NO: 2103087 - protein, 25 aa, Staphylococcus
DQQGQYHYTWQGNWNPSNSDQGHTS

SEQ ID NO: 2103088 - protein, 34 aa, Staphylococcus
DQQNMRFSFVGSGNMPPNLHIVGSQTRVVRVTYA

SEQ ID NO: 2103089 - protein, 19 aa, Staphylococcus
DQYIHGEVANALDRKTEIE

SEQ ID NO: 2103090 - protein, 17 aa, Staphylococcus
DRGTLESVIYGNYSETA

SEQ ID NO: 2103091 - protein, 17 aa, Staphylococcus
DRIRVVVEVLPLTNFVP

SEQ ID NO: 2103092 - protein, 21 aa, Staphylococcus
DRKTKIVDVIDRVLHIDHVES

SEQ ID NO: 2103093 - protein, 26 aa, Staphylococcus
DRQGRLLNEYAYRLDAIPKSPGKGKE

SEQ ID NO: 2103094 - protein, 18 aa, Staphylococcus
DSAEYDGVGTVWTHQAVS

SEQ ID NO: 2103095 - protein, 18 aa, Staphylococcus
DSAVFKEDVVKLKAPMRV

SEQ ID NO: 2103096 - protein, 19 aa, Staphylococcus
DSDAVKNSTSIPFNIDAYM

SEQ ID NO: 2103097 - protein, 24 aa, Staphylococcus
DSDSFHASGIFPSTDKSFYNKFKS

SEQ ID NO: 2103098 - protein, 18 aa, Staphylococcus
DSFNRFVNIVKDGRDMPE

SEQ ID NO: 2103099 - protein, 23 aa, Staphylococcus
DSLSRIANKYGTSVTDLMNANNF

SEQ ID NO: 2103100 - protein, 19 aa, Staphylococcus
DSLWSIANKYNMPVDELKR

SEQ ID NO: 2103101 - protein, 33 aa, Staphylococcus
DSPYPHGQCTWYVYNRMAQFDKYVSGDLGDARN

SEQ ID NO: 2103102 - protein, 18 aa, Staphylococcus
DSQIPMNVLNHSILSGVA

SEQ ID NO: 2103103 - protein, 26 aa, Staphylococcus
DSSDDLRLGKFLKLSPDEILKKMNHL

SEQ ID NO: 2103104 - protein, 21 aa, Staphylococcus
DSSWFSKELGVKMLKDPDKIY

SEQ ID NO: 2103105 - protein, 20 aa, Staphylococcus
DSVEKAIVGGAQFIGQSYVK

SEQ ID NO: 2103106 - protein, 31 aa, Staphylococcus
DSVSKAIIGGAKFIGNSYVKAGQNTLYKMRW

SEQ ID NO: 2103107 - protein, 31 aa, Staphylococcus
DSVSKAIVGGAKFIGQSYVKAGQNTLYKMRW

SEQ ID NO: 2103108 - protein, 22 aa, Staphylococcus
DSYLKKIIKALVKEGLVNSSTG

SEQ ID NO: 2103109 - protein, 22 aa, Staphylococcus
DTKLKYYVCTCEDDKEWREYDY

SEQ ID NO: 2103110 - protein, 23 aa, Staphylococcus
DTKRWKNEVEPIIGKTDVFIYPH

SEQ ID NO: 2103111 - protein, 23 aa, Staphylococcus
DTTPKTHSAVVFEAGQAGASSYY

SEQ ID NO: 2103112 - protein, 25 aa, Staphylococcus
DTVSKAIVGGAQFIKDAYINQGQNT

SEQ ID NO: 2103113 - protein, 19 aa, Staphylococcus
DVAKEFWGKQGRVGIVPLI

SEQ ID NO: 2103114 - protein, 18 aa, Staphylococcus
DVDAAAVFQDARTIVKKD

SEQ ID NO: 2103115 - protein, 26 aa, Staphylococcus
DVDGILVPGGFGFRASEGKIAAIKYA

SEQ ID NO: 2103116 - protein, 26 aa, Staphylococcus
DVDSSWPNKEIKAFSPNSSHGTYDFW

SEQ ID NO: 2103117 - protein, 20 aa, Staphylococcus
DVDVSFNYGGSGALRQQIEK

SEQ ID NO: 2103118 - protein, 24 aa, Staphylococcus
DVGNEAFIRQVLYDNMKLQGNKYS

SEQ ID NO: 2103119 - protein, 18 aa, Staphylococcus
DVILGGGSKYFGKENGHL

SEQ ID NO: 2103120 - protein, 18 aa, Staphylococcus
DVILGGGSKYFGKENGNL

SEQ ID NO: 2103121 - protein, 18 aa, Staphylococcus
DVILGGGSKYFGKNNGNL

SEQ ID NO: 2103122 - protein, 24 aa, Staphylococcus
DVIPDAYCCALVLREDLINQHHHT

SEQ ID NO: 2103123 - protein, 21 aa, Staphylococcus
DVKEAEKLLKEAGYHKNSDGI

SEQ ID NO: 2103124 - protein, 18 aa, Staphylococcus
DVKMLKDPDKIYGNNKQH

SEQ ID NO: 2103125 - protein, 18 aa, Staphylococcus
DVKRELRSGDAYDSELDK

SEQ ID NO: 2103126 - protein, 17 aa, Staphylococcus
DVLKKPQAKEEIASKVN

SEQ ID NO: 2103127 - protein, 24 aa, Staphylococcus
DVNPKWPSKEIKAYSPDQSHGTYD

SEQ ID NO: 2103128 - protein, 25 aa, Staphylococcus
DVNSSWPDKKIKAFSPNSSHGTYDF

SEQ ID NO: 2103129 - protein, 25 aa, Staphylococcus
DVNSSWPNKKIKAFSPDQSHGTYDF

SEQ ID NO: 2103130 - protein, 25 aa, Staphylococcus
DVTFANCGLPYYLGNIIDDRSELLH

SEQ ID NO: 2103131 - protein, 18 aa, Staphylococcus
DVVYELLDQSGLNPHKSE

SEQ ID NO: 2103132 - protein, 17 aa, Staphylococcus
DWDHVDFVGQDSSDTVR

SEQ ID NO: 2103133 - protein, 36 aa, Staphylococcus
DWGQCTWHAFNRRAQIGKGISTYWWNANNWDDGARA

SEQ ID NO: 2103134 - protein, 18 aa, Staphylococcus
DWIDKDGYYYGFSGSALG

SEQ ID NO: 2103135 - protein, 21 aa, Staphylococcus
DYAAVDLMKAFGVQDTIKALP

SEQ ID NO: 2103136 - protein, 19 aa, Staphylococcus
DYFKMKPVGLIGNSGGIVS

SEQ ID NO: 2103137 - protein, 18 aa, Staphylococcus
DYGFKFDSARPMQIGLVY

SEQ ID NO: 2103138 - protein, 23 aa, Staphylococcus
DYSCSACLMYIGIDQDLRDNLLL

SEQ ID NO: 2103139 - protein, 23 aa, Staphylococcus
DYVKEVSNQFGFVNIGVQNYEAD

SEQ ID NO: 2103140 - protein, 19 aa, Staphylococcus
DYVKRVIGVPGDKVQYKKD

SEQ ID NO: 2103141 - protein, 31 aa, Staphylococcus
DYVKRVQKSKLWKSKDNGFNDLTRDGATDLN

SEQ ID NO: 2103142 - protein, 24 aa, Staphylococcus
EAAGLIKLKDNFGLSGSIKDIKDN

SEQ ID NO: 2103143 - protein, 28 aa, Staphylococcus
EADLKRIKSYAVGVGPEYTDLNEKNTKH

SEQ ID NO: 2103144 - protein, 29 aa, Staphylococcus
EAFEAEIKWLKAHGAHFLTEKEFQHYKEK

SEQ ID NO: 2103145 - protein, 20 aa, Staphylococcus
EAGKAFRDNQKWVTPLGRLG

SEQ ID NO: 2103146 - protein, 18 aa, Staphylococcus
EAIDKAFEAISMSSDKAK

SEQ ID NO: 2103147 - protein, 18 aa, Staphylococcus
EAKALGFAEADPTDDVEG

SEQ ID NO: 2103148 - protein, 21 aa, Staphylococcus
EAKKIMAAQGYTKAHPLKLTV

SEQ ID NO: 2103149 - protein, 20 aa, Staphylococcus
EAKSGELIRSITYPNFNNFK

SEQ ID NO: 2103150 - protein, 22 aa, Staphylococcus
EAKTLKKDYLATVKQKRAKINE

SEQ ID NO: 2103151 - protein, 24 aa, Staphylococcus
EALIIRKNLKNVYHEDGLFHLQYE

SEQ ID NO: 2103152 - protein, 21 aa, Staphylococcus
EALLKVKPDLILAHESQKGTS

SEQ ID NO: 2103153 - protein, 21 aa, Staphylococcus
EANAKVAKQNGYTGEANGDMG

SEQ ID NO: 2103154 - protein, 31 aa, Staphylococcus
EANEYRLSDSRPLPPIYGGPEGMRYFEASPP

SEQ ID NO: 2103155 - protein, 22 aa, Staphylococcus
EANIPFKKREQQAMLNFVEKGG

SEQ ID NO: 2103156 - protein, 19 aa, Staphylococcus
EARAVRSSRRPVRGQGGTR

SEQ ID NO: 2103157 - protein, 22 aa, Staphylococcus
EATDKMKLFRVGQTVTADGVDI

SEQ ID NO: 2103158 - protein, 27 aa, Staphylococcus
EATLNVPVDFYVRINMEAFVQAVDELG

SEQ ID NO: 2103159 - protein, 26 aa, Staphylococcus
EATNDGFRYVFSFKDASKDNSYSIVT

SEQ ID NO: 2103160 - protein, 21 aa, Staphylococcus
EATVTIARGQQFEFGDLKQYF

SEQ ID NO: 2103161 - protein, 18 aa, Staphylococcus
EAVKGNEGKTVYISHDSI

SEQ ID NO: 2103162 - protein, 18 aa, Staphylococcus
EAVRRRANEVLSNDRATN

SEQ ID NO: 2103163 - protein, 23 aa, Staphylococcus
EAYPELVSELASPFSAIYDTKAD

SEQ ID NO: 2103164 - protein, 19 aa, Staphylococcus
EDADAVIINSNFAIDQKLS

SEQ ID NO: 2103165 - protein, 17 aa, Staphylococcus
EDAGRGYRRVVPSPQPK

SEQ ID NO: 2103166 - protein, 42 aa, Staphylococcus
EDAKFLPNKILNIKYKLRPVNIPTPRQVTVNQSITYKTYAQY

SEQ ID NO: 2103167 - protein, 21 aa, Staphylococcus
EDDKPNIAIVYGVKKKTDKED

SEQ ID NO: 2103168 - protein, 25 aa, Staphylococcus
EDIEEMRKWIPLMMKGHNSSDIMAA

SEQ ID NO: 2103169 - protein, 25 aa, Staphylococcus
EDIEVMRKWIPLMMKGRQNDDGYMA

SEQ ID NO: 2103170 - protein, 25 aa, Staphylococcus
EDIEVMRKWIPLMMQGRVDDGKMAA

SEQ ID NO: 2103171 - protein, 24 aa, Staphylococcus
EDIPAETKNGGLLLKQNDTNGERI

SEQ ID NO: 2103172 - protein, 19 aa, Staphylococcus
EDIPRCIYTRLESASVGLS

SEQ ID NO: 2103173 - protein, 18 aa, Staphylococcus
EDKIMLSKNDKYWDRDKV

SEQ ID NO: 2103174 - protein, 19 aa, Staphylococcus
EDNVEIFVPMVQKIVDQGF

SEQ ID NO: 2103175 - protein, 17 aa, Staphylococcus
EDRGSILYNGKRLGEGM

SEQ ID NO: 2103176 - protein, 20 aa, Staphylococcus
EDTYHTPLSVFNMNGSNHSF

SEQ ID NO: 2103177 - protein, 19 aa, Staphylococcus
EDVQDAAAVKLYNTAGASQ

SEQ ID NO: 2103178 - protein, 19 aa, Staphylococcus
EDYENGLISEDEAMERDEQ

SEQ ID NO: 2103179 - protein, 17 aa, Staphylococcus
EDYRISPINGDLEGLGR

SEQ ID NO: 2103180 - protein, 29 aa, Staphylococcus
EDYTSYFPKYGYRNGVGKPEGIVVHDTAN

SEQ ID NO: 2103181 - protein, 36 aa, Staphylococcus
EEDYSSYFPKYGYRNGVGRPEGIVVHDTANENSTIT

SEQ ID NO: 2103182 - protein, 23 aa, Staphylococcus
EEFEISKQFWAHLVKTNAISNPR

SEQ ID NO: 2103183 - protein, 18 aa, Staphylococcus
EEFWKWYQEQSEFKFDNP

SEQ ID NO: 2103184 - protein, 18 aa, Staphylococcus
EEFWKWYQHQQVFDFDNP

SEQ ID NO: 2103185 - protein, 31 aa, Staphylococcus
EEHYTSYFPKYGYRNGVGKPEGIVVHDTAND

SEQ ID NO: 2103186 - protein, 22 aa, Staphylococcus
EEIEYARVWNQLGPLKNNMDGM

SEQ ID NO: 2103187 - protein, 21 aa, Staphylococcus
EEIKSQLPLHKSLKVSEHSAD

SEQ ID NO: 2103188 - protein, 23 aa, Staphylococcus
EEIYRIDHYLGKDMVQNIEVLRF

SEQ ID NO: 2103189 - protein, 24 aa, Staphylococcus
EELKRFKEKWSYLNSGMNNLFGSD

SEQ ID NO: 2103190 - protein, 21 aa, Staphylococcus
EEMRKWVPLMMEGHSSSDIMA

SEQ ID NO: 2103191 - protein, 31 aa, Staphylococcus
EENYSSYFPKYGYRNGVGKPEGIVVHDTAND

SEQ ID NO: 2103192 - protein, 36 aa, Staphylococcus
EENYTSYFPKYGYRYGVGRPEGIVVHDTANENSTID

SEQ ID NO: 2103193 - protein, 21 aa, Staphylococcus
EEQFRKGILPILKKEGYDVKI

SEQ ID NO: 2103194 - protein, 27 aa, Staphylococcus
EESNLPKKRSRRDLPAGDSNNANTATT

SEQ ID NO: 2103195 - protein, 21 aa, Staphylococcus
EETLKSVYLYVKPELQNNIGF

SEQ ID NO: 2103196 - protein, 24 aa, Staphylococcus
EFADYKCPYCKKVEDNIMPKLEKD

SEQ ID NO: 2103197 - protein, 22 aa, Staphylococcus
EFDIELSCFSEFDVDLSDVESV

SEQ ID NO: 2103198 - protein, 20 aa, Staphylococcus
EFEISKQFWGHLVKSGSIDN

SEQ ID NO: 2103199 - protein, 19 aa, Staphylococcus
EFTYNGKIIQALDLVETSR

SEQ ID NO: 2103200 - protein, 19 aa, Staphylococcus
EGAINAGGYDNAKVTKLID

SEQ ID NO: 2103201 - protein, 20 aa, Staphylococcus
EGAKIGEPVQNLLKSNDVSV

SEQ ID NO: 2103202 - protein, 20 aa, Staphylococcus
EGFESGLLELSKEVFPTDKY

SEQ ID NO: 2103203 - protein, 37 aa, Staphylococcus
EGGRIWTYKDGKPWYFLEEKYPDYGNLVPRDIATREI

SEQ ID NO: 2103204 - protein, 18 aa, Staphylococcus
EGKIKPSLINNLGSSTIQ

SEQ ID NO: 2103205 - protein, 20 aa, Staphylococcus
EGNAGLSLYSSTKFAVRGLT

SEQ ID NO: 2103206 - protein, 27 aa, Staphylococcus
EGNPTIYKPTWKSEALTYKEATSHLSH

SEQ ID NO: 2103207 - protein, 20 aa, Staphylococcus
EGPASAAYESSLRVESGQEK

SEQ ID NO: 2103208 - protein, 19 aa, Staphylococcus
EGSNLWFDNMVIPRTAQNK

SEQ ID NO: 2103209 - protein, 17 aa, Staphylococcus
EGTELTGKYTKETNDYL

SEQ ID NO: 2103210 - protein, 19 aa, Staphylococcus
EGTLAYDIYGKKEIEERHR

SEQ ID NO: 2103211 - protein, 29 aa, Staphylococcus
EGTTYHFASDGTYFEWQYYPSNGAADDTT

SEQ ID NO: 2103212 - protein, 25 aa, Staphylococcus
EGVAKLKPDLILTYDVNTKIKKYQK

SEQ ID NO: 2103213 - protein, 19 aa, Staphylococcus
EGVDVVLGMHPHVIQPVKW

SEQ ID NO: 2103214 - protein, 27 aa, Staphylococcus
EGVEKAFAIQAGREIRVIVSPDTIDDL

SEQ ID NO: 2103215 - protein, 22 aa, Staphylococcus
EGVFHFCAYSLVGESVEKPLEY

SEQ ID NO: 2103216 - protein, 26 aa, Staphylococcus
EGVYPEWQPGQKVHLVGHSMGGQTIR

SEQ ID NO: 2103217 - protein, 25 aa, Staphylococcus
EGYYEYRTNKGLLVVTAVGKKNQGY

SEQ ID NO: 2103218 - protein, 17 aa, Staphylococcus
EHFRVNRAFICGDAGHI

SEQ ID NO: 2103219 - protein, 18 aa, Staphylococcus
EHHIKHLLVETSVDKKAM

SEQ ID NO: 2103220 - protein, 17 aa, Staphylococcus
EHIKPLIQKQIKDLNQT

SEQ ID NO: 2103221 - protein, 24 aa, Staphylococcus
EHIKRTYPRLKITGAPFEAVGLPD

SEQ ID NO: 2103222 - protein, 19 aa, Staphylococcus
EHLYHLGWITKLRDDNDQR

SEQ ID NO: 2103223 - protein, 26 aa, Staphylococcus
EHYYEFKKDNGVLVVTADGKKNNGKI

SEQ ID NO: 2103224 - protein, 24 aa, Staphylococcus
EHYYEFRTHKGVLLVTADGKKDRG

SEQ ID NO: 2103225 - protein, 21 aa, Staphylococcus
EHYYEYRTSKGVLVVTANGQK

SEQ ID NO: 2103226 - protein, 19 aa, Staphylococcus
EIKNQIIAFEKMINSNNDE

SEQ ID NO: 2103227 - protein, 25 aa, Staphylococcus
EILGTYKLQGKKMIKEDQNGNQIKS

SEQ ID NO: 2103228 - protein, 21 aa, Staphylococcus
EILTRLRANDDLKDIPIHFAI

SEQ ID NO: 2103229 - protein, 26 aa, Staphylococcus
EIPSDLQFDIVFLFTKAMQLESMLTH

SEQ ID NO: 2103230 - protein, 26 aa, Staphylococcus
EIQAMSYRYLICMNVVINDLYQKGYL

SEQ ID NO: 2103231 - protein, 17 aa, Staphylococcus
EIQSQLESRGFTVQVPP

SEQ ID NO: 2103232 - protein, 19 aa, Staphylococcus
EISRRVGYKDPLLFSKNFT

SEQ ID NO: 2103233 - protein, 19 aa, Staphylococcus
EIYLISHALLETGNGTSEL

SEQ ID NO: 2103234 - protein, 20 aa, Staphylococcus
EKAKPLLKDKGYDLKIKTIN

SEQ ID NO: 2103235 - protein, 20 aa, Staphylococcus
EKAKPLLKKKGYDLEIKTIN

SEQ ID NO: 2103236 - protein, 24 aa, Staphylococcus
EKAKSLYPKVRMYYERSEPVAEAF

SEQ ID NO: 2103237 - protein, 26 aa, Staphylococcus
EKEDRYGRTLAYVWLDEKTMYNEELV

SEQ ID NO: 2103238 - protein, 26 aa, Staphylococcus
EKEDRYGRTLAYVWLDENIMYNEELV

SEQ ID NO: 2103239 - protein, 22 aa, Staphylococcus
EKEGKALELALYYDKGSSSQKE

SEQ ID NO: 2103240 - protein, 20 aa, Staphylococcus
EKEIEVYPGNEDLALIHLNK

SEQ ID NO: 2103241 - protein, 31 aa, Staphylococcus
EKEPWSQPPSGYKWYDPSTFKAGSYGSQHQH

SEQ ID NO: 2103242 - protein, 22 aa, Staphylococcus
EKFLLNNDIHLVGGHPMAGSHK

SEQ ID NO: 2103243 - protein, 23 aa, Staphylococcus
EKGETRKGMVIYHLNNAQKVVLQ

SEQ ID NO: 2103244 - protein, 22 aa, Staphylococcus
EKIAHAYAYGGPNMAVNSLEKL

SEQ ID NO: 2103245 - protein, 19 aa, Staphylococcus
EKKKEYKKNSSSKENQASQ

SEQ ID NO: 2103246 - protein, 22 aa, Staphylococcus
EKLDYSCSAFLMYIGIDKDVTS

SEQ ID NO: 2103247 - protein, 32 aa, Staphylococcus
EKLKEAARTGRPIEIFVGFNVSDAYHNGETIK

SEQ ID NO: 2103248 - protein, 19 aa, Staphylococcus
EKLNEKWAKNHKDAKISSG

SEQ ID NO: 2103249 - protein, 19 aa, Staphylococcus
EKLPPIPKKVFVDQKSNKQ

SEQ ID NO: 2103250 - protein, 23 aa, Staphylococcus
EKNKEGIGYFGYNFYEQNKDKLK

SEQ ID NO: 2103251 - protein, 20 aa, Staphylococcus
EKNNKGFFLMVEGASIDKSG

SEQ ID NO: 2103252 - protein, 18 aa, Staphylococcus
EKSISEKTTKKASTEESQ

SEQ ID NO: 2103253 - protein, 18 aa, Staphylococcus
EKTVKFNLPKNVSKVEPE

SEQ ID NO: 2103254 - protein, 17 aa, Staphylococcus
EKVEAIGRINNAKQEAL

SEQ ID NO: 2103255 - protein, 25 aa, Staphylococcus
EKVLPAVAAKSSFLGHPSESYVGQF

SEQ ID NO: 2103256 - protein, 18 aa, Staphylococcus
ELADYVFIGAGGGAIPLL

SEQ ID NO: 2103257 - protein, 21 aa, Staphylococcus
ELAMPRPYVFVSPKDFKNGTT

SEQ ID NO: 2103258 - protein, 24 aa, Staphylococcus
ELEKDAVWKKLDAVKHNRVDVLDR

SEQ ID NO: 2103259 - protein, 23 aa, Staphylococcus
ELGADPMTFLGLGGIGDLIVTCT

SEQ ID NO: 2103260 - protein, 18 aa, Staphylococcus
ELGIPVKVHISTNYNTMV

SEQ ID NO: 2103261 - protein, 19 aa, Staphylococcus
ELGTMFRPSVYGMNDVLKY

SEQ ID NO: 2103262 - protein, 21 aa, Staphylococcus
ELKATSGFRTSLLLYNHTSPK

SEQ ID NO: 2103263 - protein, 24 aa, Staphylococcus
ELKHKTKPAQSFEGDFKQSNTRAT

SEQ ID NO: 2103264 - protein, 18 aa, Staphylococcus
ELKQRYAKRLLKFRSVPN

SEQ ID NO: 2103265 - protein, 19 aa, Staphylococcus
ELMAEWLKTDERPEELAPF

SEQ ID NO: 2103266 - protein, 23 aa, Staphylococcus
ELTDAKFYYMDIIDSDDKLTTSQ

SEQ ID NO: 2103267 - protein, 45 aa, Staphylococcus
ELTPKQAEDVVYDWYKNQGFGNRLRNEFNYNPSKSTDEMYYIDYA

SEQ ID NO: 2103268 - protein, 30 aa, Staphylococcus
ELTPRNAKWFKERFNIDIYTEYEVNKINDS

SEQ ID NO: 2103269 - protein, 21 aa, Staphylococcus
ELTQIRPLRVMSPHAVQGGKI

SEQ ID NO: 2103270 - protein, 27 aa, Staphylococcus
EMIDAILKDKCRVLAAITYLEDEYGYR

SEQ ID NO: 2103271 - protein, 21 aa, Staphylococcus
EMNWNGGFNVKSYRTITNPGS

SEQ ID NO: 2103272 - protein, 25 aa, Staphylococcus
EMSQKLKSGQNVNGMVDNEGDTWYQ

SEQ ID NO: 2103273 - protein, 41 aa, Staphylococcus
EMYYIDYAASDAYGTGTPYVAIVDKHTGSIVDNYNNMTDEE

SEQ ID NO: 2103274 - protein, 19 aa, Staphylococcus
ENAIVKCNLWLRTADRVKI

SEQ ID NO: 2103275 - protein, 18 aa, Staphylococcus
ENDGNFAAALDTNKLIYT

SEQ ID NO: 2103276 - protein, 17 aa, Staphylococcus
ENDISVGEFFRKRLGNE

SEQ ID NO: 2103277 - protein, 17 aa, Staphylococcus
ENFKKKFQAYAKAMNTV

SEQ ID NO: 2103278 - protein, 19 aa, Staphylococcus
ENGDWGFSILDKNGDLVGS

SEQ ID NO: 2103279 - protein, 24 aa, Staphylococcus
ENGISIKQFQGFWDNLLNDAVRNE

SEQ ID NO: 2103280 - protein, 25 aa, Staphylococcus
ENHFTPRECKVIALNYASNHLNENY

SEQ ID NO: 2103281 - protein, 22 aa, Staphylococcus
ENKAGFKFLAGVGPNNFTDIGE

SEQ ID NO: 2103282 - protein, 26 aa, Staphylococcus
ENKDLKEIPIHFAIYKQSGENSIVPG

SEQ ID NO: 2103283 - protein, 18 aa, Staphylococcus
ENNDYVVVNVDWGIPNER

SEQ ID NO: 2103284 - protein, 23 aa, Staphylococcus
ENRLLHHNIHLVGGHPMAGSHKS

SEQ ID NO: 2103285 - protein, 26 aa, Staphylococcus
ENSDLKDIPIHFAIYKQSGQDSITPG

SEQ ID NO: 2103286 - protein, 26 aa, Staphylococcus
ENSDLKDIPIHFAIYKQSSQESITPG

SEQ ID NO: 2103287 - protein, 20 aa, Staphylococcus
ENTYDGTGFVIARTSNTDIT

SEQ ID NO: 2103288 - protein, 20 aa, Staphylococcus
ENTYDGTGFVIARTSQTDIT

SEQ ID NO: 2103289 - protein, 24 aa, Staphylococcus
ENYPEWYGGDGTDGMFSHQLNQGN

SEQ ID NO: 2103290 - protein, 19 aa, Staphylococcus
EPDTKIPDHVFEKTSVRHV

SEQ ID NO: 2103291 - protein, 25 aa, Staphylococcus
EPEKTSDGKWGFSYDDKDGNLAGSY

SEQ ID NO: 2103292 - protein, 17 aa, Staphylococcus
EPNWNIKLYERLDRPGI

SEQ ID NO: 2103293 - protein, 23 aa, Staphylococcus
EPPESFKPLIPFAENILPIHIKN

SEQ ID NO: 2103294 - protein, 23 aa, Staphylococcus
EPQLRGVNDIVIEKGQDYNLLNG

SEQ ID NO: 2103295 - protein, 20 aa, Staphylococcus
EPQVAYLSGIEFMSGSRDFG

SEQ ID NO: 2103296 - protein, 29 aa, Staphylococcus
EPTIHIKNFKEFARAPEFQHEQDASDEAK

SEQ ID NO: 2103297 - protein, 39 aa, Staphylococcus
EQGTSELTKLLAQQGGYDYFSFEAIRPSNNTQLHVTSTH

SEQ ID NO: 2103298 - protein, 28 aa, Staphylococcus
EQLAGDHKIHFKGYLGSNIVKFFDYTFA

SEQ ID NO: 2103299 - protein, 19 aa, Staphylococcus
EQLRYIYDVYFGKNDKVRV

SEQ ID NO: 2103300 - protein, 19 aa, Staphylococcus
EQNKSAFAFSKSVDDKVVS

SEQ ID NO: 2103301 - protein, 19 aa, Staphylococcus
EQNPSRFYEAKLNYNQNHF

SEQ ID NO: 2103302 - protein, 19 aa, Staphylococcus
EQSKSGFAFSKKVDSKVVK

SEQ ID NO: 2103303 - protein, 18 aa, Staphylococcus
EQVNQAGLVPSVDQIKQT

SEQ ID NO: 2103304 - protein, 26 aa, Staphylococcus
ERGVEFKIGTPIVACNEKGFKVKTND

SEQ ID NO: 2103305 - protein, 22 aa, Staphylococcus
ERKEKKSIFEQLGETFEELQKE

SEQ ID NO: 2103306 - protein, 22 aa, Staphylococcus
ERLKEAYSHKGWLDETGPKYPV

SEQ ID NO: 2103307 - protein, 18 aa, Staphylococcus
ERLKKAYDEKGWLNESGA

SEQ ID NO: 2103308 - protein, 19 aa, Staphylococcus
ERLKKAYNEKGWLNESGAK

SEQ ID NO: 2103309 - protein, 23 aa, Staphylococcus
ERLSELFGHIVWMNTIDMIRDSS

SEQ ID NO: 2103310 - protein, 32 aa, Staphylococcus
ERNLELVGNIAPGDYLGTVRLRKKEQPFEIRV

SEQ ID NO: 2103311 - protein, 20 aa, Staphylococcus
ERRIMKKHYLDGDFATHEYA

SEQ ID NO: 2103312 - protein, 23 aa, Staphylococcus
ERRTSGDYDLMFNQTWGLLYDPQ

SEQ ID NO: 2103313 - protein, 22 aa, Staphylococcus
ERYGKSYAGAYRDWKPGQKIHL

SEQ ID NO: 2103314 - protein, 20 aa, Staphylococcus
ESAFDAAICMAEQGKQVSIY

SEQ ID NO: 2103315 - protein, 22 aa, Staphylococcus
ESAGLIKLKKNFGLNGTTKDIE

SEQ ID NO: 2103316 - protein, 20 aa, Staphylococcus
ESAGYIKLSKDFGLKGSKKD

SEQ ID NO: 2103317 - protein, 23 aa, Staphylococcus
ESFEGVKRGRIVTKQDLTIDGHD

SEQ ID NO: 2103318 - protein, 23 aa, Staphylococcus
ESGDPVPDATITWLPNNSPDKNN

SEQ ID NO: 2103319 - protein, 25 aa, Staphylococcus
ESHDPHVWLDPVLDKHFAEKIKNDL

SEQ ID NO: 2103320 - protein, 18 aa, Staphylococcus
ESIGYLAERYDFVQKGVQ

SEQ ID NO: 2103321 - protein, 18 aa, Staphylococcus
ESIRYVKTGMTLTKAANI

SEQ ID NO: 2103322 - protein, 22 aa, Staphylococcus
ESKAAPKLAMRSFAAQPTTNTT

SEQ ID NO: 2103323 - protein, 19 aa, Staphylococcus
ESKARGILQDNMTNGYNGE

SEQ ID NO: 2103324 - protein, 23 aa, Staphylococcus
ESKLMMEKMMHWCHNAYGVNYAA

SEQ ID NO: 2103325 - protein, 19 aa, Staphylococcus
ESLEGMRVQTGNVRSVGPQ

SEQ ID NO: 2103326 - protein, 24 aa, Staphylococcus
ESNVEGLGVISYRTIDADDAAQLS

SEQ ID NO: 2103327 - protein, 24 aa, Staphylococcus
ESPDDLKVVVDLSGEKAGKYHEKF

SEQ ID NO: 2103328 - protein, 18 aa, Staphylococcus
ESQARGLLQDNMANSYNG

SEQ ID NO: 2103329 - protein, 19 aa, Staphylococcus
ESQARGVLQDNMANSYNGE

SEQ ID NO: 2103330 - protein, 21 aa, Staphylococcus
ESQQALIFCVGNIHGPGGKIA

SEQ ID NO: 2103331 - protein, 27 aa, Staphylococcus
ESQTDYPLKRVRYVKELMQKGLMTKEF

SEQ ID NO: 2103332 - protein, 26 aa, Staphylococcus
ESRGFTVQVPPEYLGGLNENNFINKN

SEQ ID NO: 2103333 - protein, 31 aa, Staphylococcus
ESSLRVESGQEKSVYDRPYEEDFEPDEDTDD

SEQ ID NO: 2103334 - protein, 37 aa, Staphylococcus
ESSYMVVRTIPKQVFVTSRVTPIPGIDNPNNPKDYLK

SEQ ID NO: 2103335 - protein, 22 aa, Staphylococcus
ESTRPGLNGRQRSDIHMAASKR

SEQ ID NO: 2103336 - protein, 46 aa, Staphylococcus
ESTRYPNVFLIGPTVRHADAILCYIYKFRSRFAVLAEQVMEREALE

SEQ ID NO: 2103337 - protein, 17 aa, Staphylococcus
ESTTEKKADDKKDKKTK

SEQ ID NO: 2103338 - protein, 22 aa, Staphylococcus
ESVAKLKPDLIITYNTDKNLKK

SEQ ID NO: 2103339 - protein, 26 aa, Staphylococcus
ESVEYGSSIGDEFKELIGNFKSDINP

SEQ ID NO: 2103340 - protein, 24 aa, Staphylococcus
ESVIECRDADSLYEIPLQLSKQEM

SEQ ID NO: 2103341 - protein, 25 aa, Staphylococcus
ESVIECRDAESLYEIPLQLSDQDMD

SEQ ID NO: 2103342 - protein, 19 aa, Staphylococcus
ESYLGRKKIMTELAEEIGL

SEQ ID NO: 2103343 - protein, 19 aa, Staphylococcus
ESYLGRKTIMTDIANEIGL

SEQ ID NO: 2103344 - protein, 19 aa, Staphylococcus
ESYLGRKTIMTDLAKDIGL

SEQ ID NO: 2103345 - protein, 26 aa, Staphylococcus
ESYQELCDFIKLVIQGGNAKKYVKDN

SEQ ID NO: 2103346 - protein, 25 aa, Staphylococcus
ETAIVKCNLWLRTADRIKIVVGQFK

SEQ ID NO: 2103347 - protein, 22 aa, Staphylococcus
ETALKYYVCTSDDMNDWKEYDY

SEQ ID NO: 2103348 - protein, 25 aa, Staphylococcus
ETIMKTGYDYSWFILTEDIIKKEFV

SEQ ID NO: 2103349 - protein, 37 aa, Staphylococcus
ETLATPPKTRTFMRAMATPRMLAAAVTSPDQDAQKSL

SEQ ID NO: 2103350 - protein, 22 aa, Staphylococcus
ETNKMLPAFGLKVDKKVDRNDS

SEQ ID NO: 2103351 - protein, 23 aa, Staphylococcus
ETNLKYYVCTSDDMKEWREYDYL

SEQ ID NO: 2103352 - protein, 17 aa, Staphylococcus
ETSKVIIPNNKVEFKGD

SEQ ID NO: 2103353 - protein, 17 aa, Staphylococcus
ETTNIWKNLPAVKNNNV

SEQ ID NO: 2103354 - protein, 21 aa, Staphylococcus
ETWAPSLILRLVLGQRATIIL

SEQ ID NO: 2103355 - protein, 22 aa, Staphylococcus
EVAKGKVASFIASDNVKGGEMG

SEQ ID NO: 2103356 - protein, 30 aa, Staphylococcus
EVANALDRKTEIERQANEDYENGLISEDEA

SEQ ID NO: 2103357 - protein, 25 aa, Staphylococcus
EVDGILVPGGFGFRASEGKISAIKY

SEQ ID NO: 2103358 - protein, 18 aa, Staphylococcus
EVGKLVAFLASDDSSFIT

SEQ ID NO: 2103359 - protein, 25 aa, Staphylococcus
EVKDLKENYDFIIIRAQYGSEKVDA

SEQ ID NO: 2103360 - protein, 23 aa, Staphylococcus
EVKGNKLIVKIYQLRGDISKGEP

SEQ ID NO: 2103361 - protein, 20 aa, Staphylococcus
EVLEGLKVQVDQAIYTAKDI

SEQ ID NO: 2103362 - protein, 19 aa, Staphylococcus
EVLGTYCATKHSVRSLTQT

SEQ ID NO: 2103363 - protein, 24 aa, Staphylococcus
EVMGGIEPTVDWLRDALKSGKHVI

SEQ ID NO: 2103364 - protein, 24 aa, Staphylococcus
EVMGGIEPTVDWLRESLKRKKHVI

SEQ ID NO: 2103365 - protein, 25 aa, Staphylococcus
EVMGGIEPTVDWLRSALKNKKHVIT

SEQ ID NO: 2103366 - protein, 25 aa, Staphylococcus
EVMGGIEPTVDWLRTALKNKKHVIT

SEQ ID NO: 2103367 - protein, 23 aa, Staphylococcus
EVMGGIEPTVEWLKKSLEQGKHV

SEQ ID NO: 2103368 - protein, 19 aa, Staphylococcus
EVNDAIANLHGDQKLAQAQ

SEQ ID NO: 2103369 - protein, 24 aa, Staphylococcus
EVPESFLRKFGYIVFPDNVAIAMG

SEQ ID NO: 2103370 - protein, 20 aa, Staphylococcus
EVREDIYGALRVSFKNPQDR

SEQ ID NO: 2103371 - protein, 19 aa, Staphylococcus
EVSAGIGIGDNVLKKLGNH

SEQ ID NO: 2103372 - protein, 17 aa, Staphylococcus
EVSTRIENDGNFAAALD

SEQ ID NO: 2103373 - protein, 17 aa, Staphylococcus
EVTKYILDSNNENSEDF

SEQ ID NO: 2103374 - protein, 18 aa, Staphylococcus
EYDYIFLTIGTLSYHDPY

SEQ ID NO: 2103375 - protein, 18 aa, Staphylococcus
EYEKEAKHLPAKTNKTRQ

SEQ ID NO: 2103376 - protein, 26 aa, Staphylococcus
EYFKTRIPEHAHWSAFGIGRMQFPTV

SEQ ID NO: 2103377 - protein, 25 aa, Staphylococcus
EYGDFKCPYCKKVEKNVMPKLKKHY

SEQ ID NO: 2103378 - protein, 25 aa, Staphylococcus
EYGDFKCPYCKKVEKNVMPTIKKDY

SEQ ID NO: 2103379 - protein, 25 aa, Staphylococcus
EYIAEKDPSIIFAMDRGQAVSDNAT

SEQ ID NO: 2103380 - protein, 19 aa, Staphylococcus
EYNDLAARVEKLYEELGAE

SEQ ID NO: 2103381 - protein, 20 aa, Staphylococcus
EYSSEECRIIAQNYTNHQYG

SEQ ID NO: 2103382 - protein, 21 aa, Staphylococcus
FAATLVLSACSQDDAKEDENK

SEQ ID NO: 2103383 - protein, 17 aa, Staphylococcus
FACILIPALTGCEKDFK

SEQ ID NO: 2103384 - protein, 17 aa, Staphylococcus
FAEENMPLQIDAPKKNP

SEQ ID NO: 2103385 - protein, 18 aa, Staphylococcus
FAGGLHKLGANIVAVNNQ

SEQ ID NO: 2103386 - protein, 19 aa, Staphylococcus
FAIPHRYSTHYLLLEEMRK

SEQ ID NO: 2103387 - protein, 25 aa, Staphylococcus
FAKQYDVKPGYIWEINTEKQGTPSQ

SEQ ID NO: 2103388 - protein, 23 aa, Staphylococcus
FANCALPYYLGNVVDSRNKVLEA

SEQ ID NO: 2103389 - protein, 17 aa, Staphylococcus
FANTYAFMVTKATAEKY

SEQ ID NO: 2103390 - protein, 23 aa, Staphylococcus
FASVLVLAACGGKDDSSKDSSDS

SEQ ID NO: 2103391 - protein, 28 aa, Staphylococcus
FATIVGVSREYVCIIGTQSAVVNYEEEI

SEQ ID NO: 2103392 - protein, 27 aa, Staphylococcus
FAVILTICLIGLIFLATNQNALAKVHQ

SEQ ID NO: 2103393 - protein, 20 aa, Staphylococcus
FAVSLSVLLASCNNEASENN

SEQ ID NO: 2103394 - protein, 24 aa, Staphylococcus
FCVDNLPPVLLPKFVELMEQGNPS

SEQ ID NO: 2103395 - protein, 17 aa, Staphylococcus
FDDVPTLIHSWMNSDIH

SEQ ID NO: 2103396 - protein, 18 aa, Staphylococcus
FDELLNMRGTENAYKLHR

SEQ ID NO: 2103397 - protein, 19 aa, Staphylococcus
FDGEIKEWSLSKDDGKLVY

SEQ ID NO: 2103398 - protein, 18 aa, Staphylococcus
FDGITYAKKAGWDSVEKA

SEQ ID NO: 2103399 - protein, 17 aa, Staphylococcus
FDKVNTLLGSNHPISEK

SEQ ID NO: 2103400 - protein, 25 aa, Staphylococcus
FDNKEFKRHRIGNGDNNVEMFNDSG

SEQ ID NO: 2103401 - protein, 26 aa, Staphylococcus
FDNPKYLPRFVFGHYMKSYLSNYDLL

SEQ ID NO: 2103402 - protein, 25 aa, Staphylococcus
FDQGNRYSVPYFFGTVGILYNKKAY

SEQ ID NO: 2103403 - protein, 28 aa, Staphylococcus
FDRRQQLGRSIGSYWGNANNWAYSAKNA

SEQ ID NO: 2103404 - protein, 24 aa, Staphylococcus
FDYVKDISEQFGFVNIGVANYEAD

SEQ ID NO: 2103405 - protein, 24 aa, Staphylococcus
FDYVKEIATQFGFVNIGVVNYEAD

SEQ ID NO: 2103406 - protein, 24 aa, Staphylococcus
FDYVKEISDQFGFINVGMTNYEAD

SEQ ID NO: 2103407 - protein, 24 aa, Staphylococcus
FDYVKEISEQFGFVNIGVTNYEAD

SEQ ID NO: 2103408 - protein, 24 aa, Staphylococcus
FDYVKEISQQFGFVNIGVTNYEAD

SEQ ID NO: 2103409 - protein, 20 aa, Staphylococcus
FEFFCRDILKDVQTSKYSPS

SEQ ID NO: 2103410 - protein, 17 aa, Staphylococcus
FEILLGKLLEKKYSDKV

SEQ ID NO: 2103411 - protein, 19 aa, Staphylococcus
FEISKQFWGHLVKNNSISN

SEQ ID NO: 2103412 - protein, 19 aa, Staphylococcus
FEISKQFWGHLVKSGQIEN

SEQ ID NO: 2103413 - protein, 19 aa, Staphylococcus
FEKAFDYATQYAKANPDTL

SEQ ID NO: 2103414 - protein, 19 aa, Staphylococcus
FELTDWKVEDKILMKKNPK

SEQ ID NO: 2103415 - protein, 25 aa, Staphylococcus
FENMLLKHDIHFIGGHPMAGSHKSG

SEQ ID NO: 2103416 - protein, 17 aa, Staphylococcus
FETATSDVPEQKYKELS

SEQ ID NO: 2103417 - protein, 18 aa, Staphylococcus
FFFACQFHPEFLSRPNRP

SEQ ID NO: 2103418 - protein, 19 aa, Staphylococcus
FFRQRLGDEVLEHLIEPLI

SEQ ID NO: 2103419 - protein, 18 aa, Staphylococcus
FGAMLYRQGNDVTLIDGW

SEQ ID NO: 2103420 - protein, 20 aa, Staphylococcus
FGAMLYRQGYDVTLIDGWEP

SEQ ID NO: 2103421 - protein, 17 aa, Staphylococcus
FGGLFLVNSKIQQRLGV

SEQ ID NO: 2103422 - protein, 17 aa, Staphylococcus
FGKSVDWTIQGTDNRNG

SEQ ID NO: 2103423 - protein, 17 aa, Staphylococcus
FGNCTYYAFDRRQQLGR

SEQ ID NO: 2103424 - protein, 18 aa, Staphylococcus
FGPGGRFGDLVFNTLGFK

SEQ ID NO: 2103425 - protein, 21 aa, Staphylococcus
FGSALILGACGNDDTSNENSD

SEQ ID NO: 2103426 - protein, 25 aa, Staphylococcus
FGSGERFGSMIFDTMGFTPADDNIK

SEQ ID NO: 2103427 - protein, 20 aa, Staphylococcus
FGSSIGDEVKTMIGDFKSDI

SEQ ID NO: 2103428 - protein, 19 aa, Staphylococcus
FHTNKGVLVVTAIGKKNTG

SEQ ID NO: 2103429 - protein, 22 aa, Staphylococcus
FIAFLCVSGLTLATNLESEASV

SEQ ID NO: 2103430 - protein, 18 aa, Staphylococcus
FIDRDKVDQPTLDQVKEA

SEQ ID NO: 2103431 - protein, 29 aa, Staphylococcus
FIFGFALVVICGIGLYAQGEKLEKEDSYN

SEQ ID NO: 2103432 - protein, 18 aa, Staphylococcus
FIILVILGLVRTFENYAI

SEQ ID NO: 2103433 - protein, 28 aa, Staphylococcus
FINKDVQNFLKQNIEDINFSNSDNNDDN

SEQ ID NO: 2103434 - protein, 24 aa, Staphylococcus
FITEKYIRMSGMKKTFENEADAKK

SEQ ID NO: 2103435 - protein, 18 aa, Staphylococcus
FKDITGWKKVSKESIIKK

SEQ ID NO: 2103436 - protein, 18 aa, Staphylococcus
FKEAIGTGAFKIGDAGKE

SEQ ID NO: 2103437 - protein, 29 aa, Staphylococcus
FKEDVVKLKAPMRVGGSVTYSSNGDGSIN

SEQ ID NO: 2103438 - protein, 17 aa, Staphylococcus
FKESLKYDNFTINGYQI

SEQ ID NO: 2103439 - protein, 21 aa, Staphylococcus
FKEVRHQLGNTVKWRYHYDDR

SEQ ID NO: 2103440 - protein, 20 aa, Staphylococcus
FKFDSARPMQIGLVYDALKN

SEQ ID NO: 2103441 - protein, 17 aa, Staphylococcus
FKGDPDFTIVNRLPKSM

SEQ ID NO: 2103442 - protein, 19 aa, Staphylococcus
FKGDPDFTIVNRLPKSMPQ

SEQ ID NO: 2103443 - protein, 19 aa, Staphylococcus
FKGKEKVHVDRVVDGDTFV

SEQ ID NO: 2103444 - protein, 24 aa, Staphylococcus
FKKAAPKAKIVYMGADNKDVINSV

SEQ ID NO: 2103445 - protein, 24 aa, Staphylococcus
FKKAAPKAKVVYVGADDKDYVKSM

SEQ ID NO: 2103446 - protein, 25 aa, Staphylococcus
FKKAAPKAKVVYVGASEDHYIKDMK

SEQ ID NO: 2103447 - protein, 24 aa, Staphylococcus
FKKAAPKAKVVYVGASEKNYVNDM

SEQ ID NO: 2103448 - protein, 17 aa, Staphylococcus
FKKAEKHLDNISDKAKK

SEQ ID NO: 2103449 - protein, 18 aa, Staphylococcus
FKKDGYDVVSNKNELANS

SEQ ID NO: 2103450 - protein, 18 aa, Staphylococcus
FKLECKDHNIDLEKLVYR

SEQ ID NO: 2103451 - protein, 17 aa, Staphylococcus
FKLPDHVSKLDPSETNA

SEQ ID NO: 2103452 - protein, 22 aa, Staphylococcus
FKNTGTYMFHCHILEHEDNGMM

SEQ ID NO: 2103453 - protein, 18 aa, Staphylococcus
FKQFRHGLSSFIEALADF

SEQ ID NO: 2103454 - protein, 23 aa, Staphylococcus
FKQQEPIVFTAMEPSWFSKELDV

SEQ ID NO: 2103455 - protein, 17 aa, Staphylococcus
FKQSNTRAISLFQDVPQ

SEQ ID NO: 2103456 - protein, 25 aa, Staphylococcus
FKQSNTRATGLFQQLPKIEDSTLTD

SEQ ID NO: 2103457 - protein, 17 aa, Staphylococcus
FKQVYNLSGGNKNYQRY

SEQ ID NO: 2103458 - protein, 21 aa, Staphylococcus
FKRADGLRVNGDIRRFDKVLC

SEQ ID NO: 2103459 - protein, 18 aa, Staphylococcus
FKRTKDILKYLGEHKTHQ

SEQ ID NO: 2103460 - protein, 22 aa, Staphylococcus
FKRVFSLIAILAIVFSTLGQTL

SEQ ID NO: 2103461 - protein, 17 aa, Staphylococcus
FKSFEITDSSSPYPQGQ

SEQ ID NO: 2103462 - protein, 19 aa, Staphylococcus
FKTAFGSTAEGRWLAKNAY

SEQ ID NO: 2103463 - protein, 17 aa, Staphylococcus
FKTNIPDIYALGDVITS

SEQ ID NO: 2103464 - protein, 22 aa, Staphylococcus
FLASCELPGLGGGQSKSTVRIS

SEQ ID NO: 2103465 - protein, 17 aa, Staphylococcus
FLEGAGIEEDDAGYIPV

SEQ ID NO: 2103466 - protein, 20 aa, Staphylococcus
FLLFLCLHNLLFPDTTKESM

SEQ ID NO: 2103467 - protein, 17 aa, Staphylococcus
FLNPATSKGVWQVRPVQ

SEQ ID NO: 2103468 - protein, 30 aa, Staphylococcus
FLQKRYDALKDLPMFQGIEFTQDREKLAEW

SEQ ID NO: 2103469 - protein, 18 aa, Staphylococcus
FLVLTACGQQKESKFDDK

SEQ ID NO: 2103470 - protein, 18 aa, Staphylococcus
FMEHVYYFKHDVSDEQSY

SEQ ID NO: 2103471 - protein, 17 aa, Staphylococcus
FMGGSSAQAAEKQQEVG

SEQ ID NO: 2103472 - protein, 18 aa, Staphylococcus
FMTNFRIALVKKENSGPY

SEQ ID NO: 2103473 - protein, 21 aa, Staphylococcus
FMVVLAGCGKGESDNTKSNEK

SEQ ID NO: 2103474 - protein, 33 aa, Staphylococcus
FNELKSQYYGNVPLELAFELFKLECKDHNIDLE

SEQ ID NO: 2103475 - protein, 23 aa, Staphylococcus
FNFNSDGTNWSWSYNADSSAQQA

SEQ ID NO: 2103476 - protein, 19 aa, Staphylococcus
FNHDLAFKYFNTMDSTTVA

SEQ ID NO: 2103477 - protein, 20 aa, Staphylococcus
FNHSNLYDWGQCTWHAFNRR

SEQ ID NO: 2103478 - protein, 35 aa, Staphylococcus
FNIDAYMSGANSGTRYKIDLNLDSKIADHVTKISV

SEQ ID NO: 2103479 - protein, 23 aa, Staphylococcus
FNKIKLQSMHFLKQPNGSNYTNK

SEQ ID NO: 2103480 - protein, 20 aa, Staphylococcus
FNLESGNGWFEKALEQAGKS

SEQ ID NO: 2103481 - protein, 21 aa, Staphylococcus
FNLESGNGWFEKALKQAGKST

SEQ ID NO: 2103482 - protein, 20 aa, Staphylococcus
FNNYVKYQFDMPVADDTAFT

SEQ ID NO: 2103483 - protein, 19 aa, Staphylococcus
FNPFRQIHAEINITMPSEK

SEQ ID NO: 2103484 - protein, 17 aa, Staphylococcus
FNQKYYNSFGFENTYAF

SEQ ID NO: 2103485 - protein, 24 aa, Staphylococcus
FNQSIDLLLSKRVDGTFNDSLSYL

SEQ ID NO: 2103486 - protein, 23 aa, Staphylococcus
FNRRAQIGKGISTYWWNANNWDN

SEQ ID NO: 2103487 - protein, 21 aa, Staphylococcus
FNRRSELGRSIGSTWGNANNW

SEQ ID NO: 2103488 - protein, 18 aa, Staphylococcus
FNTAYRYYADNPKTKEMD

SEQ ID NO: 2103489 - protein, 17 aa, Staphylococcus
FNTAYRYYKNQPGAKKM

SEQ ID NO: 2103490 - protein, 18 aa, Staphylococcus
FNTLGFKPADKHVKISPH

SEQ ID NO: 2103491 - protein, 28 aa, Staphylococcus
FPAFKNKNLRLAIAQSINKQGFVDSVKN

SEQ ID NO: 2103492 - protein, 23 aa, Staphylococcus
FPMISSNIYKNGKRIFKPSTIIK

SEQ ID NO: 2103493 - protein, 21 aa, Staphylococcus
FPNGKGASPNDFFTLESGDPV

SEQ ID NO: 2103494 - protein, 27 aa, Staphylococcus
FPNPQYLPRFVFGHYMKSHLSRYDQQY

SEQ ID NO: 2103495 - protein, 17 aa, Staphylococcus
FPNQVLKVSGSSKSTAN

SEQ ID NO: 2103496 - protein, 17 aa, Staphylococcus
FPNQVLKVSGSSSSASK

SEQ ID NO: 2103497 - protein, 21 aa, Staphylococcus
FPSMIAITLFGAAFTSQHAHA

SEQ ID NO: 2103498 - protein, 22 aa, Staphylococcus
FPSMIALTLFGAAFTTHHAEAS

SEQ ID NO: 2103499 - protein, 22 aa, Staphylococcus
FPTEKFRQMIDIMLTGSFIGTK

SEQ ID NO: 2103500 - protein, 20 aa, Staphylococcus
FQDFMKFVLEDKGKSAEDAG

SEQ ID NO: 2103501 - protein, 18 aa, Staphylococcus
FQDRRWMEDDYTKSETKR

SEQ ID NO: 2103502 - protein, 19 aa, Staphylococcus
FQEFMKFTLEDKGKAAEDA

SEQ ID NO: 2103503 - protein, 39 aa, Staphylococcus
FQITKRKVVNGITWYYGKLSNGKSVWIKKSDLQQQLVKL

SEQ ID NO: 2103504 - protein, 18 aa, Staphylococcus
FQTMPGWGSTATVNDQIN

SEQ ID NO: 2103505 - protein, 22 aa, Staphylococcus
FQTNYRNVYAIGDIVSNYYRHV

SEQ ID NO: 2103506 - protein, 17 aa, Staphylococcus
FQVKGIDDDVSYSVKPK

SEQ ID NO: 2103507 - protein, 38 aa, Staphylococcus
FRDIDRAMVWGFNWKLGPFQLWDLMGFDRVKSRIEDEL

SEQ ID NO: 2103508 - protein, 19 aa, Staphylococcus
FRDNQKWVTPLGRLGKPEE

SEQ ID NO: 2103509 - protein, 19 aa, Staphylococcus
FRDNQKWVTPLGRLGQPEE

SEQ ID NO: 2103510 - protein, 19 aa, Staphylococcus
FRDNQKWVTPLGRLGTPEE

SEQ ID NO: 2103511 - protein, 24 aa, Staphylococcus
FREKRSYRSFLFEQYLRLTRVRKP

SEQ ID NO: 2103512 - protein, 19 aa, Staphylococcus
FRENQKWVTPLGRLGTPDE

SEQ ID NO: 2103513 - protein, 18 aa, Staphylococcus
FRKPSDFYNLTSLVQGAK

SEQ ID NO: 2103514 - protein, 26 aa, Staphylococcus
FRKPSEFYNPIALYRGMKLRTLGKAN

SEQ ID NO: 2103515 - protein, 17 aa, Staphylococcus
FRKQTNIYLEKLTKEID

SEQ ID NO: 2103516 - protein, 17 aa, Staphylococcus
FRSDKDGLSELLNQLFS

SEQ ID NO: 2103517 - protein, 27 aa, Staphylococcus
FSAYEFKKRAEQCIADITARGKIPIIA

SEQ ID NO: 2103518 - protein, 20 aa, Staphylococcus
FSAYEFKKRAEVLIEDITKR

SEQ ID NO: 2103519 - protein, 19 aa, Staphylococcus
FSDINGWKSVSKESIIKHN

SEQ ID NO: 2103520 - protein, 21 aa, Staphylococcus
FSHPTKPIGLFYDKETAERIE

SEQ ID NO: 2103521 - protein, 37 aa, Staphylococcus
FSHSNLYTWGQCTWHVFNRRAAIGKGISTYWWNANNW

SEQ ID NO: 2103522 - protein, 31 aa, Staphylococcus
FSIRKFNIGIFSALITTVTFLAHPSQASASE

SEQ ID NO: 2103523 - protein, 17 aa, Staphylococcus
FSKHALNDFYITYFAQA

SEQ ID NO: 2103524 - protein, 25 aa, Staphylococcus
FSKQYDIKPGYIWEINTEKQGTPEQ

SEQ ID NO: 2103525 - protein, 17 aa, Staphylococcus
FSLIISLMIFTLVGCQS

SEQ ID NO: 2103526 - protein, 20 aa, Staphylococcus
FSNPYTYSSAVLVVRDNEKN

SEQ ID NO: 2103527 - protein, 20 aa, Staphylococcus
FSNPYTYSSAVLVVRENEKN

SEQ ID NO: 2103528 - protein, 19 aa, Staphylococcus
FSNPYTYSSGVLVVRDDEK

SEQ ID NO: 2103529 - protein, 17 aa, Staphylococcus
FSNSGLVGFRSAENYNE

SEQ ID NO: 2103530 - protein, 18 aa, Staphylococcus
FSPINGRVSIINRYPSKA

SEQ ID NO: 2103531 - protein, 21 aa, Staphylococcus
FSSLLILGACGQVGDNSIKND

SEQ ID NO: 2103532 - protein, 24 aa, Staphylococcus
FSSVAKPRMMYSVNKKTTSKATSS

SEQ ID NO: 2103533 - protein, 31 aa, Staphylococcus
FSVGASSILIAALLFMGGGSAQAAEQNQEQG

SEQ ID NO: 2103534 - protein, 18 aa, Staphylococcus
FSVPDCQAIVKKAIVERL

SEQ ID NO: 2103535 - protein, 32 aa, Staphylococcus
FTATIPRNGKLVVMKDEFTDFFAKEAKKRKTE

SEQ ID NO: 2103536 - protein, 24 aa, Staphylococcus
FTEQGYFRLGLDTLPEILTYHGPF

SEQ ID NO: 2103537 - protein, 24 aa, Staphylococcus
FTHWEELKSTWKFVDVIQDEWTMN

SEQ ID NO: 2103538 - protein, 17 aa, Staphylococcus
FTKAYGFDFNTVRPMQI

SEQ ID NO: 2103539 - protein, 18 aa, Staphylococcus
FTKSIAIEYGRENIRANA

SEQ ID NO: 2103540 - protein, 22 aa, Staphylococcus
FTQDYNFVRALKYDNVSIDGYK

SEQ ID NO: 2103541 - protein, 23 aa, Staphylococcus
FTQDYNFVRALKYDNVTINGYKV

SEQ ID NO: 2103542 - protein, 17 aa, Staphylococcus
FTRSTAIEYGRENIRAN

SEQ ID NO: 2103543 - protein, 21 aa, Staphylococcus
FTSFLILGACSNKDSSSENSN

SEQ ID NO: 2103544 - protein, 18 aa, Staphylococcus
FVDPNFVRAVKYHNVTFN

SEQ ID NO: 2103545 - protein, 21 aa, Staphylococcus
FVKDNHLKHLLVETSVDKKAM

SEQ ID NO: 2103546 - protein, 21 aa, Staphylococcus
FVSIIAVLLLAGCQSQEDKEK

SEQ ID NO: 2103547 - protein, 17 aa, Staphylococcus
FVTPLAFQAIGRNPVYT

SEQ ID NO: 2103548 - protein, 18 aa, Staphylococcus
FYFHKVGPNYSLKQVYID

SEQ ID NO: 2103549 - protein, 18 aa, Staphylococcus
FYTLEMDTNFNLKNVKAK

SEQ ID NO: 2103550 - protein, 18 aa, Staphylococcus
GAHVDLFSLVPVKRSHSV

SEQ ID NO: 2103551 - protein, 25 aa, Staphylococcus
GAKDIPFANNFRGEATVYRNTPTFK

SEQ ID NO: 2103552 - protein, 26 aa, Staphylococcus
GALNESFSDVFAYFIESDNFLIGEDI

SEQ ID NO: 2103553 - protein, 26 aa, Staphylococcus
GALNESFSDVFGYFVDPDDWLMGEDV

SEQ ID NO: 2103554 - protein, 29 aa, Staphylococcus
GALTGTMLLAGCSLSDFGLGNGASDDKNK

SEQ ID NO: 2103555 - protein, 18 aa, Staphylococcus
GANPITFLGLGGIGDLIV

SEQ ID NO: 2103556 - protein, 25 aa, Staphylococcus
GAPLKRGAATIAMLGKAPILPAAYV

SEQ ID NO: 2103557 - protein, 24 aa, Staphylococcus
GAPMKRGAVTIALMAQAPILPAAY

SEQ ID NO: 2103558 - protein, 24 aa, Staphylococcus
GASCLLAGCGSQNLAPLEDKTTKL

SEQ ID NO: 2103559 - protein, 25 aa, Staphylococcus
GASCLLAGCGSQNLAPLEDKTTKLR

SEQ ID NO: 2103560 - protein, 24 aa, Staphylococcus
GASCLLVGCGSQNLGPLEDKTTKL

SEQ ID NO: 2103561 - protein, 28 aa, Staphylococcus
GASGKFQFLQSTWDSVAPAEYQGQPAAS

SEQ ID NO: 2103562 - protein, 24 aa, Staphylococcus
GASLFLVGCGSQNLGPLEDKTTNL

SEQ ID NO: 2103563 - protein, 22 aa, Staphylococcus
GASLLLAGCGSQNLGPLEDKTT

SEQ ID NO: 2103564 - protein, 21 aa, Staphylococcus
GASSIIVASMLFVGVESAQAA

SEQ ID NO: 2103565 - protein, 24 aa, Staphylococcus
GASTHPGAGVPIVLTSAKITAEAM

SEQ ID NO: 2103566 - protein, 24 aa, Staphylococcus
GASTHPGAGVPIVLTSAKITVDEI

SEQ ID NO: 2103567 - protein, 24 aa, Staphylococcus
GASTHPGAGVPIVLTSAKITVEEI

SEQ ID NO: 2103568 - protein, 25 aa, Staphylococcus
GASTHPGAGVPIVLTSAKITVNEML

SEQ ID NO: 2103569 - protein, 19 aa, Staphylococcus
GAVKMGWEGLVPPRTPERD

SEQ ID NO: 2103570 - protein, 24 aa, Staphylococcus
GAVLIPSEISNAASQVNSAKQDLN

SEQ ID NO: 2103571 - protein, 23 aa, Staphylococcus
GAYDIHFVSGGFEYNFTSDGTNF

SEQ ID NO: 2103572 - protein, 17 aa, Staphylococcus
GAYGHVAYVEKVNSDGS

SEQ ID NO: 2103573 - protein, 19 aa, Staphylococcus
GAYNYDFVLGGNEYTFTSD

SEQ ID NO: 2103574 - protein, 27 aa, Staphylococcus
GAYRDWKPGQKIHLIGHSMGGQTVRLL

SEQ ID NO: 2103575 - protein, 25 aa, Staphylococcus
GCFWCLVKPFTSYPGIENVVSGYSG

SEQ ID NO: 2103576 - protein, 25 aa, Staphylococcus
GDAHHWNNRATREGYQVSSTPKKHT

SEQ ID NO: 2103577 - protein, 28 aa, Staphylococcus
GDAKAIVQCNLWLRTADRIKIVVGRFNA

SEQ ID NO: 2103578 - protein, 21 aa, Staphylococcus
GDARREVMAALAAAKDNNFEQ

SEQ ID NO: 2103579 - protein, 24 aa, Staphylococcus
GDFFRKRLGDEVLENLIEPLMGGI

SEQ ID NO: 2103580 - protein, 25 aa, Staphylococcus
GDFQFPNKPFKYGIHYSEVTDFNEF

SEQ ID NO: 2103581 - protein, 17 aa, Staphylococcus
GDGYPAFQKEYGFKFAS

SEQ ID NO: 2103582 - protein, 22 aa, Staphylococcus
GDILSLKADYTVDNSVKSGDTF

SEQ ID NO: 2103583 - protein, 17 aa, Staphylococcus
GDIQRTIQQLKLSKVED

SEQ ID NO: 2103584 - protein, 19 aa, Staphylococcus
GDKALAFIRSRKEEGAGGD

SEQ ID NO: 2103585 - protein, 35 aa, Staphylococcus
GDKSFPQIQYKNHDPIILVHGFNGYTADNGPVLGH

SEQ ID NO: 2103586 - protein, 17 aa, Staphylococcus
GDPDFTIVNRLPKSMPQ

SEQ ID NO: 2103587 - protein, 19 aa, Staphylococcus
GDPVTADDFVYAWRKVVDP

SEQ ID NO: 2103588 - protein, 25 aa, Staphylococcus
GDPVTAHDFEYAWKRVVNPDTASEY

SEQ ID NO: 2103589 - protein, 26 aa, Staphylococcus
GDPVTANDFVYAWRKALDPQTASEYA

SEQ ID NO: 2103590 - protein, 25 aa, Staphylococcus
GDPVTAQDFVYAWRKVVNPKTGSEF

SEQ ID NO: 2103591 - protein, 21 aa, Staphylococcus
GDQSYERLIRAIKTAAGVQNI

SEQ ID NO: 2103592 - protein, 23 aa, Staphylococcus
GDRLPWIHIDSIDNFEPLKSRTW

SEQ ID NO: 2103593 - protein, 21 aa, Staphylococcus
GDSFVNPFMKEVWDYDITVAK

SEQ ID NO: 2103594 - protein, 25 aa, Staphylococcus
GDSKLYYKYLEQIGAAMTDKNGKYI

SEQ ID NO: 2103595 - protein, 18 aa, Staphylococcus
GDSLSSIASRYGTTYRHI

SEQ ID NO: 2103596 - protein, 20 aa, Staphylococcus
GDWADCIVVAPATANTIAKL

SEQ ID NO: 2103597 - protein, 20 aa, Staphylococcus
GEANGDMGGVPTSDKAFSND

SEQ ID NO: 2103598 - protein, 18 aa, Staphylococcus
GEEYNLLNGVHAYDKEDG

SEQ ID NO: 2103599 - protein, 18 aa, Staphylococcus
GEGDIYFNSMSPRSDIKA

SEQ ID NO: 2103600 - protein, 20 aa, Staphylococcus
GEHKAHQYLVGFAAETQDIE

SEQ ID NO: 2103601 - protein, 27 aa, Staphylococcus
GEINQFGSLYIKYPTATYRIIFNIDQG

SEQ ID NO: 2103602 - protein, 17 aa, Staphylococcus
GELGAKVIMPIYPKVPH

SEQ ID NO: 2103603 - protein, 26 aa, Staphylococcus
GEPMFQFCLGIPWGAENDPETIEYFK

SEQ ID NO: 2103604 - protein, 19 aa, Staphylococcus
GEQVFKELINDPGDTNTAL

SEQ ID NO: 2103605 - protein, 20 aa, Staphylococcus
GESLWSIADQYGVSVDSIKQ

SEQ ID NO: 2103606 - protein, 21 aa, Staphylococcus
GESLWSISHHYGITVSKLKSL

SEQ ID NO: 2103607 - protein, 41 aa, Staphylococcus
GESTHKGLFGRQKADLNLFFPFTVTANVIGKAKEKEWREND

SEQ ID NO: 2103608 - protein, 24 aa, Staphylococcus
GEYDPHIWLDPKMDQTFAKEIKDA

SEQ ID NO: 2103609 - protein, 24 aa, Staphylococcus
GEYQLGKPFKIYKFNGQEDGNYYF

SEQ ID NO: 2103610 - protein, 25 aa, Staphylococcus
GFSLTHLIASLFNFDSDISDYEQPA

SEQ ID NO: 2103611 - protein, 19 aa, Staphylococcus
GGCLWGVQAFVKTLPGVVE

SEQ ID NO: 2103612 - protein, 24 aa, Staphylococcus
GGDDRPYHGFKRFNTPSSVAQDLV

SEQ ID NO: 2103613 - protein, 18 aa, Staphylococcus
GGFEKFIAGESDFSNASR

SEQ ID NO: 2103614 - protein, 18 aa, Staphylococcus
GGFEKFIAGETDFSNASR

SEQ ID NO: 2103615 - protein, 18 aa, Staphylococcus
GGGFQLANKGLIFSNGLN

SEQ ID NO: 2103616 - protein, 20 aa, Staphylococcus
GGGLAEMANRILSTSHKADD

SEQ ID NO: 2103617 - protein, 24 aa, Staphylococcus
GGGYQLAEKGLIFSNGLNGPKARL

SEQ ID NO: 2103618 - protein, 24 aa, Staphylococcus
GGKTYRFHLKKGVKFSDGSDFDAQ

SEQ ID NO: 2103619 - protein, 17 aa, Staphylococcus
GGKVKAVKFYKLKDTKT

SEQ ID NO: 2103620 - protein, 22 aa, Staphylococcus
GGQAYWSFGGLFLVNSKIQQRL

SEQ ID NO: 2103621 - protein, 17 aa, Staphylococcus
GGSIIFISDHYNADRNL

SEQ ID NO: 2103622 - protein, 19 aa, Staphylococcus
GGSTKAQFLANGGTEEAWN

SEQ ID NO: 2103623 - protein, 20 aa, Staphylococcus
GGSVKAQFLANGGTEAAWNA

SEQ ID NO: 2103624 - protein, 20 aa, Staphylococcus
GGSVNPGGGMPMVTLSGQQV

SEQ ID NO: 2103625 - protein, 24 aa, Staphylococcus
GGTEEAWNAIVMPESGGNPNAVNP

SEQ ID NO: 2103626 - protein, 19 aa, Staphylococcus
GGTEEMWENIVMPESGGNP

SEQ ID NO: 2103627 - protein, 17 aa, Staphylococcus
GGTKALWDNIVMPESSG

SEQ ID NO: 2103628 - protein, 24 aa, Staphylococcus
GGTLRLGLYPSEVKEGTLAYDIYG

SEQ ID NO: 2103629 - protein, 18 aa, Staphylococcus
GGTVDYGAAHAAKYGHER

SEQ ID NO: 2103630 - protein, 19 aa, Staphylococcus
GHHPEIILAGRRINDNMAE

SEQ ID NO: 2103631 - protein, 24 aa, Staphylococcus
GHPSESYVGQFLTQLGFKEALSPD

SEQ ID NO: 2103632 - protein, 19 aa, Staphylococcus
GHSEHQTGLAFDVGTSQPL

SEQ ID NO: 2103633 - protein, 19 aa, Staphylococcus
GHSLIRWDEQGDTLSNYSL

SEQ ID NO: 2103634 - protein, 26 aa, Staphylococcus
GIANYLPSGTNFDWAPGSGQPLSNSP

SEQ ID NO: 2103635 - protein, 20 aa, Staphylococcus
GIDGNATIYQPTWKSETSSY

SEQ ID NO: 2103636 - protein, 20 aa, Staphylococcus
GIGVGVAAGFAVSLRNRDDQ

SEQ ID NO: 2103637 - protein, 23 aa, Staphylococcus
GIICAVLLYFSYVGLGASSDKII

SEQ ID NO: 2103638 - protein, 18 aa, Staphylococcus
GINESVKHHAIIDKNTGK

SEQ ID NO: 2103639 - protein, 17 aa, Staphylococcus
GIPESKNLGGFPITGQF

SEQ ID NO: 2103640 - protein, 18 aa, Staphylococcus
GISTYWWNANNWDNAAAA

SEQ ID NO: 2103641 - protein, 28 aa, Staphylococcus
GIVASTLFLGACDLNIHLPGGNNDSSED

SEQ ID NO: 2103642 - protein, 29 aa, Staphylococcus
GKAFGNKDSRVDFGLSQWGLKQKPNESYI

SEQ ID NO: 2103643 - protein, 23 aa, Staphylococcus
GKDFIKYVICNTQLYDEAVLAHY

SEQ ID NO: 2103644 - protein, 18 aa, Staphylococcus
GKDYVWNPEAIRKMKHSG

SEQ ID NO: 2103645 - protein, 17 aa, Staphylococcus
GKEPAIIAEEYLKKHNY

SEQ ID NO: 2103646 - protein, 18 aa, Staphylococcus
GKEPAVIAEEFVKKHNYF

SEQ ID NO: 2103647 - protein, 17 aa, Staphylococcus
GKEPAVVAEEFLKKHHY

SEQ ID NO: 2103648 - protein, 17 aa, Staphylococcus
GKFVYDLDLQKGNNKHE

SEQ ID NO: 2103649 - protein, 19 aa, Staphylococcus
GKHIPYKFHASNVKKLPHY

SEQ ID NO: 2103650 - protein, 17 aa, Staphylococcus
GKHQYATGVTWASVNAQ

SEQ ID NO: 2103651 - protein, 17 aa, Staphylococcus
GKIDSVVHYDKDYNNAA

SEQ ID NO: 2103652 - protein, 20 aa, Staphylococcus
GKIIKTGGAITSPDGPIKAE

SEQ ID NO: 2103653 - protein, 18 aa, Staphylococcus
GKILGGFVVGPHATDLIS

SEQ ID NO: 2103654 - protein, 17 aa, Staphylococcus
GKILSIIQIPYKVEKGE

SEQ ID NO: 2103655 - protein, 23 aa, Staphylococcus
GKKIKGMTIGLAMNSVYYYQKEK

SEQ ID NO: 2103656 - protein, 25 aa, Staphylococcus
GKKKPISRPWIQDFTASYLGNGNYI

SEQ ID NO: 2103657 - protein, 23 aa, Staphylococcus
GKKTEELKHFAITRDMESIPNAP

SEQ ID NO: 2103658 - protein, 17 aa, Staphylococcus
GKLKVVTTNSILYDMVK

SEQ ID NO: 2103659 - protein, 21 aa, Staphylococcus
GKNETPEYVGLFYNAKSYDRE

SEQ ID NO: 2103660 - protein, 21 aa, Staphylococcus
GKPMEICFTNAFGAKPYQMLQ

SEQ ID NO: 2103661 - protein, 17 aa, Staphylococcus
GKRGRVGIVPLINNQAY

SEQ ID NO: 2103662 - protein, 29 aa, Staphylococcus
GKTASLLDMEVKGQLSLTQLKKVYSKELQ

SEQ ID NO: 2103663 - protein, 32 aa, Staphylococcus
GKTNSGANYYTWGQCTYYVYDKVGGSIGNTWG

SEQ ID NO: 2103664 - protein, 22 aa, Staphylococcus
GKTPYHRIVSLMPSNTEILYEL

SEQ ID NO: 2103665 - protein, 18 aa, Staphylococcus
GKTSMYILMPVPELKTGQ

SEQ ID NO: 2103666 - protein, 22 aa, Staphylococcus
GKVYEFHLKKNVKFSDGSALDA

SEQ ID NO: 2103667 - protein, 17 aa, Staphylococcus
GKWAYKVDLQKQGEEAE

SEQ ID NO: 2103668 - protein, 20 aa, Staphylococcus
GKYPGTWGVEQGKPYEVILE

SEQ ID NO: 2103669 - protein, 17 aa, Staphylococcus
GKYRQFIQSDLGHELDV

SEQ ID NO: 2103670 - protein, 19 aa, Staphylococcus
GLAIAKVFLENGAKVVLAD

SEQ ID NO: 2103671 - protein, 23 aa, Staphylococcus
GLASLDVVRYVAFHHPKLPITMT

SEQ ID NO: 2103672 - protein, 34 aa, Staphylococcus
GLDTLREIIKYHGPFKALRGFDYFSTMQQAINRY

SEQ ID NO: 2103673 - protein, 18 aa, Staphylococcus
GLIFIIALLCTVISINGN

SEQ ID NO: 2103674 - protein, 18 aa, Staphylococcus
GLILWLGIVEKRQHSDRL

SEQ ID NO: 2103675 - protein, 19 aa, Staphylococcus
GLLDFRRFGGTLHHRTAYA

SEQ ID NO: 2103676 - protein, 26 aa, Staphylococcus
GLNGPKARLKLLIGLSNQLNIVELKN

SEQ ID NO: 2103677 - protein, 21 aa, Staphylococcus
GLSNFFIYPGQKLKVPGGGSG

SEQ ID NO: 2103678 - protein, 20 aa, Staphylococcus
GLTTPLGWVNAKDVKVVNQS

SEQ ID NO: 2103679 - protein, 28 aa, Staphylococcus
GLVLIMFVLCGFIFPLTVTALGQVLFPE

SEQ ID NO: 2103680 - protein, 18 aa, Staphylococcus
GLYSIAWGTKNQQLLPAS

SEQ ID NO: 2103681 - protein, 18 aa, Staphylococcus
GLYSIAWGTNQQRLDNKD

SEQ ID NO: 2103682 - protein, 19 aa, Staphylococcus
GLYSIPWGTTQQQLEQANS

SEQ ID NO: 2103683 - protein, 19 aa, Staphylococcus
GLYTMPWGTSKQQIDNLKQ

SEQ ID NO: 2103684 - protein, 22 aa, Staphylococcus
GMGPSYNSAYRYFADNPETKEM

SEQ ID NO: 2103685 - protein, 17 aa, Staphylococcus
GMGPSYNSAYRYYADNP

SEQ ID NO: 2103686 - protein, 24 aa, Staphylococcus
GMHPHVIEPVKWVKGKDGNKTLVA

SEQ ID NO: 2103687 - protein, 24 aa, Staphylococcus
GMHPHVIQPVKWVKGKNQHQTLVA

SEQ ID NO: 2103688 - protein, 21 aa, Staphylococcus
GMKKLKPNHYLKIKEKLNTVR

SEQ ID NO: 2103689 - protein, 24 aa, Staphylococcus
GMSAVCAVVGFSFSGMSGEEAHAA

SEQ ID NO: 2103690 - protein, 17 aa, Staphylococcus
GNAEASGAGQGPDQATN

SEQ ID NO: 2103691 - protein, 18 aa, Staphylococcus
GNAFLPHALNEFKSDQYI

SEQ ID NO: 2103692 - protein, 26 aa, Staphylococcus
GNAHEIVIMPGIFPFIGETREAAEAQ

SEQ ID NO: 2103693 - protein, 19 aa, Staphylococcus
GNDKFYLVEDYNTGKKYGW

SEQ ID NO: 2103694 - protein, 19 aa, Staphylococcus
GNDKFYLVQDYNTGKKYGW

SEQ ID NO: 2103695 - protein, 27 aa, Staphylococcus
GNEALVRQVVYDLGRAFGNKNSRVDFG

SEQ ID NO: 2103696 - protein, 26 aa, Staphylococcus
GNEPFIRQLAYDYAKFQGSKHSKVDV

SEQ ID NO: 2103697 - protein, 22 aa, Staphylococcus
GNERFINVEIVHTHDYASFARS

SEQ ID NO: 2103698 - protein, 19 aa, Staphylococcus
GNHNKTYNDYGIEGNNGNY

SEQ ID NO: 2103699 - protein, 26 aa, Staphylococcus
GNKFSRADLGLTQWGLKQRPDETYID

SEQ ID NO: 2103700 - protein, 24 aa, Staphylococcus
GNLEHKGILGTGIVRIFDMTIAQT

SEQ ID NO: 2103701 - protein, 17 aa, Staphylococcus
GNLIYPGQSLTIPGASG

SEQ ID NO: 2103702 - protein, 17 aa, Staphylococcus
GNLSFAYFMKMYGTDKD

SEQ ID NO: 2103703 - protein, 37 aa, Staphylococcus
GNLYTAGQCTWYVFDKVGGKIGSTWGNANNWATSAQS

SEQ ID NO: 2103704 - protein, 31 aa, Staphylococcus
GNLYTAGQCTWYVFDRVDGKIGSTWGNANNW

SEQ ID NO: 2103705 - protein, 32 aa, Staphylococcus
GNNSPVYRAQLFLSPYGPPAYLQAINTNQANT

SEQ ID NO: 2103706 - protein, 19 aa, Staphylococcus
GNPDFALHTGDFVENSQTE

SEQ ID NO: 2103707 - protein, 25 aa, Staphylococcus
GNPTIYKPTWKHEAIDYRDATRHLS

SEQ ID NO: 2103708 - protein, 23 aa, Staphylococcus
GNRYDVGEKLGFVKTTIEYALKD

SEQ ID NO: 2103709 - protein, 29 aa, Staphylococcus
GNSTAPHLHFQRMQGGVGNEYSVNPDSYI

SEQ ID NO: 2103710 - protein, 19 aa, Staphylococcus
GNTKDIYDLNARREVTKYI

SEQ ID NO: 2103711 - protein, 19 aa, Staphylococcus
GNVSFNKNIIVDYGDNKNN

SEQ ID NO: 2103712 - protein, 18 aa, Staphylococcus
GNWGFSFTDKDGELAGSY

SEQ ID NO: 2103713 - protein, 18 aa, Staphylococcus
GPASAAYQSSLRVESGAE

SEQ ID NO: 2103714 - protein, 25 aa, Staphylococcus
GPEYYPPLFKEWHTFSTPDTLNKIS

SEQ ID NO: 2103715 - protein, 25 aa, Staphylococcus
GPKAFKLHTLAGFVTYKSAHKQTGI

SEQ ID NO: 2103716 - protein, 23 aa, Staphylococcus
GPKEIPYETLLFATGRQPNVHVA

SEQ ID NO: 2103717 - protein, 18 aa, Staphylococcus
GPVLFGFFGHSSIAIDHD

SEQ ID NO: 2103718 - protein, 18 aa, Staphylococcus
GPVLFGFFGHSSIALDHD

SEQ ID NO: 2103719 - protein, 24 aa, Staphylococcus
GQDKDLYASVMIAQAILESSSGNS

SEQ ID NO: 2103720 - protein, 20 aa, Staphylococcus
GQDYNLLNGISAYDKEDGDL

SEQ ID NO: 2103721 - protein, 20 aa, Staphylococcus
GQDYNVLNGISAYDKEDGDL

SEQ ID NO: 2103722 - protein, 18 aa, Staphylococcus
GQELMMLQKALTKEKMVG

SEQ ID NO: 2103723 - protein, 17 aa, Staphylococcus
GQFKQFRHGLSSFIEAL

SEQ ID NO: 2103724 - protein, 28 aa, Staphylococcus
GQGTVWTHYAISRFLGGTDHSDPHAYLQ

SEQ ID NO: 2103725 - protein, 28 aa, Staphylococcus
GQGTVWTHYAISRWLGGTDHADPHQYFS

SEQ ID NO: 2103726 - protein, 17 aa, Staphylococcus
GQIALSFAEYLKAETTL

SEQ ID NO: 2103727 - protein, 17 aa, Staphylococcus
GQIALSFAQYLKKETPL

SEQ ID NO: 2103728 - protein, 17 aa, Staphylococcus
GQKAEMCVVSHALNTIQ

SEQ ID NO: 2103729 - protein, 17 aa, Staphylococcus
GQKSYRTIHNTGQYNYI

SEQ ID NO: 2103730 - protein, 20 aa, Staphylococcus
GQLPPGRHVMTARIGNETKI

SEQ ID NO: 2103731 - protein, 25 aa, Staphylococcus
GQLSDKTKLALIFYADPKGKYSLTK

SEQ ID NO: 2103732 - protein, 21 aa, Staphylococcus
GQMKQAIRFVKDNHLKHLLVE

SEQ ID NO: 2103733 - protein, 24 aa, Staphylococcus
GQNTLYRMRWNPSSPGNHQYATDI

SEQ ID NO: 2103734 - protein, 25 aa, Staphylococcus
GQPFNEIYCAAKFGVEGYTESLASY

SEQ ID NO: 2103735 - protein, 24 aa, Staphylococcus
GQPFNEIYCATKFGVEGYTEAMAS

SEQ ID NO: 2103736 - protein, 26 aa, Staphylococcus
GQSGASALYGHVAFVEKVNDDGSIII

SEQ ID NO: 2103737 - protein, 19 aa, Staphylococcus
GQTKEAWGKGSVEEQTKGM

SEQ ID NO: 2103738 - protein, 18 aa, Staphylococcus
GQTYKLSKKATLGSNAFY

SEQ ID NO: 2103739 - protein, 17 aa, Staphylococcus
GQVDTYADRLVIKHNGQ

SEQ ID NO: 2103740 - protein, 29 aa, Staphylococcus
GRAFGNKNSRVDFGLSQWGLKQKPNESRI

SEQ ID NO: 2103741 - protein, 25 aa, Staphylococcus
GRALGGGCELVLYSPFVVAASETYI

SEQ ID NO: 2103742 - protein, 21 aa, Staphylococcus
GRFGDLVFNTLGFKPADKHVK

SEQ ID NO: 2103743 - protein, 27 aa, Staphylococcus
GRFVEEKGRVIGMPKLKGLKNKEKPDL

SEQ ID NO: 2103744 - protein, 18 aa, Staphylococcus
GRIHPGRIEDMVDKARKE

SEQ ID NO: 2103745 - protein, 18 aa, Staphylococcus
GRIHPGRIEDMVEKARKE

SEQ ID NO: 2103746 - protein, 22 aa, Staphylococcus
GRQAYTGSYNRAALKQQTVKQM

SEQ ID NO: 2103747 - protein, 22 aa, Staphylococcus
GRTINANDVLKLITANTTIPGL

SEQ ID NO: 2103748 - protein, 22 aa, Staphylococcus
GRTNQFGSLILKINQHQYKLII

SEQ ID NO: 2103749 - protein, 18 aa, Staphylococcus
GSDLAMPVANKLSETLDL

SEQ ID NO: 2103750 - protein, 19 aa, Staphylococcus
GSDLLEFYANQGVDGIVVE

SEQ ID NO: 2103751 - protein, 25 aa, Staphylococcus
GSEHYYEFRTNKGVLLVTADGKKDR

SEQ ID NO: 2103752 - protein, 17 aa, Staphylococcus
GSEILYDSFGLKMPEKV

SEQ ID NO: 2103753 - protein, 21 aa, Staphylococcus
GSGLNRRGYRIAQGEAPIKET

SEQ ID NO: 2103754 - protein, 22 aa, Staphylococcus
GSGLNRRGYRLAQGEAPIKETL

SEQ ID NO: 2103755 - protein, 46 aa, Staphylococcus
GSGSNAYTAGQCTYYVYDKVGGKIGSNWGNASNWANAAAQDGYNVS

SEQ ID NO: 2103756 - protein, 20 aa, Staphylococcus
GSGYWSGTFLHATNKSAPYY

SEQ ID NO: 2103757 - protein, 19 aa, Staphylococcus
GSIGNTWGNANNWANAAAQ

SEQ ID NO: 2103758 - protein, 28 aa, Staphylococcus
GSKIVRTLEVFGVQMLQYGDVSLVYTYE

SEQ ID NO: 2103759 - protein, 18 aa, Staphylococcus
GSMASLMLLLAAGAPQNA

SEQ ID NO: 2103760 - protein, 24 aa, Staphylococcus
GSMLPKIESAISFIKNNPKGSVLI

SEQ ID NO: 2103761 - protein, 24 aa, Staphylococcus
GSMLPKVEAALQFIEKNPKGSVLI

SEQ ID NO: 2103762 - protein, 25 aa, Staphylococcus
GSNGQWTIANKPSYISVDSATGKVT

SEQ ID NO: 2103763 - protein, 18 aa, Staphylococcus
GSNIKGMTIGLAMNSVYY

SEQ ID NO: 2103764 - protein, 23 aa, Staphylococcus
GSNSIKTTLTFDDLGITTSNNRH

SEQ ID NO: 2103765 - protein, 18 aa, Staphylococcus
GSQNLGPLEDKTTNLRDE

SEQ ID NO: 2103766 - protein, 20 aa, Staphylococcus
GSRMPYVFQATEVIKVPQYD

SEQ ID NO: 2103767 - protein, 20 aa, Staphylococcus
GSSIGDEIKTLIGNFKSDIN

SEQ ID NO: 2103768 - protein, 29 aa, Staphylococcus
GSSSYPQGQCTWYVDQRMKQFGQYIHSNL

SEQ ID NO: 2103769 - protein, 30 aa, Staphylococcus
GSTAEGRWLAKNAYKYGFILRYPKGKEKIT

SEQ ID NO: 2103770 - protein, 19 aa, Staphylococcus
GSVEFKVTSHLSVKQLKEA

SEQ ID NO: 2103771 - protein, 19 aa, Staphylococcus
GSVNNKLGWIAEKDLTSLS

SEQ ID NO: 2103772 - protein, 17 aa, Staphylococcus
GSVNPGGGMPMVTLSGM

SEQ ID NO: 2103773 - protein, 17 aa, Staphylococcus
GSVNPGGGMPMVTLSGQ

SEQ ID NO: 2103774 - protein, 18 aa, Staphylococcus
GSVNTRYRNEVYQLISDF

SEQ ID NO: 2103775 - protein, 17 aa, Staphylococcus
GSVSGKSAQTFKATKQQ

SEQ ID NO: 2103776 - protein, 19 aa, Staphylococcus
GSYALSRPLFLYVKEKSLK

SEQ ID NO: 2103777 - protein, 21 aa, Staphylococcus
GSYPLSRPLFLYVKEKSLEDN

SEQ ID NO: 2103778 - protein, 20 aa, Staphylococcus
GTALLLLSACNNGDSSSDSK

SEQ ID NO: 2103779 - protein, 18 aa, Staphylococcus
GTEDMWNTIVMPESGGNP

SEQ ID NO: 2103780 - protein, 23 aa, Staphylococcus
GTGSIQNDGLWYFIPNESSKGQM

SEQ ID NO: 2103781 - protein, 17 aa, Staphylococcus
GTITIGLVGKYVSLQDA

SEQ ID NO: 2103782 - protein, 29 aa, Staphylococcus
GTNTESWDALTKPNAAQILNAKYDVFYQG

SEQ ID NO: 2103783 - protein, 24 aa, Staphylococcus
GTQEAVETFTLYYDKQYGYIHRLF

SEQ ID NO: 2103784 - protein, 25 aa, Staphylococcus
GTVNGKSGWISKYYLTTPSSSSNST

SEQ ID NO: 2103785 - protein, 24 aa, Staphylococcus
GTVNGKSGWVSKYYLTAPTQSKVA

SEQ ID NO: 2103786 - protein, 17 aa, Staphylococcus
GTVNGKTGWIAEKDLVQ

SEQ ID NO: 2103787 - protein, 26 aa, Staphylococcus
GVATPVQVPVSLYVYQFDFSPNAYTT

SEQ ID NO: 2103788 - protein, 25 aa, Staphylococcus
GVDYGMPENTPVYSLTDGTVTQAGW

SEQ ID NO: 2103789 - protein, 28 aa, Staphylococcus
GVEKAFAIQAGREIRVIVSPDEIDDLKA

SEQ ID NO: 2103790 - protein, 28 aa, Staphylococcus
GVEKAFAIQAGREIRVIVSPDEIDDLKS

SEQ ID NO: 2103791 - protein, 20 aa, Staphylococcus
GVEKAFAIQAGREIRVVVSP

SEQ ID NO: 2103792 - protein, 28 aa, Staphylococcus
GVEKAFAIQAGREIRVVVSPEEIDDLKS

SEQ ID NO: 2103793 - protein, 18 aa, Staphylococcus
GVFLLLLAACGSNDGSKE

SEQ ID NO: 2103794 - protein, 33 aa, Staphylococcus
GVGAGEGQSLPAMWRTAGGIDSSRASNFVQGPP

SEQ ID NO: 2103795 - protein, 22 aa, Staphylococcus
GVIKRISMEYNKPDGPTFKEVR

SEQ ID NO: 2103796 - protein, 17 aa, Staphylococcus
GVIQRESGGNANAVNAS

SEQ ID NO: 2103797 - protein, 21 aa, Staphylococcus
GVKMLKDPDKIYGKEDQHINL

SEQ ID NO: 2103798 - protein, 25 aa, Staphylococcus
GVKRKEIKNPGGLKQIDYWYVDPSG

SEQ ID NO: 2103799 - protein, 17 aa, Staphylococcus
GVLFLAFGLHFKDRTEL

SEQ ID NO: 2103800 - protein, 24 aa, Staphylococcus
GVNVKGYFVWSLQDMFSWSNGYNK

SEQ ID NO: 2103801 - protein, 26 aa, Staphylococcus
GVYKDWKPGQKVHLVGHSMGGQTIRQ

SEQ ID NO: 2103802 - protein, 27 aa, Staphylococcus
GVYKDWKPGQKVHLVGHSMGGQTIRQL

SEQ ID NO: 2103803 - protein, 22 aa, Staphylococcus
GVYSATKFGVWAASEALRQEEA

SEQ ID NO: 2103804 - protein, 24 aa, Staphylococcus
GWGPDYPDPLTFLNIMTTGNSNNN

SEQ ID NO: 2103805 - protein, 18 aa, Staphylococcus
GYDAKFTLDKNFKNAIKA

SEQ ID NO: 2103806 - protein, 31 aa, Staphylococcus
GYDIYVRKGTTCFGVALGILRVVEAILNNQN

SEQ ID NO: 2103807 - protein, 27 aa, Staphylococcus
GYDLESRGCIFSNGLNGPKARLKLLVG

SEQ ID NO: 2103808 - protein, 18 aa, Staphylococcus
GYPFKKDVVVKWIDSSLV

SEQ ID NO: 2103809 - protein, 18 aa, Staphylococcus
GYQYEPWHLRYLGKEKAK

SEQ ID NO: 2103810 - protein, 18 aa, Staphylococcus
GYQYEPWHLRYLGKNNAA

SEQ ID NO: 2103811 - protein, 19 aa, Staphylococcus
GYTPKELTVQFVPSQNADT

SEQ ID NO: 2103812 - protein, 17 aa, Staphylococcus
HAANYGFIIRYPKNQSK

SEQ ID NO: 2103813 - protein, 19 aa, Staphylococcus
HAGYYPGAEPLHLRVYFEN

SEQ ID NO: 2103814 - protein, 19 aa, Staphylococcus
HALNEFKSDQYINLGNPGR

SEQ ID NO: 2103815 - protein, 31 aa, Staphylococcus
HARNSFSSIEGWKAVSKEAIIKKNPDILIST

SEQ ID NO: 2103816 - protein, 23 aa, Staphylococcus
HARVAGEPVLPMLQQRYGNNVDA

SEQ ID NO: 2103817 - protein, 17 aa, Staphylococcus
HAYAYGGPNMAVKSLEK

SEQ ID NO: 2103818 - protein, 18 aa, Staphylococcus
HCQVYDYIFLTIGTLSYH

SEQ ID NO: 2103819 - protein, 23 aa, Staphylococcus
HDFLSDITYQWERLARQFEKLGT

SEQ ID NO: 2103820 - protein, 29 aa, Staphylococcus
HDFMPGYNLFHIHPIFPIPEKEQFIAKIN

SEQ ID NO: 2103821 - protein, 25 aa, Staphylococcus
HDFMPGYNLFHIYPIFPLPERQKFF

SEQ ID NO: 2103822 - protein, 26 aa, Staphylococcus
HDFYPGYNLFHIYPIFPIPEREKFFA

SEQ ID NO: 2103823 - protein, 25 aa, Staphylococcus
HDIAPSHVAVCWDMGQETFRNQMYA

SEQ ID NO: 2103824 - protein, 24 aa, Staphylococcus
HDPHVWLDPVLNKKFAKEIKDELI

SEQ ID NO: 2103825 - protein, 20 aa, Staphylococcus
HDPYHLKGIKGFKPTPYPTY

SEQ ID NO: 2103826 - protein, 23 aa, Staphylococcus
HDSLGYLAERYHFQQEGVSGMNN

SEQ ID NO: 2103827 - protein, 21 aa, Staphylococcus
HDVHKALIVGAGYISLEVLEN

SEQ ID NO: 2103828 - protein, 25 aa, Staphylococcus
HEFIPGYSLFHIYPIFPIPERERFL

SEQ ID NO: 2103829 - protein, 25 aa, Staphylococcus
HEIQPTHVAVCWDMGQSTFRNDMFE

SEQ ID NO: 2103830 - protein, 22 aa, Staphylococcus
HEKDLRLGVDSSWLNRKGDGYP

SEQ ID NO: 2103831 - protein, 21 aa, Staphylococcus
HEKGFFEQIEEAFSELEKEFT

SEQ ID NO: 2103832 - protein, 32 aa, Staphylococcus
HENKSYILEGIREWQKQLSILATQIESEDSDG

SEQ ID NO: 2103833 - protein, 25 aa, Staphylococcus
HFESNGTHWSWNYAQNGQATPQQDV

SEQ ID NO: 2103834 - protein, 19 aa, Staphylococcus
HFFRERLGDEVLENLIEPL

SEQ ID NO: 2103835 - protein, 21 aa, Staphylococcus
HGGDISPLYKGGQDNMISSIT

SEQ ID NO: 2103836 - protein, 24 aa, Staphylococcus
HGNSVPRFHITWGTGPGLVEPFSR

SEQ ID NO: 2103837 - protein, 23 aa, Staphylococcus
HHHHGGYDPHVWLDPEKNKVFAI

SEQ ID NO: 2103838 - protein, 30 aa, Staphylococcus
HHHHGGYDPHVWLDPKFDQTFAKEIKDELI

SEQ ID NO: 2103839 - protein, 17 aa, Staphylococcus
HHMLTGNSLNHGHILIQ

SEQ ID NO: 2103840 - protein, 30 aa, Staphylococcus
HIMNLNGLNSFLIFPGQQLKVSGSVSSNSH

SEQ ID NO: 2103841 - protein, 24 aa, Staphylococcus
HINAWKPYRHDVLFSGVFKSQKES

SEQ ID NO: 2103842 - protein, 17 aa, Staphylococcus
HITACTWTSKKWPFTTP

SEQ ID NO: 2103843 - protein, 18 aa, Staphylococcus
HIVASSLVHLSANQVEKH

SEQ ID NO: 2103844 - protein, 22 aa, Staphylococcus
HKANQWLKHWEKQLAKDKKALA

SEQ ID NO: 2103845 - protein, 24 aa, Staphylococcus
HKDELRLGMDTQWMNRAGDGYPAF

SEQ ID NO: 2103846 - protein, 19 aa, Staphylococcus
HKDYYTSMTQLERETKEGI

SEQ ID NO: 2103847 - protein, 19 aa, Staphylococcus
HKIESFKFSGLTDAPIDYK

SEQ ID NO: 2103848 - protein, 22 aa, Staphylococcus
HKIYELDPKLWYFSSGSTTTTM

SEQ ID NO: 2103849 - protein, 35 aa, Staphylococcus
HKPEIKVLNELKGFKMINGGSVGLVNSELERTNVF

SEQ ID NO: 2103850 - protein, 26 aa, Staphylococcus
HKSLIYRYDATSGRTINANDVLKLIT

SEQ ID NO: 2103851 - protein, 31 aa, Staphylococcus
HKVKSGESLWSISSKYGISISKLKSLNHLSS

SEQ ID NO: 2103852 - protein, 21 aa, Staphylococcus
HKVSDLKASLINVKDTNKIKA

SEQ ID NO: 2103853 - protein, 31 aa, Staphylococcus
HLIGHSMGGQTVRLLEEMLRNRNPEEIEYQK

SEQ ID NO: 2103854 - protein, 23 aa, Staphylococcus
HLKLGVYQDGGRQLARFSQDGQN

SEQ ID NO: 2103855 - protein, 22 aa, Staphylococcus
HLTAPAEYYVWGAGPKANPYFY

SEQ ID NO: 2103856 - protein, 18 aa, Staphylococcus
HLVGHSMGGQTIRLMEHF

SEQ ID NO: 2103857 - protein, 22 aa, Staphylococcus
HNKANAGLGVYRVHKNGQVEYK

SEQ ID NO: 2103858 - protein, 21 aa, Staphylococcus
HNKKIIKRNIKYIKSKKSGYI

SEQ ID NO: 2103859 - protein, 17 aa, Staphylococcus
HNMKVLAQDGYRFAEPG

SEQ ID NO: 2103860 - protein, 22 aa, Staphylococcus
HNQGIDHIYAFQARGTDSYTIQ

SEQ ID NO: 2103861 - protein, 25 aa, Staphylococcus
HNVNLRNGDPFTIALFGVDSNAQRK

SEQ ID NO: 2103862 - protein, 23 aa, Staphylococcus
HPAAYDIATRMAKDWDQKDEERL

SEQ ID NO: 2103863 - protein, 24 aa, Staphylococcus
HPAAYKIATRIADDWNEEDENKLS

SEQ ID NO: 2103864 - protein, 28 aa, Staphylococcus
HPDLVKILGRLQYRTSYGQNVLKHSIEV

SEQ ID NO: 2103865 - protein, 19 aa, Staphylococcus
HPNEIGIFQTLIENVKENL

SEQ ID NO: 2103866 - protein, 22 aa, Staphylococcus
HQSIWKKICVNGTANALCSILE

SEQ ID NO: 2103867 - protein, 24 aa, Staphylococcus
HRDYRTTFELLKLIYDKQAAKVES

SEQ ID NO: 2103868 - protein, 20 aa, Staphylococcus
HRYSTHYLLLEEMRKQLHLD

SEQ ID NO: 2103869 - protein, 32 aa, Staphylococcus
HSDPVGYFSQWGYNMNQFYSLVQKHYKVLSGG

SEQ ID NO: 2103870 - protein, 22 aa, Staphylococcus
HSKEARKALKEDTKDGEKIVDL

SEQ ID NO: 2103871 - protein, 25 aa, Staphylococcus
HSNLYDWGQCTWHVFNKRAQIGKGI

SEQ ID NO: 2103872 - protein, 24 aa, Staphylococcus
HSPELRGVNDIVIEKGQNYNLLNG

SEQ ID NO: 2103873 - protein, 18 aa, Staphylococcus
HSRSDAMILSTFNQDKHQ

SEQ ID NO: 2103874 - protein, 25 aa, Staphylococcus
HTEKAIKKLGRFSSYKVANHLVPYE

SEQ ID NO: 2103875 - protein, 20 aa, Staphylococcus
HTGNSIQLWAEFPNYLNHKS

SEQ ID NO: 2103876 - protein, 18 aa, Staphylococcus
HTGPLGFQIPDVRQLFAM

SEQ ID NO: 2103877 - protein, 25 aa, Staphylococcus
HTLKVELTKPIPYINEMFAFGTFMP

SEQ ID NO: 2103878 - protein, 17 aa, Staphylococcus
HTTIAHRGASGYAPEHT

SEQ ID NO: 2103879 - protein, 20 aa, Staphylococcus
HVNMNAQVPLAWGAHRAANI

SEQ ID NO: 2103880 - protein, 17 aa, Staphylococcus
HVVKVTAGTYWYNDPYT

SEQ ID NO: 2103881 - protein, 18 aa, Staphylococcus
HWHGLEVNGKVDGGPSQV

SEQ ID NO: 2103882 - protein, 28 aa, Staphylococcus
HYRHVNLPAQVPLAWGAHRAASIIAEQI

SEQ ID NO: 2103883 - protein, 23 aa, Staphylococcus
HYSNGRAGWNIVTSGINHTAKNF

SEQ ID NO: 2103884 - protein, 17 aa, Staphylococcus
IAATAKRENAINDKGSY

SEQ ID NO: 2103885 - protein, 19 aa, Staphylococcus
IADHVTKISVNPAGSNTPV

SEQ ID NO: 2103886 - protein, 28 aa, Staphylococcus
IAESAIKCARAGATVAHIHARDPETGGI

SEQ ID NO: 2103887 - protein, 22 aa, Staphylococcus
IAESSPAYLSNILEQDFYDTND

SEQ ID NO: 2103888 - protein, 20 aa, Staphylococcus
IAFMKRNYNSAFVHAFVDGN

SEQ ID NO: 2103889 - protein, 17 aa, Staphylococcus
IALKKQYGIEGKLAVYV

SEQ ID NO: 2103890 - protein, 17 aa, Staphylococcus
IALVFVLAACGNGGSSK

SEQ ID NO: 2103891 - protein, 17 aa, Staphylococcus
IALVFVLAACGNNDSSS

SEQ ID NO: 2103892 - protein, 17 aa, Staphylococcus
IALVFVLAACGNNSSKD

SEQ ID NO: 2103893 - protein, 24 aa, Staphylococcus
IAPKKAEHFHIFMGDNNDSLLKEM

SEQ ID NO: 2103894 - protein, 17 aa, Staphylococcus
IAPTYVFDANQSSYKDT

SEQ ID NO: 2103895 - protein, 17 aa, Staphylococcus
IAQDYIKSGQNTLYKMR

SEQ ID NO: 2103896 - protein, 19 aa, Staphylococcus
IAQIKGHDQALIALLNGDV

SEQ ID NO: 2103897 - protein, 25 aa, Staphylococcus
IASSNADMWRDITFSNQENILHLLE

SEQ ID NO: 2103898 - protein, 23 aa, Staphylococcus
IASSNAEMWKDILLSNKQNIISL

SEQ ID NO: 2103899 - protein, 22 aa, Staphylococcus
IASSNAEMWKDITLNNKTFILD

SEQ ID NO: 2103900 - protein, 26 aa, Staphylococcus
IASSNAEMWRDITISNKTAILNLIQD

SEQ ID NO: 2103901 - protein, 22 aa, Staphylococcus
IASSSPEMWRDIMHENKSYILE

SEQ ID NO: 2103902 - protein, 17 aa, Staphylococcus
IATFAFAHNDAHAAEQN

SEQ ID NO: 2103903 - protein, 18 aa, Staphylococcus
IATVYNWNPKAKQLTYGT

SEQ ID NO: 2103904 - protein, 21 aa, Staphylococcus
IAVIYICAKIFITGDKIHNPL

SEQ ID NO: 2103905 - protein, 17 aa, Staphylococcus
IAVVALVFVITYGLNRH

SEQ ID NO: 2103906 - protein, 23 aa, Staphylococcus
ICLGVPIKLGQNGVEEILELTLS

SEQ ID NO: 2103907 - protein, 19 aa, Staphylococcus
ICLTLFVGACSTQDSSKKN

SEQ ID NO: 2103908 - protein, 23 aa, Staphylococcus
IDALTEFEVAYAPPYSHPKDLIN

SEQ ID NO: 2103909 - protein, 19 aa, Staphylococcus
IDEITARINLDGVSDTTEK

SEQ ID NO: 2103910 - protein, 24 aa, Staphylococcus
IDELTEFEVAYAPPYSHPKDLVNM

SEQ ID NO: 2103911 - protein, 18 aa, Staphylococcus
IDGKHVITSLTYKNNKVI

SEQ ID NO: 2103912 - protein, 27 aa, Staphylococcus
IDGNPNIYRPTWKSEASNYQSATSHLS

SEQ ID NO: 2103913 - protein, 21 aa, Staphylococcus
IDIASGSHLKVLPKENNDAVK

SEQ ID NO: 2103914 - protein, 21 aa, Staphylococcus
IDMNAFQHFAFLHEYEKANKG

SEQ ID NO: 2103915 - protein, 24 aa, Staphylococcus
IDMNAFQHFAFLNAYKKAHKDAKI

SEQ ID NO: 2103916 - protein, 17 aa, Staphylococcus
IDNEMKKGVNLGQISKM

SEQ ID NO: 2103917 - protein, 24 aa, Staphylococcus
IDNERIQKLLAFQMLYIGIDPKRG

SEQ ID NO: 2103918 - protein, 19 aa, Staphylococcus
IDNQAYWFITINAKERDAQ

SEQ ID NO: 2103919 - protein, 19 aa, Staphylococcus
IDPIGAWFTAFEAYQDTSD

SEQ ID NO: 2103920 - protein, 27 aa, Staphylococcus
IDPKRGPSLYSIIPMIEMMFGVHFIKG

SEQ ID NO: 2103921 - protein, 38 aa, Staphylococcus
IDPKRGPSLYSIIPMVEMMFGVHFIKGGMYGLTRGLVK

SEQ ID NO: 2103922 - protein, 17 aa, Staphylococcus
IDPMLGIEGSKYFIKLW

SEQ ID NO: 2103923 - protein, 18 aa, Staphylococcus
IDQAKALLQNKADNHELV

SEQ ID NO: 2103924 - protein, 19 aa, Staphylococcus
IDRGTVCSLGSHDGVGHVF

SEQ ID NO: 2103925 - protein, 20 aa, Staphylococcus
IDRLSLMSTFPNFKEQEEKY

SEQ ID NO: 2103926 - protein, 26 aa, Staphylococcus
IDSLDNGTYSYVFSFANKANPGTFTI

SEQ ID NO: 2103927 - protein, 19 aa, Staphylococcus
IDSNTVLYKAGLTNQEVNV

SEQ ID NO: 2103928 - protein, 19 aa, Staphylococcus
IDSSEAMNGYRRGAFDDMS

SEQ ID NO: 2103929 - protein, 18 aa, Staphylococcus
IDSSESMNGYRRGAYQDM

SEQ ID NO: 2103930 - protein, 27 aa, Staphylococcus
IDYAKRVKNSNLWKSQDNGFYDLTRDG

SEQ ID NO: 2103931 - protein, 18 aa, Staphylococcus
IDYKETIEQLSLVYYDEK

SEQ ID NO: 2103932 - protein, 30 aa, Staphylococcus
IDYVKRVENSNLWKTKDNGFYDLTTEGAQE

SEQ ID NO: 2103933 - protein, 17 aa, Staphylococcus
IEAPIVITGAMRSSNEI

SEQ ID NO: 2103934 - protein, 22 aa, Staphylococcus
IEEGGHLKEDIVNYNGSDSLSS

SEQ ID NO: 2103935 - protein, 35 aa, Staphylococcus
IEGNNGNYSYVFSFKDPQQNGVYSIVTVNSQGQPV

SEQ ID NO: 2103936 - protein, 25 aa, Staphylococcus
IEKAKSLYPKVRMYYERSEPVAEAF

SEQ ID NO: 2103937 - protein, 18 aa, Staphylococcus
IEKGISIDIARTHYTKES

SEQ ID NO: 2103938 - protein, 28 aa, Staphylococcus
IEKQKLRDMLGYFIKYVGSSSYDAPAVL

SEQ ID NO: 2103939 - protein, 17 aa, Staphylococcus
IEMYYNLLNYYDTRETT

SEQ ID NO: 2103940 - protein, 23 aa, Staphylococcus
IENDIKALLPFHKSLQIAERDEN

SEQ ID NO: 2103941 - protein, 18 aa, Staphylococcus
IENGKLKLNDKVKITNKY

SEQ ID NO: 2103942 - protein, 22 aa, Staphylococcus
IEQKAKEIISDKYLSPRAKQYR

SEQ ID NO: 2103943 - protein, 21 aa, Staphylococcus
IERLPLQWRSFFTNGEVIDLY

SEQ ID NO: 2103944 - protein, 17 aa, Staphylococcus
IESFPTEKFRQMIDIML

SEQ ID NO: 2103945 - protein, 17 aa, Staphylococcus
IESLPFIEAIRQIRSDL

SEQ ID NO: 2103946 - protein, 24 aa, Staphylococcus
IETANTDYLAWGAGPQANDRFIHV

SEQ ID NO: 2103947 - protein, 21 aa, Staphylococcus
IETAVAFADIYLMALPTKAMR

SEQ ID NO: 2103948 - protein, 28 aa, Staphylococcus
IETLKIADKRGFNSLSLITSGDHVRRAT

SEQ ID NO: 2103949 - protein, 19 aa, Staphylococcus
IEVGEKISKINVEKLPKEG

SEQ ID NO: 2103950 - protein, 23 aa, Staphylococcus
IEYAQSRYGSINAAVRFRTTHGW

SEQ ID NO: 2103951 - protein, 23 aa, Staphylococcus
IFEYDILVVALGFESETFGINGM

SEQ ID NO: 2103952 - protein, 17 aa, Staphylococcus
IFFIIVLVTLIVLVGVL

SEQ ID NO: 2103953 - protein, 18 aa, Staphylococcus
IFIYGCSKQPSSIKAKQD

SEQ ID NO: 2103954 - protein, 25 aa, Staphylococcus
IFKHYRKEYEYKKVLSKGEHKIGGK

SEQ ID NO: 2103955 - protein, 17 aa, Staphylococcus
IFLLGEGDIYFNSMSPR

SEQ ID NO: 2103956 - protein, 25 aa, Staphylococcus
IFNKEKRVEVALKRAQFEADTNYIP

SEQ ID NO: 2103957 - protein, 31 aa, Staphylococcus
IFSINASFRKYPNLKASLKDYADLIKHGIDG

SEQ ID NO: 2103958 - protein, 20 aa, Staphylococcus
IFYNGFNLESGNGWFEKALK

SEQ ID NO: 2103959 - protein, 18 aa, Staphylococcus
IFYSLGILTSDSFLSKNQ

SEQ ID NO: 2103960 - protein, 18 aa, Staphylococcus
IGILSLFTLFGTSISDAA

SEQ ID NO: 2103961 - protein, 26 aa, Staphylococcus
IGIYNEVPGNFGLWVQDQISDYLVIY

SEQ ID NO: 2103962 - protein, 19 aa, Staphylococcus
IGKEQMKWIKQDIKKARKN

SEQ ID NO: 2103963 - protein, 18 aa, Staphylococcus
IGLIHALTQFYSIDNQPL

SEQ ID NO: 2103964 - protein, 19 aa, Staphylococcus
IGNIHPVFNKKQQARAKIN

SEQ ID NO: 2103965 - protein, 18 aa, Staphylococcus
IGQMKYSGIPLVNVSVIA

SEQ ID NO: 2103966 - protein, 26 aa, Staphylococcus
IGQMSNDFSPIVLPNVQKVNVVNPGD

SEQ ID NO: 2103967 - protein, 21 aa, Staphylococcus
IGRPHYQFTNLKAAKKGSKVY

SEQ ID NO: 2103968 - protein, 23 aa, Staphylococcus
IGSAQKFTTGLMLKKLETEGKVN

SEQ ID NO: 2103969 - protein, 18 aa, Staphylococcus
IGSLLPEMCTLDCGSVNM

SEQ ID NO: 2103970 - protein, 19 aa, Staphylococcus
IGTHFKVRLYSDHIRIPKS

SEQ ID NO: 2103971 - protein, 25 aa, Staphylococcus
IGYRGLGQTKEAWGTGSVATQTQGM

SEQ ID NO: 2103972 - protein, 24 aa, Staphylococcus
IHLTAPSEYYVWGAGKATNPYFYQ

SEQ ID NO: 2103973 - protein, 27 aa, Staphylococcus
IHMAASKRLTGNVIGKADEKEWRENDG

SEQ ID NO: 2103974 - protein, 21 aa, Staphylococcus
IIDEFDELVYLFLKDDSQVHY

SEQ ID NO: 2103975 - protein, 21 aa, Staphylococcus
IIDGAKFIAQDYIKSGQNTLY

SEQ ID NO: 2103976 - protein, 25 aa, Staphylococcus
IIEHLKENLDWIWNSLSLRDQELFN

SEQ ID NO: 2103977 - protein, 19 aa, Staphylococcus
IIEYLKENLNWIWNSFSFE

SEQ ID NO: 2103978 - protein, 26 aa, Staphylococcus
IIHLLDRMGVMFNRTKEGLLDFRRFG

SEQ ID NO: 2103979 - protein, 22 aa, Staphylococcus
IIHLLDRMGVMFNRTNEGLLDF

SEQ ID NO: 2103980 - protein, 21 aa, Staphylococcus
IIIEGIGIKPNTEFLEGAGIE

SEQ ID NO: 2103981 - protein, 17 aa, Staphylococcus
IIIGAIVGGAATLADKS

SEQ ID NO: 2103982 - protein, 25 aa, Staphylococcus
IIKTLHLRKTIIAIPHHILVKIKPL

SEQ ID NO: 2103983 - protein, 20 aa, Staphylococcus
IILCCLLLVSCSNDKQSAAK

SEQ ID NO: 2103984 - protein, 18 aa, Staphylococcus
IILTKGPVLFGFFGHSSI

SEQ ID NO: 2103985 - protein, 18 aa, Staphylococcus
IISLIALCLMLAGCSNGD

SEQ ID NO: 2103986 - protein, 19 aa, Staphylococcus
IITVLPFGNLISQIKVKGT

SEQ ID NO: 2103987 - protein, 23 aa, Staphylococcus
IIVICASASLPKGETRLKLLEDN

SEQ ID NO: 2103988 - protein, 26 aa, Staphylococcus
IKANTPIRLYHYGLPSGNFKNDPMGT

SEQ ID NO: 2103989 - protein, 26 aa, Staphylococcus
IKDIKPSHVAICWDMGQATFRNDMYT

SEQ ID NO: 2103990 - protein, 20 aa, Staphylococcus
IKDTEKILKEEGYKKNHNGI

SEQ ID NO: 2103991 - protein, 23 aa, Staphylococcus
IKELKCKMIKEIKNEFYYGRSRK

SEQ ID NO: 2103992 - protein, 21 aa, Staphylococcus
IKELKYDWPSLSSESEKVLKK

SEQ ID NO: 2103993 - protein, 25 aa, Staphylococcus
IKETLAASLIKLANWTGDTPLIDPF

SEQ ID NO: 2103994 - protein, 24 aa, Staphylococcus
IKETLAASLIKLANWTGQTPLIDP

SEQ ID NO: 2103995 - protein, 27 aa, Staphylococcus
IKIPKHPKRIVILTSNFGNFKDLGVTP

SEQ ID NO: 2103996 - protein, 17 aa, Staphylococcus
IKKQRPDIDVTIYEATN

SEQ ID NO: 2103997 - protein, 20 aa, Staphylococcus
IKKSNTRSTSLFQQVPQIED

SEQ ID NO: 2103998 - protein, 19 aa, Staphylococcus
IKLGGIIEIYEKFTGDDPR

SEQ ID NO: 2103999 - protein, 21 aa, Staphylococcus
IKLMKEKPEVAPIPKKNSPNR

SEQ ID NO: 2104000 - protein, 22 aa, Staphylococcus
IKNGRTYVDGVLIVNKDIGLPS

SEQ ID NO: 2104001 - protein, 20 aa, Staphylococcus
IKPNTEFLEGAGIEEDDAGY

SEQ ID NO: 2104002 - protein, 33 aa, Staphylococcus
IKQARKKGANWIILNLHKPMYSKSYHALSDEDI

SEQ ID NO: 2104003 - protein, 23 aa, Staphylococcus
IKRGGDGYAPFQEHYGFAFNSIK

SEQ ID NO: 2104004 - protein, 26 aa, Staphylococcus
IKRTYPRLRITGAPFEAVGLPDCISQ

SEQ ID NO: 2104005 - protein, 19 aa, Staphylococcus
IKSAVEFIIQEEGRIDILI

SEQ ID NO: 2104006 - protein, 25 aa, Staphylococcus
IKSGATLYTVPWGNYNQVAGTVSKS

SEQ ID NO: 2104007 - protein, 18 aa, Staphylococcus
IKSNHIVVFMTFKEDVMP

SEQ ID NO: 2104008 - protein, 19 aa, Staphylococcus
IKSNLPFHKSFDIIKRNDT

SEQ ID NO: 2104009 - protein, 22 aa, Staphylococcus
IKVTSRGTGQWNLGEPPHEGTQ

SEQ ID NO: 2104010 - protein, 24 aa, Staphylococcus
ILAESGSARGFKPVGYSKGNSIYS

SEQ ID NO: 2104011 - protein, 18 aa, Staphylococcus
ILALVLCLVGCSNSNNDK

SEQ ID NO: 2104012 - protein, 23 aa, Staphylococcus
ILASSLFTAIPMTLAQTNPTSKD

SEQ ID NO: 2104013 - protein, 32 aa, Staphylococcus
ILDVASPYPYGQCTWYVYERVQQFDKHVGGHW

SEQ ID NO: 2104014 - protein, 19 aa, Staphylococcus
ILEELFQYRFEEHQIEGHS

SEQ ID NO: 2104015 - protein, 18 aa, Staphylococcus
ILEIREDILGALQISFKT

SEQ ID NO: 2104016 - protein, 18 aa, Staphylococcus
ILERFSGLQSGKDFFVGY

SEQ ID NO: 2104017 - protein, 18 aa, Staphylococcus
ILFALSVTLLCLSLTPNI

SEQ ID NO: 2104018 - protein, 17 aa, Staphylococcus
ILFVVLGGAAIFFYENK

SEQ ID NO: 2104019 - protein, 18 aa, Staphylococcus
ILGLIFLGLSKWYSSEDN

SEQ ID NO: 2104020 - protein, 19 aa, Staphylococcus
ILGSLLILSSCSNNDEKDK

SEQ ID NO: 2104021 - protein, 17 aa, Staphylococcus
ILIGAIIGGAATLADKS

SEQ ID NO: 2104022 - protein, 26 aa, Staphylococcus
ILILSIGLVGCHRLSKEESDPSDNAK

SEQ ID NO: 2104023 - protein, 19 aa, Staphylococcus
ILILVALPVSLAIKSEDRG

SEQ ID NO: 2104024 - protein, 18 aa, Staphylococcus
ILISGIIFLAFVLMPASW

SEQ ID NO: 2104025 - protein, 17 aa, Staphylococcus
ILLGAVIGGAATLADKS

SEQ ID NO: 2104026 - protein, 23 aa, Staphylococcus
ILLGCILGVVVGYIAAQKVLHEK

SEQ ID NO: 2104027 - protein, 18 aa, Staphylococcus
ILLGKLLEKKYSDKVDTK

SEQ ID NO: 2104028 - protein, 25 aa, Staphylococcus
ILLSIMLCVLVACGKEDSSNKGSKD

SEQ ID NO: 2104029 - protein, 17 aa, Staphylococcus
ILLSLVLTVALAACGNG

SEQ ID NO: 2104030 - protein, 23 aa, Staphylococcus
ILNAKYDVFYQGQPFATSQTVRF

SEQ ID NO: 2104031 - protein, 19 aa, Staphylococcus
ILNMASINGVIGFAGKAAY

SEQ ID NO: 2104032 - protein, 19 aa, Staphylococcus
ILNRAELNGVLSNDLHQSI

SEQ ID NO: 2104033 - protein, 23 aa, Staphylococcus
ILQKDMHRHLLPTFEKYEKLAKS

SEQ ID NO: 2104034 - protein, 21 aa, Staphylococcus
ILSGCSLPGLGDSRSDDDVKI

SEQ ID NO: 2104035 - protein, 18 aa, Staphylococcus
ILSLFKIAPVHAENASMS

SEQ ID NO: 2104036 - protein, 19 aa, Staphylococcus
ILSRLRANEDLKDIPIHFA

SEQ ID NO: 2104037 - protein, 17 aa, Staphylococcus
ILTGCSFSNEDKEEDHS

SEQ ID NO: 2104038 - protein, 24 aa, Staphylococcus
ILTMCMAISLYGCEENKKKKVAKK

SEQ ID NO: 2104039 - protein, 17 aa, Staphylococcus
ILVLFSTIFLASCELPG

SEQ ID NO: 2104040 - protein, 17 aa, Staphylococcus
ILVSFILASCGGKSNSD

SEQ ID NO: 2104041 - protein, 22 aa, Staphylococcus
IMDSSTGWLLLQGVISEYGDKE

SEQ ID NO: 2104042 - protein, 20 aa, Staphylococcus
IMLICGILLSSCGNQSSADL

SEQ ID NO: 2104043 - protein, 19 aa, Staphylococcus
IMPNRLVAAQTKFIYKSKN

SEQ ID NO: 2104044 - protein, 17 aa, Staphylococcus
IMSVDMRGTFLVTKFLL

SEQ ID NO: 2104045 - protein, 25 aa, Staphylococcus
IMTVVCVVIIFAFVRNEFVDRFNPF

SEQ ID NO: 2104046 - protein, 18 aa, Staphylococcus
IMVLAFMVVLAGCGKGES

SEQ ID NO: 2104047 - protein, 18 aa, Staphylococcus
IMVMFVLAGCGTENDEAK

SEQ ID NO: 2104048 - protein, 17 aa, Staphylococcus
IMYWKDAVEEIRRNNPE

SEQ ID NO: 2104049 - protein, 23 aa, Staphylococcus
INDLKFDLEHEMEMGIFQSIIEY

SEQ ID NO: 2104050 - protein, 22 aa, Staphylococcus
INEKNPDVILAMDRGQAIGEKS

SEQ ID NO: 2104051 - protein, 18 aa, Staphylococcus
INGVIGFAGKAAYNSAKH

SEQ ID NO: 2104052 - protein, 20 aa, Staphylococcus
INHAYAYGGPTMAVKSLEKL

SEQ ID NO: 2104053 - protein, 21 aa, Staphylococcus
INIYTTVFAFESFTKQIGGKY

SEQ ID NO: 2104054 - protein, 18 aa, Staphylococcus
INKISALMSSEPTSYGDP

SEQ ID NO: 2104055 - protein, 18 aa, Staphylococcus
INKKGRLPDGASLDDITL

SEQ ID NO: 2104056 - protein, 25 aa, Staphylococcus
INKTYKINPGEVIYTVPWGTSSQKA

SEQ ID NO: 2104057 - protein, 23 aa, Staphylococcus
INKWKKIDQVSALLPSSTAKKYN

SEQ ID NO: 2104058 - protein, 23 aa, Staphylococcus
INLRKNAKWSNGDPVTADDFVYA

SEQ ID NO: 2104059 - protein, 21 aa, Staphylococcus
INLYKISGFRSYQTQIQLFNN

SEQ ID NO: 2104060 - protein, 25 aa, Staphylococcus
INNEEKLIFWNPWDTDLSIQDADSN

SEQ ID NO: 2104061 - protein, 17 aa, Staphylococcus
INNQAYWFITINANEKD

SEQ ID NO: 2104062 - protein, 17 aa, Staphylococcus
INNQAYWFITINASEKD

SEQ ID NO: 2104063 - protein, 17 aa, Staphylococcus
INNYADYAATNLQYYGL

SEQ ID NO: 2104064 - protein, 25 aa, Staphylococcus
INVSEMNYGQGAGVVTSRTISASEA

SEQ ID NO: 2104065 - protein, 22 aa, Staphylococcus
INYAKERYGSIGNAISFREANG

SEQ ID NO: 2104066 - protein, 20 aa, Staphylococcus
INYANSRYGSLSNAIAFRQS

SEQ ID NO: 2104067 - protein, 19 aa, Staphylococcus
INYANSRYGSLSNATAFRA

SEQ ID NO: 2104068 - protein, 25 aa, Staphylococcus
INYQLKVPLIKAYMGMESDIFNFYA

SEQ ID NO: 2104069 - protein, 21 aa, Staphylococcus
IPAAGLGTRFLPATKAMPKEM

SEQ ID NO: 2104070 - protein, 17 aa, Staphylococcus
IPATGFVITGHVGEKNF

SEQ ID NO: 2104071 - protein, 27 aa, Staphylococcus
IPAYESAGAGGLKIIKVFKSSGKVTFE

SEQ ID NO: 2104072 - protein, 20 aa, Staphylococcus
IPFFGICLGMQLATVEYARN

SEQ ID NO: 2104073 - protein, 25 aa, Staphylococcus
IPKDPKRIVVLGATYAGGLKELDAN

SEQ ID NO: 2104074 - protein, 17 aa, Staphylococcus
IPKFIAPAMNVHMYENK

SEQ ID NO: 2104075 - protein, 25 aa, Staphylococcus
IPMIEMMHGVYYIKGGMYSFDKGLH

SEQ ID NO: 2104076 - protein, 18 aa, Staphylococcus
IPNKAAYLTIKRIGKDKA

SEQ ID NO: 2104077 - protein, 26 aa, Staphylococcus
IPSNTEILYRLGLGKNIIGVSTVDDY

SEQ ID NO: 2104078 - protein, 17 aa, Staphylococcus
IPTLDEILERYGTSANY

SEQ ID NO: 2104079 - protein, 21 aa, Staphylococcus
IPVTASALLLGACGSDSTDSK

SEQ ID NO: 2104080 - protein, 22 aa, Staphylococcus
IPVTASALLLGACGSNAADSKD

SEQ ID NO: 2104081 - protein, 17 aa, Staphylococcus
IPYKVEKGESIYQVDIS

SEQ ID NO: 2104082 - protein, 20 aa, Staphylococcus
IPYRFNEEIDDIDGSIVHFK

SEQ ID NO: 2104083 - protein, 24 aa, Staphylococcus
IQALCTTVLAPLGIYSDKIKNIKD

SEQ ID NO: 2104084 - protein, 17 aa, Staphylococcus
IQDLFMNDYLRVYTNND

SEQ ID NO: 2104085 - protein, 24 aa, Staphylococcus
IQEGAYNVTFDYEGFTYHFESDGT

SEQ ID NO: 2104086 - protein, 22 aa, Staphylococcus
IQHVKELRDIIINANLKNESVY

SEQ ID NO: 2104087 - protein, 17 aa, Staphylococcus
IQMFMRSYTGSANWETD

SEQ ID NO: 2104088 - protein, 34 aa, Staphylococcus
IQSHNGRYEYLFSFKNPKQQGTYTIVSVNGQGQP

SEQ ID NO: 2104089 - protein, 23 aa, Staphylococcus
IQSSSPWPPQVQHTPGKWVNATK

SEQ ID NO: 2104090 - protein, 17 aa, Staphylococcus
IRFVKDNHLKHLLVETS

SEQ ID NO: 2104091 - protein, 24 aa, Staphylococcus
IRIDGGVMAYTWPGEMLSDDSWKK

SEQ ID NO: 2104092 - protein, 17 aa, Staphylococcus
IRKSELVFKNAPQGMKF

SEQ ID NO: 2104093 - protein, 25 aa, Staphylococcus
IRQGFERFDTLVLTGGLGPTKDDLT

SEQ ID NO: 2104094 - protein, 19 aa, Staphylococcus
IRRILKCHPFHKGGFDPVP

SEQ ID NO: 2104095 - protein, 25 aa, Staphylococcus
IRTTEQLRLIGIIPEEVKTNGEPPE

SEQ ID NO: 2104096 - protein, 19 aa, Staphylococcus
IRTTVFAPLGIYSKKIKDI

SEQ ID NO: 2104097 - protein, 26 aa, Staphylococcus
ISDNELKKSIKIYLDKNEELSEASEY

SEQ ID NO: 2104098 - protein, 25 aa, Staphylococcus
ISDYNGNTSRGWVPASEISVKTTTP

SEQ ID NO: 2104099 - protein, 17 aa, Staphylococcus
ISEALLRSNAPKLYVSN

SEQ ID NO: 2104100 - protein, 25 aa, Staphylococcus
ISESNIKGLGIVSYRTIDADAATEL

SEQ ID NO: 2104101 - protein, 24 aa, Staphylococcus
ISHKYGISIAKLKSLNGLTSNLIF

SEQ ID NO: 2104102 - protein, 17 aa, Staphylococcus
ISISKLKSLNHLSSNII

SEQ ID NO: 2104103 - protein, 17 aa, Staphylococcus
ISKQFWSHLVKAGHIEN

SEQ ID NO: 2104104 - protein, 17 aa, Staphylococcus
ISKQFWSHLVKNKSISN

SEQ ID NO: 2104105 - protein, 23 aa, Staphylococcus
ISLEVLENLYARGLDVTLIHRSE

SEQ ID NO: 2104106 - protein, 17 aa, Staphylococcus
ISLMIIITTASLGMLST

SEQ ID NO: 2104107 - protein, 17 aa, Staphylococcus
ISSLFHFDDDISKYEHV

SEQ ID NO: 2104108 - protein, 17 aa, Staphylococcus
ISSLGVGAGEGQSLPAM

SEQ ID NO: 2104109 - protein, 20 aa, Staphylococcus
ISTIFLLAACNNNQKDNQSD

SEQ ID NO: 2104110 - protein, 17 aa, Staphylococcus
ISVLIILGIVKTFQDHD

SEQ ID NO: 2104111 - protein, 17 aa, Staphylococcus
ITAKPQYSLSFIGEQQP

SEQ ID NO: 2104112 - protein, 24 aa, Staphylococcus
ITDPTKAKGIIFLPEHLSQKQRWS

SEQ ID NO: 2104113 - protein, 23 aa, Staphylococcus
ITEKYIRMSGMKKTFENVNEAKK

SEQ ID NO: 2104114 - protein, 24 aa, Staphylococcus
ITGHYRNGILLSPIIGELMAEWLK

SEQ ID NO: 2104115 - protein, 21 aa, Staphylococcus
ITGYQYEPWHLRYLGKDTATK

SEQ ID NO: 2104116 - protein, 20 aa, Staphylococcus
ITHAHAYGGPIAAMDSVEAT

SEQ ID NO: 2104117 - protein, 19 aa, Staphylococcus
ITHYTLKPKVNGITAEDSA

SEQ ID NO: 2104118 - protein, 19 aa, Staphylococcus
ITIALPISQCAQAASYVVN

SEQ ID NO: 2104119 - protein, 25 aa, Staphylococcus
ITIDEAKSIAFNSEDILNFTQNKDE

SEQ ID NO: 2104120 - protein, 19 aa, Staphylococcus
ITIPGVLPLGNIKAKSIIT

SEQ ID NO: 2104121 - protein, 22 aa, Staphylococcus
ITKKDPEIILAMDRGSVVGGKS

SEQ ID NO: 2104122 - protein, 18 aa, Staphylococcus
ITKNVGYDIYVRKGTTCF

SEQ ID NO: 2104123 - protein, 23 aa, Staphylococcus
ITKYPGNADLAIVKFSPNDKNQN

SEQ ID NO: 2104124 - protein, 18 aa, Staphylococcus
ITLGVFILLIGALMLVGK

SEQ ID NO: 2104125 - protein, 23 aa, Staphylococcus
ITLIGVLFILAAIYLFAKPHIDQ

SEQ ID NO: 2104126 - protein, 18 aa, Staphylococcus
ITPGEFIAGATADDDKTK

SEQ ID NO: 2104127 - protein, 18 aa, Staphylococcus
ITPGEFIAGATADDGQTK

SEQ ID NO: 2104128 - protein, 19 aa, Staphylococcus
ITPKLMLQGSVDLLNEVST

SEQ ID NO: 2104129 - protein, 24 aa, Staphylococcus
ITRHKAKRALVVGAGYISLEVLEN

SEQ ID NO: 2104130 - protein, 18 aa, Staphylococcus
ITRIASSSPEMWRDIMHE

SEQ ID NO: 2104131 - protein, 20 aa, Staphylococcus
ITSAALFFGMNHVASADQIH

SEQ ID NO: 2104132 - protein, 22 aa, Staphylococcus
ITSEGAFKYFSKAFDIKPGYIW

SEQ ID NO: 2104133 - protein, 22 aa, Staphylococcus
ITSEGAFKYFSKQFNIHSGYIW

SEQ ID NO: 2104134 - protein, 19 aa, Staphylococcus
ITSEGAFKYFSKQYGITPG

SEQ ID NO: 2104135 - protein, 17 aa, Staphylococcus
ITSIVLLTACGNNNDNK

SEQ ID NO: 2104136 - protein, 20 aa, Staphylococcus
ITSLMILTACGNGNDKNSQS

SEQ ID NO: 2104137 - protein, 32 aa, Staphylococcus
ITTYDLLFRSGFEPDVDFVIRVGKPVISKKLN

SEQ ID NO: 2104138 - protein, 23 aa, Staphylococcus
ITVKKGNQVIGTFIKNNTGKWTK

SEQ ID NO: 2104139 - protein, 32 aa, Staphylococcus
ITVNAYCPGVAKTEMWDRIDAEMVKLDSNLKP

SEQ ID NO: 2104140 - protein, 24 aa, Staphylococcus
ITVPVKHVIYNVIASPKYTIQGQD

SEQ ID NO: 2104141 - protein, 20 aa, Staphylococcus
IVAASTILLAGCTTDKKEVK

SEQ ID NO: 2104142 - protein, 23 aa, Staphylococcus
IVAIAKGKGAAFLPSSLSEFKND

SEQ ID NO: 2104143 - protein, 17 aa, Staphylococcus
IVALLFALVLVTACGNV

SEQ ID NO: 2104144 - protein, 22 aa, Staphylococcus
IVALVLLVFAIRAVKVEPVEAM

SEQ ID NO: 2104145 - protein, 20 aa, Staphylococcus
IVEAISRLLKRPAQPNPEWS

SEQ ID NO: 2104146 - protein, 18 aa, Staphylococcus
IVEFSDGTTITIPKGKDG

SEQ ID NO: 2104147 - protein, 24 aa, Staphylococcus
IVEKLNEKWAKDHPNATISSGQAG

SEQ ID NO: 2104148 - protein, 18 aa, Staphylococcus
IVGGAQFIGQSYVKAGQN

SEQ ID NO: 2104149 - protein, 22 aa, Staphylococcus
IVGLGVSSVGFISHSADAAENT

SEQ ID NO: 2104150 - protein, 19 aa, Staphylococcus
IVIRRLGLDAKYDTQLDEW

SEQ ID NO: 2104151 - protein, 17 aa, Staphylococcus
IVKNMKQPDIIGVTEVQ

SEQ ID NO: 2104152 - protein, 19 aa, Staphylococcus
IVLCACQFSTLSSSKKDTK

SEQ ID NO: 2104153 - protein, 25 aa, Staphylococcus
IVLCISIALSACSTGQYSDAKKKDV

SEQ ID NO: 2104154 - protein, 22 aa, Staphylococcus
IVLSGCSLPGLGDGDGKDSVKI

SEQ ID NO: 2104155 - protein, 24 aa, Staphylococcus
IVLTNCLKSYDFNEALERYDKLRV

SEQ ID NO: 2104156 - protein, 20 aa, Staphylococcus
IVLTSTVLLAGCTTDKKEIK

SEQ ID NO: 2104157 - protein, 19 aa, Staphylococcus
IVLVLCLTVLSGCSLPGLG

SEQ ID NO: 2104158 - protein, 19 aa, Staphylococcus
IVNMKGHDQAVISLLNGDV

SEQ ID NO: 2104159 - protein, 25 aa, Staphylococcus
IVNRLPKSMPQYHIGHMTQIRNIQN

SEQ ID NO: 2104160 - protein, 23 aa, Staphylococcus
IVNRLPKSMPQYHVGHIKNIKII

SEQ ID NO: 2104161 - protein, 24 aa, Staphylococcus
IVNRLPKSMPQYHVGHIKQIRKIQ

SEQ ID NO: 2104162 - protein, 27 aa, Staphylococcus
IVNRLPKSMPQYHVGHIQRIRDIQAHI

SEQ ID NO: 2104163 - protein, 18 aa, Staphylococcus
IYAANKGTPFALPNTPWK

SEQ ID NO: 2104164 - protein, 18 aa, Staphylococcus
IYDLTPLKTFVFGRTVLL

SEQ ID NO: 2104165 - protein, 26 aa, Staphylococcus
IYDVPMHFTGHDWNSAGFNKSETQRI

SEQ ID NO: 2104166 - protein, 25 aa, Staphylococcus
IYGDFKCPYCKKVEKNVMPKLKEKY

SEQ ID NO: 2104167 - protein, 21 aa, Staphylococcus
IYGDGDGRTFTALSGANDVVA

SEQ ID NO: 2104168 - protein, 19 aa, Staphylococcus
IYGQLKLAGIDYKETIEQL

SEQ ID NO: 2104169 - protein, 22 aa, Staphylococcus
IYGTVNNLTGWVSLSKLTAPST

SEQ ID NO: 2104170 - protein, 31 aa, Staphylococcus
IYKRYEIARKYFLERTFRKPSDFYNLTSLVQ

SEQ ID NO: 2104171 - protein, 18 aa, Staphylococcus
IYLFAKPHIDSYLHDKDN

SEQ ID NO: 2104172 - protein, 19 aa, Staphylococcus
IYLIAHALIETGNGQSQLA

SEQ ID NO: 2104173 - protein, 18 aa, Staphylococcus
IYLIAHALLETGNGQSKL

SEQ ID NO: 2104174 - protein, 19 aa, Staphylococcus
IYLISHALIETGNGTSDLA

SEQ ID NO: 2104175 - protein, 18 aa, Staphylococcus
IYLISHALLETGNGQSQL

SEQ ID NO: 2104176 - protein, 18 aa, Staphylococcus
IYPIFPIPERERFLEQLK

SEQ ID NO: 2104177 - protein, 18 aa, Staphylococcus
IYPIFPLPERQKFFTQLK

SEQ ID NO: 2104178 - protein, 18 aa, Staphylococcus
IYPSHWSNGDFGLDAPDT

SEQ ID NO: 2104179 - protein, 18 aa, Staphylococcus
IYSDGEHPFTYDGQPIQV

SEQ ID NO: 2104180 - protein, 19 aa, Staphylococcus
IYTIKDLLTQAALPSSNSA

SEQ ID NO: 2104181 - protein, 24 aa, Staphylococcus
KAAEKEWRENDGLVSVISSQHPFN

SEQ ID NO: 2104182 - protein, 18 aa, Staphylococcus
KAALKEQVNQAGLVPSVD

SEQ ID NO: 2104183 - protein, 20 aa, Staphylococcus
KADEKEWRENDGLVSTISAQ

SEQ ID NO: 2104184 - protein, 24 aa, Staphylococcus
KADKRELISAKNHLDDPISTDGKT

SEQ ID NO: 2104185 - protein, 18 aa, Staphylococcus
KAESDLHHLAPQVRGVVG

SEQ ID NO: 2104186 - protein, 19 aa, Staphylococcus
KAHASNEITEEGKLGNKDG

SEQ ID NO: 2104187 - protein, 18 aa, Staphylococcus
KAIGRVSNLNGWKKGSRD

SEQ ID NO: 2104188 - protein, 21 aa, Staphylococcus
KAKEKEWRENDGLVSVISSQH

SEQ ID NO: 2104189 - protein, 20 aa, Staphylococcus
KAKKRPINFQQYHLTEDVHE

SEQ ID NO: 2104190 - protein, 23 aa, Staphylococcus
KAKNSFSNLDGWQKVSKEAIIKK

SEQ ID NO: 2104191 - protein, 18 aa, Staphylococcus
KAKPEVIFISGRTANQKN

SEQ ID NO: 2104192 - protein, 19 aa, Staphylococcus
KAKPILKKEGYDLKIKTIN

SEQ ID NO: 2104193 - protein, 17 aa, Staphylococcus
KAKQWIKDWDKQMADDK

SEQ ID NO: 2104194 - protein, 23 aa, Staphylococcus
KAKYSINVSPFISKALNNYKNQK

SEQ ID NO: 2104195 - protein, 18 aa, Staphylococcus
KALLQNKADNHELVQAKN

SEQ ID NO: 2104196 - protein, 17 aa, Staphylococcus
KAMKVGEPRPKYQDVKL

SEQ ID NO: 2104197 - protein, 17 aa, Staphylococcus
KANELKANNVVNESAKV

SEQ ID NO: 2104198 - protein, 19 aa, Staphylococcus
KANENLGLNPSHQGETNPT

SEQ ID NO: 2104199 - protein, 26 aa, Staphylococcus
KANGDGLYGYDVGKGHIVFYVSNGYV

SEQ ID NO: 2104200 - protein, 19 aa, Staphylococcus
KAQIKQAFINANRSQLQLS

SEQ ID NO: 2104201 - protein, 26 aa, Staphylococcus
KAQPATAYKHNYIIANAGSNYYNAPN

SEQ ID NO: 2104202 - protein, 20 aa, Staphylococcus
KAQQVDPDFSRRHATEKATH

SEQ ID NO: 2104203 - protein, 19 aa, Staphylococcus
KAQTPWYSYEGYTTYDPSF

SEQ ID NO: 2104204 - protein, 18 aa, Staphylococcus
KAVKNGRVEVVNGDEVSR

SEQ ID NO: 2104205 - protein, 25 aa, Staphylococcus
KAYGFKFKTVRPMQIGLVYDALKNK

SEQ ID NO: 2104206 - protein, 18 aa, Staphylococcus
KAYNEKGWLNESGAKYPV

SEQ ID NO: 2104207 - protein, 17 aa, Staphylococcus
KCKSLKVHGKKNVPQLH

SEQ ID NO: 2104208 - protein, 20 aa, Staphylococcus
KCLITTFLIVSSLLLAFSTI

SEQ ID NO: 2104209 - protein, 23 aa, Staphylococcus
KDAKRVVALEFSFVDALAALNVK

SEQ ID NO: 2104210 - protein, 25 aa, Staphylococcus
KDASKLLQIDGYYFEEVRRDHIYQS

SEQ ID NO: 2104211 - protein, 18 aa, Staphylococcus
KDDGYRFIEPGDGFLACG

SEQ ID NO: 2104212 - protein, 18 aa, Staphylococcus
KDDKDFGKSVDWTIQGTD

SEQ ID NO: 2104213 - protein, 22 aa, Staphylococcus
KDDLRLGTDSTWVKRAGDGYPA

SEQ ID NO: 2104214 - protein, 27 aa, Staphylococcus
KDDTLKYQFLCLDRPQNLSVASLNQLL

SEQ ID NO: 2104215 - protein, 18 aa, Staphylococcus
KDEKAFKGVKGVTYKVDY

SEQ ID NO: 2104216 - protein, 22 aa, Staphylococcus
KDEVLYWKDVVEEIRRNNPELE

SEQ ID NO: 2104217 - protein, 20 aa, Staphylococcus
KDEWIKAFLQGYGKPTNSLI

SEQ ID NO: 2104218 - protein, 17 aa, Staphylococcus
KDEYGLEPKQLIDVKAF

SEQ ID NO: 2104219 - protein, 19 aa, Staphylococcus
KDGDTLYQIALSHHLSLEQ

SEQ ID NO: 2104220 - protein, 21 aa, Staphylococcus
KDGKPLIVIYGDFKCPYCKKV

SEQ ID NO: 2104221 - protein, 23 aa, Staphylococcus
KDGKVKPLLVKSFKQKSDDTLTL

SEQ ID NO: 2104222 - protein, 21 aa, Staphylococcus
KDGSLGYVIKGQMVKPFDKEL

SEQ ID NO: 2104223 - protein, 17 aa, Staphylococcus
KDGSLGYVVKGQMEDKF

SEQ ID NO: 2104224 - protein, 18 aa, Staphylococcus
KDGYWYGFSGSALGISYN

SEQ ID NO: 2104225 - protein, 19 aa, Staphylococcus
KDIQRDAVFLVRPDGYISV

SEQ ID NO: 2104226 - protein, 18 aa, Staphylococcus
KDIRSIEVNSDMSDVTIK

SEQ ID NO: 2104227 - protein, 23 aa, Staphylococcus
KDKAEQIYYLALTQYLTQNSEFS

SEQ ID NO: 2104228 - protein, 18 aa, Staphylococcus
KDKLVLYAAGPDDLVKDM

SEQ ID NO: 2104229 - protein, 17 aa, Staphylococcus
KDKSEVYTQTYTPISGY

SEQ ID NO: 2104230 - protein, 18 aa, Staphylococcus
KDKSKWHLAINSKGKVYV

SEQ ID NO: 2104231 - protein, 20 aa, Staphylococcus
KDKYKKHDDYAAAYRNILDK

SEQ ID NO: 2104232 - protein, 23 aa, Staphylococcus
KDLLKPTLAKFIFTDANEHDFVT

SEQ ID NO: 2104233 - protein, 24 aa, Staphylococcus
KDLSGAMDKIRNGYQSKDAKQIKK

SEQ ID NO: 2104234 - protein, 19 aa, Staphylococcus
KDLYFAGASTHPGAGVPIV

SEQ ID NO: 2104235 - protein, 19 aa, Staphylococcus
KDNGFYDLTREGATNLNRQ

SEQ ID NO: 2104236 - protein, 25 aa, Staphylococcus
KDNLKDFYSNLAIPPEQVARTIQFA

SEQ ID NO: 2104237 - protein, 20 aa, Staphylococcus
KDQKRLSAYQKELLNDKIKV

SEQ ID NO: 2104238 - protein, 26 aa, Staphylococcus
KDRRAMITSEGAFKYFSKQYDIKPGY

SEQ ID NO: 2104239 - protein, 25 aa, Staphylococcus
KDTERWKKEVTPIIGKTDLFIFPHG

SEQ ID NO: 2104240 - protein, 27 aa, Staphylococcus
KDVDGILVPGGFGFRASEGKIAAIKYA

SEQ ID NO: 2104241 - protein, 25 aa, Staphylococcus
KDVDGILVPGGFGYRASEGKISAIR

SEQ ID NO: 2104242 - protein, 17 aa, Staphylococcus
KDYDFIIIRGQYGSEYV

SEQ ID NO: 2104243 - protein, 24 aa, Staphylococcus
KDYGFKFDSARPMQIGLVYDALKN

SEQ ID NO: 2104244 - protein, 25 aa, Staphylococcus
KDYVWNPDAIHSMKHSGSYMTKQIA

SEQ ID NO: 2104245 - protein, 21 aa, Staphylococcus
KEALLKAKSDLILAHESQKSS

SEQ ID NO: 2104246 - protein, 27 aa, Staphylococcus
KEFQKDPVWKKLDAVKHNRVDVVDRDL

SEQ ID NO: 2104247 - protein, 19 aa, Staphylococcus
KEGAYRFMNFLLDEKNNKQ

SEQ ID NO: 2104248 - protein, 20 aa, Staphylococcus
KEGKALFKKHKALENAKGVD

SEQ ID NO: 2104249 - protein, 24 aa, Staphylococcus
KEGLNIIYRSGFRSYAEQTQLYNS

SEQ ID NO: 2104250 - protein, 25 aa, Staphylococcus
KEGQWIARNAHRYGFIIRYPKGKEQ

SEQ ID NO: 2104251 - protein, 19 aa, Staphylococcus
KEGSNLWFDNMVIPKTAQN

SEQ ID NO: 2104252 - protein, 20 aa, Staphylococcus
KEGSNLWFDNMVIPKTAQNK

SEQ ID NO: 2104253 - protein, 20 aa, Staphylococcus
KEGSNLWFDNMVMPKTAQNK

SEQ ID NO: 2104254 - protein, 24 aa, Staphylococcus
KEHSDAVIVSAHWGNENHTMPNEK

SEQ ID NO: 2104255 - protein, 20 aa, Staphylococcus
KEIAKVWLAGLPDYQNKNVP

SEQ ID NO: 2104256 - protein, 19 aa, Staphylococcus
KEIIPSYGQSLIEDYALLK

SEQ ID NO: 2104257 - protein, 17 aa, Staphylococcus
KEINEEFEISKQFWAHL

SEQ ID NO: 2104258 - protein, 17 aa, Staphylococcus
KEINEEFEISKQFWGHL

SEQ ID NO: 2104259 - protein, 24 aa, Staphylococcus
KEINPTHVAVCWDMGQQTFRNEMF

SEQ ID NO: 2104260 - protein, 20 aa, Staphylococcus
KEIQPNWNIKLFERLDGPAL

SEQ ID NO: 2104261 - protein, 23 aa, Staphylococcus
KEIRDHLSTYLKQQGVNIITNSE

SEQ ID NO: 2104262 - protein, 21 aa, Staphylococcus
KEKEQQAIVNFVKRGGSVIFI

SEQ ID NO: 2104263 - protein, 18 aa, Staphylococcus
KEKFKSLLKETLPFHKSL

SEQ ID NO: 2104264 - protein, 25 aa, Staphylococcus
KEKQLAIIERRAQKIINDKYLSNRA

SEQ ID NO: 2104265 - protein, 18 aa, Staphylococcus
KELGIPVKVHVATNYNAM

SEQ ID NO: 2104266 - protein, 20 aa, Staphylococcus
KELSKILNIKGRVIPSTNSS

SEQ ID NO: 2104267 - protein, 21 aa, Staphylococcus
KELSKVLNIKGKVIPSTNSSV

SEQ ID NO: 2104268 - protein, 25 aa, Staphylococcus
KEMGVRLTPILGWAERGGASASGHG

SEQ ID NO: 2104269 - protein, 24 aa, Staphylococcus
KENAKLSDVAALFATTTNEIKNLN

SEQ ID NO: 2104270 - protein, 24 aa, Staphylococcus
KENCPDLRNTKVIDIIRELEEYGI

SEQ ID NO: 2104271 - protein, 21 aa, Staphylococcus
KENNDLVVVNVDWGITNERSV

SEQ ID NO: 2104272 - protein, 27 aa, Staphylococcus
KEPEQKSDGSWGFSFDDKDGNLAGSYV

SEQ ID NO: 2104273 - protein, 28 aa, Staphylococcus
KEPEQKSDGSWGFSFVDKSGKLAGSYIV

SEQ ID NO: 2104274 - protein, 17 aa, Staphylococcus
KEQAIKVANAMKRDGWT

SEQ ID NO: 2104275 - protein, 17 aa, Staphylococcus
KERGVAVEQVLEDVLYP

SEQ ID NO: 2104276 - protein, 20 aa, Staphylococcus
KESKARGVLQDNMANSYNGD

SEQ ID NO: 2104277 - protein, 21 aa, Staphylococcus
KESKDGMYYTFHEYKTQRDYK

SEQ ID NO: 2104278 - protein, 20 aa, Staphylococcus
KESKWQEPAYIVIENSEEKP

SEQ ID NO: 2104279 - protein, 21 aa, Staphylococcus
KESTLYKGPYDAFRKDFSHKI

SEQ ID NO: 2104280 - protein, 17 aa, Staphylococcus
KESVINFRPLNNVENHI

SEQ ID NO: 2104281 - protein, 20 aa, Staphylococcus
KETIEQLSLVYYDEKEEKWK

SEQ ID NO: 2104282 - protein, 27 aa, Staphylococcus
KETYLHGSINHQWGWIKQSDVATPAKS

SEQ ID NO: 2104283 - protein, 26 aa, Staphylococcus
KEVDFKLRKALIEQKGLYKGQYSDGK

SEQ ID NO: 2104284 - protein, 28 aa, Staphylococcus
KEVIPSNYTLASFNAYKKLKAQAQTILD

SEQ ID NO: 2104285 - protein, 23 aa, Staphylococcus
KEWREYDYLFLTFGTFSYHDPYH

SEQ ID NO: 2104286 - protein, 17 aa, Staphylococcus
KEYGIDFDTVRPMQIGL

SEQ ID NO: 2104287 - protein, 17 aa, Staphylococcus
KEYPGSYRYGFYSNGQE

SEQ ID NO: 2104288 - protein, 25 aa, Staphylococcus
KEYVWNPDAIHKMKHSGSYMTEQIA

SEQ ID NO: 2104289 - protein, 23 aa, Staphylococcus
KEYWGPKGRIGIVPMLDNKAYWF

SEQ ID NO: 2104290 - protein, 20 aa, Staphylococcus
KFAKEWMEFLKSKKAKNILK

SEQ ID NO: 2104291 - protein, 18 aa, Staphylococcus
KFDFLFVSDSLYLDNKTH

SEQ ID NO: 2104292 - protein, 20 aa, Staphylococcus
KFKKDGYDLVSNKTQLLNSQ

SEQ ID NO: 2104293 - protein, 18 aa, Staphylococcus
KFKNAYVPDREVKIHTNP

SEQ ID NO: 2104294 - protein, 17 aa, Staphylococcus
KFLALLATLTLAIVLSA

SEQ ID NO: 2104295 - protein, 23 aa, Staphylococcus
KFPKQCAYFNNLFFVGGSVNPGG

SEQ ID NO: 2104296 - protein, 17 aa, Staphylococcus
KFPPKSVWISFDDMEQS

SEQ ID NO: 2104297 - protein, 17 aa, Staphylococcus
KFSICKYTVGAFSTVIA

SEQ ID NO: 2104298 - protein, 36 aa, Staphylococcus
KFSIRKYTVGTFSTVIATLVFLGFNASHVQADELSV

SEQ ID NO: 2104299 - protein, 28 aa, Staphylococcus
KFTFGASSILIGSLLFLGVGTAQAAEED

SEQ ID NO: 2104300 - protein, 21 aa, Staphylococcus
KGDQYDVIFLFTKSMQLSDML

SEQ ID NO: 2104301 - protein, 19 aa, Staphylococcus
KGDYLGAIAKKFNTTVSKI

SEQ ID NO: 2104302 - protein, 25 aa, Staphylococcus
KGEPRSVKLIDQFGITKDDNKKDGN

SEQ ID NO: 2104303 - protein, 26 aa, Staphylococcus
KGFQEFMKFVLKDEGKSAEDAGYVAL

SEQ ID NO: 2104304 - protein, 24 aa, Staphylococcus
KGILEGQGAAFAQAAQKYDINEIY

SEQ ID NO: 2104305 - protein, 18 aa, Staphylococcus
KGIMAFSNHMGRGTEIIY

SEQ ID NO: 2104306 - protein, 17 aa, Staphylococcus
KGISEALLRSNAPKLYV

SEQ ID NO: 2104307 - protein, 25 aa, Staphylococcus
KGKIYVKIQSSWGAFINVIGNQSWG

SEQ ID NO: 2104308 - protein, 21 aa, Staphylococcus
KGNGSFLIKEQFIKAVKSNNV

SEQ ID NO: 2104309 - protein, 21 aa, Staphylococcus
KGNPEEVKYQKKHGGDISPLY

SEQ ID NO: 2104310 - protein, 27 aa, Staphylococcus
KGNRLFYLAMAPQFFGIISDYLKSSGL

SEQ ID NO: 2104311 - protein, 19 aa, Staphylococcus
KGNSALALNYHRIRDDNWF

SEQ ID NO: 2104312 - protein, 19 aa, Staphylococcus
KGPSIVMIPEVYKAVFEES

SEQ ID NO: 2104313 - protein, 22 aa, Staphylococcus
KGQCTWWAYQRRAQLGKPVSNR

SEQ ID NO: 2104314 - protein, 23 aa, Staphylococcus
KGQFKQFRHGLSSFIEALAENVQ

SEQ ID NO: 2104315 - protein, 23 aa, Staphylococcus
KGQFKQFRHGLSSFIEALAKNVE

SEQ ID NO: 2104316 - protein, 23 aa, Staphylococcus
KGQFKQFRHGLSSFIEALAKNVQ

SEQ ID NO: 2104317 - protein, 23 aa, Staphylococcus
KGQFKQFRHGLSSFIEALEQAVK

SEQ ID NO: 2104318 - protein, 17 aa, Staphylococcus
KGQSELGQVNLSDNQTT

SEQ ID NO: 2104319 - protein, 24 aa, Staphylococcus
KGTHGRPGSISVVGKIIDKGNYYK

SEQ ID NO: 2104320 - protein, 24 aa, Staphylococcus
KGTPFALPNTPWKPLRASDSKGIA

SEQ ID NO: 2104321 - protein, 29 aa, Staphylococcus
KGVKAFGPTGRFGGFLNRDLGIKHADTAM

SEQ ID NO: 2104322 - protein, 17 aa, Staphylococcus
KGYKEGTELTGKYTKET

SEQ ID NO: 2104323 - protein, 25 aa, Staphylococcus
KHDQYGRDLVYVWLDKDHMYNKELV

SEQ ID NO: 2104324 - protein, 17 aa, Staphylococcus
KHGSKFSIKEKGNEDKK

SEQ ID NO: 2104325 - protein, 18 aa, Staphylococcus
KHHYILIDPHEAYDLKGK

SEQ ID NO: 2104326 - protein, 24 aa, Staphylococcus
KHIRSYAIGVGPDYTSLNAENTKH

SEQ ID NO: 2104327 - protein, 25 aa, Staphylococcus
KHNYPRLRIAGASFEAVGLPDCILQ

SEQ ID NO: 2104328 - protein, 26 aa, Staphylococcus
KHVIPNIRGIELFTVQGQPFPSGKGT

SEQ ID NO: 2104329 - protein, 18 aa, Staphylococcus
KHVKAIKSGHVYEVDPKL

SEQ ID NO: 2104330 - protein, 18 aa, Staphylococcus
KIDPEKDPISILFLGIDD

SEQ ID NO: 2104331 - protein, 18 aa, Staphylococcus
KIEVVFKNTGTYMFHCHI

SEQ ID NO: 2104332 - protein, 18 aa, Staphylococcus
KIGQKEKIYASVMMAQAI

SEQ ID NO: 2104333 - protein, 27 aa, Staphylococcus
KIGSAESLFKAGANGKVQKLLVDTYNQ

SEQ ID NO: 2104334 - protein, 18 aa, Staphylococcus
KIGSTWGNANNWASAAQA

SEQ ID NO: 2104335 - protein, 20 aa, Staphylococcus
KIIKRRIEYTKSQNNGYIMV

SEQ ID NO: 2104336 - protein, 18 aa, Staphylococcus
KIISPYALVDNFSKDYRL

SEQ ID NO: 2104337 - protein, 22 aa, Staphylococcus
KIKARGELRVGLSADYAPYEFE

SEQ ID NO: 2104338 - protein, 17 aa, Staphylococcus
KINPSINGNTYRVTKKA

SEQ ID NO: 2104339 - protein, 25 aa, Staphylococcus
KINSVDCARELNSYYVGNVKSNEVP

SEQ ID NO: 2104340 - protein, 18 aa, Staphylococcus
KINTTVFAFQSFAEQIGG

SEQ ID NO: 2104341 - protein, 17 aa, Staphylococcus
KIPIIAGGTGLYIQSLI

SEQ ID NO: 2104342 - protein, 20 aa, Staphylococcus
KIQPDLKWLTEKQRQEYNNL

SEQ ID NO: 2104343 - protein, 18 aa, Staphylococcus
KISAIRYARENNVPYFGI

SEQ ID NO: 2104344 - protein, 18 aa, Staphylococcus
KITFNYGGSGALRQQIEK

SEQ ID NO: 2104345 - protein, 24 aa, Staphylococcus
KITHAHAYGGAIAAMDSVEATMNV

SEQ ID NO: 2104346 - protein, 21 aa, Staphylococcus
KITHAHAYGGPIAAMDSVEAT

SEQ ID NO: 2104347 - protein, 25 aa, Staphylococcus
KKADVKVGDAIKVTGTVNEYAIDGY

SEQ ID NO: 2104348 - protein, 20 aa, Staphylococcus
KKAHKDAKIEAISTTVLAPL

SEQ ID NO: 2104349 - protein, 22 aa, Staphylococcus
KKALGKEKSLFSFINKDGATQD

SEQ ID NO: 2104350 - protein, 21 aa, Staphylococcus
KKANENLGLNPSHKGETDPEK

SEQ ID NO: 2104351 - protein, 21 aa, Staphylococcus
KKDGSLGYVIKGQMVDEFEKA

SEQ ID NO: 2104352 - protein, 21 aa, Staphylococcus
KKDGSLGYVIKGQMVDSFEKA

SEQ ID NO: 2104353 - protein, 17 aa, Staphylococcus
KKDGYDIVKNKSQMQNS

SEQ ID NO: 2104354 - protein, 18 aa, Staphylococcus
KKDQVILELSQKAQERKA

SEQ ID NO: 2104355 - protein, 21 aa, Staphylococcus
KKDVLKWANKQGEQHKRAVTN

SEQ ID NO: 2104356 - protein, 25 aa, Staphylococcus
KKELVKYSKSYRTLNQVVSLQQNAY

SEQ ID NO: 2104357 - protein, 18 aa, Staphylococcus
KKEYKTKNSDAWKEAEKQ

SEQ ID NO: 2104358 - protein, 26 aa, Staphylococcus
KKFHQKFFPSYGFDNTYAFMVTKETA

SEQ ID NO: 2104359 - protein, 21 aa, Staphylococcus
KKGDGIYSYQVGKGHIAFAIE

SEQ ID NO: 2104360 - protein, 20 aa, Staphylococcus
KKGETNFAFTDDRGTDSLDK

SEQ ID NO: 2104361 - protein, 17 aa, Staphylococcus
KKGIFEQIEEAFNEMAS

SEQ ID NO: 2104362 - protein, 23 aa, Staphylococcus
KKGIKAGLADRWKVDNSGKEYEF

SEQ ID NO: 2104363 - protein, 21 aa, Staphylococcus
KKGTMGYGYQQYMKKHPEKAK

SEQ ID NO: 2104364 - protein, 17 aa, Staphylococcus
KKGVNLGQISKMSDKEI

SEQ ID NO: 2104365 - protein, 27 aa, Staphylococcus
KKGVWQVMPVKHEWDHGDFVGSDGTEA

SEQ ID NO: 2104366 - protein, 24 aa, Staphylococcus
KKHSDAVIVSAHWGNEGHHKENKT

SEQ ID NO: 2104367 - protein, 21 aa, Staphylococcus
KKIAYLKATFKKASKISKDTN

SEQ ID NO: 2104368 - protein, 23 aa, Staphylococcus
KKIHVYRPPYMMYGDDETEGKAV

SEQ ID NO: 2104369 - protein, 20 aa, Staphylococcus
KKIKGMTIGLAMNSTYYYQK

SEQ ID NO: 2104370 - protein, 19 aa, Staphylococcus
KKIMTELAEEIGLGDDLIT

SEQ ID NO: 2104371 - protein, 19 aa, Staphylococcus
KKKAIKQVRKEINALKVKD

SEQ ID NO: 2104372 - protein, 19 aa, Staphylococcus
KKKSIYDVKEFVDLCNDSI

SEQ ID NO: 2104373 - protein, 21 aa, Staphylococcus
KKKVEAKRVDAPIQEDTTQYQ

SEQ ID NO: 2104374 - protein, 20 aa, Staphylococcus
KKLDVALGYSTDGRIAAYGL

SEQ ID NO: 2104375 - protein, 26 aa, Staphylococcus
KKLIYRGIKSTVHFNSSEILNADIKT

SEQ ID NO: 2104376 - protein, 25 aa, Staphylococcus
KKLSDAMSDIREGYNGKDKKKIQKG

SEQ ID NO: 2104377 - protein, 19 aa, Staphylococcus
KKLSYKLSFNGFDPEQEYV

SEQ ID NO: 2104378 - protein, 26 aa, Staphylococcus
KKLTEKEMDAHLKAYLKANNDIIDNK

SEQ ID NO: 2104379 - protein, 24 aa, Staphylococcus
KKLVKDYKSEILVKKNSGINSLKD

SEQ ID NO: 2104380 - protein, 17 aa, Staphylococcus
KKMTFIISPQWFSTHGV

SEQ ID NO: 2104381 - protein, 17 aa, Staphylococcus
KKQLTLITCDNYNEQTN

SEQ ID NO: 2104382 - protein, 17 aa, Staphylococcus
KKQRLVFDPETGDYLPV

SEQ ID NO: 2104383 - protein, 25 aa, Staphylococcus
KKQRREFEETLPPLSKNLEDEDADS

SEQ ID NO: 2104384 - protein, 18 aa, Staphylococcus
KKQYKTKNSDAWKKAEEQ

SEQ ID NO: 2104385 - protein, 19 aa, Staphylococcus
KKRAEVLIEDITKRGKVPI

SEQ ID NO: 2104386 - protein, 24 aa, Staphylococcus
KKTFKPGLAQKWEVEDGGKTYRFH

SEQ ID NO: 2104387 - protein, 17 aa, Staphylococcus
KKVDVGFLPPTAYTLAH

SEQ ID NO: 2104388 - protein, 18 aa, Staphylococcus
KKVDVGFLPPTAYTLAHD

SEQ ID NO: 2104389 - protein, 25 aa, Staphylococcus
KKYALQYKKRYPIVNNQVDQAIKQA

SEQ ID NO: 2104390 - protein, 24 aa, Staphylococcus
KKYKFSTPYTYSSAVLVVRENEKN

SEQ ID NO: 2104391 - protein, 19 aa, Staphylococcus
KKYNGGLSSGEMQTKTAIE

SEQ ID NO: 2104392 - protein, 17 aa, Staphylococcus
KKYTDKQLDEFLKGTEA

SEQ ID NO: 2104393 - protein, 18 aa, Staphylococcus
KLAAGGFRDITRITSSNA

SEQ ID NO: 2104394 - protein, 17 aa, Staphylococcus
KLDAVKHNRVDVLDRDL

SEQ ID NO: 2104395 - protein, 17 aa, Staphylococcus
KLDDHTYVLLSSTSGNT

SEQ ID NO: 2104396 - protein, 23 aa, Staphylococcus
KLDPHAWLSIENGIKYVKTIQDS

SEQ ID NO: 2104397 - protein, 19 aa, Staphylococcus
KLDSIKSAVEFIIQEEGRI

SEQ ID NO: 2104398 - protein, 26 aa, Staphylococcus
KLEKELKSHLPFHKSLKVTKRDADTY

SEQ ID NO: 2104399 - protein, 17 aa, Staphylococcus
KLEKNDKGFFLMVEGAS

SEQ ID NO: 2104400 - protein, 22 aa, Staphylococcus
KLEKNNNGFFLMVEGASIDKTA

SEQ ID NO: 2104401 - protein, 18 aa, Staphylococcus
KLFPIPGGSILGVPTNLK

SEQ ID NO: 2104402 - protein, 24 aa, Staphylococcus
KLHNNNIYPIARIVTFKDTKLAEE

SEQ ID NO: 2104403 - protein, 26 aa, Staphylococcus
KLIVILCAIIVFIALIGVSLRSQSQS

SEQ ID NO: 2104404 - protein, 25 aa, Staphylococcus
KLIVVFCAIIIFIALIGLSIRSQTQ

SEQ ID NO: 2104405 - protein, 25 aa, Staphylococcus
KLIVVFCAIIVFIALIGLSIRSSTQ

SEQ ID NO: 2104406 - protein, 26 aa, Staphylococcus
KLIVVFCAVIIFIALIGLSLRSHTQS

SEQ ID NO: 2104407 - protein, 25 aa, Staphylococcus
KLIVVLCAIIVFIALIGLSIRSQNQ

SEQ ID NO: 2104408 - protein, 25 aa, Staphylococcus
KLIVVLCAIIVFIALIGLSIRSQTQ

SEQ ID NO: 2104409 - protein, 20 aa, Staphylococcus
KLKDERIVGTAGGGMVAVTV

SEQ ID NO: 2104410 - protein, 21 aa, Staphylococcus
KLKDERIVGTAGGGMVAVTVT

SEQ ID NO: 2104411 - protein, 20 aa, Staphylococcus
KLKEERIVGTAGGGMVAVTV

SEQ ID NO: 2104412 - protein, 23 aa, Staphylococcus
KLKEINLAPSERKEIVIDLSKMK

SEQ ID NO: 2104413 - protein, 22 aa, Staphylococcus
KLKKDAKWSNGDPVTAQDFVYA

SEQ ID NO: 2104414 - protein, 19 aa, Staphylococcus
KLKKIAPTYVFDANQSSYK

SEQ ID NO: 2104415 - protein, 25 aa, Staphylococcus
KLLYSSVFALMIVGVLLIFQNVQAH

SEQ ID NO: 2104416 - protein, 24 aa, Staphylococcus
KLNAVFKDGEIVSGESSIPKRNKQ

SEQ ID NO: 2104417 - protein, 17 aa, Staphylococcus
KLQDNRMSDVINSTDIK

SEQ ID NO: 2104418 - protein, 22 aa, Staphylococcus
KLRNGVKMIVNQAVSAVDYLYE

SEQ ID NO: 2104419 - protein, 26 aa, Staphylococcus
KLRTKEFKPDFTAKVKPFKYNGKTYA

SEQ ID NO: 2104420 - protein, 21 aa, Staphylococcus
KLSALPAVITKTDIMAHSDKS

SEQ ID NO: 2104421 - protein, 24 aa, Staphylococcus
KLSTKERLALAFCIDGVDQYTLTK

SEQ ID NO: 2104422 - protein, 20 aa, Staphylococcus
KLTNGKYVWIKESDLTKELV

SEQ ID NO: 2104423 - protein, 19 aa, Staphylococcus
KLTQELRAKGYNVSEASVS

SEQ ID NO: 2104424 - protein, 22 aa, Staphylococcus
KLVKDYKSEILVKKDSGIKSLK

SEQ ID NO: 2104425 - protein, 22 aa, Staphylococcus
KLYSYGPNWGRGGEVLYQAFGL

SEQ ID NO: 2104426 - protein, 22 aa, Staphylococcus
KLYTYGPNWGRGGEVIYQAFGL

SEQ ID NO: 2104427 - protein, 18 aa, Staphylococcus
KMDVAIMSPVTYTIGRDK

SEQ ID NO: 2104428 - protein, 24 aa, Staphylococcus
KMNSPEFKDLSLLVDTMHQAGADV

SEQ ID NO: 2104429 - protein, 20 aa, Staphylococcus
KMPDLDRYAKQTSSGEDASG

SEQ ID NO: 2104430 - protein, 18 aa, Staphylococcus
KNDKGFFLMVEGASIDKA

SEQ ID NO: 2104431 - protein, 25 aa, Staphylococcus
KNDRYGRVLAYVWLDKDTLFNELLV

SEQ ID NO: 2104432 - protein, 24 aa, Staphylococcus
KNGKEIKVRMIGMDTPETVKPNTP

SEQ ID NO: 2104433 - protein, 19 aa, Staphylococcus
KNGKILIVEYGDFKCPYCK

SEQ ID NO: 2104434 - protein, 26 aa, Staphylococcus
KNHDPIILVHGFNGFTADNGPGLGDS

SEQ ID NO: 2104435 - protein, 24 aa, Staphylococcus
KNHDPIILVHGFNGFTDDINPAVL

SEQ ID NO: 2104436 - protein, 19 aa, Staphylococcus
KNHTAVVFEAGQSGASALY

SEQ ID NO: 2104437 - protein, 19 aa, Staphylococcus
KNIKGMTIGLAMNSEYYYQ

SEQ ID NO: 2104438 - protein, 21 aa, Staphylococcus
KNKDMRYAIAQSIDKKAYVDN

SEQ ID NO: 2104439 - protein, 23 aa, Staphylococcus
KNKESIGYFGYNFYKQNKDKLKE

SEQ ID NO: 2104440 - protein, 26 aa, Staphylococcus
KNLGGFPISGAFLVCKNPEVVKEHDA

SEQ ID NO: 2104441 - protein, 17 aa, Staphylococcus
KNLKASSTYYDKVASAV

SEQ ID NO: 2104442 - protein, 24 aa, Staphylococcus
KNLLDASSYYKAMAKESGATLYQN

SEQ ID NO: 2104443 - protein, 30 aa, Staphylococcus
KNNLYTAGQCTWYVYDKVNGAIGSTWGTAN

SEQ ID NO: 2104444 - protein, 36 aa, Staphylococcus
KNNTRIGESITVRANILFDGETTPIVKESSYMVVRT

SEQ ID NO: 2104445 - protein, 33 aa, Staphylococcus
KNPALKYQFLRLDRPQLLSVDRLNRLLKGKGML

SEQ ID NO: 2104446 - protein, 19 aa, Staphylococcus
KNPERIAVVAPTYAGGIKY

SEQ ID NO: 2104447 - protein, 19 aa, Staphylococcus
KNPKRIAVLHPTYVGALVK

SEQ ID NO: 2104448 - protein, 24 aa, Staphylococcus
KNPKYLPRFVFGHYMKSYLSNYET

SEQ ID NO: 2104449 - protein, 18 aa, Staphylococcus
KNSALALNYHRVRKNDPL

SEQ ID NO: 2104450 - protein, 17 aa, Staphylococcus
KNSDFGKSVDWTIQGTD

SEQ ID NO: 2104451 - protein, 21 aa, Staphylococcus
KNSDFGKSVDWTIQGTDARNG

SEQ ID NO: 2104452 - protein, 27 aa, Staphylococcus
KNSDNYQWYMHMNKLNVQQGQSVNAGD

SEQ ID NO: 2104453 - protein, 20 aa, Staphylococcus
KNSGNLFFIPYVFKDDKIYY

SEQ ID NO: 2104454 - protein, 24 aa, Staphylococcus
KNSKDTGMMTYEFDGSTVNIEIYH

SEQ ID NO: 2104455 - protein, 26 aa, Staphylococcus
KNTKEYFAKIWLTARNDADDIFYEED

SEQ ID NO: 2104456 - protein, 26 aa, Staphylococcus
KNTSKIWKTKDNAFYDLSREGTSKLN

SEQ ID NO: 2104457 - protein, 25 aa, Staphylococcus
KNTYPRLRITGAPFEAVGLPDCIQQ

SEQ ID NO: 2104458 - protein, 17 aa, Staphylococcus
KNVEEVIDKIHLKELDN

SEQ ID NO: 2104459 - protein, 25 aa, Staphylococcus
KNVKAKWNISKAMIKEGNGGSDETE

SEQ ID NO: 2104460 - protein, 19 aa, Staphylococcus
KPEFPDRNDDEWLKTTMAH

SEQ ID NO: 2104461 - protein, 17 aa, Staphylococcus
KPEFPDRNDEEWLKTTL

SEQ ID NO: 2104462 - protein, 20 aa, Staphylococcus
KPEFPERNDEEWLKTTLAEY

SEQ ID NO: 2104463 - protein, 19 aa, Staphylococcus
KPEFPERNDEEWLKTTMAH

SEQ ID NO: 2104464 - protein, 17 aa, Staphylococcus
KPEGAINAGGYDNAKVT

SEQ ID NO: 2104465 - protein, 30 aa, Staphylococcus
KPFESAQGFDYRYHIGDNIVQYIVEDGYVK

SEQ ID NO: 2104466 - protein, 17 aa, Staphylococcus
KPFIKTKLISPIGKLRA

SEQ ID NO: 2104467 - protein, 18 aa, Staphylococcus
KPITESFHSFKQRFGEGK

SEQ ID NO: 2104468 - protein, 24 aa, Staphylococcus
KPKQKKFTIAFGVGTYEEQFRKGI

SEQ ID NO: 2104469 - protein, 19 aa, Staphylococcus
KPPNRFLIGATSYFDNYSV

SEQ ID NO: 2104470 - protein, 19 aa, Staphylococcus
KPSNSGLFVTVYDKTGKKT

SEQ ID NO: 2104471 - protein, 19 aa, Staphylococcus
KPSNSGLYTTVYDSKGHST

SEQ ID NO: 2104472 - protein, 25 aa, Staphylococcus
KPVQAGAYDIHFVNNGFQYNFTSNG

SEQ ID NO: 2104473 - protein, 25 aa, Staphylococcus
KQANTRATSLFATMPQASDNASSTD

SEQ ID NO: 2104474 - protein, 23 aa, Staphylococcus
KQCDFDFNISIIYDGYKFVNVNM

SEQ ID NO: 2104475 - protein, 18 aa, Staphylococcus
KQEANLYGNHNKTYNDYG

SEQ ID NO: 2104476 - protein, 34 aa, Staphylococcus
KQFISTFDHMDFLKWINLRNDYTVTWTSQKLNGR

SEQ ID NO: 2104477 - protein, 24 aa, Staphylococcus
KQGFATAKNNGWNTVKKAIVGGAK

SEQ ID NO: 2104478 - protein, 17 aa, Staphylococcus
KQHGGDISPLYKGGQDN

SEQ ID NO: 2104479 - protein, 19 aa, Staphylococcus
KQIKEDKVNYILAEENVSN

SEQ ID NO: 2104480 - protein, 17 aa, Staphylococcus
KQKGKFPKRSVWINFDD

SEQ ID NO: 2104481 - protein, 25 aa, Staphylococcus
KQMKQAIQFVKSHHLKHLLVETSVD

SEQ ID NO: 2104482 - protein, 24 aa, Staphylococcus
KQNDIWKHFKAVKTNQVYDLEEVP

SEQ ID NO: 2104483 - protein, 17 aa, Staphylococcus
KQNTEWVGYATPNKEAR

SEQ ID NO: 2104484 - protein, 19 aa, Staphylococcus
KQNYDVTFIDGWEPQAQAV

SEQ ID NO: 2104485 - protein, 19 aa, Staphylococcus
KQQARAKINEKFKTKQDQI

SEQ ID NO: 2104486 - protein, 18 aa, Staphylococcus
KQQIEIFGNREDLNSISQ

SEQ ID NO: 2104487 - protein, 23 aa, Staphylococcus
KQRTEGNNTYVLLQDSTQNTPLG

SEQ ID NO: 2104488 - protein, 19 aa, Staphylococcus
KQRWSHAVDQGIYNGGGIA

SEQ ID NO: 2104489 - protein, 24 aa, Staphylococcus
KQSNNRSTAMFQLLPDLSNNDENN

SEQ ID NO: 2104490 - protein, 20 aa, Staphylococcus
KQSYTGTIFVHGYGGSANSE

SEQ ID NO: 2104491 - protein, 24 aa, Staphylococcus
KQVEKRTGTQLVVLHYQSINKLCD

SEQ ID NO: 2104492 - protein, 18 aa, Staphylococcus
KQVLKNDVIKHVKAIKSG

SEQ ID NO: 2104493 - protein, 24 aa, Staphylococcus
KQYGIEGKLAVYVPTYRENYQANR

SEQ ID NO: 2104494 - protein, 21 aa, Staphylococcus
KQYGITPGYIWEINTEKQGTP

SEQ ID NO: 2104495 - protein, 17 aa, Staphylococcus
KQYGYIHRLFVKPHTYV

SEQ ID NO: 2104496 - protein, 23 aa, Staphylococcus
KRAGDGYPAFTKAYGFKFKTVRP

SEQ ID NO: 2104497 - protein, 28 aa, Staphylococcus
KRAQAGHTISTFWGDARNWAGQASGDGF

SEQ ID NO: 2104498 - protein, 19 aa, Staphylococcus
KRDADTYAIVILGLDQSPE

SEQ ID NO: 2104499 - protein, 20 aa, Staphylococcus
KREKEFKKEEKALDDSEKEF

SEQ ID NO: 2104500 - protein, 19 aa, Staphylococcus
KREQQAMLNFVEKGGNIIF

SEQ ID NO: 2104501 - protein, 19 aa, Staphylococcus
KRHADEYGFIIRYGKGKEN

SEQ ID NO: 2104502 - protein, 21 aa, Staphylococcus
KRLLESNIHLVSGHPMAGSHK

SEQ ID NO: 2104503 - protein, 22 aa, Staphylococcus
KRMKSKSIQVVVEFKEVPMNLY

SEQ ID NO: 2104504 - protein, 18 aa, Staphylococcus
KRRNTLYTAIVLLLALIL

SEQ ID NO: 2104505 - protein, 17 aa, Staphylococcus
KRSRKIGKLAQRSNKIV

SEQ ID NO: 2104506 - protein, 22 aa, Staphylococcus
KRSYKSFLLEKMIRMSGMKKTF

SEQ ID NO: 2104507 - protein, 19 aa, Staphylococcus
KRTPDILKYLGEHKAHQYL

SEQ ID NO: 2104508 - protein, 19 aa, Staphylococcus
KRTPDILKYLGEHKESQYL

SEQ ID NO: 2104509 - protein, 19 aa, Staphylococcus
KRVDIMLTNGLFREVEALL

SEQ ID NO: 2104510 - protein, 21 aa, Staphylococcus
KRWEKEVTPIVGKTDLFIFPH

SEQ ID NO: 2104511 - protein, 19 aa, Staphylococcus
KRYRLKQLLNSKAIEQDMT

SEQ ID NO: 2104512 - protein, 17 aa, Staphylococcus
KSAFQFDNDEVVNGIIW

SEQ ID NO: 2104513 - protein, 24 aa, Staphylococcus
KSAGHPIFNVLEGNMGNSYTNSGN

SEQ ID NO: 2104514 - protein, 24 aa, Staphylococcus
KSATKYHNVFGIAAFDANPLYNGI

SEQ ID NO: 2104515 - protein, 25 aa, Staphylococcus
KSAVTPIKYDYIIHNQKGSYYIDPL

SEQ ID NO: 2104516 - protein, 22 aa, Staphylococcus
KSDQVLGLFAEKNMPLQIDAPQ

SEQ ID NO: 2104517 - protein, 20 aa, Staphylococcus
KSFEYKDFKSYKDIIKKAQN

SEQ ID NO: 2104518 - protein, 18 aa, Staphylococcus
KSGANGWAVPSTTEHPED

SEQ ID NO: 2104519 - protein, 20 aa, Staphylococcus
KSGDSLSAIAAKYGTTYQKI

SEQ ID NO: 2104520 - protein, 20 aa, Staphylococcus
KSGDSLSSIASRYGTTYRHI

SEQ ID NO: 2104521 - protein, 31 aa, Staphylococcus
KSGESLWSISNRYGITIAKLKSLNGLTSNLI

SEQ ID NO: 2104522 - protein, 23 aa, Staphylococcus
KSGKGWTQYHMWVEAKGNEKNLQ

SEQ ID NO: 2104523 - protein, 25 aa, Staphylococcus
KSGTAISPRPAFILKSSKHKDLAKK

SEQ ID NO: 2104524 - protein, 20 aa, Staphylococcus
KSHHLKHLLVETSVDHKSMQ

SEQ ID NO: 2104525 - protein, 18 aa, Staphylococcus
KSHQSTNLINQFYDGLST

SEQ ID NO: 2104526 - protein, 19 aa, Staphylococcus
KSIAYGHSLIRWDEQGDTL

SEQ ID NO: 2104527 - protein, 26 aa, Staphylococcus
KSNLWLRTSDRVRLVMGRFKATTFEE

SEQ ID NO: 2104528 - protein, 25 aa, Staphylococcus
KSNNDEIFIETPFGGINESVKHHAI

SEQ ID NO: 2104529 - protein, 25 aa, Staphylococcus
KSNVANHWRIRTGIQQGDTALNTET

SEQ ID NO: 2104530 - protein, 21 aa, Staphylococcus
KSPDVYPAMEEKLLDTLNKHG

SEQ ID NO: 2104531 - protein, 21 aa, Staphylococcus
KSPDVYPGMEEKLLDSLNKHH

SEQ ID NO: 2104532 - protein, 19 aa, Staphylococcus
KSSDWLSNQFGVRFRYNAL

SEQ ID NO: 2104533 - protein, 19 aa, Staphylococcus
KSTITRLIYSILREDQYRV

SEQ ID NO: 2104534 - protein, 19 aa, Staphylococcus
KSTSGYIYPLASLKDKGVS

SEQ ID NO: 2104535 - protein, 22 aa, Staphylococcus
KSVNNQAWLAAYMLKQNGITPT

SEQ ID NO: 2104536 - protein, 18 aa, Staphylococcus
KTDLENFGELNAIFIKNK

SEQ ID NO: 2104537 - protein, 25 aa, Staphylococcus
KTEGLYGYTVGKGHITFHVTDGYVD

SEQ ID NO: 2104538 - protein, 27 aa, Staphylococcus
KTEHYYEFKTSKGFMIVTADGQKDHGV

SEQ ID NO: 2104539 - protein, 22 aa, Staphylococcus
KTGANLSDISHIYIAKKDPDNA

SEQ ID NO: 2104540 - protein, 19 aa, Staphylococcus
KTGPLEWENPQFIKSVKEH

SEQ ID NO: 2104541 - protein, 19 aa, Staphylococcus
KTGQAAAWGTTSSGSTGGT

SEQ ID NO: 2104542 - protein, 25 aa, Staphylococcus
KTIIYRYDATTGRRITGNDVLSLLR

SEQ ID NO: 2104543 - protein, 22 aa, Staphylococcus
KTKDLKNDKALFLLVNEGELST

SEQ ID NO: 2104544 - protein, 30 aa, Staphylococcus
KTKLISPIGKLRAGMDLFKKPIQIEDDISV

SEQ ID NO: 2104545 - protein, 20 aa, Staphylococcus
KTQALADLEHLTSLNNAQKE

SEQ ID NO: 2104546 - protein, 17 aa, Staphylococcus
KTSRKLLRAAAVGQEGV

SEQ ID NO: 2104547 - protein, 24 aa, Staphylococcus
KTTFKKDFNSRGYIQKHDPDYKEE

SEQ ID NO: 2104548 - protein, 17 aa, Staphylococcus
KTTPGYETTNIWKNLPA

SEQ ID NO: 2104549 - protein, 24 aa, Staphylococcus
KTVKENPLLSGRTFSINKKATLNN

SEQ ID NO: 2104550 - protein, 18 aa, Staphylococcus
KTVKFDLPDNVTKVNPKE

SEQ ID NO: 2104551 - protein, 19 aa, Staphylococcus
KTVRQALGHLVNRNKIATD

SEQ ID NO: 2104552 - protein, 21 aa, Staphylococcus
KVDAPKLYVSNVMTQPGETNN

SEQ ID NO: 2104553 - protein, 18 aa, Staphylococcus
KVDVAFISPVSYTIAHDQ

SEQ ID NO: 2104554 - protein, 17 aa, Staphylococcus
KVDVGLKQWGLAQRDDE

SEQ ID NO: 2104555 - protein, 20 aa, Staphylococcus
KVFVDLCNQAIKANEDILEY

SEQ ID NO: 2104556 - protein, 20 aa, Staphylococcus
KVHQTICTFSKVNKVSYIED

SEQ ID NO: 2104557 - protein, 20 aa, Staphylococcus
KVIPILKERGLIQAAYSEGT

SEQ ID NO: 2104558 - protein, 24 aa, Staphylococcus
KVKFKETQWDSMFAGLDSGRFDMI

SEQ ID NO: 2104559 - protein, 25 aa, Staphylococcus
KVKFKETQWDSMFAGLDSGRFNVIA

SEQ ID NO: 2104560 - protein, 20 aa, Staphylococcus
KVLAKEGAHVLALDISDELE

SEQ ID NO: 2104561 - protein, 28 aa, Staphylococcus
KVLGNKDSRVDFGLSQWGLKQQPNESYV

SEQ ID NO: 2104562 - protein, 26 aa, Staphylococcus
KVLIPISICTLIILLIGCGKSSDGLA

SEQ ID NO: 2104563 - protein, 20 aa, Staphylococcus
KVLKEKHLPVPKSIKDLTKP

SEQ ID NO: 2104564 - protein, 19 aa, Staphylococcus
KVNSSVKNGKWHISDQDHQ

SEQ ID NO: 2104565 - protein, 25 aa, Staphylococcus
KVPEKEWRVNDGLVSVVSAQHPFNQ

SEQ ID NO: 2104566 - protein, 18 aa, Staphylococcus
KVQSAIIKSLDQLGIHEK

SEQ ID NO: 2104567 - protein, 21 aa, Staphylococcus
KVQSGESLWTIAQKYNTSVDS

SEQ ID NO: 2104568 - protein, 19 aa, Staphylococcus
KVSGGVGIVSKWPIVQQEQ

SEQ ID NO: 2104569 - protein, 24 aa, Staphylococcus
KVSKVIKTDYGYHIIKADKESDFN

SEQ ID NO: 2104570 - protein, 18 aa, Staphylococcus
KVTFNYGGSGALRQQIEK

SEQ ID NO: 2104571 - protein, 20 aa, Staphylococcus
KVVKTDYGYHIIKADKETDF

SEQ ID NO: 2104572 - protein, 17 aa, Staphylococcus
KVVREESNLPKKRSRRD

SEQ ID NO: 2104573 - protein, 19 aa, Staphylococcus
KWAGTIGNGKMEIHPYNNL

SEQ ID NO: 2104574 - protein, 26 aa, Staphylococcus
KWISGMASMVMVLSMTMYCPGNAEAS

SEQ ID NO: 2104575 - protein, 18 aa, Staphylococcus
KWYQTQSDFTFKNPKYLP

SEQ ID NO: 2104576 - protein, 20 aa, Staphylococcus
KYAKEAGWDSVSKAIVGGAK

SEQ ID NO: 2104577 - protein, 24 aa, Staphylococcus
KYDPHIWLDPVIDQKFAKEIKDEL

SEQ ID NO: 2104578 - protein, 24 aa, Staphylococcus
KYDPHIWLDPVISQKFAKEIKDEL

SEQ ID NO: 2104579 - protein, 22 aa, Staphylococcus
KYDPHVWLDPVLSQQFAKDIKD

SEQ ID NO: 2104580 - protein, 24 aa, Staphylococcus
KYFNYHPQRPFNYYKDQHSLNQNI

SEQ ID NO: 2104581 - protein, 28 aa, Staphylococcus
KYHIKRNGMVFWFGLPKGQTPTGPVRFT

SEQ ID NO: 2104582 - protein, 21 aa, Staphylococcus
KYKDGDGFKDYSAVTKEDRKA

SEQ ID NO: 2104583 - protein, 23 aa, Staphylococcus
KYKIKMGQVAPWGTTTTTKPSTG

SEQ ID NO: 2104584 - protein, 24 aa, Staphylococcus
KYKKIAATVPFNYAKHNYLEQQEE

SEQ ID NO: 2104585 - protein, 24 aa, Staphylococcus
KYKKIAATVPFNYQKHKYLEQQEE

SEQ ID NO: 2104586 - protein, 19 aa, Staphylococcus
KYKLKPFLDPSKVYSETDR

SEQ ID NO: 2104587 - protein, 25 aa, Staphylococcus
KYMKSDQASALKFYEKKDAKENKTD

SEQ ID NO: 2104588 - protein, 26 aa, Staphylococcus
KYNIKSELTKQGYRVHEANIGAFSSN

SEQ ID NO: 2104589 - protein, 21 aa, Staphylococcus
KYNRNRIGNQIIKQYRQKYEY

SEQ ID NO: 2104590 - protein, 18 aa, Staphylococcus
KYQFLRLDQPQYLSEATL

SEQ ID NO: 2104591 - protein, 17 aa, Staphylococcus
KYQFMQSTWDHVAPSEY

SEQ ID NO: 2104592 - protein, 26 aa, Staphylococcus
KYQKEHGGEISPLYKGNNDNMVSSIT

SEQ ID NO: 2104593 - protein, 21 aa, Staphylococcus
KYSTELANIFYVRQKEQKGLG

SEQ ID NO: 2104594 - protein, 21 aa, Staphylococcus
KYTFTSNGNTWSWNYTYTGGA

SEQ ID NO: 2104595 - protein, 26 aa, Staphylococcus
KYTMPARNVNPIGYYQMMAEPGSSGG

SEQ ID NO: 2104596 - protein, 21 aa, Staphylococcus
KYVDVKSIYPAGADLHSYEPT

SEQ ID NO: 2104597 - protein, 39 aa, Staphylococcus
KYYKSGLTLDQAVAIQKGLKFKPQIQHTAGKWEDASATE

SEQ ID NO: 2104598 - protein, 23 aa, Staphylococcus
KYYRKQYEYKKVLSKGEHQIDGK

SEQ ID NO: 2104599 - protein, 24 aa, Staphylococcus
LAAIFLLTACGKGNDEKQSLEQDI

SEQ ID NO: 2104600 - protein, 17 aa, Staphylococcus
LADGRIYSAQQAKSNGL

SEQ ID NO: 2104601 - protein, 23 aa, Staphylococcus
LAENGHSVLMWGKNENTVDEINQ

SEQ ID NO: 2104602 - protein, 18 aa, Staphylococcus
LAERFPRITALKGSLFGV

SEQ ID NO: 2104603 - protein, 18 aa, Staphylococcus
LAEVKSAMDTSKFVNDPV

SEQ ID NO: 2104604 - protein, 17 aa, Staphylococcus
LAFIFVLAACGGGNNKK

SEQ ID NO: 2104605 - protein, 17 aa, Staphylococcus
LAFMVVLAGCGKGESDN

SEQ ID NO: 2104606 - protein, 23 aa, Staphylococcus
LAGDKKVLFYSYENFMVENASNS

SEQ ID NO: 2104607 - protein, 23 aa, Staphylococcus
LAGNKKILFYSYENFMVNHVANA

SEQ ID NO: 2104608 - protein, 21 aa, Staphylococcus
LAGNKKVLFYSYENFMVNNVA

SEQ ID NO: 2104609 - protein, 17 aa, Staphylococcus
LAGSYIVHSDGSVEKFD

SEQ ID NO: 2104610 - protein, 19 aa, Staphylococcus
LAIEGRDAIFSSQQLLKPF

SEQ ID NO: 2104611 - protein, 20 aa, Staphylococcus
LALKSREKFNDLSIALEKET

SEQ ID NO: 2104612 - protein, 17 aa, Staphylococcus
LALMLILAACGNKSDSD

SEQ ID NO: 2104613 - protein, 17 aa, Staphylococcus
LALMLILAACGNNSSDD

SEQ ID NO: 2104614 - protein, 19 aa, Staphylococcus
LALSLILGAAACSNDDSSK

SEQ ID NO: 2104615 - protein, 26 aa, Staphylococcus
LANDGKPVLGVCNGFQILTEIGLLPG

SEQ ID NO: 2104616 - protein, 20 aa, Staphylococcus
LANGTAIWVKAADVRDTLTR

SEQ ID NO: 2104617 - protein, 22 aa, Staphylococcus
LANKSFKVSKSVVIGNTTYLYG

SEQ ID NO: 2104618 - protein, 28 aa, Staphylococcus
LAQSPHYNLFGIKGSYQGKSADFNTLED

SEQ ID NO: 2104619 - protein, 21 aa, Staphylococcus
LASFLALAACSDDDKTSHKKD

SEQ ID NO: 2104620 - protein, 23 aa, Staphylococcus
LASFLVLAACGNSEESKSEDKKE

SEQ ID NO: 2104621 - protein, 17 aa, Staphylococcus
LASFLVLTACGQQKESK

SEQ ID NO: 2104622 - protein, 30 aa, Staphylococcus
LASTLILGACGKNDEKAALQKDIDKLQKEN

SEQ ID NO: 2104623 - protein, 31 aa, Staphylococcus
LASTLMLTACGKSNEKASLEKSIDQLEKENK

SEQ ID NO: 2104624 - protein, 19 aa, Staphylococcus
LATEIPKFIAPAMNVHMYE

SEQ ID NO: 2104625 - protein, 17 aa, Staphylococcus
LATGLALSAMVATTSSM

SEQ ID NO: 2104626 - protein, 31 aa, Staphylococcus
LATSDNYTFASLVFDPEALDSDAVKNSTSIP

SEQ ID NO: 2104627 - protein, 28 aa, Staphylococcus
LAVKNDLRFKKFVKNNHIPQEYKDPTQR

SEQ ID NO: 2104628 - protein, 22 aa, Staphylococcus
LCASLFILVIFVGGCGSFNKEA

SEQ ID NO: 2104629 - protein, 21 aa, Staphylococcus
LCNKSIKANEEILDYTKVFEK

SEQ ID NO: 2104630 - protein, 20 aa, Staphylococcus
LCSFLVLGACSQSDHDSKQD

SEQ ID NO: 2104631 - protein, 21 aa, Staphylococcus
LCSLYCLILSGCGQNNNEDLN

SEQ ID NO: 2104632 - protein, 17 aa, Staphylococcus
LCSTVLGTLVFAKFREK

SEQ ID NO: 2104633 - protein, 20 aa, Staphylococcus
LCTILFLAACNSNDNHERAK

SEQ ID NO: 2104634 - protein, 22 aa, Staphylococcus
LDAEGLPTLLNQAVDHHSDVAF

SEQ ID NO: 2104635 - protein, 17 aa, Staphylococcus
LDAGSWFNNAHPEYAKP

SEQ ID NO: 2104636 - protein, 24 aa, Staphylococcus
LDDYKEQKKLAAYQKQLLADKVKV

SEQ ID NO: 2104637 - protein, 22 aa, Staphylococcus
LDEILSRYGTKANYYIETKNPN

SEQ ID NO: 2104638 - protein, 22 aa, Staphylococcus
LDEILTRYGTDANYYIETKQPD

SEQ ID NO: 2104639 - protein, 24 aa, Staphylococcus
LDGNWNQSMFDNHEYQFTLTDSEG

SEQ ID NO: 2104640 - protein, 17 aa, Staphylococcus
LDISEWQGALTDAQVKA

SEQ ID NO: 2104641 - protein, 17 aa, Staphylococcus
LDKALSIGLIDKKAEDY

SEQ ID NO: 2104642 - protein, 20 aa, Staphylococcus
LDKDKYYLVSDYNSGKLYGW

SEQ ID NO: 2104643 - protein, 25 aa, Staphylococcus
LDKGKIGQSFLNWPKSTRTITPSFT

SEQ ID NO: 2104644 - protein, 25 aa, Staphylococcus
LDKIKQPHLIGPVHFERHKGHIDGN

SEQ ID NO: 2104645 - protein, 18 aa, Staphylococcus
LDLHTLLEKYGENSNYKE

SEQ ID NO: 2104646 - protein, 25 aa, Staphylococcus
LDLLLDIRCPVVITGAMRSSNEIGS

SEQ ID NO: 2104647 - protein, 26 aa, Staphylococcus
LDLTDWRVSPIFGDIEGLGHITISIG

SEQ ID NO: 2104648 - protein, 26 aa, Staphylococcus
LDNDIPIVLVSRSFNGIVSPVYAYEG

SEQ ID NO: 2104649 - protein, 19 aa, Staphylococcus
LDNKAYWFISVNAKQGDPK

SEQ ID NO: 2104650 - protein, 26 aa, Staphylococcus
LDNNIPIVLVSRSFNGIVSPVYAYEG

SEQ ID NO: 2104651 - protein, 21 aa, Staphylococcus
LDPKIFYPLIKKLKENNDYVV

SEQ ID NO: 2104652 - protein, 17 aa, Staphylococcus
LDPKLWYFASGSTTTTV

SEQ ID NO: 2104653 - protein, 17 aa, Staphylococcus
LDRFNRHVNVPKANNAV

SEQ ID NO: 2104654 - protein, 17 aa, Staphylococcus
LDSDLRDLANIATKNQM

SEQ ID NO: 2104655 - protein, 24 aa, Staphylococcus
LDSNLKPGEAFEQFSSAIKLGRYQ

SEQ ID NO: 2104656 - protein, 22 aa, Staphylococcus
LDSSRFQYYIGQALNVAPQSVY

SEQ ID NO: 2104657 - protein, 28 aa, Staphylococcus
LDTLVKLFYKECEEWNIELDTLINRRSG

SEQ ID NO: 2104658 - protein, 18 aa, Staphylococcus
LEAAKDALQQSIQAADNT

SEQ ID NO: 2104659 - protein, 18 aa, Staphylococcus
LEELLRNGNQEEIEYQKK

SEQ ID NO: 2104660 - protein, 22 aa, Staphylococcus
LEGLGRISIFIGTKETLYPDAL

SEQ ID NO: 2104661 - protein, 23 aa, Staphylococcus
LEGLGRLSIFIGTKETLYPDALK

SEQ ID NO: 2104662 - protein, 19 aa, Staphylococcus
LEKEKDLFELIKQDGVTQS

SEQ ID NO: 2104663 - protein, 20 aa, Staphylococcus
LEKTIKFTDFKTAKASEKNE

SEQ ID NO: 2104664 - protein, 21 aa, Staphylococcus
LELQSRLQIRINSPISGKVTI

SEQ ID NO: 2104665 - protein, 25 aa, Staphylococcus
LELTTSLRKALFNNQDMSTSSRKNE

SEQ ID NO: 2104666 - protein, 22 aa, Staphylococcus
LEMPNAAQSLTLFKSFATSPYK

SEQ ID NO: 2104667 - protein, 22 aa, Staphylococcus
LENVGKISFLFNHHKVSDLKAS

SEQ ID NO: 2104668 - protein, 18 aa, Staphylococcus
LEPGQKAKIEVVFKNTGT

SEQ ID NO: 2104669 - protein, 27 aa, Staphylococcus
LEPNWNIKLYERMDRPALESSNERHNA

SEQ ID NO: 2104670 - protein, 26 aa, Staphylococcus
LEPNWNIKLYERMDRPGLESSNERHN

SEQ ID NO: 2104671 - protein, 18 aa, Staphylococcus
LEPSWNIKLYERLDRPGI

SEQ ID NO: 2104672 - protein, 17 aa, Staphylococcus
LERMGLHRDSEGRLIPI

SEQ ID NO: 2104673 - protein, 25 aa, Staphylococcus
LESAGLIKLKDNFGLSGTTKDIKDN

SEQ ID NO: 2104674 - protein, 18 aa, Staphylococcus
LESGDAWFENALKQAGKS

SEQ ID NO: 2104675 - protein, 18 aa, Staphylococcus
LETGNGWFDKALEQAGKN

SEQ ID NO: 2104676 - protein, 18 aa, Staphylococcus
LETGNGWFDKALSQANKS

SEQ ID NO: 2104677 - protein, 18 aa, Staphylococcus
LFADEGVDVVLGMHPHVI

SEQ ID NO: 2104678 - protein, 19 aa, Staphylococcus
LFAEKDMPLQIDAPQQNPL

SEQ ID NO: 2104679 - protein, 17 aa, Staphylococcus
LFLKECSDYGIDFEKLI

SEQ ID NO: 2104680 - protein, 18 aa, Staphylococcus
LFRLALKSREKFNDLSIA

SEQ ID NO: 2104681 - protein, 19 aa, Staphylococcus
LFTLVCLCLIVIFIMILSA

SEQ ID NO: 2104682 - protein, 24 aa, Staphylococcus
LFVKPKLEQSIGFYSDNATDNKEN

SEQ ID NO: 2104683 - protein, 17 aa, Staphylococcus
LGAKVIMPIYPKVPHAT

SEQ ID NO: 2104684 - protein, 28 aa, Staphylococcus
LGASCLLVGCGSQNLGPLEVKTTQLRDE

SEQ ID NO: 2104685 - protein, 24 aa, Staphylococcus
LGASILLAGCGSQNLGPLEHKTTK

SEQ ID NO: 2104686 - protein, 20 aa, Staphylococcus
LGDWADAIIIAPATANTIAK

SEQ ID NO: 2104687 - protein, 23 aa, Staphylococcus
LGEHKESQYLVGFAAETQNIEAY

SEQ ID NO: 2104688 - protein, 23 aa, Staphylococcus
LGEHKRQQYLVGFAAETQNIEAY

SEQ ID NO: 2104689 - protein, 24 aa, Staphylococcus
LGGTLRLGLYPSKIKKDTLAYDIY

SEQ ID NO: 2104690 - protein, 25 aa, Staphylococcus
LGHNYWGGNRIKLTQELRAKGYNVS

SEQ ID NO: 2104691 - protein, 18 aa, Staphylococcus
LGIAGYALTGNEAHASET

SEQ ID NO: 2104692 - protein, 19 aa, Staphylococcus
LGICLILLIILIGSCIILT

SEQ ID NO: 2104693 - protein, 18 aa, Staphylococcus
LGKHKVDYVIKGLDKDVD

SEQ ID NO: 2104694 - protein, 17 aa, Staphylococcus
LGLDAKYDTQLDEWQYL

SEQ ID NO: 2104695 - protein, 24 aa, Staphylococcus
LGLSSFIILSACGQNTDNNNKKDN

SEQ ID NO: 2104696 - protein, 19 aa, Staphylococcus
LGMLILLAACGNKVDGTYK

SEQ ID NO: 2104697 - protein, 20 aa, Staphylococcus
LGNIKAKSIITVDHVTITEQ

SEQ ID NO: 2104698 - protein, 20 aa, Staphylococcus
LGNNKFYLVEDYNSGKKYGW

SEQ ID NO: 2104699 - protein, 20 aa, Staphylococcus
LGNNKFYLVQDYNTGEKFGW

SEQ ID NO: 2104700 - protein, 21 aa, Staphylococcus
LGQTKEAWGTGSVEEQTKGMI

SEQ ID NO: 2104701 - protein, 17 aa, Staphylococcus
LGSGFGAMLYRQGNDVT

SEQ ID NO: 2104702 - protein, 19 aa, Staphylococcus
LGSHDGVGHVFGRDITGKK

SEQ ID NO: 2104703 - protein, 17 aa, Staphylococcus
LGSSQGYSVIEIVEAAR

SEQ ID NO: 2104704 - protein, 17 aa, Staphylococcus
LGVVVGYVVARNLLHQK

SEQ ID NO: 2104705 - protein, 17 aa, Staphylococcus
LHRELGEIMTANVTVVR

SEQ ID NO: 2104706 - protein, 18 aa, Staphylococcus
LHTLPPHFELKTEKTKEL

SEQ ID NO: 2104707 - protein, 17 aa, Staphylococcus
LIAILTLMLFLTYGCQS

SEQ ID NO: 2104708 - protein, 18 aa, Staphylococcus
LIALCLMLAGCSNGDNKD

SEQ ID NO: 2104709 - protein, 25 aa, Staphylococcus
LIAVPAIFAYQLFKSSESAFQTSYS

SEQ ID NO: 2104710 - protein, 19 aa, Staphylococcus
LIAVRKGHKDDKKIKALIE

SEQ ID NO: 2104711 - protein, 18 aa, Staphylococcus
LIDEFDELAYLYLNTGNS

SEQ ID NO: 2104712 - protein, 18 aa, Staphylococcus
LIEGIKYAKEAGWDSVSK

SEQ ID NO: 2104713 - protein, 25 aa, Staphylococcus
LIENIKENLNWIWNSFSREDQKDFD

SEQ ID NO: 2104714 - protein, 24 aa, Staphylococcus
LIENVKENLNWIWNSFSRQDQIEF

SEQ ID NO: 2104715 - protein, 25 aa, Staphylococcus
LIESLPQRQVRTISTRANREARAVR

SEQ ID NO: 2104716 - protein, 23 aa, Staphylococcus
LIFAKAEIGNTFYSKNNDTTYKS

SEQ ID NO: 2104717 - protein, 21 aa, Staphylococcus
LIFEIACTKLDAYYIAYQKAP

SEQ ID NO: 2104718 - protein, 17 aa, Staphylococcus
LIFPNQVLKVSGSSSSA

SEQ ID NO: 2104719 - protein, 18 aa, Staphylococcus
LIGHLFEIIDPYSRNQQG

SEQ ID NO: 2104720 - protein, 33 aa, Staphylococcus
LIGHSMGGQTVRLLEEMLRKGNPEEVKYQKKHG

SEQ ID NO: 2104721 - protein, 19 aa, Staphylococcus
LIHPGDLIAVSSKGAALLG

SEQ ID NO: 2104722 - protein, 18 aa, Staphylococcus
LIKKGIDGNPNIYRPTWK

SEQ ID NO: 2104723 - protein, 27 aa, Staphylococcus
LIKKGKSVRCAIAYDIYDVNKPVILKA

SEQ ID NO: 2104724 - protein, 17 aa, Staphylococcus
LILLTFALIAIPVVFAN

SEQ ID NO: 2104725 - protein, 17 aa, Staphylococcus
LILLTFVLVVVPIIFAT

SEQ ID NO: 2104726 - protein, 20 aa, Staphylococcus
LILSACGKSEEKVSLENDIK

SEQ ID NO: 2104727 - protein, 17 aa, Staphylococcus
LILSFALILSACANKSE

SEQ ID NO: 2104728 - protein, 17 aa, Staphylococcus
LINEKYLIKQGKVAPWG

SEQ ID NO: 2104729 - protein, 18 aa, Staphylococcus
LIQDLFMNDYLRVYTNDD

SEQ ID NO: 2104730 - protein, 18 aa, Staphylococcus
LIQDLFMNDYLRVYTNND

SEQ ID NO: 2104731 - protein, 20 aa, Staphylococcus
LIRSITYPNFNNFKDLDLSH

SEQ ID NO: 2104732 - protein, 26 aa, Staphylococcus
LISDFNGNQSHGWIPSSEINIQTTTP

SEQ ID NO: 2104733 - protein, 18 aa, Staphylococcus
LISIMFLFAACSNDSSSK

SEQ ID NO: 2104734 - protein, 18 aa, Staphylococcus
LITGVVSLWTWWKNNNFT

SEQ ID NO: 2104735 - protein, 18 aa, Staphylococcus
LIVLILILSLFKIAPVHA

SEQ ID NO: 2104736 - protein, 26 aa, Staphylococcus
LKAIKSYAVGVGPEYTDLNIKNTRHL

SEQ ID NO: 2104737 - protein, 17 aa, Staphylococcus
LKASSTYYDKVASAVDK

SEQ ID NO: 2104738 - protein, 23 aa, Staphylococcus
LKDKFKGVEKIGATGSEDVEKVI

SEQ ID NO: 2104739 - protein, 20 aa, Staphylococcus
LKDKIALFCDIDKASVIECR

SEQ ID NO: 2104740 - protein, 19 aa, Staphylococcus
LKDLGFLIHPFTVNEEADM

SEQ ID NO: 2104741 - protein, 20 aa, Staphylococcus
LKDLGFLIHPYTVDKTTDMQ

SEQ ID NO: 2104742 - protein, 17 aa, Staphylococcus
LKDLGFLVHPFTVNETA

SEQ ID NO: 2104743 - protein, 26 aa, Staphylococcus
LKDNKAFGTFMKFVLEDKGKSAEKAG

SEQ ID NO: 2104744 - protein, 21 aa, Staphylococcus
LKEDRLASIGKDNFKFYKTDL

SEQ ID NO: 2104745 - protein, 21 aa, Staphylococcus
LKENLNWIWNSFSFEDQQQFQ

SEQ ID NO: 2104746 - protein, 22 aa, Staphylococcus
LKFNAPLYSLGYPWQNGDNTKA

SEQ ID NO: 2104747 - protein, 22 aa, Staphylococcus
LKFNSPLYSLGYPWQYNDNTKA

SEQ ID NO: 2104748 - protein, 17 aa, Staphylococcus
LKGIKGFKPTPYPTYNS

SEQ ID NO: 2104749 - protein, 22 aa, Staphylococcus
LKGQLPFHKSLAVTERDAHTVG

SEQ ID NO: 2104750 - protein, 21 aa, Staphylococcus
LKGSLFGVAIHIAFHEYLLPN

SEQ ID NO: 2104751 - protein, 20 aa, Staphylococcus
LKGSQSKVLKAEQSDDIKVE

SEQ ID NO: 2104752 - protein, 19 aa, Staphylococcus
LKIKNLKASSNYYDKVAEA

SEQ ID NO: 2104753 - protein, 18 aa, Staphylococcus
LKILEVREDILGALQVTF

SEQ ID NO: 2104754 - protein, 28 aa, Staphylococcus
LKKDEKAFKGDKGVSFKIDYKDDKAVEH

SEQ ID NO: 2104755 - protein, 19 aa, Staphylococcus
LKKDRDYIRLCNQSVKTNE

SEQ ID NO: 2104756 - protein, 18 aa, Staphylococcus
LKKEGIRYGYTLEDKAVK

SEQ ID NO: 2104757 - protein, 17 aa, Staphylococcus
LKKNFGLNGTTKDIESN

SEQ ID NO: 2104758 - protein, 17 aa, Staphylococcus
LKLLESAGYIKLSKDFG

SEQ ID NO: 2104759 - protein, 18 aa, Staphylococcus
LKNAEAINMGKKDVDELG

SEQ ID NO: 2104760 - protein, 22 aa, Staphylococcus
LKNKKLDVAVGYSTDGRIAAYD

SEQ ID NO: 2104761 - protein, 20 aa, Staphylococcus
LKNNMDGMDSLNVEKLPKGS

SEQ ID NO: 2104762 - protein, 22 aa, Staphylococcus
LKNQKLDVALGYTTDGRIAAYD

SEQ ID NO: 2104763 - protein, 17 aa, Staphylococcus
LKPDLIIADSNRHKGIY

SEQ ID NO: 2104764 - protein, 19 aa, Staphylococcus
LKPDLIIADSNRHKGIYKE

SEQ ID NO: 2104765 - protein, 21 aa, Staphylococcus
LKPNTKYYYKVGSLQGGQSTV

SEQ ID NO: 2104766 - protein, 19 aa, Staphylococcus
LKQMMTFKGDPEFTIVNRL

SEQ ID NO: 2104767 - protein, 17 aa, Staphylococcus
LKQTKIHPVKKELIADL

SEQ ID NO: 2104768 - protein, 20 aa, Staphylococcus
LKQYPDYMSPILGNMGSLFV

SEQ ID NO: 2104769 - protein, 24 aa, Staphylococcus
LKRLSKFSYGIGINYKKTEKELVE

SEQ ID NO: 2104770 - protein, 17 aa, Staphylococcus
LKRNFFNIIDYGKQVKN

SEQ ID NO: 2104771 - protein, 23 aa, Staphylococcus
LKSERFTYCTKIIYQAYKYGVSK

SEQ ID NO: 2104772 - protein, 20 aa, Staphylococcus
LKSLENDGGIFGVEKNDGNV

SEQ ID NO: 2104773 - protein, 21 aa, Staphylococcus
LKSNLIFPNQVLKVSGSSKST

SEQ ID NO: 2104774 - protein, 18 aa, Staphylococcus
LKTAKAKLDDEINQTVST

SEQ ID NO: 2104775 - protein, 17 aa, Staphylococcus
LKVKIYQLYGDISKGEP

SEQ ID NO: 2104776 - protein, 19 aa, Staphylococcus
LKVVMHFEAQEAEAFDLCI

SEQ ID NO: 2104777 - protein, 17 aa, Staphylococcus
LKYYDIITTSNLATKHP

SEQ ID NO: 2104778 - protein, 25 aa, Staphylococcus
LLADFNGNVTRGWVPADQVTIAQST

SEQ ID NO: 2104779 - protein, 23 aa, Staphylococcus
LLAGCDLGDMIGLNNSSEKSEHT

SEQ ID NO: 2104780 - protein, 18 aa, Staphylococcus
LLAGSIFFASTVIINTTY

SEQ ID NO: 2104781 - protein, 17 aa, Staphylococcus
LLASGVVLAACGQGGSS

SEQ ID NO: 2104782 - protein, 18 aa, Staphylococcus
LLFGFVITLGACGNEGAN

SEQ ID NO: 2104783 - protein, 17 aa, Staphylococcus
LLFLGVGTAQAAEEDHH

SEQ ID NO: 2104784 - protein, 20 aa, Staphylococcus
LLGLFATIALAIVLSACGNG

SEQ ID NO: 2104785 - protein, 17 aa, Staphylococcus
LLGLFILTGCSFSNEDK

SEQ ID NO: 2104786 - protein, 26 aa, Staphylococcus
LLGNEAIVRQAVYDFAKSQGNKFSRA

SEQ ID NO: 2104787 - protein, 28 aa, Staphylococcus
LLGNEALIRQVVFDAGKVLGNKDSRVDF

SEQ ID NO: 2104788 - protein, 22 aa, Staphylococcus
LLHLSKSVFPTDNFLYQDGQYL

SEQ ID NO: 2104789 - protein, 18 aa, Staphylococcus
LLKAKPDLILAHESQKST

SEQ ID NO: 2104790 - protein, 17 aa, Staphylococcus
LLKELAPDWNIKLFERL

SEQ ID NO: 2104791 - protein, 23 aa, Staphylococcus
LLLCATFSLVACGNRTQSDLNQF

SEQ ID NO: 2104792 - protein, 23 aa, Staphylococcus
LLLCLCMMFSPLTTYAAKTPTQI

SEQ ID NO: 2104793 - protein, 20 aa, Staphylococcus
LLNDKFRNIYHFLTHESYQE

SEQ ID NO: 2104794 - protein, 21 aa, Staphylococcus
LLNNQAYWFISINAKENDATM

SEQ ID NO: 2104795 - protein, 18 aa, Staphylococcus
LLSDNGVIFDIKGLINKN

SEQ ID NO: 2104796 - protein, 23 aa, Staphylococcus
LLSKELKAPVNIQRTTSDYKMIE

SEQ ID NO: 2104797 - protein, 17 aa, Staphylococcus
LLSLVMLILVACGQNDQ

SEQ ID NO: 2104798 - protein, 18 aa, Staphylococcus
LLSSCGNQSSADLKDFQT

SEQ ID NO: 2104799 - protein, 17 aa, Staphylococcus
LLSSYLLAGCSNNNILE

SEQ ID NO: 2104800 - protein, 20 aa, Staphylococcus
LLVISFVCYIYAKIPTEPDT

SEQ ID NO: 2104801 - protein, 17 aa, Staphylococcus
LMLAEKGFQVYATMRNL

SEQ ID NO: 2104802 - protein, 17 aa, Staphylococcus
LMLHKSGLYKYEASTNI

SEQ ID NO: 2104803 - protein, 17 aa, Staphylococcus
LMLSLLVTLTACGNDSK

SEQ ID NO: 2104804 - protein, 24 aa, Staphylococcus
LMPLSEFSKGLVEEWDQMIDVNLK

SEQ ID NO: 2104805 - protein, 18 aa, Staphylococcus
LMQLRVAIQKEPLDPKKV

SEQ ID NO: 2104806 - protein, 19 aa, Staphylococcus
LMVEGASIDKSGHPNDVTG

SEQ ID NO: 2104807 - protein, 20 aa, Staphylococcus
LNDAMHTLRDSIANVSNIKT

SEQ ID NO: 2104808 - protein, 19 aa, Staphylococcus
LNGNLIFPGQVLTINGSST

SEQ ID NO: 2104809 - protein, 26 aa, Staphylococcus
LNGPKARLKLLVGLSNQLTLKQLNSY

SEQ ID NO: 2104810 - protein, 25 aa, Staphylococcus
LNGPKARLKLLVGLSQNMNHQKLKN

SEQ ID NO: 2104811 - protein, 26 aa, Staphylococcus
LNGPKARLKLLVSLSNELNREQIKQY

SEQ ID NO: 2104812 - protein, 25 aa, Staphylococcus
LNHFYWEIPETYKAYNEEDLLQKLQ

SEQ ID NO: 2104813 - protein, 18 aa, Staphylococcus
LNKGEPFTIALFGVDSDA

SEQ ID NO: 2104814 - protein, 18 aa, Staphylococcus
LNKMMTFHGDPEFTIVNR

SEQ ID NO: 2104815 - protein, 18 aa, Staphylococcus
LNKNFKNAVKYGNVTFNG

SEQ ID NO: 2104816 - protein, 18 aa, Staphylococcus
LNKPLPYFNQMLAFGTYM

SEQ ID NO: 2104817 - protein, 18 aa, Staphylococcus
LNKRGYRLAQGEAPIKET

SEQ ID NO: 2104818 - protein, 20 aa, Staphylococcus
LNLDSPIAFTLRNMEDTDAI

SEQ ID NO: 2104819 - protein, 23 aa, Staphylococcus
LNLGVTPLIFPGDIIIVSPYETQ

SEQ ID NO: 2104820 - protein, 22 aa, Staphylococcus
LNLKLSNNQSFEYIASDGGQLK

SEQ ID NO: 2104821 - protein, 26 aa, Staphylococcus
LNLMGVIRMTKAVLPYMRNQRDGRII

SEQ ID NO: 2104822 - protein, 19 aa, Staphylococcus
LNNHTSLNPNIVYKTYTGE

SEQ ID NO: 2104823 - protein, 20 aa, Staphylococcus
LNNKNFYLISDFNGNQSHGW

SEQ ID NO: 2104824 - protein, 27 aa, Staphylococcus
LNPNLGEVIYPGQLVAVSEKGSAHLNN

SEQ ID NO: 2104825 - protein, 17 aa, Staphylococcus
LNRVNGVFFGQTFTVYF

SEQ ID NO: 2104826 - protein, 20 aa, Staphylococcus
LNSDSPMVFTLRNMEDTDQI

SEQ ID NO: 2104827 - protein, 18 aa, Staphylococcus
LNSHLKQIAQRESGGDIH

SEQ ID NO: 2104828 - protein, 19 aa, Staphylococcus
LNSTFTKMYGLRTYGYNLM

SEQ ID NO: 2104829 - protein, 24 aa, Staphylococcus
LNYISPKAAHWKIQVDASTGEILN

SEQ ID NO: 2104830 - protein, 19 aa, Staphylococcus
LNYTHSFEINRALVEKDIR

SEQ ID NO: 2104831 - protein, 25 aa, Staphylococcus
LPAKQRGALSVAYDLYVDIPDKPGM

SEQ ID NO: 2104832 - protein, 21 aa, Staphylococcus
LPISQCAQAASYVVNNENIDK

SEQ ID NO: 2104833 - protein, 28 aa, Staphylococcus
LPIVVGLLLVLGIAWGVYAFITNTPKNT

SEQ ID NO: 2104834 - protein, 18 aa, Staphylococcus
LPKDPSIYLYFPSVEDEE

SEQ ID NO: 2104835 - protein, 24 aa, Staphylococcus
LPKLPYKYGTYKGVVIHEVGEDNR

SEQ ID NO: 2104836 - protein, 17 aa, Staphylococcus
LPKYKPAVNSSINDYIR

SEQ ID NO: 2104837 - protein, 18 aa, Staphylococcus
LPKYKPQVSSSINNYIRS

SEQ ID NO: 2104838 - protein, 25 aa, Staphylococcus
LPKYNYKSGKFIGVVIHETANPSST

SEQ ID NO: 2104839 - protein, 21 aa, Staphylococcus
LPLFILYKIRGYFLKQENRKF

SEQ ID NO: 2104840 - protein, 20 aa, Staphylococcus
LPNFETALDIAKNEANMFGN

SEQ ID NO: 2104841 - protein, 21 aa, Staphylococcus
LPSMLALSLFGATLTAQHAHA

SEQ ID NO: 2104842 - protein, 21 aa, Staphylococcus
LPSMVALTLFGTAFTAHHAHA

SEQ ID NO: 2104843 - protein, 20 aa, Staphylococcus
LPSMVAVTLLGTAFTAHHAD

SEQ ID NO: 2104844 - protein, 19 aa, Staphylococcus
LPSVRGNMIDVEFKHLTKQ

SEQ ID NO: 2104845 - protein, 27 aa, Staphylococcus
LPTTGLRFFTVYGPWGRPDMALFKFTK

SEQ ID NO: 2104846 - protein, 22 aa, Staphylococcus
LPVTASALLLGACGNSATDSKE

SEQ ID NO: 2104847 - protein, 18 aa, Staphylococcus
LQDMFSWSNGYNKRYGLF

SEQ ID NO: 2104848 - protein, 17 aa, Staphylococcus
LQQLKGLIIVGDMQHQK

SEQ ID NO: 2104849 - protein, 22 aa, Staphylococcus
LQTKADTLGSINYSDADQPKKD

SEQ ID NO: 2104850 - protein, 20 aa, Staphylococcus
LQYKKRYPITNGDADTAIAQ

SEQ ID NO: 2104851 - protein, 17 aa, Staphylococcus
LRAVAEFTLNGVATGVS

SEQ ID NO: 2104852 - protein, 21 aa, Staphylococcus
LRDANGAIIAKGKYDSNTNKT

SEQ ID NO: 2104853 - protein, 20 aa, Staphylococcus
LRLGLYPCHIKEGTLADSIY

SEQ ID NO: 2104854 - protein, 20 aa, Staphylococcus
LRLGLYPCHIKEGTLAESIY

SEQ ID NO: 2104855 - protein, 17 aa, Staphylococcus
LRLLSDNGVIFDIKGLI

SEQ ID NO: 2104856 - protein, 17 aa, Staphylococcus
LRQSFFNNQDLSFNSRS

SEQ ID NO: 2104857 - protein, 17 aa, Staphylococcus
LRSGAMASVAPIINEVK

SEQ ID NO: 2104858 - protein, 18 aa, Staphylococcus
LRSKEIKDYINIKYDGAV

SEQ ID NO: 2104859 - protein, 31 aa, Staphylococcus
LSATLMLSACGKSDERASLEKDVKKLQKEND

SEQ ID NO: 2104860 - protein, 31 aa, Staphylococcus
LSATLTLSACGKSEEKASLEKSVDKLEKENK

SEQ ID NO: 2104861 - protein, 25 aa, Staphylococcus
LSDQEIKKEVAMMLLNPQLKKQFIN

SEQ ID NO: 2104862 - protein, 22 aa, Staphylococcus
LSEKELKKSIKTYLNTNKDLAD

SEQ ID NO: 2104863 - protein, 23 aa, Staphylococcus
LSEKQKLALAFCVEDVDRYTLTK

SEQ ID NO: 2104864 - protein, 21 aa, Staphylococcus
LSERTKQLRLKQLLNSQNIER

SEQ ID NO: 2104865 - protein, 25 aa, Staphylococcus
LSETLDLPHFVSYETAYACNHKDEM

SEQ ID NO: 2104866 - protein, 22 aa, Staphylococcus
LSGNKKVLFYSYENFMTNNVPN

SEQ ID NO: 2104867 - protein, 28 aa, Staphylococcus
LSGSRLLDLNLGFSQWGFKQKPNESYIE

SEQ ID NO: 2104868 - protein, 20 aa, Staphylococcus
LSHLRNIVRSLLGIAVPTQI

SEQ ID NO: 2104869 - protein, 25 aa, Staphylococcus
LSIGFGIGVFSEWKTLASKKDNGTK

SEQ ID NO: 2104870 - protein, 19 aa, Staphylococcus
LSIKPEKAKLIYGQSGKNE

SEQ ID NO: 2104871 - protein, 17 aa, Staphylococcus
LSIVFLLLIFCISGCGS

SEQ ID NO: 2104872 - protein, 24 aa, Staphylococcus
LSKDDGKLVYNFDLQKGKEKHEVT

SEQ ID NO: 2104873 - protein, 18 aa, Staphylococcus
LSKILNIKGKVIPSTNTS

SEQ ID NO: 2104874 - protein, 23 aa, Staphylococcus
LSKKKEQKFNHIVDLQERNLKNF

SEQ ID NO: 2104875 - protein, 19 aa, Staphylococcus
LSKNDKYWDRDKVKLDKVN

SEQ ID NO: 2104876 - protein, 21 aa, Staphylococcus
LSKNQKGMVVQQDWNGKHNKF

SEQ ID NO: 2104877 - protein, 28 aa, Staphylococcus
LSLFIVCFLLGCITWFGFEKQNNKINTI

SEQ ID NO: 2104878 - protein, 24 aa, Staphylococcus
LSMCAVLILSGCGYQHRDNKEVTL

SEQ ID NO: 2104879 - protein, 19 aa, Staphylococcus
LSMDIIYKPHYVFEPERIG

SEQ ID NO: 2104880 - protein, 19 aa, Staphylococcus
LSNFDYAMVEANQGEHAGY

SEQ ID NO: 2104881 - protein, 26 aa, Staphylococcus
LSNLAVKNDLHFKKFVKNNTLPSGYN

SEQ ID NO: 2104882 - protein, 24 aa, Staphylococcus
LSNNFVFPGQVLSVGGNNTNSSQY

SEQ ID NO: 2104883 - protein, 24 aa, Staphylococcus
LSNPSDHVMGLFPRVPTDRYRGNF

SEQ ID NO: 2104884 - protein, 22 aa, Staphylococcus
LSNYSLSYLFIEYLKKQSDNGE

SEQ ID NO: 2104885 - protein, 18 aa, Staphylococcus
LSPRAKQYRLKQLLNTKS

SEQ ID NO: 2104886 - protein, 19 aa, Staphylococcus
LSRFVISLLSFVLALTVVS

SEQ ID NO: 2104887 - protein, 22 aa, Staphylococcus
LSSCLILGACGNQDSEQKDEHK

SEQ ID NO: 2104888 - protein, 17 aa, Staphylococcus
LSSFIEALADFIKQKGV

SEQ ID NO: 2104889 - protein, 17 aa, Staphylococcus
LSSFLLLGACGNNDDSV

SEQ ID NO: 2104890 - protein, 26 aa, Staphylococcus
LSSFLVLSACSHSDHSDKKDSDKNSS

SEQ ID NO: 2104891 - protein, 20 aa, Staphylococcus
LSSIAAFFAINTAANAQESE

SEQ ID NO: 2104892 - protein, 18 aa, Staphylococcus
LSSKHKWSHAVDQGVYNN

SEQ ID NO: 2104893 - protein, 25 aa, Staphylococcus
LSSTSGNTPLGWYNVKDLNIKNLDE

SEQ ID NO: 2104894 - protein, 20 aa, Staphylococcus
LSSVAACIAFSNVADAQEET

SEQ ID NO: 2104895 - protein, 20 aa, Staphylococcus
LSSVCLIGLSSMHNTTFAKD

SEQ ID NO: 2104896 - protein, 23 aa, Staphylococcus
LSSVPLEAGQTYTVKDILSQTAL

SEQ ID NO: 2104897 - protein, 26 aa, Staphylococcus
LSTHQSDFNRLWSPDQYDNSFSLTTL

SEQ ID NO: 2104898 - protein, 19 aa, Staphylococcus
LSVLARGLREFPIDITAIV

SEQ ID NO: 2104899 - protein, 25 aa, Staphylococcus
LTAFDKKRMPNLKKYTQSIGTETSG

SEQ ID NO: 2104900 - protein, 28 aa, Staphylococcus
LTANKGAYRYYAFEGIRPSDNSDLHVTS

SEQ ID NO: 2104901 - protein, 26 aa, Staphylococcus
LTDADLIFYNGFNLESGNGWFEKALE

SEQ ID NO: 2104902 - protein, 19 aa, Staphylococcus
LTDADVIFYNGLNLESGDA

SEQ ID NO: 2104903 - protein, 19 aa, Staphylococcus
LTDADVIFYNGLNLETGNG

SEQ ID NO: 2104904 - protein, 20 aa, Staphylococcus
LTDFDHKKLPDLTHYNSSNP

SEQ ID NO: 2104905 - protein, 17 aa, Staphylococcus
LTDFDKKDMPSLDKYNH

SEQ ID NO: 2104906 - protein, 27 aa, Staphylococcus
LTDSEGATHYFYFPQSALIQNYQQDDN

SEQ ID NO: 2104907 - protein, 17 aa, Staphylococcus
LTHKIQVDGHVDTTKAG

SEQ ID NO: 2104908 - protein, 26 aa, Staphylococcus
LTIDELVEFEVAYAPPYSRPKDIINM

SEQ ID NO: 2104909 - protein, 25 aa, Staphylococcus
LTIISSGFGFYLYRSSHSPDQLDQV

SEQ ID NO: 2104910 - protein, 25 aa, Staphylococcus
LTIKLRKDAKWSNGDPVTAHDFEYA

SEQ ID NO: 2104911 - protein, 17 aa, Staphylococcus
LTIVGVVLILVAIYLFA

SEQ ID NO: 2104912 - protein, 19 aa, Staphylococcus
LTKPEYKNEISFPNIMDSS

SEQ ID NO: 2104913 - protein, 22 aa, Staphylococcus
LTLMLVLAACGNDDSKKEDDNK

SEQ ID NO: 2104914 - protein, 24 aa, Staphylococcus
LTLSLALAACSNGSDDDSSKKDDS

SEQ ID NO: 2104915 - protein, 17 aa, Staphylococcus
LTMLFILTACSNQIYGK

SEQ ID NO: 2104916 - protein, 21 aa, Staphylococcus
LTMPYIFERLFNYSGKNMADY

SEQ ID NO: 2104917 - protein, 21 aa, Staphylococcus
LTPQEKVALALYAPKSADFTV

SEQ ID NO: 2104918 - protein, 24 aa, Staphylococcus
LTRFKEKWQYLNIGMTNLFGSEIN

SEQ ID NO: 2104919 - protein, 17 aa, Staphylococcus
LTSLISSLFHFDDDISK

SEQ ID NO: 2104920 - protein, 18 aa, Staphylococcus
LTTGLRQSFFNNQDLSFN

SEQ ID NO: 2104921 - protein, 19 aa, Staphylococcus
LTTKAKYPIGTHFKVTLMS

SEQ ID NO: 2104922 - protein, 17 aa, Staphylococcus
LTTLSYKRNKVVKQSTV

SEQ ID NO: 2104923 - protein, 17 aa, Staphylococcus
LVALALVGVYKLWQDDR

SEQ ID NO: 2104924 - protein, 23 aa, Staphylococcus
LVDGAREAIGLALNKLGYSLNDT

SEQ ID NO: 2104925 - protein, 23 aa, Staphylococcus
LVDGAREIIGLGLNKLGYSLNDK

SEQ ID NO: 2104926 - protein, 25 aa, Staphylococcus
LVDPFCGSGTIAIEACLIAQNIAPG

SEQ ID NO: 2104927 - protein, 25 aa, Staphylococcus
LVEDYNSGKKYGWVKQSDVVYNTAK

SEQ ID NO: 2104928 - protein, 25 aa, Staphylococcus
LVEDYNTGKKYGWVKQSDVVYNTAK

SEQ ID NO: 2104929 - protein, 27 aa, Staphylococcus
LVETSRGYGGQPIKYSNLSSNTTNSSL

SEQ ID NO: 2104930 - protein, 24 aa, Staphylococcus
LVFFIGATVCWFTFEKQNYEETKI

SEQ ID NO: 2104931 - protein, 17 aa, Staphylococcus
LVGHSMGGQTIRQLEEL

SEQ ID NO: 2104932 - protein, 26 aa, Staphylococcus
LVGMRLRRVSPRKVIGPLIKAHKAGL

SEQ ID NO: 2104933 - protein, 19 aa, Staphylococcus
LVKKEGWAEVKQEKIADYA

SEQ ID NO: 2104934 - protein, 19 aa, Staphylococcus
LVLGFIVILAGCGKINEQD

SEQ ID NO: 2104935 - protein, 23 aa, Staphylococcus
LVLICTLTVIPMNGSAHAQTNQT

SEQ ID NO: 2104936 - protein, 24 aa, Staphylococcus
LVLSGCSLPGLGDGNAKDDVKITT

SEQ ID NO: 2104937 - protein, 22 aa, Staphylococcus
LVLSGCSLPGLGDGNSKDDVKI

SEQ ID NO: 2104938 - protein, 22 aa, Staphylococcus
LVLSGCSLPGLGDGNSKNDVKI

SEQ ID NO: 2104939 - protein, 25 aa, Staphylococcus
LVNDYNTGKTFGWVKQGDVVYNTAK

SEQ ID NO: 2104940 - protein, 25 aa, Staphylococcus
LVQDYNTGKKYGWVKQSDVTYNTAK

SEQ ID NO: 2104941 - protein, 26 aa, Staphylococcus
LVSDYNSGKLYGWVKQNETIYNTITP

SEQ ID NO: 2104942 - protein, 26 aa, Staphylococcus
LVSDYNSGKVYGWVKQGETVYNTVKS

SEQ ID NO: 2104943 - protein, 19 aa, Staphylococcus
LVSEMNWAASPGIVTYRTI

SEQ ID NO: 2104944 - protein, 25 aa, Staphylococcus
LVSEMNWSAAPGYMTYRTIPSYQVR

SEQ ID NO: 2104945 - protein, 22 aa, Staphylococcus
LVSLIVLAGCGEKGKDHSQENQ

SEQ ID NO: 2104946 - protein, 25 aa, Staphylococcus
LVTKYEGWEFLGLVKDDENAARGIV

SEQ ID NO: 2104947 - protein, 20 aa, Staphylococcus
LVTSLLLAGCSTGQSNDNKG

SEQ ID NO: 2104948 - protein, 20 aa, Staphylococcus
LVVASSLVLGACSTDTHEIK

SEQ ID NO: 2104949 - protein, 19 aa, Staphylococcus
LVVDHRPEVGAVFQTPAGY

SEQ ID NO: 2104950 - protein, 18 aa, Staphylococcus
LVVLVLSVVIFAAACGNS

SEQ ID NO: 2104951 - protein, 20 aa, Staphylococcus
LVYAKDVRQVLNYVEKGNAQ

SEQ ID NO: 2104952 - protein, 24 aa, Staphylococcus
LYAKGQCTYYVFDRIRQDGNMISN

SEQ ID NO: 2104953 - protein, 24 aa, Staphylococcus
LYAYGNCTYYVFNRRSELGRSIGS

SEQ ID NO: 2104954 - protein, 17 aa, Staphylococcus
LYGSVNNKLGWIAEKDL

SEQ ID NO: 2104955 - protein, 17 aa, Staphylococcus
LYISNVMTQPGETSDYD

SEQ ID NO: 2104956 - protein, 20 aa, Staphylococcus
LYNISKRSGVSVDNIKKWNN

SEQ ID NO: 2104957 - protein, 25 aa, Staphylococcus
LYNYGNCTYYAFNRRAELGKPIGSL

SEQ ID NO: 2104958 - protein, 19 aa, Staphylococcus
LYSIIPMIEMMFGVHFIKG

SEQ ID NO: 2104959 - protein, 26 aa, Staphylococcus
LYTAGQCTWYVFDRRSQAGKPISTYW

SEQ ID NO: 2104960 - protein, 36 aa, Staphylococcus
LYTAGQCTYYVYDKVGGKIGSTWGNANNWATAAAAD

SEQ ID NO: 2104961 - protein, 26 aa, Staphylococcus
LYTSGQCTWYVFDRRSQAGKPISTYW

SEQ ID NO: 2104962 - protein, 17 aa, Staphylococcus
LYTSVISNLCVKGIADA

SEQ ID NO: 2104963 - protein, 17 aa, Staphylococcus
LYTSVISNLCVKGISQA

SEQ ID NO: 2104964 - protein, 19 aa, Staphylococcus
LYTVPWGNYNQIAGTVSKS

SEQ ID NO: 2104965 - protein, 20 aa, Staphylococcus
LYTVPWGTPSQVASKVSGSG

SEQ ID NO: 2104966 - protein, 18 aa, Staphylococcus
LYTWGQCTYHVFNRRAQI

SEQ ID NO: 2104967 - protein, 17 aa, Staphylococcus
LYVANVMTQPGETNGYD

SEQ ID NO: 2104968 - protein, 17 aa, Staphylococcus
LYVSNVMTQPGETDNYD

SEQ ID NO: 2104969 - protein, 17 aa, Staphylococcus
LYVSNVMTQPGETNNYS

SEQ ID NO: 2104970 - protein, 28 aa, Staphylococcus
MAERTGVSASQWKGVIQRESGGNANAVN

SEQ ID NO: 2104971 - protein, 25 aa, Staphylococcus
MAFLLACCLGFLLFIATNQQALAKV

SEQ ID NO: 2104972 - protein, 21 aa, Staphylococcus
MALLFRHFFATSLHNQFMYNS

SEQ ID NO: 2104973 - protein, 19 aa, Staphylococcus
MALLFRHFYATSIHNQYMR

SEQ ID NO: 2104974 - protein, 18 aa, Staphylococcus
MALLFRHFYATSLHNQFM

SEQ ID NO: 2104975 - protein, 19 aa, Staphylococcus
MALLFRHFYATSLHNQFMY

SEQ ID NO: 2104976 - protein, 30 aa, Staphylococcus
MAQRTGVPASTWSAIIARESNGQANARNAS

SEQ ID NO: 2104977 - protein, 17 aa, Staphylococcus
MAVLLFLAACGGGHSQS

SEQ ID NO: 2104978 - protein, 18 aa, Staphylococcus
MDDLKRVRLDIDNEKEKQ

SEQ ID NO: 2104979 - protein, 26 aa, Staphylococcus
MDFIPNKLNKYSIRKFTVGTASILVG

SEQ ID NO: 2104980 - protein, 18 aa, Staphylococcus
MDGTYLVHMGINRHPGQE

SEQ ID NO: 2104981 - protein, 17 aa, Staphylococcus
MDLIKILFQKAQSLDSI

SEQ ID NO: 2104982 - protein, 17 aa, Staphylococcus
MEEPLEILNVINRYFDQ

SEQ ID NO: 2104983 - protein, 18 aa, Staphylococcus
MESRGMVLYINRNTRTTK

SEQ ID NO: 2104984 - protein, 18 aa, Staphylococcus
MFNKEMDGTYLVHMGINR

SEQ ID NO: 2104985 - protein, 18 aa, Staphylococcus
MGELINIKALVYTRNGTP

SEQ ID NO: 2104986 - protein, 17 aa, Staphylococcus
MGGQTIRQLEALLRNGN

SEQ ID NO: 2104987 - protein, 19 aa, Staphylococcus
MGGQTIRQLEELLRNGNPE

SEQ ID NO: 2104988 - protein, 19 aa, Staphylococcus
MGPSFNTAYRYYKNQPGAK

SEQ ID NO: 2104989 - protein, 19 aa, Staphylococcus
MGTDFIDYVICCGNEDYSE

SEQ ID NO: 2104990 - protein, 17 aa, Staphylococcus
MGVMFNRTNEGLLDFRR

SEQ ID NO: 2104991 - protein, 29 aa, Staphylococcus
MHPDLVKILGRLKFRTSYGQNVLKHSIEV

SEQ ID NO: 2104992 - protein, 17 aa, Staphylococcus
MIFLLIVALTACSNKTD

SEQ ID NO: 2104993 - protein, 17 aa, Staphylococcus
MILLTFALIAVPAIFAY

SEQ ID NO: 2104994 - protein, 24 aa, Staphylococcus
MISYAKERYGSIEVAISFRESNGW

SEQ ID NO: 2104995 - protein, 21 aa, Staphylococcus
MITSEGAFKYFAKQYDVKPGY

SEQ ID NO: 2104996 - protein, 17 aa, Staphylococcus
MIVDQVVNTVSHLYLTQ

SEQ ID NO: 2104997 - protein, 17 aa, Staphylococcus
MIVNQAVSAVDYLYEIR

SEQ ID NO: 2104998 - protein, 20 aa, Staphylococcus
MKELRRFVPSAKDEDWELHI

SEQ ID NO: 2104999 - protein, 20 aa, Staphylococcus
MKHPFHIHGTQFKVLSVDGE

SEQ ID NO: 2105000 - protein, 21 aa, Staphylococcus
MKVGEPRPKYQDVKLRKAMDY

SEQ ID NO: 2105001 - protein, 22 aa, Staphylococcus
MLIAGIFLLAACDKEQSKTYEG

SEQ ID NO: 2105002 - protein, 18 aa, Staphylococcus
MLLHNVIFSQQFRQNIDE

SEQ ID NO: 2105003 - protein, 18 aa, Staphylococcus
MLMVLTIIMSACSNNNNE

SEQ ID NO: 2105004 - protein, 24 aa, Staphylococcus
MLNFVEKGGNIIFISDHYNADRNL

SEQ ID NO: 2105005 - protein, 21 aa, Staphylococcus
MLNQYKIPYRFNEEIDDIDGS

SEQ ID NO: 2105006 - protein, 19 aa, Staphylococcus
MMAPRRRYSSGAPYTSQYM

SEQ ID NO: 2105007 - protein, 22 aa, Staphylococcus
MMQSGTKWFYVVYDSDDSISKD

SEQ ID NO: 2105008 - protein, 19 aa, Staphylococcus
MMYHMIKEHPEILKTTQNK

SEQ ID NO: 2105009 - protein, 19 aa, Staphylococcus
MNAFQHFAFLDQYKKAHKD

SEQ ID NO: 2105010 - protein, 19 aa, Staphylococcus
MNAFQHFAFLNEYKKAHKD

SEQ ID NO: 2105011 - protein, 17 aa, Staphylococcus
MNGYRRGAFDDMSKGMT

SEQ ID NO: 2105012 - protein, 18 aa, Staphylococcus
MNGYRRGAYQDMTKDMNS

SEQ ID NO: 2105013 - protein, 27 aa, Staphylococcus
MNLNGLNSFLIFPGQKLKVTGSTATVT

SEQ ID NO: 2105014 - protein, 19 aa, Staphylococcus
MNRDGSRMPYVFQATEVIK

SEQ ID NO: 2105015 - protein, 21 aa, Staphylococcus
MNYGHGAGVVTSRTISASQAA

SEQ ID NO: 2105016 - protein, 20 aa, Staphylococcus
MNYNGGPGVVSSRTISAGQA

SEQ ID NO: 2105017 - protein, 18 aa, Staphylococcus
MNYQGVGVVSTRTISASQ

SEQ ID NO: 2105018 - protein, 19 aa, Staphylococcus
MPKRFFSGQTKFLYKTKDK

SEQ ID NO: 2105019 - protein, 24 aa, Staphylococcus
MPSNTEILYELGLENRIVGVSTVD

SEQ ID NO: 2105020 - protein, 24 aa, Staphylococcus
MPSNTEILYELGLGKDVVGVSTVD

SEQ ID NO: 2105021 - protein, 25 aa, Staphylococcus
MPSNTEILYELGLKKQLIGVSTVDD

SEQ ID NO: 2105022 - protein, 25 aa, Staphylococcus
MPSNTEILYRLGLGNNIVGVSTVDD

SEQ ID NO: 2105023 - protein, 21 aa, Staphylococcus
MQFGTELTKILNICKEHELYV

SEQ ID NO: 2105024 - protein, 19 aa, Staphylococcus
MREFLKFTLDDKGKSAEDA

SEQ ID NO: 2105025 - protein, 19 aa, Staphylococcus
MRGTFLVTKFLLPLMLDNG

SEQ ID NO: 2105026 - protein, 20 aa, Staphylococcus
MRGTFLVTKFLLPLMMDHGG

SEQ ID NO: 2105027 - protein, 20 aa, Staphylococcus
MRGTFLVTKFLLPLMMDNGG

SEQ ID NO: 2105028 - protein, 21 aa, Staphylococcus
MRKVESQAGYNFLTGNGSNPI

SEQ ID NO: 2105029 - protein, 17 aa, Staphylococcus
MSESARGEGGRIWTYKD

SEQ ID NO: 2105030 - protein, 24 aa, Staphylococcus
MSEWKEYDYIFLTTGTFAYHDPYN

SEQ ID NO: 2105031 - protein, 24 aa, Staphylococcus
MSKQWKTKISNAFLDISKSEKGKK

SEQ ID NO: 2105032 - protein, 25 aa, Staphylococcus
MSLNGLSNFFIYPGQKLKVSGTAST

SEQ ID NO: 2105033 - protein, 29 aa, Staphylococcus
MSLPTKILLWIVGVLFLLAVIAVIYICAK

SEQ ID NO: 2105034 - protein, 17 aa, Staphylococcus
MTIGLAMNSVYYYQKEK

SEQ ID NO: 2105035 - protein, 19 aa, Staphylococcus
MTIIGVILILVAIYLFAKP

SEQ ID NO: 2105036 - protein, 19 aa, Staphylococcus
MTILGVILILVAVYLFAKP

SEQ ID NO: 2105037 - protein, 24 aa, Staphylococcus
MTLLSVRCQFTFKQAEKIESGTEF

SEQ ID NO: 2105038 - protein, 19 aa, Staphylococcus
MTMIGVILILVAVYLFAKP

SEQ ID NO: 2105039 - protein, 26 aa, Staphylococcus
MTQLERETKEGIDWKKETRDQGSQVL

SEQ ID NO: 2105040 - protein, 30 aa, Staphylococcus
MTVDAGFYKSVYNIGDFVWNDTNKNGIQDD

SEQ ID NO: 2105041 - protein, 22 aa, Staphylococcus
MVEGRSATISIHGAKGDDPIVF

SEQ ID NO: 2105042 - protein, 18 aa, Staphylococcus
MVSLRNAIQNEPQVESSS

SEQ ID NO: 2105043 - protein, 23 aa, Staphylococcus
MVTSEGAFKYFSKAFDIKPGYIW

SEQ ID NO: 2105044 - protein, 18 aa, Staphylococcus
MWKDITLNNKTFILDILQ

SEQ ID NO: 2105045 - protein, 18 aa, Staphylococcus
MYHYGKPTGKYKNDPAGT

SEQ ID NO: 2105046 - protein, 21 aa, Staphylococcus
MYIHCTLLPFIKAAGEMKTKP

SEQ ID NO: 2105047 - protein, 21 aa, Staphylococcus
MYVHCTLLPFIKAAGEMKTKP

SEQ ID NO: 2105048 - protein, 18 aa, Staphylococcus
NAAKALGYKIKLIGKGTY

SEQ ID NO: 2105049 - protein, 25 aa, Staphylococcus
NADDIKVAVDLSKARAGNYKEDYVV

SEQ ID NO: 2105050 - protein, 23 aa, Staphylococcus
NADSFHASGIFPSTDKSYYNQYK

SEQ ID NO: 2105051 - protein, 19 aa, Staphylococcus
NAEKSKTAFTFTKKEDDAT

SEQ ID NO: 2105052 - protein, 18 aa, Staphylococcus
NAGLKVKLLDIVIDENDP

SEQ ID NO: 2105053 - protein, 24 aa, Staphylococcus
NAHVKSSFDIKAFETRKDKITLKE

SEQ ID NO: 2105054 - protein, 18 aa, Staphylococcus
NAKELLATTVQRLAAEHT

SEQ ID NO: 2105055 - protein, 24 aa, Staphylococcus
NANGLPTDGFHFVWTQNTTASHSE

SEQ ID NO: 2105056 - protein, 17 aa, Staphylococcus
NANYSVKISNFIAKDLD

SEQ ID NO: 2105057 - protein, 17 aa, Staphylococcus
NAPKLYVSNVMTQPGET

SEQ ID NO: 2105058 - protein, 32 aa, Staphylococcus
NAPQGMKFFKVEPPKGNFASIVGINDEKLFIG

SEQ ID NO: 2105059 - protein, 26 aa, Staphylococcus
NASSGAYGLFQLLGHGEHAGMSVQDQ

SEQ ID NO: 2105060 - protein, 19 aa, Staphylococcus
NATRMKTMYDSIGESGKYF

SEQ ID NO: 2105061 - protein, 23 aa, Staphylococcus
NAVSAYDGYWLAAYQEQEPNREK

SEQ ID NO: 2105062 - protein, 21 aa, Staphylococcus
NAYKKLKAQAQTILDEEANNK

SEQ ID NO: 2105063 - protein, 17 aa, Staphylococcus
NDAFKYSDVKNYKDAIK

SEQ ID NO: 2105064 - protein, 20 aa, Staphylococcus
NDFILEPSFIEAVKNNNFVI

SEQ ID NO: 2105065 - protein, 23 aa, Staphylococcus
NDFYIACQFHPEFLSRPNRPQPI

SEQ ID NO: 2105066 - protein, 30 aa, Staphylococcus
NDHAKLCYIYKFRARFAVLAHEIAQREGLP

SEQ ID NO: 2105067 - protein, 20 aa, Staphylococcus
NDKIEEIQAFFANAKTYRDA

SEQ ID NO: 2105068 - protein, 25 aa, Staphylococcus
NDLRAGIYADGGRQLATFGTQSSPG

SEQ ID NO: 2105069 - protein, 21 aa, Staphylococcus
NDRFIHVELVHTHDYDSFARS

SEQ ID NO: 2105070 - protein, 24 aa, Staphylococcus
NDSLLKEMDHWPTYYPASLDKDDI

SEQ ID NO: 2105071 - protein, 17 aa, Staphylococcus
NDVSLWIEELKPDPMGF

SEQ ID NO: 2105072 - protein, 22 aa, Staphylococcus
NEEISKVVGNAVHFESGKVENY

SEQ ID NO: 2105073 - protein, 24 aa, Staphylococcus
NEIKKLDAGSWFDGKYSNEKVPLL

SEQ ID NO: 2105074 - protein, 25 aa, Staphylococcus
NEINPSHVAVCWDMGQSTFRNDMYT

SEQ ID NO: 2105075 - protein, 28 aa, Staphylococcus
NEIQPSHVAVCWDMGKSTFRNDMFDGYK

SEQ ID NO: 2105076 - protein, 23 aa, Staphylococcus
NEKKLKDNKGFQDFMKFVLEDKG

SEQ ID NO: 2105077 - protein, 19 aa, Staphylococcus
NELIPQFDYVKEIATQFGF

SEQ ID NO: 2105078 - protein, 17 aa, Staphylococcus
NELTQVRPLRIMSPHAV

SEQ ID NO: 2105079 - protein, 17 aa, Staphylococcus
NELTQVRPLRIMSPHSV

SEQ ID NO: 2105080 - protein, 22 aa, Staphylococcus
NELYDLINEKYLIKTGQVAPWG

SEQ ID NO: 2105081 - protein, 18 aa, Staphylococcus
NEMKKWLIQHCVKEKDII

SEQ ID NO: 2105082 - protein, 23 aa, Staphylococcus
NENVEVWLIKKGFNIYNRYTLHR

SEQ ID NO: 2105083 - protein, 26 aa, Staphylococcus
NEQVEVWLIRKGFNIYHHYTLNRFNE

SEQ ID NO: 2105084 - protein, 27 aa, Staphylococcus
NETYLHGVINNIWGWIKSTDVKQTPKV

SEQ ID NO: 2105085 - protein, 18 aa, Staphylococcus
NEVYNYYLDKHHRDSYDN

SEQ ID NO: 2105086 - protein, 26 aa, Staphylococcus
NFLDPSHFENGFSLTSLISSLFHFDD

SEQ ID NO: 2105087 - protein, 19 aa, Staphylococcus
NFTKSIAIEYGRDNIRANA

SEQ ID NO: 2105088 - protein, 17 aa, Staphylococcus
NFTSNGTNWSWNYAQVG

SEQ ID NO: 2105089 - protein, 18 aa, Staphylococcus
NGDENLRKAKQNATTAVG

SEQ ID NO: 2105090 - protein, 37 aa, Staphylococcus
NGDGAHAQDARWLTKHPKLQEYGQYHGGGAHYGVDYG

SEQ ID NO: 2105091 - protein, 21 aa, Staphylococcus
NGENIRAILDLSGEKAGKHTA

SEQ ID NO: 2105092 - protein, 38 aa, Staphylococcus
NGIDGNSDIYRPTWKSEASSYRDATAHLAKTYATDTQY

SEQ ID NO: 2105093 - protein, 19 aa, Staphylococcus
NGITVSLLCYTYGTNGQIS

SEQ ID NO: 2105094 - protein, 25 aa, Staphylococcus
NGKDKYYNMFGIGAVDSDAVKQGFA

SEQ ID NO: 2105095 - protein, 32 aa, Staphylococcus
NGKRIFKPSTIIKRNGVRYGLVGVTTPETKIK

SEQ ID NO: 2105096 - protein, 24 aa, Staphylococcus
NGKTFKVDEGIYWLNDPYSLDYER

SEQ ID NO: 2105097 - protein, 17 aa, Staphylococcus
NGLDFGVYSYSMYENPD

SEQ ID NO: 2105098 - protein, 24 aa, Staphylococcus
NGLPTDGFTYRWNQATTGTNTESW

SEQ ID NO: 2105099 - protein, 24 aa, Staphylococcus
NGNHTFQISANFRSYPSKKESLED

SEQ ID NO: 2105100 - protein, 17 aa, Staphylococcus
NGNQEEIDYQKAHGGTI

SEQ ID NO: 2105101 - protein, 17 aa, Staphylococcus
NGNQEEIEYQKKHGGTI

SEQ ID NO: 2105102 - protein, 19 aa, Staphylococcus
NGNTWSWNYTYTGGADTAQ

SEQ ID NO: 2105103 - protein, 25 aa, Staphylococcus
NGPGLGDSNYWGGERLNITQEARAK

SEQ ID NO: 2105104 - protein, 21 aa, Staphylococcus
NGPYGHVAFVERVNADGSVFI

SEQ ID NO: 2105105 - protein, 19 aa, Staphylococcus
NGQNFTWKYIYTGEADSQP

SEQ ID NO: 2105106 - protein, 37 aa, Staphylococcus
NGQSNPYNDYAIEGSEGNYSYIFSFQNQAQPGTYTIA

SEQ ID NO: 2105107 - protein, 25 aa, Staphylococcus
NGTVWTHYAVSHWLGGTDHTDPHAY

SEQ ID NO: 2105108 - protein, 23 aa, Staphylococcus
NGWCAGYTMAFLLNATYNTGHYN

SEQ ID NO: 2105109 - protein, 22 aa, Staphylococcus
NGYNKRYGLFYIDFETQKRYIK

SEQ ID NO: 2105110 - protein, 19 aa, Staphylococcus
NGYSARTAPIVYPVNTPGY

SEQ ID NO: 2105111 - protein, 17 aa, Staphylococcus
NHAQEFVTPLAFQAISR

SEQ ID NO: 2105112 - protein, 17 aa, Staphylococcus
NHAQEFVTPLAFQSISK

SEQ ID NO: 2105113 - protein, 23 aa, Staphylococcus
NHEHPVKYDLSFQTIEDGDSRNS

SEQ ID NO: 2105114 - protein, 17 aa, Staphylococcus
NHIETAPTVFVHGQKVE

SEQ ID NO: 2105115 - protein, 22 aa, Staphylococcus
NIEAFKTIAKAVGKEDKGKERL

SEQ ID NO: 2105116 - protein, 17 aa, Staphylococcus
NIEGAQKIYELFKPTLE

SEQ ID NO: 2105117 - protein, 25 aa, Staphylococcus
NIEPKKAAHFHIFMGNNKDKILKEL

SEQ ID NO: 2105118 - protein, 24 aa, Staphylococcus
NIIFKGFLGTNIVKFFDYTLASVG

SEQ ID NO: 2105119 - protein, 19 aa, Staphylococcus
NIMKLNGLNNFLIVPGQKL

SEQ ID NO: 2105120 - protein, 25 aa, Staphylococcus
NIPYFGICLGMQLATVEFARNVVGL

SEQ ID NO: 2105121 - protein, 18 aa, Staphylococcus
NISIRKSELVFKNAPQGM

SEQ ID NO: 2105122 - protein, 17 aa, Staphylococcus
NIVGFVNILECCRHHEV

SEQ ID NO: 2105123 - protein, 35 aa, Staphylococcus
NKARDFNVVTGDHFKGPITGYVNYGFQNYKINVDL

SEQ ID NO: 2105124 - protein, 18 aa, Staphylococcus
NKDIKVLNIFGDLKDGTH

SEQ ID NO: 2105125 - protein, 18 aa, Staphylococcus
NKDVVSIKKGKKVELAKQ

SEQ ID NO: 2105126 - protein, 17 aa, Staphylococcus
NKGAMILAHSVENNPND

SEQ ID NO: 2105127 - protein, 17 aa, Staphylococcus
NKGFTHYTLQPKVGNVF

SEQ ID NO: 2105128 - protein, 22 aa, Staphylococcus
NKHQCTWWAFKRRAQVGKPVSN

SEQ ID NO: 2105129 - protein, 18 aa, Staphylococcus
NKINEAFSTYKSSVDNDS

SEQ ID NO: 2105130 - protein, 23 aa, Staphylococcus
NKKLHAWLKLSTLIDDVKVKDTY

SEQ ID NO: 2105131 - protein, 26 aa, Staphylococcus
NKLIYTVKLPENFEYIDDSTVATFVN

SEQ ID NO: 2105132 - protein, 25 aa, Staphylococcus
NKLRNGVKMIVDQAVNSVNYLYENQ

SEQ ID NO: 2105133 - protein, 23 aa, Staphylococcus
NKLRNGVKMIVDQVVNTVSHLYL

SEQ ID NO: 2105134 - protein, 22 aa, Staphylococcus
NKLRNGVKMIVNQVANAVDRLY

SEQ ID NO: 2105135 - protein, 23 aa, Staphylococcus
NKLRNGVKMIVSQVVNAVDYLYE

SEQ ID NO: 2105136 - protein, 17 aa, Staphylococcus
NKMNVQWFDRETMSLQM

SEQ ID NO: 2105137 - protein, 22 aa, Staphylococcus
NKNVREAFDVVINRKEIAKNVS

SEQ ID NO: 2105138 - protein, 17 aa, Staphylococcus
NKPEVVVNLAAQAGVRY

SEQ ID NO: 2105139 - protein, 18 aa, Staphylococcus
NKSADALVGKLKDNNKKL

SEQ ID NO: 2105140 - protein, 25 aa, Staphylococcus
NKSAKKYHNVFGIGAYDDNPLIEGI

SEQ ID NO: 2105141 - protein, 23 aa, Staphylococcus
NKVKYHRIVSLMPSNTEILYRLG

SEQ ID NO: 2105142 - protein, 19 aa, Staphylococcus
NKYKVHDEYASAYKNVLEK

SEQ ID NO: 2105143 - protein, 26 aa, Staphylococcus
NLAIMGRYVLTPDIFDYLATQGEGAG

SEQ ID NO: 2105144 - protein, 24 aa, Staphylococcus
NLCVKGIADALLKVDAPKLYVSNV

SEQ ID NO: 2105145 - protein, 25 aa, Staphylococcus
NLCVKGMSEAILRSKAPKLYISNVM

SEQ ID NO: 2105146 - protein, 24 aa, Staphylococcus
NLETGNGWFKKALEQAGKSMDDKK

SEQ ID NO: 2105147 - protein, 18 aa, Staphylococcus
NLFHEITKLKSLDYELKV

SEQ ID NO: 2105148 - protein, 21 aa, Staphylococcus
NLKDVSRYFALAHYSKNYKKV

SEQ ID NO: 2105149 - protein, 21 aa, Staphylococcus
NLKPDHAFSLSEDESADETMQ

SEQ ID NO: 2105150 - protein, 25 aa, Staphylococcus
NLKSERFTYCTKIIYQAYKYGVSKN

SEQ ID NO: 2105151 - protein, 25 aa, Staphylococcus
NLMGVIRMTKAVLPIMRSQREGRVI

SEQ ID NO: 2105152 - protein, 19 aa, Staphylococcus
NLPPSCLKGVQTCLDNNIP

SEQ ID NO: 2105153 - protein, 38 aa, Staphylococcus
NLPPTCLEGLYACIDKQIPIVIVSRSFNGIVSPVYAYE

SEQ ID NO: 2105154 - protein, 26 aa, Staphylococcus
NLSEKEKLALVFLANESGEYAITKND

SEQ ID NO: 2105155 - protein, 30 aa, Staphylococcus
NLYTAGQCTWYVYDKVGGNIGSTWGNANNW

SEQ ID NO: 2105156 - protein, 29 aa, Staphylococcus
NLYTWGQCTWHVFNRRSEIGKGISTYWWN

SEQ ID NO: 2105157 - protein, 30 aa, Staphylococcus
NMHPELVKILGRLNYRTSYGQNVLKHSIEV

SEQ ID NO: 2105158 - protein, 17 aa, Staphylococcus
NMKFGVYSYSLYENADD

SEQ ID NO: 2105159 - protein, 25 aa, Staphylococcus
NMKKEVLDWADKRAKQKGLAVSNRY

SEQ ID NO: 2105160 - protein, 25 aa, Staphylococcus
NNKEFLKKRYEAMKQSPMFDNIEYT

SEQ ID NO: 2105161 - protein, 22 aa, Staphylococcus
NNKEGIGYFGYNFYEQNKDKLK

SEQ ID NO: 2105162 - protein, 17 aa, Staphylococcus
NNKKLDVALGYSTDGRI

SEQ ID NO: 2105163 - protein, 24 aa, Staphylococcus
NNKTFRIAFSYLLIENTKTHDLYL

SEQ ID NO: 2105164 - protein, 17 aa, Staphylococcus
NNKTYYLLADFNGNVTR

SEQ ID NO: 2105165 - protein, 22 aa, Staphylococcus
NNLLKGCGVLENQGQAFSQAAK

SEQ ID NO: 2105166 - protein, 21 aa, Staphylococcus
NNLVKSFKSIRDGYSEKDKKK

SEQ ID NO: 2105167 - protein, 23 aa, Staphylococcus
NNMIFPGQVISIGGSSNNSNNAS

SEQ ID NO: 2105168 - protein, 21 aa, Staphylococcus
NNMVFPGQVINVGGSASQSSN

SEQ ID NO: 2105169 - protein, 18 aa, Staphylococcus
NNNMVFPGQVIEIGGSSS

SEQ ID NO: 2105170 - protein, 30 aa, Staphylococcus
NNPAEEGRFLKFFVDDGLIKLKKGVKIQDA

SEQ ID NO: 2105171 - protein, 25 aa, Staphylococcus
NNPAEQGRFLKFFVDADLIKIKKGV

SEQ ID NO: 2105172 - protein, 30 aa, Staphylococcus; identical to SEQ ID NO: 1841069

SEQ ID NO: 2105173 - protein, 32 aa, Staphylococcus
NNPYMNMPDQEWRKNTGDGLSSGEKQTMYAIE

SEQ ID NO: 2105174 - protein, 26 aa, Staphylococcus
NNQKFLKKRYEAMKDFPMFDNIEYTE

SEQ ID NO: 2105175 - protein, 22 aa, Staphylococcus
NNRQSKKILINIGQMSNDFSPI

SEQ ID NO: 2105176 - protein, 30 aa, Staphylococcus
NNRTYRLTKKALLGDKSFYLITDYNKNTNV

SEQ ID NO: 2105177 - protein, 35 aa, Staphylococcus
NNTTFPKGWHEWVMAAKAKPVYGAKDFLNYANKKG

SEQ ID NO: 2105178 - protein, 24 aa, Staphylococcus
NNTYRTPLSPIFDATHSSGLPASN

SEQ ID NO: 2105179 - protein, 26 aa, Staphylococcus
NNVKFLKDRYEAMKNFPMFDNIEYTE

SEQ ID NO: 2105180 - protein, 27 aa, Staphylococcus
NNVKFLKDRYEKMKAFPMFDNIEYTED

SEQ ID NO: 2105181 - protein, 26 aa, Staphylococcus
NNVQFLKDRYHAMKDFPMFDNIEYTE

SEQ ID NO: 2105182 - protein, 17 aa, Staphylococcus
NNYADYAATQLVYYGLK

SEQ ID NO: 2105183 - protein, 24 aa, Staphylococcus
NPAEEGRFLKFFQDAGLIKIKKGV

SEQ ID NO: 2105184 - protein, 23 aa, Staphylococcus
NPAEEGRFLSFFVDEGLIKLKKG

SEQ ID NO: 2105185 - protein, 24 aa, Staphylococcus
NPAEEGRFLSFFVDKGLIKIKKGV

SEQ ID NO: 2105186 - protein, 23 aa, Staphylococcus
NPAEEGRFLSFFVNEGLIKLKKG

SEQ ID NO: 2105187 - protein, 24 aa, Staphylococcus
NPAEEGRFLSFFVNEGLIKLKKGV

SEQ ID NO: 2105188 - protein, 23 aa, Staphylococcus
NPAEEGRFLSFFVNEGLVKIKKG

SEQ ID NO: 2105189 - protein, 25 aa, Staphylococcus
NPDIILRLPHGMPDEVKKMFQKEFK

SEQ ID NO: 2105190 - protein, 18 aa, Staphylococcus
NPEAIHKMKHSGSYMTKQ

SEQ ID NO: 2105191 - protein, 19 aa, Staphylococcus
NPEDLKVTIDLSDKKAGEY

SEQ ID NO: 2105192 - protein, 19 aa, Staphylococcus
NPEEVKYQKEHGGEISPLY

SEQ ID NO: 2105193 - protein, 24 aa, Staphylococcus
NPGLKKRLLASTFYIKMNQDNVPE

SEQ ID NO: 2105194 - protein, 23 aa, Staphylococcus
NPGVKPLIHPGDLIAVSDKGSAT

SEQ ID NO: 2105195 - protein, 19 aa, Staphylococcus
NPGVTALIHPGDLIAVSEK

SEQ ID NO: 2105196 - protein, 24 aa, Staphylococcus
NPKPKEGIGTWIGKDISYLTKKFG

SEQ ID NO: 2105197 - protein, 18 aa, Staphylococcus
NPLNSYEIHEMFSEEKLK

SEQ ID NO: 2105198 - protein, 19 aa, Staphylococcus
NPMPPRTAKLIKQLIKDGS

SEQ ID NO: 2105199 - protein, 21 aa, Staphylococcus
NPNIPLIRLLDKGELPFQSEA

SEQ ID NO: 2105200 - protein, 21 aa, Staphylococcus
NPNSELIFGFNTMPANNGKGG

SEQ ID NO: 2105201 - protein, 22 aa, Staphylococcus
NPNVPLIKLMNKFELTNASEQD

SEQ ID NO: 2105202 - protein, 22 aa, Staphylococcus
NPQKEMGFNWYTTDKAEQPQVW

SEQ ID NO: 2105203 - protein, 18 aa, Staphylococcus
NPQYLKEAKLCDSIKATT

SEQ ID NO: 2105204 - protein, 23 aa, Staphylococcus
NPSQGQISRFLVKHQDKISAKRP

SEQ ID NO: 2105205 - protein, 23 aa, Staphylococcus
NQAGKYKIEYKVEDSNGASSKSI

SEQ ID NO: 2105206 - protein, 18 aa, Staphylococcus
NQAIKANEDILEYTKLFE

SEQ ID NO: 2105207 - protein, 19 aa, Staphylococcus
NQAPKRWPSNIPGSENVRD

SEQ ID NO: 2105208 - protein, 19 aa, Staphylococcus
NQAPKRWPSNVPGGDNVRD

SEQ ID NO: 2105209 - protein, 24 aa, Staphylococcus
NQAQKARLTDNINHANHIADVEQL

SEQ ID NO: 2105210 - protein, 18 aa, Staphylococcus
NQATSHIWENGKVDIAPN

SEQ ID NO: 2105211 - protein, 19 aa, Staphylococcus
NQESLKQTKIHPVKKELIA

SEQ ID NO: 2105212 - protein, 17 aa, Staphylococcus
NQFDFYKSKALRNHQSI

SEQ ID NO: 2105213 - protein, 21 aa, Staphylococcus
NQKKHQIRMLSIPRDTISYIP

SEQ ID NO: 2105214 - protein, 20 aa, Staphylococcus
NQLKKAYGKDLIKKSHNKNK

SEQ ID NO: 2105215 - protein, 21 aa, Staphylococcus
NQNTPIGWYNIKDVNIKNYGT

SEQ ID NO: 2105216 - protein, 32 aa, Staphylococcus
NQSEALKQLPNFQTALDIAKQEANLYGNHNKT

SEQ ID NO: 2105217 - protein, 23 aa, Staphylococcus
NQSMDLLLSKRVDATFNDSLSYL

SEQ ID NO: 2105218 - protein, 18 aa, Staphylococcus
NQSYSVKPGTKFYTVPWG

SEQ ID NO: 2105219 - protein, 18 aa, Staphylococcus
NQYSIPYFFGTVGILYNK

SEQ ID NO: 2105220 - protein, 18 aa, Staphylococcus
NRAFICGDAGHIHSPAGG

SEQ ID NO: 2105221 - protein, 21 aa, Staphylococcus
NRAGDGYPAFQKDYGFKFKSA

SEQ ID NO: 2105222 - protein, 22 aa, Staphylococcus
NRAGDGYPAFVKDYGFKFASAR

SEQ ID NO: 2105223 - protein, 22 aa, Staphylococcus
NRAGDGYPAFVKDYGFKFDSAR

SEQ ID NO: 2105224 - protein, 22 aa, Staphylococcus
NRKVVNGKTWYYGKLSNGKYVW

SEQ ID NO: 2105225 - protein, 20 aa, Staphylococcus
NRLSTVYNEVFQIHLQTEKG

SEQ ID NO: 2105226 - protein, 17 aa, Staphylococcus
NRSSGKMGYAIAEALAK

SEQ ID NO: 2105227 - protein, 17 aa, Staphylococcus
NRSSGKMGYALAEALRN

SEQ ID NO: 2105228 - protein, 17 aa, Staphylococcus
NRSSGKMGYALAQALKQ

SEQ ID NO: 2105229 - protein, 18 aa, Staphylococcus
NRVIFDFYDVDPYQQAAL

SEQ ID NO: 2105230 - protein, 24 aa, Staphylococcus
NSANYSVRISKFIADSLNQYRQAN

SEQ ID NO: 2105231 - protein, 21 aa, Staphylococcus
NSDFSSASLLVNEFSKNQKDD

SEQ ID NO: 2105232 - protein, 21 aa, Staphylococcus
NSDGDWGFSFTDKDGELAGSY

SEQ ID NO: 2105233 - protein, 17 aa, Staphylococcus
NSEIIDGLAELQDVDAS

SEQ ID NO: 2105234 - protein, 38 aa, Staphylococcus
NSGSPVFNSRNEVIGIHWGGAANSYNGAVFINKDVQNF

SEQ ID NO: 2105235 - protein, 19 aa, Staphylococcus
NSISKAIIDGAKFIAQDYI

SEQ ID NO: 2105236 - protein, 23 aa, Staphylococcus
NSKLLENITTWFGKQDNTPNLKE

SEQ ID NO: 2105237 - protein, 25 aa, Staphylococcus
NSKNEVIGVHAFRLNSGDYKKYNLN

SEQ ID NO: 2105238 - protein, 26 aa, Staphylococcus
NSKNEVLGVHAFRIASGDYQKYNLNT

SEQ ID NO: 2105239 - protein, 17 aa, Staphylococcus
NSKSDQVLGLFAEKNMP

SEQ ID NO: 2105240 - protein, 26 aa, Staphylococcus
NSNGEGGTLRITGTVSDNQPFNSQIR

SEQ ID NO: 2105241 - protein, 23 aa, Staphylococcus
NSNLIFPNQVLKVSGSSASTSRN

SEQ ID NO: 2105242 - protein, 25 aa, Staphylococcus
NSNYKEIVNQIVFTNGKTYTDSNNT

SEQ ID NO: 2105243 - protein, 26 aa, Staphylococcus
NSQLKVIPVDSIGRVAANNHGVYTTV

SEQ ID NO: 2105244 - protein, 25 aa, Staphylococcus
NSRHKASQVDPEFSHKQAQKKADVD

SEQ ID NO: 2105245 - protein, 18 aa, Staphylococcus
NSSIKKLIYRGIKSTVHF

SEQ ID NO: 2105246 - protein, 22 aa, Staphylococcus
NSVLCLMFFFKYRQLKKDHHFY

SEQ ID NO: 2105247 - protein, 31 aa, Staphylococcus
NSVSKAIIGGAKFIGKDYIKAGQNTLYKMRW

SEQ ID NO: 2105248 - protein, 19 aa, Staphylococcus
NTATVAWADQMKKLAGNKK

SEQ ID NO: 2105249 - protein, 19 aa, Staphylococcus
NTDDIKVAVDLSNAKAGKY

SEQ ID NO: 2105250 - protein, 25 aa, Staphylococcus
NTFMPHLDYDMSFMIQEYIEDKANV

SEQ ID NO: 2105251 - protein, 18 aa, Staphylococcus
NTGIIRAIVYYNDNLMSN

SEQ ID NO: 2105252 - protein, 24 aa, Staphylococcus
NTILRILKEWKNQMSDVINIIEHN

SEQ ID NO: 2105253 - protein, 23 aa, Staphylococcus
NTKKEWRGDYLIEQLSKDNSIKK

SEQ ID NO: 2105254 - protein, 17 aa, Staphylococcus
NTNLVDQFYHNVAQSQS

SEQ ID NO: 2105255 - protein, 23 aa, Staphylococcus
NTNTSGITADWANQAQPSTNQAD

SEQ ID NO: 2105256 - protein, 24 aa, Staphylococcus
NTTFAFKQNGEFEVIPNNANASTT

SEQ ID NO: 2105257 - protein, 23 aa, Staphylococcus
NTTIPGLRTNIIGTEKALAEAGG

SEQ ID NO: 2105258 - protein, 30 aa, Staphylococcus
NTVKKAIVGGAKFIAGSYINQGQNTLYKMR

SEQ ID NO: 2105259 - protein, 19 aa, Staphylococcus
NTYDGTGFVIARTSDTRIT

SEQ ID NO: 2105260 - protein, 19 aa, Staphylococcus
NTYDGTGFVIARTSQTDIT

SEQ ID NO: 2105261 - protein, 24 aa, Staphylococcus
NTYQKGQCTYYVFDKVREDHHQIA

SEQ ID NO: 2105262 - protein, 20 aa, Staphylococcus
NVDVSFNYGGSGALRQQIEK

SEQ ID NO: 2105263 - protein, 26 aa, Staphylococcus
NVIECRDAESLYEIPLQLSKQHMDDL

SEQ ID NO: 2105264 - protein, 17 aa, Staphylococcus
NVIGKVPEKEWRVNDGL

SEQ ID NO: 2105265 - protein, 20 aa, Staphylococcus
NVKAGSTLYTVPWGTPSQVA

SEQ ID NO: 2105266 - protein, 26 aa, Staphylococcus
NVKGNANIYYVPWSKDNQVVAKTPKN

SEQ ID NO: 2105267 - protein, 24 aa, Staphylococcus
NVKSSDWLSEHFGVRFRYNALGDL

SEQ ID NO: 2105268 - protein, 20 aa, Staphylococcus
NVLSKEKDLFELVKQDGVTQ

SEQ ID NO: 2105269 - protein, 25 aa, Staphylococcus
NVNFLKRRFEALSPLSMFKGIEYTE

SEQ ID NO: 2105270 - protein, 18 aa, Staphylococcus
NVSGWKAVDKESIIRKNP

SEQ ID NO: 2105271 - protein, 18 aa, Staphylococcus
NWNGGVNVKSYRTIYNPG

SEQ ID NO: 2105272 - protein, 21 aa, Staphylococcus
NYANSRYGSLDAAIAFRDNHG

SEQ ID NO: 2105273 - protein, 24 aa, Staphylococcus
NYATKLNSLIEHYSLTDFDKKHMP

SEQ ID NO: 2105274 - protein, 18 aa, Staphylococcus
NYDLEHPNEIGIFQTLIE

SEQ ID NO: 2105275 - protein, 20 aa, Staphylococcus
NYGHGPGVVTSRTISASQAG

SEQ ID NO: 2105276 - protein, 19 aa, Staphylococcus
NYHDYRFIDRDKVDQPTLD

SEQ ID NO: 2105277 - protein, 21 aa, Staphylococcus
NYKVSEAFLNKNTVQVTGGKN

SEQ ID NO: 2105278 - protein, 18 aa, Staphylococcus
NYNGGPGVVSTRTISASQ

SEQ ID NO: 2105279 - protein, 26 aa, Staphylococcus
NYNLFGMKGSYKGASVNFNTLEASSN

SEQ ID NO: 2105280 - protein, 18 aa, Staphylococcus
NYTVQFITPDGYILSPSK

SEQ ID NO: 2105281 - protein, 19 aa, Staphylococcus
NYYFPVLQGEHIKYVLTVT

SEQ ID NO: 2105282 - protein, 24 aa, Staphylococcus
PAMIKGDVDASVFQSRAYMESIND

SEQ ID NO: 2105283 - protein, 23 aa, Staphylococcus
PANNGKGGTYLIVKNADNDKQIV

SEQ ID NO: 2105284 - protein, 19 aa, Staphylococcus
PATSKGVWQVRPVQNGWDH

SEQ ID NO: 2105285 - protein, 17 aa, Staphylococcus
PAVASKSGLLAHPSESY

SEQ ID NO: 2105286 - protein, 19 aa, Staphylococcus
PCLITIFGATGDLSHRKLF

SEQ ID NO: 2105287 - protein, 18 aa, Staphylococcus
PDHVFEKTSVRHVQISEK

SEQ ID NO: 2105288 - protein, 17 aa, Staphylococcus
PDIKWAGTIGNGKMEIH

SEQ ID NO: 2105289 - protein, 17 aa, Staphylococcus
PDLIIADSNRHKGIYKD

SEQ ID NO: 2105290 - protein, 17 aa, Staphylococcus
PDPPRIDSNTVLYKAGL

SEQ ID NO: 2105291 - protein, 18 aa, Staphylococcus
PDPTAFLEIMTKGNAQNN

SEQ ID NO: 2105292 - protein, 18 aa, Staphylococcus
PDVYPGMEQQLLDTLNRH

SEQ ID NO: 2105293 - protein, 17 aa, Staphylococcus
PEAIHKMKHSGMYMTKE

SEQ ID NO: 2105294 - protein, 19 aa, Staphylococcus
PEANFPMSSIEAAIQAHLE

SEQ ID NO: 2105295 - protein, 24 aa, Staphylococcus
PEDMKRLNHYGVDGVFTNYPDLYK

SEQ ID NO: 2105296 - protein, 20 aa, Staphylococcus
PEDVLYDVVFLFPKSMQLKE

SEQ ID NO: 2105297 - protein, 21 aa, Staphylococcus
PEEYRYGFYVTPYLNRVNGVF

SEQ ID NO: 2105298 - protein, 27 aa, Staphylococcus
PEFKNKDLRLAIAQSIDKEGYVNSVKN

SEQ ID NO: 2105299 - protein, 21 aa, Staphylococcus
PEFNIKFTIIEPGGIQSEFMP

SEQ ID NO: 2105300 - protein, 18 aa, Staphylococcus
PEGYHWYDRSTFAPGSYG

SEQ ID NO: 2105301 - protein, 23 aa, Staphylococcus
PEKDFFIACQFHPEFLSRPNRPQ

SEQ ID NO: 2105302 - protein, 39 aa, Staphylococcus
PEKEPWSQPPSGYKWYDRSTFKLGSYGSTSSQLNSNHKN

SEQ ID NO: 2105303 - protein, 24 aa, Staphylococcus
PEKNSDGEWGFSFTDKDGNLAGSY

SEQ ID NO: 2105304 - protein, 27 aa, Staphylococcus
PESKNLGGFPITGQFLICTNPDTIAKH

SEQ ID NO: 2105305 - protein, 19 aa, Staphylococcus
PESNPLLVDMENSALSKLE

SEQ ID NO: 2105306 - protein, 19 aa, Staphylococcus
PESYLRKFNYLVFPDNVAI

SEQ ID NO: 2105307 - protein, 21 aa, Staphylococcus
PEVYKAVFEACGERFEDYIDM

SEQ ID NO: 2105308 - protein, 17 aa, Staphylococcus
PEVYKAVFEACGKNFED

SEQ ID NO: 2105309 - protein, 18 aa, Staphylococcus
PFFEYARTFDYIVVSDVG

SEQ ID NO: 2105310 - protein, 21 aa, Staphylococcus
PFFEYLRTFDFIVVSDVGLIN

SEQ ID NO: 2105311 - protein, 24 aa, Staphylococcus
PFKQRVTAELTMNYSMSLSGWGPD

SEQ ID NO: 2105312 - protein, 23 aa, Staphylococcus
PFMKEVWDYDITVAKAAAKAGFQ

SEQ ID NO: 2105313 - protein, 23 aa, Staphylococcus
PFNSQIRFKISATDNANNTTNNR

SEQ ID NO: 2105314 - protein, 23 aa, Staphylococcus
PGLVEPFSRFVLEKEQEGQFKFL

SEQ ID NO: 2105315 - protein, 18 aa, Staphylococcus
PGPYGHVAYVERVNGDGS

SEQ ID NO: 2105316 - protein, 25 aa, Staphylococcus
PGYNLFHIYPIFPLPERQKFFTQLK

SEQ ID NO: 2105317 - protein, 19 aa, Staphylococcus
PHIAASSLVNLSRDHKQDS

SEQ ID NO: 2105318 - protein, 19 aa, Staphylococcus
PHIIASSLVHLNAQHVEDS

SEQ ID NO: 2105319 - protein, 20 aa, Staphylococcus
PHLGHAMAVVGNAKINNEEK

SEQ ID NO: 2105320 - protein, 24 aa, Staphylococcus
PHRDYRTTFSLLYRLYDKLLTTVK

SEQ ID NO: 2105321 - protein, 26 aa, Staphylococcus
PIGSLWGDAGSWAVNARNAGFTVNNI

SEQ ID NO: 2105322 - protein, 17 aa, Staphylococcus
PIHFNLPFREPLTPNLE

SEQ ID NO: 2105323 - protein, 24 aa, Staphylococcus
PIKETLAASLIRLANWKGDSPLID

SEQ ID NO: 2105324 - protein, 17 aa, Staphylococcus
PIKGRVTILQPFPSKSH

SEQ ID NO: 2105325 - protein, 20 aa, Staphylococcus
PILAVGFIVMAVREEKKRKA

SEQ ID NO: 2105326 - protein, 21 aa, Staphylococcus
PKDPKRIAVVAPSYAGGIKKL

SEQ ID NO: 2105327 - protein, 26 aa, Staphylococcus
PKDPKRIAVVAPTFAGGLHKLGANIV

SEQ ID NO: 2105328 - protein, 22 aa, Staphylococcus
PKDPKRIAVVAPTYAGGIKKLG

SEQ ID NO: 2105329 - protein, 22 aa, Staphylococcus
PKGEGNKSLPDFLSDFKDDKYL

SEQ ID NO: 2105330 - protein, 17 aa, Staphylococcus
PKGSVYVLPNTGGTKAY

SEQ ID NO: 2105331 - protein, 18 aa, Staphylococcus
PKGSVYVLPNTGGTKAYD

SEQ ID NO: 2105332 - protein, 23 aa, Staphylococcus
PKHPKRVVVLEYSFVDALAALDV

SEQ ID NO: 2105333 - protein, 24 aa, Staphylococcus
PKHPKRVVVLEYSFVDALASLDVK

SEQ ID NO: 2105334 - protein, 17 aa, Staphylococcus
PKIFVPLIKNLKENNDL

SEQ ID NO: 2105335 - protein, 17 aa, Staphylococcus
PKKAIVLDYGALDTLKE

SEQ ID NO: 2105336 - protein, 22 aa, Staphylococcus
PKKGGFFEELEKTFKEINDELN

SEQ ID NO: 2105337 - protein, 18 aa, Staphylococcus
PKLEHLAVTFNEDGSSRT

SEQ ID NO: 2105338 - protein, 18 aa, Staphylococcus
PKLNVPLVKSYMDMQSDL

SEQ ID NO: 2105339 - protein, 18 aa, Staphylococcus
PKNALPLKYENNGVTYVN

SEQ ID NO: 2105340 - protein, 17 aa, Staphylococcus
PKNAVVLDYGALDVLKE

SEQ ID NO: 2105341 - protein, 18 aa, Staphylococcus
PKNAVVLDYGVLNDMKEM

SEQ ID NO: 2105342 - protein, 21 aa, Staphylococcus
PKNPKRIAVVAPSYAGGLKKL

SEQ ID NO: 2105343 - protein, 21 aa, Staphylococcus
PKNPKRIAVVAPTYAGGLKKL

SEQ ID NO: 2105344 - protein, 18 aa, Staphylococcus
PKNTEIDDQYIHGEVANA

SEQ ID NO: 2105345 - protein, 27 aa, Staphylococcus
PKSGTSISLRPAFILKSAKHKDAAKDY

SEQ ID NO: 2105346 - protein, 21 aa, Staphylococcus
PKTGGFLEEIEKTFREINDEI

SEQ ID NO: 2105347 - protein, 24 aa, Staphylococcus
PKVLITSLIFFASFLMIGELNHAW

SEQ ID NO: 2105348 - protein, 34 aa, Staphylococcus
PKYLPRFIFGHYMKSYLLHFDKIFDNLTLIHDEV

SEQ ID NO: 2105349 - protein, 25 aa, Staphylococcus
PLDHYKLSPMYGDLEGLGHITITTG

SEQ ID NO: 2105350 - protein, 21 aa, Staphylococcus
PLENAKHALQQSIDQATDTTG

SEQ ID NO: 2105351 - protein, 29 aa, Staphylococcus
PLGFQIPDVRQLFAMDITSRIIGRDKNKN

SEQ ID NO: 2105352 - protein, 18 aa, Staphylococcus
PLPYHFEFIDLLAESLNA

SEQ ID NO: 2105353 - protein, 18 aa, Staphylococcus
PMGFNAYEKGQCTYYAFD

SEQ ID NO: 2105354 - protein, 17 aa, Staphylococcus
PMGGIQIIPETNQVISP

SEQ ID NO: 2105355 - protein, 18 aa, Staphylococcus
PMGGIQIVPETNQIISPR

SEQ ID NO: 2105356 - protein, 25 aa, Staphylococcus
PMIEMMFGVHFIKGGMYGMAQGLTR

SEQ ID NO: 2105357 - protein, 25 aa, Staphylococcus
PMIEMMFGVHFIKGGMYGMVKGLEQ

SEQ ID NO: 2105358 - protein, 25 aa, Staphylococcus
PNDEMKGRIIGREGRNIRTLETLTG

SEQ ID NO: 2105359 - protein, 17 aa, Staphylococcus
PNGKVLGSLRDKYGNII

SEQ ID NO: 2105360 - protein, 43 aa, Staphylococcus
PNKLNKYAIRKFTVGTASLLIGATLVFGVGNVARADELDNASS

SEQ ID NO: 2105361 - protein, 25 aa, Staphylococcus
PNQAFKKEARFEVLDNQNHVFFTSD

SEQ ID NO: 2105362 - protein, 18 aa, Staphylococcus
PNSDITMISKAGSGNSES

SEQ ID NO: 2105363 - protein, 18 aa, Staphylococcus
PNTLRGINILVLPEANIP

SEQ ID NO: 2105364 - protein, 27 aa, Staphylococcus
PNTTVKRMAREAIENKVASQIQQINAN

SEQ ID NO: 2105365 - protein, 17 aa, Staphylococcus
PNVYPGMEEQLLETLKK

SEQ ID NO: 2105366 - protein, 26 aa, Staphylococcus
PNYNLFGIKGSYKGQSVNFNTLEAGS

SEQ ID NO: 2105367 - protein, 20 aa, Staphylococcus
PNYNSVGYSLTAPDAAGQRE

SEQ ID NO: 2105368 - protein, 24 aa, Staphylococcus
PPQVQRNGYGWSNATYSEIKNAMN

SEQ ID NO: 2105369 - protein, 24 aa, Staphylococcus
PQAFIRPLPHISFVQGDKNVNFLK

SEQ ID NO: 2105370 - protein, 18 aa, Staphylococcus
PQECNVIALNYADHHLKT

SEQ ID NO: 2105371 - protein, 22 aa, Staphylococcus
PQILRANILFDGETTPIEKEAH

SEQ ID NO: 2105372 - protein, 20 aa, Staphylococcus
PQLRGVNDIIIEKGEDYNLL

SEQ ID NO: 2105373 - protein, 18 aa, Staphylococcus
PQVQRTAGKWEDANYDEI

SEQ ID NO: 2105374 - protein, 17 aa, Staphylococcus
PQVQRTPGVWSNATFSE

SEQ ID NO: 2105375 - protein, 17 aa, Staphylococcus
PQYSLSFIGEQQPQESF

SEQ ID NO: 2105376 - protein, 20 aa, Staphylococcus
PRDTISYIPKVGYYDKITHA

SEQ ID NO: 2105377 - protein, 19 aa, Staphylococcus
PRINFNFKGTKPADSRYHD

SEQ ID NO: 2105378 - protein, 17 aa, Staphylococcus
PRLPILMTSRSANLPSV

SEQ ID NO: 2105379 - protein, 21 aa, Staphylococcus
PRSLVIAEVLKKAGYDVTTTP

SEQ ID NO: 2105380 - protein, 25 aa, Staphylococcus
PSIAISLLLTGCGQKDNGQDEGPKN

SEQ ID NO: 2105381 - protein, 33 aa, Staphylococcus
PSKGKADGVWFQLKPGIVSKAELVKTYGKPLNK

SEQ ID NO: 2105382 - protein, 18 aa, Staphylococcus
PSNMKFYATQPAKGSFST

SEQ ID NO: 2105383 - protein, 18 aa, Staphylococcus
PSNPKGRYISKFKESQLL

SEQ ID NO: 2105384 - protein, 23 aa, Staphylococcus
PSNTEILYELGLGDKVVGVSTVD

SEQ ID NO: 2105385 - protein, 22 aa, Staphylococcus
PSNTEILYQLGLGDDIVGVSTV

SEQ ID NO: 2105386 - protein, 19 aa, Staphylococcus
PSNYLAWGAGANANPYFYQ

SEQ ID NO: 2105387 - protein, 19 aa, Staphylococcus
PSQKEILSIVDEVKKSKQP

SEQ ID NO: 2105388 - protein, 19 aa, Staphylococcus
PSSVRGIAEISSIRQNDGY

SEQ ID NO: 2105389 - protein, 18 aa, Staphylococcus
PSYKEFQKDPVWKKLDAV

SEQ ID NO: 2105390 - protein, 18 aa, Staphylococcus
PTATRTALAQPKMAIKSN

SEQ ID NO: 2105391 - protein, 19 aa, Staphylococcus
PTDKPKTYGTFTFDPSIII

SEQ ID NO: 2105392 - protein, 19 aa, Staphylococcus
PTDYLSWGAGPNANGRFIN

SEQ ID NO: 2105393 - protein, 18 aa, Staphylococcus
PTDYLSWGAGPNANNRFI

SEQ ID NO: 2105394 - protein, 24 aa, Staphylococcus
PTEDELKHKSKPVQSFEYDIKKSN

SEQ ID NO: 2105395 - protein, 17 aa, Staphylococcus
PTGARSELEREIETIKR

SEQ ID NO: 2105396 - protein, 25 aa, Staphylococcus
PTGDQRVFRISTFNVTDEEKAQIKQ

SEQ ID NO: 2105397 - protein, 17 aa, Staphylococcus
PTIEVIDPVRFVSNRSS

SEQ ID NO: 2105398 - protein, 37 aa, Staphylococcus
PTMKLPYRFYFGGKLGTGFQWYSWIHIADLTRAILFL

SEQ ID NO: 2105399 - protein, 22 aa, Staphylococcus
PTQKYQFLRLDKSQNISSADLD

SEQ ID NO: 2105400 - protein, 23 aa, Staphylococcus
PTSAKAPTSIHPKSGTTSTKSST

SEQ ID NO: 2105401 - protein, 17 aa, Staphylococcus
PTSAKAYSLKPFNEQIF

SEQ ID NO: 2105402 - protein, 22 aa, Staphylococcus
PTSGNYWGGDRTDLQKDLENNG

SEQ ID NO: 2105403 - protein, 21 aa, Staphylococcus
PTSQYWWAYTEYFTGGVTPAA

SEQ ID NO: 2105404 - protein, 17 aa, Staphylococcus
PTYKAVKNIVGSNAVTR

SEQ ID NO: 2105405 - protein, 17 aa, Staphylococcus
PTYKHVKHLVGNKAIAR

SEQ ID NO: 2105406 - protein, 18 aa, Staphylococcus
PTYLSVGDGDPFYSQNES

SEQ ID NO: 2105407 - protein, 17 aa, Staphylococcus
PVAVAFGKQQPVIGFDI

SEQ ID NO: 2105408 - protein, 21 aa, Staphylococcus
PVEQPKLPILAKFNKDLKHNL

SEQ ID NO: 2105409 - protein, 18 aa, Staphylococcus
PVEVFDKIMGVDMRGTFL

SEQ ID NO: 2105410 - protein, 18 aa, Staphylococcus
PVEVGCLVPEGIDNVKII

SEQ ID NO: 2105411 - protein, 17 aa, Staphylococcus
PVHFERHKGHIDGNEVK

SEQ ID NO: 2105412 - protein, 18 aa, Staphylococcus
PVKAGAYDFSFVKDGFRY

SEQ ID NO: 2105413 - protein, 17 aa, Staphylococcus
PVQDGAYNINFNYNNTD

SEQ ID NO: 2105414 - protein, 18 aa, Staphylococcus
PVQEGAYNIAFDNSGYNF

SEQ ID NO: 2105415 - protein, 18 aa, Staphylococcus
PVVHNSRPKPGSKVKKNS

SEQ ID NO: 2105416 - protein, 23 aa, Staphylococcus
PWGRPDMALFKFTKAIVNDEEID

SEQ ID NO: 2105417 - protein, 18 aa, Staphylococcus
PWSQPPEGYHWYDRSTFA

SEQ ID NO: 2105418 - protein, 26 aa, Staphylococcus
PYPELKSELASPFAAIYDTQAKGKVS

SEQ ID NO: 2105419 - protein, 19 aa, Staphylococcus
QAEFKKVGIKLNINGETSD

SEQ ID NO: 2105420 - protein, 20 aa, Staphylococcus
QAEFLQAEFKKVGIKLNING

SEQ ID NO: 2105421 - protein, 20 aa, Staphylococcus
QAKAKLASITQVLNGTPSVA

SEQ ID NO: 2105422 - protein, 20 aa, Staphylococcus
QAKKALVVGAGYISLEVLEN

SEQ ID NO: 2105423 - protein, 25 aa, Staphylococcus
QAPDGMKFYMVYPDKGSYRTVVGVN

SEQ ID NO: 2105424 - protein, 26 aa, Staphylococcus
QASKRKIVDGAAYVYGTVNGKTGWIA

SEQ ID NO: 2105425 - protein, 17 aa, Staphylococcus
QAVNFSDIFLIALPTKA

SEQ ID NO: 2105426 - protein, 17 aa, Staphylococcus
QAVQSFLNDQVSKTEAK

SEQ ID NO: 2105427 - protein, 17 aa, Staphylococcus
QAVYVLLMLNLLSEHSV

SEQ ID NO: 2105428 - protein, 17 aa, Staphylococcus
QCTYHVFNRRAQIGKGI

SEQ ID NO: 2105429 - protein, 20 aa, Staphylococcus
QCTYYAFNRRAELGKPIGSL

SEQ ID NO: 2105430 - protein, 25 aa, Staphylococcus
QDAEGYPMKAAVTIDKRTGEFIDYI

SEQ ID NO: 2105431 - protein, 22 aa, Staphylococcus
QDAQFDVIFLFTKAMQLQDMLE

SEQ ID NO: 2105432 - protein, 22 aa, Staphylococcus
QDGDISVGHFFRERLGDEVLEN

SEQ ID NO: 2105433 - protein, 21 aa, Staphylococcus
QDGKPLIVMYGDFKCPYCKKV

SEQ ID NO: 2105434 - protein, 33 aa, Staphylococcus
QDIANYLPQYNYRYGKPEGIVMHDTANDNSTIT

SEQ ID NO: 2105435 - protein, 25 aa, Staphylococcus
QDNGTLLKNLTTWLGKSDSHESMKD

SEQ ID NO: 2105436 - protein, 23 aa, Staphylococcus
QDPHAWLSLDNGIKYVKTIQQTL

SEQ ID NO: 2105437 - protein, 20 aa, Staphylococcus
QDPHAWLSLENGIKYVETIR

SEQ ID NO: 2105438 - protein, 23 aa, Staphylococcus
QDSLSELLTAIFSSDSETTEHTA

SEQ ID NO: 2105439 - protein, 28 aa, Staphylococcus
QDTFKYSEVKSYKSAIKAAQRAFDGEIK

SEQ ID NO: 2105440 - protein, 24 aa, Staphylococcus
QDVKLRKAMDYAINKDEWIKAFLQ

SEQ ID NO: 2105441 - protein, 28 aa, Staphylococcus
QDYYAKVWLTVFKDYRGSGEVENHISNM

SEQ ID NO: 2105442 - protein, 25 aa, Staphylococcus
QEFIDAGGTKALWDSIVMPESGGNP

SEQ ID NO: 2105443 - protein, 23 aa, Staphylococcus
QEGAYNYTFDYNGFTYHFESDGT

SEQ ID NO: 2105444 - protein, 24 aa, Staphylococcus
QEMMRYGQSQGRNVNYLNRMPQFD

SEQ ID NO: 2105445 - protein, 19 aa, Staphylococcus
QEPIVFTSMEPSWFSKELD

SEQ ID NO: 2105446 - protein, 31 aa, Staphylococcus
QEYQLPFPKGVKGMLDKDGFKTIPHEQYSKY

SEQ ID NO: 2105447 - protein, 27 aa, Staphylococcus
QEYTIGPDLRKYFSLSNGQDIPNNSFT

SEQ ID NO: 2105448 - protein, 27 aa, Staphylococcus
QFDNSWCAGFSMAALLNATKNTDKYNA

SEQ ID NO: 2105449 - protein, 20 aa, Staphylococcus
QFEISKQFWGHLVKSGNIED

SEQ ID NO: 2105450 - protein, 22 aa, Staphylococcus
QFLLNHDIHLVGGHPMAGSHKS

SEQ ID NO: 2105451 - protein, 26 aa, Staphylococcus
QFMSTSFYNNWLYLYLFSSASQASQE

SEQ ID NO: 2105452 - protein, 35 aa, Staphylococcus
QFNLNGKTYHFWSDGTYFKWEYYPSNGSTVNSANQ

SEQ ID NO: 2105453 - protein, 17 aa, Staphylococcus
QGASFSQAAKKYGINEI

SEQ ID NO: 2105454 - protein, 24 aa, Staphylococcus
QGDDYRMILPFKESQARGLLQQNM

SEQ ID NO: 2105455 - protein, 24 aa, Staphylococcus
QGDNYRTILPFKESQARGLLQDNM

SEQ ID NO: 2105456 - protein, 25 aa, Staphylococcus
QGDNYRTILPFKESQARGVLQDNMA

SEQ ID NO: 2105457 - protein, 24 aa, Staphylococcus
QGDNYRTILPFKESQSRGLLQDNM

SEQ ID NO: 2105458 - protein, 25 aa, Staphylococcus
QGDNYRTLLPFKESKARGILQDNMT

SEQ ID NO: 2105459 - protein, 32 aa, Staphylococcus
QGDYHYTWKGNWSPDRLNSHNNYSYSNYSNNN

SEQ ID NO: 2105460 - protein, 22 aa, Staphylococcus
QGKIMLNKGYGFQDFDIAQKAS

SEQ ID NO: 2105461 - protein, 19 aa, Staphylococcus
QGKNESYPDYVERIKKQSK

SEQ ID NO: 2105462 - protein, 22 aa, Staphylococcus
QGNYHYTWQGNWSPDKVNHNNS

SEQ ID NO: 2105463 - protein, 23 aa, Staphylococcus
QGNYHYTWQGNWSPNQAQQGQYY

SEQ ID NO: 2105464 - protein, 25 aa, Staphylococcus
QGPPFPFPECGAMSQAYIGYQMQES

SEQ ID NO: 2105465 - protein, 21 aa, Staphylococcus
QGQNAVPVAQNITSGTPDSQA

SEQ ID NO: 2105466 - protein, 27 aa, Staphylococcus
QGQPFATSQTVRFIIRNVQPTAPQISE

SEQ ID NO: 2105467 - protein, 27 aa, Staphylococcus
QGYNLFHVYPIFPLPERERFLKQLQNI

SEQ ID NO: 2105468 - protein, 18 aa, Staphylococcus
QHGVVNVGYDLYIDIPDK

SEQ ID NO: 2105469 - protein, 26 aa, Staphylococcus
QHKVKSGESLWSIAQKYNTSVENIKQ

SEQ ID NO: 2105470 - protein, 20 aa, Staphylococcus
QHVGGVCLNVGCIPSKIFLE

SEQ ID NO: 2105471 - protein, 17 aa, Staphylococcus
QIEKGAPVDVFMSANTK

SEQ ID NO: 2105472 - protein, 17 aa, Staphylococcus
QIIKIKRIFILRDPRNN

SEQ ID NO: 2105473 - protein, 18 aa, Staphylococcus
QIKAVKNGRIETVNGDEI

SEQ ID NO: 2105474 - protein, 18 aa, Staphylococcus
QINKEKLAQLAESNDQSL

SEQ ID NO: 2105475 - protein, 24 aa, Staphylococcus
QIPSNELYDVIFLFPKSMQLESVL

SEQ ID NO: 2105476 - protein, 22 aa, Staphylococcus
QISRPGPRIDDGLKALRDAIYN

SEQ ID NO: 2105477 - protein, 32 aa, Staphylococcus
QIVKQDVQDGGIWRLVKIPDNVNRVKVQFLPN

SEQ ID NO: 2105478 - protein, 27 aa, Staphylococcus
QKADINMGMSYIVTGNVIGKVPEKEWR

SEQ ID NO: 2105479 - protein, 25 aa, Staphylococcus
QKAEARRIINQKAQDKITEINQNTQ

SEQ ID NO: 2105480 - protein, 24 aa, Staphylococcus
QKAHEQWIKDQVEWNKQNETRKQK

SEQ ID NO: 2105481 - protein, 18 aa, Staphylococcus
QKDPVWKKLDAVKNNRVD

SEQ ID NO: 2105482 - protein, 27 aa, Staphylococcus
QKDYGFKFKSARPMQIGLVYDALKNKK

SEQ ID NO: 2105483 - protein, 31 aa, Staphylococcus
QKEMGFSWYTTDRFKDAKVWVSESGRFDDAQ

SEQ ID NO: 2105484 - protein, 30 aa, Staphylococcus
QKEPWSEPKAGYKWYDPSTFAAGSYGGSQS

SEQ ID NO: 2105485 - protein, 26 aa, Staphylococcus
QKEYGFKFASARPMQIGLVYDALKNK

SEQ ID NO: 2105486 - protein, 21 aa, Staphylococcus
QKGMQGWKDYKKLMDKVKLAD

SEQ ID NO: 2105487 - protein, 19 aa, Staphylococcus
QKGTMGYGYQKYLKNHPNE

SEQ ID NO: 2105488 - protein, 17 aa, Staphylococcus
QKIKRNFDLFSYDKNNH

SEQ ID NO: 2105489 - protein, 24 aa, Staphylococcus
QKKHGGTISPLFKGNNDNMVSSIT

SEQ ID NO: 2105490 - protein, 25 aa, Staphylococcus
QKKHPKVLILMGIPGSYLVATDKSY

SEQ ID NO: 2105491 - protein, 18 aa, Staphylococcus
QKKLSAYQKQLLLDKVKV

SEQ ID NO: 2105492 - protein, 17 aa, Staphylococcus
QKLKRANLLVPLNHHKL

SEQ ID NO: 2105493 - protein, 30 aa, Staphylococcus
QKLMKLNGLKSFLIHPGQKLKVSGTVSTSK

SEQ ID NO: 2105494 - protein, 20 aa, Staphylococcus
QKPIVFTAMEPSWFSKELDI

SEQ ID NO: 2105495 - protein, 20 aa, Staphylococcus
QKQQNGVTWYYGKLTNGKYV

SEQ ID NO: 2105496 - protein, 28 aa, Staphylococcus
QKRAKINELMDFIELCNKSIKANEEILD

SEQ ID NO: 2105497 - protein, 18 aa, Staphylococcus
QKTFKQKFEAYIKALNKV

SEQ ID NO: 2105498 - protein, 21 aa, Staphylococcus
QKYQFLRLDKAQNLSTSSVNQ

SEQ ID NO: 2105499 - protein, 21 aa, Staphylococcus
QKYYNSFGFENTYAFMVTKEV

SEQ ID NO: 2105500 - protein, 19 aa, Staphylococcus
QLDEWKHLLDVVNHLDGEI

SEQ ID NO: 2105501 - protein, 23 aa, Staphylococcus
QLEARVDALYDKKMDEEDKALEE

SEQ ID NO: 2105502 - protein, 20 aa, Staphylococcus
QLEELLRNGNPEEVKYQKEH

SEQ ID NO: 2105503 - protein, 19 aa, Staphylococcus
QLIKNEAFKNLEVDVYDHD

SEQ ID NO: 2105504 - protein, 19 aa, Staphylococcus
QLKGIPGYIQSPYPTYNTL

SEQ ID NO: 2105505 - protein, 30 aa, Staphylococcus
QLLNRTGTTSGMRPASITAYNQAMQALKPD

SEQ ID NO: 2105506 - protein, 21 aa, Staphylococcus
QLQERRKHEIKERSTDPKSSE

SEQ ID NO: 2105507 - protein, 17 aa, Staphylococcus
QLTKDMAKKDIIKADED

SEQ ID NO: 2105508 - protein, 19 aa, Staphylococcus
QLTWFKNKMNVQWFDRETM

SEQ ID NO: 2105509 - protein, 18 aa, Staphylococcus
QLWDSWRGVNTEHLHAAG

SEQ ID NO: 2105510 - protein, 20 aa, Staphylococcus
QMELIKLLFKKAKEMDSYDK

SEQ ID NO: 2105511 - protein, 38 aa, Staphylococcus
QMICYDLRFPELLRYPARSGATIAFYVAQWPSARLNHW

SEQ ID NO: 2105512 - protein, 17 aa, Staphylococcus
QMNESKLEQSNRQRNND

SEQ ID NO: 2105513 - protein, 17 aa, Staphylococcus
QMSLPYPPQSYVGPSKW

SEQ ID NO: 2105514 - protein, 17 aa, Staphylococcus
QNALMFCVGNIHGPGKQ

SEQ ID NO: 2105515 - protein, 21 aa, Staphylococcus
QNAYNDYGIDSLDNGTYSYVF

SEQ ID NO: 2105516 - protein, 23 aa, Staphylococcus
QNDGYLWTINFNKYHIKRNGMVF

SEQ ID NO: 2105517 - protein, 20 aa, Staphylococcus
QNDKKREEPITEKATKQQKE

SEQ ID NO: 2105518 - protein, 26 aa, Staphylococcus
QNILRYGKSFVDICIYEQEDFVVVKL

SEQ ID NO: 2105519 - protein, 26 aa, Staphylococcus
QNIMKLNGLNSFLIHPGQVLKVSGTA

SEQ ID NO: 2105520 - protein, 30 aa, Staphylococcus
QNLKIDLLREGSKVARIVDVTGVKMMQYGD

SEQ ID NO: 2105521 - protein, 25 aa, Staphylococcus
QNLYTEGQCTWYVFDKRAQAGKPIS

SEQ ID NO: 2105522 - protein, 28 aa, Staphylococcus
QNLYTEGQCTWYVFDRRAQAGKPISTYW

SEQ ID NO: 2105523 - protein, 17 aa, Staphylococcus
QNNGLTTPLGWVNAKDV

SEQ ID NO: 2105524 - protein, 23 aa, Staphylococcus
QNTASNTPLGWVNINDVDVQNLG

SEQ ID NO: 2105525 - protein, 27 aa, Staphylococcus
QNTLYKMRWNPAHPGTHQYATDINWAN

SEQ ID NO: 2105526 - protein, 23 aa, Staphylococcus
QNTLYKMRWNPENPGTHQYATDI

SEQ ID NO: 2105527 - protein, 24 aa, Staphylococcus
QNTLYKMRWNPENPGVHQYATDVA

SEQ ID NO: 2105528 - protein, 17 aa, Staphylococcus
QNTPIGWVNTKDINTRN

SEQ ID NO: 2105529 - protein, 22 aa, Staphylococcus
QNVIKDVPEKSAHVTTTSTPGN

SEQ ID NO: 2105530 - protein, 23 aa, Staphylococcus
QNVLINLGFKQVYNLSGGNKNYQ

SEQ ID NO: 2105531 - protein, 25 aa, Staphylococcus
QPAPEVQVAPEVLTPAQGQIAEKGT

SEQ ID NO: 2105532 - protein, 20 aa, Staphylococcus
QPAQMTIEMGELINIKALVY

SEQ ID NO: 2105533 - protein, 23 aa, Staphylococcus
QPFPSQYSVNIAMNEHNMIIFGS

SEQ ID NO: 2105534 - protein, 27 aa, Staphylococcus
QPGDYQLGEAFKIYKFNGEEDNSYYYP

SEQ ID NO: 2105535 - protein, 26 aa, Staphylococcus
QPGQKVHLVGHSMGGQTIRQLEALLR

SEQ ID NO: 2105536 - protein, 27 aa, Staphylococcus
QPVIKPKAREAINNKVTDQKALINQNN

SEQ ID NO: 2105537 - protein, 24 aa, Staphylococcus
QPVLPAVVAKSGLLAHPENTYVGQ

SEQ ID NO: 2105538 - protein, 17 aa, Staphylococcus
QPVVLYIHGGAWFQNPL

SEQ ID NO: 2105539 - protein, 23 aa, Staphylococcus
QQDLVKKEGWAEVSQEKIEDVAG

SEQ ID NO: 2105540 - protein, 28 aa, Staphylococcus
QQFTPEQLKGAIFFGGFYNMQTVRATEF

SEQ ID NO: 2105541 - protein, 27 aa, Staphylococcus
QQGNYHYDWKGNWSPQQAQQGNNSNYS

SEQ ID NO: 2105542 - protein, 26 aa, Staphylococcus
QQGNYHYDWKGNWSPSQQQGNNNSYS

SEQ ID NO: 2105543 - protein, 26 aa, Staphylococcus
QQGNYHYEWQGNWSPSQAQQGGQQNT

SEQ ID NO: 2105544 - protein, 27 aa, Staphylococcus
QQGNYHYTWKGNWSPDRLNHSNYNYNY

SEQ ID NO: 2105545 - protein, 26 aa, Staphylococcus
QQGNYHYTWKGNWSPNQVNHSSQSNY

SEQ ID NO: 2105546 - protein, 24 aa, Staphylococcus
QQTGKYSLGDIVWNDKNRNGIQDI

SEQ ID NO: 2105547 - protein, 18 aa, Staphylococcus
QQVFMKWFSHDPAFDYFN

SEQ ID NO: 2105548 - protein, 17 aa, Staphylococcus
QRIKHRQLYPGAPKGQF

SEQ ID NO: 2105549 - protein, 17 aa, Staphylococcus
QRIKQRQLYPGVPKGQF

SEQ ID NO: 2105550 - protein, 17 aa, Staphylococcus
QRNEGDQTYVLLQNTAS

SEQ ID NO: 2105551 - protein, 24 aa, Staphylococcus
QRQHGGTVSDLFKGGKDNMISTIT

SEQ ID NO: 2105552 - protein, 21 aa, Staphylococcus
QRQLDHYNSLFAVGKQPQKTS

SEQ ID NO: 2105553 - protein, 17 aa, Staphylococcus
QRTILYIHGGAWFQDPL

SEQ ID NO: 2105554 - protein, 20 aa, Staphylococcus
QRTPGVWSNATFSETKNAMD

SEQ ID NO: 2105555 - protein, 26 aa, Staphylococcus
QSDGENFSWSYGEGSGEGSNASSEQA

SEQ ID NO: 2105556 - protein, 19 aa, Staphylococcus
QSENVRFLVSVRPDPPRID

SEQ ID NO: 2105557 - protein, 23 aa, Staphylococcus
QSGEAAVGAGLRNQAIDAEKDGE

SEQ ID NO: 2105558 - protein, 21 aa, Staphylococcus
QSIWKKICVNGTANALCTILE

SEQ ID NO: 2105559 - protein, 21 aa, Staphylococcus
QSIWKKICVNGTANALCTVLE

SEQ ID NO: 2105560 - protein, 18 aa, Staphylococcus
QSNTRAISLFQDVPQLDG

SEQ ID NO: 2105561 - protein, 27 aa, Staphylococcus
QSSDSSYPRSLMQIKEETGKSPRDFTD

SEQ ID NO: 2105562 - protein, 20 aa, Staphylococcus
QSTAGAYGHVAYVENVNSNG

SEQ ID NO: 2105563 - protein, 19 aa, Staphylococcus
QSTAGGYGHVAYVENVNSD

SEQ ID NO: 2105564 - protein, 25 aa, Staphylococcus
QTAKSTSGFTGFRKAVSTYKATSSL

SEQ ID NO: 2105565 - protein, 25 aa, Staphylococcus
QTDEFPEWKMKAEIMQQALKKAGIK

SEQ ID NO: 2105566 - protein, 18 aa, Staphylococcus
QTFFNDMLTILHARNSFS

SEQ ID NO: 2105567 - protein, 18 aa, Staphylococcus
QTGHELDLHTLLEKYGEN

SEQ ID NO: 2105568 - protein, 18 aa, Staphylococcus
QTLYSRAPKASFYVNDFE

SEQ ID NO: 2105569 - protein, 19 aa, Staphylococcus
QTNQSWGYGSVETQTKGMI

SEQ ID NO: 2105570 - protein, 25 aa, Staphylococcus
QVDYGLAQWGFKQGKNESYPDYVER

SEQ ID NO: 2105571 - protein, 19 aa, Staphylococcus
QVISPRFGTLTNVIAIGQM

SEQ ID NO: 2105572 - protein, 19 aa, Staphylococcus
QVKIKDLKTGNVFEEVTDY

SEQ ID NO: 2105573 - protein, 19 aa, Staphylococcus
QVNDHLKAIAQRESGGDIH

SEQ ID NO: 2105574 - protein, 27 aa, Staphylococcus
QVSNGKRVADVKAIEQLATELNNNMTS

SEQ ID NO: 2105575 - protein, 23 aa, Staphylococcus
QYDIRGQHYFHMQTPDKKTDNNP

SEQ ID NO: 2105576 - protein, 17 aa, Staphylococcus
QYGLRASVYDAKGSNAA

SEQ ID NO: 2105577 - protein, 47 aa, Staphylococcus
QYKNQYPVVFVHGFAGLVGEDAFTLYPNYWGGGKYNIKSELTKQGYR

SEQ ID NO: 2105578 - protein, 27 aa, Staphylococcus
QYLAKVWAAALPAYRSSGKSQFDDMTI

SEQ ID NO: 2105579 - protein, 26 aa, Staphylococcus
QYMATSYYNNWLYFYIIASHENQSKT

SEQ ID NO: 2105580 - protein, 20 aa, Staphylococcus
QYTSTEWNQLLGRLNFNLEK

SEQ ID NO: 2105581 - protein, 23 aa, Staphylococcus
RAELQQFWHDLADDLVQSENLTR

SEQ ID NO: 2105582 - protein, 19 aa, Staphylococcus
RAGIEDIIIVTGKHKRAIE

SEQ ID NO: 2105583 - protein, 27 aa, Staphylococcus
RANDDLKDIPIHFAIYKQSDQNSITPG

SEQ ID NO: 2105584 - protein, 27 aa, Staphylococcus
RANEDLKDIPIHFAIYKQSGQDSISPG

SEQ ID NO: 2105585 - protein, 17 aa, Staphylococcus
RANRLSVNIQHDSKNVF

SEQ ID NO: 2105586 - protein, 18 aa, Staphylococcus
RATFDLMTHIYRNLLDSV

SEQ ID NO: 2105587 - protein, 20 aa, Staphylococcus
RDDNWFKNTLFTLSNSKEIK

SEQ ID NO: 2105588 - protein, 18 aa, Staphylococcus
RDDVKFHDGTKFDAEAVK

SEQ ID NO: 2105589 - protein, 21 aa, Staphylococcus
RDIYASVMIAQAILESDSGNS

SEQ ID NO: 2105590 - protein, 21 aa, Staphylococcus
RDLSKMMTFKGDPDFTIVNRL

SEQ ID NO: 2105591 - protein, 18 aa, Staphylococcus
RDYKVVVSKSGDVIQQPS

SEQ ID NO: 2105592 - protein, 24 aa, Staphylococcus
REELQQFWHGLADDLVQSEKLTST

SEQ ID NO: 2105593 - protein, 23 aa, Staphylococcus
REGDGYPGFTKAYGFDFNTVRPM

SEQ ID NO: 2105594 - protein, 22 aa, Staphylococcus
REGKLLGQYGIKGRDYTLDKKG

SEQ ID NO: 2105595 - protein, 20 aa, Staphylococcus
REHYNNVTGNFGYVQDNDLS

SEQ ID NO: 2105596 - protein, 19 aa, Staphylococcus
REIKYWSGVRPWTQGEQPI

SEQ ID NO: 2105597 - protein, 17 aa, Staphylococcus
RELGEIMTANVTVVREN

SEQ ID NO: 2105598 - protein, 20 aa, Staphylococcus
RELRSGDAYDSELDKKYGDN

SEQ ID NO: 2105599 - protein, 28 aa, Staphylococcus
RENKALKDIPIHFAIYIQSGEDEIIPGE

SEQ ID NO: 2105600 - protein, 18 aa, Staphylococcus
RENQKWVTPLGRLGTPDE

SEQ ID NO: 2105601 - protein, 21 aa, Staphylococcus
REQLKKIAYLKATYKEANKLS

SEQ ID NO: 2105602 - protein, 18 aa, Staphylococcus
RESLKRKKHVITANKDLL

SEQ ID NO: 2105603 - protein, 30 aa, Staphylococcus
RFAEPGEGFLACGYVAKGRMMEPLDIMAFV

SEQ ID NO: 2105604 - protein, 26 aa, Staphylococcus
RFFALILAIFFYLSVNNVFGNIFNND

SEQ ID NO: 2105605 - protein, 18 aa, Staphylococcus
RFGDLLFNTLGFKPADQH

SEQ ID NO: 2105606 - protein, 27 aa, Staphylococcus
RFIALLLAIFFYLSVNNVFGNIFSNDN

SEQ ID NO: 2105607 - protein, 20 aa, Staphylococcus
RFSIRKYAVGVVSIVTGITI

SEQ ID NO: 2105608 - protein, 25 aa, Staphylococcus
RFVAFILALFFYLSVNNVFGNIFSN

SEQ ID NO: 2105609 - protein, 24 aa, Staphylococcus
RFVAFVLALAFFLTVNNVFGNIFS

SEQ ID NO: 2105610 - protein, 25 aa, Staphylococcus
RFVALILAIFFFLSVNNVFGNIFNS

SEQ ID NO: 2105611 - protein, 24 aa, Staphylococcus
RFVALILAIFFFLSVNNVFGNVFN

SEQ ID NO: 2105612 - protein, 19 aa, Staphylococcus
RGDTGYFFNTAYLPKGANN

SEQ ID NO: 2105613 - protein, 19 aa, Staphylococcus
RGGEILYQAFGLKMPKAVD

SEQ ID NO: 2105614 - protein, 20 aa, Staphylococcus
RGGEVIYQAFGLKMPAKQEE

SEQ ID NO: 2105615 - protein, 19 aa, Staphylococcus
RGGEVLYQAFGLKIPDKLN

SEQ ID NO: 2105616 - protein, 19 aa, Staphylococcus
RGGEVLYQAFGLKMSEGQK

SEQ ID NO: 2105617 - protein, 19 aa, Staphylococcus
RGGEVLYQAFGLKMSKGQN

SEQ ID NO: 2105618 - protein, 18 aa, Staphylococcus
RGGEVLYQAFGLNMPKGQ

SEQ ID NO: 2105619 - protein, 19 aa, Staphylococcus
RGNSDIKFDDLDIKHGDVS

SEQ ID NO: 2105620 - protein, 27 aa, Staphylococcus
RGQQFEFGDLKQYFALSNGADLPDGTL

SEQ ID NO: 2105621 - protein, 20 aa, Staphylococcus
RGSSIISLAHVNKFQGSDNR

SEQ ID NO: 2105622 - protein, 21 aa, Staphylococcus
RGTMISETFIKDGVKGQDGKD

SEQ ID NO: 2105623 - protein, 24 aa, Staphylococcus
RHIMDLNGLHSFLIFPGQTLTVSG

SEQ ID NO: 2105624 - protein, 19 aa, Staphylococcus
RHLKDLGFLVHPYTVNKVN

SEQ ID NO: 2105625 - protein, 22 aa, Staphylococcus
RHNNQLHFGRLVGKPGESIEVR

SEQ ID NO: 2105626 - protein, 18 aa, Staphylococcus
RHQGRTGIGLYIIAQLVE

SEQ ID NO: 2105627 - protein, 28 aa, Staphylococcus
RHVDLNAHVPLAWGAHRGASVIAEQLAG

SEQ ID NO: 2105628 - protein, 28 aa, Staphylococcus
RHVNIPTHVPLAWGAHRGASIVAEHITQ

SEQ ID NO: 2105629 - protein, 27 aa, Staphylococcus
RHVNLKANVPLAWGAHRAASVIAEQLV

SEQ ID NO: 2105630 - protein, 20 aa, Staphylococcus
RIDSSEAMNGYRRGAYADMT

SEQ ID NO: 2105631 - protein, 20 aa, Staphylococcus
RIDSSEAMNGYRRGAYNDMT

SEQ ID NO: 2105632 - protein, 17 aa, Staphylococcus
RIGRLSGSRLLDLNLGF

SEQ ID NO: 2105633 - protein, 17 aa, Staphylococcus
RIGRSLTIFYTNDDNVQ

SEQ ID NO: 2105634 - protein, 17 aa, Staphylococcus
RILDISEWQGALTDAQV

SEQ ID NO: 2105635 - protein, 34 aa, Staphylococcus
RIQFKSNESANVWEISGYPPSLQIEDAVDRPNTE

SEQ ID NO: 2105636 - protein, 24 aa, Staphylococcus
RIRSYAIGVGPEYSDLNAQNTAHL

SEQ ID NO: 2105637 - protein, 19 aa, Staphylococcus
RISKYFKAVNHKAAQADQQ

SEQ ID NO: 2105638 - protein, 18 aa, Staphylococcus
RITALKGSLFGVAIHIAF

SEQ ID NO: 2105639 - protein, 29 aa, Staphylococcus
RITCVEAMPKILPMFSENLVNYVVNYLEE

SEQ ID NO: 2105640 - protein, 26 aa, Staphylococcus
RKGANELNERTSLNPNIVYKSYTGES

SEQ ID NO: 2105641 - protein, 22 aa, Staphylococcus
RKGDGYPGFKKEYGIDFDTVRP

SEQ ID NO: 2105642 - protein, 26 aa, Staphylococcus
RKMGTVPKVLLWVFGILVLLAVVAAI

SEQ ID NO: 2105643 - protein, 27 aa, Staphylococcus
RKNEDNWSPLMYQFADALHMAISKTTD

SEQ ID NO: 2105644 - protein, 17 aa, Staphylococcus
RKPFKYGQHYSEVEDFT

SEQ ID NO: 2105645 - protein, 25 aa, Staphylococcus
RKVPMKIFPAVHYSMGGLYVDYDQM

SEQ ID NO: 2105646 - protein, 48 aa, Staphylococcus
RLAKDDEYKYQFLLLDQPQYLPVSALNKLLEGKGVLEGQGASFSQAAK

SEQ ID NO: 2105647 - protein, 25 aa, Staphylococcus
RLGEGMLPFKMHKFRTMKENAADIR

SEQ ID NO: 2105648 - protein, 25 aa, Staphylococcus
RLIALMLAVLFFLSANNMFGNIFDA

SEQ ID NO: 2105649 - protein, 24 aa, Staphylococcus
RLLKRPAQPNPEWSGDNPDPSSSY

SEQ ID NO: 2105650 - protein, 20 aa, Staphylococcus
RLLLATGIMFAGTFTYQNIE

SEQ ID NO: 2105651 - protein, 19 aa, Staphylococcus
RLLTADGIQTPFQSYSIYF

SEQ ID NO: 2105652 - protein, 17 aa, Staphylococcus
RLNEVVMNVAPYMDNNA

SEQ ID NO: 2105653 - protein, 25 aa, Staphylococcus
RLNKIPLRININGIRGKSTITRMIY

SEQ ID NO: 2105654 - protein, 23 aa, Staphylococcus
RLPLQWRSFFPSGETIDLYDNVA

SEQ ID NO: 2105655 - protein, 27 aa, Staphylococcus
RLPNSMPQYRVDHMDNISAIQAHIKHN

SEQ ID NO: 2105656 - protein, 26 aa, Staphylococcus
RLQKNINHRLVLEFKEYEKEAKHLPA

SEQ ID NO: 2105657 - protein, 22 aa, Staphylococcus
RMKELRRFVPDAKDEDWDIMQA

SEQ ID NO: 2105658 - protein, 21 aa, Staphylococcus
RMMEPLDIMAFVEREMNEVKD

SEQ ID NO: 2105659 - protein, 27 aa, Staphylococcus
RMMYWFTPREYPVYRKPQGANIGEQRD

SEQ ID NO: 2105660 - protein, 26 aa, Staphylococcus
RNATIKTGTPLPVNLAGGSTTSIPVV

SEQ ID NO: 2105661 - protein, 18 aa, Staphylococcus
RNDDEWLKTTLAEYQGEY

SEQ ID NO: 2105662 - protein, 18 aa, Staphylococcus
RNDDEWLKTTLAEYQGRE

SEQ ID NO: 2105663 - protein, 19 aa, Staphylococcus
RNDEEWLKTTLAEYMGKDE

SEQ ID NO: 2105664 - protein, 18 aa, Staphylococcus
RNDEEWLKTTMAHYQGRT

SEQ ID NO: 2105665 - protein, 17 aa, Staphylococcus
RNFFNIIDYGKQVKNDG

SEQ ID NO: 2105666 - protein, 20 aa, Staphylococcus
RNGHPLDYRLTFQSIEDSDS

SEQ ID NO: 2105667 - protein, 24 aa, Staphylococcus
RNLNRFDSSEVMNGYRRGAYQDIT

SEQ ID NO: 2105668 - protein, 32 aa, Staphylococcus
RNVDIPVTIYPVARAKAPTREVQGGQLSQGTE

SEQ ID NO: 2105669 - protein, 21 aa, Staphylococcus
RNVPFKGFLASNAVKFFDYTL

SEQ ID NO: 2105670 - protein, 32 aa, Staphylococcus
RNYQASGNVLVLGRSRGTDVNDHGGFNGVEKD

SEQ ID NO: 2105671 - protein, 19 aa, Staphylococcus
RPDEIGVFQSLIENIKENL

SEQ ID NO: 2105672 - protein, 25 aa, Staphylococcus
RPEPPAELIPQFDYVKEISQQFGFV

SEQ ID NO: 2105673 - protein, 24 aa, Staphylococcus
RPSIFKAGTLVLLQLNNKNEIEDA

SEQ ID NO: 2105674 - protein, 23 aa, Staphylococcus
RPSLETPRVLFTVNHNNRVTHVD

SEQ ID NO: 2105675 - protein, 17 aa, Staphylococcus
RPYGGIAPKGMSEKQYE

SEQ ID NO: 2105676 - protein, 23 aa, Staphylococcus
RQAGQSFVDYVICCTDQFNDNVL

SEQ ID NO: 2105677 - protein, 20 aa, Staphylococcus
RQGFKAEFISTIKPKSKKVD

SEQ ID NO: 2105678 - protein, 19 aa, Staphylococcus
RQLKKDYLNHVSKQHQSIN

SEQ ID NO: 2105679 - protein, 25 aa, Staphylococcus
RQLTWFKNKMKVRWLDKENMSLQMM

SEQ ID NO: 2105680 - protein, 19 aa, Staphylococcus
RQPNVHVAKALNLEQNGKC

SEQ ID NO: 2105681 - protein, 18 aa, Staphylococcus
RQQLGKSVGNLWGNANNW

SEQ ID NO: 2105682 - protein, 24 aa, Staphylococcus
RQTYPHLRITGAGFEAVGLPDCIQ

SEQ ID NO: 2105683 - protein, 18 aa, Staphylococcus
RRAELGKPIGSLWGDAGS

SEQ ID NO: 2105684 - protein, 17 aa, Staphylococcus
RRAELGKPIGSLWGNAS

SEQ ID NO: 2105685 - protein, 19 aa, Staphylococcus
RRAQARSPISTYWSDAKYW

SEQ ID NO: 2105686 - protein, 20 aa, Staphylococcus
RRQQLGRSVGSYWGNANNWA

SEQ ID NO: 2105687 - protein, 17 aa, Staphylococcus
RRRANEVLSNDRATNTD

SEQ ID NO: 2105688 - protein, 21 aa, Staphylococcus
RSASLPSVRGKMIDIQFTHLT

SEQ ID NO: 2105689 - protein, 25 aa, Staphylococcus
RSEYLKVIRKRGGFEDLEAVKKGRV

SEQ ID NO: 2105690 - protein, 19 aa, Staphylococcus
RSKAPKLYISNVMTQPGET

SEQ ID NO: 2105691 - protein, 20 aa, Staphylococcus
RSLNELYKHHYILIDPHEAY

SEQ ID NO: 2105692 - protein, 19 aa, Staphylococcus
RSLVIAEVLKKAGYDVTTT

SEQ ID NO: 2105693 - protein, 19 aa, Staphylococcus
RSLVIAEVLKKAGYNVTTT

SEQ ID NO: 2105694 - protein, 23 aa, Staphylococcus
RSVNNQAWLAAYMLKQNGLTPSF

SEQ ID NO: 2105695 - protein, 18 aa, Staphylococcus
RSYKSFLEEIIIRATKMK

SEQ ID NO: 2105696 - protein, 18 aa, Staphylococcus
RTADRIKIVMGRSDAKTF

SEQ ID NO: 2105697 - protein, 19 aa, Staphylococcus
RTGWTTYGHTGEDVNTYAY

SEQ ID NO: 2105698 - protein, 17 aa, Staphylococcus
RTKEGLLDFRRFGGTLY

SEQ ID NO: 2105699 - protein, 18 aa, Staphylococcus
RTKEGLLDFRRFGGTLYH

SEQ ID NO: 2105700 - protein, 23 aa, Staphylococcus
RTKEGLLDFRRFGGTMYHRTAYA

SEQ ID NO: 2105701 - protein, 28 aa, Staphylococcus
RTYSDALMPYNFMSSVFKNNDGKSGVLA

SEQ ID NO: 2105702 - protein, 17 aa, Staphylococcus
RVGKPVISKKLNQWLQS

SEQ ID NO: 2105703 - protein, 23 aa, Staphylococcus
RVHYNRVTGNFGYIQNGKASYQF

SEQ ID NO: 2105704 - protein, 17 aa, Staphylococcus
RVIIATGILLTGTIAYQ

SEQ ID NO: 2105705 - protein, 25 aa, Staphylococcus
RVNADGSVFISEMNWIAPYITSTRT

SEQ ID NO: 2105706 - protein, 17 aa, Staphylococcus
RVNGVFFGQTFTVYFND

SEQ ID NO: 2105707 - protein, 20 aa, Staphylococcus
RVNPDGSILISEMNYNTPPG

SEQ ID NO: 2105708 - protein, 27 aa, Staphylococcus
RVQQFGKKVGSDWGDAHNWDNRAESDN

SEQ ID NO: 2105709 - protein, 19 aa, Staphylococcus
RVQYNSVSGNFAYIQNGKT

SEQ ID NO: 2105710 - protein, 23 aa, Staphylococcus
RVSEMNYGYGPGVVTSRTLSAGQ

SEQ ID NO: 2105711 - protein, 29 aa, Staphylococcus
RVSNPQLRDMLGYFIKYVGSSSYDAPAVL

SEQ ID NO: 2105712 - protein, 20 aa, Staphylococcus
RVVVEVLPLTNFVPSAEEHQ

SEQ ID NO: 2105713 - protein, 20 aa, Staphylococcus
RWPSNIPGSENVRDFGQTTY

SEQ ID NO: 2105714 - protein, 20 aa, Staphylococcus
RWPSNVPGGDNVRDFGQTTK

SEQ ID NO: 2105715 - protein, 17 aa, Staphylococcus
RYDKLRVKHTAKVIKRS

SEQ ID NO: 2105716 - protein, 21 aa, Staphylococcus
RYDVGEKIGFVKTTIQFALKD

SEQ ID NO: 2105717 - protein, 21 aa, Staphylococcus
RYDVGEKLGFVKTTIEYALKD

SEQ ID NO: 2105718 - protein, 20 aa, Staphylococcus
RYGKTYAGAYRDWKPGQKIH

SEQ ID NO: 2105719 - protein, 32 aa, Staphylococcus
RYGRTYEGIMPDWAPGKKIHLVGHSMGGQTIR

SEQ ID NO: 2105720 - protein, 30 aa, Staphylococcus
RYISNPKLRDMLGYFIKYVGSSSYDAPAVL

SEQ ID NO: 2105721 - protein, 18 aa, Staphylococcus
RYTFKLVDQNSHLPKYVQ

SEQ ID NO: 2105722 - protein, 19 aa, Staphylococcus
RYTLDRFKDEYGLEPKQLI

SEQ ID NO: 2105723 - protein, 18 aa, Staphylococcus
RYTLERFLEDYGITPKQF

SEQ ID NO: 2105724 - protein, 17 aa, Staphylococcus
RYVRGEESLLFGPFAAI

SEQ ID NO: 2105725 - protein, 34 aa, Staphylococcus
SADKSRFFGLHFFNPPRIMKLVEVIPTEETDPSV

SEQ ID NO: 2105726 - protein, 24 aa, Staphylococcus
SADLDKLLVGKGILEGQGEAFSEA

SEQ ID NO: 2105727 - protein, 17 aa, Staphylococcus
SAGAYGHVAYVESVGSD

SEQ ID NO: 2105728 - protein, 27 aa, Staphylococcus
SAIAVLLTICLLFLLFIATNEQALAKV

SEQ ID NO: 2105729 - protein, 19 aa, Staphylococcus
SAKDPFKFVQYTDTQNAYW

SEQ ID NO: 2105730 - protein, 18 aa, Staphylococcus
SAKFPEGTEMLTASVHAA

SEQ ID NO: 2105731 - protein, 22 aa, Staphylococcus
SAPRTLIIAEVLKKAGYDVTTT

SEQ ID NO: 2105732 - protein, 21 aa, Staphylococcus
SAPTSYRYSNISKYMKAGFIY

SEQ ID NO: 2105733 - protein, 24 aa, Staphylococcus
SARNGVPAFTIDHVIKNNTITGNN

SEQ ID NO: 2105734 - protein, 42 aa, Staphylococcus
SASGNLYTAGQCTWYVYDKVGGKVGSTWGDARNWASAAQQAG

SEQ ID NO: 2105735 - protein, 23 aa, Staphylococcus
SATLGKEQYYLVSDYNKGTLIGW

SEQ ID NO: 2105736 - protein, 21 aa, Staphylococcus
SDAGYYGHVAFVERINGDGSI

SEQ ID NO: 2105737 - protein, 17 aa, Staphylococcus
SDAKSGNSLRFTYLGNI

SEQ ID NO: 2105738 - protein, 17 aa, Staphylococcus
SDALIFAVPHKTYIEDK

SEQ ID NO: 2105739 - protein, 21 aa, Staphylococcus
SDALMPYNFMNSVFKNNGDKP

SEQ ID NO: 2105740 - protein, 29 aa, Staphylococcus
SDANLYDWGQCTWHVFNRRAETGQPISTY

SEQ ID NO: 2105741 - protein, 18 aa, Staphylococcus
SDFDLCIGADGLHSIIRQ

SEQ ID NO: 2105742 - protein, 19 aa, Staphylococcus
SDFGKSVDWTIQGTDARNG

SEQ ID NO: 2105743 - protein, 17 aa, Staphylococcus
SDFKPFVEASGSSPYPQ

SEQ ID NO: 2105744 - protein, 18 aa, Staphylococcus
SDGLYNFISAIRVASSND

SEQ ID NO: 2105745 - protein, 18 aa, Staphylococcus
SDGLYNFISAIRVASSNN

SEQ ID NO: 2105746 - protein, 19 aa, Staphylococcus
SDGLYNFISAIRVATSKEA

SEQ ID NO: 2105747 - protein, 18 aa, Staphylococcus
SDGLYNFISSIRVASSSD

SEQ ID NO: 2105748 - protein, 17 aa, Staphylococcus
SDGSIYPVLLRLNKKGY

SEQ ID NO: 2105749 - protein, 20 aa, Staphylococcus
SDIANEFKTLIGDFKSDINP

SEQ ID NO: 2105750 - protein, 25 aa, Staphylococcus
SDISYSVCGIPYYIGGNVSDIDELT

SEQ ID NO: 2105751 - protein, 22 aa, Staphylococcus
SDKKLAKEWMDFLKTDKAKQII

SEQ ID NO: 2105752 - protein, 26 aa, Staphylococcus
SDKSYVGQIFHQLGFKEALNKGTSKD

SEQ ID NO: 2105753 - protein, 34 aa, Staphylococcus
SDNQMFSINAGFRKYPNLKSSLQDYADLIKNGIE

SEQ ID NO: 2105754 - protein, 25 aa, Staphylococcus
SDNSMFSINAGFRKYPSTKASLEDY

SEQ ID NO: 2105755 - protein, 21 aa, Staphylococcus
SDQVLGLFAEENMPLQIDAPK

SEQ ID NO: 2105756 - protein, 25 aa, Staphylococcus
SDSFLSKNQKGMVVQHDWNGQHNKF

SEQ ID NO: 2105757 - protein, 19 aa, Staphylococcus
SDSKLHFDQSLAKLLTENK

SEQ ID NO: 2105758 - protein, 27 aa, Staphylococcus
SDVDGILVPGGFGFRASEGKISAIKYA

SEQ ID NO: 2105759 - protein, 24 aa, Staphylococcus
SDYIKMIKKRGGFDKINAVKNTRI

SEQ ID NO: 2105760 - protein, 27 aa, Staphylococcus
SDYYKVIKKRDGFRQIKAVKNGRIETV

SEQ ID NO: 2105761 - protein, 31 aa, Staphylococcus
SEAAKAYNINEVYLISHALLETGNGTSKLAN

SEQ ID NO: 2105762 - protein, 17 aa, Staphylococcus
SEDDSKHKLQYKKRYAI

SEQ ID NO: 2105763 - protein, 21 aa, Staphylococcus
SEGDRSLGLNPFIHLASLQGD

SEQ ID NO: 2105764 - protein, 24 aa, Staphylococcus
SEGKEIKVRLIGIDTPETVKPNTP

SEQ ID NO: 2105765 - protein, 20 aa, Staphylococcus
SEIGDEFKTLIGDFKSDINP

SEQ ID NO: 2105766 - protein, 22 aa, Staphylococcus
SEIGKGISTYWWNANNWDNAAA

SEQ ID NO: 2105767 - protein, 18 aa, Staphylococcus
SELLRFSGIGESKVETIL

SEQ ID NO: 2105768 - protein, 21 aa, Staphylococcus
SEMKTKPGLIVTDTGSTKGTI

SEQ ID NO: 2105769 - protein, 27 aa, Staphylococcus
SEMNYSGGPYVKDTRTISASQASSYNY

SEQ ID NO: 2105770 - protein, 20 aa, Staphylococcus
SENKANGVFFSLDGKSINKN

SEQ ID NO: 2105771 - protein, 21 aa, Staphylococcus
SENKANGVFFSLDGNSINENT

SEQ ID NO: 2105772 - protein, 24 aa, Staphylococcus
SEPQRLEPELNYFDPNSKADTTTP

SEQ ID NO: 2105773 - protein, 17 aa, Staphylococcus
SEQQAMVDFAKQGGSII

SEQ ID NO: 2105774 - protein, 18 aa, Staphylococcus
SERTKRYRLKQLLNSKAI

SEQ ID NO: 2105775 - protein, 18 aa, Staphylococcus
SERTKRYRLKQLLNSQNI

SEQ ID NO: 2105776 - protein, 24 aa, Staphylococcus
SESNVKGLGIISYRTLDANTADQL

SEQ ID NO: 2105777 - protein, 23 aa, Staphylococcus
SESNVKGLGIVSYRQIDADTASS

SEQ ID NO: 2105778 - protein, 23 aa, Staphylococcus
SESNVKGLGIVSYRTIDASTAED

SEQ ID NO: 2105779 - protein, 24 aa, Staphylococcus
SESNVKGLGVISYRTIDADDAAQL

SEQ ID NO: 2105780 - protein, 25 aa, Staphylococcus
SESNVKGLGVISYRTIDAEDANDLD

SEQ ID NO: 2105781 - protein, 19 aa, Staphylococcus
SESVDSCLEKAKNKPTAKF

SEQ ID NO: 2105782 - protein, 27 aa, Staphylococcus
SESVTAWKGGLFGIGVHVLFHEFVLPK

SEQ ID NO: 2105783 - protein, 22 aa, Staphylococcus
SESYVGQLLGELGFKEALNKDV

SEQ ID NO: 2105784 - protein, 18 aa, Staphylococcus
SEVKNVDRGYAINLNPFR

SEQ ID NO: 2105785 - protein, 17 aa, Staphylococcus
SEYKTKNSAAWKAANKD

SEQ ID NO: 2105786 - protein, 23 aa, Staphylococcus
SFANCALPYYIGQLVTEREKVLA

SEQ ID NO: 2105787 - protein, 25 aa, Staphylococcus
SFANCALPYYLSDTITEREKVLAYT

SEQ ID NO: 2105788 - protein, 23 aa, Staphylococcus
SFANCGLPYFIGNIVNERKDVLP

SEQ ID NO: 2105789 - protein, 24 aa, Staphylococcus
SFANCGLPYYIGHLVSDRHQILPI

SEQ ID NO: 2105790 - protein, 23 aa, Staphylococcus
SFANCGLPYYLGQIVSSRDQLLP

SEQ ID NO: 2105791 - protein, 18 aa, Staphylococcus
SFARSINNYADYAATNLQ

SEQ ID NO: 2105792 - protein, 18 aa, Staphylococcus
SFESFKQRFGVKKNDWIK

SEQ ID NO: 2105793 - protein, 25 aa, Staphylococcus
SFGTIPRGDTGYFFNQAYKPEGAIN

SEQ ID NO: 2105794 - protein, 19 aa, Staphylococcus
SFIALVLILSGCSKHDKKH

SEQ ID NO: 2105795 - protein, 17 aa, Staphylococcus
SFKENFDAKGYIQKHDP

SEQ ID NO: 2105796 - protein, 21 aa, Staphylococcus
SFKLISILLFAILLLSTIAFT

SEQ ID NO: 2105797 - protein, 20 aa, Staphylococcus
SFLALLLMLSACAPNNDNNE

SEQ ID NO: 2105798 - protein, 18 aa, Staphylococcus
SFLKEIQPNWNIKLFERL

SEQ ID NO: 2105799 - protein, 17 aa, Staphylococcus
SFLKEKFNHVSRGKQYF

SEQ ID NO: 2105800 - protein, 23 aa, Staphylococcus
SFNRLKYSLKPVVTAVQGRALGG

SEQ ID NO: 2105801 - protein, 17 aa, Staphylococcus
SFQSDGENFSWSYGEGS

SEQ ID NO: 2105802 - protein, 18 aa, Staphylococcus
SFSSNFLDPSHFENGFSL

SEQ ID NO: 2105803 - protein, 21 aa, Staphylococcus
SFVDKSGKLAGSYIVHSDGSV

SEQ ID NO: 2105804 - protein, 19 aa, Staphylococcus
SGASGLFQTMPGWGSTATV

SEQ ID NO: 2105805 - protein, 19 aa, Staphylococcus
SGDTLSGIAAKYGTTYQKI

SEQ ID NO: 2105806 - protein, 18 aa, Staphylococcus
SGGSNLYTAGQCTYYVYD

SEQ ID NO: 2105807 - protein, 26 aa, Staphylococcus
SGKYQFLQSTWDSVAPAEYKGQPASS

SEQ ID NO: 2105808 - protein, 20 aa, Staphylococcus
SGLNRRGYRIAQGEAPIKET

SEQ ID NO: 2105809 - protein, 17 aa, Staphylococcus
SGLYKYEASTNIKNLDQ

SEQ ID NO: 2105810 - protein, 17 aa, Staphylococcus
SGPYGFKGYADFNNVHP

SEQ ID NO: 2105811 - protein, 22 aa, Staphylococcus
SGSAFKPFSILDVASPYPYGQC

SEQ ID NO: 2105812 - protein, 28 aa, Staphylococcus
SGTVWTHAAISRWLGGTDHADPHGYLQQ

SEQ ID NO: 2105813 - protein, 22 aa, Staphylococcus
SHILKDKFKGVTKVGDDDVEKV

SEQ ID NO: 2105814 - protein, 22 aa, Staphylococcus
SHIPHIIASSLVHLSETNSKNH

SEQ ID NO: 2105815 - protein, 18 aa, Staphylococcus
SHMLRLLIEHDTEGKIKP

SEQ ID NO: 2105816 - protein, 19 aa, Staphylococcus
SHMNIKYLPTTNVIGKLDD

SEQ ID NO: 2105817 - protein, 23 aa, Staphylococcus
SHNSVKNDVRFKKFVKNNKFPDG

SEQ ID NO: 2105818 - protein, 21 aa, Staphylococcus
SHRKLFPSLFHLFQQDNLDEH

SEQ ID NO: 2105819 - protein, 22 aa, Staphylococcus
SHVPHIIAASLVHLNANQSTKH

SEQ ID NO: 2105820 - protein, 20 aa, Staphylococcus
SIAKDAHKIGQKEKIYASVM

SEQ ID NO: 2105821 - protein, 17 aa, Staphylococcus
SIAKIMPNRLVAAQTKF

SEQ ID NO: 2105822 - protein, 17 aa, Staphylococcus
SIASRYGTTYQHIMRLN

SEQ ID NO: 2105823 - protein, 18 aa, Staphylococcus
SIGYLAHRYGFKQEGIQN

SEQ ID NO: 2105824 - protein, 18 aa, Staphylococcus
SILTLLTILCIFQTHTIS

SEQ ID NO: 2105825 - protein, 25 aa, Staphylococcus
SINDLKSFVDLCNRSIKDNEDILDY

SEQ ID NO: 2105826 - protein, 22 aa, Staphylococcus
SINEIKSFVDLYNQSVVENEKI

SEQ ID NO: 2105827 - protein, 26 aa, Staphylococcus
SIPNAPEGMKFYVVSPSIGQFSSVIG

SEQ ID NO: 2105828 - protein, 22 aa, Staphylococcus
SIQPKHPFKVTVKLKGYDANST

SEQ ID NO: 2105829 - protein, 31 aa, Staphylococcus
SISHKYGMSIARLKSLNGLKSNLIFPNQVLK

SEQ ID NO: 2105830 - protein, 25 aa, Staphylococcus
SITIDGGVMAYTWPGEMLSDDSWKN

SEQ ID NO: 2105831 - protein, 27 aa, Staphylococcus
SIVRKDLRKMMTFKGDPDFTIVNRLPK

SEQ ID NO: 2105832 - protein, 17 aa, Staphylococcus
SIYPAGADLHSYEPTQK

SEQ ID NO: 2105833 - protein, 18 aa, Staphylococcus
SIYPPGSDIHNFEPTQKE

SEQ ID NO: 2105834 - protein, 21 aa, Staphylococcus
SKEHSYKRIVSLMPSNTEILY

SEQ ID NO: 2105835 - protein, 26 aa, Staphylococcus
SKENMKRVLLFLSRNTSSSGVERGNN

SEQ ID NO: 2105836 - protein, 17 aa, Staphylococcus
SKESFGITKDVKSVSMH

SEQ ID NO: 2105837 - protein, 23 aa, Staphylococcus
SKGAELVKVDGFNQAMDLLQSHR

SEQ ID NO: 2105838 - protein, 22 aa, Staphylococcus
SKGGDFVLDQSFYNGLKAGNVE

SEQ ID NO: 2105839 - protein, 20 aa, Staphylococcus
SKKIDIAFISPVSYTLAHDA

SEQ ID NO: 2105840 - protein, 18 aa, Staphylococcus
SKLGKKSKDKSSKSKDSK

SEQ ID NO: 2105841 - protein, 23 aa, Staphylococcus
SKLPIIFWMHGGGFVAGDKQYKN

SEQ ID NO: 2105842 - protein, 22 aa, Staphylococcus
SKMISNKAFSAARSVYVGKELF

SEQ ID NO: 2105843 - protein, 18 aa, Staphylococcus
SKNVFGLIDHYDKKNQEL

SEQ ID NO: 2105844 - protein, 19 aa, Staphylococcus
SKPDLILASFRQAHTKTLD

SEQ ID NO: 2105845 - protein, 26 aa, Staphylococcus
SKPIGAICGAVDYLAKNGFLNQYHHT

SEQ ID NO: 2105846 - protein, 22 aa, Staphylococcus
SKPKYHRIISLMPSNTEILYQL

SEQ ID NO: 2105847 - protein, 17 aa, Staphylococcus
SKPYTYSSGVLVVNKDN

SEQ ID NO: 2105848 - protein, 22 aa, Staphylococcus
SKQDPHAWLSLENGLKYVKTIQ

SEQ ID NO: 2105849 - protein, 23 aa, Staphylococcus
SKQFNIHSGYIWEINTEKQGTPE

SEQ ID NO: 2105850 - protein, 18 aa, Staphylococcus
SKQLAEIYTNVPLDTESL

SEQ ID NO: 2105851 - protein, 25 aa, Staphylococcus
SKRHKRFNFSYTLIVLIVALVLLVF

SEQ ID NO: 2105852 - protein, 23 aa, Staphylococcus
SKRIVALEFSFVDALAALNVKPV

SEQ ID NO: 2105853 - protein, 22 aa, Staphylococcus
SKRLAEIYTEVPLNSVEIYRDM

SEQ ID NO: 2105854 - protein, 18 aa, Staphylococcus
SKTLAEIHTKVPLNTVDL

SEQ ID NO: 2105855 - protein, 18 aa, Staphylococcus
SKVGKYEVKYIVTDSDGA

SEQ ID NO: 2105856 - protein, 18 aa, Staphylococcus
SKVRKLADGRIYSAQQAK

SEQ ID NO: 2105857 - protein, 18 aa, Staphylococcus
SKVSDALSQWEHDDDKNT

SEQ ID NO: 2105858 - protein, 20 aa, Staphylococcus
SKYMTIRKIAPESAITNIKA

SEQ ID NO: 2105859 - protein, 20 aa, Staphylococcus
SLAVALGVTGYAATADHNQA

SEQ ID NO: 2105860 - protein, 19 aa, Staphylococcus
SLAVALGVTGYALTTDNSA

SEQ ID NO: 2105861 - protein, 20 aa, Staphylococcus
SLAVGLGLVAGNAGHDADAS

SEQ ID NO: 2105862 - protein, 20 aa, Staphylococcus
SLAVGLGLVAGNVSHADASE

SEQ ID NO: 2105863 - protein, 20 aa, Staphylococcus
SLAVGLGVVAGNAGHADASE

SEQ ID NO: 2105864 - protein, 20 aa, Staphylococcus
SLAVSLGIAGYALTGNEAHA

SEQ ID NO: 2105865 - protein, 19 aa, Staphylococcus
SLAVTLGLTGYALTNDHSA

SEQ ID NO: 2105866 - protein, 28 aa, Staphylococcus
SLAYKGWDFDGAYGNQCFDLVNVYWNHL

SEQ ID NO: 2105867 - protein, 19 aa, Staphylococcus
SLDELYKHHYILIDPHDAY

SEQ ID NO: 2105868 - protein, 25 aa, Staphylococcus
SLDTARFEFFLSRTFDVAPQNVYAP

SEQ ID NO: 2105869 - protein, 26 aa, Staphylococcus
SLDTARFQFFLSREFDVAPNQVYAPI

SEQ ID NO: 2105870 - protein, 18 aa, Staphylococcus
SLENGLKYVKTIQHAVIQ

SEQ ID NO: 2105871 - protein, 18 aa, Staphylococcus
SLFALMMAVILFVSACGN

SEQ ID NO: 2105872 - protein, 19 aa, Staphylococcus
SLGHVAYVESVNSDGSITI

SEQ ID NO: 2105873 - protein, 18 aa, Staphylococcus
SLGNLVIAGMTSITNDFG

SEQ ID NO: 2105874 - protein, 30 aa, Staphylococcus
SLGQRVVSYPIHFVTGAIGNIFNNGGSKED

SEQ ID NO: 2105875 - protein, 25 aa, Staphylococcus
SLGQRVVSYPVNFVTGAINNLFSSN

SEQ ID NO: 2105876 - protein, 18 aa, Staphylococcus
SLITITFVTITTVALSTQ

SEQ ID NO: 2105877 - protein, 20 aa, Staphylococcus
SLKSVIGHAIELSKHPLTKE

SEQ ID NO: 2105878 - protein, 18 aa, Staphylococcus
SLLKETLPFHKSLQVEQR

SEQ ID NO: 2105879 - protein, 20 aa, Staphylococcus
SLSGIAWKYNTTYQNIMRLN

SEQ ID NO: 2105880 - protein, 17 aa, Staphylococcus
SLSKDDGKLVYDITLQK

SEQ ID NO: 2105881 - protein, 24 aa, Staphylococcus
SLTDGTVTQAGWSNYGGGNQVTIQ

SEQ ID NO: 2105882 - protein, 17 aa, Staphylococcus
SLTPNIINLTSYYLHLA

SEQ ID NO: 2105883 - protein, 18 aa, Staphylococcus
SLVIAEVLKKAGYDVTTT

SEQ ID NO: 2105884 - protein, 29 aa, Staphylococcus
SMGGQTIRLMEHFLRNGNQEEIDYQRQHG

SEQ ID NO: 2105885 - protein, 28 aa, Staphylococcus
SMGGQTIRQLEEFLRNGNQEEIDYQKAH

SEQ ID NO: 2105886 - protein, 21 aa, Staphylococcus
SMGNLSFAYFMKLYGQDTQLP

SEQ ID NO: 2105887 - protein, 19 aa, Staphylococcus
SMKALRDAIQDHQQVENSS

SEQ ID NO: 2105888 - protein, 17 aa, Staphylococcus
SMKKGETNFAFTDDRGT

SEQ ID NO: 2105889 - protein, 22 aa, Staphylococcus
SMPETGAARVFIKNSSIKKLIY

SEQ ID NO: 2105890 - protein, 19 aa, Staphylococcus
SNAAALILGEKVSGSTSTF

SEQ ID NO: 2105891 - protein, 19 aa, Staphylococcus
SNDGVYVYHGDKIKLQFKV

SEQ ID NO: 2105892 - protein, 18 aa, Staphylococcus
SNDIVPILNRFVKEHPDF

SEQ ID NO: 2105893 - protein, 17 aa, Staphylococcus
SNDPKKDNIKDYDEEKK

SEQ ID NO: 2105894 - protein, 26 aa, Staphylococcus
SNGADLPDGTLFNITAVDSLPNAAQV

SEQ ID NO: 2105895 - protein, 17 aa, Staphylococcus
SNIIFPNQVLKVSGSTS

SEQ ID NO: 2105896 - protein, 24 aa, Staphylococcus
SNIKFKGYLGANIVKFFNYTFASV

SEQ ID NO: 2105897 - protein, 29 aa, Staphylococcus
SNINFRIGYMTKHKLVITVPKAIDHLTVK

SEQ ID NO: 2105898 - protein, 23 aa, Staphylococcus
SNIPEFYAEILTKYKDGKLVYAS

SEQ ID NO: 2105899 - protein, 23 aa, Staphylococcus
SNKEYKGKMEALKEFDKQGRTNM

SEQ ID NO: 2105900 - protein, 23 aa, Staphylococcus
SNKWKKKISRAFIDISHTKKGKH

SEQ ID NO: 2105901 - protein, 23 aa, Staphylococcus
SNLAVKNDLHFKKFVNNNKIPSE

SEQ ID NO: 2105902 - protein, 17 aa, Staphylococcus
SNLIFPNQVLKVSGSSS

SEQ ID NO: 2105903 - protein, 18 aa, Staphylococcus
SNLNGWKKGSRDASVRKQ

SEQ ID NO: 2105904 - protein, 19 aa, Staphylococcus
SNNNIFSINASFRKYPNLK

SEQ ID NO: 2105905 - protein, 17 aa, Staphylococcus
SNPEKYDQPAHMKHYSK

SEQ ID NO: 2105906 - protein, 22 aa, Staphylococcus
SNPESLNAAPIQDGAYNINFNY

SEQ ID NO: 2105907 - protein, 25 aa, Staphylococcus
SNPMPPRTAELIIDLINNQSLIVKS

SEQ ID NO: 2105908 - protein, 26 aa, Staphylococcus
SNPMPPRTAKLLIELLEQEALIIRKN

SEQ ID NO: 2105909 - protein, 29 aa, Staphylococcus
SNPMPPRTAKLLIELMQNGSLIIKRGLEN

SEQ ID NO: 2105910 - protein, 25 aa, Staphylococcus
SNPMPPRTAKLLIQLIEEGYLEIKK

SEQ ID NO: 2105911 - protein, 20 aa, Staphylococcus
SNQVLGLFAEKDMPLQIDAP

SEQ ID NO: 2105912 - protein, 19 aa, Staphylococcus
SNQVLGLFSEKDMPLQIDA

SEQ ID NO: 2105913 - protein, 27 aa, Staphylococcus
SNRAKQVRLKQLFSDRNMLGNQQNQNL

SEQ ID NO: 2105914 - protein, 18 aa, Staphylococcus
SNSAVAMTDDVLSFINKN

SEQ ID NO: 2105915 - protein, 33 aa, Staphylococcus
SNSPIKYYNVYGIGAYDYAPLVNGINYAKQSGW

SEQ ID NO: 2105916 - protein, 17 aa, Staphylococcus
SNSYRTGGLGASYSTSS

SEQ ID NO: 2105917 - protein, 17 aa, Staphylococcus
SNTRSTSLFQTLPQLNG

SEQ ID NO: 2105918 - protein, 20 aa, Staphylococcus
SNVGSFVEGIANYLPSGTNF

SEQ ID NO: 2105919 - protein, 34 aa, Staphylococcus
SNYDRAVDLYYYIKGGRVDYGAAHAAKYGHHRYG

SEQ ID NO: 2105920 - protein, 33 aa, Staphylococcus; identical to SEQ ID NO: 1839602

SEQ ID NO: 2105921 - protein, 44 aa, Staphylococcus
SNYDRAVELYYYIKGGRVDYGAAHAAKYGHKRYGKTYEGVYKDW

SEQ ID NO: 2105922 - protein, 27 aa, Staphylococcus
SNYDRAVELYYYIKGGTVDYGAAHAAK

SEQ ID NO: 2105923 - protein, 26 aa, Staphylococcus
SNYDRAVELYYYIKGGTVDYGAAHAE

SEQ ID NO: 2105924 - protein, 26 aa, Staphylococcus
SPALFKRLKASTFFLKMNEKEQPEFK

SEQ ID NO: 2105925 - protein, 17 aa, Staphylococcus
SPARGPFATLIGVSDDK

SEQ ID NO: 2105926 - protein, 20 aa, Staphylococcus
SPDGPIKAENGYIDKDIYNS

SEQ ID NO: 2105927 - protein, 20 aa, Staphylococcus
SPDVYPGMENQLIQSLNKHG

SEQ ID NO: 2105928 - protein, 26 aa, Staphylococcus
SPIGKLRAGLDLVIPPIKIEDDISVG

SEQ ID NO: 2105929 - protein, 19 aa, Staphylococcus
SPIIGELMAEWLKTDERPE

SEQ ID NO: 2105930 - protein, 17 aa, Staphylococcus
SPINGDLEGLGRLSIFI

SEQ ID NO: 2105931 - protein, 20 aa, Staphylococcus
SPIQKGAYNVNFDYNGFNYH

SEQ ID NO: 2105932 - protein, 25 aa, Staphylococcus
SPKGKLRAGLDLFKKPIQIERDISV

SEQ ID NO: 2105933 - protein, 22 aa, Staphylococcus
SPKKEQIRLLSIPRDTISYIPK

SEQ ID NO: 2105934 - protein, 25 aa, Staphylococcus
SPLGKLRAGLDLFKKPIEIEDDISV

SEQ ID NO: 2105935 - protein, 25 aa, Staphylococcus
SPLGKLRAGLDLFKKPIIMPNNDIS

SEQ ID NO: 2105936 - protein, 18 aa, Staphylococcus
SPNDFFTLESGDPVPDAT

SEQ ID NO: 2105937 - protein, 20 aa, Staphylococcus
SPNVYPGMEKQLLNTLNQHG

SEQ ID NO: 2105938 - protein, 17 aa, Staphylococcus
SPTSAWGEVYMYKIGNK

SEQ ID NO: 2105939 - protein, 33 aa, Staphylococcus
SPVFNHRNLYDWGQCTWHVFNRRAAIGKGISTY

SEQ ID NO: 2105940 - protein, 31 aa, Staphylococcus
SPYPQGQCTWYVYKRMQQFDLAIGGDLGDAH

SEQ ID NO: 2105941 - protein, 18 aa, Staphylococcus
SQAPKLYISNIMTQPGET

SEQ ID NO: 2105942 - protein, 18 aa, Staphylococcus
SQELIKYSATGMTLDAAA

SEQ ID NO: 2105943 - protein, 19 aa, Staphylococcus
SQGAFGHVAYVENVNNDGS

SEQ ID NO: 2105944 - protein, 18 aa, Staphylococcus
SQGAFGHVAYVENVNSDG

SEQ ID NO: 2105945 - protein, 21 aa, Staphylococcus
SQGTEAMHYITFDPNTNTSGI

SEQ ID NO: 2105946 - protein, 18 aa, Staphylococcus
SQIKWLKKHDAKFLTLKE

SEQ ID NO: 2105947 - protein, 23 aa, Staphylococcus
SQISRLPLIVLTSDRPHELRSVG

SEQ ID NO: 2105948 - protein, 31 aa, Staphylococcus
SQKLNGRGTDGGFEWSPDGKTIIYRYDATTG

SEQ ID NO: 2105949 - protein, 19 aa, Staphylococcus
SQLDKALSIGIIDDKTTHY

SEQ ID NO: 2105950 - protein, 20 aa, Staphylococcus
SQLDKALSIGIIDYQSTDYK

SEQ ID NO: 2105951 - protein, 17 aa, Staphylococcus
SQNLAPLEDKTTKLRDD

SEQ ID NO: 2105952 - protein, 28 aa, Staphylococcus
SQPEKGYKWYDRSTFKPGSYGSSQSGSD

SEQ ID NO: 2105953 - protein, 25 aa, Staphylococcus
SQSLKYLIGDSVSSYKESKYIGKSA

SEQ ID NO: 2105954 - protein, 29 aa, Staphylococcus
SQTIPGRQTDGGFQWSQDHKSLIYRYDAT

SEQ ID NO: 2105955 - protein, 20 aa, Staphylococcus
SRAGIEDIIIVTGKHKRAIE

SEQ ID NO: 2105956 - protein, 20 aa, Staphylococcus
SRGAHYKPEFPDRNDDEWLK

SEQ ID NO: 2105957 - protein, 20 aa, Staphylococcus
SRGAHYKPEFPDRNDEEWLK

SEQ ID NO: 2105958 - protein, 23 aa, Staphylococcus
SRHIPYRLNEEIVSVKDHLVTFK

SEQ ID NO: 2105959 - protein, 17 aa, Staphylococcus
SRIKHSADIPFEQNPNQ

SEQ ID NO: 2105960 - protein, 19 aa, Staphylococcus
SRKPYTFHATKVVKVPNAD

SEQ ID NO: 2105961 - protein, 19 aa, Staphylococcus
SRNPDQWMNTLIINQGSKD

SEQ ID NO: 2105962 - protein, 19 aa, Staphylococcus
SRPGPRIDEGLKDLKEAIY

SEQ ID NO: 2105963 - protein, 21 aa, Staphylococcus
SRPGPRIDQGLKELRDAIYRY

SEQ ID NO: 2105964 - protein, 17 aa, Staphylococcus
SSALDISKGVYINIKSV

SEQ ID NO: 2105965 - protein, 22 aa, Staphylococcus
SSAPKLYVSNVMTQPGETDGYD

SEQ ID NO: 2105966 - protein, 25 aa, Staphylococcus
SSAYNFRQGNPLNRSEFYNDSVNHI

SEQ ID NO: 2105967 - protein, 17 aa, Staphylococcus
SSDKAQRVLGWKPKHDD

SEQ ID NO: 2105968 - protein, 21 aa, Staphylococcus
SSDWLSNQFGVRFRYNALGDL

SEQ ID NO: 2105969 - protein, 17 aa, Staphylococcus
SSFEILLGKLLEKKYSD

SEQ ID NO: 2105970 - protein, 17 aa, Staphylococcus
SSGKMGYALAEALRNRG

SEQ ID NO: 2105971 - protein, 17 aa, Staphylococcus
SSGLVLHLGIDKYFPQL

SEQ ID NO: 2105972 - protein, 17 aa, Staphylococcus
SSGNLYTAGQCTWYVFD

SEQ ID NO: 2105973 - protein, 17 aa, Staphylococcus
SSNAQMWKDITLNNQTH

SEQ ID NO: 2105974 - protein, 24 aa, Staphylococcus
SSNNMFNITAGFRKYPDTKASLED

SEQ ID NO: 2105975 - protein, 23 aa, Staphylococcus
SSNSEGIYNFFAHAKDYRDQLPA

SEQ ID NO: 2105976 - protein, 23 aa, Staphylococcus
SSNSFGKSVDWTIQGTDARNGVM

SEQ ID NO: 2105977 - protein, 27 aa, Staphylococcus
SSPINIPSTEMISFNYKDGSTDRISIS

SEQ ID NO: 2105978 - protein, 28 aa, Staphylococcus
SSPYPQGQCTWYVYQRMQQYDSSISGDL

SEQ ID NO: 2105979 - protein, 19 aa, Staphylococcus
SSRRPVRGQGGTRPPSNTA

SEQ ID NO: 2105980 - protein, 17 aa, Staphylococcus
SSSLLISTLPFNTVDAE

SEQ ID NO: 2105981 - protein, 17 aa, Staphylococcus
SSSQIKATVPSKGDVLK

SEQ ID NO: 2105982 - protein, 24 aa, Staphylococcus
SSVSGFRTSLIMYNHTSKKMTKPV

SEQ ID NO: 2105983 - protein, 21 aa, Staphylococcus
STCILLMSMSLIFMPVSHAQG

SEQ ID NO: 2105984 - protein, 20 aa, Staphylococcus
STCLLCLTLTACGGNGEQKE

SEQ ID NO: 2105985 - protein, 17 aa, Staphylococcus
STDKSFYNKFKSNLTVY

SEQ ID NO: 2105986 - protein, 25 aa, Staphylococcus
STEGKEWLLREAIERVPELASSREI

SEQ ID NO: 2105987 - protein, 27 aa, Staphylococcus
STFGPGGRFGGLVFDTLGFKPADKDVK

SEQ ID NO: 2105988 - protein, 29 aa, Staphylococcus
STFGPKGRFGGLVFDILGFKPADENVSNS

SEQ ID NO: 2105989 - protein, 29 aa, Staphylococcus
STGQRIISYPVNFVAGEIGNFFNSGDSKD

SEQ ID NO: 2105990 - protein, 40 aa, Staphylococcus
STHASLFGRQKSDLILFFPFTLTANVIGKAAEKEWRENDG

SEQ ID NO: 2105991 - protein, 35 aa, Staphylococcus
STKSYETGSPWGVTDLKAAIRYYRFNDSSLPGNSS

SEQ ID NO: 2105992 - protein, 18 aa, Staphylococcus
STLESIIYGDYSEMEKIQ

SEQ ID NO: 2105993 - protein, 19 aa, Staphylococcus
STLFGVGVTSALTDTSIAH

SEQ ID NO: 2105994 - protein, 29 aa, Staphylococcus
STNISRLPQGWTSEFVRNSNGEGGTLRIT

SEQ ID NO: 2105995 - protein, 17 aa, Staphylococcus
STRPALNGRQKADINMG

SEQ ID NO: 2105996 - protein, 18 aa, Staphylococcus
STSGYIYPMASLKKVNVN

SEQ ID NO: 2105997 - protein, 31 aa, Staphylococcus
STTDFYNTYVYKKGMPEFETATSDVPEQKYK

SEQ ID NO: 2105998 - protein, 19 aa, Staphylococcus
STTSIPVVITYDDGSTEQI

SEQ ID NO: 2105999 - protein, 26 aa, Staphylococcus
STTTAIKYHNVFGIGAYDSNPVFDGI

SEQ ID NO: 2106000 - protein, 26 aa, Staphylococcus
STYVYGAVNGKNAWVDSAKLSKYTAP

SEQ ID NO: 2106001 - protein, 19 aa, Staphylococcus
SVAKPRMMYATANRATSSL

SEQ ID NO: 2106002 - protein, 19 aa, Staphylococcus
SVALMLLTACQNSDSSQQE

SEQ ID NO: 2106003 - protein, 22 aa, Staphylococcus
SVALSKRLGEYLNEVFDYNVYV

SEQ ID NO: 2106004 - protein, 19 aa, Staphylococcus
SVAPAEYQGQPAASAPESV

SEQ ID NO: 2106005 - protein, 34 aa, Staphylococcus
SVGASSILVATLLFMGGGAAQAAETHQEVGNPES

SEQ ID NO: 2106006 - protein, 17 aa, Staphylococcus
SVGSYWGNANNWASSAR

SEQ ID NO: 2106007 - protein, 20 aa, Staphylococcus
SVKTVKRYAAKATTSSLPKY

SEQ ID NO: 2106008 - protein, 18 aa, Staphylococcus
SVLARGLKDYPIDITTIV

SEQ ID NO: 2106009 - protein, 19 aa, Staphylococcus
SVNILKKCKEYSNRKFDGE

SEQ ID NO: 2106010 - protein, 24 aa, Staphylococcus
SVNPVKRKQAINELNTVAQQQKQN

SEQ ID NO: 2106011 - protein, 22 aa, Staphylococcus
SVNVNSHLKAIAQRESGGDIHA

SEQ ID NO: 2106012 - protein, 19 aa, Staphylococcus
SVRGNMKKIEFQYLTKSKF

SEQ ID NO: 2106013 - protein, 19 aa, Staphylococcus
SVTFKRTTDILKYLGDNKK

SEQ ID NO: 2106014 - protein, 21 aa, Staphylococcus
SVTVKNSWEKGFRVLQNDKPL

SEQ ID NO: 2106015 - protein, 34 aa, Staphylococcus
SYDELYDLINEKYLIKMGKVAPWGTTSTNNSTPT

SEQ ID NO: 2106016 - protein, 18 aa, Staphylococcus
SYLGRKTIMTDIAHEIGL

SEQ ID NO: 2106017 - protein, 18 aa, Staphylococcus
SYLGRKTIMTDIAKDIGL

SEQ ID NO: 2106018 - protein, 18 aa, Staphylococcus
SYLGRKTIMTDMAKDIGL

SEQ ID NO: 2106019 - protein, 20 aa, Staphylococcus
SYLTVPRGDTGYFFNTAYLP

SEQ ID NO: 2106020 - protein, 19 aa, Staphylococcus
SYMGMGSDLLEFYANQGVD

SEQ ID NO: 2106021 - protein, 17 aa, Staphylococcus
SYQSAITSYYVKSPNDG

SEQ ID NO: 2106022 - protein, 20 aa, Staphylococcus
SYTLRLFLRDANRLPDYASD

SEQ ID NO: 2106023 - protein, 17 aa, Staphylococcus
SYVKYATNDGFYIAFFD

SEQ ID NO: 2106024 - protein, 32 aa, Staphylococcus
SYYNQPFFVSKQMKVDGVTWYYGQLTNGKYVW

SEQ ID NO: 2106025 - protein, 18 aa, Staphylococcus
TAAIQELGTYSNLNHAQS

SEQ ID NO: 2106026 - protein, 24 aa, Staphylococcus
TAGAADWVIDGAFSDYADSMKNKG

SEQ ID NO: 2106027 - protein, 24 aa, Staphylococcus
TAGAADWVIDGGFSDYADSMKKQG

SEQ ID NO: 2106028 - protein, 24 aa, Staphylococcus
TAGAADWVIDGGFSDYADSMRQQG

SEQ ID NO: 2106029 - protein, 25 aa, Staphylococcus
TAGAADWVLDGGFSDYANQIAKQGY

SEQ ID NO: 2106030 - protein, 26 aa, Staphylococcus
TAHTNASGQRELWVTSGDILSLKADY

SEQ ID NO: 2106031 - protein, 18 aa, Staphylococcus
TAIEYGRENIRANAISPG

SEQ ID NO: 2106032 - protein, 25 aa, Staphylococcus
TAKEANIATVFNWNPTTKKLTYGTG

SEQ ID NO: 2106033 - protein, 18 aa, Staphylococcus
TAKKVLSNNVIKDVKAVK

SEQ ID NO: 2106034 - protein, 24 aa, Staphylococcus
TAKLIKQLIKDGSLVIRKDLEDVV

SEQ ID NO: 2106035 - protein, 18 aa, Staphylococcus
TAKMLAKAGNILVIAARR

SEQ ID NO: 2106036 - protein, 17 aa, Staphylococcus
TAKQVKATVPSSGKQLK

SEQ ID NO: 2106037 - protein, 27 aa, Staphylococcus
TALLITGIAVSGVIAYQKYMKSDQASA

SEQ ID NO: 2106038 - protein, 19 aa, Staphylococcus
TALYKVLFEDVPVKESIKE

SEQ ID NO: 2106039 - protein, 21 aa, Staphylococcus
TASGGNFVLSQSFYNGLKADN

SEQ ID NO: 2106040 - protein, 19 aa, Staphylococcus
TDADVIFYNGFNLESGNGW

SEQ ID NO: 2106041 - protein, 18 aa, Staphylococcus
TDANDFILEPSFIEAVKN

SEQ ID NO: 2106042 - protein, 18 aa, Staphylococcus
TDAPKLYVANVMTQPGET

SEQ ID NO: 2106043 - protein, 21 aa, Staphylococcus
TDARMLYWFTEKEYPVLRKPQ

SEQ ID NO: 2106044 - protein, 18 aa, Staphylococcus
TDDKSVFAVSKGVKPIYL

SEQ ID NO: 2106045 - protein, 19 aa, Staphylococcus
TDEEINWQLNLNLMGVIRM

SEQ ID NO: 2106046 - protein, 19 aa, Staphylococcus
TDGKTPASITQFNNAMTNA

SEQ ID NO: 2106047 - protein, 20 aa, Staphylococcus
TDKNKKEFIALQKDINNYLM

SEQ ID NO: 2106048 - protein, 31 aa, Staphylococcus
TDSSSPYPQGQCTWYVYERVQQFGKKVGSDW

SEQ ID NO: 2106049 - protein, 34 aa, Staphylococcus
TDTRRVALLKDGYKYYSLIDSIDIASGSHLKVLP

SEQ ID NO: 2106050 - protein, 22 aa, Staphylococcus
TEAKEILNNTDVDFNKATDEEI

SEQ ID NO: 2106051 - protein, 17 aa, Staphylococcus
TEALPIKEPLFAVYEGT

SEQ ID NO: 2106052 - protein, 33 aa, Staphylococcus
TEAMASYVQPEFNIKFTLIEPGGIQSEFTNNVM

SEQ ID NO: 2106053 - protein, 27 aa, Staphylococcus
TEARISVDDLRAFWDSIAEEIVQNEKV

SEQ ID NO: 2106054 - protein, 17 aa, Staphylococcus
TELNTAMSQLQDGIANK

SEQ ID NO: 2106055 - protein, 22 aa, Staphylococcus
TETNLSLALKERVGSKNVDFKT

SEQ ID NO: 2106056 - protein, 26 aa, Staphylococcus
TFEPRTAALKGYWEKVGLKTKVSMVE

SEQ ID NO: 2106057 - protein, 27 aa, Staphylococcus
TFGPGSRFGGLVFDTLGFKPVDKDVSK

SEQ ID NO: 2106058 - protein, 30 aa, Staphylococcus
TFNDQNLYDWGQCTWHVFNRRAETGQPIST

SEQ ID NO: 2106059 - protein, 19 aa, Staphylococcus
TFTEGINRTYHLGNTKDIY

SEQ ID NO: 2106060 - protein, 17 aa, Staphylococcus
TFTISGLHFVKGQKTHV

SEQ ID NO: 2106061 - protein, 18 aa, Staphylococcus
TGADLADLNHVYVAKRDV

SEQ ID NO: 2106062 - protein, 21 aa, Staphylococcus
TGAKPHWIFEEMDLKMLKDPD

SEQ ID NO: 2106063 - protein, 18 aa, Staphylococcus
TGATLAFILAKNESADIV

SEQ ID NO: 2106064 - protein, 20 aa, Staphylococcus
TGFLGLRIVAELLKQDYSVR

SEQ ID NO: 2106065 - protein, 18 aa, Staphylococcus
TGGAITSPDGPIKAENGY

SEQ ID NO: 2106066 - protein, 25 aa, Staphylococcus
TGGSTKAQFLAAGGTEDMWNTIVMP

SEQ ID NO: 2106067 - protein, 22 aa, Staphylococcus
TGGSTKAQFLAAGGTEELWNAI

SEQ ID NO: 2106068 - protein, 18 aa, Staphylococcus
TGHIDWKDGNVIKKVKDI

SEQ ID NO: 2106069 - protein, 19 aa, Staphylococcus
TGHTPKRYAVMQSTAGYYG

SEQ ID NO: 2106070 - protein, 17 aa, Staphylococcus
TGIGLYIIAQLVEKQGG

SEQ ID NO: 2106071 - protein, 30 aa, Staphylococcus
TGIPESKHLGGFPISGQFIACTNPEVIKQH

SEQ ID NO: 2106072 - protein, 30 aa, Staphylococcus; identical to SEQ ID NO: 1841347

SEQ ID NO: 2106073 - protein, 30 aa, Staphylococcus
TGIPESKHLGGFPITGEFLVCNNPEVVAKH

SEQ ID NO: 2106074 - protein, 26 aa, Staphylococcus
TGIPESKHLGGFPITGQFLACTNPQV

SEQ ID NO: 2106075 - protein, 31 aa, Staphylococcus
TGIPESKHLGGFPITGQFLICTNPDIIAQHD

SEQ ID NO: 2106076 - protein, 25 aa, Staphylococcus
TGIPESKHLGGFPITGQFLTCTNPQ

SEQ ID NO: 2106077 - protein, 20 aa, Staphylococcus
TGIYEYRLPTGKHNYKLVDF

SEQ ID NO: 2106078 - protein, 27 aa, Staphylococcus
TGKAAGSLKDFYEGIFTVYEKQVINGV

SEQ ID NO: 2106079 - protein, 18 aa, Staphylococcus
TGKYKRQGTGDNDVKQIV

SEQ ID NO: 2106080 - protein, 26 aa, Staphylococcus
THDVKVLKAKYLKTVKTKKKSIYDVK

SEQ ID NO: 2106081 - protein, 18 aa, Staphylococcus
THIAVCWDMGQQTFRNEV

SEQ ID NO: 2106082 - protein, 22 aa, Staphylococcus
THKDKLFVSNSMPIRDVDNLLF

SEQ ID NO: 2106083 - protein, 19 aa, Staphylococcus
THLIPIVLQAALGQRDAIT

SEQ ID NO: 2106084 - protein, 23 aa, Staphylococcus
THSPKNHTAVVFEAGQLGADTQY

SEQ ID NO: 2106085 - protein, 22 aa, Staphylococcus
TIDKRTGEFIDYIDDRSDEDKE

SEQ ID NO: 2106086 - protein, 25 aa, Staphylococcus
TIDNFRWAGVPFYIRTGKRMKSKSI

SEQ ID NO: 2106087 - protein, 19 aa, Staphylococcus
TIEHKKWGKGVDVKIDTPD

SEQ ID NO: 2106088 - protein, 22 aa, Staphylococcus
TIGLLMFIGFGLATYFEMKKVS

SEQ ID NO: 2106089 - protein, 17 aa, Staphylococcus
TIIEPGGIQSEFMPNIM

SEQ ID NO: 2106090 - protein, 28 aa, Staphylococcus
TILLLVVALGFSVFFAATTTHHSTSDQK

SEQ ID NO: 2106091 - protein, 17 aa, Staphylococcus
TIMTDIANEIGLGNDLI

SEQ ID NO: 2106092 - protein, 17 aa, Staphylococcus
TIMTDLAKDIGLEDDLI

SEQ ID NO: 2106093 - protein, 19 aa, Staphylococcus
TIQQLKLSKVEDVPKYIPS

SEQ ID NO: 2106094 - protein, 26 aa, Staphylococcus
TIRIDGGVMAYTWPGEMLSDDSWKKS

SEQ ID NO: 2106095 - protein, 25 aa, Staphylococcus
TIRIDGGVMAYTWPGEMLSEDKWKH

SEQ ID NO: 2106096 - protein, 21 aa, Staphylococcus
TIRRDVNVINRFFKDPESPWH

SEQ ID NO: 2106097 - protein, 26 aa, Staphylococcus
TISARSDMSPSWKDKISKAFMHISET

SEQ ID NO: 2106098 - protein, 19 aa, Staphylococcus
TIYQPTWKSETSSYRDATA

SEQ ID NO: 2106099 - protein, 23 aa, Staphylococcus
TKAEFKLSTSIEQGMWHKYLMIT

SEQ ID NO: 2106100 - protein, 23 aa, Staphylococcus
TKAGKYKVKYEVVDSDGALETST

SEQ ID NO: 2106101 - protein, 21 aa, Staphylococcus
TKDGIKPLLAKKWDISADGKT

SEQ ID NO: 2106102 - protein, 20 aa, Staphylococcus
TKEVREALDNVINREQITSK

SEQ ID NO: 2106103 - protein, 20 aa, Staphylococcus
TKFLLPLMMDEGGSIINTAS

SEQ ID NO: 2106104 - protein, 21 aa, Staphylococcus
TKFLLPLMMDHGGSIINTASF

SEQ ID NO: 2106105 - protein, 20 aa, Staphylococcus
TKFLLPLMMDNGGSIINTAS

SEQ ID NO: 2106106 - protein, 20 aa, Staphylococcus
TKFLLPLMMEQGGSIINTAS

SEQ ID NO: 2106107 - protein, 20 aa, Staphylococcus
TKGPVLFGFFGHSSIALDHD

SEQ ID NO: 2106108 - protein, 17 aa, Staphylococcus
TKILSGMIYELALELTS

SEQ ID NO: 2106109 - protein, 17 aa, Staphylococcus
TKKATLNNKNFYLISDF

SEQ ID NO: 2106110 - protein, 19 aa, Staphylococcus
TKKDRKALADAVNALGEPL

SEQ ID NO: 2106111 - protein, 19 aa, Staphylococcus
TKKEIQSLAKMYLTGNTDI

SEQ ID NO: 2106112 - protein, 26 aa, Staphylococcus
TKLAEEHPEWSFKESDGSVWTNGKGD

SEQ ID NO: 2106113 - protein, 30 aa, Staphylococcus
TKMIVISHIFWKTGEVVPIKEVIDIAHSRG

SEQ ID NO: 2106114 - protein, 21 aa, Staphylococcus
TKMPGEEYVIIGGNESAFDAA

SEQ ID NO: 2106115 - protein, 18 aa, Staphylococcus
TKNIPWESIIPVDGNFPV

SEQ ID NO: 2106116 - protein, 20 aa, Staphylococcus
TKNLKSTYLKSVKDKKAAIN

SEQ ID NO: 2106117 - protein, 18 aa, Staphylococcus
TKNSAAWKAANKDKKDTK

SEQ ID NO: 2106118 - protein, 19 aa, Staphylococcus
TKNSDAWKKAEEQKKMTED

SEQ ID NO: 2106119 - protein, 20 aa, Staphylococcus
TKQGKRVVVVPKKQYDKIQK

SEQ ID NO: 2106120 - protein, 23 aa, Staphylococcus
TKSEIKSLAKMYLSDSVEMKKSQ

SEQ ID NO: 2106121 - protein, 21 aa, Staphylococcus
TKSGGEFVLNHTFYNALKAGN

SEQ ID NO: 2106122 - protein, 17 aa, Staphylococcus
TKSMPQYHIGHIGQIRK

SEQ ID NO: 2106123 - protein, 17 aa, Staphylococcus
TKVPKHPKRVVVLEYSF

SEQ ID NO: 2106124 - protein, 20 aa, Staphylococcus
TKVVELEGIPGASATRERGK

SEQ ID NO: 2106125 - protein, 27 aa, Staphylococcus
TKWNFLNFKPGLVGGHCIGVDPYYLTH

SEQ ID NO: 2106126 - protein, 17 aa, Staphylococcus
TKYRLNDLNQWVLTNSK

SEQ ID NO: 2106127 - protein, 20 aa, Staphylococcus
TLAELKKLDAGSSFNEQNPQ

SEQ ID NO: 2106128 - protein, 26 aa, Staphylococcus
TLAELKKLDAGSWFNKQHLDLAKSEY

SEQ ID NO: 2106129 - protein, 21 aa, Staphylococcus
TLAVGLGVTGIAAGNSADASE

SEQ ID NO: 2106130 - protein, 21 aa, Staphylococcus
TLCLLSFIIVACDTEDDHDDD

SEQ ID NO: 2106131 - protein, 22 aa, Staphylococcus
TLGKDKYYLVSDYNSGKVYGWV

SEQ ID NO: 2106132 - protein, 17 aa, Staphylococcus
TLIHKSHQLAAVENEYN

SEQ ID NO: 2106133 - protein, 22 aa, Staphylococcus
TLIVPSFSTAPIANAADDHSTT

SEQ ID NO: 2106134 - protein, 21 aa, Staphylococcus
TLKDTKIREAISKAINTNQLS

SEQ ID NO: 2106135 - protein, 18 aa, Staphylococcus
TLKELIEASMTYSDNTAN

SEQ ID NO: 2106136 - protein, 22 aa, Staphylococcus
TLKLTLKNNIKFQNGHKLTGQA

SEQ ID NO: 2106137 - protein, 23 aa, Staphylococcus
TLKYDGKKAQVWVADQYITDKQA

SEQ ID NO: 2106138 - protein, 18 aa, Staphylococcus
TLLFYLVFMKAVGEVLKY

SEQ ID NO: 2106139 - protein, 18 aa, Staphylococcus
TLLLILIILFGFYIYSKI

SEQ ID NO: 2106140 - protein, 19 aa, Staphylococcus
TLQEKYSYFVVVNSSETLD

SEQ ID NO: 2106141 - protein, 24 aa, Staphylococcus
TLTAGIGVSAFGLNIHHADAAELT

SEQ ID NO: 2106142 - protein, 17 aa, Staphylococcus
TLTLTAKVSEDINGAHI

SEQ ID NO: 2106143 - protein, 18 aa, Staphylococcus
TLVLPTFTSSVAQAEETT

SEQ ID NO: 2106144 - protein, 19 aa, Staphylococcus
TLYKMRWNPDQPGTHQYAT

SEQ ID NO: 2106145 - protein, 20 aa, Staphylococcus
TLYKMRWNPENPGKHQYATG

SEQ ID NO: 2106146 - protein, 17 aa, Staphylococcus
TMFEPISLMSIVARETQ

SEQ ID NO: 2106147 - protein, 19 aa, Staphylococcus
TMICSTLIASLAMSTTVTM

SEQ ID NO: 2106148 - protein, 29 aa, Staphylococcus
TMNVPVDYYARVNMKAFVQAVDELGGIYY

SEQ ID NO: 2106149 - protein, 25 aa, Staphylococcus
TMNVPVDYYVRINMKAFVEAVDELG

SEQ ID NO: 2106150 - protein, 18 aa, Staphylococcus
TMYDSIGESGKYFDVDNY

SEQ ID NO: 2106151 - protein, 19 aa, Staphylococcus
TNDSHPHWATNPTGEKYTT

SEQ ID NO: 2106152 - protein, 29 aa, Staphylococcus
TNEIRKLKGIKPMRVNNDIAHIAAINLYD

SEQ ID NO: 2106153 - protein, 43 aa, Staphylococcus
TNGEQNFALLNGEFKNQIYGIDRLYAFIGKGNASYTIQFKTQG

SEQ ID NO: 2106154 - protein, 21 aa, Staphylococcus
TNKGKRVIVVPKKQYDKIKTG

SEQ ID NO: 2106155 - protein, 24 aa, Staphylococcus
TNKIGKYKVEYQVIDSNGAKEISE

SEQ ID NO: 2106156 - protein, 25 aa, Staphylococcus
TNSSKKYYNMFGIGAIDTDAVRGGF

SEQ ID NO: 2106157 - protein, 17 aa, Staphylococcus
TNYKNKETFRVRKSEDE

SEQ ID NO: 2106158 - protein, 19 aa, Staphylococcus
TPDVSPLERAKADLENDIN

SEQ ID NO: 2106159 - protein, 22 aa, Staphylococcus
TPEAYPGMDRKLIDELNKKTLL

SEQ ID NO: 2106160 - protein, 17 aa, Staphylococcus
TPELKTGHIDWKDGNVI

SEQ ID NO: 2106161 - protein, 31 aa, Staphylococcus
TPIFNHRNLYDWGQCTWHVFNRRAQIGKGIS

SEQ ID NO: 2106162 - protein, 21 aa, Staphylococcus
TPKGTMAFSDHLGRGTEILYD

SEQ ID NO: 2106163 - protein, 19 aa, Staphylococcus
TPKHAGLRNHIEGQEKILA

SEQ ID NO: 2106164 - protein, 24 aa, Staphylococcus
TPLKRGAATIAMLAKVPIVPAAYV

SEQ ID NO: 2106165 - protein, 19 aa, Staphylococcus
TPLPHISFVQGIRNVQFLQ

SEQ ID NO: 2106166 - protein, 20 aa, Staphylococcus
TPNEVNHALKQVTFAEQALN

SEQ ID NO: 2106167 - protein, 32 aa, Staphylococcus
TPNKEARKMLPKDIRNDHRFYPTKKEQQRLEV

SEQ ID NO: 2106168 - protein, 24 aa, Staphylococcus
TPSQMRHAIQFVKEHHIKHLLVET

SEQ ID NO: 2106169 - protein, 21 aa, Staphylococcus
TPSTHSAVVFEAGQAGAHDIY

SEQ ID NO: 2106170 - protein, 23 aa, Staphylococcus
TPTKHDWDHVDFVGQDSSDTKRT

SEQ ID NO: 2106171 - protein, 18 aa, Staphylococcus
TPVFNHSNLYDWGQCTWH

SEQ ID NO: 2106172 - protein, 27 aa, Staphylococcus
TPWKPLRASDSKGIAYVTTKRLKDGYE

SEQ ID NO: 2106173 - protein, 23 aa, Staphylococcus
TQEAKGYSYGSYFTKDAQGNYHH

SEQ ID NO: 2106174 - protein, 49 aa, Staphylococcus
TQGNTAERFYYAAGGRALEYRQLFSFNELYVEPLNVFTERVKTFTEGIN

SEQ ID NO: 2106175 - protein, 21 aa, Staphylococcus
TQLDKALSIGIIDRKITDYKT

SEQ ID NO: 2106176 - protein, 20 aa, Staphylococcus
TQLLGSIFLLLGGALVAKQS

SEQ ID NO: 2106177 - protein, 18 aa, Staphylococcus
TQNKKDWQVYQGDIAHVF

SEQ ID NO: 2106178 - protein, 19 aa, Staphylococcus
TQNTPLGWVNIKDVTSQNL

SEQ ID NO: 2106179 - protein, 23 aa, Staphylococcus
TQPSTELTNLIGYTKDNDKLEFV

SEQ ID NO: 2106180 - protein, 20 aa, Staphylococcus
TQPTLIGPVHFERHKGTINN

SEQ ID NO: 2106181 - protein, 18 aa, Staphylococcus
TQSVYQRFLAAGGTEEMW

SEQ ID NO: 2106182 - protein, 24 aa, Staphylococcus
TQVARSLSPFNGNEGQALQQLPNF

SEQ ID NO: 2106183 - protein, 19 aa, Staphylococcus
TQVRPLRIMSPHAVEGGKV

SEQ ID NO: 2106184 - protein, 19 aa, Staphylococcus
TQVRPLRIMSPHAVKDGKV

SEQ ID NO: 2106185 - protein, 18 aa, Staphylococcus
TQVRPLRIMSPHSVENGK

SEQ ID NO: 2106186 - protein, 25 aa, Staphylococcus
TRAEEKEVIRALTAVNSNITQYLDS

SEQ ID NO: 2106187 - protein, 18 aa, Staphylococcus
TRAGRLSVNIQHKSKNVF

SEQ ID NO: 2106188 - protein, 19 aa, Staphylococcus
TRAVFKMGGVGLAFKKGKF

SEQ ID NO: 2106189 - protein, 18 aa, Staphylococcus
TRITYRDGSIEIVNVPIR

SEQ ID NO: 2106190 - protein, 18 aa, Staphylococcus
TRLSSGFAPKDHNDKDPN

SEQ ID NO: 2106191 - protein, 17 aa, Staphylococcus
TRMSDDWSKKDEDQLAK

SEQ ID NO: 2106192 - protein, 20 aa, Staphylococcus
TRNGKILIVEYGDYKCPYCK

SEQ ID NO: 2106193 - protein, 19 aa, Staphylococcus
TRQLWNMLILARVITIGAY

SEQ ID NO: 2106194 - protein, 22 aa, Staphylococcus
TRTVSIPVTIYAPATAKAPQRD

SEQ ID NO: 2106195 - protein, 20 aa, Staphylococcus
TSALYRVLFEDVPVNESVKE

SEQ ID NO: 2106196 - protein, 21 aa, Staphylococcus
TSDGTNFSWNYQEAGSTSAQT

SEQ ID NO: 2106197 - protein, 24 aa, Staphylococcus
TSDKKLAKEWMDFLKSKKAKDILK

SEQ ID NO: 2106198 - protein, 33 aa, Staphylococcus
TSDSPYPHGQCTWYVYNRMAQFDKQISGTLGDA

SEQ ID NO: 2106199 - protein, 18 aa, Staphylococcus
TSDWKPKIKEMIPSYGES

SEQ ID NO: 2106200 - protein, 33 aa, Staphylococcus
TSEGAFKYFAKQFKVKPGYIWEINTEKQGTPGQ

SEQ ID NO: 2106201 - protein, 19 aa, Staphylococcus
TSFGFKHGIQMDADLVFDV

SEQ ID NO: 2106202 - protein, 40 aa, Staphylococcus
TSGNLYTAGQCTWYVYDRVGGKIGSTWGNANNWASAASAA

SEQ ID NO: 2106203 - protein, 33 aa, Staphylococcus
TSGQCTYYVFDRVGGKIGSTWGNASNWANAAAA

SEQ ID NO: 2106204 - protein, 19 aa, Staphylococcus
TSITVPVKHVIPNIRGIEL

SEQ ID NO: 2106205 - protein, 27 aa, Staphylococcus
TSKPLYLKDFMLHRTGLKKYKATSQIH

SEQ ID NO: 2106206 - protein, 23 aa, Staphylococcus
TSKVGKYKVKYNVIDSDGAEETS

SEQ ID NO: 2106207 - protein, 35 aa, Staphylococcus
TSNATNMNFLRWVDFPNDYTVGWTSQTIPGRQTDG

SEQ ID NO: 2106208 - protein, 20 aa, Staphylococcus
TSNGTNWSWNYAQVGSTTQS

SEQ ID NO: 2106209 - protein, 17 aa, Staphylococcus
TSSNSTVMSGDIPAMNG

SEQ ID NO: 2106210 - protein, 23 aa, Staphylococcus
TSSYRDATAHLARTYATDPNYAT

SEQ ID NO: 2106211 - protein, 23 aa, Staphylococcus
TTDKKLAKEWIDFLKTDKAKDIL

SEQ ID NO: 2106212 - protein, 28 aa, Staphylococcus
TTELASDDEIMWQLNLNLMGVIRMTKAV

SEQ ID NO: 2106213 - protein, 23 aa, Staphylococcus
TTFIGVLLILLAIYLFAKPHIDN

SEQ ID NO: 2106214 - protein, 25 aa, Staphylococcus
TTIKSEARKAVQNKVNEQIGLIKAT

SEQ ID NO: 2106215 - protein, 19 aa, Staphylococcus
TTLKHAYIDKSIDRETGKK

SEQ ID NO: 2106216 - protein, 29 aa, Staphylococcus
TTLKYYVCTSKDMKHCQVYDYIFLTIGTL

SEQ ID NO: 2106217 - protein, 18 aa, Staphylococcus
TTNFGISLSLVRIVEAIL

SEQ ID NO: 2106218 - protein, 22 aa, Staphylococcus
TTTNTPLGWFNVKDLKVQNSSS

SEQ ID NO: 2106219 - protein, 22 aa, Staphylococcus
TTYQGRVGGMGSSATKAQTAKS

SEQ ID NO: 2106220 - protein, 17 aa, Staphylococcus
TVKKGDTLYSIAKNQKT

SEQ ID NO: 2106221 - protein, 23 aa, Staphylococcus
TVKSGESLWSIAQQHNTTVNDIK

SEQ ID NO: 2106222 - protein, 24 aa, Staphylococcus
TVKSGESLWSIASKYNTSVDSIKK

SEQ ID NO: 2106223 - protein, 25 aa, Staphylococcus
TVKSGESLWSISQQYGVSVDEIKQS

SEQ ID NO: 2106224 - protein, 20 aa, Staphylococcus
TVLSGCSLPGLGGNSSDDEV

SEQ ID NO: 2106225 - protein, 25 aa, Staphylococcus
TVSEMNYGHGVGVVTSRTISASQAA

SEQ ID NO: 2106226 - protein, 25 aa, Staphylococcus
TVSEMNYGHGVGVVTSRTLSSSEAA

SEQ ID NO: 2106227 - protein, 25 aa, Staphylococcus
TVVLSPSVTALGHITFKDNNDGTVT

SEQ ID NO: 2106228 - protein, 20 aa, Staphylococcus
TVYFNDRYVAILGTNIKNTN

SEQ ID NO: 2106229 - protein, 22 aa, Staphylococcus
TWDKFKDKVLFTGVFNSQEARD

SEQ ID NO: 2106230 - protein, 22 aa, Staphylococcus
TYATRNDLAFIYPKGQDKPIIL

SEQ ID NO: 2106231 - protein, 17 aa, Staphylococcus
TYAYGPGEDKFLGNKDN

SEQ ID NO: 2106232 - protein, 17 aa, Staphylococcus
TYDGTGFVIARTSDTHI

SEQ ID NO: 2106233 - protein, 19 aa, Staphylococcus
TYETFKSIGKLTHREKQAN

SEQ ID NO: 2106234 - protein, 26 aa, Staphylococcus
TYGPKERFGSLVYNTLGFKPADKNVK

SEQ ID NO: 2106235 - protein, 19 aa, Staphylococcus
TYGTFTFDPSIIIGNDDAE

SEQ ID NO: 2106236 - protein, 26 aa, Staphylococcus
TYHFESDGTNWSWNYAQSGQASQQQD

SEQ ID NO: 2106237 - protein, 27 aa, Staphylococcus
TYIVKAGDCLYNIAVEHGITLEQLYTL

SEQ ID NO: 2106238 - protein, 31 aa, Staphylococcus
TYLYGSLNGKNGWVSQAFLSNITKPSSGSKT

SEQ ID NO: 2106239 - protein, 26 aa, Staphylococcus
TYLYGTVNGISGWISKYYLTEPTATR

SEQ ID NO: 2106240 - protein, 17 aa, Staphylococcus
TYNGTGFVIARTSHTDI

SEQ ID NO: 2106241 - protein, 19 aa, Staphylococcus
TYNKQVFDQDITVIDSHSA

SEQ ID NO: 2106242 - protein, 24 aa, Staphylococcus
TYSDALMPYNFMNSVFKNIDGKSG

SEQ ID NO: 2106243 - protein, 25 aa, Staphylococcus
TYSYLKKLEICVANRNSVIISYRKS

SEQ ID NO: 2106244 - protein, 26 aa, Staphylococcus
TYVYGSVNGLTGWVSKYYLNDVQNKA

SEQ ID NO: 2106245 - protein, 20 aa, Staphylococcus
VAAASTLLLAGCTTDKKEVK

SEQ ID NO: 2106246 - protein, 18 aa, Staphylococcus
VAEKFLKAHNYFENDKKG

SEQ ID NO: 2106247 - protein, 28 aa, Staphylococcus
VAFLFACLFVMFIQMFLVKSAVVQTDDM

SEQ ID NO: 2106248 - protein, 26 aa, Staphylococcus
VAKDPKRVVALEFSFVDALAALNVKP

SEQ ID NO: 2106249 - protein, 27 aa, Staphylococcus
VALLLLFSFVPVGLWISAIAAGVKVGI

SEQ ID NO: 2106250 - protein, 17 aa, Staphylococcus
VAPAEYKGQPASSAPEH

SEQ ID NO: 2106251 - protein, 20 aa, Staphylococcus
VAPDEYKGVSPAQAPEDVQD

SEQ ID NO: 2106252 - protein, 28 aa, Staphylococcus
VAPIVEKLNEKWAKDHPSATISSGQAGT

SEQ ID NO: 2106253 - protein, 20 aa, Staphylococcus
VAPSEYKGVSPANAPEHVQD

SEQ ID NO: 2106254 - protein, 24 aa, Staphylococcus
VAQWPSARLNHWQVLLKARAIENN

SEQ ID NO: 2106255 - protein, 19 aa, Staphylococcus
VATHHPKLPITMTSRSAHL

SEQ ID NO: 2106256 - protein, 17 aa, Staphylococcus
VAVDLSNAKAGKYKEDY

SEQ ID NO: 2106257 - protein, 26 aa, Staphylococcus
VAVILSLCLAFLLFIATNQNALAKVH

SEQ ID NO: 2106258 - protein, 29 aa, Staphylococcus
VCLNVGCIPSKIFLEYGAKMRDIHSANNW

SEQ ID NO: 2106259 - protein, 17 aa, Staphylococcus
VDAAAVFQDARNIVKKD

SEQ ID NO: 2106260 - protein, 17 aa, Staphylococcus
VDAAAVFQDARNVVKKD

SEQ ID NO: 2106261 - protein, 17 aa, Staphylococcus
VDAAAVFQDARTIVKKD

SEQ ID NO: 2106262 - protein, 18 aa, Staphylococcus
VDAARKVVITSYLSFNQV

SEQ ID NO: 2106263 - protein, 20 aa, Staphylococcus
VDAISSMIYPSHWSNGDFGL

SEQ ID NO: 2106264 - protein, 23 aa, Staphylococcus
VDELVEFEVAYAPPYSHPKDLIN

SEQ ID NO: 2106265 - protein, 21 aa, Staphylococcus
VDGDTAMAFIRSRKETGAGGD

SEQ ID NO: 2106266 - protein, 17 aa, Staphylococcus
VDLPIDYYGKAETIGIT

SEQ ID NO: 2106267 - protein, 17 aa, Staphylococcus
VDLPIDYYGQAETIGIT

SEQ ID NO: 2106268 - protein, 23 aa, Staphylococcus
VDNDGRVVLTFKDGSTRIIDPAQ

SEQ ID NO: 2106269 - protein, 17 aa, Staphylococcus
VDNRTGWIAAKDLTQNS

SEQ ID NO: 2106270 - protein, 18 aa, Staphylococcus
VDRGYAINLNPFRKDDNQ

SEQ ID NO: 2106271 - protein, 17 aa, Staphylococcus
VDTELGKQLAASDNKEQ

SEQ ID NO: 2106272 - protein, 21 aa, Staphylococcus
VDVLLGGGAEYFGKENGNLTD

SEQ ID NO: 2106273 - protein, 19 aa, Staphylococcus
VDVPTHYAGDVNGKVQNKI

SEQ ID NO: 2106274 - protein, 17 aa, Staphylococcus
VDVPTHYAGDVNGNQQN

SEQ ID NO: 2106275 - protein, 27 aa, Staphylococcus
VDYVKRVKDSKLWQTKDNGFYDLTREG

SEQ ID NO: 2106276 - protein, 19 aa, Staphylococcus
VEDELSQDIAILVKEKERE

SEQ ID NO: 2106277 - protein, 17 aa, Staphylococcus
VEDKILMKKNPKYWDKK

SEQ ID NO: 2106278 - protein, 23 aa, Staphylococcus
VEDRLGKPLKEIVKGRYRVDISS

SEQ ID NO: 2106279 - protein, 17 aa, Staphylococcus
VEEALRQVQNAEQALNG

SEQ ID NO: 2106280 - protein, 18 aa, Staphylococcus
VEEELSQDIAILVKEKEK

SEQ ID NO: 2106281 - protein, 18 aa, Staphylococcus
VEEELSQDIAILVKEKER

SEQ ID NO: 2106282 - protein, 17 aa, Staphylococcus
VEILFALSVTLLCLSLT

SEQ ID NO: 2106283 - protein, 22 aa, Staphylococcus
VEKVIKNGYGFDVKSKQIDKIK

SEQ ID NO: 2106284 - protein, 18 aa, Staphylococcus
VEKVNADGSIIISESNVK

SEQ ID NO: 2106285 - protein, 17 aa, Staphylococcus
VEKVNKDGSIVISESNV

SEQ ID NO: 2106286 - protein, 24 aa, Staphylococcus
VERLRRAYQASGWLNETGAKYPIE

SEQ ID NO: 2106287 - protein, 34 aa, Staphylococcus
VESVNSDGSITISEMNYTGGAYVTDTRTISASEV

SEQ ID NO: 2106288 - protein, 23 aa, Staphylococcus
VETADTDYLAWGAGPVANQRFIH

SEQ ID NO: 2106289 - protein, 22 aa, Staphylococcus
VETLKQLKSVVVKNKHTVEINL

SEQ ID NO: 2106290 - protein, 19 aa, Staphylococcus
VETTHGIFEYDILVVALGF

SEQ ID NO: 2106291 - protein, 25 aa, Staphylococcus
VEVMGGIEPTVDWLKRALSQKKHVV

SEQ ID NO: 2106292 - protein, 24 aa, Staphylococcus
VEVPKNPKRAVVFDYAAVDLMKAF

SEQ ID NO: 2106293 - protein, 26 aa, Staphylococcus
VFDKVGGKIGSTWGNASNWASAAASE

SEQ ID NO: 2106294 - protein, 26 aa, Staphylococcus
VFERAGGKAGSLWGNANNWANAAAAA

SEQ ID NO: 2106295 - protein, 18 aa, Staphylococcus
VFETCHKYGVEPYVTLHH

SEQ ID NO: 2106296 - protein, 21 aa, Staphylococcus
VFGPTGRFGGFLNKDLGINHA

SEQ ID NO: 2106297 - protein, 17 aa, Staphylococcus
VFNENNEVIGIHQGGIE

SEQ ID NO: 2106298 - protein, 25 aa, Staphylococcus
VFNKEFKANHPAAYTIATRMSDDWS

SEQ ID NO: 2106299 - protein, 28 aa, Staphylococcus
VFNKRAQIGKGISTYWWNANNWDTAAAA

SEQ ID NO: 2106300 - protein, 18 aa, Staphylococcus
VFPTDNFLYQDGQYLDKN

SEQ ID NO: 2106301 - protein, 24 aa, Staphylococcus
VFSGRYGGGFGHTAIVLNGNYDGK

SEQ ID NO: 2106302 - protein, 21 aa, Staphylococcus
VGAFFRRRLGNEVFENLIEPL

SEQ ID NO: 2106303 - protein, 17 aa, Staphylococcus
VGAGIGIGDNVIKKLGK

SEQ ID NO: 2106304 - protein, 24 aa, Staphylococcus
VGEFFRKRLGNEMLENLIEPLMGG

SEQ ID NO: 2106305 - protein, 23 aa, Staphylococcus
VGEHGDSQIAVWSHARVAGEPVL

SEQ ID NO: 2106306 - protein, 22 aa, Staphylococcus
VGGIFALIGTFWGIKYQITKEK

SEQ ID NO: 2106307 - protein, 17 aa, Staphylococcus
VGHVFGRDITGKKAAFM

SEQ ID NO: 2106308 - protein, 17 aa, Staphylococcus
VGIGTLVGMRLRRVSPR

SEQ ID NO: 2106309 - protein, 17 aa, Staphylococcus
VGKETYLHGSINHQWGW

SEQ ID NO: 2106310 - protein, 21 aa, Staphylococcus
VGKKAIKRVQYNSVSGNFAYI

SEQ ID NO: 2106311 - protein, 17 aa, Staphylococcus
VGKLVAFLASDDSSFIT

SEQ ID NO: 2106312 - protein, 21 aa, Staphylococcus
VGKVSFRFWPLNEFKFNFNPD

SEQ ID NO: 2106313 - protein, 17 aa, Staphylococcus
VGLASGIAVSWMNRDQQ

SEQ ID NO: 2106314 - protein, 26 aa, Staphylococcus
VGLKNKYYKGEQVNFTLDITDGANGT

SEQ ID NO: 2106315 - protein, 18 aa, Staphylococcus
VGLTGYNGVLGYRTNELD

SEQ ID NO: 2106316 - protein, 17 aa, Staphylococcus
VGLWISAIAAGVKVSIA

SEQ ID NO: 2106317 - protein, 24 aa, Staphylococcus
VGMRLRRVSPRKVISPLIKAHKAG

SEQ ID NO: 2106318 - protein, 24 aa, Staphylococcus
VGTASALVASVAFLTVSHSADAAE

SEQ ID NO: 2106319 - protein, 25 aa, Staphylococcus
VGTHTYRLNANDAYRQDQAPLTLKL

SEQ ID NO: 2106320 - protein, 22 aa, Staphylococcus
VGTSSILIAALLFIGGGSAQAA

SEQ ID NO: 2106321 - protein, 17 aa, Staphylococcus
VGVLCLGISQWFKSKEN

SEQ ID NO: 2106322 - protein, 18 aa, Staphylococcus
VGYYRPDFHRTYTELSKC

SEQ ID NO: 2106323 - protein, 20 aa, Staphylococcus
VIAHGFDGYFVLPSNPVDIM

SEQ ID NO: 2106324 - protein, 25 aa, Staphylococcus
VIAIVVALALVFLIGKFVGQPYTIK

SEQ ID NO: 2106325 - protein, 18 aa, Staphylococcus
VIALVLMLIMSYLTLTTK

SEQ ID NO: 2106326 - protein, 24 aa, Staphylococcus
VIEKGQQYHPLKGIRAYDKEDGDL

SEQ ID NO: 2106327 - protein, 29 aa, Staphylococcus
VIFALVLSLGFSVFAALTHQNKSSLHKAE

SEQ ID NO: 2106328 - protein, 17 aa, Staphylococcus
VIFSELLRFSGIGESKV

SEQ ID NO: 2106329 - protein, 26 aa, Staphylococcus
VIGAICGAVDYLARNGFLNKYKHTGN

SEQ ID NO: 2106330 - protein, 29 aa, Staphylococcus
VIILLVVALGCSVFFAATHSNQSDPNQTQ

SEQ ID NO: 2106331 - protein, 19 aa, Staphylococcus
VILAGCGKINEQDKENQSS

SEQ ID NO: 2106332 - protein, 18 aa, Staphylococcus
VILKAHKGYDNIYLGEIK

SEQ ID NO: 2106333 - protein, 29 aa, Staphylococcus
VILLLVVALGFSIFFAATGTKQSNSSDDH

SEQ ID NO: 2106334 - protein, 19 aa, Staphylococcus
VILPEMWNNGYALEQLEEK

SEQ ID NO: 2106335 - protein, 18 aa, Staphylococcus
VILPLFALILTACGNDDN

SEQ ID NO: 2106336 - protein, 18 aa, Staphylococcus
VIMLLILAGCGNKADRVS

SEQ ID NO: 2106337 - protein, 20 aa, Staphylococcus
VINNVWGWILSDDVQTVKTS

SEQ ID NO: 2106338 - protein, 18 aa, Staphylococcus
VISLLSFVLALTVVSPFS

SEQ ID NO: 2106339 - protein, 17 aa, Staphylococcus
VITEPKVAFTQEKNQAK

SEQ ID NO: 2106340 - protein, 18 aa, Staphylococcus
VKAGDSLNSIAKKHHISV

SEQ ID NO: 2106341 - protein, 27 aa, Staphylococcus
VKAMKRDGWTFASHSWGHIDFANSSYD

SEQ ID NO: 2106342 - protein, 19 aa, Staphylococcus
VKASVATVSKTYDAKLDNL

SEQ ID NO: 2106343 - protein, 21 aa, Staphylococcus
VKCNLWLRTADRIKIVMGRSD

SEQ ID NO: 2106344 - protein, 21 aa, Staphylococcus
VKCNLWLRTADRVKIVMGQFK

SEQ ID NO: 2106345 - protein, 19 aa, Staphylococcus
VKDKLVYAKDVRQVLNYVE

SEQ ID NO: 2106346 - protein, 22 aa, Staphylococcus
VKDLKNKYLENVKQEKQSIYDI

SEQ ID NO: 2106347 - protein, 26 aa, Staphylococcus
VKDYGFKFASARPMQIGLVYDALKNK

SEQ ID NO: 2106348 - protein, 17 aa, Staphylococcus
VKEGTLAYDIYGKKEIE

SEQ ID NO: 2106349 - protein, 21 aa, Staphylococcus
VKEIKDSGAKYILYEDNVSNK

SEQ ID NO: 2106350 - protein, 20 aa, Staphylococcus
VKELLKKGLEVNGMTINLLG

SEQ ID NO: 2106351 - protein, 21 aa, Staphylococcus
VKGAYKTYAYVVSYKPTNGNE

SEQ ID NO: 2106352 - protein, 21 aa, Staphylococcus
VKGAYKTYAYVVSYKPTNGNK

SEQ ID NO: 2106353 - protein, 23 aa, Staphylococcus
VKGKIRAAMDLFKKPVAMQDGDI

SEQ ID NO: 2106354 - protein, 35 aa, Staphylococcus
VKIPKNPKRIAVLHPTYIGALVKFGHKPIAVPEFV

SEQ ID NO: 2106355 - protein, 19 aa, Staphylococcus
VKISNFIAKDLDAIKDKHT

SEQ ID NO: 2106356 - protein, 17 aa, Staphylococcus
VKKGRVEAVDGDKISRP

SEQ ID NO: 2106357 - protein, 22 aa, Staphylococcus
VKLGESMQSVLGKYSSPIYSYN

SEQ ID NO: 2106358 - protein, 18 aa, Staphylococcus
VKNDKYWDKKNVKLNKVN

SEQ ID NO: 2106359 - protein, 23 aa, Staphylococcus
VKNLKKAGLLVHPFTVNDPEDMK

SEQ ID NO: 2106360 - protein, 23 aa, Staphylococcus
VKNSTSIPFNIDAYMSGANSGTR

SEQ ID NO: 2106361 - protein, 21 aa, Staphylococcus
VKQMSEALGFINIGVQNYEAD

SEQ ID NO: 2106362 - protein, 29 aa, Staphylococcus
VKRDLTQMMTFKGAPDFSIVNRLPNSMPQ

SEQ ID NO: 2106363 - protein, 17 aa, Staphylococcus
VKSDAKSGNSLRFTYLG

SEQ ID NO: 2106364 - protein, 35 aa, Staphylococcus
VKSGDTFTIGYGQYIRPGGFSLPSSDTELRDANGA

SEQ ID NO: 2106365 - protein, 23 aa, Staphylococcus
VKSPEWSVKSWGKTYKYNDYSDH

SEQ ID NO: 2106366 - protein, 23 aa, Staphylococcus
VKSPEWSVKSWGKTYRYNDYSDH

SEQ ID NO: 2106367 - protein, 17 aa, Staphylococcus
VKTDYGYHIIKADKEND

SEQ ID NO: 2106368 - protein, 18 aa, Staphylococcus
VKTDYGYHIIKADKENDF

SEQ ID NO: 2106369 - protein, 23 aa, Staphylococcus
VKVKSYIKDKQWILKEETKESVI

SEQ ID NO: 2106370 - protein, 26 aa, Staphylococcus
VKYQKKHGGDISPLYKGGQDNMVSSI

SEQ ID NO: 2106371 - protein, 22 aa, Staphylococcus
VKYSSNLANMFYVRQKEQKGLG

SEQ ID NO: 2106372 - protein, 19 aa, Staphylococcus
VLAGCGFGNNDKGSSKVSD

SEQ ID NO: 2106373 - protein, 17 aa, Staphylococcus
VLENLYTRGLDVTLIHR

SEQ ID NO: 2106374 - protein, 19 aa, Staphylococcus
VLGLLATLALAIVLSACGN

SEQ ID NO: 2106375 - protein, 24 aa, Staphylococcus
VLLTSFLLSACTINIERDGENSEK

SEQ ID NO: 2106376 - protein, 17 aa, Staphylococcus
VLPEANIPFKKREQQAM

SEQ ID NO: 2106377 - protein, 23 aa, Staphylococcus
VLSGCDLPGLGGGPSKNVKITAL

SEQ ID NO: 2106378 - protein, 26 aa, Staphylococcus
VLSKGLDSGTAFEILSIDIADVDIGK

SEQ ID NO: 2106379 - protein, 26 aa, Staphylococcus
VLSKGLDSGTAFEILSIDIADVDISK

SEQ ID NO: 2106380 - protein, 18 aa, Staphylococcus
VMGGYCVIETTLDSMGEI

SEQ ID NO: 2106381 - protein, 19 aa, Staphylococcus
VMNGYRRGAYQDITKDLTN

SEQ ID NO: 2106382 - protein, 23 aa, Staphylococcus
VMNNKKIVKREIKYKKSSKSGYI

SEQ ID NO: 2106383 - protein, 21 aa, Staphylococcus
VMREFIKFTLEDKGKSAEDAG

SEQ ID NO: 2106384 - protein, 18 aa, Staphylococcus
VMTSEGLIGRTTKVNQFS

SEQ ID NO: 2106385 - protein, 22 aa, Staphylococcus
VMTSEGLVGRISKVNQFSSQVD

SEQ ID NO: 2106386 - protein, 18 aa, Staphylococcus
VMTSEGLVGRVTKVNQFS

SEQ ID NO: 2106387 - protein, 25 aa, Staphylococcus
VMYGDFKCPYCKKVEDKVMPKLRNK

SEQ ID NO: 2106388 - protein, 17 aa, Staphylococcus
VNESARNGVPAFTIDHV

SEQ ID NO: 2106389 - protein, 19 aa, Staphylococcus
VNFSDIFLIALPTKAIRDV

SEQ ID NO: 2106390 - protein, 23 aa, Staphylococcus
VNGKSGWISKAYLSAINNDSSST

SEQ ID NO: 2106391 - protein, 25 aa, Staphylococcus
VNGLVKRFDKVLCTADFPYAAQQLM

SEQ ID NO: 2106392 - protein, 17 aa, Staphylococcus
VNIQHDSKNVFGLIDHY

SEQ ID NO: 2106393 - protein, 28 aa, Staphylococcus
VNKIHQMQCQYNDYAIQSHNGRYEYLFS

SEQ ID NO: 2106394 - protein, 18 aa, Staphylococcus
VNLKRMIIEEIQITRHVS

SEQ ID NO: 2106395 - protein, 18 aa, Staphylococcus
VNMKGHDQAVISLMNGDV

SEQ ID NO: 2106396 - protein, 17 aa, Staphylococcus
VNMKGHDQSIISLLNGD

SEQ ID NO: 2106397 - protein, 19 aa, Staphylococcus
VNNQAYLAAKMLKENGLTP

SEQ ID NO: 2106398 - protein, 18 aa, Staphylococcus
VNPAGYRGLGQTMESWGT

SEQ ID NO: 2106399 - protein, 23 aa, Staphylococcus
VNPEKQPISILFLGIDDNEGREK

SEQ ID NO: 2106400 - protein, 18 aa, Staphylococcus
VNPIGYRGLGQTKEAWGT

SEQ ID NO: 2106401 - protein, 19 aa, Staphylococcus
VNPKYPAKQIKAFSPDQSH

SEQ ID NO: 2106402 - protein, 24 aa, Staphylococcus
VNSENNGLYSIAWGTKNQQLLSSK

SEQ ID NO: 2106403 - protein, 24 aa, Staphylococcus
VNSKWPDKKIKAFSPDQSHGTFDF

SEQ ID NO: 2106404 - protein, 19 aa, Staphylococcus
VNTEHLHAAGGFFSEKEPE

SEQ ID NO: 2106405 - protein, 27 aa, Staphylococcus
VNTRSATKYHNVFGIAAYDYNALGEGV

SEQ ID NO: 2106406 - protein, 19 aa, Staphylococcus
VNVGGVFWGIQAALEQFEK

SEQ ID NO: 2106407 - protein, 29 aa, Staphylococcus
VPEFKNKHLRLAIAQAINKKGYVKSVLND

SEQ ID NO: 2106408 - protein, 28 aa, Staphylococcus
VPEQKYKELSNIVGNYWQKEQGYDNESN

SEQ ID NO: 2106409 - protein, 21 aa, Staphylococcus
VPLEKAFDLFKEECELNGIDL

SEQ ID NO: 2106410 - protein, 17 aa, Staphylococcus
VPTLDEILSRYGKNANY

SEQ ID NO: 2106411 - protein, 27 aa, Staphylococcus
VPTLDEILTRYGPDTNYYIETKSPDVY

SEQ ID NO: 2106412 - protein, 21 aa, Staphylococcus
VPVKIGALESLFKMSKDGKVK

SEQ ID NO: 2106413 - protein, 22 aa, Staphylococcus
VPVTASALLLGACGSNATDSES

SEQ ID NO: 2106414 - protein, 22 aa, Staphylococcus
VPVTASALLLGACGSNATESKD

SEQ ID NO: 2106415 - protein, 23 aa, Staphylococcus
VPYFGICLGMQLATVEFARNVIG

SEQ ID NO: 2106416 - protein, 24 aa, Staphylococcus
VPYFGICLGMQLATVEFARNVLGL

SEQ ID NO: 2106417 - protein, 23 aa, Staphylococcus
VQAGESLGIIAAQYGTSAEAIMQ

SEQ ID NO: 2106418 - protein, 19 aa, Staphylococcus
VQAHPMGGIQIVPETNQII

SEQ ID NO: 2106419 - protein, 24 aa, Staphylococcus
VQFLKDRYYAMKDFPMFDNIEYTE

SEQ ID NO: 2106420 - protein, 17 aa, Staphylococcus
VQFLQKRYDALKDLPMF

SEQ ID NO: 2106421 - protein, 27 aa, Staphylococcus
VQGDNYRTILPFKESKARGVLQDNMAN

SEQ ID NO: 2106422 - protein, 25 aa, Staphylococcus
VQGDNYRTILPFKESQARGLLQDNM

SEQ ID NO: 2106423 - protein, 18 aa, Staphylococcus
VQGSDEFNYVVPKEGSNL

SEQ ID NO: 2106424 - protein, 17 aa, Staphylococcus
VQHDWNGQHNKFSITPV

SEQ ID NO: 2106425 - protein, 20 aa, Staphylococcus
VQLYNRYVARDGKKAADKYS

SEQ ID NO: 2106426 - protein, 25 aa, Staphylococcus
VQNHMLQMVALLAMEAPISLNSEDI

SEQ ID NO: 2106427 - protein, 26 aa, Staphylococcus
VQNIEVLRFSNAMFEPLWNNKYISNI

SEQ ID NO: 2106428 - protein, 22 aa, Staphylococcus
VQPHPMGGIQIIPETNQVISPR

SEQ ID NO: 2106429 - protein, 19 aa, Staphylococcus
VQRHPMGGIQIIPETNQVI

SEQ ID NO: 2106430 - protein, 24 aa, Staphylococcus
VQSRVLEFYRQYGFDDKIVEAGIP

SEQ ID NO: 2106431 - protein, 25 aa, Staphylococcus
VRGGFKTAQNYGWDTVSKAIVGGAQ

SEQ ID NO: 2106432 - protein, 24 aa, Staphylococcus
VRIDGGVMAYTWPGEMLSDDRWKN

SEQ ID NO: 2106433 - protein, 31 aa, Staphylococcus
VRLRKKEQPFEIRVKPLPPHIDTTVEQLRGK

SEQ ID NO: 2106434 - protein, 17 aa, Staphylococcus
VRPELKGLTQRQLDHYN

SEQ ID NO: 2106435 - protein, 17 aa, Staphylococcus
VRRDLKQMMTFKGDPEF

SEQ ID NO: 2106436 - protein, 18 aa, Staphylococcus
VRSLLGIAVPTQIATHDS

SEQ ID NO: 2106437 - protein, 19 aa, Staphylococcus
VRYEIELNYYSPKSKKDTS

SEQ ID NO: 2106438 - protein, 25 aa, Staphylococcus
VSFGQRVISYPVNFVTGAIGNFLKS

SEQ ID NO: 2106439 - protein, 30 aa, Staphylococcus
VSFGQRVMSYPVNFVTGAIGNIFNMGESKE

SEQ ID NO: 2106440 - protein, 18 aa, Staphylococcus
VSFKDIRVQYGQNYEYQE

SEQ ID NO: 2106441 - protein, 19 aa, Staphylococcus
VSHVPHIIASSLVHLNAQH

SEQ ID NO: 2106442 - protein, 24 aa, Staphylococcus
VSHVPHIIASSLVHLSANHVDQHE

SEQ ID NO: 2106443 - protein, 24 aa, Staphylococcus
VSHVPHIIASSLVHLSSSHAKDHA

SEQ ID NO: 2106444 - protein, 18 aa, Staphylococcus
VSHVPHIVASSLVHLSAN

SEQ ID NO: 2106445 - protein, 17 aa, Staphylococcus
VSIATLVGMRLRRVSPR

SEQ ID NO: 2106446 - protein, 19 aa, Staphylococcus
VSKALDAIDDFVSDETDDD

SEQ ID NO: 2106447 - protein, 19 aa, Staphylococcus
VSLWTWWKNNNFTHHAQKG

SEQ ID NO: 2106448 - protein, 19 aa, Staphylococcus
VSMHAGCTLAITDPNKAKG

SEQ ID NO: 2106449 - protein, 19 aa, Staphylococcus
VSNGLNIGDKVIVNPSSSL

SEQ ID NO: 2106450 - protein, 21 aa, Staphylococcus
VSNKDGWKGLGKDSMGTGTVI

SEQ ID NO: 2106451 - protein, 21 aa, Staphylococcus
VSNRASGKMGYAIADALQKRG

SEQ ID NO: 2106452 - protein, 23 aa, Staphylococcus
VSNRSSGKMGFAIANALKKRGAH

SEQ ID NO: 2106453 - protein, 26 aa, Staphylococcus
VSNVPADPNALVYLVVTGNLAQDGTN

SEQ ID NO: 2106454 - protein, 29 aa, Staphylococcus
VSPNGYMGLGQTKEGWGTGSVSAQTKGMI

SEQ ID NO: 2106455 - protein, 25 aa, Staphylococcus
VSSTPKAHTAVVFEAGQQGADQIYG

SEQ ID NO: 2106456 - protein, 25 aa, Staphylococcus
VSSTPKKHTVVVFEAGQLGADTQYG

SEQ ID NO: 2106457 - protein, 17 aa, Staphylococcus
VSVNELMSANNLNGYLI

SEQ ID NO: 2106458 - protein, 19 aa, Staphylococcus
VTASAVLLGACGNHATDSK

SEQ ID NO: 2106459 - protein, 17 aa, Staphylococcus
VTCLVILSGCSLPGLGD

SEQ ID NO: 2106460 - protein, 22 aa, Staphylococcus
VTFKRTKDILKYLGEHKRQQYL

SEQ ID NO: 2106461 - protein, 18 aa, Staphylococcus
VTKEDRKALSDAVNSLGE

SEQ ID NO: 2106462 - protein, 26 aa, Staphylococcus
VTKKAFKPRSKRDLDNTIVAEALKAD

SEQ ID NO: 2106463 - protein, 17 aa, Staphylococcus
VTKRDADTYAIVILGLD

SEQ ID NO: 2106464 - protein, 17 aa, Staphylococcus
VTKSAVTPIKYDYIIHN

SEQ ID NO: 2106465 - protein, 23 aa, Staphylococcus
VTKYEGWEFLGIVKDDDNMARGI

SEQ ID NO: 2106466 - protein, 23 aa, Staphylococcus
VTKYEGWEFLGIVKDDDNTARGI

SEQ ID NO: 2106467 - protein, 23 aa, Staphylococcus
VTKYEGWEFLGIVKDDEDAARGI

SEQ ID NO: 2106468 - protein, 26 aa, Staphylococcus
VTLIVLVGVLGFKWSKHHEVETQVLK

SEQ ID NO: 2106469 - protein, 17 aa, Staphylococcus
VTLLCLSLTPNIINLTS

SEQ ID NO: 2106470 - protein, 27 aa, Staphylococcus
VTLLKSDGTSLAIARTTYGPGHNAVVV

SEQ ID NO: 2106471 - protein, 24 aa, Staphylococcus
VTNRSSGKMGFAIAEALRDRGAEV

SEQ ID NO: 2106472 - protein, 18 aa, Staphylococcus
VTPKLRVATTSANTAVAT

SEQ ID NO: 2106473 - protein, 17 aa, Staphylococcus
VTRIASSNADMWRDITF

SEQ ID NO: 2106474 - protein, 17 aa, Staphylococcus
VTSHLSVKQLKEAYGKG

SEQ ID NO: 2106475 - protein, 26 aa, Staphylococcus
VTSTPEKYNAVVFEAGQQNADPIYGH

SEQ ID NO: 2106476 - protein, 19 aa, Staphylococcus
VTTRDKIQFISKVKEIATV

SEQ ID NO: 2106477 - protein, 22 aa, Staphylococcus
VTTSPRISHWTIQVDAETGEIV

SEQ ID NO: 2106478 - protein, 19 aa, Staphylococcus
VVAAGAWAGFLAPDSEIQE

SEQ ID NO: 2106479 - protein, 26 aa, Staphylococcus
VVAKYQVVNGVKWYYGQFSDGQFAWI

SEQ ID NO: 2106480 - protein, 19 aa, Staphylococcus
VVALTGYNGVLGYRTNELN

SEQ ID NO: 2106481 - protein, 19 aa, Staphylococcus
VVALTGYNGVLGYRTNETD

SEQ ID NO: 2106482 - protein, 17 aa, Staphylococcus
VVALVFVITYGLNRHNH

SEQ ID NO: 2106483 - protein, 19 aa, Staphylococcus
VVATLLFMGGSSAQAAEKQ

SEQ ID NO: 2106484 - protein, 18 aa, Staphylococcus
VVCLISLGVQHEQRKELE

SEQ ID NO: 2106485 - protein, 20 aa, Staphylococcus
VVDVPTHYAGDVNGKQQDKI

SEQ ID NO: 2106486 - protein, 18 aa, Staphylococcus
VVFKRTPDILKYLGEHKA

SEQ ID NO: 2106487 - protein, 19 aa, Staphylococcus
VVGGITLGTVLGFNVTEHN

SEQ ID NO: 2106488 - protein, 19 aa, Staphylococcus
VVGLMFLLVACSNGGSEDK

SEQ ID NO: 2106489 - protein, 19 aa, Staphylococcus
VVGVICLLISQKFTSKDHS

SEQ ID NO: 2106490 - protein, 30 aa, Staphylococcus
VVILLVAALSFSIYAAMTHESKYSNTDSNK

SEQ ID NO: 2106491 - protein, 19 aa, Staphylococcus
VVLAACGQGGSSDEGKKSD

SEQ ID NO: 2106492 - protein, 21 aa, Staphylococcus
VVLSGCGLPGLGDSNSKDSVK

SEQ ID NO: 2106493 - protein, 17 aa, Staphylococcus
VVNGIIWSEILAKPKQL

SEQ ID NO: 2106494 - protein, 17 aa, Staphylococcus
VVRQVVYDIGKAFGNKD

SEQ ID NO: 2106495 - protein, 21 aa, Staphylococcus
VVSIVTGITIFIGGQQAHAAE

SEQ ID NO: 2106496 - protein, 19 aa, Staphylococcus
VVSSLRAVAEFTLNGVATG

SEQ ID NO: 2106497 - protein, 18 aa, Staphylococcus
VVVPIIFATQLYKSSESA

SEQ ID NO: 2106498 - protein, 19 aa, Staphylococcus
VWLIKKGFNIYNRYTLARF

SEQ ID NO: 2106499 - protein, 25 aa, Staphylococcus
VYDKVGGKIGSTWGNANNWANAAAS

SEQ ID NO: 2106500 - protein, 21 aa, Staphylococcus
VYDKVGGSIGNTWGNANNWAN

SEQ ID NO: 2106501 - protein, 24 aa, Staphylococcus
VYEKQLVNGVTWYHGTLANGTAIW

SEQ ID NO: 2106502 - protein, 36 aa, Staphylococcus
VYEKQVINGVTWYHGKLANGKVVWVKEDDLRKELVK

SEQ ID NO: 2106503 - protein, 20 aa, Staphylococcus
VYELDPKLWYFASGSTTTAI

SEQ ID NO: 2106504 - protein, 20 aa, Staphylococcus
VYELDPKLWYFASGSTTTTM

SEQ ID NO: 2106505 - protein, 25 aa, Staphylococcus
VYHGDKIKLQFKVENGYVTSVTIGQ

SEQ ID NO: 2106506 - protein, 22 aa, Staphylococcus
VYNHKDLHATHVPDTVDVNISG

SEQ ID NO: 2106507 - protein, 25 aa, Staphylococcus
VYTYVMKWRETEIFFDKLTDLLKFM

SEQ ID NO: 2106508 - protein, 24 aa, Staphylococcus
WADSNAQVLKGLYDQIGEVGKFFD

SEQ ID NO: 2106509 - protein, 17 aa, Staphylococcus
WANLNAKSLKYLYDQIN

SEQ ID NO: 2106510 - protein, 19 aa, Staphylococcus
WAVNARNAGFTVNNIPVAG

SEQ ID NO: 2106511 - protein, 19 aa, Staphylococcus
WDASMYSYLTVPRGDTGYF

SEQ ID NO: 2106512 - protein, 17 aa, Staphylococcus
WEKGFRVLQNDKPLEMR

SEQ ID NO: 2106513 - protein, 19 aa, Staphylococcus
WFIAFVLSSVCLIGLSSMH

SEQ ID NO: 2106514 - protein, 17 aa, Staphylococcus
WGNANNWASAAAASGYT

SEQ ID NO: 2106515 - protein, 17 aa, Staphylococcus
WGNASNWASAAASEGYN

SEQ ID NO: 2106516 - protein, 18 aa, Staphylococcus
WGRRGRVGIVPLINNQAY

SEQ ID NO: 2106517 - protein, 18 aa, Staphylococcus
WGTPSQVASKVSGSGNQT

SEQ ID NO: 2106518 - protein, 24 aa, Staphylococcus
WHAAGALKYFGLKDHAVDLTNKKM

SEQ ID NO: 2106519 - protein, 23 aa, Staphylococcus
WIADRKLKGLVFQSDNDASPKMN

SEQ ID NO: 2106520 - protein, 26 aa, Staphylococcus
WIHPDERSAAFFALGLIKGSERPVAI

SEQ ID NO: 2106521 - protein, 20 aa, Staphylococcus
WITLICVLVIGSLVALDLKY

SEQ ID NO: 2106522 - protein, 19 aa, Staphylococcus
WKDKISKAFMHISETNKGK

SEQ ID NO: 2106523 - protein, 18 aa, Staphylococcus
WKPKHDDIHEIIETAWNW

SEQ ID NO: 2106524 - protein, 20 aa, Staphylococcus
WKPKIKEMIPSYGESLINDE

SEQ ID NO: 2106525 - protein, 26 aa, Staphylococcus
WLDPEKNKVFAIEIKDHLVAKDPKHK

SEQ ID NO: 2106526 - protein, 19 aa, Staphylococcus
WLFSASLRFFIYVPHTFYN

SEQ ID NO: 2106527 - protein, 18 aa, Staphylococcus
WNGHYNRVTNRTITNTSS

SEQ ID NO: 2106528 - protein, 17 aa, Staphylococcus
WNQLLGRLNFNLEKTSK

SEQ ID NO: 2106529 - protein, 17 aa, Staphylococcus
WNSFSFEDQQQFQKKYT

SEQ ID NO: 2106530 - protein, 18 aa, Staphylococcus
WNSLSLRDQELFNQKYSK

SEQ ID NO: 2106531 - protein, 18 aa, Staphylococcus
WRENDGLVSVISSQHPFN

SEQ ID NO: 2106532 - protein, 21 aa, Staphylococcus
WREYDYLFLTFGTFAYHDPYH

SEQ ID NO: 2106533 - protein, 20 aa, Staphylococcus
WRNKIAKAFINVSKKKEGRQ

SEQ ID NO: 2106534 - protein, 17 aa, Staphylococcus
WSAKGRVGVVPLLNNQA

SEQ ID NO: 2106535 - protein, 17 aa, Staphylococcus
WSPDYPDPTAFLEIMTK

SEQ ID NO: 2106536 - protein, 18 aa, Staphylococcus
WTDDYKRELMLSRIRSTQ

SEQ ID NO: 2106537 - protein, 18 aa, Staphylococcus
WVEYKGDVAHIFFHPLIT

SEQ ID NO: 2106538 - protein, 19 aa, Staphylococcus
WYDHLGIHRSTREPVYKKI

SEQ ID NO: 2106539 - protein, 17 aa, Staphylococcus
WYDRSTFAPGSYGSTKS

SEQ ID NO: 2106540 - protein, 19 aa, Staphylococcus
WYFSEGGIETTIHQLNKIE

SEQ ID NO: 2106541 - protein, 25 aa, Staphylococcus
WYYGKLSNGKYVWIKDTDLKKELVK

SEQ ID NO: 2106542 - protein, 23 aa, Staphylococcus
YADEWKPLIKKMIPSYGESLIED

SEQ ID NO: 2106543 - protein, 18 aa, Staphylococcus
YAELYDLINEKYLIKTGQ

SEQ ID NO: 2106544 - protein, 17 aa, Staphylococcus
YAFDRRQQLGRSIGSYW

SEQ ID NO: 2106545 - protein, 17 aa, Staphylococcus
YAKDVKQVLNYVEKGNA

SEQ ID NO: 2106546 - protein, 18 aa, Staphylococcus
YAKDVRQVLNYVEKGNAQ

SEQ ID NO: 2106547 - protein, 21 aa, Staphylococcus
YAKERYGSIGAAIRFRESNGW

SEQ ID NO: 2106548 - protein, 19 aa, Staphylococcus
YAKKAGWDSVEKAIVGGAQ

SEQ ID NO: 2106549 - protein, 25 aa, Staphylococcus
YAKKLNSIIKHYHLTDFDKKDMPSL

SEQ ID NO: 2106550 - protein, 25 aa, Staphylococcus
YAKKLNSIIKHYNLTAFDKKRMPNL

SEQ ID NO: 2106551 - protein, 18 aa, Staphylococcus
YAKQAGWNSVSKAIIGGA

SEQ ID NO: 2106552 - protein, 19 aa, Staphylococcus
YAKQSGWNSISKAIIDGAK

SEQ ID NO: 2106553 - protein, 22 aa, Staphylococcus
YATKLNQLIKHYHLTDFDHKKL

SEQ ID NO: 2106554 - protein, 25 aa, Staphylococcus
YATKLNSLIKHYHLTDFDKKKMPDL

SEQ ID NO: 2106555 - protein, 18 aa, Staphylococcus
YATNDGFYIAFFDQNDRL

SEQ ID NO: 2106556 - protein, 29 aa, Staphylococcus
YDAKGTVWTHYAISRYLGGTDHADPHAYL

SEQ ID NO: 2106557 - protein, 25 aa, Staphylococcus
YDEIKNAMDPIRLAKDDEYKYQFLL

SEQ ID NO: 2106558 - protein, 17 aa, Staphylococcus
YDGPRYDTVEAIEGAKE

SEQ ID NO: 2106559 - protein, 18 aa, Staphylococcus
YDGYGMKQPKALEKATQD

SEQ ID NO: 2106560 - protein, 29 aa, Staphylococcus
YDIKTFVDLCNKSIKANEDILDYTKLFES

SEQ ID NO: 2106561 - protein, 19 aa, Staphylococcus
YDKKSKKASLVDIPLKKQL

SEQ ID NO: 2106562 - protein, 24 aa, Staphylococcus
YDKSRPSFMSLPIAAAAGNHDEYP

SEQ ID NO: 2106563 - protein, 17 aa, Staphylococcus
YDLDRPDEIGVFQSLIE

SEQ ID NO: 2106564 - protein, 21 aa, Staphylococcus
YDLKPLTSFVHHRTVLLGDAA

SEQ ID NO: 2106565 - protein, 17 aa, Staphylococcus
YDLKVKIVNDYKVPNKL

SEQ ID NO: 2106566 - protein, 20 aa, Staphylococcus
YDLNARREVTKYILDSNNEN

SEQ ID NO: 2106567 - protein, 17 aa, Staphylococcus
YDLSRKGANELNERTSL

SEQ ID NO: 2106568 - protein, 19 aa, Staphylococcus
YDMKPLKSFVKERTILLGD

SEQ ID NO: 2106569 - protein, 17 aa, Staphylococcus
YDMKPLKSFVNQRILLL

SEQ ID NO: 2106570 - protein, 20 aa, Staphylococcus
YDMKPLRTFVYGRTILLGDA

SEQ ID NO: 2106571 - protein, 17 aa, Staphylococcus
YDMQQFFKLVTYHYNHM

SEQ ID NO: 2106572 - protein, 18 aa, Staphylococcus
YDMVKHVGGDKVEVHSIV

SEQ ID NO: 2106573 - protein, 24 aa, Staphylococcus
YDNIQGSFKIAATAKRENAINDKG

SEQ ID NO: 2106574 - protein, 21 aa, Staphylococcus
YDPHVWLDPKMDQTFAKEIKD

SEQ ID NO: 2106575 - protein, 22 aa, Staphylococcus
YDPKGKDASKFSGKTFTVTKQR

SEQ ID NO: 2106576 - protein, 37 aa, Staphylococcus
YDPSLPTNRYRGVGKAPLNEFEIHKLINNDTLTNASR

SEQ ID NO: 2106577 - protein, 26 aa, Staphylococcus
YDRHNRYSVPYFFGTVGIIYNKNAYP

SEQ ID NO: 2106578 - protein, 25 aa, Staphylococcus
YDSLNVFKPEPFRSDKDGLSELLNQ

SEQ ID NO: 2106579 - protein, 17 aa, Staphylococcus
YDTLLVGIEMSRETLYF

SEQ ID NO: 2106580 - protein, 17 aa, Staphylococcus
YDTLLVGIEMSRKTLYT

SEQ ID NO: 2106581 - protein, 24 aa, Staphylococcus
YDTLWTKKDFDLIFYRTYSDALMP

SEQ ID NO: 2106582 - protein, 24 aa, Staphylococcus
YDVPSHFQDHRWTEDGYSKQETAR

SEQ ID NO: 2106583 - protein, 24 aa, Staphylococcus
YDVVPKHKKWYIAINDKGNAYVHY

SEQ ID NO: 2106584 - protein, 18 aa, Staphylococcus
YDYNALGEGVKFAKASGW

SEQ ID NO: 2106585 - protein, 36 aa, Staphylococcus
YEEDIRLASEYGIKGIRISVAWSRIIPDGTGEVNPK

SEQ ID NO: 2106586 - protein, 19 aa, Staphylococcus
YEGPVGHVAYVERVNPDGS

SEQ ID NO: 2106587 - protein, 27 aa, Staphylococcus
YEIARKYFLERTYRKPSDFYNLTSLIQ

SEQ ID NO: 2106588 - protein, 26 aa, Staphylococcus
YEIERIFRAVGPPGKIIKRQIILDNN

SEQ ID NO: 2106589 - protein, 18 aa, Staphylococcus
YEKGKYVVLAYRPLSNND

SEQ ID NO: 2106590 - protein, 34 aa, Staphylococcus
YEQDISPYLPKNEYRYGKPEGIVVHDTANDNSNI

SEQ ID NO: 2106591 - protein, 17 aa, Staphylococcus
YERLDRPGIESSNERHN

SEQ ID NO: 2106592 - protein, 18 aa, Staphylococcus
YERLDRPGIESSNERHNA

SEQ ID NO: 2106593 - protein, 20 aa, Staphylococcus
YESEWTPKIQKMIPSYGKSL

SEQ ID NO: 2106594 - protein, 19 aa, Staphylococcus
YEVALELISTIQFDPNSKR

SEQ ID NO: 2106595 - protein, 30 aa, Staphylococcus
YFLEPGEGFLACGYVAKGRMEEPLQIVERI

SEQ ID NO: 2106596 - protein, 17 aa, Staphylococcus
YFLPTAIYPNWGQSQRA

SEQ ID NO: 2106597 - protein, 18 aa, Staphylococcus
YFSEGGIETTIEQLDKIE

SEQ ID NO: 2106598 - protein, 17 aa, Staphylococcus
YFSGYIFGRSVKDGIEI

SEQ ID NO: 2106599 - protein, 18 aa, Staphylococcus
YGALDIMKQMGLEDKIVA

SEQ ID NO: 2106600 - protein, 23 aa, Staphylococcus
YGDYKCPYCKKIEDNVMPIIKKD

SEQ ID NO: 2106601 - protein, 23 aa, Staphylococcus
YGDYKCPYCKKVETQVMPTIKKK

SEQ ID NO: 2106602 - protein, 24 aa, Staphylococcus
YGEDKLFFIDAISRCQTASMNPSP

SEQ ID NO: 2106603 - protein, 17 aa, Staphylococcus
YGGPIAAMDSVEATMNV

SEQ ID NO: 2106604 - protein, 18 aa, Staphylococcus
YGHERYGKSYAGAYRDWK

SEQ ID NO: 2106605 - protein, 18 aa, Staphylococcus
YGHGPGVVTTRTISASQA

SEQ ID NO: 2106606 - protein, 25 aa, Staphylococcus
YGIDSTCQGVYYYIFTFKNEAKPNT

SEQ ID NO: 2106607 - protein, 17 aa, Staphylococcus
YGKLTNGKYVWIKESDL

SEQ ID NO: 2106608 - protein, 18 aa, Staphylococcus
YGKYKGAVTKKDLSSANK

SEQ ID NO: 2106609 - protein, 20 aa, Staphylococcus
YGTFSEKEIEVYPGNEDLAL

SEQ ID NO: 2106610 - protein, 25 aa, Staphylococcus
YHFESDGTNFSWYFHQSGQSNEASN

SEQ ID NO: 2106611 - protein, 20 aa, Staphylococcus
YHFSISNGYIYRISNISLLT

SEQ ID NO: 2106612 - protein, 21 aa, Staphylococcus
YHGGGAHYGVDYGMPENTPVY

SEQ ID NO: 2106613 - protein, 24 aa, Staphylococcus
YHGPFKALRGFDYFSTMQQAINRR

SEQ ID NO: 2106614 - protein, 22 aa, Staphylococcus
YIEGKRTLLFGPFANVGPKFLK

SEQ ID NO: 2106615 - protein, 17 aa, Staphylococcus
YIGDIAVIAQQGNKSPQ

SEQ ID NO: 2106616 - protein, 17 aa, Staphylococcus
YIHGGAWFQDPLDYHFE

SEQ ID NO: 2106617 - protein, 19 aa, Staphylococcus
YIHGGAWFQNPLKYHFDFI

SEQ ID NO: 2106618 - protein, 18 aa, Staphylococcus
YIMYDLKNAEAINMGKKD

SEQ ID NO: 2106619 - protein, 22 aa, Staphylococcus
YINEMFAFGTFMPLNEKVVKKN

SEQ ID NO: 2106620 - protein, 17 aa, Staphylococcus
YIQPEFNIKFTIIEPGG

SEQ ID NO: 2106621 - protein, 29 aa, Staphylococcus
YISDKIDGAMAWCPITSLDQADAAYEWQM

SEQ ID NO: 2106622 - protein, 18 aa, Staphylococcus
YKAFKNSGNLFFIPYVFK

SEQ ID NO: 2106623 - protein, 24 aa, Staphylococcus
YKDELRLGMDTQWMNRAGDGYPAF

SEQ ID NO: 2106624 - protein, 24 aa, Staphylococcus
YKDELRLGMDTQWMNRQGDGYPAF

SEQ ID NO: 2106625 - protein, 24 aa, Staphylococcus
YKDKLRLGMDTQWMNRAGDGYPAF

SEQ ID NO: 2106626 - protein, 22 aa, Staphylococcus
YKEQKRLSAYQKQLLNDKIKVS

SEQ ID NO: 2106627 - protein, 20 aa, Staphylococcus
YKFSEPYTYSEAVLVVNKNN

SEQ ID NO: 2106628 - protein, 17 aa, Staphylococcus
YKFSNPYTYSSGVLVVR

SEQ ID NO: 2106629 - protein, 21 aa, Staphylococcus
YKGDVAHIFFHPLITDPKVAF

SEQ ID NO: 2106630 - protein, 21 aa, Staphylococcus
YKHVKHLVGNKAIARVQYNSV

SEQ ID NO: 2106631 - protein, 22 aa, Staphylococcus
YKIGNKNVRFYIDNGYVNKCQI

SEQ ID NO: 2106632 - protein, 17 aa, Staphylococcus
YKIPAIHTTGVGGLQII

SEQ ID NO: 2106633 - protein, 18 aa, Staphylococcus
YKKQIKFDKNEKVLPAVA

SEQ ID NO: 2106634 - protein, 22 aa, Staphylococcus
YKLSKKATLGSNAFYLITDNKT

SEQ ID NO: 2106635 - protein, 18 aa, Staphylococcus
YKNASIFYSLGILTSDSF

SEQ ID NO: 2106636 - protein, 18 aa, Staphylococcus
YKNEISFPNIMDSSTGWL

SEQ ID NO: 2106637 - protein, 18 aa, Staphylococcus
YKNGDAIPLGKHKKVELA

SEQ ID NO: 2106638 - protein, 26 aa, Staphylococcus
YKNHDPIILVHGFNGFTDDINPSVLA

SEQ ID NO: 2106639 - protein, 31 aa, Staphylococcus
YKNINKWAGIVSELFGKYSIPVEASILASNH

SEQ ID NO: 2106640 - protein, 26 aa, Staphylococcus
YKNQDPIILVHGFNGFTDDINPSVLA

SEQ ID NO: 2106641 - protein, 26 aa, Staphylococcus
YKNQDPIILVHGFNGLVGETAGPTSG

SEQ ID NO: 2106642 - protein, 24 aa, Staphylococcus
YKNVPYDWRDSRTDANMKEATTKA

SEQ ID NO: 2106643 - protein, 19 aa, Staphylococcus
YKQAVSNAKAIINETTNPI

SEQ ID NO: 2106644 - protein, 17 aa, Staphylococcus
YKTHDDYAKAYRNVLSK

SEQ ID NO: 2106645 - protein, 25 aa, Staphylococcus
YKVKSGDSLWSIANKYNMSVAKLKS

SEQ ID NO: 2106646 - protein, 29 aa, Staphylococcus
YKVVKGDTLYSISKRSGVTIDNIKKWNNL

SEQ ID NO: 2106647 - protein, 22 aa, Staphylococcus
YKWNPQSIHQMKHSGMYMTKEI

SEQ ID NO: 2106648 - protein, 29 aa, Staphylococcus
YKYKFKKSEYSTIVGTSFEGNGNINNYVV

SEQ ID NO: 2106649 - protein, 24 aa, Staphylococcus
YLDKEALVLFKPYRLEDDEQSSKS

SEQ ID NO: 2106650 - protein, 23 aa, Staphylococcus
YLEKSGTVNTHFRNQVYQMISDF

SEQ ID NO: 2106651 - protein, 17 aa, Staphylococcus
YLFIILAVILAACSTNS

SEQ ID NO: 2106652 - protein, 17 aa, Staphylococcus
YLISHALLETGRGQSQL

SEQ ID NO: 2106653 - protein, 24 aa, Staphylococcus
YLLSTTLVFPTFTTPTAVAKDNTD

SEQ ID NO: 2106654 - protein, 21 aa, Staphylococcus
YLMPEFKKYKKAANQLPANTN

SEQ ID NO: 2106655 - protein, 17 aa, Staphylococcus
YLPTTNVIGKLDDKAWR

SEQ ID NO: 2106656 - protein, 20 aa, Staphylococcus
YLQSHGYSYAELYDLINEKY

SEQ ID NO: 2106657 - protein, 30 aa, Staphylococcus
YLSERTKRFRLKQLMNAHAIQGTATNEQFR

SEQ ID NO: 2106658 - protein, 28 aa, Staphylococcus
YLVQDYNTGEKFGWVKQGDVVYNTAKSP

SEQ ID NO: 2106659 - protein, 22 aa, Staphylococcus
YLVRDEGFKFLAGVGPNNFTDI

SEQ ID NO: 2106660 - protein, 27 aa, Staphylococcus
YLVSDYNKGTLIGWVHQGDVSYNAAKA

SEQ ID NO: 2106661 - protein, 25 aa, Staphylococcus
YLYVKPELQNNIGFYTNNDPKNRAD

SEQ ID NO: 2106662 - protein, 18 aa, Staphylococcus
YMRGKGYADRLVLDKNKH

SEQ ID NO: 2106663 - protein, 17 aa, Staphylococcus
YNDYGIEGNNGNYSYVF

SEQ ID NO: 2106664 - protein, 18 aa, Staphylococcus
YNFTSDGTNFSWNYQEAG

SEQ ID NO: 2106665 - protein, 20 aa, Staphylococcus
YNGAVFINKDVQNFLKQNIE

SEQ ID NO: 2106666 - protein, 23 aa, Staphylococcus
YNIPNAHSVTINQIVKDYGSNVT

SEQ ID NO: 2106667 - protein, 17 aa, Staphylococcus
YNKELFLESCVESINNL

SEQ ID NO: 2106668 - protein, 23 aa, Staphylococcus
YNKETLRISEYISNSNKFNQNLD

SEQ ID NO: 2106669 - protein, 18 aa, Staphylococcus
YNLNTMAEIRGKLRKEII

SEQ ID NO: 2106670 - protein, 17 aa, Staphylococcus
YNMKFGVYSYSMYENAD

SEQ ID NO: 2106671 - protein, 17 aa, Staphylococcus
YNPHIEKHILAKKKLLS

SEQ ID NO: 2106672 - protein, 17 aa, Staphylococcus
YNSAFVHAFVDGNRIVE

SEQ ID NO: 2106673 - protein, 17 aa, Staphylococcus
YNSAYRYYADNPNTKEL

SEQ ID NO: 2106674 - protein, 17 aa, Staphylococcus
YNTKVGIYGINTENGKA

SEQ ID NO: 2106675 - protein, 18 aa, Staphylococcus
YNYNRPLAYGTRVLSKSS

SEQ ID NO: 2106676 - protein, 18 aa, Staphylococcus
YPDALRLSKLLNQQGILH

SEQ ID NO: 2106677 - protein, 27 aa, Staphylococcus
YPESGTAISPRPAFILKSSKHKELAKQ

SEQ ID NO: 2106678 - protein, 19 aa, Staphylococcus
YPGAEPLHLRVYFENKSRK

SEQ ID NO: 2106679 - protein, 24 aa, Staphylococcus
YPGDKPLATMWESRGKITQIQGED

SEQ ID NO: 2106680 - protein, 21 aa, Staphylococcus
YPGNEDLALIHLNKNKDEQSV

SEQ ID NO: 2106681 - protein, 22 aa, Staphylococcus
YPKEDFTSWRSLYNPKFKNDII

SEQ ID NO: 2106682 - protein, 26 aa, Staphylococcus
YPPQSYVGPSKWRNATLAEVKSAMDT

SEQ ID NO: 2106683 - protein, 25 aa, Staphylococcus
YPVEVFDKIMAVDMRGTFLVTKFLL

SEQ ID NO: 2106684 - protein, 26 aa, Staphylococcus
YPVEVFDKIMAVDMRGTFLVTKFLLP

SEQ ID NO: 2106685 - protein, 23 aa, Staphylococcus
YPVPSQFNGPIYGDEYGKKESQR

SEQ ID NO: 2106686 - protein, 23 aa, Staphylococcus
YPYNKIVLILNCRSDRIDRTRQF

SEQ ID NO: 2106687 - protein, 24 aa, Staphylococcus
YQDLPQVIGSYIMVQGHGQDLDKK

SEQ ID NO: 2106688 - protein, 27 aa, Staphylococcus
YQEFIKAGGTKALWEKIVLPESGGDPN

SEQ ID NO: 2106689 - protein, 26 aa, Staphylococcus
YQKAHGGTISPLFQGNHDNMISSITT

SEQ ID NO: 2106690 - protein, 22 aa, Staphylococcus
YQPTTHRWLLISADRSEQNPSR

SEQ ID NO: 2106691 - protein, 19 aa, Staphylococcus
YQTNAGIYTAYFDKNDKLM

SEQ ID NO: 2106692 - protein, 28 aa, Staphylococcus
YQVFTDMKWCKMLLRQLISNAIKYSPEG

SEQ ID NO: 2106693 - protein, 23 aa, Staphylococcus
YQVKELRGQASITPEKLKDTKIL

SEQ ID NO: 2106694 - protein, 26 aa, Staphylococcus
YQYEPWHFRYVGKKAAKAIHDQKTTL

SEQ ID NO: 2106695 - protein, 18 aa, Staphylococcus
YRDFLPGSHYPRVAADKK

SEQ ID NO: 2106696 - protein, 23 aa, Staphylococcus
YRGLGQTKESWGTGSVASQTKGM

SEQ ID NO: 2106697 - protein, 29 aa, Staphylococcus
YRHVDLQAQVPLAWGAHRGASIIAEQLAG

SEQ ID NO: 2106698 - protein, 28 aa, Staphylococcus
YRHVNLPAQVPLAWGAHRGASVIAEQLA

SEQ ID NO: 2106699 - protein, 28 aa, Staphylococcus
YRIIYWKNKWYLVAYCRLRDDVRTFRVD

SEQ ID NO: 2106700 - protein, 18 aa, Staphylococcus
YRKPSDFYNLTSLIQGYK

SEQ ID NO: 2106701 - protein, 19 aa, Staphylococcus
YRLPTGKHNYKLVDFTLVK

SEQ ID NO: 2106702 - protein, 19 aa, Staphylococcus
YRLTEKAQEKYLYSTEECK

SEQ ID NO: 2106703 - protein, 19 aa, Staphylococcus
YRNEVYQLISDFDEVELKK

SEQ ID NO: 2106704 - protein, 21 aa, Staphylococcus
YRQGYDVTLIDGWEPQAKAVI

SEQ ID NO: 2106705 - protein, 18 aa, Staphylococcus
YSCSAFLIYAGINRDLKD

SEQ ID NO: 2106706 - protein, 19 aa, Staphylococcus
YSFGNCTYYAFDRRQQLGR

SEQ ID NO: 2106707 - protein, 18 aa, Staphylococcus
YSIIPMIEMMHGVYYIKG

SEQ ID NO: 2106708 - protein, 19 aa, Staphylococcus
YSNDLGLYKPDAPKLDDYE

SEQ ID NO: 2106709 - protein, 19 aa, Staphylococcus
YSNISKYMKAGFIYVEAGL

SEQ ID NO: 2106710 - protein, 20 aa, Staphylococcus
YSPTSAWGEEYMYKIGNKDV

SEQ ID NO: 2106711 - protein, 20 aa, Staphylococcus
YSTDGGWFSSMYNVKSSISQ

SEQ ID NO: 2106712 - protein, 23 aa, Staphylococcus
YSTDGRIAAYGLKVLKDDKHFFP

SEQ ID NO: 2106713 - protein, 20 aa, Staphylococcus
YSTELANIFYVRQKEQKGLG

SEQ ID NO: 2106714 - protein, 24 aa, Staphylococcus
YSVAEPFGALGEKLGKGHTLKHGS

SEQ ID NO: 2106715 - protein, 22 aa, Staphylococcus
YSYAELYDLINEKYLIKTGQVA

SEQ ID NO: 2106716 - protein, 29 aa, Staphylococcus
YSYDELYDLIYEKYLIKTGQAAAWGTTSS

SEQ ID NO: 2106717 - protein, 19 aa, Staphylococcus
YSYQVGKGHIAFAIENGYV

SEQ ID NO: 2106718 - protein, 27 aa, Staphylococcus
YTAGQCTWYVFNRRAQARSPISTYWSD

SEQ ID NO: 2106719 - protein, 18 aa, Staphylococcus
YTAGQCTYYVFDKVGGKI

SEQ ID NO: 2106720 - protein, 35 aa, Staphylococcus
YTAGQCTYYVFDRVGGKIGSTWGNANNWASAAAAS

SEQ ID NO: 2106721 - protein, 35 aa, Staphylococcus
YTAGQCTYYVYDKVGGKIGSTWGNANNWASAAAAS

SEQ ID NO: 2106722 - protein, 34 aa, Staphylococcus
YTAGQCTYYVYDRVGGKVGSTWGNANNWANAAAA

SEQ ID NO: 2106723 - protein, 18 aa, Staphylococcus
YTCFRGMIDEVDIMNQYT

SEQ ID NO: 2106724 - protein, 19 aa, Staphylococcus
YTDGQCTYYAFNRRAELGK

SEQ ID NO: 2106725 - protein, 19 aa, Staphylococcus
YTIATRMSDDWSKKDEDQL

SEQ ID NO: 2106726 - protein, 17 aa, Staphylococcus
YTLDRFQSEYGLNPLQL

SEQ ID NO: 2106727 - protein, 17 aa, Staphylococcus
YTLTSSIDYDRYTLDID

SEQ ID NO: 2106728 - protein, 23 aa, Staphylococcus
YTNGLMPYNFLNARFKQNGKQPG

SEQ ID NO: 2106729 - protein, 26 aa, Staphylococcus
YTRINKRVDIMLGHGLFNEVKALVEQ

SEQ ID NO: 2106730 - protein, 17 aa, Staphylococcus
YTSEGDRSLGLNPFIHL

SEQ ID NO: 2106731 - protein, 18 aa, Staphylococcus
YTSGQCTYYVYDKVGGKI

SEQ ID NO: 2106732 - protein, 22 aa, Staphylococcus
YTSGQCTYYVYDKVGGKISSTW

SEQ ID NO: 2106733 - protein, 34 aa, Staphylococcus
YTSGQCTYYVYDRVGGKIGSTWGNANNWANAAAS

SEQ ID NO: 2106734 - protein, 20 aa, Staphylococcus
YTTTLGTTFARGIEASQYQH

SEQ ID NO: 2106735 - protein, 26 aa, Staphylococcus
YTVGAFSTVIATLIFLGSPQAHASEQ

SEQ ID NO: 2106736 - protein, 23 aa, Staphylococcus
YTVRAGDSLSLIASKYGTSYQNI

SEQ ID NO: 2106737 - protein, 18 aa, Staphylococcus
YVDKCLEHNSALLDKNNM

SEQ ID NO: 2106738 - protein, 18 aa, Staphylococcus
YVDVKSIYPPGSDIHNFE

SEQ ID NO: 2106739 - protein, 21 aa, Staphylococcus
YVIGCNGCGYDGKTQYAGHSV

SEQ ID NO: 2106740 - protein, 22 aa, Staphylococcus
YVKGGIHKLALALKQLAIEEGV

SEQ ID NO: 2106741 - protein, 18 aa, Staphylococcus
YVRKDIMDKLHIKPSSIK

SEQ ID NO: 2106742 - protein, 54 aa, Staphylococcus
YVTTKRLKDGYEWTIKFNQSHRMHEHMVFWFGLPDPQVPVGPVRFTIENPDHSN

SEQ ID NO: 2106743 - protein, 27 aa, Staphylococcus
YVYDKVGGKISSTWGNANNWANAAASS

SEQ ID NO: 2106744 - protein, 17 aa, Staphylococcus
YWGGDKLNIRQDLEENG

SEQ ID NO: 2106745 - protein, 19 aa, Staphylococcus
YWWNADHWANNASADGYTV

SEQ ID NO: 2106746 - protein, 17 aa, Staphylococcus
YYAAGGRGIEFNEINNY

SEQ ID NO: 2106747 - protein, 27 aa, Staphylococcus
YYAKVWLTALESYRGNSDIKFDDLDIK

SEQ ID NO: 2106748 - protein, 19 aa, Staphylococcus
YYDSFGFENTYAFMVTKEV

SEQ ID NO: 2106749 - protein, 24 aa, Staphylococcus
YYDWGQCTYYAFDRRQQLGKSVGN

SEQ ID NO: 2106750 - protein, 18 aa, Staphylococcus
YYERSEPVAESFGDLDPK

SEQ ID NO: 2106751 - protein, 18 aa, Staphylococcus
YYLAQEVNVEMPITTALY

SEQ ID NO: 2106752 - protein, 19 aa, Staphylococcus
YYNSFGFENTYAFMVTQEV

SEQ ID NO: 2106753 - protein, 19 aa, Staphylococcus
YYSQLRFTQFSANGTEIMT

SEQ ID NO: 2106754 - protein, 23 aa, Staphylococcus
YYVEELRPLTGLNEEVYTYVMKW

SEQ ID NO: 2106755 - protein, 31 aa, Staphylococcus
YYVKSPNDGSGYPVGTYIYAANKGTPFALPN

SEQ ID NO: 2106756 - protein, 27 aa, Staphylococcus
YYYKNQCTWYVFKKRASVGKAVPNGWG

SEQ ID NO: 2106757 - protein, 18 aa, Staphylococcus
YKDGKPWYFLEEKYPDYG

SEQ ID NO: 2106758 - protein, 24 aa, Staphylococcus
NPAEQGRFLKFFVDEGLIKIKKGV

SEQ ID NO: 2106759 - protein, 17 aa, Staphylococcus
RIWTYKDGKPWYFLEEK

SEQ ID NO: 2106760 - protein, 17 aa, Staphylococcus
WTYKDGKPWYFLEEKYP

SEQ ID NO: 2106761 - protein, 18 aa, Staphylococcus
ASTHPGAGVPIVLTSAKI

SEQ ID NO: 2106762 - protein, 19 aa, Staphylococcus
AYRDWKPGQKIHLIGHSMG

SEQ ID NO: 2106763 - protein, 20 aa, Staphylococcus
ESKHLGGFPISGQFIACTNP

SEQ ID NO: 2106764 - protein, 22 aa, Staphylococcus
FQSDGQYWTWSYGQGSTNAPAQ

SEQ ID NO: 2106765 - protein, 24 aa, Staphylococcus
IVMLILCGLLFPLTVTAVGQIIFP

SEQ ID NO: 2106766 - protein, 18 aa, Staphylococcus
KYQFLQSTWDSVAPSEYQ

SEQ ID NO: 2106767 - protein, 24 aa, Staphylococcus
NYDRAVELYYYIKGGTVDYGAAHA

SEQ ID NO: 2106768 - protein, 19 aa, Staphylococcus
PKVLILMGVPGSYLVATDK

SEQ ID NO: 2106769 - protein, 19 aa, Staphylococcus
PQGQCTWYVYNRLQQFNLY

SEQ ID NO: 2106770 - protein, 20 aa, Staphylococcus
RFVALILAIFFFLSVNNVFG

SEQ ID NO: 2106771 - protein, 19 aa, Staphylococcus
RIWTYKDGKPWYFLEEKYP

SEQ ID NO: 2106772 - protein, 17 aa, Staphylococcus
RLPHGMPDEVKKMFQKE

SEQ ID NO: 2106773 - protein, 19 aa, Staphylococcus
TRLVIVMLILCGLLFPLTV

SEQ ID NO: 2106774 - protein, 19 aa, Staphylococcus
VKILGRLNYRTSYGQNVLK

SEQ ID NO: 2106775 - protein, 17 aa, Staphylococcus
WYVYNRLQQFNLYVDGS

SEQ ID NO: 2106776 - protein, 19 aa, Staphylococcus
YDKVGGKIGSTWGNANNWA

SEQ ID NO: 2106777 - protein, 17 aa, Staphylococcus
YKDAWPLSASVVNFRAD

SEQ ID NO: 2106778 - protein, 17 aa, Staphylococcus
YYGHVAFVEKVNSDGSI

SEQ ID NO: 2106779 - protein, 19 aa, Staphylococcus
AAGALKYFGLKDHAVDLTN

SEQ ID NO: 2106780 - protein, 20 aa, Staphylococcus
AAGSLKDFYEGIFTVYEKQV

SEQ ID NO: 2106781 - protein, 18 aa, Staphylococcus
AAVIVTALLITGIAVSGV

SEQ ID NO: 2106782 - protein, 18 aa, Staphylococcus
AEARRIINQKAQDKITEI

SEQ ID NO: 2106783 - protein, 19 aa, Staphylococcus
AEEKEVIRALTAVNSNITQ

SEQ ID NO: 2106784 - protein, 18 aa, Staphylococcus
AFDIKPGYIWEINTEKQG

SEQ ID NO: 2106785 - protein, 19 aa, Staphylococcus
AGAADWVLDGGFSDYANQI

SEQ ID NO: 2106786 - protein, 17 aa, Staphylococcus
AGQCTWYVFDRRSQAGK

SEQ ID NO: 2106787 - protein, 20 aa, Staphylococcus
AIINKPIRTVQEVQDALRQV

SEQ ID NO: 2106788 - protein, 21 aa, Staphylococcus
AIKSYAVGVGPEYTDLNIKNT

SEQ ID NO: 2106789 - protein, 18 aa, Staphylococcus
AIMGRYVLTPEIFDYLKT

SEQ ID NO: 2106790 - protein, 18 aa, Staphylococcus
AKAIVQCNLWLRTADRIK

SEQ ID NO: 2106791 - protein, 17 aa, Staphylococcus
AKAYNINEVYLISHALL

SEQ ID NO: 2106792 - protein, 18 aa, Staphylococcus
AKDDEYKYQFLLLDQPQY

SEQ ID NO: 2106793 - protein, 20 aa, Staphylococcus
AKINELMDFIELCNKSIKAN

SEQ ID NO: 2106794 - protein, 19 aa, Staphylococcus
AKPIVKITLGLITASISLG

SEQ ID NO: 2106795 - protein, 19 aa, Staphylococcus
AKQRGALSVAYDLYVDIPD

SEQ ID NO: 2106796 - protein, 17 aa, Staphylococcus
AKTPSLYVGGFYDPSLP

SEQ ID NO: 2106797 - protein, 18 aa, Staphylococcus
ALIRQVVFDAGKVLGNKD

SEQ ID NO: 2106798 - protein, 18 aa, Staphylococcus
ALMPYNFMNSVFKNIDGK

SEQ ID NO: 2106799 - protein, 19 aa, Staphylococcus
ALMPYNFMSSVFKNNDGKS

SEQ ID NO: 2106800 - protein, 18 aa, Staphylococcus
ALVRQVVYDLGRAFGNKN

SEQ ID NO: 2106801 - protein, 19 aa, Staphylococcus
ANCGLPYYIGHLVSDRHQI

SEQ ID NO: 2106802 - protein, 19 aa, Staphylococcus
ANCGLPYYLGNIIDDRSEL

SEQ ID NO: 2106803 - protein, 25 aa, Staphylococcus
ANDDLKDIPIHFAIYKQSDQNSITP

SEQ ID NO: 2106804 - protein, 25 aa, Staphylococcus
ANEDLKDIPIHFAIYKQSGQDSISP

SEQ ID NO: 2106805 - protein, 20 aa, Staphylococcus
ANGLPTDGFHFVWTQNTTAS

SEQ ID NO: 2106806 - protein, 25 aa, Staphylococcus
ANKGAYRYYAFEGIRPSDNSDLHVT

SEQ ID NO: 2106807 - protein, 20 aa, Staphylococcus
ANTRATSLFATMPQASDNAS

SEQ ID NO: 2106808 - protein, 19 aa, Staphylococcus
AQGFDYRYHIGDNIVQYIV

SEQ ID NO: 2106809 - protein, 24 aa, Staphylococcus
AQIKTEDLRQFWLGIAEDAVKSEA

SEQ ID NO: 2106810 - protein, 17 aa, Staphylococcus
ARLKLLVSLSNELNREQ

SEQ ID NO: 2106811 - protein, 19 aa, Staphylococcus
ARNSFSSIEGWKAVSKEAI

SEQ ID NO: 2106812 - protein, 23 aa, Staphylococcus
ARTGRPIEIFVGFNVSDAYHNGE

SEQ ID NO: 2106813 - protein, 20 aa, Staphylococcus
ASDDEIMWQLNLNLMGVIRM

SEQ ID NO: 2106814 - protein, 18 aa, Staphylococcus
ASLASLVIGTGLFASTAQ

SEQ ID NO: 2106815 - protein, 20 aa, Staphylococcus
ASSNAEMWKDILLSNKQNII

SEQ ID NO: 2106816 - protein, 21 aa, Staphylococcus
ASSNAEMWRDITISNKTAILN

SEQ ID NO: 2106817 - protein, 19 aa, Staphylococcus
ASTHPGAGVPIVLTSAKIT

SEQ ID NO: 2106818 - protein, 17 aa, Staphylococcus
ATHYFYFPQSALIQNYQ

SEQ ID NO: 2106819 - protein, 23 aa, Staphylococcus
ATLMLSACGKSDERASLEKDVKK

SEQ ID NO: 2106820 - protein, 24 aa, Staphylococcus
ATNDGFRYVFSFKDASKDNSYSIV

SEQ ID NO: 2106821 - protein, 22 aa, Staphylococcus
ATPVQVPVSLYVYQFDFSPNAY

SEQ ID NO: 2106822 - protein, 20 aa, Staphylococcus
ATSYYNNWLYFYIIASHENQ

SEQ ID NO: 2106823 - protein, 17 aa, Staphylococcus
AVGAGLRNQAIDAEKDG

SEQ ID NO: 2106824 - protein, 20 aa, Staphylococcus
AVPAIFAYQLFKSSESAFQT

SEQ ID NO: 2106825 - protein, 18 aa, Staphylococcus
AYCPGVAKTEMWDRIDAE

SEQ ID NO: 2106826 - protein, 23 aa, Staphylococcus
AYKGWDFDGAYGNQCFDLVNVYW

SEQ ID NO: 2106827 - protein, 17 aa, Staphylococcus
CLLSTSLLIPSFSINDV

SEQ ID NO: 2106828 - protein, 18 aa, Staphylococcus
CPYCKKVEKNVMPKLKKH

SEQ ID NO: 2106829 - protein, 18 aa, Staphylococcus
CPYCKKVEKNVMPTIKKD

SEQ ID NO: 2106830 - protein, 18 aa, Staphylococcus
CRDAESLYEIPLQLSDQD

SEQ ID NO: 2106831 - protein, 18 aa, Staphylococcus
CRDAESLYEIPLQLSKQH

SEQ ID NO: 2106832 - protein, 22 aa, Staphylococcus
CYDLRFPELLRYPARSGATIAF

SEQ ID NO: 2106833 - protein, 18 aa, Staphylococcus
CYIYKFRSRFAVLAEQVM

SEQ ID NO: 2106834 - protein, 25 aa, Staphylococcus
DAGFYKSVYNIGDFVWNDTNKNGIQ

SEQ ID NO: 2106835 - protein, 20 aa, Staphylococcus
DALAVLSLVAGTAFISQRPL

SEQ ID NO: 2106836 - protein, 19 aa, Staphylococcus
DELRLGMDTQWMNRAGDGY

SEQ ID NO: 2106837 - protein, 23 aa, Staphylococcus
DELYDLIYEKYLIKTGQAAAWGT

SEQ ID NO: 2106838 - protein, 21 aa, Staphylococcus
DEMKGRIIGREGRNIRTLETL

SEQ ID NO: 2106839 - protein, 18 aa, Staphylococcus
DFIKYVICNTQLYDEAVL

SEQ ID NO: 2106840 - protein, 18 aa, Staphylococcus
DFREALARYDKLRVKHTA

SEQ ID NO: 2106841 - protein, 29 aa, Staphylococcus
DGAHAQDARWLTKHPKLQEYGQYHGGGAH

SEQ ID NO: 2106842 - protein, 17 aa, Staphylococcus
DGENFSWSYGEGSGEGS

SEQ ID NO: 2106843 - protein, 21 aa, Staphylococcus
DGILVPGGFGFRASEGKISAI

SEQ ID NO: 2106844 - protein, 17 aa, Staphylococcus
DIELSCFSEFDVDLSDV

SEQ ID NO: 2106845 - protein, 22 aa, Staphylococcus
DIKPSHVAICWDMGQATFRNDM

SEQ ID NO: 2106846 - protein, 20 aa, Staphylococcus
DINMGMSYIVTGNVIGKVPE

SEQ ID NO: 2106847 - protein, 22 aa, Staphylococcus
DIPAETKNGGLLLKQNDTNGER

SEQ ID NO: 2106848 - protein, 17 aa, Staphylococcus
DISPYLPKNEYRYGKPE

SEQ ID NO: 2106849 - protein, 19 aa, Staphylococcus
DIYRPTWKSEASSYRDATA

SEQ ID NO: 2106850 - protein, 23 aa, Staphylococcus
DKGKIGQSFLNWPKSTRTITPSF

SEQ ID NO: 2106851 - protein, 22 aa, Staphylococcus
DKIDGAMAWCPITSLDQADAAY

SEQ ID NO: 2106852 - protein, 19 aa, Staphylococcus
DKQIPIVIVSRSFNGIVSP

SEQ ID NO: 2106853 - protein, 23 aa, Staphylococcus
DLTDWRVSPIFGDIEGLGHITIS

SEQ ID NO: 2106854 - protein, 23 aa, Staphylococcus
DPSLPTNRYRGVGKAPLNEFEIH

SEQ ID NO: 2106855 - protein, 18 aa, Staphylococcus
DQASALKFYEKKDAKENK

SEQ ID NO: 2106856 - protein, 22 aa, Staphylococcus
DSKLYYKYLEQIGAAMTDKNGK

SEQ ID NO: 2106857 - protein, 20 aa, Staphylococcus
DSSYPRSLMQIKEETGKSPR

SEQ ID NO: 2106858 - protein, 18 aa, Staphylococcus
DTDYLAWGAGPVANQRFI

SEQ ID NO: 2106859 - protein, 19 aa, Staphylococcus
DTLREIIKYHGPFKALRGF

SEQ ID NO: 2106860 - protein, 21 aa, Staphylococcus
DVKVLKAKYLKTVKTKKKSIY

SEQ ID NO: 2106861 - protein, 25 aa, Staphylococcus
DYTSYFPKYGYRNGVGKPEGIVVHD

SEQ ID NO: 2106862 - protein, 23 aa, Staphylococcus
EAEIKWLKAHGAHFLTEKEFQHY

SEQ ID NO: 2106863 - protein, 25 aa, Staphylococcus
EDYSSYFPKYGYRNGVGRPEGIVVH

SEQ ID NO: 2106864 - protein, 22 aa, Staphylococcus
EEDIRLASEYGIKGIRISVAWS

SEQ ID NO: 2106865 - protein, 20 aa, Staphylococcus
EEMRKWIPLMMKGHNSSDIM

SEQ ID NO: 2106866 - protein, 19 aa, Staphylococcus
EGGTLRITGTVSDNQPFNS

SEQ ID NO: 2106867 - protein, 21 aa, Staphylococcus
EGKEWLLREAIERVPELASSR

SEQ ID NO: 2106868 - protein, 17 aa, Staphylococcus
EGLGVISYRTIDADDAA

SEQ ID NO: 2106869 - protein, 18 aa, Staphylococcus
EGMLPFKMHKFRTMKENA

SEQ ID NO: 2106870 - protein, 18 aa, Staphylococcus
EGRFLSFFVDKGLIKIKK

SEQ ID NO: 2106871 - protein, 17 aa, Staphylococcus
EHLKENLDWIWNSLSLR

SEQ ID NO: 2106872 - protein, 20 aa, Staphylococcus
EHSDAVIVSAHWGNENHTMP

SEQ ID NO: 2106873 - protein, 22 aa, Staphylococcus
EHYYEFKTSKGFMIVTADGQKD

SEQ ID NO: 2106874 - protein, 19 aa, Staphylococcus
EHYYEFRTNKGVLLVTADG

SEQ ID NO: 2106875 - protein, 19 aa, Staphylococcus
EILTRYGPDTNYYIETKSP

SEQ ID NO: 2106876 - protein, 17 aa, Staphylococcus
EKDAVWKKLDAVKHNRV

SEQ ID NO: 2106877 - protein, 20 aa, Staphylococcus
ELKSHLPFHKSLKVTKRDAD

SEQ ID NO: 2106878 - protein, 21 aa, Staphylococcus
ELVKILGRLNYRTSYGQNVLK

SEQ ID NO: 2106879 - protein, 17 aa, Staphylococcus
ELYYYIKGGTVDYGAAH

SEQ ID NO: 2106880 - protein, 18 aa, Staphylococcus
EMDAHLKAYLKANNDIID

SEQ ID NO: 2106881 - protein, 26 aa, Staphylococcus
ENKALKDIPIHFAIYIQSGEDEIIPG

SEQ ID NO: 2106882 - protein, 26 aa, Staphylococcus
ENKDLKEIPIHFAIYKQSGENSIVPG

SEQ ID NO: 2106883 - protein, 19 aa, Staphylococcus
ENMLLKHDIHFIGGHPMAG

SEQ ID NO: 2106884 - protein, 19 aa, Staphylococcus
ENSNLWKTKDNGFYDLTTE

SEQ ID NO: 2106885 - protein, 19 aa, Staphylococcus
EPKAGYKWYDPSTFAAGSY

SEQ ID NO: 2106886 - protein, 23 aa, Staphylococcus
EPMFQFCLGIPWGAENDPETIEY

SEQ ID NO: 2106887 - protein, 20 aa, Staphylococcus
EQGYFRLGLDTLPEILTYHG

SEQ ID NO: 2106888 - protein, 23 aa, Staphylococcus
EQKSDGSWGFSFVDKSGKLAGSY

SEQ ID NO: 2106889 - protein, 17 aa, Staphylococcus
ERAGGKAGSLWGNANNW

SEQ ID NO: 2106890 - protein, 19 aa, Staphylococcus
ERFGSLVYNTLGFKPADKN

SEQ ID NO: 2106891 - protein, 23 aa, Staphylococcus
ERTGVSASQWKGVIQRESGGNAN

SEQ ID NO: 2106892 - protein, 18 aa, Staphylococcus
ESIGYFGYNFYKQNKDKL

SEQ ID NO: 2106893 - protein, 20 aa, Staphylococcus
ESKHLGGFPITGQFLACTNP

SEQ ID NO: 2106894 - protein, 19 aa, Staphylococcus
ESLPQRQVRTISTRANREA

SEQ ID NO: 2106895 - protein, 18 aa, Staphylococcus
ESLWSISQQYGVSVDEIK

SEQ ID NO: 2106896 - protein, 21 aa, Staphylococcus
ESNIKGLGIVSYRTIDADAAT

SEQ ID NO: 2106897 - protein, 17 aa, Staphylococcus
ESRGCIFSNGLNGPKAR

SEQ ID NO: 2106898 - protein, 22 aa, Staphylococcus
ESTRYPNIFLIGATVENDHAKL

SEQ ID NO: 2106899 - protein, 17 aa, Staphylococcus
ETGSPWGVTDLKAAIRY

SEQ ID NO: 2106900 - protein, 18 aa, Staphylococcus
EYGFKFASARPMQIGLVY

SEQ ID NO: 2106901 - protein, 18 aa, Staphylococcus
FAATLVLSACSQDDAKED

SEQ ID NO: 2106902 - protein, 24 aa, Staphylococcus
FAKQFKVKPGYIWEINTEKQGTPG

SEQ ID NO: 2106903 - protein, 18 aa, Staphylococcus
FDKVGGKIGSTWGNANNW

SEQ ID NO: 2106904 - protein, 18 aa, Staphylococcus
FDKVGGKIGSTWGNASNW

SEQ ID NO: 2106905 - protein, 24 aa, Staphylococcus
FDNSWCAGFSMAALLNATKNTDKY

SEQ ID NO: 2106906 - protein, 17 aa, Staphylococcus
FGDLVFNTLGFKPADKH

SEQ ID NO: 2106907 - protein, 26 aa, Staphylococcus
FGFALVVICGIGLYAQGEKLEKEDSY

SEQ ID NO: 2106908 - protein, 20 aa, Staphylococcus
FGMKGSYKGASVNFNTLEAS

SEQ ID NO: 2106909 - protein, 24 aa, Staphylococcus
FGPGGRFGGLVFDTLGFKPADKDV

SEQ ID NO: 2106910 - protein, 25 aa, Staphylococcus
FGPKGRFGGLVFDILGFKPADENVS

SEQ ID NO: 2106911 - protein, 19 aa, Staphylococcus
FGPTGRFGGFLNRDLGIKH

SEQ ID NO: 2106912 - protein, 26 aa, Staphylococcus
FGRQKSDLILFFPFTLTANVIGKAAE

SEQ ID NO: 2106913 - protein, 18 aa, Staphylococcus
FGTIPRGDTGYFFNQAYK

SEQ ID NO: 2106914 - protein, 17 aa, Staphylococcus
FHQKFFPSYGFDNTYAF

SEQ ID NO: 2106915 - protein, 18 aa, Staphylococcus
FIGATVCWFTFEKQNYEE

SEQ ID NO: 2106916 - protein, 17 aa, Staphylococcus
FIILVILGLVRTFENYA

SEQ ID NO: 2106917 - protein, 17 aa, Staphylococcus
FKFASARPMQIGLVYDA

SEQ ID NO: 2106918 - protein, 20 aa, Staphylococcus
FKGPITGYVNYGFQNYKINV

SEQ ID NO: 2106919 - protein, 17 aa, Staphylococcus
FKKEARFEVLDNQNHVF

SEQ ID NO: 2106920 - protein, 21 aa, Staphylococcus
FKNKDLRLAIAQSIDKEGYVN

SEQ ID NO: 2106921 - protein, 24 aa, Staphylococcus
FKNKHLRLAIAQAINKKGYVKSVL

SEQ ID NO: 2106922 - protein, 21 aa, Staphylococcus
FKRVFSLIAILAIVFSTLGQT

SEQ ID NO: 2106923 - protein, 18 aa, Staphylococcus
FLERTFRKPSDFYNLTSL

SEQ ID NO: 2106924 - protein, 18 aa, Staphylococcus
FLERTFRKPSEFYNPIAL

SEQ ID NO: 2106925 - protein, 20 aa, Staphylococcus
FLKDRYEKMKAFPMFDNIEY

SEQ ID NO: 2106926 - protein, 20 aa, Staphylococcus
FLKRRFEALSPLSMFKGIEY

SEQ ID NO: 2106927 - protein, 17 aa, Staphylococcus
FNAPLYSLGYPWQNGDN

SEQ ID NO: 2106928 - protein, 17 aa, Staphylococcus
FNHRNLYDWGQCTWHVF

SEQ ID NO: 2106929 - protein, 17 aa, Staphylococcus
FNIKFTLIEPGGIQSEF

SEQ ID NO: 2106930 - protein, 18 aa, Staphylococcus
FPDHKWLYGPEGLGFLFV

SEQ ID NO: 2106931 - protein, 20 aa, Staphylococcus
FPSMIAITLFGAAFTSQHAH

SEQ ID NO: 2106932 - protein, 20 aa, Staphylococcus
FPSMIALTLFGAAFTTHHAE

SEQ ID NO: 2106933 - protein, 17 aa, Staphylococcus
FPSYGFDNTYAFMVTKE

SEQ ID NO: 2106934 - protein, 19 aa, Staphylococcus
FQEFMKFVLKDEGKSAEDA

SEQ ID NO: 2106935 - protein, 18 aa, Staphylococcus
FQIPDVRQLFAMDITSRI

SEQ ID NO: 2106936 - protein, 19 aa, Staphylococcus
FQKDPVWKKLDAVKHNRVD

SEQ ID NO: 2106937 - protein, 20 aa, Staphylococcus
FRIGYMTKHKLVITVPKAID

SEQ ID NO: 2106938 - protein, 18 aa, Staphylococcus
FRQGNPLNRSEFYNDSVN

SEQ ID NO: 2106939 - protein, 17 aa, Staphylococcus
FRTSLIMYNHTSKKMTK

SEQ ID NO: 2106940 - protein, 17 aa, Staphylococcus
FSDVFAYFIESDNFLIG

SEQ ID NO: 2106941 - protein, 17 aa, Staphylococcus
FSDVFGYFVDDEDFLMG

SEQ ID NO: 2106942 - protein, 17 aa, Staphylococcus
FSDVFGYFVDPDDWLMG

SEQ ID NO: 2106943 - protein, 24 aa, Staphylococcus
FSIRKFNIGIFSALITTVTFLAHP

SEQ ID NO: 2106944 - protein, 21 aa, Staphylococcus
FSSIEGWKAVSKEAIIKKNPD

SEQ ID NO: 2106945 - protein, 23 aa, Staphylococcus
FVEEKGRVIGMPKLKGLKNKEKP

SEQ ID NO: 2106946 - protein, 20 aa, Staphylococcus
FVKPKLEQSIGFYSDNATDN

SEQ ID NO: 2106947 - protein, 29 aa, Staphylococcus
GAGEGQSLPAMWRTAGGIDSSRASNFVQG

SEQ ID NO: 2106948 - protein, 21 aa, Staphylococcus
GAICGAVDYLARNGFLNKYKH

SEQ ID NO: 2106949 - protein, 25 aa, Staphylococcus
GANSGTRYKIDLNLDSKIADHVTKI

SEQ ID NO: 2106950 - protein, 22 aa, Staphylococcus
GASCLLAGCGSQNLAPLEDKTT

SEQ ID NO: 2106951 - protein, 23 aa, Staphylococcus
GASCLLAGCGSQNLAPLEDKTTK

SEQ ID NO: 2106952 - protein, 22 aa, Staphylococcus
GASCLLVGCGSQNLGPLEDKTT

SEQ ID NO: 2106953 - protein, 21 aa, Staphylococcus
GASLFLVGCGSQNLGPLEDKT

SEQ ID NO: 2106954 - protein, 20 aa, Staphylococcus
GCFWCLVKPFTSYPGIENVV

SEQ ID NO: 2106955 - protein, 17 aa, Staphylococcus
GDFKCPYCKKVEKNVMP

SEQ ID NO: 2106956 - protein, 17 aa, Staphylococcus
GDTGYFFNQAYKPEGAI

SEQ ID NO: 2106957 - protein, 23 aa, Staphylococcus
GDYQLGEAFKIYKFNGEEDNSYY

SEQ ID NO: 2106958 - protein, 23 aa, Staphylococcus
GEGVKFAKASGWDSVSKAIIGGA

SEQ ID NO: 2106959 - protein, 21 aa, Staphylococcus
GERFGSMIFDTMGFTPADDNI

SEQ ID NO: 2106960 - protein, 17 aa, Staphylococcus
GESLGIIAAQYGTSAEA

SEQ ID NO: 2106961 - protein, 17 aa, Staphylococcus
GEYHKKFQVKGIDDDVS

SEQ ID NO: 2106962 - protein, 17 aa, Staphylococcus
GGESFKGKAGQFIKDNI

SEQ ID NO: 2106963 - protein, 17 aa, Staphylococcus
GGESFKGYAGRFVRQHI

SEQ ID NO: 2106964 - protein, 24 aa, Staphylococcus
GGQTIRLMEHFLRNGNQEEIDYQR

SEQ ID NO: 2106965 - protein, 26 aa, Staphylococcus
GGRALEYRQLFSFNELYVEPLNVFTE

SEQ ID NO: 2106966 - protein, 23 aa, Staphylococcus
GGTEELWEKIVLPESGGDPNASN

SEQ ID NO: 2106967 - protein, 22 aa, Staphylococcus
GGTEEMWEKIVLPESGGNPNAS

SEQ ID NO: 2106968 - protein, 21 aa, Staphylococcus
GIICAVLLYFSYVGLGASSDK

SEQ ID NO: 2106969 - protein, 24 aa, Staphylococcus
GIKGIRISVAWSRIIPDGTGEVNP

SEQ ID NO: 2106970 - protein, 19 aa, Staphylococcus
GILVPGGFGFRASEGKISA

SEQ ID NO: 2106971 - protein, 20 aa, Staphylococcus
GKEIKVRMIGMDTPETVKPN

SEQ ID NO: 2106972 - protein, 22 aa, Staphylococcus
GKFQFLQSTWDSVAPAEYQGQP

SEQ ID NO: 2106973 - protein, 19 aa, Staphylococcus
GKFQFLQSTWDSVAPEQYK

SEQ ID NO: 2106974 - protein, 20 aa, Staphylococcus
GKIGSNWGNASNWANAAAQD

SEQ ID NO: 2106975 - protein, 18 aa, Staphylococcus
GKIGSTWGNANNWASAAS

SEQ ID NO: 2106976 - protein, 17 aa, Staphylococcus
GKVKPLLVKSFKQKSDD

SEQ ID NO: 2106977 - protein, 17 aa, Staphylococcus
GLIFIIALLCTVISING

SEQ ID NO: 2106978 - protein, 20 aa, Staphylococcus
GLNIIYRSGFRSYAEQTQLY

SEQ ID NO: 2106979 - protein, 17 aa, Staphylococcus
GLREFPIDITAIVTVAD

SEQ ID NO: 2106980 - protein, 19 aa, Staphylococcus
GLVGCHRLSKEESDPSDNA

SEQ ID NO: 2106981 - protein, 26 aa, Staphylococcus
GLVLIMFVLCGFIFPLTVTALGQVLF

SEQ ID NO: 2106982 - protein, 18 aa, Staphylococcus
GNANIYYVPWSKDNQVVA

SEQ ID NO: 2106983 - protein, 24 aa, Staphylococcus
GNKDSRVDFGLSQWGLKQQPNESY

SEQ ID NO: 2106984 - protein, 31 aa, Staphylococcus
GNNGNYSYVFSFKDPQQNGVYSIVTVNSQGQ

SEQ ID NO: 2106985 - protein, 18 aa, Staphylococcus
GNQSHGWIPSSEINIQTT

SEQ ID NO: 2106986 - protein, 21 aa, Staphylococcus
GNSVPRFHITWGTGPGLVEPF

SEQ ID NO: 2106987 - protein, 17 aa, Staphylococcus
GNTAERFYYAAGGRALE

SEQ ID NO: 2106988 - protein, 18 aa, Staphylococcus
GNTPLGWYNVKDLNIKNL

SEQ ID NO: 2106989 - protein, 18 aa, Staphylococcus
GNTSRGWVPASEISVKTT

SEQ ID NO: 2106990 - protein, 23 aa, Staphylococcus
GNYHYTWKGNWSPDRLNHTNDSN

SEQ ID NO: 2106991 - protein, 23 aa, Staphylococcus
GPGSRFGGLVFDTLGFKPVDKDV

SEQ ID NO: 2106992 - protein, 21 aa, Staphylococcus
GQKAVSYPVQFVTGSINNLFS

SEQ ID NO: 2106993 - protein, 19 aa, Staphylococcus
GQYHYTWQGNWNPSNSDQG

SEQ ID NO: 2106994 - protein, 21 aa, Staphylococcus
GRLLNEYAYRLDAIPKSPGKG

SEQ ID NO: 2106995 - protein, 24 aa, Staphylococcus
GSTDRISISNAITYEPIRKSIYAD

SEQ ID NO: 2106996 - protein, 17 aa, Staphylococcus
GTLRLGLYPSKIKKDTL

SEQ ID NO: 2106997 - protein, 20 aa, Staphylococcus
GTSISLRPAFILKSAKHKDA

SEQ ID NO: 2106998 - protein, 19 aa, Staphylococcus
GTTSGMRPASITAYNQAMQ

SEQ ID NO: 2106999 - protein, 25 aa, Staphylococcus
GTVWTHAAISRWLGGTDHADPHGYL

SEQ ID NO: 2107000 - protein, 20 aa, Staphylococcus
GYDPHVWLDPKFDQTFAKEI

SEQ ID NO: 2107001 - protein, 17 aa, Staphylococcus
HADLIGLDLPDFKRTGA

SEQ ID NO: 2107002 - protein, 17 aa, Staphylococcus
HDFEYAWKRVVNPDTAS

SEQ ID NO: 2107003 - protein, 21 aa, Staphylococcus
HDPIILVHGFNGFTADNGPGL

SEQ ID NO: 2107004 - protein, 20 aa, Staphylococcus
HDPIILVHGFNGYTADNGPV

SEQ ID NO: 2107005 - protein, 23 aa, Staphylococcus
HDQYGRDLVYVWLDKDHMYNKEL

SEQ ID NO: 2107006 - protein, 19 aa, Staphylococcus
HIRSYAIGVGPDYTSLNAE

SEQ ID NO: 2107007 - protein, 19 aa, Staphylococcus
HKAKRALVVGAGYISLEVL

SEQ ID NO: 2107008 - protein, 22 aa, Staphylococcus
HKYGMSIARLKSLNGLKSNLIF

SEQ ID NO: 2107009 - protein, 17 aa, Staphylococcus
HLLDRMGVMFNRTKEGL

SEQ ID NO: 2107010 - protein, 20 aa, Staphylococcus
HLLDRMGVMFSRTKEGLLDF

SEQ ID NO: 2107011 - protein, 20 aa, Staphylococcus
HLLDRMGVMFSRTNEGLLDF

SEQ ID NO: 2107012 - protein, 19 aa, Staphylococcus
HNYPRLRIAGASFEAVGLP

SEQ ID NO: 2107013 - protein, 19 aa, Staphylococcus
HQHAGKPFIDYVICSNDAF

SEQ ID NO: 2107014 - protein, 17 aa, Staphylococcus
HRVIKHYGSLVPLTELS

SEQ ID NO: 2107015 - protein, 17 aa, Staphylococcus
HSDAVIVSAHWGNEGHH

SEQ ID NO: 2107016 - protein, 20 aa, Staphylococcus
HVDLQAQVPLAWGAHRGASI

SEQ ID NO: 2107017 - protein, 23 aa, Staphylococcus
HVNLKANVPLAWGAHRAASVIAE

SEQ ID NO: 2107018 - protein, 18 aa, Staphylococcus
HWSSYRFIQKSSNGTELQ

SEQ ID NO: 2107019 - protein, 20 aa, Staphylococcus
HYMKSYLLHFDKIFDNLTLI

SEQ ID NO: 2107020 - protein, 18 aa, Staphylococcus
HYNLFGIKGSYQGKSADF

SEQ ID NO: 2107021 - protein, 25 aa, Staphylococcus
HYTSYFPKYGYRNGVGKPEGIVVHD

SEQ ID NO: 2107022 - protein, 18 aa, Staphylococcus
HYYEFKKDNGVLVVTADG

SEQ ID NO: 2107023 - protein, 17 aa, Staphylococcus
IARKYFLERTFRKPSDF

SEQ ID NO: 2107024 - protein, 21 aa, Staphylococcus
IASSNPIMWRDITIENKNTIL

SEQ ID NO: 2107025 - protein, 17 aa, Staphylococcus
ICLTLFVGACSTQDSSK

SEQ ID NO: 2107026 - protein, 23 aa, Staphylococcus
IDAILKDKCRVLAAITYLEDEYG

SEQ ID NO: 2107027 - protein, 19 aa, Staphylococcus
IDLLREGSKVARIVDVTGV

SEQ ID NO: 2107028 - protein, 17 aa, Staphylococcus
IDRAMVWGFNWKLGPFQ

SEQ ID NO: 2107029 - protein, 17 aa, Staphylococcus
IEGIGIKPNTEFLEGAG

SEQ ID NO: 2107030 - protein, 25 aa, Staphylococcus
IEGSEGNYSYIFSFQNQAQPGTYTI

SEQ ID NO: 2107031 - protein, 20 aa, Staphylococcus
IEITPRFDGCHMHKLIQYYN

SEQ ID NO: 2107032 - protein, 17 aa, Staphylococcus
IEPVKWVKGKDGNKTLV

SEQ ID NO: 2107033 - protein, 19 aa, Staphylococcus
IGAYDYAPLVNGINYAKQS

SEQ ID NO: 2107034 - protein, 17 aa, Staphylococcus
IGCNGCGYDGKTQYAGH

SEQ ID NO: 2107035 - protein, 18 aa, Staphylococcus
IGGAKFIGKDYIKAGQNT

SEQ ID NO: 2107036 - protein, 17 aa, Staphylococcus
IGLLCLGISHLFSGHEK

SEQ ID NO: 2107037 - protein, 18 aa, Staphylococcus
IGVFSEWKTLASKKDNGT

SEQ ID NO: 2107038 - protein, 21 aa, Staphylococcus
IHIKNFKEFARAPEFQHEQDA

SEQ ID NO: 2107039 - protein, 21 aa, Staphylococcus
IHLLDRMGVMFSRTKEGLLDF

SEQ ID NO: 2107040 - protein, 21 aa, Staphylococcus
IHLLDRMGVMFSRTNEGLLDF

SEQ ID NO: 2107041 - protein, 20 aa, Staphylococcus
IHQMQCQYNDYAIQSHNGRY

SEQ ID NO: 2107042 - protein, 17 aa, Staphylococcus
IKALLPFHKSLQIAERD

SEQ ID NO: 2107043 - protein, 24 aa, Staphylococcus
IKKGKSVRCAIAYDIYDVNKPVIL

SEQ ID NO: 2107044 - protein, 18 aa, Staphylococcus
IKKLGRFSSYKVANHLVP

SEQ ID NO: 2107045 - protein, 18 aa, Staphylococcus
IKKRDGFRQIKAVKNGRI

SEQ ID NO: 2107046 - protein, 20 aa, Staphylococcus
IKMIKKRGGFDKINAVKNTR

SEQ ID NO: 2107047 - protein, 17 aa, Staphylococcus
IKPGYIWEINTEKQGTP

SEQ ID NO: 2107048 - protein, 19 aa, Staphylococcus
IKPKAREAINNKVTDQKAL

SEQ ID NO: 2107049 - protein, 18 aa, Staphylococcus
IKSTVHFNSSEILNADIK

SEQ ID NO: 2107050 - protein, 26 aa, Staphylococcus
IKYKLRPVNIPTPRQVTVNQSITYKT

SEQ ID NO: 2107051 - protein, 17 aa, Staphylococcus
ILCCLLLVSCSNDKQSA

SEQ ID NO: 2107052 - protein, 25 aa, Staphylococcus
ILEGIREWQKQLSILATQIESEDSD

SEQ ID NO: 2107053 - protein, 17 aa, Staphylococcus
IMGRYVLTPDIFDYLAT

SEQ ID NO: 2107054 - protein, 23 aa, Staphylococcus
INKWAGIVSELFGKYSIPVEASI

SEQ ID NO: 2107055 - protein, 17 aa, Staphylococcus
INPGEVIYTVPWGTSSQ

SEQ ID NO: 2107056 - protein, 24 aa, Staphylococcus
IPGRQTDGGFQWSQDHKSLIYRYD

SEQ ID NO: 2107057 - protein, 21 aa, Staphylococcus
IPSNYTLASFNAYKKLKAQAQ

SEQ ID NO: 2107058 - protein, 18 aa, Staphylococcus
IPSSLRIENAAGRTNNNS

SEQ ID NO: 2107059 - protein, 17 aa, Staphylococcus
IPTHVPLAWGAHRGASI

SEQ ID NO: 2107060 - protein, 18 aa, Staphylococcus
IQGSFKIAATAKRENAIN

SEQ ID NO: 2107061 - protein, 21 aa, Staphylococcus
IQKGLKFKPQIQHTAGKWEDA

SEQ ID NO: 2107062 - protein, 17 aa, Staphylococcus
IQNDGLWYFIPNESSKG

SEQ ID NO: 2107063 - protein, 26 aa, Staphylococcus
IQSHNGRYEYLFSFKNPKQQGTYTIV

SEQ ID NO: 2107064 - protein, 17 aa, Staphylococcus
IRKRGGFEDLEAVKKGR

SEQ ID NO: 2107065 - protein, 19 aa, Staphylococcus
ISHIFWKTGEVVPIKEVID

SEQ ID NO: 2107066 - protein, 17 aa, Staphylococcus
ITSAALFFGMNHVASAD

SEQ ID NO: 2107067 - protein, 19 aa, Staphylococcus
IVGGAKFIAGSYINQGQNT

SEQ ID NO: 2107068 - protein, 18 aa, Staphylococcus
IVGGAKFIGQSYVKAGQN

SEQ ID NO: 2107069 - protein, 18 aa, Staphylococcus
IVIMPGIFPFIGETREAA

SEQ ID NO: 2107070 - protein, 24 aa, Staphylococcus
IVKAGDCLYNIAVEHGITLEQLYT

SEQ ID NO: 2107071 - protein, 17 aa, Staphylococcus
IVLCISIALSACSTGQY

SEQ ID NO: 2107072 - protein, 20 aa, Staphylococcus
IVRKDLRKMMTFKGDPDFTI

SEQ ID NO: 2107073 - protein, 17 aa, Staphylococcus
IVRQAVYDFAKSQGNKF

SEQ ID NO: 2107074 - protein, 22 aa, Staphylococcus
IYNEVPGNFGLWVQDQISDYLV

SEQ ID NO: 2107075 - protein, 17 aa, Staphylococcus
IYRPTWKSEASNYQSAT

SEQ ID NO: 2107076 - protein, 20 aa, Staphylococcus
IYYKRGFNAKAYVEQHKPDY

SEQ ID NO: 2107077 - protein, 17 aa, Staphylococcus
KAAPKLAMRSFAAQPTT

SEQ ID NO: 2107078 - protein, 22 aa, Staphylococcus
KAFDIKPGYIWEINTEKQGTPS

SEQ ID NO: 2107079 - protein, 19 aa, Staphylococcus
KAFKGDKGVSFKIDYKDDK

SEQ ID NO: 2107080 - protein, 21 aa, Staphylococcus
KAFKLHTLAGFVTYKSAHKQT

SEQ ID NO: 2107081 - protein, 21 aa, Staphylococcus
KAFKPRSKRDLDNTIVAEALK

SEQ ID NO: 2107082 - protein, 17 aa, Staphylococcus
KAGSLWGNANNWANAAA

SEQ ID NO: 2107083 - protein, 17 aa, Staphylococcus
KAHGGTISPLFQGNHDN

SEQ ID NO: 2107084 - protein, 18 aa, Staphylococcus
KAHTAVVFEAGQQGADQI

SEQ ID NO: 2107085 - protein, 17 aa, Staphylococcus
KARGELRVGLSADYAPY

SEQ ID NO: 2107086 - protein, 17 aa, Staphylococcus
KAVSKEAIIKKNPDILI

SEQ ID NO: 2107087 - protein, 18 aa, Staphylococcus
KCLITTFLIVSSLLLAFS

SEQ ID NO: 2107088 - protein, 20 aa, Staphylococcus
KDELRLGMDTQWMNRAGDGY

SEQ ID NO: 2107089 - protein, 20 aa, Staphylococcus
KDELRLGMDTQWMNRQGDGY

SEQ ID NO: 2107090 - protein, 20 aa, Staphylococcus
KDKLRLGMDTQWMNRAGDGY

SEQ ID NO: 2107091 - protein, 22 aa, Staphylococcus
KDNGVNEFLLWNAGNEYTEGAN

SEQ ID NO: 2107092 - protein, 19 aa, Staphylococcus
KDPKRIAVVAPTFAGGLHK

SEQ ID NO: 2107093 - protein, 19 aa, Staphylococcus
KDPKRIVVLGATYAGGLKE

SEQ ID NO: 2107094 - protein, 24 aa, Staphylococcus
KEDRYGRTLAYVWLDEKTMYNEEL

SEQ ID NO: 2107095 - protein, 24 aa, Staphylococcus
KEDRYGRTLAYVWLDENIMYNEEL

SEQ ID NO: 2107096 - protein, 26 aa, Staphylococcus
KEDVVKLKAPMRVGGSVTYSSNGDGS

SEQ ID NO: 2107097 - protein, 17 aa, Staphylococcus
KEFLKKRYEAMKQSPMF

SEQ ID NO: 2107098 - protein, 19 aa, Staphylococcus
KEIKVRLIGIDTPETVKPN

SEQ ID NO: 2107099 - protein, 20 aa, Staphylococcus
KELSKILNIRGRVIPSTNTS

SEQ ID NO: 2107100 - protein, 20 aa, Staphylococcus
KEMGFSWYTTDRFKDAKVWV

SEQ ID NO: 2107101 - protein, 18 aa, Staphylococcus
KENLNWIWNSFSREDQKD

SEQ ID NO: 2107102 - protein, 21 aa, Staphylococcus
KENMKRVLLFLSRNTSSSGVE

SEQ ID NO: 2107103 - protein, 17 aa, Staphylococcus
KENYDFIIIRAQYGSEK

SEQ ID NO: 2107104 - protein, 21 aa, Staphylococcus
KEQPFEIRVKPLPPHIDTTVE

SEQ ID NO: 2107105 - protein, 18 aa, Staphylococcus
KERFNIDIYTEYEVNKIN

SEQ ID NO: 2107106 - protein, 17 aa, Staphylococcus
KEWRVNDGLVSVVSAQH

SEQ ID NO: 2107107 - protein, 17 aa, Staphylococcus
KEYEYKKVLSKGEHKIG

SEQ ID NO: 2107108 - protein, 19 aa, Staphylococcus
KGGLFGIGVHVLFHEFVLP

SEQ ID NO: 2107109 - protein, 17 aa, Staphylococcus
KGVKGMLDKDGFKTIPH

SEQ ID NO: 2107110 - protein, 18 aa, Staphylococcus
KGWHEWVMAAKAKPVYGA

SEQ ID NO: 2107111 - protein, 19 aa, Staphylococcus
KIADKRGFNSLSLITSGDH

SEQ ID NO: 2107112 - protein, 17 aa, Staphylococcus
KIGSTWGNANNWASAAA

SEQ ID NO: 2107113 - protein, 17 aa, Staphylococcus
KIGSTWGNANNWATAAA

SEQ ID NO: 2107114 - protein, 17 aa, Staphylococcus
KISSTWGNANNWANAAA

SEQ ID NO: 2107115 - protein, 18 aa, Staphylococcus
KKAIKRVQYNSVSGNFAY

SEQ ID NO: 2107116 - protein, 19 aa, Staphylococcus
KKLEICVANRNSVIISYRK

SEQ ID NO: 2107117 - protein, 19 aa, Staphylococcus
KKSEYSTIVGTSFEGNGNI

SEQ ID NO: 2107118 - protein, 24 aa, Staphylococcus
KKYKFTLKKGVKWQNGDPLTVNDW

SEQ ID NO: 2107119 - protein, 20 aa, Staphylococcus
KKYYNMFGIGAIDTDAVRGG

SEQ ID NO: 2107120 - protein, 19 aa, Staphylococcus
KLGTGFQWYSWIHIADLTR

SEQ ID NO: 2107121 - protein, 24 aa, Staphylococcus
KLIVILCAIIVFIALIGVSLRSQS

SEQ ID NO: 2107122 - protein, 23 aa, Staphylococcus
KLIVVFCAIIIFIALIGLSIRSQ

SEQ ID NO: 2107123 - protein, 19 aa, Staphylococcus
KLIVVFCAIIVFIALIGLS

SEQ ID NO: 2107124 - protein, 23 aa, Staphylococcus
KLIVVFCAVIIFIALIGLSLRSH

SEQ ID NO: 2107125 - protein, 19 aa, Staphylococcus
KLIVVLCAIIVFIALIGLS

SEQ ID NO: 2107126 - protein, 20 aa, Staphylococcus
KLIVVLCAIIVFIALIGLSI

SEQ ID NO: 2107127 - protein, 20 aa, Staphylococcus
KLIYTVKLPENFEYIDDSTV

SEQ ID NO: 2107128 - protein, 24 aa, Staphylococcus
KNEDNWSPLMYQFADALHMAISKT

SEQ ID NO: 2107129 - protein, 18 aa, Staphylococcus
KNEVIGVHAFRLNSGDYK

SEQ ID NO: 2107130 - protein, 19 aa, Staphylococcus
KNINHRLVLEFKEYEKEAK

SEQ ID NO: 2107131 - protein, 18 aa, Staphylococcus
KNLGGFPITGQFLICTNP

SEQ ID NO: 2107132 - protein, 22 aa, Staphylococcus
KNQDPIILVHGFNGFTDDINPS

SEQ ID NO: 2107133 - protein, 26 aa, Staphylococcus
KNQIYGIDRLYAFIGKGNASYTIQFK

SEQ ID NO: 2107134 - protein, 29 aa, Staphylococcus
KNQYPVVFVHGFAGLVGEDAFTLYPNYWG

SEQ ID NO: 2107135 - protein, 18 aa, Staphylococcus
KNTGDGLSSGEKQTMYAI

SEQ ID NO: 2107136 - protein, 17 aa, Staphylococcus
KPNTEFLEGAGIEEDDA

SEQ ID NO: 2107137 - protein, 17 aa, Staphylococcus
KQLMNAHAIQGTATNEQ

SEQ ID NO: 2107138 - protein, 20 aa, Staphylococcus
KQVINGVTWYHGKLANGKVV

SEQ ID NO: 2107139 - protein, 22 aa, Staphylococcus
KQYDIKPGYIWEINTEKQGTPE

SEQ ID NO: 2107140 - protein, 21 aa, Staphylococcus
KQYDVKPGYIWEINTEKQGTP

SEQ ID NO: 2107141 - protein, 22 aa, Staphylococcus
KRIKSYAVGVGPEYTDLNEKNT

SEQ ID NO: 2107142 - protein, 17 aa, Staphylococcus
KRLKASTFFLKMNEKEQ

SEQ ID NO: 2107143 - protein, 20 aa, Staphylococcus
KRNGMVFWFGLPKGQTPTGP

SEQ ID NO: 2107144 - protein, 20 aa, Staphylococcus
KRVADVKAIEQLATELNNNM

SEQ ID NO: 2107145 - protein, 23 aa, Staphylococcus
KSAKKYHNVFGIGAYDDNPLIEG

SEQ ID NO: 2107146 - protein, 18 aa, Staphylococcus
KSEARKAVQNKVNEQIGL

SEQ ID NO: 2107147 - protein, 19 aa, Staphylococcus
KSQYYGNVPLELAFELFKL

SEQ ID NO: 2107148 - protein, 17 aa, Staphylococcus
KSYILEGIREWQKQLSI

SEQ ID NO: 2107149 - protein, 21 aa, Staphylococcus
KTFRIAFSYLLIENTKTHDLY

SEQ ID NO: 2107150 - protein, 27 aa, Staphylococcus
KTYHFWSDGTYFKWEYYPSNGSTVNSA

SEQ ID NO: 2107151 - protein, 18 aa, Staphylococcus
KVGSDWGDAHNWDNRAES

SEQ ID NO: 2107152 - protein, 20 aa, Staphylococcus
KYQFLCLDRPQNLSVASLNQ

SEQ ID NO: 2107153 - protein, 20 aa, Staphylococcus
KYQFLQSTWDSVAPAEYKGQ

SEQ ID NO: 2107154 - protein, 18 aa, Staphylococcus
KYQFLQSTWDSVAPAQYK

SEQ ID NO: 2107155 - protein, 19 aa, Staphylococcus
KYQFLQSTWDSVAPDEYKG

SEQ ID NO: 2107156 - protein, 19 aa, Staphylococcus
KYQFLQTTWDSVAPAEYQG

SEQ ID NO: 2107157 - protein, 27 aa, Staphylococcus
KYQFLRLDRPQLLSVDRLNRLLKGKGM

SEQ ID NO: 2107158 - protein, 23 aa, Staphylococcus
LAAIFLLTACGKGNDEKQSLEQD

SEQ ID NO: 2107159 - protein, 20 aa, Staphylococcus
LAGDHKIHFKGYLGSNIVKF

SEQ ID NO: 2107160 - protein, 24 aa, Staphylococcus
LAIMGRYVLKPDIFDYLERQEIGR

SEQ ID NO: 2107161 - protein, 27 aa, Staphylococcus
LAIMGRYVLKPEIFDYLSTQDKGSGGE

SEQ ID NO: 2107162 - protein, 21 aa, Staphylococcus
LASFLVLAACGNSEESKSEDK

SEQ ID NO: 2107163 - protein, 31 aa, Staphylococcus
LATPPKTRTFMRAMATPRMLAAAVTSPDQDA

SEQ ID NO: 2107164 - protein, 17 aa, Staphylococcus
LAVGLGVTGFAAGNSAD

SEQ ID NO: 2107165 - protein, 17 aa, Staphylococcus
LAVGLGVVAGNAGHADA

SEQ ID NO: 2107166 - protein, 17 aa, Staphylococcus
LAVGLGVVAGNAGHDAH

SEQ ID NO: 2107167 - protein, 18 aa, Staphylococcus
LCASLFILVIFVGGCGSF

SEQ ID NO: 2107168 - protein, 20 aa, Staphylococcus
LCISIALSACSTGQYSDAKK

SEQ ID NO: 2107169 - protein, 19 aa, Staphylococcus
LCSLYCLILSGCGQNNNED

SEQ ID NO: 2107170 - protein, 21 aa, Staphylococcus
LCYIYKFRARFAVLAHEIAQR

SEQ ID NO: 2107171 - protein, 17 aa, Staphylococcus
LDAGSWFDGKYSNEKVP

SEQ ID NO: 2107172 - protein, 27 aa, Staphylococcus
LDLPDFKRTGAELGKYYLGMINNMMRV

SEQ ID NO: 2107173 - protein, 19 aa, Staphylococcus
LDLPHFVSYETAYACNHKD

SEQ ID NO: 2107174 - protein, 19 aa, Staphylococcus
LDMEVKGQLSLTQLKKVYS

SEQ ID NO: 2107175 - protein, 23 aa, Staphylococcus
LDTARFEFFLSRTFDVAPQNVYA

SEQ ID NO: 2107176 - protein, 17 aa, Staphylococcus
LEEMLRKGNPEEVKYQK

SEQ ID NO: 2107177 - protein, 20 aa, Staphylococcus
LFRSGFEPDVDFVIRVGKPV

SEQ ID NO: 2107178 - protein, 17 aa, Staphylococcus
LFYKECEEWNIELDTLI

SEQ ID NO: 2107179 - protein, 22 aa, Staphylococcus
LGASCLLVGCGSQNLGPLEVKT

SEQ ID NO: 2107180 - protein, 22 aa, Staphylococcus
LGGFPISGAFLVCKNPEVVKEH

SEQ ID NO: 2107181 - protein, 21 aa, Staphylococcus
LGLSSFIILSACGQNTDNNNK

SEQ ID NO: 2107182 - protein, 17 aa, Staphylococcus
LGRKTKQGFYKKDKEKK

SEQ ID NO: 2107183 - protein, 22 aa, Staphylococcus
LITGIAVSGVIAYQKYMKSDQA

SEQ ID NO: 2107184 - protein, 23 aa, Staphylococcus
LIVLVGVLGFKWSKHHEVETQVL

SEQ ID NO: 2107185 - protein, 19 aa, Staphylococcus
LIYRGIKSTVHFNSSEILN

SEQ ID NO: 2107186 - protein, 20 aa, Staphylococcus
LKENLDWIWNSLSLRDQELF

SEQ ID NO: 2107187 - protein, 18 aa, Staphylococcus
LKEYDFREALARYDKLRV

SEQ ID NO: 2107188 - protein, 18 aa, Staphylococcus
LKHDIHFIGGHPMAGSHK

SEQ ID NO: 2107189 - protein, 19 aa, Staphylococcus
LKKAGLLVHPFTVNDPEDM

SEQ ID NO: 2107190 - protein, 17 aa, Staphylococcus
LKLLIGLSNQLNIVELK

SEQ ID NO: 2107191 - protein, 17 aa, Staphylococcus
LKLLVGLSNQLTLKQLN

SEQ ID NO: 2107192 - protein, 17 aa, Staphylococcus
LKLLVSLSNELNREQIK

SEQ ID NO: 2107193 - protein, 17 aa, Staphylococcus
LKPQFDLVKQMSEALGF

SEQ ID NO: 2107194 - protein, 25 aa, Staphylococcus
LKQLPNFQTALDIAKQEANLYGNHN

SEQ ID NO: 2107195 - protein, 17 aa, Staphylococcus
LKSDLLFHKSLQIEQRD

SEQ ID NO: 2107196 - protein, 26 aa, Staphylococcus
LLAQQGGYDYFSFEAIRPSNNTQLHV

SEQ ID NO: 2107197 - protein, 17 aa, Staphylococcus
LLFGFVITLGACGNEGA

SEQ ID NO: 2107198 - protein, 19 aa, Staphylococcus
LLFMGGGAAQAAETHQEVG

SEQ ID NO: 2107199 - protein, 18 aa, Staphylococcus
LLGLFATIALAIVLSACG

SEQ ID NO: 2107200 - protein, 17 aa, Staphylococcus
LLLATGIMFAGTFTYQN

SEQ ID NO: 2107201 - protein, 18 aa, Staphylococcus
LLQIDGYYFEEVRRDHIY

SEQ ID NO: 2107202 - protein, 19 aa, Staphylococcus
LNESFSDVFAYFIESDNFL

SEQ ID NO: 2107203 - protein, 19 aa, Staphylococcus
LNESFSDVFGYFVDPDDWL

SEQ ID NO: 2107204 - protein, 18 aa, Staphylococcus
LNGLKSFLIHPGQKLKVS

SEQ ID NO: 2107205 - protein, 25 aa, Staphylococcus
LNGRGTDGGFEWSPDGKTIIYRYDA

SEQ ID NO: 2107206 - protein, 18 aa, Staphylococcus
LNSIIKHYNLTAFDKKRM

SEQ ID NO: 2107207 - protein, 25 aa, Staphylococcus
LPDGEIKARTSLITRNITYTTQNSQ

SEQ ID NO: 2107208 - protein, 19 aa, Staphylococcus
LPDGTLFNITAVDSLPNAA

SEQ ID NO: 2107209 - protein, 24 aa, Staphylococcus
LPIVVGLLLVLGIAWGVYAFITNT

SEQ ID NO: 2107210 - protein, 24 aa, Staphylococcus
LPKNEYRYGKPEGIVVHDTANDNS

SEQ ID NO: 2107211 - protein, 17 aa, Staphylococcus
LPMFQGIEFTQDREKLA

SEQ ID NO: 2107212 - protein, 26 aa, Staphylococcus
LPQYNYRYGKPEGIVMHDTANDNSTI

SEQ ID NO: 2107213 - protein, 19 aa, Staphylococcus
LPSMLALSLFGATLTAQHA

SEQ ID NO: 2107214 - protein, 18 aa, Staphylococcus
LPSMVALTLFGTAFTAHH

SEQ ID NO: 2107215 - protein, 18 aa, Staphylococcus
LPSMVAVTLLGTAFTAHH

SEQ ID NO: 2107216 - protein, 17 aa, Staphylococcus
LQEYGQYHGGGAHYGVD

SEQ ID NO: 2107217 - protein, 18 aa, Staphylococcus
LRARLFVDQIVSFVNNSP

SEQ ID NO: 2107218 - protein, 20 aa, Staphylococcus
LRNGDPFTIALFGVDSNAQR

SEQ ID NO: 2107219 - protein, 19 aa, Staphylococcus
LRNGVKMIVDQAVNSVNYL

SEQ ID NO: 2107220 - protein, 18 aa, Staphylococcus
LRRVSPRKVIGPLIKAHK

SEQ ID NO: 2107221 - protein, 20 aa, Staphylococcus
LRYGKSFVDICIYEQEDFVV

SEQ ID NO: 2107222 - protein, 25 aa, Staphylococcus
LRYPARSGATIAFYVAQWPSARLNH

SEQ ID NO: 2107223 - protein, 25 aa, Staphylococcus
LSATLTLSACGKSEEKASLEKSVDK

SEQ ID NO: 2107224 - protein, 17 aa, Staphylococcus
LSDAMSDIREGYNGKDK

SEQ ID NO: 2107225 - protein, 18 aa, Staphylococcus
LSEFSKGLVEEWDQMIDV

SEQ ID NO: 2107226 - protein, 23 aa, Staphylococcus
LSEKEKLALVFLANESGEYAITK

SEQ ID NO: 2107227 - protein, 18 aa, Staphylococcus
LSKKATLGSNAFYLITDN

SEQ ID NO: 2107228 - protein, 27 aa, Staphylococcus
LSLFIVCFLLGCITWFGFEKQNNKINT

SEQ ID NO: 2107229 - protein, 19 aa, Staphylococcus
LSSCLILGACGNQDSEQKD

SEQ ID NO: 2107230 - protein, 23 aa, Staphylococcus
LSSFLVLSACSHSDHSDKKDSDK

SEQ ID NO: 2107231 - protein, 22 aa, Staphylococcus
LSSGEKQTMYAIENNQYEVEDA

SEQ ID NO: 2107232 - protein, 17 aa, Staphylococcus
LTACGKSNEKASLEKSI

SEQ ID NO: 2107233 - protein, 18 aa, Staphylococcus
LTKKALLGDKSFYLITDY

SEQ ID NO: 2107234 - protein, 19 aa, Staphylococcus
LTLMLVLAACGNDDSKKED

SEQ ID NO: 2107235 - protein, 19 aa, Staphylococcus
LVATLLFMGGGAAQAAETH

SEQ ID NO: 2107236 - protein, 19 aa, Staphylococcus
LVKILGRLKFRTSYGQNVL

SEQ ID NO: 2107237 - protein, 18 aa, Staphylococcus
LVKLFYKECEEWNIELDT

SEQ ID NO: 2107238 - protein, 17 aa, Staphylococcus
LVLICTLTVIPMNGSAH

SEQ ID NO: 2107239 - protein, 18 aa, Staphylococcus
LVNGVTWYHGTLANGTAI

SEQ ID NO: 2107240 - protein, 17 aa, Staphylococcus
LVPGGFGFRASEGKIAA

SEQ ID NO: 2107241 - protein, 18 aa, Staphylococcus
LVTSLLLAGCSTGQSNDN

SEQ ID NO: 2107242 - protein, 18 aa, Staphylococcus
LYGPEGLGFLFVRKNIQK

SEQ ID NO: 2107243 - protein, 23 aa, Staphylococcus
LYGTVNGISGWISKYYLTEPTAT

SEQ ID NO: 2107244 - protein, 18 aa, Staphylococcus
LYKMRWNPDHPATHQYAT

SEQ ID NO: 2107245 - protein, 23 aa, Staphylococcus
LYTAGQCTWYVYDKVNGAIGSTW

SEQ ID NO: 2107246 - protein, 20 aa, Staphylococcus
LYTEGQCTWYVFDKRAQAGK

SEQ ID NO: 2107247 - protein, 24 aa, Staphylococcus
LYTEGQCTWYVFDRRAQAGKPIST

SEQ ID NO: 2107248 - protein, 24 aa, Staphylococcus
LYVKPELQNNIGFYTNNDPKNRAD

SEQ ID NO: 2107249 - protein, 19 aa, Staphylococcus
MAASKRLTGNVIGKADEKE

SEQ ID NO: 2107250 - protein, 23 aa, Staphylococcus
MAFLLACCLGFLLFIATNQQALA

SEQ ID NO: 2107251 - protein, 17 aa, Staphylococcus
MAREAIENKVASQIQQI

SEQ ID NO: 2107252 - protein, 19 aa, Staphylococcus
MCMAISLYGCEENKKKKVA

SEQ ID NO: 2107253 - protein, 22 aa, Staphylococcus
MGGQTVRLLEEMLRKGNPEEVK

SEQ ID NO: 2107254 - protein, 21 aa, Staphylococcus
MGGQTVRLLEEMLRNRNPEEI

SEQ ID NO: 2107255 - protein, 17 aa, Staphylococcus
MGVMFSRTKEGLLDFRR

SEQ ID NO: 2107256 - protein, 18 aa, Staphylococcus
MGVMFSRTKEGLLDFRRF

SEQ ID NO: 2107257 - protein, 22 aa, Staphylococcus
MGVRLTPILGWAERGGASASGH

SEQ ID NO: 2107258 - protein, 19 aa, Staphylococcus
MHFTGHDWNSAGFNKSETQ

SEQ ID NO: 2107259 - protein, 17 aa, Staphylococcus
MHPHVIEPVKWVKGKDG

SEQ ID NO: 2107260 - protein, 19 aa, Staphylococcus
MKEVWDYDITVAKAAAKAG

SEQ ID NO: 2107261 - protein, 17 aa, Staphylococcus
MKGRIIGREGRNIRTLE

SEQ ID NO: 2107262 - protein, 18 aa, Staphylococcus
MLLAGCSLSDFGLGNGAS

SEQ ID NO: 2107263 - protein, 20 aa, Staphylococcus
MNYGHGVGVVTSRTISASQA

SEQ ID NO: 2107264 - protein, 20 aa, Staphylococcus
MNYGHGVGVVTSRTLSSSEA

SEQ ID NO: 2107265 - protein, 17 aa, Staphylococcus
MPEFKKYKKAANQLPAN

SEQ ID NO: 2107266 - protein, 17 aa, Staphylococcus
MSLPTKILLWIVGVLFL

SEQ ID NO: 2107267 - protein, 17 aa, Staphylococcus
MTSFLVLGACGQKEDNK

SEQ ID NO: 2107268 - protein, 18 aa, Staphylococcus
MVEMMFGVHFIKGGMYGL

SEQ ID NO: 2107269 - protein, 18 aa, Staphylococcus
MWRDITISNKTAILNLIQ

SEQ ID NO: 2107270 - protein, 18 aa, Staphylococcus
NAFQHFAFLNAYKKAHKD

SEQ ID NO: 2107271 - protein, 17 aa, Staphylococcus
NAHSVTINQIVKDYGSN

SEQ ID NO: 2107272 - protein, 23 aa, Staphylococcus
NATIKTGTPLPVNLAGGSTTSIP

SEQ ID NO: 2107273 - protein, 17 aa, Staphylococcus
NCALPYYIGQLVTEREK

SEQ ID NO: 2107274 - protein, 18 aa, Staphylococcus
NCALPYYLGNVVDSRNKV

SEQ ID NO: 2107275 - protein, 18 aa, Staphylococcus
NCALPYYLSDTITEREKV

SEQ ID NO: 2107276 - protein, 17 aa, Staphylococcus
NCGLPYFIGNIVNERKD

SEQ ID NO: 2107277 - protein, 17 aa, Staphylococcus
NCGLPYYLGQIVSSRDQ

SEQ ID NO: 2107278 - protein, 17 aa, Staphylococcus
NCPDLRNTKVIDIIREL

SEQ ID NO: 2107279 - protein, 22 aa, Staphylococcus
NDLKSFVDLCNRSIKDNEDILD

SEQ ID NO: 2107280 - protein, 18 aa, Staphylococcus
NDLRFKKFVKNNHIPQEY

SEQ ID NO: 2107281 - protein, 21 aa, Staphylococcus
NDRYGRVLAYVWLDKDTLFNE

SEQ ID NO: 2107282 - protein, 21 aa, Staphylococcus
NGPKARLKLLIGLSNQLNIVE

SEQ ID NO: 2107283 - protein, 19 aa, Staphylococcus
NGTHWSWNYAQNGQATPQQ

SEQ ID NO: 2107284 - protein, 17 aa, Staphylococcus
NGVRYGLVGVTTPETKI

SEQ ID NO: 2107285 - protein, 21 aa, Staphylococcus
NHDPIILVHGFNGFTDDINPS

SEQ ID NO: 2107286 - protein, 22 aa, Staphylococcus
NHFTPRECKVIALNYASNHLNE

SEQ ID NO: 2107287 - protein, 22 aa, Staphylococcus
NIEVLRFSNAMFEPLWNNKYIS

SEQ ID NO: 2107288 - protein, 18 aa, Staphylococcus
NINFRIGYMTKHKLVITV

SEQ ID NO: 2107289 - protein, 21 aa, Staphylococcus
NKDSRVDFGLSQWGLKQKPNE

SEQ ID NO: 2107290 - protein, 18 aa, Staphylococcus
NKEFKRHRIGNGDNNVEM

SEQ ID NO: 2107291 - protein, 25 aa, Staphylococcus
NKFSRADLGLTQWGLKQRPDETYID

SEQ ID NO: 2107292 - protein, 20 aa, Staphylococcus
NKNALLFEWSRLNEMLDNQL

SEQ ID NO: 2107293 - protein, 22 aa, Staphylococcus
NKNSRVDFGLSQWGLKQKPNES

SEQ ID NO: 2107294 - protein, 18 aa, Staphylococcus
NKRVDIMLGHGLFNEVKA

SEQ ID NO: 2107295 - protein, 17 aa, Staphylococcus
NKVFAIEIKDHLVAKDP

SEQ ID NO: 2107296 - protein, 22 aa, Staphylococcus
NLGEVIYPGQLVAVSEKGSAHL

SEQ ID NO: 2107297 - protein, 23 aa, Staphylococcus
NLYDWGQCTWHVFNRRAETGQPI

SEQ ID NO: 2107298 - protein, 17 aa, Staphylococcus
NNDLVVVNVDWGITNER

SEQ ID NO: 2107299 - protein, 17 aa, Staphylococcus
NNQAWLAAYMLKQNGIT

SEQ ID NO: 2107300 - protein, 27 aa, Staphylococcus
NNSPVYRAQLFLSPYGPPAYLQAINTN

SEQ ID NO: 2107301 - protein, 24 aa, Staphylococcus
NPAEEGRFLKFFVDDGLIKLKKGV

SEQ ID NO: 2107302 - protein, 23 aa, Staphylococcus
NPAEQGRFLKFFVDADLIKIKKG

SEQ ID NO: 2107303 - protein, 19 aa, Staphylococcus
NPQYLPRFVFGHYMKSHLS

SEQ ID NO: 2107304 - protein, 20 aa, Staphylococcus
NPSHVAVCWDMGQSTFRNDM

SEQ ID NO: 2107305 - protein, 20 aa, Staphylococcus
NQDPIILVHGFNGLVGETAG

SEQ ID NO: 2107306 - protein, 17 aa, Staphylococcus
NQKGMVVQQDWNGKHNK

SEQ ID NO: 2107307 - protein, 17 aa, Staphylococcus
NRYSVPYFFGTVGIIYN

SEQ ID NO: 2107308 - protein, 24 aa, Staphylococcus
NSDLKDIPIHFAIYKQSGQDSITP

SEQ ID NO: 2107309 - protein, 24 aa, Staphylococcus
NSDLKDIPIHFAIYKQSSQESITP

SEQ ID NO: 2107310 - protein, 25 aa, Staphylococcus
NSDNYQWYMHMNKLNVQQGQSVNAG

SEQ ID NO: 2107311 - protein, 18 aa, Staphylococcus
NSPIKYYNVYGIGAYDYA

SEQ ID NO: 2107312 - protein, 17 aa, Staphylococcus
NTDYLAWGAGPQANDRF

SEQ ID NO: 2107313 - protein, 22 aa, Staphylococcus
NTYRTPLSPIFDATHSSGLPAS

SEQ ID NO: 2107314 - protein, 20 aa, Staphylococcus
NVANHWRIRTGIQQGDTALN

SEQ ID NO: 2107315 - protein, 25 aa, Staphylococcus
NVDIPVTIYPVARAKAPTREVQGGQ

SEQ ID NO: 2107316 - protein, 23 aa, Staphylococcus
NVKAKWNISKAMIKEGNGGSDET

SEQ ID NO: 2107317 - protein, 24 aa, Staphylococcus
NVKFLKDRYEAMKNFPMFDNIEYT

SEQ ID NO: 2107318 - protein, 19 aa, Staphylococcus
NVPLELAFELFKLECKDHN

SEQ ID NO: 2107319 - protein, 25 aa, Staphylococcus
NYDRAVELYYYIKGGRVDYGAAHAA

SEQ ID NO: 2107320 - protein, 20 aa, Staphylococcus
NYDRAVELYYYIKGGTVDYG

SEQ ID NO: 2107321 - protein, 18 aa, Staphylococcus
NYHYEWQGNWSPSQAQQG

SEQ ID NO: 2107322 - protein, 19 aa, Staphylococcus
NYSGGPYVKDTRTISASQA

SEQ ID NO: 2107323 - protein, 26 aa, Staphylococcus
NYSSYFPKYGYRNGVGKPEGIVVHDT

SEQ ID NO: 2107324 - protein, 31 aa, Staphylococcus
NYTSYFPKYGYRYGVGRPEGIVVHDTANENS

SEQ ID NO: 2107325 - protein, 23 aa, Staphylococcus
PAEQGRFLKFFVDEGLIKLKKGV

SEQ ID NO: 2107326 - protein, 23 aa, Staphylococcus
PAFKNKNLRLAIAQSINKQGFVD

SEQ ID NO: 2107327 - protein, 22 aa, Staphylococcus
PAMNGAAGFHLDKVLKQNGTGN

SEQ ID NO: 2107328 - protein, 18 aa, Staphylococcus
PDDLKVVVDLSGEKAGKY

SEQ ID NO: 2107329 - protein, 20 aa, Staphylococcus
PDGMKFYMVYPDKGSYRTVV

SEQ ID NO: 2107330 - protein, 21 aa, Staphylococcus
PDQEWRKNTGDGLSSGEKQTM

SEQ ID NO: 2107331 - protein, 19 aa, Staphylococcus
PEGMKFYVVSPSIGQFSSV

SEQ ID NO: 2107332 - protein, 23 aa, Staphylococcus
PEQKSDGSWGFSFDDKDGNLAGS

SEQ ID NO: 2107333 - protein, 26 aa, Staphylococcus
PEQKYKELSNIVGNYWQKEQGYDNES

SEQ ID NO: 2107334 - protein, 19 aa, Staphylococcus
PFNEIYCAAKFGVEGYTES

SEQ ID NO: 2107335 - protein, 17 aa, Staphylococcus
PGQKIHLIGHSMGGQTV

SEQ ID NO: 2107336 - protein, 17 aa, Staphylococcus
PGQKVHLVGHSMGGQTI

SEQ ID NO: 2107337 - protein, 23 aa, Staphylococcus
PGVAKTEMWDRIDAEMVKLDSNL

SEQ ID NO: 2107338 - protein, 25 aa, Staphylococcus
PHQLKILYMHGGSWVAGPFKEHYQM

SEQ ID NO: 2107339 - protein, 19 aa, Staphylococcus
PIGAICGAVDYLAKNGFLN

SEQ ID NO: 2107340 - protein, 23 aa, Staphylococcus
PIGKLRAGLDLVIPPIKIEDDIS

SEQ ID NO: 2107341 - protein, 22 aa, Staphylococcus
PIGKLRAGMDLFKKPIQIEDDI

SEQ ID NO: 2107342 - protein, 22 aa, Staphylococcus
PKHPKRIVILTSNFGNFKDLGV

SEQ ID NO: 2107343 - protein, 18 aa, Staphylococcus
PKKAEHFHIFMGDNNDSL

SEQ ID NO: 2107344 - protein, 19 aa, Staphylococcus
PKKHTVVVFEAGQLGADTQ

SEQ ID NO: 2107345 - protein, 21 aa, Staphylococcus
PKLRDMLGYFIKYVGSSSYDA

SEQ ID NO: 2107346 - protein, 19 aa, Staphylococcus
PKVLILMGIPGSYLVATDK

SEQ ID NO: 2107347 - protein, 23 aa, Staphylococcus
PLGKLRAGLDLVIPPIKIENDIS

SEQ ID NO: 2107348 - protein, 18 aa, Staphylococcus
PLYLKDFMLHRTGLKKYK

SEQ ID NO: 2107349 - protein, 20 aa, Staphylococcus
PNKLNKYAIRKFTVGTASLL

SEQ ID NO: 2107350 - protein, 17 aa, Staphylococcus
PNKPFKYGIHYSEVTDF

SEQ ID NO: 2107351 - protein, 19 aa, Staphylococcus
PNSMPQYRVDHMDNISAIQ

SEQ ID NO: 2107352 - protein, 17 aa, Staphylococcus
PPAELIPQFDYVKEISQ

SEQ ID NO: 2107353 - protein, 17 aa, Staphylococcus
PPFPFPECGAMSQAYIG

SEQ ID NO: 2107354 - protein, 19 aa, Staphylococcus
PPSGYKWYDRSTFKLGSYG

SEQ ID NO: 2107355 - protein, 20 aa, Staphylococcus
PQLRDMLGYFIKYVGSSSYD

SEQ ID NO: 2107356 - protein, 20 aa, Staphylococcus
PRSVKLIDQFGITKDDNKKD

SEQ ID NO: 2107357 - protein, 21 aa, Staphylococcus
PRTAALKGYWEKVGLKTKVSM

SEQ ID NO: 2107358 - protein, 18 aa, Staphylococcus
PRTAKLLIELLEQEALII

SEQ ID NO: 2107359 - protein, 21 aa, Staphylococcus
PSDLQFDIVFLFTKAMQLESM

SEQ ID NO: 2107360 - protein, 21 aa, Staphylococcus
PSIAISLLLTGCGQKDNGQDE

SEQ ID NO: 2107361 - protein, 23 aa, Staphylococcus
PSNTEILYRLGLGNNIVGVSTVD

SEQ ID NO: 2107362 - protein, 20 aa, Staphylococcus
PTIYKPTWKHEAIDYRDATR

SEQ ID NO: 2107363 - protein, 20 aa, Staphylococcus
PTIYKPTWKSEALTYKEATS

SEQ ID NO: 2107364 - protein, 18 aa, Staphylococcus
PYNDYAIEGSEGNYSYIF

SEQ ID NO: 2107365 - protein, 26 aa, Staphylococcus
PYPQGQCTWYVYKRMQQFDLAIGGDL

SEQ ID NO: 2107366 - protein, 25 aa, Staphylococcus
PYPQGQCTWYVYQRMQQYDSSISGD

SEQ ID NO: 2107367 - protein, 27 aa, Staphylococcus
QAINKYPVIFVHGFMGFVGDIKPDLYP

SEQ ID NO: 2107368 - protein, 23 aa, Staphylococcus
QAMSYRYLICMNVVINDLYQKGY

SEQ ID NO: 2107369 - protein, 18 aa, Staphylococcus
QAYTGSYNRAALKQQTVK

SEQ ID NO: 2107370 - protein, 17 aa, Staphylococcus
QAYWSFGGLFLVNSKIQ

SEQ ID NO: 2107371 - protein, 17 aa, Staphylococcus
QCTWHVFNRRSEIGKGI

SEQ ID NO: 2107372 - protein, 23 aa, Staphylococcus
QDYNTGEKFGWVKQGDVVYNTAK

SEQ ID NO: 2107373 - protein, 25 aa, Staphylococcus
QEFIKAGGTKALWEKIVLPESGGDP

SEQ ID NO: 2107374 - protein, 18 aa, Staphylococcus
QGASAVWQDNADNWKNNV

SEQ ID NO: 2107375 - protein, 25 aa, Staphylococcus
QGTVWTHYAISRFLGGTDHSDPHAY

SEQ ID NO: 2107376 - protein, 26 aa, Staphylococcus
QGTVWTHYAISRWLGGTDHADPHQYF

SEQ ID NO: 2107377 - protein, 25 aa, Staphylococcus
QITKRKVVNGITWYYGKLSNGKSVW

SEQ ID NO: 2107378 - protein, 24 aa, Staphylococcus
QKADLNLFFPFTVTANVIGKAKEK

SEQ ID NO: 2107379 - protein, 24 aa, Staphylococcus
QKADLNMFLPFILTGNVIGKANEK

SEQ ID NO: 2107380 - protein, 18 aa, Staphylococcus
QKEHGGEISPLYKGNNDN

SEQ ID NO: 2107381 - protein, 23 aa, Staphylococcus
QKFLKKRYEAMKDFPMFDNIEYT

SEQ ID NO: 2107382 - protein, 17 aa, Staphylococcus
QKKHGGDISPLYKGGQD

SEQ ID NO: 2107383 - protein, 17 aa, Staphylococcus
QKLKSGQNVNGMVDNEG

SEQ ID NO: 2107384 - protein, 21 aa, Staphylococcus
QKLRDMLGYFIKYVGSSSYDA

SEQ ID NO: 2107385 - protein, 18 aa, Staphylococcus
QLEEFLRNGNQEEIDYQK

SEQ ID NO: 2107386 - protein, 23 aa, Staphylococcus
QLERETKEGIDWKKETRDQGSQV

SEQ ID NO: 2107387 - protein, 18 aa, Staphylococcus
QNLYDWGQCTWHVFNRRA

SEQ ID NO: 2107388 - protein, 21 aa, Staphylococcus
QNMRFSFVGSGNMPPNLHIVG

SEQ ID NO: 2107389 - protein, 18 aa, Staphylococcus
QPATAYKHNYIIANAGSN

SEQ ID NO: 2107390 - protein, 18 aa, Staphylococcus
QPISTYWWNAENWADNAR

SEQ ID NO: 2107391 - protein, 21 aa, Staphylococcus
QPSHVAVCWDMGKSTFRNDMF

SEQ ID NO: 2107392 - protein, 25 aa, Staphylococcus
QVFVTSRVTPIPGIDNPNNPKDYLK

SEQ ID NO: 2107393 - protein, 20 aa, Staphylococcus
RFFALILAIFFYLSVNNVFG

SEQ ID NO: 2107394 - protein, 19 aa, Staphylococcus
RFFGLHFFNPPRIMKLVEV

SEQ ID NO: 2107395 - protein, 21 aa, Staphylococcus
RFIALLLAIFFYLSVNNVFGN

SEQ ID NO: 2107396 - protein, 17 aa, Staphylococcus
RFTYCTKIIYQAYKYGV

SEQ ID NO: 2107397 - protein, 20 aa, Staphylococcus
RFVAFILALFFYLSVNNVFG

SEQ ID NO: 2107398 - protein, 20 aa, Staphylococcus
RFVAFVLALAFFLTVNNVFG

SEQ ID NO: 2107399 - protein, 19 aa, Staphylococcus
RGAATIAMLAKVPIVPAAY

SEQ ID NO: 2107400 - protein, 22 aa, Staphylococcus
RGFTVQVPPEYLGGLNENNFIN

SEQ ID NO: 2107401 - protein, 24 aa, Staphylococcus
RGGFKTAQNYGWDTVSKAIVGGAQ

SEQ ID NO: 2107402 - protein, 21 aa, Staphylococcus
RHKRFNFSYTLIVLIVALVLL

SEQ ID NO: 2107403 - protein, 24 aa, Staphylococcus
RHVNLPAQVPLAWGAHRAASIIAE

SEQ ID NO: 2107404 - protein, 24 aa, Staphylococcus
RHVNLPAQVPLAWGAHRGASVIAE

SEQ ID NO: 2107405 - protein, 22 aa, Staphylococcus
RIGESITVRANILFDGETTPIV

SEQ ID NO: 2107406 - protein, 25 aa, Staphylococcus
RIIYWKNKWYLVAYCRLRDDVRTFR

SEQ ID NO: 2107407 - protein, 22 aa, Staphylococcus
RIWTYKDGKPWYFLEEKYPDYG

SEQ ID NO: 2107408 - protein, 20 aa, Staphylococcus
RKGTTCFGVALGILRVVEAI

SEQ ID NO: 2107409 - protein, 17 aa, Staphylococcus
RKLKGIKPMRVNNDIAH

SEQ ID NO: 2107410 - protein, 25 aa, Staphylococcus
RKNGSKWIILNLHKPMYSKSYHALT

SEQ ID NO: 2107411 - protein, 24 aa, Staphylococcus
RKPSEFYNPIALYRGMKLRTLGKA

SEQ ID NO: 2107412 - protein, 17 aa, Staphylococcus
RKWVPLMMEGRVDDGKM

SEQ ID NO: 2107413 - protein, 21 aa, Staphylococcus
RLIALMLAVLFFLSANNMFGN

SEQ ID NO: 2107414 - protein, 19 aa, Staphylococcus
RLPQGWTSEFVRNSNGEGG

SEQ ID NO: 2107415 - protein, 20 aa, Staphylococcus
RNAKWFKERFNIDIYTEYEV

SEQ ID NO: 2107416 - protein, 18 aa, Staphylococcus
RNGVKMIVDQVVNTVSHL

SEQ ID NO: 2107417 - protein, 18 aa, Staphylococcus
RNGVKMIVNQAVSAVDYL

SEQ ID NO: 2107418 - protein, 18 aa, Staphylococcus
RQQLGRSIGSYWGNANNW

SEQ ID NO: 2107419 - protein, 21 aa, Staphylococcus
RSATKYHNVFGIAAYDYNALG

SEQ ID NO: 2107420 - protein, 25 aa, Staphylococcus
RTGNPIKLNIGFDIQDGYGNEETLK

SEQ ID NO: 2107421 - protein, 22 aa, Staphylococcus
RTKEFKPDFTAKVKPFKYNGKT

SEQ ID NO: 2107422 - protein, 19 aa, Staphylococcus
RTYPRLRITGAPFEAVGLP

SEQ ID NO: 2107423 - protein, 18 aa, Staphylococcus
RVISYPVNFVTGAIGNFL

SEQ ID NO: 2107424 - protein, 20 aa, Staphylococcus
RVKDSKLWQTKDNGFYDLTR

SEQ ID NO: 2107425 - protein, 17 aa, Staphylococcus
RVLEFYRQYGFDDKIVE

SEQ ID NO: 2107426 - protein, 19 aa, Staphylococcus
RVVSYPVNFVTGAINNLFS

SEQ ID NO: 2107427 - protein, 23 aa, Staphylococcus
SAIAVLLTICLLFLLFIATNEQA

SEQ ID NO: 2107428 - protein, 19 aa, Staphylococcus
SAIKCARAGATVAHIHARD

SEQ ID NO: 2107429 - protein, 19 aa, Staphylococcus
SDGKWGFSYDDKDGNLAGS

SEQ ID NO: 2107430 - protein, 18 aa, Staphylococcus
SDKTRIALAFFADKKGEY

SEQ ID NO: 2107431 - protein, 23 aa, Staphylococcus
SDNELKKSIKIYLDKNEELSEAS

SEQ ID NO: 2107432 - protein, 19 aa, Staphylococcus
SDYNSGKLYGWVKQNETIY

SEQ ID NO: 2107433 - protein, 18 aa, Staphylococcus
SELTKLLAQQGGYDYFSF

SEQ ID NO: 2107434 - protein, 20 aa, Staphylococcus
SEYLKVIRKRGGFEDLEAVK

SEQ ID NO: 2107435 - protein, 18 aa, Staphylococcus
SFLALLLMLSACAPNNDN

SEQ ID NO: 2107436 - protein, 23 aa, Staphylococcus
SGASALYGHVAFVEKVNDDGSII

SEQ ID NO: 2107437 - protein, 19 aa, Staphylococcus
SGKLYGWVKQNETIYNTIT

SEQ ID NO: 2107438 - protein, 18 aa, Staphylococcus
SGQRELWVTSGDILSLKA

SEQ ID NO: 2107439 - protein, 20 aa, Staphylococcus
SGTAISPRPAFILKSSKHKE

SEQ ID NO: 2107440 - protein, 18 aa, Staphylococcus
SHVAVCWDMGQETFRNQM

SEQ ID NO: 2107441 - protein, 17 aa, Staphylococcus
SIMLCVLVACGKEDSSN

SEQ ID NO: 2107442 - protein, 17 aa, Staphylococcus
SKDTGMMTYEFDGSTVN

SEQ ID NO: 2107443 - protein, 20 aa, Staphylococcus
SKHLGGFPITGEFLVCNNPE

SEQ ID NO: 2107444 - protein, 19 aa, Staphylococcus
SKHLGGFPITGQFLICTNP

SEQ ID NO: 2107445 - protein, 18 aa, Staphylococcus
SKHLGGFPITGQFLTCTN

SEQ ID NO: 2107446 - protein, 20 aa, Staphylococcus
SKMKKFKIGQAVDADGVQVK

SEQ ID NO: 2107447 - protein, 24 aa, Staphylococcus
SKNEVLGVHAFRIASGDYQKYNLN

SEQ ID NO: 2107448 - protein, 25 aa, Staphylococcus
SLDTARFQFFLSREFDVAPNQVYAP

SEQ ID NO: 2107449 - protein, 17 aa, Staphylococcus
SLITITFVTITTVALST

SEQ ID NO: 2107450 - protein, 18 aa, Staphylococcus
SLIYRYDATSGRTINAND

SEQ ID NO: 2107451 - protein, 24 aa, Staphylococcus
SLNGKNGWVSQAFLSNITKPSSGS

SEQ ID NO: 2107452 - protein, 19 aa, Staphylococcus
SNELYDVIFLFPKSMQLES

SEQ ID NO: 2107453 - protein, 20 aa, Staphylococcus
SNESANVWEISGYPPSLQIE

SEQ ID NO: 2107454 - protein, 19 aa, Staphylococcus
SNIEGWKPVDKEGIIKKNP

SEQ ID NO: 2107455 - protein, 23 aa, Staphylococcus
SNLPKKRSRRDLPAGDSNNANTA

SEQ ID NO: 2107456 - protein, 23 aa, Staphylococcus
SNLWLRTSDRVRLVMGRFKATTF

SEQ ID NO: 2107457 - protein, 20 aa, Staphylococcus
SNNDEIFIETPFGGINESVK

SEQ ID NO: 2107458 - protein, 17 aa, Staphylococcus
SNTEILYELGLENRIVG

SEQ ID NO: 2107459 - protein, 18 aa, Staphylococcus
SNTEILYELGLGKDVVGV

SEQ ID NO: 2107460 - protein, 17 aa, Staphylococcus
SNTEILYELGLKKQLIG

SEQ ID NO: 2107461 - protein, 22 aa, Staphylococcus
SNTEILYRLGLGKNIIGVSTVD

SEQ ID NO: 2107462 - protein, 19 aa, Staphylococcus
SNVKGLGIISYRTLDANTA

SEQ ID NO: 2107463 - protein, 19 aa, Staphylococcus
SNVKGLGIVSYRQIDADTA

SEQ ID NO: 2107464 - protein, 19 aa, Staphylococcus
SNVKGLGIVSYRTIDASTA

SEQ ID NO: 2107465 - protein, 19 aa, Staphylococcus
SNVKGLGVISYRTIDADDA

SEQ ID NO: 2107466 - protein, 21 aa, Staphylococcus
SNVKGLGVISYRTIDAEDAND

SEQ ID NO: 2107467 - protein, 24 aa, Staphylococcus
SNVPADPNALVYLVVTGNLAQDGT

SEQ ID NO: 2107468 - protein, 22 aa, Staphylococcus
SNYKEIVNQIVFTNGKTYTDSN

SEQ ID NO: 2107469 - protein, 19 aa, Staphylococcus
SPHFNLFGIKGAYEGQSAT

SEQ ID NO: 2107470 - protein, 28 aa, Staphylococcus
SPYPHGQCTWYVYNRMAQFDKQISGTLG

SEQ ID NO: 2107471 - protein, 28 aa, Staphylococcus
SPYPHGQCTWYVYNRMAQFDKYVSGDLG

SEQ ID NO: 2107472 - protein, 17 aa, Staphylococcus
SQIRFKISATDNANNTT

SEQ ID NO: 2107473 - protein, 23 aa, Staphylococcus
SQLKVIPVDSIGRVAANNHGVYT

SEQ ID NO: 2107474 - protein, 19 aa, Staphylococcus
SQWGYNMNQFYSLVQKHYK

SEQ ID NO: 2107475 - protein, 24 aa, Staphylococcus
SRLLDLNLGFSQWGFKQKPNESYI

SEQ ID NO: 2107476 - protein, 20 aa, Staphylococcus
SRPGPRIDEGMKELRDAIYK

SEQ ID NO: 2107477 - protein, 24 aa, Staphylococcus
SSDDLRLGKFLKLSPDEILKKMNH

SEQ ID NO: 2107478 - protein, 21 aa, Staphylococcus
SSGAYGLFQLLGHGEHAGMSV

SEQ ID NO: 2107479 - protein, 18 aa, Staphylococcus
SSNAEMWKDITLNNKTFI

SEQ ID NO: 2107480 - protein, 19 aa, Staphylococcus
SSYYGHVAFVERVNDDGSI

SEQ ID NO: 2107481 - protein, 18 aa, Staphylococcus
STCLLCLTLTACGGNGEQ

SEQ ID NO: 2107482 - protein, 17 aa, Staphylococcus
STCQGVYYYIFTFKNEA

SEQ ID NO: 2107483 - protein, 17 aa, Staphylococcus
STHPGAGVPIVLTSAKI

SEQ ID NO: 2107484 - protein, 20 aa, Staphylococcus
STSFYNNWLYLYLFSSASQA

SEQ ID NO: 2107485 - protein, 18 aa, Staphylococcus
SVAKPRMMYSVNKKTTSK

SEQ ID NO: 2107486 - protein, 21 aa, Staphylococcus
SVGASSILVATLLFMGGGAAQ

SEQ ID NO: 2107487 - protein, 18 aa, Staphylococcus
SVLAHYWGGDKLNIRQDL

SEQ ID NO: 2107488 - protein, 18 aa, Staphylococcus
SVSKAIVGGAKFIGQSYV

SEQ ID NO: 2107489 - protein, 23 aa, Staphylococcus
SYQELCDFIKLVIQGGNAKKYVK

SEQ ID NO: 2107490 - protein, 17 aa, Staphylococcus
SYRSFLFEQYLRLTRVR

SEQ ID NO: 2107491 - protein, 17 aa, Staphylococcus
TAGQCTWYVFDKVGGKI

SEQ ID NO: 2107492 - protein, 17 aa, Staphylococcus
TAGQCTWYVYDKVGGKV

SEQ ID NO: 2107493 - protein, 17 aa, Staphylococcus
TAGQCTWYVYDKVGGNI

SEQ ID NO: 2107494 - protein, 22 aa, Staphylococcus
TAPHLHFQRMQGGVGNEYSVNP

SEQ ID NO: 2107495 - protein, 25 aa, Staphylococcus
TATIPRNGKLVVMKDEFTDFFAKEA

SEQ ID NO: 2107496 - protein, 19 aa, Staphylococcus
TEELKHFAITRDMESIPNA

SEQ ID NO: 2107497 - protein, 17 aa, Staphylococcus
TERWKKEVTPIIGKTDL

SEQ ID NO: 2107498 - protein, 27 aa, Staphylococcus
TFDHMDFLKWINLRNDYTVTWTSQKLN

SEQ ID NO: 2107499 - protein, 18 aa, Staphylococcus
TGKTFGWVKQGDVVYNTA

SEQ ID NO: 2107500 - protein, 22 aa, Staphylococcus
TGQRIISYPVNFVAGEIGNFFN

SEQ ID NO: 2107501 - protein, 23 aa, Staphylococcus
TGVPASTWSAIIARESNGQANAR

SEQ ID NO: 2107502 - protein, 19 aa, Staphylococcus
TGYDYSWFILTEDIIKKEF

SEQ ID NO: 2107503 - protein, 17 aa, Staphylococcus
THSAVVFEAGQAGASSY

SEQ ID NO: 2107504 - protein, 18 aa, Staphylococcus
THTYRLNANDAYRQDQAP

SEQ ID NO: 2107505 - protein, 18 aa, Staphylococcus
THVAVCWDMGQSTFRNDM

SEQ ID NO: 2107506 - protein, 17 aa, Staphylococcus
THVPLAWGAHRGASIVA

SEQ ID NO: 2107507 - protein, 19 aa, Staphylococcus
THYAISRYLGGTDHADPHA

SEQ ID NO: 2107508 - protein, 17 aa, Staphylococcus
TIDGGVMAYTWPGEMLS

SEQ ID NO: 2107509 - protein, 27 aa, Staphylococcus
TILLLVVALGFSVFFAATTTHHSTSDQ

SEQ ID NO: 2107510 - protein, 18 aa, Staphylococcus
TILPFKESKARGVLQDNM

SEQ ID NO: 2107511 - protein, 24 aa, Staphylococcus
TIVGVSREYVCIIGTQSAVVNYEE

SEQ ID NO: 2107512 - protein, 19 aa, Staphylococcus
TIYKSSWKNIAPSYRSATR

SEQ ID NO: 2107513 - protein, 21 aa, Staphylococcus
TKEYFAKIWLTARNDADDIFY

SEQ ID NO: 2107514 - protein, 20 aa, Staphylococcus
TKLNSLIKHYHLTDFDKKKM

SEQ ID NO: 2107515 - protein, 19 aa, Staphylococcus
TKYEGWEFLGIVKDDDNMA

SEQ ID NO: 2107516 - protein, 19 aa, Staphylococcus
TLAAALIRLANWNGNTPLI

SEQ ID NO: 2107517 - protein, 18 aa, Staphylococcus
TLAVGLGVTGFAAGNSAD

SEQ ID NO: 2107518 - protein, 20 aa, Staphylococcus
TLCLLSFIIVACDTEDDHDD

SEQ ID NO: 2107519 - protein, 18 aa, Staphylococcus
TLLPFKESKARGILQDNM

SEQ ID NO: 2107520 - protein, 20 aa, Staphylococcus
TLYKMRWNPAHPGTHQYATD

SEQ ID NO: 2107521 - protein, 19 aa, Staphylococcus
TLYPNYWGGGKYNIKSELT

SEQ ID NO: 2107522 - protein, 28 aa, Staphylococcus
TNMNFLRWVDFPNDYTVGWTSQTIPGRQ

SEQ ID NO: 2107523 - protein, 18 aa, Staphylococcus
TNTPLGWFNVKDLKVQNS

SEQ ID NO: 2107524 - protein, 24 aa, Staphylococcus
TPEQLKGAIFFGGFYNMQTVRATE

SEQ ID NO: 2107525 - protein, 41 aa, Staphylococcus
TPKQAEDVVYDWYKNQGFGNRLRNEFNYNPSKSTDEMYYID

SEQ ID NO: 2107526 - protein, 18 aa, Staphylococcus
TQMMTFKGAPDFSIVNRL

SEQ ID NO: 2107527 - protein, 22 aa, Staphylococcus
TRFKEKWQYLNIGMTNLFGSEI

SEQ ID NO: 2107528 - protein, 17 aa, Staphylococcus
TRIALAFFADKKGEYLI

SEQ ID NO: 2107529 - protein, 20 aa, Staphylococcus
TRYPNVFLIGPTVRHADAIL

SEQ ID NO: 2107530 - protein, 24 aa, Staphylococcus
TSDNYTFASLVFDPEALDSDAVKN

SEQ ID NO: 2107531 - protein, 19 aa, Staphylococcus
TSQTVRFIIRNVQPTAPQI

SEQ ID NO: 2107532 - protein, 24 aa, Staphylococcus
TSTPEKYNAVVFEAGQQNADPIYG

SEQ ID NO: 2107533 - protein, 18 aa, Staphylococcus
TTSLRKALFNNQDMSTSS

SEQ ID NO: 2107534 - protein, 18 aa, Staphylococcus
TVSKAIVGGAQFIKDAYI

SEQ ID NO: 2107535 - protein, 17 aa, Staphylococcus
TVTIARGQQFEFGDLKQ

SEQ ID NO: 2107536 - protein, 22 aa, Staphylococcus
TVWTHYAVSHWLGGTDHTDPHA

SEQ ID NO: 2107537 - protein, 22 aa, Staphylococcus
TWKGNWSPDRLNSHNNYSYSNY

SEQ ID NO: 2107538 - protein, 21 aa, Staphylococcus
TYEGIMPDWAPGKKIHLVGHS

SEQ ID NO: 2107539 - protein, 19 aa, Staphylococcus
TYLHGSINHQWGWIKQSDV

SEQ ID NO: 2107540 - protein, 18 aa, Staphylococcus
TYPRLRITGAPFEAVGLP

SEQ ID NO: 2107541 - protein, 18 aa, Staphylococcus
TYVMKWRETEIFFDKLTD

SEQ ID NO: 2107542 - protein, 25 aa, Staphylococcus
VALLKDGYKYYSLIDSIDIASGSHL

SEQ ID NO: 2107543 - protein, 26 aa, Staphylococcus
VASPYPYGQCTWYVYERVQQFDKHVG

SEQ ID NO: 2107544 - protein, 24 aa, Staphylococcus
VASTLFLGACDLNIHLPGGNNDSS

SEQ ID NO: 2107545 - protein, 17 aa, Staphylococcus
VCGIPYYIGGNVSDIDE

SEQ ID NO: 2107546 - protein, 21 aa, Staphylococcus
VDFKLRKALIEQKGLYKGQYS

SEQ ID NO: 2107547 - protein, 20 aa, Staphylococcus
VDGILVPGGFGFRASEGKIA

SEQ ID NO: 2107548 - protein, 19 aa, Staphylococcus
VDSSWPNKEIKAFSPNSSH

SEQ ID NO: 2107549 - protein, 18 aa, Staphylococcus
VDYYARVNMKAFVQAVDE

SEQ ID NO: 2107550 - protein, 18 aa, Staphylococcus
VEAMPKILPMFSENLVNY

SEQ ID NO: 2107551 - protein, 17 aa, Staphylococcus
VEKRTGTQLVVLHYQSI

SEQ ID NO: 2107552 - protein, 19 aa, Staphylococcus
VELYYYIKGGRVDYGAAHA

SEQ ID NO: 2107553 - protein, 19 aa, Staphylococcus
VELYYYIKGGTVDYGAAHA

SEQ ID NO: 2107554 - protein, 17 aa, Staphylococcus
VETFTLYYDKQYGYIHR

SEQ ID NO: 2107555 - protein, 20 aa, Staphylococcus
VFDRVGGKIGSTWGNASNWA

SEQ ID NO: 2107556 - protein, 18 aa, Staphylococcus
VFHFCAYSLVGESVEKPL

SEQ ID NO: 2107557 - protein, 20 aa, Staphylococcus
VFTDMKWCKMLLRQLISNAI

SEQ ID NO: 2107558 - protein, 22 aa, Staphylococcus
VGCIPSKIFLEYGAKMRDIHSA

SEQ ID NO: 2107559 - protein, 18 aa, Staphylococcus
VGSGNMPPNLHIVGSQTR

SEQ ID NO: 2107560 - protein, 26 aa, Staphylococcus
VGTASLLIGATLVFGVGNVARADELD

SEQ ID NO: 2107561 - protein, 27 aa, Staphylococcus
VGTFSTVIATLVFLGFNASHVQADELS

SEQ ID NO: 2107562 - protein, 25 aa, Staphylococcus
VIFALVLSLGFSVFAALTHQNKSSL

SEQ ID NO: 2107563 - protein, 28 aa, Staphylococcus
VIILLVVALGCSVFFAATHSNQSDPNQT

SEQ ID NO: 2107564 - protein, 28 aa, Staphylococcus
VILLLVVALGFSIFFAATGTKQSNSSDD

SEQ ID NO: 2107565 - protein, 23 aa, Staphylococcus
VILSICLVGLIFLATNQNALAKV

SEQ ID NO: 2107566 - protein, 24 aa, Staphylococcus
VILTICLIGLIFLATNQNALAKVH

SEQ ID NO: 2107567 - protein, 18 aa, Staphylococcus
VKILGRLQYRTSYGQNVL

SEQ ID NO: 2107568 - protein, 17 aa, Staphylococcus
VKKAIVGGAKFIAGSYI

SEQ ID NO: 2107569 - protein, 18 aa, Staphylococcus
VKLPENFEYIDDSTVATF

SEQ ID NO: 2107570 - protein, 19 aa, Staphylococcus
VKNSNLWKSQDNGFYDLTR

SEQ ID NO: 2107571 - protein, 25 aa, Staphylococcus
VKQDVQDGGIWRLVKIPDNVNRVKV

SEQ ID NO: 2107572 - protein, 19 aa, Staphylococcus
VKSGESLWSIAQKYNTSVE

SEQ ID NO: 2107573 - protein, 17 aa, Staphylococcus
VLARLIYDLALEMTSTI

SEQ ID NO: 2107574 - protein, 24 aa, Staphylococcus
VLNELKGFKMINGGSVGLVNSELE

SEQ ID NO: 2107575 - protein, 19 aa, Staphylococcus
VLPAVAAKSSFLGHPSESY

SEQ ID NO: 2107576 - protein, 17 aa, Staphylococcus
VMGGIEPTVDWLRDALK

SEQ ID NO: 2107577 - protein, 18 aa, Staphylococcus
VNDYNTGKTFGWVKQGDV

SEQ ID NO: 2107578 - protein, 24 aa, Staphylococcus
VNFVKRGGSVIFISDHYNADRNLN

SEQ ID NO: 2107579 - protein, 17 aa, Staphylococcus
VNIPTHVPLAWGAHRGA

SEQ ID NO: 2107580 - protein, 17 aa, Staphylococcus
VNLRNGDPFTIALFGVD

SEQ ID NO: 2107581 - protein, 18 aa, Staphylococcus
VNNQAWLAAYMLKQNGLT

SEQ ID NO: 2107582 - protein, 20 aa, Staphylococcus
VNRVKVQFLPNNDIMTDTRR

SEQ ID NO: 2107583 - protein, 22 aa, Staphylococcus
VQFLKDRYHAMKDFPMFDNIEY

SEQ ID NO: 2107584 - protein, 20 aa, Staphylococcus
VQKSKLWKSKDNGFNDLTRD

SEQ ID NO: 2107585 - protein, 17 aa, Staphylococcus
VRANILFDGETTPIVKE

SEQ ID NO: 2107586 - protein, 17 aa, Staphylococcus
VRCQFTFKQAEKIESGT

SEQ ID NO: 2107587 - protein, 18 aa, Staphylococcus
VRTIPKQVFVTSRVTPIP

SEQ ID NO: 2107588 - protein, 20 aa, Staphylococcus
VRTLEVFGVQMLQYGDVSLV

SEQ ID NO: 2107589 - protein, 23 aa, Staphylococcus
VSDYNKGTLIGWVHQGDVSYNAA

SEQ ID NO: 2107590 - protein, 23 aa, Staphylococcus
VSDYNSGKVYGWVKQGETVYNTV

SEQ ID NO: 2107591 - protein, 17 aa, Staphylococcus
VSGFRTSLIMYNHTSKK

SEQ ID NO: 2107592 - protein, 17 aa, Staphylococcus
VSKQMKVDGVTWYYGQL

SEQ ID NO: 2107593 - protein, 17 aa, Staphylococcus
VTAWKGGLFGIGVHVLF

SEQ ID NO: 2107594 - protein, 18 aa, Staphylococcus
VTDLKAAIRYYRFNDSSL

SEQ ID NO: 2107595 - protein, 18 aa, Staphylococcus
VTGDHFKGPITGYVNYGF

SEQ ID NO: 2107596 - protein, 22 aa, Staphylococcus
VTKYEGWEFLGLVKDDENAARG

SEQ ID NO: 2107597 - protein, 29 aa, Staphylococcus
VVILLVAALSFSIYAAMTHESKYSNTDSN

SEQ ID NO: 2107598 - protein, 19 aa, Staphylococcus
VVSYPIHFVTGAIGNIFNN

SEQ ID NO: 2107599 - protein, 26 aa, Staphylococcus
VWGFNWKLGPFQLWDLMGFDRVKSRI

SEQ ID NO: 2107600 - protein, 18 aa, Staphylococcus
VWLDPKFDQTFAKEIKDE

SEQ ID NO: 2107601 - protein, 19 aa, Staphylococcus
VYDKVGGKVGSTWGDARNW

SEQ ID NO: 2107602 - protein, 23 aa, Staphylococcus
VYGSVNGLTGWVSKYYLNDVQNK

SEQ ID NO: 2107603 - protein, 17 aa, Staphylococcus
WEISGYPPSLQIEDAVD

SEQ ID NO: 2107604 - protein, 17 aa, Staphylococcus
WFIAFVLSSVCLIGLSS

SEQ ID NO: 2107605 - protein, 17 aa, Staphylococcus
WGQCTWHVFNRRAETGQ

SEQ ID NO: 2107606 - protein, 20 aa, Staphylococcus
WKPGQKIHLIGHSMGGQTVR

SEQ ID NO: 2107607 - protein, 17 aa, Staphylococcus
WLAKNAYKYGFILRYPK

SEQ ID NO: 2107608 - protein, 20 aa, Staphylococcus
WLTVFKDYRGSGEVENHISN

SEQ ID NO: 2107609 - protein, 17 aa, Staphylococcus
WNPAHPGTHQYATDINW

SEQ ID NO: 2107610 - protein, 20 aa, Staphylococcus
WPNKEIKAFSPNSSHGTYDF

SEQ ID NO: 2107611 - protein, 20 aa, Staphylococcus
WYDRSTFKLGSYGSTSSQLN

SEQ ID NO: 2107612 - protein, 19 aa, Staphylococcus
WYTTDRFKDAKVWVSESGR

SEQ ID NO: 2107613 - protein, 20 aa, Staphylococcus
YAKSRYGSWDAAIAFRQGHG

SEQ ID NO: 2107614 - protein, 19 aa, Staphylococcus
YDKVGGKIGSNWGNASNWA

SEQ ID NO: 2107615 - protein, 18 aa, Staphylococcus
YDKVGGKIGSTWGNANNW

SEQ ID NO: 2107616 - protein, 20 aa, Staphylococcus
YDKVGGKISSTWGNANNWAN

SEQ ID NO: 2107617 - protein, 19 aa, Staphylococcus
YDRAVELYYYIKGGTVDYG

SEQ ID NO: 2107618 - protein, 21 aa, Staphylococcus
YFYQIEVVRAYTFDDFARSVN

SEQ ID NO: 2107619 - protein, 17 aa, Staphylococcus
YGFKFASARPMQIGLVY

SEQ ID NO: 2107620 - protein, 22 aa, Staphylococcus
YGFKFKSARPMQIGLVYDALKN

SEQ ID NO: 2107621 - protein, 18 aa, Staphylococcus
YGGQPIKYSNLSSNTTNS

SEQ ID NO: 2107622 - protein, 24 aa, Staphylococcus
YGQYIRPGGFSLPSSDTELRDANG

SEQ ID NO: 2107623 - protein, 22 aa, Staphylococcus
YHFASDGTYFEWQYYPSNGAAD

SEQ ID NO: 2107624 - protein, 17 aa, Staphylococcus
YHNVFGIAAFDANPLYN

SEQ ID NO: 2107625 - protein, 17 aa, Staphylococcus
YHNVFGIGAYDSNPVFD

SEQ ID NO: 2107626 - protein, 20 aa, Staphylococcus
YHYDWKGNWSPQQAQQGNNS

SEQ ID NO: 2107627 - protein, 17 aa, Staphylococcus
YHYDWKGNWSPSQQQGN

SEQ ID NO: 2107628 - protein, 19 aa, Staphylococcus
YHYTWKGNWSPDRLNHSNY

SEQ ID NO: 2107629 - protein, 18 aa, Staphylococcus
YHYTWKGNWSPDRLNSHN

SEQ ID NO: 2107630 - protein, 19 aa, Staphylococcus
YHYTWKGNWSPNQVNHSSQ

SEQ ID NO: 2107631 - protein, 23 aa, Staphylococcus
YIAEKDPSIIFAMDRGQAVSDNA

SEQ ID NO: 2107632 - protein, 21 aa, Staphylococcus
YIAHLPQGASAVWQDNADNWK

SEQ ID NO: 2107633 - protein, 18 aa, Staphylococcus
YKECEEWNIELDTLINRR

SEQ ID NO: 2107634 - protein, 19 aa, Staphylococcus
YKNQCTWYVFKKRASVGKA

SEQ ID NO: 2107635 - protein, 17 aa, Staphylococcus
YKSGKFIGVVIHETANP

SEQ ID NO: 2107636 - protein, 20 aa, Staphylococcus
YKWYDRSTFKPGSYGSSQSG

SEQ ID NO: 2107637 - protein, 19 aa, Staphylococcus
YKYQFLLLDQPQYLPVSAL

SEQ ID NO: 2107638 - protein, 18 aa, Staphylococcus
YLIGDSVSSYKESKYIGK

SEQ ID NO: 2107639 - protein, 25 aa, Staphylococcus
YLYGSVNGVNGWISKSFLTTPSTSN

SEQ ID NO: 2107640 - protein, 17 aa, Staphylococcus
YNDYGIDSLDNGTYSYV

SEQ ID NO: 2107641 - protein, 21 aa, Staphylococcus
YNRNRIGNAIFKHYRKEYEYK

SEQ ID NO: 2107642 - protein, 24 aa, Staphylococcus
YNTYVYKKGMPEFETATSDVPEQK

SEQ ID NO: 2107643 - protein, 19 aa, Staphylococcus
YPQGQCTWYVDQRMKQFGQ

SEQ ID NO: 2107644 - protein, 21 aa, Staphylococcus
YPQGQCTWYVYERVQQFGKKV

SEQ ID NO: 2107645 - protein, 22 aa, Staphylococcus
YQASGNVLVLGRSRGTDVNDHG

SEQ ID NO: 2107646 - protein, 20 aa, Staphylococcus
YQVVNGVKWYYGQFSDGQFA

SEQ ID NO: 2107647 - protein, 17 aa, Staphylococcus
YRFHLKKGVKFSDGSDF

SEQ ID NO: 2107648 - protein, 19 aa, Staphylococcus
YRNGVGRPEGIVVHDTANE

SEQ ID NO: 2107649 - protein, 17 aa, Staphylococcus
YRTTFSLLYRLYDKLLT

SEQ ID NO: 2107650 - protein, 17 aa, Staphylococcus
YSRPKDIINMIGYKARN

SEQ ID NO: 2107651 - protein, 22 aa, Staphylococcus
YTAGQCTWYVFDRVDGKIGSTW

SEQ ID NO: 2107652 - protein, 30 aa, Staphylococcus
YTAGQCTWYVYDRVGGKIGSTWGNANNWAS

SEQ ID NO: 2107653 - protein, 17 aa, Staphylococcus
YTAGQCTYYVYDKVGGK

SEQ ID NO: 2107654 - protein, 24 aa, Staphylococcus
YTIGPDLRKYFSLSNGQDIPNNSF

SEQ ID NO: 2107655 - protein, 46 aa, Staphylococcus
YVTTKRLKDGYEWTIKFNQSHRMHEHMVFWFGLPDPQVPVGPVRFT

SEQ ID NO: 2107656 - protein, 21 aa, Staphylococcus
YVYDRVGGKVGSTWGNANNWA

SEQ ID NO: 2107657 - protein, 20 aa, Staphylococcus
YYAKVWLTVFKDYRGSGEVE

SEQ ID NO: 2107658 - protein, 21 aa, Staphylococcus
YYGKWGYDMQQFFKLVTYHYN

SEQ ID NO: 2107659 - protein, 21 aa, Staphylococcus
YYGRWGYDMHQMFDLIKYYYD

SEQ ID NO: 2107660 - protein, 25 aa, Staphylococcus
YYKNSLDFFKPAPFKEQKNSTPSLW

SEQ ID NO: 2107661 - protein, 23 aa, Staphylococcus
YYVCTSKDMKHCQVYDYIFLTIG

SEQ ID NO: 2107662 - protein, 23 aa, Staphylococcus
YYVFDRVGGKIGSTWGNANNWAS

SEQ ID NO: 2107663 - protein, 23 aa, Staphylococcus
YYVYDRVGGKIGSTWGNANNWAN

SEQ ID NO: 2107664 - protein, 25 aa, Staphylococcus
DVEPTSIISILVAAADALSAARPGA

SEQ ID NO: 2107665 - protein, 18 aa, Staphylococcus
FLLDLMLNNKSGDTLIKD

SEQ ID NO: 2107666 - protein, 32 aa, Staphylococcus; identical to SEQ ID NO: 1719958

SEQ ID NO: 2107667 - protein, 19 aa, Staphylococcus
KENKKFLLDLMLNNKSGDT

SEQ ID NO: 2107668 - protein, 20 aa, Staphylococcus
KGQSEPIVLVIFTNKDNKSD

SEQ ID NO: 2107669 - protein, 22 aa, Staphylococcus
LSGFDPIRREIARTALVNLVSD

SEQ ID NO: 2107670 - protein, 27 aa, Staphylococcus
MKSKKVDVGFLPPTAYTLAHDQKAADL

SEQ ID NO: 2107671 - protein, 23 aa, Staphylococcus
RFGGTLYHRTAFAGATTGQQLLY

SEQ ID NO: 2107672 - protein, 21 aa, Staphylococcus
TGDDPRKVPMKIFPAVHYSMG

SEQ ID NO: 2107673 - protein, 32 aa, Staphylococcus; identical to SEQ ID NO: 1720038

SEQ ID NO: 2107674 - protein, 24 aa, Staphylococcus
DGMALLFRHFYATSLHNQFMYNSK

SEQ ID NO: 2107675 - protein, 21 aa, Staphylococcus
EEVGKLVAFLASDDSSFITGE

SEQ ID NO: 2107676 - protein, 28 aa, Staphylococcus
GEKLGADPMTFLGLGGIGDLIVTCTSTH

SEQ ID NO: 2107677 - protein, 18 aa, Staphylococcus
IVLVIFTNKDNKSDKPND

SEQ ID NO: 2107678 - protein, 21 aa, Staphylococcus
NVPYFGICLGMQLATVEFARN

SEQ ID NO: 2107679 - protein, 25 aa, Staphylococcus
PAEQGRFLKFFVDEGLIKIKKGVKI

SEQ ID NO: 2107680 - protein, 20 aa, Staphylococcus
TAKELLATTVQRLAADHTTE

SEQ ID NO: 2107681 - protein, 20 aa, Staphylococcus
VMYVHCTLLPYIKAAGEMKT

SEQ ID NO: 2107682 - protein, 19 aa, Staphylococcus
YARENNVPYFGICLGMQLA

SEQ ID NO: 2107683 - protein, 26 aa, Staphylococcus
AAGKYQFLQSTWDSVAPSEYQGVSPT

SEQ ID NO: 2107684 - protein, 25 aa, Staphylococcus
AALEDYAKLIRYGIDGNNNIYQGSW

SEQ ID NO: 2107685 - protein, 17 aa, Staphylococcus
AIAQRESGGDLKAVNPS

SEQ ID NO: 2107686 - protein, 18 aa, Staphylococcus
AKELLATTVQRLAAEHTS

SEQ ID NO: 2107687 - protein, 18 aa, Staphylococcus
CVITVTALSQLISTPLSS

SEQ ID NO: 2107688 - protein, 23 aa, Staphylococcus
DAKGKPKTWIADRKLKGLVFQSK

SEQ ID NO: 2107689 - protein, 24 aa, Staphylococcus
DEMKPFYKQLNMKGYYYDYDSLDG

SEQ ID NO: 2107690 - protein, 21 aa, Staphylococcus
DEVGKLVTFLASDDSSFITGE

SEQ ID NO: 2107691 - protein, 19 aa, Staphylococcus
DFIVYYLDNSGRPEMKVLN

SEQ ID NO: 2107692 - protein, 23 aa, Staphylococcus
DGTYFVHMGINRKPGDPGRKVVG

SEQ ID NO: 2107693 - protein, 18 aa, Staphylococcus
DITACTWTSKKWPFTTPE

SEQ ID NO: 2107694 - protein, 23 aa, Staphylococcus
DKIDPHAWLSLDNGIQYVKNIQE

SEQ ID NO: 2107695 - protein, 22 aa, Staphylococcus
DNYRTILPFKESQARGLLQDNM

SEQ ID NO: 2107696 - protein, 27 aa, Staphylococcus
EKLGADPMTFLGLGGIGDLIVTCTSTH

SEQ ID NO: 2107697 - protein, 22 aa, Staphylococcus
EKLKDERIVGTAGGGMVAVTVT

SEQ ID NO: 2107698 - protein, 17 aa, Staphylococcus
ESKHLGGFPISGQFIAC

SEQ ID NO: 2107699 - protein, 17 aa, Staphylococcus
FKFKDTTKLMGKALGKE

SEQ ID NO: 2107700 - protein, 24 aa, Staphylococcus
FKPGQLNADRYYGHVAFVEKVNSD

SEQ ID NO: 2107701 - protein, 23 aa, Staphylococcus
FLGLLATLALAIVLSACGNSGSG

SEQ ID NO: 2107702 - protein, 19 aa, Staphylococcus
FNETSWDSMFAGLDAKRFD

SEQ ID NO: 2107703 - protein, 24 aa, Staphylococcus
GAFKYFSKAFDIKPGYIWEINTEK

SEQ ID NO: 2107704 - protein, 21 aa, Staphylococcus
GEEMPILDEAFFNKSYDDNQG

SEQ ID NO: 2107705 - protein, 24 aa, Staphylococcus
GERTLLFGPFASVGPKFLKNGSNL

SEQ ID NO: 2107706 - protein, 18 aa, Staphylococcus
GLLDFRRFGGTLYHRTAF

SEQ ID NO: 2107707 - protein, 28 aa, Staphylococcus
GSNYDRAVELYYYIKGGTVDYGAAHAAK

SEQ ID NO: 2107708 - protein, 26 aa, Staphylococcus
HNMHPDLVKILGRLNYRTSYGQNVLK

SEQ ID NO: 2107709 - protein, 17 aa, Staphylococcus
IILRLPHGMPDEVKKMF

SEQ ID NO: 2107710 - protein, 17 aa, Staphylococcus
ILIGAIVGGAATLADKS

SEQ ID NO: 2107711 - protein, 21 aa, Staphylococcus
ILLGIILGVVVGYVVARNLLH

SEQ ID NO: 2107712 - protein, 21 aa, Staphylococcus
ILLLVLLLVFVTACGKDEDEE

SEQ ID NO: 2107713 - protein, 24 aa, Staphylococcus
KDIVIKHILVRDKSKKRPLNISQY

SEQ ID NO: 2107714 - protein, 19 aa, Staphylococcus
KIAAIKYARENNVPYFGIC

SEQ ID NO: 2107715 - protein, 24 aa, Staphylococcus
KKHPKVLILMGVPGSYLVATDKSY

SEQ ID NO: 2107716 - protein, 31 aa, Staphylococcus
KNFYPQGQCTWYVYNRLQQFNLYVDGSMGNG

SEQ ID NO: 2107717 - protein, 21 aa, Staphylococcus
KRGFRGAGSYWADHLGLTDVD

SEQ ID NO: 2107718 - protein, 17 aa, Staphylococcus
LDKLDIPIVGKPTTYKT

SEQ ID NO: 2107719 - protein, 26 aa, Staphylococcus
LEKNDKGFFLMVEGASIDKSGHPNDI

SEQ ID NO: 2107720 - protein, 26 aa, Staphylococcus
LGHAIWTARQFIGNEPFAVLLGDDIV

SEQ ID NO: 2107721 - protein, 22 aa, Staphylococcus
NDIWKHFKAVKEDRVYDLEEIP

SEQ ID NO: 2107722 - protein, 19 aa, Staphylococcus
NSHLQAIAQRESGGDLKAV

SEQ ID NO: 2107723 - protein, 29 aa, Staphylococcus
NTDYSFQSDGQYWTWSYGQGSTNAPAQET

SEQ ID NO: 2107724 - protein, 20 aa, Staphylococcus
NVPYFGICLGMQLATVEFAR

SEQ ID NO: 2107725 - protein, 24 aa, Staphylococcus
PDDIEMLQDLVLAATNEAMNKADE

SEQ ID NO: 2107726 - protein, 18 aa, Staphylococcus
QFIEPGDGYLACGYVAKG

SEQ ID NO: 2107727 - protein, 21 aa, Staphylococcus
QGNAYRIVPTTVALTMTLDKL

SEQ ID NO: 2107728 - protein, 33 aa, Staphylococcus; identical to SEQ ID NO: 2082439

SEQ ID NO: 2107729 - protein, 23 aa, Staphylococcus
SARPMQIGLVYDALKNKKLDVAV

SEQ ID NO: 2107730 - protein, 18 aa, Staphylococcus
SIRKLSVGASSIIVASML

SEQ ID NO: 2107731 - protein, 20 aa, Staphylococcus
SLAILLMLLTGCSQSSKHTK

SEQ ID NO: 2107732 - protein, 17 aa, Staphylococcus
SLHNISISNLKILEVRE

SEQ ID NO: 2107733 - protein, 20 aa, Staphylococcus
TGDDPRKVPMKIFPAVHYSM

SEQ ID NO: 2107734 - protein, 27 aa, Staphylococcus
TKAMPKEMLPILDKPTIQYIVEEAARA

SEQ ID NO: 2107735 - protein, 24 aa, Staphylococcus
TLDITPKLMLQGSVDLLNEVSTSK

SEQ ID NO: 2107736 - protein, 23 aa, Staphylococcus
TPRSLVIAEVLKKAGYDVTTTPV

SEQ ID NO: 2107737 - protein, 33 aa, Staphylococcus
TRLVIVMLILCGLLFPLTVTAVGQIIFPHQANG

SEQ ID NO: 2107738 - protein, 21 aa, Staphylococcus
TVKSFLPKFDKGEELEIALDE

SEQ ID NO: 2107739 - protein, 26 aa, Staphylococcus
VTENQSMKYIPLGPLNTVKGKYQMEM

SEQ ID NO: 2107740 - protein, 25 aa, Staphylococcus
VVSDLLNVALFFESNLHTLPPHFEL

SEQ ID NO: 2107741 - protein, 20 aa, Staphylococcus
WTQKPKYNYLKKALKDTTIV

SEQ ID NO: 2107742 - protein, 18 aa, Staphylococcus
YGHVAYVESVGSNGSVTV

SEQ ID NO: 2107743 - protein, 24 aa, Staphylococcus
AAAIYEMIDAILKDKCRVLAAITY

SEQ ID NO: 2107744 - protein, 24 aa, Staphylococcus
AAFMKKVIDTRAVFKMGGVGLAFK

SEQ ID NO: 2107745 - protein, 26 aa, Staphylococcus
AAGKYQFLQTTWDSVAPAEYQGKPAS

SEQ ID NO: 2107746 - protein, 27 aa, Staphylococcus
AAGQREFTYNGKIIQALDLVETSRGYG

SEQ ID NO: 2107747 - protein, 17 aa, Staphylococcus
AAIICLIIIVVACSQKK

SEQ ID NO: 2107748 - protein, 25 aa, Staphylococcus
AAITPYYTYHGYAGYNPSFLLTHEF

SEQ ID NO: 2107749 - protein, 25 aa, Staphylococcus
AAKALGYKIKLIGKGTYNNGKVNAS

SEQ ID NO: 2107750 - protein, 28 aa, Staphylococcus
AAKKYGINEIYLISHALIETGNGTSDLA

SEQ ID NO: 2107751 - protein, 26 aa, Staphylococcus
AANFTDIYLMALPTKAMREVTSEIDS

SEQ ID NO: 2107752 - protein, 23 aa, Staphylococcus
AAQNVLINLGFKQVYNLSGGNKN

SEQ ID NO: 2107753 - protein, 19 aa, Staphylococcus
AARKVVITSYLSFNQVINL

SEQ ID NO: 2107754 - protein, 18 aa, Staphylococcus
AAVASLSLFLTGCSGNND

SEQ ID NO: 2107755 - protein, 26 aa, Staphylococcus
AAVIVTALLITGIAVSGVIAYQKYMK

SEQ ID NO: 2107756 - protein, 18 aa, Staphylococcus
ADDMITSTLLATTAPKFA

SEQ ID NO: 2107757 - protein, 20 aa, Staphylococcus
ADGFNIMPPLNPTQFDLFVD

SEQ ID NO: 2107758 - protein, 19 aa, Staphylococcus
ADKLGTRKIVKDAMNRIGR

SEQ ID NO: 2107759 - protein, 27 aa, Staphylococcus
ADKSRFFGLHFFNPPRIMKLVEVIPTE

SEQ ID NO: 2107760 - protein, 26 aa, Staphylococcus
ADNGPVLGHNYWGGNRIKLTQELRAK

SEQ ID NO: 2107761 - protein, 25 aa, Staphylococcus
ADPESIRFDPLYKQIMYTSEGDRSL

SEQ ID NO: 2107762 - protein, 24 aa, Staphylococcus
ADQLGFKIKLIGKGTYENGHVHAS

SEQ ID NO: 2107763 - protein, 24 aa, Staphylococcus
ADQLGYKIKLIGKGTYENGQVQAS

SEQ ID NO: 2107764 - protein, 22 aa, Staphylococcus
ADSAAGYIYPLADLQREHIPKS

SEQ ID NO: 2107765 - protein, 56 aa, Staphylococcus
ADVQNLTINVTYPGVATPVQVPVSLYVYQFDFSPNAYTTTLGTTFARGIEASQYQH

SEQ ID NO: 2107766 - protein, 17 aa, Staphylococcus
ADWVIDGGFSDYADSMK

SEQ ID NO: 2107767 - protein, 24 aa, Staphylococcus
ADYAATQLQYYGLTPNSAENDGQG

SEQ ID NO: 2107768 - protein, 24 aa, Staphylococcus
ADYQFINMAFLGKDSIIGARAGHA

SEQ ID NO: 2107769 - protein, 18 aa, Staphylococcus
AEDEVVNGIIWSEVLERP

SEQ ID NO: 2107770 - protein, 26 aa, Staphylococcus
AEENMPLQIDAPKKNPMLADMQQSAL

SEQ ID NO: 2107771 - protein, 23 aa, Staphylococcus
AEIDSLLHQLQNTLINRVDAAQE

SEQ ID NO: 2107772 - protein, 18 aa, Staphylococcus
AEKIKDLLKPTLAKFIFT

SEQ ID NO: 2107773 - protein, 25 aa, Staphylococcus
AEKNMPLQIDAPQQNPLLADMEESA

SEQ ID NO: 2107774 - protein, 26 aa, Staphylococcus
AEYNLNPLQLIDIKAFMGDSADGYPG

SEQ ID NO: 2107775 - protein, 18 aa, Staphylococcus
AFFLVTSTALTGCGNKES

SEQ ID NO: 2107776 - protein, 17 aa, Staphylococcus
AFGTFMKFVLEDKGKSA

SEQ ID NO: 2107777 - protein, 17 aa, Staphylococcus
AFGTLLSASASVAPVIN

SEQ ID NO: 2107778 - protein, 17 aa, Staphylococcus
AFKYFSKQYGITPGYIW

SEQ ID NO: 2107779 - protein, 24 aa, Staphylococcus
AGAGGLKIIKVFKSSGKVTFEDND

SEQ ID NO: 2107780 - protein, 26 aa, Staphylococcus
AGEGQSLPAMWRTAGGIDSSRASNFV

SEQ ID NO: 2107781 - protein, 25 aa, Staphylococcus
AGKYQFLQSTWDSVAPDEYKGVSPA

SEQ ID NO: 2107782 - protein, 23 aa, Staphylococcus
AGKYQFMQSTWDHVAPSEYKGVS

SEQ ID NO: 2107783 - protein, 32 aa, Staphylococcus
AGNHASFVLNQLFINSLKYDTFRMNGIKIPYT

SEQ ID NO: 2107784 - protein, 37 aa, Staphylococcus
AGNKNIIFKGFLGTNIVKFFDYTLASVGIKVEELTHF

SEQ ID NO: 2107785 - protein, 24 aa, Staphylococcus
AGRQTFFNDMLTILHARNSFSSIE

SEQ ID NO: 2107786 - protein, 25 aa, Staphylococcus
AGVATGLGVALMNRDKKDSSLNTAR

SEQ ID NO: 2107787 - protein, 22 aa, Staphylococcus
AGYIPVNEYFQTNYRNVYAIGD

SEQ ID NO: 2107788 - protein, 23 aa, Staphylococcus
AHDAYAKAYKKALNKEKELFTFL

SEQ ID NO: 2107789 - protein, 32 aa, Staphylococcus
AHHLTLDELYAFNPGVKPLIHPGDLIAVSDKG

SEQ ID NO: 2107790 - protein, 34 aa, Staphylococcus
AHTYSHLYNLPTTGLRFFTVYGPWGRPDMALFKF

SEQ ID NO: 2107791 - protein, 18 aa, Staphylococcus
AHVFYHPVITEPKVAFTQ

SEQ ID NO: 2107792 - protein, 17 aa, Staphylococcus
AIAPKEYLTFQKNIYAH

SEQ ID NO: 2107793 - protein, 28 aa, Staphylococcus
AIDGLNLYDFKYKLKPFLDPSKVYSETD

SEQ ID NO: 2107794 - protein, 25 aa, Staphylococcus
AIDGSKYFIKLWANGLDLTDWRVSP

SEQ ID NO: 2107795 - protein, 20 aa, Staphylococcus
AIEMYYSLQNYYDTRIDTIE

SEQ ID NO: 2107796 - protein, 25 aa, Staphylococcus
AIHIAFHEYLLPNLKLTPQVKDLPY

SEQ ID NO: 2107797 - protein, 21 aa, Staphylococcus
AIKNVPLIKYSIDQVIMTKEG

SEQ ID NO: 2107798 - protein, 22 aa, Staphylococcus
AILFTIIVLLSACGKNSTSESS

SEQ ID NO: 2107799 - protein, 20 aa, Staphylococcus
AILSSALVLTACGQSEDHSK

SEQ ID NO: 2107800 - protein, 22 aa, Staphylococcus
AILTIIFIYGCSKQPSSIKAKQ

SEQ ID NO: 2107801 - protein, 18 aa, Staphylococcus
AILWMLSSDKKVTAKQIS

SEQ ID NO: 2107802 - protein, 18 aa, Staphylococcus
AIMGRYVLTPDIFDYLAT

SEQ ID NO: 2107803 - protein, 18 aa, Staphylococcus
AIMGRYVLTPEIFDYLKT

SEQ ID NO: 2107804 - protein, 26 aa, Staphylococcus
AINFSDTYLIALPTKAIREVIKNIDS

SEQ ID NO: 2107805 - protein, 27 aa, Staphylococcus
AIPTNDWDWYIYPQGLYDMILRIKNDY

SEQ ID NO: 2107806 - protein, 26 aa, Staphylococcus
AIQFSDVFLMALPTKAMREVAGEIDQ

SEQ ID NO: 2107807 - protein, 17 aa, Staphylococcus
AISPRPAFILKSSKHKD

SEQ ID NO: 2107808 - protein, 17 aa, Staphylococcus
AISPRPAFILKSSKHKE

SEQ ID NO: 2107809 - protein, 17 aa, Staphylococcus
AISVIISIISAMGDKSH

SEQ ID NO: 2107810 - protein, 20 aa, Staphylococcus
AIVLLSLLLVLSACGSKKSD

SEQ ID NO: 2107811 - protein, 20 aa, Staphylococcus
AIVNFVKRGGSVIFISDHYN

SEQ ID NO: 2107812 - protein, 17 aa, Staphylococcus
AIVVITIVTLSACDKER

SEQ ID NO: 2107813 - protein, 18 aa, Staphylococcus
AIYSARQFIGDEPFAVLL

SEQ ID NO: 2107814 - protein, 26 aa, Staphylococcus
AKAEDLFHLDLAYAPPFSTTKDPVIY

SEQ ID NO: 2107815 - protein, 24 aa, Staphylococcus
AKAKPEVIFTSFRQAHTKTLDEIK

SEQ ID NO: 2107816 - protein, 25 aa, Staphylococcus
AKAKPLEKLLSKKLGIPVKVSVSTN

SEQ ID NO: 2107817 - protein, 37 aa, Staphylococcus
AKDDEYKYQFLLLDQPQYLPVSALNKLLEGKGVLEGQ

SEQ ID NO: 2107818 - protein, 23 aa, Staphylococcus
AKDNIKDSKLGKKSKDKSSKSKD

SEQ ID NO: 2107819 - protein, 24 aa, Staphylococcus
AKELGYKIKLIGKGTYENGNIEAS

SEQ ID NO: 2107820 - protein, 28 aa, Staphylococcus
AKKHLFENAYYILVFNQDANKQAAEKIK

SEQ ID NO: 2107821 - protein, 30 aa, Staphylococcus
AKNVEKLGIYVPAAYFKGKKNHNGTYTVTV

SEQ ID NO: 2107822 - protein, 27 aa, Staphylococcus
AKPIVKITLGLITASISLGTISVVTQQ

SEQ ID NO: 2107823 - protein, 27 aa, Staphylococcus
AKQYGLNEIYLISHALLETGNGQSQLA

SEQ ID NO: 2107824 - protein, 24 aa, Staphylococcus
AKSKPDLILASFRQAHTKTLDEMK

SEQ ID NO: 2107825 - protein, 26 aa, Staphylococcus
ALAQSPHYNLFGIKGSYQGKSADFNT

SEQ ID NO: 2107826 - protein, 18 aa, Staphylococcus
ALDKIKQPHLIGPVHFER

SEQ ID NO: 2107827 - protein, 31 aa, Staphylococcus
ALDKYTVQIKLNKPLPYFNQMLAFGTYMPQN

SEQ ID NO: 2107828 - protein, 19 aa, Staphylococcus
ALEILENLYHRGLDVTLIH

SEQ ID NO: 2107829 - protein, 24 aa, Staphylococcus
ALGSGFGAMLYRQGYDVTLIDGWE

SEQ ID NO: 2107830 - protein, 23 aa, Staphylococcus
ALHPLQLIDIKAFMGDSADGYPG

SEQ ID NO: 2107831 - protein, 21 aa, Staphylococcus
ALILFLGIREKKRHTHRLNKI

SEQ ID NO: 2107832 - protein, 17 aa, Staphylococcus
ALIQDLFMNDYLRVYTN

SEQ ID NO: 2107833 - protein, 23 aa, Staphylococcus
ALKEHLEFFSIFTKDIVDINAIR

SEQ ID NO: 2107834 - protein, 21 aa, Staphylococcus
ALKKRGAHVTLITGPTQLADP

SEQ ID NO: 2107835 - protein, 20 aa, Staphylococcus
ALKLLEAAGLIKLKDNFGLS

SEQ ID NO: 2107836 - protein, 22 aa, Staphylococcus
ALLPILILVALPVSLAIKSEDR

SEQ ID NO: 2107837 - protein, 18 aa, Staphylococcus
ALMAQAPILPAAYVGPKK

SEQ ID NO: 2107838 - protein, 19 aa, Staphylococcus
ALMLGIAALVLSGCSQGGG

SEQ ID NO: 2107839 - protein, 27 aa, Staphylococcus
ALNDARQHLVPDKAPLEAAKQALQQSI

SEQ ID NO: 2107840 - protein, 21 aa, Staphylococcus
ALRSKKVDVAFISPVSYTIAH

SEQ ID NO: 2107841 - protein, 23 aa, Staphylococcus
ALTDADIVFYNGLNLETGNGWFD

SEQ ID NO: 2107842 - protein, 20 aa, Staphylococcus
ALTEFEVAYAPPYSHPKDLI

SEQ ID NO: 2107843 - protein, 18 aa, Staphylococcus
ALVAICLVLAGCSNSDSG

SEQ ID NO: 2107844 - protein, 18 aa, Staphylococcus
AMITSEGAFKYFAKQYDV

SEQ ID NO: 2107845 - protein, 20 aa, Staphylococcus
AMLIAGIFLLAACDKEQSKT

SEQ ID NO: 2107846 - protein, 19 aa, Staphylococcus
AMLVLCLVLAGCSNSSNSS

SEQ ID NO: 2107847 - protein, 18 aa, Staphylococcus
AMMTSEGAFKYFAKQFKV

SEQ ID NO: 2107848 - protein, 24 aa, Staphylococcus
AMNLNKEALLKAKPDLILAHESQK

SEQ ID NO: 2107849 - protein, 25 aa, Staphylococcus
ANAIVKCNLWLRTADRLKIVVGRFN

SEQ ID NO: 2107850 - protein, 25 aa, Staphylococcus
ANCLQAYPFEAALQRYDKIRVDHTK

SEQ ID NO: 2107851 - protein, 25 aa, Staphylococcus
ANGNKYLLMPYFSGYIFGRSVKDGI

SEQ ID NO: 2107852 - protein, 42 aa, Staphylococcus
ANGQSENVRFLVSVRPDPPRIDSNTVLYKAGLTNQEVNVSNV

SEQ ID NO: 2107853 - protein, 19 aa, Staphylococcus
ANIYVYENGKYVVLAYKPL

SEQ ID NO: 2107854 - protein, 20 aa, Staphylococcus
ANNLSGYLITPNQKLKIPNG

SEQ ID NO: 2107855 - protein, 23 aa, Staphylococcus
ANNVKRLIFVTSIGIYNEVPGNF

SEQ ID NO: 2107856 - protein, 23 aa, Staphylococcus
ANPKYISFDMARDGSRKPYTFHA

SEQ ID NO: 2107857 - protein, 21 aa, Staphylococcus
ANQALMQLPHLNDAQRHDLET

SEQ ID NO: 2107858 - protein, 22 aa, Staphylococcus
ANTSFNIVLNKILADKYKDKVD

SEQ ID NO: 2107859 - protein, 24 aa, Staphylococcus
ANVDVVFDILKHSGLNPLKSENLQ

SEQ ID NO: 2107860 - protein, 21 aa, Staphylococcus
APAIIALTIAGTAITTHQAFA

SEQ ID NO: 2107861 - protein, 22 aa, Staphylococcus
APDAIIIVLTNPVDAMTYSALV

SEQ ID NO: 2107862 - protein, 26 aa, Staphylococcus
APENGKVLKVYLKFKNNNKDQVLVDS

SEQ ID NO: 2107863 - protein, 26 aa, Staphylococcus
APIKETLAAALIRLANWNGNTPLIDP

SEQ ID NO: 2107864 - protein, 27 aa, Staphylococcus
APIKETLAASLIKLANWTGQTPLIDPF

SEQ ID NO: 2107865 - protein, 29 aa, Staphylococcus
APIKETLAASLIRLANWKGDSPLIDPFCG

SEQ ID NO: 2107866 - protein, 26 aa, Staphylococcus
APIKETLAASLIRLANWTGDTPLVDP

SEQ ID NO: 2107867 - protein, 22 aa, Staphylococcus
APNYNLFGMKGSYKGASVNFNT

SEQ ID NO: 2107868 - protein, 22 aa, Staphylococcus
APPEELIPQFDYVKEISDQFGF

SEQ ID NO: 2107869 - protein, 22 aa, Staphylococcus
APPEELIPQFDYVKEISEQFGF

SEQ ID NO: 2107870 - protein, 22 aa, Staphylococcus
APPNELIPQFDYVKEIATQFGF

SEQ ID NO: 2107871 - protein, 19 aa, Staphylococcus
APQFFGIISDYLKSSGLTD

SEQ ID NO: 2107872 - protein, 20 aa, Staphylococcus
APSNMKFYATQPAKGSFSTL

SEQ ID NO: 2107873 - protein, 19 aa, Staphylococcus
APYYATRSHYRNMSPSSVR

SEQ ID NO: 2107874 - protein, 27 aa, Staphylococcus
AQAGKPISTYWSDAKYWATGAANDGYQ

SEQ ID NO: 2107875 - protein, 17 aa, Staphylococcus
AQAKPEVIFISGRTANQ

SEQ ID NO: 2107876 - protein, 22 aa, Staphylococcus
AQAPNYNLFGIKGSYKGQSVNF

SEQ ID NO: 2107877 - protein, 26 aa, Staphylococcus
AQEFVTPLAFQAISRNPVYTSTFVEE

SEQ ID NO: 2107878 - protein, 24 aa, Staphylococcus
AQENFKKKFQAYAKAMNTVNKEKQ

SEQ ID NO: 2107879 - protein, 22 aa, Staphylococcus
AQGFDVPMPVYSAVYQSLVKYG

SEQ ID NO: 2107880 - protein, 19 aa, Staphylococcus
AQIGKGISTYWWNANNWDD

SEQ ID NO: 2107881 - protein, 19 aa, Staphylococcus
AQIGKGISTYWWNANNWDN

SEQ ID NO: 2107882 - protein, 20 aa, Staphylococcus
AQIGKGISTYWWNANNWDTA

SEQ ID NO: 2107883 - protein, 28 aa, Staphylococcus
AQYKNQDPIILVHGFNGFTDDINPSVLA

SEQ ID NO: 2107884 - protein, 18 aa, Staphylococcus
ARENNIPFFGICLGMQLA

SEQ ID NO: 2107885 - protein, 18 aa, Staphylococcus
ARENNIPYFGICLGMQLA

SEQ ID NO: 2107886 - protein, 17 aa, Staphylococcus
ARENNVPYFGICLGMQL

SEQ ID NO: 2107887 - protein, 29 aa, Staphylococcus
ARKKGANWIILNLHKPMYSKSYHALSDED

SEQ ID NO: 2107888 - protein, 27 aa, Staphylococcus
ARKNAIEMYYNLLNYYDTRETTIEIEK

SEQ ID NO: 2107889 - protein, 26 aa, Staphylococcus
ARKNAIEMYYNLLNYYETRETTIKIE

SEQ ID NO: 2107890 - protein, 25 aa, Staphylococcus
ARKNAIEMYYSLQNYYETRVETIDI

SEQ ID NO: 2107891 - protein, 23 aa, Staphylococcus
ARKYFLERTFRKPSDFYNLTSLV

SEQ ID NO: 2107892 - protein, 25 aa, Staphylococcus
ARMNNLPKYNYKSGKFIGVVIHETA

SEQ ID NO: 2107893 - protein, 27 aa, Staphylococcus
ARQTLNELNQLIAGQPTVADIKAKVAQ

SEQ ID NO: 2107894 - protein, 26 aa, Staphylococcus
ARSPISTYWSDAKYWTYNAASDGYIV

SEQ ID NO: 2107895 - protein, 20 aa, Staphylococcus
ARTGRPIEIFVGFNVSDAYH

SEQ ID NO: 2107896 - protein, 24 aa, Staphylococcus
ARTNLTLDRQPTLTTLQNATSLND

SEQ ID NO: 2107897 - protein, 18 aa, Staphylococcus
ASAEYYQQITKAIDMYNK

SEQ ID NO: 2107898 - protein, 18 aa, Staphylococcus
ASATLALLLSGCGHSDNK

SEQ ID NO: 2107899 - protein, 24 aa, Staphylococcus
ASDANLYDWGQCTWHVFNRRAETG

SEQ ID NO: 2107900 - protein, 25 aa, Staphylococcus
ASEYALNLVYKLTQEILAVATIDGV

SEQ ID NO: 2107901 - protein, 24 aa, Staphylococcus
ASGGNFVLSQSFYNGLKADNLEFN

SEQ ID NO: 2107902 - protein, 31 aa, Staphylococcus
ASGKYQFLQSTWDSVAPAEYKGQPASSAPEH

SEQ ID NO: 2107903 - protein, 22 aa, Staphylococcus
ASIFYSLGILTSDSFLSKNQKG

SEQ ID NO: 2107904 - protein, 20 aa, Staphylococcus
ASKKMDVAIMSPVTYTIGRD

SEQ ID NO: 2107905 - protein, 21 aa, Staphylococcus
ASLASLVIGTGLFASTAQASE

SEQ ID NO: 2107906 - protein, 18 aa, Staphylococcus
ASLGRLLKDRGLSVTIQK

SEQ ID NO: 2107907 - protein, 24 aa, Staphylococcus
ASLSKMMTLYLTLEAVHQGKLKLD

SEQ ID NO: 2107908 - protein, 24 aa, Staphylococcus
ASMSKMMTLYLTYEAIENGKLKLN

SEQ ID NO: 2107909 - protein, 18 aa, Staphylococcus
ASMVMVLSMTMYCPGNAE

SEQ ID NO: 2107910 - protein, 36 aa, Staphylococcus
ASMYSYLTVPRGDTGYFFNTAYLPKGANNKGNYNNK

SEQ ID NO: 2107911 - protein, 18 aa, Staphylococcus
ASSVLIASTLLSASPDTY

SEQ ID NO: 2107912 - protein, 23 aa, Staphylococcus
ASTSFSIALNKILADKYKDKVDT

SEQ ID NO: 2107913 - protein, 19 aa, Staphylococcus
ASTTLAFGTLLGVSSAVLP

SEQ ID NO: 2107914 - protein, 17 aa, Staphylococcus
ASVTLAFGTMLGVSTTV

SEQ ID NO: 2107915 - protein, 18 aa, Staphylococcus
ATAGIATFGIMQHDADAA

SEQ ID NO: 2107916 - protein, 18 aa, Staphylococcus
ATAPYYSFTGYAGNHASF

SEQ ID NO: 2107917 - protein, 26 aa, Staphylococcus
ATATIVTSLLMGPVYFTIESGKANAE

SEQ ID NO: 2107918 - protein, 33 aa, Staphylococcus
ATDINWANLNAKSLKYLYDQINSVGKYFEIPVF

SEQ ID NO: 2107919 - protein, 21 aa, Staphylococcus
ATGLKPNTKYYYKVGSLQGGQ

SEQ ID NO: 2107920 - protein, 21 aa, Staphylococcus
ATIILIISILTLSSCSQNKGM

SEQ ID NO: 2107921 - protein, 19 aa, Staphylococcus
ATITLSMLSVSTPALASGD

SEQ ID NO: 2107922 - protein, 18 aa, Staphylococcus
ATNKSAPYYATRSHYRNM

SEQ ID NO: 2107923 - protein, 26 aa, Staphylococcus
ATSGINEIYLIAHALIETGNGQSQLA

SEQ ID NO: 2107924 - protein, 26 aa, Staphylococcus
AVAFADIYLMALPTKAMREVAQTIDS

SEQ ID NO: 2107925 - protein, 19 aa, Staphylococcus
AVATLLLSASGVVKAAENK

SEQ ID NO: 2107926 - protein, 32 aa, Staphylococcus; identical to SEQ ID NO: 1842541

SEQ ID NO: 2107927 - protein, 32 aa, Staphylococcus
AVDMRGTFLVTKFLLPLMMEQGGSIINTASFS

SEQ ID NO: 2107928 - protein, 17 aa, Staphylococcus
AVFVLTIALAACGKGDS

SEQ ID NO: 2107929 - protein, 22 aa, Staphylococcus
AVGLMLVLVLVATCGSNGSNNS

SEQ ID NO: 2107930 - protein, 17 aa, Staphylococcus
AVIASTVLVAGCTTDKG

SEQ ID NO: 2107931 - protein, 20 aa, Staphylococcus
AVLSMLFHMQQEQGLWYVKG

SEQ ID NO: 2107932 - protein, 19 aa, Staphylococcus
AVLVLSVVALSACSKEQTK

SEQ ID NO: 2107933 - protein, 17 aa, Staphylococcus
AVLVLTAALAACGNKDK

SEQ ID NO: 2107934 - protein, 24 aa, Staphylococcus
AVSQLIQDLFMNDYLRVYTNNDLI

SEQ ID NO: 2107935 - protein, 19 aa, Staphylococcus
AWYDEMKRLAGDKKVLFYS

SEQ ID NO: 2107936 - protein, 19 aa, Staphylococcus
AYGHVAYVESVGSDGSVTV

SEQ ID NO: 2107937 - protein, 24 aa, Staphylococcus
AYGNCTYYVFNRRSELGRSIGSTW

SEQ ID NO: 2107938 - protein, 18 aa, Staphylococcus
AYIAIAKVGKGKAAFIGD

SEQ ID NO: 2107939 - protein, 31 aa, Staphylococcus
AYKQQKPIVFTAMEPSWFSKELDIKMLKDPE

SEQ ID NO: 2107940 - protein, 19 aa, Staphylococcus
AYKYGFILRYPKGKEKITG

SEQ ID NO: 2107941 - protein, 32 aa, Staphylococcus
AYQPTLAELAMPRPYVFVSPKDFKNGTTKDGV

SEQ ID NO: 2107942 - protein, 34 aa, Staphylococcus
AYQTQFMSTSFYNNWLYLYLFSSASQASQEKKNN

SEQ ID NO: 2107943 - protein, 25 aa, Staphylococcus
AYTAGQCTYYVYDKVGGKIGSNWGN

SEQ ID NO: 2107944 - protein, 24 aa, Staphylococcus
CELVLYSPFVVAASETYIGLVEAG

SEQ ID NO: 2107945 - protein, 17 aa, Staphylococcus
CIGIIAAVLQGCSQKDP

SEQ ID NO: 2107946 - protein, 22 aa, Staphylococcus
CIITTMVVLSSLLLVFSSITYA

SEQ ID NO: 2107947 - protein, 25 aa, Staphylococcus
CINNNVEVWLIKKGFNIYNRYTLAR

SEQ ID NO: 2107948 - protein, 17 aa, Staphylococcus
CISLIIVLVSGCGKEEV

SEQ ID NO: 2107949 - protein, 24 aa, Staphylococcus
CLLSTSLLIPSFSINDVSAESLEK

SEQ ID NO: 2107950 - protein, 24 aa, Staphylococcus
CRSPMAEAIMRQKLLDRNINDIKV

SEQ ID NO: 2107951 - protein, 23 aa, Staphylococcus
CVKGISEALLRSNAPKLYVSNVM

SEQ ID NO: 2107952 - protein, 26 aa, Staphylococcus
DAAAQLQMSLPYPPQSYVGPSKWRNA

SEQ ID NO: 2107953 - protein, 17 aa, Staphylococcus
DADPDKQTAYQDAIRQA

SEQ ID NO: 2107954 - protein, 18 aa, Staphylococcus
DAERTISFTTLLEKGQKL

SEQ ID NO: 2107955 - protein, 23 aa, Staphylococcus
DAESLYEIPLQLSKQHMDDLVIK

SEQ ID NO: 2107956 - protein, 20 aa, Staphylococcus
DAEVFEYSTDGGWFSSMYNV

SEQ ID NO: 2107957 - protein, 23 aa, Staphylococcus
DAGYVSQIIFTKNGKVKSVPIDQ

SEQ ID NO: 2107958 - protein, 19 aa, Staphylococcus
DAISSMIYPSHWSNGDFGL

SEQ ID NO: 2107959 - protein, 25 aa, Staphylococcus
DAKAIVQCNLWLRTADRIKIVVGRF

SEQ ID NO: 2107960 - protein, 24 aa, Staphylococcus
DAMHNLKQGIANKNDILGSENYHD

SEQ ID NO: 2107961 - protein, 23 aa, Staphylococcus
DANDFILEPSFIEAVKNNNFVIN

SEQ ID NO: 2107962 - protein, 20 aa, Staphylococcus
DANIYVYDKGKYVILAYKPL

SEQ ID NO: 2107963 - protein, 20 aa, Staphylococcus
DANIYVYEKGKYVVLAYRPL

SEQ ID NO: 2107964 - protein, 40 aa, Staphylococcus
DAQSYYDTLWTKKDYDLIFYRTYSDALMPYNFMNSVFKNN

SEQ ID NO: 2107965 - protein, 25 aa, Staphylococcus
DARYEARMLYNRAPKAEFYINDYEQ

SEQ ID NO: 2107966 - protein, 24 aa, Staphylococcus
DASKLLQIDGYYFEEVRRDHIYQS

SEQ ID NO: 2107967 - protein, 19 aa, Staphylococcus
DAVKPYINLIAVNSKDKDN

SEQ ID NO: 2107968 - protein, 23 aa, Staphylococcus
DDEDYWAKQWAEAYVRFATFEKE

SEQ ID NO: 2107969 - protein, 22 aa, Staphylococcus
DDEEFWKWYQTQSDFTFKNPKY

SEQ ID NO: 2107970 - protein, 19 aa, Staphylococcus
DDGLYYFVPDKASLENMTE

SEQ ID NO: 2107971 - protein, 18 aa, Staphylococcus
DDIFKHFNSSYYGVPIAY

SEQ ID NO: 2107972 - protein, 25 aa, Staphylococcus
DDINPAVLSHYWGGDKMNIRQDLEE

SEQ ID NO: 2107973 - protein, 27 aa, Staphylococcus
DDINPSVLAHYWGGDKLNIRQDLEENG

SEQ ID NO: 2107974 - protein, 27 aa, Staphylococcus
DDINPSVLAHYWGGDKMNIRQDLEENG

SEQ ID NO: 2107975 - protein, 24 aa, Staphylococcus
DDLRKELVKYYKSGLTLDQAVAIQ

SEQ ID NO: 2107976 - protein, 21 aa, Staphylococcus
DDLSIFNKLFSDDTLSSNYLN

SEQ ID NO: 2107977 - protein, 19 aa, Staphylococcus
DDSNYLAYFNFSPVKYDKD

SEQ ID NO: 2107978 - protein, 21 aa, Staphylococcus
DDTLKLTLKNNIKFQNGHKLT

SEQ ID NO: 2107979 - protein, 18 aa, Staphylococcus
DDVCHHWFLGHYLTERTF

SEQ ID NO: 2107980 - protein, 26 aa, Staphylococcus
DEAAIVKCNLWLRTADRIKIVMGRSD

SEQ ID NO: 2107981 - protein, 17 aa, Staphylococcus
DELIKFIKDSKLNTMVI

SEQ ID NO: 2107982 - protein, 24 aa, Staphylococcus
DENAIVKCNLWLRTADRVKIVMGQ

SEQ ID NO: 2107983 - protein, 24 aa, Staphylococcus
DENSLLFGPFAAIGPKFLKNGSNL

SEQ ID NO: 2107984 - protein, 24 aa, Staphylococcus
DEQPSQIFTVVAPQPNQATSHIWE

SEQ ID NO: 2107985 - protein, 20 aa, Staphylococcus
DEQWYPHHIIINATGSKTHL

SEQ ID NO: 2107986 - protein, 25 aa, Staphylococcus
DETAIAKSNLWLRTSDRVRLVMGRF

SEQ ID NO: 2107987 - protein, 25 aa, Staphylococcus
DETAIVKCNLWLRTADRIKIVVGQF

SEQ ID NO: 2107988 - protein, 58 aa, Staphylococcus
DFASDPMSYAKTPSLYVGGFYDPSLPTNRYRGVGKAPLNEFEIHKLINNDTLTNASRT

SEQ ID NO: 2107989 - protein, 26 aa, Staphylococcus
DFDNPTYLPRFVFGHYMKSYLSKFDE

SEQ ID NO: 2107990 - protein, 26 aa, Staphylococcus
DFSSAARYIAHLPQGASAVWQDNADN

SEQ ID NO: 2107991 - protein, 38 aa, Staphylococcus
DGDTLYQIALSHHLSLEQLYNFNPGVTALIHPGDLIAV

SEQ ID NO: 2107992 - protein, 26 aa, Staphylococcus
DGERTLLFGPFANIGPKFLKFGSNLD

SEQ ID NO: 2107993 - protein, 22 aa, Staphylococcus
DGFNQSIDLLLSKRVDGTFNDS

SEQ ID NO: 2107994 - protein, 22 aa, Staphylococcus
DGFNQSMDLLLSKRVDATFNDS

SEQ ID NO: 2107995 - protein, 17 aa, Staphylococcus
DGKILGGFVVGPHATDL

SEQ ID NO: 2107996 - protein, 18 aa, Staphylococcus
DGKLVYDITLQKGKEQRD

SEQ ID NO: 2107997 - protein, 19 aa, Staphylococcus
DGKLVYNFDLQKGKEKHEV

SEQ ID NO: 2107998 - protein, 23 aa, Staphylococcus
DGKTIIYRYDATTGRRITGNDVL

SEQ ID NO: 2107999 - protein, 24 aa, Staphylococcus
DGMALLFRHFFATSLHKQFMRNSS

SEQ ID NO: 2108000 - protein, 24 aa, Staphylococcus
DGMALLFRHFFATSLHNQFMYNSK

SEQ ID NO: 2108001 - protein, 23 aa, Staphylococcus
DGMALLFRHFYATSIHNQYMRNR

SEQ ID NO: 2108002 - protein, 24 aa, Staphylococcus
DGMALLFRHFYATSLHKQFMYNSK

SEQ ID NO: 2108003 - protein, 21 aa, Staphylococcus
DGMDSLNVEKLPKGSKVNPQA

SEQ ID NO: 2108004 - protein, 19 aa, Staphylococcus
DGNFYYPVLNKSGDVKYIV

SEQ ID NO: 2108005 - protein, 23 aa, Staphylococcus
DGNPNIYRPTWKSEASNYQSATS

SEQ ID NO: 2108006 - protein, 22 aa, Staphylococcus
DGNVYEYIFKPNEKVTLSSGFA

SEQ ID NO: 2108007 - protein, 27 aa, Staphylococcus
DGPKEIPYETLLFATGRQPNVHVAKAL

SEQ ID NO: 2108008 - protein, 23 aa, Staphylococcus
DGQGTVWTHYAISKYLGGTDHSD

SEQ ID NO: 2108009 - protein, 25 aa, Staphylococcus
DGQRTLLFGPFANVGPKFLKNGSNL

SEQ ID NO: 2108010 - protein, 24 aa, Staphylococcus
DGRKEGLNIIYRSGFRSYAEQTQL

SEQ ID NO: 2108011 - protein, 44 aa, Staphylococcus
DGSGYPVGTYIYAANKGTPFALPNTPWKPLRASDSKGIAYVTTK

SEQ ID NO: 2108012 - protein, 23 aa, Staphylococcus
DGSIYPVLLRLNKKGYVTSVSKK

SEQ ID NO: 2108013 - protein, 27 aa, Staphylococcus
DGSVSITIPGVLPLGNIKAKSIITVDH

SEQ ID NO: 2108014 - protein, 25 aa, Staphylococcus
DGTVTFYDVPSHFQDHRWTEDGYSK

SEQ ID NO: 2108015 - protein, 28 aa, Staphylococcus
DGYRFIEPGDGFLACGYIAKGRMEEPLQ

SEQ ID NO: 2108016 - protein, 19 aa, Staphylococcus
DHAKALINQLPHLNDAQKH

SEQ ID NO: 2108017 - protein, 19 aa, Staphylococcus
DHEKLKVWMPLMMEGRDPN

SEQ ID NO: 2108018 - protein, 26 aa, Staphylococcus
DHGNILNKAYLKKGTINLTLPRQTLI

SEQ ID NO: 2108019 - protein, 17 aa, Staphylococcus
DHKIHFKGYLGSNIVKF

SEQ ID NO: 2108020 - protein, 24 aa, Staphylococcus
DHKKPWINEKLLDKLIDGLKISNK

SEQ ID NO: 2108021 - protein, 40 aa, Staphylococcus
DHSDPHAYLQAHNYSYDQLYDLINEKYLIKQGKVAPWGTT

SEQ ID NO: 2108022 - protein, 25 aa, Staphylococcus
DIAILSHHLIAKHPKILNITQLSQD

SEQ ID NO: 2108023 - protein, 20 aa, Staphylococcus
DIDMNAFQHFAFLHEYEKAN

SEQ ID NO: 2108024 - protein, 26 aa, Staphylococcus
DIDMNAFQHFAFLNAYKKAHKDAKIS

SEQ ID NO: 2108025 - protein, 19 aa, Staphylococcus
DIDRLSLMSTFPNFKEQEE

SEQ ID NO: 2108026 - protein, 24 aa, Staphylococcus
DIEVMRKWIPLMMKGRQNDDGYMA

SEQ ID NO: 2108027 - protein, 23 aa, Staphylococcus
DIIDNKYLIQYQLDKQTGTDTKI

SEQ ID NO: 2108028 - protein, 19 aa, Staphylococcus
DIIIEKGEDYNLLQGISAY

SEQ ID NO: 2108029 - protein, 33 aa, Staphylococcus
DILLHDIYDLQPLKTFVYQRVILLGDAAHATTP

SEQ ID NO: 2108030 - protein, 18 aa, Staphylococcus
DIMGIRYLDKEALVLFKP

SEQ ID NO: 2108031 - protein, 29 aa, Staphylococcus
DIPESYLRKFNYLVFPDNVAIALGVAQAV

SEQ ID NO: 2108032 - protein, 23 aa, Staphylococcus
DIQIKHILVRDKKKKRPLNISQY

SEQ ID NO: 2108033 - protein, 30 aa, Staphylococcus
DIRKQTYADYYKNSLDFFKPAPFKEQKNST

SEQ ID NO: 2108034 - protein, 17 aa, Staphylococcus
DISNLSEKEKLALVFLA

SEQ ID NO: 2108035 - protein, 17 aa, Staphylococcus
DIYASVMIAQAILESDS

SEQ ID NO: 2108036 - protein, 23 aa, Staphylococcus
DKAKGIIYTPEGLSSEQKWSHAV

SEQ ID NO: 2108037 - protein, 23 aa, Staphylococcus
DKDKYLRLLSDNGVIFDIKGLIN

SEQ ID NO: 2108038 - protein, 25 aa, Staphylococcus
DKGAAHLQVLFTGKIAPETEKQAYN

SEQ ID NO: 2108039 - protein, 18 aa, Staphylococcus
DKGKYVILAYKPLSDDEE

SEQ ID NO: 2108040 - protein, 23 aa, Staphylococcus
DKGSYFIININNKSGAGVGAYKV

SEQ ID NO: 2108041 - protein, 27 aa, Staphylococcus
DKIIQTAPSNYLAWGAGANANPYFYQI

SEQ ID NO: 2108042 - protein, 22 aa, Staphylococcus
DKIKEIIKSNLPFHKSFDIIKR

SEQ ID NO: 2108043 - protein, 18 aa, Staphylococcus
DKILPYDPTIYLVNANKT

SEQ ID NO: 2108044 - protein, 27 aa, Staphylococcus
DKKLAKEWMDFLKSKKAKDILKEYHFE

SEQ ID NO: 2108045 - protein, 25 aa, Staphylococcus
DKKVMYLLVNEGELSTFGPGSRFGG

SEQ ID NO: 2108046 - protein, 18 aa, Staphylococcus
DKLGYKIKLIGKGIYEHG

SEQ ID NO: 2108047 - protein, 23 aa, Staphylococcus
DKLGYKIKLIGKGTYQNSKVNAS

SEQ ID NO: 2108048 - protein, 18 aa, Staphylococcus
DKLGYKIKLIGKSTYHHS

SEQ ID NO: 2108049 - protein, 20 aa, Staphylococcus
DKMHLVPMLDEPAFLTAGKN

SEQ ID NO: 2108050 - protein, 19 aa, Staphylococcus
DKNFFPPYDASAVAPNKLL

SEQ ID NO: 2108051 - protein, 35 aa, Staphylococcus
DKNKKEFIALQKDINNYLMPEFKKYKKAANQLPAN

SEQ ID NO: 2108052 - protein, 27 aa, Staphylococcus
DKNTKEYFAKIWLTARNDADDIFYEED

SEQ ID NO: 2108053 - protein, 17 aa, Staphylococcus
DKQLKVIAKQSAKFDRA

SEQ ID NO: 2108054 - protein, 20 aa, Staphylococcus
DKSRPSFMSLPIAAAAGNHD

SEQ ID NO: 2108055 - protein, 25 aa, Staphylococcus
DKSVMYLLVNEGELSTFGPGGRFGD

SEQ ID NO: 2108056 - protein, 24 aa, Staphylococcus
DKTEHYYEFKTSKGFMIVTADGQK

SEQ ID NO: 2108057 - protein, 23 aa, Staphylococcus
DKTVMYLLVNEGELSTYGPKERF

SEQ ID NO: 2108058 - protein, 26 aa, Staphylococcus
DKVYELDPKLWYFASGSTTTTMKQID

SEQ ID NO: 2108059 - protein, 24 aa, Staphylococcus
DKYNYVIPKEGSNLWFDNMVIPKT

SEQ ID NO: 2108060 - protein, 24 aa, Staphylococcus
DKYNYVVPKEGSNLWFDNMVIPRT

SEQ ID NO: 2108061 - protein, 19 aa, Staphylococcus
DLFELVKQDGVTQSQVDEK

SEQ ID NO: 2108062 - protein, 17 aa, Staphylococcus
DLFSIVPVKRSHSVCAQ

SEQ ID NO: 2108063 - protein, 17 aa, Staphylococcus
DLFSLVPVKRSHSVCAQ

SEQ ID NO: 2108064 - protein, 25 aa, Staphylococcus
DLGPSILTMPYIFEQLFQHSGKEMR

SEQ ID NO: 2108065 - protein, 28 aa, Staphylococcus
DLGPSILTMPYIFERLFNYSGKNMADYI

SEQ ID NO: 2108066 - protein, 17 aa, Staphylococcus
DLHTLLEKYGENSNYKE

SEQ ID NO: 2108067 - protein, 19 aa, Staphylococcus
DLIVLGPGSLYTSVISNLC

SEQ ID NO: 2108068 - protein, 21 aa, Staphylococcus
DLKDIPIHFAIYKQSDQNSIT

SEQ ID NO: 2108069 - protein, 26 aa, Staphylococcus
DLMFNQTWGLLYDPQSTIAAFKAKNG

SEQ ID NO: 2108070 - protein, 26 aa, Staphylococcus
DLPDGTLFNITAVDSLPNAAQVSQFA

SEQ ID NO: 2108071 - protein, 25 aa, Staphylococcus
DLQAQVPLAWGAHRGASIIAEQLAG

SEQ ID NO: 2108072 - protein, 17 aa, Staphylococcus
DLRKMMTFKGDPDFTIV

SEQ ID NO: 2108073 - protein, 22 aa, Staphylococcus
DLSHRKLFPSLFHLFQQDNLDE

SEQ ID NO: 2108074 - protein, 17 aa, Staphylococcus
DMALFKFTKAIVNDEEI

SEQ ID NO: 2108075 - protein, 27 aa, Staphylococcus
DMDENYFKSIEIFYNSFKDLENVIEHK

SEQ ID NO: 2108076 - protein, 25 aa, Staphylococcus
DMEQLRYIYDVYFGKNDKVRVPTDL

SEQ ID NO: 2108077 - protein, 30 aa, Staphylococcus
DMKHCQVYDYIFLTIGTLSYHDPYHLKGIK

SEQ ID NO: 2108078 - protein, 22 aa, Staphylococcus
DMWNTIVMPESGGNPNAVSPNG

SEQ ID NO: 2108079 - protein, 18 aa, Staphylococcus
DNDEVVNGIIWSEILAKP

SEQ ID NO: 2108080 - protein, 27 aa, Staphylococcus
DNKFAKEWMEFLKSKKAKNILKEYHFK

SEQ ID NO: 2108081 - protein, 24 aa, Staphylococcus
DNKGFQDFMKFVLEDKGKSAEDAG

SEQ ID NO: 2108082 - protein, 24 aa, Staphylococcus
DNKGFTHYTLQPKVGNVFAPDEEV

SEQ ID NO: 2108083 - protein, 26 aa, Staphylococcus
DNKLAKDWMKFLKSDKAKKIMKEYKF

SEQ ID NO: 2108084 - protein, 23 aa, Staphylococcus
DNKPNRIIKPLRDKIKGYTSVGT

SEQ ID NO: 2108085 - protein, 28 aa, Staphylococcus
DNKVYELDPKLWYFASGSTTTAIKQIDE

SEQ ID NO: 2108086 - protein, 23 aa, Staphylococcus
DNPGLKKRLLASTFYIKMNQDNV

SEQ ID NO: 2108087 - protein, 18 aa, Staphylococcus
DNPKGSVYVLPNTGGTKA

SEQ ID NO: 2108088 - protein, 26 aa, Staphylococcus
DNQNHVFFTSDPAIFKVTNAVPNPAT

SEQ ID NO: 2108089 - protein, 61 aa, Staphylococcus
DNVNRVKVQFLPNNDIMTDTRRVALLKDGYKYYSLIDSIDIASGSHLKVLPKENNDAVKNN

SEQ ID NO: 2108090 - protein, 22 aa, Staphylococcus
DNYRTILPFKESQSRGLLQDNM

SEQ ID NO: 2108091 - protein, 25 aa, Staphylococcus
DPASLTKMMTMYLTLDAVKSGKIHM

SEQ ID NO: 2108092 - protein, 19 aa, Staphylococcus
DPDKQTAYQDAIRQAESII

SEQ ID NO: 2108093 - protein, 21 aa, Staphylococcus
DPETPYPVIDLLPEQKDIEDL

SEQ ID NO: 2108094 - protein, 35 aa, Staphylococcus
DPHAYLQSHNYTYNELYDLINEKYLIKTGQVAPWG

SEQ ID NO: 2108095 - protein, 39 aa, Staphylococcus
DPHGYLAAHNYSYDELYDLIYEKYLIKTGQAAAWGTTSS

SEQ ID NO: 2108096 - protein, 25 aa, Staphylococcus
DPHGYLQQHNYSYNELYDLINEKYK

SEQ ID NO: 2108097 - protein, 25 aa, Staphylococcus
DPHQLKILYMHGGSWVAGPFKEHYQ

SEQ ID NO: 2108098 - protein, 21 aa, Staphylococcus
DPVGYFSQWGYNMNQFYSLVQ

SEQ ID NO: 2108099 - protein, 25 aa, Staphylococcus
DPVQKYQFLQLDQPQYLSVASLNNL

SEQ ID NO: 2108100 - protein, 23 aa, Staphylococcus
DQAKAHLTPDKAPLEAAKNSLET

SEQ ID NO: 2108101 - protein, 20 aa, Staphylococcus
DQLEKALSIGIIDKKIEDYS

SEQ ID NO: 2108102 - protein, 25 aa, Staphylococcus
DQLGYTHYTLQPKFKNAYVPDREVK

SEQ ID NO: 2108103 - protein, 17 aa, Staphylococcus
DQTFFDSYGFANTYAFM

SEQ ID NO: 2108104 - protein, 20 aa, Staphylococcus
DRAVELYYYIKGGRVDYGAA

SEQ ID NO: 2108105 - protein, 26 aa, Staphylococcus
DRHNQYSLPYFFGTVGILYNKDKYPN

SEQ ID NO: 2108106 - protein, 25 aa, Staphylococcus
DRIRVVVEVLPLTNFVPSAEEHQDR

SEQ ID NO: 2108107 - protein, 17 aa, Staphylococcus
DRLVIKHNGQVITTFVR

SEQ ID NO: 2108108 - protein, 21 aa, Staphylococcus
DRPYHGFKRFNTPSSVAQDLV

SEQ ID NO: 2108109 - protein, 31 aa, Staphylococcus
DRQVDPYRIIYWKNKWYLVAYCRLRDDVRTF

SEQ ID NO: 2108110 - protein, 19 aa, Staphylococcus
DRRYVRGEESLLFGPFAAI

SEQ ID NO: 2108111 - protein, 24 aa, Staphylococcus
DRVAPFDVILLSSKSYHLEQAMTD

SEQ ID NO: 2108112 - protein, 21 aa, Staphylococcus
DRVRLVMGRFKATTFEELFEQ

SEQ ID NO: 2108113 - protein, 23 aa, Staphylococcus
DRYGRVLAYVWLDKDTLFNELLV

SEQ ID NO: 2108114 - protein, 18 aa, Staphylococcus
DSAQLFQDMAFATTLNHI

SEQ ID NO: 2108115 - protein, 24 aa, Staphylococcus
DSARPMQIGLVYDALKNKKLDVAV

SEQ ID NO: 2108116 - protein, 22 aa, Staphylococcus
DSKNNVYYQLNISYVSNPQAKN

SEQ ID NO: 2108117 - protein, 26 aa, Staphylococcus
DSKYSKIYGLRTYGYNLWNNSTDKYA

SEQ ID NO: 2108118 - protein, 30 aa, Staphylococcus
DSLDNGTYSYVFSFANKANPGTFTIVSVNQ

SEQ ID NO: 2108119 - protein, 30 aa, Staphylococcus
DSLGKKKPISRPWIQDFTASYLGNGNYIDY

SEQ ID NO: 2108120 - protein, 43 aa, Staphylococcus
DSQSYYDTLWTKKDFDLIFYRTYSDALMPYNFMNSVFKNIDGK

SEQ ID NO: 2108121 - protein, 39 aa, Staphylococcus; identical to SEQ ID NO: 1842583

SEQ ID NO: 2108122 - protein, 17 aa, Staphylococcus
DSQYLAVPIAYPNETFV

SEQ ID NO: 2108123 - protein, 23 aa, Staphylococcus
DSRPLPPIYGGPEGMRYFEASPP

SEQ ID NO: 2108124 - protein, 25 aa, Staphylococcus
DSSDDLRLGKFLKLSPDEILKKMNH

SEQ ID NO: 2108125 - protein, 17 aa, Staphylococcus
DSSDIFLKDSKLGKLKV

SEQ ID NO: 2108126 - protein, 23 aa, Staphylococcus
DSSFFVDPNFVRAVKYHNVTFNG

SEQ ID NO: 2108127 - protein, 26 aa, Staphylococcus
DSSYALSRPLFIYTNDKKLKDNKAFG

SEQ ID NO: 2108128 - protein, 28 aa, Staphylococcus
DSTCQGVYYYIFTFKNEAKPNTYYRVTV

SEQ ID NO: 2108129 - protein, 19 aa, Staphylococcus
DTFKYSEVKSYKSAIKAAQ

SEQ ID NO: 2108130 - protein, 21 aa, Staphylococcus
DTISYIPKVGYYDKITHAHAY

SEQ ID NO: 2108131 - protein, 25 aa, Staphylococcus
DTLDITPKLMLQGSVDLLNEVSTSK

SEQ ID NO: 2108132 - protein, 25 aa, Staphylococcus
DTLEITPKLMLQGSVDLLNEVSTSK

SEQ ID NO: 2108133 - protein, 25 aa, Staphylococcus
DTLKITPKLMLQGSVDLLNEVSTSK

SEQ ID NO: 2108134 - protein, 26 aa, Staphylococcus
DTLSNYSLSYLFIEYLKKQSDNGEQV

SEQ ID NO: 2108135 - protein, 18 aa, Staphylococcus
DTLVKLFYKECEEWNIEL

SEQ ID NO: 2108136 - protein, 30 aa, Staphylococcus
DTNSTQYLAKVWAAALPAYRSSGKSQFDDM

SEQ ID NO: 2108137 - protein, 17 aa, Staphylococcus
DVALVYTKEKMSQYATP

SEQ ID NO: 2108138 - protein, 24 aa, Staphylococcus
DVDANFFQHVPYLKAEKKSHGYKI

SEQ ID NO: 2108139 - protein, 24 aa, Staphylococcus
DVDANFFQHVPYLKAERKSHGYKI

SEQ ID NO: 2108140 - protein, 23 aa, Staphylococcus
DVDANFFQHVPYLNAEKKSHGYK

SEQ ID NO: 2108141 - protein, 24 aa, Staphylococcus
DVEPTSIISILVAAADALSAARPG

SEQ ID NO: 2108142 - protein, 17 aa, Staphylococcus
DVGKGHIVFYVSNGYVK

SEQ ID NO: 2108143 - protein, 17 aa, Staphylococcus
DVKSIYPAGADLHSYEP

SEQ ID NO: 2108144 - protein, 20 aa, Staphylococcus
DVMREFIKFTLEDKGKSAED

SEQ ID NO: 2108145 - protein, 17 aa, Staphylococcus
DVNSIILDNKYLMQSKL

SEQ ID NO: 2108146 - protein, 25 aa, Staphylococcus
DVSGKLIDPYLPDVSAKFPEGTEML

SEQ ID NO: 2108147 - protein, 23 aa, Staphylococcus
DYAATNLQYYGLTPDSAEYDGQG

SEQ ID NO: 2108148 - protein, 25 aa, Staphylococcus
DYAATQLQYYGLKPDSAEYDAKGTV

SEQ ID NO: 2108149 - protein, 25 aa, Staphylococcus
DYAATQLQYYGLKPNSAENDGSGTV

SEQ ID NO: 2108150 - protein, 23 aa, Staphylococcus
DYAKDVYDYYKNKFGRESYDDKG

SEQ ID NO: 2108151 - protein, 18 aa, Staphylococcus
DYAPLVNGINYAKQSGWN

SEQ ID NO: 2108152 - protein, 17 aa, Staphylococcus
DYDYLVMSPGCRANQLP

SEQ ID NO: 2108153 - protein, 17 aa, Staphylococcus
DYLILSPGCSANRLNFN

SEQ ID NO: 2108154 - protein, 32 aa, Staphylococcus
DYNGFNYHFESNGTHWSWNYAQNGQATPQQDV

SEQ ID NO: 2108155 - protein, 34 aa, Staphylococcus
DYNGFTYHFESDGTNFSWYFHQSGQSNEASNTQA

SEQ ID NO: 2108156 - protein, 30 aa, Staphylococcus
DYSLEATNDGFRYVFSFKDASKDNSYSIVT

SEQ ID NO: 2108157 - protein, 20 aa, Staphylococcus
DYTLAQLKQLDAGSWFNNAH

SEQ ID NO: 2108158 - protein, 22 aa, Staphylococcus
EAAWNAIVMPESGGNPNAVNPA

SEQ ID NO: 2108159 - protein, 22 aa, Staphylococcus
EAAWNAIVMPESGGNPNAVNPI

SEQ ID NO: 2108160 - protein, 24 aa, Staphylococcus
EAGKFLWETLRNNFYYSAKNVPKA

SEQ ID NO: 2108161 - protein, 18 aa, Staphylococcus
EAGSDNQMFSINAGFRKY

SEQ ID NO: 2108162 - protein, 24 aa, Staphylococcus
EAHPNIKAIFAQNDEMALGAIEAI

SEQ ID NO: 2108163 - protein, 25 aa, Staphylococcus
EAKAKPLEKLLSKKLDIPVKVSVST

SEQ ID NO: 2108164 - protein, 19 aa, Staphylococcus
EAKQFRENLRYIINDNRKI

SEQ ID NO: 2108165 - protein, 17 aa, Staphylococcus
EAKSLMEKAGYSKKHPL

SEQ ID NO: 2108166 - protein, 22 aa, Staphylococcus
EAKYKFSKPYTYSSGVLVVNKD

SEQ ID NO: 2108167 - protein, 18 aa, Staphylococcus
EANEYRLSDSRPLPPIYG

SEQ ID NO: 2108168 - protein, 22 aa, Staphylococcus
EANGDMGGVPTSDKAFSNDQLD

SEQ ID NO: 2108169 - protein, 28 aa, Staphylococcus
EAPIKETLAASLIKLANWTGDTPLIDPF

SEQ ID NO: 2108170 - protein, 26 aa, Staphylococcus
EAQIKTEDLRQFWLGIAEDAVKSEAV

SEQ ID NO: 2108171 - protein, 27 aa, Staphylococcus
EASGTKWNFLNFKPGLVGGHCIGVDPY

SEQ ID NO: 2108172 - protein, 21 aa, Staphylococcus
EDAPEGMTFYSASPARGPFAT

SEQ ID NO: 2108173 - protein, 25 aa, Staphylococcus
EDATQKYQFLRLDKAQNLSTSSVNQ

SEQ ID NO: 2108174 - protein, 28 aa, Staphylococcus
EDELDKLFHINVYGTLFGIQAAAKQFIK

SEQ ID NO: 2108175 - protein, 26 aa, Staphylococcus
EDEVDRHIIPLIKKQILDINQTNITD

SEQ ID NO: 2108176 - protein, 23 aa, Staphylococcus
EDLKDIPIHFAIYKQSGQDSISP

SEQ ID NO: 2108177 - protein, 24 aa, Staphylococcus
EDNSYYYPVLKDGKIIYTLTVSPK

SEQ ID NO: 2108178 - protein, 27 aa, Staphylococcus
EDNVFELDPKLWYFSSGSTSTTIKQID

SEQ ID NO: 2108179 - protein, 21 aa, Staphylococcus
EDQHINLVFNKEFKANHPAAY

SEQ ID NO: 2108180 - protein, 18 aa, Staphylococcus
EDRYGSIDAAIDFRLANG

SEQ ID NO: 2108181 - protein, 25 aa, Staphylococcus
EDVVKLKAPMRVGGSVTYSSNGDGS

SEQ ID NO: 2108182 - protein, 23 aa, Staphylococcus
EEAWNAIVMPESGGNPNAVNPAG

SEQ ID NO: 2108183 - protein, 19 aa, Staphylococcus
EEFVAKYNFIKLIKLNENT

SEQ ID NO: 2108184 - protein, 30 aa, Staphylococcus
EEINWQLNLNLMGVIRMTKAVLPIMRSQRE

SEQ ID NO: 2108185 - protein, 19 aa, Staphylococcus
EEKGRVIGMPKLKGLKNKE

SEQ ID NO: 2108186 - protein, 27 aa, Staphylococcus
EELGADPMTFLGLGGIGDLIVTCTSTH

SEQ ID NO: 2108187 - protein, 24 aa, Staphylococcus
EENKGFQEFMKFVLKDEGKSAEDA

SEQ ID NO: 2108188 - protein, 19 aa, Staphylococcus
EEPYDYLILSPGCSANRLN

SEQ ID NO: 2108189 - protein, 17 aa, Staphylococcus
EERDILQSVLDDSFNRF

SEQ ID NO: 2108190 - protein, 17 aa, Staphylococcus
EEWDQMIDVNLKGTLYG

SEQ ID NO: 2108191 - protein, 22 aa, Staphylococcus
EEWGWKQFSDQITLKRLSKPED

SEQ ID NO: 2108192 - protein, 20 aa, Staphylococcus
EEYRYGFYVTPYLNRVNGVF

SEQ ID NO: 2108193 - protein, 22 aa, Staphylococcus
EFEYLVDRKATKRRKLFNGYIE

SEQ ID NO: 2108194 - protein, 22 aa, Staphylococcus
EFEYLVNRKATKRRKLFNGYIE

SEQ ID NO: 2108195 - protein, 17 aa, Staphylococcus
EFLDQYYGAGNLYMAPK

SEQ ID NO: 2108196 - protein, 18 aa, Staphylococcus
EFNYVVPKEGSNLWFDNM

SEQ ID NO: 2108197 - protein, 17 aa, Staphylococcus
EFQYLTKSKFNDIKDKY

SEQ ID NO: 2108198 - protein, 23 aa, Staphylococcus
EFVTPLSFQAISRNPVYTNTFKE

SEQ ID NO: 2108199 - protein, 19 aa, Staphylococcus
EGAQKIYELFKPELEKKDK

SEQ ID NO: 2108200 - protein, 24 aa, Staphylococcus
EGAQKIYELFKPELNKKDKKLSAD

SEQ ID NO: 2108201 - protein, 24 aa, Staphylococcus
EGAQKIYELFKPTLEKKDKKLSSN

SEQ ID NO: 2108202 - protein, 17 aa, Staphylococcus
EGIGYFGYNFYEQNKDK

SEQ ID NO: 2108203 - protein, 24 aa, Staphylococcus
EGIGYFGYNFYQQNKDKLKEVKIK

SEQ ID NO: 2108204 - protein, 18 aa, Staphylococcus
EGLGRISIFIGTKETLYP

SEQ ID NO: 2108205 - protein, 20 aa, Staphylococcus
EGMKFYVVSPSIGQFSSVIG

SEQ ID NO: 2108206 - protein, 28 aa, Staphylococcus
EGNNGNYSYVFSFKDPQQNGVYSIVTVN

SEQ ID NO: 2108207 - protein, 18 aa, Staphylococcus
EGRQLIHDLFDHEGYEKT

SEQ ID NO: 2108208 - protein, 23 aa, Staphylococcus
EGSKYFIQLWSGDTPIEDYKISP

SEQ ID NO: 2108209 - protein, 26 aa, Staphylococcus
EGTQQILRKHNIPFDGMISELFEPSD

SEQ ID NO: 2108210 - protein, 21 aa, Staphylococcus
EGYNHEAFLKQLDNVKKDDSI

SEQ ID NO: 2108211 - protein, 22 aa, Staphylococcus
EHGKYDPHIWLDPVIDQKFAKE

SEQ ID NO: 2108212 - protein, 27 aa, Staphylococcus
EHKIYELDPKLWYFSSGSTTTTMKQID

SEQ ID NO: 2108213 - protein, 17 aa, Staphylococcus
EIAFMKRNYNSAFVHAF

SEQ ID NO: 2108214 - protein, 17 aa, Staphylococcus
EIENFKFFVQYGNFKDF

SEQ ID NO: 2108215 - protein, 27 aa, Staphylococcus
EIEYARVWNQLGPLKNNMDGMDSLNVE

SEQ ID NO: 2108216 - protein, 30 aa, Staphylococcus
EIGKDKAEQIYYLALTQYLTQNSEFSDAKT

SEQ ID NO: 2108217 - protein, 18 aa, Staphylococcus
EIIEEFVAKYNFIKLIKL

SEQ ID NO: 2108218 - protein, 18 aa, Staphylococcus
EIKARTSLITRNITYTTQ

SEQ ID NO: 2108219 - protein, 25 aa, Staphylococcus
EIKKEVAMMLLNPQLKKQFINGQQL

SEQ ID NO: 2108220 - protein, 23 aa, Staphylococcus
EIKYVNMAFLGKDSIIGSRAGHA

SEQ ID NO: 2108221 - protein, 21 aa, Staphylococcus
EINQAVLQAALTEMANKQKST

SEQ ID NO: 2108222 - protein, 17 aa, Staphylococcus
EINQILQSHPNVATIRE

SEQ ID NO: 2108223 - protein, 26 aa, Staphylococcus
EIPANDFFIACQFHPEFLSRPNRPQP

SEQ ID NO: 2108224 - protein, 26 aa, Staphylococcus
EIPENDFFIACQFHPEFLSRPNRPQP

SEQ ID NO: 2108225 - protein, 23 aa, Staphylococcus
EITPRFDGCHMHKLIQYYNEDDL

SEQ ID NO: 2108226 - protein, 23 aa, Staphylococcus
EKDMPLQIDAPESNPLLVDMENS

SEQ ID NO: 2108227 - protein, 21 aa, Staphylococcus
EKDMPLQIDAPQQNPLLVDME

SEQ ID NO: 2108228 - protein, 18 aa, Staphylococcus
EKDPSIIFAMDRGQAVSD

SEQ ID NO: 2108229 - protein, 22 aa, Staphylococcus
EKGKYVVLAYRPLSNNDEMHYY

SEQ ID NO: 2108230 - protein, 21 aa, Staphylococcus
EKGYKWYDRSTFKPGSYGSSQ

SEQ ID NO: 2108231 - protein, 22 aa, Staphylococcus
EKIRKLLAFQTLYIGIDPKQGP

SEQ ID NO: 2108232 - protein, 27 aa, Staphylococcus
EKKLAKEWMKFLKSDKAKKILKEYQFS

SEQ ID NO: 2108233 - protein, 24 aa, Staphylococcus
EKKYKFSNPYTYSSAVLVVRDNEK

SEQ ID NO: 2108234 - protein, 23 aa, Staphylococcus
EKKYKFSNPYTYSSAVLVVRENE

SEQ ID NO: 2108235 - protein, 24 aa, Staphylococcus
EKKYKFSTPYTYSSAVLVVRENEK

SEQ ID NO: 2108236 - protein, 21 aa, Staphylococcus
EKLHYSFNRLKYSLKPVVTAV

SEQ ID NO: 2108237 - protein, 24 aa, Staphylococcus
EKNEALTRLTQAKDAVLQTISNSQ

SEQ ID NO: 2108238 - protein, 23 aa, Staphylococcus
EKNMPLQIDAPQSNPLLVDMENS

SEQ ID NO: 2108239 - protein, 22 aa, Staphylococcus
EKYKFSNPYTYSSGVLVVRDDE

SEQ ID NO: 2108240 - protein, 22 aa, Staphylococcus
ELASSREIKYWSGVRPWTQGEQ

SEQ ID NO: 2108241 - protein, 24 aa, Staphylococcus
ELEREIETIKRSFYNIIDYSKQVK

SEQ ID NO: 2108242 - protein, 20 aa, Staphylococcus
ELGYRGLGQTKEAWGTGSVE

SEQ ID NO: 2108243 - protein, 20 aa, Staphylococcus
ELKKPITYKAGATSNSKLAK

SEQ ID NO: 2108244 - protein, 19 aa, Staphylococcus
ELKSHLPFHKSLKVTKRDA

SEQ ID NO: 2108245 - protein, 20 aa, Staphylococcus
ELQYKKRYPITNGDADTAIA

SEQ ID NO: 2108246 - protein, 24 aa, Staphylococcus
ELTPRNAKWFKERFNIDIYTEYEV

SEQ ID NO: 2108247 - protein, 17 aa, Staphylococcus
ELTQVRPLRIMSPHAVE

SEQ ID NO: 2108248 - protein, 17 aa, Staphylococcus
ELTQVRPLRIMSPHAVK

SEQ ID NO: 2108249 - protein, 17 aa, Staphylococcus
ELTQVRPLRIMSPHSVE

SEQ ID NO: 2108250 - protein, 17 aa, Staphylococcus
EMKPFYKQLNMKGYFYD

SEQ ID NO: 2108251 - protein, 17 aa, Staphylococcus
EMLDNQLYLVRLDSKNR

SEQ ID NO: 2108252 - protein, 27 aa, Staphylococcus
ENDHAKLCYIYKFRARFAVLAHEIAQR

SEQ ID NO: 2108253 - protein, 26 aa, Staphylococcus
ENDYSNDLGLYKPDAPKLDDYEITVE

SEQ ID NO: 2108254 - protein, 25 aa, Staphylococcus
ENGSEHYYEFRTNKGVLLVTADGKK

SEQ ID NO: 2108255 - protein, 17 aa, Staphylococcus
ENIKVLPHIPYIQDKPF

SEQ ID NO: 2108256 - protein, 24 aa, Staphylococcus
ENKKDVLELLSANYTPVHDSYMSF

SEQ ID NO: 2108257 - protein, 23 aa, Staphylococcus
ENKNTILRILKEWKNQMSDVINI

SEQ ID NO: 2108258 - protein, 23 aa, Staphylococcus
ENNGLYSIAWGTKNQQLLSSKMI

SEQ ID NO: 2108259 - protein, 19 aa, Staphylococcus
ENPLLSGRTFSINKKATLN

SEQ ID NO: 2108260 - protein, 30 aa, Staphylococcus
ENTHSNTYYAKVWLTALESYRGNSDIKFDD

SEQ ID NO: 2108261 - protein, 33 aa, Staphylococcus
ENTNTQDYYAKVWLTVFKDYRGSGEVENHISNM

SEQ ID NO: 2108262 - protein, 24 aa, Staphylococcus
ENVEVWLIKKGFNIYNRYTLHRFN

SEQ ID NO: 2108263 - protein, 23 aa, Staphylococcus
ENYKKIDVWINNAGLMPLSEFSK

SEQ ID NO: 2108264 - protein, 25 aa, Staphylococcus
EPIVFTSMEPSWFSKELDVKMLKDP

SEQ ID NO: 2108265 - protein, 23 aa, Staphylococcus
EPPESFKPLIPFAENILPIHIKN

SEQ ID NO: 2108266 - protein, 18 aa, Staphylococcus
EPQHLDYILLDRDHAQPS

SEQ ID NO: 2108267 - protein, 18 aa, Staphylococcus
EPTVDWLRSALKNKKHVI

SEQ ID NO: 2108268 - protein, 27 aa, Staphylococcus
EPWSQPPSGYKWYDPSTFKAGSYGSQH

SEQ ID NO: 2108269 - protein, 22 aa, Staphylococcus
EQGLWYVKGGIHKLALALKQLA

SEQ ID NO: 2108270 - protein, 23 aa, Staphylococcus
EQGRFLKFFVDADLIKIKKGVKI

SEQ ID NO: 2108271 - protein, 20 aa, Staphylococcus
EQKKLAAYQKQLLADKVKVS

SEQ ID NO: 2108272 - protein, 23 aa, Staphylococcus
EQKYQFSTPYTYSNAVLVVRDNE

SEQ ID NO: 2108273 - protein, 39 aa, Staphylococcus
EQNFALLNGEFKNQIYGIDRLYAFIGKGNASYTIQFKTQ

SEQ ID NO: 2108274 - protein, 27 aa, Staphylococcus
EQVLEDVLYPFIPQKRLLDIKDIADYA

SEQ ID NO: 2108275 - protein, 20 aa, Staphylococcus
EQYIGKTMSLKALIKASMLQ

SEQ ID NO: 2108276 - protein, 19 aa, Staphylococcus
EQYLKFQELMFKQQPNSEK

SEQ ID NO: 2108277 - protein, 25 aa, Staphylococcus
ERLPLQWRSFFPSGETIDLYDNVAD

SEQ ID NO: 2108278 - protein, 37 aa, Staphylococcus
ERNQDGTLYYLLQNNGLTTPLGWVNAKDVKVVNQSNA

SEQ ID NO: 2108279 - protein, 20 aa, Staphylococcus
ERQMELIKLLFKKAKEMDSY

SEQ ID NO: 2108280 - protein, 24 aa, Staphylococcus
ERSAAFFALGLIKGSERPVAILCT

SEQ ID NO: 2108281 - protein, 25 aa, Staphylococcus
ERTKRFRLKQLMNAHAIQGTATNEQ

SEQ ID NO: 2108282 - protein, 23 aa, Staphylococcus
ESAIVKCNLWLRTADRVKIVVGR

SEQ ID NO: 2108283 - protein, 17 aa, Staphylococcus
ESKHLGGFPITGEFLVC

SEQ ID NO: 2108284 - protein, 17 aa, Staphylococcus
ESKHLGGFPITGQFLAC

SEQ ID NO: 2108285 - protein, 22 aa, Staphylococcus
ESKNLGGFPISGAFLVCKNPEV

SEQ ID NO: 2108286 - protein, 24 aa, Staphylococcus
ESKNLGGFPITGQFLICTNPDTIA

SEQ ID NO: 2108287 - protein, 21 aa, Staphylococcus
ESNDLLGRLNFKLVKNAKGVK

SEQ ID NO: 2108288 - protein, 37 aa, Staphylococcus
ESTHASLFGRQKSDLILFFPFTLTANVIGKAAEKEWR

SEQ ID NO: 2108289 - protein, 22 aa, Staphylococcus
ESTLEQLFQYRFKENQVEGHSL

SEQ ID NO: 2108290 - protein, 26 aa, Staphylococcus
ESTRYPNVFLIGPTVRHADAILCYIY

SEQ ID NO: 2108291 - protein, 23 aa, Staphylococcus
ESYPDYVERIKKQSKLWTTTDNA

SEQ ID NO: 2108292 - protein, 30 aa, Staphylococcus
ETAYLLDLLLDIRCPVVITGAMRSSNEIGS

SEQ ID NO: 2108293 - protein, 17 aa, Staphylococcus
ETDILLHDIYDLQPLKT

SEQ ID NO: 2108294 - protein, 18 aa, Staphylococcus
ETFTNIKIKLDPDGKQQQ

SEQ ID NO: 2108295 - protein, 26 aa, Staphylococcus
ETGDYLPVEQPKLPILAKFNKDLKHN

SEQ ID NO: 2108296 - protein, 26 aa, Staphylococcus
ETHGKNLEYYLLNDKFRNIYHFLTHE

SEQ ID NO: 2108297 - protein, 26 aa, Staphylococcus
ETLKNAHILVIPEANNPFKEKEQQAI

SEQ ID NO: 2108298 - protein, 17 aa, Staphylococcus
ETLYPDALRLSKLLNQQ

SEQ ID NO: 2108299 - protein, 17 aa, Staphylococcus
ETQLDEWQYLLDTVNSL

SEQ ID NO: 2108300 - protein, 24 aa, Staphylococcus
ETYAKYLEVVAYHYGISIQTNTAV

SEQ ID NO: 2108301 - protein, 20 aa, Staphylococcus
ETYNYPYNKIVLILNCRSDR

SEQ ID NO: 2108302 - protein, 17 aa, Staphylococcus
EVFHDKILPYDPTIYLV

SEQ ID NO: 2108303 - protein, 18 aa, Staphylococcus
EVIRALTAVNSNITQYLD

SEQ ID NO: 2108304 - protein, 17 aa, Staphylococcus
EVKSYKSAIKAAQRAFD

SEQ ID NO: 2108305 - protein, 24 aa, Staphylococcus
EVLAKLIYDIALDLTSTIPFKPTR

SEQ ID NO: 2108306 - protein, 20 aa, Staphylococcus
EVLGVHAFRIASGDYQKYNL

SEQ ID NO: 2108307 - protein, 25 aa, Staphylococcus
EVNVDMPITTALYKVLFENRPVDES

SEQ ID NO: 2108308 - protein, 25 aa, Staphylococcus
EVYQEFIKAGGTKALWEKIVLPESG

SEQ ID NO: 2108309 - protein, 20 aa, Staphylococcus
EYQFINASFLGKDSLMGSRA

SEQ ID NO: 2108310 - protein, 26 aa, Staphylococcus
EYQTNAGIYTAYFDKNDKLMKIMINF

SEQ ID NO: 2108311 - protein, 20 aa, Staphylococcus
EYYQQITKAIDMYNKLDLTK

SEQ ID NO: 2108312 - protein, 17 aa, Staphylococcus
FAAFSIATAASAGIQAD

SEQ ID NO: 2108313 - protein, 20 aa, Staphylococcus
FAATLVLSACSQDDAKEDEN

SEQ ID NO: 2108314 - protein, 22 aa, Staphylococcus
FACILIPALTGCEKDFKDKKEV

SEQ ID NO: 2108315 - protein, 20 aa, Staphylococcus
FALLVLSVSILGACTQSRSK

SEQ ID NO: 2108316 - protein, 19 aa, Staphylococcus
FANCALPYYLGNVVDSRNK

SEQ ID NO: 2108317 - protein, 18 aa, Staphylococcus
FANCGLPYYLGNIIDDRS

SEQ ID NO: 2108318 - protein, 27 aa, Staphylococcus
FAVILTICLIGLIFLATNQNALAKVHQ

SEQ ID NO: 2108319 - protein, 17 aa, Staphylococcus
FAVSLSVLLASCNNEAS

SEQ ID NO: 2108320 - protein, 18 aa, Staphylococcus
FAYMRETAFLKKLSEMHE

SEQ ID NO: 2108321 - protein, 25 aa, Staphylococcus
FDAMKLNKEALLKAKPDLILAHESQ

SEQ ID NO: 2108322 - protein, 24 aa, Staphylococcus
FDAMKLNKEQLLKAKPDLIVAHES

SEQ ID NO: 2108323 - protein, 21 aa, Staphylococcus
FDKDEVINGLIWSEVLSKPKQ

SEQ ID NO: 2108324 - protein, 22 aa, Staphylococcus
FDKIAAAKPDVIYISGRTASQK

SEQ ID NO: 2108325 - protein, 27 aa, Staphylococcus
FDLGPSILTMPYIFENLFNYSDKQMKD

SEQ ID NO: 2108326 - protein, 21 aa, Staphylococcus
FDRHNLVGVVMYKSKNGTTGF

SEQ ID NO: 2108327 - protein, 25 aa, Staphylococcus
FDSARPMQIGLVYDALKNKKLDVAV

SEQ ID NO: 2108328 - protein, 25 aa, Staphylococcus
FDTVRPMQIGLVYDALNNKKLDVAL

SEQ ID NO: 2108329 - protein, 18 aa, Staphylococcus
FEDYVDMEQLRYIYDVYF

SEQ ID NO: 2108330 - protein, 21 aa, Staphylococcus
FEFLVNKKATKRRKLFNGYIE

SEQ ID NO: 2108331 - protein, 24 aa, Staphylococcus
FEPRTAALKGYWEKVGLKTKVSMV

SEQ ID NO: 2108332 - protein, 21 aa, Staphylococcus
FESQIKWLKKHDAKFLTLKEF

SEQ ID NO: 2108333 - protein, 26 aa, Staphylococcus
FFDKLTDLLKFMIPGYKKEGKSQLVI

SEQ ID NO: 2108334 - protein, 19 aa, Staphylococcus
FFKPAPFKEQKNSTPSLWE

SEQ ID NO: 2108335 - protein, 17 aa, Staphylococcus
FGAMLYRQGNDVTLIDG

SEQ ID NO: 2108336 - protein, 24 aa, Staphylococcus
FGNRLRNEFNYNPSKSTDEMYYID

SEQ ID NO: 2108337 - protein, 19 aa, Staphylococcus
FGSALILGACGNDDTSNEN

SEQ ID NO: 2108338 - protein, 18 aa, Staphylococcus
FIEPGDGYLACGYVAKGR

SEQ ID NO: 2108339 - protein, 24 aa, Staphylococcus
FIFGFALVVICGIGLYAQGEKLEK

SEQ ID NO: 2108340 - protein, 24 aa, Staphylococcus
FIFGLILSIGFGIGVFSEWKTLAS

SEQ ID NO: 2108341 - protein, 21 aa, Staphylococcus
FIILVILGLVRTFENYAIIDD

SEQ ID NO: 2108342 - protein, 22 aa, Staphylococcus
FIIVGVILFFVSLIPATETQNT

SEQ ID NO: 2108343 - protein, 24 aa, Staphylococcus
FIKNSSIKKLIYRGIKSTVHFNSS

SEQ ID NO: 2108344 - protein, 18 aa, Staphylococcus
FKEQESEAFDLCIGADGI

SEQ ID NO: 2108345 - protein, 27 aa, Staphylococcus
FKGYLGSNIVKFFDYTFASVGVKPNEL

SEQ ID NO: 2108346 - protein, 18 aa, Staphylococcus
FKPNKYYRNGHPLDYRLT

SEQ ID NO: 2108347 - protein, 30 aa, Staphylococcus; identical to SEQ ID NO: 1842137

SEQ ID NO: 2108348 - protein, 25 aa, Staphylococcus
FKRVFSLIAILAIVFSTLGQTLNAQ

SEQ ID NO: 2108349 - protein, 25 aa, Staphylococcus
FKSARPMQIGLVYDALKNKKLDVAV

SEQ ID NO: 2108350 - protein, 23 aa, Staphylococcus
FKTFNRNRYAIDYWESLEGMRVQ

SEQ ID NO: 2108351 - protein, 31 aa, Staphylococcus
FKTQGNTAERFYYAAGGRALEYRQLFSFNEL

SEQ ID NO: 2108352 - protein, 24 aa, Staphylococcus
FLDHRVIKHYGSLVPLTELSDSLL

SEQ ID NO: 2108353 - protein, 23 aa, Staphylococcus
FLGSNIVKFFDYTFASVGIKPEE

SEQ ID NO: 2108354 - protein, 21 aa, Staphylococcus
FLKDRYEAMKNFPMFDNIEYT

SEQ ID NO: 2108355 - protein, 23 aa, Staphylococcus
FLLFLCLHNLLFPDTTKESMVLG

SEQ ID NO: 2108356 - protein, 18 aa, Staphylococcus
FLSLIYVYQHFISPMTPA

SEQ ID NO: 2108357 - protein, 30 aa, Staphylococcus
FMPGYNLFHIYPIFPLPERQKFFTQLKSII

SEQ ID NO: 2108358 - protein, 19 aa, Staphylococcus
FMQWFNHDPAFDYFNTMDS

SEQ ID NO: 2108359 - protein, 29 aa, Staphylococcus
FMVGDGMGPAYNTAYRYYADNPKTKELDQ

SEQ ID NO: 2108360 - protein, 24 aa, Staphylococcus
FNDNDWEITGIPSSLRIENAAGRT

SEQ ID NO: 2108361 - protein, 24 aa, Staphylococcus
FNDQNLYDWGQCTWHVFNRRAETG

SEQ ID NO: 2108362 - protein, 18 aa, Staphylococcus
FNDSLSYLDYKKQKPDAK

SEQ ID NO: 2108363 - protein, 18 aa, Staphylococcus
FNHSNLYDWGQCTWHVFN

SEQ ID NO: 2108364 - protein, 20 aa, Staphylococcus
FNIYNRYTLHRFNEEYELAP

SEQ ID NO: 2108365 - protein, 26 aa, Staphylococcus
FNLKNVKAKWNISKAMIKEGNGGSDE

SEQ ID NO: 2108366 - protein, 17 aa, Staphylococcus
FNQQYYGVPIAYPNETF

SEQ ID NO: 2108367 - protein, 18 aa, Staphylococcus
FNQQYYGVPIAYPNETFV

SEQ ID NO: 2108368 - protein, 18 aa, Staphylococcus
FNSSYYGVPIAYPNETFV

SEQ ID NO: 2108369 - protein, 18 aa, Staphylococcus
FNTAYRYYQNDPSAKSMK

SEQ ID NO: 2108370 - protein, 19 aa, Staphylococcus
FPNIMDSSTGWLLLQGVIS

SEQ ID NO: 2108371 - protein, 23 aa, Staphylococcus
FPSMIAITLFGAAFTSQHAHAAE

SEQ ID NO: 2108372 - protein, 23 aa, Staphylococcus
FPSMIALTLFGAAFTTHHAEASE

SEQ ID NO: 2108373 - protein, 19 aa, Staphylococcus
FQDRRWMEDDYTKSETKRI

SEQ ID NO: 2108374 - protein, 34 aa, Staphylococcus
FQEHNNHLKYFNYHPQRPFNYYKDQHSLNQNIRT

SEQ ID NO: 2108375 - protein, 39 aa, Staphylococcus
FRDIDRAMVWGFNWKLGPFQLWDLMGFDRVKSRIEDELG

SEQ ID NO: 2108376 - protein, 26 aa, Staphylococcus
FRIGYMTKHKLVITVPKAIDHLTVKG

SEQ ID NO: 2108377 - protein, 21 aa, Staphylococcus
FSEASLLKMHQLNSNVPLIRL

SEQ ID NO: 2108378 - protein, 35 aa, Staphylococcus
FSIRKFNIGIFSALITTVTFLAHPSQASASELDST

SEQ ID NO: 2108379 - protein, 20 aa, Staphylococcus
FSLIISLMIFTLVGCQSKSN

SEQ ID NO: 2108380 - protein, 30 aa, Staphylococcus
FSLILLLTIISSGFGFYLYRSSHSPDQLDQ

SEQ ID NO: 2108381 - protein, 26 aa, Staphylococcus
FSLNKPLNQITFYDVFLAIEGRDAIF

SEQ ID NO: 2108382 - protein, 18 aa, Staphylococcus
FSSLLILGACGQVGDNSI

SEQ ID NO: 2108383 - protein, 39 aa, Staphylococcus
FSYENPKYLPRFIFGHYMKSYLLHFDKIFDNLTLIHDEV

SEQ ID NO: 2108384 - protein, 23 aa, Staphylococcus
FTERVKTFTEGINRTYHLGNTKD

SEQ ID NO: 2108385 - protein, 29 aa, Staphylococcus
FTFIESLLIILILTILLNATLRVNVFNNI

SEQ ID NO: 2108386 - protein, 17 aa, Staphylococcus
FTIAFGVGTYEEQFRKG

SEQ ID NO: 2108387 - protein, 24 aa, Staphylococcus
FTIGLLMFIGFGLATYFEMKKVSN

SEQ ID NO: 2108388 - protein, 19 aa, Staphylococcus
FTSFLILGACSNKDSSSEN

SEQ ID NO: 2108389 - protein, 17 aa, Staphylococcus
FTSWRSLYNPKFKNDII

SEQ ID NO: 2108390 - protein, 32 aa, Staphylococcus
FVAHSMGNLSFAYFMKLYGQDTQLPQLNKEVN

SEQ ID NO: 2108391 - protein, 23 aa, Staphylococcus
FVNPFMKEVWDYDITVAKAAAKA

SEQ ID NO: 2108392 - protein, 19 aa, Staphylococcus
FVPMIQRIVDSGFDGYFVL

SEQ ID NO: 2108393 - protein, 20 aa, Staphylococcus
FVSIIAVLLLAGCQSQEDKE

SEQ ID NO: 2108394 - protein, 24 aa, Staphylococcus
FVSILLMVFILEGCSKQKDSHTED

SEQ ID NO: 2108395 - protein, 18 aa, Staphylococcus
FVYAWRKVVNPKTGSEYA

SEQ ID NO: 2108396 - protein, 23 aa, Staphylococcus
FYHDMNGLLMAKLNDIHLNIVII

SEQ ID NO: 2108397 - protein, 19 aa, Staphylococcus
FYLISDFNGNQSHGWIPSS

SEQ ID NO: 2108398 - protein, 20 aa, Staphylococcus
GAADWVIDGAFSDYADSMKN

SEQ ID NO: 2108399 - protein, 18 aa, Staphylococcus
GAADWVLDGGFSDYANQI

SEQ ID NO: 2108400 - protein, 27 aa, Staphylococcus
GADIHCDQLIILTAIDYVYVNYNTDNQ

SEQ ID NO: 2108401 - protein, 23 aa, Staphylococcus
GAEPLHLRVYFENKSRKILRAAA

SEQ ID NO: 2108402 - protein, 28 aa, Staphylococcus
GAHAQDARWLTKHPKLQEYGQYHGGGAH

SEQ ID NO: 2108403 - protein, 18 aa, Staphylococcus
GAITATTLLAGCDLGDMI

SEQ ID NO: 2108404 - protein, 22 aa, Staphylococcus
GALTGTMLLAGCSLSDFGLGNG

SEQ ID NO: 2108405 - protein, 22 aa, Staphylococcus
GASLFLVGCGSQNLGPLEDKTT

SEQ ID NO: 2108406 - protein, 18 aa, Staphylococcus
GASLLLAGCGSQNLGPLE

SEQ ID NO: 2108407 - protein, 25 aa, Staphylococcus
GATIAFYVAQWPSARLNHWQVLLKA

SEQ ID NO: 2108408 - protein, 26 aa, Staphylococcus
GAVDKQQLYLTPYGAKSYIERLGQSM

SEQ ID NO: 2108409 - protein, 20 aa, Staphylococcus
GCFWCLVKPFTSYPGIENVV

SEQ ID NO: 2108410 - protein, 23 aa, Staphylococcus
GDDYRMILPFKESQARGLLQQNM

SEQ ID NO: 2108411 - protein, 26 aa, Staphylococcus
GDIDMNAFQHFAFLDQYKKAHKDAKI

SEQ ID NO: 2108412 - protein, 26 aa, Staphylococcus
GDIDMNAFQHFAFLNEYKKAHKDAKI

SEQ ID NO: 2108413 - protein, 29 aa, Staphylococcus
GDKDILQCINPNVEIWLTKKGFNIYNRYT

SEQ ID NO: 2108414 - protein, 24 aa, Staphylococcus
GDKDILQCINPNVQVWLTKKGFNI

SEQ ID NO: 2108415 - protein, 34 aa, Staphylococcus
GDKSFPQIQYKNHDPIILVHGFNGYTADNGPVLG

SEQ ID NO: 2108416 - protein, 21 aa, Staphylococcus
GDLNHVYIAKRDPKTLPDDES

SEQ ID NO: 2108417 - protein, 23 aa, Staphylococcus
GDNYRTILPFKESKARGVLQDNM

SEQ ID NO: 2108418 - protein, 23 aa, Staphylococcus
GDNYRTILPFKESQARGVLQDNM

SEQ ID NO: 2108419 - protein, 24 aa, Staphylococcus
GDNYRTLLPFKESKARGILQDNMT

SEQ ID NO: 2108420 - protein, 27 aa, Staphylococcus
GDPVPDATITWLPNNSPDKNNTRIGES

SEQ ID NO: 2108421 - protein, 24 aa, Staphylococcus
GEDVNTYAYGPGADKFRGNIDNTD

SEQ ID NO: 2108422 - protein, 25 aa, Staphylococcus
GEEQLNQIAYLKATYKNATKISKDT

SEQ ID NO: 2108423 - protein, 24 aa, Staphylococcus
GERTLLFGPFANVGPKFLKNGSNL

SEQ ID NO: 2108424 - protein, 21 aa, Staphylococcus
GESITVRANILFDGETTPIVK

SEQ ID NO: 2108425 - protein, 18 aa, Staphylococcus
GEWGFSFTDKDGNLAGSY

SEQ ID NO: 2108426 - protein, 31 aa, Staphylococcus
GFAGLVGEDAFTLYPNYWGGGKYNIKSELTK

SEQ ID NO: 2108427 - protein, 27 aa, Staphylococcus
GFDFNTVRPMQIGLVYDALNSNNLDVA

SEQ ID NO: 2108428 - protein, 19 aa, Staphylococcus
GFDSDYIFTLRNMEDTDAI

SEQ ID NO: 2108429 - protein, 17 aa, Staphylococcus
GFEKAFQNAIDYSNKHK

SEQ ID NO: 2108430 - protein, 27 aa, Staphylococcus
GFKFKTVRPMQIGLVYDALKNKKLDVA

SEQ ID NO: 2108431 - protein, 26 aa, Staphylococcus
GFQKKFHQKFFPSYGFDNTYAFMVTK

SEQ ID NO: 2108432 - protein, 25 aa, Staphylococcus
GFQYNFTSNGTNWSWNYAQVGSTTQ

SEQ ID NO: 2108433 - protein, 18 aa, Staphylococcus
GFSIAQRLFNDGFNVAVV

SEQ ID NO: 2108434 - protein, 18 aa, Staphylococcus
GFVIQYGLGFLQIKHFTK

SEQ ID NO: 2108435 - protein, 18 aa, Staphylococcus
GFYVTPYLNRVNGVFFGQ

SEQ ID NO: 2108436 - protein, 21 aa, Staphylococcus
GGCLWGVQAFVKTLPGVVETE

SEQ ID NO: 2108437 - protein, 29 aa, Staphylococcus
GGEQQLKKIAYLKATFKKASKISKDTNDV

SEQ ID NO: 2108438 - protein, 17 aa, Staphylococcus
GGFPISGQFIACTNPEV

SEQ ID NO: 2108439 - protein, 23 aa, Staphylococcus
GGIEPTVDWLRESLKRKKHVITA

SEQ ID NO: 2108440 - protein, 25 aa, Staphylococcus
GGKEQLNQIAYLKATFRNANKIDKD

SEQ ID NO: 2108441 - protein, 23 aa, Staphylococcus
GGKTLTINLRKNAKWSNGDPVTA

SEQ ID NO: 2108442 - protein, 25 aa, Staphylococcus
GGNLYTAGQCTYYVYDRVGGKVGST

SEQ ID NO: 2108443 - protein, 26 aa, Staphylococcus
GGRFGDLLFNTLGFKPADQHVKASPH

SEQ ID NO: 2108444 - protein, 19 aa, Staphylococcus
GGWFSSMYNVKSSISQFTN

SEQ ID NO: 2108445 - protein, 17 aa, Staphylococcus
GHHPEIILAGRRINDNM

SEQ ID NO: 2108446 - protein, 26 aa, Staphylococcus
GHVYEVDPKLWYFSAGGTTTTIKQIE

SEQ ID NO: 2108447 - protein, 34 aa, Staphylococcus
GIAIVMLFVTFITSLCLAFYLTKRKLYNANDLLK

SEQ ID NO: 2108448 - protein, 34 aa, Staphylococcus
GIDGNQDIYKPTWKSEAYSYRSATMHLATTYATD

SEQ ID NO: 2108449 - protein, 18 aa, Staphylococcus
GIGVGVAAGFAVSLRNRD

SEQ ID NO: 2108450 - protein, 26 aa, Staphylococcus
GIICAVLLYFSYVGLGASSDKIIIQT

SEQ ID NO: 2108451 - protein, 21 aa, Staphylococcus
GILFLTLTLVILAACGSVSDN

SEQ ID NO: 2108452 - protein, 31 aa, Staphylococcus
GILHHDIYDLTPLKTFVFGRTVLLGDAAHAT

SEQ ID NO: 2108453 - protein, 17 aa, Staphylococcus
GIPTDIKPFLKTRLISP

SEQ ID NO: 2108454 - protein, 21 aa, Staphylococcus
GISTYWWNANNWDTAAAADGY

SEQ ID NO: 2108455 - protein, 31 aa, Staphylococcus
GITLEQLYTLNPGIQPLIFPGDKIVVSESGV

SEQ ID NO: 2108456 - protein, 23 aa, Staphylococcus
GITPKQFIDVKAFMGDTADGYPG

SEQ ID NO: 2108457 - protein, 26 aa, Staphylococcus
GITYQPTTHRWLLISADRSEQNPSRF

SEQ ID NO: 2108458 - protein, 26 aa, Staphylococcus
GIVASTLFLGACDLNIHLPGGNNDSS

SEQ ID NO: 2108459 - protein, 20 aa, Staphylococcus
GIVPMLDNKAYWFISVNAKQ

SEQ ID NO: 2108460 - protein, 18 aa, Staphylococcus
GIYVYKPNKDGLATSFVL

SEQ ID NO: 2108461 - protein, 22 aa, Staphylococcus
GKADGVWFQLKPGIVSKAELVK

SEQ ID NO: 2108462 - protein, 22 aa, Staphylococcus
GKEQYYLVSDYNKGTLIGWVHQ

SEQ ID NO: 2108463 - protein, 30 aa, Staphylococcus
GKETYLHGSINHQWGWIKQSDVATPAKSAV

SEQ ID NO: 2108464 - protein, 22 aa, Staphylococcus
GKHNYKLVDFTLVKMKQPVKHA

SEQ ID NO: 2108465 - protein, 23 aa, Staphylococcus
GKKIYVYNWGEYIDPELIKQFEN

SEQ ID NO: 2108466 - protein, 19 aa, Staphylococcus
GKLRAGLDLFKKPIIMPNN

SEQ ID NO: 2108467 - protein, 34 aa, Staphylococcus
GKSYAGAYRDWKPGQKIHLIGHSMGGQTVRLLEE

SEQ ID NO: 2108468 - protein, 26 aa, Staphylococcus
GKTYEGVYKDWKPGQKVHLVGHSMGG

SEQ ID NO: 2108469 - protein, 21 aa, Staphylococcus
GKTYTFHLRDDVKFHDGTKFD

SEQ ID NO: 2108470 - protein, 23 aa, Staphylococcus
GKVKAVKFYKLKDTKTPVTLKVK

SEQ ID NO: 2108471 - protein, 21 aa, Staphylococcus
GKVSTFRLLLIDTPETKDPRK

SEQ ID NO: 2108472 - protein, 22 aa, Staphylococcus
GKYDPHVWLDPVLSQQFAKDIK

SEQ ID NO: 2108473 - protein, 29 aa, Staphylococcus
GKYQFLQSTWDSVAPAQYKGVSPAQAPES

SEQ ID NO: 2108474 - protein, 18 aa, Staphylococcus
GLGAGVATGLGVALMNRD

SEQ ID NO: 2108475 - protein, 17 aa, Staphylococcus
GLGVGAAAGFAVALRNR

SEQ ID NO: 2108476 - protein, 19 aa, Staphylococcus
GLIEPYKVKNHKKLYKDWI

SEQ ID NO: 2108477 - protein, 23 aa, Staphylococcus
GLIFIIALLCTVISINGNTYAAT

SEQ ID NO: 2108478 - protein, 17 aa, Staphylococcus
GLILWLGIVEKRQHSDR

SEQ ID NO: 2108479 - protein, 37 aa, Staphylococcus
GLKYRLTSGTFFIKMNEKEFPAFKNKNLRLAIAQSIN

SEQ ID NO: 2108480 - protein, 18 aa, Staphylococcus
GLLASTLLLTACGQGEKN

SEQ ID NO: 2108481 - protein, 23 aa, Staphylococcus
GLNGNLIYPGQSLTIPGASGGQG

SEQ ID NO: 2108482 - protein, 22 aa, Staphylococcus
GLNPLQLIDVKAFMGDTADGYP

SEQ ID NO: 2108483 - protein, 19 aa, Staphylococcus
GLSAAYYLKKEYPQFDAHV

SEQ ID NO: 2108484 - protein, 22 aa, Staphylococcus
GLTDLYIGTPTRINGAGAQQVI

SEQ ID NO: 2108485 - protein, 19 aa, Staphylococcus
GLVEAGVGLLPSGGGLAEM

SEQ ID NO: 2108486 - protein, 31 aa, Staphylococcus; identical to SEQ ID NO: 1720930

SEQ ID NO: 2108487 - protein, 20 aa, Staphylococcus
GLYIQSLIYNYPFEKEEITA

SEQ ID NO: 2108488 - protein, 19 aa, Staphylococcus
GLYVLMPTPELKTGPLEWE

SEQ ID NO: 2108489 - protein, 18 aa, Staphylococcus
GMFSHQLNQGNTATGTLI

SEQ ID NO: 2108490 - protein, 19 aa, Staphylococcus
GMGPSFNTAYRYYQNDPSA

SEQ ID NO: 2108491 - protein, 18 aa, Staphylococcus
GMHPHVIEPVKWVKGKDG

SEQ ID NO: 2108492 - protein, 18 aa, Staphylococcus
GMKFFKVEPPKGNFASIV

SEQ ID NO: 2108493 - protein, 31 aa, Staphylococcus
GMSYQKLMKLNGLKSFLIHPGQKLKVSGTVS

SEQ ID NO: 2108494 - protein, 22 aa, Staphylococcus
GMTIGLAMNSVYYYQKEKDGET

SEQ ID NO: 2108495 - protein, 24 aa, Staphylococcus
GMTIGLAMNSVYYYQKEKDGETYS

SEQ ID NO: 2108496 - protein, 25 aa, Staphylococcus
GMTIGLAMNSVYYYQKEKDGETYSE

SEQ ID NO: 2108497 - protein, 18 aa, Staphylococcus
GMTINLLGLTFKENCPDL

SEQ ID NO: 2108498 - protein, 31 aa, Staphylococcus
GMVAVILSLCLAFLLFIATNQNALAKVHQTI

SEQ ID NO: 2108499 - protein, 23 aa, Staphylococcus
GMVDNEGDTWYQAPGGGDVVGYT

SEQ ID NO: 2108500 - protein, 18 aa, Staphylococcus
GMVLYINRNTRTTKGNFI

SEQ ID NO: 2108501 - protein, 18 aa, Staphylococcus
GMVTTAILLGSGVTHNVQ

SEQ ID NO: 2108502 - protein, 25 aa, Staphylococcus
GNETKIFEVIAKPNPPVISTLAAQL

SEQ ID NO: 2108503 - protein, 33 aa, Staphylococcus
GNFAAALDTNKLIYTVKLPENFEYIDDSTVATF

SEQ ID NO: 2108504 - protein, 26 aa, Staphylococcus
GNHTFQISANFRSYPSKKESLEDYAN

SEQ ID NO: 2108505 - protein, 18 aa, Staphylococcus
GNITLNKHFRQMDLNDVF

SEQ ID NO: 2108506 - protein, 22 aa, Staphylococcus
GNLLGPTLKLKKGDKVKIKLIN

SEQ ID NO: 2108507 - protein, 24 aa, Staphylococcus
GNSDIYRPTWKSEASSYRDATAHL

SEQ ID NO: 2108508 - protein, 25 aa, Staphylococcus
GNSVPRFHITWGTGPGLVEPFSRFV

SEQ ID NO: 2108509 - protein, 24 aa, Staphylococcus
GNTKLHLRVYFDKTNRRIIRAAAV

SEQ ID NO: 2108510 - protein, 24 aa, Staphylococcus
GNTPLHLRVYFNKDNRRLLRAAAV

SEQ ID NO: 2108511 - protein, 27 aa, Staphylococcus
GNTQKEMGFSWYTTDRFKDAKVWVSES

SEQ ID NO: 2108512 - protein, 21 aa, Staphylococcus
GNTVKWRYHYDDRTGNFGYVK

SEQ ID NO: 2108513 - protein, 29 aa, Staphylococcus
GNVSNHAQFLLDESFLKSLDKGTVSFNGY

SEQ ID NO: 2108514 - protein, 25 aa, Staphylococcus
GPKAFKLHTLAGFVTYKSAHKQTGI

SEQ ID NO: 2108515 - protein, 21 aa, Staphylococcus
GPSYNSAYRYYADNPNTKELD

SEQ ID NO: 2108516 - protein, 18 aa, Staphylococcus
GQADRSYRYSDHYKNYVF

SEQ ID NO: 2108517 - protein, 18 aa, Staphylococcus
GQAYWSFGGLFLVNSKIQ

SEQ ID NO: 2108518 - protein, 21 aa, Staphylococcus
GQNTLYKMRWNPENPGTHQYA

SEQ ID NO: 2108519 - protein, 21 aa, Staphylococcus
GQNTLYKMRWNPENPGVHQYA

SEQ ID NO: 2108520 - protein, 24 aa, Staphylococcus
GQTIRLMEHFLRNGNQEEIDYQRQ

SEQ ID NO: 2108521 - protein, 23 aa, Staphylococcus
GQTVRLLEEMLRKGNPEEVKYQK

SEQ ID NO: 2108522 - protein, 23 aa, Staphylococcus
GQYDGYWLANYNPGQPTREHVLW

SEQ ID NO: 2108523 - protein, 34 aa, Staphylococcus
GRALEYRQLFSFNELYVEPLNVFTERVKTFTEGI

SEQ ID NO: 2108524 - protein, 22 aa, Staphylococcus
GRFGDLVFNTLGFKPADKHVKI

SEQ ID NO: 2108525 - protein, 25 aa, Staphylococcus
GRFGGLVFDILGFKPADENVSNSPH

SEQ ID NO: 2108526 - protein, 25 aa, Staphylococcus
GRGGEILYQAFGLKMPKAVDDLTKK

SEQ ID NO: 2108527 - protein, 34 aa, Staphylococcus
GRQTDGGFQWSQDHKSLIYRYDATSGRTINANDV

SEQ ID NO: 2108528 - protein, 27 aa, Staphylococcus
GRTYEGIMPDWAPGKKIHLVGHSMGGQ

SEQ ID NO: 2108529 - protein, 31 aa, Staphylococcus
GRVGIVPLIDNQAYWFITINAKERDAQYQSF

SEQ ID NO: 2108530 - protein, 18 aa, Staphylococcus
GSAKDPFKFVQYTDTQNA

SEQ ID NO: 2108531 - protein, 17 aa, Staphylococcus
GSANDEAKAAEKDQVST

SEQ ID NO: 2108532 - protein, 23 aa, Staphylococcus
GSGYWSGTFLHATNKSAPYYATR

SEQ ID NO: 2108533 - protein, 26 aa, Staphylococcus
GSIQNDGLWYFIPNESSKGQMTEVLN

SEQ ID NO: 2108534 - protein, 23 aa, Staphylococcus
GSKIVRTLEVFGVQMLQYGDVSL

SEQ ID NO: 2108535 - protein, 18 aa, Staphylococcus
GSKYLATLWAGDTPLEDY

SEQ ID NO: 2108536 - protein, 19 aa, Staphylococcus
GSLVWFVHDKNILPNEEVH

SEQ ID NO: 2108537 - protein, 27 aa, Staphylococcus
GSNLYTAGQCTYYVFDRVGGKIGSTWG

SEQ ID NO: 2108538 - protein, 28 aa, Staphylococcus
GSNLYTAGQCTYYVYDKVGGKIGSTWGN

SEQ ID NO: 2108539 - protein, 27 aa, Staphylococcus
GSNYDRAVELYYYIKGGTVDYGAAHAE

SEQ ID NO: 2108540 - protein, 17 aa, Staphylococcus
GSPWGVTDLKAAIRYYR

SEQ ID NO: 2108541 - protein, 25 aa, Staphylococcus
GSSPYPQGQCTWYVYQRMQQYDSSI

SEQ ID NO: 2108542 - protein, 27 aa, Staphylococcus
GSTAEGRWLAKNAYKYGFILRYPKGKE

SEQ ID NO: 2108543 - protein, 25 aa, Staphylococcus
GSYALSRPLYIYTNEKKLKDNKGFQ

SEQ ID NO: 2108544 - protein, 23 aa, Staphylococcus
GSYWGNANNWAYSAKNAGLTVDN

SEQ ID NO: 2108545 - protein, 25 aa, Staphylococcus
GTDARMLYWFTEKEYPVLRKPQGAN

SEQ ID NO: 2108546 - protein, 22 aa, Staphylococcus
GTGTPYVAIVDKHTGSIVDNYN

SEQ ID NO: 2108547 - protein, 17 aa, Staphylococcus
GTGYIGLEILDNLYERG

SEQ ID NO: 2108548 - protein, 29 aa, Staphylococcus
GTHITPIRTTVFAPLGIYSKKIKDIKDLK

SEQ ID NO: 2108549 - protein, 20 aa, Staphylococcus
GTLRLGLYPCHIKEGTLADS

SEQ ID NO: 2108550 - protein, 20 aa, Staphylococcus
GTLRLGLYPCHIKEGTLAES

SEQ ID NO: 2108551 - protein, 21 aa, Staphylococcus
GTLRLGLYPCTIKDHTLAHDI

SEQ ID NO: 2108552 - protein, 18 aa, Staphylococcus
GTLTHLTDAQRQAFEANV

SEQ ID NO: 2108553 - protein, 17 aa, Staphylococcus
GTQLVVLHYQSINKLCD

SEQ ID NO: 2108554 - protein, 18 aa, Staphylococcus
GTRKIVKDAMNRIGRLSG

SEQ ID NO: 2108555 - protein, 28 aa, Staphylococcus
GTSLDTARFQFFLSREFDVAPNQVYAPI

SEQ ID NO: 2108556 - protein, 31 aa, Staphylococcus
GTTYHFASDGTYFEWQYYPSNGAADDTTMNS

SEQ ID NO: 2108557 - protein, 33 aa, Staphylococcus
GTTYRHIMNLNGLNSFLIFPGQQLKVSGSVSSN

SEQ ID NO: 2108558 - protein, 18 aa, Staphylococcus
GTVNGKTGWIAEKDLVQS

SEQ ID NO: 2108559 - protein, 17 aa, Staphylococcus
GTWITYDKKTKRAHITS

SEQ ID NO: 2108560 - protein, 33 aa, Staphylococcus
GVDMRGTFLVTKFLLPLMMDNGGSIINTASFSG

SEQ ID NO: 2108561 - protein, 20 aa, Staphylococcus
GVFLLLLAACGSNDGSKEDS

SEQ ID NO: 2108562 - protein, 18 aa, Staphylococcus
GVGGLQIIKVYKSNGKVT

SEQ ID NO: 2108563 - protein, 18 aa, Staphylococcus
GVLNDMKEMGLSSKVKAL

SEQ ID NO: 2108564 - protein, 25 aa, Staphylococcus
GVSISTLNNPFFVKIKDGISAEAKK

SEQ ID NO: 2108565 - protein, 28 aa, Staphylococcus
GVSISTLNNPFFVKIKNGIEKDAKAQGM

SEQ ID NO: 2108566 - protein, 19 aa, Staphylococcus
GVTLTLALSASVLPANNDA

SEQ ID NO: 2108567 - protein, 26 aa, Staphylococcus
GVVFADIYLMALPTKAMREVATQIDD

SEQ ID NO: 2108568 - protein, 21 aa, Staphylococcus
GWVSKYYLTAPTQSKVATSSK

SEQ ID NO: 2108569 - protein, 25 aa, Staphylococcus
GYANVADMSYPITKYLIADNGKVYK

SEQ ID NO: 2108570 - protein, 26 aa, Staphylococcus
GYDPNNPYMNMPDQEWRKNTGDGLSS

SEQ ID NO: 2108571 - protein, 18 aa, Staphylococcus
GYFEIKSHNKANAGLGVY

SEQ ID NO: 2108572 - protein, 30 aa, Staphylococcus
GYFRLGLDTLPEILTYHGPFKALRGFDYFS

SEQ ID NO: 2108573 - protein, 21 aa, Staphylococcus
GYHWYDRSTFAPGSYGSTKST

SEQ ID NO: 2108574 - protein, 20 aa, Staphylococcus
GYKIKLIGKGIYEHGKVHAS

SEQ ID NO: 2108575 - protein, 17 aa, Staphylococcus
GYKIKLIGKSTYHHSEV

SEQ ID NO: 2108576 - protein, 20 aa, Staphylococcus
GYQYEPWHLRYLGKNNAAKV

SEQ ID NO: 2108577 - protein, 27 aa, Staphylococcus
GYVIKGQMVKPFDKELFKLKDSQISDV

SEQ ID NO: 2108578 - protein, 32 aa, Staphylococcus
HAADIGNEPFIRQLAYDYAKFQGSKHSKVDVG

SEQ ID NO: 2108579 - protein, 17 aa, Staphylococcus
HAISLLQNKADNSALVE

SEQ ID NO: 2108580 - protein, 26 aa, Staphylococcus
HAQEFVTPLAFQAISRNPVYTNTFKE

SEQ ID NO: 2108581 - protein, 24 aa, Staphylococcus
HAQEFVTPLAFQSISKNPVYTNTF

SEQ ID NO: 2108582 - protein, 31 aa, Staphylococcus
HDFMPGYNLFHIHPIFPIPEKEQFIAKINKI

SEQ ID NO: 2108583 - protein, 33 aa, Staphylococcus
HDFTPGYNLFHIYPIFPLPERQKFFTQLKNIMG

SEQ ID NO: 2108584 - protein, 32 aa, Staphylococcus
HDFYPGYNLFHIYPIFPIPEREKFFAQVITII

SEQ ID NO: 2108585 - protein, 18 aa, Staphylococcus
HDPAFDYFNTMDSTTVAT

SEQ ID NO: 2108586 - protein, 30 aa, Staphylococcus
HEFIPGYSLFHIYPIFPIPERERFLEQLKR

SEQ ID NO: 2108587 - protein, 20 aa, Staphylococcus
HEPWSQPEKGYKWYDRSTFK

SEQ ID NO: 2108588 - protein, 17 aa, Staphylococcus
HETWAPSLILRLVLGQR

SEQ ID NO: 2108589 - protein, 29 aa, Staphylococcus
HFKGYLGSNIVKFFDYTFASVGVSPKELS

SEQ ID NO: 2108590 - protein, 24 aa, Staphylococcus
HFKNKEMINIKRGKKVQLAEQILD

SEQ ID NO: 2108591 - protein, 23 aa, Staphylococcus
HGEYDPHIWLDPKMDQTFAKEIK

SEQ ID NO: 2108592 - protein, 21 aa, Staphylococcus
HGFMKFLADVYGRYEIARKYF

SEQ ID NO: 2108593 - protein, 22 aa, Staphylococcus
HGGTISPLFQGNHDNMISSITT

SEQ ID NO: 2108594 - protein, 25 aa, Staphylococcus
HGGYDPHVWLDPKFDQTFAKEIKDE

SEQ ID NO: 2108595 - protein, 23 aa, Staphylococcus
HGKYDPHVWLDPKMDQTFAKEIK

SEQ ID NO: 2108596 - protein, 26 aa, Staphylococcus
HGYSYAELYDLINEKYLIKTGQVAPW

SEQ ID NO: 2108597 - protein, 25 aa, Staphylococcus
HHHGKYDPHIWLDPVISQKFAKEIK

SEQ ID NO: 2108598 - protein, 21 aa, Staphylococcus
HHPRLPILMTSRSANLPSVRG

SEQ ID NO: 2108599 - protein, 19 aa, Staphylococcus
HIALGDWADAVIIVPATAN

SEQ ID NO: 2108600 - protein, 19 aa, Staphylococcus
HIDLVFNKDFKEAHPAAYT

SEQ ID NO: 2108601 - protein, 19 aa, Staphylococcus
HIDLVFNKNFKEAHPAAYT

SEQ ID NO: 2108602 - protein, 25 aa, Staphylococcus
HIENPREFINPLPHISFVRGVNNKE

SEQ ID NO: 2108603 - protein, 19 aa, Staphylococcus
HIKQYNFVAHSMGNLSFAY

SEQ ID NO: 2108604 - protein, 29 aa, Staphylococcus
HIMRLNGLNNFFIYPGQKLRVSGSASSNT

SEQ ID NO: 2108605 - protein, 18 aa, Staphylococcus
HITACTWTSKKWPFTTPE

SEQ ID NO: 2108606 - protein, 30 aa, Staphylococcus
HIVNQNGLPTDGFTYRWNQATTGTNTESWD

SEQ ID NO: 2108607 - protein, 27 aa, Staphylococcus
HKDAKIQALCTTVLAPLGIYSDKIKNI

SEQ ID NO: 2108608 - protein, 24 aa, Staphylococcus
HKGILGTGIVRIFDMTIAQTGLTE

SEQ ID NO: 2108609 - protein, 33 aa, Staphylococcus
HKGLFGRQKADLNLFFPFTVTANVIGKAKEKEW

SEQ ID NO: 2108610 - protein, 31 aa, Staphylococcus
HKLEIQLNRPIPYINELLTLSTFYPQDEKIS

SEQ ID NO: 2108611 - protein, 20 aa, Staphylococcus
HKMNKNIPLILLVEDNDISK

SEQ ID NO: 2108612 - protein, 36 aa, Staphylococcus
HKRRNTLYTAIVLLLALILLVFAIRAIHVDPVKSDA

SEQ ID NO: 2108613 - protein, 20 aa, Staphylococcus
HKVDVLLGGGSKYFGKENGN

SEQ ID NO: 2108614 - protein, 23 aa, Staphylococcus
HLKDLGFLVHPFTVNETADMQRL

SEQ ID NO: 2108615 - protein, 26 aa, Staphylococcus
HLQSDQLIILTAVDYVYINYGKDNQK

SEQ ID NO: 2108616 - protein, 27 aa, Staphylococcus
HNGETIKKVNLFVKPKLEQSIGFYSDN

SEQ ID NO: 2108617 - protein, 28 aa, Staphylococcus
HNMHPDLVKILGRLKFRTSYGQNVLKHS

SEQ ID NO: 2108618 - protein, 26 aa, Staphylococcus
HNMHPDLVKILGRLQYRTSYGQNVLK

SEQ ID NO: 2108619 - protein, 25 aa, Staphylococcus
HNMHPELVKILGRLNYRTSYGQNVL

SEQ ID NO: 2108620 - protein, 25 aa, Staphylococcus
HNPETHLIPIVLQAALGQRDAITIF

SEQ ID NO: 2108621 - protein, 24 aa, Staphylococcus
HNTTGIYFYQPNSKGMTVWFDVDN

SEQ ID NO: 2108622 - protein, 24 aa, Staphylococcus
HNVNLRNGDPFTIALFGVDSNAQR

SEQ ID NO: 2108623 - protein, 18 aa, Staphylococcus
HQLKLDIQQLNQDISNQK

SEQ ID NO: 2108624 - protein, 23 aa, Staphylococcus
HQLKLDIQQLNQDISNQKSTIAG

SEQ ID NO: 2108625 - protein, 41 aa, Staphylococcus
HQSDFNRLWSPDQYDNSFSLTTLIQNLFHFDSDISDYEQPS

SEQ ID NO: 2108626 - protein, 17 aa, Staphylococcus
HQYFSNHNYSYAELYDL

SEQ ID NO: 2108627 - protein, 28 aa, Staphylococcus
HRDYRTTFSLLYRLYDKLLTTVKNPEQL

SEQ ID NO: 2108628 - protein, 18 aa, Staphylococcus
HRGLDVTLIHRSEHINKL

SEQ ID NO: 2108629 - protein, 17 aa, Staphylococcus
HRKNILNTNFSTLGVGV

SEQ ID NO: 2108630 - protein, 17 aa, Staphylococcus
HSDPVGYFSQWGYNMNQ

SEQ ID NO: 2108631 - protein, 17 aa, Staphylococcus
HSGDPRNYQASGNVLVL

SEQ ID NO: 2108632 - protein, 35 aa, Staphylococcus
HSKGKYSMMARNVNPIGYYQMMAEPGSSGGAILNS

SEQ ID NO: 2108633 - protein, 19 aa, Staphylococcus
HSLGNLLIAALTNITDDFG

SEQ ID NO: 2108634 - protein, 17 aa, Staphylococcus
HTLLEKYGENSNYKEIV

SEQ ID NO: 2108635 - protein, 18 aa, Staphylococcus
HTSYKMINPKLNVPLVKS

SEQ ID NO: 2108636 - protein, 22 aa, Staphylococcus
HTYHRIISLIPSNTEILYRLGL

SEQ ID NO: 2108637 - protein, 19 aa, Staphylococcus
HVALGDWADAIIVAPATAN

SEQ ID NO: 2108638 - protein, 19 aa, Staphylococcus
HVDLFSIVPVKRSHSVCAQ

SEQ ID NO: 2108639 - protein, 18 aa, Staphylococcus
IAAHILAYQYLKDGGESG

SEQ ID NO: 2108640 - protein, 19 aa, Staphylococcus
IACLTIMATSIGALNANAS

SEQ ID NO: 2108641 - protein, 18 aa, Staphylococcus
IADALLKVDAPKLYVSNV

SEQ ID NO: 2108642 - protein, 31 aa, Staphylococcus
IADTFFDMEQLPKQLVIIGGGVIASEIASSM

SEQ ID NO: 2108643 - protein, 19 aa, Staphylococcus
IAKGKDYVWNPEAIHKMKH

SEQ ID NO: 2108644 - protein, 17 aa, Staphylococcus
IALILVLAACGSNSSEQ

SEQ ID NO: 2108645 - protein, 17 aa, Staphylococcus
IALMLVLAACSSNSNEQ

SEQ ID NO: 2108646 - protein, 19 aa, Staphylococcus
IALSTTITIALPISQCAQA

SEQ ID NO: 2108647 - protein, 17 aa, Staphylococcus
IALVFVLAACGNGGSSK

SEQ ID NO: 2108648 - protein, 17 aa, Staphylococcus
IALVFVLAACGNNDSSS

SEQ ID NO: 2108649 - protein, 17 aa, Staphylococcus
IALVFVLAACGNNSSKD

SEQ ID NO: 2108650 - protein, 17 aa, Staphylococcus
IALVLLLAACGNNSGNG

SEQ ID NO: 2108651 - protein, 19 aa, Staphylococcus
IALVLVLAACGQSKDADKK

SEQ ID NO: 2108652 - protein, 24 aa, Staphylococcus
IANTSFSIMLNKLLADKYKDDVNT

SEQ ID NO: 2108653 - protein, 24 aa, Staphylococcus
IASKSFSIALDKILADKYKDKVDT

SEQ ID NO: 2108654 - protein, 20 aa, Staphylococcus
IASTIILSPLAFNLPNDINP

SEQ ID NO: 2108655 - protein, 17 aa, Staphylococcus
IASTLAFGTLLSASASV

SEQ ID NO: 2108656 - protein, 23 aa, Staphylococcus
IATAGFATFGLMQHDADAAENNN

SEQ ID NO: 2108657 - protein, 22 aa, Staphylococcus
IATAGFATIALAGGHDAHAAEQ

SEQ ID NO: 2108658 - protein, 18 aa, Staphylococcus
IATAGIATFGLAHQDADA

SEQ ID NO: 2108659 - protein, 25 aa, Staphylococcus
IATTVLLMCSGITHHYTYAAADQYE

SEQ ID NO: 2108660 - protein, 21 aa, Staphylococcus
IAVLHPTYVGALVKFGHKPIA

SEQ ID NO: 2108661 - protein, 18 aa, Staphylococcus
IAVLVLLGVIKTVQTHDV

SEQ ID NO: 2108662 - protein, 17 aa, Staphylococcus
IAVVALVFVITYGLNRH

SEQ ID NO: 2108663 - protein, 18 aa, Staphylococcus
IAVVIILGVVKTFEDHDV

SEQ ID NO: 2108664 - protein, 17 aa, Staphylococcus
ICLTLFVGACSTQDSSK

SEQ ID NO: 2108665 - protein, 17 aa, Staphylococcus
ICSTLIASLAMSTTVTM

SEQ ID NO: 2108666 - protein, 19 aa, Staphylococcus
IDAQGNYHYTWKGNWSPNQ

SEQ ID NO: 2108667 - protein, 17 aa, Staphylococcus
IDEFDELAYLYLNTGNS

SEQ ID NO: 2108668 - protein, 20 aa, Staphylococcus
IDEFDELVYLFLKDDSQVHY

SEQ ID NO: 2108669 - protein, 23 aa, Staphylococcus
IDGLNLYDFKYKLKPFVDPDKVY

SEQ ID NO: 2108670 - protein, 33 aa, Staphylococcus
IDKDIYNSTTDFYNTYVYKKGMPEFETATSDVP

SEQ ID NO: 2108671 - protein, 19 aa, Staphylococcus
IDLVFNHNFKEKHPAAYDI

SEQ ID NO: 2108672 - protein, 30 aa, Staphylococcus
IDNERIQKLLAFQMLYIGIDPKRGPSLYSI

SEQ ID NO: 2108673 - protein, 24 aa, Staphylococcus
IDNPREFINPLPHISFVRGVNNQK

SEQ ID NO: 2108674 - protein, 28 aa, Staphylococcus
IEDPRAFINPLPHISFVRGKNNVKFLKD

SEQ ID NO: 2108675 - protein, 17 aa, Staphylococcus
IEDYALLKQIRQASNAE

SEQ ID NO: 2108676 - protein, 28 aa, Staphylococcus
IEGAQKIYELFKPILNKKDKKLSETIQT

SEQ ID NO: 2108677 - protein, 25 aa, Staphylococcus
IEGAQKIYTLFKPELNKKDKKLSAD

SEQ ID NO: 2108678 - protein, 26 aa, Staphylococcus
IEGKRTLLFGPFANVGPKFLKNGSNL

SEQ ID NO: 2108679 - protein, 26 aa, Staphylococcus
IEGNPTIYKPTWKSEALTYKEATSHL

SEQ ID NO: 2108680 - protein, 29 aa, Staphylococcus
IEGSEGNYSYIFSFQNQAQPGTYTIATVD

SEQ ID NO: 2108681 - protein, 25 aa, Staphylococcus
IEGSKYFIKLWAGQLPIEDYRISPI

SEQ ID NO: 2108682 - protein, 27 aa, Staphylococcus
IEHLKENLDWIWNSLSLRDQELFNQKY

SEQ ID NO: 2108683 - protein, 25 aa, Staphylococcus
IEKNDKMVVLLPGPPSEMKPMAKNE

SEQ ID NO: 2108684 - protein, 30 aa, Staphylococcus
IEMVELPKNDFFFACQFHPEFLSRPNRPQP

SEQ ID NO: 2108685 - protein, 28 aa, Staphylococcus
IENPREFIHPLPHISFVRGKNNVKFLKD

SEQ ID NO: 2108686 - protein, 21 aa, Staphylococcus
IEPTVEWLKKSLEQGKHVITA

SEQ ID NO: 2108687 - protein, 18 aa, Staphylococcus
IEQYVELPQIVRGVTTWT

SEQ ID NO: 2108688 - protein, 27 aa, Staphylococcus
IEVKAETYWYNDPYTLDFMRKDLKDKL

SEQ ID NO: 2108689 - protein, 24 aa, Staphylococcus
IEVMRKWIPLMMQGRVDDGKMAAS

SEQ ID NO: 2108690 - protein, 21 aa, Staphylococcus
IFFIIVLVTLIVLVGVLGFKW

SEQ ID NO: 2108691 - protein, 18 aa, Staphylococcus
IFIGTKETLYPDALRLSK

SEQ ID NO: 2108692 - protein, 22 aa, Staphylococcus
IFKPSTIIKRNGVRYGLVGVTT

SEQ ID NO: 2108693 - protein, 28 aa, Staphylococcus
IFLVGDGMGPSYNSAYRYFADNPETKEM

SEQ ID NO: 2108694 - protein, 30 aa, Staphylococcus
IFQSIIEYLKENLNWIWNSFSFEDQQQFQK

SEQ ID NO: 2108695 - protein, 21 aa, Staphylococcus
IFSAVATATVILIPQSVHAET

SEQ ID NO: 2108696 - protein, 25 aa, Staphylococcus
IGALILGLIFLGLSKWYSSEDNQKT

SEQ ID NO: 2108697 - protein, 26 aa, Staphylococcus
IGANMPLIRKYWPKRLGNPPKTMIQG

SEQ ID NO: 2108698 - protein, 21 aa, Staphylococcus
IGFSIVGLTFSLGACGQKNSS

SEQ ID NO: 2108699 - protein, 23 aa, Staphylococcus
IGILSLFTLFGTSISDAAETPVD

SEQ ID NO: 2108700 - protein, 17 aa, Staphylococcus
IGKDYIKAGQNTLYKMR

SEQ ID NO: 2108701 - protein, 27 aa, Staphylococcus
IGKGKAQQIYYRALTEYLSSNSNFSDA

SEQ ID NO: 2108702 - protein, 22 aa, Staphylococcus
IGLEILDNLYERGISPTLIHRS

SEQ ID NO: 2108703 - protein, 17 aa, Staphylococcus
IGQQWTEPKYFHGRISA

SEQ ID NO: 2108704 - protein, 24 aa, Staphylococcus
IGSTWGTANNWANAAKAAGYTVNH

SEQ ID NO: 2108705 - protein, 26 aa, Staphylococcus
IGVHVLFHEFVLPKLKLTPERDELPP

SEQ ID NO: 2108706 - protein, 23 aa, Staphylococcus
IGYFCVDNLPPVLLPKFVELMEQ

SEQ ID NO: 2108707 - protein, 19 aa, Staphylococcus
IHEIIETAWNWHQSHPNGY

SEQ ID NO: 2108708 - protein, 25 aa, Staphylococcus
IHHRNSHMNIKYLPTTNVIGKLDDK

SEQ ID NO: 2108709 - protein, 26 aa, Staphylococcus
IHLTAPAEYYVWGAGPKANPYFYQIE

SEQ ID NO: 2108710 - protein, 24 aa, Staphylococcus
IIDPAQVITYRPQRKSIYTEPGSS

SEQ ID NO: 2108711 - protein, 25 aa, Staphylococcus
IIETANTDYLAWGAGPQANDRFIHV

SEQ ID NO: 2108712 - protein, 27 aa, Staphylococcus
IIFVIFILLLFFAFSSHTYASISSTSS

SEQ ID NO: 2108713 - protein, 20 aa, Staphylococcus
IIGLLFLLVTAAACGNVSDN

SEQ ID NO: 2108714 - protein, 27 aa, Staphylococcus
IIHNQKGSYYIDPLTGKAAGSLKDFYE

SEQ ID NO: 2108715 - protein, 17 aa, Staphylococcus
IIIGAIVGGAATLADKS

SEQ ID NO: 2108716 - protein, 19 aa, Staphylococcus
IIILLSTVVLSGCDLPGLG

SEQ ID NO: 2108717 - protein, 18 aa, Staphylococcus
IIKKLDAMGIHETIDQLK

SEQ ID NO: 2108718 - protein, 21 aa, Staphylococcus
IILCCLLLVSCSNDKQSAAKQ

SEQ ID NO: 2108719 - protein, 18 aa, Staphylococcus
IILLISIALTACSQTSDQ

SEQ ID NO: 2108720 - protein, 17 aa, Staphylococcus
IILVLVLAACGNKSGDQ

SEQ ID NO: 2108721 - protein, 24 aa, Staphylococcus
IIMVLSLLVLSGCSLPGLGDGNSK

SEQ ID NO: 2108722 - protein, 19 aa, Staphylococcus
IISDKYLSPRAKQYRLKQL

SEQ ID NO: 2108723 - protein, 19 aa, Staphylococcus
IISFSMLATSLGMVNANAE

SEQ ID NO: 2108724 - protein, 18 aa, Staphylococcus
IISIIVTGISAMRDKSHE

SEQ ID NO: 2108725 - protein, 23 aa, Staphylococcus
IISILLTLILITACGKVSNNGSK

SEQ ID NO: 2108726 - protein, 18 aa, Staphylococcus
IISIVISLITAINDKSHK

SEQ ID NO: 2108727 - protein, 19 aa, Staphylococcus
IISIVVGVICLLISQKFTS

SEQ ID NO: 2108728 - protein, 20 aa, Staphylococcus
IISLIALCLMLAGCSNGDNK

SEQ ID NO: 2108729 - protein, 19 aa, Staphylococcus
IISLVFILAACGNQSNNSQ

SEQ ID NO: 2108730 - protein, 19 aa, Staphylococcus
IISVIVTGISALRDKSHES

SEQ ID NO: 2108731 - protein, 22 aa, Staphylococcus
IITLLILLTTLCTTTALAEKPV

SEQ ID NO: 2108732 - protein, 24 aa, Staphylococcus
IIVFAVIVIGVLAFQFLNHTGPFK

SEQ ID NO: 2108733 - protein, 22 aa, Staphylococcus
IIVLAVLVVGVLAFQFINHTGP

SEQ ID NO: 2108734 - protein, 17 aa, Staphylococcus
IIVSFILASCSSNATNK

SEQ ID NO: 2108735 - protein, 29 aa, Staphylococcus
IKDKPTSQYWWAYTEYFTGGVTPAANPSA

SEQ ID NO: 2108736 - protein, 17 aa, Staphylococcus
IKDKYFGNVPLEKAFDL

SEQ ID NO: 2108737 - protein, 19 aa, Staphylococcus
IKDLLKPTLAKFIFTDANE

SEQ ID NO: 2108738 - protein, 26 aa, Staphylococcus
IKDPTQKYQFLRLDKSQNISSADLDK

SEQ ID NO: 2108739 - protein, 19 aa, Staphylococcus
IKEIDRVLNNHPTVAQIND

SEQ ID NO: 2108740 - protein, 20 aa, Staphylococcus
IKGVLLTVNTPGGGTYPSDE

SEQ ID NO: 2108741 - protein, 25 aa, Staphylococcus
IKIFFVTLIILITFPTHLLAYTSNS

SEQ ID NO: 2108742 - protein, 23 aa, Staphylococcus
IKKGVWQVMPVKHEWDHGDFVGS

SEQ ID NO: 2108743 - protein, 17 aa, Staphylococcus
IKQKAVPASSSFIGKHV

SEQ ID NO: 2108744 - protein, 24 aa, Staphylococcus
IKSGATLYTVPWGNYNQVAGTVSK

SEQ ID NO: 2108745 - protein, 30 aa, Staphylococcus
IKSHYRHVNLPAQVPLAWGAHRAASIIAEQ

SEQ ID NO: 2108746 - protein, 17 aa, Staphylococcus
ILAKFNKDLKHNLDVIF

SEQ ID NO: 2108747 - protein, 17 aa, Staphylococcus
ILALVLCLVGCSNSNND

SEQ ID NO: 2108748 - protein, 26 aa, Staphylococcus
ILDKERSYFKLLKQKTVMQQQEKEKG

SEQ ID NO: 2108749 - protein, 18 aa, Staphylococcus
ILDYTKLFEKNRSQVEKK

SEQ ID NO: 2108750 - protein, 18 aa, Staphylococcus
ILEGIREWQKQLSILATQ

SEQ ID NO: 2108751 - protein, 18 aa, Staphylococcus
ILEKLIVAKKKALSSLIN

SEQ ID NO: 2108752 - protein, 22 aa, Staphylococcus
ILFTLVLVLAACGQNQSSEKGH

SEQ ID NO: 2108753 - protein, 19 aa, Staphylococcus
ILFVVLGGAAIFFYENKND

SEQ ID NO: 2108754 - protein, 18 aa, Staphylococcus
ILGLMLALVLVTACGSVS

SEQ ID NO: 2108755 - protein, 17 aa, Staphylococcus
ILGSLLILSACSNNDEK

SEQ ID NO: 2108756 - protein, 17 aa, Staphylococcus
ILGSLLILSSCSNNDEK

SEQ ID NO: 2108757 - protein, 18 aa, Staphylococcus
ILIALSVVLAGCGSAEGV

SEQ ID NO: 2108758 - protein, 20 aa, Staphylococcus
ILIGAIIGGAATLADKSTRN

SEQ ID NO: 2108759 - protein, 28 aa, Staphylococcus
ILISGIIFLAFVLMPASWFTGLVNNKTL

SEQ ID NO: 2108760 - protein, 25 aa, Staphylococcus
ILKDDRKFFPPYDGSPLATEKLIKD

SEQ ID NO: 2108761 - protein, 24 aa, Staphylococcus
ILKDDRKFFPPYDGSPLATEKVIK

SEQ ID NO: 2108762 - protein, 25 aa, Staphylococcus
ILKDDRSFFPPYDGSPLVTEELIKE

SEQ ID NO: 2108763 - protein, 22 aa, Staphylococcus
ILLAMSLIVLSGCSLPGLGDGD

SEQ ID NO: 2108764 - protein, 19 aa, Staphylococcus
ILLGAVIGGAATLADKSTR

SEQ ID NO: 2108765 - protein, 22 aa, Staphylococcus
ILLGCILGVVVGYIAAQKVLHE

SEQ ID NO: 2108766 - protein, 21 aa, Staphylococcus
ILLGIILGVVVGYFVARNLLH

SEQ ID NO: 2108767 - protein, 21 aa, Staphylococcus
ILLGIILGVVVGYIVARNLLH

SEQ ID NO: 2108768 - protein, 17 aa, Staphylococcus
ILLHHLYQHLLNKVDDA

SEQ ID NO: 2108769 - protein, 22 aa, Staphylococcus
ILLILVLVLTSLGFGYHTYSKI

SEQ ID NO: 2108770 - protein, 32 aa, Staphylococcus
ILLNDIYDMKPLRTFVYGRTILLGDAAHATTP

SEQ ID NO: 2108771 - protein, 19 aa, Staphylococcus
ILLSIMLCVLVACGKEDSS

SEQ ID NO: 2108772 - protein, 19 aa, Staphylococcus
ILLSLVLTVALAACGNGSN

SEQ ID NO: 2108773 - protein, 23 aa, Staphylococcus
ILLVILILASILHHRYMQSRIDT

SEQ ID NO: 2108774 - protein, 19 aa, Staphylococcus
ILMVTCLVILSGCSLPGLG

SEQ ID NO: 2108775 - protein, 19 aa, Staphylococcus
ILPIHIKNINWYSSYRSHH

SEQ ID NO: 2108776 - protein, 24 aa, Staphylococcus
ILQSDMGYYGHVAFVESVNANGSI

SEQ ID NO: 2108777 - protein, 20 aa, Staphylococcus
ILQTTQGGFGHVAYVESVNS

SEQ ID NO: 2108778 - protein, 20 aa, Staphylococcus
ILSIVLVLAACGKDSGNKSS

SEQ ID NO: 2108779 - protein, 20 aa, Staphylococcus
ILSLHNISISNLKILEIRED

SEQ ID NO: 2108780 - protein, 18 aa, Staphylococcus
ILSLVLVLAACGNQSKDS

SEQ ID NO: 2108781 - protein, 19 aa, Staphylococcus
ILSTLILCACNFEQDVENK

SEQ ID NO: 2108782 - protein, 19 aa, Staphylococcus
ILTMCMAISLYGCEENKKK

SEQ ID NO: 2108783 - protein, 24 aa, Staphylococcus
ILTNLVQNILRYGKSFVDICIYEQ

SEQ ID NO: 2108784 - protein, 30 aa, Staphylococcus
ILTVVVIALVILGFQYFNHSGPFKNSGSHI

SEQ ID NO: 2108785 - protein, 17 aa, Staphylococcus
ILVIPEANIPFKTTEQQ

SEQ ID NO: 2108786 - protein, 17 aa, Staphylococcus
ILVLAISLAACSQGSNQ

SEQ ID NO: 2108787 - protein, 25 aa, Staphylococcus
ILVLFSTIFLASCELPGLGGGQSKS

SEQ ID NO: 2108788 - protein, 19 aa, Staphylococcus
ILVLVLALTVVTACGNGNS

SEQ ID NO: 2108789 - protein, 21 aa, Staphylococcus
IMGIPTDIKPFIKTKLISPIG

SEQ ID NO: 2108790 - protein, 20 aa, Staphylococcus
IMGIPTDIKPFIKTKLISPL

SEQ ID NO: 2108791 - protein, 23 aa, Staphylococcus
IMGIPTDIKPFIKTKLISPLGKL

SEQ ID NO: 2108792 - protein, 20 aa, Staphylococcus
IMLICGILLSSCGNQSSADL

SEQ ID NO: 2108793 - protein, 28 aa, Staphylococcus
IMQLNGLNNFFIYPGQKLKVTGTAAKNN

SEQ ID NO: 2108794 - protein, 28 aa, Staphylococcus
IMQLNGLNNFFIYPGQKLKVTGTASGSS

SEQ ID NO: 2108795 - protein, 19 aa, Staphylococcus
IMQTSQGAFGHVAYVENVN

SEQ ID NO: 2108796 - protein, 27 aa, Staphylococcus
IMRLNGLNNFFIYPGQKLRVSGTASSS

SEQ ID NO: 2108797 - protein, 26 aa, Staphylococcus
IMSLNGLSNFNIYPGQKLKVSGAASS

SEQ ID NO: 2108798 - protein, 26 aa, Staphylococcus
IMSLNGLTNFNIYPGQKLKVSGKAST

SEQ ID NO: 2108799 - protein, 24 aa, Staphylococcus
IMTVVCVVIIFAFVRNEFVDRFNP

SEQ ID NO: 2108800 - protein, 20 aa, Staphylococcus
IMVLAFMVVLAGCGKGESDN

SEQ ID NO: 2108801 - protein, 18 aa, Staphylococcus
IMVMFVLAGCGTENDEAK

SEQ ID NO: 2108802 - protein, 26 aa, Staphylococcus
INANDVLKLITANTTIPGLRTNIIGT

SEQ ID NO: 2108803 - protein, 23 aa, Staphylococcus
INASKADLFLYTGDNLDPVAKKV

SEQ ID NO: 2108804 - protein, 18 aa, Staphylococcus
INDKYLSNRAKQVRLKQL

SEQ ID NO: 2108805 - protein, 17 aa, Staphylococcus
INDYIRKNNFKAPTYEQ

SEQ ID NO: 2108806 - protein, 20 aa, Staphylococcus
INEEFEISKQFWSHLVKAGH

SEQ ID NO: 2108807 - protein, 19 aa, Staphylococcus
INELLALNTFDPQNSKIAK

SEQ ID NO: 2108808 - protein, 25 aa, Staphylococcus
INEQVEVWLIRKGFNIYHHYTLNRF

SEQ ID NO: 2108809 - protein, 17 aa, Staphylococcus
INGLKYNTKLYSVGYPW

SEQ ID NO: 2108810 - protein, 25 aa, Staphylococcus
INGVTWYHGKLANGKVVWVKEDDLR

SEQ ID NO: 2108811 - protein, 20 aa, Staphylococcus
INHSWDNDQQNMRFSFVGSG

SEQ ID NO: 2108812 - protein, 18 aa, Staphylococcus
INKTYKINPGEVIYTVPW

SEQ ID NO: 2108813 - protein, 18 aa, Staphylococcus
INVPLKTLRSYAKTLDEN

SEQ ID NO: 2108814 - protein, 28 aa, Staphylococcus
IPEDVLYDVVFLFPKSMQLKEVLDYIQP

SEQ ID NO: 2108815 - protein, 25 aa, Staphylococcus
IPENDFFIACQFHPEFLSRPNRPQP

SEQ ID NO: 2108816 - protein, 25 aa, Staphylococcus
IPENDFYIACQFHPEFLSRPNRPQP

SEQ ID NO: 2108817 - protein, 17 aa, Staphylococcus
IPFFGICLGMQLATVEY

SEQ ID NO: 2108818 - protein, 17 aa, Staphylococcus
IPGGFSFGDYLRSGAMA

SEQ ID NO: 2108819 - protein, 18 aa, Staphylococcus
IPMNVLNHSILSGVAPNV

SEQ ID NO: 2108820 - protein, 27 aa, Staphylococcus
IPSDLQFDIVFLFTKAMQLESMLTHIQ

SEQ ID NO: 2108821 - protein, 28 aa, Staphylococcus
IPSNELYDVIFLFPKSMQLESVLDAIKP

SEQ ID NO: 2108822 - protein, 19 aa, Staphylococcus
IPVITLDREVAKGKVASFI

SEQ ID NO: 2108823 - protein, 18 aa, Staphylococcus
IPVTASALLLGACGSDST

SEQ ID NO: 2108824 - protein, 18 aa, Staphylococcus
IPVTASALLLGACGSNAA

SEQ ID NO: 2108825 - protein, 17 aa, Staphylococcus
IPVTASAVLLGACGNHA

SEQ ID NO: 2108826 - protein, 19 aa, Staphylococcus
IPYFGICLGMQLATVEFAR

SEQ ID NO: 2108827 - protein, 30 aa, Staphylococcus
IQDNSYALSRPLFIYAKEKSLKDNKAFQEF

SEQ ID NO: 2108828 - protein, 28 aa, Staphylococcus
IQGYNLFHVYPIFPLPERERFLKQLQNI

SEQ ID NO: 2108829 - protein, 31 aa, Staphylococcus
IQMDADLVFDVRFLPNPYYVEELRPLTGLNE

SEQ ID NO: 2108830 - protein, 24 aa, Staphylococcus
IQNPQAFIRPLPHISFVQGDKNVN

SEQ ID NO: 2108831 - protein, 25 aa, Staphylococcus
IQPEFNIKFTIIEPGGIQSEFMPNI

SEQ ID NO: 2108832 - protein, 20 aa, Staphylococcus
IQSSSPWPPQVQHTPGKWVN

SEQ ID NO: 2108833 - protein, 18 aa, Staphylococcus
ISAIKYARENNVPYFGIC

SEQ ID NO: 2108834 - protein, 17 aa, Staphylococcus
ISAIRYARENNVPYFGI

SEQ ID NO: 2108835 - protein, 19 aa, Staphylococcus
ISALAITGSILVASPNSAH

SEQ ID NO: 2108836 - protein, 17 aa, Staphylococcus
ISCLTVASLSLAIIHTP

SEQ ID NO: 2108837 - protein, 20 aa, Staphylococcus
ISFIALVLILSGCSKHDKKH

SEQ ID NO: 2108838 - protein, 17 aa, Staphylococcus
ISIAKLKSLNGLTSNLI

SEQ ID NO: 2108839 - protein, 33 aa, Staphylococcus
ISILEDDGYHFIQPGDGFLACGYVAKGRMEEPL

SEQ ID NO: 2108840 - protein, 24 aa, Staphylococcus
ISILIIALIIVALAIVVRQQHATK

SEQ ID NO: 2108841 - protein, 18 aa, Staphylococcus
ISKQFWSHLVKAGHIENP

SEQ ID NO: 2108842 - protein, 18 aa, Staphylococcus
ISLLLILTACGNKDEQDK

SEQ ID NO: 2108843 - protein, 20 aa, Staphylococcus
ISLMIIITTASLGMLSTELD

SEQ ID NO: 2108844 - protein, 17 aa, Staphylococcus
ISLVVMLVMTNVTPSFH

SEQ ID NO: 2108845 - protein, 29 aa, Staphylococcus
ISNPREFITPLPHISFVQGIRNVQFLQKR

SEQ ID NO: 2108846 - protein, 46 aa, Staphylococcus
ISSIRQNDGYLWTINFNKYHIKRNGMVFWFGLPKGQTPTGPVRFTT

SEQ ID NO: 2108847 - protein, 21 aa, Staphylococcus
ISSISVIAISSSFYSGQVNAK

SEQ ID NO: 2108848 - protein, 18 aa, Staphylococcus
ISTIFILAACSNDKDKSS

SEQ ID NO: 2108849 - protein, 18 aa, Staphylococcus
ISVLFILAACSNGNQDDR

SEQ ID NO: 2108850 - protein, 17 aa, Staphylococcus
ITACTWTSKKWPFTTPE

SEQ ID NO: 2108851 - protein, 18 aa, Staphylococcus
ITACTWTSKKWPFTTPQG

SEQ ID NO: 2108852 - protein, 30 aa, Staphylococcus
ITACTWTTKKWPFTTPKGKVLLRAYVGKPG

SEQ ID NO: 2108853 - protein, 17 aa, Staphylococcus
ITAINPSSGAAGKYQFL

SEQ ID NO: 2108854 - protein, 26 aa, Staphylococcus
ITANKDLLAVHLRLLEDLAEANGVAL

SEQ ID NO: 2108855 - protein, 19 aa, Staphylococcus
ITELYINLYDNLNKISKAK

SEQ ID NO: 2108856 - protein, 23 aa, Staphylococcus
ITLFITLGTILNFNLVNASEQHT

SEQ ID NO: 2108857 - protein, 26 aa, Staphylococcus
ITLGVFILLIGALMLVGKIYSEHHPN

SEQ ID NO: 2108858 - protein, 29 aa, Staphylococcus
ITLIGVLFILAAIYLFAKPHIDQYLHEKE

SEQ ID NO: 2108859 - protein, 19 aa, Staphylococcus
ITSAALFFGMNHVASADQI

SEQ ID NO: 2108860 - protein, 17 aa, Staphylococcus
ITSIVLLTACGNNNDNK

SEQ ID NO: 2108861 - protein, 33 aa, Staphylococcus
ITSTYRHVNLPAQVPLAWGAHRGASVIAEQLAG

SEQ ID NO: 2108862 - protein, 17 aa, Staphylococcus
ITTPHQTFMKWFNHDQA

SEQ ID NO: 2108863 - protein, 18 aa, Staphylococcus
ITTYDLLFRSGFEPDVDF

SEQ ID NO: 2108864 - protein, 17 aa, Staphylococcus
IVAASTILLAGCTTDKK

SEQ ID NO: 2108865 - protein, 26 aa, Staphylococcus
IVAGSMASLMLLLAAGAPQNAEADAN

SEQ ID NO: 2108866 - protein, 18 aa, Staphylococcus
IVALLFALVLVTACGNVS

SEQ ID NO: 2108867 - protein, 19 aa, Staphylococcus
IVETAPTDYLSWGAGPAGN

SEQ ID NO: 2108868 - protein, 23 aa, Staphylococcus
IVETAPTDYLSWGAGPNANNRFI

SEQ ID NO: 2108869 - protein, 29 aa, Staphylococcus
IVIFVVIVLIVLGFQYINHTGPFQSLLSQ

SEQ ID NO: 2108870 - protein, 22 aa, Staphylococcus
IVLALSLVVLSGCGLPGLGDSN

SEQ ID NO: 2108871 - protein, 17 aa, Staphylococcus
IVLCISIALSACSTGQY

SEQ ID NO: 2108872 - protein, 18 aa, Staphylococcus
IVLTSTVLLAGCTTDKKE

SEQ ID NO: 2108873 - protein, 17 aa, Staphylococcus
IVLVIFTNKDNKSDKPN

SEQ ID NO: 2108874 - protein, 21 aa, Staphylococcus
IVLVLCLTVLSGCSLPGLGGN

SEQ ID NO: 2108875 - protein, 17 aa, Staphylococcus
IVLVLVLAACGNNSGNS

SEQ ID NO: 2108876 - protein, 18 aa, Staphylococcus
IVNKQLALPAKYKPGENK

SEQ ID NO: 2108877 - protein, 20 aa, Staphylococcus
IVRGVTTWTAGLESPGHTHL

SEQ ID NO: 2108878 - protein, 31 aa, Staphylococcus
IVSNYYRHVNIPTHVPLAWGAHRGASIVAEH

SEQ ID NO: 2108879 - protein, 17 aa, Staphylococcus
IWENGKVDIAPNNTPNN

SEQ ID NO: 2108880 - protein, 26 aa, Staphylococcus
IYKSSWKNIAPSYRSATRHLSQTYAT

SEQ ID NO: 2108881 - protein, 17 aa, Staphylococcus
IYLVITIIVSGCSNIDN

SEQ ID NO: 2108882 - protein, 25 aa, Staphylococcus
IYSRSLDHIKKIQPDLKWLTEKQRQ

SEQ ID NO: 2108883 - protein, 18 aa, Staphylococcus
KAEHFHIFMGDNNDSLLK

SEQ ID NO: 2108884 - protein, 19 aa, Staphylococcus
KAGFIYVEAGLRGRSMSMG

SEQ ID NO: 2108885 - protein, 23 aa, Staphylococcus
KAGQNTLYKMRWNPAHPGTHQYA

SEQ ID NO: 2108886 - protein, 22 aa, Staphylococcus
KAHEQWIKDQVEWNKQNETRKQ

SEQ ID NO: 2108887 - protein, 17 aa, Staphylococcus
KAKARITVRANISRLVG

SEQ ID NO: 2108888 - protein, 23 aa, Staphylococcus
KAKKRGFRGAGSYWADHLGYTDI

SEQ ID NO: 2108889 - protein, 20 aa, Staphylococcus
KAKLASITQVLNGTPSVADI

SEQ ID NO: 2108890 - protein, 23 aa, Staphylococcus
KAKPDIIFASFRQAHTKTLDEMK

SEQ ID NO: 2108891 - protein, 26 aa, Staphylococcus
KALGKEKSLFSFINKDGATQDQVDEK

SEQ ID NO: 2108892 - protein, 25 aa, Staphylococcus
KALTDADIILYNGLNLETGNGWFDK

SEQ ID NO: 2108893 - protein, 24 aa, Staphylococcus
KALTDADVIFYNGLNLETGNGWFE

SEQ ID NO: 2108894 - protein, 24 aa, Staphylococcus
KANEDILEYTKLFEKSRSQVEAHM

SEQ ID NO: 2108895 - protein, 25 aa, Staphylococcus
KANTPIHMYHYGKPTGKYKNDPAGT

SEQ ID NO: 2108896 - protein, 24 aa, Staphylococcus
KAQKNFQNKFKDYSKAMNTVNKEK

SEQ ID NO: 2108897 - protein, 17 aa, Staphylococcus
KARITVRANISRLVGGS

SEQ ID NO: 2108898 - protein, 20 aa, Staphylococcus
KARLKLLIGLSNQLNIVELK

SEQ ID NO: 2108899 - protein, 19 aa, Staphylococcus
KASLVTKKAFKPRSKRDLD

SEQ ID NO: 2108900 - protein, 24 aa, Staphylococcus
KATNNGLYAVPWGTKSQQLDTLKN

SEQ ID NO: 2108901 - protein, 37 aa, Staphylococcus
KATYLYGTVNGISGWISKYYLTEPTATRTALAQPKMA

SEQ ID NO: 2108902 - protein, 22 aa, Staphylococcus
KAYDTVTIYCDKAHVVFGNAKI

SEQ ID NO: 2108903 - protein, 26 aa, Staphylococcus
KAYNINEVYLISHALLETGNGTSKLA

SEQ ID NO: 2108904 - protein, 26 aa, Staphylococcus
KCLITTFLIVSSLLLAFSTITYANES

SEQ ID NO: 2108905 - protein, 17 aa, Staphylococcus
KDAWDASMYSYLTVPRG

SEQ ID NO: 2108906 - protein, 27 aa, Staphylococcus
KDDTLKYQFLCLDRPQNLSVASLNQLL

SEQ ID NO: 2108907 - protein, 25 aa, Staphylococcus
KDEYIYGIVNNKTGWIAAKDLNSTT

SEQ ID NO: 2108908 - protein, 24 aa, Staphylococcus
KDFYEGIFTVYEKQVINGVTWYHG

SEQ ID NO: 2108909 - protein, 22 aa, Staphylococcus
KDGKLIYASVEPGLYHVSFSDA

SEQ ID NO: 2108910 - protein, 24 aa, Staphylococcus
KDIVIKHILVRDKSKKRPINISRY

SEQ ID NO: 2108911 - protein, 24 aa, Staphylococcus
KDIVIKHILVRDTTKKRPINISQY

SEQ ID NO: 2108912 - protein, 22 aa, Staphylococcus
KDKKFQELLKVLQSKEIKAYIK

SEQ ID NO: 2108913 - protein, 24 aa, Staphylococcus
KDKLDPHAWLSLDNGIQYVKNIQQ

SEQ ID NO: 2108914 - protein, 17 aa, Staphylococcus
KDLGFLIHPYTVDKTTD

SEQ ID NO: 2108915 - protein, 25 aa, Staphylococcus
KDLKNDKALFLLVNEGELSTFGSGE

SEQ ID NO: 2108916 - protein, 24 aa, Staphylococcus
KDMHRHLLPTFEKYEKLAKSTPAK

SEQ ID NO: 2108917 - protein, 24 aa, Staphylococcus
KDMNIMMYHMIKEHPEILKTTQNK

SEQ ID NO: 2108918 - protein, 18 aa, Staphylococcus
KDNEDILDYTKLFEKNRS

SEQ ID NO: 2108919 - protein, 19 aa, Staphylococcus
KDNEDILDYTKLFEKNRSQ

SEQ ID NO: 2108920 - protein, 17 aa, Staphylococcus
KDNGKFIKNHKWMTGNE

SEQ ID NO: 2108921 - protein, 18 aa, Staphylococcus
KDNGKIIKNHKWMTGNEL

SEQ ID NO: 2108922 - protein, 23 aa, Staphylococcus
KDNKLMLTDFKSSKGPDLHVYLT

SEQ ID NO: 2108923 - protein, 23 aa, Staphylococcus
KDPTQRIINYFNALNSTIANVDE

SEQ ID NO: 2108924 - protein, 18 aa, Staphylococcus
KDRYEKMKAFPMFDNIEY

SEQ ID NO: 2108925 - protein, 20 aa, Staphylococcus
KDRYHAMKDFPMFDNIEYTE

SEQ ID NO: 2108926 - protein, 23 aa, Staphylococcus
KDSRVDFGLSQWGLKQKPNESYI

SEQ ID NO: 2108927 - protein, 23 aa, Staphylococcus
KDSRVDFGLSQWGLKQQPNESYV

SEQ ID NO: 2108928 - protein, 26 aa, Staphylococcus
KDWQDKDGYWYGFSGSALGISYNTDK

SEQ ID NO: 2108929 - protein, 25 aa, Staphylococcus
KEDQVPVLAFYTFSPFNYNSDKEPQ

SEQ ID NO: 2108930 - protein, 24 aa, Staphylococcus
KEDRKLIMPLHFKEDVELPPKLVG

SEQ ID NO: 2108931 - protein, 28 aa, Staphylococcus
KEEFGRKYIIFPNPMYGSWESTLYNNDY

SEQ ID NO: 2108932 - protein, 23 aa, Staphylococcus
KEEKIRLRLLNGSNARDLNLKLS

SEQ ID NO: 2108933 - protein, 28 aa, Staphylococcus
KEEVPESFLRKFGYIVFPDNVAIAMGVA

SEQ ID NO: 2108934 - protein, 25 aa, Staphylococcus
KEGIGYFGYNFYQQNKDKLKEVKIK

SEQ ID NO: 2108935 - protein, 20 aa, Staphylococcus
KEGLLDFRRFGGTLYHRTAF

SEQ ID NO: 2108936 - protein, 18 aa, Staphylococcus
KEHTTLFGKIFKKEEKAK

SEQ ID NO: 2108937 - protein, 25 aa, Staphylococcus
KEHVDMPITSALYRVLFEDVPVNES

SEQ ID NO: 2108938 - protein, 28 aa, Staphylococcus
KEINSLKFNAPLYSLGYPWQNGDNTKAY

SEQ ID NO: 2108939 - protein, 23 aa, Staphylococcus
KEKDLFQYIVDTKGKAEQSKIDE

SEQ ID NO: 2108940 - protein, 24 aa, Staphylococcus
KEKFKSLLKETLPFHKSLQVEQRD

SEQ ID NO: 2108941 - protein, 17 aa, Staphylococcus
KEKKLSIKPEKAKLIYG

SEQ ID NO: 2108942 - protein, 20 aa, Staphylococcus
KELNKIAPTIFLPSFDGDYK

SEQ ID NO: 2108943 - protein, 17 aa, Staphylococcus
KELSNIVGNYWQKEQGY

SEQ ID NO: 2108944 - protein, 25 aa, Staphylococcus
KESIGYFGYNFYKQNKDKLKEVKIK

SEQ ID NO: 2108945 - protein, 26 aa, Staphylococcus
KEVDFKLRKALIEQKGLYKGQYSDGK

SEQ ID NO: 2108946 - protein, 28 aa, Staphylococcus
KEWREYDYLFLTFGTFAYHDPYHLKGIK

SEQ ID NO: 2108947 - protein, 29 aa, Staphylococcus
KEWREYDYLFLTFGTFSYHDPYHLKGKKG

SEQ ID NO: 2108948 - protein, 21 aa, Staphylococcus
KEYDYIFLTTGTFAYHDPYNL

SEQ ID NO: 2108949 - protein, 18 aa, Staphylococcus
KEYLTFQKNIYAHQQDEK

SEQ ID NO: 2108950 - protein, 41 aa, Staphylococcus
KFDNPKYLPRFVFGHYMKSYLSNYDLLFDNLTIIKHPVREI

SEQ ID NO: 2108951 - protein, 23 aa, Staphylococcus
KFLALLATLTLAIVLSACGNSQS

SEQ ID NO: 2108952 - protein, 20 aa, Staphylococcus
KFLTLKEFLKYKQKGKFPKR

SEQ ID NO: 2108953 - protein, 20 aa, Staphylococcus
KFQELMFKQQPNSEKAWITN

SEQ ID NO: 2108954 - protein, 38 aa, Staphylococcus
KFSIRKYTVGTFSTVIATLVFLGFNASHVQADELSVTE

SEQ ID NO: 2108955 - protein, 21 aa, Staphylococcus
KGAYRYYAFEGIRPSDNSDLH

SEQ ID NO: 2108956 - protein, 17 aa, Staphylococcus
KGDLFIYTSKDMDPAAG

SEQ ID NO: 2108957 - protein, 25 aa, Staphylococcus
KGDVAHIFFHPLITDPKVAFTGEAN

SEQ ID NO: 2108958 - protein, 28 aa, Staphylococcus
KGFKFPKQCAYFNNLFFVGGSVNPGGGM

SEQ ID NO: 2108959 - protein, 18 aa, Staphylococcus
KGFKPTPYPTYNSLDDVN

SEQ ID NO: 2108960 - protein, 18 aa, Staphylococcus
KGGTYLIVKNADNDKQIV

SEQ ID NO: 2108961 - protein, 17 aa, Staphylococcus
KGIPGYIQSPYPTYNTL

SEQ ID NO: 2108962 - protein, 21 aa, Staphylococcus
KGKFRVEKPYKSGANGWAVPS

SEQ ID NO: 2108963 - protein, 24 aa, Staphylococcus
KGKKMTFIISPQWFSTHGVNDMDM

SEQ ID NO: 2108964 - protein, 19 aa, Staphylococcus
KGKPDTWIADRKLKGLVFQ

SEQ ID NO: 2108965 - protein, 23 aa, Staphylococcus
KGKTLNVELPLKTTSIAPYETDV

SEQ ID NO: 2108966 - protein, 20 aa, Staphylococcus
KGLIEPYKVKNADKLYKDWQ

SEQ ID NO: 2108967 - protein, 25 aa, Staphylococcus
KGNQYSIPYFFGTVGILYNKQAYPD

SEQ ID NO: 2108968 - protein, 22 aa, Staphylococcus
KGPDLHVYLTKNGDIKTGKKID

SEQ ID NO: 2108969 - protein, 19 aa, Staphylococcus
KGQCTWWAYQRRAQLGKPV

SEQ ID NO: 2108970 - protein, 25 aa, Staphylococcus
KGQDKPIILAIYSKQDQKDAKPNDK

SEQ ID NO: 2108971 - protein, 17 aa, Staphylococcus
KGQFKQFRHGLSSFIEA

SEQ ID NO: 2108972 - protein, 19 aa, Staphylococcus
KGQFKQFRHGLSSFIEALA

SEQ ID NO: 2108973 - protein, 23 aa, Staphylococcus
KGQMVSKFEKALFKLKEGQVSDV

SEQ ID NO: 2108974 - protein, 28 aa, Staphylococcus
KGRVGVVPLLNNQAYWFISINAKENDAT

SEQ ID NO: 2108975 - protein, 32 aa, Staphylococcus
KGRVGVVPLLNNQAYWFITVPAKERDPKYQTF

SEQ ID NO: 2108976 - protein, 22 aa, Staphylococcus
KGTINLTLPRQTLIDIIKSYVP

SEQ ID NO: 2108977 - protein, 22 aa, Staphylococcus
KGTTCFGVALGILRVVEAILNN

SEQ ID NO: 2108978 - protein, 21 aa, Staphylococcus
KGYYVYLLQKNGEDFKLINVE

SEQ ID NO: 2108979 - protein, 20 aa, Staphylococcus
KHDNIKFNGIKLAKTNSTTV

SEQ ID NO: 2108980 - protein, 22 aa, Staphylococcus
KHERLIQHYVDESRIVRGVTTW

SEQ ID NO: 2108981 - protein, 19 aa, Staphylococcus
KHERLIRNYVEDARIVRGV

SEQ ID NO: 2108982 - protein, 29 aa, Staphylococcus
KIEEDYTSYFPKYGYRNGVGKPEGIVVHD

SEQ ID NO: 2108983 - protein, 29 aa, Staphylococcus
KIEENYSSYFPKYGYRNGVGKPEGIVVHD

SEQ ID NO: 2108984 - protein, 17 aa, Staphylococcus
KIEFQYLTKSKFNDIKD

SEQ ID NO: 2108985 - protein, 22 aa, Staphylococcus
KIEKYKNTPIFYSLGNTTSDDF

SEQ ID NO: 2108986 - protein, 18 aa, Staphylococcus
KIEKYNFVGHSMGNLSFA

SEQ ID NO: 2108987 - protein, 18 aa, Staphylococcus
KIIHLLDRMGVMFSRTNE

SEQ ID NO: 2108988 - protein, 17 aa, Staphylococcus
KIKLIGKSTYHHSEVNA

SEQ ID NO: 2108989 - protein, 21 aa, Staphylococcus
KILAESGSARGFKPVGYSKGN

SEQ ID NO: 2108990 - protein, 21 aa, Staphylococcus
KIMAAQGYTKAHPLKLTVSTY

SEQ ID NO: 2108991 - protein, 19 aa, Staphylococcus
KIMLTDFKSAKGPDLYVYL

SEQ ID NO: 2108992 - protein, 28 aa, Staphylococcus
KIMQLNGLSNFFIYPGQKLKVPGGGSGG

SEQ ID NO: 2108993 - protein, 19 aa, Staphylococcus
KISAIKYARENNIPFFGIC

SEQ ID NO: 2108994 - protein, 20 aa, Staphylococcus
KISAIKYARENNIPYFGICL

SEQ ID NO: 2108995 - protein, 19 aa, Staphylococcus
KISAIKYARENNVPYFGIC

SEQ ID NO: 2108996 - protein, 20 aa, Staphylococcus
KIVISLRNSIAKIMPNRLVA

SEQ ID NO: 2108997 - protein, 24 aa, Staphylococcus
KKAIKNYISPLIEKQIKDINQTNI

SEQ ID NO: 2108998 - protein, 32 aa, Staphylococcus
KKDANIYVFKKGKYVILAYKPLSDDAEVHYYT

SEQ ID NO: 2108999 - protein, 24 aa, Staphylococcus
KKDANIYVYEKGKFVIIAYKPIKN

SEQ ID NO: 2109000 - protein, 25 aa, Staphylococcus
KKDLYDVVPKDKSKWHLAINSKGKV

SEQ ID NO: 2109001 - protein, 18 aa, Staphylococcus
KKGFTIYNRYTLDRFKDE

SEQ ID NO: 2109002 - protein, 17 aa, Staphylococcus
KKGIDGNPNIYRPTWKS

SEQ ID NO: 2109003 - protein, 17 aa, Staphylococcus
KKGTWITYDKKTKRAHI

SEQ ID NO: 2109004 - protein, 25 aa, Staphylococcus
KKHPKVLILMGIPGSYLVATDKSYI

SEQ ID NO: 2109005 - protein, 20 aa, Staphylococcus
KKIKALIKVLQSKEIKDYIN

SEQ ID NO: 2109006 - protein, 21 aa, Staphylococcus
KKKEKNLKASSTYYDKVASAV

SEQ ID NO: 2109007 - protein, 25 aa, Staphylococcus
KKLAKEWIDFLKTDKAKDILKKYQF

SEQ ID NO: 2109008 - protein, 25 aa, Staphylococcus
KKLAKEWMDFLKTDKAKQIIKDYQF

SEQ ID NO: 2109009 - protein, 27 aa, Staphylococcus
KKLLKKLHNNNIYPIARIVTFKDTKLA

SEQ ID NO: 2109010 - protein, 24 aa, Staphylococcus
KKNHNLLMLFGDNLLDFEDPKAQT

SEQ ID NO: 2109011 - protein, 19 aa, Staphylococcus
KKNSPLLEYFNPSKATQLD

SEQ ID NO: 2109012 - protein, 18 aa, Staphylococcus
KKPIIVLDGHSHSVIKHG

SEQ ID NO: 2109013 - protein, 34 aa, Staphylococcus
KKVINPKVLITSLIFFASFLMIGELNHAWAAEET

SEQ ID NO: 2109014 - protein, 20 aa, Staphylococcus
KKVLFYSYENFMVENASNSV

SEQ ID NO: 2109015 - protein, 20 aa, Staphylococcus
KKVLFYSYENFMVNNVANAV

SEQ ID NO: 2109016 - protein, 35 aa, Staphylococcus
KKYKKQEPIIFTGAKPHWIFEEMDLKMLKDPDKVY

SEQ ID NO: 2109017 - protein, 17 aa, Staphylococcus
KKYPQILQISKLTRDTQ

SEQ ID NO: 2109018 - protein, 28 aa, Staphylococcus
KLATKHPFFEYLRTFDFIVVSDVGLINI

SEQ ID NO: 2109019 - protein, 21 aa, Staphylococcus
KLDPHAWLSIENGIKYVKTIQ

SEQ ID NO: 2109020 - protein, 29 aa, Staphylococcus
KLIVILCAIIVFIALIGVSLRSQSQSPVE

SEQ ID NO: 2109021 - protein, 29 aa, Staphylococcus
KLIVVFCAIIIFIALIGLSIRSQTQSPPE

SEQ ID NO: 2109022 - protein, 33 aa, Staphylococcus
KLIVVFCAIIVFIALIGLSIRSSTQSPPEQFIG

SEQ ID NO: 2109023 - protein, 29 aa, Staphylococcus
KLIVVFCAVIIFIALIGLSLRSHTQSPPE

SEQ ID NO: 2109024 - protein, 29 aa, Staphylococcus
KLIVVLCAIIVFIALIGLSIRSQNQSPPE

SEQ ID NO: 2109025 - protein, 30 aa, Staphylococcus
KLIVVLCAIIVFIALIGLSIRSQTQSPPEQ

SEQ ID NO: 2109026 - protein, 25 aa, Staphylococcus
KLKDTKILVIPEANTPFKSSEQQAM

SEQ ID NO: 2109027 - protein, 21 aa, Staphylococcus
KLKYYDIITTSNLATKHPFFE

SEQ ID NO: 2109028 - protein, 35 aa, Staphylococcus
KLLYSSVFALMIVGVLLIFQNVQAHAAEVAPKVNP

SEQ ID NO: 2109029 - protein, 25 aa, Staphylococcus
KLNGLNSFLIHPGQVLKVSGTAPAS

SEQ ID NO: 2109030 - protein, 24 aa, Staphylococcus
KLNSIIKHYNLTAFDKKRMPNLKK

SEQ ID NO: 2109031 - protein, 17 aa, Staphylococcus
KLNVYTTVFAFQSFIEQ

SEQ ID NO: 2109032 - protein, 24 aa, Staphylococcus
KLTDADVIFYNGLNLESGDAWFEN

SEQ ID NO: 2109033 - protein, 24 aa, Staphylococcus
KLTDADVIFYNGLNLETGNGWFKK

SEQ ID NO: 2109034 - protein, 26 aa, Staphylococcus
KLTGVNEIYLIAHALLETGNGQSKLA

SEQ ID NO: 2109035 - protein, 29 aa, Staphylococcus
KLYKDWIDKDGYYYGFSGSALGLSYNTKN

SEQ ID NO: 2109036 - protein, 27 aa, Staphylococcus
KMINHQLYVPLIKSYMGMGSDLLEFYA

SEQ ID NO: 2109037 - protein, 17 aa, Staphylococcus
KMKPWLLTLLYLAIFIA

SEQ ID NO: 2109038 - protein, 29 aa, Staphylococcus
KMKQLNPNIPLIRLLDKGELPFQSEADLK

SEQ ID NO: 2109039 - protein, 26 aa, Staphylococcus
KMLKNTKIYSKYFKKGYLPKDTKDNI

SEQ ID NO: 2109040 - protein, 18 aa, Staphylococcus
KMMQYGDVALLYTNEDLS

SEQ ID NO: 2109041 - protein, 20 aa, Staphylococcus
KMNVQWFDRETMSLQMMLDE

SEQ ID NO: 2109042 - protein, 18 aa, Staphylococcus
KMSQYATPLKLASNAQIN

SEQ ID NO: 2109043 - protein, 23 aa, Staphylococcus
KNAIEMYYSLQNYYETRVTTIKL

SEQ ID NO: 2109044 - protein, 28 aa, Staphylococcus
KNDKVYQLDPKLWYFASGSTTTTMKQID

SEQ ID NO: 2109045 - protein, 21 aa, Staphylococcus
KNDLHFKKFVKNNTLPSGYNE

SEQ ID NO: 2109046 - protein, 23 aa, Staphylococcus
KNDLYDLKPLTSFVHHRTVLLGD

SEQ ID NO: 2109047 - protein, 27 aa, Staphylococcus
KNEDNWSPLMYQFADALHMAISKTTDT

SEQ ID NO: 2109048 - protein, 24 aa, Staphylococcus
KNEVIGVHAFRLNSGDYKKYNLNT

SEQ ID NO: 2109049 - protein, 39 aa, Staphylococcus
KNGKYGFYELESGNYTVQFITPDGYILSPSKVGTDVTKD

SEQ ID NO: 2109050 - protein, 19 aa, Staphylococcus
KNILNTNFSTLGVGVDFNE

SEQ ID NO: 2109051 - protein, 30 aa, Staphylococcus
KNNGDGTITIYPVPSQFNGPIYGDEYGKKE

SEQ ID NO: 2109052 - protein, 31 aa, Staphylococcus
KNNLYTAGQCTWYVYDKVNGAIGSTWGTANN

SEQ ID NO: 2109053 - protein, 17 aa, Staphylococcus
KNNMDGMDSLNVEKLPK

SEQ ID NO: 2109054 - protein, 26 aa, Staphylococcus
KNPKLLTDAYKDLLDQYKVDYKDRDL

SEQ ID NO: 2109055 - protein, 36 aa, Staphylococcus
KNPKNVIFLIGDGMGPSFNTAYRYYADNPKTKEMDK

SEQ ID NO: 2109056 - protein, 25 aa, Staphylococcus
KNSGNLFFIPYVFKDDKIYYKEHFD

SEQ ID NO: 2109057 - protein, 25 aa, Staphylococcus
KNSTPSLWEQIFSNSGSSYLDVNKT

SEQ ID NO: 2109058 - protein, 26 aa, Staphylococcus
KNSTSIPFNIDAYMSGANSGTRYKID

SEQ ID NO: 2109059 - protein, 20 aa, Staphylococcus
KNVLLGYYTQPSTELTNLIG

SEQ ID NO: 2109060 - protein, 32 aa, Staphylococcus
KPDKYDDSFSLTTLIQNLFNFDSNISNYEQSD

SEQ ID NO: 2109061 - protein, 19 aa, Staphylococcus
KPDLILVYSTDKNIKKYKK

SEQ ID NO: 2109062 - protein, 17 aa, Staphylococcus
KPEFLDQYYGAGNLYMA

SEQ ID NO: 2109063 - protein, 21 aa, Staphylococcus
KPENTLLKLQPGKGKALIENK

SEQ ID NO: 2109064 - protein, 21 aa, Staphylococcus
KPLEKLLSDKLGIPVKVSVST

SEQ ID NO: 2109065 - protein, 17 aa, Staphylococcus
KPLIVIYGDFKCPYCKK

SEQ ID NO: 2109066 - protein, 18 aa, Staphylococcus
KPLQKLLSKELGIPVKVH

SEQ ID NO: 2109067 - protein, 26 aa, Staphylococcus
KPNESRIDYVKRVQKSKLWKSKDNGF

SEQ ID NO: 2109068 - protein, 18 aa, Staphylococcus
KPVPYINELLALNTFDPQ

SEQ ID NO: 2109069 - protein, 25 aa, Staphylococcus
KPVQAGAYDIHFVNNGFQYNFTSNG

SEQ ID NO: 2109070 - protein, 17 aa, Staphylococcus
KPVTLTISREKAKKITV

SEQ ID NO: 2109071 - protein, 18 aa, Staphylococcus
KPYEVILEANEYRLSDSR

SEQ ID NO: 2109072 - protein, 17 aa, Staphylococcus
KQGAIMQTSQGAFGHVA

SEQ ID NO: 2109073 - protein, 31 aa, Staphylococcus
KQGPSLYSIIPMIEMMFGVHFIKGGMYGMVK

SEQ ID NO: 2109074 - protein, 25 aa, Staphylococcus
KQGSNGLYTMPWGTSKQQIDNLKQT

SEQ ID NO: 2109075 - protein, 18 aa, Staphylococcus
KQHPYLSTYILTSNKEFE

SEQ ID NO: 2109076 - protein, 29 aa, Staphylococcus
KQHSRQYAKRQLTWFKNKMKVRWLDKENM

SEQ ID NO: 2109077 - protein, 30 aa, Staphylococcus
KQLSMDIIYKPHYVFEPERIGRSLTIFYTN

SEQ ID NO: 2109078 - protein, 19 aa, Staphylococcus
KQSIFMEVSSKPDIYTAGK

SEQ ID NO: 2109079 - protein, 22 aa, Staphylococcus
KQVSIDLPIDYYGKAELTGITQ

SEQ ID NO: 2109080 - protein, 27 aa, Staphylococcus
KQYGLNEIYLISHALLETGRGQSQLAK

SEQ ID NO: 2109081 - protein, 25 aa, Staphylococcus
KRGPSLYSIIPMVEMMFGVHFIKGG

SEQ ID NO: 2109082 - protein, 36 aa, Staphylococcus
KRHKRFNFSYTLIVLIVALVLLVFAIRAVKVEPVEA

SEQ ID NO: 2109083 - protein, 29 aa, Staphylococcus
KRNATIKTGTPLPVNLAGGSTTSIPVVIT

SEQ ID NO: 2109084 - protein, 18 aa, Staphylococcus
KRRKLFNGYIECNYYQYW

SEQ ID NO: 2109085 - protein, 23 aa, Staphylococcus
KRRKLFNGYIECTYYQYWGKKPN

SEQ ID NO: 2109086 - protein, 20 aa, Staphylococcus
KRSYKSFLKEKFNHVSRGKQ

SEQ ID NO: 2109087 - protein, 22 aa, Staphylococcus
KRTRKHFVLYNLHDYTPALAEK

SEQ ID NO: 2109088 - protein, 18 aa, Staphylococcus
KRVVVLEYSFVDALAALD

SEQ ID NO: 2109089 - protein, 18 aa, Staphylococcus
KRVVVLEYSFVDALASLD

SEQ ID NO: 2109090 - protein, 24 aa, Staphylococcus
KSAKKYHNVFGIGAYDDNPLIEGI

SEQ ID NO: 2109091 - protein, 21 aa, Staphylococcus
KSFYLITDYNKNTNVGWVQTS

SEQ ID NO: 2109092 - protein, 20 aa, Staphylococcus
KSGKKLSYKLSFNGFDPEQE

SEQ ID NO: 2109093 - protein, 22 aa, Staphylococcus
KSKPNVIFASFRQAHTKTIDEM

SEQ ID NO: 2109094 - protein, 33 aa, Staphylococcus
KSNIKFKGYLGANIVKFFNYTFASVGVKPDELS

SEQ ID NO: 2109095 - protein, 40 aa, Staphylococcus
KSNNDEIFIETPFGGINESVKHHAIIDKNTGKIIKTGGAI

SEQ ID NO: 2109096 - protein, 29 aa, Staphylococcus
KSSDWLSNQFGVRFRYNALGDLNTQNIVS

SEQ ID NO: 2109097 - protein, 27 aa, Staphylococcus
KSSDWLSNQFGVRFRYNALGDMNTKNI

SEQ ID NO: 2109098 - protein, 24 aa, Staphylococcus
KSTMYLLVNEGELSTFGPGGRFGG

SEQ ID NO: 2109099 - protein, 17 aa, Staphylococcus
KSTYLKSVKDKKAAIND

SEQ ID NO: 2109100 - protein, 24 aa, Staphylococcus
KSVKPYNITTLLSAAAKNLPLIKY

SEQ ID NO: 2109101 - protein, 21 aa, Staphylococcus
KSVNEFVYKILQGKYDVLKEK

SEQ ID NO: 2109102 - protein, 23 aa, Staphylococcus
KSYDRIISLIPSNTEILYELGLG

SEQ ID NO: 2109103 - protein, 31 aa, Staphylococcus
KTIQDGSYPLSRPLFLYVKEKSLEDNDVMRE

SEQ ID NO: 2109104 - protein, 21 aa, Staphylococcus
KTLTIKLRKDAKWSNGDPVTA

SEQ ID NO: 2109105 - protein, 31 aa, Staphylococcus
KTNSGANYYTWGQCTYYVYDKVGGSIGNTWG

SEQ ID NO: 2109106 - protein, 21 aa, Staphylococcus
KTTVYPLKSFAQQIGGKYVDV

SEQ ID NO: 2109107 - protein, 28 aa, Staphylococcus
KTYAGAYRDWKPGQKIHLIGHSMGGQTV

SEQ ID NO: 2109108 - protein, 25 aa, Staphylococcus
KTYEGVYKDWKPGQKVHLVGHSMGG

SEQ ID NO: 2109109 - protein, 25 aa, Staphylococcus
KTYEGVYKDWQPGQKVHLVGHSMGG

SEQ ID NO: 2109110 - protein, 21 aa, Staphylococcus
KVAAAKPEVIFISGRTANQKN

SEQ ID NO: 2109111 - protein, 25 aa, Staphylococcus
KVDKYGLNFNPFRQIHAEINITMPS

SEQ ID NO: 2109112 - protein, 20 aa, Staphylococcus
KVDVILGGGSKYFGKENGHL

SEQ ID NO: 2109113 - protein, 19 aa, Staphylococcus
KVDVLLGGGSKYFGKENGN

SEQ ID NO: 2109114 - protein, 19 aa, Staphylococcus
KVIETPFITGVAMNGIEVK

SEQ ID NO: 2109115 - protein, 22 aa, Staphylococcus
KVKAVYDYRPSLETPRVLFTVN

SEQ ID NO: 2109116 - protein, 22 aa, Staphylococcus
KVKFINKKPRQLTVDLPIDYYG

SEQ ID NO: 2109117 - protein, 19 aa, Staphylococcus
KVKPFKYNGKTYAGISPYD

SEQ ID NO: 2109118 - protein, 25 aa, Staphylococcus
KVLIPISICTLIILLIGCGKSSDGL

SEQ ID NO: 2109119 - protein, 17 aa, Staphylococcus
KVMDDEAFIIEITPRFD

SEQ ID NO: 2109120 - protein, 27 aa, Staphylococcus
KVNATYTIKPGVKLYTVPWGTFNQEAS

SEQ ID NO: 2109121 - protein, 25 aa, Staphylococcus
KVNETKRMINKDKVLLLVVDDKGMK

SEQ ID NO: 2109122 - protein, 23 aa, Staphylococcus
KVPSIVALTLAGTALTTHHAQAA

SEQ ID NO: 2109123 - protein, 27 aa, Staphylococcus
KVQKKPKLLTDAYKDLLDDYKVDYKDR

SEQ ID NO: 2109124 - protein, 24 aa, Staphylococcus
KVQKNPKLLTNAYKDLLKEYNVDY

SEQ ID NO: 2109125 - protein, 24 aa, Staphylococcus
KVQPATFSAKVTPKLRVATTSANT

SEQ ID NO: 2109126 - protein, 31 aa, Staphylococcus
KVRITCVEAMPKILPMFSENLVNYVVNYLEE

SEQ ID NO: 2109127 - protein, 24 aa, Staphylococcus
KVSKLIQDLFMNDYLRVYTNNDLV

SEQ ID NO: 2109128 - protein, 23 aa, Staphylococcus
KVSQLIQDLFMNDYLRVYTNNDL

SEQ ID NO: 2109129 - protein, 32 aa, Staphylococcus
KVTQMICYDLRFPELLRYPARSGATIAFYVAQ

SEQ ID NO: 2109130 - protein, 26 aa, Staphylococcus
KVTQNDIITVLPFGNLISQIKVKGTN

SEQ ID NO: 2109131 - protein, 19 aa, Staphylococcus
KWISGMASMVMVLSMTMYC

SEQ ID NO: 2109132 - protein, 18 aa, Staphylococcus
KYALQYKKRYPIVNNQVD

SEQ ID NO: 2109133 - protein, 34 aa, Staphylococcus
KYFFVTPHSLMYMNYDYWLTYELGDKFYDVKVRN

SEQ ID NO: 2109134 - protein, 31 aa, Staphylococcus
KYKDSPALFKRLKASTFFLKMNEKEQPEFKN

SEQ ID NO: 2109135 - protein, 22 aa, Staphylococcus
KYLLSGSIVAATLLSSTNVSLA

SEQ ID NO: 2109136 - protein, 24 aa, Staphylococcus
KYMIALIVIILMTLVPAFQQQASA

SEQ ID NO: 2109137 - protein, 20 aa, Staphylococcus
KYMKSDQASALKFYEKKDAK

SEQ ID NO: 2109138 - protein, 18 aa, Staphylococcus
KYQVVNGVKWYYGQFSDG

SEQ ID NO: 2109139 - protein, 31 aa, Staphylococcus
KYTMPARNVNPIGYYQMMAEPGSSGGAVLNS

SEQ ID NO: 2109140 - protein, 27 aa, Staphylococcus
LAAAVKNLPLIKYSFDQIIMTKEGCMN

SEQ ID NO: 2109141 - protein, 28 aa, Staphylococcus
LAAAVKNLPLLKYSFDQIIMTKEGCMNH

SEQ ID NO: 2109142 - protein, 22 aa, Staphylococcus
LAAIFLLTACGKGNDEKQSLEQ

SEQ ID NO: 2109143 - protein, 18 aa, Staphylococcus
LAASLVRLANWKGDTPFI

SEQ ID NO: 2109144 - protein, 19 aa, Staphylococcus
LAFIFVLAACGGGNNKKVT

SEQ ID NO: 2109145 - protein, 18 aa, Staphylococcus
LAIFIVLVGCSQSNGDKQ

SEQ ID NO: 2109146 - protein, 22 aa, Staphylococcus
LAIMGRYVLKPEIFDYLSTQDK

SEQ ID NO: 2109147 - protein, 24 aa, Staphylococcus
LAKAPNFNLFGIKGAYKGESSEFN

SEQ ID NO: 2109148 - protein, 26 aa, Staphylococcus
LAKDPVSKYQFLRLDQPQYLSEATLN

SEQ ID NO: 2109149 - protein, 19 aa, Staphylococcus
LALIFVLAACGNGGSSDKN

SEQ ID NO: 2109150 - protein, 19 aa, Staphylococcus
LALLLVLTACGSKDTSHNH

SEQ ID NO: 2109151 - protein, 19 aa, Staphylococcus
LALMLILAACGNKSDSDSN

SEQ ID NO: 2109152 - protein, 19 aa, Staphylococcus
LALMLILAACGNNSSDDAS

SEQ ID NO: 2109153 - protein, 20 aa, Staphylococcus
LALSLILGAAACSNDDSSKD

SEQ ID NO: 2109154 - protein, 23 aa, Staphylococcus
LALVLFLAACSLESPLKNDKNGK

SEQ ID NO: 2109155 - protein, 22 aa, Staphylococcus
LAPKQLIDIKAFMGDTADGYAG

SEQ ID NO: 2109156 - protein, 18 aa, Staphylococcus
LAQSPNYNLFGVKGSYNG

SEQ ID NO: 2109157 - protein, 22 aa, Staphylococcus
LARGLREFPIDITAIVTVADDG

SEQ ID NO: 2109158 - protein, 26 aa, Staphylococcus
LASAVKNLPLIKYSFDQVIMTKEGCM

SEQ ID NO: 2109159 - protein, 20 aa, Staphylococcus
LASFLALAACSDDDKTSHKK

SEQ ID NO: 2109160 - protein, 22 aa, Staphylococcus
LASFLVLAACGNSEESKSEDKK

SEQ ID NO: 2109161 - protein, 20 aa, Staphylococcus
LASFLVLTACGQQKESKFDD

SEQ ID NO: 2109162 - protein, 19 aa, Staphylococcus
LASTLILGACGKNDEKAAL

SEQ ID NO: 2109163 - protein, 20 aa, Staphylococcus
LASTLMLTACGKSNEKASLE

SEQ ID NO: 2109164 - protein, 17 aa, Staphylococcus
LATGLALSAMVATTSSM

SEQ ID NO: 2109165 - protein, 23 aa, Staphylococcus
LATGTKPFVPPIEGLDKAHFEIA

SEQ ID NO: 2109166 - protein, 17 aa, Staphylococcus
LAVFLTIILTACNQNDS

SEQ ID NO: 2109167 - protein, 19 aa, Staphylococcus
LAVHLKLLEDLAEANGVAL

SEQ ID NO: 2109168 - protein, 17 aa, Staphylococcus
LAWGAHRAANIIAEQLS

SEQ ID NO: 2109169 - protein, 18 aa, Staphylococcus
LAWGAHRAASIIAEQIAG

SEQ ID NO: 2109170 - protein, 18 aa, Staphylococcus
LAWGAHRAASVIAEQLVG

SEQ ID NO: 2109171 - protein, 24 aa, Staphylococcus
LCASLFILVIFVGGCGSFNKEAQI

SEQ ID NO: 2109172 - protein, 18 aa, Staphylococcus
LCLLMIIVMGCTKGDRLP

SEQ ID NO: 2109173 - protein, 17 aa, Staphylococcus
LCLSLTPNIINLTSYYL

SEQ ID NO: 2109174 - protein, 17 aa, Staphylococcus
LCSFLVLGACSQSDHDS

SEQ ID NO: 2109175 - protein, 22 aa, Staphylococcus
LCSLYCLILSGCGQNNNEDLNR

SEQ ID NO: 2109176 - protein, 18 aa, Staphylococcus
LCTILFLAACNSNDNHER

SEQ ID NO: 2109177 - protein, 24 aa, Staphylococcus
LDHLNMDYFKMKPVGLIGNSGGIV

SEQ ID NO: 2109178 - protein, 19 aa, Staphylococcus
LDHYNSLFAVGKQPQKTSA

SEQ ID NO: 2109179 - protein, 19 aa, Staphylococcus
LDKALSIGIIDRKITDYKT

SEQ ID NO: 2109180 - protein, 17 aa, Staphylococcus
LDKDMINAFLNPKYTKD

SEQ ID NO: 2109181 - protein, 18 aa, Staphylococcus
LDKLDLPIVGKPTSYKKL

SEQ ID NO: 2109182 - protein, 26 aa, Staphylococcus
LDKNNKGFFLMVEGASIDKAAHPNDV

SEQ ID NO: 2109183 - protein, 24 aa, Staphylococcus
LDKNNMKFGVYSYSLYENADDARN

SEQ ID NO: 2109184 - protein, 17 aa, Staphylococcus
LDLFKSIKPYNITTLLS

SEQ ID NO: 2109185 - protein, 20 aa, Staphylococcus
LDNWPTYYPNSLSSEEIKEE

SEQ ID NO: 2109186 - protein, 22 aa, Staphylococcus
LDPNTPYPIIDLLPEQKDIEDL

SEQ ID NO: 2109187 - protein, 17 aa, Staphylococcus
LDQYKVDYKDRDLKKVV

SEQ ID NO: 2109188 - protein, 21 aa, Staphylococcus
LDVKDLYHKYGKDSDYKKVAK

SEQ ID NO: 2109189 - protein, 27 aa, Staphylococcus
LEEDIMHKYIPQILLSYGKEIQVVEPL

SEQ ID NO: 2109190 - protein, 26 aa, Staphylococcus
LEETAYLLDLLLDIDEPVVITGAMRS

SEQ ID NO: 2109191 - protein, 25 aa, Staphylococcus
LEKEKDLFELIKQDGVTQSQVDEKN

SEQ ID NO: 2109192 - protein, 17 aa, Staphylococcus
LEKLLSKELDIPVKVSV

SEQ ID NO: 2109193 - protein, 26 aa, Staphylococcus
LEKNDKGFFLMVEGASIDKAAHPNDV

SEQ ID NO: 2109194 - protein, 26 aa, Staphylococcus
LEKNNKGFFLMVEGASIDKSGHPNDI

SEQ ID NO: 2109195 - protein, 19 aa, Staphylococcus
LELALYYDKGSSSQKEQAE

SEQ ID NO: 2109196 - protein, 17 aa, Staphylococcus
LELIILKISKSLEVQGK

SEQ ID NO: 2109197 - protein, 43 aa, Staphylococcus
LEMPNAAQSLTLFKSFATSPYKNKLAAITQPTLIGPVHFERHK

SEQ ID NO: 2109198 - protein, 25 aa, Staphylococcus
LENTSYTLRLFLRDANRLPDYASDR

SEQ ID NO: 2109199 - protein, 22 aa, Staphylococcus
LEPKQLIDVKAFMGDTADGYPG

SEQ ID NO: 2109200 - protein, 23 aa, Staphylococcus
LEPQHLDYILLDRDHAQPSSWHN

SEQ ID NO: 2109201 - protein, 24 aa, Staphylococcus
LEQANALIESLPQRQVRTISTRAN

SEQ ID NO: 2109202 - protein, 18 aa, Staphylococcus
LESYRYYHQGDMIRPVNG

SEQ ID NO: 2109203 - protein, 20 aa, Staphylococcus
LETGNGWFKKALEQAGKSMD

SEQ ID NO: 2109204 - protein, 17 aa, Staphylococcus
LFENACYILVYDDEHNT

SEQ ID NO: 2109205 - protein, 19 aa, Staphylococcus
LFENAYYVLVYNSTKNRDA

SEQ ID NO: 2109206 - protein, 18 aa, Staphylococcus
LFGKIFKKEEKAKALNHK

SEQ ID NO: 2109207 - protein, 17 aa, Staphylococcus
LFIIGFIALSIYEEKRR

SEQ ID NO: 2109208 - protein, 20 aa, Staphylococcus
LFITISLTLAAIFDGLNNQD

SEQ ID NO: 2109209 - protein, 20 aa, Staphylococcus
LFLSLLLTLSACAPEDDNDT

SEQ ID NO: 2109210 - protein, 17 aa, Staphylococcus
LFLYGTVDNRTGWIAAK

SEQ ID NO: 2109211 - protein, 18 aa, Staphylococcus
LFNNKWFGKFLSSLNAFP

SEQ ID NO: 2109212 - protein, 20 aa, Staphylococcus
LFQDMAFATTLNHILSICNE

SEQ ID NO: 2109213 - protein, 25 aa, Staphylococcus
LFTLVCLCLIVIFIMILSANNFKPT

SEQ ID NO: 2109214 - protein, 19 aa, Staphylococcus
LFVAVLTLSLAACGKGDSD

SEQ ID NO: 2109215 - protein, 22 aa, Staphylococcus
LGAKVIMPIYPKVPHATYKETF

SEQ ID NO: 2109216 - protein, 19 aa, Staphylococcus
LGASILLAGCGSQNLGPLE

SEQ ID NO: 2109217 - protein, 17 aa, Staphylococcus
LGDIVWNDKNRNGIQDI

SEQ ID NO: 2109218 - protein, 18 aa, Staphylococcus
LGGFPISGQFIACTNPQV

SEQ ID NO: 2109219 - protein, 18 aa, Staphylococcus
LGGFPITGEFLVCNNPEV

SEQ ID NO: 2109220 - protein, 18 aa, Staphylococcus
LGGFPITGQFLACTNPQV

SEQ ID NO: 2109221 - protein, 23 aa, Staphylococcus
LGGTLRLGLYPCKIKENTLAHQI

SEQ ID NO: 2109222 - protein, 24 aa, Staphylococcus
LGGTLRLGLYPCTIKEGTLAHSIY

SEQ ID NO: 2109223 - protein, 17 aa, Staphylococcus
LGHELDVKDLYHKYGKD

SEQ ID NO: 2109224 - protein, 20 aa, Staphylococcus
LGHVITIFDALYKVRNIAKE

SEQ ID NO: 2109225 - protein, 26 aa, Staphylococcus
LGICLILLIILIGSCIILTKTNSRNA

SEQ ID NO: 2109226 - protein, 17 aa, Staphylococcus
LGLFADNDMPLQIDAPK

SEQ ID NO: 2109227 - protein, 18 aa, Staphylococcus
LGLFAEENMPLQIDAPKK

SEQ ID NO: 2109228 - protein, 22 aa, Staphylococcus
LGLSSFIILSACGQNTDNNNKK

SEQ ID NO: 2109229 - protein, 20 aa, Staphylococcus
LGMLILLAACGNKVDGTYKN

SEQ ID NO: 2109230 - protein, 27 aa, Staphylococcus
LGNEALVRQVVYDLGRAFGNKNSRVDF

SEQ ID NO: 2109231 - protein, 24 aa, Staphylococcus
LGSNHPISEKSLQLAYQDLEQAVA

SEQ ID NO: 2109232 - protein, 29 aa, Staphylococcus
LGVCNGFQILTEIGLLPGALLHNDSHLFI

SEQ ID NO: 2109233 - protein, 33 aa, Staphylococcus
LGVDLRGTFLMTKFLLPLMMDEGGSIINTASFS

SEQ ID NO: 2109234 - protein, 29 aa, Staphylococcus
LHELNPGLTNLILPGDILAVSDKGAAHLQ

SEQ ID NO: 2109235 - protein, 26 aa, Staphylococcus
LHQMNPNVPLIKLMNKFELTNASEQD

SEQ ID NO: 2109236 - protein, 24 aa, Staphylococcus
LIAILTLMLFLTYGCQSSSQSKQN

SEQ ID NO: 2109237 - protein, 27 aa, Staphylococcus
LIDGEPMFQFCLGIPWGAENDPETIEY

SEQ ID NO: 2109238 - protein, 24 aa, Staphylococcus
LIENIKENLNWIWNSFSREDQKDF

SEQ ID NO: 2109239 - protein, 17 aa, Staphylococcus
LIEPYKVKNHNKLYKDW

SEQ ID NO: 2109240 - protein, 29 aa, Staphylococcus
LIETMLALFIIQLLLFISISYLSTYHYIQ

SEQ ID NO: 2109241 - protein, 19 aa, Staphylococcus
LIFIMILAACGNQHNKDHS

SEQ ID NO: 2109242 - protein, 19 aa, Staphylococcus
LIFLVLLSACTQSNSQKQS

SEQ ID NO: 2109243 - protein, 21 aa, Staphylococcus
LIHPGDLIAVSSKGAALLGTN

SEQ ID NO: 2109244 - protein, 25 aa, Staphylococcus
LIIGILFLTYKYLALKRDVSQLTIQ

SEQ ID NO: 2109245 - protein, 22 aa, Staphylococcus
LIIIFSIIIIASNDTFAESKND

SEQ ID NO: 2109246 - protein, 21 aa, Staphylococcus
LILAVVIVLGGIIMSSISAVV

SEQ ID NO: 2109247 - protein, 20 aa, Staphylococcus
LILILSIGLVGCHRLSKEES

SEQ ID NO: 2109248 - protein, 18 aa, Staphylococcus
LILLIGLAGYSYTKSSKK

SEQ ID NO: 2109249 - protein, 20 aa, Staphylococcus
LILLLFLAACSNGKSDSNSN

SEQ ID NO: 2109250 - protein, 28 aa, Staphylococcus
LILLTFALIAIPVVFANNLFKSSEKAFE

SEQ ID NO: 2109251 - protein, 31 aa, Staphylococcus
LILLTFVLVVVPIIFATQLYKSSESAFEKSQ

SEQ ID NO: 2109252 - protein, 19 aa, Staphylococcus
LILSFALILSACANKSEDD

SEQ ID NO: 2109253 - protein, 18 aa, Staphylococcus
LILSLSLAACSHDDGNSN

SEQ ID NO: 2109254 - protein, 26 aa, Staphylococcus
LIPSNTEILYRLGLGKNIIGVSTVDD

SEQ ID NO: 2109255 - protein, 20 aa, Staphylococcus
LISIMFLFAACSNDSSSKDE

SEQ ID NO: 2109256 - protein, 17 aa, Staphylococcus
LISSLVLTACGSKSHSE

SEQ ID NO: 2109257 - protein, 19 aa, Staphylococcus
LITASVLFLGACSQSDNHT

SEQ ID NO: 2109258 - protein, 19 aa, Staphylococcus
LIVIILIAAGCSAPTKTDK

SEQ ID NO: 2109259 - protein, 19 aa, Staphylococcus
LIVKIYQLRGDISKGEPRS

SEQ ID NO: 2109260 - protein, 25 aa, Staphylococcus
LIVLILILSLFKIAPVHAENASMSE

SEQ ID NO: 2109261 - protein, 23 aa, Staphylococcus
LKDDKHFFPPYDASPVATDAVLK

SEQ ID NO: 2109262 - protein, 23 aa, Staphylococcus
LKDDKHFFPPYDASSVATNNLLK

SEQ ID NO: 2109263 - protein, 24 aa, Staphylococcus
LKDDRKFFPPYDGSPLATEKLIKD

SEQ ID NO: 2109264 - protein, 24 aa, Staphylococcus
LKDNGVNEFLLWNAGNEYTEGANY

SEQ ID NO: 2109265 - protein, 17 aa, Staphylococcus
LKDQLKSDLLFHKSLQI

SEQ ID NO: 2109266 - protein, 24 aa, Staphylococcus
LKDVSRYFALAHYSKNYKKVTMDG

SEQ ID NO: 2109267 - protein, 19 aa, Staphylococcus
LKGIKGFKPTPYPTYNSLD

SEQ ID NO: 2109268 - protein, 24 aa, Staphylococcus
LKGKKGYIKTPYPTYNTLDHVDDS

SEQ ID NO: 2109269 - protein, 23 aa, Staphylococcus
LKGTLYGIDAALPTMRKQQSGHI

SEQ ID NO: 2109270 - protein, 28 aa, Staphylococcus
LKMHQLNSNVPLIRLLDKGELAQQSEAD

SEQ ID NO: 2109271 - protein, 19 aa, Staphylococcus
LKSKKVDVAFISPVSYTIA

SEQ ID NO: 2109272 - protein, 17 aa, Staphylococcus
LKVLPKENNDAVKNNKQ

SEQ ID NO: 2109273 - protein, 25 aa, Staphylococcus
LLAERFPRITALKGSLFGVAIHIAF

SEQ ID NO: 2109274 - protein, 21 aa, Staphylococcus
LLAGSIFFASTVIINTTYASD

SEQ ID NO: 2109275 - protein, 17 aa, Staphylococcus
LLALGLTLAGCSHHDND

SEQ ID NO: 2109276 - protein, 17 aa, Staphylococcus
LLATLILSACGKSEEKV

SEQ ID NO: 2109277 - protein, 17 aa, Staphylococcus
LLDLLLEIEEPVVITGA

SEQ ID NO: 2109278 - protein, 24 aa, Staphylococcus
LLEDNVNIFVPMIQKVIAHGFDGY

SEQ ID NO: 2109279 - protein, 18 aa, Staphylococcus
LLEYFNPSKATQLDDQQQ

SEQ ID NO: 2109280 - protein, 20 aa, Staphylococcus
LLFGFVITLGACGNEGANEF

SEQ ID NO: 2109281 - protein, 18 aa, Staphylococcus
LLFILKGGNFIKNNIYFN

SEQ ID NO: 2109282 - protein, 19 aa, Staphylococcus
LLFTIMLVLSACSNGDIDD

SEQ ID NO: 2109283 - protein, 21 aa, Staphylococcus
LLGLFATIALAIVLSACGNGG

SEQ ID NO: 2109284 - protein, 19 aa, Staphylococcus
LLGLFILTGCSFSNEDKEE

SEQ ID NO: 2109285 - protein, 18 aa, Staphylococcus
LLGLTFKENCPDLRNTKV

SEQ ID NO: 2109286 - protein, 20 aa, Staphylococcus
LLIAVMILTSACGKDKSQDE

SEQ ID NO: 2109287 - protein, 18 aa, Staphylococcus
LLIFSLVLTGCNNLESKE

SEQ ID NO: 2109288 - protein, 22 aa, Staphylococcus
LLILSVILILSACNKQSDSNSS

SEQ ID NO: 2109289 - protein, 21 aa, Staphylococcus
LLIPLMILALAACGNGDDHKK

SEQ ID NO: 2109290 - protein, 19 aa, Staphylococcus
LLIVLALVLSACSNQSEDD

SEQ ID NO: 2109291 - protein, 25 aa, Staphylococcus
LLKEMDHWPTYYPASLDKDDIKEEM

SEQ ID NO: 2109292 - protein, 17 aa, Staphylococcus
LLKQHSRQYAKRQLTWF

SEQ ID NO: 2109293 - protein, 18 aa, Staphylococcus
LLLCATFSLVACGNRTQS

SEQ ID NO: 2109294 - protein, 21 aa, Staphylococcus
LLLCLCMMFSPLTTYAAKTPT

SEQ ID NO: 2109295 - protein, 22 aa, Staphylococcus
LLLSILLILSGCSQSDKTQRSQ

SEQ ID NO: 2109296 - protein, 18 aa, Staphylococcus
LLLSLTVALAACGGKDDD

SEQ ID NO: 2109297 - protein, 21 aa, Staphylococcus
LLLTFLVILSACAQQKKDAPS

SEQ ID NO: 2109298 - protein, 19 aa, Staphylococcus
LLNRTGTTSGMRPASITAY

SEQ ID NO: 2109299 - protein, 22 aa, Staphylococcus
LLSLVMLILVACGQNDQHKQED

SEQ ID NO: 2109300 - protein, 17 aa, Staphylococcus
LLSSAAILLGACGNGGS

SEQ ID NO: 2109301 - protein, 20 aa, Staphylococcus
LLVLSVVIFAAACGGNSSLD

SEQ ID NO: 2109302 - protein, 17 aa, Staphylococcus
LMEKAGYSKKHPLTINV

SEQ ID NO: 2109303 - protein, 17 aa, Staphylococcus
LMLSLLVTLTACGNDSK

SEQ ID NO: 2109304 - protein, 28 aa, Staphylococcus
LMMEKMMHWCHNAYGVNYAALRYFNVAG

SEQ ID NO: 2109305 - protein, 26 aa, Staphylococcus
LMPSNTEILYRLGLGNNIVGVSTVDD

SEQ ID NO: 2109306 - protein, 20 aa, Staphylococcus
LMSDNLTEALPIKEPLFAVY

SEQ ID NO: 2109307 - protein, 19 aa, Staphylococcus
LMSIIVGVLCLGISQWFKS

SEQ ID NO: 2109308 - protein, 21 aa, Staphylococcus
LMSISLILILVGCSQSKQQTQ

SEQ ID NO: 2109309 - protein, 25 aa, Staphylococcus
LNDIYDMKPLKSFVKERTILLGDAA

SEQ ID NO: 2109310 - protein, 29 aa, Staphylococcus
LNESFSDVFGYFVDPDDWLMGEDVYTPGT

SEQ ID NO: 2109311 - protein, 21 aa, Staphylococcus
LNGYLIHPNQTLTIPGTTGTG

SEQ ID NO: 2109312 - protein, 21 aa, Staphylococcus
LNGYLITPNQTLKIPNGGSGA

SEQ ID NO: 2109313 - protein, 24 aa, Staphylococcus
LNKEKELFTFLNQDGATQSEVDSK

SEQ ID NO: 2109314 - protein, 29 aa, Staphylococcus
LNNIKNPNFILIGQVLKVPFISSNNSSTN

SEQ ID NO: 2109315 - protein, 24 aa, Staphylococcus
LNNKTYYLLADFNGNVTRGWVPAD

SEQ ID NO: 2109316 - protein, 27 aa, Staphylococcus
LNNNQRVILIWNPWDNGLTTQSADSNV

SEQ ID NO: 2109317 - protein, 21 aa, Staphylococcus
LNPNIVYKSYTGESTRPGLNG

SEQ ID NO: 2109318 - protein, 22 aa, Staphylococcus
LNPQQLIDIKAFMGDSADGYPG

SEQ ID NO: 2109319 - protein, 27 aa, Staphylococcus
LNSYYNQPFFVSKQMKVDGVTWYYGQL

SEQ ID NO: 2109320 - protein, 25 aa, Staphylococcus
LNVGCIPSKIFLEYGAKMRDIHSAN

SEQ ID NO: 2109321 - protein, 19 aa, Staphylococcus
LNYTRLFEKRRAQLEIKVA

SEQ ID NO: 2109322 - protein, 25 aa, Staphylococcus
LPASNFLNPDLYQNGFSLTHLIASL

SEQ ID NO: 2109323 - protein, 24 aa, Staphylococcus
LPESKSAGHPIFNVLEGNMGNSYT

SEQ ID NO: 2109324 - protein, 17 aa, Staphylococcus
LPEYTLINKLHPAALKL

SEQ ID NO: 2109325 - protein, 19 aa, Staphylococcus
LPGVTLKIKQLPFKQRLNQ

SEQ ID NO: 2109326 - protein, 34 aa, Staphylococcus
LPIVVGLLLVLGIAWGVYAFITNTPKNTYLLSEK

SEQ ID NO: 2109327 - protein, 19 aa, Staphylococcus
LPNNGVIRAITYYEDSVQS

SEQ ID NO: 2109328 - protein, 22 aa, Staphylococcus
LPSMLALSLFGATLTAQHAHAA

SEQ ID NO: 2109329 - protein, 23 aa, Staphylococcus
LPSMVALTLFGTAFTAHHAHAAE

SEQ ID NO: 2109330 - protein, 22 aa, Staphylococcus
LPSMVAVTLLGTAFTAHHADAA

SEQ ID NO: 2109331 - protein, 24 aa, Staphylococcus
LPTMKLPYRFYFGGKLGTGFQWYS

SEQ ID NO: 2109332 - protein, 18 aa, Staphylococcus
LPVTASALLLGACGNSAT

SEQ ID NO: 2109333 - protein, 29 aa, Staphylococcus
LQAFFDANYHDYRFIDRDKVDQPTLDQVK

SEQ ID NO: 2109334 - protein, 19 aa, Staphylococcus
LQCINPNVEVWLTKKGFNI

SEQ ID NO: 2109335 - protein, 17 aa, Staphylococcus
LQEYGQYHGGGAHYGVD

SEQ ID NO: 2109336 - protein, 20 aa, Staphylococcus
LQFTLVSMRETWPQHPGLIH

SEQ ID NO: 2109337 - protein, 18 aa, Staphylococcus
LQIVKVLNDFFNSQKIKE

SEQ ID NO: 2109338 - protein, 25 aa, Staphylococcus
LQKAESILLHDAPVAPIYQKGEAHL

SEQ ID NO: 2109339 - protein, 36 aa, Staphylococcus
LQKSFTSNATNMNFLRWVDFPNDYTVGWTSQTIPGR

SEQ ID NO: 2109340 - protein, 18 aa, Staphylococcus
LQTSQGAFGHVAYVESVN

SEQ ID NO: 2109341 - protein, 21 aa, Staphylococcus
LRFSNAMFEPLWNNKYISNIQ

SEQ ID NO: 2109342 - protein, 19 aa, Staphylococcus
LSATLMLSACGKSDERASL

SEQ ID NO: 2109343 - protein, 18 aa, Staphylococcus
LSATLTLSACGKSEEKAS

SEQ ID NO: 2109344 - protein, 20 aa, Staphylococcus
LSGFDPIRREIARTALVNLV

SEQ ID NO: 2109345 - protein, 26 aa, Staphylococcus
LSIAKGKDYVWNPDAIHSMKHSGSYM

SEQ ID NO: 2109346 - protein, 22 aa, Staphylococcus
LSIAKGKEYVWNPDAIHKMKHS

SEQ ID NO: 2109347 - protein, 17 aa, Staphylococcus
LSIKPEKAKLIYGQSGK

SEQ ID NO: 2109348 - protein, 18 aa, Staphylococcus
LSIVFLLLIFCISGCGSS

SEQ ID NO: 2109349 - protein, 17 aa, Staphylococcus
LSKDDGKLVYNFDLQKG

SEQ ID NO: 2109350 - protein, 19 aa, Staphylococcus
LSKYLQGPYLKLNSETLAD

SEQ ID NO: 2109351 - protein, 19 aa, Staphylococcus
LSKYLQGPYLQLNSETLSE

SEQ ID NO: 2109352 - protein, 28 aa, Staphylococcus
LSLFIVCFLLGCITWFGFEKQNNKINTI

SEQ ID NO: 2109353 - protein, 19 aa, Staphylococcus
LSLLIILSACGQNKDSNKE

SEQ ID NO: 2109354 - protein, 19 aa, Staphylococcus
LSMCAVLILSGCGYQHRDN

SEQ ID NO: 2109355 - protein, 17 aa, Staphylococcus
LSPTDWLRKQAQLVKEA

SEQ ID NO: 2109356 - protein, 25 aa, Staphylococcus
LSRFVISLLSFVLALTVVSPFSSKA

SEQ ID NO: 2109357 - protein, 24 aa, Staphylococcus
LSRQSLIELIYSYVKPNTVFTDYE

SEQ ID NO: 2109358 - protein, 25 aa, Staphylococcus
LSSCLILGACGNQDSEQKDEHKKTE

SEQ ID NO: 2109359 - protein, 23 aa, Staphylococcus
LSSFLVLSACSHSDHSDKKDSDK

SEQ ID NO: 2109360 - protein, 17 aa, Staphylococcus
LSSIAAFFAINTAANAQ

SEQ ID NO: 2109361 - protein, 28 aa, Staphylococcus
LSVGASSIIVASMLFIGGGAAHAAEQDV

SEQ ID NO: 2109362 - protein, 25 aa, Staphylococcus
LTAGIGVSAFGLNIHHADAAELTQN

SEQ ID NO: 2109363 - protein, 18 aa, Staphylococcus
LTASIVLAGCGFGNNDKG

SEQ ID NO: 2109364 - protein, 19 aa, Staphylococcus
LTEALPIKEPLFAVYEGTH

SEQ ID NO: 2109365 - protein, 20 aa, Staphylococcus
LTEFEVAYAPPYSHPKDLVN

SEQ ID NO: 2109366 - protein, 17 aa, Staphylococcus
LTGIYEYKLATGNKNFK

SEQ ID NO: 2109367 - protein, 19 aa, Staphylococcus
LTIILTITLTACGGGKSED

SEQ ID NO: 2109368 - protein, 30 aa, Staphylococcus
LTIVGVVLILVAIYLFAKPHIDNYLHEKDN

SEQ ID NO: 2109369 - protein, 17 aa, Staphylococcus
LTIVLTVALAACGNGSS

SEQ ID NO: 2109370 - protein, 36 aa, Staphylococcus
LTKQFISTFDHMDFLKWINLRNDYTVTWTSQKLNGR

SEQ ID NO: 2109371 - protein, 20 aa, Staphylococcus
LTLIFVLAACGNSGSSDKNS

SEQ ID NO: 2109372 - protein, 19 aa, Staphylococcus
LTLLLVVGLAACGTSDKKD

SEQ ID NO: 2109373 - protein, 19 aa, Staphylococcus
LTLMLVLAACGNDDSKKED

SEQ ID NO: 2109374 - protein, 18 aa, Staphylococcus
LTLSLALAACSNGSDDDS

SEQ ID NO: 2109375 - protein, 21 aa, Staphylococcus
LTMLFILTACSNQIYGKYKAE

SEQ ID NO: 2109376 - protein, 17 aa, Staphylococcus
LTSIAALTVASPFVTMD

SEQ ID NO: 2109377 - protein, 18 aa, Staphylococcus
LTSSLLLTACGHNNHDNA

SEQ ID NO: 2109378 - protein, 19 aa, Staphylococcus
LTVNDWIFTLETLANPEYD

SEQ ID NO: 2109379 - protein, 36 aa, Staphylococcus
LTVRKDFDLIYYRSYTNGLMPYNFLNARFKQNGKQP

SEQ ID NO: 2109380 - protein, 20 aa, Staphylococcus
LVETSRGYGGQPIKYSNLSS

SEQ ID NO: 2109381 - protein, 21 aa, Staphylococcus
LVFFIGATVCWFTFEKQNYEE

SEQ ID NO: 2109382 - protein, 17 aa, Staphylococcus
LVLALTVALAACGGAGD

SEQ ID NO: 2109383 - protein, 22 aa, Staphylococcus
LVLGFIVILAGCGKINEQDKEN

SEQ ID NO: 2109384 - protein, 20 aa, Staphylococcus
LVLICTLTVIPMNGSAHAQT

SEQ ID NO: 2109385 - protein, 18 aa, Staphylococcus
LVLIIVLAACGNNGGSGK

SEQ ID NO: 2109386 - protein, 18 aa, Staphylococcus
LVLTLTVVLAACGNGSGD

SEQ ID NO: 2109387 - protein, 18 aa, Staphylococcus
LVLTLTVVLVACGKGGDE

SEQ ID NO: 2109388 - protein, 18 aa, Staphylococcus
LVLVLTVILAACSNDESD

SEQ ID NO: 2109389 - protein, 26 aa, Staphylococcus
LVNGVTWYHGTLANGTAIWVKAADVR

SEQ ID NO: 2109390 - protein, 17 aa, Staphylococcus
LVNKKATKRRKLFNGYI

SEQ ID NO: 2109391 - protein, 17 aa, Staphylococcus
LVSGLVISGVGIYHVEA

SEQ ID NO: 2109392 - protein, 17 aa, Staphylococcus
LVSGLVLTGVSAGHHAE

SEQ ID NO: 2109393 - protein, 17 aa, Staphylococcus
LVSLIVLAGCGEKGKDH

SEQ ID NO: 2109394 - protein, 18 aa, Staphylococcus
LVSPRRPYSSSAAYQTQF

SEQ ID NO: 2109395 - protein, 25 aa, Staphylococcus
LVTFLIYLFYSPRLQFDVLENPNKS

SEQ ID NO: 2109396 - protein, 17 aa, Staphylococcus
LVVASSLVLGACSTDTH

SEQ ID NO: 2109397 - protein, 23 aa, Staphylococcus
LVVLVLSVVIFAAACGNSSSLDN

SEQ ID NO: 2109398 - protein, 18 aa, Staphylococcus
LWARARGLISSEEMAKEL

SEQ ID NO: 2109399 - protein, 18 aa, Staphylococcus
LWARARGLISSEQMAKEI

SEQ ID NO: 2109400 - protein, 18 aa, Staphylococcus
LWARSRGLISSEEMAKEL

SEQ ID NO: 2109401 - protein, 18 aa, Staphylococcus
LWQTKDNGFYDLTREGAT

SEQ ID NO: 2109402 - protein, 17 aa, Staphylococcus
LYDWGQCTWHVFNKRAQ

SEQ ID NO: 2109403 - protein, 19 aa, Staphylococcus
LYERGISPTLIHRSTHINK

SEQ ID NO: 2109404 - protein, 21 aa, Staphylococcus
LYFILVKLGKSLFVIGKENVP

SEQ ID NO: 2109405 - protein, 18 aa, Staphylococcus
LYIQSLIYDYPFDDENIS

SEQ ID NO: 2109406 - protein, 17 aa, Staphylococcus
LYKMRWNPDQPGTHQYA

SEQ ID NO: 2109407 - protein, 17 aa, Staphylococcus
LYNPKFKNDIILVDGAR

SEQ ID NO: 2109408 - protein, 19 aa, Staphylococcus
LYQNKLNQAIYFAKKQQDA

SEQ ID NO: 2109409 - protein, 21 aa, Staphylococcus
LYTAGQCTYYVFDKVGGKIGS

SEQ ID NO: 2109410 - protein, 18 aa, Staphylococcus
LYTSGQCTYYVYDKVGGK

SEQ ID NO: 2109411 - protein, 18 aa, Staphylococcus
LYWLLVKKCKSLKVHGKK

SEQ ID NO: 2109412 - protein, 29 aa, Staphylococcus
MAFLLACCLGFLLFIATNQQALAKVHETI

SEQ ID NO: 2109413 - protein, 19 aa, Staphylococcus
MAGKYLVDKVGKNAKVGEL

SEQ ID NO: 2109414 - protein, 17 aa, Staphylococcus
MALVVVLAACGGNKKDD

SEQ ID NO: 2109415 - protein, 22 aa, Staphylococcus
MAMILLLAGCSLESPLEKQDSG

SEQ ID NO: 2109416 - protein, 18 aa, Staphylococcus
MAVLLFLAACGGGHSQSS

SEQ ID NO: 2109417 - protein, 22 aa, Staphylococcus
MEGIPHYLIDILNPDESFSAYE

SEQ ID NO: 2109418 - protein, 25 aa, Staphylococcus
MGGIEPTVDWLKRALSQKKHVVTAN

SEQ ID NO: 2109419 - protein, 18 aa, Staphylococcus
MGGKLIVDKFGKGTKVVE

SEQ ID NO: 2109420 - protein, 22 aa, Staphylococcus
MGIPTDIKPFLKTRLISPIGKL

SEQ ID NO: 2109421 - protein, 17 aa, Staphylococcus
MHFKNHLQIDISKGKKI

SEQ ID NO: 2109422 - protein, 18 aa, Staphylococcus
MIDIYDQIIAKTGEQTAS

SEQ ID NO: 2109423 - protein, 20 aa, Staphylococcus
MIFLLIVALTACSNKTDSDL

SEQ ID NO: 2109424 - protein, 32 aa, Staphylococcus
MILLTFALIAVPAIFAYQLFKSSESAFQTSYS

SEQ ID NO: 2109425 - protein, 17 aa, Staphylococcus
MITSEGAFKYFSKQYDI

SEQ ID NO: 2109426 - protein, 20 aa, Staphylococcus
MITSTLLATTAPKFAAPAMN

SEQ ID NO: 2109427 - protein, 17 aa, Staphylococcus
MIYPSHWSNGDFGLDAP

SEQ ID NO: 2109428 - protein, 20 aa, Staphylococcus
MKPLKSFVNQRILLLGDAAH

SEQ ID NO: 2109429 - protein, 27 aa, Staphylococcus
MKSKKVDVGFLPPTAYTLAHDQKAADV

SEQ ID NO: 2109430 - protein, 25 aa, Staphylococcus
MKTGYDYSWFILTEDIIKKEFVLSG

SEQ ID NO: 2109431 - protein, 21 aa, Staphylococcus
MLIMLIMGSGYLMIKSELHHD

SEQ ID NO: 2109432 - protein, 17 aa, Staphylococcus
MLPKIESAISFIKNNPK

SEQ ID NO: 2109433 - protein, 25 aa, Staphylococcus
MMQSGTKWFYVVYDSDDSISKDNDV

SEQ ID NO: 2109434 - protein, 18 aa, Staphylococcus
MMSLLIILAGCSQNDQHQ

SEQ ID NO: 2109435 - protein, 28 aa, Staphylococcus
MNANNFSNYLIYPGQIIKIPSSSSTTNS

SEQ ID NO: 2109436 - protein, 21 aa, Staphylococcus
MNEFAVIFDKVGIDTNEVLEA

SEQ ID NO: 2109437 - protein, 28 aa, Staphylococcus
MNNYADYAATQLVYYGLKPDSAENDGQG

SEQ ID NO: 2109438 - protein, 26 aa, Staphylococcus
MNPQVKNFYFHKVGPNYSLKQVYIDK

SEQ ID NO: 2109439 - protein, 18 aa, Staphylococcus
MNSVYYYQKEKDGETYSK

SEQ ID NO: 2109440 - protein, 17 aa, Staphylococcus
MNTYKMKLYSNQKLSNT

SEQ ID NO: 2109441 - protein, 25 aa, Staphylococcus
MNWFSHDPAFDYFKHMDATSVATIV

SEQ ID NO: 2109442 - protein, 24 aa, Staphylococcus
MQGFEKAFDYATQYAKANPDTLVV

SEQ ID NO: 2109443 - protein, 19 aa, Staphylococcus
MRETWPQHPGLIHKHVIDP

SEQ ID NO: 2109444 - protein, 24 aa, Staphylococcus
MSEMSGFDKAFQNAIDYAKNHKDT

SEQ ID NO: 2109445 - protein, 23 aa, Staphylococcus
MSFANCALPYYLSDTITEREKVL

SEQ ID NO: 2109446 - protein, 34 aa, Staphylococcus
MSLPTKILLWIVGVLFLLAVIAVIYICAKIFITG

SEQ ID NO: 2109447 - protein, 26 aa, Staphylococcus
MSNDFSPIVLPNVQKVNVVNPGDLTR

SEQ ID NO: 2109448 - protein, 23 aa, Staphylococcus
MSSLLLFTIVNSQLTYAATYTSL

SEQ ID NO: 2109449 - protein, 29 aa, Staphylococcus
MSTRMNMYNPMYYLSDYYSGYGKSNVANH

SEQ ID NO: 2109450 - protein, 34 aa, Staphylococcus
MSVDMRGTFLVTKFLLPLMLDNGGSIINTASFSG

SEQ ID NO: 2109451 - protein, 17 aa, Staphylococcus
MSVSWYQNSAEAKALYL

SEQ ID NO: 2109452 - protein, 26 aa, Staphylococcus
MTIAGSILTTTLFSTSHPTLASAGGQ

SEQ ID NO: 2109453 - protein, 20 aa, Staphylococcus
MTIGLAMNSEYYYQKEKDGE

SEQ ID NO: 2109454 - protein, 20 aa, Staphylococcus
MTIGLAMNSVYYYQKEKDGE

SEQ ID NO: 2109455 - protein, 29 aa, Staphylococcus
MTIIGVILILVAIYLFAKPHIDSYLHDKD

SEQ ID NO: 2109456 - protein, 29 aa, Staphylococcus
MTILGVILILVAVYLFAKPHIDNYLHEKD

SEQ ID NO: 2109457 - protein, 29 aa, Staphylococcus
MTMIGVILILVAVYLFAKPYIDNYLHQKD

SEQ ID NO: 2109458 - protein, 18 aa, Staphylococcus
MTMLSLGAAGLESGQAHA

SEQ ID NO: 2109459 - protein, 21 aa, Staphylococcus
MTMNQLYQLNPNLGEVIYPGQ

SEQ ID NO: 2109460 - protein, 18 aa, Staphylococcus
MTMVSLGAAGLESGQAHA

SEQ ID NO: 2109461 - protein, 26 aa, Staphylococcus
MTQPTIHFWEKNPMKLNLYAKGQCTY

SEQ ID NO: 2109462 - protein, 21 aa, Staphylococcus
MTSFLVLGACGQKEDNKSDDK

SEQ ID NO: 2109463 - protein, 18 aa, Staphylococcus
MTVILISSGILTYISPVA

SEQ ID NO: 2109464 - protein, 18 aa, Staphylococcus
MVDFAKQGGSIIFISDHY

SEQ ID NO: 2109465 - protein, 18 aa, Staphylococcus
MVEALRSKKVDVAFISPV

SEQ ID NO: 2109466 - protein, 27 aa, Staphylococcus
MVGDGMGPAYNSAYRYYADNPNTKELD

SEQ ID NO: 2109467 - protein, 19 aa, Staphylococcus
MYVHCTLLPYIKAAGEMKT

SEQ ID NO: 2109468 - protein, 28 aa, Staphylococcus
NAEFNLPQSIQPKHPFKVTVKLKGYDAN

SEQ ID NO: 2109469 - protein, 25 aa, Staphylococcus
NAHEIVIMPGIFPFIGETREAAEAQ

SEQ ID NO: 2109470 - protein, 20 aa, Staphylococcus
NAIEMYYSLQDYYDTRVDTI

SEQ ID NO: 2109471 - protein, 18 aa, Staphylococcus
NAKTLAKNPALKYQFLRL

SEQ ID NO: 2109472 - protein, 18 aa, Staphylococcus
NANDAYRQDQAPLTLKLK

SEQ ID NO: 2109473 - protein, 26 aa, Staphylococcus
NANGLPTDGFHFVWTQNTTASHSEQW

SEQ ID NO: 2109474 - protein, 23 aa, Staphylococcus
NANPYFYQIELTRSNTFDDFAKS

SEQ ID NO: 2109475 - protein, 18 aa, Staphylococcus
NAQVPLAWGAHRAANIIA

SEQ ID NO: 2109476 - protein, 21 aa, Staphylococcus
NATIYQPTWKSETSSYRDATA

SEQ ID NO: 2109477 - protein, 25 aa, Staphylococcus
NDGQGTVWTHYAISRFLGGTDHSDP

SEQ ID NO: 2109478 - protein, 27 aa, Staphylococcus
NDGQGTVWTHYAISRWLGGTDHADPHQ

SEQ ID NO: 2109479 - protein, 23 aa, Staphylococcus
NDIVIEKGQQYHPLKGIRAYDKE

SEQ ID NO: 2109480 - protein, 22 aa, Staphylococcus
NDIWKHFKAVKTNQVYDLEEVP

SEQ ID NO: 2109481 - protein, 22 aa, Staphylococcus
NDKFRNIYHFLTHESYQELCDF

SEQ ID NO: 2109482 - protein, 22 aa, Staphylococcus
NDKFYLVQDYNTGKKYGWVKQS

SEQ ID NO: 2109483 - protein, 26 aa, Staphylococcus
NDKIQKLLAFQTLYIGIDPKRGPSLY

SEQ ID NO: 2109484 - protein, 21 aa, Staphylococcus
NDLPIIIQDKTFVSKKLNYSK

SEQ ID NO: 2109485 - protein, 17 aa, Staphylococcus
NDMPLQIDAPKQNPKLV

SEQ ID NO: 2109486 - protein, 20 aa, Staphylococcus
NDQQNMRFSFVGSGNMPPNL

SEQ ID NO: 2109487 - protein, 31 aa, Staphylococcus
NDTHVGMDLIAGTSLLAGGLLIGGRKRREKT

SEQ ID NO: 2109488 - protein, 20 aa, Staphylococcus
NDVMREFLKFTLDDKGKSAE

SEQ ID NO: 2109489 - protein, 19 aa, Staphylococcus
NEDDLLDKTFKHLLENQKP

SEQ ID NO: 2109490 - protein, 18 aa, Staphylococcus
NEEFEISKQFWAHLVKTN

SEQ ID NO: 2109491 - protein, 17 aa, Staphylococcus
NEEFEISKQFWGHLVKS

SEQ ID NO: 2109492 - protein, 17 aa, Staphylococcus
NEGIPVITLDRSVDKGD

SEQ ID NO: 2109493 - protein, 27 aa, Staphylococcus
NEKVQKLLAFQMLYIGIDPKQGPSLYS

SEQ ID NO: 2109494 - protein, 26 aa, Staphylococcus
NENSKLPIIFWMHGGGFVAGDKQYKN

SEQ ID NO: 2109495 - protein, 17 aa, Staphylococcus
NEQFEISKQFWGHLVKS

SEQ ID NO: 2109496 - protein, 24 aa, Staphylococcus
NESFSDVFAYFIESDNFLIGEDIY

SEQ ID NO: 2109497 - protein, 18 aa, Staphylococcus
NESPIQKGAYNVNFDYNG

SEQ ID NO: 2109498 - protein, 29 aa, Staphylococcus
NETGQSYIFAKNKLYPIPGGSIMGIPTDI

SEQ ID NO: 2109499 - protein, 17 aa, Staphylococcus
NETPEYVGLFYNAKSYD

SEQ ID NO: 2109500 - protein, 17 aa, Staphylococcus
NETSWDSMFAGLDAGRF

SEQ ID NO: 2109501 - protein, 26 aa, Staphylococcus
NETTAVFNVLIKPLKDKYSVMTTADE

SEQ ID NO: 2109502 - protein, 24 aa, Staphylococcus
NEYGAKWYTYYNNDYDNFIMVSYL

SEQ ID NO: 2109503 - protein, 19 aa, Staphylococcus
NFFFLMINGERVNRSELIK

SEQ ID NO: 2109504 - protein, 19 aa, Staphylococcus
NFGLDTLREIIKYHGPFKA

SEQ ID NO: 2109505 - protein, 19 aa, Staphylococcus
NFVRAVKYHNVTFNGYKIQ

SEQ ID NO: 2109506 - protein, 17 aa, Staphylococcus
NFYTLEMDTNFNLKNVK

SEQ ID NO: 2109507 - protein, 29 aa, Staphylococcus
NGDGSINVYKNVPYDWRDSRTDANMKEAT

SEQ ID NO: 2109508 - protein, 25 aa, Staphylococcus
NGEKYQYEFIINTTNGYYYDDPSSA

SEQ ID NO: 2109509 - protein, 23 aa, Staphylococcus
NGERIPFKMYDNNKARDFNVVTG

SEQ ID NO: 2109510 - protein, 25 aa, Staphylococcus
NGEYFGLAQTKLSWGYGTVEQQTRG

SEQ ID NO: 2109511 - protein, 21 aa, Staphylococcus
NGGGIFSFLPQKESAAHYFER

SEQ ID NO: 2109512 - protein, 19 aa, Staphylococcus
NGIFNLKFKHDEQWYPHHI

SEQ ID NO: 2109513 - protein, 23 aa, Staphylococcus
NGKHKVDVILGGGSKYFGKENGN

SEQ ID NO: 2109514 - protein, 20 aa, Staphylococcus
NGNLIFPGQVLTINGSSTTT

SEQ ID NO: 2109515 - protein, 23 aa, Staphylococcus
NGSNYYDWGQCTYYAFDRRQQLG

SEQ ID NO: 2109516 - protein, 36 aa, Staphylococcus
NGVEKDFTVNPNSELIFGFNTMPANNGKGGTYLIVK

SEQ ID NO: 2109517 - protein, 17 aa, Staphylococcus
NGVIPQGNVMEGPASAA

SEQ ID NO: 2109518 - protein, 18 aa, Staphylococcus
NGVNGWISKSFLTTPSTS

SEQ ID NO: 2109519 - protein, 27 aa, Staphylococcus
NGWCAGYTMAFLLNATYNTGHYNAEMI

SEQ ID NO: 2109520 - protein, 32 aa, Staphylococcus
NHEDYSFAIPHRYSTHYLLLEEMRKQLHLDSD

SEQ ID NO: 2109521 - protein, 34 aa, Staphylococcus
NHEFDFGYNQLLKLQKQLHFPMISSNIYKNGKRI

SEQ ID NO: 2109522 - protein, 18 aa, Staphylococcus
NHIFKHFNQQYYGVPIAY

SEQ ID NO: 2109523 - protein, 18 aa, Staphylococcus
NHMLQMVALLAMEAPISL

SEQ ID NO: 2109524 - protein, 32 aa, Staphylococcus
NHNKLYKDWIDSKGYYYGFSGSALGLSYNTKA

SEQ ID NO: 2109525 - protein, 23 aa, Staphylococcus
NHSKLFTGKILSIIQIPYKVEKG

SEQ ID NO: 2109526 - protein, 23 aa, Staphylococcus
NHTNPNLHLASHTTEDVASATST

SEQ ID NO: 2109527 - protein, 22 aa, Staphylococcus
NIAKSDLFIYSSDDLDPVAKTI

SEQ ID NO: 2109528 - protein, 25 aa, Staphylococcus
NIATVFNWNPTTKKLTYGTGTAIGK

SEQ ID NO: 2109529 - protein, 29 aa, Staphylococcus
NIDMPITSALYGVLFKQVPLDESLKLLMG

SEQ ID NO: 2109530 - protein, 28 aa, Staphylococcus
NIKANTPIRLYHYGLPSGNFKNDPMGTM

SEQ ID NO: 2109531 - protein, 24 aa, Staphylococcus
NIKGLGIVSYRTIDADAATELSYI

SEQ ID NO: 2109532 - protein, 18 aa, Staphylococcus
NIKGMTIGLAMNSVYYYQ

SEQ ID NO: 2109533 - protein, 24 aa, Staphylococcus
NIKLDQFKDYWQGKPKLDHVNVTY

SEQ ID NO: 2109534 - protein, 18 aa, Staphylococcus
NILLAVLFFLNQKKLKED

SEQ ID NO: 2109535 - protein, 29 aa, Staphylococcus
NIMKLNGLNNFLIVPGQKLKVSGSVSTSK

SEQ ID NO: 2109536 - protein, 22 aa, Staphylococcus
NKAFQEFMKFTLEDKGKAAEDA

SEQ ID NO: 2109537 - protein, 25 aa, Staphylococcus
NKDIIIKHILVRNKAKKRPINFQQY

SEQ ID NO: 2109538 - protein, 25 aa, Staphylococcus
NKDLKEIPIHFAIYKQSGENSIVPG

SEQ ID NO: 2109539 - protein, 21 aa, Staphylococcus
NKDVRFYIYNGYVNKCQIISE

SEQ ID NO: 2109540 - protein, 22 aa, Staphylococcus
NKDYLWDNIKMTKDSWSINYRN

SEQ ID NO: 2109541 - protein, 31 aa, Staphylococcus
NKEVIPSNYTLASFNAYKKLKAQAQTILDEE

SEQ ID NO: 2109542 - protein, 25 aa, Staphylococcus
NKFSRADLGLTQWGLKQRPDETYID

SEQ ID NO: 2109543 - protein, 22 aa, Staphylococcus
NKGDAFKFVQYTDTQNAFWNEH

SEQ ID NO: 2109544 - protein, 23 aa, Staphylococcus
NKLQFIVKGDLTYSQLKKAYGKD

SEQ ID NO: 2109545 - protein, 22 aa, Staphylococcus
NKNNGLYSIAWGTNQQRLDNKD

SEQ ID NO: 2109546 - protein, 25 aa, Staphylococcus
NKNNPLNASTLYRDPKTNQQYRIIY

SEQ ID NO: 2109547 - protein, 25 aa, Staphylococcus
NKNSRVDFGLSQWGLKQKPNESRID

SEQ ID NO: 2109548 - protein, 43 aa, Staphylococcus
NKQKSTETLATPPKTRTFMRAMATPRMLAAAVTSPDQDAQKSL

SEQ ID NO: 2109549 - protein, 24 aa, Staphylococcus
NKRTQHNLVTLSSDGYYFLEPGEG

SEQ ID NO: 2109550 - protein, 29 aa, Staphylococcus
NKSYTIKPGTTLYTVPWGNYNQIAGTVSK

SEQ ID NO: 2109551 - protein, 22 aa, Staphylococcus
NKTFRIAFSYLLIENTKTHDLY

SEQ ID NO: 2109552 - protein, 25 aa, Staphylococcus
NKTHPDMFTMFEPISLMSIVARETQ

SEQ ID NO: 2109553 - protein, 24 aa, Staphylococcus
NKTVMYLLVNEGELSTFGPKGRFG

SEQ ID NO: 2109554 - protein, 22 aa, Staphylococcus
NKYNEVTIYCEKAHVIFGGAKL

SEQ ID NO: 2109555 - protein, 25 aa, Staphylococcus
NLATKHPFFEYARTFDYIVVSDVGL

SEQ ID NO: 2109556 - protein, 19 aa, Staphylococcus
NLDRIVNYFTALNSTIKNA

SEQ ID NO: 2109557 - protein, 26 aa, Staphylococcus
NLEDDLEFWHWYQQQNIFSYENPKYL

SEQ ID NO: 2109558 - protein, 20 aa, Staphylococcus
NLELVRFNNWPDLMDALNSG

SEQ ID NO: 2109559 - protein, 18 aa, Staphylococcus
NLIFPNQVLKVSGSSKST

SEQ ID NO: 2109560 - protein, 22 aa, Staphylococcus
NLKANVPLAWGAHRAASVIAEQ

SEQ ID NO: 2109561 - protein, 17 aa, Staphylococcus
NLKLDIQQLNQDISNQK

SEQ ID NO: 2109562 - protein, 19 aa, Staphylococcus
NLLHLSFNRDYTWDDTMIG

SEQ ID NO: 2109563 - protein, 22 aa, Staphylococcus
NLNGYLIMPNQTLNIPSGSGNG

SEQ ID NO: 2109564 - protein, 18 aa, Staphylococcus
NLNNNLVKSFKSIRDGYS

SEQ ID NO: 2109565 - protein, 20 aa, Staphylococcus
NLNQLSGLNDAQRDAFESQI

SEQ ID NO: 2109566 - protein, 18 aa, Staphylococcus
NLQSYFTNFTQAAGKVKF

SEQ ID NO: 2109567 - protein, 26 aa, Staphylococcus
NLYTAGQCTWYVYDKVGGKVGSTWGD

SEQ ID NO: 2109568 - protein, 19 aa, Staphylococcus
NMESRGMVLYINRNTRTTK

SEQ ID NO: 2109569 - protein, 18 aa, Staphylococcus
NMKKIEFQYLTKSKFNDI

SEQ ID NO: 2109570 - protein, 25 aa, Staphylococcus
NNDYDNFIMVSYLGNKVNALYSNQN

SEQ ID NO: 2109571 - protein, 25 aa, Staphylococcus
NNEEKLIFWNPWDTDLSIQDADSNL

SEQ ID NO: 2109572 - protein, 18 aa, Staphylococcus
NNINRKLIPKLEEYETAA

SEQ ID NO: 2109573 - protein, 23 aa, Staphylococcus
NNMFNITAGFRKYPDTKASLEDY

SEQ ID NO: 2109574 - protein, 24 aa, Staphylococcus
NNNGLYSIAWGTKNQQLLPASQLA

SEQ ID NO: 2109575 - protein, 24 aa, Staphylococcus
NNNGLYTIAWGTNQQRLDKNNIAN

SEQ ID NO: 2109576 - protein, 32 aa, Staphylococcus
NNNIFSINASFRKYPNLKASLKDYADLIKHGI

SEQ ID NO: 2109577 - protein, 27 aa, Staphylococcus
NNNVYELDPKLWYFASGSTTTTVKQID

SEQ ID NO: 2109578 - protein, 24 aa, Staphylococcus
NNQGVYSLALSKYIKGENISNFDA

SEQ ID NO: 2109579 - protein, 25 aa, Staphylococcus
NNQLYSIQAAFRKYPNKKASLEDYV

SEQ ID NO: 2109580 - protein, 21 aa, Staphylococcus
NNRSTAMFQLLPDLSNNDENN

SEQ ID NO: 2109581 - protein, 26 aa, Staphylococcus
NNSNDILIMQYLYQLVYTLQEKFPKN

SEQ ID NO: 2109582 - protein, 24 aa, Staphylococcus
NNTPAVGAIFQTGAGYYGHVGVVE

SEQ ID NO: 2109583 - protein, 17 aa, Staphylococcus
NPKGSVYVLPNTGGTKA

SEQ ID NO: 2109584 - protein, 25 aa, Staphylococcus
NPKLRDMLGYFIKYVGSSSYDAPAV

SEQ ID NO: 2109585 - protein, 25 aa, Staphylococcus
NPKNVIFLVGDGMGPSFNTAYRYYQ

SEQ ID NO: 2109586 - protein, 37 aa, Staphylococcus
NPKNVIFMVGDGMGPSFNTAYRYYKNQPGAKKMNATA

SEQ ID NO: 2109587 - protein, 26 aa, Staphylococcus
NPKRIAVLHPTYIGALVKFGHKPIAV

SEQ ID NO: 2109588 - protein, 26 aa, Staphylococcus
NPMPPRTAKLLIQLIEEGYLEIKKDL

SEQ ID NO: 2109589 - protein, 18 aa, Staphylococcus
NPNDPYSYSYTYTIDQQG

SEQ ID NO: 2109590 - protein, 19 aa, Staphylococcus
NPNIVYKTYSGESTRPALN

SEQ ID NO: 2109591 - protein, 18 aa, Staphylococcus
NPNIVYKTYTGESTHASL

SEQ ID NO: 2109592 - protein, 19 aa, Staphylococcus
NPNIVYKTYTGESTHKGLF

SEQ ID NO: 2109593 - protein, 22 aa, Staphylococcus
NPTIYKPTWKHEAIDYRDATRH

SEQ ID NO: 2109594 - protein, 20 aa, Staphylococcus
NPVFDGITYAKKAGWDSVEK

SEQ ID NO: 2109595 - protein, 22 aa, Staphylococcus
NQARQQLTVDKAPLEAAKDALQ

SEQ ID NO: 2109596 - protein, 20 aa, Staphylococcus
NQARQQLTVDKAPLQQAKTE

SEQ ID NO: 2109597 - protein, 39 aa, Staphylococcus
NQEDAKFLPNKILNIKYKLRPVNIPTPRQVTVNQSITYK

SEQ ID NO: 2109598 - protein, 34 aa, Staphylococcus
NQEDFVQNLPNTGIIRAIVYYNDNLMSNFSNAVE

SEQ ID NO: 2109599 - protein, 18 aa, Staphylococcus
NQGIDHIYAFQARGTDSY

SEQ ID NO: 2109600 - protein, 25 aa, Staphylococcus
NQGNHYYFGNCTYYAFDRRQQLGRS

SEQ ID NO: 2109601 - protein, 17 aa, Staphylococcus
NQHPVQAGAYNIDFVYN

SEQ ID NO: 2109602 - protein, 24 aa, Staphylococcus
NQKGIWQVTPTKHDWDHVDFVGQD

SEQ ID NO: 2109603 - protein, 22 aa, Staphylococcus
NQNIKVLKKEGIRYGYTLEDKA

SEQ ID NO: 2109604 - protein, 20 aa, Staphylococcus
NQPFNSQIRFKISATDNANN

SEQ ID NO: 2109605 - protein, 26 aa, Staphylococcus
NQSEALKQLPNFQTALDIAKQEANLY

SEQ ID NO: 2109606 - protein, 23 aa, Staphylococcus
NQSITYKTYAQYYLNTNDNTVTA

SEQ ID NO: 2109607 - protein, 26 aa, Staphylococcus
NQTGQSYIYAKNKLFPIPGGSILGVP

SEQ ID NO: 2109608 - protein, 21 aa, Staphylococcus
NQYYQSPFFKDTYSIKNSEII

SEQ ID NO: 2109609 - protein, 32 aa, Staphylococcus
NRHKPEIKVLNELKGFKMINGGSVGLVNSELE

SEQ ID NO: 2109610 - protein, 21 aa, Staphylococcus
NRPQPIFKAFIEAANKYKEAK

SEQ ID NO: 2109611 - protein, 18 aa, Staphylococcus
NRPQPIFKAFVEAAYKHQ

SEQ ID NO: 2109612 - protein, 30 aa, Staphylococcus
NRTGKSYIFAKNKLYPIPGGAIMGIPTDIK

SEQ ID NO: 2109613 - protein, 24 aa, Staphylococcus
NRYAIRKYTVGTASALVASVAFLT

SEQ ID NO: 2109614 - protein, 22 aa, Staphylococcus
NSGKLYGWVKQNETIYNTITPK

SEQ ID NO: 2109615 - protein, 21 aa, Staphylococcus
NSGTRYKIDLNLDSKIADHVT

SEQ ID NO: 2109616 - protein, 28 aa, Staphylococcus
NSGYNFNFNSDGTNWSWSYNADSSAQQA

SEQ ID NO: 2109617 - protein, 18 aa, Staphylococcus
NSLRFTYLGNITLNKHIR

SEQ ID NO: 2109618 - protein, 23 aa, Staphylococcus
NSNYLSMMKFIKEQKEVLDQGVH

SEQ ID NO: 2109619 - protein, 22 aa, Staphylococcus
NSPGIFTETINVIYPNGQVDPV

SEQ ID NO: 2109620 - protein, 33 aa, Staphylococcus
NSQVVKNWIIPYIFPTLLHLDILKKKLYKTISQ

SEQ ID NO: 2109621 - protein, 29 aa, Staphylococcus
NSSDWLAENFGVRFRYNGLNNLTTKNMVT

SEQ ID NO: 2109622 - protein, 24 aa, Staphylococcus
NSVSKAIIGGAKFIGKDYIKAGQN

SEQ ID NO: 2109623 - protein, 27 aa, Staphylococcus
NTATGTLIYDVPESNFYTLEMDTNFNL

SEQ ID NO: 2109624 - protein, 22 aa, Staphylococcus
NTKLYSVGYPWQNGDNTKTHWS

SEQ ID NO: 2109625 - protein, 20 aa, Staphylococcus
NTLYKMRWNPDHPATHQYAT

SEQ ID NO: 2109626 - protein, 22 aa, Staphylococcus
NTNVHLRVYFDTNNRHLLRAAA

SEQ ID NO: 2109627 - protein, 18 aa, Staphylococcus
NTPLHLRVYYDEDTRVII

SEQ ID NO: 2109628 - protein, 20 aa, Staphylococcus
NTPLHLRVYYDKTSRKLLRA

SEQ ID NO: 2109629 - protein, 29 aa, Staphylococcus
NTPSYLKNNPFLTSPLLYSQLIQTQNPIH

SEQ ID NO: 2109630 - protein, 24 aa, Staphylococcus
NTQRDVNIALMNEFAVIFDKVGID

SEQ ID NO: 2109631 - protein, 19 aa, Staphylococcus
NTSKIWKTKDNAFYDLSRE

SEQ ID NO: 2109632 - protein, 29 aa, Staphylococcus
NTTGQSYIYAKNKLFPIPGGSIMGIPTDI

SEQ ID NO: 2109633 - protein, 30 aa, Staphylococcus
NTTGQSYIYAKNKLYPIPGGSIMGIPTDIK

SEQ ID NO: 2109634 - protein, 18 aa, Staphylococcus
NVEMPITTALYKVLFEDV

SEQ ID NO: 2109635 - protein, 19 aa, Staphylococcus
NVFIATTLLMTGTVTFQAI

SEQ ID NO: 2109636 - protein, 25 aa, Staphylococcus
NVKAGSTLYTVPWGTPSQVASKVSG

SEQ ID NO: 2109637 - protein, 25 aa, Staphylococcus
NVKGNANIYYVPWSKDNQVVAKTPK

SEQ ID NO: 2109638 - protein, 22 aa, Staphylococcus
NVMYVHCTLLPFIKAAGEMKTK

SEQ ID NO: 2109639 - protein, 21 aa, Staphylococcus
NVMYVHCTLLPYIKAAGEMKT

SEQ ID NO: 2109640 - protein, 23 aa, Staphylococcus
NVNFLKRRFEALSPLSMFKGIEY

SEQ ID NO: 2109641 - protein, 21 aa, Staphylococcus
NVNRIIKYFHALNSTIANVDE

SEQ ID NO: 2109642 - protein, 24 aa, Staphylococcus
NVQFLQKRYDALKDLPMFQGIEFT

SEQ ID NO: 2109643 - protein, 18 aa, Staphylococcus
NVQTSESTTLSQVNPEQV

SEQ ID NO: 2109644 - protein, 18 aa, Staphylococcus
NVYQFETNAWYFGEGGHQ

SEQ ID NO: 2109645 - protein, 20 aa, Staphylococcus
NVYTTVFAFQSFIEQIGGKY

SEQ ID NO: 2109646 - protein, 18 aa, Staphylococcus
NWNIKLFERLDGPALESS

SEQ ID NO: 2109647 - protein, 17 aa, Staphylococcus
NYADYAATQLQYYGLTP

SEQ ID NO: 2109648 - protein, 17 aa, Staphylococcus
NYDFIIIRGQYGSEYVD

SEQ ID NO: 2109649 - protein, 24 aa, Staphylococcus
NYDRAVELYYYIKGGRVDYGAAHA

SEQ ID NO: 2109650 - protein, 24 aa, Staphylococcus
NYHRIRDDNWFKNTLFTLSNSKEI

SEQ ID NO: 2109651 - protein, 23 aa, Staphylococcus
NYNQLYLEPLEQYNDRKTKIVDV

SEQ ID NO: 2109652 - protein, 24 aa, Staphylococcus
NYYKDIAKIIDKFNQLDLNKTKKD

SEQ ID NO: 2109653 - protein, 19 aa, Staphylococcus
NYYYKNQCTWYVFKKRASV

SEQ ID NO: 2109654 - protein, 23 aa, Staphylococcus
PADPNALVYLVVTGNLAQDGTND

SEQ ID NO: 2109655 - protein, 25 aa, Staphylococcus
PAEEGRFLKFFQDAGLIKIKKGVKI

SEQ ID NO: 2109656 - protein, 26 aa, Staphylococcus
PAEEGRFLKFFVDDGLIKLKKGVKIQ

SEQ ID NO: 2109657 - protein, 27 aa, Staphylococcus
PAEEGRFLSFFVDEGLIKLKKGVKIED

SEQ ID NO: 2109658 - protein, 27 aa, Staphylococcus
PAEEGRFLSFFVDKGLIKIKKGVSIED

SEQ ID NO: 2109659 - protein, 26 aa, Staphylococcus
PAEEGRFLSFFVNEGLIKLKKGVKIE

SEQ ID NO: 2109660 - protein, 27 aa, Staphylococcus
PAEEGRFLSFFVNEGLIKLKKGVKIEN

SEQ ID NO: 2109661 - protein, 25 aa, Staphylococcus
PAEEGRFLSFFVNEGLVKIKKGVKI

SEQ ID NO: 2109662 - protein, 26 aa, Staphylococcus
PAEQGRFLKFFVDEGLIKLKKGVKIE

SEQ ID NO: 2109663 - protein, 20 aa, Staphylococcus
PAIHTTGVGGLQIIKVYKSN

SEQ ID NO: 2109664 - protein, 18 aa, Staphylococcus
PAKKYKFTLKKGVKWQNG

SEQ ID NO: 2109665 - protein, 25 aa, Staphylococcus
PAVLTLLIHMQYEQGLWYVKGGIHK

SEQ ID NO: 2109666 - protein, 18 aa, Staphylococcus
PAVNSSINDYIRKNNFKA

SEQ ID NO: 2109667 - protein, 17 aa, Staphylococcus
PCLITIFGATGDLSHRK

SEQ ID NO: 2109668 - protein, 23 aa, Staphylococcus
PDDIEMLQDLVLAATNEAMNKAD

SEQ ID NO: 2109669 - protein, 17 aa, Staphylococcus
PDDWLMGEDVYTPGTEG

SEQ ID NO: 2109670 - protein, 19 aa, Staphylococcus
PDETYIDYVKRVENSNLWK

SEQ ID NO: 2109671 - protein, 21 aa, Staphylococcus
PDFIVYYLDDSGRPEMKVLNK

SEQ ID NO: 2109672 - protein, 25 aa, Staphylococcus
PDGKEHYYEFKKDNGVLVVTADGKK

SEQ ID NO: 2109673 - protein, 19 aa, Staphylococcus
PDGVQIINGTPTAAGHVIY

SEQ ID NO: 2109674 - protein, 25 aa, Staphylococcus
PDKAKGIVYMPKNLSNKQKWSHAVD

SEQ ID NO: 2109675 - protein, 19 aa, Staphylococcus
PDPSGLYKSNALWNESRYN

SEQ ID NO: 2109676 - protein, 17 aa, Staphylococcus
PDQWMNTVIIDKGKKAG

SEQ ID NO: 2109677 - protein, 21 aa, Staphylococcus
PELKGLTQRQLDHYNSLFAVG

SEQ ID NO: 2109678 - protein, 24 aa, Staphylococcus
PENGKVIKVYLKFKNNNEDQVLMD

SEQ ID NO: 2109679 - protein, 34 aa, Staphylococcus
PEQLNEKPLHAGAYNYDFVLGGNEYTFTSDGQTW

SEQ ID NO: 2109680 - protein, 25 aa, Staphylococcus
PESKHLGGFPITGQFLICTNPDIIA

SEQ ID NO: 2109681 - protein, 24 aa, Staphylococcus
PESKHLGGFPITGQFLTCTNPQVI

SEQ ID NO: 2109682 - protein, 17 aa, Staphylococcus
PFHKSFDIIKRNDTTYA

SEQ ID NO: 2109683 - protein, 17 aa, Staphylococcus
PFKFVQYTDTQNAYWNE

SEQ ID NO: 2109684 - protein, 19 aa, Staphylococcus
PFKIYKFNGQEDGNYYFPV

SEQ ID NO: 2109685 - protein, 19 aa, Staphylococcus
PGTYTIATVDQQGTVRVVD

SEQ ID NO: 2109686 - protein, 18 aa, Staphylococcus
PHLHFQRMQGGVGNEYSV

SEQ ID NO: 2109687 - protein, 20 aa, Staphylococcus
PHLIGPVHFERHKGHIDGNE

SEQ ID NO: 2109688 - protein, 24 aa, Staphylococcus
PHQTFMQWFSEDPALDYFKTMDST

SEQ ID NO: 2109689 - protein, 20 aa, Staphylococcus
PIGYRGLGQTKEAWGTGSVA

SEQ ID NO: 2109690 - protein, 19 aa, Staphylococcus
PIIQDLFQYRFEANQIGGH

SEQ ID NO: 2109691 - protein, 24 aa, Staphylococcus
PIKKKSLKLPKGKKPLILSIDDMN

SEQ ID NO: 2109692 - protein, 25 aa, Staphylococcus
PIQDGAYNINFNYNNTDYSFQSDGE

SEQ ID NO: 2109693 - protein, 19 aa, Staphylococcus
PKERFGSLVYNTLGFKPAD

SEQ ID NO: 2109694 - protein, 25 aa, Staphylococcus
PKGDQYDVIFLFTKSMQLSDMLEQI

SEQ ID NO: 2109695 - protein, 17 aa, Staphylococcus
PKGFINEQKDRFSNVSE

SEQ ID NO: 2109696 - protein, 21 aa, Staphylococcus
PKGQFKQFRHGLSSFIEALEQ

SEQ ID NO: 2109697 - protein, 24 aa, Staphylococcus
PKHMQFFTVYPDKSTYQALIGVNK

SEQ ID NO: 2109698 - protein, 17 aa, Staphylococcus
PKNAIVLDYGALDTLKA

SEQ ID NO: 2109699 - protein, 18 aa, Staphylococcus
PKQYLDFQKKIFAVQPDT

SEQ ID NO: 2109700 - protein, 32 aa, Staphylococcus; identical to SEQ ID NO: 1698838

SEQ ID NO: 2109701 - protein, 23 aa, Staphylococcus
PKRVVALEFSFVDALAALNVKPV

SEQ ID NO: 2109702 - protein, 25 aa, Staphylococcus
PKTNQQYRIIYINEPGKTYKNVKYH

SEQ ID NO: 2109703 - protein, 18 aa, Staphylococcus
PLEKLLSKELDIPVKVSV

SEQ ID NO: 2109704 - protein, 19 aa, Staphylococcus
PLQIVKIINDYFKNKNKLS

SEQ ID NO: 2109705 - protein, 21 aa, Staphylococcus
PLSHLRNIVRSLLGIAVPTQI

SEQ ID NO: 2109706 - protein, 23 aa, Staphylococcus
PLYLKDFMLHRTGLKKYKATSQI

SEQ ID NO: 2109707 - protein, 21 aa, Staphylococcus
PMVEMMFGVHFIKGGMYGLTR

SEQ ID NO: 2109708 - protein, 18 aa, Staphylococcus
PNIKGQLFKLLEFSDMTE

SEQ ID NO: 2109709 - protein, 40 aa, Staphylococcus
PNKLNKYAIRKFTVGTASLLIGATLVFGVGNVARADELDN

SEQ ID NO: 2109710 - protein, 19 aa, Staphylococcus
PNLHIVGSQTRVVRVTYAN

SEQ ID NO: 2109711 - protein, 18 aa, Staphylococcus
PNVITTYDLLFRSGFEPD

SEQ ID NO: 2109712 - protein, 29 aa, Staphylococcus
PNYEQDIANYLPQYNYRYGKPEGIVMHDT

SEQ ID NO: 2109713 - protein, 20 aa, Staphylococcus
PPDELIPQFDYVKDISEQFG

SEQ ID NO: 2109714 - protein, 25 aa, Staphylococcus
PPLNPTQFDLFVDKVIPILKERGLI

SEQ ID NO: 2109715 - protein, 18 aa, Staphylococcus
PPTFSNVRGLQDKYYRGD

SEQ ID NO: 2109716 - protein, 19 aa, Staphylococcus
PPVLLPKFVELMEQGNPSL

SEQ ID NO: 2109717 - protein, 26 aa, Staphylococcus
PQDAQFDVIFLFTKAMQLQDMLEHIK

SEQ ID NO: 2109718 - protein, 21 aa, Staphylococcus
PQESFTLYFNPSLGNVSSLLV

SEQ ID NO: 2109719 - protein, 30 aa, Staphylococcus
PQIEENYTSYFPKYGYRYGVGRPEGIVVHD

SEQ ID NO: 2109720 - protein, 24 aa, Staphylococcus
PQLRDMLGYFIKYVGSSSYDAPAV

SEQ ID NO: 2109721 - protein, 20 aa, Staphylococcus
PQQMFIMIDEKDKPLLEKQE

SEQ ID NO: 2109722 - protein, 24 aa, Staphylococcus
PRDTISYIPKVGYYDKITHAHAYG

SEQ ID NO: 2109723 - protein, 23 aa, Staphylococcus
PRNYQASGNVLVLGRSRGTDVND

SEQ ID NO: 2109724 - protein, 24 aa, Staphylococcus
PRTAKLLIELLEQEALIIRKNLKN

SEQ ID NO: 2109725 - protein, 24 aa, Staphylococcus
PSAGSILQTYEGPVGHVAYVEQVN

SEQ ID NO: 2109726 - protein, 24 aa, Staphylococcus
PSGKEHYYEYRTSKGVLVVTANGQ

SEQ ID NO: 2109727 - protein, 23 aa, Staphylococcus
PSIAISLLLTGCGQKDNGQDEGP

SEQ ID NO: 2109728 - protein, 27 aa, Staphylococcus
PSKSTDEMYYIDYAASDAYGTGTPYVA

SEQ ID NO: 2109729 - protein, 20 aa, Staphylococcus
PSLILRLVLGQRATIILDTQ

SEQ ID NO: 2109730 - protein, 24 aa, Staphylococcus
PSNDFFVACQFHPEFLSRPNRPQP

SEQ ID NO: 2109731 - protein, 23 aa, Staphylococcus
PSNNEGYYEYRTNKGLLVVTAVG

SEQ ID NO: 2109732 - protein, 23 aa, Staphylococcus
PSNSGLFVTVYDKTGKKTNQVQK

SEQ ID NO: 2109733 - protein, 24 aa, Staphylococcus
PSNTEILYELGLKKQLIGVSTVDD

SEQ ID NO: 2109734 - protein, 17 aa, Staphylococcus
PSQKDILALIKQINQSK

SEQ ID NO: 2109735 - protein, 19 aa, Staphylococcus
PSTPYPIIDLLPEQKDIED

SEQ ID NO: 2109736 - protein, 25 aa, Staphylococcus
PTDALAVLSLVAGTAFISQRPLRKI

SEQ ID NO: 2109737 - protein, 20 aa, Staphylococcus
PTREKVLWQYTDSFYSSELN

SEQ ID NO: 2109738 - protein, 26 aa, Staphylococcus
PTYEQDISPYLPKNEYRYGKPEGIVV

SEQ ID NO: 2109739 - protein, 17 aa, Staphylococcus
PVDIMSYVIKRVSQFPK

SEQ ID NO: 2109740 - protein, 25 aa, Staphylococcus
PVFNSRNEVIGIHWGGAANSYNGAV

SEQ ID NO: 2109741 - protein, 18 aa, Staphylococcus
PVGLKNKYYKGEQVNFTL

SEQ ID NO: 2109742 - protein, 19 aa, Staphylococcus
PVIILTFTLVGCSSSSEEK

SEQ ID NO: 2109743 - protein, 29 aa, Staphylococcus
PVKAGAYDFSFVKDGFRYTFTSNGQNFTW

SEQ ID NO: 2109744 - protein, 23 aa, Staphylococcus
PVKVYEYKYKFKKSEYSTIVGTS

SEQ ID NO: 2109745 - protein, 27 aa, Staphylococcus
PVQAGAYNITFVKDGFKYNFTSDGQSW

SEQ ID NO: 2109746 - protein, 18 aa, Staphylococcus
PVQLFSQQELKTVVNPNS

SEQ ID NO: 2109747 - protein, 26 aa, Staphylococcus
PVTANDFVYAWRKALDPQTASEYAYI

SEQ ID NO: 2109748 - protein, 20 aa, Staphylococcus
PVVLTTKAKYPIGTHFKVTL

SEQ ID NO: 2109749 - protein, 22 aa, Staphylococcus
PWGVTDLKAAIRYYRFNDSSLP

SEQ ID NO: 2109750 - protein, 28 aa, Staphylococcus
PWSEPKAGYKWYDPSTFAAGSYGGSQSE

SEQ ID NO: 2109751 - protein, 25 aa, Staphylococcus
PYPQGQCTWYVYERVQQFGKKVGSD

SEQ ID NO: 2109752 - protein, 19 aa, Staphylococcus
QAAILVIPEANVPFKTSEQ

SEQ ID NO: 2109753 - protein, 23 aa, Staphylococcus
QAAKTLQDLLSPTQAKFIVTNAK

SEQ ID NO: 2109754 - protein, 42 aa, Staphylococcus
QAGAYNIDFVYNGNEFHFESDGQHFSWNYTAAGSNASAQPTQ

SEQ ID NO: 2109755 - protein, 26 aa, Staphylococcus
QAGAYNISFVQDGFKYTFTSNGNTWS

SEQ ID NO: 2109756 - protein, 27 aa, Staphylococcus
QAGKPISTYWSDAKYWAANAANDGYQV

SEQ ID NO: 2109757 - protein, 20 aa, Staphylococcus
QAGQTFTIKIQFKGQPANQT

SEQ ID NO: 2109758 - protein, 25 aa, Staphylococcus
QAHPDIKAIFAQNDEMALGAVEAVG

SEQ ID NO: 2109759 - protein, 22 aa, Staphylococcus
QAIVNFVNHGGSIIFISDHYNA

SEQ ID NO: 2109760 - protein, 17 aa, Staphylococcus
QAKAKLASITQVLNGTP

SEQ ID NO: 2109761 - protein, 23 aa, Staphylococcus
QANNLNIELPLKTNTLAPYDTDV

SEQ ID NO: 2109762 - protein, 26 aa, Staphylococcus
QANTTDVINVYFVPSDSVNPTLNVGN

SEQ ID NO: 2109763 - protein, 27 aa, Staphylococcus
QAPDGMKFYMVYPDKGSYRTVVGVNND

SEQ ID NO: 2109764 - protein, 17 aa, Staphylococcus
QAVFNRDASGDAGTLVI

SEQ ID NO: 2109765 - protein, 27 aa, Staphylococcus
QAVNFSDIFLIALPTKAIRDVVTEINQ

SEQ ID NO: 2109766 - protein, 25 aa, Staphylococcus
QCFDLVNVYWNHLYGHGLRGYGAKD

SEQ ID NO: 2109767 - protein, 25 aa, Staphylococcus
QDENGDWGFSILDKNGDLVGSYIVT

SEQ ID NO: 2109768 - protein, 21 aa, Staphylococcus
QDIQFDYVRFPEGFENEADSL

SEQ ID NO: 2109769 - protein, 18 aa, Staphylococcus
QDPHAWLSLDNGIKYVKT

SEQ ID NO: 2109770 - protein, 25 aa, Staphylococcus
QEAAKYLQNLFKHTLAKFITTNADE

SEQ ID NO: 2109771 - protein, 19 aa, Staphylococcus
QEAKFLKASAEYYQQITKA

SEQ ID NO: 2109772 - protein, 26 aa, Staphylococcus
QEDGNYYFPVLQGEHIKYVLTVTPKN

SEQ ID NO: 2109773 - protein, 24 aa, Staphylococcus
QEFVTPLAFQAIGRNPVYTSTFIE

SEQ ID NO: 2109774 - protein, 24 aa, Staphylococcus
QEFVTPLAFQAISRNPVYTNTFIE

SEQ ID NO: 2109775 - protein, 22 aa, Staphylococcus
QEGAYIRIYEVNPDGSRGTMIS

SEQ ID NO: 2109776 - protein, 22 aa, Staphylococcus
QEGAYNVTFDYEGFTYHFESDG

SEQ ID NO: 2109777 - protein, 44 aa, Staphylococcus
QEGAYNYQFNLNGKTYHFWSDGTYFKWEYYPSNGSTVNSANQNV

SEQ ID NO: 2109778 - protein, 23 aa, Staphylococcus
QEKLKEERIVGTAGGGMVAVTVT

SEQ ID NO: 2109779 - protein, 28 aa, Staphylococcus
QEKNSDNYQWYMHMNKLNVQQGQSVNAG

SEQ ID NO: 2109780 - protein, 24 aa, Staphylococcus
QEPNREKVLWQYTDSYYAPELNQN

SEQ ID NO: 2109781 - protein, 27 aa, Staphylococcus
QFDAMNLNKEKLLKAKPDLILAHESQK

SEQ ID NO: 2109782 - protein, 18 aa, Staphylococcus
QFKQFRHGLSSFIEALAK

SEQ ID NO: 2109783 - protein, 26 aa, Staphylococcus
QGIFNKPVITPIKPYKNFYPAETYHQ

SEQ ID NO: 2109784 - protein, 24 aa, Staphylococcus
QGINPYQQLVNIGGLYDVKDLYNQ

SEQ ID NO: 2109785 - protein, 29 aa, Staphylococcus
QGKDGRDRVYYKQLGYHPDLTGKDASKLL

SEQ ID NO: 2109786 - protein, 22 aa, Staphylococcus
QGKFVYDLDLQKGNNKHEFSYD

SEQ ID NO: 2109787 - protein, 17 aa, Staphylococcus
QGKPYEVILEANEYRLS

SEQ ID NO: 2109788 - protein, 24 aa, Staphylococcus
QGMWHKYLMITVLSSITTLMHAPI

SEQ ID NO: 2109789 - protein, 26 aa, Staphylococcus
QGNLPPTCLEGLYACIDKQIPIVIVS

SEQ ID NO: 2109790 - protein, 25 aa, Staphylococcus
QGQIYTIKDLLTQAALPSSNSAAMI

SEQ ID NO: 2109791 - protein, 25 aa, Staphylococcus
QGQNTLYRMRWNPSSPGNHQYATDI

SEQ ID NO: 2109792 - protein, 24 aa, Staphylococcus
QGTEAMHYITFDPNTNTSGITADW

SEQ ID NO: 2109793 - protein, 24 aa, Staphylococcus
QGTEHYYEFRTHKGVLLVTADGKK

SEQ ID NO: 2109794 - protein, 31 aa, Staphylococcus
QGTRNVDIPVTIYPVARAKAPTREVQGGQLS

SEQ ID NO: 2109795 - protein, 23 aa, Staphylococcus
QHDPHVWLDPVLNKKFAKEIKDE

SEQ ID NO: 2109796 - protein, 20 aa, Staphylococcus
QHIALGDWADAIVVAPATAN

SEQ ID NO: 2109797 - protein, 26 aa, Staphylococcus
QHSRQYAKRQLTWFKNKMNVQWFDRE

SEQ ID NO: 2109798 - protein, 24 aa, Staphylococcus
QHVSLGDWADAIIIAPATANTIAK

SEQ ID NO: 2109799 - protein, 24 aa, Staphylococcus
QHVTLLIGDLAFYHDMNGLLMAKL

SEQ ID NO: 2109800 - protein, 25 aa, Staphylococcus
QIANSSFEILLGKLLEKKYSDKVDT

SEQ ID NO: 2109801 - protein, 25 aa, Staphylococcus
QIANTSFSIMLNKILEDKYKDKVDT

SEQ ID NO: 2109802 - protein, 26 aa, Staphylococcus
QIDKAIYLYGSVNGVNGWISKSFLTT

SEQ ID NO: 2109803 - protein, 25 aa, Staphylococcus
QIDKAIYLYGTVNGKSGWISKYYLT

SEQ ID NO: 2109804 - protein, 29 aa, Staphylococcus
QIEEDYSSYFPKYGYRNGVGRPEGIVVHD

SEQ ID NO: 2109805 - protein, 33 aa, Staphylococcus
QIFQITKRKVVNGITWYYGKLSNGKSVWIKKSD

SEQ ID NO: 2109806 - protein, 20 aa, Staphylococcus
QKDILALIKQINQSKQPYIL

SEQ ID NO: 2109807 - protein, 23 aa, Staphylococcus
QKDPQILVDAYKDLLKEYKVDFK

SEQ ID NO: 2109808 - protein, 24 aa, Staphylococcus
QKFLKKRYEAMKDFPMFDNIEYTE

SEQ ID NO: 2109809 - protein, 22 aa, Staphylococcus
QKGIWQVTPTKHDWDHVDFVGQ

SEQ ID NO: 2109810 - protein, 23 aa, Staphylococcus
QKGNNKHEFSYDAKTGKLLSNEK

SEQ ID NO: 2109811 - protein, 22 aa, Staphylococcus
QKGVWQVTPTKHDWDHVDFVGQ

SEQ ID NO: 2109812 - protein, 19 aa, Staphylococcus
QKIHLIGHSMGGQTVRLLE

SEQ ID NO: 2109813 - protein, 30 aa, Staphylococcus
QKIMSLNGLSNFFIYPGQKLKVSGTASTSN

SEQ ID NO: 2109814 - protein, 23 aa, Staphylococcus
QKIQLSKYKDYWQGTPKLSKINV

SEQ ID NO: 2109815 - protein, 17 aa, Staphylococcus
QKKIKAFLKTHHLDTKP

SEQ ID NO: 2109816 - protein, 23 aa, Staphylococcus
QKKLSAYQKQLLLDKVKVSDKGI

SEQ ID NO: 2109817 - protein, 24 aa, Staphylococcus
QKLRDMLGYFIKYVGSSSYDAPAV

SEQ ID NO: 2109818 - protein, 26 aa, Staphylococcus
QKMKKGHLLLPLNHQKLPNMKNLDPN

SEQ ID NO: 2109819 - protein, 22 aa, Staphylococcus
QKNSYYVVLKTNGAPLKRVEEE

SEQ ID NO: 2109820 - protein, 21 aa, Staphylococcus
QKPIPNKIFDRKIINSRISDN

SEQ ID NO: 2109821 - protein, 29 aa, Staphylococcus
QKQYKNQDPIILVHGFNGLVGETAGPTSG

SEQ ID NO: 2109822 - protein, 24 aa, Staphylococcus
QKRLLDIKDIADYALFLCSDSAKS

SEQ ID NO: 2109823 - protein, 26 aa, Staphylococcus
QKYDINEIYLISHALLETGNGTSELS

SEQ ID NO: 2109824 - protein, 26 aa, Staphylococcus
QLAGNKKILFYSYENFMVNHVANAVS

SEQ ID NO: 2109825 - protein, 18 aa, Staphylococcus
QLDKALSIGLIDKKAEDY

SEQ ID NO: 2109826 - protein, 21 aa, Staphylococcus
QLDKIAYLKATFKNATNISED

SEQ ID NO: 2109827 - protein, 23 aa, Staphylococcus
QLKGAIFFGGFYNMQTVRATEFP

SEQ ID NO: 2109828 - protein, 21 aa, Staphylococcus
QLKKIAYLKATYKEANKLSQD

SEQ ID NO: 2109829 - protein, 19 aa, Staphylococcus
QLKQLDAGSWFNKANPKYA

SEQ ID NO: 2109830 - protein, 18 aa, Staphylococcus
QLKQLDAGSWFNNAHPEY

SEQ ID NO: 2109831 - protein, 20 aa, Staphylococcus
QLKVIAKQSAKFDRAEGLNV

SEQ ID NO: 2109832 - protein, 21 aa, Staphylococcus
QLLNNLTSWLSKKEATPNLAK

SEQ ID NO: 2109833 - protein, 22 aa, Staphylococcus
QLPYIYDVYFAKDDKVRVPTDL

SEQ ID NO: 2109834 - protein, 19 aa, Staphylococcus
QLPYIYDVYFDKEDKVRVP

SEQ ID NO: 2109835 - protein, 28 aa, Staphylococcus
QLSDKTKLALIFYADPKGKYSLTKNEIL

SEQ ID NO: 2109836 - protein, 21 aa, Staphylococcus
QLSVNPVKRKQAINELNTVAQ

SEQ ID NO: 2109837 - protein, 23 aa, Staphylococcus
QLTDADLIFYNGFNLESGNGWFE

SEQ ID NO: 2109838 - protein, 23 aa, Staphylococcus
QLTDADVIFYNGFNLESGNGWFE

SEQ ID NO: 2109839 - protein, 25 aa, Staphylococcus
QMPNNDYVIYTDKISRYISTANRIE

SEQ ID NO: 2109840 - protein, 25 aa, Staphylococcus
QNADPIYGHVAFVEKVNSDGSIVIS

SEQ ID NO: 2109841 - protein, 25 aa, Staphylococcus
QNEFKEDSPLFRLALKSREKFNDLS

SEQ ID NO: 2109842 - protein, 21 aa, Staphylococcus
QNGFSLTHLIASLFNFDSDIS

SEQ ID NO: 2109843 - protein, 31 aa, Staphylococcus
QNIMNLNGLNSFLIFPGQKLKVTGSTATVTN

SEQ ID NO: 2109844 - protein, 20 aa, Staphylococcus
QNTLYKMRWNPENPGKHQYA

SEQ ID NO: 2109845 - protein, 27 aa, Staphylococcus
QNTTTNTPLGWFNVKDLKVQNSSSEQK

SEQ ID NO: 2109846 - protein, 19 aa, Staphylococcus
QNVKLPKNTEIDDQYIHGE

SEQ ID NO: 2109847 - protein, 24 aa, Staphylococcus
QPEFNIKFTLIEPGGIQSEFTNNV

SEQ ID NO: 2109848 - protein, 27 aa, Staphylococcus
QPGDIILTKGPVLFGFFGHSSIAIDHD

SEQ ID NO: 2109849 - protein, 25 aa, Staphylococcus
QPISQIPETLAPQGSVLFQTNQDFN

SEQ ID NO: 2109850 - protein, 26 aa, Staphylococcus
QPITVTGYPGDKPLATMWESRGKITQ

SEQ ID NO: 2109851 - protein, 25 aa, Staphylococcus
QPTGDQRVFRISTFNVTDEEKAQIK

SEQ ID NO: 2109852 - protein, 19 aa, Staphylococcus
QQAAQLLNRTGTTSGMRPA

SEQ ID NO: 2109853 - protein, 25 aa, Staphylococcus
QQGNYHYEWQGNWSPSQAQQGGQQN

SEQ ID NO: 2109854 - protein, 29 aa, Staphylococcus
QQNGVTWYYGKLTNGKYVWIKESDLTKEL

SEQ ID NO: 2109855 - protein, 18 aa, Staphylococcus
QQNIFSYENPKYLPRFIF

SEQ ID NO: 2109856 - protein, 31 aa, Staphylococcus
QQNSIFAHEGLMISLGHRKNILNTNFSTLGV

SEQ ID NO: 2109857 - protein, 29 aa, Staphylococcus
QQQYKNHDPIILVHGFNGFTADNGPGLGD

SEQ ID NO: 2109858 - protein, 31 aa, Staphylococcus
QQTEFDFPNPQYLPRFVFGHYMKSHLSRYDQ

SEQ ID NO: 2109859 - protein, 27 aa, Staphylococcus
QQYKNHDPIILVHGFNGFTDDINPAVL

SEQ ID NO: 2109860 - protein, 20 aa, Staphylococcus
QRCPTGDLLILIGGNNWHIE

SEQ ID NO: 2109861 - protein, 19 aa, Staphylococcus
QRIISYPVNFVAGEIGNFF

SEQ ID NO: 2109862 - protein, 23 aa, Staphylococcus
QRVVSYPVNFVTGAINNLFSSNK

SEQ ID NO: 2109863 - protein, 31 aa, Staphylococcus
QSALNKLEKNNNGFFLMVEGASIDKTAHAND

SEQ ID NO: 2109864 - protein, 30 aa, Staphylococcus
QSDFTFKNPKYLPRFVFGHYMKSYLSNYET

SEQ ID NO: 2109865 - protein, 17 aa, Staphylococcus
QSDGENFSWSYGEGSGE

SEQ ID NO: 2109866 - protein, 28 aa, Staphylococcus
QSFKIINYQLKVPLIKAYMGMESDIFNF

SEQ ID NO: 2109867 - protein, 26 aa, Staphylococcus
QSHNGRYEYLFSFKNPKQQGTYTIVS

SEQ ID NO: 2109868 - protein, 22 aa, Staphylococcus
QSKKILINIGQMSNDFSPIVLP

SEQ ID NO: 2109869 - protein, 17 aa, Staphylococcus
QSMFDNHEYQFTLTDSE

SEQ ID NO: 2109870 - protein, 25 aa, Staphylococcus
QSNNLSNNFVFPGQVLSVGGNNTNS

SEQ ID NO: 2109871 - protein, 24 aa, Staphylococcus
QSPTKPIGLFYTKEQAEKTKEEKG

SEQ ID NO: 2109872 - protein, 18 aa, Staphylococcus
QSVYQRFLAAGGTEEMWE

SEQ ID NO: 2109873 - protein, 25 aa, Staphylococcus
QSYIFAKNQLYPIPGGSIMGIPTDI

SEQ ID NO: 2109874 - protein, 17 aa, Staphylococcus
QTDYDMYLDTAQGIVNQ

SEQ ID NO: 2109875 - protein, 25 aa, Staphylococcus
QTGTYIGGYFHPRDLYNVRGSNHSE

SEQ ID NO: 2109876 - protein, 31 aa, Staphylococcus
QTLQAQYKNQYPVVFVHGFAGLVGEDAFTLY

SEQ ID NO: 2109877 - protein, 20 aa, Staphylococcus
QTNIPNIYALGDIITSHYRH

SEQ ID NO: 2109878 - protein, 25 aa, Staphylococcus
QTRNVPFKGFLASNAVKFFDYTLTS

SEQ ID NO: 2109879 - protein, 33 aa, Staphylococcus
QTWSNQAVFFTRQLWNMLQLARVITIGAYNRNE

SEQ ID NO: 2109880 - protein, 19 aa, Staphylococcus
QVDYLIVNPTDSSAISSAV

SEQ ID NO: 2109881 - protein, 24 aa, Staphylococcus
QVEKNLPGVTLKIKQLPFKQRVNL

SEQ ID NO: 2109882 - protein, 25 aa, Staphylococcus
QVGKATYLYGSLNGKNGWVSQAFLS

SEQ ID NO: 2109883 - protein, 21 aa, Staphylococcus
QVKLSKPITYKAGATSDKKLA

SEQ ID NO: 2109884 - protein, 17 aa, Staphylococcus
QVPPEYLGGLNENNFIN

SEQ ID NO: 2109885 - protein, 20 aa, Staphylococcus
QVRLKQLFSDRNMLGNQQNQ

SEQ ID NO: 2109886 - protein, 18 aa, Staphylococcus
QVTVNQSITYKTYAQYYL

SEQ ID NO: 2109887 - protein, 23 aa, Staphylococcus
QVYQFEANAWYFSEGGIETTIHQ

SEQ ID NO: 2109888 - protein, 20 aa, Staphylococcus
QVYQFESNAWYFSEGGIETT

SEQ ID NO: 2109889 - protein, 19 aa, Staphylococcus
QYGLGFLQIKHFTKHYTEL

SEQ ID NO: 2109890 - protein, 17 aa, Staphylococcus
QYLENKAGFKFLAGVGP

SEQ ID NO: 2109891 - protein, 28 aa, Staphylococcus
QYQLKGNRLFYLAMAPQFFGIISDYLKS

SEQ ID NO: 2109892 - protein, 28 aa, Staphylococcus
RAETGQPISTYWWNAENWADNARADGYT

SEQ ID NO: 2109893 - protein, 21 aa, Staphylococcus
RALSSNYRVRALAAATPTGKD

SEQ ID NO: 2109894 - protein, 18 aa, Staphylococcus
RANILFDGETTPIVKESS

SEQ ID NO: 2109895 - protein, 36 aa, Staphylococcus
RASDSKGIAYVTTKRLKDGYEWTIKFNQSHRMHEHM

SEQ ID NO: 2109896 - protein, 23 aa, Staphylococcus
RATFDLMTHIYRNLLDSVSSSDQ

SEQ ID NO: 2109897 - protein, 17 aa, Staphylococcus
RCIQQKIPVIIVSRSFN

SEQ ID NO: 2109898 - protein, 21 aa, Staphylococcus
RDILQSVLDDSFNRFVNIVKD

SEQ ID NO: 2109899 - protein, 22 aa, Staphylococcus
RDMESIPNAPEGMKFYVVSPSI

SEQ ID NO: 2109900 - protein, 22 aa, Staphylococcus
RDQALSRMWDSAGGITSSAYNF

SEQ ID NO: 2109901 - protein, 23 aa, Staphylococcus
RDTISYIPKVGYYDKITHAHAYG

SEQ ID NO: 2109902 - protein, 19 aa, Staphylococcus
REDIYGALRISFKSPEDRE

SEQ ID NO: 2109903 - protein, 26 aa, Staphylococcus
REIESLKRNFFNIIDYGKQVKNDGVS

SEQ ID NO: 2109904 - protein, 19 aa, Staphylococcus
REKVLWQYTDSYYSPELDQ

SEQ ID NO: 2109905 - protein, 25 aa, Staphylococcus
RENKALKDIPIHFAIYIQSGEDEII

SEQ ID NO: 2109906 - protein, 25 aa, Staphylococcus
RENVMYIHCTLLPFIKAAGEMKTKP

SEQ ID NO: 2109907 - protein, 22 aa, Staphylococcus
RFAEPGEGFLACGYVAKGRMME

SEQ ID NO: 2109908 - protein, 18 aa, Staphylococcus
RFDKVLCTVDFPYAAQHL

SEQ ID NO: 2109909 - protein, 27 aa, Staphylococcus
RFFALILAIFFYLSVNNVFGNIFNNDN

SEQ ID NO: 2109910 - protein, 27 aa, Staphylococcus
RFIALLLAIFFYLSVNNVFGNIFSNDN

SEQ ID NO: 2109911 - protein, 20 aa, Staphylococcus
RFSIRKYAVGVVSIVTGITI

SEQ ID NO: 2109912 - protein, 28 aa, Staphylococcus
RFVAFILALFFYLSVNNVFGNIFSNNDL

SEQ ID NO: 2109913 - protein, 29 aa, Staphylococcus
RFVAFVLALAFFLTVNNVFGNIFSSSALT

SEQ ID NO: 2109914 - protein, 28 aa, Staphylococcus
RFVALILAIFFFLSVNNVFGNIFNSDDI

SEQ ID NO: 2109915 - protein, 28 aa, Staphylococcus
RFVALILAIFFFLSVNNVFGNVFNTDDI

SEQ ID NO: 2109916 - protein, 25 aa, Staphylococcus
RGEESLLFGPFAAIGPKFLKHGSNL

SEQ ID NO: 2109917 - protein, 22 aa, Staphylococcus
RGENYPEWYGGDGTDGMFSHQL

SEQ ID NO: 2109918 - protein, 24 aa, Staphylococcus
RGGEVLYQAFGLKIPDKLNDLVKK

SEQ ID NO: 2109919 - protein, 23 aa, Staphylococcus
RGQRQMDLIKILFQKAQSLDSID

SEQ ID NO: 2109920 - protein, 25 aa, Staphylococcus
RGQRQMDLIKILFQKAQTLDSFDKL

SEQ ID NO: 2109921 - protein, 17 aa, Staphylococcus
RHDVLFSGVFKSQKESE

SEQ ID NO: 2109922 - protein, 20 aa, Staphylococcus
RHHLEHLYHLGWITKLRDDN

SEQ ID NO: 2109923 - protein, 17 aa, Staphylococcus
RHIFSAIEDINPTHIAV

SEQ ID NO: 2109924 - protein, 25 aa, Staphylococcus
RHNTKVLARLIYDLALEMTSTIQFR

SEQ ID NO: 2109925 - protein, 18 aa, Staphylococcus
RHVNLKANVPLAWGAHRA

SEQ ID NO: 2109926 - protein, 28 aa, Staphylococcus
RIGKDKAEQIYYRTLTQYLSSNSNFADA

SEQ ID NO: 2109927 - protein, 25 aa, Staphylococcus
RIIETAPTDYLSWGAGPNANGRFIN

SEQ ID NO: 2109928 - protein, 25 aa, Staphylococcus
RIIETAPTDYLSWGAGPNANNRFIN

SEQ ID NO: 2109929 - protein, 26 aa, Staphylococcus
RIIETAPTDYLSWGAGPYGNNRFINV

SEQ ID NO: 2109930 - protein, 18 aa, Staphylococcus
RILDNANTIKLYDASQDE

SEQ ID NO: 2109931 - protein, 27 aa, Staphylococcus
RILIATLTLLVISFVCYIYAKIPTEPD

SEQ ID NO: 2109932 - protein, 24 aa, Staphylococcus
RISKLIQDLFMNDYLRVYTNNDLI

SEQ ID NO: 2109933 - protein, 20 aa, Staphylococcus
RIVAGIGAAAAAVALSRESS

SEQ ID NO: 2109934 - protein, 18 aa, Staphylococcus
RIVSLMPSNTEILYELGL

SEQ ID NO: 2109935 - protein, 36 aa, Staphylococcus
RKMGTVPKVLLWVFGILVLLAVVAAIYLAVKIFAVG

SEQ ID NO: 2109936 - protein, 28 aa, Staphylococcus
RKNGSKWIILNLHKPMYSKSYHALTDED

SEQ ID NO: 2109937 - protein, 29 aa, Staphylococcus
RKRVLRAIEYYLKTKKLLSSRKKVQQFTE

SEQ ID NO: 2109938 - protein, 17 aa, Staphylococcus
RKTKIVDVIDRVLHIDH

SEQ ID NO: 2109939 - protein, 23 aa, Staphylococcus
RKYFLERTFRKPSEFYNPIALYR

SEQ ID NO: 2109940 - protein, 19 aa, Staphylococcus
RLAGDKKVLFYSYENFMVE

SEQ ID NO: 2109941 - protein, 18 aa, Staphylococcus
RLEYIIRQGFERFDTLVL

SEQ ID NO: 2109942 - protein, 31 aa, Staphylococcus
RLGEKLGANPITFLGLGGIGDLIVTCTSTHS

SEQ ID NO: 2109943 - protein, 27 aa, Staphylococcus
RLIALMLAVLFFLSANNMFGNIFDADN

SEQ ID NO: 2109944 - protein, 17 aa, Staphylococcus
RLLLATGIMFAGTFTYQ

SEQ ID NO: 2109945 - protein, 19 aa, Staphylococcus
RLPKDPSIYLYFPSVEDEE

SEQ ID NO: 2109946 - protein, 23 aa, Staphylococcus
RLPLQWRSFFPDGEIIDLYENTE

SEQ ID NO: 2109947 - protein, 22 aa, Staphylococcus
RLPLQWRSFFTNGEVIDLYEDL

SEQ ID NO: 2109948 - protein, 29 aa, Staphylococcus
RLSGSRLLDLNLGFSQWGFKQKPNESYIE

SEQ ID NO: 2109949 - protein, 17 aa, Staphylococcus
RMTKAVLPIMRSQREGR

SEQ ID NO: 2109950 - protein, 27 aa, Staphylococcus
RNTKDGIKPLLAKKWDISADGKTYTFH

SEQ ID NO: 2109951 - protein, 24 aa, Staphylococcus
RNYYTSGQCTYYVYDRVGGKIGST

SEQ ID NO: 2109952 - protein, 17 aa, Staphylococcus
RPQPIFKAFIEASLNHQ

SEQ ID NO: 2109953 - protein, 17 aa, Staphylococcus
RPQPIFKAFVEAAYKYQ

SEQ ID NO: 2109954 - protein, 30 aa, Staphylococcus
RRAETGQPISTYWWNADHWANNASADGYTV

SEQ ID NO: 2109955 - protein, 26 aa, Staphylococcus
RRITGNDVLSLLRATPKHAGLRNHIE

SEQ ID NO: 2109956 - protein, 25 aa, Staphylococcus
RSATKYHNVFGIAAYDYNALGEGVK

SEQ ID NO: 2109957 - protein, 25 aa, Staphylococcus
RSLGLNPFIHLASLQGDFITEIPIS

SEQ ID NO: 2109958 - protein, 17 aa, Staphylococcus
RSNKIVISLRNSIAKIM

SEQ ID NO: 2109959 - protein, 17 aa, Staphylococcus
RSTSLFQTLPQLNGSDV

SEQ ID NO: 2109960 - protein, 17 aa, Staphylococcus
RTKEGLLDFRRFGGTLY

SEQ ID NO: 2109961 - protein, 22 aa, Staphylococcus
RTKEGLLDFRRFGGTLYHRTAF

SEQ ID NO: 2109962 - protein, 24 aa, Staphylococcus
RTKRYRLKQLLNSKAIEQDMTYQS

SEQ ID NO: 2109963 - protein, 24 aa, Staphylococcus
RTRAELQQFWHDLADDLVQSENLT

SEQ ID NO: 2109964 - protein, 27 aa, Staphylococcus
RTTFELLTKLYHHLLNKIDDSKQMIIM

SEQ ID NO: 2109965 - protein, 19 aa, Staphylococcus
RTVYRYMDTLSKSGVPIIS

SEQ ID NO: 2109966 - protein, 25 aa, Staphylococcus
RVGIVPLINNQAYWFITINASEKDP

SEQ ID NO: 2109967 - protein, 17 aa, Staphylococcus
RVIGMPKLKGLKNKEKP

SEQ ID NO: 2109968 - protein, 17 aa, Staphylococcus
RVIIATGILLTGTIAYQ

SEQ ID NO: 2109969 - protein, 20 aa, Staphylococcus
RVIKHYGSLVPLTELEESLL

SEQ ID NO: 2109970 - protein, 23 aa, Staphylococcus
RVQFHHHPYRQSSFKMINHQLYV

SEQ ID NO: 2109971 - protein, 21 aa, Staphylococcus
RVQKSKLWKSKDNGFNDLTRD

SEQ ID NO: 2109972 - protein, 20 aa, Staphylococcus
RVSIVSRDTWARARGLISSE

SEQ ID NO: 2109973 - protein, 23 aa, Staphylococcus
RVSPRKVISPLIKAHKAGLHLTT

SEQ ID NO: 2109974 - protein, 23 aa, Staphylococcus
RYEARTLYNRAPKASFYINDYEQ

SEQ ID NO: 2109975 - protein, 28 aa, Staphylococcus
RYGKTYEGVYPEWQPGQKVHLVGHSMGG

SEQ ID NO: 2109976 - protein, 18 aa, Staphylococcus
RYNGLNNLTTKNMVTGKD

SEQ ID NO: 2109977 - protein, 26 aa, Staphylococcus
SAAAKNLPLIKYSFDQILMTKEGCMN

SEQ ID NO: 2109978 - protein, 23 aa, Staphylococcus
SAEDAGYVALPKDDYKKEQKQLD

SEQ ID NO: 2109979 - protein, 31 aa, Staphylococcus
SAIAVLLTICLLFLLFIATNEQALAKVHQTI

SEQ ID NO: 2109980 - protein, 25 aa, Staphylococcus
SAKGPDLYVYLTKDGNIKEGKQLEM

SEQ ID NO: 2109981 - protein, 24 aa, Staphylococcus
SAKNGYSLKTYFEKPFVVIKQKQQ

SEQ ID NO: 2109982 - protein, 27 aa, Staphylococcus
SALAQKPNFNLFGIKGTYQGQSVSFNT

SEQ ID NO: 2109983 - protein, 29 aa, Staphylococcus
SANLYTAGQCTWYVYDKVGGNIGSTWGNA

SEQ ID NO: 2109984 - protein, 23 aa, Staphylococcus
SANVWEISGYPPSLQIEDAVDRP

SEQ ID NO: 2109985 - protein, 25 aa, Staphylococcus
SAPRTLIIAEVLKKAGYDVTTTPVQ

SEQ ID NO: 2109986 - protein, 19 aa, Staphylococcus
SAQGFDYRYHIGDNIVQYI

SEQ ID NO: 2109987 - protein, 39 aa, Staphylococcus
SDDEIMWQLNLNLMGVIRMTKAVLPYMRNQRDGRIINIS

SEQ ID NO: 2109988 - protein, 17 aa, Staphylococcus
SDDKPVQLFSQQELKTV

SEQ ID NO: 2109989 - protein, 23 aa, Staphylococcus
SDGSIYPVLLRLSKKGYVHTTTR

SEQ ID NO: 2109990 - protein, 25 aa, Staphylococcus
SDGYYFLEPGEGFLACGYVAKGRME

SEQ ID NO: 2109991 - protein, 22 aa, Staphylococcus
SDISYSVCGIPYYIGGNVSDID

SEQ ID NO: 2109992 - protein, 27 aa, Staphylococcus
SDLASSPHFNLFGIKGAYEGQSATFNT

SEQ ID NO: 2109993 - protein, 23 aa, Staphylococcus
SDLKDIPIHFAIYKQSGQDSITP

SEQ ID NO: 2109994 - protein, 24 aa, Staphylococcus
SDLKDIPIHFAIYKQSSQESITPG

SEQ ID NO: 2109995 - protein, 27 aa, Staphylococcus
SDLLGNEAIVRQAVYDFAKSQGNKFSR

SEQ ID NO: 2109996 - protein, 28 aa, Staphylococcus
SDLLGNEALIRQVVFDAGKVLGNKDSRV

SEQ ID NO: 2109997 - protein, 37 aa, Staphylococcus
SDNQMFSINAGFRKYPNLKSSLQDYADLIKNGIEGNP

SEQ ID NO: 2109998 - protein, 27 aa, Staphylococcus
SDNSMFSINAGFRKYPSTKASLEDYAD

SEQ ID NO: 2109999 - protein, 24 aa, Staphylococcus
SDTPLFEYYNPILEKLIVAKKKAL

SEQ ID NO: 2110000 - protein, 24 aa, Staphylococcus
SEDPSLYLYVPKVGDATLAPEGQT

SEQ ID NO: 2110001 - protein, 26 aa, Staphylococcus
SEFYNPIALYRGMKLRTLGKANHLID

SEQ ID NO: 2110002 - protein, 32 aa, Staphylococcus
SEIKQLKFNSPLYSLGYPWQYNDNTKAYFNKL

SEQ ID NO: 2110003 - protein, 24 aa, Staphylococcus
SEKDMPLQIDAPSKNPLLVDMEQS

SEQ ID NO: 2110004 - protein, 24 aa, Staphylococcus
SEKEKLALVFLANESGEYAITKND

SEQ ID NO: 2110005 - protein, 19 aa, Staphylococcus
SEMGGFEKAFQNAIDYSNK

SEQ ID NO: 2110006 - protein, 17 aa, Staphylococcus
SEPLSHLRNIVRSLLGI

SEQ ID NO: 2110007 - protein, 28 aa, Staphylococcus
SEQSTQLLGSIFLLLGGALVAKQSHKKI

SEQ ID NO: 2110008 - protein, 24 aa, Staphylococcus
SESKRIMDNPKVVKLYDGNQSALD

SEQ ID NO: 2110009 - protein, 23 aa, Staphylococcus
SFANCALPYYIGQLVTEREKVLA

SEQ ID NO: 2110010 - protein, 18 aa, Staphylococcus
SFEKEQGKWAYKVDLQKQ

SEQ ID NO: 2110011 - protein, 24 aa, Staphylococcus
SFERLQKNINHRLVLEFKEYEKEA

SEQ ID NO: 2110012 - protein, 18 aa, Staphylococcus
SFEYKDFKSYKDIIKKAQ

SEQ ID NO: 2110013 - protein, 23 aa, Staphylococcus
SFGQRVISYPVNFVTGAIGNFLK

SEQ ID NO: 2110014 - protein, 25 aa, Staphylococcus
SFGQRVMSYPVNFVTGAIGNIFNMG

SEQ ID NO: 2110015 - protein, 29 aa, Staphylococcus
SFKLISILLFAILLLSTIAFTDLNKSYAA

SEQ ID NO: 2110016 - protein, 22 aa, Staphylococcus
SFLALLLMLSACAPNNDNNEDN

SEQ ID NO: 2110017 - protein, 20 aa, Staphylococcus
SFLRPNVLDQYFGAGNLYMA

SEQ ID NO: 2110018 - protein, 34 aa, Staphylococcus
SGASGKFQFLQSTWDSVAPAEYQGQPAASAPESV

SEQ ID NO: 2110019 - protein, 24 aa, Staphylococcus
SGDSKLYYKYLEQIGAAMTDKNGK

SEQ ID NO: 2110020 - protein, 32 aa, Staphylococcus
SGDTFTIGYGQYIRPGGFSLPSSDTELRDANG

SEQ ID NO: 2110021 - protein, 23 aa, Staphylococcus
SGEKIYVYNWGEYIDPSLIKKFQ

SEQ ID NO: 2110022 - protein, 19 aa, Staphylococcus
SGIFEYQPKKDGLIVSFVI

SEQ ID NO: 2110023 - protein, 26 aa, Staphylococcus
SGIPNKAAYLTIKRIGKDKAEQIYYR

SEQ ID NO: 2110024 - protein, 17 aa, Staphylococcus
SGLAVALLGSAGASVFS

SEQ ID NO: 2110025 - protein, 26 aa, Staphylococcus
SGNLYTAGQCTWYVFDRVDGKIGSTW

SEQ ID NO: 2110026 - protein, 22 aa, Staphylococcus
SGNTPLGWYNVKDLNIKNLDEE

SEQ ID NO: 2110027 - protein, 20 aa, Staphylococcus
SGQCTYYVYDKVGGKISSTW

SEQ ID NO: 2110028 - protein, 37 aa, Staphylococcus
SGSAFKPFSILDVASPYPYGQCTWYVYERVQQFDKHV

SEQ ID NO: 2110029 - protein, 24 aa, Staphylococcus
SGWGPDYPDPLTFLNIMTTGNSNN

SEQ ID NO: 2110030 - protein, 18 aa, Staphylococcus
SGYITYDVPDSDNYTLEM

SEQ ID NO: 2110031 - protein, 23 aa, Staphylococcus
SGYIYPLASLMEKGIKKSDIQIQ

SEQ ID NO: 2110032 - protein, 19 aa, Staphylococcus
SGYIYPMASLKKVNVNQND

SEQ ID NO: 2110033 - protein, 25 aa, Staphylococcus
SHFENGFSLTSLISSLFHFDDDISK

SEQ ID NO: 2110034 - protein, 23 aa, Staphylococcus
SHPTKPIGLFYDKETAERIEKEK

SEQ ID NO: 2110035 - protein, 25 aa, Staphylococcus
SIAIGTLLLLMPHAQSEAAADKYEV

SEQ ID NO: 2110036 - protein, 20 aa, Staphylococcus
SIAKGKDYVWNPEAIRKMKH

SEQ ID NO: 2110037 - protein, 29 aa, Staphylococcus
SIEEHYTSYFPKYGYRNGVGKPEGIVVHD

SEQ ID NO: 2110038 - protein, 23 aa, Staphylococcus
SIHTWDKFKDKVLFTGVFNSQEA

SEQ ID NO: 2110039 - protein, 19 aa, Staphylococcus
SIILDNKYLMQSKLDKQSD

SEQ ID NO: 2110040 - protein, 18 aa, Staphylococcus
SILLVTITLAACGNQKED

SEQ ID NO: 2110041 - protein, 23 aa, Staphylococcus
SILTLLTILCIFQTHTISSAKSK

SEQ ID NO: 2110042 - protein, 18 aa, Staphylococcus
SILVLVIVLAGCGKDKED

SEQ ID NO: 2110043 - protein, 31 aa, Staphylococcus
SIMLTLLLILIILFGFYIYSKIPKTTHLSKI

SEQ ID NO: 2110044 - protein, 17 aa, Staphylococcus
SINDYIRKKNFKAPQIE

SEQ ID NO: 2110045 - protein, 20 aa, Staphylococcus
SIPVTIYAPATAKAPQRDVV

SEQ ID NO: 2110046 - protein, 33 aa, Staphylococcus
SIRKFAIGTSSILVASLFFIGSGGADAAEASPE

SEQ ID NO: 2110047 - protein, 33 aa, Staphylococcus
SIRKFSVGASSILIAALLFMGGGSAQAAEQNQE

SEQ ID NO: 2110048 - protein, 33 aa, Staphylococcus
SIRKFSVGTSSILIAALLFIGGGSAQAAENQDK

SEQ ID NO: 2110049 - protein, 33 aa, Staphylococcus
SIRKFTFGASSILIGSLLFLGVGTAQAAEEDHH

SEQ ID NO: 2110050 - protein, 18 aa, Staphylococcus
SIRKLSVGASSVVVATLL

SEQ ID NO: 2110051 - protein, 26 aa, Staphylococcus
SISLDPKIFYPLIKKLKENNDYVVVN

SEQ ID NO: 2110052 - protein, 17 aa, Staphylococcus
SISLRPAFILKSAKHKD

SEQ ID NO: 2110053 - protein, 21 aa, Staphylococcus
SKADFIIVAVPTPINKHNQPD

SEQ ID NO: 2110054 - protein, 24 aa, Staphylococcus
SKGGDFVLDQSFYNGLKAGNVEFN

SEQ ID NO: 2110055 - protein, 25 aa, Staphylococcus
SKHALNDFYITYFAQANQIDNLQDA

SEQ ID NO: 2110056 - protein, 18 aa, Staphylococcus
SKHKLQYKKRYAISNHDV

SEQ ID NO: 2110057 - protein, 24 aa, Staphylococcus
SKKASLVDIPLKKQLKLTDLQKSY

SEQ ID NO: 2110058 - protein, 21 aa, Staphylococcus
SKKATLGSNAFYLITDNKTNT

SEQ ID NO: 2110059 - protein, 22 aa, Staphylococcus
SKKHLFENAYYILVFNEKENQE

SEQ ID NO: 2110060 - protein, 17 aa, Staphylococcus
SKKWPFTTPQGKVLIRA

SEQ ID NO: 2110061 - protein, 25 aa, Staphylococcus
SKLAKEWMDFLKSDKAKAILKDYKF

SEQ ID NO: 2110062 - protein, 17 aa, Staphylococcus
SKNQGLYSIPWGTTQQQ

SEQ ID NO: 2110063 - protein, 23 aa, Staphylococcus
SKRIVALEFSFVDALAALNVKPV

SEQ ID NO: 2110064 - protein, 19 aa, Staphylococcus
SKSLKYLLADSPKSYKESQ

SEQ ID NO: 2110065 - protein, 21 aa, Staphylococcus
SKVILHFKEQESEAFDLCIGA

SEQ ID NO: 2110066 - protein, 27 aa, Staphylococcus
SKVNADLVVPLIKAYLGISSDIFNFYA

SEQ ID NO: 2110067 - protein, 28 aa, Staphylococcus
SLATSDNYTFASLVFDPEALDSDAVKNS

SEQ ID NO: 2110068 - protein, 21 aa, Staphylococcus
SLAVGLGLVAGNAGHDADASE

SEQ ID NO: 2110069 - protein, 17 aa, Staphylococcus
SLAVGLGVVAGNAGHDA

SEQ ID NO: 2110070 - protein, 19 aa, Staphylococcus
SLAVGLGVVAGNAGHDAHA

SEQ ID NO: 2110071 - protein, 18 aa, Staphylococcus
SLAVSLGIAGYALTGNEA

SEQ ID NO: 2110072 - protein, 19 aa, Staphylococcus
SLAVTLGLTGYALTNDHSA

SEQ ID NO: 2110073 - protein, 24 aa, Staphylococcus
SLDPKIFVPLIKNLKENNDLVVVN

SEQ ID NO: 2110074 - protein, 25 aa, Staphylococcus
SLFALMMAVILFVSACGNGSSLDNK

SEQ ID NO: 2110075 - protein, 17 aa, Staphylococcus
SLFVLTIILAACGKSNG

SEQ ID NO: 2110076 - protein, 24 aa, Staphylococcus
SLGLVVTLLLAVLLSACGNGGSKS

SEQ ID NO: 2110077 - protein, 18 aa, Staphylococcus
SLHNISISNLRILEVRED

SEQ ID NO: 2110078 - protein, 19 aa, Staphylococcus
SLITITFVTITTVALSTQL

SEQ ID NO: 2110079 - protein, 28 aa, Staphylococcus
SLKITTHNVYFLPTAIYPNWGQSQRADL

SEQ ID NO: 2110080 - protein, 28 aa, Staphylococcus
SLKITTHNVYFLPTALYPNWGQSQRADL

SEQ ID NO: 2110081 - protein, 17 aa, Staphylococcus
SLLSLAFILTACGETGK

SEQ ID NO: 2110082 - protein, 23 aa, Staphylococcus
SLSKFMTNFRIALVKKENSGPYG

SEQ ID NO: 2110083 - protein, 19 aa, Staphylococcus
SMLMVLTIIMSACSNNNNE

SEQ ID NO: 2110084 - protein, 32 aa, Staphylococcus
SMYSFGTIPRGDTGYFFNQAYKPEGAINAGGY

SEQ ID NO: 2110085 - protein, 21 aa, Staphylococcus
SNAVKFFDYTLTSVGVSPSDL

SEQ ID NO: 2110086 - protein, 21 aa, Staphylococcus
SNDGVYVYHGDKIKLQFKVEN

SEQ ID NO: 2110087 - protein, 22 aa, Staphylococcus
SNDKNRFIGKVKYISNIPKQIN

SEQ ID NO: 2110088 - protein, 17 aa, Staphylococcus
SNFAPITNVIYFKVEKT

SEQ ID NO: 2110089 - protein, 24 aa, Staphylococcus
SNHSEIFYMDTYPSMGTDRQHLNE

SEQ ID NO: 2110090 - protein, 24 aa, Staphylococcus
SNIGNIHPVFNKKQQARAKINEKF

SEQ ID NO: 2110091 - protein, 25 aa, Staphylococcus
SNKEFEFLANRKATKRRKLFNGYIE

SEQ ID NO: 2110092 - protein, 26 aa, Staphylococcus
SNKEFEFLTQRKATKRRKLFNGYIEC

SEQ ID NO: 2110093 - protein, 25 aa, Staphylococcus
SNKEFEFLVNRKATKRRKLFNGYIE

SEQ ID NO: 2110094 - protein, 25 aa, Staphylococcus
SNLDLFRSVKPYNISTLLAAAIKNV

SEQ ID NO: 2110095 - protein, 17 aa, Staphylococcus
SNLYTAGQCTYYVFDKV

SEQ ID NO: 2110096 - protein, 29 aa, Staphylococcus
SNNLYTAGQCTYYVYDKVGGKIGSTWGNA

SEQ ID NO: 2110097 - protein, 19 aa, Staphylococcus
SNNMIFPGQVISIGGSSNN

SEQ ID NO: 2110098 - protein, 25 aa, Staphylococcus
SNPKEFIQPLPHISFVRGKNNVQFL

SEQ ID NO: 2110099 - protein, 26 aa, Staphylococcus
SNPKEFIQPLPHISFVRGKNNVQFLK

SEQ ID NO: 2110100 - protein, 31 aa, Staphylococcus
SNSPIKYYNVYGIGAYDYAPLVNGINYAKQS

SEQ ID NO: 2110101 - protein, 29 aa, Staphylococcus
SNTYLHGVINNVWGWILSDDVQTVKTSQK

SEQ ID NO: 2110102 - protein, 21 aa, Staphylococcus
SNVLNQSPVTLLKSDGTSLAI

SEQ ID NO: 2110103 - protein, 25 aa, Staphylococcus
SNYDRAVDLYYYIKGGRVDYGAAHA

SEQ ID NO: 2110104 - protein, 27 aa, Staphylococcus
SNYDRAVELYYYIKGGTVDYGAAHAAK

SEQ ID NO: 2110105 - protein, 24 aa, Staphylococcus
SNYYNQAPKRWPSNIPGSENVRDF

SEQ ID NO: 2110106 - protein, 26 aa, Staphylococcus
SPIQEGAYNYTFDYNGFTYHFESDGT

SEQ ID NO: 2110107 - protein, 18 aa, Staphylococcus
SPNDGSGYPVGTYIYAAN

SEQ ID NO: 2110108 - protein, 24 aa, Staphylococcus
SPSKRNITPYNPKTTAIGYGKQET

SEQ ID NO: 2110109 - protein, 24 aa, Staphylococcus
SQAALQNLPNFQNALDNATTEVNG

SEQ ID NO: 2110110 - protein, 28 aa, Staphylococcus
SQAGKPISTYWSDAKYWAGNAAADGYTV

SEQ ID NO: 2110111 - protein, 28 aa, Staphylococcus
SQAGKPISTYWSDAKYWAGNAANDGYRV

SEQ ID NO: 2110112 - protein, 26 aa, Staphylococcus
SQESLLKMKKLNPNIPLIQLTDVLEI

SEQ ID NO: 2110113 - protein, 35 aa, Staphylococcus
SQESLLKMQKLNSNVPLIRLLDKGELLALSQQDFN

SEQ ID NO: 2110114 - protein, 23 aa, Staphylococcus
SQISRLPLIVLTSDRPHELRSVG

SEQ ID NO: 2110115 - protein, 29 aa, Staphylococcus
SQKLVYDVELNYISPKAAHWKIQVDASTG

SEQ ID NO: 2110116 - protein, 24 aa, Staphylococcus
SQPPSGYKWYDRSTFKLGSYGSTS

SEQ ID NO: 2110117 - protein, 44 aa, Staphylococcus
SQRMDFIPNKLNKYSIRKFTVGTASILVGATLFLGHHEAEAAEK

SEQ ID NO: 2110118 - protein, 19 aa, Staphylococcus
SQWDASMYSFGTIPRGDTG

SEQ ID NO: 2110119 - protein, 28 aa, Staphylococcus
SQYKNHDPIILVHGFNGFTDDINPSVLA

SEQ ID NO: 2110120 - protein, 23 aa, Staphylococcus
SRMNTLPKLPYKYGTYKGVVIHE

SEQ ID NO: 2110121 - protein, 26 aa, Staphylococcus
SSAVKNLPLIKYSFDQILMTKEGCMN

SEQ ID NO: 2110122 - protein, 28 aa, Staphylococcus
SSDWLSEHFGVRFRYNALGDLNTQNIVS

SEQ ID NO: 2110123 - protein, 22 aa, Staphylococcus
SSGAYGLFQLLGHGEHAGMSVQ

SEQ ID NO: 2110124 - protein, 25 aa, Staphylococcus
SSKGPDLYVYLTKDGNIKSGKKIST

SEQ ID NO: 2110125 - protein, 22 aa, Staphylococcus
SSLLIATLTSATLINPAHAETT

SEQ ID NO: 2110126 - protein, 22 aa, Staphylococcus
SSNQPLPKPYVIKHVPEAISSN

SEQ ID NO: 2110127 - protein, 23 aa, Staphylococcus
SSNYVQPLRIQLASNEDFNDNDW

SEQ ID NO: 2110128 - protein, 19 aa, Staphylococcus
SSQDRLYYAAGGRGIEFNE

SEQ ID NO: 2110129 - protein, 43 aa, Staphylococcus
SSRASNFVQGPPTGYTFYDEPTIHIKNFKEFARAPEFQHEQDA

SEQ ID NO: 2110130 - protein, 28 aa, Staphylococcus
SSSDWLAQNFGVRFRYNALGDLNTSNLV

SEQ ID NO: 2110131 - protein, 24 aa, Staphylococcus
SSYDSLNVFKPEPFRSDKDGLSEL

SEQ ID NO: 2110132 - protein, 30 aa, Staphylococcus
SSYPQGQCTWYVDQRMKQFGQYIHSNLGDA

SEQ ID NO: 2110133 - protein, 18 aa, Staphylococcus
STALATSLLLGACGNSNH

SEQ ID NO: 2110134 - protein, 26 aa, Staphylococcus
STCILLMSMSLIFMPVSHAQGLSSKQ

SEQ ID NO: 2110135 - protein, 18 aa, Staphylococcus
STCLLCLTLTACGGNGEQ

SEQ ID NO: 2110136 - protein, 29 aa, Staphylococcus
STDRISISNAITYEPIRKSIYADGNNTKE

SEQ ID NO: 2110137 - protein, 25 aa, Staphylococcus
STEQITETIFTKADKRELISAKNHL

SEQ ID NO: 2110138 - protein, 29 aa, Staphylococcus
STGAAGKFQFLQSTWDSVAPEQYKGQSPA

SEQ ID NO: 2110139 - protein, 26 aa, Staphylococcus
STGVQLELTTSLRKALFNNQDMSTSS

SEQ ID NO: 2110140 - protein, 18 aa, Staphylococcus
STITRLIYSILREDQYRV

SEQ ID NO: 2110141 - protein, 23 aa, Staphylococcus
STLKRPIKLLKENKTVGIFPTGH

SEQ ID NO: 2110142 - protein, 23 aa, Staphylococcus
STLNYLNSLAYKGWDFDGAYGNQ

SEQ ID NO: 2110143 - protein, 19 aa, Staphylococcus
STLYKGPYDAFRKDFSHKI

SEQ ID NO: 2110144 - protein, 19 aa, Staphylococcus
STNISRLPQGWTSEFVRNS

SEQ ID NO: 2110145 - protein, 25 aa, Staphylococcus
STNLSLKGQPLYLPGTDGLKTGTSN

SEQ ID NO: 2110146 - protein, 18 aa, Staphylococcus
STPYPIIDLLPEQKDIED

SEQ ID NO: 2110147 - protein, 31 aa, Staphylococcus
STSPYPQGQCTWYVYKRMQQFDLAIGGDLGD

SEQ ID NO: 2110148 - protein, 24 aa, Staphylococcus
STWGNANNWAYSAKRAGFTVNNTP

SEQ ID NO: 2110149 - protein, 17 aa, Staphylococcus
STYKAIASGILLNKVAP

SEQ ID NO: 2110150 - protein, 17 aa, Staphylococcus
STYWWNANNWDNAAAAD

SEQ ID NO: 2110151 - protein, 26 aa, Staphylococcus
SVFISEMNWIAPYITSTRTISSMEAG

SEQ ID NO: 2110152 - protein, 30 aa, Staphylococcus
SVGASSILVATLLFMGGGAAQAAETHQEVG

SEQ ID NO: 2110153 - protein, 18 aa, Staphylococcus
SVLIITLALSACGKDNKE

SEQ ID NO: 2110154 - protein, 24 aa, Staphylococcus
SVNNQAWLAAYMLKQNGLTPSFAD

SEQ ID NO: 2110155 - protein, 26 aa, Staphylococcus
SVPTHFHDHEWLEDPEFSKSESKRIM

SEQ ID NO: 2110156 - protein, 23 aa, Staphylococcus
SVRQLTQDLFMNDYLRVYTNEDL

SEQ ID NO: 2110157 - protein, 17 aa, Staphylococcus
SVTLLCLSLTPNIINLT

SEQ ID NO: 2110158 - protein, 30 aa, Staphylococcus
SVVAIILSICLAFLLFIATNQNALAKVHRT

SEQ ID NO: 2110159 - protein, 30 aa, Staphylococcus
SVVAVILSICLVGLIFLATNQNALAKVHQT

SEQ ID NO: 2110160 - protein, 20 aa, Staphylococcus
SVVFKRTPDILKYLGEHKAH

SEQ ID NO: 2110161 - protein, 19 aa, Staphylococcus
SVYVGKELFLYGTVDNRTG

SEQ ID NO: 2110162 - protein, 34 aa, Staphylococcus
SYEYTYTIDQQGNYHYDWKGNWSPSQQQGNNNSY

SEQ ID NO: 2110163 - protein, 20 aa, Staphylococcus
SYFSNFTQAVGKVKFINKKP

SEQ ID NO: 2110164 - protein, 19 aa, Staphylococcus
SYHDPYHLKGIKGYIQTPY

SEQ ID NO: 2110165 - protein, 17 aa, Staphylococcus
SYLDYKKQKPDAKIKEI

SEQ ID NO: 2110166 - protein, 17 aa, Staphylococcus
SYLDYKKQKPNAKIKAI

SEQ ID NO: 2110167 - protein, 21 aa, Staphylococcus
SYNLITGNPIYRPLGSTANKM

SEQ ID NO: 2110168 - protein, 34 aa, Staphylococcus
SYSYTIDQQGQYHYTWQGNWNPSNSDQGHTSNGY

SEQ ID NO: 2110169 - protein, 31 aa, Staphylococcus
SYTIDQQGDYHYTWKGNWSPDRLNSHNNYSY

SEQ ID NO: 2110170 - protein, 31 aa, Staphylococcus
SYTIDQQGNYHYTWKGNWSPDRLNHSNYNYN

SEQ ID NO: 2110171 - protein, 31 aa, Staphylococcus
SYTIDQQGNYHYTWKGNWSPDRLNHTNDSNH

SEQ ID NO: 2110172 - protein, 29 aa, Staphylococcus
SYTIDQQGNYHYTWKGNWSPNQVNHSSQS

SEQ ID NO: 2110173 - protein, 25 aa, Staphylococcus
SYVGQFLSQLGFKEALNKDVTKGLS

SEQ ID NO: 2110174 - protein, 24 aa, Staphylococcus
SYVGQFLTQLGFKEALSPDVTKGL

SEQ ID NO: 2110175 - protein, 24 aa, Staphylococcus
TAAKTVFNGPFKVKEWKVEDKIQL

SEQ ID NO: 2110176 - protein, 23 aa, Staphylococcus
TADDFVYAWRKVVDPKTASEFAY

SEQ ID NO: 2110177 - protein, 18 aa, Staphylococcus
TAGIGAAIVGLDHGNEAD

SEQ ID NO: 2110178 - protein, 23 aa, Staphylococcus
TAGQCTWYVFDKVGGKIGSTWGN

SEQ ID NO: 2110179 - protein, 20 aa, Staphylococcus
TAGQCTWYVFNRRAQARSPI

SEQ ID NO: 2110180 - protein, 20 aa, Staphylococcus
TAGYTFPLATLKKETGINAT

SEQ ID NO: 2110181 - protein, 28 aa, Staphylococcus
TAKDMNLLMQALIKKYPQILQISKLTRD

SEQ ID NO: 2110182 - protein, 21 aa, Staphylococcus
TAKVIFVDNYYLLMGGFRKKK

SEQ ID NO: 2110183 - protein, 19 aa, Staphylococcus
TANKDLLAVHLKLLEDLAE

SEQ ID NO: 2110184 - protein, 20 aa, Staphylococcus
TANKDLLAVHLKLLEDLAEA

SEQ ID NO: 2110185 - protein, 20 aa, Staphylococcus
TANKDLLAVHLKLLEDLAES

SEQ ID NO: 2110186 - protein, 18 aa, Staphylococcus
TANKGAYRYYAFEGIRPS

SEQ ID NO: 2110187 - protein, 23 aa, Staphylococcus
TAQDFVYAWRKVVNPKTGSEFAY

SEQ ID NO: 2110188 - protein, 23 aa, Staphylococcus
TARSLVIAEVLKKAGYDVTTTPV

SEQ ID NO: 2110189 - protein, 18 aa, Staphylococcus
TASLTAALILGGCGNKEK

SEQ ID NO: 2110190 - protein, 31 aa, Staphylococcus
TAVNKLKQNDKGFFLMVEGASIDKSGHPNDV

SEQ ID NO: 2110191 - protein, 45 aa, Staphylococcus
TAYNYTFVINNKDSYFYDDLSLQTKHLLSPYYEQTFVVAKYQVVN

SEQ ID NO: 2110192 - protein, 25 aa, Staphylococcus
TDKKRPLLFDLSLADHLTYGNFNED

SEQ ID NO: 2110193 - protein, 24 aa, Staphylococcus
TDKPKTYGTFTFDPSIIIGNDDAE

SEQ ID NO: 2110194 - protein, 25 aa, Staphylococcus
TDKSLMYLLVNEGELSTFGPGGRFG

SEQ ID NO: 2110195 - protein, 26 aa, Staphylococcus
TDMKWCKMLLRQLISNAIKYSPEGQD

SEQ ID NO: 2110196 - protein, 28 aa, Staphylococcus
TDPTKAKGIIFLPEHLSQKQRWSHAVDQ

SEQ ID NO: 2110197 - protein, 17 aa, Staphylococcus
TEFEVAYAPPYSHPKDL

SEQ ID NO: 2110198 - protein, 18 aa, Staphylococcus
TEFEVAYAPPYSHPKDLI

SEQ ID NO: 2110199 - protein, 24 aa, Staphylococcus
TEKFRQMIDIMLTGSFIGTKYALP

SEQ ID NO: 2110200 - protein, 24 aa, Staphylococcus
TENQNMKYVPLGPLNTVKGKFRVE

SEQ ID NO: 2110201 - protein, 23 aa, Staphylococcus
TEQRRYLNIIKNKTTTLIETVNL

SEQ ID NO: 2110202 - protein, 19 aa, Staphylococcus
TFKQKFEAYIKALNKVNKE

SEQ ID NO: 2110203 - protein, 28 aa, Staphylococcus
TFKVDEGIYWLNDPYSLDYERKDLKEKL

SEQ ID NO: 2110204 - protein, 25 aa, Staphylococcus
TFPKGWHEWVMAAKAKPVYGAKDFL

SEQ ID NO: 2110205 - protein, 17 aa, Staphylococcus
TFSYHDPYHLKGKKGYI

SEQ ID NO: 2110206 - protein, 19 aa, Staphylococcus
TFTLYYDKQYGYIHRLFVK

SEQ ID NO: 2110207 - protein, 26 aa, Staphylococcus
TFTSDGQTWSWNYTTAGAQSASSNTI

SEQ ID NO: 2110208 - protein, 35 aa, Staphylococcus
TFVSGRLTIDNFRWAGVPFYIRTGKRMKSKSIQVV

SEQ ID NO: 2110209 - protein, 24 aa, Staphylococcus
TGDFQFPNKPFKYGIHYSEVTDFN

SEQ ID NO: 2110210 - protein, 27 aa, Staphylococcus
TGFQWYSWIHIADLTRAILFLINDSQA

SEQ ID NO: 2110211 - protein, 18 aa, Staphylococcus
TGIYYYQPKKNGEAVWFD

SEQ ID NO: 2110212 - protein, 19 aa, Staphylococcus
TGKYSLGDIVWNDKNRNGI

SEQ ID NO: 2110213 - protein, 34 aa, Staphylococcus
TGNNSPVYRAQLFLSPYGPPAYLQAINTNQANTT

SEQ ID NO: 2110214 - protein, 27 aa, Staphylococcus
TGTDARMMYWFTPREYPVYRKPQGANI

SEQ ID NO: 2110215 - protein, 18 aa, Staphylococcus
TGTIGLTSLLLTSQSYAV

SEQ ID NO: 2110216 - protein, 22 aa, Staphylococcus
TGVVSLWTWWKNNNFTHHAQKG

SEQ ID NO: 2110217 - protein, 22 aa, Staphylococcus
TGYQYEPWHFRYVGKKAAKAIH

SEQ ID NO: 2110218 - protein, 26 aa, Staphylococcus
TGYQYEPWHLRYLGKDTATKVYQSGK

SEQ ID NO: 2110219 - protein, 19 aa, Staphylococcus
THILSLHNISISNLKILEV

SEQ ID NO: 2110220 - protein, 17 aa, Staphylococcus
THLVKEHKLFNTPDYKD

SEQ ID NO: 2110221 - protein, 34 aa, Staphylococcus
THPSLFGRQKADLNMFLPFILTGNVIGKANEKEW

SEQ ID NO: 2110222 - protein, 20 aa, Staphylococcus
THRYGIIDPLQKFGRKYEVN

SEQ ID NO: 2110223 - protein, 31 aa, Staphylococcus
THTGPLGFQIPDVRQLFAMDITSRIIGRDKN

SEQ ID NO: 2110224 - protein, 34 aa, Staphylococcus
TIARGQQFEFGDLKQYFALSNGADLPDGTLFNIT

SEQ ID NO: 2110225 - protein, 18 aa, Staphylococcus
TIDNINVDVLKKPQAKEE

SEQ ID NO: 2110226 - protein, 25 aa, Staphylococcus
TIDQQGNYHYTWQGNWSPDKVNHNN

SEQ ID NO: 2110227 - protein, 24 aa, Staphylococcus
TIDQQGNYHYTWQGNWSPNQAQQG

SEQ ID NO: 2110228 - protein, 17 aa, Staphylococcus
TIERLPLQWRSFFTNGE

SEQ ID NO: 2110229 - protein, 21 aa, Staphylococcus
TIFIILLLLAACQNDDNSSNH

SEQ ID NO: 2110230 - protein, 18 aa, Staphylococcus
TIGLAMNSTYYYQKEKDG

SEQ ID NO: 2110231 - protein, 19 aa, Staphylococcus
TIILFIVLLSGCEADDINK

SEQ ID NO: 2110232 - protein, 31 aa, Staphylococcus
TIKDGSYALSRPLFLYVKEKSLKDNDVMREF

SEQ ID NO: 2110233 - protein, 20 aa, Staphylococcus
TILLILAWVNQALALNHISP

SEQ ID NO: 2110234 - protein, 30 aa, Staphylococcus
TILLLVVALGFSVFFAATTTHHSTSDQKDK

SEQ ID NO: 2110235 - protein, 19 aa, Staphylococcus
TILMVLSVSILGACSKERS

SEQ ID NO: 2110236 - protein, 17 aa, Staphylococcus
TILYIHGGAWFQDPLDY

SEQ ID NO: 2110237 - protein, 18 aa, Staphylococcus
TIMYLSELPNYKTKPHLI

SEQ ID NO: 2110238 - protein, 25 aa, Staphylococcus
TINKKKLKLPKGKKPLILSIDDMNY

SEQ ID NO: 2110239 - protein, 29 aa, Staphylococcus
TIQDNSYALSRPLFIYAKEKSLEENKGFQ

SEQ ID NO: 2110240 - protein, 20 aa, Staphylococcus
TIVIFITTLTACGNKTNKDF

SEQ ID NO: 2110241 - protein, 24 aa, Staphylococcus
TIYQNAYPVLKKYKIPATGFVITG

SEQ ID NO: 2110242 - protein, 20 aa, Staphylococcus
TKALWEKIVLPESGGDPNAS

SEQ ID NO: 2110243 - protein, 26 aa, Staphylococcus
TKAMPKEMLPILDKPTIQYIVEEASR

SEQ ID NO: 2110244 - protein, 26 aa, Staphylococcus
TKAMPKEMLPILDKPTIQYIVEEAVA

SEQ ID NO: 2110245 - protein, 23 aa, Staphylococcus
TKEGPYIAISKVGKGKAAFIGDT

SEQ ID NO: 2110246 - protein, 20 aa, Staphylococcus
TKIVDVIDRVLHIDHVESAY

SEQ ID NO: 2110247 - protein, 19 aa, Staphylococcus
TKKAFKPRSKRDLDNTIVA

SEQ ID NO: 2110248 - protein, 26 aa, Staphylococcus
TKKNYYNQAPKRWPSNVPGGDNVRDF

SEQ ID NO: 2110249 - protein, 30 aa, Staphylococcus
TKLLAQQGGYDYFSFEAIRPSNNTQLHVTS

SEQ ID NO: 2110250 - protein, 25 aa, Staphylococcus
TKRRKLFNGYIECTYYQYWGDKKPR

SEQ ID NO: 2110251 - protein, 25 aa, Staphylococcus
TKRRKLFNGYIECTYYQYWGKKPDF

SEQ ID NO: 2110252 - protein, 25 aa, Staphylococcus
TKRRKLFNGYIECTYYQYWGKKPQL

SEQ ID NO: 2110253 - protein, 25 aa, Staphylococcus
TKRRKLFNGYIECTYYQYWGKKPTT

SEQ ID NO: 2110254 - protein, 26 aa, Staphylococcus
TKSATKYHNVFGIAAFDANPLYNGIN

SEQ ID NO: 2110255 - protein, 17 aa, Staphylococcus
TKYFIKLWAGKTAIKDY

SEQ ID NO: 2110256 - protein, 44 aa, Staphylococcus
TLAKNPALKYQFLRLDRPQLLSVDRLNRLLKGKGMLENQGQAFA

SEQ ID NO: 2110257 - protein, 18 aa, Staphylococcus
TLALTLGAAGYAVSGHEA

SEQ ID NO: 2110258 - protein, 18 aa, Staphylococcus
TLAVGLGVTGIAAGNSAD

SEQ ID NO: 2110259 - protein, 19 aa, Staphylococcus
TLCLLSFIIVACDTEDDHD

SEQ ID NO: 2110260 - protein, 34 aa, Staphylococcus
TLEELYNLNLGVTPLIFPGDIIIVSPYETQYQVN

SEQ ID NO: 2110261 - protein, 27 aa, Staphylococcus
TLEETAFLLDLIISIEAPIVITGAMRS

SEQ ID NO: 2110262 - protein, 27 aa, Staphylococcus
TLEQAKFDFLFVSDSLYLDNKTHPDMF

SEQ ID NO: 2110263 - protein, 18 aa, Staphylococcus
TLERFLEDYGITPKQFID

SEQ ID NO: 2110264 - protein, 33 aa, Staphylococcus
TLFMTNGCYIVPKPPNRFLIGATSYFDNYSVGV

SEQ ID NO: 2110265 - protein, 19 aa, Staphylococcus
TLISDFMKDIKPNINHIQE

SEQ ID NO: 2110266 - protein, 17 aa, Staphylococcus
TLISSTVLLTAFSGHQA

SEQ ID NO: 2110267 - protein, 20 aa, Staphylococcus
TLIVLISIVLCACQFSTLSS

SEQ ID NO: 2110268 - protein, 19 aa, Staphylococcus
TLIVLLLTACSSGKYTEKI

SEQ ID NO: 2110269 - protein, 28 aa, Staphylococcus
TLKIDLEKPIPYINQLLALNTFDPQNEK

SEQ ID NO: 2110270 - protein, 26 aa, Staphylococcus
TLKVELTKPIPYINEMFAFGTFMPLN

SEQ ID NO: 2110271 - protein, 23 aa, Staphylococcus
TLLFYLVFMKAVGEVLKYSYQLK

SEQ ID NO: 2110272 - protein, 22 aa, Staphylococcus
TLLIVVLVLSACSNNKSLYSDD

SEQ ID NO: 2110273 - protein, 19 aa, Staphylococcus
TLTAGIGAAYFGTTDHHAD

SEQ ID NO: 2110274 - protein, 17 aa, Staphylococcus
TLTAGLGATLISTSHQA

SEQ ID NO: 2110275 - protein, 32 aa, Staphylococcus
TLTDSEGATHYFYFPQSALIQNYQQDDNNYSP

SEQ ID NO: 2110276 - protein, 19 aa, Staphylococcus
TLTRNAIATPKKKSAQQAE

SEQ ID NO: 2110277 - protein, 17 aa, Staphylococcus
TLTSIAALAGLSGLANA

SEQ ID NO: 2110278 - protein, 21 aa, Staphylococcus
TLVGMRLRRVSPRKVISPLIK

SEQ ID NO: 2110279 - protein, 17 aa, Staphylococcus
TLVTCSLISVTSLQAHA

SEQ ID NO: 2110280 - protein, 19 aa, Staphylococcus
TLVVIAFALAACGQSKSAE

SEQ ID NO: 2110281 - protein, 22 aa, Staphylococcus
TMIDGLPNLNPAQKAALKEQVN

SEQ ID NO: 2110282 - protein, 31 aa, Staphylococcus
TMIEGLKSKKIDIAFISPVSYTLAHDAHAAD

SEQ ID NO: 2110283 - protein, 18 aa, Staphylococcus
TMYAIENNQYEVEDAEQK

SEQ ID NO: 2110284 - protein, 27 aa, Staphylococcus
TNASRTGNPIKLNIGFDIQDGYGNEET

SEQ ID NO: 2110285 - protein, 35 aa, Staphylococcus
TNDSPYPHGQCTWYVYNRMAQFDKYVSGDLGDARN

SEQ ID NO: 2110286 - protein, 26 aa, Staphylococcus
TNEDLSKYMTIRKIAPESAITNIKAN

SEQ ID NO: 2110287 - protein, 21 aa, Staphylococcus
TNLNPNIVYTTYTGAATHTGP

SEQ ID NO: 2110288 - protein, 19 aa, Staphylococcus
TNLSIKHEPLYLKGTDGLK

SEQ ID NO: 2110289 - protein, 28 aa, Staphylococcus
TNNTYRTPLSPIFDATHSSGLPASNFLN

SEQ ID NO: 2110290 - protein, 31 aa, Staphylococcus
TNPGLWVITGHYRNGILLSPIIGELMAEWLK

SEQ ID NO: 2110291 - protein, 22 aa, Staphylococcus
TNQKIYVYNWGEYIDPSLIKKF

SEQ ID NO: 2110292 - protein, 25 aa, Staphylococcus
TNSSKKYYNMFGIGAIDTDAVRGGF

SEQ ID NO: 2110293 - protein, 22 aa, Staphylococcus
TPAYNYLIKEGHFKYLAGVGPN

SEQ ID NO: 2110294 - protein, 31 aa, Staphylococcus
TPKQAEDVVYDWYKNQGFGNRLRNEFNYNPS

SEQ ID NO: 2110295 - protein, 27 aa, Staphylococcus
TPNTLRGINILVLPEANIPFKKREQQA

SEQ ID NO: 2110296 - protein, 24 aa, Staphylococcus
TPRSLVIAEVLKKAGYNVTTTPVQ

SEQ ID NO: 2110297 - protein, 19 aa, Staphylococcus
TPYHYTFVVNNNKGYYYND

SEQ ID NO: 2110298 - protein, 25 aa, Staphylococcus
TQHADVYLMALPTKAMREVATNIDK

SEQ ID NO: 2110299 - protein, 19 aa, Staphylococcus
TQKRYIKDSAKWYKALSLD

SEQ ID NO: 2110300 - protein, 20 aa, Staphylococcus
TQLDLKLKDDIKFQNGKKVT

SEQ ID NO: 2110301 - protein, 22 aa, Staphylococcus
TRATSLFATMPQASDNASSTDD

SEQ ID NO: 2110302 - protein, 21 aa, Staphylococcus
TRITACTWTSKKWPFTTPEGK

SEQ ID NO: 2110303 - protein, 23 aa, Staphylococcus
TSDGQSWSWNYTYVGGADTVATT

SEQ ID NO: 2110304 - protein, 31 aa, Staphylococcus
TSDSPYPHGQCTWYVYNRMAQFDKQISGTLG

SEQ ID NO: 2110305 - protein, 17 aa, Staphylococcus
TSDTRITACTWTSKKWP

SEQ ID NO: 2110306 - protein, 21 aa, Staphylococcus
TSEYIFVATGDFSFARKPFKY

SEQ ID NO: 2110307 - protein, 18 aa, Staphylococcus
TSGFRTHLLLYNHDSKKM

SEQ ID NO: 2110308 - protein, 29 aa, Staphylococcus
TSGMRPASITAYNQAMQALKPDLTQARQN

SEQ ID NO: 2110309 - protein, 28 aa, Staphylococcus
TSGNLYTAGQCTWYVYDRVGGKIGSTWG

SEQ ID NO: 2110310 - protein, 17 aa, Staphylococcus
TSILSLHNISISNLKIL

SEQ ID NO: 2110311 - protein, 22 aa, Staphylococcus
TSLAIARTTYGPGHNAVVVVSD

SEQ ID NO: 2110312 - protein, 27 aa, Staphylococcus
TSLDTARFEFFLSRTFDVAPQNVYAPV

SEQ ID NO: 2110313 - protein, 32 aa, Staphylococcus
TSQYMATSYYNNWLYFYIIASHENQSKTSSVK

SEQ ID NO: 2110314 - protein, 18 aa, Staphylococcus
TTAIGASLLLGACGGGGN

SEQ ID NO: 2110315 - protein, 24 aa, Staphylococcus
TTAIKYHNVFGIGAYDSNPVFDGI

SEQ ID NO: 2110316 - protein, 17 aa, Staphylococcus
TTDILLHHLYQHLLNKV

SEQ ID NO: 2110317 - protein, 30 aa, Staphylococcus
TTFIGVLLILLAIYLFAKPHIDNYLHEKDN

SEQ ID NO: 2110318 - protein, 26 aa, Staphylococcus
TTHGIFEYDILVVALGFESETFGING

SEQ ID NO: 2110319 - protein, 23 aa, Staphylococcus
TTIDTINTIIPNVTKKPTANREI

SEQ ID NO: 2110320 - protein, 17 aa, Staphylococcus
TTLATSDPLGGSIGSLL

SEQ ID NO: 2110321 - protein, 32 aa, Staphylococcus
TTPHQTFMKWFNHDLAFKYFNTMDSTTVATVV

SEQ ID NO: 2110322 - protein, 19 aa, Staphylococcus
TTVITGAVLFTTANVSEAK

SEQ ID NO: 2110323 - protein, 18 aa, Staphylococcus
TTVLAPLGIYSKKVKNIK

SEQ ID NO: 2110324 - protein, 24 aa, Staphylococcus
TTVLASTVLFSVSFASEAKAEEVT

SEQ ID NO: 2110325 - protein, 18 aa, Staphylococcus
TTVLGASFLLGACGGNNG

SEQ ID NO: 2110326 - protein, 17 aa, Staphylococcus
TTVLGASVLLGACGGNG

SEQ ID NO: 2110327 - protein, 27 aa, Staphylococcus
TTVVVIILLLVGLLFGLKVYGNHHPNN

SEQ ID NO: 2110328 - protein, 20 aa, Staphylococcus
TTVYPLKSFAQQIGGKYVHV

SEQ ID NO: 2110329 - protein, 17 aa, Staphylococcus
TTYQKIMSLNGLSNFFI

SEQ ID NO: 2110330 - protein, 24 aa, Staphylococcus
TVDAGFYKSVYNIGDFVWNDTNKN

SEQ ID NO: 2110331 - protein, 27 aa, Staphylococcus
TVGAFSTVIATLIFLGSPQAHASEQLQ

SEQ ID NO: 2110332 - protein, 30 aa, Staphylococcus
TVKKDLYDVVPKHKKWYIAINDKGNAYVHY

SEQ ID NO: 2110333 - protein, 19 aa, Staphylococcus
TVLTLILAACSHSGSDENE

SEQ ID NO: 2110334 - protein, 18 aa, Staphylococcus
TVLYIHGGAWFQDPLPYH

SEQ ID NO: 2110335 - protein, 26 aa, Staphylococcus
TVNGKSGWISKYYLTTPSSSSNSTKP

SEQ ID NO: 2110336 - protein, 31 aa, Staphylococcus
TVPVKHVIPNIRGIELFTVQGQPFPSGKGTN

SEQ ID NO: 2110337 - protein, 27 aa, Staphylococcus
TVRHADAILCYIYKFRSRFAVLAEQVM

SEQ ID NO: 2110338 - protein, 29 aa, Staphylococcus
TVRSREELQQFWHGLADDLVQSEKLTSTK

SEQ ID NO: 2110339 - protein, 26 aa, Staphylococcus
TVRTREELQQFWHGLADDLVQSEKLT

SEQ ID NO: 2110340 - protein, 24 aa, Staphylococcus
TVSIYDVPMHFTGHDWNSAGFNKS

SEQ ID NO: 2110341 - protein, 18 aa, Staphylococcus
TVWTHYAVSHWLGGTDHT

SEQ ID NO: 2110342 - protein, 18 aa, Staphylococcus
TWIADRKLKGLVFQSDND

SEQ ID NO: 2110343 - protein, 33 aa, Staphylococcus
TWSNQAVFFTRQLWNMLILARVITIGAYNRNES

SEQ ID NO: 2110344 - protein, 20 aa, Staphylococcus
TWWAYQRRAQLGKPVSNRWG

SEQ ID NO: 2110345 - protein, 27 aa, Staphylococcus
TYDGEIYHIFYHPLITDAKVAFSGSPQ

SEQ ID NO: 2110346 - protein, 27 aa, Staphylococcus
TYKINPGEVIYTVPWGTSSQKAGSVSG

SEQ ID NO: 2110347 - protein, 32 aa, Staphylococcus
TYRHIMDLNGLHSFLIFPGQTLTVSGTARSSS

SEQ ID NO: 2110348 - protein, 30 aa, Staphylococcus
TYTIDQQGNYHYDWKGNWSPQQAQQGNNSN

SEQ ID NO: 2110349 - protein, 20 aa, Staphylococcus
TYVLLQNTASNTPLGWVNIN

SEQ ID NO: 2110350 - protein, 19 aa, Staphylococcus
TYYAFDRRQQLGRSIGSYW

SEQ ID NO: 2110351 - protein, 17 aa, Staphylococcus
VAAASTLLLAGCTTDKK

SEQ ID NO: 2110352 - protein, 29 aa, Staphylococcus
VAFLFACLFVMFIQMFLVKSAVVQTDDMS

SEQ ID NO: 2110353 - protein, 21 aa, Staphylococcus
VAKAKPEVIFISGRTANQKNL

SEQ ID NO: 2110354 - protein, 19 aa, Staphylococcus
VALEFSFVDALAALNVKPV

SEQ ID NO: 2110355 - protein, 18 aa, Staphylococcus
VALGDWADVIIVAPATAN

SEQ ID NO: 2110356 - protein, 20 aa, Staphylococcus
VALVLVLTVVLSACGQNQDE

SEQ ID NO: 2110357 - protein, 20 aa, Staphylococcus
VATTIAFSTLLGASVTGALV

SEQ ID NO: 2110358 - protein, 22 aa, Staphylococcus
VATTLALSTLFGVGVTSALTDT

SEQ ID NO: 2110359 - protein, 26 aa, Staphylococcus
VDAARKVVIVTYLSFNRVINLDDVKR

SEQ ID NO: 2110360 - protein, 25 aa, Staphylococcus
VDAKTYWFNDPYTLDYMRKDLKEKF

SEQ ID NO: 2110361 - protein, 22 aa, Staphylococcus
VDANLFQHVPYLNAEKKSHGYK

SEQ ID NO: 2110362 - protein, 36 aa, Staphylococcus
VDGVTWYYGQLTNGKYVWIKSTDLSKESIRYVKTGM

SEQ ID NO: 2110363 - protein, 25 aa, Staphylococcus
VDHRPEVGAVFQTPAGYYGHVGIVE

SEQ ID NO: 2110364 - protein, 25 aa, Staphylococcus
VDNRPEVGAIFQTTAGYYGHVGVVE

SEQ ID NO: 2110365 - protein, 21 aa, Staphylococcus
VDPVNVLFKVKPTTPSIDTLS

SEQ ID NO: 2110366 - protein, 18 aa, Staphylococcus
VDTYADRLVIKHNGQVIT

SEQ ID NO: 2110367 - protein, 24 aa, Staphylococcus
VDYQFVNMAFLGDDSIIGSRAGHA

SEQ ID NO: 2110368 - protein, 22 aa, Staphylococcus
VEDKILMKKNPKYWDKKAVKLD

SEQ ID NO: 2110369 - protein, 19 aa, Staphylococcus
VEFEVAYAPPYSRPKDIIN

SEQ ID NO: 2110370 - protein, 18 aa, Staphylococcus
VEILFALSVTLLCLSLTP

SEQ ID NO: 2110371 - protein, 27 aa, Staphylococcus
VEIPEKDFFIACQFHPEFLSRPNRPQP

SEQ ID NO: 2110372 - protein, 19 aa, Staphylococcus
VEIVTTSPRISHWTIQVDA

SEQ ID NO: 2110373 - protein, 23 aa, Staphylococcus
VERLHQHGLLVHPYTANTKLAMQ

SEQ ID NO: 2110374 - protein, 19 aa, Staphylococcus
VFEHGKYVILGYKPLSDND

SEQ ID NO: 2110375 - protein, 18 aa, Staphylococcus
VFGLIDRYDSKKQELIIS

SEQ ID NO: 2110376 - protein, 20 aa, Staphylococcus
VFISILTLSLVACGTSNSGS

SEQ ID NO: 2110377 - protein, 25 aa, Staphylococcus
VFMKWFSHDPAFDYFNKMDSTTVAT

SEQ ID NO: 2110378 - protein, 19 aa, Staphylococcus
VFTVLIAIVLCACQSTSQT

SEQ ID NO: 2110379 - protein, 26 aa, Staphylococcus
VGASSIIVASMLFVGVESAQAAETEP

SEQ ID NO: 2110380 - protein, 26 aa, Staphylococcus
VGASSVVVATLLFMGGSSAQAAEKQQ

SEQ ID NO: 2110381 - protein, 26 aa, Staphylococcus
VGGIFALIGTFWGIKYQITKEKEEKR

SEQ ID NO: 2110382 - protein, 23 aa, Staphylococcus
VGIVPLINNQAYWFITINANEKD

SEQ ID NO: 2110383 - protein, 18 aa, Staphylococcus
VGLWISAIAAGVKVSIAT

SEQ ID NO: 2110384 - protein, 25 aa, Staphylococcus
VGNEAFIRQVLYDNMKLQGNKYSQV

SEQ ID NO: 2110385 - protein, 32 aa, Staphylococcus
VGNETYLHGVINNIWGWIKSTDVKQTPKVNAK

SEQ ID NO: 2110386 - protein, 20 aa, Staphylococcus
VGNIAPGDYLGTVRLRKKEQ

SEQ ID NO: 2110387 - protein, 24 aa, Staphylococcus
VGTASALVASVAFLTVSHSADAAE

SEQ ID NO: 2110388 - protein, 19 aa, Staphylococcus
VGVVSIVTGITIFIGGQQA

SEQ ID NO: 2110389 - protein, 20 aa, Staphylococcus
VHVTPQLHAISEGAHFIKDD

SEQ ID NO: 2110390 - protein, 24 aa, Staphylococcus
VHWLSMIPIVIFIKAPKYILFINV

SEQ ID NO: 2110391 - protein, 25 aa, Staphylococcus
VIAIVVALALVFLIGKFVGQPYTIK

SEQ ID NO: 2110392 - protein, 28 aa, Staphylococcus
VIALVLMLIMSYLTLTTKVNASASVVAV

SEQ ID NO: 2110393 - protein, 19 aa, Staphylococcus
VIATLVLILAGCSSGGNDK

SEQ ID NO: 2110394 - protein, 20 aa, Staphylococcus
VIAYQKYMKSDQASALKFYE

SEQ ID NO: 2110395 - protein, 30 aa, Staphylococcus
VIFALVLSLGFSVFAALTHQNKSSLHKAEH

SEQ ID NO: 2110396 - protein, 24 aa, Staphylococcus
VIFFIAFLCVSGLTLATNLESEAS

SEQ ID NO: 2110397 - protein, 30 aa, Staphylococcus
VIILLVVALGCSVFFAATHSNQSDPNQTQS

SEQ ID NO: 2110398 - protein, 23 aa, Staphylococcus
VIIVILILAFILNQRYMQDRVDT

SEQ ID NO: 2110399 - protein, 28 aa, Staphylococcus
VIKVKAETYWYNDPYSLDFMRKDLKKKL

SEQ ID NO: 2110400 - protein, 28 aa, Staphylococcus
VIKVQAETYWYNDPYTLEFMRKDLKEKL

SEQ ID NO: 2110401 - protein, 17 aa, Staphylococcus
VILAYKPLSDDEEVRYY

SEQ ID NO: 2110402 - protein, 25 aa, Staphylococcus
VILIALSLLVLSGCSLPGLGDGNAK

SEQ ID NO: 2110403 - protein, 25 aa, Staphylococcus
VILIALSLLVLSGCSLPGLGDGNSK

SEQ ID NO: 2110404 - protein, 19 aa, Staphylococcus
VILIATVVLLAACQNKPEN

SEQ ID NO: 2110405 - protein, 22 aa, Staphylococcus
VILLLIVFTFFPKHSKQSDIEK

SEQ ID NO: 2110406 - protein, 30 aa, Staphylococcus
VILLLVVALGFSIFFAATGTKQSNSSDDHK

SEQ ID NO: 2110407 - protein, 17 aa, Staphylococcus
VILMALVMVLAGCQNKP

SEQ ID NO: 2110408 - protein, 20 aa, Staphylococcus
VILPLFALILTACGNDDNKK

SEQ ID NO: 2110409 - protein, 17 aa, Staphylococcus
VIMLLILAGCGNKADRV

SEQ ID NO: 2110410 - protein, 19 aa, Staphylococcus
VINDGYGIDFPKEQLDKVK

SEQ ID NO: 2110411 - protein, 17 aa, Staphylococcus
VISVIATIISTIRDNSH

SEQ ID NO: 2110412 - protein, 17 aa, Staphylococcus
VISVIVTGISAMRDKSH

SEQ ID NO: 2110413 - protein, 17 aa, Staphylococcus
VISVIVTVIGAISDNSH

SEQ ID NO: 2110414 - protein, 24 aa, Staphylococcus
VITSFYRHVDLQAQVPLAWGAHRG

SEQ ID NO: 2110415 - protein, 32 aa, Staphylococcus
VIVLVALLLLFSFVPVGLWISAIAAGVKVGIG

SEQ ID NO: 2110416 - protein, 21 aa, Staphylococcus
VIVTLVIILAGCSNSGSNDSG

SEQ ID NO: 2110417 - protein, 19 aa, Staphylococcus
VKDSKLWQTKDNGFYDLTR

SEQ ID NO: 2110418 - protein, 35 aa, Staphylococcus
VKESSYMVVRTIPKQVFVTSRVTPIPGIDNPNNPK

SEQ ID NO: 2110419 - protein, 24 aa, Staphylococcus
VKGNGSFLIKEQFIKAVKSNNVTF

SEQ ID NO: 2110420 - protein, 19 aa, Staphylococcus
VKKAIVGGAKFIAGSYINQ

SEQ ID NO: 2110421 - protein, 23 aa, Staphylococcus
VKKDQVILELSQKAQERKATLNQ

SEQ ID NO: 2110422 - protein, 30 aa, Staphylococcus
VKQDVQDGGIWRLVKIPDNVNRVKVQFLPN

SEQ ID NO: 2110423 - protein, 18 aa, Staphylococcus
VKQFKFSGLTDAPIDYKA

SEQ ID NO: 2110424 - protein, 20 aa, Staphylococcus
VKSTSGYIYPLASLKDKGVS

SEQ ID NO: 2110425 - protein, 22 aa, Staphylococcus
VLALSVIIFAAACGNNSSLDNN

SEQ ID NO: 2110426 - protein, 23 aa, Staphylococcus
VLARGLREFPIDITAIVTVADNG

SEQ ID NO: 2110427 - protein, 23 aa, Staphylococcus
VLGLLATLALAIVLSACGNGDSG

SEQ ID NO: 2110428 - protein, 19 aa, Staphylococcus
VLGTFIIIMAGCSNSKDNE

SEQ ID NO: 2110429 - protein, 22 aa, Staphylococcus
VLIFATPVQQTIRYLAQLHLFN

SEQ ID NO: 2110430 - protein, 25 aa, Staphylococcus
VLKDDRKFFPPYDGSPLATEKLIKD

SEQ ID NO: 2110431 - protein, 19 aa, Staphylococcus
VLLASTLLLAGCTTDRKEV

SEQ ID NO: 2110432 - protein, 17 aa, Staphylococcus
VLLTSFLLSACTINIER

SEQ ID NO: 2110433 - protein, 19 aa, Staphylococcus
VLLTSSLILEACSGHDDHE

SEQ ID NO: 2110434 - protein, 17 aa, Staphylococcus
VLLTVCMVLTACDSHGD

SEQ ID NO: 2110435 - protein, 17 aa, Staphylococcus
VLPAVVAKSGLLAHPEN

SEQ ID NO: 2110436 - protein, 19 aa, Staphylococcus
VLSLVLVLSACSNGSSSND

SEQ ID NO: 2110437 - protein, 18 aa, Staphylococcus
VLSMLYHMQQEQGLWYVK

SEQ ID NO: 2110438 - protein, 17 aa, Staphylococcus
VLTIAAVLVLTACQNKS

SEQ ID NO: 2110439 - protein, 17 aa, Staphylococcus
VLTLALVLSACSNNSGN

SEQ ID NO: 2110440 - protein, 17 aa, Staphylococcus
VLTTSALLLAACSNGDN

SEQ ID NO: 2110441 - protein, 18 aa, Staphylococcus
VLVLTLVLATACTNPEDT

SEQ ID NO: 2110442 - protein, 19 aa, Staphylococcus
VLVQEKLNFYVVLKSQAQS

SEQ ID NO: 2110443 - protein, 29 aa, Staphylococcus
VLVTTPHQTFMKWFGNDPALDYFKTMPST

SEQ ID NO: 2110444 - protein, 17 aa, Staphylococcus
VMLMSLLVLGGCSNSST

SEQ ID NO: 2110445 - protein, 27 aa, Staphylococcus
VNGKTWYYGKLSNGKYVWIKDTDLKKE

SEQ ID NO: 2110446 - protein, 31 aa, Staphylococcus
VNGNYQIFGLRTYGYNLWANSTTNYAKVEMA

SEQ ID NO: 2110447 - protein, 20 aa, Staphylococcus
VNGVKWYYGQFSDGQFAWIN

SEQ ID NO: 2110448 - protein, 30 aa, Staphylococcus
VNINDPITKYLPWFKTSKPLYLKDFMLHRT

SEQ ID NO: 2110449 - protein, 24 aa, Staphylococcus
VNKVETLLKGQLPFHKSLAVTERD

SEQ ID NO: 2110450 - protein, 26 aa, Staphylococcus
VNQDSATLWYHPHPSPNTAKQVYNGL

SEQ ID NO: 2110451 - protein, 23 aa, Staphylococcus
VNVKGYFVWSLQDMFSWSNGYNK

SEQ ID NO: 2110452 - protein, 40 aa, Staphylococcus
VPAARNIVQPPANNQVALKNLPNFPQSLTTAQNAADSLNG

SEQ ID NO: 2110453 - protein, 17 aa, Staphylococcus
VPASSSFIGKHVLITAG

SEQ ID NO: 2110454 - protein, 21 aa, Staphylococcus
VPLELAFELFKLECKDHNIDL

SEQ ID NO: 2110455 - protein, 25 aa, Staphylococcus
VPVKHVIYNVIASPKYTIQGQDFPN

SEQ ID NO: 2110456 - protein, 19 aa, Staphylococcus
VPVTAGVLLLGGCSSDSTD

SEQ ID NO: 2110457 - protein, 17 aa, Staphylococcus
VPVTASALLLGACGSNA

SEQ ID NO: 2110458 - protein, 18 aa, Staphylococcus
VPVTASALLLGACGSNAT

SEQ ID NO: 2110459 - protein, 24 aa, Staphylococcus
VQFLKDRYYAMKDFPMFDNIEYTE

SEQ ID NO: 2110460 - protein, 22 aa, Staphylococcus
VQKLKRANLLVPLNHHKLPNMR

SEQ ID NO: 2110461 - protein, 23 aa, Staphylococcus
VQLLGNGSAYYAPAAAIYEMIDA

SEQ ID NO: 2110462 - protein, 25 aa, Staphylococcus
VQNIAPRSYLQFQKLMFEHQQDEKK

SEQ ID NO: 2110463 - protein, 24 aa, Staphylococcus
VQPGTKLYHTPWGSELQSIGSVTG

SEQ ID NO: 2110464 - protein, 26 aa, Staphylococcus
VQQNKKLHAWLKLSTLIDDVKVKDTY

SEQ ID NO: 2110465 - protein, 24 aa, Staphylococcus
VQRNTFMPHLDYDMSFMIQEYIED

SEQ ID NO: 2110466 - protein, 28 aa, Staphylococcus
VQSGAYDFTFNYEGTTYHFASDGTYFEW

SEQ ID NO: 2110467 - protein, 18 aa, Staphylococcus
VRGLQYHKVGPDTTLKHV

SEQ ID NO: 2110468 - protein, 18 aa, Staphylococcus
VRHNNEVLAKLIYDIALD

SEQ ID NO: 2110469 - protein, 25 aa, Staphylococcus
VRHNTKILSGMIYELALELTSTIQF

SEQ ID NO: 2110470 - protein, 26 aa, Staphylococcus
VRHNTKVLANLIYDLALELTSTIQFK

SEQ ID NO: 2110471 - protein, 25 aa, Staphylococcus
VRHNTKVLSTLIYEVALELISTIQF

SEQ ID NO: 2110472 - protein, 25 aa, Staphylococcus
VRHNTTILAKMIYDLALDLTSTIPF

SEQ ID NO: 2110473 - protein, 17 aa, Staphylococcus
VSAIVTSLTLGACGNSN

SEQ ID NO: 2110474 - protein, 17 aa, Staphylococcus
VSAQHPFNQAYTPATKD

SEQ ID NO: 2110475 - protein, 25 aa, Staphylococcus
VSDGSIYPVLLRLSKKGYVHTTTRK

SEQ ID NO: 2110476 - protein, 36 aa, Staphylococcus
VSIATLVGMRLRRVSPRKVIGPLIKAHKAGLNLTTN

SEQ ID NO: 2110477 - protein, 20 aa, Staphylococcus
VSKAIIGGAKFIGNSYVKAG

SEQ ID NO: 2110478 - protein, 22 aa, Staphylococcus
VSKLIQDLFMNDYLRVYTNDDL

SEQ ID NO: 2110479 - protein, 27 aa, Staphylococcus
VSLGQRVVSYPIHFVTGAIGNIFNNGG

SEQ ID NO: 2110480 - protein, 19 aa, Staphylococcus
VSLILTSVIFAPTTYATNP

SEQ ID NO: 2110481 - protein, 19 aa, Staphylococcus
VSMKKLVKQLKRNGLKEKS

SEQ ID NO: 2110482 - protein, 30 aa, Staphylococcus
VSQLTPQEKVALALYAPKSADFTVTPSELL

SEQ ID NO: 2110483 - protein, 25 aa, Staphylococcus
VSSILASSLFTAIPMTLAQTNPTSK

SEQ ID NO: 2110484 - protein, 19 aa, Staphylococcus
VSSITALTLSGLCTSSFIE

SEQ ID NO: 2110485 - protein, 35 aa, Staphylococcus
VSSSIYPTAQAFKKVGFLNPATSKGVWQVRPVQNG

SEQ ID NO: 2110486 - protein, 25 aa, Staphylococcus
VTAGTYWYNDPYTLDFMRKDLKEKL

SEQ ID NO: 2110487 - protein, 23 aa, Staphylococcus
VTGEGALAGIYKAYEEKGNDLIL

SEQ ID NO: 2110488 - protein, 20 aa, Staphylococcus
VTHILSLHNISISNLKILEV

SEQ ID NO: 2110489 - protein, 23 aa, Staphylococcus
VTKGQMMESFDKALFKLKEGEVT

SEQ ID NO: 2110490 - protein, 17 aa, Staphylococcus
VTLLASGMILAGCSDNK

SEQ ID NO: 2110491 - protein, 25 aa, Staphylococcus
VTNHINAWKPYRHDVLFSGVFKSQK

SEQ ID NO: 2110492 - protein, 22 aa, Staphylococcus
VTPIKYDYIIHNQKGSYYIDPL

SEQ ID NO: 2110493 - protein, 17 aa, Staphylococcus
VTSTHYDDPTLHQMVEG

SEQ ID NO: 2110494 - protein, 22 aa, Staphylococcus
VTYILSLHNISISNLKILEVRE

SEQ ID NO: 2110495 - protein, 17 aa, Staphylococcus
VVATSAVLLAGCTTDKK

SEQ ID NO: 2110496 - protein, 19 aa, Staphylococcus
VVGLMFLLVACSNGGSEDK

SEQ ID NO: 2110497 - protein, 26 aa, Staphylococcus
VVGVNVGGVFWGIQAALEQFEKLGHG

SEQ ID NO: 2110498 - protein, 23 aa, Staphylococcus
VVGYFVARNLLHQKQLQARQTAD

SEQ ID NO: 2110499 - protein, 19 aa, Staphylococcus
VVIALSAITLAACSKEQTK

SEQ ID NO: 2110500 - protein, 31 aa, Staphylococcus
VVILLVAALSFSIYAAMTHESKYSNTDSNKD

SEQ ID NO: 2110501 - protein, 20 aa, Staphylococcus
VVIQEKLNYYIVLQNNHLTV

SEQ ID NO: 2110502 - protein, 27 aa, Staphylococcus
VVKGSNGQWTIANKPSYISVDSATGKV

SEQ ID NO: 2110503 - protein, 29 aa, Staphylococcus
VVKVKAETYWYNDPYTLDFMRKDLKKKLM

SEQ ID NO: 2110504 - protein, 29 aa, Staphylococcus
VVLYIHGGAWFQNPLKYHFDFIDSLAGEL

SEQ ID NO: 2110505 - protein, 26 aa, Staphylococcus
VVSDLLNVALFFESNLHTLPPHFELK

SEQ ID NO: 2110506 - protein, 24 aa, Staphylococcus
VVSDLLNVALFFESNTHTLPPHFE

SEQ ID NO: 2110507 - protein, 25 aa, Staphylococcus
VVSDLLNVSLFFESNLHTLPPHFEL

SEQ ID NO: 2110508 - protein, 17 aa, Staphylococcus
VVTTTTLLLAGCSSHTK

SEQ ID NO: 2110509 - protein, 19 aa, Staphylococcus
VYDFAKSQGNKFSRADLGL

SEQ ID NO: 2110510 - protein, 28 aa, Staphylococcus
VYNDGKLIIISYPLYKGNNKLFYAAYEY

SEQ ID NO: 2110511 - protein, 23 aa, Staphylococcus
VYNGPFKVINWQVEDKIQLVKND

SEQ ID NO: 2110512 - protein, 21 aa, Staphylococcus
VYNVELITTTPKISHWNIKVD

SEQ ID NO: 2110513 - protein, 17 aa, Staphylococcus
VYPYLKNGDLDDVMKHK

SEQ ID NO: 2110514 - protein, 19 aa, Staphylococcus
VYQGDATRLQFVVKKGYVS

SEQ ID NO: 2110515 - protein, 22 aa, Staphylococcus
VYSQFIEAGGTKALWDNIVMPE

SEQ ID NO: 2110516 - protein, 18 aa, Staphylococcus
VYTTMRHLEKQDALIQLS

SEQ ID NO: 2110517 - protein, 17 aa, Staphylococcus
VYVLPNTGGTKAYDDIY

SEQ ID NO: 2110518 - protein, 17 aa, Staphylococcus
VYVYHGDQIKLQFKIEN

SEQ ID NO: 2110519 - protein, 18 aa, Staphylococcus
WAYQRRAQLGKPVSNRWG

SEQ ID NO: 2110520 - protein, 52 aa, Staphylococcus
WDALTKPNAAQILNAKYDVFYQGQPFATSQTVRFIIRNVQPTAPQISESKQG

SEQ ID NO: 2110521 - protein, 17 aa, Staphylococcus
WDHADLIGLDLPDFKRT

SEQ ID NO: 2110522 - protein, 26 aa, Staphylococcus
WDKKHQIFKIIKTLHLRKTIIAIPHH

SEQ ID NO: 2110523 - protein, 21 aa, Staphylococcus
WFIAFVLSSVCLIGLSSMHNT

SEQ ID NO: 2110524 - protein, 20 aa, Staphylococcus
WGNAKYWYSKAKKAGYRVGK

SEQ ID NO: 2110525 - protein, 19 aa, Staphylococcus
WGRPDMALFKFTKAIVNDE

SEQ ID NO: 2110526 - protein, 19 aa, Staphylococcus
WIARNAHRYGFIIRYPKGK

SEQ ID NO: 2110527 - protein, 22 aa, Staphylococcus
WITLICVLVIGSLVALDLKYHY

SEQ ID NO: 2110528 - protein, 25 aa, Staphylococcus
WKEYDYIFLTIGTLSYHDPYQLKGI

SEQ ID NO: 2110529 - protein, 18 aa, Staphylococcus
WLLTLLYLAIFIALYLIY

SEQ ID NO: 2110530 - protein, 18 aa, Staphylococcus
WLSLENGLKYVKTIQHAV

SEQ ID NO: 2110531 - protein, 19 aa, Staphylococcus
WNPKAKQLTYGTGTAIGKH

SEQ ID NO: 2110532 - protein, 44 aa, Staphylococcus
WTIKFNQSHRMHEHMVFWFGLPDPQVPVGPVRFTIENPDHSNKI

SEQ ID NO: 2110533 - protein, 25 aa, Staphylococcus
YAATNLQYYGLVPDSAEYDGVGTVW

SEQ ID NO: 2110534 - protein, 21 aa, Staphylococcus
YAATQLQYYGLKPDSAENDGN

SEQ ID NO: 2110535 - protein, 20 aa, Staphylococcus
YACIDKQIPIVIVSRSFNGI

SEQ ID NO: 2110536 - protein, 26 aa, Staphylococcus
YADSKNPNLAIVYKVKNKSSEKITAS

SEQ ID NO: 2110537 - protein, 17 aa, Staphylococcus
YAFNRRAELGKPIGSLW

SEQ ID NO: 2110538 - protein, 25 aa, Staphylococcus
YAHVYAIGDLVPGYQLAHTASAHGK

SEQ ID NO: 2110539 - protein, 21 aa, Staphylococcus
YAKAYKKALGKEKSLFSFINK

SEQ ID NO: 2110540 - protein, 21 aa, Staphylococcus
YAKERYGSIGAAIRFRESNGW

SEQ ID NO: 2110541 - protein, 18 aa, Staphylococcus
YAKERYGSIGNAISFREA

SEQ ID NO: 2110542 - protein, 20 aa, Staphylococcus
YARENNVPYFGICLGMQLAT

SEQ ID NO: 2110543 - protein, 27 aa, Staphylococcus
YATRNDLAFIYPKGQDKPIILAIYSKQ

SEQ ID NO: 2110544 - protein, 23 aa, Staphylococcus
YAYEPWHLRYVGPQLAKTINEKN

SEQ ID NO: 2110545 - protein, 33 aa, Staphylococcus
YCFPDHKWLYGPEGLGFLFVRKNIQKDLDIIFS

SEQ ID NO: 2110546 - protein, 24 aa, Staphylococcus
YDAKGTVWTHYAISRYLGGTDHAD

SEQ ID NO: 2110547 - protein, 19 aa, Staphylococcus
YDDPTLHQMVEGRSATISI

SEQ ID NO: 2110548 - protein, 22 aa, Staphylococcus
YDGYWLAAYQEQEPNREKVLWQ

SEQ ID NO: 2110549 - protein, 26 aa, Staphylococcus
YDKQYGYIHRLFVKPHTYVKKNSPLL

SEQ ID NO: 2110550 - protein, 18 aa, Staphylococcus
YDSQLPIYHIPWVTQMSQ

SEQ ID NO: 2110551 - protein, 23 aa, Staphylococcus
YDSYATLGLLLSIKSLTPKLHRN

SEQ ID NO: 2110552 - protein, 31 aa, Staphylococcus
YEGFTYHFESDGTNWSWNYAQSGQASQQQDV

SEQ ID NO: 2110553 - protein, 19 aa, Staphylococcus
YEGKWQSVYPYLKNGDLDD

SEQ ID NO: 2110554 - protein, 17 aa, Staphylococcus
YEKFLLNNDIHLVGGHP

SEQ ID NO: 2110555 - protein, 17 aa, Staphylococcus
YELFKPELEKKDKKLSS

SEQ ID NO: 2110556 - protein, 17 aa, Staphylococcus
YELLNKLTHKDKLFVSN

SEQ ID NO: 2110557 - protein, 24 aa, Staphylococcus
YENGKYVVLAYKPLSNNEEVHYYT

SEQ ID NO: 2110558 - protein, 19 aa, Staphylococcus
YFKINKRVDIMLTNGLFRE

SEQ ID NO: 2110559 - protein, 24 aa, Staphylococcus
YFLTTTLVLPTFTTSIAHAEDTNE

SEQ ID NO: 2110560 - protein, 31 aa, Staphylococcus
YFSNHNYSYAELYDLINEKYLIKTGQVAPWG

SEQ ID NO: 2110561 - protein, 28 aa, Staphylococcus
YGFAFNSIKPMQIGLVYDALKNQKLDVA

SEQ ID NO: 2110562 - protein, 18 aa, Staphylococcus
YGHVAFVEKVNADGSIII

SEQ ID NO: 2110563 - protein, 18 aa, Staphylococcus
YGKALKKVGPPKPSKKVK

SEQ ID NO: 2110564 - protein, 19 aa, Staphylococcus
YGMSIARLKSLNGLKSNLI

SEQ ID NO: 2110565 - protein, 28 aa, Staphylococcus
YGNEETLKSVYLYVKPELQNNIGFYTNN

SEQ ID NO: 2110566 - protein, 27 aa, Staphylococcus
YGPHRGPIHFNLPFREPLTPNLECTEY

SEQ ID NO: 2110567 - protein, 17 aa, Staphylococcus
YGSLVPLTKLDDSLLRK

SEQ ID NO: 2110568 - protein, 27 aa, Staphylococcus
YGTVNNLTGWVSLSKLTAPSTTPSKPS

SEQ ID NO: 2110569 - protein, 23 aa, Staphylococcus
YGVADHTFVPHFTIAQGLTSQEF

SEQ ID NO: 2110570 - protein, 18 aa, Staphylococcus
YGVNYAALRYFNVAGAKE

SEQ ID NO: 2110571 - protein, 17 aa, Staphylococcus
YGWVKQGETVYNTVKSP

SEQ ID NO: 2110572 - protein, 18 aa, Staphylococcus
YHYRKWLTKNDEKIEKGE

SEQ ID NO: 2110573 - protein, 23 aa, Staphylococcus
YIFSSSLLISTLPFNTVDAEVSE

SEQ ID NO: 2110574 - protein, 27 aa, Staphylococcus
YIHGGAWFQDPLPYHFEFIDLLAESLN

SEQ ID NO: 2110575 - protein, 24 aa, Staphylococcus
YIYANNHLYPIPGGSIMGIPTDVK

SEQ ID NO: 2110576 - protein, 22 aa, Staphylococcus
YKDMNKAFKKYSDTMNKVNKEK

SEQ ID NO: 2110577 - protein, 26 aa, Staphylococcus
YKDPTNRIIKYFKALNSTIANVDEDI

SEQ ID NO: 2110578 - protein, 19 aa, Staphylococcus
YKEIVNQIVFTNGKTYTDS

SEQ ID NO: 2110579 - protein, 23 aa, Staphylococcus
YKEQKKLQAYQKQLLMDKVKVSD

SEQ ID NO: 2110580 - protein, 18 aa, Staphylococcus
YKFTLKKGVKWQNGDPLT

SEQ ID NO: 2110581 - protein, 18 aa, Staphylococcus
YKGEQVNFTLDITDGANG

SEQ ID NO: 2110582 - protein, 24 aa, Staphylococcus
YKGNWQSVYPYLKDGTLDEVMEHK

SEQ ID NO: 2110583 - protein, 19 aa, Staphylococcus
YKMINPKLNVPLVKSYMDM

SEQ ID NO: 2110584 - protein, 18 aa, Staphylococcus
YKQFIAAGGTEELWEKIV

SEQ ID NO: 2110585 - protein, 24 aa, Staphylococcus
YKQQQPILFTAMDSSWFSKELGVK

SEQ ID NO: 2110586 - protein, 20 aa, Staphylococcus
YLFIILAVILAACSTNSDKS

SEQ ID NO: 2110587 - protein, 23 aa, Staphylococcus
YLGSNIVKFFDYSFASVGIKPNE

SEQ ID NO: 2110588 - protein, 33 aa, Staphylococcus
YLGTVRLRKKEQPFEIRVKPLPPHIDTTVEQLR

SEQ ID NO: 2110589 - protein, 17 aa, Staphylococcus
YLIKQGKVAPWGTTSST

SEQ ID NO: 2110590 - protein, 18 aa, Staphylococcus
YLLIISILNGLYKKRKIK

SEQ ID NO: 2110591 - protein, 19 aa, Staphylococcus
YLLSTTLIVPTFTSDIAHA

SEQ ID NO: 2110592 - protein, 26 aa, Staphylococcus
YLLSTTLVFPTFTTPTAVAKDNTDDM

SEQ ID NO: 2110593 - protein, 25 aa, Staphylococcus
YLLTTTLIVPSFSTAPIANAADDHS

SEQ ID NO: 2110594 - protein, 23 aa, Staphylococcus
YLLTTTLVLPTFTSSVAQAEETT

SEQ ID NO: 2110595 - protein, 20 aa, Staphylococcus
YLPSGTNFDWAPGSGQPLSN

SEQ ID NO: 2110596 - protein, 18 aa, Staphylococcus
YLPWFKTDKEITIKDLML

SEQ ID NO: 2110597 - protein, 17 aa, Staphylococcus
YMTSFNQLSYHFKTSMQ

SEQ ID NO: 2110598 - protein, 22 aa, Staphylococcus
YNYYNKHQCTWWAFKRRAQVGK

SEQ ID NO: 2110599 - protein, 19 aa, Staphylococcus
YQFNEKQLRFLENNGYITE

SEQ ID NO: 2110600 - protein, 19 aa, Staphylococcus
YQKAHGGTISPLFQGNHDN

SEQ ID NO: 2110601 - protein, 27 aa, Staphylococcus
YQKEIAKVWLAGLPDYQNKNVPNGFEI

SEQ ID NO: 2110602 - protein, 18 aa, Staphylococcus
YQMVNVAFLGKDSIIGSR

SEQ ID NO: 2110603 - protein, 25 aa, Staphylococcus
YQQQQPILFTSMEPNWFSKELDVKM

SEQ ID NO: 2110604 - protein, 23 aa, Staphylococcus
YQYEPWHLRYLGKEKAKEVKDSG

SEQ ID NO: 2110605 - protein, 29 aa, Staphylococcus
YRHVDLNAHVPLAWGAHRGASVIAEQLAG

SEQ ID NO: 2110606 - protein, 25 aa, Staphylococcus
YRLTKKALLGDKSFYLITDYNKNTN

SEQ ID NO: 2110607 - protein, 20 aa, Staphylococcus
YRQDQAPLTLKLKVVDVNQP

SEQ ID NO: 2110608 - protein, 20 aa, Staphylococcus
YRSFLFEQYLRLTRVRKPFE

SEQ ID NO: 2110609 - protein, 19 aa, Staphylococcus
YSQLAHHNFFFSKDSKKNY

SEQ ID NO: 2110610 - protein, 27 aa, Staphylococcus
YSVKPGTKFYTVPWGTPSQVAGTVSGS

SEQ ID NO: 2110611 - protein, 31 aa, Staphylococcus
YSYDELYDLINEKYLIKMGKVAPWGTTSTNN

SEQ ID NO: 2110612 - protein, 21 aa, Staphylococcus
YSYSYTYTIDQQGNYHYEWQG

SEQ ID NO: 2110613 - protein, 27 aa, Staphylococcus
YTDKQKIAMLLFQPGLDDKFITADDVL

SEQ ID NO: 2110614 - protein, 26 aa, Staphylococcus
YTFTSNGNTWSWNYTYTGGADTAQST

SEQ ID NO: 2110615 - protein, 27 aa, Staphylococcus
YTFTSNGQNFTWKYIYTGEADSQPSTQ

SEQ ID NO: 2110616 - protein, 17 aa, Staphylococcus
YTIDQQGNYHYEWQGNW

SEQ ID NO: 2110617 - protein, 23 aa, Staphylococcus
YTIGPDLRKYFSLSNGQDIPNNS

SEQ ID NO: 2110618 - protein, 18 aa, Staphylococcus
YTKEKMSQYATPLKLASN

SEQ ID NO: 2110619 - protein, 26 aa, Staphylococcus
YTKSGGEFVLNHTFYNALKAGNVTFN

SEQ ID NO: 2110620 - protein, 23 aa, Staphylococcus
YTSTEWNQLLGRLNFNLEKTSKG

SEQ ID NO: 2110621 - protein, 19 aa, Staphylococcus
YTYKAKATGLKPNTKYYYK

SEQ ID NO: 2110622 - protein, 19 aa, Staphylococcus
YVDYVKRVKDSKLWQTKDN

SEQ ID NO: 2110623 - protein, 17 aa, Staphylococcus
YVFNRRAQARSPISTYW

SEQ ID NO: 2110624 - protein, 23 aa, Staphylococcus
YVGQIFHQLGFKEALNKGTSKDL

SEQ ID NO: 2110625 - protein, 31 aa, Staphylococcus
YVIKGQMVDKFDKALFKLKEGQISDIVKTEY

SEQ ID NO: 2110626 - protein, 18 aa, Staphylococcus
YVILGYKPLSDNDEIHYY

SEQ ID NO: 2110627 - protein, 19 aa, Staphylococcus
YVILPVNGKWYDHLGIHRS

SEQ ID NO: 2110628 - protein, 17 aa, Staphylococcus
YVLTPDIFDYLATQGEG

SEQ ID NO: 2110629 - protein, 20 aa, Staphylococcus
YVVPKEGSNLWFDNMVMPKT

SEQ ID NO: 2110630 - protein, 24 aa, Staphylococcus
YYAKQVYDYYKDTFGRESYDDRGS

SEQ ID NO: 2110631 - protein, 22 aa, Staphylococcus
YYEIPAYESAGAGGLKIIKVFK

SEQ ID NO: 2110632 - protein, 17 aa, Staphylococcus
YYLGMINNMMRVEELDG

SEQ ID NO: 2110633 - protein, 17 aa, Staphylococcus
YYNYTGYTANDSSFFVD

SEQ ID NO: 2110634 - protein, 17 aa, Staphylococcus
YYPVVLTTKAKYPIGTH

SEQ ID NO: 2110635 - protein, 19 aa, Staphylococcus
YYQDIAKSIKQYDVIESDV

SEQ ID NO: 2110636 - protein, 18 aa, Staphylococcus
YYRNGHPLDYRLTFQSIE

SEQ ID NO: 2110637 - protein, 28 aa, Staphylococcus
NQAVFFTRQLWNMLVLARVITIGAYNRN

SEQ ID NO: 2110638 - protein, 17 aa, Staphylococcus
CVITVTALSQLISTPLS

SEQ ID NO: 2110639 - protein, 19 aa, Staphylococcus
FLGLLATLALAIVLSACGN

SEQ ID NO: 2110640 - protein, 18 aa, Staphylococcus
ILLGIILGVVVGYVVARN

SEQ ID NO: 2110641 - protein, 19 aa, Staphylococcus
ILLLVLLLVFVTACGKDED

SEQ ID NO: 2110642 - protein, 17 aa, Staphylococcus
LILMGVPGSYLVATDKS

SEQ ID NO: 2110643 - protein, 27 aa, Staphylococcus
TRLVIVMLILCGLLFPLTVTAVGQIIF

SEQ ID NO: 2110644 - protein, 19 aa, Staphylococcus
VILIALSLLVLSGCSLPGL

SEQ ID NO: 2110645 - protein, 18 aa, Staphylococcus
AELAMPRPYVFVSPKDFK

SEQ ID NO: 2110646 - protein, 22 aa, Staphylococcus
AGAYRDWKPGQKIHLIGHSMGG

SEQ ID NO: 2110647 - protein, 26 aa, Staphylococcus
AIGTSSILVASLFFIGSGGADAAEAS

SEQ ID NO: 2110648 - protein, 18 aa, Staphylococcus
AILFTIIVLLSACGKNST

SEQ ID NO: 2110649 - protein, 18 aa, Staphylococcus
AILSSALVLTACGQSEDH

SEQ ID NO: 2110650 - protein, 20 aa, Staphylococcus
AILTIIFIYGCSKQPSSIKA

SEQ ID NO: 2110651 - protein, 18 aa, Staphylococcus
AIVLLSLLLVLSACGSKK

SEQ ID NO: 2110652 - protein, 32 aa, Staphylococcus
AKFLPNKILNIKYKLRPVNIPTPRQVTVNQSI

SEQ ID NO: 2110653 - protein, 19 aa, Staphylococcus
ALSRPLFIYAKEKSLKDNK

SEQ ID NO: 2110654 - protein, 17 aa, Staphylococcus
AMLVLCLVLAGCSNSSN

SEQ ID NO: 2110655 - protein, 20 aa, Staphylococcus
ANYYTWGQCTYYVYDKVGGS

SEQ ID NO: 2110656 - protein, 23 aa, Staphylococcus
AQDARWLTKHPKLQEYGQYHGGG

SEQ ID NO: 2110657 - protein, 18 aa, Staphylococcus
ARQHLVPDKAPLEAAKQA

SEQ ID NO: 2110658 - protein, 17 aa, Staphylococcus
ATIILIISILTLSSCSQ

SEQ ID NO: 2110659 - protein, 29 aa, Staphylococcus
ATPVQVPVSLYVYQFDFSPNAYTTTLGTT

SEQ ID NO: 2110660 - protein, 20 aa, Staphylococcus
AVFNVLIKPLKDKYSVMTTA

SEQ ID NO: 2110661 - protein, 25 aa, Staphylococcus
AVILSLCLAFLLFIATNQNALAKVH

SEQ ID NO: 2110662 - protein, 17 aa, Staphylococcus
AVLSHYWGGDKMNIRQD

SEQ ID NO: 2110663 - protein, 17 aa, Staphylococcus
AVLVLSVVALSACSKEQ

SEQ ID NO: 2110664 - protein, 17 aa, Staphylococcus
CLLSTSLLIPSFSINDV

SEQ ID NO: 2110665 - protein, 21 aa, Staphylococcus
DATQKYQFLRLDKAQNLSTSS

SEQ ID NO: 2110666 - protein, 26 aa, Staphylococcus
DDEYKYQFLLLDQPQYLPVSALNKLL

SEQ ID NO: 2110667 - protein, 23 aa, Staphylococcus
DGGIWRLVKIPDNVNRVKVQFLP

SEQ ID NO: 2110668 - protein, 21 aa, Staphylococcus
DGKEHYYEFKKDNGVLVVTAD

SEQ ID NO: 2110669 - protein, 17 aa, Staphylococcus
DGMALLFRHFFATSLHK

SEQ ID NO: 2110670 - protein, 19 aa, Staphylococcus
DIPVTIYPVARAKAPTREV

SEQ ID NO: 2110671 - protein, 23 aa, Staphylococcus
DKQKIAMLLFQPGLDDKFITADD

SEQ ID NO: 2110672 - protein, 19 aa, Staphylococcus
DLRFPELLRYPARSGATIA

SEQ ID NO: 2110673 - protein, 23 aa, Staphylococcus
DPITKYLPWFKTSKPLYLKDFML

SEQ ID NO: 2110674 - protein, 18 aa, Staphylococcus
DPKLWYFASGSTTTTVKQ

SEQ ID NO: 2110675 - protein, 18 aa, Staphylococcus
DRAMVWGFNWKLGPFQLW

SEQ ID NO: 2110676 - protein, 17 aa, Staphylococcus
DSKNPNLAIVYKVKNKS

SEQ ID NO: 2110677 - protein, 24 aa, Staphylococcus
EDGNYYFPVLQGEHIKYVLTVTPK

SEQ ID NO: 2110678 - protein, 24 aa, Staphylococcus
EDNWSPLMYQFADALHMAISKTTD

SEQ ID NO: 2110679 - protein, 24 aa, Staphylococcus
EDVLYDVVFLFPKSMQLKEVLDYI

SEQ ID NO: 2110680 - protein, 17 aa, Staphylococcus
EFPAFKNKNLRLAIAQS

SEQ ID NO: 2110681 - protein, 18 aa, Staphylococcus
EKDFFIACQFHPEFLSRP

SEQ ID NO: 2110682 - protein, 23 aa, Staphylococcus
ELNPGLTNLILPGDILAVSDKGA

SEQ ID NO: 2110683 - protein, 28 aa, Staphylococcus
EQAINKYPVIFVHGFMGFVGDIKPDLYP

SEQ ID NO: 2110684 - protein, 18 aa, Staphylococcus
ETTAVFNVLIKPLKDKYS

SEQ ID NO: 2110685 - protein, 18 aa, Staphylococcus
FACILIPALTGCEKDFKD

SEQ ID NO: 2110686 - protein, 17 aa, Staphylococcus
FALLVLSVSILGACTQS

SEQ ID NO: 2110687 - protein, 24 aa, Staphylococcus
FASDGTYFEWQYYPSNGAADDTTM

SEQ ID NO: 2110688 - protein, 20 aa, Staphylococcus
FDLIYYRSYTNGLMPYNFLN

SEQ ID NO: 2110689 - protein, 18 aa, Staphylococcus
FFIACQFHPEFLSRPNRP

SEQ ID NO: 2110690 - protein, 20 aa, Staphylococcus
FFIKMNEKEFPAFKNKNLRL

SEQ ID NO: 2110691 - protein, 19 aa, Staphylococcus
FHIYPIFPLPERQKFFTQL

SEQ ID NO: 2110692 - protein, 17 aa, Staphylococcus
FIACQFHPEFLSRPNRP

SEQ ID NO: 2110693 - protein, 21 aa, Staphylococcus
FIFGFALVVICGIGLYAQGEK

SEQ ID NO: 2110694 - protein, 20 aa, Staphylococcus
FIFGLILSIGFGIGVFSEWK

SEQ ID NO: 2110695 - protein, 25 aa, Staphylococcus
FIGVLLILLAIYLFAKPHIDNYLHE

SEQ ID NO: 2110696 - protein, 23 aa, Staphylococcus
FKNQIYGIDRLYAFIGKGNASYT

SEQ ID NO: 2110697 - protein, 17 aa, Staphylococcus
FKRVFSLIAILAIVFST

SEQ ID NO: 2110698 - protein, 19 aa, Staphylococcus
FLLFLCLHNLLFPDTTKES

SEQ ID NO: 2110699 - protein, 21 aa, Staphylococcus
FLMTKFLLPLMMDEGGSIINT

SEQ ID NO: 2110700 - protein, 21 aa, Staphylococcus
FLVTKFLLPLMMEQGGSIINT

SEQ ID NO: 2110701 - protein, 33 aa, Staphylococcus
FNQSHRMHEHMVFWFGLPDPQVPVGPVRFTIEN

SEQ ID NO: 2110702 - protein, 21 aa, Staphylococcus
FPSMIAITLFGAAFTSQHAHA

SEQ ID NO: 2110703 - protein, 21 aa, Staphylococcus
FPSMIALTLFGAAFTTHHAEA

SEQ ID NO: 2110704 - protein, 30 aa, Staphylococcus
FSIRKFNIGIFSALITTVTFLAHPSQASAS

SEQ ID NO: 2110705 - protein, 21 aa, Staphylococcus
FSLILLLTIISSGFGFYLYRS

SEQ ID NO: 2110706 - protein, 25 aa, Staphylococcus
FSTVIATLVFLGFNASHVQADELSV

SEQ ID NO: 2110707 - protein, 20 aa, Staphylococcus
FTIGLLMFIGFGLATYFEMK

SEQ ID NO: 2110708 - protein, 23 aa, Staphylococcus
FTIGYGQYIRPGGFSLPSSDTEL

SEQ ID NO: 2110709 - protein, 19 aa, Staphylococcus
FVSIIAVLLLAGCQSQEDK

SEQ ID NO: 2110710 - protein, 20 aa, Staphylococcus
FVSILLMVFILEGCSKQKDS

SEQ ID NO: 2110711 - protein, 23 aa, Staphylococcus
GAFSTVIATLIFLGSPQAHASEQ

SEQ ID NO: 2110712 - protein, 17 aa, Staphylococcus
GAITATTLLAGCDLGDM

SEQ ID NO: 2110713 - protein, 24 aa, Staphylococcus
GASSILIGSLLFLGVGTAQAAEED

SEQ ID NO: 2110714 - protein, 18 aa, Staphylococcus
GAYRDWKPGQKIHLIGHS

SEQ ID NO: 2110715 - protein, 24 aa, Staphylococcus
GEDAFTLYPNYWGGGKYNIKSELT

SEQ ID NO: 2110716 - protein, 24 aa, Staphylococcus
GEGQSLPAMWRTAGGIDSSRASNF

SEQ ID NO: 2110717 - protein, 17 aa, Staphylococcus
GIFEYDILVVALGFESE

SEQ ID NO: 2110718 - protein, 23 aa, Staphylococcus
GIICAVLLYFSYVGLGASSDKII

SEQ ID NO: 2110719 - protein, 18 aa, Staphylococcus
GILFLTLTLVILAACGSV

SEQ ID NO: 2110720 - protein, 23 aa, Staphylococcus
GISIKQFQGFWDNLLNDAVRNEK

SEQ ID NO: 2110721 - protein, 25 aa, Staphylococcus
GIVASTLFLGACDLNIHLPGGNNDS

SEQ ID NO: 2110722 - protein, 18 aa, Staphylococcus
GIYTAYFDKNDKLMKIMI

SEQ ID NO: 2110723 - protein, 18 aa, Staphylococcus
GKDKAEQIYYRTLTQYLS

SEQ ID NO: 2110724 - protein, 19 aa, Staphylococcus
GLIFIIALLCTVISINGNT

SEQ ID NO: 2110725 - protein, 17 aa, Staphylococcus
GLLASTLLLTACGQGEK

SEQ ID NO: 2110726 - protein, 18 aa, Staphylococcus
GLNSFLIFPGQKLKVTGS

SEQ ID NO: 2110727 - protein, 25 aa, Staphylococcus
GLVLIMFVLCGFIFPLTVTALGQVL

SEQ ID NO: 2110728 - protein, 18 aa, Staphylococcus
GMVAVILSLCLAFLLFIA

SEQ ID NO: 2110729 - protein, 17 aa, Staphylococcus
GPDLYVYLTKDGNIKEG

SEQ ID NO: 2110730 - protein, 19 aa, Staphylococcus
GQYHYTWQGNWNPSNSDQG

SEQ ID NO: 2110731 - protein, 18 aa, Staphylococcus
GSEHYYEFRTNKGVLLVT

SEQ ID NO: 2110732 - protein, 23 aa, Staphylococcus
GSRLLDLNLGFSQWGFKQKPNES

SEQ ID NO: 2110733 - protein, 24 aa, Staphylococcus
GSYALSRPLFLYVKEKSLKDNDVM

SEQ ID NO: 2110734 - protein, 23 aa, Staphylococcus
GSYPLSRPLFLYVKEKSLEDNDV

SEQ ID NO: 2110735 - protein, 20 aa, Staphylococcus
GTASILVGATLFLGHHEAEA

SEQ ID NO: 2110736 - protein, 17 aa, Staphylococcus
GTFFIKMNEKEFPAFKN

SEQ ID NO: 2110737 - protein, 21 aa, Staphylococcus
GTLYYLLQNNGLTTPLGWVNA

SEQ ID NO: 2110738 - protein, 19 aa, Staphylococcus
GTNIVKFFDYTLASVGIKV

SEQ ID NO: 2110739 - protein, 17 aa, Staphylococcus
GVTWYHGTLANGTAIWV

SEQ ID NO: 2110740 - protein, 21 aa, Staphylococcus
GYKYYSLIDSIDIASGSHLKV

SEQ ID NO: 2110741 - protein, 18 aa, Staphylococcus
GYNLFHIYPIFPLPERQK

SEQ ID NO: 2110742 - protein, 17 aa, Staphylococcus
GYTMAFLLNATYNTGHY

SEQ ID NO: 2110743 - protein, 17 aa, Staphylococcus
HNTKILSGMIYELALEL

SEQ ID NO: 2110744 - protein, 18 aa, Staphylococcus
HYYEFRTNKGVLLVTADG

SEQ ID NO: 2110745 - protein, 17 aa, Staphylococcus
IAKVWLAGLPDYQNKNV

SEQ ID NO: 2110746 - protein, 21 aa, Staphylococcus
IATAGFATIALAGGHDAHAAE

SEQ ID NO: 2110747 - protein, 26 aa, Staphylococcus
IAVLLTICLLFLLFIATNEQALAKVH

SEQ ID NO: 2110748 - protein, 19 aa, Staphylococcus
IFFIIVLVTLIVLVGVLGF

SEQ ID NO: 2110749 - protein, 18 aa, Staphylococcus
IFGFNTMPANNGKGGTYL

SEQ ID NO: 2110750 - protein, 18 aa, Staphylococcus
IFNKPVITPIKPYKNFYP

SEQ ID NO: 2110751 - protein, 23 aa, Staphylococcus
IGALILGLIFLGLSKWYSSEDNQ

SEQ ID NO: 2110752 - protein, 22 aa, Staphylococcus
IHCDQLIILTAIDYVYVNYNTD

SEQ ID NO: 2110753 - protein, 18 aa, Staphylococcus
IHIKNFKEFARAPEFQHE

SEQ ID NO: 2110754 - protein, 21 aa, Staphylococcus
IIFVIFILLLFFAFSSHTYAS

SEQ ID NO: 2110755 - protein, 18 aa, Staphylococcus
IIGLLFLLVTAAACGNVS

SEQ ID NO: 2110756 - protein, 17 aa, Staphylococcus
IIILLSTVVLSGCDLPG

SEQ ID NO: 2110757 - protein, 17 aa, Staphylococcus
IILCCLLLVSCSNDKQS

SEQ ID NO: 2110758 - protein, 17 aa, Staphylococcus
IILLISIALTACSQTSD

SEQ ID NO: 2110759 - protein, 23 aa, Staphylococcus
IILSICLAFLLFIATNQNALAKV

SEQ ID NO: 2110760 - protein, 19 aa, Staphylococcus
IIMVLSLLVLSGCSLPGLG

SEQ ID NO: 2110761 - protein, 18 aa, Staphylococcus
IISILLTLILITACGKVS

SEQ ID NO: 2110762 - protein, 19 aa, Staphylococcus
IISLIALCLMLAGCSNGDN

SEQ ID NO: 2110763 - protein, 19 aa, Staphylococcus
IITLLILLTTLCTTTALAE

SEQ ID NO: 2110764 - protein, 18 aa, Staphylococcus
IIVFAVIVIGVLAFQFLN

SEQ ID NO: 2110765 - protein, 19 aa, Staphylococcus
IKIFFVTLIILITFPTHLL

SEQ ID NO: 2110766 - protein, 19 aa, Staphylococcus
ILFTLVLVLAACGQNQSSE

SEQ ID NO: 2110767 - protein, 17 aa, Staphylococcus
ILIALSVVLAGCGSAEG

SEQ ID NO: 2110768 - protein, 26 aa, Staphylococcus
ILISGIIFLAFVLMPASWFTGLVNNK

SEQ ID NO: 2110769 - protein, 19 aa, Staphylococcus
ILLAMSLIVLSGCSLPGLG

SEQ ID NO: 2110770 - protein, 18 aa, Staphylococcus
ILLGCILGVVVGYIAAQK

SEQ ID NO: 2110771 - protein, 17 aa, Staphylococcus
ILLGIILGVVVGYFVAR

SEQ ID NO: 2110772 - protein, 18 aa, Staphylococcus
ILLGIILGVVVGYIVARN

SEQ ID NO: 2110773 - protein, 21 aa, Staphylococcus
ILLILVLVLTSLGFGYHTYSK

SEQ ID NO: 2110774 - protein, 17 aa, Staphylococcus
ILLSLVLTVALAACGNG

SEQ ID NO: 2110775 - protein, 18 aa, Staphylococcus
ILLVILILASILHHRYMQ

SEQ ID NO: 2110776 - protein, 17 aa, Staphylococcus
ILTICLIGLIFLATNQN

SEQ ID NO: 2110777 - protein, 23 aa, Staphylococcus
ILTVVVIALVILGFQYFNHSGPF

SEQ ID NO: 2110778 - protein, 19 aa, Staphylococcus
ILVLFSTIFLASCELPGLG

SEQ ID NO: 2110779 - protein, 17 aa, Staphylococcus
IMLICGILLSSCGNQSS

SEQ ID NO: 2110780 - protein, 17 aa, Staphylococcus
IMTVVCVVIIFAFVRNE

SEQ ID NO: 2110781 - protein, 17 aa, Staphylococcus
IMVMFVLAGCGTENDEA

SEQ ID NO: 2110782 - protein, 19 aa, Staphylococcus
INEIYLIAHALIETGNGQS

SEQ ID NO: 2110783 - protein, 17 aa, Staphylococcus
INILVLPEANIPFKKRE

SEQ ID NO: 2110784 - protein, 26 aa, Staphylococcus
INPKVLITSLIFFASFLMIGELNHAW

SEQ ID NO: 2110785 - protein, 17 aa, Staphylococcus
IPVTASALLLGACGSDS

SEQ ID NO: 2110786 - protein, 24 aa, Staphylococcus
IQFSDVFLMALPTKAMREVAGEID

SEQ ID NO: 2110787 - protein, 20 aa, Staphylococcus
IQKLLAFQMLYIGIDPKRGP

SEQ ID NO: 2110788 - protein, 27 aa, Staphylococcus
IRQNDGYLWTINFNKYHIKRNGMVFWF

SEQ ID NO: 2110789 - protein, 17 aa, Staphylococcus
ISFIALVLILSGCSKHD

SEQ ID NO: 2110790 - protein, 19 aa, Staphylococcus
ISILIIALIIVALAIVVRQ

SEQ ID NO: 2110791 - protein, 17 aa, Staphylococcus
ISLMIIITTASLGMLST

SEQ ID NO: 2110792 - protein, 20 aa, Staphylococcus
ITLFITLGTILNFNLVNASE

SEQ ID NO: 2110793 - protein, 21 aa, Staphylococcus
ITLGVFILLIGALMLVGKIYS

SEQ ID NO: 2110794 - protein, 27 aa, Staphylococcus
ITLIGVLFILAAIYLFAKPHIDQYLHE

SEQ ID NO: 2110795 - protein, 26 aa, Staphylococcus
IVGVVLILVAIYLFAKPHIDNYLHEK

SEQ ID NO: 2110796 - protein, 18 aa, Staphylococcus
IVLALSLVVLSGCGLPGL

SEQ ID NO: 2110797 - protein, 32 aa, Staphylococcus
IYAANKGTPFALPNTPWKPLRASDSKGIAYVT

SEQ ID NO: 2110798 - protein, 17 aa, Staphylococcus
IYYRALTEYLSSNSNFS

SEQ ID NO: 2110799 - protein, 23 aa, Staphylococcus
KAEDLFHLDLAYAPPFSTTKDPV

SEQ ID NO: 2110800 - protein, 19 aa, Staphylococcus
KAEQIYYRTLTQYLSSNSN

SEQ ID NO: 2110801 - protein, 20 aa, Staphylococcus
KAGYKWYDPSTFAAGSYGGS

SEQ ID NO: 2110802 - protein, 17 aa, Staphylococcus
KAQQIYYRALTEYLSSN

SEQ ID NO: 2110803 - protein, 23 aa, Staphylococcus
KDKAEQIYYLALTQYLTQNSEFS

SEQ ID NO: 2110804 - protein, 24 aa, Staphylococcus
KDMNLLMQALIKKYPQILQISKLT

SEQ ID NO: 2110805 - protein, 24 aa, Staphylococcus
KFAKEWMEFLKSKKAKNILKEYHF

SEQ ID NO: 2110806 - protein, 19 aa, Staphylococcus
KFLALLATLTLAIVLSACG

SEQ ID NO: 2110807 - protein, 20 aa, Staphylococcus
KFSIRKYTVGTFSTVIATLV

SEQ ID NO: 2110808 - protein, 17 aa, Staphylococcus
KFYTVPWGTPSQVAGTV

SEQ ID NO: 2110809 - protein, 17 aa, Staphylococcus
KGANWIILNLHKPMYSK

SEQ ID NO: 2110810 - protein, 18 aa, Staphylococcus
KHPKVLILMGIPGSYLVA

SEQ ID NO: 2110811 - protein, 17 aa, Staphylococcus
KILYMHGGSWVAGPFKE

SEQ ID NO: 2110812 - protein, 25 aa, Staphylococcus
KKLAKEWMDFLKSKKAKDILKEYHF

SEQ ID NO: 2110813 - protein, 20 aa, Staphylococcus
KKVDVGFLPPTAYTLAHDQK

SEQ ID NO: 2110814 - protein, 23 aa, Staphylococcus
KLAKDWMKFLKSDKAKKIMKEYK

SEQ ID NO: 2110815 - protein, 23 aa, Staphylococcus
KLAKEWMKFLKSDKAKKILKEYQ

SEQ ID NO: 2110816 - protein, 19 aa, Staphylococcus
KLGPFQLWDLMGFDRVKSR

SEQ ID NO: 2110817 - protein, 20 aa, Staphylococcus
KLIIISYPLYKGNNKLFYAA

SEQ ID NO: 2110818 - protein, 23 aa, Staphylococcus
KLIVILCAIIVFIALIGVSLRSQ

SEQ ID NO: 2110819 - protein, 27 aa, Staphylococcus
KLIVVFCAIIIFIALIGLSIRSQTQSP

SEQ ID NO: 2110820 - protein, 28 aa, Staphylococcus
KLIVVFCAIIVFIALIGLSIRSSTQSPP

SEQ ID NO: 2110821 - protein, 24 aa, Staphylococcus
KLIVVFCAVIIFIALIGLSLRSHT

SEQ ID NO: 2110822 - protein, 26 aa, Staphylococcus
KLIVVLCAIIVFIALIGLSIRSQNQS

SEQ ID NO: 2110823 - protein, 27 aa, Staphylococcus
KLIVVLCAIIVFIALIGLSIRSQTQSP

SEQ ID NO: 2110824 - protein, 27 aa, Staphylococcus
KLLYSSVFALMIVGVLLIFQNVQAHAA

SEQ ID NO: 2110825 - protein, 26 aa, Staphylococcus
KNPALKYQFLRLDRPQLLSVDRLNRL

SEQ ID NO: 2110826 - protein, 17 aa, Staphylococcus
KPGTKFYTVPWGTPSQV

SEQ ID NO: 2110827 - protein, 22 aa, Staphylococcus
KPTSQYWWAYTEYFTGGVTPAA

SEQ ID NO: 2110828 - protein, 25 aa, Staphylococcus
KQAEDVVYDWYKNQGFGNRLRNEFN

SEQ ID NO: 2110829 - protein, 23 aa, Staphylococcus
KQLNPNIPLIRLLDKGELPFQSE

SEQ ID NO: 2110830 - protein, 23 aa, Staphylococcus
KSTDEMYYIDYAASDAYGTGTPY

SEQ ID NO: 2110831 - protein, 18 aa, Staphylococcus
KTPSLYVGGFYDPSLPTN

SEQ ID NO: 2110832 - protein, 23 aa, Staphylococcus
KTYEGVYPEWQPGQKVHLVGHSM

SEQ ID NO: 2110833 - protein, 17 aa, Staphylococcus
KVDVGFLPPTAYTLAHD

SEQ ID NO: 2110834 - protein, 19 aa, Staphylococcus
KVLILMGIPGSYLVATDKS

SEQ ID NO: 2110835 - protein, 18 aa, Staphylococcus
KVLIPISICTLIILLIGC

SEQ ID NO: 2110836 - protein, 19 aa, Staphylococcus
KVYQLDPKLWYFASGSTTT

SEQ ID NO: 2110837 - protein, 20 aa, Staphylococcus
LAAIFLLTACGKGNDEKQSL

SEQ ID NO: 2110838 - protein, 17 aa, Staphylococcus
LAFIYPKGQDKPIILAI

SEQ ID NO: 2110839 - protein, 17 aa, Staphylococcus
LALFIIQLLLFISISYL

SEQ ID NO: 2110840 - protein, 18 aa, Staphylococcus
LALSLILGAAACSNDDSS

SEQ ID NO: 2110841 - protein, 20 aa, Staphylococcus
LALVLFLAACSLESPLKNDK

SEQ ID NO: 2110842 - protein, 19 aa, Staphylococcus
LASFLVLAACGNSEESKSE

SEQ ID NO: 2110843 - protein, 17 aa, Staphylococcus
LASTLMLTACGKSNEKA

SEQ ID NO: 2110844 - protein, 19 aa, Staphylococcus
LCASLFILVIFVGGCGSFN

SEQ ID NO: 2110845 - protein, 17 aa, Staphylococcus
LCSLYCLILSGCGQNNN

SEQ ID NO: 2110846 - protein, 19 aa, Staphylococcus
LDLLLDIRCPVVITGAMRS

SEQ ID NO: 2110847 - protein, 23 aa, Staphylococcus
LDTARFQFFLSREFDVAPNQVYA

SEQ ID NO: 2110848 - protein, 25 aa, Staphylococcus
LDTNKLIYTVKLPENFEYIDDSTVA

SEQ ID NO: 2110849 - protein, 28 aa, Staphylococcus
LFGRQKADLNMFLPFILTGNVIGKANEK

SEQ ID NO: 2110850 - protein, 30 aa, Staphylococcus
LFGRQKSDLILFFPFTLTANVIGKAAEKEW

SEQ ID NO: 2110851 - protein, 17 aa, Staphylococcus
LFITISLTLAAIFDGLN

SEQ ID NO: 2110852 - protein, 18 aa, Staphylococcus
LFLSLLLTLSACAPEDDN

SEQ ID NO: 2110853 - protein, 17 aa, Staphylococcus
LFVAVLTLSLAACGKGD

SEQ ID NO: 2110854 - protein, 24 aa, Staphylococcus
LGANPITFLGLGGIGDLIVTCTST

SEQ ID NO: 2110855 - protein, 23 aa, Staphylococcus
LGICLILLIILIGSCIILTKTNS

SEQ ID NO: 2110856 - protein, 17 aa, Staphylococcus
LGLSSFIILSACGQNTD

SEQ ID NO: 2110857 - protein, 18 aa, Staphylococcus
LIAILTLMLFLTYGCQSS

SEQ ID NO: 2110858 - protein, 20 aa, Staphylococcus
LIIGILFLTYKYLALKRDVS

SEQ ID NO: 2110859 - protein, 18 aa, Staphylococcus
LIIIFSIIIIASNDTFAE

SEQ ID NO: 2110860 - protein, 18 aa, Staphylococcus
LILILSIGLVGCHRLSKE

SEQ ID NO: 2110861 - protein, 17 aa, Staphylococcus
LILLLFLAACSNGKSDS

SEQ ID NO: 2110862 - protein, 21 aa, Staphylococcus
LILLTFALIAIPVVFANNLFK

SEQ ID NO: 2110863 - protein, 23 aa, Staphylococcus
LILLTFVLVVVPIIFATQLYKSS

SEQ ID NO: 2110864 - protein, 17 aa, Staphylococcus
LILSFALILSACANKSE

SEQ ID NO: 2110865 - protein, 17 aa, Staphylococcus
LILSLSLAACSHDDGNS

SEQ ID NO: 2110866 - protein, 17 aa, Staphylococcus
LISIMFLFAACSNDSSS

SEQ ID NO: 2110867 - protein, 17 aa, Staphylococcus
LIVIILIAAGCSAPTKT

SEQ ID NO: 2110868 - protein, 23 aa, Staphylococcus
LIVLILILSLFKIAPVHAENASM

SEQ ID NO: 2110869 - protein, 17 aa, Staphylococcus
LLFILKGGNFIKNNIYF

SEQ ID NO: 2110870 - protein, 17 aa, Staphylococcus
LLFRHFFATSLHNQFMY

SEQ ID NO: 2110871 - protein, 17 aa, Staphylococcus
LLFRHFYATSLHNQFMY

SEQ ID NO: 2110872 - protein, 18 aa, Staphylococcus
LLFTIMLVLSACSNGDID

SEQ ID NO: 2110873 - protein, 17 aa, Staphylococcus
LLGLFATIALAIVLSAC

SEQ ID NO: 2110874 - protein, 17 aa, Staphylococcus
LLIAVMILTSACGKDKS

SEQ ID NO: 2110875 - protein, 19 aa, Staphylococcus
LLIILILTILLNATLRVNV

SEQ ID NO: 2110876 - protein, 17 aa, Staphylococcus
LLILSVILILSACNKQS

SEQ ID NO: 2110877 - protein, 19 aa, Staphylococcus
LLIPLMILALAACGNGDDH

SEQ ID NO: 2110878 - protein, 17 aa, Staphylococcus
LLIVLALVLSACSNQSE

SEQ ID NO: 2110879 - protein, 17 aa, Staphylococcus
LLLLMPHAQSEAAADKY

SEQ ID NO: 2110880 - protein, 17 aa, Staphylococcus
LLLSILLILSGCSQSDK

SEQ ID NO: 2110881 - protein, 17 aa, Staphylococcus
LLLTFLVILSACAQQKK

SEQ ID NO: 2110882 - protein, 19 aa, Staphylococcus
LLSLVMLILVACGQNDQHK

SEQ ID NO: 2110883 - protein, 18 aa, Staphylococcus
LLSVDRLNRLLKGKGMLE

SEQ ID NO: 2110884 - protein, 17 aa, Staphylococcus
LLVLSVVIFAAACGGNS

SEQ ID NO: 2110885 - protein, 22 aa, Staphylococcus
LNSNVPLIRLLDKGELLALSQQ

SEQ ID NO: 2110886 - protein, 24 aa, Staphylococcus
LPIVVGLLLVLGIAWGVYAFITNT

SEQ ID NO: 2110887 - protein, 24 aa, Staphylococcus
LPKNDFFFACQFHPEFLSRPNRPQ

SEQ ID NO: 2110888 - protein, 20 aa, Staphylococcus
LPSMLALSLFGATLTAQHAH

SEQ ID NO: 2110889 - protein, 21 aa, Staphylococcus
LPSMVALTLFGTAFTAHHAHA

SEQ ID NO: 2110890 - protein, 20 aa, Staphylococcus
LSKYMTIRKIAPESAITNIK

SEQ ID NO: 2110891 - protein, 25 aa, Staphylococcus
LSLFIVCFLLGCITWFGFEKQNNKI

SEQ ID NO: 2110892 - protein, 22 aa, Staphylococcus
LSSCLILGACGNQDSEQKDEHK

SEQ ID NO: 2110893 - protein, 22 aa, Staphylococcus
LSSFLVLSACSHSDHSDKKDSD

SEQ ID NO: 2110894 - protein, 17 aa, Staphylococcus
LTIVGVVLILVAIYLFA

SEQ ID NO: 2110895 - protein, 17 aa, Staphylococcus
LTLMLVLAACGNDDSKK

SEQ ID NO: 2110896 - protein, 17 aa, Staphylococcus
LTLSLALAACSNGSDDD

SEQ ID NO: 2110897 - protein, 18 aa, Staphylococcus
LTSGTFFIKMNEKEFPAF

SEQ ID NO: 2110898 - protein, 19 aa, Staphylococcus
LVFFIGATVCWFTFEKQNY

SEQ ID NO: 2110899 - protein, 17 aa, Staphylococcus
LVKILGRLKFRTSYGQN

SEQ ID NO: 2110900 - protein, 24 aa, Staphylococcus
LVTFLIYLFYSPRLQFDVLENPNK

SEQ ID NO: 2110901 - protein, 20 aa, Staphylococcus
LVTKFLLPLMMDNGGSIINT

SEQ ID NO: 2110902 - protein, 18 aa, Staphylococcus
LVVLVLSVVIFAAACGNS

SEQ ID NO: 2110903 - protein, 17 aa, Staphylococcus
LYFILVKLGKSLFVIGK

SEQ ID NO: 2110904 - protein, 23 aa, Staphylococcus
LYTAGQCTWYVYDKVNGAIGSTW

SEQ ID NO: 2110905 - protein, 24 aa, Staphylococcus
MAFLLACCLGFLLFIATNQQALAK

SEQ ID NO: 2110906 - protein, 18 aa, Staphylococcus
MAMILLLAGCSLESPLEK

SEQ ID NO: 2110907 - protein, 22 aa, Staphylococcus
MDLIAGTSLLAGGLLIGGRKRR

SEQ ID NO: 2110908 - protein, 27 aa, Staphylococcus
MGTVPKVLLWVFGILVLLAVVAAIYLA

SEQ ID NO: 2110909 - protein, 19 aa, Staphylococcus
MIFLLIVALTACSNKTDSD

SEQ ID NO: 2110910 - protein, 22 aa, Staphylococcus
MILLTFALIAVPAIFAYQLFKS

SEQ ID NO: 2110911 - protein, 25 aa, Staphylococcus
MRGTFLVTKFLLPLMLDNGGSIINT

SEQ ID NO: 2110912 - protein, 29 aa, Staphylococcus
MSLPTKILLWIVGVLFLLAVIAVIYICAK

SEQ ID NO: 2110913 - protein, 25 aa, Staphylococcus
MTDTRRVALLKDGYKYYSLIDSIDI

SEQ ID NO: 2110914 - protein, 27 aa, Staphylococcus
MTIIGVILILVAIYLFAKPHIDSYLHD

SEQ ID NO: 2110915 - protein, 27 aa, Staphylococcus
MTILGVILILVAVYLFAKPHIDNYLHE

SEQ ID NO: 2110916 - protein, 26 aa, Staphylococcus
MTMIGVILILVAVYLFAKPYIDNYLH

SEQ ID NO: 2110917 - protein, 17 aa, Staphylococcus
MTSFLVLGACGQKEDNK

SEQ ID NO: 2110918 - protein, 19 aa, Staphylococcus
NADLVVPLIKAYLGISSDI

SEQ ID NO: 2110919 - protein, 26 aa, Staphylococcus
NATNMNFLRWVDFPNDYTVGWTSQTI

SEQ ID NO: 2110920 - protein, 17 aa, Staphylococcus
NFLNFKPGLVGGHCIGV

SEQ ID NO: 2110921 - protein, 23 aa, Staphylococcus
NFSDTYLIALPTKAIREVIKNID

SEQ ID NO: 2110922 - protein, 23 aa, Staphylococcus
NFTDIYLMALPTKAMREVTSEID

SEQ ID NO: 2110923 - protein, 21 aa, Staphylococcus
NHAQFLLDESFLKSLDKGTVS

SEQ ID NO: 2110924 - protein, 26 aa, Staphylococcus
NKLNKYAIRKFTVGTASLLIGATLVF

SEQ ID NO: 2110925 - protein, 17 aa, Staphylococcus
NLPLIKYSFDQILMTKE

SEQ ID NO: 2110926 - protein, 17 aa, Staphylococcus
NLPLIKYSFDQVIMTKE

SEQ ID NO: 2110927 - protein, 26 aa, Staphylococcus
NLPNTGIIRAIVYYNDNLMSNFSNAV

SEQ ID NO: 2110928 - protein, 19 aa, Staphylococcus
NLYDFKYKLKPFLDPSKVY

SEQ ID NO: 2110929 - protein, 24 aa, Staphylococcus
NNGNYSYVFSFKDPQQNGVYSIVT

SEQ ID NO: 2110930 - protein, 29 aa, Staphylococcus
NNSPVYRAQLFLSPYGPPAYLQAINTNQA

SEQ ID NO: 2110931 - protein, 20 aa, Staphylococcus
NPSVLAHYWGGDKMNIRQDL

SEQ ID NO: 2110932 - protein, 26 aa, Staphylococcus
NQAVFFTRQLWNMLQLARVITIGAYN

SEQ ID NO: 2110933 - protein, 19 aa, Staphylococcus
NQRVILIWNPWDNGLTTQS

SEQ ID NO: 2110934 - protein, 20 aa, Staphylococcus
NRYAIRKYTVGTASALVASV

SEQ ID NO: 2110935 - protein, 20 aa, Staphylococcus
NSNVPLIRLLDKGELAQQSE

SEQ ID NO: 2110936 - protein, 25 aa, Staphylococcus
NSTQYLAKVWAAALPAYRSSGKSQF

SEQ ID NO: 2110937 - protein, 20 aa, Staphylococcus
NTAERFYYAAGGRALEYRQL

SEQ ID NO: 2110938 - protein, 22 aa, Staphylococcus
NTKEYFAKIWLTARNDADDIFY

SEQ ID NO: 2110939 - protein, 21 aa, Staphylococcus
NTPIRLYHYGLPSGNFKNDPM

SEQ ID NO: 2110940 - protein, 28 aa, Staphylococcus
NTQDYYAKVWLTVFKDYRGSGEVENHIS

SEQ ID NO: 2110941 - protein, 19 aa, Staphylococcus
NWIILNLHKPMYSKSYHAL

SEQ ID NO: 2110942 - protein, 17 aa, Staphylococcus
NWKLGPFQLWDLMGFDR

SEQ ID NO: 2110943 - protein, 18 aa, Staphylococcus
NYHDYRFIDRDKVDQPTL

SEQ ID NO: 2110944 - protein, 24 aa, Staphylococcus
PDGMKFYMVYPDKGSYRTVVGVNN

SEQ ID NO: 2110945 - protein, 18 aa, Staphylococcus
PFIRQLAYDYAKFQGSKH

SEQ ID NO: 2110946 - protein, 20 aa, Staphylococcus
PHAYLQAHNYSYDQLYDLIN

SEQ ID NO: 2110947 - protein, 21 aa, Staphylococcus
PIVKITLGLITASISLGTISV

SEQ ID NO: 2110948 - protein, 21 aa, Staphylococcus
PNFILIGQVLKVPFISSNNSS

SEQ ID NO: 2110949 - protein, 21 aa, Staphylococcus
PRAFINPLPHISFVRGKNNVK

SEQ ID NO: 2110950 - protein, 25 aa, Staphylococcus
PSDLQFDIVFLFTKAMQLESMLTHI

SEQ ID NO: 2110951 - protein, 20 aa, Staphylococcus
PSIAISLLLTGCGQKDNGQD

SEQ ID NO: 2110952 - protein, 24 aa, Staphylococcus
PSNYTLASFNAYKKLKAQAQTILD

SEQ ID NO: 2110953 - protein, 18 aa, Staphylococcus
PSVLAHYWGGDKLNIRQD

SEQ ID NO: 2110954 - protein, 23 aa, Staphylococcus
PTNDWDWYIYPQGLYDMILRIKN

SEQ ID NO: 2110955 - protein, 18 aa, Staphylococcus
PTQKYQFLRLDKSQNISS

SEQ ID NO: 2110956 - protein, 18 aa, Staphylococcus
PVIILTFTLVGCSSSSEE

SEQ ID NO: 2110957 - protein, 24 aa, Staphylococcus
QDAQFDVIFLFTKAMQLQDMLEHI

SEQ ID NO: 2110958 - protein, 29 aa, Staphylococcus
QFISTFDHMDFLKWINLRNDYTVTWTSQK

SEQ ID NO: 2110959 - protein, 20 aa, Staphylococcus
QGQCTWYVDQRMKQFGQYIH

SEQ ID NO: 2110960 - protein, 19 aa, Staphylococcus
QHADVYLMALPTKAMREVA

SEQ ID NO: 2110961 - protein, 24 aa, Staphylococcus
QLKGNRLFYLAMAPQFFGIISDYL

SEQ ID NO: 2110962 - protein, 22 aa, Staphylococcus
QLKKIAYLKATFKKASKISKDT

SEQ ID NO: 2110963 - protein, 24 aa, Staphylococcus
QLNEKPLHAGAYNYDFVLGGNEYT

SEQ ID NO: 2110964 - protein, 17 aa, Staphylococcus
QMNPNVPLIKLMNKFEL

SEQ ID NO: 2110965 - protein, 20 aa, Staphylococcus
QPISTYWWNADHWANNASAD

SEQ ID NO: 2110966 - protein, 17 aa, Staphylococcus
QQIYYRALTEYLSSNSN

SEQ ID NO: 2110967 - protein, 17 aa, Staphylococcus
QSDGQYWTWSYGQGSTN

SEQ ID NO: 2110968 - protein, 24 aa, Staphylococcus
QSTQLLGSIFLLLGGALVAKQSHK

SEQ ID NO: 2110969 - protein, 21 aa, Staphylococcus
QTKHLLSPYYEQTFVVAKYQV

SEQ ID NO: 2110970 - protein, 25 aa, Staphylococcus
QVVKNWIIPYIFPTLLHLDILKKKL

SEQ ID NO: 2110971 - protein, 23 aa, Staphylococcus
QYGLNEIYLISHALLETGNGQSQ

SEQ ID NO: 2110972 - protein, 17 aa, Staphylococcus
RDRVYYKQLGYHPDLTG

SEQ ID NO: 2110973 - protein, 26 aa, Staphylococcus
RFFALILAIFFYLSVNNVFGNIFNND

SEQ ID NO: 2110974 - protein, 26 aa, Staphylococcus
RFIALLLAIFFYLSVNNVFGNIFSND

SEQ ID NO: 2110975 - protein, 17 aa, Staphylococcus
RFLSFFVDKGLIKIKKG

SEQ ID NO: 2110976 - protein, 26 aa, Staphylococcus
RFNFSYTLIVLIVALVLLVFAIRAVK

SEQ ID NO: 2110977 - protein, 26 aa, Staphylococcus
RFVAFILALFFYLSVNNVFGNIFSNN

SEQ ID NO: 2110978 - protein, 27 aa, Staphylococcus
RFVAFVLALAFFLTVNNVFGNIFSSSA

SEQ ID NO: 2110979 - protein, 27 aa, Staphylococcus
RFVALILAIFFFLSVNNVFGNIFNSDD

SEQ ID NO: 2110980 - protein, 27 aa, Staphylococcus
RFVALILAIFFFLSVNNVFGNVFNTDD

SEQ ID NO: 2110981 - protein, 17 aa, Staphylococcus
RGINILVLPEANIPFKK

SEQ ID NO: 2110982 - protein, 17 aa, Staphylococcus
RGTFLVTKFLLPLMMEQ

SEQ ID NO: 2110983 - protein, 24 aa, Staphylococcus
RHADAILCYIYKFRSRFAVLAEQV

SEQ ID NO: 2110984 - protein, 18 aa, Staphylococcus
RILIATLTLLVISFVCYI

SEQ ID NO: 2110985 - protein, 26 aa, Staphylococcus
RLIALMLAVLFFLSANNMFGNIFDAD

SEQ ID NO: 2110986 - protein, 24 aa, Staphylococcus
RLNGLNNFFIYPGQKLRVSGSASS

SEQ ID NO: 2110987 - protein, 23 aa, Staphylococcus
RLNGLNNFFIYPGQKLRVSGTAS

SEQ ID NO: 2110988 - protein, 31 aa, Staphylococcus
RNTLYTAIVLLLALILLVFAIRAIHVDPVKS

SEQ ID NO: 2110989 - protein, 26 aa, Staphylococcus
RQKADLNLFFPFTVTANVIGKAKEKE

SEQ ID NO: 2110990 - protein, 25 aa, Staphylococcus
RQVDPYRIIYWKNKWYLVAYCRLRD

SEQ ID NO: 2110991 - protein, 17 aa, Staphylococcus
RVVSYPIHFVTGAIGNI

SEQ ID NO: 2110992 - protein, 22 aa, Staphylococcus
SDNYQWYMHMNKLNVQQGQSVN

SEQ ID NO: 2110993 - protein, 18 aa, Staphylococcus
SEGNYSYIFSFQNQAQPG

SEQ ID NO: 2110994 - protein, 19 aa, Staphylococcus
SENVRFLVSVRPDPPRIDS

SEQ ID NO: 2110995 - protein, 27 aa, Staphylococcus
SFKLISILLFAILLLSTIAFTDLNKSY

SEQ ID NO: 2110996 - protein, 20 aa, Staphylococcus
SFLALLLMLSACAPNNDNNE

SEQ ID NO: 2110997 - protein, 17 aa, Staphylococcus
SFRFWPLNEFKFNFNPD

SEQ ID NO: 2110998 - protein, 21 aa, Staphylococcus
SIAIGTLLLLMPHAQSEAAAD

SEQ ID NO: 2110999 - protein, 26 aa, Staphylococcus
SIMLTLLLILIILFGFYIYSKIPKTT

SEQ ID NO: 2111000 - protein, 19 aa, Staphylococcus
SIRKFAIGTSSILVASLFF

SEQ ID NO: 2111001 - protein, 20 aa, Staphylococcus
SIRKFTFGASSILIGSLLFL

SEQ ID NO: 2111002 - protein, 17 aa, Staphylococcus
SIRKFTVGTASILVGAT

SEQ ID NO: 2111003 - protein, 20 aa, Staphylococcus
SLFALMMAVILFVSACGNGS

SEQ ID NO: 2111004 - protein, 20 aa, Staphylococcus
SLYVGGFYDPSLPTNRYRGV

SEQ ID NO: 2111005 - protein, 24 aa, Staphylococcus
SNELYDVIFLFPKSMQLESVLDAI

SEQ ID NO: 2111006 - protein, 29 aa, Staphylococcus
SNQAVFFTRQLWNMLILARVITIGAYNRN

SEQ ID NO: 2111007 - protein, 23 aa, Staphylococcus
STRMNMYNPMYYLSDYYSGYGKS

SEQ ID NO: 2111008 - protein, 26 aa, Staphylococcus
STSFYNNWLYLYLFSSASQASQEKKN

SEQ ID NO: 2111009 - protein, 27 aa, Staphylococcus
SVGASSILVATLLFMGGGAAQAAETHQ

SEQ ID NO: 2111010 - protein, 22 aa, Staphylococcus
SVSITIPGVLPLGNIKAKSIIT

SEQ ID NO: 2111011 - protein, 22 aa, Staphylococcus
SYMVVRTIPKQVFVTSRVTPIP

SEQ ID NO: 2111012 - protein, 28 aa, Staphylococcus
TDSEGATHYFYFPQSALIQNYQQDDNNY

SEQ ID NO: 2111013 - protein, 17 aa, Staphylococcus
TETLATPPKTRTFMRAM

SEQ ID NO: 2111014 - protein, 22 aa, Staphylococcus
TGVNEIYLIAHALLETGNGQSK

SEQ ID NO: 2111015 - protein, 20 aa, Staphylococcus
TGYFFNTAYLPKGANNKGNY

SEQ ID NO: 2111016 - protein, 24 aa, Staphylococcus
THGKNLEYYLLNDKFRNIYHFLTH

SEQ ID NO: 2111017 - protein, 23 aa, Staphylococcus
THSNTYYAKVWLTALESYRGNSD

SEQ ID NO: 2111018 - protein, 20 aa, Staphylococcus
TIDNFRWAGVPFYIRTGKRM

SEQ ID NO: 2111019 - protein, 17 aa, Staphylococcus
TIFIILLLLAACQNDDN

SEQ ID NO: 2111020 - protein, 17 aa, Staphylococcus
TIILFIVLLSGCEADDI

SEQ ID NO: 2111021 - protein, 23 aa, Staphylococcus
TILLLVVALGFSVFFAATTTHHS

SEQ ID NO: 2111022 - protein, 18 aa, Staphylococcus
TIVIFITTLTACGNKTNK

SEQ ID NO: 2111023 - protein, 25 aa, Staphylococcus
TKKDFDLIFYRTYSDALMPYNFMNS

SEQ ID NO: 2111024 - protein, 25 aa, Staphylococcus
TKKDYDLIFYRTYSDALMPYNFMNS

SEQ ID NO: 2111025 - protein, 25 aa, Staphylococcus
TKKDYDLIFYRTYSDALMPYNFMSS

SEQ ID NO: 2111026 - protein, 17 aa, Staphylococcus
TLCLLSFIIVACDTEDD

SEQ ID NO: 2111027 - protein, 18 aa, Staphylococcus
TLKSVYLYVKPELQNNIG

SEQ ID NO: 2111028 - protein, 17 aa, Staphylococcus
TLLIVVLVLSACSNNKS

SEQ ID NO: 2111029 - protein, 17 aa, Staphylococcus
TPLPVNLAGGSTTSIPV

SEQ ID NO: 2111030 - protein, 30 aa, Staphylococcus
TPPKTRTFMRAMATPRMLAAAVTSPDQDAQ

SEQ ID NO: 2111031 - protein, 17 aa, Staphylococcus
TRNVDIPVTIYPVARAK

SEQ ID NO: 2111032 - protein, 22 aa, Staphylococcus
TRYPNVFLIGPTVRHADAILCY

SEQ ID NO: 2111033 - protein, 23 aa, Staphylococcus
TSQTVRFIIRNVQPTAPQISESK

SEQ ID NO: 2111034 - protein, 21 aa, Staphylococcus
TTDFYNTYVYKKGMPEFETAT

SEQ ID NO: 2111035 - protein, 18 aa, Staphylococcus
TVGTFSTVIATLVFLGFN

SEQ ID NO: 2111036 - protein, 25 aa, Staphylococcus
TYHFWSDGTYFKWEYYPSNGSTVNS

SEQ ID NO: 2111037 - protein, 24 aa, Staphylococcus
VAFADIYLMALPTKAMREVAQTID

SEQ ID NO: 2111038 - protein, 19 aa, Staphylococcus
VAFLFACLFVMFIQMFLVK

SEQ ID NO: 2111039 - protein, 20 aa, Staphylococcus
VAHIFFHPLITDPKVAFTGE

SEQ ID NO: 2111040 - protein, 18 aa, Staphylococcus
VALVLVLTVVLSACGQNQ

SEQ ID NO: 2111041 - protein, 23 aa, Staphylococcus
VFADIYLMALPTKAMREVATQID

SEQ ID NO: 2111042 - protein, 17 aa, Staphylococcus
VFISILTLSLVACGTSN

SEQ ID NO: 2111043 - protein, 25 aa, Staphylococcus
VGASSILIAALLFMGGGSAQAAEQN

SEQ ID NO: 2111044 - protein, 25 aa, Staphylococcus
VGTSSILIAALLFIGGGSAQAAENQ

SEQ ID NO: 2111045 - protein, 17 aa, Staphylococcus
VIATLVLILAGCSSGGN

SEQ ID NO: 2111046 - protein, 21 aa, Staphylococcus
VIFALVLSLGFSVFAALTHQN

SEQ ID NO: 2111047 - protein, 21 aa, Staphylococcus
VIFFIAFLCVSGLTLATNLES

SEQ ID NO: 2111048 - protein, 24 aa, Staphylococcus
VIILLVVALGCSVFFAATHSNQSD

SEQ ID NO: 2111049 - protein, 18 aa, Staphylococcus
VIIVILILAFILNQRYMQ

SEQ ID NO: 2111050 - protein, 17 aa, Staphylococcus
VILIATVVLLAACQNKP

SEQ ID NO: 2111051 - protein, 28 aa, Staphylococcus
VILLLVVALGFSIFFAATGTKQSNSSDD

SEQ ID NO: 2111052 - protein, 18 aa, Staphylococcus
VILPLFALILTACGNDDN

SEQ ID NO: 2111053 - protein, 29 aa, Staphylococcus
VIVLVALLLLFSFVPVGLWISAIAAGVKV

SEQ ID NO: 2111054 - protein, 20 aa, Staphylococcus
VKNLPLIKYSFDQIIMTKEG

SEQ ID NO: 2111055 - protein, 19 aa, Staphylococcus
VKNLPLIKYSFDQILMTKE

SEQ ID NO: 2111056 - protein, 20 aa, Staphylococcus
VKNLPLLKYSFDQIIMTKEG

SEQ ID NO: 2111057 - protein, 17 aa, Staphylococcus
VLALSVIIFAAACGNNS

SEQ ID NO: 2111058 - protein, 18 aa, Staphylococcus
VLEDVLYPFIPQKRLLDI

SEQ ID NO: 2111059 - protein, 17 aa, Staphylococcus
VLGLLATLALAIVLSAC

SEQ ID NO: 2111060 - protein, 17 aa, Staphylococcus
VLLASTLLLAGCTTDRK

SEQ ID NO: 2111061 - protein, 17 aa, Staphylococcus
VLLTSSLILEACSGHDD

SEQ ID NO: 2111062 - protein, 19 aa, Staphylococcus
VLNQLFINSLKYDTFRMNG

SEQ ID NO: 2111063 - protein, 24 aa, Staphylococcus
VNFSDIFLIALPTKAIRDVVTEIN

SEQ ID NO: 2111064 - protein, 18 aa, Staphylococcus
VQIKLNKPLPYFNQMLAF

SEQ ID NO: 2111065 - protein, 18 aa, Staphylococcus
VQKLLAFQMLYIGIDPKQ

SEQ ID NO: 2111066 - protein, 17 aa, Staphylococcus
VQNLPNTGIIRAIVYYN

SEQ ID NO: 2111067 - protein, 17 aa, Staphylococcus
VSLILTSVIFAPTTYAT

SEQ ID NO: 2111068 - protein, 17 aa, Staphylococcus
VVIALSAITLAACSKEQ

SEQ ID NO: 2111069 - protein, 25 aa, Staphylococcus
VVILLVAALSFSIYAAMTHESKYSN

SEQ ID NO: 2111070 - protein, 20 aa, Staphylococcus
VVVIILLLVGLLFGLKVYGN

SEQ ID NO: 2111071 - protein, 19 aa, Staphylococcus
VWGFNWKLGPFQLWDLMGF

SEQ ID NO: 2111072 - protein, 23 aa, Staphylococcus
VYELDPKLWYFASGSTTTAIKQI

SEQ ID NO: 2111073 - protein, 18 aa, Staphylococcus
WCAGYTMAFLLNATYNTG

SEQ ID NO: 2111074 - protein, 24 aa, Staphylococcus
YDELYDLIYEKYLIKTGQAAAWGT

SEQ ID NO: 2111075 - protein, 22 aa, Staphylococcus
YDINEIYLISHALLETGNGTSE

SEQ ID NO: 2111076 - protein, 23 aa, Staphylococcus
YDMKPLRTFVYGRTILLGDAAHA

SEQ ID NO: 2111077 - protein, 17 aa, Staphylococcus
YELDPKLWYFASGSTTT

SEQ ID NO: 2111078 - protein, 18 aa, Staphylococcus
YFLTTTLVLPTFTTSIAH

SEQ ID NO: 2111079 - protein, 21 aa, Staphylococcus
YGINEIYLISHALIETGNGTS

SEQ ID NO: 2111080 - protein, 23 aa, Staphylococcus
YGLNEIYLISHALLETGRGQSQL

SEQ ID NO: 2111081 - protein, 21 aa, Staphylococcus
YHFESNGTHWSWNYAQNGQAT

SEQ ID NO: 2111082 - protein, 26 aa, Staphylococcus
YHIKRNGMVFWFGLPKGQTPTGPVRF

SEQ ID NO: 2111083 - protein, 18 aa, Staphylococcus
YIFSSSLLISTLPFNTVD

SEQ ID NO: 2111084 - protein, 18 aa, Staphylococcus
YLFIILAVILAACSTNSD

SEQ ID NO: 2111085 - protein, 17 aa, Staphylococcus
YLLSTTLIVPTFTSDIA

SEQ ID NO: 2111086 - protein, 23 aa, Staphylococcus
YLLSTTLVFPTFTTPTAVAKDNT

SEQ ID NO: 2111087 - protein, 18 aa, Staphylococcus
YLLTTTLIVPSFSTAPIA

SEQ ID NO: 2111088 - protein, 18 aa, Staphylococcus
YLLTTTLVLPTFTSSVAQ

SEQ ID NO: 2111089 - protein, 17 aa, Staphylococcus
YLMALPTKAMREVATNI

SEQ ID NO: 2111090 - protein, 22 aa, Staphylococcus
YNINEVYLISHALLETGNGTSK

SEQ ID NO: 2111091 - protein, 23 aa, Staphylococcus
YRQLFSFNELYVEPLNVFTERVK

SEQ ID NO: 2111092 - protein, 19 aa, Staphylococcus
YSYIFSFQNQAQPGTYTIA

SEQ ID NO: 2111093 - protein, 18 aa, Staphylococcus
YSYVFSFANKANPGTFTI

SEQ ID NO: 2111094 - protein, 19 aa, Staphylococcus
YTSYFPKYGYRYGVGRPEG

SEQ ID NO: 2111095 - protein, 24 aa, Staphylococcus
YVHYYRDFLPGSHYPRVAADKKWK

SEQ ID NO: 2111096 - protein, 6 aa, Cryptosporidium hominis
KTGTLT

SEQ ID NO: 2111097 - protein, 4 aa, Cryptosporidium hominis
ACSE

SEQ ID NO: 2111098 - protein, 9 aa, Cryptosporidium hominis
AQTAPKPKT

SEQ ID NO: 2111099 - protein, 4 aa, Cryptosporidium hominis
DGRS

SEQ ID NO: 2111100 - protein, 4 aa, Cryptosporidium hominis
EESL

SEQ ID NO: 2111101 - protein, 4 aa, Cryptosporidium hominis
EYPG

SEQ ID NO: 2111102 - protein, 4 aa, Cryptosporidium hominis
GLGS

SEQ ID NO: 2111103 - protein, 4 aa, Cryptosporidium hominis
IDEE

SEQ ID NO: 2111104 - protein, 5 aa, Cryptosporidium hominis
IDKNT

SEQ ID NO: 2111105 - protein, 4 aa, Cryptosporidium hominis
ISSN

SEQ ID NO: 2111106 - protein, 4 aa, Cryptosporidium hominis
KNKG

SEQ ID NO: 2111107 - protein, 4 aa, Cryptosporidium hominis
KTSL

SEQ ID NO: 2111108 - protein, 4 aa, Cryptosporidium hominis
LKSN

SEQ ID NO: 2111109 - protein, 4 aa, Cryptosporidium hominis
NDRI

SEQ ID NO: 2111110 - protein, 4 aa, Cryptosporidium hominis
NGIP

SEQ ID NO: 2111111 - protein, 4 aa, Cryptosporidium hominis
NIDS

SEQ ID NO: 2111112 - protein, 4 aa, Cryptosporidium hominis
NKEV

SEQ ID NO: 2111113 - protein, 5 aa, Cryptosporidium hominis
NKTKK

SEQ ID NO: 2111114 - protein, 5 aa, Cryptosporidium hominis
NNSNI

SEQ ID NO: 2111115 - protein, 4 aa, Cryptosporidium hominis
NSQL

SEQ ID NO: 2111116 - protein, 4 aa, Cryptosporidium hominis
PPEK

SEQ ID NO: 2111117 - protein, 4 aa, Cryptosporidium hominis
PSGI

SEQ ID NO: 2111118 - protein, 10 aa, Cryptosporidium hominis
QIQNPESREQ

SEQ ID NO: 2111119 - protein, 4 aa, Cryptosporidium hominis
RPST

SEQ ID NO: 2111120 - protein, 12 aa, Cryptosporidium hominis
SETTPAPPPTPT

SEQ ID NO: 2111121 - protein, 4 aa, Cryptosporidium hominis
SPSI

SEQ ID NO: 2111122 - protein, 4 aa, Cryptosporidium hominis
SYDP

SEQ ID NO: 2111123 - protein, 9 aa, Cryptosporidium hominis
TKLVEGSQK

SEQ ID NO: 2111124 - protein, 4 aa, Cryptosporidium hominis
TNLT

SEQ ID NO: 2111125 - protein, 4 aa, Cryptosporidium hominis
TNNL

SEQ ID NO: 2111126 - protein, 4 aa, Cryptosporidium hominis
TQNI

SEQ ID NO: 2111127 - protein, 4 aa, Cryptosporidium hominis
TSIP

SEQ ID NO: 2111128 - protein, 4 aa, Cryptosporidium hominis
TSLN

SEQ ID NO: 2111129 - protein, 10 aa, Cryptosporidium hominis
AAAEVDSEMS

SEQ ID NO: 2111130 - protein, 6 aa, Cryptosporidium hominis
AAANSV

SEQ ID NO: 2111131 - protein, 20 aa, Cryptosporidium hominis
AAASGGGLAGSQGRSGGELS

SEQ ID NO: 2111132 - protein, 7 aa, Cryptosporidium hominis
AAASRPI

SEQ ID NO: 2111133 - protein, 8 aa, Cryptosporidium hominis
AADGKHAR

SEQ ID NO: 2111134 - protein, 5 aa, Cryptosporidium hominis
AADKL

SEQ ID NO: 2111135 - protein, 10 aa, Cryptosporidium hominis
AADPKYTISG

SEQ ID NO: 2111136 - protein, 11 aa, Cryptosporidium hominis
AADTKSIQEKN

SEQ ID NO: 2111137 - protein, 9 aa, Cryptosporidium hominis
AAEAAQTQE

SEQ ID NO: 2111138 - protein, 7 aa, Cryptosporidium hominis
AAEETTR

SEQ ID NO: 2111139 - protein, 5 aa, Cryptosporidium hominis
AAELQ

SEQ ID NO: 2111140 - protein, 5 aa, Cryptosporidium hominis
AAENK

SEQ ID NO: 2111141 - protein, 7 aa, Cryptosporidium hominis
AAETTCE

SEQ ID NO: 2111142 - protein, 5 aa, Cryptosporidium hominis
AAGST

SEQ ID NO: 2111143 - protein, 11 aa, Cryptosporidium hominis
AALDSQSKISG

SEQ ID NO: 2111144 - protein, 8 aa, Cryptosporidium hominis
AALGRRGQ

SEQ ID NO: 2111145 - protein, 7 aa, Cryptosporidium hominis
AAMDARQ

SEQ ID NO: 2111146 - protein, 8 aa, Cryptosporidium hominis
AAMGKSGR

SEQ ID NO: 2111147 - protein, 6 aa, Cryptosporidium hominis
AANNEW

SEQ ID NO: 2111148 - protein, 6 aa, Cryptosporidium hominis
AANRIL

SEQ ID NO: 2111149 - protein, 4 aa, Cryptosporidium hominis
AANS

SEQ ID NO: 2111150 - protein, 6 aa, Cryptosporidium hominis
AAPRSA

SEQ ID NO: 2111151 - protein, 6 aa, Cryptosporidium hominis
AAPSLG

SEQ ID NO: 2111152 - protein, 13 aa, Cryptosporidium hominis
AASGDSGSKNTSV

SEQ ID NO: 2111153 - protein, 5 aa, Cryptosporidium hominis
AASIE

SEQ ID NO: 2111154 - protein, 7 aa, Cryptosporidium hominis
AASSQEG

SEQ ID NO: 2111155 - protein, 4 aa, Cryptosporidium hominis
AAYE

SEQ ID NO: 2111156 - protein, 9 aa, Cryptosporidium hominis
AAYGTAKAG

SEQ ID NO: 2111157 - protein, 5 aa, Cryptosporidium hominis
AAYKG

SEQ ID NO: 2111158 - protein, 5 aa, Cryptosporidium hominis
ACETT

SEQ ID NO: 2111159 - protein, 6 aa, Cryptosporidium hominis
ACQNGQ

SEQ ID NO: 2111160 - protein, 7 aa, Cryptosporidium hominis
ACTGPNE

SEQ ID NO: 2111161 - protein, 8 aa, Cryptosporidium hominis
ADAEDEDV

SEQ ID NO: 2111162 - protein, 5 aa, Cryptosporidium hominis
ADASY

SEQ ID NO: 2111163 - protein, 9 aa, Cryptosporidium hominis
ADDNDKDLW

SEQ ID NO: 2111164 - protein, 4 aa, Cryptosporidium hominis
ADDY

SEQ ID NO: 2111165 - protein, 6 aa, Cryptosporidium hominis
ADEARA

SEQ ID NO: 2111166 - protein, 16 aa, Cryptosporidium hominis
ADEEPNPETCSPNPQK

SEQ ID NO: 2111167 - protein, 8 aa, Cryptosporidium hominis
ADENTTDL

SEQ ID NO: 2111168 - protein, 16 aa, Cryptosporidium hominis
ADGAEKTKTYQKLPDD

SEQ ID NO: 2111169 - protein, 6 aa, Cryptosporidium hominis
ADGATK

SEQ ID NO: 2111170 - protein, 6 aa, Cryptosporidium hominis
ADGNHS

SEQ ID NO: 2111171 - protein, 7 aa, Cryptosporidium hominis
ADGNIED

SEQ ID NO: 2111172 - protein, 8 aa, Cryptosporidium hominis
ADGTQSSK

SEQ ID NO: 2111173 - protein, 6 aa, Cryptosporidium hominis
ADHGRP

SEQ ID NO: 2111174 - protein, 12 aa, Cryptosporidium hominis
ADKTNNNINSNS

SEQ ID NO: 2111175 - protein, 29 aa, Cryptosporidium hominis
ADKTSKSTTSHFQRTTRNRNRKAPREFRN

SEQ ID NO: 2111176 - protein, 11 aa, Cryptosporidium hominis
ADLAPGSSEMN

SEQ ID NO: 2111177 - protein, 12 aa, Cryptosporidium hominis
ADLSPSKPEHMP

SEQ ID NO: 2111178 - protein, 9 aa, Cryptosporidium hominis
ADNLTNNDD

SEQ ID NO: 2111179 - protein, 13 aa, Cryptosporidium hominis
ADNSNESSSIGSS

SEQ ID NO: 2111180 - protein, 11 aa, Cryptosporidium hominis
ADNTGNPQIQK

SEQ ID NO: 2111181 - protein, 6 aa, Cryptosporidium hominis
ADNYGN

SEQ ID NO: 2111182 - protein, 11 aa, Cryptosporidium hominis
ADPDKRTTSLE

SEQ ID NO: 2111183 - protein, 5 aa, Cryptosporidium hominis
ADPKD

SEQ ID NO: 2111184 - protein, 8 aa, Cryptosporidium hominis
ADPPKSLQ

SEQ ID NO: 2111185 - protein, 10 aa, Cryptosporidium hominis
ADQNEPQQRQ

SEQ ID NO: 2111186 - protein, 4 aa, Cryptosporidium hominis
ADRT

SEQ ID NO: 2111187 - protein, 11 aa, Cryptosporidium hominis
ADSKNQSSCNE

SEQ ID NO: 2111188 - protein, 8 aa, Cryptosporidium hominis
ADSNSASG

SEQ ID NO: 2111189 - protein, 9 aa, Cryptosporidium hominis
ADTASGWGG

SEQ ID NO: 2111190 - protein, 7 aa, Cryptosporidium hominis
ADTNGDG

SEQ ID NO: 2111191 - protein, 30 aa, Cryptosporidium hominis
ADTRASSDKNLKTSESCSCSKRKHSSETGK

SEQ ID NO: 2111192 - protein, 7 aa, Cryptosporidium hominis
ADVNAAT

SEQ ID NO: 2111193 - protein, 8 aa, Cryptosporidium hominis
ADWDNGNA

SEQ ID NO: 2111194 - protein, 4 aa, Cryptosporidium hominis
AEES

SEQ ID NO: 2111195 - protein, 5 aa, Cryptosporidium hominis
AEESL

SEQ ID NO: 2111196 - protein, 13 aa, Cryptosporidium hominis
AEFQQDRDIEQES

SEQ ID NO: 2111197 - protein, 16 aa, Cryptosporidium hominis
AEGAHQEEIENGMTKY

SEQ ID NO: 2111198 - protein, 17 aa, Cryptosporidium hominis
AEGSNISKNLEKNTNTE

SEQ ID NO: 2111199 - protein, 12 aa, Cryptosporidium hominis
AEGSYTDSESRI

SEQ ID NO: 2111200 - protein, 13 aa, Cryptosporidium hominis
AEIDNKSSQHDGC

SEQ ID NO: 2111201 - protein, 8 aa, Cryptosporidium hominis
AEKDFEED

SEQ ID NO: 2111202 - protein, 9 aa, Cryptosporidium hominis
AEKEAENKK

SEQ ID NO: 2111203 - protein, 4 aa, Cryptosporidium hominis
AEKG

SEQ ID NO: 2111204 - protein, 11 aa, Cryptosporidium hominis
AELERNNRSGF

SEQ ID NO: 2111205 - protein, 4 aa, Cryptosporidium hominis
AENE

SEQ ID NO: 2111206 - protein, 4 aa, Cryptosporidium hominis
AENL

SEQ ID NO: 2111207 - protein, 13 aa, Cryptosporidium hominis
AENPESENREEEA

SEQ ID NO: 2111208 - protein, 7 aa, Cryptosporidium hominis
AENPTYG

SEQ ID NO: 2111209 - protein, 7 aa, Cryptosporidium hominis
AENTDTV

SEQ ID NO: 2111210 - protein, 24 aa, Cryptosporidium hominis
AENTSNSKKSKKSSKKSENAQNSA

SEQ ID NO: 2111211 - protein, 15 aa, Cryptosporidium hominis
AEPCEGSTTHNNNQE

SEQ ID NO: 2111212 - protein, 6 aa, Cryptosporidium hominis
AEPNIA

SEQ ID NO: 2111213 - protein, 7 aa, Cryptosporidium hominis
AERNGQN

SEQ ID NO: 2111214 - protein, 6 aa, Cryptosporidium hominis
AERSSR

SEQ ID NO: 2111215 - protein, 7 aa, Cryptosporidium hominis
AESGGKY

SEQ ID NO: 2111216 - protein, 8 aa, Cryptosporidium hominis
AESHGFNQ

SEQ ID NO: 2111217 - protein, 9 aa, Cryptosporidium hominis
AESKPTVTG

SEQ ID NO: 2111218 - protein, 18 aa, Cryptosporidium hominis
AESNSSQKEQKKHAGKAQ

SEQ ID NO: 2111219 - protein, 10 aa, Cryptosporidium hominis
AESQDYPKNE

SEQ ID NO: 2111220 - protein, 16 aa, Cryptosporidium hominis
AESQKECKLPSGKKSS

SEQ ID NO: 2111221 - protein, 15 aa, Cryptosporidium hominis
AESSPPPPPPTPTLI

SEQ ID NO: 2111222 - protein, 5 aa, Cryptosporidium hominis
AESVE

SEQ ID NO: 2111223 - protein, 5 aa, Cryptosporidium hominis
AETAY

SEQ ID NO: 2111224 - protein, 8 aa, Cryptosporidium hominis
AETPGSLG

SEQ ID NO: 2111225 - protein, 6 aa, Cryptosporidium hominis
AETSEK

SEQ ID NO: 2111226 - protein, 14 aa, Cryptosporidium hominis
AETSKGLSKSSDSI

SEQ ID NO: 2111227 - protein, 6 aa, Cryptosporidium hominis
AEYRPP

SEQ ID NO: 2111228 - protein, 9 aa, Cryptosporidium hominis
AEYSESELD

SEQ ID NO: 2111229 - protein, 4 aa, Cryptosporidium hominis
AFGQ

SEQ ID NO: 2111230 - protein, 7 aa, Cryptosporidium hominis
AFGRKEK

SEQ ID NO: 2111231 - protein, 7 aa, Cryptosporidium hominis
AFPTSNN

SEQ ID NO: 2111232 - protein, 10 aa, Cryptosporidium hominis
AFQQSTTGIL

SEQ ID NO: 2111233 - protein, 31 aa, Cryptosporidium hominis
AFRRNTSTGGGSSSSRRRSGRGYNRSIRDDL

SEQ ID NO: 2111234 - protein, 7 aa, Cryptosporidium hominis
AFSGQSR

SEQ ID NO: 2111235 - protein, 5 aa, Cryptosporidium hominis
AFSNG

SEQ ID NO: 2111236 - protein, 8 aa, Cryptosporidium hominis
AFSTSGQL

SEQ ID NO: 2111237 - protein, 5 aa, Cryptosporidium hominis
AGCAP

SEQ ID NO: 2111238 - protein, 5 aa, Cryptosporidium hominis
AGCNR

SEQ ID NO: 2111239 - protein, 6 aa, Cryptosporidium hominis
AGEAAA

SEQ ID NO: 2111240 - protein, 4 aa, Cryptosporidium hominis
AGED

SEQ ID NO: 2111241 - protein, 9 aa, Cryptosporidium hominis
AGENSSTLI

SEQ ID NO: 2111242 - protein, 7 aa, Cryptosporidium hominis
AGGKEAQ

SEQ ID NO: 2111243 - protein, 5 aa, Cryptosporidium hominis
AGGPS

SEQ ID NO: 2111244 - protein, 8 aa, Cryptosporidium hominis
AGGSGGEY

SEQ ID NO: 2111245 - protein, 10 aa, Cryptosporidium hominis
AGKDSGPMRN

SEQ ID NO: 2111246 - protein, 21 aa, Cryptosporidium hominis
AGKNTEEGDSKIYASSNTTDV

SEQ ID NO: 2111247 - protein, 19 aa, Cryptosporidium hominis
AGKQSNSQEIDNNKSEEEI

SEQ ID NO: 2111248 - protein, 9 aa, Cryptosporidium hominis
AGKYEPRSK

SEQ ID NO: 2111249 - protein, 6 aa, Cryptosporidium hominis
AGNATV

SEQ ID NO: 2111250 - protein, 10 aa, Cryptosporidium hominis
AGNLSSYPNG

SEQ ID NO: 2111251 - protein, 6 aa, Cryptosporidium hominis
AGPDYD

SEQ ID NO: 2111252 - protein, 7 aa, Cryptosporidium hominis
AGSPKSL

SEQ ID NO: 2111253 - protein, 5 aa, Cryptosporidium hominis
AGSPL

SEQ ID NO: 2111254 - protein, 8 aa, Cryptosporidium hominis
AGTKYNPE

SEQ ID NO: 2111255 - protein, 9 aa, Cryptosporidium hominis
AGTNNSRTA

SEQ ID NO: 2111256 - protein, 6 aa, Cryptosporidium hominis
AGTPAN

SEQ ID NO: 2111257 - protein, 7 aa, Cryptosporidium hominis
AGTSGDF

SEQ ID NO: 2111258 - protein, 57 aa, Cryptosporidium hominis
AGTSGGGSRAPMPKFSGGSGSSPRSSITPLSPQRSSSFKRNSSLSGSNLGVDSKANN

SEQ ID NO: 2111259 - protein, 18 aa, Cryptosporidium hominis
AHKKQNKDIKEEITDSKQ

SEQ ID NO: 2111260 - protein, 10 aa, Cryptosporidium hominis
AHKSDTNRLD

SEQ ID NO: 2111261 - protein, 14 aa, Cryptosporidium hominis
AIDTGSSVSTAPSS

SEQ ID NO: 2111262 - protein, 8 aa, Cryptosporidium hominis
AIGKSARK

SEQ ID NO: 2111263 - protein, 4 aa, Cryptosporidium hominis
AIGR

SEQ ID NO: 2111264 - protein, 10 aa, Cryptosporidium hominis
AIKNNSFGYP

SEQ ID NO: 2111265 - protein, 12 aa, Cryptosporidium hominis
AIPTKKPSKPCS

SEQ ID NO: 2111266 - protein, 12 aa, Cryptosporidium hominis
AIPYPEPQGSVR

SEQ ID NO: 2111267 - protein, 4 aa, Cryptosporidium hominis
AIQG

SEQ ID NO: 2111268 - protein, 5 aa, Cryptosporidium hominis
AISGS

SEQ ID NO: 2111269 - protein, 10 aa, Cryptosporidium hominis
AISGTNSNLD

SEQ ID NO: 2111270 - protein, 6 aa, Cryptosporidium hominis
AISSSN

SEQ ID NO: 2111271 - protein, 5 aa, Cryptosporidium hominis
AISYP

SEQ ID NO: 2111272 - protein, 21 aa, Cryptosporidium hominis
AITEEESSNYDESQSSKKNSR

SEQ ID NO: 2111273 - protein, 6 aa, Cryptosporidium hominis
AIYSSI

SEQ ID NO: 2111274 - protein, 7 aa, Cryptosporidium hominis
AKANVTD

SEQ ID NO: 2111275 - protein, 8 aa, Cryptosporidium hominis
AKCKAQDN

SEQ ID NO: 2111276 - protein, 12 aa, Cryptosporidium hominis
AKCPGDESFPPS

SEQ ID NO: 2111277 - protein, 8 aa, Cryptosporidium hominis
AKDDKESS

SEQ ID NO: 2111278 - protein, 5 aa, Cryptosporidium hominis
AKDGG

SEQ ID NO: 2111279 - protein, 6 aa, Cryptosporidium hominis
AKDGTY

SEQ ID NO: 2111280 - protein, 6 aa, Cryptosporidium hominis
AKDREK

SEQ ID NO: 2111281 - protein, 6 aa, Cryptosporidium hominis
AKEDRK

SEQ ID NO: 2111282 - protein, 18 aa, Cryptosporidium hominis
AKEFKSKNAQGDIAKNGM

SEQ ID NO: 2111283 - protein, 6 aa, Cryptosporidium hominis
AKEGYN

SEQ ID NO: 2111284 - protein, 5 aa, Cryptosporidium hominis
AKEIG

SEQ ID NO: 2111285 - protein, 5 aa, Cryptosporidium hominis
AKESP

SEQ ID NO: 2111286 - protein, 7 aa, Cryptosporidium hominis
AKFSKDD

SEQ ID NO: 2111287 - protein, 16 aa, Cryptosporidium hominis
AKGKAALDDTTQKGKK

SEQ ID NO: 2111288 - protein, 12 aa, Cryptosporidium hominis
AKGKENKKEGGG

SEQ ID NO: 2111289 - protein, 7 aa, Cryptosporidium hominis
AKGLYGP

SEQ ID NO: 2111290 - protein, 5 aa, Cryptosporidium hominis
AKHLS

SEQ ID NO: 2111291 - protein, 6 aa, Cryptosporidium hominis
AKIDEY

SEQ ID NO: 2111292 - protein, 4 aa, Cryptosporidium hominis
AKIG

SEQ ID NO: 2111293 - protein, 6 aa, Cryptosporidium hominis
AKINAK

SEQ ID NO: 2111294 - protein, 4 aa, Cryptosporidium hominis
AKKE

SEQ ID NO: 2111295 - protein, 7 aa, Cryptosporidium hominis
AKKSQKN

SEQ ID NO: 2111296 - protein, 7 aa, Cryptosporidium hominis
AKKSVES

SEQ ID NO: 2111297 - protein, 6 aa, Cryptosporidium hominis
AKNLGA

SEQ ID NO: 2111298 - protein, 6 aa, Cryptosporidium hominis
AKNPTN

SEQ ID NO: 2111299 - protein, 9 aa, Cryptosporidium hominis
AKNSSVSKD

SEQ ID NO: 2111300 - protein, 20 aa, Cryptosporidium hominis
AKPIEEPTSTRTAKDLKETK

SEQ ID NO: 2111301 - protein, 17 aa, Cryptosporidium hominis
AKQARKQRREAYEAKQR

SEQ ID NO: 2111302 - protein, 5 aa, Cryptosporidium hominis
AKQCQ

SEQ ID NO: 2111303 - protein, 40 aa, Cryptosporidium hominis
AKQDNYKESINDDISDSQSQSFESSAAEDSMNSSQLTQSL

SEQ ID NO: 2111304 - protein, 14 aa, Cryptosporidium hominis
AKQTNKNSNKFNEN

SEQ ID NO: 2111305 - protein, 22 aa, Cryptosporidium hominis
AKQTPGGSTENKYNTSNATPAP

SEQ ID NO: 2111306 - protein, 13 aa, Cryptosporidium hominis
AKQTQNELKNTPN

SEQ ID NO: 2111307 - protein, 8 aa, Cryptosporidium hominis
AKQYSSYE

SEQ ID NO: 2111308 - protein, 7 aa, Cryptosporidium hominis
AKRKEEI

SEQ ID NO: 2111309 - protein, 12 aa, Cryptosporidium hominis
AKSEPKESPGMI

SEQ ID NO: 2111310 - protein, 5 aa, Cryptosporidium hominis
AKSFE

SEQ ID NO: 2111311 - protein, 8 aa, Cryptosporidium hominis
AKSGEEDN

SEQ ID NO: 2111312 - protein, 5 aa, Cryptosporidium hominis
AKSMG

SEQ ID NO: 2111313 - protein, 8 aa, Cryptosporidium hominis
AKSNCPEG

SEQ ID NO: 2111314 - protein, 9 aa, Cryptosporidium hominis
AKSNQNGGM

SEQ ID NO: 2111315 - protein, 15 aa, Cryptosporidium hominis
AKSQPSVDSSARGSL

SEQ ID NO: 2111316 - protein, 8 aa, Cryptosporidium hominis
AKSTSKSL

SEQ ID NO: 2111317 - protein, 21 aa, Cryptosporidium hominis
AKTKTKATGWAGRGGGGGGKK

SEQ ID NO: 2111318 - protein, 8 aa, Cryptosporidium hominis
AKTRNSNV

SEQ ID NO: 2111319 - protein, 17 aa, Cryptosporidium hominis
AKYQDEAIRNKENKVKK

SEQ ID NO: 2111320 - protein, 12 aa, Cryptosporidium hominis
AKYQSQSNYSGE

SEQ ID NO: 2111321 - protein, 7 aa, Cryptosporidium hominis
ALDMETE

SEQ ID NO: 2111322 - protein, 7 aa, Cryptosporidium hominis
ALDPEDK

SEQ ID NO: 2111323 - protein, 10 aa, Cryptosporidium hominis
ALETGNANRI

SEQ ID NO: 2111324 - protein, 5 aa, Cryptosporidium hominis
ALFPS

SEQ ID NO: 2111325 - protein, 4 aa, Cryptosporidium hominis
ALGA

SEQ ID NO: 2111326 - protein, 9 aa, Cryptosporidium hominis
ALNERGEEI

SEQ ID NO: 2111327 - protein, 5 aa, Cryptosporidium hominis
ALPNT

SEQ ID NO: 2111328 - protein, 7 aa, Cryptosporidium hominis
ALQPGDI

SEQ ID NO: 2111329 - protein, 7 aa, Cryptosporidium hominis
ALQPYQG

SEQ ID NO: 2111330 - protein, 9 aa, Cryptosporidium hominis
ALSEDNVSN

SEQ ID NO: 2111331 - protein, 19 aa, Cryptosporidium hominis
ALSGNNESESSSEGFRSDN

SEQ ID NO: 2111332 - protein, 25 aa, Cryptosporidium hominis
ALSKEKHKLSATKSISTVFKKKVEI

SEQ ID NO: 2111333 - protein, 5 aa, Cryptosporidium hominis
ALSSN

SEQ ID NO: 2111334 - protein, 9 aa, Cryptosporidium hominis
ALTRPQRRK

SEQ ID NO: 2111335 - protein, 9 aa, Cryptosporidium hominis
AMNPQEQKR

SEQ ID NO: 2111336 - protein, 5 aa, Cryptosporidium hominis
AMQTA

SEQ ID NO: 2111337 - protein, 5 aa, Cryptosporidium hominis
AMRNG

SEQ ID NO: 2111338 - protein, 6 aa, Cryptosporidium hominis
ANAYRP

SEQ ID NO: 2111339 - protein, 5 aa, Cryptosporidium hominis
ANDDI

SEQ ID NO: 2111340 - protein, 13 aa, Cryptosporidium hominis
ANDKIQSKSRPEV

SEQ ID NO: 2111341 - protein, 20 aa, Cryptosporidium hominis
ANDTAELEDPLATARKETSI

SEQ ID NO: 2111342 - protein, 9 aa, Cryptosporidium hominis
ANEEKKSTI

SEQ ID NO: 2111343 - protein, 6 aa, Cryptosporidium hominis
ANEENW

SEQ ID NO: 2111344 - protein, 7 aa, Cryptosporidium hominis
ANEKSSI

SEQ ID NO: 2111345 - protein, 6 aa, Cryptosporidium hominis
ANESIN

SEQ ID NO: 2111346 - protein, 13 aa, Cryptosporidium hominis
ANFGNTNDITENN

SEQ ID NO: 2111347 - protein, 6 aa, Cryptosporidium hominis
ANFGSE

SEQ ID NO: 2111348 - protein, 11 aa, Cryptosporidium hominis
ANFQANQNNLQ

SEQ ID NO: 2111349 - protein, 8 aa, Cryptosporidium hominis
ANGEDVES

SEQ ID NO: 2111350 - protein, 21 aa, Cryptosporidium hominis
ANGQAGRRSISQERKANKNEK

SEQ ID NO: 2111351 - protein, 10 aa, Cryptosporidium hominis
ANGYNKTTSM

SEQ ID NO: 2111352 - protein, 9 aa, Cryptosporidium hominis
ANKKEDFTE

SEQ ID NO: 2111353 - protein, 8 aa, Cryptosporidium hominis
ANKLKNNV

SEQ ID NO: 2111354 - protein, 6 aa, Cryptosporidium hominis
ANKSKN

SEQ ID NO: 2111355 - protein, 5 aa, Cryptosporidium hominis
ANLDQ

SEQ ID NO: 2111356 - protein, 5 aa, Cryptosporidium hominis
ANLEN

SEQ ID NO: 2111357 - protein, 15 aa, Cryptosporidium hominis
ANLSNENRNNSAEDI

SEQ ID NO: 2111358 - protein, 17 aa, Cryptosporidium hominis
ANNEENKVNKDELNSGI

SEQ ID NO: 2111359 - protein, 9 aa, Cryptosporidium hominis
ANNKAGGEK

SEQ ID NO: 2111360 - protein, 6 aa, Cryptosporidium hominis
ANNPIE

SEQ ID NO: 2111361 - protein, 6 aa, Cryptosporidium hominis
ANNSDQ

SEQ ID NO: 2111362 - protein, 6 aa, Cryptosporidium hominis
ANNSNS

SEQ ID NO: 2111363 - protein, 10 aa, Cryptosporidium hominis
ANNSSGRRKY

SEQ ID NO: 2111364 - protein, 5 aa, Cryptosporidium hominis
ANNVQ

SEQ ID NO: 2111365 - protein, 13 aa, Cryptosporidium hominis
ANPENSEDQGLKE

SEQ ID NO: 2111366 - protein, 4 aa, Cryptosporidium hominis
ANPK

SEQ ID NO: 2111367 - protein, 13 aa, Cryptosporidium hominis
ANPNEKDKYRRTP

SEQ ID NO: 2111368 - protein, 17 aa, Cryptosporidium hominis
ANPNKYYTGPNSNYYGD

SEQ ID NO: 2111369 - protein, 7 aa, Cryptosporidium hominis
ANQESNI

SEQ ID NO: 2111370 - protein, 28 aa, Cryptosporidium hominis
ANQGHGNNSGEGSGNGAGGAGNGSGGIG

SEQ ID NO: 2111371 - protein, 6 aa, Cryptosporidium hominis
ANREKN

SEQ ID NO: 2111372 - protein, 6 aa, Cryptosporidium hominis
ANRTTL

SEQ ID NO: 2111373 - protein, 13 aa, Cryptosporidium hominis
ANSDGNVSNSVET

SEQ ID NO: 2111374 - protein, 9 aa, Cryptosporidium hominis
ANSEKVQKS

SEQ ID NO: 2111375 - protein, 4 aa, Cryptosporidium hominis
ANSG

SEQ ID NO: 2111376 - protein, 8 aa, Cryptosporidium hominis
ANSPKNND

SEQ ID NO: 2111377 - protein, 6 aa, Cryptosporidium hominis
ANSVGK

SEQ ID NO: 2111378 - protein, 4 aa, Cryptosporidium hominis
ANTE

SEQ ID NO: 2111379 - protein, 12 aa, Cryptosporidium hominis
ANTQNISEDPKD

SEQ ID NO: 2111380 - protein, 15 aa, Cryptosporidium hominis
ANTQSNTQSTIRPNK

SEQ ID NO: 2111381 - protein, 5 aa, Cryptosporidium hominis
ANTQY

SEQ ID NO: 2111382 - protein, 5 aa, Cryptosporidium hominis
ANVYE

SEQ ID NO: 2111383 - protein, 13 aa, Cryptosporidium hominis
ANYDSSDSGSVDS

SEQ ID NO: 2111384 - protein, 8 aa, Cryptosporidium hominis
APAPNSLY

SEQ ID NO: 2111385 - protein, 5 aa, Cryptosporidium hominis
APEGI

SEQ ID NO: 2111386 - protein, 10 aa, Cryptosporidium hominis
APEGRGPSQP

SEQ ID NO: 2111387 - protein, 9 aa, Cryptosporidium hominis
APEHGKNVP

SEQ ID NO: 2111388 - protein, 6 aa, Cryptosporidium hominis
APGGYY

SEQ ID NO: 2111389 - protein, 4 aa, Cryptosporidium hominis
APGQ

SEQ ID NO: 2111390 - protein, 23 aa, Cryptosporidium hominis
APHRGGCGQDKDNYSELGSGGLP

SEQ ID NO: 2111391 - protein, 5 aa, Cryptosporidium hominis
APHSV

SEQ ID NO: 2111392 - protein, 5 aa, Cryptosporidium hominis
APIES

SEQ ID NO: 2111393 - protein, 4 aa, Cryptosporidium hominis
APIG

SEQ ID NO: 2111394 - protein, 12 aa, Cryptosporidium hominis
APKNTNKDLNSP

SEQ ID NO: 2111395 - protein, 8 aa, Cryptosporidium hominis
APKSSPKY

SEQ ID NO: 2111396 - protein, 4 aa, Cryptosporidium hominis
APLD

SEQ ID NO: 2111397 - protein, 5 aa, Cryptosporidium hominis
APLGT

SEQ ID NO: 2111398 - protein, 6 aa, Cryptosporidium hominis
APLSPQ

SEQ ID NO: 2111399 - protein, 6 aa, Cryptosporidium hominis
APNNEK

SEQ ID NO: 2111400 - protein, 8 aa, Cryptosporidium hominis
APPESSIE

SEQ ID NO: 2111401 - protein, 8 aa, Cryptosporidium hominis
APPKEGLQ

SEQ ID NO: 2111402 - protein, 4 aa, Cryptosporidium hominis
APSI

SEQ ID NO: 2111403 - protein, 7 aa, Cryptosporidium hominis
APSQKGN

SEQ ID NO: 2111404 - protein, 6 aa, Cryptosporidium hominis
APTDSK

SEQ ID NO: 2111405 - protein, 7 aa, Cryptosporidium hominis
APTESEV

SEQ ID NO: 2111406 - protein, 7 aa, Cryptosporidium hominis
APTFQPR

SEQ ID NO: 2111407 - protein, 14 aa, Cryptosporidium hominis
APVGEDGQGNASKR

SEQ ID NO: 2111408 - protein, 7 aa, Cryptosporidium hominis
AQAEKTP

SEQ ID NO: 2111409 - protein, 5 aa, Cryptosporidium hominis
AQETQ

SEQ ID NO: 2111410 - protein, 5 aa, Cryptosporidium hominis
AQGIS

SEQ ID NO: 2111411 - protein, 17 aa, Cryptosporidium hominis
AQHQKEVKDGRYKEEKA

SEQ ID NO: 2111412 - protein, 10 aa, Cryptosporidium hominis
AQHQQESNNF

SEQ ID NO: 2111413 - protein, 12 aa, Cryptosporidium hominis
AQKDNDEAENTL

SEQ ID NO: 2111414 - protein, 13 aa, Cryptosporidium hominis
AQPKPKPKPKPVV

SEQ ID NO: 2111415 - protein, 11 aa, Cryptosporidium hominis
AQPKPKPKQNV

SEQ ID NO: 2111416 - protein, 7 aa, Cryptosporidium hominis
AQRPNSD

SEQ ID NO: 2111417 - protein, 8 aa, Cryptosporidium hominis
AQRRDKNT

SEQ ID NO: 2111418 - protein, 5 aa, Cryptosporidium hominis
AQRRI

SEQ ID NO: 2111419 - protein, 7 aa, Cryptosporidium hominis
AQSASSA

SEQ ID NO: 2111420 - protein, 12 aa, Cryptosporidium hominis
AQSASSQSIEAQ

SEQ ID NO: 2111421 - protein, 4 aa, Cryptosporidium hominis
AQTA

SEQ ID NO: 2111422 - protein, 10 aa, Cryptosporidium hominis
AQTKKNPDIS

SEQ ID NO: 2111423 - protein, 4 aa, Cryptosporidium hominis
AQYQ

SEQ ID NO: 2111424 - protein, 8 aa, Cryptosporidium hominis
ARAEETQN

SEQ ID NO: 2111425 - protein, 7 aa, Cryptosporidium hominis
ARDHGPG

SEQ ID NO: 2111426 - protein, 7 aa, Cryptosporidium hominis
ARINTQE

SEQ ID NO: 2111427 - protein, 4 aa, Cryptosporidium hominis
ARKG

SEQ ID NO: 2111428 - protein, 7 aa, Cryptosporidium hominis
ARKNNNL

SEQ ID NO: 2111429 - protein, 7 aa, Cryptosporidium hominis
ARKRKNG

SEQ ID NO: 2111430 - protein, 4 aa, Cryptosporidium hominis
ARKV

SEQ ID NO: 2111431 - protein, 5 aa, Cryptosporidium hominis
ARNTA

SEQ ID NO: 2111432 - protein, 10 aa, Cryptosporidium hominis
ARPNEKRGEM

SEQ ID NO: 2111433 - protein, 6 aa, Cryptosporidium hominis
ARQEGR

SEQ ID NO: 2111434 - protein, 7 aa, Cryptosporidium hominis
ARSGKTT

SEQ ID NO: 2111435 - protein, 10 aa, Cryptosporidium hominis
ARSQNQGSAR

SEQ ID NO: 2111436 - protein, 26 aa, Cryptosporidium hominis
ARSSSGSFESDSTESGRVNEERNDTL

SEQ ID NO: 2111437 - protein, 6 aa, Cryptosporidium hominis
ARTDES

SEQ ID NO: 2111438 - protein, 9 aa, Cryptosporidium hominis
ARTSFEDDS

SEQ ID NO: 2111439 - protein, 6 aa, Cryptosporidium hominis
ASCDGG

SEQ ID NO: 2111440 - protein, 5 aa, Cryptosporidium hominis
ASCPN

SEQ ID NO: 2111441 - protein, 10 aa, Cryptosporidium hominis
ASCTSSTNAQ

SEQ ID NO: 2111442 - protein, 7 aa, Cryptosporidium hominis
ASDGIGK

SEQ ID NO: 2111443 - protein, 4 aa, Cryptosporidium hominis
ASDI

SEQ ID NO: 2111444 - protein, 5 aa, Cryptosporidium hominis
ASDLT

SEQ ID NO: 2111445 - protein, 15 aa, Cryptosporidium hominis
ASDSSFQDGFENDSH

SEQ ID NO: 2111446 - protein, 14 aa, Cryptosporidium hominis
ASDTRTATREEVES

SEQ ID NO: 2111447 - protein, 6 aa, Cryptosporidium hominis
ASEDEE

SEQ ID NO: 2111448 - protein, 38 aa, Cryptosporidium hominis
ASEEVGGELAGTIDSSSIKDSKELEKMESNVTDGKAIY

SEQ ID NO: 2111449 - protein, 11 aa, Cryptosporidium hominis
ASESSSSHSMG

SEQ ID NO: 2111450 - protein, 9 aa, Cryptosporidium hominis
ASFAKNEGK

SEQ ID NO: 2111451 - protein, 4 aa, Cryptosporidium hominis
ASGA

SEQ ID NO: 2111452 - protein, 33 aa, Cryptosporidium hominis
ASGAGIGTSPGGNIGPSPSLTPSPGTPTTGAGA

SEQ ID NO: 2111453 - protein, 11 aa, Cryptosporidium hominis
ASGGSNSGTPL

SEQ ID NO: 2111454 - protein, 4 aa, Cryptosporidium hominis
ASGI

SEQ ID NO: 2111455 - protein, 7 aa, Cryptosporidium hominis
ASGLPQE

SEQ ID NO: 2111456 - protein, 6 aa, Cryptosporidium hominis
ASGPNL

SEQ ID NO: 2111457 - protein, 8 aa, Cryptosporidium hominis
ASGSDNIA

SEQ ID NO: 2111458 - protein, 39 aa, Cryptosporidium hominis
ASINGHNRAQRHAKPTASASSYTPQKHHPTVSVNSEKKI

SEQ ID NO: 2111459 - protein, 4 aa, Cryptosporidium hominis
ASIR

SEQ ID NO: 2111460 - protein, 10 aa, Cryptosporidium hominis
ASLEGSTKTR

SEQ ID NO: 2111461 - protein, 17 aa, Cryptosporidium hominis
ASMADSTAGTNGQNAGE

SEQ ID NO: 2111462 - protein, 27 aa, Cryptosporidium hominis
ASMEDGDSSNSGEDKKKSTGDSQLESN

SEQ ID NO: 2111463 - protein, 7 aa, Cryptosporidium hominis
ASMTTET

SEQ ID NO: 2111464 - protein, 8 aa, Cryptosporidium hominis
ASNFKNDS

SEQ ID NO: 2111465 - protein, 4 aa, Cryptosporidium hominis
ASNG

SEQ ID NO: 2111466 - protein, 6 aa, Cryptosporidium hominis
ASNGRT

SEQ ID NO: 2111467 - protein, 8 aa, Cryptosporidium hominis
ASNIKRRK

SEQ ID NO: 2111468 - protein, 9 aa, Cryptosporidium hominis
ASNLKDEEI

SEQ ID NO: 2111469 - protein, 6 aa, Cryptosporidium hominis
ASNPIS

SEQ ID NO: 2111470 - protein, 4 aa, Cryptosporidium hominis
ASNS

SEQ ID NO: 2111471 - protein, 10 aa, Cryptosporidium hominis
ASNSEDSTKI

SEQ ID NO: 2111472 - protein, 8 aa, Cryptosporidium hominis
ASNTAGEA

SEQ ID NO: 2111473 - protein, 13 aa, Cryptosporidium hominis
ASPASNNRRRSSL

SEQ ID NO: 2111474 - protein, 7 aa, Cryptosporidium hominis
ASPEDEA

SEQ ID NO: 2111475 - protein, 10 aa, Cryptosporidium hominis
ASPEDTGIDY

SEQ ID NO: 2111476 - protein, 18 aa, Cryptosporidium hominis
ASPSNVSLSASNDSRKGT

SEQ ID NO: 2111477 - protein, 8 aa, Cryptosporidium hominis
ASQETSNK

SEQ ID NO: 2111478 - protein, 7 aa, Cryptosporidium hominis
ASQGNNY

SEQ ID NO: 2111479 - protein, 5 aa, Cryptosporidium hominis
ASQKN

SEQ ID NO: 2111480 - protein, 51 aa, Cryptosporidium hominis
ASQNNQGSESTHSEVKSQNIVSNNGEDGECTNRRNNKGSNNIKTVSSYQRE

SEQ ID NO: 2111481 - protein, 32 aa, Cryptosporidium hominis
ASQSPRQGSPRASSSGILDTSSPYANRHTPEQ

SEQ ID NO: 2111482 - protein, 9 aa, Cryptosporidium hominis
ASQTSPNIE

SEQ ID NO: 2111483 - protein, 9 aa, Cryptosporidium hominis
ASRSQLSNS

SEQ ID NO: 2111484 - protein, 8 aa, Cryptosporidium hominis
ASRTAENS

SEQ ID NO: 2111485 - protein, 26 aa, Cryptosporidium hominis
ASSAKGSKYKGSKFDTSISGSSSSLK

SEQ ID NO: 2111486 - protein, 4 aa, Cryptosporidium hominis
ASSE

SEQ ID NO: 2111487 - protein, 7 aa, Cryptosporidium hominis
ASSGIGK

SEQ ID NO: 2111488 - protein, 4 aa, Cryptosporidium hominis
ASSH

SEQ ID NO: 2111489 - protein, 8 aa, Cryptosporidium hominis
ASSHGDPL

SEQ ID NO: 2111490 - protein, 17 aa, Cryptosporidium hominis
ASSKPRTSFGATDENSI

SEQ ID NO: 2111491 - protein, 7 aa, Cryptosporidium hominis
ASSPELV

SEQ ID NO: 2111492 - protein, 7 aa, Cryptosporidium hominis
ASSPSNV

SEQ ID NO: 2111493 - protein, 8 aa, Cryptosporidium hominis
ASSQERAP

SEQ ID NO: 2111494 - protein, 9 aa, Cryptosporidium hominis
ASSQKTQAC

SEQ ID NO: 2111495 - protein, 10 aa, Cryptosporidium hominis
ASSSNKSSIS

SEQ ID NO: 2111496 - protein, 10 aa, Cryptosporidium hominis
ASSVKRTKRH

SEQ ID NO: 2111497 - protein, 8 aa, Cryptosporidium hominis
ASTKSEKR

SEQ ID NO: 2111498 - protein, 9 aa, Cryptosporidium hominis
ASTPCRDET

SEQ ID NO: 2111499 - protein, 7 aa, Cryptosporidium hominis
ASTPNDL

SEQ ID NO: 2111500 - protein, 36 aa, Cryptosporidium hominis
ASTQHRVPRDNPSKGKKNKQKVRKEKPFTGAEKLPR

SEQ ID NO: 2111501 - protein, 4 aa, Cryptosporidium hominis
ASTS

SEQ ID NO: 2111502 - protein, 8 aa, Cryptosporidium hominis
ASTSEQLN

SEQ ID NO: 2111503 - protein, 25 aa, Cryptosporidium hominis
ASTTTTTTKVDTKNYNVQSPTDNSI

SEQ ID NO: 2111504 - protein, 21 aa, Cryptosporidium hominis
ASVSASSETEIPPAASVPRES

SEQ ID NO: 2111505 - protein, 7 aa, Cryptosporidium hominis
ASYPTSL

SEQ ID NO: 2111506 - protein, 12 aa, Cryptosporidium hominis
ATCGSGSTTRTR

SEQ ID NO: 2111507 - protein, 11 aa, Cryptosporidium hominis
ATDKKKAKVSA

SEQ ID NO: 2111508 - protein, 4 aa, Cryptosporidium hominis
ATDP

SEQ ID NO: 2111509 - protein, 5 aa, Cryptosporidium hominis
ATEED

SEQ ID NO: 2111510 - protein, 5 aa, Cryptosporidium hominis
ATGQA

SEQ ID NO: 2111511 - protein, 7 aa, Cryptosporidium hominis
ATHGSEL

SEQ ID NO: 2111512 - protein, 26 aa, Cryptosporidium hominis
ATHPPPNSTNSTPNNESTQSNRNSLS

SEQ ID NO: 2111513 - protein, 6 aa, Cryptosporidium hominis
ATIKNG

SEQ ID NO: 2111514 - protein, 6 aa, Cryptosporidium hominis
ATISKT

SEQ ID NO: 2111515 - protein, 4 aa, Cryptosporidium hominis
ATKS

SEQ ID NO: 2111516 - protein, 4 aa, Cryptosporidium hominis
ATLP

SEQ ID NO: 2111517 - protein, 8 aa, Cryptosporidium hominis
ATNSGKMD

SEQ ID NO: 2111518 - protein, 8 aa, Cryptosporidium hominis
ATQKSQAV

SEQ ID NO: 2111519 - protein, 11 aa, Cryptosporidium hominis
ATQSSQKWRNY

SEQ ID NO: 2111520 - protein, 4 aa, Cryptosporidium hominis
ATSA

SEQ ID NO: 2111521 - protein, 22 aa, Cryptosporidium hominis
ATSNANNGPSSHSNVNNGPIEM

SEQ ID NO: 2111522 - protein, 9 aa, Cryptosporidium hominis
ATSSTGIPS

SEQ ID NO: 2111523 - protein, 11 aa, Cryptosporidium hominis
ATSSVDSHTDS

SEQ ID NO: 2111524 - protein, 6 aa, Cryptosporidium hominis
ATSTSS

SEQ ID NO: 2111525 - protein, 9 aa, Cryptosporidium hominis
ATTAPIAPA

SEQ ID NO: 2111526 - protein, 23 aa, Cryptosporidium hominis
ATTFNSEETETDFPPSRSSGDKY

SEQ ID NO: 2111527 - protein, 11 aa, Cryptosporidium hominis
ATTLTGNQKTR

SEQ ID NO: 2111528 - protein, 24 aa, Cryptosporidium hominis
ATTPDRPDSDYETWSPYDGRNSEK

SEQ ID NO: 2111529 - protein, 21 aa, Cryptosporidium hominis
ATTPVHTSNNSLKNDDSVSVR

SEQ ID NO: 2111530 - protein, 16 aa, Cryptosporidium hominis
ATTTTTTEKTKTTSND

SEQ ID NO: 2111531 - protein, 6 aa, Cryptosporidium hominis
ATVRPE

SEQ ID NO: 2111532 - protein, 10 aa, Cryptosporidium hominis
ATVSGISSGV

SEQ ID NO: 2111533 - protein, 16 aa, Cryptosporidium hominis
AVDKSSTSTSTSTAFT

SEQ ID NO: 2111534 - protein, 6 aa, Cryptosporidium hominis
AVEGKY

SEQ ID NO: 2111535 - protein, 15 aa, Cryptosporidium hominis
AVEKNTDKDGSAFSV

SEQ ID NO: 2111536 - protein, 12 aa, Cryptosporidium hominis
AVENPKQSKTIT

SEQ ID NO: 2111537 - protein, 6 aa, Cryptosporidium hominis
AVGGRR

SEQ ID NO: 2111538 - protein, 20 aa, Cryptosporidium hominis
AVNQDGKSASLTAPNGPSQK

SEQ ID NO: 2111539 - protein, 12 aa, Cryptosporidium hominis
AVTNPKVNSDQV

SEQ ID NO: 2111540 - protein, 12 aa, Cryptosporidium hominis
AWGEGSDSYRRS

SEQ ID NO: 2111541 - protein, 5 aa, Cryptosporidium hominis
AYDTL

SEQ ID NO: 2111542 - protein, 5 aa, Cryptosporidium hominis
AYGNK

SEQ ID NO: 2111543 - protein, 5 aa, Cryptosporidium hominis
AYKSS

SEQ ID NO: 2111544 - protein, 23 aa, Cryptosporidium hominis
AYNEQLDKESKEYQKFIQKYNNI

SEQ ID NO: 2111545 - protein, 7 aa, Cryptosporidium hominis
AYNSSSY

SEQ ID NO: 2111546 - protein, 5 aa, Cryptosporidium hominis
AYPSR

SEQ ID NO: 2111547 - protein, 5 aa, Cryptosporidium hominis
AYQNS

SEQ ID NO: 2111548 - protein, 5 aa, Cryptosporidium hominis
AYSND

SEQ ID NO: 2111549 - protein, 10 aa, Cryptosporidium hominis
AYYSENERRW

SEQ ID NO: 2111550 - protein, 9 aa, Cryptosporidium hominis
CASNNPTSS

SEQ ID NO: 2111551 - protein, 8 aa, Cryptosporidium hominis
CDDNSASC

SEQ ID NO: 2111552 - protein, 9 aa, Cryptosporidium hominis
CDDSNFNDI

SEQ ID NO: 2111553 - protein, 5 aa, Cryptosporidium hominis
CDNES

SEQ ID NO: 2111554 - protein, 8 aa, Cryptosporidium hominis
CDSANSRG

SEQ ID NO: 2111555 - protein, 4 aa, Cryptosporidium hominis
CDSP

SEQ ID NO: 2111556 - protein, 9 aa, Cryptosporidium hominis
CDSSPRPWN

SEQ ID NO: 2111557 - protein, 7 aa, Cryptosporidium hominis
CEENNPC

SEQ ID NO: 2111558 - protein, 7 aa, Cryptosporidium hominis
CEEVSSD

SEQ ID NO: 2111559 - protein, 11 aa, Cryptosporidium hominis
CEKGELSSANQ

SEQ ID NO: 2111560 - protein, 5 aa, Cryptosporidium hominis
CEQAP

SEQ ID NO: 2111561 - protein, 11 aa, Cryptosporidium hominis
CFKTSKPSSFC

SEQ ID NO: 2111562 - protein, 5 aa, Cryptosporidium hominis
CFQSN

SEQ ID NO: 2111563 - protein, 6 aa, Cryptosporidium hominis
CGENRK

SEQ ID NO: 2111564 - protein, 18 aa, Cryptosporidium hominis
CGEVSNEEFKKSQSYSNS

SEQ ID NO: 2111565 - protein, 11 aa, Cryptosporidium hominis
CGKGNSTRSRS

SEQ ID NO: 2111566 - protein, 10 aa, Cryptosporidium hominis
CGKNSSENTI

SEQ ID NO: 2111567 - protein, 5 aa, Cryptosporidium hominis
CGSNP

SEQ ID NO: 2111568 - protein, 6 aa, Cryptosporidium hominis
CGSSDQ

SEQ ID NO: 2111569 - protein, 25 aa, Cryptosporidium hominis
CGTTTRNREVKGENCTELSTESKKC

SEQ ID NO: 2111570 - protein, 6 aa, Cryptosporidium hominis
CHPEQR

SEQ ID NO: 2111571 - protein, 5 aa, Cryptosporidium hominis
CKASA

SEQ ID NO: 2111572 - protein, 7 aa, Cryptosporidium hominis
CKEGYTG

SEQ ID NO: 2111573 - protein, 5 aa, Cryptosporidium hominis
CKHEN

SEQ ID NO: 2111574 - protein, 18 aa, Cryptosporidium hominis
CKPDDSTERNKEKRRGIT

SEQ ID NO: 2111575 - protein, 6 aa, Cryptosporidium hominis
CKPGEE

SEQ ID NO: 2111576 - protein, 17 aa, Cryptosporidium hominis
CKQAGSPSSGTEENSPL

SEQ ID NO: 2111577 - protein, 21 aa, Cryptosporidium hominis
CKSNESKSLECETSKENPPAP

SEQ ID NO: 2111578 - protein, 7 aa, Cryptosporidium hominis
CKSSGGS

SEQ ID NO: 2111579 - protein, 6 aa, Cryptosporidium hominis
CLDKAS

SEQ ID NO: 2111580 - protein, 5 aa, Cryptosporidium hominis
CNARS

SEQ ID NO: 2111581 - protein, 8 aa, Cryptosporidium hominis
CNDSSLDE

SEQ ID NO: 2111582 - protein, 6 aa, Cryptosporidium hominis
CNETNS

SEQ ID NO: 2111583 - protein, 22 aa, Cryptosporidium hominis
CNGDSNEAQALGDQSDVNKTNA

SEQ ID NO: 2111584 - protein, 19 aa, Cryptosporidium hominis
CNGYSSEKYSFKRDSSTYS

SEQ ID NO: 2111585 - protein, 22 aa, Cryptosporidium hominis
CNKQTNSQQNITSTCGSKKPEA

SEQ ID NO: 2111586 - protein, 7 aa, Cryptosporidium hominis
CNNNGQR

SEQ ID NO: 2111587 - protein, 12 aa, Cryptosporidium hominis
CNNSSRKVNNLQ

SEQ ID NO: 2111588 - protein, 21 aa, Cryptosporidium hominis
CNQSGDGDSNIESEIRENSNG

SEQ ID NO: 2111589 - protein, 9 aa, Cryptosporidium hominis
CNSNEDQDK

SEQ ID NO: 2111590 - protein, 11 aa, Cryptosporidium hominis
CNSNSNNKDND

SEQ ID NO: 2111591 - protein, 23 aa, Cryptosporidium hominis
CNSNSNNNNNDSNQQEISTSSKY

SEQ ID NO: 2111592 - protein, 11 aa, Cryptosporidium hominis
CNSSKEKFDYP

SEQ ID NO: 2111593 - protein, 5 aa, Cryptosporidium hominis
CNTQY

SEQ ID NO: 2111594 - protein, 8 aa, Cryptosporidium hominis
CNYPRNNE

SEQ ID NO: 2111595 - protein, 6 aa, Cryptosporidium hominis
CPANSF

SEQ ID NO: 2111596 - protein, 6 aa, Cryptosporidium hominis
CPENCP

SEQ ID NO: 2111597 - protein, 4 aa, Cryptosporidium hominis
CPGA

SEQ ID NO: 2111598 - protein, 12 aa, Cryptosporidium hominis
CPPGSSMTEDNK

SEQ ID NO: 2111599 - protein, 5 aa, Cryptosporidium hominis
CPQGS

SEQ ID NO: 2111600 - protein, 10 aa, Cryptosporidium hominis
CQKDSSASQF

SEQ ID NO: 2111601 - protein, 6 aa, Cryptosporidium hominis
CQNNNC

SEQ ID NO: 2111602 - protein, 19 aa, Cryptosporidium hominis
CQSNNFSATSSSSYSSNLG

SEQ ID NO: 2111603 - protein, 27 aa, Cryptosporidium hominis
CQSSKDTRSCSKPEGCTETAPDSGDAT

SEQ ID NO: 2111604 - protein, 4 aa, Cryptosporidium hominis
CRNL

SEQ ID NO: 2111605 - protein, 4 aa, Cryptosporidium hominis
CRRQ

SEQ ID NO: 2111606 - protein, 8 aa, Cryptosporidium hominis
CSGTQTRD

SEQ ID NO: 2111607 - protein, 11 aa, Cryptosporidium hominis
CSKSASHSSIQ

SEQ ID NO: 2111608 - protein, 10 aa, Cryptosporidium hominis
CSLSGGEKQR

SEQ ID NO: 2111609 - protein, 8 aa, Cryptosporidium hominis
CSLSGGQR

SEQ ID NO: 2111610 - protein, 4 aa, Cryptosporidium hominis
CSNI

SEQ ID NO: 2111611 - protein, 8 aa, Cryptosporidium hominis
CSPPGKDL

SEQ ID NO: 2111612 - protein, 15 aa, Cryptosporidium hominis
CSPSSCDNKPKEPTH

SEQ ID NO: 2111613 - protein, 4 aa, Cryptosporidium hominis
CSSE

SEQ ID NO: 2111614 - protein, 7 aa, Cryptosporidium hominis
CSSNEKI

SEQ ID NO: 2111615 - protein, 9 aa, Cryptosporidium hominis
CSSPNSDLG

SEQ ID NO: 2111616 - protein, 12 aa, Cryptosporidium hominis
CSSSSQLEPLGE

SEQ ID NO: 2111617 - protein, 6 aa, Cryptosporidium hominis
CSTDCQ

SEQ ID NO: 2111618 - protein, 9 aa, Cryptosporidium hominis
CSTSDDSEV

SEQ ID NO: 2111619 - protein, 6 aa, Cryptosporidium hominis
CSYSPN

SEQ ID NO: 2111620 - protein, 4 aa, Cryptosporidium hominis
CTEN

SEQ ID NO: 2111621 - protein, 4 aa, Cryptosporidium hominis
CTGR

SEQ ID NO: 2111622 - protein, 5 aa, Cryptosporidium hominis
CTKGI

SEQ ID NO: 2111623 - protein, 12 aa, Cryptosporidium hominis
CTKSDGSPNNHE

SEQ ID NO: 2111624 - protein, 6 aa, Cryptosporidium hominis
CTPCPE

SEQ ID NO: 2111625 - protein, 7 aa, Cryptosporidium hominis
CTRGTES

SEQ ID NO: 2111626 - protein, 5 aa, Cryptosporidium hominis
CTRKS

SEQ ID NO: 2111627 - protein, 6 aa, Cryptosporidium hominis
CVPRSS

SEQ ID NO: 2111628 - protein, 9 aa, Cryptosporidium hominis
DAANKRSGA

SEQ ID NO: 2111629 - protein, 11 aa, Cryptosporidium hominis
DACSNNKSKTW

SEQ ID NO: 2111630 - protein, 9 aa, Cryptosporidium hominis
DADISGNKS

SEQ ID NO: 2111631 - protein, 5 aa, Cryptosporidium hominis
DADSY

SEQ ID NO: 2111632 - protein, 18 aa, Cryptosporidium hominis
DAERRKKHPDTGKLPRYP

SEQ ID NO: 2111633 - protein, 11 aa, Cryptosporidium hominis
DAGIRGTAQQS

SEQ ID NO: 2111634 - protein, 13 aa, Cryptosporidium hominis
DAGNDSGKNDSSF

SEQ ID NO: 2111635 - protein, 6 aa, Cryptosporidium hominis
DAGSSA

SEQ ID NO: 2111636 - protein, 6 aa, Cryptosporidium hominis
DAGTSI

SEQ ID NO: 2111637 - protein, 11 aa, Cryptosporidium hominis
DAKSIPSSIKN

SEQ ID NO: 2111638 - protein, 4 aa, Cryptosporidium hominis
DAKT

SEQ ID NO: 2111639 - protein, 94 aa, Cryptosporidium hominis
DANDNVQTKDESKEGSKDMSKEEQSTQETSSDGSNNDNDISSGTEEKSDSETEKGEDNKSGISEAIDEKNDENANTDTKDEQSNATNGQDGSLL

SEQ ID NO: 2111640 - protein, 7 aa, Cryptosporidium hominis
DANEDAD

SEQ ID NO: 2111641 - protein, 14 aa, Cryptosporidium hominis
DANENTQSKNLNEK

SEQ ID NO: 2111642 - protein, 5 aa, Cryptosporidium hominis
DAPVD

SEQ ID NO: 2111643 - protein, 11 aa, Cryptosporidium hominis
DARKSVSTSLD

SEQ ID NO: 2111644 - protein, 12 aa, Cryptosporidium hominis
DASEDSSGSEND

SEQ ID NO: 2111645 - protein, 7 aa, Cryptosporidium hominis
DASNKYK

SEQ ID NO: 2111646 - protein, 8 aa, Cryptosporidium hominis
DASRGSQT

SEQ ID NO: 2111647 - protein, 12 aa, Cryptosporidium hominis
DASRSTEYGGTD

SEQ ID NO: 2111648 - protein, 8 aa, Cryptosporidium hominis
DASSNINS

SEQ ID NO: 2111649 - protein, 10 aa, Cryptosporidium hominis
DASSSSPESI

SEQ ID NO: 2111650 - protein, 7 aa, Cryptosporidium hominis
DATQSAI

SEQ ID NO: 2111651 - protein, 12 aa, Cryptosporidium hominis
DATTEGSENVDD

SEQ ID NO: 2111652 - protein, 9 aa, Cryptosporidium hominis
DAYGDGPWH

SEQ ID NO: 2111653 - protein, 17 aa, Cryptosporidium hominis
DAYNQNHNNKSKVDNSI

SEQ ID NO: 2111654 - protein, 4 aa, Cryptosporidium hominis
DCDP

SEQ ID NO: 2111655 - protein, 7 aa, Cryptosporidium hominis
DCNKNSN

SEQ ID NO: 2111656 - protein, 4 aa, Cryptosporidium hominis
DCNP

SEQ ID NO: 2111657 - protein, 16 aa, Cryptosporidium hominis
DCPPPKSAKSDGIPTA

SEQ ID NO: 2111658 - protein, 25 aa, Cryptosporidium hominis
DCSSDSENNTYGSQKHETKNSNCEI

SEQ ID NO: 2111659 - protein, 10 aa, Cryptosporidium hominis
DCTDSDGRTP

SEQ ID NO: 2111660 - protein, 7 aa, Cryptosporidium hominis
DCTKDSL

SEQ ID NO: 2111661 - protein, 9 aa, Cryptosporidium hominis
DDADPDKVS

SEQ ID NO: 2111662 - protein, 7 aa, Cryptosporidium hominis
DDAGKNR

SEQ ID NO: 2111663 - protein, 4 aa, Cryptosporidium hominis
DDCR

SEQ ID NO: 2111664 - protein, 36 aa, Cryptosporidium hominis
DDDDEEDDIDFDEEDDVVEDSNLSENEPEIETLNDQ

SEQ ID NO: 2111665 - protein, 4 aa, Cryptosporidium hominis
DDDF

SEQ ID NO: 2111666 - protein, 9 aa, Cryptosporidium hominis
DDDGNSKSV

SEQ ID NO: 2111667 - protein, 9 aa, Cryptosporidium hominis
DDDKKLSED

SEQ ID NO: 2111668 - protein, 9 aa, Cryptosporidium hominis
DDEDEDDHA

SEQ ID NO: 2111669 - protein, 6 aa, Cryptosporidium hominis
DDELEN

SEQ ID NO: 2111670 - protein, 6 aa, Cryptosporidium hominis
DDENTE

SEQ ID NO: 2111671 - protein, 4 aa, Cryptosporidium hominis
DDET

SEQ ID NO: 2111672 - protein, 4 aa, Cryptosporidium hominis
DDEY

SEQ ID NO: 2111673 - protein, 4 aa, Cryptosporidium hominis
DDFS

SEQ ID NO: 2111674 - protein, 4 aa, Cryptosporidium hominis
DDGE

SEQ ID NO: 2111675 - protein, 8 aa, Cryptosporidium hominis
DDGEDFQN

SEQ ID NO: 2111676 - protein, 6 aa, Cryptosporidium hominis
DDGEEF

SEQ ID NO: 2111677 - protein, 8 aa, Cryptosporidium hominis
DDGKGVAP

SEQ ID NO: 2111678 - protein, 6 aa, Cryptosporidium hominis
DDHLTS

SEQ ID NO: 2111679 - protein, 8 aa, Cryptosporidium hominis
DDHSNHAA

SEQ ID NO: 2111680 - protein, 5 aa, Cryptosporidium hominis
DDILD

SEQ ID NO: 2111681 - protein, 9 aa, Cryptosporidium hominis
DDKKEIENR

SEQ ID NO: 2111682 - protein, 17 aa, Cryptosporidium hominis
DDKSTKAKANSSTPTRK

SEQ ID NO: 2111683 - protein, 4 aa, Cryptosporidium hominis
DDLL

SEQ ID NO: 2111684 - protein, 21 aa, Cryptosporidium hominis
DDNPSNTGNINGGISGNLCKY

SEQ ID NO: 2111685 - protein, 15 aa, Cryptosporidium hominis
DDNQTNQANTSINQN

SEQ ID NO: 2111686 - protein, 4 aa, Cryptosporidium hominis
DDPI

SEQ ID NO: 2111687 - protein, 6 aa, Cryptosporidium hominis
DDPIYS

SEQ ID NO: 2111688 - protein, 6 aa, Cryptosporidium hominis
DDPNPL

SEQ ID NO: 2111689 - protein, 7 aa, Cryptosporidium hominis
DDPSASL

SEQ ID NO: 2111690 - protein, 5 aa, Cryptosporidium hominis
DDPSS

SEQ ID NO: 2111691 - protein, 12 aa, Cryptosporidium hominis
DDPVRNFSKESL

SEQ ID NO: 2111692 - protein, 9 aa, Cryptosporidium hominis
DDRHNDETF

SEQ ID NO: 2111693 - protein, 8 aa, Cryptosporidium hominis
DDRLPESL

SEQ ID NO: 2111694 - protein, 4 aa, Cryptosporidium hominis
DDRT

SEQ ID NO: 2111695 - protein, 16 aa, Cryptosporidium hominis
DDSDAHLDSTDEGTKL

SEQ ID NO: 2111696 - protein, 11 aa, Cryptosporidium hominis
DDSDPSLINSN

SEQ ID NO: 2111697 - protein, 7 aa, Cryptosporidium hominis
DDSDTKL

SEQ ID NO: 2111698 - protein, 10 aa, Cryptosporidium hominis
DDSEKKSEKS

SEQ ID NO: 2111699 - protein, 8 aa, Cryptosporidium hominis
DDSENSIN

SEQ ID NO: 2111700 - protein, 21 aa, Cryptosporidium hominis
DDSEQIGVDDNDDDNDEAENL

SEQ ID NO: 2111701 - protein, 7 aa, Cryptosporidium hominis
DDSFSGN

SEQ ID NO: 2111702 - protein, 13 aa, Cryptosporidium hominis
DDSGDEEASKNLG

SEQ ID NO: 2111703 - protein, 11 aa, Cryptosporidium hominis
DDSGFQPSDST

SEQ ID NO: 2111704 - protein, 5 aa, Cryptosporidium hominis
DDSGI

SEQ ID NO: 2111705 - protein, 9 aa, Cryptosporidium hominis
DDSLKYSNN

SEQ ID NO: 2111706 - protein, 7 aa, Cryptosporidium hominis
DDSLPRN

SEQ ID NO: 2111707 - protein, 6 aa, Cryptosporidium hominis
DDSNFS

SEQ ID NO: 2111708 - protein, 4 aa, Cryptosporidium hominis
DDSQ

SEQ ID NO: 2111709 - protein, 10 aa, Cryptosporidium hominis
DDSSNSLSEE

SEQ ID NO: 2111710 - protein, 15 aa, Cryptosporidium hominis
DDSTPSFNKEKSITI

SEQ ID NO: 2111711 - protein, 7 aa, Cryptosporidium hominis
DDTDSMT

SEQ ID NO: 2111712 - protein, 32 aa, Cryptosporidium hominis
DDTMEEERREGVEGVEGGEGEGEERGADARTC

SEQ ID NO: 2111713 - protein, 6 aa, Cryptosporidium hominis
DDTQGR

SEQ ID NO: 2111714 - protein, 8 aa, Cryptosporidium hominis
DDTTSPVT

SEQ ID NO: 2111715 - protein, 9 aa, Cryptosporidium hominis
DDYNTRYSN

SEQ ID NO: 2111716 - protein, 23 aa, Cryptosporidium hominis
DDYSKNNQNCEKKLNSNNMKGIV

SEQ ID NO: 2111717 - protein, 7 aa, Cryptosporidium hominis
DDYTDSA

SEQ ID NO: 2111718 - protein, 8 aa, Cryptosporidium hominis
DEALDNEP

SEQ ID NO: 2111719 - protein, 10 aa, Cryptosporidium hominis
DEATGGDEDF

SEQ ID NO: 2111720 - protein, 8 aa, Cryptosporidium hominis
DEDEQVSK

SEQ ID NO: 2111721 - protein, 10 aa, Cryptosporidium hominis
DEDGNGQINQ

SEQ ID NO: 2111722 - protein, 5 aa, Cryptosporidium hominis
DEDLT

SEQ ID NO: 2111723 - protein, 26 aa, Cryptosporidium hominis
DEDQEVSSCGKLDQKKSRWDNGEVET

SEQ ID NO: 2111724 - protein, 6 aa, Cryptosporidium hominis
DEDTNK

SEQ ID NO: 2111725 - protein, 10 aa, Cryptosporidium hominis
DEDTTASKTS

SEQ ID NO: 2111726 - protein, 7 aa, Cryptosporidium hominis
DEEDMLG

SEQ ID NO: 2111727 - protein, 23 aa, Cryptosporidium hominis
DEEIREDLKSSGQKENTEVYEKD

SEQ ID NO: 2111728 - protein, 6 aa, Cryptosporidium hominis
DEEKAL

SEQ ID NO: 2111729 - protein, 20 aa, Cryptosporidium hominis
DEETEESEAPGDDRVESRGR

SEQ ID NO: 2111730 - protein, 5 aa, Cryptosporidium hominis
DEEVS

SEQ ID NO: 2111731 - protein, 6 aa, Cryptosporidium hominis
DEGTDG

SEQ ID NO: 2111732 - protein, 15 aa, Cryptosporidium hominis
DEGTQKDGIKKEDDI

SEQ ID NO: 2111733 - protein, 4 aa, Cryptosporidium hominis
DEGV

SEQ ID NO: 2111734 - protein, 13 aa, Cryptosporidium hominis
DEGYYTKKSEINQ

SEQ ID NO: 2111735 - protein, 7 aa, Cryptosporidium hominis
DEIENET

SEQ ID NO: 2111736 - protein, 4 aa, Cryptosporidium hominis
DEIK

SEQ ID NO: 2111737 - protein, 4 aa, Cryptosporidium hominis
DEIN

SEQ ID NO: 2111738 - protein, 6 aa, Cryptosporidium hominis
DEISTT

SEQ ID NO: 2111739 - protein, 13 aa, Cryptosporidium hominis
DEKKSKEIQDRSE

SEQ ID NO: 2111740 - protein, 9 aa, Cryptosporidium hominis
DEKSLEPLS

SEQ ID NO: 2111741 - protein, 12 aa, Cryptosporidium hominis
DEKVQERKDDPV

SEQ ID NO: 2111742 - protein, 6 aa, Cryptosporidium hominis
DELSSK

SEQ ID NO: 2111743 - protein, 17 aa, Cryptosporidium hominis
DEMEGYEEELENNDDGL

SEQ ID NO: 2111744 - protein, 7 aa, Cryptosporidium hominis
DEMSTAY

SEQ ID NO: 2111745 - protein, 9 aa, Cryptosporidium hominis
DENAQDSDS

SEQ ID NO: 2111746 - protein, 7 aa, Cryptosporidium hominis
DENDNIG

SEQ ID NO: 2111747 - protein, 9 aa, Cryptosporidium hominis
DENGNLVDK

SEQ ID NO: 2111748 - protein, 9 aa, Cryptosporidium hominis
DENKESREV

SEQ ID NO: 2111749 - protein, 16 aa, Cryptosporidium hominis
DENMSRNEKGCIGREE

SEQ ID NO: 2111750 - protein, 10 aa, Cryptosporidium hominis
DENNSSGGSR

SEQ ID NO: 2111751 - protein, 7 aa, Cryptosporidium hominis
DENNSTV

SEQ ID NO: 2111752 - protein, 17 aa, Cryptosporidium hominis
DENPDIISSSKPSGNFP

SEQ ID NO: 2111753 - protein, 17 aa, Cryptosporidium hominis
DENPTVSTECSNSEISP

SEQ ID NO: 2111754 - protein, 11 aa, Cryptosporidium hominis
DENQKSGINER

SEQ ID NO: 2111755 - protein, 10 aa, Cryptosporidium hominis
DENSTNEKNI

SEQ ID NO: 2111756 - protein, 7 aa, Cryptosporidium hominis
DENVDDD

SEQ ID NO: 2111757 - protein, 9 aa, Cryptosporidium hominis
DEPETLPGL

SEQ ID NO: 2111758 - protein, 5 aa, Cryptosporidium hominis
DEPNY

SEQ ID NO: 2111759 - protein, 18 aa, Cryptosporidium hominis
DEPSLTDTYESVRPNDQI

SEQ ID NO: 2111760 - protein, 5 aa, Cryptosporidium hominis
DEPYH

SEQ ID NO: 2111761 - protein, 6 aa, Cryptosporidium hominis
DEQSGI

SEQ ID NO: 2111762 - protein, 5 aa, Cryptosporidium hominis
DEQTE

SEQ ID NO: 2111763 - protein, 8 aa, Cryptosporidium hominis
DEQWDASP

SEQ ID NO: 2111764 - protein, 8 aa, Cryptosporidium hominis
DERKGCEM

SEQ ID NO: 2111765 - protein, 9 aa, Cryptosporidium hominis
DERPNDRVQ

SEQ ID NO: 2111766 - protein, 6 aa, Cryptosporidium hominis
DERTAK

SEQ ID NO: 2111767 - protein, 10 aa, Cryptosporidium hominis
DESDSSENHV

SEQ ID NO: 2111768 - protein, 7 aa, Cryptosporidium hominis
DESERNA

SEQ ID NO: 2111769 - protein, 7 aa, Cryptosporidium hominis
DESHHRD

SEQ ID NO: 2111770 - protein, 21 aa, Cryptosporidium hominis
DESNSDTQSTETHYNSKDGTG

SEQ ID NO: 2111771 - protein, 7 aa, Cryptosporidium hominis
DESPSRR

SEQ ID NO: 2111772 - protein, 4 aa, Cryptosporidium hominis
DESQ

SEQ ID NO: 2111773 - protein, 18 aa, Cryptosporidium hominis
DESTKDLRSSSFDPSSQA

SEQ ID NO: 2111774 - protein, 4 aa, Cryptosporidium hominis
DETE

SEQ ID NO: 2111775 - protein, 4 aa, Cryptosporidium hominis
DETG

SEQ ID NO: 2111776 - protein, 8 aa, Cryptosporidium hominis
DETSKNRP

SEQ ID NO: 2111777 - protein, 30 aa, Cryptosporidium hominis
DEVQERKIGNDQFSNQHNNSLNRGDSFSGN

SEQ ID NO: 2111778 - protein, 4 aa, Cryptosporidium hominis
DEVV

SEQ ID NO: 2111779 - protein, 18 aa, Cryptosporidium hominis
DEWDNDSDPMSNYSKQNT

SEQ ID NO: 2111780 - protein, 12 aa, Cryptosporidium hominis
DFDGPGKVAKAT

SEQ ID NO: 2111781 - protein, 18 aa, Cryptosporidium hominis
DFDNNQELSNQNDSTMEN

SEQ ID NO: 2111782 - protein, 5 aa, Cryptosporidium hominis
DFDSN

SEQ ID NO: 2111783 - protein, 4 aa, Cryptosporidium hominis
DFEG

SEQ ID NO: 2111784 - protein, 15 aa, Cryptosporidium hominis
DFEPESGIDESKQTK

SEQ ID NO: 2111785 - protein, 12 aa, Cryptosporidium hominis
DFGNNNPRVQQT

SEQ ID NO: 2111786 - protein, 13 aa, Cryptosporidium hominis
DFGRAKKHSAQVT

SEQ ID NO: 2111787 - protein, 4 aa, Cryptosporidium hominis
DFNK

SEQ ID NO: 2111788 - protein, 4 aa, Cryptosporidium hominis
DFNR

SEQ ID NO: 2111789 - protein, 4 aa, Cryptosporidium hominis
DFPK

SEQ ID NO: 2111790 - protein, 10 aa, Cryptosporidium hominis
DFQDNQKTYN

SEQ ID NO: 2111791 - protein, 22 aa, Cryptosporidium hominis
DFRKKQEEERRRKEEEEKVASE

SEQ ID NO: 2111792 - protein, 11 aa, Cryptosporidium hominis
DFRRESKNPSL

SEQ ID NO: 2111793 - protein, 29 aa, Cryptosporidium hominis
DFSEGSSTEAGTDTDTDSTEAQGEDISKE

SEQ ID NO: 2111794 - protein, 6 aa, Cryptosporidium hominis
DFSENA

SEQ ID NO: 2111795 - protein, 4 aa, Cryptosporidium hominis
DFSN

SEQ ID NO: 2111796 - protein, 5 aa, Cryptosporidium hominis
DFTEE

SEQ ID NO: 2111797 - protein, 40 aa, Cryptosporidium hominis
DFTSDQAKPNINSEPTSAQSSSAFNSNESGSSTDASSDSF

SEQ ID NO: 2111798 - protein, 13 aa, Cryptosporidium hominis
DFVSNNDEKDGIL

SEQ ID NO: 2111799 - protein, 12 aa, Cryptosporidium hominis
DFYTKNSNETLN

SEQ ID NO: 2111800 - protein, 8 aa, Cryptosporidium hominis
DGADGIPN

SEQ ID NO: 2111801 - protein, 6 aa, Cryptosporidium hominis
DGAPPN

SEQ ID NO: 2111802 - protein, 7 aa, Cryptosporidium hominis
DGAPSET

SEQ ID NO: 2111803 - protein, 5 aa, Cryptosporidium hominis
DGATS

SEQ ID NO: 2111804 - protein, 31 aa, Cryptosporidium hominis
DGDDQYISTSEGANNSSGGGSSNNQNSSSAQ

SEQ ID NO: 2111805 - protein, 4 aa, Cryptosporidium hominis
DGDP

SEQ ID NO: 2111806 - protein, 7 aa, Cryptosporidium hominis
DGDQTLI

SEQ ID NO: 2111807 - protein, 7 aa, Cryptosporidium hominis
DGDTTRR

SEQ ID NO: 2111808 - protein, 7 aa, Cryptosporidium hominis
DGECKRT

SEQ ID NO: 2111809 - protein, 5 aa, Cryptosporidium hominis
DGEGF

SEQ ID NO: 2111810 - protein, 8 aa, Cryptosporidium hominis
DGETGLPL

SEQ ID NO: 2111811 - protein, 7 aa, Cryptosporidium hominis
DGEVNTK

SEQ ID NO: 2111812 - protein, 8 aa, Cryptosporidium hominis
DGFPQQPK

SEQ ID NO: 2111813 - protein, 8 aa, Cryptosporidium hominis
DGFSPGPK

SEQ ID NO: 2111814 - protein, 14 aa, Cryptosporidium hominis
DGFTSIDVLKNKMD

SEQ ID NO: 2111815 - protein, 29 aa, Cryptosporidium hominis
DGGHPGDENYIGSDNTRYQKSKSSYPGKN

SEQ ID NO: 2111816 - protein, 8 aa, Cryptosporidium hominis
DGGNDDTL

SEQ ID NO: 2111817 - protein, 6 aa, Cryptosporidium hominis
DGGPAV

SEQ ID NO: 2111818 - protein, 7 aa, Cryptosporidium hominis
DGGPNAS

SEQ ID NO: 2111819 - protein, 4 aa, Cryptosporidium hominis
DGGQ

SEQ ID NO: 2111820 - protein, 5 aa, Cryptosporidium hominis
DGHHR

SEQ ID NO: 2111821 - protein, 6 aa, Cryptosporidium hominis
DGHQNE

SEQ ID NO: 2111822 - protein, 7 aa, Cryptosporidium hominis
DGIENGA

SEQ ID NO: 2111823 - protein, 5 aa, Cryptosporidium hominis
DGIPH

SEQ ID NO: 2111824 - protein, 5 aa, Cryptosporidium hominis
DGKKE

SEQ ID NO: 2111825 - protein, 11 aa, Cryptosporidium hominis
DGKNNSSDYYT

SEQ ID NO: 2111826 - protein, 16 aa, Cryptosporidium hominis
DGKQARRLGVSSNSGE

SEQ ID NO: 2111827 - protein, 34 aa, Cryptosporidium hominis
DGKTSKEPEDSIQSKEMNSNNENDGSVKNADKNI

SEQ ID NO: 2111828 - protein, 5 aa, Cryptosporidium hominis
DGKYY

SEQ ID NO: 2111829 - protein, 39 aa, Cryptosporidium hominis
DGLDGEDIDDNDEDDDDNDVEDMDDDVEDDVEDDDENDD

SEQ ID NO: 2111830 - protein, 8 aa, Cryptosporidium hominis
DGMNTDRY

SEQ ID NO: 2111831 - protein, 8 aa, Cryptosporidium hominis
DGMSNKPC

SEQ ID NO: 2111832 - protein, 4 aa, Cryptosporidium hominis
DGNN

SEQ ID NO: 2111833 - protein, 5 aa, Cryptosporidium hominis
DGNSI

SEQ ID NO: 2111834 - protein, 6 aa, Cryptosporidium hominis
DGPHGP

SEQ ID NO: 2111835 - protein, 5 aa, Cryptosporidium hominis
DGPND

SEQ ID NO: 2111836 - protein, 23 aa, Cryptosporidium hominis
DGPTANPSNTNEKIKTTSQNLDT

SEQ ID NO: 2111837 - protein, 9 aa, Cryptosporidium hominis
DGQTKKTTL

SEQ ID NO: 2111838 - protein, 7 aa, Cryptosporidium hominis
DGSFPDT

SEQ ID NO: 2111839 - protein, 15 aa, Cryptosporidium hominis
DGSGKKKKSVYPNNI

SEQ ID NO: 2111840 - protein, 11 aa, Cryptosporidium hominis
DGSISQTRGFR

SEQ ID NO: 2111841 - protein, 8 aa, Cryptosporidium hominis
DGSNSEHI

SEQ ID NO: 2111842 - protein, 6 aa, Cryptosporidium hominis
DGSSIR

SEQ ID NO: 2111843 - protein, 5 aa, Cryptosporidium hominis
DGTIR

SEQ ID NO: 2111844 - protein, 12 aa, Cryptosporidium hominis
DGTNDVAAVKDS

SEQ ID NO: 2111845 - protein, 7 aa, Cryptosporidium hominis
DGTPENL

SEQ ID NO: 2111846 - protein, 4 aa, Cryptosporidium hominis
DGVQ

SEQ ID NO: 2111847 - protein, 7 aa, Cryptosporidium hominis
DHDEDHK

SEQ ID NO: 2111848 - protein, 106 aa, Cryptosporidium hominis
DHEEEEEEEEEEEEEEEEEEEEEEEEEEEEEEEEEEEEEEEEEEEEEEEEEEEEEEEEEEEEEEEAPKQLKTPQRGRRAAENIAKEDDRLNNTYNTSVRRSNRLKK

SEQ ID NO: 2111849 - protein, 13 aa, Cryptosporidium hominis
DHEHRKGSSTNQE

SEQ ID NO: 2111850 - protein, 9 aa, Cryptosporidium hominis
DHEMSTNSS

SEQ ID NO: 2111851 - protein, 4 aa, Cryptosporidium hominis
DHGI

SEQ ID NO: 2111852 - protein, 11 aa, Cryptosporidium hominis
DHGKELDNGIE

SEQ ID NO: 2111853 - protein, 6 aa, Cryptosporidium hominis
DHNKDS

SEQ ID NO: 2111854 - protein, 12 aa, Cryptosporidium hominis
DHNNGLEPDESA

SEQ ID NO: 2111855 - protein, 10 aa, Cryptosporidium hominis
DHNSDNQDTL

SEQ ID NO: 2111856 - protein, 7 aa, Cryptosporidium hominis
DHQKNNF

SEQ ID NO: 2111857 - protein, 11 aa, Cryptosporidium hominis
DHQKNNTTPDL

SEQ ID NO: 2111858 - protein, 4 aa, Cryptosporidium hominis
DHQV

SEQ ID NO: 2111859 - protein, 20 aa, Cryptosporidium hominis
DHSQEQAKNTWDSLSTGAKA

SEQ ID NO: 2111860 - protein, 7 aa, Cryptosporidium hominis
DHTCEEK

SEQ ID NO: 2111861 - protein, 14 aa, Cryptosporidium hominis
DHVKPQKEPPLRSD

SEQ ID NO: 2111862 - protein, 6 aa, Cryptosporidium hominis
DIDDED

SEQ ID NO: 2111863 - protein, 9 aa, Cryptosporidium hominis
DIEKNTTNL

SEQ ID NO: 2111864 - protein, 12 aa, Cryptosporidium hominis
DIEKQEKNIENI

SEQ ID NO: 2111865 - protein, 4 aa, Cryptosporidium hominis
DIEN

SEQ ID NO: 2111866 - protein, 10 aa, Cryptosporidium hominis
DIGSGGEKGE

SEQ ID NO: 2111867 - protein, 6 aa, Cryptosporidium hominis
DIKNGF

SEQ ID NO: 2111868 - protein, 7 aa, Cryptosporidium hominis
DIKQKRE

SEQ ID NO: 2111869 - protein, 5 aa, Cryptosporidium hominis
DIKQN

SEQ ID NO: 2111870 - protein, 6 aa, Cryptosporidium hominis
DIKSKS

SEQ ID NO: 2111871 - protein, 9 aa, Cryptosporidium hominis
DIKSTENIP

SEQ ID NO: 2111872 - protein, 6 aa, Cryptosporidium hominis
DILGPQ

SEQ ID NO: 2111873 - protein, 9 aa, Cryptosporidium hominis
DINANSSLI

SEQ ID NO: 2111874 - protein, 14 aa, Cryptosporidium hominis
DINNNNNNNGKSNW

SEQ ID NO: 2111875 - protein, 21 aa, Cryptosporidium hominis
DINTEEKKEEQKSESGHKDSD

SEQ ID NO: 2111876 - protein, 4 aa, Cryptosporidium hominis
DIPK

SEQ ID NO: 2111877 - protein, 10 aa, Cryptosporidium hominis
DIPPPPSYPA

SEQ ID NO: 2111878 - protein, 4 aa, Cryptosporidium hominis
DISA

SEQ ID NO: 2111879 - protein, 7 aa, Cryptosporidium hominis
DISEDSK

SEQ ID NO: 2111880 - protein, 5 aa, Cryptosporidium hominis
DISIG

SEQ ID NO: 2111881 - protein, 12 aa, Cryptosporidium hominis
DISKDYKSLLVP

SEQ ID NO: 2111882 - protein, 10 aa, Cryptosporidium hominis
DISSISGSHR

SEQ ID NO: 2111883 - protein, 13 aa, Cryptosporidium hominis
DISTEKNGDISTG

SEQ ID NO: 2111884 - protein, 27 aa, Cryptosporidium hominis
DITNKDESSSLGNEGQSSLRSSSPTQH

SEQ ID NO: 2111885 - protein, 4 aa, Cryptosporidium hominis
DITS

SEQ ID NO: 2111886 - protein, 15 aa, Cryptosporidium hominis
DITTNPTKRNPVPQD

SEQ ID NO: 2111887 - protein, 5 aa, Cryptosporidium hominis
DKAKS

SEQ ID NO: 2111888 - protein, 8 aa, Cryptosporidium hominis
DKDHGRSV

SEQ ID NO: 2111889 - protein, 5 aa, Cryptosporidium hominis
DKDKP

SEQ ID NO: 2111890 - protein, 8 aa, Cryptosporidium hominis
DKDNETDI

SEQ ID NO: 2111891 - protein, 33 aa, Cryptosporidium hominis
DKDNSGINCQNNQTGTGYSTADNTNVVNSTKTN

SEQ ID NO: 2111892 - protein, 9 aa, Cryptosporidium hominis
DKDSKVQNF

SEQ ID NO: 2111893 - protein, 5 aa, Cryptosporidium hominis
DKDSS

SEQ ID NO: 2111894 - protein, 5 aa, Cryptosporidium hominis
DKEQL

SEQ ID NO: 2111895 - protein, 23 aa, Cryptosporidium hominis
DKESEQSKKEQHREKEDLNEDEF

SEQ ID NO: 2111896 - protein, 9 aa, Cryptosporidium hominis
DKESITSND

SEQ ID NO: 2111897 - protein, 12 aa, Cryptosporidium hominis
DKESSKRSEVVP

SEQ ID NO: 2111898 - protein, 6 aa, Cryptosporidium hominis
DKFFGE

SEQ ID NO: 2111899 - protein, 25 aa, Cryptosporidium hominis
DKFGQPSNSLRRSSSLNPINSNSRH

SEQ ID NO: 2111900 - protein, 5 aa, Cryptosporidium hominis
DKGNL

SEQ ID NO: 2111901 - protein, 4 aa, Cryptosporidium hominis
DKGY

SEQ ID NO: 2111902 - protein, 4 aa, Cryptosporidium hominis
DKID

SEQ ID NO: 2111903 - protein, 4 aa, Cryptosporidium hominis
DKIE

SEQ ID NO: 2111904 - protein, 7 aa, Cryptosporidium hominis
DKIEPED

SEQ ID NO: 2111905 - protein, 12 aa, Cryptosporidium hominis
DKIKSNTSSTTC

SEQ ID NO: 2111906 - protein, 4 aa, Cryptosporidium hominis
DKIS

SEQ ID NO: 2111907 - protein, 6 aa, Cryptosporidium hominis
DKITYN

SEQ ID NO: 2111908 - protein, 9 aa, Cryptosporidium hominis
DKKSKPRYD

SEQ ID NO: 2111909 - protein, 7 aa, Cryptosporidium hominis
DKKVGDN

SEQ ID NO: 2111910 - protein, 7 aa, Cryptosporidium hominis
DKLGGEA

SEQ ID NO: 2111911 - protein, 7 aa, Cryptosporidium hominis
DKLPDGS

SEQ ID NO: 2111912 - protein, 5 aa, Cryptosporidium hominis
DKLSG

SEQ ID NO: 2111913 - protein, 5 aa, Cryptosporidium hominis
DKMRN

SEQ ID NO: 2111914 - protein, 5 aa, Cryptosporidium hominis
DKNCS

SEQ ID NO: 2111915 - protein, 8 aa, Cryptosporidium hominis
DKNESLET

SEQ ID NO: 2111916 - protein, 5 aa, Cryptosporidium hominis
DKNGI

SEQ ID NO: 2111917 - protein, 22 aa, Cryptosporidium hominis
DKNHMSKSISAKQSCNSLNPNT

SEQ ID NO: 2111918 - protein, 8 aa, Cryptosporidium hominis
DKNISSQN

SEQ ID NO: 2111919 - protein, 9 aa, Cryptosporidium hominis
DKNKTIDEV

SEQ ID NO: 2111920 - protein, 9 aa, Cryptosporidium hominis
DKNLNSSRK

SEQ ID NO: 2111921 - protein, 6 aa, Cryptosporidium hominis
DKNNPL

SEQ ID NO: 2111922 - protein, 5 aa, Cryptosporidium hominis
DKNNT

SEQ ID NO: 2111923 - protein, 7 aa, Cryptosporidium hominis
DKNPDCE

SEQ ID NO: 2111924 - protein, 6 aa, Cryptosporidium hominis
DKPANM

SEQ ID NO: 2111925 - protein, 19 aa, Cryptosporidium hominis
DKPDGDNRPASQEIPSQDQ

SEQ ID NO: 2111926 - protein, 5 aa, Cryptosporidium hominis
DKQNN

SEQ ID NO: 2111927 - protein, 7 aa, Cryptosporidium hominis
DKSDSIT

SEQ ID NO: 2111928 - protein, 7 aa, Cryptosporidium hominis
DKSDYSF

SEQ ID NO: 2111929 - protein, 11 aa, Cryptosporidium hominis
DKSFANKSHAY

SEQ ID NO: 2111930 - protein, 9 aa, Cryptosporidium hominis
DKSKRSAFL

SEQ ID NO: 2111931 - protein, 8 aa, Cryptosporidium hominis
DKSPNGNL

SEQ ID NO: 2111932 - protein, 8 aa, Cryptosporidium hominis
DKSSSYTT

SEQ ID NO: 2111933 - protein, 6 aa, Cryptosporidium hominis
DKSTAS

SEQ ID NO: 2111934 - protein, 14 aa, Cryptosporidium hominis
DKSTNQRKQEQFHQ

SEQ ID NO: 2111935 - protein, 8 aa, Cryptosporidium hominis
DKTDLNKG

SEQ ID NO: 2111936 - protein, 8 aa, Cryptosporidium hominis
DKTPKVRE

SEQ ID NO: 2111937 - protein, 10 aa, Cryptosporidium hominis
DKVDEGGNYD

SEQ ID NO: 2111938 - protein, 6 aa, Cryptosporidium hominis
DKVSWN

SEQ ID NO: 2111939 - protein, 6 aa, Cryptosporidium hominis
DKVTGY

SEQ ID NO: 2111940 - protein, 4 aa, Cryptosporidium hominis
DKYS

SEQ ID NO: 2111941 - protein, 8 aa, Cryptosporidium hominis
DLATKGES

SEQ ID NO: 2111942 - protein, 8 aa, Cryptosporidium hominis
DLDDEDKR

SEQ ID NO: 2111943 - protein, 10 aa, Cryptosporidium hominis
DLDQDYPHSH

SEQ ID NO: 2111944 - protein, 13 aa, Cryptosporidium hominis
DLEDNLETKEETY

SEQ ID NO: 2111945 - protein, 11 aa, Cryptosporidium hominis
DLESDPESNIY

SEQ ID NO: 2111946 - protein, 4 aa, Cryptosporidium hominis
DLHS

SEQ ID NO: 2111947 - protein, 8 aa, Cryptosporidium hominis
DLKERPAM

SEQ ID NO: 2111948 - protein, 10 aa, Cryptosporidium hominis
DLKKSRKETL

SEQ ID NO: 2111949 - protein, 16 aa, Cryptosporidium hominis
DLKNRQTTIESNSYSN

SEQ ID NO: 2111950 - protein, 9 aa, Cryptosporidium hominis
DLKRAKNKT

SEQ ID NO: 2111951 - protein, 10 aa, Cryptosporidium hominis
DLKSKKTSLK

SEQ ID NO: 2111952 - protein, 4 aa, Cryptosporidium hominis
DLKT

SEQ ID NO: 2111953 - protein, 16 aa, Cryptosporidium hominis
DLNSQNNNLSTIPRKR

SEQ ID NO: 2111954 - protein, 6 aa, Cryptosporidium hominis
DLPKRN

SEQ ID NO: 2111955 - protein, 5 aa, Cryptosporidium hominis
DLPPK

SEQ ID NO: 2111956 - protein, 5 aa, Cryptosporidium hominis
DLPSE

SEQ ID NO: 2111957 - protein, 12 aa, Cryptosporidium hominis
DLPSRNSESSRI

SEQ ID NO: 2111958 - protein, 6 aa, Cryptosporidium hominis
DLQATP

SEQ ID NO: 2111959 - protein, 6 aa, Cryptosporidium hominis
DLQTSS

SEQ ID NO: 2111960 - protein, 13 aa, Cryptosporidium hominis
DLRSGGTQKRLSR

SEQ ID NO: 2111961 - protein, 8 aa, Cryptosporidium hominis
DLRSTKRP

SEQ ID NO: 2111962 - protein, 10 aa, Cryptosporidium hominis
DLSENEKEKK

SEQ ID NO: 2111963 - protein, 8 aa, Cryptosporidium hominis
DLSEPIKG

SEQ ID NO: 2111964 - protein, 4 aa, Cryptosporidium hominis
DLSG

SEQ ID NO: 2111965 - protein, 24 aa, Cryptosporidium hominis
DLSGGESSNEIDPEELGRRKSSLD

SEQ ID NO: 2111966 - protein, 4 aa, Cryptosporidium hominis
DLSR

SEQ ID NO: 2111967 - protein, 6 aa, Cryptosporidium hominis
DLSSPK

SEQ ID NO: 2111968 - protein, 5 aa, Cryptosporidium hominis
DLSTE

SEQ ID NO: 2111969 - protein, 10 aa, Cryptosporidium hominis
DLTAGKENSS

SEQ ID NO: 2111970 - protein, 10 aa, Cryptosporidium hominis
DLTNGNNVGN

SEQ ID NO: 2111971 - protein, 4 aa, Cryptosporidium hominis
DLTP

SEQ ID NO: 2111972 - protein, 4 aa, Cryptosporidium hominis
DLTS

SEQ ID NO: 2111973 - protein, 21 aa, Cryptosporidium hominis
DMDDSKLSKKEKKKRKKRKKM

SEQ ID NO: 2111974 - protein, 6 aa, Cryptosporidium hominis
DMESTV

SEQ ID NO: 2111975 - protein, 10 aa, Cryptosporidium hominis
DMKRSDTIEE

SEQ ID NO: 2111976 - protein, 4 aa, Cryptosporidium hominis
DMQK

SEQ ID NO: 2111977 - protein, 7 aa, Cryptosporidium hominis
DMSNHRN

SEQ ID NO: 2111978 - protein, 12 aa, Cryptosporidium hominis
DNAFSKDKNLSN

SEQ ID NO: 2111979 - protein, 14 aa, Cryptosporidium hominis
DNCYPGQGGGNTGM

SEQ ID NO: 2111980 - protein, 8 aa, Cryptosporidium hominis
DNDCGSVS

SEQ ID NO: 2111981 - protein, 8 aa, Cryptosporidium hominis
DNDEGGKY

SEQ ID NO: 2111982 - protein, 12 aa, Cryptosporidium hominis
DNDEKNKGRKSK

SEQ ID NO: 2111983 - protein, 7 aa, Cryptosporidium hominis
DNDLERN

SEQ ID NO: 2111984 - protein, 12 aa, Cryptosporidium hominis
DNDSDNFNPHET

SEQ ID NO: 2111985 - protein, 6 aa, Cryptosporidium hominis
DNEGRT

SEQ ID NO: 2111986 - protein, 5 aa, Cryptosporidium hominis
DNEIE

SEQ ID NO: 2111987 - protein, 15 aa, Cryptosporidium hominis
DNEKRQVYDTTQGGE

SEQ ID NO: 2111988 - protein, 4 aa, Cryptosporidium hominis
DNEL

SEQ ID NO: 2111989 - protein, 9 aa, Cryptosporidium hominis
DNENESQNL

SEQ ID NO: 2111990 - protein, 9 aa, Cryptosporidium hominis
DNEREPKLR

SEQ ID NO: 2111991 - protein, 4 aa, Cryptosporidium hominis
DNES

SEQ ID NO: 2111992 - protein, 6 aa, Cryptosporidium hominis
DNETPC

SEQ ID NO: 2111993 - protein, 9 aa, Cryptosporidium hominis
DNGAESSSF

SEQ ID NO: 2111994 - protein, 6 aa, Cryptosporidium hominis
DNGNCG

SEQ ID NO: 2111995 - protein, 6 aa, Cryptosporidium hominis
DNGSYN

SEQ ID NO: 2111996 - protein, 18 aa, Cryptosporidium hominis
DNGYNGGISTDSGKQLSP

SEQ ID NO: 2111997 - protein, 6 aa, Cryptosporidium hominis
DNKGRT

SEQ ID NO: 2111998 - protein, 7 aa, Cryptosporidium hominis
DNKQDLE

SEQ ID NO: 2111999 - protein, 9 aa, Cryptosporidium hominis
DNLTRSKYG

SEQ ID NO: 2112000 - protein, 4 aa, Cryptosporidium hominis
DNMK

SEQ ID NO: 2112001 - protein, 11 aa, Cryptosporidium hominis
DNNDQKLGGSR

SEQ ID NO: 2112002 - protein, 26 aa, Cryptosporidium hominis
DNNEDAEGNKTFEKGNDLGENDNIEN

SEQ ID NO: 2112003 - protein, 5 aa, Cryptosporidium hominis
DNNEQ

SEQ ID NO: 2112004 - protein, 25 aa, Cryptosporidium hominis
DNNEQTNKTDANWKRRPSSNKGTEH

SEQ ID NO: 2112005 - protein, 13 aa, Cryptosporidium hominis
DNNGHVGAPIPSS

SEQ ID NO: 2112006 - protein, 4 aa, Cryptosporidium hominis
DNNH

SEQ ID NO: 2112007 - protein, 8 aa, Cryptosporidium hominis
DNNNSSEI

SEQ ID NO: 2112008 - protein, 9 aa, Cryptosporidium hominis
DNNPPSEFK

SEQ ID NO: 2112009 - protein, 5 aa, Cryptosporidium hominis
DNNPY

SEQ ID NO: 2112010 - protein, 9 aa, Cryptosporidium hominis
DNNSLEPEM

SEQ ID NO: 2112011 - protein, 16 aa, Cryptosporidium hominis
DNNSNSNNKLLTPQKD

SEQ ID NO: 2112012 - protein, 5 aa, Cryptosporidium hominis
DNNTS

SEQ ID NO: 2112013 - protein, 6 aa, Cryptosporidium hominis
DNNTTS

SEQ ID NO: 2112014 - protein, 13 aa, Cryptosporidium hominis
DNNVGGIDGRNEV

SEQ ID NO: 2112015 - protein, 7 aa, Cryptosporidium hominis
DNPDAPL

SEQ ID NO: 2112016 - protein, 12 aa, Cryptosporidium hominis
DNPMDSNGGGNL

SEQ ID NO: 2112017 - protein, 5 aa, Cryptosporidium hominis
DNPNN

SEQ ID NO: 2112018 - protein, 5 aa, Cryptosporidium hominis
DNPTS

SEQ ID NO: 2112019 - protein, 7 aa, Cryptosporidium hominis
DNPTTLY

SEQ ID NO: 2112020 - protein, 4 aa, Cryptosporidium hominis
DNPW

SEQ ID NO: 2112021 - protein, 9 aa, Cryptosporidium hominis
DNQKGSINE

SEQ ID NO: 2112022 - protein, 22 aa, Cryptosporidium hominis
DNQLSTDTEDEDDDAAERSSST

SEQ ID NO: 2112023 - protein, 14 aa, Cryptosporidium hominis
DNQSKTKDPNSPIS

SEQ ID NO: 2112024 - protein, 6 aa, Cryptosporidium hominis
DNQTHS

SEQ ID NO: 2112025 - protein, 7 aa, Cryptosporidium hominis
DNRDNSI

SEQ ID NO: 2112026 - protein, 11 aa, Cryptosporidium hominis
DNREVNERKTK

SEQ ID NO: 2112027 - protein, 8 aa, Cryptosporidium hominis
DNRKEEIN

SEQ ID NO: 2112028 - protein, 9 aa, Cryptosporidium hominis
DNRNTAEAI

SEQ ID NO: 2112029 - protein, 8 aa, Cryptosporidium hominis
DNRTSKNL

SEQ ID NO: 2112030 - protein, 8 aa, Cryptosporidium hominis
DNSEESEI

SEQ ID NO: 2112031 - protein, 5 aa, Cryptosporidium hominis
DNSGE

SEQ ID NO: 2112032 - protein, 4 aa, Cryptosporidium hominis
DNSL

SEQ ID NO: 2112033 - protein, 5 aa, Cryptosporidium hominis
DNSLR

SEQ ID NO: 2112034 - protein, 8 aa, Cryptosporidium hominis
DNSYSENN

SEQ ID NO: 2112035 - protein, 12 aa, Cryptosporidium hominis
DNTDVQRSRARK

SEQ ID NO: 2112036 - protein, 4 aa, Cryptosporidium hominis
DNTI

SEQ ID NO: 2112037 - protein, 5 aa, Cryptosporidium hominis
DNTPS

SEQ ID NO: 2112038 - protein, 7 aa, Cryptosporidium hominis
DNVGRNN

SEQ ID NO: 2112039 - protein, 17 aa, Cryptosporidium hominis
DNVKDSEVVKSSKSSSL

SEQ ID NO: 2112040 - protein, 7 aa, Cryptosporidium hominis
DNVYPNP

SEQ ID NO: 2112041 - protein, 19 aa, Cryptosporidium hominis
DNYNNSEDNIENDYSIDSN

SEQ ID NO: 2112042 - protein, 7 aa, Cryptosporidium hominis
DNYNSEQ

SEQ ID NO: 2112043 - protein, 7 aa, Cryptosporidium hominis
DNYRPSI

SEQ ID NO: 2112044 - protein, 11 aa, Cryptosporidium hominis
DPAAEGINPQE

SEQ ID NO: 2112045 - protein, 8 aa, Cryptosporidium hominis
DPAHGSTI

SEQ ID NO: 2112046 - protein, 5 aa, Cryptosporidium hominis
DPAQR

SEQ ID NO: 2112047 - protein, 8 aa, Cryptosporidium hominis
DPATREYR

SEQ ID NO: 2112048 - protein, 6 aa, Cryptosporidium hominis
DPAWSA

SEQ ID NO: 2112049 - protein, 6 aa, Cryptosporidium hominis
DPDDSI

SEQ ID NO: 2112050 - protein, 8 aa, Cryptosporidium hominis
DPDDSSLI

SEQ ID NO: 2112051 - protein, 10 aa, Cryptosporidium hominis
DPDDYGASNK

SEQ ID NO: 2112052 - protein, 18 aa, Cryptosporidium hominis
DPEAQDDETNSILHQVDT

SEQ ID NO: 2112053 - protein, 5 aa, Cryptosporidium hominis
DPEKC

SEQ ID NO: 2112054 - protein, 7 aa, Cryptosporidium hominis
DPEKIDP

SEQ ID NO: 2112055 - protein, 4 aa, Cryptosporidium hominis
DPEN

SEQ ID NO: 2112056 - protein, 5 aa, Cryptosporidium hominis
DPENL

SEQ ID NO: 2112057 - protein, 5 aa, Cryptosporidium hominis
DPESI

SEQ ID NO: 2112058 - protein, 9 aa, Cryptosporidium hominis
DPESQIEST

SEQ ID NO: 2112059 - protein, 5 aa, Cryptosporidium hominis
DPETN

SEQ ID NO: 2112060 - protein, 4 aa, Cryptosporidium hominis
DPFH

SEQ ID NO: 2112061 - protein, 5 aa, Cryptosporidium hominis
DPFKK

SEQ ID NO: 2112062 - protein, 6 aa, Cryptosporidium hominis
DPFSRR

SEQ ID NO: 2112063 - protein, 7 aa, Cryptosporidium hominis
DPGGHNG

SEQ ID NO: 2112064 - protein, 25 aa, Cryptosporidium hominis
DPGISSQYISSSQKKHSKQSHSPHL

SEQ ID NO: 2112065 - protein, 7 aa, Cryptosporidium hominis
DPHTDQQ

SEQ ID NO: 2112066 - protein, 4 aa, Cryptosporidium hominis
DPIE

SEQ ID NO: 2112067 - protein, 14 aa, Cryptosporidium hominis
DPKCTQDLSAETDS

SEQ ID NO: 2112068 - protein, 10 aa, Cryptosporidium hominis
DPKGSYSDEE

SEQ ID NO: 2112069 - protein, 6 aa, Cryptosporidium hominis
DPKKNT

SEQ ID NO: 2112070 - protein, 10 aa, Cryptosporidium hominis
DPKNGEFSED

SEQ ID NO: 2112071 - protein, 7 aa, Cryptosporidium hominis
DPKSPEF

SEQ ID NO: 2112072 - protein, 9 aa, Cryptosporidium hominis
DPKSPLYKG

SEQ ID NO: 2112073 - protein, 16 aa, Cryptosporidium hominis
DPKTGEKDRSTESLSR

SEQ ID NO: 2112074 - protein, 8 aa, Cryptosporidium hominis
DPKTSKDV

SEQ ID NO: 2112075 - protein, 6 aa, Cryptosporidium hominis
DPLSET

SEQ ID NO: 2112076 - protein, 11 aa, Cryptosporidium hominis
DPLSSTESDDI

SEQ ID NO: 2112077 - protein, 9 aa, Cryptosporidium hominis
DPNDPGSSF

SEQ ID NO: 2112078 - protein, 8 aa, Cryptosporidium hominis
DPNDPSQH

SEQ ID NO: 2112079 - protein, 9 aa, Cryptosporidium hominis
DPNGSKTSG

SEQ ID NO: 2112080 - protein, 5 aa, Cryptosporidium hominis
DPNHE

SEQ ID NO: 2112081 - protein, 4 aa, Cryptosporidium hominis
DPNL

SEQ ID NO: 2112082 - protein, 8 aa, Cryptosporidium hominis
DPNSNSES

SEQ ID NO: 2112083 - protein, 8 aa, Cryptosporidium hominis
DPPRPGVK

SEQ ID NO: 2112084 - protein, 4 aa, Cryptosporidium hominis
DPRP

SEQ ID NO: 2112085 - protein, 7 aa, Cryptosporidium hominis
DPSDGNT

SEQ ID NO: 2112086 - protein, 8 aa, Cryptosporidium hominis
DPSDSDGV

SEQ ID NO: 2112087 - protein, 5 aa, Cryptosporidium hominis
DPSER

SEQ ID NO: 2112088 - protein, 7 aa, Cryptosporidium hominis
DPSEVPP

SEQ ID NO: 2112089 - protein, 5 aa, Cryptosporidium hominis
DPSPI

SEQ ID NO: 2112090 - protein, 5 aa, Cryptosporidium hominis
DPSQL

SEQ ID NO: 2112091 - protein, 6 aa, Cryptosporidium hominis
DPSSIE

SEQ ID NO: 2112092 - protein, 10 aa, Cryptosporidium hominis
DPSTKNYRGD

SEQ ID NO: 2112093 - protein, 8 aa, Cryptosporidium hominis
DPSTPLRN

SEQ ID NO: 2112094 - protein, 5 aa, Cryptosporidium hominis
DPTEK

SEQ ID NO: 2112095 - protein, 5 aa, Cryptosporidium hominis
DPTIG

SEQ ID NO: 2112096 - protein, 5 aa, Cryptosporidium hominis
DPTNL

SEQ ID NO: 2112097 - protein, 11 aa, Cryptosporidium hominis
DPTNVGNSEFE

SEQ ID NO: 2112098 - protein, 8 aa, Cryptosporidium hominis
DPTTPDAC

SEQ ID NO: 2112099 - protein, 5 aa, Cryptosporidium hominis
DPTTS

SEQ ID NO: 2112100 - protein, 19 aa, Cryptosporidium hominis
DPTYRTDRTHRVSHDQKSA

SEQ ID NO: 2112101 - protein, 6 aa, Cryptosporidium hominis
DPYDNE

SEQ ID NO: 2112102 - protein, 7 aa, Cryptosporidium hominis
DPYGDAQ

SEQ ID NO: 2112103 - protein, 4 aa, Cryptosporidium hominis
DPYR

SEQ ID NO: 2112104 - protein, 12 aa, Cryptosporidium hominis
DQANSSNNTPSF

SEQ ID NO: 2112105 - protein, 8 aa, Cryptosporidium hominis
DQDFSSNS

SEQ ID NO: 2112106 - protein, 4 aa, Cryptosporidium hominis
DQDI

SEQ ID NO: 2112107 - protein, 10 aa, Cryptosporidium hominis
DQDIQPSNSI

SEQ ID NO: 2112108 - protein, 9 aa, Cryptosporidium hominis
DQDSSKVSR

SEQ ID NO: 2112109 - protein, 4 aa, Cryptosporidium hominis
DQDT

SEQ ID NO: 2112110 - protein, 9 aa, Cryptosporidium hominis
DQDYEKDAN

SEQ ID NO: 2112111 - protein, 17 aa, Cryptosporidium hominis
DQEEDDDDEDSSGNDQR

SEQ ID NO: 2112112 - protein, 10 aa, Cryptosporidium hominis
DQEETEKVVG

SEQ ID NO: 2112113 - protein, 6 aa, Cryptosporidium hominis
DQEIGG

SEQ ID NO: 2112114 - protein, 9 aa, Cryptosporidium hominis
DQEKSNIKV

SEQ ID NO: 2112115 - protein, 8 aa, Cryptosporidium hominis
DQEPRIAR

SEQ ID NO: 2112116 - protein, 7 aa, Cryptosporidium hominis
DQERLSE

SEQ ID NO: 2112117 - protein, 6 aa, Cryptosporidium hominis
DQESVC

SEQ ID NO: 2112118 - protein, 10 aa, Cryptosporidium hominis
DQGDNSRDEE

SEQ ID NO: 2112119 - protein, 4 aa, Cryptosporidium hominis
DQIA

SEQ ID NO: 2112120 - protein, 6 aa, Cryptosporidium hominis
DQKGTN

SEQ ID NO: 2112121 - protein, 17 aa, Cryptosporidium hominis
DQKLNKEENNDKLKPNL

SEQ ID NO: 2112122 - protein, 5 aa, Cryptosporidium hominis
DQKSR

SEQ ID NO: 2112123 - protein, 9 aa, Cryptosporidium hominis
DQLKGGPHY

SEQ ID NO: 2112124 - protein, 12 aa, Cryptosporidium hominis
DQLSSKANNDEI

SEQ ID NO: 2112125 - protein, 7 aa, Cryptosporidium hominis
DQMNKQQ

SEQ ID NO: 2112126 - protein, 5 aa, Cryptosporidium hominis
DQNER

SEQ ID NO: 2112127 - protein, 8 aa, Cryptosporidium hominis
DQNKRSDL

SEQ ID NO: 2112128 - protein, 5 aa, Cryptosporidium hominis
DQNKY

SEQ ID NO: 2112129 - protein, 5 aa, Cryptosporidium hominis
DQNNS

SEQ ID NO: 2112130 - protein, 7 aa, Cryptosporidium hominis
DQNTRNN

SEQ ID NO: 2112131 - protein, 5 aa, Cryptosporidium hominis
DQPGE

SEQ ID NO: 2112132 - protein, 25 aa, Cryptosporidium hominis
DQQDNGLDSSSPSNSKSNKDRENAN

SEQ ID NO: 2112133 - protein, 7 aa, Cryptosporidium hominis
DQQITDE

SEQ ID NO: 2112134 - protein, 6 aa, Cryptosporidium hominis
DQQPTA

SEQ ID NO: 2112135 - protein, 6 aa, Cryptosporidium hominis
DQRKHE

SEQ ID NO: 2112136 - protein, 14 aa, Cryptosporidium hominis
DQRSSLEESELQSI

SEQ ID NO: 2112137 - protein, 5 aa, Cryptosporidium hominis
DQSKV

SEQ ID NO: 2112138 - protein, 19 aa, Cryptosporidium hominis
DQSPTSPAQPQKIDPNSNH

SEQ ID NO: 2112139 - protein, 27 aa, Cryptosporidium hominis
DQSQDQDHKQEKGDRESNKGLKKTNFE

SEQ ID NO: 2112140 - protein, 5 aa, Cryptosporidium hominis
DQSTS

SEQ ID NO: 2112141 - protein, 5 aa, Cryptosporidium hominis
DQTIS

SEQ ID NO: 2112142 - protein, 4 aa, Cryptosporidium hominis
DQTP

SEQ ID NO: 2112143 - protein, 6 aa, Cryptosporidium hominis
DQTSSF

SEQ ID NO: 2112144 - protein, 11 aa, Cryptosporidium hominis
DQVDKENSKKI

SEQ ID NO: 2112145 - protein, 6 aa, Cryptosporidium hominis
DQVKKA

SEQ ID NO: 2112146 - protein, 9 aa, Cryptosporidium hominis
DQVNENTNI

SEQ ID NO: 2112147 - protein, 5 aa, Cryptosporidium hominis
DRDPI

SEQ ID NO: 2112148 - protein, 10 aa, Cryptosporidium hominis
DREREEKSEG

SEQ ID NO: 2112149 - protein, 9 aa, Cryptosporidium hominis
DRESGSCKN

SEQ ID NO: 2112150 - protein, 5 aa, Cryptosporidium hominis
DRETS

SEQ ID NO: 2112151 - protein, 4 aa, Cryptosporidium hominis
DRFG

SEQ ID NO: 2112152 - protein, 10 aa, Cryptosporidium hominis
DRHDRNEKDF

SEQ ID NO: 2112153 - protein, 5 aa, Cryptosporidium hominis
DRHPN

SEQ ID NO: 2112154 - protein, 4 aa, Cryptosporidium hominis
DRME

SEQ ID NO: 2112155 - protein, 4 aa, Cryptosporidium hominis
DRNG

SEQ ID NO: 2112156 - protein, 10 aa, Cryptosporidium hominis
DRNKDHIKDN

SEQ ID NO: 2112157 - protein, 15 aa, Cryptosporidium hominis
DRNKTLNNENGPNYL

SEQ ID NO: 2112158 - protein, 7 aa, Cryptosporidium hominis
DRNPQIE

SEQ ID NO: 2112159 - protein, 6 aa, Cryptosporidium hominis
DRNQTN

SEQ ID NO: 2112160 - protein, 7 aa, Cryptosporidium hominis
DRNSTDE

SEQ ID NO: 2112161 - protein, 6 aa, Cryptosporidium hominis
DRPFPP

SEQ ID NO: 2112162 - protein, 6 aa, Cryptosporidium hominis
DRQETA

SEQ ID NO: 2112163 - protein, 5 aa, Cryptosporidium hominis
DRQLS

SEQ ID NO: 2112164 - protein, 8 aa, Cryptosporidium hominis
DRRRKEKI

SEQ ID NO: 2112165 - protein, 4 aa, Cryptosporidium hominis
DRSA

SEQ ID NO: 2112166 - protein, 4 aa, Cryptosporidium hominis
DRSI

SEQ ID NO: 2112167 - protein, 10 aa, Cryptosporidium hominis
DRTDNNYQFS

SEQ ID NO: 2112168 - protein, 5 aa, Cryptosporidium hominis
DRTHT

SEQ ID NO: 2112169 - protein, 14 aa, Cryptosporidium hominis
DSAERLKSSINSQI

SEQ ID NO: 2112170 - protein, 7 aa, Cryptosporidium hominis
DSAGNNP

SEQ ID NO: 2112171 - protein, 17 aa, Cryptosporidium hominis
DSASENGLSSRKKSTDF

SEQ ID NO: 2112172 - protein, 8 aa, Cryptosporidium hominis
DSASSQSS

SEQ ID NO: 2112173 - protein, 6 aa, Cryptosporidium hominis
DSDEEL

SEQ ID NO: 2112174 - protein, 4 aa, Cryptosporidium hominis
DSDF

SEQ ID NO: 2112175 - protein, 10 aa, Cryptosporidium hominis
DSDHEQEDPQ

SEQ ID NO: 2112176 - protein, 7 aa, Cryptosporidium hominis
DSDHTNF

SEQ ID NO: 2112177 - protein, 12 aa, Cryptosporidium hominis
DSDKKELRSSKD

SEQ ID NO: 2112178 - protein, 8 aa, Cryptosporidium hominis
DSDRQGAL

SEQ ID NO: 2112179 - protein, 36 aa, Cryptosporidium hominis
DSDTDSDSSDSGTSTSKSSSSDSDSDTSVPGTPVTK

SEQ ID NO: 2112180 - protein, 8 aa, Cryptosporidium hominis
DSEDGRDR

SEQ ID NO: 2112181 - protein, 9 aa, Cryptosporidium hominis
DSEGDSIQD

SEQ ID NO: 2112182 - protein, 11 aa, Cryptosporidium hominis
DSEKKNSKNHL

SEQ ID NO: 2112183 - protein, 5 aa, Cryptosporidium hominis
DSEKL

SEQ ID NO: 2112184 - protein, 6 aa, Cryptosporidium hominis
DSENIK

SEQ ID NO: 2112185 - protein, 4 aa, Cryptosporidium hominis
DSEQ

SEQ ID NO: 2112186 - protein, 12 aa, Cryptosporidium hominis
DSESISKGFSPD

SEQ ID NO: 2112187 - protein, 14 aa, Cryptosporidium hominis
DSETQKNEDSSKEM

SEQ ID NO: 2112188 - protein, 4 aa, Cryptosporidium hominis
DSEW

SEQ ID NO: 2112189 - protein, 4 aa, Cryptosporidium hominis
DSFN

SEQ ID NO: 2112190 - protein, 4 aa, Cryptosporidium hominis
DSFR

SEQ ID NO: 2112191 - protein, 6 aa, Cryptosporidium hominis
DSFSPD

SEQ ID NO: 2112192 - protein, 6 aa, Cryptosporidium hominis
DSGANW

SEQ ID NO: 2112193 - protein, 7 aa, Cryptosporidium hominis
DSGLQDV

SEQ ID NO: 2112194 - protein, 4 aa, Cryptosporidium hominis
DSID

SEQ ID NO: 2112195 - protein, 7 aa, Cryptosporidium hominis
DSIGSNL

SEQ ID NO: 2112196 - protein, 8 aa, Cryptosporidium hominis
DSINRRNE

SEQ ID NO: 2112197 - protein, 8 aa, Cryptosporidium hominis
DSINSNGE

SEQ ID NO: 2112198 - protein, 10 aa, Cryptosporidium hominis
DSITKDTKEN

SEQ ID NO: 2112199 - protein, 10 aa, Cryptosporidium hominis
DSKITTEDAE

SEQ ID NO: 2112200 - protein, 4 aa, Cryptosporidium hominis
DSKK

SEQ ID NO: 2112201 - protein, 9 aa, Cryptosporidium hominis
DSKKEFGSN

SEQ ID NO: 2112202 - protein, 10 aa, Cryptosporidium hominis
DSKPQCPEET

SEQ ID NO: 2112203 - protein, 7 aa, Cryptosporidium hominis
DSKQQVE

SEQ ID NO: 2112204 - protein, 7 aa, Cryptosporidium hominis
DSKTKDR

SEQ ID NO: 2112205 - protein, 15 aa, Cryptosporidium hominis
DSKTNNGNSNVISGD

SEQ ID NO: 2112206 - protein, 7 aa, Cryptosporidium hominis
DSKTSIW

SEQ ID NO: 2112207 - protein, 10 aa, Cryptosporidium hominis
DSKVDEARNW

SEQ ID NO: 2112208 - protein, 7 aa, Cryptosporidium hominis
DSKVNTQ

SEQ ID NO: 2112209 - protein, 7 aa, Cryptosporidium hominis
DSLNSTQ

SEQ ID NO: 2112210 - protein, 6 aa, Cryptosporidium hominis
DSLSGD

SEQ ID NO: 2112211 - protein, 24 aa, Cryptosporidium hominis
DSLSNKDLTYDQNNGESGKNIDNS

SEQ ID NO: 2112212 - protein, 4 aa, Cryptosporidium hominis
DSLY

SEQ ID NO: 2112213 - protein, 9 aa, Cryptosporidium hominis
DSNCEENEG

SEQ ID NO: 2112214 - protein, 6 aa, Cryptosporidium hominis
DSNDSF

SEQ ID NO: 2112215 - protein, 6 aa, Cryptosporidium hominis
DSNKQA

SEQ ID NO: 2112216 - protein, 6 aa, Cryptosporidium hominis
DSNKTH

SEQ ID NO: 2112217 - protein, 7 aa, Cryptosporidium hominis
DSNKTNQ

SEQ ID NO: 2112218 - protein, 18 aa, Cryptosporidium hominis
DSNSKSCSESNSNNNQEP

SEQ ID NO: 2112219 - protein, 7 aa, Cryptosporidium hominis
DSPELNN

SEQ ID NO: 2112220 - protein, 6 aa, Cryptosporidium hominis
DSPKIM

SEQ ID NO: 2112221 - protein, 23 aa, Cryptosporidium hominis
DSPKSHASKYGKKQVNKNMQNHS

SEQ ID NO: 2112222 - protein, 8 aa, Cryptosporidium hominis
DSPNHGEV

SEQ ID NO: 2112223 - protein, 6 aa, Cryptosporidium hominis
DSPWNT

SEQ ID NO: 2112224 - protein, 7 aa, Cryptosporidium hominis
DSQDFSN

SEQ ID NO: 2112225 - protein, 7 aa, Cryptosporidium hominis
DSQDGAL

SEQ ID NO: 2112226 - protein, 4 aa, Cryptosporidium hominis
DSQL

SEQ ID NO: 2112227 - protein, 19 aa, Cryptosporidium hominis
DSRKQDNESKQSNTKKSGH

SEQ ID NO: 2112228 - protein, 7 aa, Cryptosporidium hominis
DSRREST

SEQ ID NO: 2112229 - protein, 8 aa, Cryptosporidium hominis
DSRSNTND

SEQ ID NO: 2112230 - protein, 9 aa, Cryptosporidium hominis
DSRTPSGTN

SEQ ID NO: 2112231 - protein, 8 aa, Cryptosporidium hominis
DSSASQQE

SEQ ID NO: 2112232 - protein, 12 aa, Cryptosporidium hominis
DSSENKDESNTL

SEQ ID NO: 2112233 - protein, 14 aa, Cryptosporidium hominis
DSSGKSSVPTSTKE

SEQ ID NO: 2112234 - protein, 8 aa, Cryptosporidium hominis
DSSGNEIW

SEQ ID NO: 2112235 - protein, 7 aa, Cryptosporidium hominis
DSSIPGS

SEQ ID NO: 2112236 - protein, 10 aa, Cryptosporidium hominis
DSSIRNPNEC

SEQ ID NO: 2112237 - protein, 9 aa, Cryptosporidium hominis
DSSKKREPL

SEQ ID NO: 2112238 - protein, 7 aa, Cryptosporidium hominis
DSSLINE

SEQ ID NO: 2112239 - protein, 8 aa, Cryptosporidium hominis
DSSLSNEK

SEQ ID NO: 2112240 - protein, 7 aa, Cryptosporidium hominis
DSSMSNT

SEQ ID NO: 2112241 - protein, 12 aa, Cryptosporidium hominis
DSSMSSSKDVPS

SEQ ID NO: 2112242 - protein, 6 aa, Cryptosporidium hominis
DSSNIE

SEQ ID NO: 2112243 - protein, 32 aa, Cryptosporidium hominis
DSSNYYGDSGSHTVGQNQSVAAGSGPGAVSGG

SEQ ID NO: 2112244 - protein, 4 aa, Cryptosporidium hominis
DSSR

SEQ ID NO: 2112245 - protein, 9 aa, Cryptosporidium hominis
DSSRGRNEL

SEQ ID NO: 2112246 - protein, 27 aa, Cryptosporidium hominis
DSSRNPRKNFTRSTKMRNTQEFSGQQN

SEQ ID NO: 2112247 - protein, 11 aa, Cryptosporidium hominis
DSSSSYGNQNN

SEQ ID NO: 2112248 - protein, 5 aa, Cryptosporidium hominis
DSSVT

SEQ ID NO: 2112249 - protein, 22 aa, Cryptosporidium hominis
DSTISGSSSLEYDSEKKPEMND

SEQ ID NO: 2112250 - protein, 6 aa, Cryptosporidium hominis
DSTNRR

SEQ ID NO: 2112251 - protein, 6 aa, Cryptosporidium hominis
DSTPTS

SEQ ID NO: 2112252 - protein, 8 aa, Cryptosporidium hominis
DSTTSDIN

SEQ ID NO: 2112253 - protein, 4 aa, Cryptosporidium hominis
DSTV

SEQ ID NO: 2112254 - protein, 4 aa, Cryptosporidium hominis
DSTY

SEQ ID NO: 2112255 - protein, 6 aa, Cryptosporidium hominis
DSVNES

SEQ ID NO: 2112256 - protein, 5 aa, Cryptosporidium hominis
DSVNG

SEQ ID NO: 2112257 - protein, 6 aa, Cryptosporidium hominis
DSVVNG

SEQ ID NO: 2112258 - protein, 11 aa, Cryptosporidium hominis
DSYSSKSVNSK

SEQ ID NO: 2112259 - protein, 6 aa, Cryptosporidium hominis
DTANAP

SEQ ID NO: 2112260 - protein, 10 aa, Cryptosporidium hominis
DTARRGQITE

SEQ ID NO: 2112261 - protein, 7 aa, Cryptosporidium hominis
DTDDGEI

SEQ ID NO: 2112262 - protein, 16 aa, Cryptosporidium hominis
DTDDSRNKSGFDKESS

SEQ ID NO: 2112263 - protein, 13 aa, Cryptosporidium hominis
DTDERIHTGNGEF

SEQ ID NO: 2112264 - protein, 4 aa, Cryptosporidium hominis
DTDH

SEQ ID NO: 2112265 - protein, 18 aa, Cryptosporidium hominis
DTDTPTRFEEKMPPIMKE

SEQ ID NO: 2112266 - protein, 6 aa, Cryptosporidium hominis
DTEGNN

SEQ ID NO: 2112267 - protein, 12 aa, Cryptosporidium hominis
DTEKNNNLPNTD

SEQ ID NO: 2112268 - protein, 5 aa, Cryptosporidium hominis
DTGQQ

SEQ ID NO: 2112269 - protein, 8 aa, Cryptosporidium hominis
DTGTGKTT

SEQ ID NO: 2112270 - protein, 5 aa, Cryptosporidium hominis
DTIVS

SEQ ID NO: 2112271 - protein, 7 aa, Cryptosporidium hominis
DTLQKRT

SEQ ID NO: 2112272 - protein, 8 aa, Cryptosporidium hominis
DTNLSSSK

SEQ ID NO: 2112273 - protein, 7 aa, Cryptosporidium hominis
DTNSCSE

SEQ ID NO: 2112274 - protein, 15 aa, Cryptosporidium hominis
DTPMTGSVDEGKYVR

SEQ ID NO: 2112275 - protein, 12 aa, Cryptosporidium hominis
DTPTLEEEPCTS

SEQ ID NO: 2112276 - protein, 5 aa, Cryptosporidium hominis
DTRDY

SEQ ID NO: 2112277 - protein, 4 aa, Cryptosporidium hominis
DTRL

SEQ ID NO: 2112278 - protein, 14 aa, Cryptosporidium hominis
DTRPKAGTNPYSED

SEQ ID NO: 2112279 - protein, 9 aa, Cryptosporidium hominis
DTRPQTQKQ

SEQ ID NO: 2112280 - protein, 5 aa, Cryptosporidium hominis
DTRYS

SEQ ID NO: 2112281 - protein, 12 aa, Cryptosporidium hominis
DTSERKSSIDAL

SEQ ID NO: 2112282 - protein, 8 aa, Cryptosporidium hominis
DTSKLGGK

SEQ ID NO: 2112283 - protein, 4 aa, Cryptosporidium hominis
DTSR

SEQ ID NO: 2112284 - protein, 8 aa, Cryptosporidium hominis
DTSSLSDE

SEQ ID NO: 2112285 - protein, 10 aa, Cryptosporidium hominis
DTSVPGSTRS

SEQ ID NO: 2112286 - protein, 4 aa, Cryptosporidium hominis
DTTE

SEQ ID NO: 2112287 - protein, 11 aa, Cryptosporidium hominis
DTTKQYKEGSA

SEQ ID NO: 2112288 - protein, 29 aa, Cryptosporidium hominis
DTTREGQTEDKQEIVRSTEGVSKGKADIK

SEQ ID NO: 2112289 - protein, 15 aa, Cryptosporidium hominis
DTVKKTEEDSDATNI

SEQ ID NO: 2112290 - protein, 5 aa, Cryptosporidium hominis
DTVNP

SEQ ID NO: 2112291 - protein, 7 aa, Cryptosporidium hominis
DTVSTSN

SEQ ID NO: 2112292 - protein, 10 aa, Cryptosporidium hominis
DVEDSEHGHS

SEQ ID NO: 2112293 - protein, 8 aa, Cryptosporidium hominis
DVENTISK

SEQ ID NO: 2112294 - protein, 12 aa, Cryptosporidium hominis
DVESTGYTAEER

SEQ ID NO: 2112295 - protein, 7 aa, Cryptosporidium hominis
DVGTSET

SEQ ID NO: 2112296 - protein, 5 aa, Cryptosporidium hominis
DVNDP

SEQ ID NO: 2112297 - protein, 5 aa, Cryptosporidium hominis
DVNGG

SEQ ID NO: 2112298 - protein, 6 aa, Cryptosporidium hominis
DVRDSN

SEQ ID NO: 2112299 - protein, 11 aa, Cryptosporidium hominis
DVSKEEKQSKD

SEQ ID NO: 2112300 - protein, 12 aa, Cryptosporidium hominis
DVSSGQQIQAGQ

SEQ ID NO: 2112301 - protein, 7 aa, Cryptosporidium hominis
DVTDDQS

SEQ ID NO: 2112302 - protein, 14 aa, Cryptosporidium hominis
DVTSGRGGSNTGSI

SEQ ID NO: 2112303 - protein, 10 aa, Cryptosporidium hominis
DWESPGKSDM

SEQ ID NO: 2112304 - protein, 8 aa, Cryptosporidium hominis
DWGENEPI

SEQ ID NO: 2112305 - protein, 7 aa, Cryptosporidium hominis
DYDDNSS

SEQ ID NO: 2112306 - protein, 9 aa, Cryptosporidium hominis
DYDEDDPID

SEQ ID NO: 2112307 - protein, 21 aa, Cryptosporidium hominis
DYDKSKRISNALSSNLNSEGC

SEQ ID NO: 2112308 - protein, 18 aa, Cryptosporidium hominis
DYEKAVESKQVAQQQAER

SEQ ID NO: 2112309 - protein, 11 aa, Cryptosporidium hominis
DYGSNHSKNQI

SEQ ID NO: 2112310 - protein, 10 aa, Cryptosporidium hominis
DYHKNSRKDE

SEQ ID NO: 2112311 - protein, 10 aa, Cryptosporidium hominis
DYIKEGRRNY

SEQ ID NO: 2112312 - protein, 9 aa, Cryptosporidium hominis
DYNKIPKSF

SEQ ID NO: 2112313 - protein, 11 aa, Cryptosporidium hominis
DYNNQNGNRME

SEQ ID NO: 2112314 - protein, 10 aa, Cryptosporidium hominis
DYNSKEEYQK

SEQ ID NO: 2112315 - protein, 17 aa, Cryptosporidium hominis
DYPGNTAQQEYEDEEEF

SEQ ID NO: 2112316 - protein, 15 aa, Cryptosporidium hominis
DYQVDEDSDHDHDED

SEQ ID NO: 2112317 - protein, 7 aa, Cryptosporidium hominis
DYSPSSE

SEQ ID NO: 2112318 - protein, 6 aa, Cryptosporidium hominis
DYTDEN

SEQ ID NO: 2112319 - protein, 9 aa, Cryptosporidium hominis
DYTNGRQQF

SEQ ID NO: 2112320 - protein, 11 aa, Cryptosporidium hominis
DYTRRHEGTGL

SEQ ID NO: 2112321 - protein, 8 aa, Cryptosporidium hominis
DYYETGDL

SEQ ID NO: 2112322 - protein, 5 aa, Cryptosporidium hominis
EAAKY

SEQ ID NO: 2112323 - protein, 7 aa, Cryptosporidium hominis
EAEDNSL

SEQ ID NO: 2112324 - protein, 4 aa, Cryptosporidium hominis
EAEK

SEQ ID NO: 2112325 - protein, 8 aa, Cryptosporidium hominis
EAENEEKV

SEQ ID NO: 2112326 - protein, 9 aa, Cryptosporidium hominis
EAENEGNGF

SEQ ID NO: 2112327 - protein, 58 aa, Cryptosporidium hominis
EAEQNVRRNRVNSGYSHNKGQHGSSFQQKQRNTSSQHSSSKRNDDRSYSGSRGHRGSH

SEQ ID NO: 2112328 - protein, 5 aa, Cryptosporidium hominis
EAETP

SEQ ID NO: 2112329 - protein, 7 aa, Cryptosporidium hominis
EAGPTDK

SEQ ID NO: 2112330 - protein, 5 aa, Cryptosporidium hominis
EAHNC

SEQ ID NO: 2112331 - protein, 14 aa, Cryptosporidium hominis
EAINSAKKNAENIG

SEQ ID NO: 2112332 - protein, 12 aa, Cryptosporidium hominis
EAISSATSSIWS

SEQ ID NO: 2112333 - protein, 10 aa, Cryptosporidium hominis
EAKNDTNKKM

SEQ ID NO: 2112334 - protein, 41 aa, Cryptosporidium hominis
EANCENSDNHSKQKADIMDSTQSNSNTEDKGDLKDIQETRN

SEQ ID NO: 2112335 - protein, 8 aa, Cryptosporidium hominis
EANEKNMT

SEQ ID NO: 2112336 - protein, 45 aa, Cryptosporidium hominis
EANESSSENNIEKKASHEEQSEVDDKKAQESDKGEDEQSTKPKSF

SEQ ID NO: 2112337 - protein, 7 aa, Cryptosporidium hominis
EANNFGS

SEQ ID NO: 2112338 - protein, 5 aa, Cryptosporidium hominis
EANQD

SEQ ID NO: 2112339 - protein, 15 aa, Cryptosporidium hominis
EAPEENSPNNSNNPL

SEQ ID NO: 2112340 - protein, 5 aa, Cryptosporidium hominis
EAPNE

SEQ ID NO: 2112341 - protein, 5 aa, Cryptosporidium hominis
EAPNL

SEQ ID NO: 2112342 - protein, 6 aa, Cryptosporidium hominis
EAPPAL

SEQ ID NO: 2112343 - protein, 9 aa, Cryptosporidium hominis
EASDQHNDT

SEQ ID NO: 2112344 - protein, 4 aa, Cryptosporidium hominis
EASN

SEQ ID NO: 2112345 - protein, 8 aa, Cryptosporidium hominis
EATPREQA

SEQ ID NO: 2112346 - protein, 5 aa, Cryptosporidium hominis
EAWGE

SEQ ID NO: 2112347 - protein, 6 aa, Cryptosporidium hominis
ECENDN

SEQ ID NO: 2112348 - protein, 6 aa, Cryptosporidium hominis
ECESDS

SEQ ID NO: 2112349 - protein, 36 aa, Cryptosporidium hominis
ECISPSPRTRSSQRLRPSIPKSSSSSSSSSSNKREF

SEQ ID NO: 2112350 - protein, 4 aa, Cryptosporidium hominis
ECKH

SEQ ID NO: 2112351 - protein, 11 aa, Cryptosporidium hominis
ECRSRNSKKVA

SEQ ID NO: 2112352 - protein, 5 aa, Cryptosporidium hominis
ECSDK

SEQ ID NO: 2112353 - protein, 7 aa, Cryptosporidium hominis
EDANDHN

SEQ ID NO: 2112354 - protein, 10 aa, Cryptosporidium hominis
EDANSESSCL

SEQ ID NO: 2112355 - protein, 10 aa, Cryptosporidium hominis
EDDDTSTDCE

SEQ ID NO: 2112356 - protein, 8 aa, Cryptosporidium hominis
EDDEDSEL

SEQ ID NO: 2112357 - protein, 10 aa, Cryptosporidium hominis
EDEAKQAGIS

SEQ ID NO: 2112358 - protein, 23 aa, Cryptosporidium hominis
EDEEDQNSNNRNSEKKELDSPSK

SEQ ID NO: 2112359 - protein, 6 aa, Cryptosporidium hominis
EDEEKI

SEQ ID NO: 2112360 - protein, 8 aa, Cryptosporidium hominis
EDEKQLDF

SEQ ID NO: 2112361 - protein, 6 aa, Cryptosporidium hominis
EDETFS

SEQ ID NO: 2112362 - protein, 12 aa, Cryptosporidium hominis
EDETQPGEIQSL

SEQ ID NO: 2112363 - protein, 8 aa, Cryptosporidium hominis
EDEVDGDL

SEQ ID NO: 2112364 - protein, 13 aa, Cryptosporidium hominis
EDGCIDDRSHHTL

SEQ ID NO: 2112365 - protein, 7 aa, Cryptosporidium hominis
EDGDESF

SEQ ID NO: 2112366 - protein, 6 aa, Cryptosporidium hominis
EDGETT

SEQ ID NO: 2112367 - protein, 12 aa, Cryptosporidium hominis
EDGFKGRKRKNG

SEQ ID NO: 2112368 - protein, 12 aa, Cryptosporidium hominis
EDGKFKSSHKKS

SEQ ID NO: 2112369 - protein, 8 aa, Cryptosporidium hominis
EDGLENHR

SEQ ID NO: 2112370 - protein, 4 aa, Cryptosporidium hominis
EDGN

SEQ ID NO: 2112371 - protein, 7 aa, Cryptosporidium hominis
EDGSVSR

SEQ ID NO: 2112372 - protein, 4 aa, Cryptosporidium hominis
EDHH

SEQ ID NO: 2112373 - protein, 10 aa, Cryptosporidium hominis
EDHIKESYPE

SEQ ID NO: 2112374 - protein, 7 aa, Cryptosporidium hominis
EDKFQNN

SEQ ID NO: 2112375 - protein, 10 aa, Cryptosporidium hominis
EDKHYDNNEV

SEQ ID NO: 2112376 - protein, 8 aa, Cryptosporidium hominis
EDKTIGKN

SEQ ID NO: 2112377 - protein, 12 aa, Cryptosporidium hominis
EDKTQKTSNGYN

SEQ ID NO: 2112378 - protein, 4 aa, Cryptosporidium hominis
EDLK

SEQ ID NO: 2112379 - protein, 15 aa, Cryptosporidium hominis
EDLNKKENETEEDFG

SEQ ID NO: 2112380 - protein, 5 aa, Cryptosporidium hominis
EDNAR

SEQ ID NO: 2112381 - protein, 11 aa, Cryptosporidium hominis
EDNDSSTKHKA

SEQ ID NO: 2112382 - protein, 4 aa, Cryptosporidium hominis
EDNE

SEQ ID NO: 2112383 - protein, 7 aa, Cryptosporidium hominis
EDNNHKV

SEQ ID NO: 2112384 - protein, 6 aa, Cryptosporidium hominis
EDNPKI

SEQ ID NO: 2112385 - protein, 9 aa, Cryptosporidium hominis
EDNSFSKPK

SEQ ID NO: 2112386 - protein, 6 aa, Cryptosporidium hominis
EDNYST

SEQ ID NO: 2112387 - protein, 7 aa, Cryptosporidium hominis
EDPCENE

SEQ ID NO: 2112388 - protein, 4 aa, Cryptosporidium hominis
EDPL

SEQ ID NO: 2112389 - protein, 20 aa, Cryptosporidium hominis
EDQGTTSTQNSSQNESSNKK

SEQ ID NO: 2112390 - protein, 7 aa, Cryptosporidium hominis
EDQKDGE

SEQ ID NO: 2112391 - protein, 5 aa, Cryptosporidium hominis
EDQLG

SEQ ID NO: 2112392 - protein, 17 aa, Cryptosporidium hominis
EDSDDIRDNKKTNTSCS

SEQ ID NO: 2112393 - protein, 11 aa, Cryptosporidium hominis
EDSEHNIDSKE

SEQ ID NO: 2112394 - protein, 5 aa, Cryptosporidium hominis
EDSEK

SEQ ID NO: 2112395 - protein, 13 aa, Cryptosporidium hominis
EDSEQLPKSKISR

SEQ ID NO: 2112396 - protein, 6 aa, Cryptosporidium hominis
EDSGEY

SEQ ID NO: 2112397 - protein, 12 aa, Cryptosporidium hominis
EDSGKKEGLKEV

SEQ ID NO: 2112398 - protein, 10 aa, Cryptosporidium hominis
EDSPAKKEIN

SEQ ID NO: 2112399 - protein, 8 aa, Cryptosporidium hominis
EDSPGNGK

SEQ ID NO: 2112400 - protein, 7 aa, Cryptosporidium hominis
EDSSRQQ

SEQ ID NO: 2112401 - protein, 8 aa, Cryptosporidium hominis
EDSSSEKL

SEQ ID NO: 2112402 - protein, 4 aa, Cryptosporidium hominis
EDSV

SEQ ID NO: 2112403 - protein, 12 aa, Cryptosporidium hominis
EDTAAQIADPPM

SEQ ID NO: 2112404 - protein, 8 aa, Cryptosporidium hominis
EDWPSQGK

SEQ ID NO: 2112405 - protein, 7 aa, Cryptosporidium hominis
EDYIDPE

SEQ ID NO: 2112406 - protein, 13 aa, Cryptosporidium hominis
EDYKLTKDTSYYQ

SEQ ID NO: 2112407 - protein, 4 aa, Cryptosporidium hominis
EDYN

SEQ ID NO: 2112408 - protein, 5 aa, Cryptosporidium hominis
EEAAF

SEQ ID NO: 2112409 - protein, 5 aa, Cryptosporidium hominis
EEAAL

SEQ ID NO: 2112410 - protein, 14 aa, Cryptosporidium hominis
EEAKYNEQKEIQTR

SEQ ID NO: 2112411 - protein, 10 aa, Cryptosporidium hominis
EEARKRDPEF

SEQ ID NO: 2112412 - protein, 6 aa, Cryptosporidium hominis
EEDDAM

SEQ ID NO: 2112413 - protein, 4 aa, Cryptosporidium hominis
EEDE

SEQ ID NO: 2112414 - protein, 8 aa, Cryptosporidium hominis
EEDETEQR

SEQ ID NO: 2112415 - protein, 16 aa, Cryptosporidium hominis
EEDGTPEQGNTHSSGM

SEQ ID NO: 2112416 - protein, 4 aa, Cryptosporidium hominis
EEDL

SEQ ID NO: 2112417 - protein, 4 aa, Cryptosporidium hominis
EEDM

SEQ ID NO: 2112418 - protein, 20 aa, Cryptosporidium hominis
EEDQNLQENQNPRRERDLEQ

SEQ ID NO: 2112419 - protein, 9 aa, Cryptosporidium hominis
EEDQSKQKS

SEQ ID NO: 2112420 - protein, 4 aa, Cryptosporidium hominis
EEDY

SEQ ID NO: 2112421 - protein, 11 aa, Cryptosporidium hominis
EEEDSKEGNSE

SEQ ID NO: 2112422 - protein, 33 aa, Cryptosporidium hominis
EEEEETPMSQNANIESQLQTQQSYNSETSFPDE

SEQ ID NO: 2112423 - protein, 37 aa, Cryptosporidium hominis
EEEEKEKKEAQPQENTNHDGLSDNEKELDHEENQGRL

SEQ ID NO: 2112424 - protein, 11 aa, Cryptosporidium hominis
EEEGKTVEENR

SEQ ID NO: 2112425 - protein, 9 aa, Cryptosporidium hominis
EEEIPKNNT

SEQ ID NO: 2112426 - protein, 11 aa, Cryptosporidium hominis
EEEKEEERNNN

SEQ ID NO: 2112427 - protein, 13 aa, Cryptosporidium hominis
EEEKGTAKEGGAI

SEQ ID NO: 2112428 - protein, 13 aa, Cryptosporidium hominis
EEELEKREEEIAN

SEQ ID NO: 2112429 - protein, 7 aa, Cryptosporidium hominis
EEENDNL

SEQ ID NO: 2112430 - protein, 16 aa, Cryptosporidium hominis
EEEQEEENEEEDDDEY

SEQ ID NO: 2112431 - protein, 19 aa, Cryptosporidium hominis
EEESNSVSNLSSSNEEQID

SEQ ID NO: 2112432 - protein, 5 aa, Cryptosporidium hominis
EEFKS

SEQ ID NO: 2112433 - protein, 9 aa, Cryptosporidium hominis
EEGDRDSEF

SEQ ID NO: 2112434 - protein, 4 aa, Cryptosporidium hominis
EEGG

SEQ ID NO: 2112435 - protein, 4 aa, Cryptosporidium hominis
EEHE

SEQ ID NO: 2112436 - protein, 13 aa, Cryptosporidium hominis
EEIEEVEDTDEVT

SEQ ID NO: 2112437 - protein, 10 aa, Cryptosporidium hominis
EEIPENSEKK

SEQ ID NO: 2112438 - protein, 9 aa, Cryptosporidium hominis
EEITDSKDL

SEQ ID NO: 2112439 - protein, 9 aa, Cryptosporidium hominis
EEKDSSGKI

SEQ ID NO: 2112440 - protein, 16 aa, Cryptosporidium hominis
EEKENSNSDSIKEETK

SEQ ID NO: 2112441 - protein, 11 aa, Cryptosporidium hominis
EEKNNSNQTPL

SEQ ID NO: 2112442 - protein, 19 aa, Cryptosporidium hominis
EEKNQEAGFDSSNLPRGIT

SEQ ID NO: 2112443 - protein, 4 aa, Cryptosporidium hominis
EEKT

SEQ ID NO: 2112444 - protein, 9 aa, Cryptosporidium hominis
EELDPPSYS

SEQ ID NO: 2112445 - protein, 4 aa, Cryptosporidium hominis
EELE

SEQ ID NO: 2112446 - protein, 14 aa, Cryptosporidium hominis
EELENGSDIKNSDI

SEQ ID NO: 2112447 - protein, 31 aa, Cryptosporidium hominis
EELKSTLKTSVPTISDNDEAKKFAENTYSDT

SEQ ID NO: 2112448 - protein, 8 aa, Cryptosporidium hominis
EELNSRTN

SEQ ID NO: 2112449 - protein, 6 aa, Cryptosporidium hominis
EELSEA

SEQ ID NO: 2112450 - protein, 22 aa, Cryptosporidium hominis
EELTNSETSNTSSSSSSSYPNF

SEQ ID NO: 2112451 - protein, 5 aa, Cryptosporidium hominis
EENFK

SEQ ID NO: 2112452 - protein, 8 aa, Cryptosporidium hominis
EENFTEQS

SEQ ID NO: 2112453 - protein, 11 aa, Cryptosporidium hominis
EENGRRPTRNE

SEQ ID NO: 2112454 - protein, 6 aa, Cryptosporidium hominis
EENKNC

SEQ ID NO: 2112455 - protein, 6 aa, Cryptosporidium hominis
EEPIQD

SEQ ID NO: 2112456 - protein, 7 aa, Cryptosporidium hominis
EEPSDDS

SEQ ID NO: 2112457 - protein, 8 aa, Cryptosporidium hominis
EEQGGGKD

SEQ ID NO: 2112458 - protein, 5 aa, Cryptosporidium hominis
EEQPY

SEQ ID NO: 2112459 - protein, 8 aa, Cryptosporidium hominis
EEQSNKNS

SEQ ID NO: 2112460 - protein, 6 aa, Cryptosporidium hominis
EEQSNR

SEQ ID NO: 2112461 - protein, 9 aa, Cryptosporidium hominis
EERKDNYKQ

SEQ ID NO: 2112462 - protein, 7 aa, Cryptosporidium hominis
EERRNDR

SEQ ID NO: 2112463 - protein, 9 aa, Cryptosporidium hominis
EERSQEQCT

SEQ ID NO: 2112464 - protein, 12 aa, Cryptosporidium hominis
EERTGEDISKQL

SEQ ID NO: 2112465 - protein, 7 aa, Cryptosporidium hominis
EERVEET

SEQ ID NO: 2112466 - protein, 7 aa, Cryptosporidium hominis
EESANQL

SEQ ID NO: 2112467 - protein, 7 aa, Cryptosporidium hominis
EESDELD

SEQ ID NO: 2112468 - protein, 9 aa, Cryptosporidium hominis
EESGGSDIS

SEQ ID NO: 2112469 - protein, 14 aa, Cryptosporidium hominis
EESGIQKARSVSDN

SEQ ID NO: 2112470 - protein, 9 aa, Cryptosporidium hominis
EESINSKAP

SEQ ID NO: 2112471 - protein, 18 aa, Cryptosporidium hominis
EESLSNNDSKNNSGIKKR

SEQ ID NO: 2112472 - protein, 9 aa, Cryptosporidium hominis
EESSDIGTL

SEQ ID NO: 2112473 - protein, 30 aa, Cryptosporidium hominis
EESSSYKNVSNNTKISKKNKNKRSSNNHNI

SEQ ID NO: 2112474 - protein, 5 aa, Cryptosporidium hominis
EETDD

SEQ ID NO: 2112475 - protein, 4 aa, Cryptosporidium hominis
EETH

SEQ ID NO: 2112476 - protein, 7 aa, Cryptosporidium hominis
EETKSEW

SEQ ID NO: 2112477 - protein, 9 aa, Cryptosporidium hominis
EETNNEKKL

SEQ ID NO: 2112478 - protein, 6 aa, Cryptosporidium hominis
EETPFT

SEQ ID NO: 2112479 - protein, 17 aa, Cryptosporidium hominis
EETQLKDSSVANSSQNI

SEQ ID NO: 2112480 - protein, 6 aa, Cryptosporidium hominis
EETSNG

SEQ ID NO: 2112481 - protein, 4 aa, Cryptosporidium hominis
EEVN

SEQ ID NO: 2112482 - protein, 7 aa, Cryptosporidium hominis
EEVTSDS

SEQ ID NO: 2112483 - protein, 6 aa, Cryptosporidium hominis
EEWRSG

SEQ ID NO: 2112484 - protein, 6 aa, Cryptosporidium hominis
EEYEED

SEQ ID NO: 2112485 - protein, 5 aa, Cryptosporidium hominis
EFGDS

SEQ ID NO: 2112486 - protein, 12 aa, Cryptosporidium hominis
EFGRSNENHNSK

SEQ ID NO: 2112487 - protein, 6 aa, Cryptosporidium hominis
EFNESQ

SEQ ID NO: 2112488 - protein, 32 aa, Cryptosporidium hominis
EFPDDNSKASSSSAKSGSTTSSTGSNTKDEEI

SEQ ID NO: 2112489 - protein, 6 aa, Cryptosporidium hominis
EFPPET

SEQ ID NO: 2112490 - protein, 22 aa, Cryptosporidium hominis
EFQNSEEKLESASTEEEKRTRA

SEQ ID NO: 2112491 - protein, 4 aa, Cryptosporidium hominis
EFSD

SEQ ID NO: 2112492 - protein, 14 aa, Cryptosporidium hominis
EFSGKRSGNGNNLR

SEQ ID NO: 2112493 - protein, 8 aa, Cryptosporidium hominis
EFSKPEAV

SEQ ID NO: 2112494 - protein, 5 aa, Cryptosporidium hominis
EFSTD

SEQ ID NO: 2112495 - protein, 10 aa, Cryptosporidium hominis
EGANRKNSKK

SEQ ID NO: 2112496 - protein, 10 aa, Cryptosporidium hominis
EGASQRIQED

SEQ ID NO: 2112497 - protein, 13 aa, Cryptosporidium hominis
EGASQRVQEDTAR

SEQ ID NO: 2112498 - protein, 7 aa, Cryptosporidium hominis
EGCDSEK

SEQ ID NO: 2112499 - protein, 7 aa, Cryptosporidium hominis
EGCNNKE

SEQ ID NO: 2112500 - protein, 13 aa, Cryptosporidium hominis
EGDAISPKLQDER

SEQ ID NO: 2112501 - protein, 11 aa, Cryptosporidium hominis
EGDDTSPKTPI

SEQ ID NO: 2112502 - protein, 13 aa, Cryptosporidium hominis
EGDEDSSSNRNGF

SEQ ID NO: 2112503 - protein, 5 aa, Cryptosporidium hominis
EGDQT

SEQ ID NO: 2112504 - protein, 5 aa, Cryptosporidium hominis
EGDRN

SEQ ID NO: 2112505 - protein, 16 aa, Cryptosporidium hominis
EGDSASSDNSENPSNV

SEQ ID NO: 2112506 - protein, 13 aa, Cryptosporidium hominis
EGEENKTNSKSKG

SEQ ID NO: 2112507 - protein, 4 aa, Cryptosporidium hominis
EGEI

SEQ ID NO: 2112508 - protein, 10 aa, Cryptosporidium hominis
EGFASSRWTN

SEQ ID NO: 2112509 - protein, 30 aa, Cryptosporidium hominis
EGGAGTGTGIKQTSSCSTHNNSSNNNIGRK

SEQ ID NO: 2112510 - protein, 7 aa, Cryptosporidium hominis
EGGGAQL

SEQ ID NO: 2112511 - protein, 8 aa, Cryptosporidium hominis
EGGGIGGI

SEQ ID NO: 2112512 - protein, 25 aa, Cryptosporidium hominis
EGGISGNDDFAQTQSQNHMQTQTLS

SEQ ID NO: 2112513 - protein, 6 aa, Cryptosporidium hominis
EGGPSF

SEQ ID NO: 2112514 - protein, 8 aa, Cryptosporidium hominis
EGGSHDRT

SEQ ID NO: 2112515 - protein, 13 aa, Cryptosporidium hominis
EGGTSLSGGQKTR

SEQ ID NO: 2112516 - protein, 6 aa, Cryptosporidium hominis
EGHSYT

SEQ ID NO: 2112517 - protein, 10 aa, Cryptosporidium hominis
EGIKSEKKEI

SEQ ID NO: 2112518 - protein, 9 aa, Cryptosporidium hominis
EGIKSGSIN

SEQ ID NO: 2112519 - protein, 6 aa, Cryptosporidium hominis
EGISSA

SEQ ID NO: 2112520 - protein, 4 aa, Cryptosporidium hominis
EGIY

SEQ ID NO: 2112521 - protein, 8 aa, Cryptosporidium hominis
EGKEEAQL

SEQ ID NO: 2112522 - protein, 11 aa, Cryptosporidium hominis
EGKETKEGSIQ

SEQ ID NO: 2112523 - protein, 12 aa, Cryptosporidium hominis
EGKKKEKNEITK

SEQ ID NO: 2112524 - protein, 5 aa, Cryptosporidium hominis
EGKKL

SEQ ID NO: 2112525 - protein, 8 aa, Cryptosporidium hominis
EGLAPNEG

SEQ ID NO: 2112526 - protein, 4 aa, Cryptosporidium hominis
EGLD

SEQ ID NO: 2112527 - protein, 7 aa, Cryptosporidium hominis
EGLQSNT

SEQ ID NO: 2112528 - protein, 12 aa, Cryptosporidium hominis
EGNDTGNVTKSD

SEQ ID NO: 2112529 - protein, 9 aa, Cryptosporidium hominis
EGNGRTAKG

SEQ ID NO: 2112530 - protein, 7 aa, Cryptosporidium hominis
EGNNSKI

SEQ ID NO: 2112531 - protein, 18 aa, Cryptosporidium hominis
EGPIKDEENESSGSESLN

SEQ ID NO: 2112532 - protein, 9 aa, Cryptosporidium hominis
EGPPQQSPR

SEQ ID NO: 2112533 - protein, 5 aa, Cryptosporidium hominis
EGQEK

SEQ ID NO: 2112534 - protein, 4 aa, Cryptosporidium hominis
EGRK

SEQ ID NO: 2112535 - protein, 11 aa, Cryptosporidium hominis
EGSGGSNVSNE

SEQ ID NO: 2112536 - protein, 14 aa, Cryptosporidium hominis
EGSLDSKVKKVRNS

SEQ ID NO: 2112537 - protein, 17 aa, Cryptosporidium hominis
EGSPNDISIDDNDNYEE

SEQ ID NO: 2112538 - protein, 30 aa, Cryptosporidium hominis
EGSQSDSTNEQNKAVDETKVKVEEADPKEV

SEQ ID NO: 2112539 - protein, 13 aa, Cryptosporidium hominis
EGTNKTNKMNEKG

SEQ ID NO: 2112540 - protein, 10 aa, Cryptosporidium hominis
EGTPSNNGSH

SEQ ID NO: 2112541 - protein, 16 aa, Cryptosporidium hominis
EGVADRSLDSDKQEGV

SEQ ID NO: 2112542 - protein, 7 aa, Cryptosporidium hominis
EGVGNSY

SEQ ID NO: 2112543 - protein, 7 aa, Cryptosporidium hominis
EGYFNTS

SEQ ID NO: 2112544 - protein, 8 aa, Cryptosporidium hominis
EGYSAGAL

SEQ ID NO: 2112545 - protein, 11 aa, Cryptosporidium hominis
EGYTPAEGARR

SEQ ID NO: 2112546 - protein, 12 aa, Cryptosporidium hominis
EHNMKKPRDDED

SEQ ID NO: 2112547 - protein, 6 aa, Cryptosporidium hominis
EHQATT

SEQ ID NO: 2112548 - protein, 6 aa, Cryptosporidium hominis
EHSDAK

SEQ ID NO: 2112549 - protein, 13 aa, Cryptosporidium hominis
EHSEDDSEDFSKA

SEQ ID NO: 2112550 - protein, 4 aa, Cryptosporidium hominis
EHSL

SEQ ID NO: 2112551 - protein, 7 aa, Cryptosporidium hominis
EHSNNTY

SEQ ID NO: 2112552 - protein, 10 aa, Cryptosporidium hominis
EHTEKQKITP

SEQ ID NO: 2112553 - protein, 10 aa, Cryptosporidium hominis
EIDGSSIERV

SEQ ID NO: 2112554 - protein, 7 aa, Cryptosporidium hominis
EIDPDSM

SEQ ID NO: 2112555 - protein, 7 aa, Cryptosporidium hominis
EIEDSEL

SEQ ID NO: 2112556 - protein, 5 aa, Cryptosporidium hominis
EIGEN

SEQ ID NO: 2112557 - protein, 7 aa, Cryptosporidium hominis
EIGQGTS

SEQ ID NO: 2112558 - protein, 5 aa, Cryptosporidium hominis
EIING

SEQ ID NO: 2112559 - protein, 5 aa, Cryptosporidium hominis
EIIPP

SEQ ID NO: 2112560 - protein, 7 aa, Cryptosporidium hominis
EIKNKSS

SEQ ID NO: 2112561 - protein, 5 aa, Cryptosporidium hominis
EINDG

SEQ ID NO: 2112562 - protein, 20 aa, Cryptosporidium hominis
EINKSSEGRPFQDSQQDSSF

SEQ ID NO: 2112563 - protein, 4 aa, Cryptosporidium hominis
EINN

SEQ ID NO: 2112564 - protein, 17 aa, Cryptosporidium hominis
EINQPDISEKNNSTYVS

SEQ ID NO: 2112565 - protein, 8 aa, Cryptosporidium hominis
EINSDEDK

SEQ ID NO: 2112566 - protein, 55 aa, Cryptosporidium hominis
EIPSGLEDYNTEAGTVTTDTETITTDTYSDTDIDTDSTDIYSRDSTDTDNRVQEE

SEQ ID NO: 2112567 - protein, 10 aa, Cryptosporidium hominis
EIPSSTSEKE

SEQ ID NO: 2112568 - protein, 7 aa, Cryptosporidium hominis
EIPTEED

SEQ ID NO: 2112569 - protein, 8 aa, Cryptosporidium hominis
EIQSKESV

SEQ ID NO: 2112570 - protein, 11 aa, Cryptosporidium hominis
EIQSKNSTGLI

SEQ ID NO: 2112571 - protein, 13 aa, Cryptosporidium hominis
EIQTNQNASEACN

SEQ ID NO: 2112572 - protein, 6 aa, Cryptosporidium hominis
EIRGKG

SEQ ID NO: 2112573 - protein, 4 aa, Cryptosporidium hominis
EIRN

SEQ ID NO: 2112574 - protein, 7 aa, Cryptosporidium hominis
EIRTGPI

SEQ ID NO: 2112575 - protein, 10 aa, Cryptosporidium hominis
EIRTKQQARD

SEQ ID NO: 2112576 - protein, 19 aa, Cryptosporidium hominis
EISASHSSATFTDSRNTFQ

SEQ ID NO: 2112577 - protein, 6 aa, Cryptosporidium hominis
EISEDE

SEQ ID NO: 2112578 - protein, 10 aa, Cryptosporidium hominis
EISEKSEKIR

SEQ ID NO: 2112579 - protein, 9 aa, Cryptosporidium hominis
EISETDPNS

SEQ ID NO: 2112580 - protein, 10 aa, Cryptosporidium hominis
EISKEKAEFN

SEQ ID NO: 2112581 - protein, 5 aa, Cryptosporidium hominis
EISPD

SEQ ID NO: 2112582 - protein, 8 aa, Cryptosporidium hominis
EISPGGAK

SEQ ID NO: 2112583 - protein, 9 aa, Cryptosporidium hominis
EISPGKRNT

SEQ ID NO: 2112584 - protein, 7 aa, Cryptosporidium hominis
EISSQND

SEQ ID NO: 2112585 - protein, 6 aa, Cryptosporidium hominis
EISTKT

SEQ ID NO: 2112586 - protein, 6 aa, Cryptosporidium hominis
EKALQA

SEQ ID NO: 2112587 - protein, 7 aa, Cryptosporidium hominis
EKARDEK

SEQ ID NO: 2112588 - protein, 6 aa, Cryptosporidium hominis
EKDGQW

SEQ ID NO: 2112589 - protein, 8 aa, Cryptosporidium hominis
EKDPTNDN

SEQ ID NO: 2112590 - protein, 10 aa, Cryptosporidium hominis
EKDSEKSNYK

SEQ ID NO: 2112591 - protein, 7 aa, Cryptosporidium hominis
EKDYNKS

SEQ ID NO: 2112592 - protein, 5 aa, Cryptosporidium hominis
EKEED

SEQ ID NO: 2112593 - protein, 8 aa, Cryptosporidium hominis
EKEHSGYG

SEQ ID NO: 2112594 - protein, 8 aa, Cryptosporidium hominis
EKEKRRNQ

SEQ ID NO: 2112595 - protein, 11 aa, Cryptosporidium hominis
EKENQLGDKNW

SEQ ID NO: 2112596 - protein, 27 aa, Cryptosporidium hominis
EKEPEEDEDEDGDGNEDGDDAKDEITR

SEQ ID NO: 2112597 - protein, 7 aa, Cryptosporidium hominis
EKEQRDV

SEQ ID NO: 2112598 - protein, 6 aa, Cryptosporidium hominis
EKERDD

SEQ ID NO: 2112599 - protein, 12 aa, Cryptosporidium hominis
EKERSHKSQRES

SEQ ID NO: 2112600 - protein, 8 aa, Cryptosporidium hominis
EKERSNKA

SEQ ID NO: 2112601 - protein, 16 aa, Cryptosporidium hominis
EKETKRESNEFKPHDS

SEQ ID NO: 2112602 - protein, 11 aa, Cryptosporidium hominis
EKEYVRNKSSQ

SEQ ID NO: 2112603 - protein, 19 aa, Cryptosporidium hominis
EKFQGSDSIEEEDSNSELT

SEQ ID NO: 2112604 - protein, 7 aa, Cryptosporidium hominis
EKGDQIV

SEQ ID NO: 2112605 - protein, 10 aa, Cryptosporidium hominis
EKGIDKNSSR

SEQ ID NO: 2112606 - protein, 11 aa, Cryptosporidium hominis
EKGINSEPSPY

SEQ ID NO: 2112607 - protein, 4 aa, Cryptosporidium hominis
EKGK

SEQ ID NO: 2112608 - protein, 6 aa, Cryptosporidium hominis
EKGKEI

SEQ ID NO: 2112609 - protein, 10 aa, Cryptosporidium hominis
EKGLNENNTL

SEQ ID NO: 2112610 - protein, 9 aa, Cryptosporidium hominis
EKGSTVKKN

SEQ ID NO: 2112611 - protein, 11 aa, Cryptosporidium hominis
EKHRNGNSQSQ

SEQ ID NO: 2112612 - protein, 6 aa, Cryptosporidium hominis
EKIDKT

SEQ ID NO: 2112613 - protein, 12 aa, Cryptosporidium hominis
EKIINGNSSTIK

SEQ ID NO: 2112614 - protein, 13 aa, Cryptosporidium hominis
EKIKDNTNKTIGD

SEQ ID NO: 2112615 - protein, 5 aa, Cryptosporidium hominis
EKINP

SEQ ID NO: 2112616 - protein, 4 aa, Cryptosporidium hominis
EKIP

SEQ ID NO: 2112617 - protein, 6 aa, Cryptosporidium hominis
EKISKA

SEQ ID NO: 2112618 - protein, 25 aa, Cryptosporidium hominis
EKITIDSSGISGSLSLKDEKSECSA

SEQ ID NO: 2112619 - protein, 5 aa, Cryptosporidium hominis
EKKDT

SEQ ID NO: 2112620 - protein, 17 aa, Cryptosporidium hominis
EKKEDVENTDLNGNSNN

SEQ ID NO: 2112621 - protein, 8 aa, Cryptosporidium hominis
EKKEEMPE

SEQ ID NO: 2112622 - protein, 9 aa, Cryptosporidium hominis
EKKELNNLT

SEQ ID NO: 2112623 - protein, 11 aa, Cryptosporidium hominis
EKKHRKSSCKH

SEQ ID NO: 2112624 - protein, 6 aa, Cryptosporidium hominis
EKKLTS

SEQ ID NO: 2112625 - protein, 4 aa, Cryptosporidium hominis
EKKN

SEQ ID NO: 2112626 - protein, 9 aa, Cryptosporidium hominis
EKKNKTSFS

SEQ ID NO: 2112627 - protein, 7 aa, Cryptosporidium hominis
EKKPEFE

SEQ ID NO: 2112628 - protein, 8 aa, Cryptosporidium hominis
EKKVTSNA

SEQ ID NO: 2112629 - protein, 7 aa, Cryptosporidium hominis
EKKYNGY

SEQ ID NO: 2112630 - protein, 4 aa, Cryptosporidium hominis
EKLE

SEQ ID NO: 2112631 - protein, 4 aa, Cryptosporidium hominis
EKLK

SEQ ID NO: 2112632 - protein, 5 aa, Cryptosporidium hominis
EKLQD

SEQ ID NO: 2112633 - protein, 7 aa, Cryptosporidium hominis
EKMKNSS

SEQ ID NO: 2112634 - protein, 7 aa, Cryptosporidium hominis
EKMPTTA

SEQ ID NO: 2112635 - protein, 8 aa, Cryptosporidium hominis
EKNALNKR

SEQ ID NO: 2112636 - protein, 4 aa, Cryptosporidium hominis
EKND

SEQ ID NO: 2112637 - protein, 10 aa, Cryptosporidium hominis
EKNDEETGEE

SEQ ID NO: 2112638 - protein, 10 aa, Cryptosporidium hominis
EKNEAPSYSY

SEQ ID NO: 2112639 - protein, 5 aa, Cryptosporidium hominis
EKNEF

SEQ ID NO: 2112640 - protein, 4 aa, Cryptosporidium hominis
EKNF

SEQ ID NO: 2112641 - protein, 9 aa, Cryptosporidium hominis
EKNGAAVNN

SEQ ID NO: 2112642 - protein, 15 aa, Cryptosporidium hominis
EKNKEIKYSSDNHIN

SEQ ID NO: 2112643 - protein, 9 aa, Cryptosporidium hominis
EKNPKGGYP

SEQ ID NO: 2112644 - protein, 11 aa, Cryptosporidium hominis
EKNQTVNNYQP

SEQ ID NO: 2112645 - protein, 8 aa, Cryptosporidium hominis
EKNSFRGL

SEQ ID NO: 2112646 - protein, 12 aa, Cryptosporidium hominis
EKNTNKISDTSN

SEQ ID NO: 2112647 - protein, 32 aa, Cryptosporidium hominis
EKNVKKDKAAEDEAVSNNGELSGNASNKEAAS

SEQ ID NO: 2112648 - protein, 7 aa, Cryptosporidium hominis
EKPGTDF

SEQ ID NO: 2112649 - protein, 7 aa, Cryptosporidium hominis
EKPHEGN

SEQ ID NO: 2112650 - protein, 13 aa, Cryptosporidium hominis
EKPIESNDADLAK

SEQ ID NO: 2112651 - protein, 12 aa, Cryptosporidium hominis
EKPQNKDKIGGI

SEQ ID NO: 2112652 - protein, 18 aa, Cryptosporidium hominis
EKQAQLEEKISESQGISK

SEQ ID NO: 2112653 - protein, 11 aa, Cryptosporidium hominis
EKQKWGHPKSA

SEQ ID NO: 2112654 - protein, 12 aa, Cryptosporidium hominis
EKQLSASGQEIG

SEQ ID NO: 2112655 - protein, 9 aa, Cryptosporidium hominis
EKQNPKSYW

SEQ ID NO: 2112656 - protein, 8 aa, Cryptosporidium hominis
EKQPEKKQ

SEQ ID NO: 2112657 - protein, 14 aa, Cryptosporidium hominis
EKQRKREKSGNSAV

SEQ ID NO: 2112658 - protein, 10 aa, Cryptosporidium hominis
EKQSSYKNKK

SEQ ID NO: 2112659 - protein, 8 aa, Cryptosporidium hominis
EKRAEGEL

SEQ ID NO: 2112660 - protein, 8 aa, Cryptosporidium hominis
EKRCSGKG

SEQ ID NO: 2112661 - protein, 4 aa, Cryptosporidium hominis
EKRK

SEQ ID NO: 2112662 - protein, 6 aa, Cryptosporidium hominis
EKRPEE

SEQ ID NO: 2112663 - protein, 152 aa, Cryptosporidium hominis
EKRSKSSKRDRSDDLERVEEDDEDDDNDDELASGNESDPYTGSDSQSETRSNLDSSSDVEEKKRQHPSKSLKNKEKKSRKDKKKKKKRQEDRIRSRNIGSENSFSNSNEESDVEQIGSKMRDSSSESDTLASKLKKNKKKKSNDAKKREEKR

SEQ ID NO: 2112664 - protein, 8 aa, Cryptosporidium hominis
EKSDSLYD

SEQ ID NO: 2112665 - protein, 4 aa, Cryptosporidium hominis
EKSK

SEQ ID NO: 2112666 - protein, 10 aa, Cryptosporidium hominis
EKSKESKTKY

SEQ ID NO: 2112667 - protein, 8 aa, Cryptosporidium hominis
EKSKYDVP

SEQ ID NO: 2112668 - protein, 6 aa, Cryptosporidium hominis
EKSNEL

SEQ ID NO: 2112669 - protein, 8 aa, Cryptosporidium hominis
EKSRPANI

SEQ ID NO: 2112670 - protein, 10 aa, Cryptosporidium hominis
EKSSCNSSPC

SEQ ID NO: 2112671 - protein, 12 aa, Cryptosporidium hominis
EKSSLSNTSVSS

SEQ ID NO: 2112672 - protein, 23 aa, Cryptosporidium hominis
EKSSSDNSYLNNEKNSIGERVIL

SEQ ID NO: 2112673 - protein, 9 aa, Cryptosporidium hominis
EKSTPDEQD

SEQ ID NO: 2112674 - protein, 7 aa, Cryptosporidium hominis
EKSTSLS

SEQ ID NO: 2112675 - protein, 10 aa, Cryptosporidium hominis
EKSVKENENL

SEQ ID NO: 2112676 - protein, 4 aa, Cryptosporidium hominis
EKTD

SEQ ID NO: 2112677 - protein, 8 aa, Cryptosporidium hominis
EKTESDIP

SEQ ID NO: 2112678 - protein, 6 aa, Cryptosporidium hominis
EKTGGV

SEQ ID NO: 2112679 - protein, 4 aa, Cryptosporidium hominis
EKTI

SEQ ID NO: 2112680 - protein, 9 aa, Cryptosporidium hominis
EKTLKDTNI

SEQ ID NO: 2112681 - protein, 12 aa, Cryptosporidium hominis
EKTNLERNGSLN

SEQ ID NO: 2112682 - protein, 7 aa, Cryptosporidium hominis
EKTREQL

SEQ ID NO: 2112683 - protein, 11 aa, Cryptosporidium hominis
EKTSEPKISNL

SEQ ID NO: 2112684 - protein, 15 aa, Cryptosporidium hominis
EKVRKEAHNGPSLSK

SEQ ID NO: 2112685 - protein, 7 aa, Cryptosporidium hominis
EKVTTAK

SEQ ID NO: 2112686 - protein, 5 aa, Cryptosporidium hominis
EKWEG

SEQ ID NO: 2112687 - protein, 15 aa, Cryptosporidium hominis
EKYDETNIGANNNNN

SEQ ID NO: 2112688 - protein, 5 aa, Cryptosporidium hominis
EKYEN

SEQ ID NO: 2112689 - protein, 4 aa, Cryptosporidium hominis
EKYK

SEQ ID NO: 2112690 - protein, 4 aa, Cryptosporidium hominis
EKYN

SEQ ID NO: 2112691 - protein, 7 aa, Cryptosporidium hominis
EKYQTGG

SEQ ID NO: 2112692 - protein, 7 aa, Cryptosporidium hominis
ELAHGSK

SEQ ID NO: 2112693 - protein, 12 aa, Cryptosporidium hominis
ELANEGKVVGRT

SEQ ID NO: 2112694 - protein, 20 aa, Cryptosporidium hominis
ELDEDDYPYNPNCGAQSQSN

SEQ ID NO: 2112695 - protein, 15 aa, Cryptosporidium hominis
ELDENNSNLQLKPDS

SEQ ID NO: 2112696 - protein, 6 aa, Cryptosporidium hominis
ELDQDN

SEQ ID NO: 2112697 - protein, 5 aa, Cryptosporidium hominis
ELEEA

SEQ ID NO: 2112698 - protein, 6 aa, Cryptosporidium hominis
ELEKGT

SEQ ID NO: 2112699 - protein, 12 aa, Cryptosporidium hominis
ELEKSSNKPTSI

SEQ ID NO: 2112700 - protein, 9 aa, Cryptosporidium hominis
ELEKSTTEE

SEQ ID NO: 2112701 - protein, 6 aa, Cryptosporidium hominis
ELETKE

SEQ ID NO: 2112702 - protein, 6 aa, Cryptosporidium hominis
ELGDGR

SEQ ID NO: 2112703 - protein, 11 aa, Cryptosporidium hominis
ELKSGSNPCTK

SEQ ID NO: 2112704 - protein, 14 aa, Cryptosporidium hominis
ELKSPSSYKSASGH

SEQ ID NO: 2112705 - protein, 8 aa, Cryptosporidium hominis
ELKSSSSV

SEQ ID NO: 2112706 - protein, 20 aa, Cryptosporidium hominis
ELNDNNNTNTNNKIRNEKDE

SEQ ID NO: 2112707 - protein, 8 aa, Cryptosporidium hominis
ELNDPSKV

SEQ ID NO: 2112708 - protein, 15 aa, Cryptosporidium hominis
ELNGKDDSNKIEDRS

SEQ ID NO: 2112709 - protein, 12 aa, Cryptosporidium hominis
ELNGSNSSLPSM

SEQ ID NO: 2112710 - protein, 10 aa, Cryptosporidium hominis
ELNSESLNRS

SEQ ID NO: 2112711 - protein, 8 aa, Cryptosporidium hominis
ELPDRSME

SEQ ID NO: 2112712 - protein, 13 aa, Cryptosporidium hominis
ELPKNQNKVNSSE

SEQ ID NO: 2112713 - protein, 27 aa, Cryptosporidium hominis
ELPNKSNFPQIDNQKSPNRVTTGNIPN

SEQ ID NO: 2112714 - protein, 11 aa, Cryptosporidium hominis
ELQESTKRRVG

SEQ ID NO: 2112715 - protein, 12 aa, Cryptosporidium hominis
ELQNGNSKEARS

SEQ ID NO: 2112716 - protein, 9 aa, Cryptosporidium hominis
ELQNNGSFE

SEQ ID NO: 2112717 - protein, 5 aa, Cryptosporidium hominis
ELSEA

SEQ ID NO: 2112718 - protein, 5 aa, Cryptosporidium hominis
ELSEK

SEQ ID NO: 2112719 - protein, 5 aa, Cryptosporidium hominis
ELSEN

SEQ ID NO: 2112720 - protein, 15 aa, Cryptosporidium hominis
ELSKEQTKKREERVK

SEQ ID NO: 2112721 - protein, 16 aa, Cryptosporidium hominis
ELSNESLEKQEVDKEY

SEQ ID NO: 2112722 - protein, 9 aa, Cryptosporidium hominis
ELSQNQDNF

SEQ ID NO: 2112723 - protein, 12 aa, Cryptosporidium hominis
ELSRKRKRRFTK

SEQ ID NO: 2112724 - protein, 5 aa, Cryptosporidium hominis
ELTGS

SEQ ID NO: 2112725 - protein, 13 aa, Cryptosporidium hominis
EMEGGKPRKKEEA

SEQ ID NO: 2112726 - protein, 10 aa, Cryptosporidium hominis
EMEPKAEKRA

SEQ ID NO: 2112727 - protein, 19 aa, Cryptosporidium hominis
EMGTPHTKRVNNKNPSLES

SEQ ID NO: 2112728 - protein, 7 aa, Cryptosporidium hominis
EMSGNSL

SEQ ID NO: 2112729 - protein, 5 aa, Cryptosporidium hominis
EMSLK

SEQ ID NO: 2112730 - protein, 4 aa, Cryptosporidium hominis
ENAE

SEQ ID NO: 2112731 - protein, 5 aa, Cryptosporidium hominis
ENAEK

SEQ ID NO: 2112732 - protein, 12 aa, Cryptosporidium hominis
ENAETTKIETND

SEQ ID NO: 2112733 - protein, 5 aa, Cryptosporidium hominis
ENCPT

SEQ ID NO: 2112734 - protein, 7 aa, Cryptosporidium hominis
ENDAPDY

SEQ ID NO: 2112735 - protein, 4 aa, Cryptosporidium hominis
ENDD

SEQ ID NO: 2112736 - protein, 5 aa, Cryptosporidium hominis
ENDEK

SEQ ID NO: 2112737 - protein, 10 aa, Cryptosporidium hominis
ENDGHKNKIS

SEQ ID NO: 2112738 - protein, 6 aa, Cryptosporidium hominis
ENDKPL

SEQ ID NO: 2112739 - protein, 12 aa, Cryptosporidium hominis
ENDSNSNINKKD

SEQ ID NO: 2112740 - protein, 8 aa, Cryptosporidium hominis
ENDTENNY

SEQ ID NO: 2112741 - protein, 6 aa, Cryptosporidium hominis
ENECKN

SEQ ID NO: 2112742 - protein, 6 aa, Cryptosporidium hominis
ENEDGE

SEQ ID NO: 2112743 - protein, 18 aa, Cryptosporidium hominis
ENEDKQELSERKEIPWKS

SEQ ID NO: 2112744 - protein, 7 aa, Cryptosporidium hominis
ENEESTF

SEQ ID NO: 2112745 - protein, 8 aa, Cryptosporidium hominis
ENEGFGSN

SEQ ID NO: 2112746 - protein, 8 aa, Cryptosporidium hominis
ENEGSPDQ

SEQ ID NO: 2112747 - protein, 7 aa, Cryptosporidium hominis
ENELEDL

SEQ ID NO: 2112748 - protein, 5 aa, Cryptosporidium hominis
ENENL

SEQ ID NO: 2112749 - protein, 8 aa, Cryptosporidium hominis
ENEPEMTK

SEQ ID NO: 2112750 - protein, 7 aa, Cryptosporidium hominis
ENEPSIN

SEQ ID NO: 2112751 - protein, 10 aa, Cryptosporidium hominis
ENETLNSKTK

SEQ ID NO: 2112752 - protein, 4 aa, Cryptosporidium hominis
ENEY

SEQ ID NO: 2112753 - protein, 6 aa, Cryptosporidium hominis
ENEYVS

SEQ ID NO: 2112754 - protein, 13 aa, Cryptosporidium hominis
ENFTKNDSEPTVQ

SEQ ID NO: 2112755 - protein, 11 aa, Cryptosporidium hominis
ENGANLSSSRK

SEQ ID NO: 2112756 - protein, 10 aa, Cryptosporidium hominis
ENGDASRPHL

SEQ ID NO: 2112757 - protein, 5 aa, Cryptosporidium hominis
ENGDE

SEQ ID NO: 2112758 - protein, 7 aa, Cryptosporidium hominis
ENGEADN

SEQ ID NO: 2112759 - protein, 6 aa, Cryptosporidium hominis
ENGETF

SEQ ID NO: 2112760 - protein, 7 aa, Cryptosporidium hominis
ENGFEKS

SEQ ID NO: 2112761 - protein, 17 aa, Cryptosporidium hominis
ENGKSNTNTLEGSANPA

SEQ ID NO: 2112762 - protein, 8 aa, Cryptosporidium hominis
ENGKTNNF

SEQ ID NO: 2112763 - protein, 25 aa, Cryptosporidium hominis
ENGNITSLKGNEGKLNNGESKKSGL

SEQ ID NO: 2112764 - protein, 45 aa, Cryptosporidium hominis
ENGNSNNNNNNNNSQSLNLSSGTSSKNPPNYRHSADNDTISESHW

SEQ ID NO: 2112765 - protein, 9 aa, Cryptosporidium hominis
ENGQKDNLK

SEQ ID NO: 2112766 - protein, 13 aa, Cryptosporidium hominis
ENGRNDIRTVGTA

SEQ ID NO: 2112767 - protein, 20 aa, Cryptosporidium hominis
ENGSYIKNEKGSYIKERNGK

SEQ ID NO: 2112768 - protein, 17 aa, Cryptosporidium hominis
ENHTISSESTPSSTDIS

SEQ ID NO: 2112769 - protein, 5 aa, Cryptosporidium hominis
ENHTN

SEQ ID NO: 2112770 - protein, 10 aa, Cryptosporidium hominis
ENIEKDDSNY

SEQ ID NO: 2112771 - protein, 4 aa, Cryptosporidium hominis
ENIG

SEQ ID NO: 2112772 - protein, 8 aa, Cryptosporidium hominis
ENIGPPRR

SEQ ID NO: 2112773 - protein, 5 aa, Cryptosporidium hominis
ENIRS

SEQ ID NO: 2112774 - protein, 7 aa, Cryptosporidium hominis
ENKANKP

SEQ ID NO: 2112775 - protein, 14 aa, Cryptosporidium hominis
ENKASKSENSEEID

SEQ ID NO: 2112776 - protein, 7 aa, Cryptosporidium hominis
ENKDNVK

SEQ ID NO: 2112777 - protein, 7 aa, Cryptosporidium hominis
ENKDPYE

SEQ ID NO: 2112778 - protein, 10 aa, Cryptosporidium hominis
ENKIKDDSAF

SEQ ID NO: 2112779 - protein, 14 aa, Cryptosporidium hominis
ENKIPSNKVSSDQD

SEQ ID NO: 2112780 - protein, 14 aa, Cryptosporidium hominis
ENKNHDSKTKHNNK

SEQ ID NO: 2112781 - protein, 16 aa, Cryptosporidium hominis
ENKNNSNKNKEASYGH

SEQ ID NO: 2112782 - protein, 4 aa, Cryptosporidium hominis
ENKP

SEQ ID NO: 2112783 - protein, 8 aa, Cryptosporidium hominis
ENKSPVST

SEQ ID NO: 2112784 - protein, 29 aa, Cryptosporidium hominis
ENKYDGNKQKEESLSPGINQPIENSQGEN

SEQ ID NO: 2112785 - protein, 4 aa, Cryptosporidium hominis
ENLG

SEQ ID NO: 2112786 - protein, 6 aa, Cryptosporidium hominis
ENLGGT

SEQ ID NO: 2112787 - protein, 8 aa, Cryptosporidium hominis
ENLPPQLR

SEQ ID NO: 2112788 - protein, 9 aa, Cryptosporidium hominis
ENLSEEDEN

SEQ ID NO: 2112789 - protein, 8 aa, Cryptosporidium hominis
ENMDETNE

SEQ ID NO: 2112790 - protein, 10 aa, Cryptosporidium hominis
ENNDCGKNEL

SEQ ID NO: 2112791 - protein, 9 aa, Cryptosporidium hominis
ENNEGNFTK

SEQ ID NO: 2112792 - protein, 6 aa, Cryptosporidium hominis
ENNGIQ

SEQ ID NO: 2112793 - protein, 9 aa, Cryptosporidium hominis
ENNGRYSSR

SEQ ID NO: 2112794 - protein, 4 aa, Cryptosporidium hominis
ENNI

SEQ ID NO: 2112795 - protein, 6 aa, Cryptosporidium hominis
ENNIEG

SEQ ID NO: 2112796 - protein, 5 aa, Cryptosporidium hominis
ENNKM

SEQ ID NO: 2112797 - protein, 10 aa, Cryptosporidium hominis
ENNMDQETQH

SEQ ID NO: 2112798 - protein, 8 aa, Cryptosporidium hominis
ENNNETHK

SEQ ID NO: 2112799 - protein, 6 aa, Cryptosporidium hominis
ENNNNS

SEQ ID NO: 2112800 - protein, 7 aa, Cryptosporidium hominis
ENNPDNV

SEQ ID NO: 2112801 - protein, 10 aa, Cryptosporidium hominis
ENNSSAHDQH

SEQ ID NO: 2112802 - protein, 9 aa, Cryptosporidium hominis
ENPCNQTTS

SEQ ID NO: 2112803 - protein, 4 aa, Cryptosporidium hominis
ENPI

SEQ ID NO: 2112804 - protein, 6 aa, Cryptosporidium hominis
ENPINS

SEQ ID NO: 2112805 - protein, 6 aa, Cryptosporidium hominis
ENPKEP

SEQ ID NO: 2112806 - protein, 7 aa, Cryptosporidium hominis
ENPQSIE

SEQ ID NO: 2112807 - protein, 5 aa, Cryptosporidium hominis
ENPTV

SEQ ID NO: 2112808 - protein, 16 aa, Cryptosporidium hominis
ENPYSYPYSSSPGGGY

SEQ ID NO: 2112809 - protein, 4 aa, Cryptosporidium hominis
ENQE

SEQ ID NO: 2112810 - protein, 14 aa, Cryptosporidium hominis
ENQSEENNIQTNKK

SEQ ID NO: 2112811 - protein, 6 aa, Cryptosporidium hominis
ENQSLT

SEQ ID NO: 2112812 - protein, 10 aa, Cryptosporidium hominis
ENQSSNQAIN

SEQ ID NO: 2112813 - protein, 8 aa, Cryptosporidium hominis
ENQSTEEI

SEQ ID NO: 2112814 - protein, 12 aa, Cryptosporidium hominis
ENRNQNTKLENK

SEQ ID NO: 2112815 - protein, 4 aa, Cryptosporidium hominis
ENRS

SEQ ID NO: 2112816 - protein, 7 aa, Cryptosporidium hominis
ENRTTGC

SEQ ID NO: 2112817 - protein, 7 aa, Cryptosporidium hominis
ENSEEID

SEQ ID NO: 2112818 - protein, 9 aa, Cryptosporidium hominis
ENSEHTSPL

SEQ ID NO: 2112819 - protein, 10 aa, Cryptosporidium hominis
ENSETENIQG

SEQ ID NO: 2112820 - protein, 16 aa, Cryptosporidium hominis
ENSGDFSINASKDTEY

SEQ ID NO: 2112821 - protein, 5 aa, Cryptosporidium hominis
ENSGI

SEQ ID NO: 2112822 - protein, 4 aa, Cryptosporidium hominis
ENSK

SEQ ID NO: 2112823 - protein, 6 aa, Cryptosporidium hominis
ENSSRS

SEQ ID NO: 2112824 - protein, 10 aa, Cryptosporidium hominis
ENTKDQKFSN

SEQ ID NO: 2112825 - protein, 5 aa, Cryptosporidium hominis
ENTKR

SEQ ID NO: 2112826 - protein, 4 aa, Cryptosporidium hominis
ENTN

SEQ ID NO: 2112827 - protein, 7 aa, Cryptosporidium hominis
ENTNKKA

SEQ ID NO: 2112828 - protein, 15 aa, Cryptosporidium hominis
ENTSLSSVPFHSIDN

SEQ ID NO: 2112829 - protein, 5 aa, Cryptosporidium hominis
ENTTI

SEQ ID NO: 2112830 - protein, 5 aa, Cryptosporidium hominis
ENTTM

SEQ ID NO: 2112831 - protein, 6 aa, Cryptosporidium hominis
ENTYDS

SEQ ID NO: 2112832 - protein, 4 aa, Cryptosporidium hominis
ENVG

SEQ ID NO: 2112833 - protein, 5 aa, Cryptosporidium hominis
ENVKK

SEQ ID NO: 2112834 - protein, 8 aa, Cryptosporidium hominis
ENYNSGSS

SEQ ID NO: 2112835 - protein, 4 aa, Cryptosporidium hominis
ENYQ

SEQ ID NO: 2112836 - protein, 9 aa, Cryptosporidium hominis
EPAPPKSIS

SEQ ID NO: 2112837 - protein, 19 aa, Cryptosporidium hominis
EPEAGQNFKYNNNSKNYSL

SEQ ID NO: 2112838 - protein, 16 aa, Cryptosporidium hominis
EPEENDENNGNQGAIS

SEQ ID NO: 2112839 - protein, 10 aa, Cryptosporidium hominis
EPEMSTSEFQ

SEQ ID NO: 2112840 - protein, 6 aa, Cryptosporidium hominis
EPETQE

SEQ ID NO: 2112841 - protein, 15 aa, Cryptosporidium hominis
EPGEGPESPNQKVTS

SEQ ID NO: 2112842 - protein, 5 aa, Cryptosporidium hominis
EPHTN

SEQ ID NO: 2112843 - protein, 11 aa, Cryptosporidium hominis
EPIGSVTEESL

SEQ ID NO: 2112844 - protein, 4 aa, Cryptosporidium hominis
EPIT

SEQ ID NO: 2112845 - protein, 8 aa, Cryptosporidium hominis
EPKEKDYK

SEQ ID NO: 2112846 - protein, 7 aa, Cryptosporidium hominis
EPKQSGF

SEQ ID NO: 2112847 - protein, 4 aa, Cryptosporidium hominis
EPKT

SEQ ID NO: 2112848 - protein, 8 aa, Cryptosporidium hominis
EPKTPEEI

SEQ ID NO: 2112849 - protein, 15 aa, Cryptosporidium hominis
EPLETTSIEERNPDQ

SEQ ID NO: 2112850 - protein, 4 aa, Cryptosporidium hominis
EPMN

SEQ ID NO: 2112851 - protein, 8 aa, Cryptosporidium hominis
EPNDHPKK

SEQ ID NO: 2112852 - protein, 5 aa, Cryptosporidium hominis
EPNES

SEQ ID NO: 2112853 - protein, 29 aa, Cryptosporidium hominis
EPNPAAKYASRPSNESPLSSDENSYPLPP

SEQ ID NO: 2112854 - protein, 11 aa, Cryptosporidium hominis
EPNSNSNQANC

SEQ ID NO: 2112855 - protein, 5 aa, Cryptosporidium hominis
EPNTT

SEQ ID NO: 2112856 - protein, 19 aa, Cryptosporidium hominis
EPPEELSSDLQKQNGSDNY

SEQ ID NO: 2112857 - protein, 5 aa, Cryptosporidium hominis
EPPEF

SEQ ID NO: 2112858 - protein, 6 aa, Cryptosporidium hominis
EPPPDV

SEQ ID NO: 2112859 - protein, 14 aa, Cryptosporidium hominis
EPPPNTNGDQGLQQ

SEQ ID NO: 2112860 - protein, 8 aa, Cryptosporidium hominis
EPPPPEFD

SEQ ID NO: 2112861 - protein, 5 aa, Cryptosporidium hominis
EPRAS

SEQ ID NO: 2112862 - protein, 4 aa, Cryptosporidium hominis
EPRV

SEQ ID NO: 2112863 - protein, 7 aa, Cryptosporidium hominis
EPSSEGI

SEQ ID NO: 2112864 - protein, 6 aa, Cryptosporidium hominis
EPSTLN

SEQ ID NO: 2112865 - protein, 17 aa, Cryptosporidium hominis
EPSTTNSKSTSSAGSGK

SEQ ID NO: 2112866 - protein, 10 aa, Cryptosporidium hominis
EPTDGNSKLT

SEQ ID NO: 2112867 - protein, 13 aa, Cryptosporidium hominis
EPTQKNRKGRHNA

SEQ ID NO: 2112868 - protein, 15 aa, Cryptosporidium hominis
EPYSESINEENDQDW

SEQ ID NO: 2112869 - protein, 9 aa, Cryptosporidium hominis
EPYSPKYPI

SEQ ID NO: 2112870 - protein, 4 aa, Cryptosporidium hominis
EQAN

SEQ ID NO: 2112871 - protein, 10 aa, Cryptosporidium hominis
EQDEESDNHT

SEQ ID NO: 2112872 - protein, 6 aa, Cryptosporidium hominis
EQDENQ

SEQ ID NO: 2112873 - protein, 21 aa, Cryptosporidium hominis
EQDSCQNHSNFSSKSFSTLEP

SEQ ID NO: 2112874 - protein, 8 aa, Cryptosporidium hominis
EQEIKEPA

SEQ ID NO: 2112875 - protein, 5 aa, Cryptosporidium hominis
EQENI

SEQ ID NO: 2112876 - protein, 5 aa, Cryptosporidium hominis
EQESQ

SEQ ID NO: 2112877 - protein, 5 aa, Cryptosporidium hominis
EQGPI

SEQ ID NO: 2112878 - protein, 10 aa, Cryptosporidium hominis
EQGSRSELAT

SEQ ID NO: 2112879 - protein, 12 aa, Cryptosporidium hominis
EQGSTKTQEELH

SEQ ID NO: 2112880 - protein, 14 aa, Cryptosporidium hominis
EQGVGGSRRTEDSI

SEQ ID NO: 2112881 - protein, 17 aa, Cryptosporidium hominis
EQHKEAKIANKDKYPYA

SEQ ID NO: 2112882 - protein, 8 aa, Cryptosporidium hominis
EQIQSSDD

SEQ ID NO: 2112883 - protein, 5 aa, Cryptosporidium hominis
EQKAY

SEQ ID NO: 2112884 - protein, 6 aa, Cryptosporidium hominis
EQKDLT

SEQ ID NO: 2112885 - protein, 13 aa, Cryptosporidium hominis
EQKEKNNEQADSI

SEQ ID NO: 2112886 - protein, 10 aa, Cryptosporidium hominis
EQKKQEPKRK

SEQ ID NO: 2112887 - protein, 30 aa, Cryptosporidium hominis
EQKRKSITSALSQKDNANIKQKSNISQNNK

SEQ ID NO: 2112888 - protein, 11 aa, Cryptosporidium hominis
EQKRNKNDEDY

SEQ ID NO: 2112889 - protein, 8 aa, Cryptosporidium hominis
EQKSFSEK

SEQ ID NO: 2112890 - protein, 8 aa, Cryptosporidium hominis
EQKSSYTP

SEQ ID NO: 2112891 - protein, 8 aa, Cryptosporidium hominis
EQLSPELA

SEQ ID NO: 2112892 - protein, 9 aa, Cryptosporidium hominis
EQNDPSYSL

SEQ ID NO: 2112893 - protein, 12 aa, Cryptosporidium hominis
EQNQEKHENQEM

SEQ ID NO: 2112894 - protein, 7 aa, Cryptosporidium hominis
EQPNQSA

SEQ ID NO: 2112895 - protein, 4 aa, Cryptosporidium hominis
EQRY

SEQ ID NO: 2112896 - protein, 8 aa, Cryptosporidium hominis
EQSDSTIE

SEQ ID NO: 2112897 - protein, 5 aa, Cryptosporidium hominis
EQSPS

SEQ ID NO: 2112898 - protein, 12 aa, Cryptosporidium hominis
EQSQRPRISGST

SEQ ID NO: 2112899 - protein, 8 aa, Cryptosporidium hominis
EQTENCSP

SEQ ID NO: 2112900 - protein, 19 aa, Cryptosporidium hominis
EQTIESRPTITDDKSPIPY

SEQ ID NO: 2112901 - protein, 4 aa, Cryptosporidium hominis
EQTN

SEQ ID NO: 2112902 - protein, 5 aa, Cryptosporidium hominis
EQVED

SEQ ID NO: 2112903 - protein, 6 aa, Cryptosporidium hominis
EQVPSS

SEQ ID NO: 2112904 - protein, 10 aa, Cryptosporidium hominis
EQYKEERNSQ

SEQ ID NO: 2112905 - protein, 48 aa, Cryptosporidium hominis
ERDESSTAQNTETASDSTNSRIAKNDENGNKDLEVAKDDETNNNSSIQ

SEQ ID NO: 2112906 - protein, 7 aa, Cryptosporidium hominis
ERDRRKR

SEQ ID NO: 2112907 - protein, 7 aa, Cryptosporidium hominis
ERDRSNT

SEQ ID NO: 2112908 - protein, 12 aa, Cryptosporidium hominis
EREAAGNDIQGL

SEQ ID NO: 2112909 - protein, 5 aa, Cryptosporidium hominis
EREEE

SEQ ID NO: 2112910 - protein, 17 aa, Cryptosporidium hominis
EREGGYLKSKDEAQECK

SEQ ID NO: 2112911 - protein, 8 aa, Cryptosporidium hominis
EREMSENS

SEQ ID NO: 2112912 - protein, 14 aa, Cryptosporidium hominis
EREWESSKSTRNVS

SEQ ID NO: 2112913 - protein, 20 aa, Cryptosporidium hominis
EREYNNSYESSADLHNATSG

SEQ ID NO: 2112914 - protein, 18 aa, Cryptosporidium hominis
ERGEGGMHGGNPTPSSPL

SEQ ID NO: 2112915 - protein, 4 aa, Cryptosporidium hominis
ERGF

SEQ ID NO: 2112916 - protein, 7 aa, Cryptosporidium hominis
ERGGDNS

SEQ ID NO: 2112917 - protein, 4 aa, Cryptosporidium hominis
ERGT

SEQ ID NO: 2112918 - protein, 6 aa, Cryptosporidium hominis
ERHEQK

SEQ ID NO: 2112919 - protein, 5 aa, Cryptosporidium hominis
ERKNI

SEQ ID NO: 2112920 - protein, 8 aa, Cryptosporidium hominis
ERKPTSLT

SEQ ID NO: 2112921 - protein, 5 aa, Cryptosporidium hominis
ERKST

SEQ ID NO: 2112922 - protein, 8 aa, Cryptosporidium hominis
ERKTKRKK

SEQ ID NO: 2112923 - protein, 7 aa, Cryptosporidium hominis
ERLPESL

SEQ ID NO: 2112924 - protein, 8 aa, Cryptosporidium hominis
ERNDTSAL

SEQ ID NO: 2112925 - protein, 6 aa, Cryptosporidium hominis
ERNEYF

SEQ ID NO: 2112926 - protein, 4 aa, Cryptosporidium hominis
ERNQ

SEQ ID NO: 2112927 - protein, 4 aa, Cryptosporidium hominis
ERNS

SEQ ID NO: 2112928 - protein, 11 aa, Cryptosporidium hominis
ERPEIQSYSSK

SEQ ID NO: 2112929 - protein, 35 aa, Cryptosporidium hominis
ERPGRYNPKNQEEQEIEYDDDTGGKTEYGKKPNSL

SEQ ID NO: 2112930 - protein, 5 aa, Cryptosporidium hominis
ERPNH

SEQ ID NO: 2112931 - protein, 8 aa, Cryptosporidium hominis
ERQSNNSK

SEQ ID NO: 2112932 - protein, 10 aa, Cryptosporidium hominis
ERRGKARKYK

SEQ ID NO: 2112933 - protein, 5 aa, Cryptosporidium hominis
ERRPS

SEQ ID NO: 2112934 - protein, 4 aa, Cryptosporidium hominis
ERRS

SEQ ID NO: 2112935 - protein, 4 aa, Cryptosporidium hominis
ERRT

SEQ ID NO: 2112936 - protein, 8 aa, Cryptosporidium hominis
ERSDSKEL

SEQ ID NO: 2112937 - protein, 17 aa, Cryptosporidium hominis
ERSGGKLPTNFENESNA

SEQ ID NO: 2112938 - protein, 12 aa, Cryptosporidium hominis
ERSNHTVGHTKN

SEQ ID NO: 2112939 - protein, 9 aa, Cryptosporidium hominis
ERSNYKENG

SEQ ID NO: 2112940 - protein, 5 aa, Cryptosporidium hominis
ERSSD

SEQ ID NO: 2112941 - protein, 5 aa, Cryptosporidium hominis
ERVTK

SEQ ID NO: 2112942 - protein, 23 aa, Cryptosporidium hominis
ESAFNGDSHINGNRYADGSEGFG

SEQ ID NO: 2112943 - protein, 4 aa, Cryptosporidium hominis
ESAI

SEQ ID NO: 2112944 - protein, 4 aa, Cryptosporidium hominis
ESCK

SEQ ID NO: 2112945 - protein, 7 aa, Cryptosporidium hominis
ESCNKDV

SEQ ID NO: 2112946 - protein, 4 aa, Cryptosporidium hominis
ESCR

SEQ ID NO: 2112947 - protein, 12 aa, Cryptosporidium hominis
ESDENKGRSPTF

SEQ ID NO: 2112948 - protein, 12 aa, Cryptosporidium hominis
ESDHDETSYNGP

SEQ ID NO: 2112949 - protein, 24 aa, Cryptosporidium hominis
ESDMDSGMSSEDSDVDELRRTPRI

SEQ ID NO: 2112950 - protein, 7 aa, Cryptosporidium hominis
ESDNQNI

SEQ ID NO: 2112951 - protein, 8 aa, Cryptosporidium hominis
ESDQEVDD

SEQ ID NO: 2112952 - protein, 7 aa, Cryptosporidium hominis
ESDSRHQ

SEQ ID NO: 2112953 - protein, 10 aa, Cryptosporidium hominis
ESDSSPEDIK

SEQ ID NO: 2112954 - protein, 4 aa, Cryptosporidium hominis
ESED

SEQ ID NO: 2112955 - protein, 9 aa, Cryptosporidium hominis
ESEEFDSTT

SEQ ID NO: 2112956 - protein, 4 aa, Cryptosporidium hominis
ESEI

SEQ ID NO: 2112957 - protein, 8 aa, Cryptosporidium hominis
ESEIGTST

SEQ ID NO: 2112958 - protein, 8 aa, Cryptosporidium hominis
ESESENVS

SEQ ID NO: 2112959 - protein, 7 aa, Cryptosporidium hominis
ESESKIA

SEQ ID NO: 2112960 - protein, 10 aa, Cryptosporidium hominis
ESESNLKSSI

SEQ ID NO: 2112961 - protein, 6 aa, Cryptosporidium hominis
ESETPR

SEQ ID NO: 2112962 - protein, 13 aa, Cryptosporidium hominis
ESFGSRNEENIEL

SEQ ID NO: 2112963 - protein, 4 aa, Cryptosporidium hominis
ESFN

SEQ ID NO: 2112964 - protein, 30 aa, Cryptosporidium hominis
ESFSASSSNKNNVAKQTRIKENKRYSRVES

SEQ ID NO: 2112965 - protein, 14 aa, Cryptosporidium hominis
ESFTSENNNKRNKD

SEQ ID NO: 2112966 - protein, 5 aa, Cryptosporidium hominis
ESGIE

SEQ ID NO: 2112967 - protein, 7 aa, Cryptosporidium hominis
ESGKYDP

SEQ ID NO: 2112968 - protein, 21 aa, Cryptosporidium hominis
ESGPLTGQKPKTTISSGSSTW

SEQ ID NO: 2112969 - protein, 12 aa, Cryptosporidium hominis
ESGQIGYKANTE

SEQ ID NO: 2112970 - protein, 16 aa, Cryptosporidium hominis
ESGRDPVTGKDDKNSL

SEQ ID NO: 2112971 - protein, 4 aa, Cryptosporidium hominis
ESGS

SEQ ID NO: 2112972 - protein, 5 aa, Cryptosporidium hominis
ESHHL

SEQ ID NO: 2112973 - protein, 7 aa, Cryptosporidium hominis
ESIKRSP

SEQ ID NO: 2112974 - protein, 6 aa, Cryptosporidium hominis
ESINNS

SEQ ID NO: 2112975 - protein, 10 aa, Cryptosporidium hominis
ESINRSKEHK

SEQ ID NO: 2112976 - protein, 7 aa, Cryptosporidium hominis
ESIPENK

SEQ ID NO: 2112977 - protein, 13 aa, Cryptosporidium hominis
ESIQQSKTSTKLT

SEQ ID NO: 2112978 - protein, 12 aa, Cryptosporidium hominis
ESISPSACGGKQ

SEQ ID NO: 2112979 - protein, 6 aa, Cryptosporidium hominis
ESITPG

SEQ ID NO: 2112980 - protein, 7 aa, Cryptosporidium hominis
ESKESVR

SEQ ID NO: 2112981 - protein, 9 aa, Cryptosporidium hominis
ESKGLSGPA

SEQ ID NO: 2112982 - protein, 4 aa, Cryptosporidium hominis
ESKN

SEQ ID NO: 2112983 - protein, 6 aa, Cryptosporidium hominis
ESKNDT

SEQ ID NO: 2112984 - protein, 5 aa, Cryptosporidium hominis
ESKNG

SEQ ID NO: 2112985 - protein, 9 aa, Cryptosporidium hominis
ESKNKQFNT

SEQ ID NO: 2112986 - protein, 10 aa, Cryptosporidium hominis
ESKNPPFQPS

SEQ ID NO: 2112987 - protein, 6 aa, Cryptosporidium hominis
ESKPTL

SEQ ID NO: 2112988 - protein, 18 aa, Cryptosporidium hominis
ESKRKSRRRAASNTKKIS

SEQ ID NO: 2112989 - protein, 11 aa, Cryptosporidium hominis
ESKSDAEYKDQ

SEQ ID NO: 2112990 - protein, 7 aa, Cryptosporidium hominis
ESKSDLV

SEQ ID NO: 2112991 - protein, 5 aa, Cryptosporidium hominis
ESKSN

SEQ ID NO: 2112992 - protein, 40 aa, Cryptosporidium hominis
ESKSVEKDKKKNKETEKISDKDDEYDNTENSQKSDIYESS

SEQ ID NO: 2112993 - protein, 15 aa, Cryptosporidium hominis
ESKTPQCLAGNGSSH

SEQ ID NO: 2112994 - protein, 7 aa, Cryptosporidium hominis
ESKYYRE

SEQ ID NO: 2112995 - protein, 4 aa, Cryptosporidium hominis
ESLL

SEQ ID NO: 2112996 - protein, 4 aa, Cryptosporidium hominis
ESLN

SEQ ID NO: 2112997 - protein, 7 aa, Cryptosporidium hominis
ESLTPTG

SEQ ID NO: 2112998 - protein, 10 aa, Cryptosporidium hominis
ESMNGNDTDK

SEQ ID NO: 2112999 - protein, 10 aa, Cryptosporidium hominis
ESMQLSQSDQ

SEQ ID NO: 2113000 - protein, 8 aa, Cryptosporidium hominis
ESNAESAL

SEQ ID NO: 2113001 - protein, 8 aa, Cryptosporidium hominis
ESNFTKQE

SEQ ID NO: 2113002 - protein, 8 aa, Cryptosporidium hominis
ESNGGVEG

SEQ ID NO: 2113003 - protein, 19 aa, Cryptosporidium hominis
ESNKEVEKQNELDEQNEFE

SEQ ID NO: 2113004 - protein, 5 aa, Cryptosporidium hominis
ESNPI

SEQ ID NO: 2113005 - protein, 9 aa, Cryptosporidium hominis
ESNQASKEL

SEQ ID NO: 2113006 - protein, 12 aa, Cryptosporidium hominis
ESNQTNSDEEIS

SEQ ID NO: 2113007 - protein, 8 aa, Cryptosporidium hominis
ESNRRKTN

SEQ ID NO: 2113008 - protein, 4 aa, Cryptosporidium hominis
ESNS

SEQ ID NO: 2113009 - protein, 8 aa, Cryptosporidium hominis
ESNSAISG

SEQ ID NO: 2113010 - protein, 8 aa, Cryptosporidium hominis
ESNSEYSQ

SEQ ID NO: 2113011 - protein, 5 aa, Cryptosporidium hominis
ESNSH

SEQ ID NO: 2113012 - protein, 23 aa, Cryptosporidium hominis
ESNVPSKERKSLKGITSNNSQEG

SEQ ID NO: 2113013 - protein, 10 aa, Cryptosporidium hominis
ESNVTSTESI

SEQ ID NO: 2113014 - protein, 6 aa, Cryptosporidium hominis
ESPEEE

SEQ ID NO: 2113015 - protein, 14 aa, Cryptosporidium hominis
ESPKSTTSVNTSSS

SEQ ID NO: 2113016 - protein, 7 aa, Cryptosporidium hominis
ESPNEQE

SEQ ID NO: 2113017 - protein, 6 aa, Cryptosporidium hominis
ESPSAL

SEQ ID NO: 2113018 - protein, 7 aa, Cryptosporidium hominis
ESPSGIP

SEQ ID NO: 2113019 - protein, 13 aa, Cryptosporidium hominis
ESQDQAPGAPTVE

SEQ ID NO: 2113020 - protein, 6 aa, Cryptosporidium hominis
ESQEGI

SEQ ID NO: 2113021 - protein, 8 aa, Cryptosporidium hominis
ESQEQFSK

SEQ ID NO: 2113022 - protein, 17 aa, Cryptosporidium hominis
ESQGRAFRPQKVSGHTL

SEQ ID NO: 2113023 - protein, 8 aa, Cryptosporidium hominis
ESQKEDIS

SEQ ID NO: 2113024 - protein, 7 aa, Cryptosporidium hominis
ESQLEDY

SEQ ID NO: 2113025 - protein, 17 aa, Cryptosporidium hominis
ESQNKAFSYPGEKKYSI

SEQ ID NO: 2113026 - protein, 8 aa, Cryptosporidium hominis
ESQNNPHQ

SEQ ID NO: 2113027 - protein, 5 aa, Cryptosporidium hominis
ESQNS

SEQ ID NO: 2113028 - protein, 11 aa, Cryptosporidium hominis
ESQNSLGNQIP

SEQ ID NO: 2113029 - protein, 7 aa, Cryptosporidium hominis
ESRGGRY

SEQ ID NO: 2113030 - protein, 4 aa, Cryptosporidium hominis
ESRH

SEQ ID NO: 2113031 - protein, 14 aa, Cryptosporidium hominis
ESRKHTPKSQTTVK

SEQ ID NO: 2113032 - protein, 12 aa, Cryptosporidium hominis
ESRNKKNSEEYK

SEQ ID NO: 2113033 - protein, 25 aa, Cryptosporidium hominis
ESRQGYSQDDYNTDNLQDCEKTGHK

SEQ ID NO: 2113034 - protein, 4 aa, Cryptosporidium hominis
ESRS

SEQ ID NO: 2113035 - protein, 12 aa, Cryptosporidium hominis
ESRTNCSSGGVS

SEQ ID NO: 2113036 - protein, 7 aa, Cryptosporidium hominis
ESSADSA

SEQ ID NO: 2113037 - protein, 15 aa, Cryptosporidium hominis
ESSEITTESESSEIA

SEQ ID NO: 2113038 - protein, 12 aa, Cryptosporidium hominis
ESSIGKNIDPNE

SEQ ID NO: 2113039 - protein, 10 aa, Cryptosporidium hominis
ESSIPNKKSL

SEQ ID NO: 2113040 - protein, 5 aa, Cryptosporidium hominis
ESSIQ

SEQ ID NO: 2113041 - protein, 12 aa, Cryptosporidium hominis
ESSKKFPGVLNL

SEQ ID NO: 2113042 - protein, 9 aa, Cryptosporidium hominis
ESSLKEEYP

SEQ ID NO: 2113043 - protein, 5 aa, Cryptosporidium hominis
ESSNA

SEQ ID NO: 2113044 - protein, 8 aa, Cryptosporidium hominis
ESSNIGVN

SEQ ID NO: 2113045 - protein, 6 aa, Cryptosporidium hominis
ESSPIS

SEQ ID NO: 2113046 - protein, 7 aa, Cryptosporidium hominis
ESSPLSE

SEQ ID NO: 2113047 - protein, 19 aa, Cryptosporidium hominis
ESSPVGIGREEPNKDPYLP

SEQ ID NO: 2113048 - protein, 7 aa, Cryptosporidium hominis
ESSRKKA

SEQ ID NO: 2113049 - protein, 11 aa, Cryptosporidium hominis
ESSSQHQYSNS

SEQ ID NO: 2113050 - protein, 9 aa, Cryptosporidium hominis
ESSSYNNSN

SEQ ID NO: 2113051 - protein, 8 aa, Cryptosporidium hominis
ESSTMDPQ

SEQ ID NO: 2113052 - protein, 4 aa, Cryptosporidium hominis
ESSV

SEQ ID NO: 2113053 - protein, 24 aa, Cryptosporidium hominis
ESSVEMKRNRTNFEEVKENNSTYS

SEQ ID NO: 2113054 - protein, 15 aa, Cryptosporidium hominis
ESSVNNYEQSQVQNS

SEQ ID NO: 2113055 - protein, 13 aa, Cryptosporidium hominis
ESTCNSDLAPNNL

SEQ ID NO: 2113056 - protein, 11 aa, Cryptosporidium hominis
ESTCSNKSEIK

SEQ ID NO: 2113057 - protein, 4 aa, Cryptosporidium hominis
ESTD

SEQ ID NO: 2113058 - protein, 8 aa, Cryptosporidium hominis
ESTDQRNI

SEQ ID NO: 2113059 - protein, 5 aa, Cryptosporidium hominis
ESTKE

SEQ ID NO: 2113060 - protein, 10 aa, Cryptosporidium hominis
ESTNGSNDNK

SEQ ID NO: 2113061 - protein, 4 aa, Cryptosporidium hominis
ESTQ

SEQ ID NO: 2113062 - protein, 8 aa, Cryptosporidium hominis
ESTSGISR

SEQ ID NO: 2113063 - protein, 6 aa, Cryptosporidium hominis
ESTSPF

SEQ ID NO: 2113064 - protein, 11 aa, Cryptosporidium hominis
ESTTPDNLSEL

SEQ ID NO: 2113065 - protein, 10 aa, Cryptosporidium hominis
ESVEKGISKM

SEQ ID NO: 2113066 - protein, 8 aa, Cryptosporidium hominis
ESWDSSIG

SEQ ID NO: 2113067 - protein, 5 aa, Cryptosporidium hominis
ESYNN

SEQ ID NO: 2113068 - protein, 7 aa, Cryptosporidium hominis
ESYSANI

SEQ ID NO: 2113069 - protein, 8 aa, Cryptosporidium hominis
ESYSKISK

SEQ ID NO: 2113070 - protein, 5 aa, Cryptosporidium hominis
ETAKT

SEQ ID NO: 2113071 - protein, 6 aa, Cryptosporidium hominis
ETDRPH

SEQ ID NO: 2113072 - protein, 20 aa, Cryptosporidium hominis
ETDTRDSRMTSNDTNSVDGS

SEQ ID NO: 2113073 - protein, 6 aa, Cryptosporidium hominis
ETEAKE

SEQ ID NO: 2113074 - protein, 9 aa, Cryptosporidium hominis
ETEKTGNKN

SEQ ID NO: 2113075 - protein, 6 aa, Cryptosporidium hominis
ETGEDY

SEQ ID NO: 2113076 - protein, 12 aa, Cryptosporidium hominis
ETGGSKIDGQEG

SEQ ID NO: 2113077 - protein, 6 aa, Cryptosporidium hominis
ETGKDT

SEQ ID NO: 2113078 - protein, 12 aa, Cryptosporidium hominis
ETGNDNTPDQAL

SEQ ID NO: 2113079 - protein, 15 aa, Cryptosporidium hominis
ETGPKKTNSFVSSSS

SEQ ID NO: 2113080 - protein, 15 aa, Cryptosporidium hominis
ETGRLTDDPVEGKDI

SEQ ID NO: 2113081 - protein, 11 aa, Cryptosporidium hominis
ETGSQANSKNY

SEQ ID NO: 2113082 - protein, 6 aa, Cryptosporidium hominis
ETGTGS

SEQ ID NO: 2113083 - protein, 6 aa, Cryptosporidium hominis
ETHEKT

SEQ ID NO: 2113084 - protein, 16 aa, Cryptosporidium hominis
ETHGASKNSQKGPSNI

SEQ ID NO: 2113085 - protein, 7 aa, Cryptosporidium hominis
ETIRGEN

SEQ ID NO: 2113086 - protein, 23 aa, Cryptosporidium hominis
ETKEETQKNNVNDVESLKNDRDR

SEQ ID NO: 2113087 - protein, 37 aa, Cryptosporidium hominis
ETKKQTQKKNTRRQSTKSATSTKEKLASLNSKEETVV

SEQ ID NO: 2113088 - protein, 8 aa, Cryptosporidium hominis
ETLRKTAS

SEQ ID NO: 2113089 - protein, 4 aa, Cryptosporidium hominis
ETMD

SEQ ID NO: 2113090 - protein, 7 aa, Cryptosporidium hominis
ETNDNIE

SEQ ID NO: 2113091 - protein, 7 aa, Cryptosporidium hominis
ETNHNKS

SEQ ID NO: 2113092 - protein, 4 aa, Cryptosporidium hominis
ETNI

SEQ ID NO: 2113093 - protein, 16 aa, Cryptosporidium hominis
ETNIGDDDDDNDLNKS

SEQ ID NO: 2113094 - protein, 6 aa, Cryptosporidium hominis
ETNIPD

SEQ ID NO: 2113095 - protein, 4 aa, Cryptosporidium hominis
ETNK

SEQ ID NO: 2113096 - protein, 9 aa, Cryptosporidium hominis
ETNKTTRGN

SEQ ID NO: 2113097 - protein, 18 aa, Cryptosporidium hominis
ETNPVSKVDKEKVTKKEI

SEQ ID NO: 2113098 - protein, 4 aa, Cryptosporidium hominis
ETNS

SEQ ID NO: 2113099 - protein, 13 aa, Cryptosporidium hominis
ETNSQTDNKMTTE

SEQ ID NO: 2113100 - protein, 5 aa, Cryptosporidium hominis
ETNSY

SEQ ID NO: 2113101 - protein, 16 aa, Cryptosporidium hominis
ETNTGERRSKSLSSSN

SEQ ID NO: 2113102 - protein, 4 aa, Cryptosporidium hominis
ETPD

SEQ ID NO: 2113103 - protein, 6 aa, Cryptosporidium hominis
ETPEIT

SEQ ID NO: 2113104 - protein, 8 aa, Cryptosporidium hominis
ETPGKLDD

SEQ ID NO: 2113105 - protein, 30 aa, Cryptosporidium hominis
ETPKRTSHENLGEASSERESRRGEEGTALD

SEQ ID NO: 2113106 - protein, 4 aa, Cryptosporidium hominis
ETPS

SEQ ID NO: 2113107 - protein, 9 aa, Cryptosporidium hominis
ETPVKGGNK

SEQ ID NO: 2113108 - protein, 5 aa, Cryptosporidium hominis
ETQFG

SEQ ID NO: 2113109 - protein, 21 aa, Cryptosporidium hominis
ETQKSHSAVEDDAEANIPYDD

SEQ ID NO: 2113110 - protein, 10 aa, Cryptosporidium hominis
ETQNKGSVGV

SEQ ID NO: 2113111 - protein, 14 aa, Cryptosporidium hominis
ETQNQENFEKVTDK

SEQ ID NO: 2113112 - protein, 7 aa, Cryptosporidium hominis
ETQSGDL

SEQ ID NO: 2113113 - protein, 5 aa, Cryptosporidium hominis
ETQYV

SEQ ID NO: 2113114 - protein, 5 aa, Cryptosporidium hominis
ETRIN

SEQ ID NO: 2113115 - protein, 40 aa, Cryptosporidium hominis
ETRKPTKKHKNRKSDSSGLKGRKKNSKKELADNSETLDQG

SEQ ID NO: 2113116 - protein, 11 aa, Cryptosporidium hominis
ETRNRGEKQSR

SEQ ID NO: 2113117 - protein, 4 aa, Cryptosporidium hominis
ETRR

SEQ ID NO: 2113118 - protein, 8 aa, Cryptosporidium hominis
ETRRNLSQ

SEQ ID NO: 2113119 - protein, 5 aa, Cryptosporidium hominis
ETRSV

SEQ ID NO: 2113120 - protein, 14 aa, Cryptosporidium hominis
ETSDIEKEKFNKHK

SEQ ID NO: 2113121 - protein, 14 aa, Cryptosporidium hominis
ETSFNQTDNPNLVN

SEQ ID NO: 2113122 - protein, 9 aa, Cryptosporidium hominis
ETSNSSDDL

SEQ ID NO: 2113123 - protein, 6 aa, Cryptosporidium hominis
ETSQSK

SEQ ID NO: 2113124 - protein, 4 aa, Cryptosporidium hominis
ETSR

SEQ ID NO: 2113125 - protein, 6 aa, Cryptosporidium hominis
ETSTGI

SEQ ID NO: 2113126 - protein, 5 aa, Cryptosporidium hominis
ETSWN

SEQ ID NO: 2113127 - protein, 7 aa, Cryptosporidium hominis
ETTGDRP

SEQ ID NO: 2113128 - protein, 19 aa, Cryptosporidium hominis
ETTNRGGQNDQDSKRQIRG

SEQ ID NO: 2113129 - protein, 14 aa, Cryptosporidium hominis
ETVETGSSEQSSEV

SEQ ID NO: 2113130 - protein, 5 aa, Cryptosporidium hominis
ETVNP

SEQ ID NO: 2113131 - protein, 10 aa, Cryptosporidium hominis
ETYDPNSDEF

SEQ ID NO: 2113132 - protein, 8 aa, Cryptosporidium hominis
EVAEEKEL

SEQ ID NO: 2113133 - protein, 6 aa, Cryptosporidium hominis
EVDGQP

SEQ ID NO: 2113134 - protein, 10 aa, Cryptosporidium hominis
EVDSQSREDG

SEQ ID NO: 2113135 - protein, 6 aa, Cryptosporidium hominis
EVEEDV

SEQ ID NO: 2113136 - protein, 13 aa, Cryptosporidium hominis
EVGDARNPSQTKI

SEQ ID NO: 2113137 - protein, 15 aa, Cryptosporidium hominis
EVGRQSKYNEGEKYP

SEQ ID NO: 2113138 - protein, 9 aa, Cryptosporidium hominis
EVKDSNSYS

SEQ ID NO: 2113139 - protein, 9 aa, Cryptosporidium hominis
EVNDTYSGI

SEQ ID NO: 2113140 - protein, 9 aa, Cryptosporidium hominis
EVQEPSSIA

SEQ ID NO: 2113141 - protein, 8 aa, Cryptosporidium hominis
EVQEVSTQ

SEQ ID NO: 2113142 - protein, 9 aa, Cryptosporidium hominis
EVQNESADH

SEQ ID NO: 2113143 - protein, 9 aa, Cryptosporidium hominis
EVRKTDSDK

SEQ ID NO: 2113144 - protein, 8 aa, Cryptosporidium hominis
EVRSASGE

SEQ ID NO: 2113145 - protein, 6 aa, Cryptosporidium hominis
EVSGKP

SEQ ID NO: 2113146 - protein, 5 aa, Cryptosporidium hominis
EVSNP

SEQ ID NO: 2113147 - protein, 7 aa, Cryptosporidium hominis
EVSPAPL

SEQ ID NO: 2113148 - protein, 53 aa, Cryptosporidium hominis
EVSTASELSGDEVQTTDLSGDEVQTTDLSGDEVQTTDLSGDEVQTTDLSGDEV

SEQ ID NO: 2113149 - protein, 6 aa, Cryptosporidium hominis
EVTGGQ

SEQ ID NO: 2113150 - protein, 31 aa, Cryptosporidium hominis
EVTQKKDTFPNKNPKKNQHKEVDKATLNNSY

SEQ ID NO: 2113151 - protein, 12 aa, Cryptosporidium hominis
EVYNKGGRLFLE

SEQ ID NO: 2113152 - protein, 13 aa, Cryptosporidium hominis
EWGSSRRSFSNSS

SEQ ID NO: 2113153 - protein, 5 aa, Cryptosporidium hominis
EWSED

SEQ ID NO: 2113154 - protein, 13 aa, Cryptosporidium hominis
EYDEEKDEKRGSN

SEQ ID NO: 2113155 - protein, 11 aa, Cryptosporidium hominis
EYDSPQNLLSN

SEQ ID NO: 2113156 - protein, 9 aa, Cryptosporidium hominis
EYDSSESEF

SEQ ID NO: 2113157 - protein, 9 aa, Cryptosporidium hominis
EYEKGSDGE

SEQ ID NO: 2113158 - protein, 6 aa, Cryptosporidium hominis
EYGEED

SEQ ID NO: 2113159 - protein, 7 aa, Cryptosporidium hominis
EYGNSLP

SEQ ID NO: 2113160 - protein, 12 aa, Cryptosporidium hominis
EYISSNEKLPLN

SEQ ID NO: 2113161 - protein, 12 aa, Cryptosporidium hominis
EYLGESKDDSEL

SEQ ID NO: 2113162 - protein, 8 aa, Cryptosporidium hominis
EYNNTLNS

SEQ ID NO: 2113163 - protein, 10 aa, Cryptosporidium hominis
EYNSEEDNED

SEQ ID NO: 2113164 - protein, 18 aa, Cryptosporidium hominis
EYNSNTSTISSDNHKPVF

SEQ ID NO: 2113165 - protein, 8 aa, Cryptosporidium hominis
EYPNTETM

SEQ ID NO: 2113166 - protein, 11 aa, Cryptosporidium hominis
EYQEREGANQM

SEQ ID NO: 2113167 - protein, 7 aa, Cryptosporidium hominis
EYRPDPS

SEQ ID NO: 2113168 - protein, 5 aa, Cryptosporidium hominis
EYRSR

SEQ ID NO: 2113169 - protein, 8 aa, Cryptosporidium hominis
EYSGNNNI

SEQ ID NO: 2113170 - protein, 10 aa, Cryptosporidium hominis
EYSGQSDPPM

SEQ ID NO: 2113171 - protein, 6 aa, Cryptosporidium hominis
EYSKTT

SEQ ID NO: 2113172 - protein, 6 aa, Cryptosporidium hominis
EYTNTE

SEQ ID NO: 2113173 - protein, 21 aa, Cryptosporidium hominis
FADDENLSSSESNEDTNSLGS

SEQ ID NO: 2113174 - protein, 7 aa, Cryptosporidium hominis
FAGRNTE

SEQ ID NO: 2113175 - protein, 5 aa, Cryptosporidium hominis
FASNE

SEQ ID NO: 2113176 - protein, 5 aa, Cryptosporidium hominis
FASPD

SEQ ID NO: 2113177 - protein, 10 aa, Cryptosporidium hominis
FATEEEQNHL

SEQ ID NO: 2113178 - protein, 12 aa, Cryptosporidium hominis
FCSGNNSRIGIS

SEQ ID NO: 2113179 - protein, 4 aa, Cryptosporidium hominis
FDAD

SEQ ID NO: 2113180 - protein, 24 aa, Cryptosporidium hominis
FDASPKPLKSTDDLDTHKNNEQVI

SEQ ID NO: 2113181 - protein, 14 aa, Cryptosporidium hominis
FDCDQSKQDIQSYD

SEQ ID NO: 2113182 - protein, 10 aa, Cryptosporidium hominis
FDDDEDNDLD

SEQ ID NO: 2113183 - protein, 9 aa, Cryptosporidium hominis
FDDDNDITS

SEQ ID NO: 2113184 - protein, 9 aa, Cryptosporidium hominis
FDEDDGYAS

SEQ ID NO: 2113185 - protein, 37 aa, Cryptosporidium hominis
FDGSRNISPRNTSSKYCEKSESEDKTSSEGMKGYSSD

SEQ ID NO: 2113186 - protein, 10 aa, Cryptosporidium hominis
FDPEKQSHND

SEQ ID NO: 2113187 - protein, 8 aa, Cryptosporidium hominis
FDPGKFTD

SEQ ID NO: 2113188 - protein, 7 aa, Cryptosporidium hominis
FDPYSSH

SEQ ID NO: 2113189 - protein, 11 aa, Cryptosporidium hominis
FDQDGNGKISV

SEQ ID NO: 2113190 - protein, 31 aa, Cryptosporidium hominis
FDQSNDKTVKQNSISDADARSSSSTSNDNLQ

SEQ ID NO: 2113191 - protein, 12 aa, Cryptosporidium hominis
FEDTSSQGHPDT

SEQ ID NO: 2113192 - protein, 7 aa, Cryptosporidium hominis
FEGEEAK

SEQ ID NO: 2113193 - protein, 7 aa, Cryptosporidium hominis
FEKNEME

SEQ ID NO: 2113194 - protein, 9 aa, Cryptosporidium hominis
FEKSESTVT

SEQ ID NO: 2113195 - protein, 6 aa, Cryptosporidium hominis
FENNTH

SEQ ID NO: 2113196 - protein, 12 aa, Cryptosporidium hominis
FEPGTSIGGEIG

SEQ ID NO: 2113197 - protein, 10 aa, Cryptosporidium hominis
FESDSKTSKK

SEQ ID NO: 2113198 - protein, 9 aa, Cryptosporidium hominis
FESEIDPKS

SEQ ID NO: 2113199 - protein, 12 aa, Cryptosporidium hominis
FESENKSSKYDH

SEQ ID NO: 2113200 - protein, 8 aa, Cryptosporidium hominis
FESPENLN

SEQ ID NO: 2113201 - protein, 11 aa, Cryptosporidium hominis
FESRPTEKSSP

SEQ ID NO: 2113202 - protein, 10 aa, Cryptosporidium hominis
FESSTDTYSV

SEQ ID NO: 2113203 - protein, 5 aa, Cryptosporidium hominis
FESSY

SEQ ID NO: 2113204 - protein, 5 aa, Cryptosporidium hominis
FESTT

SEQ ID NO: 2113205 - protein, 10 aa, Cryptosporidium hominis
FETNEYPNSY

SEQ ID NO: 2113206 - protein, 53 aa, Cryptosporidium hominis
FETTQSKEVKPKQISYNAAPARRTTRNSSKTSNEKPAETSTGKRRVTRSSSKM

SEQ ID NO: 2113207 - protein, 11 aa, Cryptosporidium hominis
FFSDSNNSYSW

SEQ ID NO: 2113208 - protein, 16 aa, Cryptosporidium hominis
FGASGVEDANYKNGEH

SEQ ID NO: 2113209 - protein, 7 aa, Cryptosporidium hominis
FGDGGGD

SEQ ID NO: 2113210 - protein, 9 aa, Cryptosporidium hominis
FGDKSRFSS

SEQ ID NO: 2113211 - protein, 8 aa, Cryptosporidium hominis
FGEATRDN

SEQ ID NO: 2113212 - protein, 11 aa, Cryptosporidium hominis
FGEGEEAIKKS

SEQ ID NO: 2113213 - protein, 6 aa, Cryptosporidium hominis
FGENTS

SEQ ID NO: 2113214 - protein, 7 aa, Cryptosporidium hominis
FGKNSQK

SEQ ID NO: 2113215 - protein, 8 aa, Cryptosporidium hominis
FGNGQNNF

SEQ ID NO: 2113216 - protein, 7 aa, Cryptosporidium hominis
FGQENSG

SEQ ID NO: 2113217 - protein, 18 aa, Cryptosporidium hominis
FGQSSTKHGNSNSIKGSE

SEQ ID NO: 2113218 - protein, 5 aa, Cryptosporidium hominis
FGSAG

SEQ ID NO: 2113219 - protein, 7 aa, Cryptosporidium hominis
FGSNQGE

SEQ ID NO: 2113220 - protein, 12 aa, Cryptosporidium hominis
FGSSDEERDEEF

SEQ ID NO: 2113221 - protein, 5 aa, Cryptosporidium hominis
FGTPE

SEQ ID NO: 2113222 - protein, 6 aa, Cryptosporidium hominis
FGYSGD

SEQ ID NO: 2113223 - protein, 10 aa, Cryptosporidium hominis
FHSSSGPVSL

SEQ ID NO: 2113224 - protein, 9 aa, Cryptosporidium hominis
FKGNSNRHN

SEQ ID NO: 2113225 - protein, 5 aa, Cryptosporidium hominis
FKGTD

SEQ ID NO: 2113226 - protein, 10 aa, Cryptosporidium hominis
FKHKKNNSNY

SEQ ID NO: 2113227 - protein, 30 aa, Cryptosporidium hominis
FKKSETLDKEPEIEKEPSENRVENEKKYEI

SEQ ID NO: 2113228 - protein, 9 aa, Cryptosporidium hominis
FKKSQTTSG

SEQ ID NO: 2113229 - protein, 10 aa, Cryptosporidium hominis
FKNQNGNGYA

SEQ ID NO: 2113230 - protein, 8 aa, Cryptosporidium hominis
FKNQTSPI

SEQ ID NO: 2113231 - protein, 10 aa, Cryptosporidium hominis
FKPTKSESLL

SEQ ID NO: 2113232 - protein, 7 aa, Cryptosporidium hominis
FKQGRQS

SEQ ID NO: 2113233 - protein, 8 aa, Cryptosporidium hominis
FKRSHSSK

SEQ ID NO: 2113234 - protein, 8 aa, Cryptosporidium hominis
FKSESRMN

SEQ ID NO: 2113235 - protein, 7 aa, Cryptosporidium hominis
FKSGKNE

SEQ ID NO: 2113236 - protein, 12 aa, Cryptosporidium hominis
FKSRSKILFNGF

SEQ ID NO: 2113237 - protein, 4 aa, Cryptosporidium hominis
FKTR

SEQ ID NO: 2113238 - protein, 8 aa, Cryptosporidium hominis
FNASKKRT

SEQ ID NO: 2113239 - protein, 7 aa, Cryptosporidium hominis
FNGDRSG

SEQ ID NO: 2113240 - protein, 11 aa, Cryptosporidium hominis
FNGQPKDLDSQ

SEQ ID NO: 2113241 - protein, 10 aa, Cryptosporidium hominis
FNGSSSKSST

SEQ ID NO: 2113242 - protein, 7 aa, Cryptosporidium hominis
FNNDNKK

SEQ ID NO: 2113243 - protein, 8 aa, Cryptosporidium hominis
FNNGDNTQ

SEQ ID NO: 2113244 - protein, 8 aa, Cryptosporidium hominis
FNNGTQIP

SEQ ID NO: 2113245 - protein, 7 aa, Cryptosporidium hominis
FNPPDPR

SEQ ID NO: 2113246 - protein, 4 aa, Cryptosporidium hominis
FNQK

SEQ ID NO: 2113247 - protein, 5 aa, Cryptosporidium hominis
FNSEK

SEQ ID NO: 2113248 - protein, 9 aa, Cryptosporidium hominis
FNSSTSNLN

SEQ ID NO: 2113249 - protein, 28 aa, Cryptosporidium hominis
FNTNNKEDLNYADNNNSNSNEEINNKEK

SEQ ID NO: 2113250 - protein, 39 aa, Cryptosporidium hominis
FNTNNKSHNNPNNDNRYPATSNINKHDTDISGNNQKKYS

SEQ ID NO: 2113251 - protein, 9 aa, Cryptosporidium hominis
FNTNQQSEF

SEQ ID NO: 2113252 - protein, 6 aa, Cryptosporidium hominis
FNTNSP

SEQ ID NO: 2113253 - protein, 42 aa, Cryptosporidium hominis
FPAGGPFSSPSDSSTFPSSSTTTTTTTTSPVRTTTSNASTLT

SEQ ID NO: 2113254 - protein, 4 aa, Cryptosporidium hominis
FPDE

SEQ ID NO: 2113255 - protein, 6 aa, Cryptosporidium hominis
FPDHKV

SEQ ID NO: 2113256 - protein, 12 aa, Cryptosporidium hominis
FPDKNSKKNNIP

SEQ ID NO: 2113257 - protein, 6 aa, Cryptosporidium hominis
FPDNYN

SEQ ID NO: 2113258 - protein, 11 aa, Cryptosporidium hominis
FPDTQNSPFSK

SEQ ID NO: 2113259 - protein, 5 aa, Cryptosporidium hominis
FPEDE

SEQ ID NO: 2113260 - protein, 10 aa, Cryptosporidium hominis
FPENEDSAFE

SEQ ID NO: 2113261 - protein, 5 aa, Cryptosporidium hominis
FPGNK

SEQ ID NO: 2113262 - protein, 5 aa, Cryptosporidium hominis
FPITE

SEQ ID NO: 2113263 - protein, 4 aa, Cryptosporidium hominis
FPNA

SEQ ID NO: 2113264 - protein, 24 aa, Cryptosporidium hominis
FPNNPFPDAKDPMIADPDGELEAK

SEQ ID NO: 2113265 - protein, 5 aa, Cryptosporidium hominis
FPNST

SEQ ID NO: 2113266 - protein, 5 aa, Cryptosporidium hominis
FPNTV

SEQ ID NO: 2113267 - protein, 4 aa, Cryptosporidium hominis
FPPG

SEQ ID NO: 2113268 - protein, 10 aa, Cryptosporidium hominis
FPPNKNWGPI

SEQ ID NO: 2113269 - protein, 18 aa, Cryptosporidium hominis
FPPNNSKIENTNNTNAQN

SEQ ID NO: 2113270 - protein, 7 aa, Cryptosporidium hominis
FPSDENK

SEQ ID NO: 2113271 - protein, 10 aa, Cryptosporidium hominis
FPSESNLAQG

SEQ ID NO: 2113272 - protein, 8 aa, Cryptosporidium hominis
FPSNSSSA

SEQ ID NO: 2113273 - protein, 8 aa, Cryptosporidium hominis
FPTGSSDI

SEQ ID NO: 2113274 - protein, 16 aa, Cryptosporidium hominis
FPTTDTNTNNTTTNTI

SEQ ID NO: 2113275 - protein, 18 aa, Cryptosporidium hominis
FQDSSKSNESETKDQNLG

SEQ ID NO: 2113276 - protein, 5 aa, Cryptosporidium hominis
FQESG

SEQ ID NO: 2113277 - protein, 13 aa, Cryptosporidium hominis
FQGNGSITSSTIT

SEQ ID NO: 2113278 - protein, 5 aa, Cryptosporidium hominis
FQKDE

SEQ ID NO: 2113279 - protein, 5 aa, Cryptosporidium hominis
FQKSN

SEQ ID NO: 2113280 - protein, 9 aa, Cryptosporidium hominis
FQKSNNNRC

SEQ ID NO: 2113281 - protein, 6 aa, Cryptosporidium hominis
FQNGSI

SEQ ID NO: 2113282 - protein, 8 aa, Cryptosporidium hominis
FQNSKNNN

SEQ ID NO: 2113283 - protein, 8 aa, Cryptosporidium hominis
FQSETDTE

SEQ ID NO: 2113284 - protein, 11 aa, Cryptosporidium hominis
FQTDERPNADN

SEQ ID NO: 2113285 - protein, 6 aa, Cryptosporidium hominis
FRDKEK

SEQ ID NO: 2113286 - protein, 4 aa, Cryptosporidium hominis
FRKR

SEQ ID NO: 2113287 - protein, 10 aa, Cryptosporidium hominis
FRTENNSATI

SEQ ID NO: 2113288 - protein, 6 aa, Cryptosporidium hominis
FRTKGQ

SEQ ID NO: 2113289 - protein, 4 aa, Cryptosporidium hominis
FRTN

SEQ ID NO: 2113290 - protein, 10 aa, Cryptosporidium hominis
FRTSGEKGTL

SEQ ID NO: 2113291 - protein, 4 aa, Cryptosporidium hominis
FSAE

SEQ ID NO: 2113292 - protein, 9 aa, Cryptosporidium hominis
FSAESSNHR

SEQ ID NO: 2113293 - protein, 4 aa, Cryptosporidium hominis
FSDH

SEQ ID NO: 2113294 - protein, 4 aa, Cryptosporidium hominis
FSDS

SEQ ID NO: 2113295 - protein, 9 aa, Cryptosporidium hominis
FSEDNKDSK

SEQ ID NO: 2113296 - protein, 4 aa, Cryptosporidium hominis
FSEE

SEQ ID NO: 2113297 - protein, 7 aa, Cryptosporidium hominis
FSEEDAQ

SEQ ID NO: 2113298 - protein, 16 aa, Cryptosporidium hominis
FSEETRNEKNDQYFGE

SEQ ID NO: 2113299 - protein, 12 aa, Cryptosporidium hominis
FSEKFEDSSPSK

SEQ ID NO: 2113300 - protein, 10 aa, Cryptosporidium hominis
FSEKSQRSNI

SEQ ID NO: 2113301 - protein, 6 aa, Cryptosporidium hominis
FSEREE

SEQ ID NO: 2113302 - protein, 45 aa, Cryptosporidium hominis
FSESSRNEETDLNENNQGVDELDDEEESTNRVGAQESNSLTRENR

SEQ ID NO: 2113303 - protein, 16 aa, Cryptosporidium hominis
FSGAKDLESAYSNDTG

SEQ ID NO: 2113304 - protein, 7 aa, Cryptosporidium hominis
FSGTPSE

SEQ ID NO: 2113305 - protein, 6 aa, Cryptosporidium hominis
FSHKKN

SEQ ID NO: 2113306 - protein, 9 aa, Cryptosporidium hominis
FSKKYPNFT

SEQ ID NO: 2113307 - protein, 7 aa, Cryptosporidium hominis
FSKSSQS

SEQ ID NO: 2113308 - protein, 6 aa, Cryptosporidium hominis
FSKSTG

SEQ ID NO: 2113309 - protein, 6 aa, Cryptosporidium hominis
FSKTNG

SEQ ID NO: 2113310 - protein, 4 aa, Cryptosporidium hominis
FSND

SEQ ID NO: 2113311 - protein, 7 aa, Cryptosporidium hominis
FSNEEKK

SEQ ID NO: 2113312 - protein, 6 aa, Cryptosporidium hominis
FSNGPF

SEQ ID NO: 2113313 - protein, 6 aa, Cryptosporidium hominis
FSNGSS

SEQ ID NO: 2113314 - protein, 19 aa, Cryptosporidium hominis
FSNPGTVSNYGNNISSTSQ

SEQ ID NO: 2113315 - protein, 11 aa, Cryptosporidium hominis
FSPEKKNEYKM

SEQ ID NO: 2113316 - protein, 9 aa, Cryptosporidium hominis
FSPNKNSLS

SEQ ID NO: 2113317 - protein, 6 aa, Cryptosporidium hominis
FSPPEF

SEQ ID NO: 2113318 - protein, 13 aa, Cryptosporidium hominis
FSPRNSPEQLSNV

SEQ ID NO: 2113319 - protein, 6 aa, Cryptosporidium hominis
FSPSTI

SEQ ID NO: 2113320 - protein, 9 aa, Cryptosporidium hominis
FSQASLAGT

SEQ ID NO: 2113321 - protein, 21 aa, Cryptosporidium hominis
FSQGPAPPDPLQAANGQPQYY

SEQ ID NO: 2113322 - protein, 6 aa, Cryptosporidium hominis
FSQNNS

SEQ ID NO: 2113323 - protein, 6 aa, Cryptosporidium hominis
FSQNSK

SEQ ID NO: 2113324 - protein, 6 aa, Cryptosporidium hominis
FSQTKG

SEQ ID NO: 2113325 - protein, 4 aa, Cryptosporidium hominis
FSRE

SEQ ID NO: 2113326 - protein, 12 aa, Cryptosporidium hominis
FSRSKSKDEKNQ

SEQ ID NO: 2113327 - protein, 8 aa, Cryptosporidium hominis
FSRSSYNS

SEQ ID NO: 2113328 - protein, 15 aa, Cryptosporidium hominis
FSSDESDDDNLAGPR

SEQ ID NO: 2113329 - protein, 8 aa, Cryptosporidium hominis
FSSDEYDN

SEQ ID NO: 2113330 - protein, 6 aa, Cryptosporidium hominis
FSSLSS

SEQ ID NO: 2113331 - protein, 36 aa, Cryptosporidium hominis
FSSNQKIGATGSKLDTENHPNSENRASQESKPRNDS

SEQ ID NO: 2113332 - protein, 12 aa, Cryptosporidium hominis
FSSQDKDYKNST

SEQ ID NO: 2113333 - protein, 5 aa, Cryptosporidium hominis
FSSQE

SEQ ID NO: 2113334 - protein, 10 aa, Cryptosporidium hominis
FSSQSNDKTI

SEQ ID NO: 2113335 - protein, 13 aa, Cryptosporidium hominis
FSSSNNQNESLSE

SEQ ID NO: 2113336 - protein, 14 aa, Cryptosporidium hominis
FSSSSLKNSENISS

SEQ ID NO: 2113337 - protein, 31 aa, Cryptosporidium hominis
FSSSSSFGFSQPSNENGNTSGSRINSHPSSQ

SEQ ID NO: 2113338 - protein, 5 aa, Cryptosporidium hominis
FSSTS

SEQ ID NO: 2113339 - protein, 13 aa, Cryptosporidium hominis
FSTENSHILYYIN

SEQ ID NO: 2113340 - protein, 9 aa, Cryptosporidium hominis
FSTKSSDDK

SEQ ID NO: 2113341 - protein, 12 aa, Cryptosporidium hominis
FSTPTASPHDKG

SEQ ID NO: 2113342 - protein, 6 aa, Cryptosporidium hominis
FSTSTN

SEQ ID NO: 2113343 - protein, 13 aa, Cryptosporidium hominis
FSTTSASNNSDTR

SEQ ID NO: 2113344 - protein, 6 aa, Cryptosporidium hominis
FSVSSN

SEQ ID NO: 2113345 - protein, 8 aa, Cryptosporidium hominis
FTATGAAA

SEQ ID NO: 2113346 - protein, 4 aa, Cryptosporidium hominis
FTDE

SEQ ID NO: 2113347 - protein, 8 aa, Cryptosporidium hominis
FTEGPNGR

SEQ ID NO: 2113348 - protein, 6 aa, Cryptosporidium hominis
FTESGG

SEQ ID NO: 2113349 - protein, 14 aa, Cryptosporidium hominis
FTNGTSQSSQPLNP

SEQ ID NO: 2113350 - protein, 5 aa, Cryptosporidium hominis
FTNNS

SEQ ID NO: 2113351 - protein, 4 aa, Cryptosporidium hominis
FTNT

SEQ ID NO: 2113352 - protein, 9 aa, Cryptosporidium hominis
FTPNTSENE

SEQ ID NO: 2113353 - protein, 5 aa, Cryptosporidium hominis
FTPSD

SEQ ID NO: 2113354 - protein, 5 aa, Cryptosporidium hominis
FTPTQ

SEQ ID NO: 2113355 - protein, 11 aa, Cryptosporidium hominis
FTSDRKRSSTV

SEQ ID NO: 2113356 - protein, 4 aa, Cryptosporidium hominis
FTSG

SEQ ID NO: 2113357 - protein, 16 aa, Cryptosporidium hominis
FTSGNEDKSTENYSNS

SEQ ID NO: 2113358 - protein, 10 aa, Cryptosporidium hominis
FTSKNPEAIP

SEQ ID NO: 2113359 - protein, 4 aa, Cryptosporidium hominis
FTSN

SEQ ID NO: 2113360 - protein, 13 aa, Cryptosporidium hominis
FTSRKREENEKEV

SEQ ID NO: 2113361 - protein, 9 aa, Cryptosporidium hominis
FVGSKPPEI

SEQ ID NO: 2113362 - protein, 12 aa, Cryptosporidium hominis
FVGSNNSQQKLE

SEQ ID NO: 2113363 - protein, 7 aa, Cryptosporidium hominis
FVPPERN

SEQ ID NO: 2113364 - protein, 24 aa, Cryptosporidium hominis
FVSSSSVSTFDDSSDNSPSESSSF

SEQ ID NO: 2113365 - protein, 16 aa, Cryptosporidium hominis
GADDQDQYQEQEQSNL

SEQ ID NO: 2113366 - protein, 5 aa, Cryptosporidium hominis
GADPE

SEQ ID NO: 2113367 - protein, 5 aa, Cryptosporidium hominis
GADSA

SEQ ID NO: 2113368 - protein, 5 aa, Cryptosporidium hominis
GAEAS

SEQ ID NO: 2113369 - protein, 12 aa, Cryptosporidium hominis
GAENNDESCSKL

SEQ ID NO: 2113370 - protein, 70 aa, Cryptosporidium hominis
GAESSGKVADAPSEATALGEGYVGSEKNITTEATSQGPNTNIKQKSLKKAVSSSRDKSKRKSSRTEDSAL

SEQ ID NO: 2113371 - protein, 11 aa, Cryptosporidium hominis
GAIQGSSLSEA

SEQ ID NO: 2113372 - protein, 6 aa, Cryptosporidium hominis
GAKHSK

SEQ ID NO: 2113373 - protein, 18 aa, Cryptosporidium hominis
GAKSSQNLDENIDYSNIQ

SEQ ID NO: 2113374 - protein, 9 aa, Cryptosporidium hominis
GALRPSGAF

SEQ ID NO: 2113375 - protein, 5 aa, Cryptosporidium hominis
GANEG

SEQ ID NO: 2113376 - protein, 11 aa, Cryptosporidium hominis
GANNEDSGSVD

SEQ ID NO: 2113377 - protein, 6 aa, Cryptosporidium hominis
GANPNF

SEQ ID NO: 2113378 - protein, 5 aa, Cryptosporidium hominis
GAPDR

SEQ ID NO: 2113379 - protein, 6 aa, Cryptosporidium hominis
GAPESI

SEQ ID NO: 2113380 - protein, 4 aa, Cryptosporidium hominis
GAPI

SEQ ID NO: 2113381 - protein, 6 aa, Cryptosporidium hominis
GAPNSQ

SEQ ID NO: 2113382 - protein, 19 aa, Cryptosporidium hominis
GARHGLNSNEKDSHSNDWS

SEQ ID NO: 2113383 - protein, 5 aa, Cryptosporidium hominis
GARLN

SEQ ID NO: 2113384 - protein, 5 aa, Cryptosporidium hominis
GASES

SEQ ID NO: 2113385 - protein, 5 aa, Cryptosporidium hominis
GASGV

SEQ ID NO: 2113386 - protein, 17 aa, Cryptosporidium hominis
GASGVSSVPNPYGVEMQ

SEQ ID NO: 2113387 - protein, 22 aa, Cryptosporidium hominis
GASNNNSSLTSIESQQSDDEEI

SEQ ID NO: 2113388 - protein, 42 aa, Cryptosporidium hominis
GASQAEELQHSSDNLRRENTTVAQENTQEHSEDSQGNNRAKT

SEQ ID NO: 2113389 - protein, 5 aa, Cryptosporidium hominis
GATGF

SEQ ID NO: 2113390 - protein, 9 aa, Cryptosporidium hominis
GATTGNPNS

SEQ ID NO: 2113391 - protein, 6 aa, Cryptosporidium hominis
GCKGEE

SEQ ID NO: 2113392 - protein, 5 aa, Cryptosporidium hominis
GDEDP

SEQ ID NO: 2113393 - protein, 12 aa, Cryptosporidium hominis
GDEHRSNVTGGA

SEQ ID NO: 2113394 - protein, 4 aa, Cryptosporidium hominis
GDEM

SEQ ID NO: 2113395 - protein, 41 aa, Cryptosporidium hominis
GDEQNQDAPDKLKKRRVKSKKTRPRRKKSKLKDDSDKLSID

SEQ ID NO: 2113396 - protein, 4 aa, Cryptosporidium hominis
GDER

SEQ ID NO: 2113397 - protein, 5 aa, Cryptosporidium hominis
GDERL

SEQ ID NO: 2113398 - protein, 8 aa, Cryptosporidium hominis
GDESKRRR

SEQ ID NO: 2113399 - protein, 7 aa, Cryptosporidium hominis
GDESNNS

SEQ ID NO: 2113400 - protein, 6 aa, Cryptosporidium hominis
GDESPM

SEQ ID NO: 2113401 - protein, 4 aa, Cryptosporidium hominis
GDFD

SEQ ID NO: 2113402 - protein, 6 aa, Cryptosporidium hominis
GDGAND

SEQ ID NO: 2113403 - protein, 13 aa, Cryptosporidium hominis
GDGGHLRPSIHTY

SEQ ID NO: 2113404 - protein, 7 aa, Cryptosporidium hominis
GDGGNDC

SEQ ID NO: 2113405 - protein, 8 aa, Cryptosporidium hominis
GDGGNDCG

SEQ ID NO: 2113406 - protein, 7 aa, Cryptosporidium hominis
GDGGNDV

SEQ ID NO: 2113407 - protein, 6 aa, Cryptosporidium hominis
GDGPKK

SEQ ID NO: 2113408 - protein, 12 aa, Cryptosporidium hominis
GDGRKNKRNTLL

SEQ ID NO: 2113409 - protein, 12 aa, Cryptosporidium hominis
GDGVNDAPALKA

SEQ ID NO: 2113410 - protein, 4 aa, Cryptosporidium hominis
GDIE

SEQ ID NO: 2113411 - protein, 10 aa, Cryptosporidium hominis
GDIETKSHSG

SEQ ID NO: 2113412 - protein, 9 aa, Cryptosporidium hominis
GDIPGSDEI

SEQ ID NO: 2113413 - protein, 6 aa, Cryptosporidium hominis
GDKIPK

SEQ ID NO: 2113414 - protein, 26 aa, Cryptosporidium hominis
GDKMEDESIGNQIKDTVKEEDEKNEL

SEQ ID NO: 2113415 - protein, 6 aa, Cryptosporidium hominis
GDKNLE

SEQ ID NO: 2113416 - protein, 6 aa, Cryptosporidium hominis
GDKNPF

SEQ ID NO: 2113417 - protein, 11 aa, Cryptosporidium hominis
GDKRGKHKKIT

SEQ ID NO: 2113418 - protein, 5 aa, Cryptosporidium hominis
GDKSF

SEQ ID NO: 2113419 - protein, 11 aa, Cryptosporidium hominis
GDKSFKNSDNI

SEQ ID NO: 2113420 - protein, 8 aa, Cryptosporidium hominis
GDLKTSNL

SEQ ID NO: 2113421 - protein, 4 aa, Cryptosporidium hominis
GDNK

SEQ ID NO: 2113422 - protein, 8 aa, Cryptosporidium hominis
GDNKSPEC

SEQ ID NO: 2113423 - protein, 18 aa, Cryptosporidium hominis
GDNLSSHPCPKDNSSVND

SEQ ID NO: 2113424 - protein, 5 aa, Cryptosporidium hominis
GDNSD

SEQ ID NO: 2113425 - protein, 9 aa, Cryptosporidium hominis
GDNTPLGEF

SEQ ID NO: 2113426 - protein, 4 aa, Cryptosporidium hominis
GDQL

SEQ ID NO: 2113427 - protein, 11 aa, Cryptosporidium hominis
GDQTIQSRTIE

SEQ ID NO: 2113428 - protein, 6 aa, Cryptosporidium hominis
GDRLSA

SEQ ID NO: 2113429 - protein, 9 aa, Cryptosporidium hominis
GDSALRPSS

SEQ ID NO: 2113430 - protein, 8 aa, Cryptosporidium hominis
GDSGVGKS

SEQ ID NO: 2113431 - protein, 7 aa, Cryptosporidium hominis
GDSKTKL

SEQ ID NO: 2113432 - protein, 9 aa, Cryptosporidium hominis
GDSSPTPLT

SEQ ID NO: 2113433 - protein, 8 aa, Cryptosporidium hominis
GDSTGKIN

SEQ ID NO: 2113434 - protein, 8 aa, Cryptosporidium hominis
GDSTNKEL

SEQ ID NO: 2113435 - protein, 5 aa, Cryptosporidium hominis
GDSVN

SEQ ID NO: 2113436 - protein, 6 aa, Cryptosporidium hominis
GDSVPA

SEQ ID NO: 2113437 - protein, 5 aa, Cryptosporidium hominis
GDTGL

SEQ ID NO: 2113438 - protein, 6 aa, Cryptosporidium hominis
GDTPSH

SEQ ID NO: 2113439 - protein, 12 aa, Cryptosporidium hominis
GDTQLDKEKRQA

SEQ ID NO: 2113440 - protein, 5 aa, Cryptosporidium hominis
GDVEG

SEQ ID NO: 2113441 - protein, 5 aa, Cryptosporidium hominis
GDVLP

SEQ ID NO: 2113442 - protein, 18 aa, Cryptosporidium hominis
GDVTPKENCSPTASQKIK

SEQ ID NO: 2113443 - protein, 6 aa, Cryptosporidium hominis
GEAEAK

SEQ ID NO: 2113444 - protein, 12 aa, Cryptosporidium hominis
GEDAEGSSTKDR

SEQ ID NO: 2113445 - protein, 10 aa, Cryptosporidium hominis
GEDSLKGTGN

SEQ ID NO: 2113446 - protein, 6 aa, Cryptosporidium hominis
GEEEIP

SEQ ID NO: 2113447 - protein, 8 aa, Cryptosporidium hominis
GEEIDSKS

SEQ ID NO: 2113448 - protein, 68 aa, Cryptosporidium hominis
GEEIRNNNEVGDDKEDKFEQLSEAEEGIQKDVQKNKRKKRRNAIKKKKAKIQNKQISKNKEEQEEEEL

SEQ ID NO: 2113449 - protein, 5 aa, Cryptosporidium hominis
GEERE

SEQ ID NO: 2113450 - protein, 8 aa, Cryptosporidium hominis
GEEYPPIP

SEQ ID NO: 2113451 - protein, 5 aa, Cryptosporidium hominis
GEGNL

SEQ ID NO: 2113452 - protein, 7 aa, Cryptosporidium hominis
GEGPKPL

SEQ ID NO: 2113453 - protein, 10 aa, Cryptosporidium hominis
GEHISERTPI

SEQ ID NO: 2113454 - protein, 10 aa, Cryptosporidium hominis
GEINPDQSNV

SEQ ID NO: 2113455 - protein, 25 aa, Cryptosporidium hominis
GEIPSSEKLGRGSNQYSESEDAKFG

SEQ ID NO: 2113456 - protein, 4 aa, Cryptosporidium hominis
GEIT

SEQ ID NO: 2113457 - protein, 4 aa, Cryptosporidium hominis
GEKD

SEQ ID NO: 2113458 - protein, 8 aa, Cryptosporidium hominis
GEKKPDES

SEQ ID NO: 2113459 - protein, 8 aa, Cryptosporidium hominis
GEKKSENF

SEQ ID NO: 2113460 - protein, 6 aa, Cryptosporidium hominis
GEKKSH

SEQ ID NO: 2113461 - protein, 11 aa, Cryptosporidium hominis
GEKTFSSHTDI

SEQ ID NO: 2113462 - protein, 4 aa, Cryptosporidium hominis
GELK

SEQ ID NO: 2113463 - protein, 5 aa, Cryptosporidium hominis
GELSG

SEQ ID NO: 2113464 - protein, 10 aa, Cryptosporidium hominis
GENEEEEEEE

SEQ ID NO: 2113465 - protein, 5 aa, Cryptosporidium hominis
GENGL

SEQ ID NO: 2113466 - protein, 8 aa, Cryptosporidium hominis
GENPDKSG

SEQ ID NO: 2113467 - protein, 5 aa, Cryptosporidium hominis
GENQN

SEQ ID NO: 2113468 - protein, 9 aa, Cryptosporidium hominis
GENQVDSKE

SEQ ID NO: 2113469 - protein, 10 aa, Cryptosporidium hominis
GENYDEDNRI

SEQ ID NO: 2113470 - protein, 17 aa, Cryptosporidium hominis
GEPARERACSSAAQDES

SEQ ID NO: 2113471 - protein, 7 aa, Cryptosporidium hominis
GEPTNSY

SEQ ID NO: 2113472 - protein, 7 aa, Cryptosporidium hominis
GEQGMAK

SEQ ID NO: 2113473 - protein, 25 aa, Cryptosporidium hominis
GEQINSKQNYNNRVSSESVTIQKKN

SEQ ID NO: 2113474 - protein, 9 aa, Cryptosporidium hominis
GEQQPSPNE

SEQ ID NO: 2113475 - protein, 10 aa, Cryptosporidium hominis
GEQSRNPSTI

SEQ ID NO: 2113476 - protein, 14 aa, Cryptosporidium hominis
GERAWTPSPPPPKD

SEQ ID NO: 2113477 - protein, 6 aa, Cryptosporidium hominis
GERDDY

SEQ ID NO: 2113478 - protein, 11 aa, Cryptosporidium hominis
GERVSKKHPST

SEQ ID NO: 2113479 - protein, 10 aa, Cryptosporidium hominis
GESEERDRSP

SEQ ID NO: 2113480 - protein, 36 aa, Cryptosporidium hominis
GESFSNSENQNITNVRTKSGKSHASDKLSQVGNGLP

SEQ ID NO: 2113481 - protein, 6 aa, Cryptosporidium hominis
GESHSG

SEQ ID NO: 2113482 - protein, 30 aa, Cryptosporidium hominis
GESKKDDYETIGEDGKGVEKAEKTLEEEEK

SEQ ID NO: 2113483 - protein, 4 aa, Cryptosporidium hominis
GESN

SEQ ID NO: 2113484 - protein, 17 aa, Cryptosporidium hominis
GESPSFEDVNEKESDGV

SEQ ID NO: 2113485 - protein, 4 aa, Cryptosporidium hominis
GESS

SEQ ID NO: 2113486 - protein, 6 aa, Cryptosporidium hominis
GESSTK

SEQ ID NO: 2113487 - protein, 4 aa, Cryptosporidium hominis
GESV

SEQ ID NO: 2113488 - protein, 7 aa, Cryptosporidium hominis
GESYDGQ

SEQ ID NO: 2113489 - protein, 11 aa, Cryptosporidium hominis
GETELTNDVET

SEQ ID NO: 2113490 - protein, 5 aa, Cryptosporidium hominis
GETGT

SEQ ID NO: 2113491 - protein, 5 aa, Cryptosporidium hominis
GETNQ

SEQ ID NO: 2113492 - protein, 13 aa, Cryptosporidium hominis
GETPKNIEYCEDQ

SEQ ID NO: 2113493 - protein, 6 aa, Cryptosporidium hominis
GETSCY

SEQ ID NO: 2113494 - protein, 6 aa, Cryptosporidium hominis
GETTYN

SEQ ID NO: 2113495 - protein, 4 aa, Cryptosporidium hominis
GEVE

SEQ ID NO: 2113496 - protein, 8 aa, Cryptosporidium hominis
GEWSSEEK

SEQ ID NO: 2113497 - protein, 5 aa, Cryptosporidium hominis
GEYED

SEQ ID NO: 2113498 - protein, 56 aa, Cryptosporidium hominis
GFGAGQAESSTEGSVERSNQEENSDQSSEESSTSQNEKETGGASPILNSKSESAFL

SEQ ID NO: 2113499 - protein, 5 aa, Cryptosporidium hominis
GFGED

SEQ ID NO: 2113500 - protein, 4 aa, Cryptosporidium hominis
GFGG

SEQ ID NO: 2113501 - protein, 5 aa, Cryptosporidium hominis
GFGGT

SEQ ID NO: 2113502 - protein, 5 aa, Cryptosporidium hominis
GFNGG

SEQ ID NO: 2113503 - protein, 4 aa, Cryptosporidium hominis
GFNN

SEQ ID NO: 2113504 - protein, 12 aa, Cryptosporidium hominis
GFQNSKNKNRNL

SEQ ID NO: 2113505 - protein, 7 aa, Cryptosporidium hominis
GFSENEI

SEQ ID NO: 2113506 - protein, 11 aa, Cryptosporidium hominis
GFSSNKSQESL

SEQ ID NO: 2113507 - protein, 9 aa, Cryptosporidium hominis
GFSSYSDGI

SEQ ID NO: 2113508 - protein, 14 aa, Cryptosporidium hominis
GGAGQGIPQPHSHP

SEQ ID NO: 2113509 - protein, 5 aa, Cryptosporidium hominis
GGDEH

SEQ ID NO: 2113510 - protein, 6 aa, Cryptosporidium hominis
GGDLPT

SEQ ID NO: 2113511 - protein, 5 aa, Cryptosporidium hominis
GGDYS

SEQ ID NO: 2113512 - protein, 9 aa, Cryptosporidium hominis
GGEASVTGD

SEQ ID NO: 2113513 - protein, 6 aa, Cryptosporidium hominis
GGEGNT

SEQ ID NO: 2113514 - protein, 6 aa, Cryptosporidium hominis
GGFRQE

SEQ ID NO: 2113515 - protein, 6 aa, Cryptosporidium hominis
GGGFNR

SEQ ID NO: 2113516 - protein, 11 aa, Cryptosporidium hominis
GGGISMNGTGS

SEQ ID NO: 2113517 - protein, 4 aa, Cryptosporidium hominis
GGGL

SEQ ID NO: 2113518 - protein, 22 aa, Cryptosporidium hominis
GGGLGGGDLGVGGGGGGKFSRL

SEQ ID NO: 2113519 - protein, 5 aa, Cryptosporidium hominis
GGGNE

SEQ ID NO: 2113520 - protein, 7 aa, Cryptosporidium hominis
GGGPAPL

SEQ ID NO: 2113521 - protein, 6 aa, Cryptosporidium hominis
GGGTTS

SEQ ID NO: 2113522 - protein, 17 aa, Cryptosporidium hominis
GGGVGEEARQLSGDKWK

SEQ ID NO: 2113523 - protein, 32 aa, Cryptosporidium hominis
GGGVSGGVGGDQQVPLQQSSYTPPVISGQPGQ

SEQ ID NO: 2113524 - protein, 6 aa, Cryptosporidium hominis
GGINAS

SEQ ID NO: 2113525 - protein, 5 aa, Cryptosporidium hominis
GGIQE

SEQ ID NO: 2113526 - protein, 7 aa, Cryptosporidium hominis
GGKGRTG

SEQ ID NO: 2113527 - protein, 5 aa, Cryptosporidium hominis
GGKLT

SEQ ID NO: 2113528 - protein, 7 aa, Cryptosporidium hominis
GGKSSFE

SEQ ID NO: 2113529 - protein, 4 aa, Cryptosporidium hominis
GGNC

SEQ ID NO: 2113530 - protein, 19 aa, Cryptosporidium hominis
GGNCHNGDNHNDDNNNNAF

SEQ ID NO: 2113531 - protein, 10 aa, Cryptosporidium hominis
GGNDPYDEKY

SEQ ID NO: 2113532 - protein, 6 aa, Cryptosporidium hominis
GGNKFN

SEQ ID NO: 2113533 - protein, 6 aa, Cryptosporidium hominis
GGNPTV

SEQ ID NO: 2113534 - protein, 4 aa, Cryptosporidium hominis
GGNS

SEQ ID NO: 2113535 - protein, 10 aa, Cryptosporidium hominis
GGNSGGSNEA

SEQ ID NO: 2113536 - protein, 7 aa, Cryptosporidium hominis
GGPLDTN

SEQ ID NO: 2113537 - protein, 5 aa, Cryptosporidium hominis
GGPMS

SEQ ID NO: 2113538 - protein, 4 aa, Cryptosporidium hominis
GGPV

SEQ ID NO: 2113539 - protein, 40 aa, Cryptosporidium hominis
GGPVAPPASTTTLSPVTTQSTDATSSSDATSSTDATQTTV

SEQ ID NO: 2113540 - protein, 8 aa, Cryptosporidium hominis
GGREGESA

SEQ ID NO: 2113541 - protein, 7 aa, Cryptosporidium hominis
GGRGDEY

SEQ ID NO: 2113542 - protein, 6 aa, Cryptosporidium hominis
GGRKPL

SEQ ID NO: 2113543 - protein, 8 aa, Cryptosporidium hominis
GGRKREMR

SEQ ID NO: 2113544 - protein, 26 aa, Cryptosporidium hominis
GGRSGENLLKGGSGSSKFGSKDEQQL

SEQ ID NO: 2113545 - protein, 12 aa, Cryptosporidium hominis
GGRVRGTKRDQL

SEQ ID NO: 2113546 - protein, 9 aa, Cryptosporidium hominis
GGSANKNVG

SEQ ID NO: 2113547 - protein, 8 aa, Cryptosporidium hominis
GGSCRRPS

SEQ ID NO: 2113548 - protein, 15 aa, Cryptosporidium hominis
GGSFHPSSNNNAINT

SEQ ID NO: 2113549 - protein, 8 aa, Cryptosporidium hominis
GGSGCGKS

SEQ ID NO: 2113550 - protein, 7 aa, Cryptosporidium hominis
GGSHNDT

SEQ ID NO: 2113551 - protein, 11 aa, Cryptosporidium hominis
GGSIGRERSRS

SEQ ID NO: 2113552 - protein, 4 aa, Cryptosporidium hominis
GGSN

SEQ ID NO: 2113553 - protein, 8 aa, Cryptosporidium hominis
GGSPNYEG

SEQ ID NO: 2113554 - protein, 6 aa, Cryptosporidium hominis
GGSSSN

SEQ ID NO: 2113555 - protein, 10 aa, Cryptosporidium hominis
GGSSTSKWAT

SEQ ID NO: 2113556 - protein, 6 aa, Cryptosporidium hominis
GGSYGS

SEQ ID NO: 2113557 - protein, 8 aa, Cryptosporidium hominis
GGTDDING

SEQ ID NO: 2113558 - protein, 5 aa, Cryptosporidium hominis
GGTGA

SEQ ID NO: 2113559 - protein, 6 aa, Cryptosporidium hominis
GGTGCQ

SEQ ID NO: 2113560 - protein, 9 aa, Cryptosporidium hominis
GGTGISQPD

SEQ ID NO: 2113561 - protein, 6 aa, Cryptosporidium hominis
GGTRTL

SEQ ID NO: 2113562 - protein, 138 aa, Cryptosporidium hominis
GGTSVGGSSAGGTSIGGTSIGGTSVGGTSVGGTSVGGTSVGGSDLEETSQGFGSDTSIDFEDGDYGKTSGFETSSDEQRKDSTSVQDSSSNLSIGGNQEGDVVSDDSGFTEKNQDDEPNNSNANGVSSNENQDDPKDK

SEQ ID NO: 2113563 - protein, 15 aa, Cryptosporidium hominis
GGVQCPTEKEITERA

SEQ ID NO: 2113564 - protein, 11 aa, Cryptosporidium hominis
GGYENDQSQLN

SEQ ID NO: 2113565 - protein, 8 aa, Cryptosporidium hominis
GHASIYSS

SEQ ID NO: 2113566 - protein, 25 aa, Cryptosporidium hominis
GHASTSRVKGRSSSGSSSSSGDFNV

SEQ ID NO: 2113567 - protein, 5 aa, Cryptosporidium hominis
GHGKP

SEQ ID NO: 2113568 - protein, 5 aa, Cryptosporidium hominis
GHKST

SEQ ID NO: 2113569 - protein, 15 aa, Cryptosporidium hominis
GHNTPIYGMKSDNSI

SEQ ID NO: 2113570 - protein, 15 aa, Cryptosporidium hominis
GHQGEKVRGGGLDRE

SEQ ID NO: 2113571 - protein, 4 aa, Cryptosporidium hominis
GHSA

SEQ ID NO: 2113572 - protein, 7 aa, Cryptosporidium hominis
GHSNEFD

SEQ ID NO: 2113573 - protein, 5 aa, Cryptosporidium hominis
GHSTN

SEQ ID NO: 2113574 - protein, 7 aa, Cryptosporidium hominis
GIASKSL

SEQ ID NO: 2113575 - protein, 24 aa, Cryptosporidium hominis
GIDDYREEAEYDKEDNTEDTPLQD

SEQ ID NO: 2113576 - protein, 6 aa, Cryptosporidium hominis
GIDENA

SEQ ID NO: 2113577 - protein, 13 aa, Cryptosporidium hominis
GIEGGAAGAGIGQ

SEQ ID NO: 2113578 - protein, 6 aa, Cryptosporidium hominis
GIELSS

SEQ ID NO: 2113579 - protein, 4 aa, Cryptosporidium hominis
GIFS

SEQ ID NO: 2113580 - protein, 38 aa, Cryptosporidium hominis
GIGLPQSSAVSSVGGAMGGGVAGGAVSASGGISGPSTV

SEQ ID NO: 2113581 - protein, 9 aa, Cryptosporidium hominis
GIGNNHESA

SEQ ID NO: 2113582 - protein, 4 aa, Cryptosporidium hominis
GIGQ

SEQ ID NO: 2113583 - protein, 33 aa, Cryptosporidium hominis
GIGSTSTSSGQNKNKKKSNSTSSSSNATPLPPK

SEQ ID NO: 2113584 - protein, 17 aa, Cryptosporidium hominis
GIKDEKGLNNQEEEDEK

SEQ ID NO: 2113585 - protein, 10 aa, Cryptosporidium hominis
GIKESSEIEE

SEQ ID NO: 2113586 - protein, 6 aa, Cryptosporidium hominis
GIKRRT

SEQ ID NO: 2113587 - protein, 12 aa, Cryptosporidium hominis
GINKKNISNSDI

SEQ ID NO: 2113588 - protein, 8 aa, Cryptosporidium hominis
GINNNEEN

SEQ ID NO: 2113589 - protein, 16 aa, Cryptosporidium hominis
GINPDKPRGLAKAVTV

SEQ ID NO: 2113590 - protein, 10 aa, Cryptosporidium hominis
GINPGKTQSD

SEQ ID NO: 2113591 - protein, 9 aa, Cryptosporidium hominis
GINSEEVTK

SEQ ID NO: 2113592 - protein, 5 aa, Cryptosporidium hominis
GINSS

SEQ ID NO: 2113593 - protein, 9 aa, Cryptosporidium hominis
GINTSESEY

SEQ ID NO: 2113594 - protein, 4 aa, Cryptosporidium hominis
GIPA

SEQ ID NO: 2113595 - protein, 6 aa, Cryptosporidium hominis
GIPPNA

SEQ ID NO: 2113596 - protein, 7 aa, Cryptosporidium hominis
GIPQGSS

SEQ ID NO: 2113597 - protein, 5 aa, Cryptosporidium hominis
GIPSM

SEQ ID NO: 2113598 - protein, 5 aa, Cryptosporidium hominis
GIPSS

SEQ ID NO: 2113599 - protein, 11 aa, Cryptosporidium hominis
GIRESKNQSSF

SEQ ID NO: 2113600 - protein, 5 aa, Cryptosporidium hominis
GISNN

SEQ ID NO: 2113601 - protein, 11 aa, Cryptosporidium hominis
GIVNNDPKQRE

SEQ ID NO: 2113602 - protein, 6 aa, Cryptosporidium hominis
GIYSEN

SEQ ID NO: 2113603 - protein, 13 aa, Cryptosporidium hominis
GIYSKNKNFNQNT

SEQ ID NO: 2113604 - protein, 10 aa, Cryptosporidium hominis
GKANEGQPVN

SEQ ID NO: 2113605 - protein, 6 aa, Cryptosporidium hominis
GKCPVN

SEQ ID NO: 2113606 - protein, 8 aa, Cryptosporidium hominis
GKDERAYE

SEQ ID NO: 2113607 - protein, 13 aa, Cryptosporidium hominis
GKDGKEIVNPKKN

SEQ ID NO: 2113608 - protein, 9 aa, Cryptosporidium hominis
GKEAPGITT

SEQ ID NO: 2113609 - protein, 5 aa, Cryptosporidium hominis
GKEAW

SEQ ID NO: 2113610 - protein, 4 aa, Cryptosporidium hominis
GKED

SEQ ID NO: 2113611 - protein, 10 aa, Cryptosporidium hominis
GKENLEREGV

SEQ ID NO: 2113612 - protein, 11 aa, Cryptosporidium hominis
GKEQAEETGKY

SEQ ID NO: 2113613 - protein, 7 aa, Cryptosporidium hominis
GKESNLA

SEQ ID NO: 2113614 - protein, 7 aa, Cryptosporidium hominis
GKETLGE

SEQ ID NO: 2113615 - protein, 11 aa, Cryptosporidium hominis
GKFGKNKDNLA

SEQ ID NO: 2113616 - protein, 8 aa, Cryptosporidium hominis
GKFQGAGS

SEQ ID NO: 2113617 - protein, 14 aa, Cryptosporidium hominis
GKGDNSGIDSPNQL

SEQ ID NO: 2113618 - protein, 7 aa, Cryptosporidium hominis
GKHTPRN

SEQ ID NO: 2113619 - protein, 7 aa, Cryptosporidium hominis
GKIEKDL

SEQ ID NO: 2113620 - protein, 12 aa, Cryptosporidium hominis
GKKLDKKNANNY

SEQ ID NO: 2113621 - protein, 31 aa, Cryptosporidium hominis
GKKPKSNEKGEKKKDDGDGDGDGDDDKDEEP

SEQ ID NO: 2113622 - protein, 8 aa, Cryptosporidium hominis
GKKPSLVS

SEQ ID NO: 2113623 - protein, 9 aa, Cryptosporidium hominis
GKLDSAPNI

SEQ ID NO: 2113624 - protein, 6 aa, Cryptosporidium hominis
GKLNAS

SEQ ID NO: 2113625 - protein, 12 aa, Cryptosporidium hominis
GKLNSTLSPSEI

SEQ ID NO: 2113626 - protein, 6 aa, Cryptosporidium hominis
GKLTRQ

SEQ ID NO: 2113627 - protein, 4 aa, Cryptosporidium hominis
GKMI

SEQ ID NO: 2113628 - protein, 28 aa, Cryptosporidium hominis
GKNHSSKEGGNSQKNAVAANNRTCENGR

SEQ ID NO: 2113629 - protein, 9 aa, Cryptosporidium hominis
GKNKQKNEK

SEQ ID NO: 2113630 - protein, 31 aa, Cryptosporidium hominis
GKNLPKSSSFGYRKNEQEQKQELESVNNHSN

SEQ ID NO: 2113631 - protein, 14 aa, Cryptosporidium hominis
GKNRNFSNSTVTNN

SEQ ID NO: 2113632 - protein, 5 aa, Cryptosporidium hominis
GKNSD

SEQ ID NO: 2113633 - protein, 7 aa, Cryptosporidium hominis
GKNSSNN

SEQ ID NO: 2113634 - protein, 8 aa, Cryptosporidium hominis
GKPPNSLQ

SEQ ID NO: 2113635 - protein, 18 aa, Cryptosporidium hominis
GKPTKIDSVEKEEDYEEL

SEQ ID NO: 2113636 - protein, 9 aa, Cryptosporidium hominis
GKRDLASNF

SEQ ID NO: 2113637 - protein, 8 aa, Cryptosporidium hominis
GKRNFNNK

SEQ ID NO: 2113638 - protein, 4 aa, Cryptosporidium hominis
GKRP

SEQ ID NO: 2113639 - protein, 5 aa, Cryptosporidium hominis
GKRPI

SEQ ID NO: 2113640 - protein, 5 aa, Cryptosporidium hominis
GKRPK

SEQ ID NO: 2113641 - protein, 13 aa, Cryptosporidium hominis
GKSHYKSPKKVEL

SEQ ID NO: 2113642 - protein, 7 aa, Cryptosporidium hominis
GKSNRTQ

SEQ ID NO: 2113643 - protein, 16 aa, Cryptosporidium hominis
GKSYNSKESNNNNNNR

SEQ ID NO: 2113644 - protein, 4 aa, Cryptosporidium hominis
GKTA

SEQ ID NO: 2113645 - protein, 51 aa, Cryptosporidium hominis
GKTETGTSPCRGNSHIPDHQNSSYRSNSRDSVSTMDTRREAGRERSYDSLM

SEQ ID NO: 2113646 - protein, 8 aa, Cryptosporidium hominis
GKTTDKRN

SEQ ID NO: 2113647 - protein, 9 aa, Cryptosporidium hominis
GKVSPNNSL

SEQ ID NO: 2113648 - protein, 9 aa, Cryptosporidium hominis
GKYDTESSL

SEQ ID NO: 2113649 - protein, 6 aa, Cryptosporidium hominis
GKYGPG

SEQ ID NO: 2113650 - protein, 9 aa, Cryptosporidium hominis
GKYPSTGYL

SEQ ID NO: 2113651 - protein, 5 aa, Cryptosporidium hominis
GKYQS

SEQ ID NO: 2113652 - protein, 25 aa, Cryptosporidium hominis
GLAQEGVEQSTSGCDLSPSVAAQRQ

SEQ ID NO: 2113653 - protein, 9 aa, Cryptosporidium hominis
GLCSGDSEL

SEQ ID NO: 2113654 - protein, 9 aa, Cryptosporidium hominis
GLDHPNRKN

SEQ ID NO: 2113655 - protein, 5 aa, Cryptosporidium hominis
GLDQT

SEQ ID NO: 2113656 - protein, 5 aa, Cryptosporidium hominis
GLEDD

SEQ ID NO: 2113657 - protein, 36 aa, Cryptosporidium hominis
GLEGPDRTEQNREGSSSSSSLPPIPSSVSSRSISGE

SEQ ID NO: 2113658 - protein, 6 aa, Cryptosporidium hominis
GLEKSS

SEQ ID NO: 2113659 - protein, 18 aa, Cryptosporidium hominis
GLGDGDYELSKNNDNEYI

SEQ ID NO: 2113660 - protein, 7 aa, Cryptosporidium hominis
GLGEISA

SEQ ID NO: 2113661 - protein, 45 aa, Cryptosporidium hominis
GLGGQEYDHKAGDSISNSKRSIKASKEVGSSSVNKKNQKSTSKPR

SEQ ID NO: 2113662 - protein, 21 aa, Cryptosporidium hominis
GLGQENEQPPPPPPTPAPIEE

SEQ ID NO: 2113663 - protein, 4 aa, Cryptosporidium hominis
GLKN

SEQ ID NO: 2113664 - protein, 10 aa, Cryptosporidium hominis
GLKNDDRGHY

SEQ ID NO: 2113665 - protein, 7 aa, Cryptosporidium hominis
GLNNEQS

SEQ ID NO: 2113666 - protein, 4 aa, Cryptosporidium hominis
GLPA

SEQ ID NO: 2113667 - protein, 7 aa, Cryptosporidium hominis
GLRKPKE

SEQ ID NO: 2113668 - protein, 6 aa, Cryptosporidium hominis
GLSDSV

SEQ ID NO: 2113669 - protein, 8 aa, Cryptosporidium hominis
GLSGLGEK

SEQ ID NO: 2113670 - protein, 5 aa, Cryptosporidium hominis
GLSNN

SEQ ID NO: 2113671 - protein, 6 aa, Cryptosporidium hominis
GLSPKS

SEQ ID NO: 2113672 - protein, 13 aa, Cryptosporidium hominis
GLTQDDQSNKKSK

SEQ ID NO: 2113673 - protein, 4 aa, Cryptosporidium hominis
GLVN

SEQ ID NO: 2113674 - protein, 6 aa, Cryptosporidium hominis
GMASEK

SEQ ID NO: 2113675 - protein, 22 aa, Cryptosporidium hominis
GMASGQGGIPGAMGGAATPSAL

SEQ ID NO: 2113676 - protein, 24 aa, Cryptosporidium hominis
GMGGGGVSGTSSGLPSNENSISGT

SEQ ID NO: 2113677 - protein, 9 aa, Cryptosporidium hominis
GMPTSQQKA

SEQ ID NO: 2113678 - protein, 10 aa, Cryptosporidium hominis
GMSNGNDSQL

SEQ ID NO: 2113679 - protein, 7 aa, Cryptosporidium hominis
GMYTNDN

SEQ ID NO: 2113680 - protein, 11 aa, Cryptosporidium hominis
GNADEGSPSEF

SEQ ID NO: 2113681 - protein, 6 aa, Cryptosporidium hominis
GNANNE

SEQ ID NO: 2113682 - protein, 9 aa, Cryptosporidium hominis
GNASSDSQI

SEQ ID NO: 2113683 - protein, 7 aa, Cryptosporidium hominis
GNCQNEN

SEQ ID NO: 2113684 - protein, 12 aa, Cryptosporidium hominis
GNDDDDKKESRA

SEQ ID NO: 2113685 - protein, 5 aa, Cryptosporidium hominis
GNDGI

SEQ ID NO: 2113686 - protein, 10 aa, Cryptosporidium hominis
GNDHGSTRSI

SEQ ID NO: 2113687 - protein, 4 aa, Cryptosporidium hominis
GNDN

SEQ ID NO: 2113688 - protein, 10 aa, Cryptosporidium hominis
GNDPNPAVNG

SEQ ID NO: 2113689 - protein, 8 aa, Cryptosporidium hominis
GNDQTRRS

SEQ ID NO: 2113690 - protein, 6 aa, Cryptosporidium hominis
GNDSAG

SEQ ID NO: 2113691 - protein, 25 aa, Cryptosporidium hominis
GNDSLNHKSTYTDEKFTKKEKRKID

SEQ ID NO: 2113692 - protein, 19 aa, Cryptosporidium hominis
GNEEKNHNYGNTFNSEENM

SEQ ID NO: 2113693 - protein, 18 aa, Cryptosporidium hominis
GNEGSLKNEISKNKISQK

SEQ ID NO: 2113694 - protein, 7 aa, Cryptosporidium hominis
GNEHEKR

SEQ ID NO: 2113695 - protein, 9 aa, Cryptosporidium hominis
GNERTSSIR

SEQ ID NO: 2113696 - protein, 7 aa, Cryptosporidium hominis
GNERYSE

SEQ ID NO: 2113697 - protein, 4 aa, Cryptosporidium hominis
GNFE

SEQ ID NO: 2113698 - protein, 6 aa, Cryptosporidium hominis
GNFQGS

SEQ ID NO: 2113699 - protein, 5 aa, Cryptosporidium hominis
GNGGS

SEQ ID NO: 2113700 - protein, 9 aa, Cryptosporidium hominis
GNGNFPASS

SEQ ID NO: 2113701 - protein, 9 aa, Cryptosporidium hominis
GNGQSETKF

SEQ ID NO: 2113702 - protein, 5 aa, Cryptosporidium hominis
GNHDK

SEQ ID NO: 2113703 - protein, 7 aa, Cryptosporidium hominis
GNIDSNG

SEQ ID NO: 2113704 - protein, 4 aa, Cryptosporidium hominis
GNIG

SEQ ID NO: 2113705 - protein, 11 aa, Cryptosporidium hominis
GNKEKGREEEL

SEQ ID NO: 2113706 - protein, 7 aa, Cryptosporidium hominis
GNKELNE

SEQ ID NO: 2113707 - protein, 5 aa, Cryptosporidium hominis
GNKKG

SEQ ID NO: 2113708 - protein, 6 aa, Cryptosporidium hominis
GNKNEK

SEQ ID NO: 2113709 - protein, 31 aa, Cryptosporidium hominis
GNKNLEKADGKEESKNKTTKNGSRKLSQTCN

SEQ ID NO: 2113710 - protein, 6 aa, Cryptosporidium hominis
GNKNTI

SEQ ID NO: 2113711 - protein, 5 aa, Cryptosporidium hominis
GNKQG

SEQ ID NO: 2113712 - protein, 4 aa, Cryptosporidium hominis
GNKR

SEQ ID NO: 2113713 - protein, 12 aa, Cryptosporidium hominis
GNKRYSASNKSL

SEQ ID NO: 2113714 - protein, 6 aa, Cryptosporidium hominis
GNKSGK

SEQ ID NO: 2113715 - protein, 20 aa, Cryptosporidium hominis
GNLKENGEPGQGNLSNDESA

SEQ ID NO: 2113716 - protein, 6 aa, Cryptosporidium hominis
GNLNKT

SEQ ID NO: 2113717 - protein, 10 aa, Cryptosporidium hominis
GNLPSATSVE

SEQ ID NO: 2113718 - protein, 12 aa, Cryptosporidium hominis
GNLSRNGSNEDL

SEQ ID NO: 2113719 - protein, 5 aa, Cryptosporidium hominis
GNNAL

SEQ ID NO: 2113720 - protein, 8 aa, Cryptosporidium hominis
GNNKSNQN

SEQ ID NO: 2113721 - protein, 9 aa, Cryptosporidium hominis
GNNLDADKS

SEQ ID NO: 2113722 - protein, 22 aa, Cryptosporidium hominis
GNNLGNDLNYGNDNNATTSANS

SEQ ID NO: 2113723 - protein, 4 aa, Cryptosporidium hominis
GNNS

SEQ ID NO: 2113724 - protein, 10 aa, Cryptosporidium hominis
GNNSSPSSRI

SEQ ID NO: 2113725 - protein, 4 aa, Cryptosporidium hominis
GNNT

SEQ ID NO: 2113726 - protein, 15 aa, Cryptosporidium hominis
GNPMPAGGNEETRQE

SEQ ID NO: 2113727 - protein, 7 aa, Cryptosporidium hominis
GNPSEGI

SEQ ID NO: 2113728 - protein, 7 aa, Cryptosporidium hominis
GNPSNRY

SEQ ID NO: 2113729 - protein, 19 aa, Cryptosporidium hominis
GNQPENDQEALNQNGNLSK

SEQ ID NO: 2113730 - protein, 6 aa, Cryptosporidium hominis
GNQTPA

SEQ ID NO: 2113731 - protein, 18 aa, Cryptosporidium hominis
GNRGRRKENTRNENINFC

SEQ ID NO: 2113732 - protein, 35 aa, Cryptosporidium hominis
GNSADGFDDDDLDDDFDDEFDSEDVQQSMHQDNGY

SEQ ID NO: 2113733 - protein, 15 aa, Cryptosporidium hominis
GNSGQTNYSAANGNI

SEQ ID NO: 2113734 - protein, 5 aa, Cryptosporidium hominis
GNSKD

SEQ ID NO: 2113735 - protein, 5 aa, Cryptosporidium hominis
GNSNH

SEQ ID NO: 2113736 - protein, 6 aa, Cryptosporidium hominis
GNSQLK

SEQ ID NO: 2113737 - protein, 9 aa, Cryptosporidium hominis
GNSSNDEDL

SEQ ID NO: 2113738 - protein, 8 aa, Cryptosporidium hominis
GNSSNFNR

SEQ ID NO: 2113739 - protein, 10 aa, Cryptosporidium hominis
GNTKNHQQSV

SEQ ID NO: 2113740 - protein, 4 aa, Cryptosporidium hominis
GNTL

SEQ ID NO: 2113741 - protein, 24 aa, Cryptosporidium hominis
GNTNEGNSENQVNVRSDRENNSGF

SEQ ID NO: 2113742 - protein, 21 aa, Cryptosporidium hominis
GNTSGGISKRRGSKDKNEHKF

SEQ ID NO: 2113743 - protein, 18 aa, Cryptosporidium hominis
GNVGARSSGAVGSTGSSY

SEQ ID NO: 2113744 - protein, 4 aa, Cryptosporidium hominis
GNVN

SEQ ID NO: 2113745 - protein, 19 aa, Cryptosporidium hominis
GNYKHENKRNGKIVSDNAR

SEQ ID NO: 2113746 - protein, 12 aa, Cryptosporidium hominis
GNYNSVDNTHRS

SEQ ID NO: 2113747 - protein, 10 aa, Cryptosporidium hominis
GNYPGQQNAG

SEQ ID NO: 2113748 - protein, 8 aa, Cryptosporidium hominis
GPAGTEFE

SEQ ID NO: 2113749 - protein, 4 aa, Cryptosporidium hominis
GPEL

SEQ ID NO: 2113750 - protein, 7 aa, Cryptosporidium hominis
GPENHSS

SEQ ID NO: 2113751 - protein, 8 aa, Cryptosporidium hominis
GPERPPMD

SEQ ID NO: 2113752 - protein, 5 aa, Cryptosporidium hominis
GPFPS

SEQ ID NO: 2113753 - protein, 15 aa, Cryptosporidium hominis
GPGEINKPQKKSTEY

SEQ ID NO: 2113754 - protein, 18 aa, Cryptosporidium hominis
GPGKEGNSKKNKNSSNAE

SEQ ID NO: 2113755 - protein, 7 aa, Cryptosporidium hominis
GPGQVTK

SEQ ID NO: 2113756 - protein, 5 aa, Cryptosporidium hominis
GPGSI

SEQ ID NO: 2113757 - protein, 9 aa, Cryptosporidium hominis
GPHNNTENK

SEQ ID NO: 2113758 - protein, 6 aa, Cryptosporidium hominis
GPINID

SEQ ID NO: 2113759 - protein, 24 aa, Cryptosporidium hominis
GPKAATKPLLDETNSQIWKKQESK

SEQ ID NO: 2113760 - protein, 6 aa, Cryptosporidium hominis
GPKEEM

SEQ ID NO: 2113761 - protein, 9 aa, Cryptosporidium hominis
GPKNSCNAN

SEQ ID NO: 2113762 - protein, 13 aa, Cryptosporidium hominis
GPKRASYVHTGAA

SEQ ID NO: 2113763 - protein, 4 aa, Cryptosporidium hominis
GPKS

SEQ ID NO: 2113764 - protein, 5 aa, Cryptosporidium hominis
GPLTE

SEQ ID NO: 2113765 - protein, 6 aa, Cryptosporidium hominis
GPLYDS

SEQ ID NO: 2113766 - protein, 10 aa, Cryptosporidium hominis
GPNDTPPTSD

SEQ ID NO: 2113767 - protein, 6 aa, Cryptosporidium hominis
GPPFAT

SEQ ID NO: 2113768 - protein, 5 aa, Cryptosporidium hominis
GPRHF

SEQ ID NO: 2113769 - protein, 5 aa, Cryptosporidium hominis
GPSFS

SEQ ID NO: 2113770 - protein, 10 aa, Cryptosporidium hominis
GPSGSGKSTL

SEQ ID NO: 2113771 - protein, 9 aa, Cryptosporidium hominis
GPSGSGKTS

SEQ ID NO: 2113772 - protein, 8 aa, Cryptosporidium hominis
GPSLTPGQ

SEQ ID NO: 2113773 - protein, 5 aa, Cryptosporidium hominis
GPSRN

SEQ ID NO: 2113774 - protein, 6 aa, Cryptosporidium hominis
GPSVAG

SEQ ID NO: 2113775 - protein, 5 aa, Cryptosporidium hominis
GPSVT

SEQ ID NO: 2113776 - protein, 4 aa, Cryptosporidium hominis
GPTK

SEQ ID NO: 2113777 - protein, 12 aa, Cryptosporidium hominis
GQAPNKTNLVNH

SEQ ID NO: 2113778 - protein, 4 aa, Cryptosporidium hominis
GQDP

SEQ ID NO: 2113779 - protein, 6 aa, Cryptosporidium hominis
GQEKLE

SEQ ID NO: 2113780 - protein, 6 aa, Cryptosporidium hominis
GQELEN

SEQ ID NO: 2113781 - protein, 6 aa, Cryptosporidium hominis
GQETDE

SEQ ID NO: 2113782 - protein, 4 aa, Cryptosporidium hominis
GQEV

SEQ ID NO: 2113783 - protein, 10 aa, Cryptosporidium hominis
GQGIHDKPSL

SEQ ID NO: 2113784 - protein, 4 aa, Cryptosporidium hominis
GQID

SEQ ID NO: 2113785 - protein, 7 aa, Cryptosporidium hominis
GQILSAG

SEQ ID NO: 2113786 - protein, 7 aa, Cryptosporidium hominis
GQISPGR

SEQ ID NO: 2113787 - protein, 8 aa, Cryptosporidium hominis
GQKDSNAI

SEQ ID NO: 2113788 - protein, 24 aa, Cryptosporidium hominis
GQKENLNSNTGSWKSKSKMSSNPQ

SEQ ID NO: 2113789 - protein, 8 aa, Cryptosporidium hominis
GQKKSENI

SEQ ID NO: 2113790 - protein, 12 aa, Cryptosporidium hominis
GQKQDKSGNYVS

SEQ ID NO: 2113791 - protein, 5 aa, Cryptosporidium hominis
GQNCK

SEQ ID NO: 2113792 - protein, 5 aa, Cryptosporidium hominis
GQNKR

SEQ ID NO: 2113793 - protein, 8 aa, Cryptosporidium hominis
GQNLNQQQ

SEQ ID NO: 2113794 - protein, 13 aa, Cryptosporidium hominis
GQNRGTYNSTIEG

SEQ ID NO: 2113795 - protein, 9 aa, Cryptosporidium hominis
GQNRLSSSK

SEQ ID NO: 2113796 - protein, 7 aa, Cryptosporidium hominis
GQNSKGQ

SEQ ID NO: 2113797 - protein, 4 aa, Cryptosporidium hominis
GQPL

SEQ ID NO: 2113798 - protein, 5 aa, Cryptosporidium hominis
GQPRW

SEQ ID NO: 2113799 - protein, 8 aa, Cryptosporidium hominis
GQPTTIPG

SEQ ID NO: 2113800 - protein, 8 aa, Cryptosporidium hominis
GQSDTGGN

SEQ ID NO: 2113801 - protein, 4 aa, Cryptosporidium hominis
GQSF

SEQ ID NO: 2113802 - protein, 5 aa, Cryptosporidium hominis
GQSIP

SEQ ID NO: 2113803 - protein, 16 aa, Cryptosporidium hominis
GQSKGDYFKNGELGND

SEQ ID NO: 2113804 - protein, 5 aa, Cryptosporidium hominis
GQSSY

SEQ ID NO: 2113805 - protein, 8 aa, Cryptosporidium hominis
GQTESNKS

SEQ ID NO: 2113806 - protein, 8 aa, Cryptosporidium hominis
GQTGKPQL

SEQ ID NO: 2113807 - protein, 15 aa, Cryptosporidium hominis
GQTNISNNKAGLEKP

SEQ ID NO: 2113808 - protein, 39 aa, Cryptosporidium hominis
GQTPSSKASTSGRSYTSENLPSIGSYARSTTPDVNASTV

SEQ ID NO: 2113809 - protein, 5 aa, Cryptosporidium hominis
GRDGV

SEQ ID NO: 2113810 - protein, 6 aa, Cryptosporidium hominis
GRDLGS

SEQ ID NO: 2113811 - protein, 7 aa, Cryptosporidium hominis
GREGKYG

SEQ ID NO: 2113812 - protein, 14 aa, Cryptosporidium hominis
GREKKDNNTMNGPS

SEQ ID NO: 2113813 - protein, 10 aa, Cryptosporidium hominis
GRETDESSTT

SEQ ID NO: 2113814 - protein, 9 aa, Cryptosporidium hominis
GREVEESNA

SEQ ID NO: 2113815 - protein, 17 aa, Cryptosporidium hominis
GRGSEKSREQKQNENAV

SEQ ID NO: 2113816 - protein, 5 aa, Cryptosporidium hominis
GRKPF

SEQ ID NO: 2113817 - protein, 10 aa, Cryptosporidium hominis
GRKRNENTTS

SEQ ID NO: 2113818 - protein, 8 aa, Cryptosporidium hominis
GRKWKPPR

SEQ ID NO: 2113819 - protein, 8 aa, Cryptosporidium hominis
GRLDENSD

SEQ ID NO: 2113820 - protein, 13 aa, Cryptosporidium hominis
GRLDKSVASKVDG

SEQ ID NO: 2113821 - protein, 13 aa, Cryptosporidium hominis
GRNGARATFTSDG

SEQ ID NO: 2113822 - protein, 5 aa, Cryptosporidium hominis
GRNGS

SEQ ID NO: 2113823 - protein, 5 aa, Cryptosporidium hominis
GRNIE

SEQ ID NO: 2113824 - protein, 6 aa, Cryptosporidium hominis
GRNPQG

SEQ ID NO: 2113825 - protein, 19 aa, Cryptosporidium hominis
GRNSLQTNTDKNKKCNQGL

SEQ ID NO: 2113826 - protein, 5 aa, Cryptosporidium hominis
GRPEI

SEQ ID NO: 2113827 - protein, 9 aa, Cryptosporidium hominis
GRQDRETFK

SEQ ID NO: 2113828 - protein, 5 aa, Cryptosporidium hominis
GRRPC

SEQ ID NO: 2113829 - protein, 10 aa, Cryptosporidium hominis
GRSDTSTSVT

SEQ ID NO: 2113830 - protein, 30 aa, Cryptosporidium hominis
GRSEKRISNKNQISSKKSTRDSENHSISTS

SEQ ID NO: 2113831 - protein, 9 aa, Cryptosporidium hominis
GRSKGFENV

SEQ ID NO: 2113832 - protein, 26 aa, Cryptosporidium hominis
GRSSGKGTNGNCCGGSNSKRKGSCGS

SEQ ID NO: 2113833 - protein, 6 aa, Cryptosporidium hominis
GRSSLA

SEQ ID NO: 2113834 - protein, 10 aa, Cryptosporidium hominis
GRSVSTRRAG

SEQ ID NO: 2113835 - protein, 8 aa, Cryptosporidium hominis
GRTGAGKS

SEQ ID NO: 2113836 - protein, 10 aa, Cryptosporidium hominis
GRTGSGKSSI

SEQ ID NO: 2113837 - protein, 9 aa, Cryptosporidium hominis
GRTGSGKST

SEQ ID NO: 2113838 - protein, 10 aa, Cryptosporidium hominis
GRTGSGKSTL

SEQ ID NO: 2113839 - protein, 9 aa, Cryptosporidium hominis
GRTGSGKTT

SEQ ID NO: 2113840 - protein, 26 aa, Cryptosporidium hominis
GRTPLPTEENHSSLKNSTNALNFETR

SEQ ID NO: 2113841 - protein, 15 aa, Cryptosporidium hominis
GRTTPNITPSSHSDY

SEQ ID NO: 2113842 - protein, 5 aa, Cryptosporidium hominis
GRYDK

SEQ ID NO: 2113843 - protein, 7 aa, Cryptosporidium hominis
GRYSANN

SEQ ID NO: 2113844 - protein, 4 aa, Cryptosporidium hominis
GSAD

SEQ ID NO: 2113845 - protein, 11 aa, Cryptosporidium hominis
GSADRTSSTYN

SEQ ID NO: 2113846 - protein, 4 aa, Cryptosporidium hominis
GSAG

SEQ ID NO: 2113847 - protein, 47 aa, Cryptosporidium hominis
GSANGGNSIEDSGQTLNGDSTIAGVQGGADGNASANNANESNQGEDL

SEQ ID NO: 2113848 - protein, 8 aa, Cryptosporidium hominis
GSANHGIN

SEQ ID NO: 2113849 - protein, 7 aa, Cryptosporidium hominis
GSATAKA

SEQ ID NO: 2113850 - protein, 5 aa, Cryptosporidium hominis
GSCNG

SEQ ID NO: 2113851 - protein, 17 aa, Cryptosporidium hominis
GSDFADEKTGYSPFPGN

SEQ ID NO: 2113852 - protein, 11 aa, Cryptosporidium hominis
GSDGRGKCECN

SEQ ID NO: 2113853 - protein, 14 aa, Cryptosporidium hominis
GSDSPTSKESCPSN

SEQ ID NO: 2113854 - protein, 6 aa, Cryptosporidium hominis
GSEGMQ

SEQ ID NO: 2113855 - protein, 7 aa, Cryptosporidium hominis
GSEGTSA

SEQ ID NO: 2113856 - protein, 4 aa, Cryptosporidium hominis
GSEN

SEQ ID NO: 2113857 - protein, 5 aa, Cryptosporidium hominis
GSENL

SEQ ID NO: 2113858 - protein, 9 aa, Cryptosporidium hominis
GSENYSDST

SEQ ID NO: 2113859 - protein, 6 aa, Cryptosporidium hominis
GSESAI

SEQ ID NO: 2113860 - protein, 4 aa, Cryptosporidium hominis
GSEY

SEQ ID NO: 2113861 - protein, 11 aa, Cryptosporidium hominis
GSFGNGPNSKL

SEQ ID NO: 2113862 - protein, 4 aa, Cryptosporidium hominis
GSFP

SEQ ID NO: 2113863 - protein, 6 aa, Cryptosporidium hominis
GSFSPP

SEQ ID NO: 2113864 - protein, 17 aa, Cryptosporidium hominis
GSGASSGPGNSGVSSFQ

SEQ ID NO: 2113865 - protein, 8 aa, Cryptosporidium hominis
GSGEFDQS

SEQ ID NO: 2113866 - protein, 37 aa, Cryptosporidium hominis
GSGGGSNSRAEGLEQNDNASKGIECEDTPSNRMEGGE

SEQ ID NO: 2113867 - protein, 10 aa, Cryptosporidium hominis
GSGNIYRPPS

SEQ ID NO: 2113868 - protein, 7 aa, Cryptosporidium hominis
GSGNQSI

SEQ ID NO: 2113869 - protein, 6 aa, Cryptosporidium hominis
GSGRDY

SEQ ID NO: 2113870 - protein, 16 aa, Cryptosporidium hominis
GSGSGGGGGGGEGQLP

SEQ ID NO: 2113871 - protein, 5 aa, Cryptosporidium hominis
GSGSV

SEQ ID NO: 2113872 - protein, 4 aa, Cryptosporidium hominis
GSGT

SEQ ID NO: 2113873 - protein, 8 aa, Cryptosporidium hominis
GSGTEEIC

SEQ ID NO: 2113874 - protein, 11 aa, Cryptosporidium hominis
GSGTLGEAPKQ

SEQ ID NO: 2113875 - protein, 6 aa, Cryptosporidium hominis
GSGVAT

SEQ ID NO: 2113876 - protein, 7 aa, Cryptosporidium hominis
GSHETIG

SEQ ID NO: 2113877 - protein, 15 aa, Cryptosporidium hominis
GSILGGANQDSGGFG

SEQ ID NO: 2113878 - protein, 32 aa, Cryptosporidium hominis
GSIPKEKFQPEDEVATAAEKDDPDCDMTPQGS

SEQ ID NO: 2113879 - protein, 22 aa, Cryptosporidium hominis
GSISNITNNELANSKFDGQETN

SEQ ID NO: 2113880 - protein, 4 aa, Cryptosporidium hominis
GSKD

SEQ ID NO: 2113881 - protein, 17 aa, Cryptosporidium hominis
GSKDEIPKIQRPKPKLS

SEQ ID NO: 2113882 - protein, 17 aa, Cryptosporidium hominis
GSKEALEASNKTKIEEL

SEQ ID NO: 2113883 - protein, 5 aa, Cryptosporidium hominis
GSKID

SEQ ID NO: 2113884 - protein, 13 aa, Cryptosporidium hominis
GSKKDYENHTTNY

SEQ ID NO: 2113885 - protein, 9 aa, Cryptosporidium hominis
GSKSKSHYS

SEQ ID NO: 2113886 - protein, 5 aa, Cryptosporidium hominis
GSKTR

SEQ ID NO: 2113887 - protein, 22 aa, Cryptosporidium hominis
GSLDGWTQNKPQLLTSASDKTF

SEQ ID NO: 2113888 - protein, 5 aa, Cryptosporidium hominis
GSLDP

SEQ ID NO: 2113889 - protein, 5 aa, Cryptosporidium hominis
GSLGS

SEQ ID NO: 2113890 - protein, 11 aa, Cryptosporidium hominis
GSLLSGGQRQR

SEQ ID NO: 2113891 - protein, 16 aa, Cryptosporidium hominis
GSLQPSFQSTQSKDIG

SEQ ID NO: 2113892 - protein, 16 aa, Cryptosporidium hominis
GSNDQFNSQTQQWNNS

SEQ ID NO: 2113893 - protein, 6 aa, Cryptosporidium hominis
GSNEKK

SEQ ID NO: 2113894 - protein, 15 aa, Cryptosporidium hominis
GSNESNANSSSGCGP

SEQ ID NO: 2113895 - protein, 4 aa, Cryptosporidium hominis
GSNF

SEQ ID NO: 2113896 - protein, 6 aa, Cryptosporidium hominis
GSNGVI

SEQ ID NO: 2113897 - protein, 13 aa, Cryptosporidium hominis
GSNLDSRRSVENT

SEQ ID NO: 2113898 - protein, 26 aa, Cryptosporidium hominis
GSNNNRNTGNKSDSLINSRTSSNKSI

SEQ ID NO: 2113899 - protein, 9 aa, Cryptosporidium hominis
GSNNQNKSE

SEQ ID NO: 2113900 - protein, 6 aa, Cryptosporidium hominis
GSNQPL

SEQ ID NO: 2113901 - protein, 10 aa, Cryptosporidium hominis
GSNTDTSIRE

SEQ ID NO: 2113902 - protein, 6 aa, Cryptosporidium hominis
GSPEQL

SEQ ID NO: 2113903 - protein, 9 aa, Cryptosporidium hominis
GSPGTGKTC

SEQ ID NO: 2113904 - protein, 9 aa, Cryptosporidium hominis
GSPKAKEEL

SEQ ID NO: 2113905 - protein, 5 aa, Cryptosporidium hominis
GSPQF

SEQ ID NO: 2113906 - protein, 5 aa, Cryptosporidium hominis
GSPRI

SEQ ID NO: 2113907 - protein, 5 aa, Cryptosporidium hominis
GSPRS

SEQ ID NO: 2113908 - protein, 8 aa, Cryptosporidium hominis
GSPRWSAR

SEQ ID NO: 2113909 - protein, 7 aa, Cryptosporidium hominis
GSQDDEM

SEQ ID NO: 2113910 - protein, 6 aa, Cryptosporidium hominis
GSQFEN

SEQ ID NO: 2113911 - protein, 6 aa, Cryptosporidium hominis
GSQIST

SEQ ID NO: 2113912 - protein, 7 aa, Cryptosporidium hominis
GSQSGEE

SEQ ID NO: 2113913 - protein, 9 aa, Cryptosporidium hominis
GSQSSFPTI

SEQ ID NO: 2113914 - protein, 9 aa, Cryptosporidium hominis
GSRLEGDFS

SEQ ID NO: 2113915 - protein, 6 aa, Cryptosporidium hominis
GSRTSD

SEQ ID NO: 2113916 - protein, 4 aa, Cryptosporidium hominis
GSRV

SEQ ID NO: 2113917 - protein, 23 aa, Cryptosporidium hominis
GSSCTNKKNIKSPTSKSTPSNRR

SEQ ID NO: 2113918 - protein, 14 aa, Cryptosporidium hominis
GSSDPLNSEESSDL

SEQ ID NO: 2113919 - protein, 7 aa, Cryptosporidium hominis
GSSDRSA

SEQ ID NO: 2113920 - protein, 24 aa, Cryptosporidium hominis
GSSENTKSLDYSTSSLVSTGPLGR

SEQ ID NO: 2113921 - protein, 16 aa, Cryptosporidium hominis
GSSESIQSFSKNRKLS

SEQ ID NO: 2113922 - protein, 5 aa, Cryptosporidium hominis
GSSGE

SEQ ID NO: 2113923 - protein, 10 aa, Cryptosporidium hominis
GSSGSGKTTL

SEQ ID NO: 2113924 - protein, 6 aa, Cryptosporidium hominis
GSSHGT

SEQ ID NO: 2113925 - protein, 17 aa, Cryptosporidium hominis
GSSKTLNSVATNSLTKS

SEQ ID NO: 2113926 - protein, 11 aa, Cryptosporidium hominis
GSSLGKEPDLV

SEQ ID NO: 2113927 - protein, 5 aa, Cryptosporidium hominis
GSSLN

SEQ ID NO: 2113928 - protein, 7 aa, Cryptosporidium hominis
GSSLPNP

SEQ ID NO: 2113929 - protein, 6 aa, Cryptosporidium hominis
GSSLTG

SEQ ID NO: 2113930 - protein, 8 aa, Cryptosporidium hominis
GSSNGEVL

SEQ ID NO: 2113931 - protein, 11 aa, Cryptosporidium hominis
GSSNSAKSSVS

SEQ ID NO: 2113932 - protein, 7 aa, Cryptosporidium hominis
GSSNSNL

SEQ ID NO: 2113933 - protein, 9 aa, Cryptosporidium hominis
GSSQRPSIE

SEQ ID NO: 2113934 - protein, 4 aa, Cryptosporidium hominis
GSST

SEQ ID NO: 2113935 - protein, 6 aa, Cryptosporidium hominis
GSTDLE

SEQ ID NO: 2113936 - protein, 7 aa, Cryptosporidium hominis
GSTGNKG

SEQ ID NO: 2113937 - protein, 10 aa, Cryptosporidium hominis
GSTSPKVAST

SEQ ID NO: 2113938 - protein, 10 aa, Cryptosporidium hominis
GSTTTRGSEL

SEQ ID NO: 2113939 - protein, 4 aa, Cryptosporidium hominis
GSTV

SEQ ID NO: 2113940 - protein, 6 aa, Cryptosporidium hominis
GSVAGT

SEQ ID NO: 2113941 - protein, 6 aa, Cryptosporidium hominis
GSVDSL

SEQ ID NO: 2113942 - protein, 8 aa, Cryptosporidium hominis
GSVGNPVN

SEQ ID NO: 2113943 - protein, 4 aa, Cryptosporidium hominis
GSVS

SEQ ID NO: 2113944 - protein, 4 aa, Cryptosporidium hominis
GSYE

SEQ ID NO: 2113945 - protein, 5 aa, Cryptosporidium hominis
GTAST

SEQ ID NO: 2113946 - protein, 6 aa, Cryptosporidium hominis
GTATGG

SEQ ID NO: 2113947 - protein, 15 aa, Cryptosporidium hominis
GTDSLERGEDRATFE

SEQ ID NO: 2113948 - protein, 9 aa, Cryptosporidium hominis
GTDVAKEAS

SEQ ID NO: 2113949 - protein, 5 aa, Cryptosporidium hominis
GTEDF

SEQ ID NO: 2113950 - protein, 9 aa, Cryptosporidium hominis
GTEEKDDNT

SEQ ID NO: 2113951 - protein, 4 aa, Cryptosporidium hominis
GTEF

SEQ ID NO: 2113952 - protein, 9 aa, Cryptosporidium hominis
GTERNSDEV

SEQ ID NO: 2113953 - protein, 7 aa, Cryptosporidium hominis
GTESTLG

SEQ ID NO: 2113954 - protein, 46 aa, Cryptosporidium hominis
GTETGTKGAETGTETGTETETGTKTGAETETGTKTKEAETGTGAEI

SEQ ID NO: 2113955 - protein, 9 aa, Cryptosporidium hominis
GTEVAKGAS

SEQ ID NO: 2113956 - protein, 5 aa, Cryptosporidium hominis
GTGCN

SEQ ID NO: 2113957 - protein, 8 aa, Cryptosporidium hominis
GTGGSSSV

SEQ ID NO: 2113958 - protein, 21 aa, Cryptosporidium hominis
GTGIRTKAGPGIGTGEPGASD

SEQ ID NO: 2113959 - protein, 8 aa, Cryptosporidium hominis
GTGTPLGD

SEQ ID NO: 2113960 - protein, 4 aa, Cryptosporidium hominis
GTIG

SEQ ID NO: 2113961 - protein, 9 aa, Cryptosporidium hominis
GTIKGSNGE

SEQ ID NO: 2113962 - protein, 10 aa, Cryptosporidium hominis
GTIPSSSENN

SEQ ID NO: 2113963 - protein, 5 aa, Cryptosporidium hominis
GTKDK

SEQ ID NO: 2113964 - protein, 12 aa, Cryptosporidium hominis
GTKIENKQAIPV

SEQ ID NO: 2113965 - protein, 5 aa, Cryptosporidium hominis
GTKIG

SEQ ID NO: 2113966 - protein, 4 aa, Cryptosporidium hominis
GTKQ

SEQ ID NO: 2113967 - protein, 5 aa, Cryptosporidium hominis
GTKSR

SEQ ID NO: 2113968 - protein, 6 aa, Cryptosporidium hominis
GTLPRS

SEQ ID NO: 2113969 - protein, 4 aa, Cryptosporidium hominis
GTLT

SEQ ID NO: 2113970 - protein, 5 aa, Cryptosporidium hominis
GTLTN

SEQ ID NO: 2113971 - protein, 4 aa, Cryptosporidium hominis
GTNE

SEQ ID NO: 2113972 - protein, 5 aa, Cryptosporidium hominis
GTNFT

SEQ ID NO: 2113973 - protein, 4 aa, Cryptosporidium hominis
GTNH

SEQ ID NO: 2113974 - protein, 9 aa, Cryptosporidium hominis
GTNHSETLN

SEQ ID NO: 2113975 - protein, 6 aa, Cryptosporidium hominis
GTNKPQ

SEQ ID NO: 2113976 - protein, 6 aa, Cryptosporidium hominis
GTNNNT

SEQ ID NO: 2113977 - protein, 7 aa, Cryptosporidium hominis
GTNPTHY

SEQ ID NO: 2113978 - protein, 6 aa, Cryptosporidium hominis
GTNSAS

SEQ ID NO: 2113979 - protein, 7 aa, Cryptosporidium hominis
GTNSPSL

SEQ ID NO: 2113980 - protein, 4 aa, Cryptosporidium hominis
GTNT

SEQ ID NO: 2113981 - protein, 8 aa, Cryptosporidium hominis
GTPAENYE

SEQ ID NO: 2113982 - protein, 13 aa, Cryptosporidium hominis
GTPGYTAPEGGAL

SEQ ID NO: 2113983 - protein, 7 aa, Cryptosporidium hominis
GTPQSYS

SEQ ID NO: 2113984 - protein, 5 aa, Cryptosporidium hominis
GTQLE

SEQ ID NO: 2113985 - protein, 17 aa, Cryptosporidium hominis
GTRGMGGGLEQGEGLEG

SEQ ID NO: 2113986 - protein, 4 aa, Cryptosporidium hominis
GTSK

SEQ ID NO: 2113987 - protein, 11 aa, Cryptosporidium hominis
GTSPDLKTASE

SEQ ID NO: 2113988 - protein, 15 aa, Cryptosporidium hominis
GTSPEAEIASKYPTS

SEQ ID NO: 2113989 - protein, 6 aa, Cryptosporidium hominis
GTSSGT

SEQ ID NO: 2113990 - protein, 9 aa, Cryptosporidium hominis
GTSSISSNN

SEQ ID NO: 2113991 - protein, 9 aa, Cryptosporidium hominis
GTTEPAKVN

SEQ ID NO: 2113992 - protein, 24 aa, Cryptosporidium hominis
GTTSGQKSSSSLQEESQTSLGGGG

SEQ ID NO: 2113993 - protein, 5 aa, Cryptosporidium hominis
GTTSS

SEQ ID NO: 2113994 - protein, 8 aa, Cryptosporidium hominis
GTTTNGSS

SEQ ID NO: 2113995 - protein, 5 aa, Cryptosporidium hominis
GTVGK

SEQ ID NO: 2113996 - protein, 4 aa, Cryptosporidium hominis
GTVK

SEQ ID NO: 2113997 - protein, 14 aa, Cryptosporidium hominis
GTVPPKPLTEIPSH

SEQ ID NO: 2113998 - protein, 35 aa, Cryptosporidium hominis
GVDGDKGSTEDNTPKKRRIGESNSLETNKEQQNGI

SEQ ID NO: 2113999 - protein, 5 aa, Cryptosporidium hominis
GVDSE

SEQ ID NO: 2114000 - protein, 10 aa, Cryptosporidium hominis
GVEKQDVANN

SEQ ID NO: 2114001 - protein, 5 aa, Cryptosporidium hominis
GVGAS

SEQ ID NO: 2114002 - protein, 8 aa, Cryptosporidium hominis
GVGGAGLS

SEQ ID NO: 2114003 - protein, 11 aa, Cryptosporidium hominis
GVGGSSSGLQN

SEQ ID NO: 2114004 - protein, 10 aa, Cryptosporidium hominis
GVGYSSPSHA

SEQ ID NO: 2114005 - protein, 8 aa, Cryptosporidium hominis
GVKASNIA

SEQ ID NO: 2114006 - protein, 5 aa, Cryptosporidium hominis
GVNNA

SEQ ID NO: 2114007 - protein, 8 aa, Cryptosporidium hominis
GVPQSRDN

SEQ ID NO: 2114008 - protein, 4 aa, Cryptosporidium hominis
GVSE

SEQ ID NO: 2114009 - protein, 16 aa, Cryptosporidium hominis
GVSGPQIDLPMMNQQG

SEQ ID NO: 2114010 - protein, 7 aa, Cryptosporidium hominis
GVSGSTT

SEQ ID NO: 2114011 - protein, 4 aa, Cryptosporidium hominis
GVSK

SEQ ID NO: 2114012 - protein, 4 aa, Cryptosporidium hominis
GVTS

SEQ ID NO: 2114013 - protein, 19 aa, Cryptosporidium hominis
GVYTPDTESQAKTTEKTYT

SEQ ID NO: 2114014 - protein, 10 aa, Cryptosporidium hominis
GWSPSSSSTL

SEQ ID NO: 2114015 - protein, 13 aa, Cryptosporidium hominis
GYAPKNKDRSQIQ

SEQ ID NO: 2114016 - protein, 4 aa, Cryptosporidium hominis
GYDK

SEQ ID NO: 2114017 - protein, 13 aa, Cryptosporidium hominis
GYGDSEGTPSEEG

SEQ ID NO: 2114018 - protein, 44 aa, Cryptosporidium hominis
GYKLSGSKNSASNEKPVTLGSSSKSIGGNSTDNNVSNNNEIKSL

SEQ ID NO: 2114019 - protein, 10 aa, Cryptosporidium hominis
GYKRKAPDEL

SEQ ID NO: 2114020 - protein, 7 aa, Cryptosporidium hominis
GYKSDER

SEQ ID NO: 2114021 - protein, 8 aa, Cryptosporidium hominis
GYNPEWDN

SEQ ID NO: 2114022 - protein, 7 aa, Cryptosporidium hominis
GYSRVNK

SEQ ID NO: 2114023 - protein, 15 aa, Cryptosporidium hominis
GYSSRPESIPLPSPG

SEQ ID NO: 2114024 - protein, 4 aa, Cryptosporidium hominis
GYTR

SEQ ID NO: 2114025 - protein, 8 aa, Cryptosporidium hominis
HAESDDGS

SEQ ID NO: 2114026 - protein, 5 aa, Cryptosporidium hominis
HAGTH

SEQ ID NO: 2114027 - protein, 8 aa, Cryptosporidium hominis
HDEDDQVR

SEQ ID NO: 2114028 - protein, 9 aa, Cryptosporidium hominis
HDEKERTDL

SEQ ID NO: 2114029 - protein, 11 aa, Cryptosporidium hominis
HDHRSSIDPGN

SEQ ID NO: 2114030 - protein, 20 aa, Cryptosporidium hominis
HDPNTQAKQDTCAEEKLENK

SEQ ID NO: 2114031 - protein, 17 aa, Cryptosporidium hominis
HDQYPDKIREILYYVNF

SEQ ID NO: 2114032 - protein, 21 aa, Cryptosporidium hominis
HDSDSDALNNSISENAYDSRN

SEQ ID NO: 2114033 - protein, 5 aa, Cryptosporidium hominis
HDSGF

SEQ ID NO: 2114034 - protein, 26 aa, Cryptosporidium hominis
HDSTRSEGRIGNSGQSNRYSNSIQGS

SEQ ID NO: 2114035 - protein, 8 aa, Cryptosporidium hominis
HDTKSQSI

SEQ ID NO: 2114036 - protein, 6 aa, Cryptosporidium hominis
HEDQEK

SEQ ID NO: 2114037 - protein, 4 aa, Cryptosporidium hominis
HEDS

SEQ ID NO: 2114038 - protein, 14 aa, Cryptosporidium hominis
HEEESSLQEEKRPY

SEQ ID NO: 2114039 - protein, 68 aa, Cryptosporidium hominis
HEESELKTLSQDSQEPYSSKSQRGLRGYKEEAHPELSSVGPDSDSGSKPPAGSASASNLASTSNSGSG

SEQ ID NO: 2114040 - protein, 6 aa, Cryptosporidium hominis
HEFDPS

SEQ ID NO: 2114041 - protein, 13 aa, Cryptosporidium hominis
HEFSDSEKPEEKN

SEQ ID NO: 2114042 - protein, 20 aa, Cryptosporidium hominis
HEGRNSEIEMGGDKMNSDDA

SEQ ID NO: 2114043 - protein, 6 aa, Cryptosporidium hominis
HEINNR

SEQ ID NO: 2114044 - protein, 4 aa, Cryptosporidium hominis
HEKK

SEQ ID NO: 2114045 - protein, 11 aa, Cryptosporidium hominis
HEKKTDHVKAS

SEQ ID NO: 2114046 - protein, 4 aa, Cryptosporidium hominis
HEKV

SEQ ID NO: 2114047 - protein, 4 aa, Cryptosporidium hominis
HENK

SEQ ID NO: 2114048 - protein, 4 aa, Cryptosporidium hominis
HENN

SEQ ID NO: 2114049 - protein, 4 aa, Cryptosporidium hominis
HENQ

SEQ ID NO: 2114050 - protein, 8 aa, Cryptosporidium hominis
HENSPASA

SEQ ID NO: 2114051 - protein, 4 aa, Cryptosporidium hominis
HEPY

SEQ ID NO: 2114052 - protein, 13 aa, Cryptosporidium hominis
HEQDTSKEPEAVP

SEQ ID NO: 2114053 - protein, 5 aa, Cryptosporidium hominis
HEQVD

SEQ ID NO: 2114054 - protein, 21 aa, Cryptosporidium hominis
HESNSNCSINSESAPKSNPKR

SEQ ID NO: 2114055 - protein, 4 aa, Cryptosporidium hominis
HESS

SEQ ID NO: 2114056 - protein, 15 aa, Cryptosporidium hominis
HESWTGEKSAKERFS

SEQ ID NO: 2114057 - protein, 17 aa, Cryptosporidium hominis
HFSPNNTSLEKKEGSLH

SEQ ID NO: 2114058 - protein, 8 aa, Cryptosporidium hominis
HGDKDVAE

SEQ ID NO: 2114059 - protein, 10 aa, Cryptosporidium hominis
HGEEIEENSN

SEQ ID NO: 2114060 - protein, 5 aa, Cryptosporidium hominis
HGEQL

SEQ ID NO: 2114061 - protein, 4 aa, Cryptosporidium hominis
HGIT

SEQ ID NO: 2114062 - protein, 10 aa, Cryptosporidium hominis
HGNPHDKNGL

SEQ ID NO: 2114063 - protein, 20 aa, Cryptosporidium hominis
HGNSKQDLNKNLENSMGSQG

SEQ ID NO: 2114064 - protein, 4 aa, Cryptosporidium hominis
HGPH

SEQ ID NO: 2114065 - protein, 14 aa, Cryptosporidium hominis
HGPNHGNRQHHNQF

SEQ ID NO: 2114066 - protein, 6 aa, Cryptosporidium hominis
HGPPIE

SEQ ID NO: 2114067 - protein, 17 aa, Cryptosporidium hominis
HGQNENGGHGGSCITET

SEQ ID NO: 2114068 - protein, 11 aa, Cryptosporidium hominis
HGRNTVDDQKS

SEQ ID NO: 2114069 - protein, 10 aa, Cryptosporidium hominis
HGTDPTPLGR

SEQ ID NO: 2114070 - protein, 9 aa, Cryptosporidium hominis
HGTGTQLGD

SEQ ID NO: 2114071 - protein, 11 aa, Cryptosporidium hominis
HGYLSSDSRIG

SEQ ID NO: 2114072 - protein, 11 aa, Cryptosporidium hominis
HHDNGSPIETS

SEQ ID NO: 2114073 - protein, 16 aa, Cryptosporidium hominis
HIKKAQNEISNFVFEI

SEQ ID NO: 2114074 - protein, 7 aa, Cryptosporidium hominis
HIKKSQK

SEQ ID NO: 2114075 - protein, 9 aa, Cryptosporidium hominis
HIKTKKGGI

SEQ ID NO: 2114076 - protein, 11 aa, Cryptosporidium hominis
HISNSDNKASL

SEQ ID NO: 2114077 - protein, 5 aa, Cryptosporidium hominis
HISSK

SEQ ID NO: 2114078 - protein, 11 aa, Cryptosporidium hominis
HISSPPSSSWE

SEQ ID NO: 2114079 - protein, 9 aa, Cryptosporidium hominis
HKADSEINN

SEQ ID NO: 2114080 - protein, 6 aa, Cryptosporidium hominis
HKEDNS

SEQ ID NO: 2114081 - protein, 7 aa, Cryptosporidium hominis
HKELNSS

SEQ ID NO: 2114082 - protein, 8 aa, Cryptosporidium hominis
HKGNEESK

SEQ ID NO: 2114083 - protein, 7 aa, Cryptosporidium hominis
HKGQSDL

SEQ ID NO: 2114084 - protein, 5 aa, Cryptosporidium hominis
HKISD

SEQ ID NO: 2114085 - protein, 9 aa, Cryptosporidium hominis
HKKTDDLPT

SEQ ID NO: 2114086 - protein, 8 aa, Cryptosporidium hominis
HKKTKETM

SEQ ID NO: 2114087 - protein, 8 aa, Cryptosporidium hominis
HKNSGATF

SEQ ID NO: 2114088 - protein, 4 aa, Cryptosporidium hominis
HKQE

SEQ ID NO: 2114089 - protein, 8 aa, Cryptosporidium hominis
HKRGTNWS

SEQ ID NO: 2114090 - protein, 5 aa, Cryptosporidium hominis
HKSEN

SEQ ID NO: 2114091 - protein, 5 aa, Cryptosporidium hominis
HKSSV

SEQ ID NO: 2114092 - protein, 14 aa, Cryptosporidium hominis
HKTSSVSASQPIAS

SEQ ID NO: 2114093 - protein, 5 aa, Cryptosporidium hominis
HKYPD

SEQ ID NO: 2114094 - protein, 13 aa, Cryptosporidium hominis
HLGPSIKQNSMNQ

SEQ ID NO: 2114095 - protein, 9 aa, Cryptosporidium hominis
HLPPQTYNQ

SEQ ID NO: 2114096 - protein, 5 aa, Cryptosporidium hominis
HNDPN

SEQ ID NO: 2114097 - protein, 5 aa, Cryptosporidium hominis
HNEKY

SEQ ID NO: 2114098 - protein, 5 aa, Cryptosporidium hominis
HNENV

SEQ ID NO: 2114099 - protein, 9 aa, Cryptosporidium hominis
HNGNNGNGN

SEQ ID NO: 2114100 - protein, 8 aa, Cryptosporidium hominis
HNHSNNTN

SEQ ID NO: 2114101 - protein, 11 aa, Cryptosporidium hominis
HNHSQNKHQPI

SEQ ID NO: 2114102 - protein, 9 aa, Cryptosporidium hominis
HNKEESNQG

SEQ ID NO: 2114103 - protein, 8 aa, Cryptosporidium hominis
HNLPPNLP

SEQ ID NO: 2114104 - protein, 12 aa, Cryptosporidium hominis
HNNDKNDSNDYA

SEQ ID NO: 2114105 - protein, 15 aa, Cryptosporidium hominis
HNNESNNGNNRNNSF

SEQ ID NO: 2114106 - protein, 6 aa, Cryptosporidium hominis
HNNQDE

SEQ ID NO: 2114107 - protein, 23 aa, Cryptosporidium hominis
HNPELEQPLSTASSTRGHGITGT

SEQ ID NO: 2114108 - protein, 6 aa, Cryptosporidium hominis
HNPGGH

SEQ ID NO: 2114109 - protein, 13 aa, Cryptosporidium hominis
HNPNIKKQKGNRC

SEQ ID NO: 2114110 - protein, 5 aa, Cryptosporidium hominis
HNPNN

SEQ ID NO: 2114111 - protein, 8 aa, Cryptosporidium hominis
HNQPNDNG

SEQ ID NO: 2114112 - protein, 4 aa, Cryptosporidium hominis
HNSF

SEQ ID NO: 2114113 - protein, 15 aa, Cryptosporidium hominis
HNSPESPSPLAALSN

SEQ ID NO: 2114114 - protein, 9 aa, Cryptosporidium hominis
HNSSHVSDR

SEQ ID NO: 2114115 - protein, 12 aa, Cryptosporidium hominis
HNSSSMSESSEL

SEQ ID NO: 2114116 - protein, 7 aa, Cryptosporidium hominis
HNTDQNK

SEQ ID NO: 2114117 - protein, 4 aa, Cryptosporidium hominis
HNTS

SEQ ID NO: 2114118 - protein, 9 aa, Cryptosporidium hominis
HNTSNTIDH

SEQ ID NO: 2114119 - protein, 12 aa, Cryptosporidium hominis
HPDKNPNDPTAA

SEQ ID NO: 2114120 - protein, 4 aa, Cryptosporidium hominis
HPEF

SEQ ID NO: 2114121 - protein, 4 aa, Cryptosporidium hominis
HPEK

SEQ ID NO: 2114122 - protein, 25 aa, Cryptosporidium hominis
HPENFSDEDIESSNNQLNNSNEVSN

SEQ ID NO: 2114123 - protein, 4 aa, Cryptosporidium hominis
HPGR

SEQ ID NO: 2114124 - protein, 11 aa, Cryptosporidium hominis
HPGSCNPSGTV

SEQ ID NO: 2114125 - protein, 6 aa, Cryptosporidium hominis
HPGSSE

SEQ ID NO: 2114126 - protein, 4 aa, Cryptosporidium hominis
HPNS

SEQ ID NO: 2114127 - protein, 4 aa, Cryptosporidium hominis
HPTI

SEQ ID NO: 2114128 - protein, 5 aa, Cryptosporidium hominis
HPTIK

SEQ ID NO: 2114129 - protein, 12 aa, Cryptosporidium hominis
HPTSKISKNNSV

SEQ ID NO: 2114130 - protein, 6 aa, Cryptosporidium hominis
HPVGPF

SEQ ID NO: 2114131 - protein, 6 aa, Cryptosporidium hominis
HQGGKF

SEQ ID NO: 2114132 - protein, 7 aa, Cryptosporidium hominis
HQIETSK

SEQ ID NO: 2114133 - protein, 8 aa, Cryptosporidium hominis
HQKRKSRQ

SEQ ID NO: 2114134 - protein, 15 aa, Cryptosporidium hominis
HQNDQEKNKDNSNYK

SEQ ID NO: 2114135 - protein, 5 aa, Cryptosporidium hominis
HQSSA

SEQ ID NO: 2114136 - protein, 11 aa, Cryptosporidium hominis
HRADTKSKQMS

SEQ ID NO: 2114137 - protein, 14 aa, Cryptosporidium hominis
HRESNSDKNDHEKV

SEQ ID NO: 2114138 - protein, 7 aa, Cryptosporidium hominis
HRPPRNW

SEQ ID NO: 2114139 - protein, 22 aa, Cryptosporidium hominis
HRSKSKKMELKNERNEANNTFS

SEQ ID NO: 2114140 - protein, 9 aa, Cryptosporidium hominis
HSAVNRRGN

SEQ ID NO: 2114141 - protein, 10 aa, Cryptosporidium hominis
HSEQGEYEGY

SEQ ID NO: 2114142 - protein, 4 aa, Cryptosporidium hominis
HSGE

SEQ ID NO: 2114143 - protein, 15 aa, Cryptosporidium hominis
HSGHQKFKADTDLSS

SEQ ID NO: 2114144 - protein, 11 aa, Cryptosporidium hominis
HSGRASCSPFG

SEQ ID NO: 2114145 - protein, 6 aa, Cryptosporidium hominis
HSITSN

SEQ ID NO: 2114146 - protein, 8 aa, Cryptosporidium hominis
HSKNENIT

SEQ ID NO: 2114147 - protein, 9 aa, Cryptosporidium hominis
HSKSEPVNS

SEQ ID NO: 2114148 - protein, 5 aa, Cryptosporidium hominis
HSLGS

SEQ ID NO: 2114149 - protein, 4 aa, Cryptosporidium hominis
HSND

SEQ ID NO: 2114150 - protein, 11 aa, Cryptosporidium hominis
HSNIGSGIPHG

SEQ ID NO: 2114151 - protein, 4 aa, Cryptosporidium hominis
HSNN

SEQ ID NO: 2114152 - protein, 8 aa, Cryptosporidium hominis
HSNRKPLE

SEQ ID NO: 2114153 - protein, 14 aa, Cryptosporidium hominis
HSNSNNINSKVPDT

SEQ ID NO: 2114154 - protein, 4 aa, Cryptosporidium hominis
HSPI

SEQ ID NO: 2114155 - protein, 12 aa, Cryptosporidium hominis
HSPSKRSPNHQQ

SEQ ID NO: 2114156 - protein, 8 aa, Cryptosporidium hominis
HSPSSISK

SEQ ID NO: 2114157 - protein, 7 aa, Cryptosporidium hominis
HSQFDNN

SEQ ID NO: 2114158 - protein, 10 aa, Cryptosporidium hominis
HSQFSNSDSC

SEQ ID NO: 2114159 - protein, 28 aa, Cryptosporidium hominis
HSQRNNSSLNNLPAQSERKMSSETNRSN

SEQ ID NO: 2114160 - protein, 9 aa, Cryptosporidium hominis
HSRSENSIQ

SEQ ID NO: 2114161 - protein, 5 aa, Cryptosporidium hominis
HSSER

SEQ ID NO: 2114162 - protein, 14 aa, Cryptosporidium hominis
HSSTESQSSQIPNS

SEQ ID NO: 2114163 - protein, 9 aa, Cryptosporidium hominis
HSSYPKLDS

SEQ ID NO: 2114164 - protein, 5 aa, Cryptosporidium hominis
HSTGK

SEQ ID NO: 2114165 - protein, 7 aa, Cryptosporidium hominis
HSYSEHA

SEQ ID NO: 2114166 - protein, 7 aa, Cryptosporidium hominis
HTAENTN

SEQ ID NO: 2114167 - protein, 15 aa, Cryptosporidium hominis
HTEFGNEHDKNDLNE

SEQ ID NO: 2114168 - protein, 7 aa, Cryptosporidium hominis
HTNKAIK

SEQ ID NO: 2114169 - protein, 12 aa, Cryptosporidium hominis
HTNNKEVQENNT

SEQ ID NO: 2114170 - protein, 13 aa, Cryptosporidium hominis
HTPKSKRESFSDS

SEQ ID NO: 2114171 - protein, 4 aa, Cryptosporidium hominis
HTQT

SEQ ID NO: 2114172 - protein, 13 aa, Cryptosporidium hominis
HTRHNTDSNHMKD

SEQ ID NO: 2114173 - protein, 14 aa, Cryptosporidium hominis
HTRNSLESTSIIKK

SEQ ID NO: 2114174 - protein, 7 aa, Cryptosporidium hominis
HTSAGKT

SEQ ID NO: 2114175 - protein, 8 aa, Cryptosporidium hominis
HTSTASAA

SEQ ID NO: 2114176 - protein, 8 aa, Cryptosporidium hominis
HTTKSSKY

SEQ ID NO: 2114177 - protein, 15 aa, Cryptosporidium hominis
HTTNGYSSSPKNAQL

SEQ ID NO: 2114178 - protein, 17 aa, Cryptosporidium hominis
HTTNNNIKKKNDTEHIQ

SEQ ID NO: 2114179 - protein, 11 aa, Cryptosporidium hominis
HVNAGKGRRGT

SEQ ID NO: 2114180 - protein, 8 aa, Cryptosporidium hominis
HVNKGKTG

SEQ ID NO: 2114181 - protein, 8 aa, Cryptosporidium hominis
HYKGNEKV

SEQ ID NO: 2114182 - protein, 9 aa, Cryptosporidium hominis
HYNYETRST

SEQ ID NO: 2114183 - protein, 24 aa, Cryptosporidium hominis
HYPTGKLPIEEKNSMSNNDNLNTK

SEQ ID NO: 2114184 - protein, 8 aa, Cryptosporidium hominis
HYSSSDNE

SEQ ID NO: 2114185 - protein, 7 aa, Cryptosporidium hominis
IADQARM

SEQ ID NO: 2114186 - protein, 11 aa, Cryptosporidium hominis
IAEEEGKITTT

SEQ ID NO: 2114187 - protein, 9 aa, Cryptosporidium hominis
IAEGEEIQS

SEQ ID NO: 2114188 - protein, 11 aa, Cryptosporidium hominis
IAEPSRKSSKY

SEQ ID NO: 2114189 - protein, 4 aa, Cryptosporidium hominis
IAET

SEQ ID NO: 2114190 - protein, 10 aa, Cryptosporidium hominis
IAETENKSTF

SEQ ID NO: 2114191 - protein, 17 aa, Cryptosporidium hominis
IAKKTQVRRKTTTKSKQ

SEQ ID NO: 2114192 - protein, 4 aa, Cryptosporidium hominis
IANR

SEQ ID NO: 2114193 - protein, 5 aa, Cryptosporidium hominis
IAPEE

SEQ ID NO: 2114194 - protein, 9 aa, Cryptosporidium hominis
IAPKPKPKT

SEQ ID NO: 2114195 - protein, 7 aa, Cryptosporidium hominis
IAPNSSS

SEQ ID NO: 2114196 - protein, 16 aa, Cryptosporidium hominis
IAQNPNSGRNLNSTVR

SEQ ID NO: 2114197 - protein, 9 aa, Cryptosporidium hominis
IASKDEANY

SEQ ID NO: 2114198 - protein, 23 aa, Cryptosporidium hominis
IASNSNDINMKSPSTQTSSSSLT

SEQ ID NO: 2114199 - protein, 30 aa, Cryptosporidium hominis
IASQGEDKFSQKDSDDHQGSKISTNTDTQY

SEQ ID NO: 2114200 - protein, 9 aa, Cryptosporidium hominis
IASRANRAD

SEQ ID NO: 2114201 - protein, 6 aa, Cryptosporidium hominis
IASSNH

SEQ ID NO: 2114202 - protein, 21 aa, Cryptosporidium hominis
IATSPNTDCSNGNSGTPPRYS

SEQ ID NO: 2114203 - protein, 5 aa, Cryptosporidium hominis
IDDNI

SEQ ID NO: 2114204 - protein, 9 aa, Cryptosporidium hominis
IDDPNSGKK

SEQ ID NO: 2114205 - protein, 4 aa, Cryptosporidium hominis
IDED

SEQ ID NO: 2114206 - protein, 5 aa, Cryptosporidium hominis
IDEEF

SEQ ID NO: 2114207 - protein, 6 aa, Cryptosporidium hominis
IDEMKN

SEQ ID NO: 2114208 - protein, 15 aa, Cryptosporidium hominis
IDEPPLYSASSTDEE

SEQ ID NO: 2114209 - protein, 9 aa, Cryptosporidium hominis
IDGDGKLSV

SEQ ID NO: 2114210 - protein, 8 aa, Cryptosporidium hominis
IDGTSSAD

SEQ ID NO: 2114211 - protein, 5 aa, Cryptosporidium hominis
IDHPD

SEQ ID NO: 2114212 - protein, 5 aa, Cryptosporidium hominis
IDIND

SEQ ID NO: 2114213 - protein, 5 aa, Cryptosporidium hominis
IDKGN

SEQ ID NO: 2114214 - protein, 11 aa, Cryptosporidium hominis
IDKNDDSSTNS

SEQ ID NO: 2114215 - protein, 17 aa, Cryptosporidium hominis
IDKNKNKKEKGRRKRRL

SEQ ID NO: 2114216 - protein, 7 aa, Cryptosporidium hominis
IDNGTQK

SEQ ID NO: 2114217 - protein, 9 aa, Cryptosporidium hominis
IDNNRKDMN

SEQ ID NO: 2114218 - protein, 19 aa, Cryptosporidium hominis
IDSENDQKRINGELPGDQQ

SEQ ID NO: 2114219 - protein, 6 aa, Cryptosporidium hominis
IDSGIE

SEQ ID NO: 2114220 - protein, 4 aa, Cryptosporidium hominis
IDSK

SEQ ID NO: 2114221 - protein, 5 aa, Cryptosporidium hominis
IDSNI

SEQ ID NO: 2114222 - protein, 7 aa, Cryptosporidium hominis
IDSNKGH

SEQ ID NO: 2114223 - protein, 10 aa, Cryptosporidium hominis
IDSNNDGDVD

SEQ ID NO: 2114224 - protein, 9 aa, Cryptosporidium hominis
IDSPTGNED

SEQ ID NO: 2114225 - protein, 8 aa, Cryptosporidium hominis
IDSSEDYQ

SEQ ID NO: 2114226 - protein, 19 aa, Cryptosporidium hominis
IDSTGSFSRENTNERFNRL

SEQ ID NO: 2114227 - protein, 5 aa, Cryptosporidium hominis
IDTDE

SEQ ID NO: 2114228 - protein, 5 aa, Cryptosporidium hominis
IDTDN

SEQ ID NO: 2114229 - protein, 10 aa, Cryptosporidium hominis
IDTNQGQDTA

SEQ ID NO: 2114230 - protein, 8 aa, Cryptosporidium hominis
IDTNSTPW

SEQ ID NO: 2114231 - protein, 9 aa, Cryptosporidium hominis
IDYSDNRDL

SEQ ID NO: 2114232 - protein, 6 aa, Cryptosporidium hominis
IEAEKK

SEQ ID NO: 2114233 - protein, 13 aa, Cryptosporidium hominis
IEAREEKKLKENL

SEQ ID NO: 2114234 - protein, 12 aa, Cryptosporidium hominis
IEASKTKPQKIK

SEQ ID NO: 2114235 - protein, 6 aa, Cryptosporidium hominis
IEDDGA

SEQ ID NO: 2114236 - protein, 13 aa, Cryptosporidium hominis
IEDEQEYENGDSY

SEQ ID NO: 2114237 - protein, 4 aa, Cryptosporidium hominis
IEDH

SEQ ID NO: 2114238 - protein, 7 aa, Cryptosporidium hominis
IEDPPKS

SEQ ID NO: 2114239 - protein, 7 aa, Cryptosporidium hominis
IEDSSSG

SEQ ID NO: 2114240 - protein, 5 aa, Cryptosporidium hominis
IEDTQ

SEQ ID NO: 2114241 - protein, 4 aa, Cryptosporidium hominis
IEEA

SEQ ID NO: 2114242 - protein, 10 aa, Cryptosporidium hominis
IEEDDNPSAL

SEQ ID NO: 2114243 - protein, 14 aa, Cryptosporidium hominis
IEEGLPTGNNNENR

SEQ ID NO: 2114244 - protein, 12 aa, Cryptosporidium hominis
IEENDAIKTYTS

SEQ ID NO: 2114245 - protein, 14 aa, Cryptosporidium hominis
IEENENNNENNSLK

SEQ ID NO: 2114246 - protein, 5 aa, Cryptosporidium hominis
IEENS

SEQ ID NO: 2114247 - protein, 24 aa, Cryptosporidium hominis
IEENYNKDEGPVPEAECETNEQES

SEQ ID NO: 2114248 - protein, 7 aa, Cryptosporidium hominis
IEEPSSA

SEQ ID NO: 2114249 - protein, 62 aa, Cryptosporidium hominis
IEGEDDDLSNDDIVGDDDLTSDVDDVDDDDDDDDDDDDDDDDDDDDDDDDDDEGDDEDGMNF

SEQ ID NO: 2114250 - protein, 13 aa, Cryptosporidium hominis
IEGNSDKMESNEL

SEQ ID NO: 2114251 - protein, 7 aa, Cryptosporidium hominis
IEGNSQN

SEQ ID NO: 2114252 - protein, 6 aa, Cryptosporidium hominis
IEGPKK

SEQ ID NO: 2114253 - protein, 6 aa, Cryptosporidium hominis
IEGSNK

SEQ ID NO: 2114254 - protein, 19 aa, Cryptosporidium hominis
IEHEKSKLNPEDKNYERRL

SEQ ID NO: 2114255 - protein, 5 aa, Cryptosporidium hominis
IEHQN

SEQ ID NO: 2114256 - protein, 4 aa, Cryptosporidium hominis
IEIQ

SEQ ID NO: 2114257 - protein, 8 aa, Cryptosporidium hominis
IEKGKEVS

SEQ ID NO: 2114258 - protein, 21 aa, Cryptosporidium hominis
IEKSESKVEIENSPLSDSSDY

SEQ ID NO: 2114259 - protein, 13 aa, Cryptosporidium hominis
IELENSKDAEYRR

SEQ ID NO: 2114260 - protein, 17 aa, Cryptosporidium hominis
IEMSEGDIEKVNEKQGR

SEQ ID NO: 2114261 - protein, 7 aa, Cryptosporidium hominis
IENPEKL

SEQ ID NO: 2114262 - protein, 10 aa, Cryptosporidium hominis
IENSNRRANR

SEQ ID NO: 2114263 - protein, 22 aa, Cryptosporidium hominis
IENSPNYDSTKYNSQKDQSSTN

SEQ ID NO: 2114264 - protein, 14 aa, Cryptosporidium hominis
IENTEKGDEPREAE

SEQ ID NO: 2114265 - protein, 6 aa, Cryptosporidium hominis
IEPEQD

SEQ ID NO: 2114266 - protein, 6 aa, Cryptosporidium hominis
IEPERY

SEQ ID NO: 2114267 - protein, 16 aa, Cryptosporidium hominis
IEPSITSTETQSPNEA

SEQ ID NO: 2114268 - protein, 7 aa, Cryptosporidium hominis
IEQDSSS

SEQ ID NO: 2114269 - protein, 13 aa, Cryptosporidium hominis
IEQEKSRKDENNS

SEQ ID NO: 2114270 - protein, 15 aa, Cryptosporidium hominis
IERNPSNFRVESGDE

SEQ ID NO: 2114271 - protein, 5 aa, Cryptosporidium hominis
IERSN

SEQ ID NO: 2114272 - protein, 5 aa, Cryptosporidium hominis
IESEL

SEQ ID NO: 2114273 - protein, 6 aa, Cryptosporidium hominis
IESNAK

SEQ ID NO: 2114274 - protein, 9 aa, Cryptosporidium hominis
IESNKQNAF

SEQ ID NO: 2114275 - protein, 7 aa, Cryptosporidium hominis
IESNPAD

SEQ ID NO: 2114276 - protein, 8 aa, Cryptosporidium hominis
IESNPNIS

SEQ ID NO: 2114277 - protein, 7 aa, Cryptosporidium hominis
IESNPQS

SEQ ID NO: 2114278 - protein, 8 aa, Cryptosporidium hominis
IESQSKEE

SEQ ID NO: 2114279 - protein, 6 aa, Cryptosporidium hominis
IESSTP

SEQ ID NO: 2114280 - protein, 8 aa, Cryptosporidium hominis
IETANKQN

SEQ ID NO: 2114281 - protein, 8 aa, Cryptosporidium hominis
IETQGESV

SEQ ID NO: 2114282 - protein, 18 aa, Cryptosporidium hominis
IETSDLNSSPYSDSQSNH

SEQ ID NO: 2114283 - protein, 14 aa, Cryptosporidium hominis
IGANKNGENSSSNE

SEQ ID NO: 2114284 - protein, 5 aa, Cryptosporidium hominis
IGASY

SEQ ID NO: 2114285 - protein, 11 aa, Cryptosporidium hominis
IGAYGKDIGTN

SEQ ID NO: 2114286 - protein, 4 aa, Cryptosporidium hominis
IGDA

SEQ ID NO: 2114287 - protein, 6 aa, Cryptosporidium hominis
IGEDDS

SEQ ID NO: 2114288 - protein, 5 aa, Cryptosporidium hominis
IGEGS

SEQ ID NO: 2114289 - protein, 14 aa, Cryptosporidium hominis
IGENRDQIKSSINR

SEQ ID NO: 2114290 - protein, 4 aa, Cryptosporidium hominis
IGES

SEQ ID NO: 2114291 - protein, 5 aa, Cryptosporidium hominis
IGESL

SEQ ID NO: 2114292 - protein, 12 aa, Cryptosporidium hominis
IGGANSSNSISL

SEQ ID NO: 2114293 - protein, 4 aa, Cryptosporidium hominis
IGGF

SEQ ID NO: 2114294 - protein, 8 aa, Cryptosporidium hominis
IGGGGNGY

SEQ ID NO: 2114295 - protein, 6 aa, Cryptosporidium hominis
IGGPQH

SEQ ID NO: 2114296 - protein, 9 aa, Cryptosporidium hominis
IGHRDHKGN

SEQ ID NO: 2114297 - protein, 14 aa, Cryptosporidium hominis
IGKENDEANSEEQF

SEQ ID NO: 2114298 - protein, 8 aa, Cryptosporidium hominis
IGKSTGYK

SEQ ID NO: 2114299 - protein, 4 aa, Cryptosporidium hominis
IGMN

SEQ ID NO: 2114300 - protein, 11 aa, Cryptosporidium hominis
IGNENDEKGIE

SEQ ID NO: 2114301 - protein, 17 aa, Cryptosporidium hominis
IGNESIKTNKDSISDTS

SEQ ID NO: 2114302 - protein, 5 aa, Cryptosporidium hominis
IGNPK

SEQ ID NO: 2114303 - protein, 6 aa, Cryptosporidium hominis
IGNRPN

SEQ ID NO: 2114304 - protein, 4 aa, Cryptosporidium hominis
IGPE

SEQ ID NO: 2114305 - protein, 12 aa, Cryptosporidium hominis
IGPSSTSNQENF

SEQ ID NO: 2114306 - protein, 7 aa, Cryptosporidium hominis
IGQSSSD

SEQ ID NO: 2114307 - protein, 9 aa, Cryptosporidium hominis
IGQSSSVSN

SEQ ID NO: 2114308 - protein, 10 aa, Cryptosporidium hominis
IGRDKEKAKR

SEQ ID NO: 2114309 - protein, 10 aa, Cryptosporidium hominis
IGRKKNKGYG

SEQ ID NO: 2114310 - protein, 10 aa, Cryptosporidium hominis
IGRNSGVEEV

SEQ ID NO: 2114311 - protein, 6 aa, Cryptosporidium hominis
IGRQDS

SEQ ID NO: 2114312 - protein, 7 aa, Cryptosporidium hominis
IGSGKTG

SEQ ID NO: 2114313 - protein, 10 aa, Cryptosporidium hominis
IGSGQELGFE

SEQ ID NO: 2114314 - protein, 5 aa, Cryptosporidium hominis
IGSPN

SEQ ID NO: 2114315 - protein, 15 aa, Cryptosporidium hominis
IGSQTSQRIENTNAA

SEQ ID NO: 2114316 - protein, 18 aa, Cryptosporidium hominis
IGSSDNLSRRQLSKSTTK

SEQ ID NO: 2114317 - protein, 7 aa, Cryptosporidium hominis
IGSSSNV

SEQ ID NO: 2114318 - protein, 5 aa, Cryptosporidium hominis
IGSTK

SEQ ID NO: 2114319 - protein, 12 aa, Cryptosporidium hominis
IGSVSNKTYGSY

SEQ ID NO: 2114320 - protein, 5 aa, Cryptosporidium hominis
IGTAG

SEQ ID NO: 2114321 - protein, 6 aa, Cryptosporidium hominis
IGTNNK

SEQ ID NO: 2114322 - protein, 5 aa, Cryptosporidium hominis
IGTNQ

SEQ ID NO: 2114323 - protein, 7 aa, Cryptosporidium hominis
IGTSSQA

SEQ ID NO: 2114324 - protein, 14 aa, Cryptosporidium hominis
IGVGNGNDQLEDDQ

SEQ ID NO: 2114325 - protein, 12 aa, Cryptosporidium hominis
IGVTEDNPDEYD

SEQ ID NO: 2114326 - protein, 6 aa, Cryptosporidium hominis
IHGGDL

SEQ ID NO: 2114327 - protein, 8 aa, Cryptosporidium hominis
IHNNNSSK

SEQ ID NO: 2114328 - protein, 6 aa, Cryptosporidium hominis
IHPNSS

SEQ ID NO: 2114329 - protein, 11 aa, Cryptosporidium hominis
IIESSNSNTLI

SEQ ID NO: 2114330 - protein, 9 aa, Cryptosporidium hominis
IKAPGTQIG

SEQ ID NO: 2114331 - protein, 15 aa, Cryptosporidium hominis
IKAQTAGITASSDSF

SEQ ID NO: 2114332 - protein, 6 aa, Cryptosporidium hominis
IKDEKI

SEQ ID NO: 2114333 - protein, 31 aa, Cryptosporidium hominis
IKDGEKVKIGKQGPVTLDDPDENKKGKTIPP

SEQ ID NO: 2114334 - protein, 4 aa, Cryptosporidium hominis
IKDS

SEQ ID NO: 2114335 - protein, 19 aa, Cryptosporidium hominis
IKEKPKLNFKTTSKGRWSE

SEQ ID NO: 2114336 - protein, 8 aa, Cryptosporidium hominis
IKENEPNI

SEQ ID NO: 2114337 - protein, 8 aa, Cryptosporidium hominis
IKERDDNI

SEQ ID NO: 2114338 - protein, 9 aa, Cryptosporidium hominis
IKERPETLS

SEQ ID NO: 2114339 - protein, 4 aa, Cryptosporidium hominis
IKES

SEQ ID NO: 2114340 - protein, 9 aa, Cryptosporidium hominis
IKESDESFS

SEQ ID NO: 2114341 - protein, 6 aa, Cryptosporidium hominis
IKEYEE

SEQ ID NO: 2114342 - protein, 4 aa, Cryptosporidium hominis
IKGH

SEQ ID NO: 2114343 - protein, 5 aa, Cryptosporidium hominis
IKGKE

SEQ ID NO: 2114344 - protein, 7 aa, Cryptosporidium hominis
IKGKNSG

SEQ ID NO: 2114345 - protein, 21 aa, Cryptosporidium hominis
IKGSTNRDFENTNSEGSRKQS

SEQ ID NO: 2114346 - protein, 7 aa, Cryptosporidium hominis
IKGTASR

SEQ ID NO: 2114347 - protein, 9 aa, Cryptosporidium hominis
IKHKSTDNQ

SEQ ID NO: 2114348 - protein, 15 aa, Cryptosporidium hominis
IKKEEEEEEEEEDPR

SEQ ID NO: 2114349 - protein, 13 aa, Cryptosporidium hominis
IKKKPQKVTSDQD

SEQ ID NO: 2114350 - protein, 10 aa, Cryptosporidium hominis
IKKNDSLYED

SEQ ID NO: 2114351 - protein, 24 aa, Cryptosporidium hominis
IKKNSNERFNSTQNEISANTKEWA

SEQ ID NO: 2114352 - protein, 10 aa, Cryptosporidium hominis
IKKPDSNTTR

SEQ ID NO: 2114353 - protein, 24 aa, Cryptosporidium hominis
IKKQNGLEVTNRSSNNHTNNYGNN

SEQ ID NO: 2114354 - protein, 10 aa, Cryptosporidium hominis
IKKSKTINVS

SEQ ID NO: 2114355 - protein, 9 aa, Cryptosporidium hominis
IKKSTDPSK

SEQ ID NO: 2114356 - protein, 17 aa, Cryptosporidium hominis
IKKTGKKTSAKNRSKSI

SEQ ID NO: 2114357 - protein, 11 aa, Cryptosporidium hominis
IKKTSKDGSLT

SEQ ID NO: 2114358 - protein, 10 aa, Cryptosporidium hominis
IKNEESENKK

SEQ ID NO: 2114359 - protein, 10 aa, Cryptosporidium hominis
IKNETSSTNI

SEQ ID NO: 2114360 - protein, 7 aa, Cryptosporidium hominis
IKNRKYQ

SEQ ID NO: 2114361 - protein, 19 aa, Cryptosporidium hominis
IKNTKDNEIDSEKKYSNVS

SEQ ID NO: 2114362 - protein, 5 aa, Cryptosporidium hominis
IKPGD

SEQ ID NO: 2114363 - protein, 8 aa, Cryptosporidium hominis
IKRDPGAY

SEQ ID NO: 2114364 - protein, 7 aa, Cryptosporidium hominis
IKSEHSE

SEQ ID NO: 2114365 - protein, 12 aa, Cryptosporidium hominis
IKSGPNNNFRDS

SEQ ID NO: 2114366 - protein, 36 aa, Cryptosporidium hominis
IKSNNYNSRIGSGSNLSQRQRSNSNNYISAGQDNVS

SEQ ID NO: 2114367 - protein, 9 aa, Cryptosporidium hominis
IKSQSSTTS

SEQ ID NO: 2114368 - protein, 19 aa, Cryptosporidium hominis
IKSSTVRNTNTTSDKNIHS

SEQ ID NO: 2114369 - protein, 9 aa, Cryptosporidium hominis
IKSTKKDIL

SEQ ID NO: 2114370 - protein, 7 aa, Cryptosporidium hominis
IKTANNL

SEQ ID NO: 2114371 - protein, 9 aa, Cryptosporidium hominis
IKTGSSSDI

SEQ ID NO: 2114372 - protein, 20 aa, Cryptosporidium hominis
IKTINPNQVTSNGKSNPDLK

SEQ ID NO: 2114373 - protein, 15 aa, Cryptosporidium hominis
IKTNGYEYKNKEELD

SEQ ID NO: 2114374 - protein, 7 aa, Cryptosporidium hominis
IKTSGVP

SEQ ID NO: 2114375 - protein, 6 aa, Cryptosporidium hominis
IKTTTD

SEQ ID NO: 2114376 - protein, 9 aa, Cryptosporidium hominis
ILDGGRGKY

SEQ ID NO: 2114377 - protein, 17 aa, Cryptosporidium hominis
ILEQDTDTHWNSSDGTA

SEQ ID NO: 2114378 - protein, 4 aa, Cryptosporidium hominis
ILES

SEQ ID NO: 2114379 - protein, 7 aa, Cryptosporidium hominis
ILGPNDA

SEQ ID NO: 2114380 - protein, 5 aa, Cryptosporidium hominis
ILSSS

SEQ ID NO: 2114381 - protein, 4 aa, Cryptosporidium hominis
INDP

SEQ ID NO: 2114382 - protein, 9 aa, Cryptosporidium hominis
INDRNTYHG

SEQ ID NO: 2114383 - protein, 8 aa, Cryptosporidium hominis
INDSNNSF

SEQ ID NO: 2114384 - protein, 15 aa, Cryptosporidium hominis
INEAKSGYNRKNNKN

SEQ ID NO: 2114385 - protein, 11 aa, Cryptosporidium hominis
INEENSEAAEK

SEQ ID NO: 2114386 - protein, 6 aa, Cryptosporidium hominis
INEKSY

SEQ ID NO: 2114387 - protein, 7 aa, Cryptosporidium hominis
INEPTRY

SEQ ID NO: 2114388 - protein, 4 aa, Cryptosporidium hominis
INES

SEQ ID NO: 2114389 - protein, 7 aa, Cryptosporidium hominis
INETPTL

SEQ ID NO: 2114390 - protein, 6 aa, Cryptosporidium hominis
INGDSS

SEQ ID NO: 2114391 - protein, 9 aa, Cryptosporidium hominis
INGEGGGSD

SEQ ID NO: 2114392 - protein, 18 aa, Cryptosporidium hominis
INGNDSNIEGSITESTCE

SEQ ID NO: 2114393 - protein, 5 aa, Cryptosporidium hominis
INGPT

SEQ ID NO: 2114394 - protein, 6 aa, Cryptosporidium hominis
INGSTS

SEQ ID NO: 2114395 - protein, 15 aa, Cryptosporidium hominis
INISSTNSSTQAPLN

SEQ ID NO: 2114396 - protein, 9 aa, Cryptosporidium hominis
INKANESSI

SEQ ID NO: 2114397 - protein, 6 aa, Cryptosporidium hominis
INKGAT

SEQ ID NO: 2114398 - protein, 4 aa, Cryptosporidium hominis
INKI

SEQ ID NO: 2114399 - protein, 14 aa, Cryptosporidium hominis
INKKKQTKNYKNKK

SEQ ID NO: 2114400 - protein, 9 aa, Cryptosporidium hominis
INKKSKKGV

SEQ ID NO: 2114401 - protein, 7 aa, Cryptosporidium hominis
INKLDPK

SEQ ID NO: 2114402 - protein, 11 aa, Cryptosporidium hominis
INKLSSESKRE

SEQ ID NO: 2114403 - protein, 31 aa, Cryptosporidium hominis
INKNSTLSSKKARVNLSENDNGLRAELGKSS

SEQ ID NO: 2114404 - protein, 10 aa, Cryptosporidium hominis
INKYSDTYES

SEQ ID NO: 2114405 - protein, 8 aa, Cryptosporidium hominis
INNEKNHE

SEQ ID NO: 2114406 - protein, 7 aa, Cryptosporidium hominis
INNISDS

SEQ ID NO: 2114407 - protein, 9 aa, Cryptosporidium hominis
INNKSINSH

SEQ ID NO: 2114408 - protein, 5 aa, Cryptosporidium hominis
INNLS

SEQ ID NO: 2114409 - protein, 13 aa, Cryptosporidium hominis
INNNLSNNSTINS

SEQ ID NO: 2114410 - protein, 25 aa, Cryptosporidium hominis
INNNNNNLSTLNSTPDNKCNQPAPA

SEQ ID NO: 2114411 - protein, 12 aa, Cryptosporidium hominis
INNNNNNNNNNI

SEQ ID NO: 2114412 - protein, 15 aa, Cryptosporidium hominis
INNNSDSDTYTDTNI

SEQ ID NO: 2114413 - protein, 4 aa, Cryptosporidium hominis
INNP

SEQ ID NO: 2114414 - protein, 6 aa, Cryptosporidium hominis
INNQRE

SEQ ID NO: 2114415 - protein, 10 aa, Cryptosporidium hominis
INPKTSSSSM

SEQ ID NO: 2114416 - protein, 4 aa, Cryptosporidium hominis
INPN

SEQ ID NO: 2114417 - protein, 5 aa, Cryptosporidium hominis
INPPI

SEQ ID NO: 2114418 - protein, 13 aa, Cryptosporidium hominis
INPRDNYQKPISE

SEQ ID NO: 2114419 - protein, 7 aa, Cryptosporidium hominis
INPTSTN

SEQ ID NO: 2114420 - protein, 18 aa, Cryptosporidium hominis
INQEEEEIQTEEEPERDY

SEQ ID NO: 2114421 - protein, 36 aa, Cryptosporidium hominis
INQHEETTEDDTNASGFTSKPRKNKKIKSSEISGHG

SEQ ID NO: 2114422 - protein, 7 aa, Cryptosporidium hominis
INQKTES

SEQ ID NO: 2114423 - protein, 4 aa, Cryptosporidium hominis
INQP

SEQ ID NO: 2114424 - protein, 26 aa, Cryptosporidium hominis
INQPDFKSKDKKKEGKNEEEKTEEKK

SEQ ID NO: 2114425 - protein, 7 aa, Cryptosporidium hominis
INQPSDS

SEQ ID NO: 2114426 - protein, 9 aa, Cryptosporidium hominis
INQQGEFEN

SEQ ID NO: 2114427 - protein, 14 aa, Cryptosporidium hominis
INRKREKSKSDQEH

SEQ ID NO: 2114428 - protein, 9 aa, Cryptosporidium hominis
INSDGPGPI

SEQ ID NO: 2114429 - protein, 10 aa, Cryptosporidium hominis
INSDKNMKSV

SEQ ID NO: 2114430 - protein, 6 aa, Cryptosporidium hominis
INSENF

SEQ ID NO: 2114431 - protein, 8 aa, Cryptosporidium hominis
INSGPIGR

SEQ ID NO: 2114432 - protein, 27 aa, Cryptosporidium hominis
INSISSSVTTSSINDQSVGKSASRSIS

SEQ ID NO: 2114433 - protein, 11 aa, Cryptosporidium hominis
INSKDECNPIS

SEQ ID NO: 2114434 - protein, 10 aa, Cryptosporidium hominis
INSKKSNENI

SEQ ID NO: 2114435 - protein, 15 aa, Cryptosporidium hominis
INSNSESDSDETELD

SEQ ID NO: 2114436 - protein, 12 aa, Cryptosporidium hominis
INSNSKKEVKHK

SEQ ID NO: 2114437 - protein, 7 aa, Cryptosporidium hominis
INSPSSF

SEQ ID NO: 2114438 - protein, 6 aa, Cryptosporidium hominis
INSREA

SEQ ID NO: 2114439 - protein, 9 aa, Cryptosporidium hominis
INSRGNAGL

SEQ ID NO: 2114440 - protein, 13 aa, Cryptosporidium hominis
INSSDTPCEKGNY

SEQ ID NO: 2114441 - protein, 25 aa, Cryptosporidium hominis
INSSGNSNNHGSGSGNNNSNSHTNN

SEQ ID NO: 2114442 - protein, 11 aa, Cryptosporidium hominis
INSSKIEQRME

SEQ ID NO: 2114443 - protein, 5 aa, Cryptosporidium hominis
INSSP

SEQ ID NO: 2114444 - protein, 14 aa, Cryptosporidium hominis
INSTKSISSNSGAF

SEQ ID NO: 2114445 - protein, 12 aa, Cryptosporidium hominis
INSTNPHKDSSF

SEQ ID NO: 2114446 - protein, 14 aa, Cryptosporidium hominis
INSTSNSKNGNNDL

SEQ ID NO: 2114447 - protein, 8 aa, Cryptosporidium hominis
INTENSPM

SEQ ID NO: 2114448 - protein, 18 aa, Cryptosporidium hominis
INTKPNNFRGNNDSPSNA

SEQ ID NO: 2114449 - protein, 19 aa, Cryptosporidium hominis
INTNNSNSEETEKNKDQEI

SEQ ID NO: 2114450 - protein, 11 aa, Cryptosporidium hominis
INTNTKTAGIS

SEQ ID NO: 2114451 - protein, 6 aa, Cryptosporidium hominis
INTPKS

SEQ ID NO: 2114452 - protein, 18 aa, Cryptosporidium hominis
INTPSTNLDYSPGTQHFI

SEQ ID NO: 2114453 - protein, 8 aa, Cryptosporidium hominis
INTTSGSF

SEQ ID NO: 2114454 - protein, 152 aa, Cryptosporidium hominis
INTTTTPTAKSTTTTATTTSTTTTTTTTKPTTTTTTTTTTTTTTTTTTTTTTTTTTTTTTTTTTTTTTTSTTTTTTTTTTTTTKPTTTTTTNTSTTTTTTTTITTKPNTTTTTSTIKPTTTSTTTTKKPNTTTTKSNTTTAKTTNTSTNITY

SEQ ID NO: 2114455 - protein, 12 aa, Cryptosporidium hominis
IPAKGKKAISTA

SEQ ID NO: 2114456 - protein, 4 aa, Cryptosporidium hominis
IPAP

SEQ ID NO: 2114457 - protein, 8 aa, Cryptosporidium hominis
IPASDNKP

SEQ ID NO: 2114458 - protein, 12 aa, Cryptosporidium hominis
IPDNTGSKFTSR

SEQ ID NO: 2114459 - protein, 12 aa, Cryptosporidium hominis
IPDSEKDSPTYQ

SEQ ID NO: 2114460 - protein, 5 aa, Cryptosporidium hominis
IPEDS

SEQ ID NO: 2114461 - protein, 10 aa, Cryptosporidium hominis
IPEGKQQEVG

SEQ ID NO: 2114462 - protein, 27 aa, Cryptosporidium hominis
IPERPRSSIPREASGNKEGNSSINTEE

SEQ ID NO: 2114463 - protein, 14 aa, Cryptosporidium hominis
IPESDDENFKKTKN

SEQ ID NO: 2114464 - protein, 5 aa, Cryptosporidium hominis
IPESQ

SEQ ID NO: 2114465 - protein, 6 aa, Cryptosporidium hominis
IPETGK

SEQ ID NO: 2114466 - protein, 18 aa, Cryptosporidium hominis
IPETNSSISLKKENRKMG

SEQ ID NO: 2114467 - protein, 8 aa, Cryptosporidium hominis
IPGESTNN

SEQ ID NO: 2114468 - protein, 17 aa, Cryptosporidium hominis
IPGGGTSGSPTSPGSPI

SEQ ID NO: 2114469 - protein, 5 aa, Cryptosporidium hominis
IPGND

SEQ ID NO: 2114470 - protein, 5 aa, Cryptosporidium hominis
IPIGN

SEQ ID NO: 2114471 - protein, 4 aa, Cryptosporidium hominis
IPIP

SEQ ID NO: 2114472 - protein, 4 aa, Cryptosporidium hominis
IPKE

SEQ ID NO: 2114473 - protein, 10 aa, Cryptosporidium hominis
IPKNSSNNHE

SEQ ID NO: 2114474 - protein, 12 aa, Cryptosporidium hominis
IPKSESGINSSN

SEQ ID NO: 2114475 - protein, 9 aa, Cryptosporidium hominis
IPKSPESKL

SEQ ID NO: 2114476 - protein, 4 aa, Cryptosporidium hominis
IPNE

SEQ ID NO: 2114477 - protein, 13 aa, Cryptosporidium hominis
IPNESKSSRDDEV

SEQ ID NO: 2114478 - protein, 8 aa, Cryptosporidium hominis
IPNKNNNL

SEQ ID NO: 2114479 - protein, 8 aa, Cryptosporidium hominis
IPNKSCGR

SEQ ID NO: 2114480 - protein, 36 aa, Cryptosporidium hominis
IPNNDETSYQENASGQFSQNLSNRNDHSSKEVDSTI

SEQ ID NO: 2114481 - protein, 9 aa, Cryptosporidium hominis
IPNSPSNYQ

SEQ ID NO: 2114482 - protein, 15 aa, Cryptosporidium hominis
IPNSSSSSSPDESYS

SEQ ID NO: 2114483 - protein, 6 aa, Cryptosporidium hominis
IPNTSF

SEQ ID NO: 2114484 - protein, 6 aa, Cryptosporidium hominis
IPPDDR

SEQ ID NO: 2114485 - protein, 8 aa, Cryptosporidium hominis
IPPKPENE

SEQ ID NO: 2114486 - protein, 8 aa, Cryptosporidium hominis
IPPKPESL

SEQ ID NO: 2114487 - protein, 4 aa, Cryptosporidium hominis
IPPM

SEQ ID NO: 2114488 - protein, 5 aa, Cryptosporidium hominis
IPPPK

SEQ ID NO: 2114489 - protein, 11 aa, Cryptosporidium hominis
IPPPPRGTNFP

SEQ ID NO: 2114490 - protein, 6 aa, Cryptosporidium hominis
IPPPQP

SEQ ID NO: 2114491 - protein, 10 aa, Cryptosporidium hominis
IPPPVDSIDA

SEQ ID NO: 2114492 - protein, 6 aa, Cryptosporidium hominis
IPPSNQ

SEQ ID NO: 2114493 - protein, 6 aa, Cryptosporidium hominis
IPPSRG

SEQ ID NO: 2114494 - protein, 9 aa, Cryptosporidium hominis
IPPTASSTD

SEQ ID NO: 2114495 - protein, 11 aa, Cryptosporidium hominis
IPQHQQQPQSM

SEQ ID NO: 2114496 - protein, 11 aa, Cryptosporidium hominis
IPQNISPESQV

SEQ ID NO: 2114497 - protein, 10 aa, Cryptosporidium hominis
IPRSAKLPQP

SEQ ID NO: 2114498 - protein, 7 aa, Cryptosporidium hominis
IPSEEEC

SEQ ID NO: 2114499 - protein, 19 aa, Cryptosporidium hominis
IPSGNEQNLKEVEPKLSSG

SEQ ID NO: 2114500 - protein, 19 aa, Cryptosporidium hominis
IPSNKSSKTYLKDSENNQK

SEQ ID NO: 2114501 - protein, 14 aa, Cryptosporidium hominis
IPSTQISLPLHLGK

SEQ ID NO: 2114502 - protein, 5 aa, Cryptosporidium hominis
IPSTR

SEQ ID NO: 2114503 - protein, 4 aa, Cryptosporidium hominis
IPVD

SEQ ID NO: 2114504 - protein, 5 aa, Cryptosporidium hominis
IPYNN

SEQ ID NO: 2114505 - protein, 19 aa, Cryptosporidium hominis
IPYSKENISTAKSNPDKEY

SEQ ID NO: 2114506 - protein, 8 aa, Cryptosporidium hominis
IQAGQSKE

SEQ ID NO: 2114507 - protein, 11 aa, Cryptosporidium hominis
IQDQKGENPSI

SEQ ID NO: 2114508 - protein, 11 aa, Cryptosporidium hominis
IQEDEKPIQPS

SEQ ID NO: 2114509 - protein, 9 aa, Cryptosporidium hominis
IQEKDSKNI

SEQ ID NO: 2114510 - protein, 4 aa, Cryptosporidium hominis
IQES

SEQ ID NO: 2114511 - protein, 5 aa, Cryptosporidium hominis
IQESS

SEQ ID NO: 2114512 - protein, 9 aa, Cryptosporidium hominis
IQGEPTEGA

SEQ ID NO: 2114513 - protein, 4 aa, Cryptosporidium hominis
IQGG

SEQ ID NO: 2114514 - protein, 12 aa, Cryptosporidium hominis
IQGGESSSIIPT

SEQ ID NO: 2114515 - protein, 7 aa, Cryptosporidium hominis
IQGGSTV

SEQ ID NO: 2114516 - protein, 9 aa, Cryptosporidium hominis
IQGSRKGSA

SEQ ID NO: 2114517 - protein, 8 aa, Cryptosporidium hominis
IQKDNTGL

SEQ ID NO: 2114518 - protein, 6 aa, Cryptosporidium hominis
IQKEPS

SEQ ID NO: 2114519 - protein, 15 aa, Cryptosporidium hominis
IQKQTVDGEDSESLI

SEQ ID NO: 2114520 - protein, 4 aa, Cryptosporidium hominis
IQKY

SEQ ID NO: 2114521 - protein, 4 aa, Cryptosporidium hominis
IQMD

SEQ ID NO: 2114522 - protein, 9 aa, Cryptosporidium hominis
IQNEDSNPN

SEQ ID NO: 2114523 - protein, 12 aa, Cryptosporidium hominis
IQNEEGGGASLS

SEQ ID NO: 2114524 - protein, 8 aa, Cryptosporidium hominis
IQNKTDNE

SEQ ID NO: 2114525 - protein, 7 aa, Cryptosporidium hominis
IQNPDAT

SEQ ID NO: 2114526 - protein, 6 aa, Cryptosporidium hominis
IQNPIE

SEQ ID NO: 2114527 - protein, 6 aa, Cryptosporidium hominis
IQNQEY

SEQ ID NO: 2114528 - protein, 18 aa, Cryptosporidium hominis
IQNQQQKLRSSTSLEHGN

SEQ ID NO: 2114529 - protein, 17 aa, Cryptosporidium hominis
IQNQTVQSSMATKSSNT

SEQ ID NO: 2114530 - protein, 5 aa, Cryptosporidium hominis
IQPYQ

SEQ ID NO: 2114531 - protein, 7 aa, Cryptosporidium hominis
IQQGERY

SEQ ID NO: 2114532 - protein, 7 aa, Cryptosporidium hominis
IQQSGGV

SEQ ID NO: 2114533 - protein, 39 aa, Cryptosporidium hominis
IQSGNSLSKSSYDGNKRLSDTFKQTNSFSGSGSTEISGL

SEQ ID NO: 2114534 - protein, 16 aa, Cryptosporidium hominis
IQSPSEKRYSKGSKHI

SEQ ID NO: 2114535 - protein, 5 aa, Cryptosporidium hominis
IQSRN

SEQ ID NO: 2114536 - protein, 15 aa, Cryptosporidium hominis
IQTKGYNSLKTEKDG

SEQ ID NO: 2114537 - protein, 33 aa, Cryptosporidium hominis
IQTKNSSGVGGFSSNLNNQDLSSGLGNSTTYNK

SEQ ID NO: 2114538 - protein, 19 aa, Cryptosporidium hominis
IQTPGQESKEGDQTQNTPY

SEQ ID NO: 2114539 - protein, 5 aa, Cryptosporidium hominis
IRDNK

SEQ ID NO: 2114540 - protein, 36 aa, Cryptosporidium hominis
IREERKKALNQKSNKSNESNNKVKDSQDNLDQPNKG

SEQ ID NO: 2114541 - protein, 10 aa, Cryptosporidium hominis
IREKNKVKNW

SEQ ID NO: 2114542 - protein, 9 aa, Cryptosporidium hominis
IRESEKKTI

SEQ ID NO: 2114543 - protein, 4 aa, Cryptosporidium hominis
IRGT

SEQ ID NO: 2114544 - protein, 8 aa, Cryptosporidium hominis
IRKQQEEM

SEQ ID NO: 2114545 - protein, 7 aa, Cryptosporidium hominis
IRNARSK

SEQ ID NO: 2114546 - protein, 6 aa, Cryptosporidium hominis
IRNQKN

SEQ ID NO: 2114547 - protein, 14 aa, Cryptosporidium hominis
IRPENSDLESERKS

SEQ ID NO: 2114548 - protein, 6 aa, Cryptosporidium hominis
IRPESM

SEQ ID NO: 2114549 - protein, 29 aa, Cryptosporidium hominis
IRRNKGKNTNINHNTQTHPDPTSNPQNNW

SEQ ID NO: 2114550 - protein, 16 aa, Cryptosporidium hominis
IRRQSRALSEDTDQLE

SEQ ID NO: 2114551 - protein, 5 aa, Cryptosporidium hominis
IRRSD

SEQ ID NO: 2114552 - protein, 17 aa, Cryptosporidium hominis
IRSDKLQKSSETPTELQ

SEQ ID NO: 2114553 - protein, 15 aa, Cryptosporidium hominis
IRSPKNEEIVNTTNK

SEQ ID NO: 2114554 - protein, 9 aa, Cryptosporidium hominis
IRSSKSSEY

SEQ ID NO: 2114555 - protein, 10 aa, Cryptosporidium hominis
IRTEKKNVPE

SEQ ID NO: 2114556 - protein, 4 aa, Cryptosporidium hominis
IRTP

SEQ ID NO: 2114557 - protein, 11 aa, Cryptosporidium hominis
IRTSPRKRRPS

SEQ ID NO: 2114558 - protein, 11 aa, Cryptosporidium hominis
IRTTPKQTAVS

SEQ ID NO: 2114559 - protein, 7 aa, Cryptosporidium hominis
ISAPTNI

SEQ ID NO: 2114560 - protein, 12 aa, Cryptosporidium hominis
ISASGQLGRGDS

SEQ ID NO: 2114561 - protein, 5 aa, Cryptosporidium hominis
ISASI

SEQ ID NO: 2114562 - protein, 22 aa, Cryptosporidium hominis
ISDDEEQDYGEFDNNANNKRNV

SEQ ID NO: 2114563 - protein, 4 aa, Cryptosporidium hominis
ISDE

SEQ ID NO: 2114564 - protein, 10 aa, Cryptosporidium hominis
ISDNEAKNEY

SEQ ID NO: 2114565 - protein, 6 aa, Cryptosporidium hominis
ISDPGL

SEQ ID NO: 2114566 - protein, 8 aa, Cryptosporidium hominis
ISDQSISS

SEQ ID NO: 2114567 - protein, 4 aa, Cryptosporidium hominis
ISDS

SEQ ID NO: 2114568 - protein, 9 aa, Cryptosporidium hominis
ISDSENSTI

SEQ ID NO: 2114569 - protein, 17 aa, Cryptosporidium hominis
ISDSNPVGKGREPPNVD

SEQ ID NO: 2114570 - protein, 7 aa, Cryptosporidium hominis
ISEASGR

SEQ ID NO: 2114571 - protein, 7 aa, Cryptosporidium hominis
ISEDTKP

SEQ ID NO: 2114572 - protein, 7 aa, Cryptosporidium hominis
ISEKESL

SEQ ID NO: 2114573 - protein, 17 aa, Cryptosporidium hominis
ISEKNGIEQKRHSKRKV

SEQ ID NO: 2114574 - protein, 24 aa, Cryptosporidium hominis
ISEKQDSRKSNTKPFGAKNQSREK

SEQ ID NO: 2114575 - protein, 6 aa, Cryptosporidium hominis
ISEKQK

SEQ ID NO: 2114576 - protein, 6 aa, Cryptosporidium hominis
ISEKSE

SEQ ID NO: 2114577 - protein, 10 aa, Cryptosporidium hominis
ISENKNSNTI

SEQ ID NO: 2114578 - protein, 5 aa, Cryptosporidium hominis
ISEQV

SEQ ID NO: 2114579 - protein, 9 aa, Cryptosporidium hominis
ISERTSNTN

SEQ ID NO: 2114580 - protein, 4 aa, Cryptosporidium hominis
ISES

SEQ ID NO: 2114581 - protein, 5 aa, Cryptosporidium hominis
ISESD

SEQ ID NO: 2114582 - protein, 11 aa, Cryptosporidium hominis
ISESDQNEVNA

SEQ ID NO: 2114583 - protein, 17 aa, Cryptosporidium hominis
ISESESESEIQKKKKIR

SEQ ID NO: 2114584 - protein, 11 aa, Cryptosporidium hominis
ISETSENLNRS

SEQ ID NO: 2114585 - protein, 5 aa, Cryptosporidium hominis
ISEYY

SEQ ID NO: 2114586 - protein, 13 aa, Cryptosporidium hominis
ISGNKSLSVEELH

SEQ ID NO: 2114587 - protein, 5 aa, Cryptosporidium hominis
ISGVV

SEQ ID NO: 2114588 - protein, 5 aa, Cryptosporidium hominis
ISHSE

SEQ ID NO: 2114589 - protein, 9 aa, Cryptosporidium hominis
ISISEKKNK

SEQ ID NO: 2114590 - protein, 16 aa, Cryptosporidium hominis
ISKAAKEGVQLKGIDL

SEQ ID NO: 2114591 - protein, 10 aa, Cryptosporidium hominis
ISKEEYENAK

SEQ ID NO: 2114592 - protein, 5 aa, Cryptosporidium hominis
ISKEQ

SEQ ID NO: 2114593 - protein, 4 aa, Cryptosporidium hominis
ISKG

SEQ ID NO: 2114594 - protein, 5 aa, Cryptosporidium hominis
ISKGN

SEQ ID NO: 2114595 - protein, 12 aa, Cryptosporidium hominis
ISKGVDKESWNT

SEQ ID NO: 2114596 - protein, 6 aa, Cryptosporidium hominis
ISKKTG

SEQ ID NO: 2114597 - protein, 17 aa, Cryptosporidium hominis
ISKNNSWNSREKRNFSN

SEQ ID NO: 2114598 - protein, 14 aa, Cryptosporidium hominis
ISKNSFKETKIPNY

SEQ ID NO: 2114599 - protein, 9 aa, Cryptosporidium hominis
ISNESRALQ

SEQ ID NO: 2114600 - protein, 4 aa, Cryptosporidium hominis
ISNI

SEQ ID NO: 2114601 - protein, 8 aa, Cryptosporidium hominis
ISNKNPVA

SEQ ID NO: 2114602 - protein, 6 aa, Cryptosporidium hominis
ISNLTG

SEQ ID NO: 2114603 - protein, 7 aa, Cryptosporidium hominis
ISNNDSE

SEQ ID NO: 2114604 - protein, 9 aa, Cryptosporidium hominis
ISNQNTYKS

SEQ ID NO: 2114605 - protein, 7 aa, Cryptosporidium hominis
ISNSEYN

SEQ ID NO: 2114606 - protein, 22 aa, Cryptosporidium hominis
ISNSTDNELVSDAGESKYKTGS

SEQ ID NO: 2114607 - protein, 8 aa, Cryptosporidium hominis
ISNSTGET

SEQ ID NO: 2114608 - protein, 4 aa, Cryptosporidium hominis
ISNT

SEQ ID NO: 2114609 - protein, 48 aa, Cryptosporidium hominis
ISNTDESNSGDTNSNDEEDPKCCSSSSSSSSSKRKKADISKGHPGHPG

SEQ ID NO: 2114610 - protein, 12 aa, Cryptosporidium hominis
ISNTIESQGNTL

SEQ ID NO: 2114611 - protein, 5 aa, Cryptosporidium hominis
ISNVN

SEQ ID NO: 2114612 - protein, 7 aa, Cryptosporidium hominis
ISPESRI

SEQ ID NO: 2114613 - protein, 5 aa, Cryptosporidium hominis
ISPEY

SEQ ID NO: 2114614 - protein, 5 aa, Cryptosporidium hominis
ISPGQ

SEQ ID NO: 2114615 - protein, 10 aa, Cryptosporidium hominis
ISPNSPKSMG

SEQ ID NO: 2114616 - protein, 9 aa, Cryptosporidium hominis
ISPSSGQVI

SEQ ID NO: 2114617 - protein, 6 aa, Cryptosporidium hominis
ISQDEN

SEQ ID NO: 2114618 - protein, 8 aa, Cryptosporidium hominis
ISQEGNSI

SEQ ID NO: 2114619 - protein, 11 aa, Cryptosporidium hominis
ISQHDTSGEYD

SEQ ID NO: 2114620 - protein, 4 aa, Cryptosporidium hominis
ISQI

SEQ ID NO: 2114621 - protein, 9 aa, Cryptosporidium hominis
ISQRNEKKV

SEQ ID NO: 2114622 - protein, 13 aa, Cryptosporidium hominis
ISRESSTDLKSSM

SEQ ID NO: 2114623 - protein, 4 aa, Cryptosporidium hominis
ISRN

SEQ ID NO: 2114624 - protein, 14 aa, Cryptosporidium hominis
ISRQEDKNELNQND

SEQ ID NO: 2114625 - protein, 10 aa, Cryptosporidium hominis
ISRRNERCPA

SEQ ID NO: 2114626 - protein, 10 aa, Cryptosporidium hominis
ISRSSPLDSR

SEQ ID NO: 2114627 - protein, 4 aa, Cryptosporidium hominis
ISSD

SEQ ID NO: 2114628 - protein, 25 aa, Cryptosporidium hominis
ISSGGKKEQKKRSQIKDINLIYNDK

SEQ ID NO: 2114629 - protein, 12 aa, Cryptosporidium hominis
ISSGGSSHKSIK

SEQ ID NO: 2114630 - protein, 12 aa, Cryptosporidium hominis
ISSKDRGKGSEN

SEQ ID NO: 2114631 - protein, 8 aa, Cryptosporidium hominis
ISSKSDQK

SEQ ID NO: 2114632 - protein, 12 aa, Cryptosporidium hominis
ISSNASKSEITA

SEQ ID NO: 2114633 - protein, 33 aa, Cryptosporidium hominis
ISSNSKKKKMEKAKQAMKKLEKQKKNKTENNSL

SEQ ID NO: 2114634 - protein, 13 aa, Cryptosporidium hominis
ISSNYDESSLQSL

SEQ ID NO: 2114635 - protein, 7 aa, Cryptosporidium hominis
ISSPKND

SEQ ID NO: 2114636 - protein, 80 aa, Cryptosporidium hominis
ISSQALSGSSSGSSSSAPPPPTPSPSSSSPSSSPSSSSKSQKPSKKTQKPKKAPKASSPKVKEKKEKPSSEDDSESYSMD

SEQ ID NO: 2114637 - protein, 22 aa, Cryptosporidium hominis
ISSQNQSSSEQISSQSSTYTNQ

SEQ ID NO: 2114638 - protein, 8 aa, Cryptosporidium hominis
ISSRGGTN

SEQ ID NO: 2114639 - protein, 8 aa, Cryptosporidium hominis
ISSSESKC

SEQ ID NO: 2114640 - protein, 9 aa, Cryptosporidium hominis
ISSSESSTL

SEQ ID NO: 2114641 - protein, 8 aa, Cryptosporidium hominis
ISSSGGIP

SEQ ID NO: 2114642 - protein, 11 aa, Cryptosporidium hominis
ISSSRDDIGNS

SEQ ID NO: 2114643 - protein, 24 aa, Cryptosporidium hominis
ISSSSDQSDSSSVASDDFKSKHKK

SEQ ID NO: 2114644 - protein, 11 aa, Cryptosporidium hominis
ISSSSGGSTSI

SEQ ID NO: 2114645 - protein, 36 aa, Cryptosporidium hominis
ISSTSNSNRRRRRGRSGTGGNDGEGDGGSGNEENFT

SEQ ID NO: 2114646 - protein, 13 aa, Cryptosporidium hominis
ISSVGNNDNNNNA

SEQ ID NO: 2114647 - protein, 7 aa, Cryptosporidium hominis
ISSYRNS

SEQ ID NO: 2114648 - protein, 4 aa, Cryptosporidium hominis
ISTI

SEQ ID NO: 2114649 - protein, 10 aa, Cryptosporidium hominis
ISTNSTDHHG

SEQ ID NO: 2114650 - protein, 15 aa, Cryptosporidium hominis
ISTPKTKAGSKDAGF

SEQ ID NO: 2114651 - protein, 9 aa, Cryptosporidium hominis
ISTRSGNIP

SEQ ID NO: 2114652 - protein, 7 aa, Cryptosporidium hominis
ISTSQNT

SEQ ID NO: 2114653 - protein, 7 aa, Cryptosporidium hominis
ISTSRNS

SEQ ID NO: 2114654 - protein, 11 aa, Cryptosporidium hominis
ISTTQNGSDPT

SEQ ID NO: 2114655 - protein, 11 aa, Cryptosporidium hominis
ISYDDKSDLES

SEQ ID NO: 2114656 - protein, 7 aa, Cryptosporidium hominis
ITAHSSV

SEQ ID NO: 2114657 - protein, 4 aa, Cryptosporidium hominis
ITEE

SEQ ID NO: 2114658 - protein, 11 aa, Cryptosporidium hominis
ITEEEGESSRF

SEQ ID NO: 2114659 - protein, 7 aa, Cryptosporidium hominis
ITEKREK

SEQ ID NO: 2114660 - protein, 10 aa, Cryptosporidium hominis
ITESCGGELQ

SEQ ID NO: 2114661 - protein, 12 aa, Cryptosporidium hominis
ITFSKGEQVRRG

SEQ ID NO: 2114662 - protein, 6 aa, Cryptosporidium hominis
ITGASG

SEQ ID NO: 2114663 - protein, 12 aa, Cryptosporidium hominis
ITGGTGAGVGVG

SEQ ID NO: 2114664 - protein, 15 aa, Cryptosporidium hominis
ITGSSTALADAQRGE

SEQ ID NO: 2114665 - protein, 4 aa, Cryptosporidium hominis
ITIN

SEQ ID NO: 2114666 - protein, 13 aa, Cryptosporidium hominis
ITKGTESKNSIIP

SEQ ID NO: 2114667 - protein, 4 aa, Cryptosporidium hominis
ITND

SEQ ID NO: 2114668 - protein, 5 aa, Cryptosporidium hominis
ITNDE

SEQ ID NO: 2114669 - protein, 7 aa, Cryptosporidium hominis
ITNGTGK

SEQ ID NO: 2114670 - protein, 7 aa, Cryptosporidium hominis
ITNSKGE

SEQ ID NO: 2114671 - protein, 10 aa, Cryptosporidium hominis
ITNSNSANNI

SEQ ID NO: 2114672 - protein, 4 aa, Cryptosporidium hominis
ITPE

SEQ ID NO: 2114673 - protein, 4 aa, Cryptosporidium hominis
ITPH

SEQ ID NO: 2114674 - protein, 4 aa, Cryptosporidium hominis
ITPN

SEQ ID NO: 2114675 - protein, 12 aa, Cryptosporidium hominis
ITPNKVCPNGTE

SEQ ID NO: 2114676 - protein, 9 aa, Cryptosporidium hominis
ITPNQSPIN

SEQ ID NO: 2114677 - protein, 4 aa, Cryptosporidium hominis
ITPR

SEQ ID NO: 2114678 - protein, 9 aa, Cryptosporidium hominis
ITQPKPKPL

SEQ ID NO: 2114679 - protein, 7 aa, Cryptosporidium hominis
ITSAGAK

SEQ ID NO: 2114680 - protein, 8 aa, Cryptosporidium hominis
ITSEDQSH

SEQ ID NO: 2114681 - protein, 7 aa, Cryptosporidium hominis
ITSKNGI

SEQ ID NO: 2114682 - protein, 4 aa, Cryptosporidium hominis
ITSN

SEQ ID NO: 2114683 - protein, 7 aa, Cryptosporidium hominis
ITSNSFE

SEQ ID NO: 2114684 - protein, 5 aa, Cryptosporidium hominis
ITSRE

SEQ ID NO: 2114685 - protein, 11 aa, Cryptosporidium hominis
ITSSHYPETCN

SEQ ID NO: 2114686 - protein, 10 aa, Cryptosporidium hominis
ITSSKTPSIV

SEQ ID NO: 2114687 - protein, 7 aa, Cryptosporidium hominis
ITSSSGL

SEQ ID NO: 2114688 - protein, 18 aa, Cryptosporidium hominis
ITTSTSGKTVSLRPSIDS

SEQ ID NO: 2114689 - protein, 20 aa, Cryptosporidium hominis
ITTTTTGGGGGGGGTIGGTP

SEQ ID NO: 2114690 - protein, 9 aa, Cryptosporidium hominis
ITVTGGSDN

SEQ ID NO: 2114691 - protein, 23 aa, Cryptosporidium hominis
IVDPSKSKNNRSKRKRPSRASTS

SEQ ID NO: 2114692 - protein, 26 aa, Cryptosporidium hominis
IVPQNQPTMQPPPGRQVFGYAVVPNI

SEQ ID NO: 2114693 - protein, 13 aa, Cryptosporidium hominis
IYNGASNEEDTRE

SEQ ID NO: 2114694 - protein, 12 aa, Cryptosporidium hominis
IYPKDSSDISTP

SEQ ID NO: 2114695 - protein, 4 aa, Cryptosporidium hominis
IYTG

SEQ ID NO: 2114696 - protein, 7 aa, Cryptosporidium hominis
IYTKDSK

SEQ ID NO: 2114697 - protein, 8 aa, Cryptosporidium hominis
KAAESFPV

SEQ ID NO: 2114698 - protein, 6 aa, Cryptosporidium hominis
KAANSA

SEQ ID NO: 2114699 - protein, 6 aa, Cryptosporidium hominis
KAARNT

SEQ ID NO: 2114700 - protein, 8 aa, Cryptosporidium hominis
KACADKDQ

SEQ ID NO: 2114701 - protein, 6 aa, Cryptosporidium hominis
KAEFSE

SEQ ID NO: 2114702 - protein, 10 aa, Cryptosporidium hominis
KAEGEAKAAK

SEQ ID NO: 2114703 - protein, 4 aa, Cryptosporidium hominis
KAER

SEQ ID NO: 2114704 - protein, 5 aa, Cryptosporidium hominis
KAEVN

SEQ ID NO: 2114705 - protein, 6 aa, Cryptosporidium hominis
KAFKER

SEQ ID NO: 2114706 - protein, 5 aa, Cryptosporidium hominis
KAGIT

SEQ ID NO: 2114707 - protein, 5 aa, Cryptosporidium hominis
KAISN

SEQ ID NO: 2114708 - protein, 7 aa, Cryptosporidium hominis
KAKDSKC

SEQ ID NO: 2114709 - protein, 17 aa, Cryptosporidium hominis
KAKKNQRNKKNSFVRND

SEQ ID NO: 2114710 - protein, 14 aa, Cryptosporidium hominis
KAKPERTSSHQANA

SEQ ID NO: 2114711 - protein, 8 aa, Cryptosporidium hominis
KAKVPTKF

SEQ ID NO: 2114712 - protein, 7 aa, Cryptosporidium hominis
KALDDAG

SEQ ID NO: 2114713 - protein, 5 aa, Cryptosporidium hominis
KALVS

SEQ ID NO: 2114714 - protein, 7 aa, Cryptosporidium hominis
KANETPY

SEQ ID NO: 2114715 - protein, 13 aa, Cryptosporidium hominis
KANKENKSEKGAV

SEQ ID NO: 2114716 - protein, 10 aa, Cryptosporidium hominis
KANKKSIRRA

SEQ ID NO: 2114717 - protein, 8 aa, Cryptosporidium hominis
KANPETQK

SEQ ID NO: 2114718 - protein, 5 aa, Cryptosporidium hominis
KANQS

SEQ ID NO: 2114719 - protein, 6 aa, Cryptosporidium hominis
KANSVG

SEQ ID NO: 2114720 - protein, 12 aa, Cryptosporidium hominis
KAPKKSKRNGFS

SEQ ID NO: 2114721 - protein, 7 aa, Cryptosporidium hominis
KAPKLSE

SEQ ID NO: 2114722 - protein, 7 aa, Cryptosporidium hominis
KAPKRIS

SEQ ID NO: 2114723 - protein, 5 aa, Cryptosporidium hominis
KAQEI

SEQ ID NO: 2114724 - protein, 19 aa, Cryptosporidium hominis
KARAIESDGQEDYSTEATL

SEQ ID NO: 2114725 - protein, 7 aa, Cryptosporidium hominis
KARESQI

SEQ ID NO: 2114726 - protein, 7 aa, Cryptosporidium hominis
KARSTYG

SEQ ID NO: 2114727 - protein, 7 aa, Cryptosporidium hominis
KASEELY

SEQ ID NO: 2114728 - protein, 13 aa, Cryptosporidium hominis
KASGSKSEKKETN

SEQ ID NO: 2114729 - protein, 9 aa, Cryptosporidium hominis
KASISRDNS

SEQ ID NO: 2114730 - protein, 8 aa, Cryptosporidium hominis
KASKEEKI

SEQ ID NO: 2114731 - protein, 9 aa, Cryptosporidium hominis
KASKPKVNK

SEQ ID NO: 2114732 - protein, 10 aa, Cryptosporidium hominis
KASNSKSIDE

SEQ ID NO: 2114733 - protein, 18 aa, Cryptosporidium hominis
KASPPAKSSSKSQTSNSK

SEQ ID NO: 2114734 - protein, 10 aa, Cryptosporidium hominis
KASSGKTMDR

SEQ ID NO: 2114735 - protein, 9 aa, Cryptosporidium hominis
KASSNSTLE

SEQ ID NO: 2114736 - protein, 6 aa, Cryptosporidium hominis
KASYGI

SEQ ID NO: 2114737 - protein, 7 aa, Cryptosporidium hominis
KATARTG

SEQ ID NO: 2114738 - protein, 11 aa, Cryptosporidium hominis
KATKSKNEAER

SEQ ID NO: 2114739 - protein, 8 aa, Cryptosporidium hominis
KATNQTND

SEQ ID NO: 2114740 - protein, 6 aa, Cryptosporidium hominis
KATPIT

SEQ ID NO: 2114741 - protein, 14 aa, Cryptosporidium hominis
KAVGASKGPKNEQL

SEQ ID NO: 2114742 - protein, 7 aa, Cryptosporidium hominis
KAVRSQS

SEQ ID NO: 2114743 - protein, 4 aa, Cryptosporidium hominis
KCDQ

SEQ ID NO: 2114744 - protein, 11 aa, Cryptosporidium hominis
KCGSYKSSSLN

SEQ ID NO: 2114745 - protein, 10 aa, Cryptosporidium hominis
KCKAPSAEEA

SEQ ID NO: 2114746 - protein, 8 aa, Cryptosporidium hominis
KCKEKKSC

SEQ ID NO: 2114747 - protein, 6 aa, Cryptosporidium hominis
KCLTST

SEQ ID NO: 2114748 - protein, 5 aa, Cryptosporidium hominis
KCPNT

SEQ ID NO: 2114749 - protein, 7 aa, Cryptosporidium hominis
KCTTHSE

SEQ ID NO: 2114750 - protein, 13 aa, Cryptosporidium hominis
KCYTTSSKETAEI

SEQ ID NO: 2114751 - protein, 11 aa, Cryptosporidium hominis
KDASPQDPLDK

SEQ ID NO: 2114752 - protein, 6 aa, Cryptosporidium hominis
KDATVS

SEQ ID NO: 2114753 - protein, 5 aa, Cryptosporidium hominis
KDDFS

SEQ ID NO: 2114754 - protein, 7 aa, Cryptosporidium hominis
KDDIQEK

SEQ ID NO: 2114755 - protein, 5 aa, Cryptosporidium hominis
KDDLS

SEQ ID NO: 2114756 - protein, 37 aa, Cryptosporidium hominis
KDDSAKSDKSVKTESNSKVSTHSQKIKNEDDDKVNEE

SEQ ID NO: 2114757 - protein, 9 aa, Cryptosporidium hominis
KDEARSGSI

SEQ ID NO: 2114758 - protein, 4 aa, Cryptosporidium hominis
KDEI

SEQ ID NO: 2114759 - protein, 5 aa, Cryptosporidium hominis
KDENG

SEQ ID NO: 2114760 - protein, 14 aa, Cryptosporidium hominis
KDENKEKTSQINSS

SEQ ID NO: 2114761 - protein, 6 aa, Cryptosporidium hominis
KDENQK

SEQ ID NO: 2114762 - protein, 11 aa, Cryptosporidium hominis
KDEQEPAKFSR

SEQ ID NO: 2114763 - protein, 5 aa, Cryptosporidium hominis
KDEQQ

SEQ ID NO: 2114764 - protein, 4 aa, Cryptosporidium hominis
KDES

SEQ ID NO: 2114765 - protein, 6 aa, Cryptosporidium hominis
KDETLS

SEQ ID NO: 2114766 - protein, 4 aa, Cryptosporidium hominis
KDEV

SEQ ID NO: 2114767 - protein, 8 aa, Cryptosporidium hominis
KDFGKPIP

SEQ ID NO: 2114768 - protein, 4 aa, Cryptosporidium hominis
KDGE

SEQ ID NO: 2114769 - protein, 4 aa, Cryptosporidium hominis
KDGK

SEQ ID NO: 2114770 - protein, 9 aa, Cryptosporidium hominis
KDGKKYPKL

SEQ ID NO: 2114771 - protein, 8 aa, Cryptosporidium hominis
KDGKSFGD

SEQ ID NO: 2114772 - protein, 12 aa, Cryptosporidium hominis
KDGSSVPDAKRS

SEQ ID NO: 2114773 - protein, 8 aa, Cryptosporidium hominis
KDHDPEYK

SEQ ID NO: 2114774 - protein, 4 aa, Cryptosporidium hominis
KDHN

SEQ ID NO: 2114775 - protein, 8 aa, Cryptosporidium hominis
KDHRKTNS

SEQ ID NO: 2114776 - protein, 11 aa, Cryptosporidium hominis
KDINAKRNEVG

SEQ ID NO: 2114777 - protein, 8 aa, Cryptosporidium hominis
KDINTEQE

SEQ ID NO: 2114778 - protein, 6 aa, Cryptosporidium hominis
KDIPIS

SEQ ID NO: 2114779 - protein, 10 aa, Cryptosporidium hominis
KDIPTSTARQ

SEQ ID NO: 2114780 - protein, 5 aa, Cryptosporidium hominis
KDIRS

SEQ ID NO: 2114781 - protein, 12 aa, Cryptosporidium hominis
KDISRGNRESQH

SEQ ID NO: 2114782 - protein, 12 aa, Cryptosporidium hominis
KDITNQKSLDEL

SEQ ID NO: 2114783 - protein, 12 aa, Cryptosporidium hominis
KDKDSSPSATST

SEQ ID NO: 2114784 - protein, 7 aa, Cryptosporidium hominis
KDKDTNC

SEQ ID NO: 2114785 - protein, 6 aa, Cryptosporidium hominis
KDKERN

SEQ ID NO: 2114786 - protein, 7 aa, Cryptosporidium hominis
KDKMDNV

SEQ ID NO: 2114787 - protein, 21 aa, Cryptosporidium hominis
KDKNNSQDKNNSLGSINKDVS

SEQ ID NO: 2114788 - protein, 10 aa, Cryptosporidium hominis
KDKNQSGVNS

SEQ ID NO: 2114789 - protein, 24 aa, Cryptosporidium hominis
KDKPKWSPPPPLEPIDNSTNTQTI

SEQ ID NO: 2114790 - protein, 11 aa, Cryptosporidium hominis
KDKSNEVGSNE

SEQ ID NO: 2114791 - protein, 9 aa, Cryptosporidium hominis
KDKSSMEKI

SEQ ID NO: 2114792 - protein, 13 aa, Cryptosporidium hominis
KDLKEDNNRTNPV

SEQ ID NO: 2114793 - protein, 7 aa, Cryptosporidium hominis
KDLNGSR

SEQ ID NO: 2114794 - protein, 6 aa, Cryptosporidium hominis
KDLNKI

SEQ ID NO: 2114795 - protein, 11 aa, Cryptosporidium hominis
KDNENDETQDY

SEQ ID NO: 2114796 - protein, 9 aa, Cryptosporidium hominis
KDNETSNSL

SEQ ID NO: 2114797 - protein, 4 aa, Cryptosporidium hominis
KDNF

SEQ ID NO: 2114798 - protein, 5 aa, Cryptosporidium hominis
KDNKH

SEQ ID NO: 2114799 - protein, 5 aa, Cryptosporidium hominis
KDNNF

SEQ ID NO: 2114800 - protein, 7 aa, Cryptosporidium hominis
KDNNRMN

SEQ ID NO: 2114801 - protein, 8 aa, Cryptosporidium hominis
KDNPKSFE

SEQ ID NO: 2114802 - protein, 15 aa, Cryptosporidium hominis
KDNPSVRPETSKDVE

SEQ ID NO: 2114803 - protein, 5 aa, Cryptosporidium hominis
KDNSD

SEQ ID NO: 2114804 - protein, 13 aa, Cryptosporidium hominis
KDNSKTLKSNYDS

SEQ ID NO: 2114805 - protein, 9 aa, Cryptosporidium hominis
KDNTERNNE

SEQ ID NO: 2114806 - protein, 19 aa, Cryptosporidium hominis
KDPCSNTETMSRNRTVKTV

SEQ ID NO: 2114807 - protein, 9 aa, Cryptosporidium hominis
KDPDDSKIV

SEQ ID NO: 2114808 - protein, 7 aa, Cryptosporidium hominis
KDPSGTI

SEQ ID NO: 2114809 - protein, 10 aa, Cryptosporidium hominis
KDPSHPNSNP

SEQ ID NO: 2114810 - protein, 9 aa, Cryptosporidium hominis
KDPSISSTE

SEQ ID NO: 2114811 - protein, 7 aa, Cryptosporidium hominis
KDPTNKI

SEQ ID NO: 2114812 - protein, 5 aa, Cryptosporidium hominis
KDQCE

SEQ ID NO: 2114813 - protein, 17 aa, Cryptosporidium hominis
KDQDQPAKEGIGKHSSS

SEQ ID NO: 2114814 - protein, 6 aa, Cryptosporidium hominis
KDQEPT

SEQ ID NO: 2114815 - protein, 14 aa, Cryptosporidium hominis
KDQNLSDQSNKEYE

SEQ ID NO: 2114816 - protein, 8 aa, Cryptosporidium hominis
KDQNQEYI

SEQ ID NO: 2114817 - protein, 7 aa, Cryptosporidium hominis
KDQQGIQ

SEQ ID NO: 2114818 - protein, 8 aa, Cryptosporidium hominis
KDQSNAFR

SEQ ID NO: 2114819 - protein, 11 aa, Cryptosporidium hominis
KDQTDPAPRYI

SEQ ID NO: 2114820 - protein, 8 aa, Cryptosporidium hominis
KDQTEKST

SEQ ID NO: 2114821 - protein, 18 aa, Cryptosporidium hominis
KDREIRRSSRSSLKSISK

SEQ ID NO: 2114822 - protein, 5 aa, Cryptosporidium hominis
KDRPS

SEQ ID NO: 2114823 - protein, 24 aa, Cryptosporidium hominis
KDRSSNNQGDFSKKRTLECKSDQI

SEQ ID NO: 2114824 - protein, 10 aa, Cryptosporidium hominis
KDRSSVSASD

SEQ ID NO: 2114825 - protein, 7 aa, Cryptosporidium hominis
KDRTGDY

SEQ ID NO: 2114826 - protein, 6 aa, Cryptosporidium hominis
KDRTGI

SEQ ID NO: 2114827 - protein, 14 aa, Cryptosporidium hominis
KDSDAKNKQDEHST

SEQ ID NO: 2114828 - protein, 6 aa, Cryptosporidium hominis
KDSDNM

SEQ ID NO: 2114829 - protein, 4 aa, Cryptosporidium hominis
KDSE

SEQ ID NO: 2114830 - protein, 4 aa, Cryptosporidium hominis
KDSI

SEQ ID NO: 2114831 - protein, 7 aa, Cryptosporidium hominis
KDSIESS

SEQ ID NO: 2114832 - protein, 9 aa, Cryptosporidium hominis
KDSKDDERV

SEQ ID NO: 2114833 - protein, 7 aa, Cryptosporidium hominis
KDSKING

SEQ ID NO: 2114834 - protein, 7 aa, Cryptosporidium hominis
KDSNDRR

SEQ ID NO: 2114835 - protein, 8 aa, Cryptosporidium hominis
KDSNYQKS

SEQ ID NO: 2114836 - protein, 19 aa, Cryptosporidium hominis
KDSPIEKTDFKSNDNLKNQ

SEQ ID NO: 2114837 - protein, 11 aa, Cryptosporidium hominis
KDSQREDTTSI

SEQ ID NO: 2114838 - protein, 6 aa, Cryptosporidium hominis
KDSQTP

SEQ ID NO: 2114839 - protein, 7 aa, Cryptosporidium hominis
KDSSEFS

SEQ ID NO: 2114840 - protein, 11 aa, Cryptosporidium hominis
KDSSSGNTKPI

SEQ ID NO: 2114841 - protein, 18 aa, Cryptosporidium hominis
KDSSSNFSPNSSPSSNEL

SEQ ID NO: 2114842 - protein, 13 aa, Cryptosporidium hominis
KDTGENDEKSENI

SEQ ID NO: 2114843 - protein, 7 aa, Cryptosporidium hominis
KDTGENI

SEQ ID NO: 2114844 - protein, 12 aa, Cryptosporidium hominis
KDTNDKSKNNEL

SEQ ID NO: 2114845 - protein, 10 aa, Cryptosporidium hominis
KDTPSVASEF

SEQ ID NO: 2114846 - protein, 6 aa, Cryptosporidium hominis
KDTQHE

SEQ ID NO: 2114847 - protein, 19 aa, Cryptosporidium hominis
KDTTETDDQKYNENIPSPE

SEQ ID NO: 2114848 - protein, 16 aa, Cryptosporidium hominis
KDVPENTVKGSLDTFT

SEQ ID NO: 2114849 - protein, 6 aa, Cryptosporidium hominis
KDVQSE

SEQ ID NO: 2114850 - protein, 7 aa, Cryptosporidium hominis
KDYGPAT

SEQ ID NO: 2114851 - protein, 6 aa, Cryptosporidium hominis
KDYSQN

SEQ ID NO: 2114852 - protein, 6 aa, Cryptosporidium hominis
KDYSSD

SEQ ID NO: 2114853 - protein, 17 aa, Cryptosporidium hominis
KEAADGETNLKETPKEL

SEQ ID NO: 2114854 - protein, 7 aa, Cryptosporidium hominis
KEAEKRH

SEQ ID NO: 2114855 - protein, 7 aa, Cryptosporidium hominis
KEAESIA

SEQ ID NO: 2114856 - protein, 8 aa, Cryptosporidium hominis
KEATEPKV

SEQ ID NO: 2114857 - protein, 8 aa, Cryptosporidium hominis
KECKGDQD

SEQ ID NO: 2114858 - protein, 8 aa, Cryptosporidium hominis
KECSGGNC

SEQ ID NO: 2114859 - protein, 6 aa, Cryptosporidium hominis
KEDFEK

SEQ ID NO: 2114860 - protein, 11 aa, Cryptosporidium hominis
KEDGDSGSGYA

SEQ ID NO: 2114861 - protein, 10 aa, Cryptosporidium hominis
KEDPRTRKDS

SEQ ID NO: 2114862 - protein, 23 aa, Cryptosporidium hominis
KEDSNDDKSEKMKENNSKLNRRE

SEQ ID NO: 2114863 - protein, 6 aa, Cryptosporidium hominis
KEDTYI

SEQ ID NO: 2114864 - protein, 4 aa, Cryptosporidium hominis
KEED

SEQ ID NO: 2114865 - protein, 13 aa, Cryptosporidium hominis
KEEDAASKITNAE

SEQ ID NO: 2114866 - protein, 10 aa, Cryptosporidium hominis
KEEDFTKKED

SEQ ID NO: 2114867 - protein, 45 aa, Cryptosporidium hominis
KEEDNSLTISSSRNLDNSTEKDSYFTSETLSEKVENSKLKKKSTI

SEQ ID NO: 2114868 - protein, 6 aa, Cryptosporidium hominis
KEEEER

SEQ ID NO: 2114869 - protein, 8 aa, Cryptosporidium hominis
KEEESNEK

SEQ ID NO: 2114870 - protein, 4 aa, Cryptosporidium hominis
KEEK

SEQ ID NO: 2114871 - protein, 8 aa, Cryptosporidium hominis
KEEKKEKM

SEQ ID NO: 2114872 - protein, 16 aa, Cryptosporidium hominis
KEELSSQKTREESQNM

SEQ ID NO: 2114873 - protein, 23 aa, Cryptosporidium hominis
KEELYEKNKEENSSESAPKTVNA

SEQ ID NO: 2114874 - protein, 20 aa, Cryptosporidium hominis
KEENPTKQESLNKSNSTISM

SEQ ID NO: 2114875 - protein, 7 aa, Cryptosporidium hominis
KEEQTNL

SEQ ID NO: 2114876 - protein, 22 aa, Cryptosporidium hominis
KEEVKPLDETPRQVNKRSGGII

SEQ ID NO: 2114877 - protein, 6 aa, Cryptosporidium hominis
KEEYSG

SEQ ID NO: 2114878 - protein, 5 aa, Cryptosporidium hominis
KEFGE

SEQ ID NO: 2114879 - protein, 12 aa, Cryptosporidium hominis
KEFNRENKQVYK

SEQ ID NO: 2114880 - protein, 41 aa, Cryptosporidium hominis
KEFSTLSANSSSPTKDNGESSDSQVQSRSRRSLAEENGETV

SEQ ID NO: 2114881 - protein, 8 aa, Cryptosporidium hominis
KEGGGISI

SEQ ID NO: 2114882 - protein, 5 aa, Cryptosporidium hominis
KEGKI

SEQ ID NO: 2114883 - protein, 6 aa, Cryptosporidium hominis
KEGLEI

SEQ ID NO: 2114884 - protein, 10 aa, Cryptosporidium hominis
KEGQQAANAA

SEQ ID NO: 2114885 - protein, 7 aa, Cryptosporidium hominis
KEGRVTG

SEQ ID NO: 2114886 - protein, 6 aa, Cryptosporidium hominis
KEGSEI

SEQ ID NO: 2114887 - protein, 10 aa, Cryptosporidium hominis
KEGSPNSSPA

SEQ ID NO: 2114888 - protein, 15 aa, Cryptosporidium hominis
KEHNRQIKDSKCKET

SEQ ID NO: 2114889 - protein, 6 aa, Cryptosporidium hominis
KEIAAA

SEQ ID NO: 2114890 - protein, 16 aa, Cryptosporidium hominis
KEIDLDQNQKNATQKN

SEQ ID NO: 2114891 - protein, 4 aa, Cryptosporidium hominis
KEIE

SEQ ID NO: 2114892 - protein, 10 aa, Cryptosporidium hominis
KEIEDSEARF

SEQ ID NO: 2114893 - protein, 12 aa, Cryptosporidium hominis
KEIESKASQEIT

SEQ ID NO: 2114894 - protein, 7 aa, Cryptosporidium hominis
KEIGGAT

SEQ ID NO: 2114895 - protein, 7 aa, Cryptosporidium hominis
KEIHNKK

SEQ ID NO: 2114896 - protein, 12 aa, Cryptosporidium hominis
KEIKYSRNSGNY

SEQ ID NO: 2114897 - protein, 6 aa, Cryptosporidium hominis
KEISEK

SEQ ID NO: 2114898 - protein, 8 aa, Cryptosporidium hominis
KEISTKEF

SEQ ID NO: 2114899 - protein, 6 aa, Cryptosporidium hominis
KEKAKH

SEQ ID NO: 2114900 - protein, 5 aa, Cryptosporidium hominis
KEKDQ

SEQ ID NO: 2114901 - protein, 21 aa, Cryptosporidium hominis
KEKEQEEERQKAQDEAKRKEF

SEQ ID NO: 2114902 - protein, 8 aa, Cryptosporidium hominis
KEKEQEEL

SEQ ID NO: 2114903 - protein, 9 aa, Cryptosporidium hominis
KEKERNEQN

SEQ ID NO: 2114904 - protein, 19 aa, Cryptosporidium hominis
KEKIKKKINSSKKTKSGLI

SEQ ID NO: 2114905 - protein, 9 aa, Cryptosporidium hominis
KEKKKNSKI

SEQ ID NO: 2114906 - protein, 10 aa, Cryptosporidium hominis
KEKKNNGEKI

SEQ ID NO: 2114907 - protein, 5 aa, Cryptosporidium hominis
KEKMA

SEQ ID NO: 2114908 - protein, 15 aa, Cryptosporidium hominis
KEKNAVQGGVSPGGI

SEQ ID NO: 2114909 - protein, 19 aa, Cryptosporidium hominis
KEKNNENLEENKVEKNTNI

SEQ ID NO: 2114910 - protein, 7 aa, Cryptosporidium hominis
KEKPHDS

SEQ ID NO: 2114911 - protein, 14 aa, Cryptosporidium hominis
KEKPQDGLSDSEKK

SEQ ID NO: 2114912 - protein, 4 aa, Cryptosporidium hominis
KEKR

SEQ ID NO: 2114913 - protein, 11 aa, Cryptosporidium hominis
KEKTKIPNQIN

SEQ ID NO: 2114914 - protein, 11 aa, Cryptosporidium hominis
KELDKSAIETK

SEQ ID NO: 2114915 - protein, 23 aa, Cryptosporidium hominis
KELEQEKEQEKQQEKQQETENAN

SEQ ID NO: 2114916 - protein, 17 aa, Cryptosporidium hominis
KELNKDNLEKSPEKHST

SEQ ID NO: 2114917 - protein, 8 aa, Cryptosporidium hominis
KELSRESG

SEQ ID NO: 2114918 - protein, 4 aa, Cryptosporidium hominis
KEME

SEQ ID NO: 2114919 - protein, 10 aa, Cryptosporidium hominis
KENANENPNN

SEQ ID NO: 2114920 - protein, 7 aa, Cryptosporidium hominis
KENCNDQ

SEQ ID NO: 2114921 - protein, 11 aa, Cryptosporidium hominis
KENDDQVQDEK

SEQ ID NO: 2114922 - protein, 16 aa, Cryptosporidium hominis
KENDSSKTETESTEKR

SEQ ID NO: 2114923 - protein, 9 aa, Cryptosporidium hominis
KENDTKTEL

SEQ ID NO: 2114924 - protein, 23 aa, Cryptosporidium hominis
KENDTLNKTEKETHSGTANETKK

SEQ ID NO: 2114925 - protein, 5 aa, Cryptosporidium hominis
KENEI

SEQ ID NO: 2114926 - protein, 8 aa, Cryptosporidium hominis
KENEMKKS

SEQ ID NO: 2114927 - protein, 10 aa, Cryptosporidium hominis
KENIESERER

SEQ ID NO: 2114928 - protein, 11 aa, Cryptosporidium hominis
KENKLSDLDQE

SEQ ID NO: 2114929 - protein, 13 aa, Cryptosporidium hominis
KENKNNRSNKNEN

SEQ ID NO: 2114930 - protein, 9 aa, Cryptosporidium hominis
KENNSLDTI

SEQ ID NO: 2114931 - protein, 8 aa, Cryptosporidium hominis
KENPNIKT

SEQ ID NO: 2114932 - protein, 5 aa, Cryptosporidium hominis
KENRS

SEQ ID NO: 2114933 - protein, 6 aa, Cryptosporidium hominis
KENTKA

SEQ ID NO: 2114934 - protein, 8 aa, Cryptosporidium hominis
KENTNKNS

SEQ ID NO: 2114935 - protein, 4 aa, Cryptosporidium hominis
KENY

SEQ ID NO: 2114936 - protein, 8 aa, Cryptosporidium hominis
KENYSQNN

SEQ ID NO: 2114937 - protein, 5 aa, Cryptosporidium hominis
KEPGK

SEQ ID NO: 2114938 - protein, 13 aa, Cryptosporidium hominis
KEQDEMDSESETN

SEQ ID NO: 2114939 - protein, 6 aa, Cryptosporidium hominis
KEQEEL

SEQ ID NO: 2114940 - protein, 7 aa, Cryptosporidium hominis
KEQEELR

SEQ ID NO: 2114941 - protein, 24 aa, Cryptosporidium hominis
KEQNSNVRQESDSKGEKNNTQSSY

SEQ ID NO: 2114942 - protein, 4 aa, Cryptosporidium hominis
KERA

SEQ ID NO: 2114943 - protein, 5 aa, Cryptosporidium hominis
KEREI

SEQ ID NO: 2114944 - protein, 5 aa, Cryptosporidium hominis
KERID

SEQ ID NO: 2114945 - protein, 8 aa, Cryptosporidium hominis
KERKLDPK

SEQ ID NO: 2114946 - protein, 7 aa, Cryptosporidium hominis
KERNYAN

SEQ ID NO: 2114947 - protein, 6 aa, Cryptosporidium hominis
KERREK

SEQ ID NO: 2114948 - protein, 9 aa, Cryptosporidium hominis
KERSGTYKR

SEQ ID NO: 2114949 - protein, 8 aa, Cryptosporidium hominis
KERSYNNR

SEQ ID NO: 2114950 - protein, 8 aa, Cryptosporidium hominis
KESEDDLS

SEQ ID NO: 2114951 - protein, 8 aa, Cryptosporidium hominis
KESEISEQ

SEQ ID NO: 2114952 - protein, 6 aa, Cryptosporidium hominis
KESHDF

SEQ ID NO: 2114953 - protein, 5 aa, Cryptosporidium hominis
KESKN

SEQ ID NO: 2114954 - protein, 7 aa, Cryptosporidium hominis
KESKREF

SEQ ID NO: 2114955 - protein, 6 aa, Cryptosporidium hominis
KESPKS

SEQ ID NO: 2114956 - protein, 10 aa, Cryptosporidium hominis
KESPPNGPAK

SEQ ID NO: 2114957 - protein, 6 aa, Cryptosporidium hominis
KESSIN

SEQ ID NO: 2114958 - protein, 6 aa, Cryptosporidium hominis
KESSNG

SEQ ID NO: 2114959 - protein, 8 aa, Cryptosporidium hominis
KETAEDGY

SEQ ID NO: 2114960 - protein, 5 aa, Cryptosporidium hominis
KETAN

SEQ ID NO: 2114961 - protein, 8 aa, Cryptosporidium hominis
KETDKIKE

SEQ ID NO: 2114962 - protein, 7 aa, Cryptosporidium hominis
KETFPDS

SEQ ID NO: 2114963 - protein, 5 aa, Cryptosporidium hominis
KETHE

SEQ ID NO: 2114964 - protein, 4 aa, Cryptosporidium hominis
KETI

SEQ ID NO: 2114965 - protein, 7 aa, Cryptosporidium hominis
KETMTSE

SEQ ID NO: 2114966 - protein, 6 aa, Cryptosporidium hominis
KETNQS

SEQ ID NO: 2114967 - protein, 5 aa, Cryptosporidium hominis
KETQN

SEQ ID NO: 2114968 - protein, 9 aa, Cryptosporidium hominis
KETTSPIEG

SEQ ID NO: 2114969 - protein, 4 aa, Cryptosporidium hominis
KETY

SEQ ID NO: 2114970 - protein, 12 aa, Cryptosporidium hominis
KEVARQSVGTAS

SEQ ID NO: 2114971 - protein, 38 aa, Cryptosporidium hominis
KEVNASGNSKKGEQVGYNNGIQETKFSNKKSSNNLPNR

SEQ ID NO: 2114972 - protein, 8 aa, Cryptosporidium hominis
KEVNEESN

SEQ ID NO: 2114973 - protein, 5 aa, Cryptosporidium hominis
KEVTE

SEQ ID NO: 2114974 - protein, 21 aa, Cryptosporidium hominis
KEYQQGNELSQDDDQFMYLLS

SEQ ID NO: 2114975 - protein, 6 aa, Cryptosporidium hominis
KEYSKF

SEQ ID NO: 2114976 - protein, 9 aa, Cryptosporidium hominis
KFPAKNTTS

SEQ ID NO: 2114977 - protein, 6 aa, Cryptosporidium hominis
KFPKRS

SEQ ID NO: 2114978 - protein, 7 aa, Cryptosporidium hominis
KFPPPDT

SEQ ID NO: 2114979 - protein, 5 aa, Cryptosporidium hominis
KFPSD

SEQ ID NO: 2114980 - protein, 12 aa, Cryptosporidium hominis
KFPTKDSEDLHS

SEQ ID NO: 2114981 - protein, 39 aa, Cryptosporidium hominis
KFQSRGRDLTESEFPHSNKPGEKRTSTSLYSKAGGAVLG

SEQ ID NO: 2114982 - protein, 7 aa, Cryptosporidium hominis
KFQSSQN

SEQ ID NO: 2114983 - protein, 10 aa, Cryptosporidium hominis
KFSNSAPGLY

SEQ ID NO: 2114984 - protein, 19 aa, Cryptosporidium hominis
KFTQPSNSLRTKSLSSTNV

SEQ ID NO: 2114985 - protein, 25 aa, Cryptosporidium hominis
KGCEPHNKYDPKLSTSYQKLGDGSL

SEQ ID NO: 2114986 - protein, 9 aa, Cryptosporidium hominis
KGCSPEDRL

SEQ ID NO: 2114987 - protein, 17 aa, Cryptosporidium hominis
KGCSVSPYEEDSVKNPD

SEQ ID NO: 2114988 - protein, 13 aa, Cryptosporidium hominis
KGDAKKWVDIALG

SEQ ID NO: 2114989 - protein, 6 aa, Cryptosporidium hominis
KGDDKN

SEQ ID NO: 2114990 - protein, 9 aa, Cryptosporidium hominis
KGDESQEDT

SEQ ID NO: 2114991 - protein, 8 aa, Cryptosporidium hominis
KGDEVPSI

SEQ ID NO: 2114992 - protein, 6 aa, Cryptosporidium hominis
KGDPSQ

SEQ ID NO: 2114993 - protein, 21 aa, Cryptosporidium hominis
KGDQTMISGSSNNLSGGQRQR

SEQ ID NO: 2114994 - protein, 8 aa, Cryptosporidium hominis
KGDSSGME

SEQ ID NO: 2114995 - protein, 4 aa, Cryptosporidium hominis
KGEE

SEQ ID NO: 2114996 - protein, 8 aa, Cryptosporidium hominis
KGEEKTIT

SEQ ID NO: 2114997 - protein, 8 aa, Cryptosporidium hominis
KGEETKSL

SEQ ID NO: 2114998 - protein, 4 aa, Cryptosporidium hominis
KGEF

SEQ ID NO: 2114999 - protein, 7 aa, Cryptosporidium hominis
KGEKKVD

SEQ ID NO: 2115000 - protein, 16 aa, Cryptosporidium hominis
KGENKGKARMKPENPP

SEQ ID NO: 2115001 - protein, 5 aa, Cryptosporidium hominis
KGEPD

SEQ ID NO: 2115002 - protein, 5 aa, Cryptosporidium hominis
KGESF

SEQ ID NO: 2115003 - protein, 11 aa, Cryptosporidium hominis
KGESSNNDTNL

SEQ ID NO: 2115004 - protein, 6 aa, Cryptosporidium hominis
KGFDGK

SEQ ID NO: 2115005 - protein, 6 aa, Cryptosporidium hominis
KGFESK

SEQ ID NO: 2115006 - protein, 6 aa, Cryptosporidium hominis
KGFSSS

SEQ ID NO: 2115007 - protein, 4 aa, Cryptosporidium hominis
KGFY

SEQ ID NO: 2115008 - protein, 8 aa, Cryptosporidium hominis
KGGDFVSP

SEQ ID NO: 2115009 - protein, 6 aa, Cryptosporidium hominis
KGGNYK

SEQ ID NO: 2115010 - protein, 10 aa, Cryptosporidium hominis
KGGRYKGGEG

SEQ ID NO: 2115011 - protein, 7 aa, Cryptosporidium hominis
KGGWGIK

SEQ ID NO: 2115012 - protein, 5 aa, Cryptosporidium hominis
KGHAI

SEQ ID NO: 2115013 - protein, 7 aa, Cryptosporidium hominis
KGHGNGK

SEQ ID NO: 2115014 - protein, 4 aa, Cryptosporidium hominis
KGHL

SEQ ID NO: 2115015 - protein, 20 aa, Cryptosporidium hominis
KGHTGLGADAGSLKDESKQV

SEQ ID NO: 2115016 - protein, 5 aa, Cryptosporidium hominis
KGIGN

SEQ ID NO: 2115017 - protein, 9 aa, Cryptosporidium hominis
KGINSRKSM

SEQ ID NO: 2115018 - protein, 8 aa, Cryptosporidium hominis
KGKGRRAD

SEQ ID NO: 2115019 - protein, 10 aa, Cryptosporidium hominis
KGKQGNLTKN

SEQ ID NO: 2115020 - protein, 9 aa, Cryptosporidium hominis
KGKYTFDSP

SEQ ID NO: 2115021 - protein, 7 aa, Cryptosporidium hominis
KGLKNEE

SEQ ID NO: 2115022 - protein, 4 aa, Cryptosporidium hominis
KGLR

SEQ ID NO: 2115023 - protein, 13 aa, Cryptosporidium hominis
KGLSSTSQHKTTF

SEQ ID NO: 2115024 - protein, 5 aa, Cryptosporidium hominis
KGLTR

SEQ ID NO: 2115025 - protein, 8 aa, Cryptosporidium hominis
KGNGNNFE

SEQ ID NO: 2115026 - protein, 8 aa, Cryptosporidium hominis
KGNYNCEE

SEQ ID NO: 2115027 - protein, 8 aa, Cryptosporidium hominis
KGPASLKM

SEQ ID NO: 2115028 - protein, 7 aa, Cryptosporidium hominis
KGPQVSP

SEQ ID NO: 2115029 - protein, 24 aa, Cryptosporidium hominis
KGRKNYKEEKTASEGKGPRQKGVL

SEQ ID NO: 2115030 - protein, 5 aa, Cryptosporidium hominis
KGRSA

SEQ ID NO: 2115031 - protein, 13 aa, Cryptosporidium hominis
KGSIPKKIGNHKN

SEQ ID NO: 2115032 - protein, 5 aa, Cryptosporidium hominis
KGSLT

SEQ ID NO: 2115033 - protein, 4 aa, Cryptosporidium hominis
KGSN

SEQ ID NO: 2115034 - protein, 7 aa, Cryptosporidium hominis
KGSNPQI

SEQ ID NO: 2115035 - protein, 9 aa, Cryptosporidium hominis
KGSNYQENV

SEQ ID NO: 2115036 - protein, 12 aa, Cryptosporidium hominis
KGSSNKGGSKPF

SEQ ID NO: 2115037 - protein, 7 aa, Cryptosporidium hominis
KGSSNNV

SEQ ID NO: 2115038 - protein, 6 aa, Cryptosporidium hominis
KGTEMS

SEQ ID NO: 2115039 - protein, 6 aa, Cryptosporidium hominis
KGTKGY

SEQ ID NO: 2115040 - protein, 5 aa, Cryptosporidium hominis
KGTLE

SEQ ID NO: 2115041 - protein, 4 aa, Cryptosporidium hominis
KGTP

SEQ ID NO: 2115042 - protein, 7 aa, Cryptosporidium hominis
KGVDVEN

SEQ ID NO: 2115043 - protein, 4 aa, Cryptosporidium hominis
KGVS

SEQ ID NO: 2115044 - protein, 8 aa, Cryptosporidium hominis
KGYEKEQE

SEQ ID NO: 2115045 - protein, 10 aa, Cryptosporidium hominis
KHDDSVPNKK

SEQ ID NO: 2115046 - protein, 9 aa, Cryptosporidium hominis
KHDSNTEQV

SEQ ID NO: 2115047 - protein, 28 aa, Cryptosporidium hominis
KHESRPSFGVESRNSSAEREKEKVSGVG

SEQ ID NO: 2115048 - protein, 12 aa, Cryptosporidium hominis
KHGENEKSSIQE

SEQ ID NO: 2115049 - protein, 12 aa, Cryptosporidium hominis
KHGNLSLQNHLN

SEQ ID NO: 2115050 - protein, 5 aa, Cryptosporidium hominis
KHGPR

SEQ ID NO: 2115051 - protein, 6 aa, Cryptosporidium hominis
KHISNK

SEQ ID NO: 2115052 - protein, 8 aa, Cryptosporidium hominis
KHKDKYKH

SEQ ID NO: 2115053 - protein, 17 aa, Cryptosporidium hominis
KHKKRKEKYGPSGSEYK

SEQ ID NO: 2115054 - protein, 6 aa, Cryptosporidium hominis
KHKNGK

SEQ ID NO: 2115055 - protein, 6 aa, Cryptosporidium hominis
KHLKTK

SEQ ID NO: 2115056 - protein, 7 aa, Cryptosporidium hominis
KHNTENV

SEQ ID NO: 2115057 - protein, 6 aa, Cryptosporidium hominis
KHPDPL

SEQ ID NO: 2115058 - protein, 6 aa, Cryptosporidium hominis
KHPNGN

SEQ ID NO: 2115059 - protein, 7 aa, Cryptosporidium hominis
KHPQTST

SEQ ID NO: 2115060 - protein, 4 aa, Cryptosporidium hominis
KHSL

SEQ ID NO: 2115061 - protein, 8 aa, Cryptosporidium hominis
KHSNNKWT

SEQ ID NO: 2115062 - protein, 6 aa, Cryptosporidium hominis
KHSSSL

SEQ ID NO: 2115063 - protein, 9 aa, Cryptosporidium hominis
KHTEISKTT

SEQ ID NO: 2115064 - protein, 27 aa, Cryptosporidium hominis
KIAAKKNKIKEEKENTSKGDSNYDNAN

SEQ ID NO: 2115065 - protein, 16 aa, Cryptosporidium hominis
KIASSINNKKVANTIK

SEQ ID NO: 2115066 - protein, 19 aa, Cryptosporidium hominis
KIDSEISQGEYNEKLNESY

SEQ ID NO: 2115067 - protein, 11 aa, Cryptosporidium hominis
KIDSKNEQSQI

SEQ ID NO: 2115068 - protein, 12 aa, Cryptosporidium hominis
KIEDSDNKFKNN

SEQ ID NO: 2115069 - protein, 12 aa, Cryptosporidium hominis
KIEKRNAKIAEQ

SEQ ID NO: 2115070 - protein, 17 aa, Cryptosporidium hominis
KIENINNRSKLQKKREI

SEQ ID NO: 2115071 - protein, 7 aa, Cryptosporidium hominis
KIENLGK

SEQ ID NO: 2115072 - protein, 8 aa, Cryptosporidium hominis
KIENTSIE

SEQ ID NO: 2115073 - protein, 19 aa, Cryptosporidium hominis
KIGQKFSQNNNYPKKSESP

SEQ ID NO: 2115074 - protein, 61 aa, Cryptosporidium hominis
KIKGKGRMKEEEEEEEEEEEEEEKEEEEEEEEEKEEEGKEKEGDDEEDDGEKEETEEDRDF

SEQ ID NO: 2115075 - protein, 9 aa, Cryptosporidium hominis
KIKNGKNDG

SEQ ID NO: 2115076 - protein, 7 aa, Cryptosporidium hominis
KIKNNPG

SEQ ID NO: 2115077 - protein, 9 aa, Cryptosporidium hominis
KIKNQNNNN

SEQ ID NO: 2115078 - protein, 6 aa, Cryptosporidium hominis
KIKPES

SEQ ID NO: 2115079 - protein, 18 aa, Cryptosporidium hominis
KIKSGYRRDSVPVSNASI

SEQ ID NO: 2115080 - protein, 5 aa, Cryptosporidium hominis
KIMPS

SEQ ID NO: 2115081 - protein, 5 aa, Cryptosporidium hominis
KINDE

SEQ ID NO: 2115082 - protein, 11 aa, Cryptosporidium hominis
KINSSQKKVTS

SEQ ID NO: 2115083 - protein, 6 aa, Cryptosporidium hominis
KIPIET

SEQ ID NO: 2115084 - protein, 31 aa, Cryptosporidium hominis
KIPNGNSAEKNTSHKATANNFSNNRAEDISS

SEQ ID NO: 2115085 - protein, 9 aa, Cryptosporidium hominis
KIPQQLNRA

SEQ ID NO: 2115086 - protein, 7 aa, Cryptosporidium hominis
KIQEKQK

SEQ ID NO: 2115087 - protein, 6 aa, Cryptosporidium hominis
KIQPIP

SEQ ID NO: 2115088 - protein, 9 aa, Cryptosporidium hominis
KIRSNTRAE

SEQ ID NO: 2115089 - protein, 6 aa, Cryptosporidium hominis
KISCEN

SEQ ID NO: 2115090 - protein, 13 aa, Cryptosporidium hominis
KISKDENSEEKTD

SEQ ID NO: 2115091 - protein, 5 aa, Cryptosporidium hominis
KISNN

SEQ ID NO: 2115092 - protein, 10 aa, Cryptosporidium hominis
KISPPEDFTP

SEQ ID NO: 2115093 - protein, 6 aa, Cryptosporidium hominis
KISRSS

SEQ ID NO: 2115094 - protein, 8 aa, Cryptosporidium hominis
KISSKGNN

SEQ ID NO: 2115095 - protein, 9 aa, Cryptosporidium hominis
KISSTDSNN

SEQ ID NO: 2115096 - protein, 5 aa, Cryptosporidium hominis
KISVN

SEQ ID NO: 2115097 - protein, 4 aa, Cryptosporidium hominis
KITE

SEQ ID NO: 2115098 - protein, 6 aa, Cryptosporidium hominis
KITGYY

SEQ ID NO: 2115099 - protein, 28 aa, Cryptosporidium hominis
KITPPPTNNNKSNIGNNFNQDNSNGIEL

SEQ ID NO: 2115100 - protein, 6 aa, Cryptosporidium hominis
KITSST

SEQ ID NO: 2115101 - protein, 7 aa, Cryptosporidium hominis
KITTRSP

SEQ ID NO: 2115102 - protein, 7 aa, Cryptosporidium hominis
KKADSCD

SEQ ID NO: 2115103 - protein, 16 aa, Cryptosporidium hominis
KKAELDEYQKMLSKTG

SEQ ID NO: 2115104 - protein, 6 aa, Cryptosporidium hominis
KKAEWA

SEQ ID NO: 2115105 - protein, 7 aa, Cryptosporidium hominis
KKAFENK

SEQ ID NO: 2115106 - protein, 4 aa, Cryptosporidium hominis
KKAG

SEQ ID NO: 2115107 - protein, 8 aa, Cryptosporidium hominis
KKALANSK

SEQ ID NO: 2115108 - protein, 6 aa, Cryptosporidium hominis
KKAPKF

SEQ ID NO: 2115109 - protein, 6 aa, Cryptosporidium hominis
KKDKSY

SEQ ID NO: 2115110 - protein, 8 aa, Cryptosporidium hominis
KKDSPRKK

SEQ ID NO: 2115111 - protein, 5 aa, Cryptosporidium hominis
KKDTL

SEQ ID NO: 2115112 - protein, 7 aa, Cryptosporidium hominis
KKEANGK

SEQ ID NO: 2115113 - protein, 6 aa, Cryptosporidium hominis
KKECYK

SEQ ID NO: 2115114 - protein, 8 aa, Cryptosporidium hominis
KKEEAGLK

SEQ ID NO: 2115115 - protein, 18 aa, Cryptosporidium hominis
KKEESSEVGRISNSSTYR

SEQ ID NO: 2115116 - protein, 14 aa, Cryptosporidium hominis
KKEFPKSTPSGSQI

SEQ ID NO: 2115117 - protein, 12 aa, Cryptosporidium hominis
KKEGKTNGNTTI

SEQ ID NO: 2115118 - protein, 9 aa, Cryptosporidium hominis
KKEIDVRSS

SEQ ID NO: 2115119 - protein, 6 aa, Cryptosporidium hominis
KKEIQS

SEQ ID NO: 2115120 - protein, 28 aa, Cryptosporidium hominis
KKEKKNTGEHGNNSNHNKQERPLDDPTR

SEQ ID NO: 2115121 - protein, 15 aa, Cryptosporidium hominis
KKELESTERNGFGSK

SEQ ID NO: 2115122 - protein, 5 aa, Cryptosporidium hominis
KKELN

SEQ ID NO: 2115123 - protein, 8 aa, Cryptosporidium hominis
KKENESEK

SEQ ID NO: 2115124 - protein, 6 aa, Cryptosporidium hominis
KKENSL

SEQ ID NO: 2115125 - protein, 7 aa, Cryptosporidium hominis
KKEQNRI

SEQ ID NO: 2115126 - protein, 23 aa, Cryptosporidium hominis
KKERSKKNDESNKKGNDISSSIS

SEQ ID NO: 2115127 - protein, 8 aa, Cryptosporidium hominis
KKESGIEL

SEQ ID NO: 2115128 - protein, 6 aa, Cryptosporidium hominis
KKESNI

SEQ ID NO: 2115129 - protein, 7 aa, Cryptosporidium hominis
KKESTDI

SEQ ID NO: 2115130 - protein, 7 aa, Cryptosporidium hominis
KKFRSSK

SEQ ID NO: 2115131 - protein, 5 aa, Cryptosporidium hominis
KKGAE

SEQ ID NO: 2115132 - protein, 10 aa, Cryptosporidium hominis
KKGDTNGGYG

SEQ ID NO: 2115133 - protein, 8 aa, Cryptosporidium hominis
KKGHANLA

SEQ ID NO: 2115134 - protein, 6 aa, Cryptosporidium hominis
KKGKDV

SEQ ID NO: 2115135 - protein, 7 aa, Cryptosporidium hominis
KKGKEWG

SEQ ID NO: 2115136 - protein, 7 aa, Cryptosporidium hominis
KKGKTAV

SEQ ID NO: 2115137 - protein, 8 aa, Cryptosporidium hominis
KKGNSKIS

SEQ ID NO: 2115138 - protein, 6 aa, Cryptosporidium hominis
KKGSKI

SEQ ID NO: 2115139 - protein, 6 aa, Cryptosporidium hominis
KKGTQA

SEQ ID NO: 2115140 - protein, 5 aa, Cryptosporidium hominis
KKGVT

SEQ ID NO: 2115141 - protein, 12 aa, Cryptosporidium hominis
KKGYQSGIERTN

SEQ ID NO: 2115142 - protein, 7 aa, Cryptosporidium hominis
KKHGSTF

SEQ ID NO: 2115143 - protein, 8 aa, Cryptosporidium hominis
KKHQTNNF

SEQ ID NO: 2115144 - protein, 9 aa, Cryptosporidium hominis
KKIDEQPKV

SEQ ID NO: 2115145 - protein, 10 aa, Cryptosporidium hominis
KKINKSPDKR

SEQ ID NO: 2115146 - protein, 10 aa, Cryptosporidium hominis
KKKAGRINPP

SEQ ID NO: 2115147 - protein, 7 aa, Cryptosporidium hominis
KKKASTL

SEQ ID NO: 2115148 - protein, 23 aa, Cryptosporidium hominis
KKKETRTHLNQSQNNPSGSSSSY

SEQ ID NO: 2115149 - protein, 5 aa, Cryptosporidium hominis
KKKFP

SEQ ID NO: 2115150 - protein, 24 aa, Cryptosporidium hominis
KKKGEDGDTFKNQDQDKKLKEEHR

SEQ ID NO: 2115151 - protein, 7 aa, Cryptosporidium hominis
KKKHKED

SEQ ID NO: 2115152 - protein, 5 aa, Cryptosporidium hominis
KKKID

SEQ ID NO: 2115153 - protein, 6 aa, Cryptosporidium hominis
KKKNNF

SEQ ID NO: 2115154 - protein, 4 aa, Cryptosporidium hominis
KKKQ

SEQ ID NO: 2115155 - protein, 6 aa, Cryptosporidium hominis
KKKSAY

SEQ ID NO: 2115156 - protein, 6 aa, Cryptosporidium hominis
KKKSIP

SEQ ID NO: 2115157 - protein, 8 aa, Cryptosporidium hominis
KKKSSSIQ

SEQ ID NO: 2115158 - protein, 6 aa, Cryptosporidium hominis
KKLESD

SEQ ID NO: 2115159 - protein, 22 aa, Cryptosporidium hominis
KKLYSEQSTNHKYNSSLEYQNR

SEQ ID NO: 2115160 - protein, 6 aa, Cryptosporidium hominis
KKMEKR

SEQ ID NO: 2115161 - protein, 17 aa, Cryptosporidium hominis
KKNAFKKQGGDSLGGHS

SEQ ID NO: 2115162 - protein, 8 aa, Cryptosporidium hominis
KKNEESDL

SEQ ID NO: 2115163 - protein, 7 aa, Cryptosporidium hominis
KKNENLK

SEQ ID NO: 2115164 - protein, 13 aa, Cryptosporidium hominis
KKNISSSADTGLQ

SEQ ID NO: 2115165 - protein, 15 aa, Cryptosporidium hominis
KKNLASENIGNTSSD

SEQ ID NO: 2115166 - protein, 8 aa, Cryptosporidium hominis
KKNMNESR

SEQ ID NO: 2115167 - protein, 22 aa, Cryptosporidium hominis
KKNMRQISNKGGDDQSNSINNL

SEQ ID NO: 2115168 - protein, 6 aa, Cryptosporidium hominis
KKNNRR

SEQ ID NO: 2115169 - protein, 7 aa, Cryptosporidium hominis
KKNNSIN

SEQ ID NO: 2115170 - protein, 7 aa, Cryptosporidium hominis
KKNRVKC

SEQ ID NO: 2115171 - protein, 8 aa, Cryptosporidium hominis
KKNSEHIK

SEQ ID NO: 2115172 - protein, 8 aa, Cryptosporidium hominis
KKNSIKNL

SEQ ID NO: 2115173 - protein, 8 aa, Cryptosporidium hominis
KKNSNIGK

SEQ ID NO: 2115174 - protein, 9 aa, Cryptosporidium hominis
KKNTSEDDK

SEQ ID NO: 2115175 - protein, 10 aa, Cryptosporidium hominis
KKNVKESKIY

SEQ ID NO: 2115176 - protein, 6 aa, Cryptosporidium hominis
KKNYEN

SEQ ID NO: 2115177 - protein, 16 aa, Cryptosporidium hominis
KKPKNLNGDDENNAIN

SEQ ID NO: 2115178 - protein, 6 aa, Cryptosporidium hominis
KKPNCK

SEQ ID NO: 2115179 - protein, 10 aa, Cryptosporidium hominis
KKPSSVENQD

SEQ ID NO: 2115180 - protein, 15 aa, Cryptosporidium hominis
KKQDSEGIKKEYKDG

SEQ ID NO: 2115181 - protein, 6 aa, Cryptosporidium hominis
KKQETV

SEQ ID NO: 2115182 - protein, 10 aa, Cryptosporidium hominis
KKQGDQPRYG

SEQ ID NO: 2115183 - protein, 4 aa, Cryptosporidium hominis
KKQI

SEQ ID NO: 2115184 - protein, 4 aa, Cryptosporidium hominis
KKQL

SEQ ID NO: 2115185 - protein, 10 aa, Cryptosporidium hominis
KKQSGAPKRV

SEQ ID NO: 2115186 - protein, 5 aa, Cryptosporidium hominis
KKQTF

SEQ ID NO: 2115187 - protein, 18 aa, Cryptosporidium hominis
KKREKELREKRKKYRSPL

SEQ ID NO: 2115188 - protein, 7 aa, Cryptosporidium hominis
KKRHGFT

SEQ ID NO: 2115189 - protein, 14 aa, Cryptosporidium hominis
KKRKNRIYEYLYKE

SEQ ID NO: 2115190 - protein, 20 aa, Cryptosporidium hominis
KKRNKQQTIYKGKQKETLSS

SEQ ID NO: 2115191 - protein, 24 aa, Cryptosporidium hominis
KKRTGKETKKETEAKRDAEVGIEG

SEQ ID NO: 2115192 - protein, 11 aa, Cryptosporidium hominis
KKRTSKDPNYK

SEQ ID NO: 2115193 - protein, 8 aa, Cryptosporidium hominis
KKSDNSDI

SEQ ID NO: 2115194 - protein, 7 aa, Cryptosporidium hominis
KKSENDE

SEQ ID NO: 2115195 - protein, 6 aa, Cryptosporidium hominis
KKSISN

SEQ ID NO: 2115196 - protein, 15 aa, Cryptosporidium hominis
KKSKRSKKLGKKNSG

SEQ ID NO: 2115197 - protein, 34 aa, Cryptosporidium hominis
KKSKVYNRKGEESEIEESDNDDSDDSSDDDDNDD

SEQ ID NO: 2115198 - protein, 6 aa, Cryptosporidium hominis
KKSKYF

SEQ ID NO: 2115199 - protein, 23 aa, Cryptosporidium hominis
KKSKYKIDNPELGPESNLDRSKR

SEQ ID NO: 2115200 - protein, 4 aa, Cryptosporidium hominis
KKSN

SEQ ID NO: 2115201 - protein, 8 aa, Cryptosporidium hominis
KKSNEKNK

SEQ ID NO: 2115202 - protein, 16 aa, Cryptosporidium hominis
KKSNGTCTSLNSKTTT

SEQ ID NO: 2115203 - protein, 5 aa, Cryptosporidium hominis
KKSNH

SEQ ID NO: 2115204 - protein, 74 aa, Cryptosporidium hominis
KKSNSTDSSKEEKKKRKKEEKERKKQEKEMKKQEKASEKAQAKEMKKKDKEDEKEIKNLGKKNNISSKEVSKKL

SEQ ID NO: 2115205 - protein, 5 aa, Cryptosporidium hominis
KKSPH

SEQ ID NO: 2115206 - protein, 7 aa, Cryptosporidium hominis
KKSPRTS

SEQ ID NO: 2115207 - protein, 6 aa, Cryptosporidium hominis
KKSQEC

SEQ ID NO: 2115208 - protein, 6 aa, Cryptosporidium hominis
KKSRLL

SEQ ID NO: 2115209 - protein, 6 aa, Cryptosporidium hominis
KKSSDI

SEQ ID NO: 2115210 - protein, 5 aa, Cryptosporidium hominis
KKSSS

SEQ ID NO: 2115211 - protein, 9 aa, Cryptosporidium hominis
KKSSSAGNK

SEQ ID NO: 2115212 - protein, 7 aa, Cryptosporidium hominis
KKSSVDT

SEQ ID NO: 2115213 - protein, 17 aa, Cryptosporidium hominis
KKSTETKSYNEKEDDYY

SEQ ID NO: 2115214 - protein, 7 aa, Cryptosporidium hominis
KKSTIGG

SEQ ID NO: 2115215 - protein, 7 aa, Cryptosporidium hominis
KKSTNLE

SEQ ID NO: 2115216 - protein, 23 aa, Cryptosporidium hominis
KKTDSSTGEAEKEHKTGIKSSDI

SEQ ID NO: 2115217 - protein, 4 aa, Cryptosporidium hominis
KKTI

SEQ ID NO: 2115218 - protein, 6 aa, Cryptosporidium hominis
KKTSNF

SEQ ID NO: 2115219 - protein, 5 aa, Cryptosporidium hominis
KKTVE

SEQ ID NO: 2115220 - protein, 8 aa, Cryptosporidium hominis
KKTVSTSN

SEQ ID NO: 2115221 - protein, 14 aa, Cryptosporidium hominis
KKVRKNKDSKANKL

SEQ ID NO: 2115222 - protein, 4 aa, Cryptosporidium hominis
KKVS

SEQ ID NO: 2115223 - protein, 12 aa, Cryptosporidium hominis
KKVSCSNPSSVN

SEQ ID NO: 2115224 - protein, 40 aa, Cryptosporidium hominis
KKVSRESNKGEGLESPKSARLGSSRGDHPKTTKHRKHKQY

SEQ ID NO: 2115225 - protein, 11 aa, Cryptosporidium hominis
KKVTSKDLKSR

SEQ ID NO: 2115226 - protein, 7 aa, Cryptosporidium hominis
KKYASNG

SEQ ID NO: 2115227 - protein, 4 aa, Cryptosporidium hominis
KKYG

SEQ ID NO: 2115228 - protein, 6 aa, Cryptosporidium hominis
KKYITK

SEQ ID NO: 2115229 - protein, 12 aa, Cryptosporidium hominis
KKYKQNQEDECN

SEQ ID NO: 2115230 - protein, 5 aa, Cryptosporidium hominis
KKYPV

SEQ ID NO: 2115231 - protein, 4 aa, Cryptosporidium hominis
KKYQ

SEQ ID NO: 2115232 - protein, 9 aa, Cryptosporidium hominis
KKYSKSSDY

SEQ ID NO: 2115233 - protein, 4 aa, Cryptosporidium hominis
KLDE

SEQ ID NO: 2115234 - protein, 13 aa, Cryptosporidium hominis
KLDGEAPTADQDL

SEQ ID NO: 2115235 - protein, 18 aa, Cryptosporidium hominis
KLDKSESKLKSSNQGNIA

SEQ ID NO: 2115236 - protein, 7 aa, Cryptosporidium hominis
KLDQEEL

SEQ ID NO: 2115237 - protein, 6 aa, Cryptosporidium hominis
KLDSPA

SEQ ID NO: 2115238 - protein, 5 aa, Cryptosporidium hominis
KLEDL

SEQ ID NO: 2115239 - protein, 11 aa, Cryptosporidium hominis
KLEDYGVENGT

SEQ ID NO: 2115240 - protein, 12 aa, Cryptosporidium hominis
KLENINSNNYSN

SEQ ID NO: 2115241 - protein, 14 aa, Cryptosporidium hominis
KLERSGSVGSSSGS

SEQ ID NO: 2115242 - protein, 5 aa, Cryptosporidium hominis
KLGER

SEQ ID NO: 2115243 - protein, 30 aa, Cryptosporidium hominis
KLGKKSQKSIRKGGTCENNLEKGKNPKLEM

SEQ ID NO: 2115244 - protein, 9 aa, Cryptosporidium hominis
KLGNREEAS

SEQ ID NO: 2115245 - protein, 8 aa, Cryptosporidium hominis
KLGPGSGV

SEQ ID NO: 2115246 - protein, 5 aa, Cryptosporidium hominis
KLGRK

SEQ ID NO: 2115247 - protein, 6 aa, Cryptosporidium hominis
KLHSSG

SEQ ID NO: 2115248 - protein, 8 aa, Cryptosporidium hominis
KLIGSSTN

SEQ ID NO: 2115249 - protein, 7 aa, Cryptosporidium hominis
KLKETKK

SEQ ID NO: 2115250 - protein, 6 aa, Cryptosporidium hominis
KLKIDG

SEQ ID NO: 2115251 - protein, 4 aa, Cryptosporidium hominis
KLKK

SEQ ID NO: 2115252 - protein, 12 aa, Cryptosporidium hominis
KLKKKNRGFNEG

SEQ ID NO: 2115253 - protein, 9 aa, Cryptosporidium hominis
KLKPEDKNH

SEQ ID NO: 2115254 - protein, 7 aa, Cryptosporidium hominis
KLKTEKP

SEQ ID NO: 2115255 - protein, 14 aa, Cryptosporidium hominis
KLNEKTGKLESSKN

SEQ ID NO: 2115256 - protein, 11 aa, Cryptosporidium hominis
KLNKNENQKNY

SEQ ID NO: 2115257 - protein, 7 aa, Cryptosporidium hominis
KLNNGHK

SEQ ID NO: 2115258 - protein, 6 aa, Cryptosporidium hominis
KLNNSL

SEQ ID NO: 2115259 - protein, 7 aa, Cryptosporidium hominis
KLNSKKN

SEQ ID NO: 2115260 - protein, 9 aa, Cryptosporidium hominis
KLNTSNSEN

SEQ ID NO: 2115261 - protein, 7 aa, Cryptosporidium hominis
KLNYETE

SEQ ID NO: 2115262 - protein, 5 aa, Cryptosporidium hominis
KLPGD

SEQ ID NO: 2115263 - protein, 13 aa, Cryptosporidium hominis
KLPPSNNSETSQL

SEQ ID NO: 2115264 - protein, 7 aa, Cryptosporidium hominis
KLPSDPE

SEQ ID NO: 2115265 - protein, 9 aa, Cryptosporidium hominis
KLPSTTKNL

SEQ ID NO: 2115266 - protein, 7 aa, Cryptosporidium hominis
KLPTDND

SEQ ID NO: 2115267 - protein, 13 aa, Cryptosporidium hominis
KLQENENSDNFTA

SEQ ID NO: 2115268 - protein, 25 aa, Cryptosporidium hominis
KLQEYSHQNNSAKRNFSMPPKSNPV

SEQ ID NO: 2115269 - protein, 19 aa, Cryptosporidium hominis
KLQKGGRYQGSMKETKAIG

SEQ ID NO: 2115270 - protein, 10 aa, Cryptosporidium hominis
KLQSKHPNTG

SEQ ID NO: 2115271 - protein, 17 aa, Cryptosporidium hominis
KLRHKDGVRKRLGSIFV

SEQ ID NO: 2115272 - protein, 10 aa, Cryptosporidium hominis
KLSEKSQSID

SEQ ID NO: 2115273 - protein, 5 aa, Cryptosporidium hominis
KLSER

SEQ ID NO: 2115274 - protein, 5 aa, Cryptosporidium hominis
KLSFK

SEQ ID NO: 2115275 - protein, 6 aa, Cryptosporidium hominis
KLSGEE

SEQ ID NO: 2115276 - protein, 7 aa, Cryptosporidium hominis
KLSNPPC

SEQ ID NO: 2115277 - protein, 10 aa, Cryptosporidium hominis
KLSQDSHSDE

SEQ ID NO: 2115278 - protein, 8 aa, Cryptosporidium hominis
KLSQMDQT

SEQ ID NO: 2115279 - protein, 11 aa, Cryptosporidium hominis
KLSSALSTNTL

SEQ ID NO: 2115280 - protein, 20 aa, Cryptosporidium hominis
KLSSNNTNTFDSTEKTEQFK

SEQ ID NO: 2115281 - protein, 6 aa, Cryptosporidium hominis
KLSSSG

SEQ ID NO: 2115282 - protein, 11 aa, Cryptosporidium hominis
KLTPQPVPDPL

SEQ ID NO: 2115283 - protein, 20 aa, Cryptosporidium hominis
KLTSSNKKRKKEIKKLNSNM

SEQ ID NO: 2115284 - protein, 6 aa, Cryptosporidium hominis
KMEKEE

SEQ ID NO: 2115285 - protein, 10 aa, Cryptosporidium hominis
KMIETSDNGK

SEQ ID NO: 2115286 - protein, 8 aa, Cryptosporidium hominis
KMKEASER

SEQ ID NO: 2115287 - protein, 10 aa, Cryptosporidium hominis
KMKENKLSNY

SEQ ID NO: 2115288 - protein, 11 aa, Cryptosporidium hominis
KMNKTSSIKRN

SEQ ID NO: 2115289 - protein, 22 aa, Cryptosporidium hominis
KMNNNGVNEKVEAKRREKIRSE

SEQ ID NO: 2115290 - protein, 4 aa, Cryptosporidium hominis
KMSQ

SEQ ID NO: 2115291 - protein, 5 aa, Cryptosporidium hominis
KNAAQ

SEQ ID NO: 2115292 - protein, 11 aa, Cryptosporidium hominis
KNALNDQNLSP

SEQ ID NO: 2115293 - protein, 9 aa, Cryptosporidium hominis
KNASEDQNI

SEQ ID NO: 2115294 - protein, 9 aa, Cryptosporidium hominis
KNATTSNLP

SEQ ID NO: 2115295 - protein, 4 aa, Cryptosporidium hominis
KNCE

SEQ ID NO: 2115296 - protein, 6 aa, Cryptosporidium hominis
KNDIQQ

SEQ ID NO: 2115297 - protein, 8 aa, Cryptosporidium hominis
KNDQREIC

SEQ ID NO: 2115298 - protein, 6 aa, Cryptosporidium hominis
KNDQSD

SEQ ID NO: 2115299 - protein, 4 aa, Cryptosporidium hominis
KNDR

SEQ ID NO: 2115300 - protein, 8 aa, Cryptosporidium hominis
KNDRTNRI

SEQ ID NO: 2115301 - protein, 41 aa, Cryptosporidium hominis
KNDSTECSNLNSGDENISSLENTEFNEASYANRSRSYKSHS

SEQ ID NO: 2115302 - protein, 17 aa, Cryptosporidium hominis
KNDSTSSTTETTDSSNQ

SEQ ID NO: 2115303 - protein, 10 aa, Cryptosporidium hominis
KNDTGNPSSI

SEQ ID NO: 2115304 - protein, 5 aa, Cryptosporidium hominis
KNEDQ

SEQ ID NO: 2115305 - protein, 4 aa, Cryptosporidium hominis
KNEE

SEQ ID NO: 2115306 - protein, 15 aa, Cryptosporidium hominis
KNEEITRRDKRNENI

SEQ ID NO: 2115307 - protein, 6 aa, Cryptosporidium hominis
KNEESC

SEQ ID NO: 2115308 - protein, 7 aa, Cryptosporidium hominis
KNEFDRE

SEQ ID NO: 2115309 - protein, 11 aa, Cryptosporidium hominis
KNEGNKNGELR

SEQ ID NO: 2115310 - protein, 7 aa, Cryptosporidium hominis
KNEKSGI

SEQ ID NO: 2115311 - protein, 6 aa, Cryptosporidium hominis
KNELSS

SEQ ID NO: 2115312 - protein, 7 aa, Cryptosporidium hominis
KNENNQQ

SEQ ID NO: 2115313 - protein, 8 aa, Cryptosporidium hominis
KNERKTPE

SEQ ID NO: 2115314 - protein, 5 aa, Cryptosporidium hominis
KNESL

SEQ ID NO: 2115315 - protein, 8 aa, Cryptosporidium hominis
KNETNTEI

SEQ ID NO: 2115316 - protein, 9 aa, Cryptosporidium hominis
KNFSNNKNE

SEQ ID NO: 2115317 - protein, 9 aa, Cryptosporidium hominis
KNGDGQLDR

SEQ ID NO: 2115318 - protein, 9 aa, Cryptosporidium hominis
KNGFEKTAN

SEQ ID NO: 2115319 - protein, 6 aa, Cryptosporidium hominis
KNGKAY

SEQ ID NO: 2115320 - protein, 8 aa, Cryptosporidium hominis
KNGNLKSR

SEQ ID NO: 2115321 - protein, 56 aa, Cryptosporidium hominis
KNGSNHQKSNNQKKIVEEQQADHNYSNTNNNNSSNERSQTQADNKNKNQSLPTTLP

SEQ ID NO: 2115322 - protein, 18 aa, Cryptosporidium hominis
KNHEQLKRDYAKNSKIHE

SEQ ID NO: 2115323 - protein, 7 aa, Cryptosporidium hominis
KNHSKKN

SEQ ID NO: 2115324 - protein, 11 aa, Cryptosporidium hominis
KNIEGSKISRD

SEQ ID NO: 2115325 - protein, 12 aa, Cryptosporidium hominis
KNIEPTKKEKCS

SEQ ID NO: 2115326 - protein, 5 aa, Cryptosporidium hominis
KNIET

SEQ ID NO: 2115327 - protein, 18 aa, Cryptosporidium hominis
KNIKNSYSRIKNSKSHNF

SEQ ID NO: 2115328 - protein, 9 aa, Cryptosporidium hominis
KNINSSYSS

SEQ ID NO: 2115329 - protein, 4 aa, Cryptosporidium hominis
KNIP

SEQ ID NO: 2115330 - protein, 8 aa, Cryptosporidium hominis
KNIPSPKS

SEQ ID NO: 2115331 - protein, 15 aa, Cryptosporidium hominis
KNISEYGADTATQPV

SEQ ID NO: 2115332 - protein, 7 aa, Cryptosporidium hominis
KNITDST

SEQ ID NO: 2115333 - protein, 6 aa, Cryptosporidium hominis
KNITEL

SEQ ID NO: 2115334 - protein, 10 aa, Cryptosporidium hominis
KNKAKKMKEQ

SEQ ID NO: 2115335 - protein, 6 aa, Cryptosporidium hominis
KNKEQL

SEQ ID NO: 2115336 - protein, 8 aa, Cryptosporidium hominis
KNKESKSV

SEQ ID NO: 2115337 - protein, 17 aa, Cryptosporidium hominis
KNKESQRIENMPLLNNK

SEQ ID NO: 2115338 - protein, 5 aa, Cryptosporidium hominis
KNKIH

SEQ ID NO: 2115339 - protein, 5 aa, Cryptosporidium hominis
KNKIR

SEQ ID NO: 2115340 - protein, 8 aa, Cryptosporidium hominis
KNKKSPFD

SEQ ID NO: 2115341 - protein, 7 aa, Cryptosporidium hominis
KNKNEIS

SEQ ID NO: 2115342 - protein, 6 aa, Cryptosporidium hominis
KNKNGI

SEQ ID NO: 2115343 - protein, 7 aa, Cryptosporidium hominis
KNKNISS

SEQ ID NO: 2115344 - protein, 4 aa, Cryptosporidium hominis
KNKQ

SEQ ID NO: 2115345 - protein, 8 aa, Cryptosporidium hominis
KNKSISSS

SEQ ID NO: 2115346 - protein, 6 aa, Cryptosporidium hominis
KNKTIP

SEQ ID NO: 2115347 - protein, 6 aa, Cryptosporidium hominis
KNKTYR

SEQ ID NO: 2115348 - protein, 12 aa, Cryptosporidium hominis
KNKYKASVPKST

SEQ ID NO: 2115349 - protein, 25 aa, Cryptosporidium hominis
KNLEENSRENKVINPESCTKYENGT

SEQ ID NO: 2115350 - protein, 10 aa, Cryptosporidium hominis
KNLGKNNLEE

SEQ ID NO: 2115351 - protein, 20 aa, Cryptosporidium hominis
KNLNSEESGFSSGENEPVVK

SEQ ID NO: 2115352 - protein, 6 aa, Cryptosporidium hominis
KNLQIS

SEQ ID NO: 2115353 - protein, 10 aa, Cryptosporidium hominis
KNLSQSSKNN

SEQ ID NO: 2115354 - protein, 9 aa, Cryptosporidium hominis
KNLTEAQEV

SEQ ID NO: 2115355 - protein, 23 aa, Cryptosporidium hominis
KNLVDSKNETEKKSLKNNNKELI

SEQ ID NO: 2115356 - protein, 14 aa, Cryptosporidium hominis
KNMDGNNGNCNHNK

SEQ ID NO: 2115357 - protein, 5 aa, Cryptosporidium hominis
KNNDF

SEQ ID NO: 2115358 - protein, 9 aa, Cryptosporidium hominis
KNNDNKYNN

SEQ ID NO: 2115359 - protein, 7 aa, Cryptosporidium hominis
KNNEADE

SEQ ID NO: 2115360 - protein, 6 aa, Cryptosporidium hominis
KNNESF

SEQ ID NO: 2115361 - protein, 9 aa, Cryptosporidium hominis
KNNGENSLE

SEQ ID NO: 2115362 - protein, 8 aa, Cryptosporidium hominis
KNNHGQNS

SEQ ID NO: 2115363 - protein, 6 aa, Cryptosporidium hominis
KNNKDG

SEQ ID NO: 2115364 - protein, 6 aa, Cryptosporidium hominis
KNNKKD

SEQ ID NO: 2115365 - protein, 6 aa, Cryptosporidium hominis
KNNKSE

SEQ ID NO: 2115366 - protein, 14 aa, Cryptosporidium hominis
KNNNHTKLQSLSPN

SEQ ID NO: 2115367 - protein, 6 aa, Cryptosporidium hominis
KNNNIP

SEQ ID NO: 2115368 - protein, 6 aa, Cryptosporidium hominis
KNNNIT

SEQ ID NO: 2115369 - protein, 15 aa, Cryptosporidium hominis
KNNNSNKNNKSSSQI

SEQ ID NO: 2115370 - protein, 7 aa, Cryptosporidium hominis
KNNNSTM

SEQ ID NO: 2115371 - protein, 16 aa, Cryptosporidium hominis
KNNPRFSSESVEDRGT

SEQ ID NO: 2115372 - protein, 7 aa, Cryptosporidium hominis
KNNPSDA

SEQ ID NO: 2115373 - protein, 19 aa, Cryptosporidium hominis
KNNQLPLDKKGNNSNIKDS

SEQ ID NO: 2115374 - protein, 13 aa, Cryptosporidium hominis
KNNQRLNDEASEF

SEQ ID NO: 2115375 - protein, 6 aa, Cryptosporidium hominis
KNNSDL

SEQ ID NO: 2115376 - protein, 7 aa, Cryptosporidium hominis
KNNSSLM

SEQ ID NO: 2115377 - protein, 14 aa, Cryptosporidium hominis
KNPEGNKQIEEKSK

SEQ ID NO: 2115378 - protein, 7 aa, Cryptosporidium hominis
KNPESKP

SEQ ID NO: 2115379 - protein, 6 aa, Cryptosporidium hominis
KNPESL

SEQ ID NO: 2115380 - protein, 9 aa, Cryptosporidium hominis
KNPGNPNFN

SEQ ID NO: 2115381 - protein, 6 aa, Cryptosporidium hominis
KNPIFP

SEQ ID NO: 2115382 - protein, 18 aa, Cryptosporidium hominis
KNPNLNSDSTSKNSDNQF

SEQ ID NO: 2115383 - protein, 7 aa, Cryptosporidium hominis
KNPPPVQ

SEQ ID NO: 2115384 - protein, 5 aa, Cryptosporidium hominis
KNPSQ

SEQ ID NO: 2115385 - protein, 6 aa, Cryptosporidium hominis
KNPVEN

SEQ ID NO: 2115386 - protein, 8 aa, Cryptosporidium hominis
KNQDPSID

SEQ ID NO: 2115387 - protein, 28 aa, Cryptosporidium hominis
KNQEISEDVDGNENESENQVKDSDSNSG

SEQ ID NO: 2115388 - protein, 7 aa, Cryptosporidium hominis
KNQGFES

SEQ ID NO: 2115389 - protein, 4 aa, Cryptosporidium hominis
KNQK

SEQ ID NO: 2115390 - protein, 6 aa, Cryptosporidium hominis
KNQRIK

SEQ ID NO: 2115391 - protein, 9 aa, Cryptosporidium hominis
KNQRNSGIK

SEQ ID NO: 2115392 - protein, 7 aa, Cryptosporidium hominis
KNQTGSI

SEQ ID NO: 2115393 - protein, 7 aa, Cryptosporidium hominis
KNREDKQ

SEQ ID NO: 2115394 - protein, 8 aa, Cryptosporidium hominis
KNRGDDSA

SEQ ID NO: 2115395 - protein, 4 aa, Cryptosporidium hominis
KNRN

SEQ ID NO: 2115396 - protein, 7 aa, Cryptosporidium hominis
KNRNNGY

SEQ ID NO: 2115397 - protein, 8 aa, Cryptosporidium hominis
KNRPTALP

SEQ ID NO: 2115398 - protein, 7 aa, Cryptosporidium hominis
KNRVEHE

SEQ ID NO: 2115399 - protein, 6 aa, Cryptosporidium hominis
KNRYSS

SEQ ID NO: 2115400 - protein, 6 aa, Cryptosporidium hominis
KNSADL

SEQ ID NO: 2115401 - protein, 10 aa, Cryptosporidium hominis
KNSECSSDLD

SEQ ID NO: 2115402 - protein, 8 aa, Cryptosporidium hominis
KNSEFSEN

SEQ ID NO: 2115403 - protein, 15 aa, Cryptosporidium hominis
KNSEGRTKSSSSIPT

SEQ ID NO: 2115404 - protein, 18 aa, Cryptosporidium hominis
KNSGEKITEGGRSDHEKK

SEQ ID NO: 2115405 - protein, 6 aa, Cryptosporidium hominis
KNSGNL

SEQ ID NO: 2115406 - protein, 5 aa, Cryptosporidium hominis
KNSHD

SEQ ID NO: 2115407 - protein, 10 aa, Cryptosporidium hominis
KNSHIDTKKN

SEQ ID NO: 2115408 - protein, 9 aa, Cryptosporidium hominis
KNSKELNSE

SEQ ID NO: 2115409 - protein, 9 aa, Cryptosporidium hominis
KNSNKINKT

SEQ ID NO: 2115410 - protein, 8 aa, Cryptosporidium hominis
KNSPENVT

SEQ ID NO: 2115411 - protein, 7 aa, Cryptosporidium hominis
KNSQRIN

SEQ ID NO: 2115412 - protein, 9 aa, Cryptosporidium hominis
KNSSLNKNS

SEQ ID NO: 2115413 - protein, 6 aa, Cryptosporidium hominis
KNSSNL

SEQ ID NO: 2115414 - protein, 8 aa, Cryptosporidium hominis
KNSSPLNK

SEQ ID NO: 2115415 - protein, 8 aa, Cryptosporidium hominis
KNSSTKSL

SEQ ID NO: 2115416 - protein, 26 aa, Cryptosporidium hominis
KNTATNTRNASSIPVESKKQTDSTIG

SEQ ID NO: 2115417 - protein, 7 aa, Cryptosporidium hominis
KNTCEYY

SEQ ID NO: 2115418 - protein, 4 aa, Cryptosporidium hominis
KNTN

SEQ ID NO: 2115419 - protein, 15 aa, Cryptosporidium hominis
KNTNLDGESRSPKCD

SEQ ID NO: 2115420 - protein, 7 aa, Cryptosporidium hominis
KNTNLSD

SEQ ID NO: 2115421 - protein, 9 aa, Cryptosporidium hominis
KNTQTSEKK

SEQ ID NO: 2115422 - protein, 11 aa, Cryptosporidium hominis
KNTTNTLSEKS

SEQ ID NO: 2115423 - protein, 11 aa, Cryptosporidium hominis
KNVEDSINENT

SEQ ID NO: 2115424 - protein, 20 aa, Cryptosporidium hominis
KNVEGEHKNLENNSKYIQNN

SEQ ID NO: 2115425 - protein, 4 aa, Cryptosporidium hominis
KNVG

SEQ ID NO: 2115426 - protein, 19 aa, Cryptosporidium hominis
KNVGAKKKSSVKSKMDQQN

SEQ ID NO: 2115427 - protein, 9 aa, Cryptosporidium hominis
KNVSEGAKD

SEQ ID NO: 2115428 - protein, 6 aa, Cryptosporidium hominis
KNYFNE

SEQ ID NO: 2115429 - protein, 6 aa, Cryptosporidium hominis
KNYPDP

SEQ ID NO: 2115430 - protein, 10 aa, Cryptosporidium hominis
KNYPKVKKSG

SEQ ID NO: 2115431 - protein, 18 aa, Cryptosporidium hominis
KNYQELNESREEFNGSRG

SEQ ID NO: 2115432 - protein, 7 aa, Cryptosporidium hominis
KNYSNEY

SEQ ID NO: 2115433 - protein, 9 aa, Cryptosporidium hominis
KNYSNSIKN

SEQ ID NO: 2115434 - protein, 4 aa, Cryptosporidium hominis
KNYT

SEQ ID NO: 2115435 - protein, 10 aa, Cryptosporidium hominis
KNYTSKETLG

SEQ ID NO: 2115436 - protein, 7 aa, Cryptosporidium hominis
KPDKSFS

SEQ ID NO: 2115437 - protein, 4 aa, Cryptosporidium hominis
KPDP

SEQ ID NO: 2115438 - protein, 7 aa, Cryptosporidium hominis
KPDSDEC

SEQ ID NO: 2115439 - protein, 5 aa, Cryptosporidium hominis
KPEAI

SEQ ID NO: 2115440 - protein, 16 aa, Cryptosporidium hominis
KPEEQKNNIINIFQKI

SEQ ID NO: 2115441 - protein, 6 aa, Cryptosporidium hominis
KPEGVS

SEQ ID NO: 2115442 - protein, 17 aa, Cryptosporidium hominis
KPEYQRSDQNFRRGSGK

SEQ ID NO: 2115443 - protein, 13 aa, Cryptosporidium hominis
KPFYTGANSGITN

SEQ ID NO: 2115444 - protein, 11 aa, Cryptosporidium hominis
KPGEIPDTPEW

SEQ ID NO: 2115445 - protein, 5 aa, Cryptosporidium hominis
KPGWG

SEQ ID NO: 2115446 - protein, 75 aa, Cryptosporidium hominis
KPHKTTTTTTTSTTTTTTTTTTTTTTTTTTTTTTTTTTTTTTTTTTTTTTTTTTTTTTTTTTTTTTTTTTEAPSL

SEQ ID NO: 2115447 - protein, 14 aa, Cryptosporidium hominis
KPIKSNEKQKNKQI

SEQ ID NO: 2115448 - protein, 9 aa, Cryptosporidium hominis
KPINNIETS

SEQ ID NO: 2115449 - protein, 8 aa, Cryptosporidium hominis
KPINSTAP

SEQ ID NO: 2115450 - protein, 9 aa, Cryptosporidium hominis
KPIPQGNNN

SEQ ID NO: 2115451 - protein, 18 aa, Cryptosporidium hominis
KPISKQEESRNEVSQHDI

SEQ ID NO: 2115452 - protein, 7 aa, Cryptosporidium hominis
KPISPKN

SEQ ID NO: 2115453 - protein, 9 aa, Cryptosporidium hominis
KPKFDNENN

SEQ ID NO: 2115454 - protein, 5 aa, Cryptosporidium hominis
KPKGF

SEQ ID NO: 2115455 - protein, 7 aa, Cryptosporidium hominis
KPKGFRT

SEQ ID NO: 2115456 - protein, 9 aa, Cryptosporidium hominis
KPKGKTIPP

SEQ ID NO: 2115457 - protein, 8 aa, Cryptosporidium hominis
KPKKGWSE

SEQ ID NO: 2115458 - protein, 7 aa, Cryptosporidium hominis
KPKKPSD

SEQ ID NO: 2115459 - protein, 13 aa, Cryptosporidium hominis
KPKNSSNSQDRTI

SEQ ID NO: 2115460 - protein, 4 aa, Cryptosporidium hominis
KPKQ

SEQ ID NO: 2115461 - protein, 10 aa, Cryptosporidium hominis
KPKYAPPSHN

SEQ ID NO: 2115462 - protein, 6 aa, Cryptosporidium hominis
KPLGEK

SEQ ID NO: 2115463 - protein, 6 aa, Cryptosporidium hominis
KPLNET

SEQ ID NO: 2115464 - protein, 7 aa, Cryptosporidium hominis
KPLPNSD

SEQ ID NO: 2115465 - protein, 7 aa, Cryptosporidium hominis
KPLSPNQ

SEQ ID NO: 2115466 - protein, 6 aa, Cryptosporidium hominis
KPNEGF

SEQ ID NO: 2115467 - protein, 33 aa, Cryptosporidium hominis
KPNSFQEKRGPEISPRQKVTNSNSPAASPSLRE

SEQ ID NO: 2115468 - protein, 9 aa, Cryptosporidium hominis
KPNYKTYED

SEQ ID NO: 2115469 - protein, 8 aa, Cryptosporidium hominis
KPPEGYEK

SEQ ID NO: 2115470 - protein, 15 aa, Cryptosporidium hominis
KPPVDSPTLNEATTT

SEQ ID NO: 2115471 - protein, 19 aa, Cryptosporidium hominis
KPQRNATKTNKKPNKFKDS

SEQ ID NO: 2115472 - protein, 4 aa, Cryptosporidium hominis
KPQT

SEQ ID NO: 2115473 - protein, 4 aa, Cryptosporidium hominis
KPRI

SEQ ID NO: 2115474 - protein, 6 aa, Cryptosporidium hominis
KPRKVS

SEQ ID NO: 2115475 - protein, 7 aa, Cryptosporidium hominis
KPRLSNQ

SEQ ID NO: 2115476 - protein, 12 aa, Cryptosporidium hominis
KPRSNVSRNTLE

SEQ ID NO: 2115477 - protein, 5 aa, Cryptosporidium hominis
KPSEI

SEQ ID NO: 2115478 - protein, 7 aa, Cryptosporidium hominis
KPSGDKF

SEQ ID NO: 2115479 - protein, 7 aa, Cryptosporidium hominis
KPSPDVF

SEQ ID NO: 2115480 - protein, 6 aa, Cryptosporidium hominis
KPSPLY

SEQ ID NO: 2115481 - protein, 8 aa, Cryptosporidium hominis
KPSPYKKD

SEQ ID NO: 2115482 - protein, 10 aa, Cryptosporidium hominis
KPSQDADLRE

SEQ ID NO: 2115483 - protein, 6 aa, Cryptosporidium hominis
KPSTEI

SEQ ID NO: 2115484 - protein, 6 aa, Cryptosporidium hominis
KPTKYS

SEQ ID NO: 2115485 - protein, 5 aa, Cryptosporidium hominis
KPTNS

SEQ ID NO: 2115486 - protein, 14 aa, Cryptosporidium hominis
KPTSSSSTTTTSEP

SEQ ID NO: 2115487 - protein, 5 aa, Cryptosporidium hominis
KPVDF

SEQ ID NO: 2115488 - protein, 9 aa, Cryptosporidium hominis
KPVGTNTGD

SEQ ID NO: 2115489 - protein, 17 aa, Cryptosporidium hominis
KPVNNSNNSTKAANLSA

SEQ ID NO: 2115490 - protein, 9 aa, Cryptosporidium hominis
KQASSNNGF

SEQ ID NO: 2115491 - protein, 10 aa, Cryptosporidium hominis
KQDHSSPGIE

SEQ ID NO: 2115492 - protein, 12 aa, Cryptosporidium hominis
KQDQNGNNQAIL

SEQ ID NO: 2115493 - protein, 8 aa, Cryptosporidium hominis
KQDTTKAY

SEQ ID NO: 2115494 - protein, 6 aa, Cryptosporidium hominis
KQDYNS

SEQ ID NO: 2115495 - protein, 11 aa, Cryptosporidium hominis
KQEDNDLKEAS

SEQ ID NO: 2115496 - protein, 5 aa, Cryptosporidium hominis
KQEKA

SEQ ID NO: 2115497 - protein, 9 aa, Cryptosporidium hominis
KQEKGVDNR

SEQ ID NO: 2115498 - protein, 12 aa, Cryptosporidium hominis
KQELGKKDSSIE

SEQ ID NO: 2115499 - protein, 4 aa, Cryptosporidium hominis
KQEN

SEQ ID NO: 2115500 - protein, 7 aa, Cryptosporidium hominis
KQESPNS

SEQ ID NO: 2115501 - protein, 6 aa, Cryptosporidium hominis
KQFSPS

SEQ ID NO: 2115502 - protein, 11 aa, Cryptosporidium hominis
KQGEDDPSEIK

SEQ ID NO: 2115503 - protein, 8 aa, Cryptosporidium hominis
KQGFSEKE

SEQ ID NO: 2115504 - protein, 8 aa, Cryptosporidium hominis
KQGLSGGQ

SEQ ID NO: 2115505 - protein, 6 aa, Cryptosporidium hominis
KQGSVA

SEQ ID NO: 2115506 - protein, 7 aa, Cryptosporidium hominis
KQINSSV

SEQ ID NO: 2115507 - protein, 6 aa, Cryptosporidium hominis
KQIPNK

SEQ ID NO: 2115508 - protein, 7 aa, Cryptosporidium hominis
KQISTGQ

SEQ ID NO: 2115509 - protein, 4 aa, Cryptosporidium hominis
KQIT

SEQ ID NO: 2115510 - protein, 4 aa, Cryptosporidium hominis
KQIY

SEQ ID NO: 2115511 - protein, 10 aa, Cryptosporidium hominis
KQKDSGKKKV

SEQ ID NO: 2115512 - protein, 6 aa, Cryptosporidium hominis
KQKEAE

SEQ ID NO: 2115513 - protein, 16 aa, Cryptosporidium hominis
KQKKKGSNNKNGEKNK

SEQ ID NO: 2115514 - protein, 10 aa, Cryptosporidium hominis
KQKRSSSISY

SEQ ID NO: 2115515 - protein, 14 aa, Cryptosporidium hominis
KQKSGVSKSSSQHH

SEQ ID NO: 2115516 - protein, 11 aa, Cryptosporidium hominis
KQKSPDSKMTK

SEQ ID NO: 2115517 - protein, 5 aa, Cryptosporidium hominis
KQKSS

SEQ ID NO: 2115518 - protein, 6 aa, Cryptosporidium hominis
KQLGNS

SEQ ID NO: 2115519 - protein, 4 aa, Cryptosporidium hominis
KQLN

SEQ ID NO: 2115520 - protein, 6 aa, Cryptosporidium hominis
KQLPNK

SEQ ID NO: 2115521 - protein, 8 aa, Cryptosporidium hominis
KQNDRIGV

SEQ ID NO: 2115522 - protein, 8 aa, Cryptosporidium hominis
KQNGERNI

SEQ ID NO: 2115523 - protein, 12 aa, Cryptosporidium hominis
KQNGNFGCDGGT

SEQ ID NO: 2115524 - protein, 6 aa, Cryptosporidium hominis
KQNLAS

SEQ ID NO: 2115525 - protein, 14 aa, Cryptosporidium hominis
KQNLDNSSRDESAF

SEQ ID NO: 2115526 - protein, 6 aa, Cryptosporidium hominis
KQNLND

SEQ ID NO: 2115527 - protein, 11 aa, Cryptosporidium hominis
KQNQNRDNYGE

SEQ ID NO: 2115528 - protein, 5 aa, Cryptosporidium hominis
KQNQT

SEQ ID NO: 2115529 - protein, 6 aa, Cryptosporidium hominis
KQNTDN

SEQ ID NO: 2115530 - protein, 4 aa, Cryptosporidium hominis
KQPK

SEQ ID NO: 2115531 - protein, 12 aa, Cryptosporidium hominis
KQPNPSQINTNM

SEQ ID NO: 2115532 - protein, 4 aa, Cryptosporidium hominis
KQQE

SEQ ID NO: 2115533 - protein, 11 aa, Cryptosporidium hominis
KQQQRQNSQRY

SEQ ID NO: 2115534 - protein, 13 aa, Cryptosporidium hominis
KQQSQNESLEGSE

SEQ ID NO: 2115535 - protein, 20 aa, Cryptosporidium hominis
KQSKSKNNKNQNNNYSELPP

SEQ ID NO: 2115536 - protein, 8 aa, Cryptosporidium hominis
KQSNELKE

SEQ ID NO: 2115537 - protein, 9 aa, Cryptosporidium hominis
KQSNSSQLK

SEQ ID NO: 2115538 - protein, 11 aa, Cryptosporidium hominis
KQSSCSETKHS

SEQ ID NO: 2115539 - protein, 4 aa, Cryptosporidium hominis
KQST

SEQ ID NO: 2115540 - protein, 9 aa, Cryptosporidium hominis
KQSTKNSGE

SEQ ID NO: 2115541 - protein, 4 aa, Cryptosporidium hominis
KQVI

SEQ ID NO: 2115542 - protein, 5 aa, Cryptosporidium hominis
KQVPN

SEQ ID NO: 2115543 - protein, 5 aa, Cryptosporidium hominis
KQVSS

SEQ ID NO: 2115544 - protein, 11 aa, Cryptosporidium hominis
KQYANDRPRDF

SEQ ID NO: 2115545 - protein, 6 aa, Cryptosporidium hominis
KRADKT

SEQ ID NO: 2115546 - protein, 9 aa, Cryptosporidium hominis
KRASSGKGI

SEQ ID NO: 2115547 - protein, 10 aa, Cryptosporidium hominis
KRDKEFNNKK

SEQ ID NO: 2115548 - protein, 11 aa, Cryptosporidium hominis
KRDKSIHGSGT

SEQ ID NO: 2115549 - protein, 4 aa, Cryptosporidium hominis
KRDL

SEQ ID NO: 2115550 - protein, 21 aa, Cryptosporidium hominis
KRDYDTSGNRGKDMTVNTRNH

SEQ ID NO: 2115551 - protein, 6 aa, Cryptosporidium hominis
KREASR

SEQ ID NO: 2115552 - protein, 9 aa, Cryptosporidium hominis
KREDHNLNS

SEQ ID NO: 2115553 - protein, 7 aa, Cryptosporidium hominis
KRENSSS

SEQ ID NO: 2115554 - protein, 4 aa, Cryptosporidium hominis
KRET

SEQ ID NO: 2115555 - protein, 8 aa, Cryptosporidium hominis
KRGENGEI

SEQ ID NO: 2115556 - protein, 5 aa, Cryptosporidium hominis
KRGGL

SEQ ID NO: 2115557 - protein, 4 aa, Cryptosporidium hominis
KRGK

SEQ ID NO: 2115558 - protein, 4 aa, Cryptosporidium hominis
KRGL

SEQ ID NO: 2115559 - protein, 9 aa, Cryptosporidium hominis
KRGRQRLRE

SEQ ID NO: 2115560 - protein, 7 aa, Cryptosporidium hominis
KRHPGTK

SEQ ID NO: 2115561 - protein, 13 aa, Cryptosporidium hominis
KRIESKNPLGSKT

SEQ ID NO: 2115562 - protein, 6 aa, Cryptosporidium hominis
KRITKT

SEQ ID NO: 2115563 - protein, 13 aa, Cryptosporidium hominis
KRKGYSGKNTLSA

SEQ ID NO: 2115564 - protein, 6 aa, Cryptosporidium hominis
KRKNSK

SEQ ID NO: 2115565 - protein, 22 aa, Cryptosporidium hominis
KRKPEGNPIPELENSSSGSAEC

SEQ ID NO: 2115566 - protein, 6 aa, Cryptosporidium hominis
KRLSSS

SEQ ID NO: 2115567 - protein, 10 aa, Cryptosporidium hominis
KRNKKKNHPG

SEQ ID NO: 2115568 - protein, 9 aa, Cryptosporidium hominis
KRNLGLTNE

SEQ ID NO: 2115569 - protein, 15 aa, Cryptosporidium hominis
KRNPTELRYTNPNET

SEQ ID NO: 2115570 - protein, 7 aa, Cryptosporidium hominis
KRNQNAK

SEQ ID NO: 2115571 - protein, 7 aa, Cryptosporidium hominis
KRNSFTA

SEQ ID NO: 2115572 - protein, 14 aa, Cryptosporidium hominis
KRNSRSEYSNPNSQ

SEQ ID NO: 2115573 - protein, 6 aa, Cryptosporidium hominis
KRPDAF

SEQ ID NO: 2115574 - protein, 5 aa, Cryptosporidium hominis
KRPDY

SEQ ID NO: 2115575 - protein, 7 aa, Cryptosporidium hominis
KRPKRTH

SEQ ID NO: 2115576 - protein, 6 aa, Cryptosporidium hominis
KRPNSL

SEQ ID NO: 2115577 - protein, 30 aa, Cryptosporidium hominis
KRPPPPKSESSNSSSSSSSNSSSAETSHRS

SEQ ID NO: 2115578 - protein, 10 aa, Cryptosporidium hominis
KRQKKIPSIN

SEQ ID NO: 2115579 - protein, 5 aa, Cryptosporidium hominis
KRQNF

SEQ ID NO: 2115580 - protein, 6 aa, Cryptosporidium hominis
KRQNSI

SEQ ID NO: 2115581 - protein, 10 aa, Cryptosporidium hominis
KRQQELKEKE

SEQ ID NO: 2115582 - protein, 7 aa, Cryptosporidium hominis
KRQSPPS

SEQ ID NO: 2115583 - protein, 5 aa, Cryptosporidium hominis
KRRAI

SEQ ID NO: 2115584 - protein, 7 aa, Cryptosporidium hominis
KRRSSSL

SEQ ID NO: 2115585 - protein, 5 aa, Cryptosporidium hominis
KRSFE

SEQ ID NO: 2115586 - protein, 5 aa, Cryptosporidium hominis
KRSGI

SEQ ID NO: 2115587 - protein, 9 aa, Cryptosporidium hominis
KRSGSKTKN

SEQ ID NO: 2115588 - protein, 16 aa, Cryptosporidium hominis
KRSIEAEEKKKKKPIR

SEQ ID NO: 2115589 - protein, 6 aa, Cryptosporidium hominis
KRSKEK

SEQ ID NO: 2115590 - protein, 7 aa, Cryptosporidium hominis
KRSKHNL

SEQ ID NO: 2115591 - protein, 22 aa, Cryptosporidium hominis
KRSKSDSSINPKPSISKPAPLN

SEQ ID NO: 2115592 - protein, 14 aa, Cryptosporidium hominis
KRSNSISNINSKTN

SEQ ID NO: 2115593 - protein, 5 aa, Cryptosporidium hominis
KRSQL

SEQ ID NO: 2115594 - protein, 24 aa, Cryptosporidium hominis
KRSQSKIANDANQVPSNNDKNNGS

SEQ ID NO: 2115595 - protein, 6 aa, Cryptosporidium hominis
KRSSQD

SEQ ID NO: 2115596 - protein, 5 aa, Cryptosporidium hominis
KRTIG

SEQ ID NO: 2115597 - protein, 5 aa, Cryptosporidium hominis
KRTRV

SEQ ID NO: 2115598 - protein, 18 aa, Cryptosporidium hominis
KRTWTQGQNQCKHKNTIP

SEQ ID NO: 2115599 - protein, 14 aa, Cryptosporidium hominis
KRVDNVTKSTPNFH

SEQ ID NO: 2115600 - protein, 5 aa, Cryptosporidium hominis
KRVNA

SEQ ID NO: 2115601 - protein, 11 aa, Cryptosporidium hominis
KRVNNGESEIK

SEQ ID NO: 2115602 - protein, 11 aa, Cryptosporidium hominis
KRYGNLKGGVS

SEQ ID NO: 2115603 - protein, 4 aa, Cryptosporidium hominis
KRYV

SEQ ID NO: 2115604 - protein, 13 aa, Cryptosporidium hominis
KSAKGWRKKPPSF

SEQ ID NO: 2115605 - protein, 10 aa, Cryptosporidium hominis
KSAKRFPSEI

SEQ ID NO: 2115606 - protein, 7 aa, Cryptosporidium hominis
KSAQISS

SEQ ID NO: 2115607 - protein, 5 aa, Cryptosporidium hominis
KSASI

SEQ ID NO: 2115608 - protein, 6 aa, Cryptosporidium hominis
KSASNT

SEQ ID NO: 2115609 - protein, 7 aa, Cryptosporidium hominis
KSASQRE

SEQ ID NO: 2115610 - protein, 9 aa, Cryptosporidium hominis
KSASRTSKL

SEQ ID NO: 2115611 - protein, 8 aa, Cryptosporidium hominis
KSCDPSPC

SEQ ID NO: 2115612 - protein, 6 aa, Cryptosporidium hominis
KSCEGE

SEQ ID NO: 2115613 - protein, 8 aa, Cryptosporidium hominis
KSCSTGEI

SEQ ID NO: 2115614 - protein, 10 aa, Cryptosporidium hominis
KSDEDYEQQL

SEQ ID NO: 2115615 - protein, 7 aa, Cryptosporidium hominis
KSDEYSR

SEQ ID NO: 2115616 - protein, 7 aa, Cryptosporidium hominis
KSDGLPA

SEQ ID NO: 2115617 - protein, 5 aa, Cryptosporidium hominis
KSDGT

SEQ ID NO: 2115618 - protein, 6 aa, Cryptosporidium hominis
KSDISG

SEQ ID NO: 2115619 - protein, 8 aa, Cryptosporidium hominis
KSDKDHRE

SEQ ID NO: 2115620 - protein, 6 aa, Cryptosporidium hominis
KSDNEI

SEQ ID NO: 2115621 - protein, 4 aa, Cryptosporidium hominis
KSDQ

SEQ ID NO: 2115622 - protein, 8 aa, Cryptosporidium hominis
KSDSQNFE

SEQ ID NO: 2115623 - protein, 7 aa, Cryptosporidium hominis
KSEDNLN

SEQ ID NO: 2115624 - protein, 4 aa, Cryptosporidium hominis
KSEF

SEQ ID NO: 2115625 - protein, 8 aa, Cryptosporidium hominis
KSEGSLAS

SEQ ID NO: 2115626 - protein, 17 aa, Cryptosporidium hominis
KSEIKSNRQEDSESITK

SEQ ID NO: 2115627 - protein, 20 aa, Cryptosporidium hominis
KSEKDITKTTTMTEQTPPLS

SEQ ID NO: 2115628 - protein, 9 aa, Cryptosporidium hominis
KSEKEKIKK

SEQ ID NO: 2115629 - protein, 5 aa, Cryptosporidium hominis
KSELA

SEQ ID NO: 2115630 - protein, 15 aa, Cryptosporidium hominis
KSELKCDTKNLEKGW

SEQ ID NO: 2115631 - protein, 5 aa, Cryptosporidium hominis
KSENP

SEQ ID NO: 2115632 - protein, 8 aa, Cryptosporidium hominis
KSEPDDDK

SEQ ID NO: 2115633 - protein, 19 aa, Cryptosporidium hominis
KSEQEQEQKQKHYNDESSL

SEQ ID NO: 2115634 - protein, 8 aa, Cryptosporidium hominis
KSESLSKP

SEQ ID NO: 2115635 - protein, 35 aa, Cryptosporidium hominis
KSETGGVTSNQQSKHNSAQSMKSIDTTSENSPSFK

SEQ ID NO: 2115636 - protein, 10 aa, Cryptosporidium hominis
KSFKTKSGLP

SEQ ID NO: 2115637 - protein, 4 aa, Cryptosporidium hominis
KSFN

SEQ ID NO: 2115638 - protein, 7 aa, Cryptosporidium hominis
KSFSESL

SEQ ID NO: 2115639 - protein, 5 aa, Cryptosporidium hominis
KSFSK

SEQ ID NO: 2115640 - protein, 16 aa, Cryptosporidium hominis
KSFSSSQLSTSSSNLD

SEQ ID NO: 2115641 - protein, 6 aa, Cryptosporidium hominis
KSGAQT

SEQ ID NO: 2115642 - protein, 17 aa, Cryptosporidium hominis
KSGENINRSNRERKEEY

SEQ ID NO: 2115643 - protein, 8 aa, Cryptosporidium hominis
KSGGPEKD

SEQ ID NO: 2115644 - protein, 16 aa, Cryptosporidium hominis
KSGIDKNSNNRTSSEV

SEQ ID NO: 2115645 - protein, 7 aa, Cryptosporidium hominis
KSGKTIG

SEQ ID NO: 2115646 - protein, 11 aa, Cryptosporidium hominis
KSGNPDSNSVL

SEQ ID NO: 2115647 - protein, 7 aa, Cryptosporidium hominis
KSGRGPV

SEQ ID NO: 2115648 - protein, 8 aa, Cryptosporidium hominis
KSGSGKST

SEQ ID NO: 2115649 - protein, 7 aa, Cryptosporidium hominis
KSGSSIK

SEQ ID NO: 2115650 - protein, 37 aa, Cryptosporidium hominis
KSGSSSSGTTANTQTLPSSAVASNESSSLGNAPLTDE

SEQ ID NO: 2115651 - protein, 9 aa, Cryptosporidium hominis
KSGYNEYGR

SEQ ID NO: 2115652 - protein, 9 aa, Cryptosporidium hominis
KSHDSNKRI

SEQ ID NO: 2115653 - protein, 7 aa, Cryptosporidium hominis
KSHNPSE

SEQ ID NO: 2115654 - protein, 6 aa, Cryptosporidium hominis
KSHSEA

SEQ ID NO: 2115655 - protein, 12 aa, Cryptosporidium hominis
KSHSFSATNDGR

SEQ ID NO: 2115656 - protein, 6 aa, Cryptosporidium hominis
KSHTGR

SEQ ID NO: 2115657 - protein, 21 aa, Cryptosporidium hominis
KSHVDEENDNQKEDQSNENEA

SEQ ID NO: 2115658 - protein, 6 aa, Cryptosporidium hominis
KSIDKK

SEQ ID NO: 2115659 - protein, 6 aa, Cryptosporidium hominis
KSIDTL

SEQ ID NO: 2115660 - protein, 5 aa, Cryptosporidium hominis
KSIKA

SEQ ID NO: 2115661 - protein, 13 aa, Cryptosporidium hominis
KSIKEKKEEVEDE

SEQ ID NO: 2115662 - protein, 14 aa, Cryptosporidium hominis
KSIKGAKGKINKKN

SEQ ID NO: 2115663 - protein, 11 aa, Cryptosporidium hominis
KSINESEERDI

SEQ ID NO: 2115664 - protein, 13 aa, Cryptosporidium hominis
KSISSAAGNVEES

SEQ ID NO: 2115665 - protein, 6 aa, Cryptosporidium hominis
KSISSN

SEQ ID NO: 2115666 - protein, 6 aa, Cryptosporidium hominis
KSITSS

SEQ ID NO: 2115667 - protein, 4 aa, Cryptosporidium hominis
KSKA

SEQ ID NO: 2115668 - protein, 25 aa, Cryptosporidium hominis
KSKDSDSNSKESSGSKTKSDQSKSL

SEQ ID NO: 2115669 - protein, 8 aa, Cryptosporidium hominis
KSKFTHSA

SEQ ID NO: 2115670 - protein, 9 aa, Cryptosporidium hominis
KSKHSETAL

SEQ ID NO: 2115671 - protein, 13 aa, Cryptosporidium hominis
KSKHSSTERTSGL

SEQ ID NO: 2115672 - protein, 20 aa, Cryptosporidium hominis
KSKKSNKSSYRQKPRKVTVN

SEQ ID NO: 2115673 - protein, 7 aa, Cryptosporidium hominis
KSKKYNK

SEQ ID NO: 2115674 - protein, 11 aa, Cryptosporidium hominis
KSKPGSGEKNY

SEQ ID NO: 2115675 - protein, 10 aa, Cryptosporidium hominis
KSKQKAKYIE

SEQ ID NO: 2115676 - protein, 10 aa, Cryptosporidium hominis
KSKQNNNKRN

SEQ ID NO: 2115677 - protein, 17 aa, Cryptosporidium hominis
KSKRVSFTNEKSSLSPI

SEQ ID NO: 2115678 - protein, 4 aa, Cryptosporidium hominis
KSKS

SEQ ID NO: 2115679 - protein, 6 aa, Cryptosporidium hominis
KSKSLI

SEQ ID NO: 2115680 - protein, 9 aa, Cryptosporidium hominis
KSKSLKSSE

SEQ ID NO: 2115681 - protein, 10 aa, Cryptosporidium hominis
KSKSSSGTNT

SEQ ID NO: 2115682 - protein, 6 aa, Cryptosporidium hominis
KSKVSE

SEQ ID NO: 2115683 - protein, 9 aa, Cryptosporidium hominis
KSLAPSLTS

SEQ ID NO: 2115684 - protein, 4 aa, Cryptosporidium hominis
KSLD

SEQ ID NO: 2115685 - protein, 10 aa, Cryptosporidium hominis
KSLDNKIDEN

SEQ ID NO: 2115686 - protein, 20 aa, Cryptosporidium hominis
KSLEDSEGSENKAENGCPKV

SEQ ID NO: 2115687 - protein, 16 aa, Cryptosporidium hominis
KSLKQQQDKKKRNTGY

SEQ ID NO: 2115688 - protein, 7 aa, Cryptosporidium hominis
KSLPKKR

SEQ ID NO: 2115689 - protein, 9 aa, Cryptosporidium hominis
KSLQSSTSI

SEQ ID NO: 2115690 - protein, 6 aa, Cryptosporidium hominis
KSLSDD

SEQ ID NO: 2115691 - protein, 4 aa, Cryptosporidium hominis
KSLT

SEQ ID NO: 2115692 - protein, 6 aa, Cryptosporidium hominis
KSLYSS

SEQ ID NO: 2115693 - protein, 8 aa, Cryptosporidium hominis
KSMDLEQE

SEQ ID NO: 2115694 - protein, 7 aa, Cryptosporidium hominis
KSMKNKE

SEQ ID NO: 2115695 - protein, 7 aa, Cryptosporidium hominis
KSNANLN

SEQ ID NO: 2115696 - protein, 32 aa, Cryptosporidium hominis
KSNDDKKVSQKDSNSVSYSKQLTKEQKRTSSL

SEQ ID NO: 2115697 - protein, 9 aa, Cryptosporidium hominis
KSNDNSEKL

SEQ ID NO: 2115698 - protein, 12 aa, Cryptosporidium hominis
KSNEETKNKESD

SEQ ID NO: 2115699 - protein, 11 aa, Cryptosporidium hominis
KSNEPAEKVGK

SEQ ID NO: 2115700 - protein, 9 aa, Cryptosporidium hominis
KSNESNACY

SEQ ID NO: 2115701 - protein, 9 aa, Cryptosporidium hominis
KSNGSSEIG

SEQ ID NO: 2115702 - protein, 8 aa, Cryptosporidium hominis
KSNISDGG

SEQ ID NO: 2115703 - protein, 8 aa, Cryptosporidium hominis
KSNITHSN

SEQ ID NO: 2115704 - protein, 6 aa, Cryptosporidium hominis
KSNNEP

SEQ ID NO: 2115705 - protein, 10 aa, Cryptosporidium hominis
KSNNSNISTE

SEQ ID NO: 2115706 - protein, 7 aa, Cryptosporidium hominis
KSNPTAE

SEQ ID NO: 2115707 - protein, 6 aa, Cryptosporidium hominis
KSNQGL

SEQ ID NO: 2115708 - protein, 7 aa, Cryptosporidium hominis
KSNSGYL

SEQ ID NO: 2115709 - protein, 13 aa, Cryptosporidium hominis
KSNSTQKYSQEGI

SEQ ID NO: 2115710 - protein, 10 aa, Cryptosporidium hominis
KSNTPSGNKY

SEQ ID NO: 2115711 - protein, 6 aa, Cryptosporidium hominis
KSPELS

SEQ ID NO: 2115712 - protein, 5 aa, Cryptosporidium hominis
KSPIE

SEQ ID NO: 2115713 - protein, 6 aa, Cryptosporidium hominis
KSPLTN

SEQ ID NO: 2115714 - protein, 16 aa, Cryptosporidium hominis
KSPNISPAKQEESSLL

SEQ ID NO: 2115715 - protein, 7 aa, Cryptosporidium hominis
KSPQRNE

SEQ ID NO: 2115716 - protein, 6 aa, Cryptosporidium hominis
KSPVEH

SEQ ID NO: 2115717 - protein, 5 aa, Cryptosporidium hominis
KSQED

SEQ ID NO: 2115718 - protein, 13 aa, Cryptosporidium hominis
KSQENISNSNNTF

SEQ ID NO: 2115719 - protein, 8 aa, Cryptosporidium hominis
KSQKSDDF

SEQ ID NO: 2115720 - protein, 4 aa, Cryptosporidium hominis
KSQL

SEQ ID NO: 2115721 - protein, 6 aa, Cryptosporidium hominis
KSQRKN

SEQ ID NO: 2115722 - protein, 21 aa, Cryptosporidium hominis
KSQSSFSSNSYSNNPKPSGSC

SEQ ID NO: 2115723 - protein, 14 aa, Cryptosporidium hominis
KSRHGTDDEDNADF

SEQ ID NO: 2115724 - protein, 19 aa, Cryptosporidium hominis
KSRKDSKTDNNNHFENNSQ

SEQ ID NO: 2115725 - protein, 35 aa, Cryptosporidium hominis
KSRMQSPCPSSNSTNTGLKPTLSQLNNSNGSTSLS

SEQ ID NO: 2115726 - protein, 25 aa, Cryptosporidium hominis
KSRNSGSDSQANEISSTHSTTTDDF

SEQ ID NO: 2115727 - protein, 8 aa, Cryptosporidium hominis
KSRSTSYT

SEQ ID NO: 2115728 - protein, 20 aa, Cryptosporidium hominis
KSSAEWSNYEKRQRNDEELE

SEQ ID NO: 2115729 - protein, 5 aa, Cryptosporidium hominis
KSSCN

SEQ ID NO: 2115730 - protein, 5 aa, Cryptosporidium hominis
KSSDG

SEQ ID NO: 2115731 - protein, 5 aa, Cryptosporidium hominis
KSSDL

SEQ ID NO: 2115732 - protein, 6 aa, Cryptosporidium hominis
KSSDVP

SEQ ID NO: 2115733 - protein, 6 aa, Cryptosporidium hominis
KSSEHL

SEQ ID NO: 2115734 - protein, 8 aa, Cryptosporidium hominis
KSSENKTK

SEQ ID NO: 2115735 - protein, 8 aa, Cryptosporidium hominis
KSSENSNY

SEQ ID NO: 2115736 - protein, 23 aa, Cryptosporidium hominis
KSSESGNGKDGVEVQANGSSVSS

SEQ ID NO: 2115737 - protein, 28 aa, Cryptosporidium hominis
KSSFLQSAKSSFSQFDEEKRGKLNYTET

SEQ ID NO: 2115738 - protein, 9 aa, Cryptosporidium hominis
KSSGAENSN

SEQ ID NO: 2115739 - protein, 6 aa, Cryptosporidium hominis
KSSGDK

SEQ ID NO: 2115740 - protein, 9 aa, Cryptosporidium hominis
KSSGTSDLG

SEQ ID NO: 2115741 - protein, 9 aa, Cryptosporidium hominis
KSSIPNPIT

SEQ ID NO: 2115742 - protein, 6 aa, Cryptosporidium hominis
KSSKCG

SEQ ID NO: 2115743 - protein, 7 aa, Cryptosporidium hominis
KSSKFSK

SEQ ID NO: 2115744 - protein, 13 aa, Cryptosporidium hominis
KSSKKISPALPSE

SEQ ID NO: 2115745 - protein, 15 aa, Cryptosporidium hominis
KSSKQQSDTNNQSSS

SEQ ID NO: 2115746 - protein, 11 aa, Cryptosporidium hominis
KSSKSIDRSQE

SEQ ID NO: 2115747 - protein, 7 aa, Cryptosporidium hominis
KSSLESL

SEQ ID NO: 2115748 - protein, 10 aa, Cryptosporidium hominis
KSSNNNNHLP

SEQ ID NO: 2115749 - protein, 8 aa, Cryptosporidium hominis
KSSNNNSA

SEQ ID NO: 2115750 - protein, 6 aa, Cryptosporidium hominis
KSSNPK

SEQ ID NO: 2115751 - protein, 6 aa, Cryptosporidium hominis
KSSPKI

SEQ ID NO: 2115752 - protein, 4 aa, Cryptosporidium hominis
KSSR

SEQ ID NO: 2115753 - protein, 7 aa, Cryptosporidium hominis
KSSRERM

SEQ ID NO: 2115754 - protein, 9 aa, Cryptosporidium hominis
KSSRPVGDG

SEQ ID NO: 2115755 - protein, 9 aa, Cryptosporidium hominis
KSSSNTDCN

SEQ ID NO: 2115756 - protein, 9 aa, Cryptosporidium hominis
KSSSSAQEY

SEQ ID NO: 2115757 - protein, 10 aa, Cryptosporidium hominis
KSSSSDSTVS

SEQ ID NO: 2115758 - protein, 19 aa, Cryptosporidium hominis
KSSSTVTKKDDMDKEVAPG

SEQ ID NO: 2115759 - protein, 18 aa, Cryptosporidium hominis
KSSTEERNDSKKRRIEES

SEQ ID NO: 2115760 - protein, 6 aa, Cryptosporidium hominis
KSSVEM

SEQ ID NO: 2115761 - protein, 13 aa, Cryptosporidium hominis
KSSYQSKKPPKSE

SEQ ID NO: 2115762 - protein, 4 aa, Cryptosporidium hominis
KSTE

SEQ ID NO: 2115763 - protein, 9 aa, Cryptosporidium hominis
KSTEESESY

SEQ ID NO: 2115764 - protein, 6 aa, Cryptosporidium hominis
KSTKYN

SEQ ID NO: 2115765 - protein, 7 aa, Cryptosporidium hominis
KSTSNDC

SEQ ID NO: 2115766 - protein, 18 aa, Cryptosporidium hominis
KSTSNSPDDAKDKEASDL

SEQ ID NO: 2115767 - protein, 8 aa, Cryptosporidium hominis
KSTTASSN

SEQ ID NO: 2115768 - protein, 5 aa, Cryptosporidium hominis
KSTTE

SEQ ID NO: 2115769 - protein, 7 aa, Cryptosporidium hominis
KSTTRFT

SEQ ID NO: 2115770 - protein, 9 aa, Cryptosporidium hominis
KSTYSTVRG

SEQ ID NO: 2115771 - protein, 4 aa, Cryptosporidium hominis
KSVE

SEQ ID NO: 2115772 - protein, 6 aa, Cryptosporidium hominis
KSVEDA

SEQ ID NO: 2115773 - protein, 7 aa, Cryptosporidium hominis
KSVEDGV

SEQ ID NO: 2115774 - protein, 14 aa, Cryptosporidium hominis
KSVEIDDSYADEEI

SEQ ID NO: 2115775 - protein, 13 aa, Cryptosporidium hominis
KSVNSQKNSTGES

SEQ ID NO: 2115776 - protein, 5 aa, Cryptosporidium hominis
KSVSN

SEQ ID NO: 2115777 - protein, 7 aa, Cryptosporidium hominis
KSVSNSN

SEQ ID NO: 2115778 - protein, 7 aa, Cryptosporidium hominis
KSVTDGL

SEQ ID NO: 2115779 - protein, 9 aa, Cryptosporidium hominis
KSYKNTKAL

SEQ ID NO: 2115780 - protein, 20 aa, Cryptosporidium hominis
KSYNRYNNNVQDNFRCYTRI

SEQ ID NO: 2115781 - protein, 13 aa, Cryptosporidium hominis
KSYWNDKSENMNK

SEQ ID NO: 2115782 - protein, 10 aa, Cryptosporidium hominis
KTANNPNYYT

SEQ ID NO: 2115783 - protein, 7 aa, Cryptosporidium hominis
KTAYRSK

SEQ ID NO: 2115784 - protein, 11 aa, Cryptosporidium hominis
KTCSTGSKARY

SEQ ID NO: 2115785 - protein, 8 aa, Cryptosporidium hominis
KTCTGNSC

SEQ ID NO: 2115786 - protein, 10 aa, Cryptosporidium hominis
KTCTRTEAFP

SEQ ID NO: 2115787 - protein, 6 aa, Cryptosporidium hominis
KTDAKV

SEQ ID NO: 2115788 - protein, 17 aa, Cryptosporidium hominis
KTDDDTIHATGDDKEKM

SEQ ID NO: 2115789 - protein, 5 aa, Cryptosporidium hominis
KTDDN

SEQ ID NO: 2115790 - protein, 5 aa, Cryptosporidium hominis
KTDGS

SEQ ID NO: 2115791 - protein, 7 aa, Cryptosporidium hominis
KTDPEVR

SEQ ID NO: 2115792 - protein, 30 aa, Cryptosporidium hominis
KTDSFRDLPKRPSSFSSNISESQDQSDNQR

SEQ ID NO: 2115793 - protein, 18 aa, Cryptosporidium hominis
KTEEEKDNGAPKPSNNEL

SEQ ID NO: 2115794 - protein, 6 aa, Cryptosporidium hominis
KTEKPN

SEQ ID NO: 2115795 - protein, 10 aa, Cryptosporidium hominis
KTEKYKEPIV

SEQ ID NO: 2115796 - protein, 11 aa, Cryptosporidium hominis
KTENEENKEMP

SEQ ID NO: 2115797 - protein, 8 aa, Cryptosporidium hominis
KTENNSEE

SEQ ID NO: 2115798 - protein, 14 aa, Cryptosporidium hominis
KTENSTPSTPRVPT

SEQ ID NO: 2115799 - protein, 6 aa, Cryptosporidium hominis
KTESID

SEQ ID NO: 2115800 - protein, 13 aa, Cryptosporidium hominis
KTFDKDADGYVRG

SEQ ID NO: 2115801 - protein, 4 aa, Cryptosporidium hominis
KTFN

SEQ ID NO: 2115802 - protein, 7 aa, Cryptosporidium hominis
KTGDDEI

SEQ ID NO: 2115803 - protein, 11 aa, Cryptosporidium hominis
KTGKKLTGNSF

SEQ ID NO: 2115804 - protein, 33 aa, Cryptosporidium hominis
KTGNESSSNSKTNSEDHCSDSNYKAKSEPAEND

SEQ ID NO: 2115805 - protein, 6 aa, Cryptosporidium hominis
KTGQTP

SEQ ID NO: 2115806 - protein, 4 aa, Cryptosporidium hominis
KTGR

SEQ ID NO: 2115807 - protein, 9 aa, Cryptosporidium hominis
KTGTLTEGK

SEQ ID NO: 2115808 - protein, 7 aa, Cryptosporidium hominis
KTGTLTT

SEQ ID NO: 2115809 - protein, 8 aa, Cryptosporidium hominis
KTGTYNPS

SEQ ID NO: 2115810 - protein, 8 aa, Cryptosporidium hominis
KTGVRTKG

SEQ ID NO: 2115811 - protein, 14 aa, Cryptosporidium hominis
KTHLNSSSCENKYK

SEQ ID NO: 2115812 - protein, 9 aa, Cryptosporidium hominis
KTHTASDVG

SEQ ID NO: 2115813 - protein, 10 aa, Cryptosporidium hominis
KTIEENRAAP

SEQ ID NO: 2115814 - protein, 5 aa, Cryptosporidium hominis
KTIKE

SEQ ID NO: 2115815 - protein, 10 aa, Cryptosporidium hominis
KTKGKKNKLV

SEQ ID NO: 2115816 - protein, 9 aa, Cryptosporidium hominis
KTKGRPNYS

SEQ ID NO: 2115817 - protein, 4 aa, Cryptosporidium hominis
KTKN

SEQ ID NO: 2115818 - protein, 8 aa, Cryptosporidium hominis
KTKPFSPD

SEQ ID NO: 2115819 - protein, 5 aa, Cryptosporidium hominis
KTKPK

SEQ ID NO: 2115820 - protein, 8 aa, Cryptosporidium hominis
KTKSKSPG

SEQ ID NO: 2115821 - protein, 13 aa, Cryptosporidium hominis
KTKSVQMKQTSAI

SEQ ID NO: 2115822 - protein, 14 aa, Cryptosporidium hominis
KTKTEYRKTDSIGE

SEQ ID NO: 2115823 - protein, 14 aa, Cryptosporidium hominis
KTLKEQKVKENDTH

SEQ ID NO: 2115824 - protein, 6 aa, Cryptosporidium hominis
KTLNPS

SEQ ID NO: 2115825 - protein, 6 aa, Cryptosporidium hominis
KTLSKN

SEQ ID NO: 2115826 - protein, 6 aa, Cryptosporidium hominis
KTMNRT

SEQ ID NO: 2115827 - protein, 8 aa, Cryptosporidium hominis
KTNGEETV

SEQ ID NO: 2115828 - protein, 5 aa, Cryptosporidium hominis
KTNGM

SEQ ID NO: 2115829 - protein, 7 aa, Cryptosporidium hominis
KTNGSNF

SEQ ID NO: 2115830 - protein, 5 aa, Cryptosporidium hominis
KTNIK

SEQ ID NO: 2115831 - protein, 20 aa, Cryptosporidium hominis
KTNKRCSQNALNDSQPTVNE

SEQ ID NO: 2115832 - protein, 23 aa, Cryptosporidium hominis
KTNNKYNNSNNSIRDSSEREIQG

SEQ ID NO: 2115833 - protein, 15 aa, Cryptosporidium hominis
KTNNSDVTLTSRNEE

SEQ ID NO: 2115834 - protein, 5 aa, Cryptosporidium hominis
KTNQV

SEQ ID NO: 2115835 - protein, 6 aa, Cryptosporidium hominis
KTPLTV

SEQ ID NO: 2115836 - protein, 9 aa, Cryptosporidium hominis
KTPNSNNNI

SEQ ID NO: 2115837 - protein, 7 aa, Cryptosporidium hominis
KTQNSNM

SEQ ID NO: 2115838 - protein, 9 aa, Cryptosporidium hominis
KTQNSPVSV

SEQ ID NO: 2115839 - protein, 5 aa, Cryptosporidium hominis
KTQVG

SEQ ID NO: 2115840 - protein, 4 aa, Cryptosporidium hominis
KTRN

SEQ ID NO: 2115841 - protein, 9 aa, Cryptosporidium hominis
KTRPSSKDV

SEQ ID NO: 2115842 - protein, 12 aa, Cryptosporidium hominis
KTRSIEKPAPKP

SEQ ID NO: 2115843 - protein, 9 aa, Cryptosporidium hominis
KTRSSEEKL

SEQ ID NO: 2115844 - protein, 4 aa, Cryptosporidium hominis
KTRW

SEQ ID NO: 2115845 - protein, 8 aa, Cryptosporidium hominis
KTSAEYSH

SEQ ID NO: 2115846 - protein, 5 aa, Cryptosporidium hominis
KTSCN

SEQ ID NO: 2115847 - protein, 7 aa, Cryptosporidium hominis
KTSDNSH

SEQ ID NO: 2115848 - protein, 5 aa, Cryptosporidium hominis
KTSES

SEQ ID NO: 2115849 - protein, 15 aa, Cryptosporidium hominis
KTSGFSKENALKVML

SEQ ID NO: 2115850 - protein, 16 aa, Cryptosporidium hominis
KTSNDDDTSRNNNGNS

SEQ ID NO: 2115851 - protein, 5 aa, Cryptosporidium hominis
KTSNI

SEQ ID NO: 2115852 - protein, 10 aa, Cryptosporidium hominis
KTSNRSGRIN

SEQ ID NO: 2115853 - protein, 8 aa, Cryptosporidium hominis
KTSNSTGM

SEQ ID NO: 2115854 - protein, 4 aa, Cryptosporidium hominis
KTSR

SEQ ID NO: 2115855 - protein, 6 aa, Cryptosporidium hominis
KTSSFD

SEQ ID NO: 2115856 - protein, 10 aa, Cryptosporidium hominis
KTSSTRSSDS

SEQ ID NO: 2115857 - protein, 7 aa, Cryptosporidium hominis
KTSSYNQ

SEQ ID NO: 2115858 - protein, 7 aa, Cryptosporidium hominis
KTSTGAS

SEQ ID NO: 2115859 - protein, 5 aa, Cryptosporidium hominis
KTSTI

SEQ ID NO: 2115860 - protein, 7 aa, Cryptosporidium hominis
KTSTSGM

SEQ ID NO: 2115861 - protein, 9 aa, Cryptosporidium hominis
KTSVPTSTQ

SEQ ID NO: 2115862 - protein, 7 aa, Cryptosporidium hominis
KTSVTEL

SEQ ID NO: 2115863 - protein, 22 aa, Cryptosporidium hominis
KTTGGLQSDLKSKELKSNGERR

SEQ ID NO: 2115864 - protein, 4 aa, Cryptosporidium hominis
KTTP

SEQ ID NO: 2115865 - protein, 19 aa, Cryptosporidium hominis
KTTPGQAAEPSEQSSSSDH

SEQ ID NO: 2115866 - protein, 5 aa, Cryptosporidium hominis
KTTYE

SEQ ID NO: 2115867 - protein, 10 aa, Cryptosporidium hominis
KTVKTKNNFK

SEQ ID NO: 2115868 - protein, 7 aa, Cryptosporidium hominis
KTYNEEK

SEQ ID NO: 2115869 - protein, 7 aa, Cryptosporidium hominis
KTYSQRR

SEQ ID NO: 2115870 - protein, 21 aa, Cryptosporidium hominis
KVAPPHGTPRGTQNKIAFIVR

SEQ ID NO: 2115871 - protein, 7 aa, Cryptosporidium hominis
KVAPSKA

SEQ ID NO: 2115872 - protein, 8 aa, Cryptosporidium hominis
KVDGLTGN

SEQ ID NO: 2115873 - protein, 8 aa, Cryptosporidium hominis
KVDPNVKD

SEQ ID NO: 2115874 - protein, 12 aa, Cryptosporidium hominis
KVEDSNNSDEGY

SEQ ID NO: 2115875 - protein, 8 aa, Cryptosporidium hominis
KVESSPSP

SEQ ID NO: 2115876 - protein, 8 aa, Cryptosporidium hominis
KVETAREI

SEQ ID NO: 2115877 - protein, 8 aa, Cryptosporidium hominis
KVETNSKS

SEQ ID NO: 2115878 - protein, 9 aa, Cryptosporidium hominis
KVGDQSTEK

SEQ ID NO: 2115879 - protein, 10 aa, Cryptosporidium hominis
KVIKSGSDSL

SEQ ID NO: 2115880 - protein, 10 aa, Cryptosporidium hominis
KVKAATTNNH

SEQ ID NO: 2115881 - protein, 7 aa, Cryptosporidium hominis
KVKSEND

SEQ ID NO: 2115882 - protein, 16 aa, Cryptosporidium hominis
KVLDNNNNNNNNNNNN

SEQ ID NO: 2115883 - protein, 21 aa, Cryptosporidium hominis
KVLTPSSNYGFGRDKDNEDFE

SEQ ID NO: 2115884 - protein, 7 aa, Cryptosporidium hominis
KVNTNNP

SEQ ID NO: 2115885 - protein, 7 aa, Cryptosporidium hominis
KVPGKAD

SEQ ID NO: 2115886 - protein, 12 aa, Cryptosporidium hominis
KVPKSLKASSPL

SEQ ID NO: 2115887 - protein, 7 aa, Cryptosporidium hominis
KVPSIST

SEQ ID NO: 2115888 - protein, 22 aa, Cryptosporidium hominis
KVPTDAKENLASSPPPPPAEES

SEQ ID NO: 2115889 - protein, 23 aa, Cryptosporidium hominis
KVPTDAKENLASSPPPPPAEKSS

SEQ ID NO: 2115890 - protein, 9 aa, Cryptosporidium hominis
KVQFQSGKT

SEQ ID NO: 2115891 - protein, 8 aa, Cryptosporidium hominis
KVRGQQGS

SEQ ID NO: 2115892 - protein, 11 aa, Cryptosporidium hominis
KVRSISGGERK

SEQ ID NO: 2115893 - protein, 6 aa, Cryptosporidium hominis
KVSEEE

SEQ ID NO: 2115894 - protein, 5 aa, Cryptosporidium hominis
KVSRS

SEQ ID NO: 2115895 - protein, 4 aa, Cryptosporidium hominis
KVTK

SEQ ID NO: 2115896 - protein, 7 aa, Cryptosporidium hominis
KVTPYTN

SEQ ID NO: 2115897 - protein, 11 aa, Cryptosporidium hominis
KVVKGKNSSRQ

SEQ ID NO: 2115898 - protein, 5 aa, Cryptosporidium hominis
KWDGD

SEQ ID NO: 2115899 - protein, 6 aa, Cryptosporidium hominis
KWDTPE

SEQ ID NO: 2115900 - protein, 34 aa, Cryptosporidium hominis
KWRSTKFSSEASEFSNRNGSINPIESKSPKFQYP

SEQ ID NO: 2115901 - protein, 4 aa, Cryptosporidium hominis
KYDD

SEQ ID NO: 2115902 - protein, 5 aa, Cryptosporidium hominis
KYDEK

SEQ ID NO: 2115903 - protein, 12 aa, Cryptosporidium hominis
KYDKMNKSTSSS

SEQ ID NO: 2115904 - protein, 10 aa, Cryptosporidium hominis
KYEESPSDAV

SEQ ID NO: 2115905 - protein, 13 aa, Cryptosporidium hominis
KYEQNSEKANINS

SEQ ID NO: 2115906 - protein, 5 aa, Cryptosporidium hominis
KYESH

SEQ ID NO: 2115907 - protein, 6 aa, Cryptosporidium hominis
KYFPGT

SEQ ID NO: 2115908 - protein, 13 aa, Cryptosporidium hominis
KYGPNKLQKEKHE

SEQ ID NO: 2115909 - protein, 5 aa, Cryptosporidium hominis
KYGQL

SEQ ID NO: 2115910 - protein, 4 aa, Cryptosporidium hominis
KYGS

SEQ ID NO: 2115911 - protein, 15 aa, Cryptosporidium hominis
KYHPDKNKLDEKSNY

SEQ ID NO: 2115912 - protein, 7 aa, Cryptosporidium hominis
KYKANTD

SEQ ID NO: 2115913 - protein, 9 aa, Cryptosporidium hominis
KYKDAEPNY

SEQ ID NO: 2115914 - protein, 10 aa, Cryptosporidium hominis
KYKEDNEEIN

SEQ ID NO: 2115915 - protein, 10 aa, Cryptosporidium hominis
KYKTENIGGC

SEQ ID NO: 2115916 - protein, 7 aa, Cryptosporidium hominis
KYKYDDY

SEQ ID NO: 2115917 - protein, 4 aa, Cryptosporidium hominis
KYLN

SEQ ID NO: 2115918 - protein, 6 aa, Cryptosporidium hominis
KYLSPP

SEQ ID NO: 2115919 - protein, 14 aa, Cryptosporidium hominis
KYNKTYSSMEEENQ

SEQ ID NO: 2115920 - protein, 4 aa, Cryptosporidium hominis
KYNN

SEQ ID NO: 2115921 - protein, 6 aa, Cryptosporidium hominis
KYNSSL

SEQ ID NO: 2115922 - protein, 11 aa, Cryptosporidium hominis
KYNSSRKPIET

SEQ ID NO: 2115923 - protein, 4 aa, Cryptosporidium hominis
KYNY

SEQ ID NO: 2115924 - protein, 25 aa, Cryptosporidium hominis
KYPKLKKDSKNKSKTNNKEQDTSGN

SEQ ID NO: 2115925 - protein, 5 aa, Cryptosporidium hominis
KYPNA

SEQ ID NO: 2115926 - protein, 8 aa, Cryptosporidium hominis
KYQKKTQK

SEQ ID NO: 2115927 - protein, 16 aa, Cryptosporidium hominis
KYQNKEGSRTSKTSSV

SEQ ID NO: 2115928 - protein, 7 aa, Cryptosporidium hominis
KYRISNP

SEQ ID NO: 2115929 - protein, 12 aa, Cryptosporidium hominis
KYRPLKTNSPRD

SEQ ID NO: 2115930 - protein, 7 aa, Cryptosporidium hominis
KYSAEEY

SEQ ID NO: 2115931 - protein, 8 aa, Cryptosporidium hominis
KYSDSTPS

SEQ ID NO: 2115932 - protein, 9 aa, Cryptosporidium hominis
KYSEIEPQV

SEQ ID NO: 2115933 - protein, 8 aa, Cryptosporidium hominis
KYSRSGQK

SEQ ID NO: 2115934 - protein, 6 aa, Cryptosporidium hominis
KYSSDD

SEQ ID NO: 2115935 - protein, 16 aa, Cryptosporidium hominis
KYSSKESGDSIERLKN

SEQ ID NO: 2115936 - protein, 5 aa, Cryptosporidium hominis
KYYPE

SEQ ID NO: 2115937 - protein, 9 aa, Cryptosporidium hominis
KYYSNNNNK

SEQ ID NO: 2115938 - protein, 7 aa, Cryptosporidium hominis
LADNELP

SEQ ID NO: 2115939 - protein, 9 aa, Cryptosporidium hominis
LAEASSPYG

SEQ ID NO: 2115940 - protein, 8 aa, Cryptosporidium hominis
LAEEDRNI

SEQ ID NO: 2115941 - protein, 8 aa, Cryptosporidium hominis
LAGAASSG

SEQ ID NO: 2115942 - protein, 5 aa, Cryptosporidium hominis
LAKDS

SEQ ID NO: 2115943 - protein, 21 aa, Cryptosporidium hominis
LAKGGKKLPEDEDQMDDDESD

SEQ ID NO: 2115944 - protein, 6 aa, Cryptosporidium hominis
LANAKD

SEQ ID NO: 2115945 - protein, 8 aa, Cryptosporidium hominis
LANTTKNV

SEQ ID NO: 2115946 - protein, 5 aa, Cryptosporidium hominis
LANYS

SEQ ID NO: 2115947 - protein, 6 aa, Cryptosporidium hominis
LAPPDK

SEQ ID NO: 2115948 - protein, 15 aa, Cryptosporidium hominis
LAQNSTIQKINNENQ

SEQ ID NO: 2115949 - protein, 6 aa, Cryptosporidium hominis
LASNGQ

SEQ ID NO: 2115950 - protein, 12 aa, Cryptosporidium hominis
LASPTSSKSSSI

SEQ ID NO: 2115951 - protein, 4 aa, Cryptosporidium hominis
LASS

SEQ ID NO: 2115952 - protein, 37 aa, Cryptosporidium hominis
LASSNEDDFEDPDESDIGSDIEDSTSIKVSKSSENIM

SEQ ID NO: 2115953 - protein, 4 aa, Cryptosporidium hominis
LCGS

SEQ ID NO: 2115954 - protein, 9 aa, Cryptosporidium hominis
LCPSGSELS

SEQ ID NO: 2115955 - protein, 15 aa, Cryptosporidium hominis
LCSDETIKSNSENSK

SEQ ID NO: 2115956 - protein, 17 aa, Cryptosporidium hominis
LDAPNKKKNYSASSNGC

SEQ ID NO: 2115957 - protein, 34 aa, Cryptosporidium hominis
LDATYSSQSTVNNKKATTQSIHPEPTLPKSYNQL

SEQ ID NO: 2115958 - protein, 66 aa, Cryptosporidium hominis
LDDNTENMDSIQGGEESAQHQDQEQSDDDNEDDEEDDDDDDNDDDGVDDEDDEEVDEESDENMEDE

SEQ ID NO: 2115959 - protein, 4 aa, Cryptosporidium hominis
LDDS

SEQ ID NO: 2115960 - protein, 9 aa, Cryptosporidium hominis
LDDSETGKI

SEQ ID NO: 2115961 - protein, 6 aa, Cryptosporidium hominis
LDDTTD

SEQ ID NO: 2115962 - protein, 4 aa, Cryptosporidium hominis
LDEE

SEQ ID NO: 2115963 - protein, 7 aa, Cryptosporidium hominis
LDEKDAR

SEQ ID NO: 2115964 - protein, 8 aa, Cryptosporidium hominis
LDENQDNT

SEQ ID NO: 2115965 - protein, 4 aa, Cryptosporidium hominis
LDEV

SEQ ID NO: 2115966 - protein, 4 aa, Cryptosporidium hominis
LDFD

SEQ ID NO: 2115967 - protein, 11 aa, Cryptosporidium hominis
LDGEDNYQGIE

SEQ ID NO: 2115968 - protein, 9 aa, Cryptosporidium hominis
LDGNSTDTN

SEQ ID NO: 2115969 - protein, 7 aa, Cryptosporidium hominis
LDINGDR

SEQ ID NO: 2115970 - protein, 6 aa, Cryptosporidium hominis
LDKKSR

SEQ ID NO: 2115971 - protein, 15 aa, Cryptosporidium hominis
LDKNQDDYYNSRRNG

SEQ ID NO: 2115972 - protein, 20 aa, Cryptosporidium hominis
LDKNTKSSSSNDEEKSKTTQ

SEQ ID NO: 2115973 - protein, 9 aa, Cryptosporidium hominis
LDKPQPRSL

SEQ ID NO: 2115974 - protein, 6 aa, Cryptosporidium hominis
LDKRTS

SEQ ID NO: 2115975 - protein, 14 aa, Cryptosporidium hominis
LDKSKNKALSQSNI

SEQ ID NO: 2115976 - protein, 10 aa, Cryptosporidium hominis
LDKSRKKMSS

SEQ ID NO: 2115977 - protein, 6 aa, Cryptosporidium hominis
LDNPNP

SEQ ID NO: 2115978 - protein, 5 aa, Cryptosporidium hominis
LDNSS

SEQ ID NO: 2115979 - protein, 8 aa, Cryptosporidium hominis
LDNSTSTI

SEQ ID NO: 2115980 - protein, 7 aa, Cryptosporidium hominis
LDPAELP

SEQ ID NO: 2115981 - protein, 5 aa, Cryptosporidium hominis
LDPGL

SEQ ID NO: 2115982 - protein, 11 aa, Cryptosporidium hominis
LDPGNEDYQPY

SEQ ID NO: 2115983 - protein, 9 aa, Cryptosporidium hominis
LDPKEYSKF

SEQ ID NO: 2115984 - protein, 6 aa, Cryptosporidium hominis
LDPKYR

SEQ ID NO: 2115985 - protein, 5 aa, Cryptosporidium hominis
LDPNT

SEQ ID NO: 2115986 - protein, 15 aa, Cryptosporidium hominis
LDQDQDHQFGKGNNR

SEQ ID NO: 2115987 - protein, 7 aa, Cryptosporidium hominis
LDRPPSK

SEQ ID NO: 2115988 - protein, 6 aa, Cryptosporidium hominis
LDSEKE

SEQ ID NO: 2115989 - protein, 5 aa, Cryptosporidium hominis
LDSGD

SEQ ID NO: 2115990 - protein, 9 aa, Cryptosporidium hominis
LDSKPNNNK

SEQ ID NO: 2115991 - protein, 7 aa, Cryptosporidium hominis
LDSQNES

SEQ ID NO: 2115992 - protein, 10 aa, Cryptosporidium hominis
LDSSTNNESN

SEQ ID NO: 2115993 - protein, 12 aa, Cryptosporidium hominis
LDSTKTAFKSPT

SEQ ID NO: 2115994 - protein, 7 aa, Cryptosporidium hominis
LDTASNK

SEQ ID NO: 2115995 - protein, 11 aa, Cryptosporidium hominis
LEAGDEAKKAE

SEQ ID NO: 2115996 - protein, 4 aa, Cryptosporidium hominis
LEAK

SEQ ID NO: 2115997 - protein, 9 aa, Cryptosporidium hominis
LEDEKSQRN

SEQ ID NO: 2115998 - protein, 9 aa, Cryptosporidium hominis
LEDPETQAN

SEQ ID NO: 2115999 - protein, 12 aa, Cryptosporidium hominis
LEDSKKKEFNEE

SEQ ID NO: 2116000 - protein, 8 aa, Cryptosporidium hominis
LEDSKSEC

SEQ ID NO: 2116001 - protein, 8 aa, Cryptosporidium hominis
LEEDRESY

SEQ ID NO: 2116002 - protein, 4 aa, Cryptosporidium hominis
LEEN

SEQ ID NO: 2116003 - protein, 35 aa, Cryptosporidium hominis
LEENGKTIEEERKTIEKAAKGQEKSYVENDKSSLE

SEQ ID NO: 2116004 - protein, 5 aa, Cryptosporidium hominis
LEEQE

SEQ ID NO: 2116005 - protein, 5 aa, Cryptosporidium hominis
LEEQT

SEQ ID NO: 2116006 - protein, 4 aa, Cryptosporidium hominis
LEEV

SEQ ID NO: 2116007 - protein, 10 aa, Cryptosporidium hominis
LEGATGSFGM

SEQ ID NO: 2116008 - protein, 7 aa, Cryptosporidium hominis
LEGKNIE

SEQ ID NO: 2116009 - protein, 11 aa, Cryptosporidium hominis
LEGNEKNVNET

SEQ ID NO: 2116010 - protein, 6 aa, Cryptosporidium hominis
LEKCKS

SEQ ID NO: 2116011 - protein, 16 aa, Cryptosporidium hominis
LEKDPEKSLLIQRDTK

SEQ ID NO: 2116012 - protein, 10 aa, Cryptosporidium hominis
LEKLSKATQR

SEQ ID NO: 2116013 - protein, 8 aa, Cryptosporidium hominis
LEKNNEKI

SEQ ID NO: 2116014 - protein, 10 aa, Cryptosporidium hominis
LEKPTISDQS

SEQ ID NO: 2116015 - protein, 11 aa, Cryptosporidium hominis
LEKRAESKSSL

SEQ ID NO: 2116016 - protein, 11 aa, Cryptosporidium hominis
LELPSKEEFEK

SEQ ID NO: 2116017 - protein, 5 aa, Cryptosporidium hominis
LENDK

SEQ ID NO: 2116018 - protein, 11 aa, Cryptosporidium hominis
LENDNNVSYEQ

SEQ ID NO: 2116019 - protein, 12 aa, Cryptosporidium hominis
LENEKERIDYPK

SEQ ID NO: 2116020 - protein, 20 aa, Cryptosporidium hominis
LENESSENEKISNGKRISEV

SEQ ID NO: 2116021 - protein, 11 aa, Cryptosporidium hominis
LENKTTQNKTL

SEQ ID NO: 2116022 - protein, 5 aa, Cryptosporidium hominis
LENQK

SEQ ID NO: 2116023 - protein, 19 aa, Cryptosporidium hominis
LENQTSNMNTRLGSGPGAG

SEQ ID NO: 2116024 - protein, 9 aa, Cryptosporidium hominis
LENSSNSNW

SEQ ID NO: 2116025 - protein, 7 aa, Cryptosporidium hominis
LENTNSK

SEQ ID NO: 2116026 - protein, 18 aa, Cryptosporidium hominis
LEPDSSNKNNFDNNKNNY

SEQ ID NO: 2116027 - protein, 6 aa, Cryptosporidium hominis
LEPGRI

SEQ ID NO: 2116028 - protein, 5 aa, Cryptosporidium hominis
LEPIQ

SEQ ID NO: 2116029 - protein, 7 aa, Cryptosporidium hominis
LEPSQAS

SEQ ID NO: 2116030 - protein, 5 aa, Cryptosporidium hominis
LEPSS

SEQ ID NO: 2116031 - protein, 8 aa, Cryptosporidium hominis
LEPSSQEE

SEQ ID NO: 2116032 - protein, 10 aa, Cryptosporidium hominis
LEPTHSSGNE

SEQ ID NO: 2116033 - protein, 15 aa, Cryptosporidium hominis
LEQRTFGSEYGSQEF

SEQ ID NO: 2116034 - protein, 8 aa, Cryptosporidium hominis
LERDSETA

SEQ ID NO: 2116035 - protein, 8 aa, Cryptosporidium hominis
LERNSNGM

SEQ ID NO: 2116036 - protein, 8 aa, Cryptosporidium hominis
LESDKSER

SEQ ID NO: 2116037 - protein, 5 aa, Cryptosporidium hominis
LESGE

SEQ ID NO: 2116038 - protein, 13 aa, Cryptosporidium hominis
LESKSNDLDGHGY

SEQ ID NO: 2116039 - protein, 5 aa, Cryptosporidium hominis
LESNK

SEQ ID NO: 2116040 - protein, 9 aa, Cryptosporidium hominis
LESNTTENV

SEQ ID NO: 2116041 - protein, 8 aa, Cryptosporidium hominis
LESPNEGM

SEQ ID NO: 2116042 - protein, 16 aa, Cryptosporidium hominis
LESQNENGTLEPGLKD

SEQ ID NO: 2116043 - protein, 9 aa, Cryptosporidium hominis
LESYDSKRR

SEQ ID NO: 2116044 - protein, 5 aa, Cryptosporidium hominis
LETNQ

SEQ ID NO: 2116045 - protein, 7 aa, Cryptosporidium hominis
LETSTQE

SEQ ID NO: 2116046 - protein, 85 aa, Cryptosporidium hominis
LETTNNALNPIKTTDGNISSISTQSKYYTSTTTSTKNSNIKRTITSSPKAKDEETRTSTSTDKISKTNTTTPSITTTNSLNSTTI

SEQ ID NO: 2116047 - protein, 8 aa, Cryptosporidium hominis
LETTPSDE

SEQ ID NO: 2116048 - protein, 10 aa, Cryptosporidium hominis
LGDKSSDPLV

SEQ ID NO: 2116049 - protein, 4 aa, Cryptosporidium hominis
LGDM

SEQ ID NO: 2116050 - protein, 6 aa, Cryptosporidium hominis
LGEEEE

SEQ ID NO: 2116051 - protein, 35 aa, Cryptosporidium hominis
LGEGNGQSTGQNNQNGNNINSNSNSNNMKSSQRPS

SEQ ID NO: 2116052 - protein, 10 aa, Cryptosporidium hominis
LGEKQRGHNI

SEQ ID NO: 2116053 - protein, 9 aa, Cryptosporidium hominis
LGENEKSFN

SEQ ID NO: 2116054 - protein, 6 aa, Cryptosporidium hominis
LGENLD

SEQ ID NO: 2116055 - protein, 8 aa, Cryptosporidium hominis
LGESSYSK

SEQ ID NO: 2116056 - protein, 24 aa, Cryptosporidium hominis
LGFSNQSSTCSHSETENVAPNGAC

SEQ ID NO: 2116057 - protein, 4 aa, Cryptosporidium hominis
LGGG

SEQ ID NO: 2116058 - protein, 4 aa, Cryptosporidium hominis
LGGS

SEQ ID NO: 2116059 - protein, 6 aa, Cryptosporidium hominis
LGGTIG

SEQ ID NO: 2116060 - protein, 20 aa, Cryptosporidium hominis
LGGVAGSAGLSLGGEGGRDD

SEQ ID NO: 2116061 - protein, 9 aa, Cryptosporidium hominis
LGINSTDYN

SEQ ID NO: 2116062 - protein, 17 aa, Cryptosporidium hominis
LGIPYSKENPIKRQKNQ

SEQ ID NO: 2116063 - protein, 10 aa, Cryptosporidium hominis
LGKATKKNLE

SEQ ID NO: 2116064 - protein, 20 aa, Cryptosporidium hominis
LGKGGSKTEQGANESEEQEG

SEQ ID NO: 2116065 - protein, 7 aa, Cryptosporidium hominis
LGKNSSK

SEQ ID NO: 2116066 - protein, 9 aa, Cryptosporidium hominis
LGKSQVKDI

SEQ ID NO: 2116067 - protein, 5 aa, Cryptosporidium hominis
LGMST

SEQ ID NO: 2116068 - protein, 4 aa, Cryptosporidium hominis
LGNI

SEQ ID NO: 2116069 - protein, 12 aa, Cryptosporidium hominis
LGNIEASGKKLP

SEQ ID NO: 2116070 - protein, 6 aa, Cryptosporidium hominis
LGNTED

SEQ ID NO: 2116071 - protein, 8 aa, Cryptosporidium hominis
LGNTNPSQ

SEQ ID NO: 2116072 - protein, 7 aa, Cryptosporidium hominis
LGPERNI

SEQ ID NO: 2116073 - protein, 5 aa, Cryptosporidium hominis
LGPRT

SEQ ID NO: 2116074 - protein, 24 aa, Cryptosporidium hominis
LGPSFGRDENSSDSEVDSATADKV

SEQ ID NO: 2116075 - protein, 7 aa, Cryptosporidium hominis
LGPTSDR

SEQ ID NO: 2116076 - protein, 7 aa, Cryptosporidium hominis
LGPYSND

SEQ ID NO: 2116077 - protein, 5 aa, Cryptosporidium hominis
LGQSE

SEQ ID NO: 2116078 - protein, 10 aa, Cryptosporidium hominis
LGQSTPSLGS

SEQ ID NO: 2116079 - protein, 6 aa, Cryptosporidium hominis
LGSGAY

SEQ ID NO: 2116080 - protein, 5 aa, Cryptosporidium hominis
LGSNK

SEQ ID NO: 2116081 - protein, 5 aa, Cryptosporidium hominis
LGSSS

SEQ ID NO: 2116082 - protein, 6 aa, Cryptosporidium hominis
LGSTRG

SEQ ID NO: 2116083 - protein, 14 aa, Cryptosporidium hominis
LGVSDDEDNSDEDF

SEQ ID NO: 2116084 - protein, 30 aa, Cryptosporidium hominis
LHGKREYENHQKKTFGTIRPNNKQLSDNKL

SEQ ID NO: 2116085 - protein, 7 aa, Cryptosporidium hominis
LHGNDEG

SEQ ID NO: 2116086 - protein, 14 aa, Cryptosporidium hominis
LHNDSESSVKIDTE

SEQ ID NO: 2116087 - protein, 12 aa, Cryptosporidium hominis
LIKKSSKSTEPE

SEQ ID NO: 2116088 - protein, 21 aa, Cryptosporidium hominis
LINSNQRSKKVPNNKTRSSIK

SEQ ID NO: 2116089 - protein, 16 aa, Cryptosporidium hominis
LKAKSENYSMNENSDD

SEQ ID NO: 2116090 - protein, 20 aa, Cryptosporidium hominis
LKALKSSTEVKSGEKNDSYT

SEQ ID NO: 2116091 - protein, 6 aa, Cryptosporidium hominis
LKDGTF

SEQ ID NO: 2116092 - protein, 14 aa, Cryptosporidium hominis
LKDPERENQEKKIR

SEQ ID NO: 2116093 - protein, 14 aa, Cryptosporidium hominis
LKDSKDGVNPREGC

SEQ ID NO: 2116094 - protein, 11 aa, Cryptosporidium hominis
LKECSERQNDY

SEQ ID NO: 2116095 - protein, 6 aa, Cryptosporidium hominis
LKEGGL

SEQ ID NO: 2116096 - protein, 8 aa, Cryptosporidium hominis
LKEGNKEE

SEQ ID NO: 2116097 - protein, 22 aa, Cryptosporidium hominis
LKEKNKKEEEKKKQKEKEEEQR

SEQ ID NO: 2116098 - protein, 9 aa, Cryptosporidium hominis
LKEPSEKKK

SEQ ID NO: 2116099 - protein, 6 aa, Cryptosporidium hominis
LKGESN

SEQ ID NO: 2116100 - protein, 8 aa, Cryptosporidium hominis
LKGGSKRL

SEQ ID NO: 2116101 - protein, 9 aa, Cryptosporidium hominis
LKGKKNKYR

SEQ ID NO: 2116102 - protein, 17 aa, Cryptosporidium hominis
LKGQKNSNNNISNSHRT

SEQ ID NO: 2116103 - protein, 7 aa, Cryptosporidium hominis
LKGTKTG

SEQ ID NO: 2116104 - protein, 5 aa, Cryptosporidium hominis
LKGVD

SEQ ID NO: 2116105 - protein, 7 aa, Cryptosporidium hominis
LKHQGPT

SEQ ID NO: 2116106 - protein, 12 aa, Cryptosporidium hominis
LKHSEDKLAELE

SEQ ID NO: 2116107 - protein, 7 aa, Cryptosporidium hominis
LKKADDI

SEQ ID NO: 2116108 - protein, 11 aa, Cryptosporidium hominis
LKKARKNGNPK

SEQ ID NO: 2116109 - protein, 18 aa, Cryptosporidium hominis
LKKDKSSKFADEENDNKD

SEQ ID NO: 2116110 - protein, 11 aa, Cryptosporidium hominis
LKKDNSSGRPI

SEQ ID NO: 2116111 - protein, 4 aa, Cryptosporidium hominis
LKKE

SEQ ID NO: 2116112 - protein, 27 aa, Cryptosporidium hominis
LKKKGEEGSKETDRANKSPINEGFESK

SEQ ID NO: 2116113 - protein, 9 aa, Cryptosporidium hominis
LKKRNQEEI

SEQ ID NO: 2116114 - protein, 7 aa, Cryptosporidium hominis
LKKSTQF

SEQ ID NO: 2116115 - protein, 9 aa, Cryptosporidium hominis
LKNASVDDA

SEQ ID NO: 2116116 - protein, 9 aa, Cryptosporidium hominis
LKNDSKQAF

SEQ ID NO: 2116117 - protein, 14 aa, Cryptosporidium hominis
LKNESSNSSNSNQE

SEQ ID NO: 2116118 - protein, 10 aa, Cryptosporidium hominis
LKNKEDVASQ

SEQ ID NO: 2116119 - protein, 7 aa, Cryptosporidium hominis
LKNKNKA

SEQ ID NO: 2116120 - protein, 7 aa, Cryptosporidium hominis
LKNPSFE

SEQ ID NO: 2116121 - protein, 15 aa, Cryptosporidium hominis
LKNQNKSSNAVRTFI

SEQ ID NO: 2116122 - protein, 4 aa, Cryptosporidium hominis
LKPK

SEQ ID NO: 2116123 - protein, 11 aa, Cryptosporidium hominis
LKPKKSKNNSN

SEQ ID NO: 2116124 - protein, 6 aa, Cryptosporidium hominis
LKPNIK

SEQ ID NO: 2116125 - protein, 11 aa, Cryptosporidium hominis
LKPTEEEEENA

SEQ ID NO: 2116126 - protein, 9 aa, Cryptosporidium hominis
LKPTKKMSN

SEQ ID NO: 2116127 - protein, 12 aa, Cryptosporidium hominis
LKQAQYKSGGIS

SEQ ID NO: 2116128 - protein, 5 aa, Cryptosporidium hominis
LKQHA

SEQ ID NO: 2116129 - protein, 8 aa, Cryptosporidium hominis
LKSDKKSI

SEQ ID NO: 2116130 - protein, 10 aa, Cryptosporidium hominis
LKSDSESENI

SEQ ID NO: 2116131 - protein, 8 aa, Cryptosporidium hominis
LKSEPPSN

SEQ ID NO: 2116132 - protein, 8 aa, Cryptosporidium hominis
LKSETNSD

SEQ ID NO: 2116133 - protein, 6 aa, Cryptosporidium hominis
LKSGNN

SEQ ID NO: 2116134 - protein, 11 aa, Cryptosporidium hominis
LKSGSKNQSSI

SEQ ID NO: 2116135 - protein, 20 aa, Cryptosporidium hominis
LKSKESTAKPANENESKPKK

SEQ ID NO: 2116136 - protein, 12 aa, Cryptosporidium hominis
LKSKSGSNNKYN

SEQ ID NO: 2116137 - protein, 6 aa, Cryptosporidium hominis
LKSNKR

SEQ ID NO: 2116138 - protein, 7 aa, Cryptosporidium hominis
LKSQNTT

SEQ ID NO: 2116139 - protein, 6 aa, Cryptosporidium hominis
LKSRQF

SEQ ID NO: 2116140 - protein, 7 aa, Cryptosporidium hominis
LKSSSND

SEQ ID NO: 2116141 - protein, 10 aa, Cryptosporidium hominis
LKSSSSQNEL

SEQ ID NO: 2116142 - protein, 5 aa, Cryptosporidium hominis
LKSSW

SEQ ID NO: 2116143 - protein, 4 aa, Cryptosporidium hominis
LKTE

SEQ ID NO: 2116144 - protein, 9 aa, Cryptosporidium hominis
LKTENLEEL

SEQ ID NO: 2116145 - protein, 9 aa, Cryptosporidium hominis
LKTNGQRSN

SEQ ID NO: 2116146 - protein, 7 aa, Cryptosporidium hominis
LKTNTTH

SEQ ID NO: 2116147 - protein, 6 aa, Cryptosporidium hominis
LKTRSR

SEQ ID NO: 2116148 - protein, 6 aa, Cryptosporidium hominis
LKTSDK

SEQ ID NO: 2116149 - protein, 18 aa, Cryptosporidium hominis
LKTSSQQKIPYEQYPTQL

SEQ ID NO: 2116150 - protein, 17 aa, Cryptosporidium hominis
LKTSTKDSLKSKESPVT

SEQ ID NO: 2116151 - protein, 5 aa, Cryptosporidium hominis
LKTTN

SEQ ID NO: 2116152 - protein, 9 aa, Cryptosporidium hominis
LLPPSGDLN

SEQ ID NO: 2116153 - protein, 6 aa, Cryptosporidium hominis
LLSDED

SEQ ID NO: 2116154 - protein, 4 aa, Cryptosporidium hominis
LLSP

SEQ ID NO: 2116155 - protein, 8 aa, Cryptosporidium hominis
LLSSASVT

SEQ ID NO: 2116156 - protein, 6 aa, Cryptosporidium hominis
LLTTPK

SEQ ID NO: 2116157 - protein, 4 aa, Cryptosporidium hominis
LMNQ

SEQ ID NO: 2116158 - protein, 24 aa, Cryptosporidium hominis
LNATRGRTEEDDKEQRKESKQSLE

SEQ ID NO: 2116159 - protein, 9 aa, Cryptosporidium hominis
LNDEKEKGF

SEQ ID NO: 2116160 - protein, 7 aa, Cryptosporidium hominis
LNDESIE

SEQ ID NO: 2116161 - protein, 15 aa, Cryptosporidium hominis
LNEANSQIDIKDNSR

SEQ ID NO: 2116162 - protein, 8 aa, Cryptosporidium hominis
LNEDPTGT

SEQ ID NO: 2116163 - protein, 11 aa, Cryptosporidium hominis
LNETGKDRTNP

SEQ ID NO: 2116164 - protein, 9 aa, Cryptosporidium hominis
LNGDNKEVS

SEQ ID NO: 2116165 - protein, 5 aa, Cryptosporidium hominis
LNGGE

SEQ ID NO: 2116166 - protein, 8 aa, Cryptosporidium hominis
LNGNQIDE

SEQ ID NO: 2116167 - protein, 15 aa, Cryptosporidium hominis
LNGQTETTSTGVTVE

SEQ ID NO: 2116168 - protein, 14 aa, Cryptosporidium hominis
LNGTESSSEKNSIK

SEQ ID NO: 2116169 - protein, 31 aa, Cryptosporidium hominis
LNGTSERSSINGKEVRDRVSSDNAPLSNKNG

SEQ ID NO: 2116170 - protein, 4 aa, Cryptosporidium hominis
LNIG

SEQ ID NO: 2116171 - protein, 8 aa, Cryptosporidium hominis
LNKDDNKY

SEQ ID NO: 2116172 - protein, 29 aa, Cryptosporidium hominis
LNKDGIKKDENGDDITLSENKDVSSSEND

SEQ ID NO: 2116173 - protein, 5 aa, Cryptosporidium hominis
LNKKQ

SEQ ID NO: 2116174 - protein, 17 aa, Cryptosporidium hominis
LNKNSSGDLNDTKNYKY

SEQ ID NO: 2116175 - protein, 5 aa, Cryptosporidium hominis
LNKPG

SEQ ID NO: 2116176 - protein, 8 aa, Cryptosporidium hominis
LNKPSTFT

SEQ ID NO: 2116177 - protein, 26 aa, Cryptosporidium hominis
LNKTANDNNKEKKVENVSENEIPASP

SEQ ID NO: 2116178 - protein, 11 aa, Cryptosporidium hominis
LNNGKSKAGGW

SEQ ID NO: 2116179 - protein, 8 aa, Cryptosporidium hominis
LNNMGDSE

SEQ ID NO: 2116180 - protein, 10 aa, Cryptosporidium hominis
LNNNNNNNNE

SEQ ID NO: 2116181 - protein, 8 aa, Cryptosporidium hominis
LNNNSKIK

SEQ ID NO: 2116182 - protein, 12 aa, Cryptosporidium hominis
LNNQNKSSNILS

SEQ ID NO: 2116183 - protein, 10 aa, Cryptosporidium hominis
LNNSKDRKGL

SEQ ID NO: 2116184 - protein, 5 aa, Cryptosporidium hominis
LNNSN

SEQ ID NO: 2116185 - protein, 10 aa, Cryptosporidium hominis
LNNSNPAEWS

SEQ ID NO: 2116186 - protein, 4 aa, Cryptosporidium hominis
LNPK

SEQ ID NO: 2116187 - protein, 5 aa, Cryptosporidium hominis
LNPKV

SEQ ID NO: 2116188 - protein, 7 aa, Cryptosporidium hominis
LNPQKNA

SEQ ID NO: 2116189 - protein, 18 aa, Cryptosporidium hominis
LNPSDKNHNTRKKSKSIS

SEQ ID NO: 2116190 - protein, 8 aa, Cryptosporidium hominis
LNPSEPSI

SEQ ID NO: 2116191 - protein, 23 aa, Cryptosporidium hominis
LNPSGLSTSNQGGNDSNFTQSSN

SEQ ID NO: 2116192 - protein, 11 aa, Cryptosporidium hominis
LNQQSNKNADL

SEQ ID NO: 2116193 - protein, 21 aa, Cryptosporidium hominis
LNRSQNNIRKQYTTTTTNNPE

SEQ ID NO: 2116194 - protein, 8 aa, Cryptosporidium hominis
LNSELKPE

SEQ ID NO: 2116195 - protein, 7 aa, Cryptosporidium hominis
LNSESRK

SEQ ID NO: 2116196 - protein, 4 aa, Cryptosporidium hominis
LNSK

SEQ ID NO: 2116197 - protein, 15 aa, Cryptosporidium hominis
LNSNDSSNNNNIEGG

SEQ ID NO: 2116198 - protein, 5 aa, Cryptosporidium hominis
LNSNE

SEQ ID NO: 2116199 - protein, 9 aa, Cryptosporidium hominis
LNSNGQKPI

SEQ ID NO: 2116200 - protein, 7 aa, Cryptosporidium hominis
LNSPETA

SEQ ID NO: 2116201 - protein, 14 aa, Cryptosporidium hominis
LNSPRRQKNNDRQQ

SEQ ID NO: 2116202 - protein, 12 aa, Cryptosporidium hominis
LNSQSGEKIGPS

SEQ ID NO: 2116203 - protein, 8 aa, Cryptosporidium hominis
LNSSNNYD

SEQ ID NO: 2116204 - protein, 10 aa, Cryptosporidium hominis
LNSSSLLDSS

SEQ ID NO: 2116205 - protein, 10 aa, Cryptosporidium hominis
LNSSSSESSV

SEQ ID NO: 2116206 - protein, 9 aa, Cryptosporidium hominis
LNSSTFSKK

SEQ ID NO: 2116207 - protein, 5 aa, Cryptosporidium hominis
LNSTL

SEQ ID NO: 2116208 - protein, 10 aa, Cryptosporidium hominis
LNTESNKNYK

SEQ ID NO: 2116209 - protein, 12 aa, Cryptosporidium hominis
LNTNDADSNTFN

SEQ ID NO: 2116210 - protein, 7 aa, Cryptosporidium hominis
LNTPSNL

SEQ ID NO: 2116211 - protein, 14 aa, Cryptosporidium hominis
LNTSNSLETEDEQE

SEQ ID NO: 2116212 - protein, 13 aa, Cryptosporidium hominis
LPCSNNNEQEKNI

SEQ ID NO: 2116213 - protein, 6 aa, Cryptosporidium hominis
LPDQDE

SEQ ID NO: 2116214 - protein, 6 aa, Cryptosporidium hominis
LPEKSE

SEQ ID NO: 2116215 - protein, 15 aa, Cryptosporidium hominis
LPENKYKSSLGSNDS

SEQ ID NO: 2116216 - protein, 9 aa, Cryptosporidium hominis
LPENSKKQE

SEQ ID NO: 2116217 - protein, 5 aa, Cryptosporidium hominis
LPENY

SEQ ID NO: 2116218 - protein, 12 aa, Cryptosporidium hominis
LPETPKESESNL

SEQ ID NO: 2116219 - protein, 12 aa, Cryptosporidium hominis
LPFKGKQHRESS

SEQ ID NO: 2116220 - protein, 7 aa, Cryptosporidium hominis
LPGGENK

SEQ ID NO: 2116221 - protein, 5 aa, Cryptosporidium hominis
LPGGK

SEQ ID NO: 2116222 - protein, 21 aa, Cryptosporidium hominis
LPGMSSSSYGIPPSQGTPFPG

SEQ ID NO: 2116223 - protein, 6 aa, Cryptosporidium hominis
LPGSEY

SEQ ID NO: 2116224 - protein, 5 aa, Cryptosporidium hominis
LPGSS

SEQ ID NO: 2116225 - protein, 8 aa, Cryptosporidium hominis
LPGSTEDI

SEQ ID NO: 2116226 - protein, 5 aa, Cryptosporidium hominis
LPGTD

SEQ ID NO: 2116227 - protein, 8 aa, Cryptosporidium hominis
LPISSSSS

SEQ ID NO: 2116228 - protein, 5 aa, Cryptosporidium hominis
LPKNT

SEQ ID NO: 2116229 - protein, 9 aa, Cryptosporidium hominis
LPKNTTMDD

SEQ ID NO: 2116230 - protein, 4 aa, Cryptosporidium hominis
LPLD

SEQ ID NO: 2116231 - protein, 11 aa, Cryptosporidium hominis
LPNPNYKSPIN

SEQ ID NO: 2116232 - protein, 9 aa, Cryptosporidium hominis
LPNPSDIND

SEQ ID NO: 2116233 - protein, 7 aa, Cryptosporidium hominis
LPNSNNS

SEQ ID NO: 2116234 - protein, 5 aa, Cryptosporidium hominis
LPPAP

SEQ ID NO: 2116235 - protein, 5 aa, Cryptosporidium hominis
LPPGK

SEQ ID NO: 2116236 - protein, 6 aa, Cryptosporidium hominis
LPPHPK

SEQ ID NO: 2116237 - protein, 4 aa, Cryptosporidium hominis
LPPK

SEQ ID NO: 2116238 - protein, 8 aa, Cryptosporidium hominis
LPPPGVGS

SEQ ID NO: 2116239 - protein, 6 aa, Cryptosporidium hominis
LPPPRT

SEQ ID NO: 2116240 - protein, 8 aa, Cryptosporidium hominis
LPQDGFNK

SEQ ID NO: 2116241 - protein, 13 aa, Cryptosporidium hominis
LPQEQNSFEKPNY

SEQ ID NO: 2116242 - protein, 4 aa, Cryptosporidium hominis
LPQP

SEQ ID NO: 2116243 - protein, 4 aa, Cryptosporidium hominis
LPQT

SEQ ID NO: 2116244 - protein, 16 aa, Cryptosporidium hominis
LPSDDISSKEFRVNYY

SEQ ID NO: 2116245 - protein, 30 aa, Cryptosporidium hominis
LPSGTSPGFPSEGPGQDQDGDQAQRSQRAA

SEQ ID NO: 2116246 - protein, 16 aa, Cryptosporidium hominis
LPSPRDSERNSSCDNP

SEQ ID NO: 2116247 - protein, 7 aa, Cryptosporidium hominis
LPSSGRI

SEQ ID NO: 2116248 - protein, 5 aa, Cryptosporidium hominis
LPTPS

SEQ ID NO: 2116249 - protein, 4 aa, Cryptosporidium hominis
LPTQ

SEQ ID NO: 2116250 - protein, 4 aa, Cryptosporidium hominis
LPTS

SEQ ID NO: 2116251 - protein, 8 aa, Cryptosporidium hominis
LPVPKTSA

SEQ ID NO: 2116252 - protein, 8 aa, Cryptosporidium hominis
LPYSSTSG

SEQ ID NO: 2116253 - protein, 13 aa, Cryptosporidium hominis
LPYTSDDKGNTNN

SEQ ID NO: 2116254 - protein, 34 aa, Cryptosporidium hominis
LQDANNSPSDSKNENQDANSDNKDSSSRYSNSQP

SEQ ID NO: 2116255 - protein, 9 aa, Cryptosporidium hominis
LQDKLKPKT

SEQ ID NO: 2116256 - protein, 7 aa, Cryptosporidium hominis
LQDSGRR

SEQ ID NO: 2116257 - protein, 6 aa, Cryptosporidium hominis
LQEEEK

SEQ ID NO: 2116258 - protein, 7 aa, Cryptosporidium hominis
LQGSGGI

SEQ ID NO: 2116259 - protein, 11 aa, Cryptosporidium hominis
LQINKDTPSIH

SEQ ID NO: 2116260 - protein, 9 aa, Cryptosporidium hominis
LQKEKEKFS

SEQ ID NO: 2116261 - protein, 14 aa, Cryptosporidium hominis
LQKGDYGDDLRDGS

SEQ ID NO: 2116262 - protein, 9 aa, Cryptosporidium hominis
LQNAPSSEI

SEQ ID NO: 2116263 - protein, 20 aa, Cryptosporidium hominis
LQPDYNKDEDLNERRHPTND

SEQ ID NO: 2116264 - protein, 9 aa, Cryptosporidium hominis
LQPGKATAL

SEQ ID NO: 2116265 - protein, 11 aa, Cryptosporidium hominis
LQREASSVQLE

SEQ ID NO: 2116266 - protein, 7 aa, Cryptosporidium hominis
LQRENPL

SEQ ID NO: 2116267 - protein, 6 aa, Cryptosporidium hominis
LQSPDQ

SEQ ID NO: 2116268 - protein, 8 aa, Cryptosporidium hominis
LQSPSEMA

SEQ ID NO: 2116269 - protein, 7 aa, Cryptosporidium hominis
LQTGTPL

SEQ ID NO: 2116270 - protein, 4 aa, Cryptosporidium hominis
LQTP

SEQ ID NO: 2116271 - protein, 4 aa, Cryptosporidium hominis
LQTT

SEQ ID NO: 2116272 - protein, 4 aa, Cryptosporidium hominis
LRED

SEQ ID NO: 2116273 - protein, 10 aa, Cryptosporidium hominis
LRESSSEASF

SEQ ID NO: 2116274 - protein, 11 aa, Cryptosporidium hominis
LRGNRACSGNS

SEQ ID NO: 2116275 - protein, 7 aa, Cryptosporidium hominis
LRGTSDG

SEQ ID NO: 2116276 - protein, 10 aa, Cryptosporidium hominis
LRKGGEQVRN

SEQ ID NO: 2116277 - protein, 9 aa, Cryptosporidium hominis
LRKKQGEKL

SEQ ID NO: 2116278 - protein, 14 aa, Cryptosporidium hominis
LRKRTKTMKHNDPD

SEQ ID NO: 2116279 - protein, 7 aa, Cryptosporidium hominis
LRNDPDF

SEQ ID NO: 2116280 - protein, 27 aa, Cryptosporidium hominis
LRNSTSSKQRATEENHLNQTTSEEGGH

SEQ ID NO: 2116281 - protein, 6 aa, Cryptosporidium hominis
LRPKTR

SEQ ID NO: 2116282 - protein, 24 aa, Cryptosporidium hominis
LRQEELKKKKKEKPKKTKTFPEAT

SEQ ID NO: 2116283 - protein, 4 aa, Cryptosporidium hominis
LRQK

SEQ ID NO: 2116284 - protein, 10 aa, Cryptosporidium hominis
LRREKSGKTI

SEQ ID NO: 2116285 - protein, 13 aa, Cryptosporidium hominis
LRRNQNRQDKERD

SEQ ID NO: 2116286 - protein, 6 aa, Cryptosporidium hominis
LRSGNK

SEQ ID NO: 2116287 - protein, 4 aa, Cryptosporidium hominis
LRSK

SEQ ID NO: 2116288 - protein, 6 aa, Cryptosporidium hominis
LRSNHG

SEQ ID NO: 2116289 - protein, 8 aa, Cryptosporidium hominis
LRSSSIER

SEQ ID NO: 2116290 - protein, 17 aa, Cryptosporidium hominis
LRSSSTSITSSDTQSPM

SEQ ID NO: 2116291 - protein, 10 aa, Cryptosporidium hominis
LRTSLERNKN

SEQ ID NO: 2116292 - protein, 7 aa, Cryptosporidium hominis
LRTSTRE

SEQ ID NO: 2116293 - protein, 54 aa, Cryptosporidium hominis
LSADQKGGDLREKDYNETGEENSDDELDDGLEECEDETESEELDSEDEIYEDNS

SEQ ID NO: 2116294 - protein, 10 aa, Cryptosporidium hominis
LSAGNYNSEL

SEQ ID NO: 2116295 - protein, 34 aa, Cryptosporidium hominis
LSAGTTSGATSSSATSSSAIGSSATSSSAASSAS

SEQ ID NO: 2116296 - protein, 6 aa, Cryptosporidium hominis
LSDELT

SEQ ID NO: 2116297 - protein, 7 aa, Cryptosporidium hominis
LSDENQK

SEQ ID NO: 2116298 - protein, 23 aa, Cryptosporidium hominis
LSDISSSSNSAAGQAGNYPIYKG

SEQ ID NO: 2116299 - protein, 5 aa, Cryptosporidium hominis
LSDKN

SEQ ID NO: 2116300 - protein, 23 aa, Cryptosporidium hominis
LSDNDTDKEEGEMSKEKEDYNSG

SEQ ID NO: 2116301 - protein, 9 aa, Cryptosporidium hominis
LSDPGNPGR

SEQ ID NO: 2116302 - protein, 20 aa, Cryptosporidium hominis
LSDRNTYKLSSDQDSRSNSI

SEQ ID NO: 2116303 - protein, 16 aa, Cryptosporidium hominis
LSDSGSRTRESDFSSS

SEQ ID NO: 2116304 - protein, 6 aa, Cryptosporidium hominis
LSDTGA

SEQ ID NO: 2116305 - protein, 5 aa, Cryptosporidium hominis
LSEDN

SEQ ID NO: 2116306 - protein, 6 aa, Cryptosporidium hominis
LSEDNL

SEQ ID NO: 2116307 - protein, 21 aa, Cryptosporidium hominis
LSEDNSQDVEEVNPQEEASRL

SEQ ID NO: 2116308 - protein, 8 aa, Cryptosporidium hominis
LSEESQKR

SEQ ID NO: 2116309 - protein, 6 aa, Cryptosporidium hominis
LSEGNI

SEQ ID NO: 2116310 - protein, 8 aa, Cryptosporidium hominis
LSEGSDDV

SEQ ID NO: 2116311 - protein, 11 aa, Cryptosporidium hominis
LSEKENDSRTD

SEQ ID NO: 2116312 - protein, 4 aa, Cryptosporidium hominis
LSEP

SEQ ID NO: 2116313 - protein, 4 aa, Cryptosporidium hominis
LSEQ

SEQ ID NO: 2116314 - protein, 12 aa, Cryptosporidium hominis
LSEQKTELLEEL

SEQ ID NO: 2116315 - protein, 87 aa, Cryptosporidium hominis
LSESDGSSNKVTHGKKKKKSTKSKKRVEERSKSNEGEEEKASKRKRSRSGSGSKPRKSSSDSTSSDSKEESSMPSGRSKKSTQTDQA

SEQ ID NO: 2116316 - protein, 8 aa, Cryptosporidium hominis
LSESKDVD

SEQ ID NO: 2116317 - protein, 14 aa, Cryptosporidium hominis
LSETENEKNIETNN

SEQ ID NO: 2116318 - protein, 5 aa, Cryptosporidium hominis
LSFDD

SEQ ID NO: 2116319 - protein, 12 aa, Cryptosporidium hominis
LSFSSSKNTPLP

SEQ ID NO: 2116320 - protein, 5 aa, Cryptosporidium hominis
LSGGL

SEQ ID NO: 2116321 - protein, 8 aa, Cryptosporidium hominis
LSGGQRSR

SEQ ID NO: 2116322 - protein, 31 aa, Cryptosporidium hominis
LSGGTGGAEGKGGVGGTGAGGSISSIQGKEQ

SEQ ID NO: 2116323 - protein, 16 aa, Cryptosporidium hominis
LSGINTEKLSSSDSLR

SEQ ID NO: 2116324 - protein, 6 aa, Cryptosporidium hominis
LSGKGG

SEQ ID NO: 2116325 - protein, 18 aa, Cryptosporidium hominis
LSGQNQVESSKDDDDDDI

SEQ ID NO: 2116326 - protein, 8 aa, Cryptosporidium hominis
LSGQTSDY

SEQ ID NO: 2116327 - protein, 4 aa, Cryptosporidium hominis
LSGS

SEQ ID NO: 2116328 - protein, 7 aa, Cryptosporidium hominis
LSGSRDI

SEQ ID NO: 2116329 - protein, 7 aa, Cryptosporidium hominis
LSGSSIN

SEQ ID NO: 2116330 - protein, 19 aa, Cryptosporidium hominis
LSHQNDRKSSPSFSPLGSD

SEQ ID NO: 2116331 - protein, 7 aa, Cryptosporidium hominis
LSIPSKK

SEQ ID NO: 2116332 - protein, 4 aa, Cryptosporidium hominis
LSKE

SEQ ID NO: 2116333 - protein, 9 aa, Cryptosporidium hominis
LSKEDKKSE

SEQ ID NO: 2116334 - protein, 10 aa, Cryptosporidium hominis
LSKEEARNKS

SEQ ID NO: 2116335 - protein, 19 aa, Cryptosporidium hominis
LSKEKKEFNEDQEKKIIDE

SEQ ID NO: 2116336 - protein, 4 aa, Cryptosporidium hominis
LSKG

SEQ ID NO: 2116337 - protein, 8 aa, Cryptosporidium hominis
LSKGANGH

SEQ ID NO: 2116338 - protein, 10 aa, Cryptosporidium hominis
LSKGSKKKNL

SEQ ID NO: 2116339 - protein, 19 aa, Cryptosporidium hominis
LSKPIGSEDQDKHSSGHEG

SEQ ID NO: 2116340 - protein, 4 aa, Cryptosporidium hominis
LSKQ

SEQ ID NO: 2116341 - protein, 14 aa, Cryptosporidium hominis
LSKQSEDLDNSNNA

SEQ ID NO: 2116342 - protein, 6 aa, Cryptosporidium hominis
LSLKPT

SEQ ID NO: 2116343 - protein, 10 aa, Cryptosporidium hominis
LSLSRSQNSH

SEQ ID NO: 2116344 - protein, 9 aa, Cryptosporidium hominis
LSNDNEDEL

SEQ ID NO: 2116345 - protein, 10 aa, Cryptosporidium hominis
LSNDPSRNNN

SEQ ID NO: 2116346 - protein, 15 aa, Cryptosporidium hominis
LSNEISSRISSDKKI

SEQ ID NO: 2116347 - protein, 7 aa, Cryptosporidium hominis
LSNEPPM

SEQ ID NO: 2116348 - protein, 5 aa, Cryptosporidium hominis
LSNGD

SEQ ID NO: 2116349 - protein, 9 aa, Cryptosporidium hominis
LSNGNAGSK

SEQ ID NO: 2116350 - protein, 5 aa, Cryptosporidium hominis
LSNIP

SEQ ID NO: 2116351 - protein, 9 aa, Cryptosporidium hominis
LSNKGENLK

SEQ ID NO: 2116352 - protein, 5 aa, Cryptosporidium hominis
LSNNE

SEQ ID NO: 2116353 - protein, 9 aa, Cryptosporidium hominis
LSNNKNDQN

SEQ ID NO: 2116354 - protein, 7 aa, Cryptosporidium hominis
LSNQKYR

SEQ ID NO: 2116355 - protein, 7 aa, Cryptosporidium hominis
LSNSDPV

SEQ ID NO: 2116356 - protein, 6 aa, Cryptosporidium hominis
LSNSKA

SEQ ID NO: 2116357 - protein, 19 aa, Cryptosporidium hominis
LSPEDQATASKESLTHSEN

SEQ ID NO: 2116358 - protein, 4 aa, Cryptosporidium hominis
LSPN

SEQ ID NO: 2116359 - protein, 5 aa, Cryptosporidium hominis
LSPPI

SEQ ID NO: 2116360 - protein, 7 aa, Cryptosporidium hominis
LSPPSSY

SEQ ID NO: 2116361 - protein, 5 aa, Cryptosporidium hominis
LSPRG

SEQ ID NO: 2116362 - protein, 7 aa, Cryptosporidium hominis
LSPSEKV

SEQ ID NO: 2116363 - protein, 37 aa, Cryptosporidium hominis
LSPTKKNRKQLNNKDTTNSSNGDFTQDPNLKENNVEN

SEQ ID NO: 2116364 - protein, 15 aa, Cryptosporidium hominis
LSQAKYSKTSNNVPD

SEQ ID NO: 2116365 - protein, 15 aa, Cryptosporidium hominis
LSQDTRDWESLKDPE

SEQ ID NO: 2116366 - protein, 6 aa, Cryptosporidium hominis
LSQSEN

SEQ ID NO: 2116367 - protein, 6 aa, Cryptosporidium hominis
LSQTDS

SEQ ID NO: 2116368 - protein, 9 aa, Cryptosporidium hominis
LSRQNANQY

SEQ ID NO: 2116369 - protein, 5 aa, Cryptosporidium hominis
LSRRD

SEQ ID NO: 2116370 - protein, 7 aa, Cryptosporidium hominis
LSSAQKF

SEQ ID NO: 2116371 - protein, 8 aa, Cryptosporidium hominis
LSSDPSSA

SEQ ID NO: 2116372 - protein, 4 aa, Cryptosporidium hominis
LSSE

SEQ ID NO: 2116373 - protein, 6 aa, Cryptosporidium hominis
LSSEEE

SEQ ID NO: 2116374 - protein, 7 aa, Cryptosporidium hominis
LSSEEIE

SEQ ID NO: 2116375 - protein, 8 aa, Cryptosporidium hominis
LSSGTISD

SEQ ID NO: 2116376 - protein, 4 aa, Cryptosporidium hominis
LSSK

SEQ ID NO: 2116377 - protein, 6 aa, Cryptosporidium hominis
LSSKEI

SEQ ID NO: 2116378 - protein, 10 aa, Cryptosporidium hominis
LSSKSDCISE

SEQ ID NO: 2116379 - protein, 18 aa, Cryptosporidium hominis
LSSNQNLNGLSASGSTNI

SEQ ID NO: 2116380 - protein, 21 aa, Cryptosporidium hominis
LSSPINNNTNSQKTASTENVS

SEQ ID NO: 2116381 - protein, 22 aa, Cryptosporidium hominis
LSSPQSNQINENGDQRSNISSA

SEQ ID NO: 2116382 - protein, 12 aa, Cryptosporidium hominis
LSSPVSSQADIS

SEQ ID NO: 2116383 - protein, 6 aa, Cryptosporidium hominis
LSSQGK

SEQ ID NO: 2116384 - protein, 38 aa, Cryptosporidium hominis
LSSQNSSCSVSSSSENEREFTSNTEMPKSNHDDESAWD

SEQ ID NO: 2116385 - protein, 8 aa, Cryptosporidium hominis
LSSQVNGD

SEQ ID NO: 2116386 - protein, 9 aa, Cryptosporidium hominis
LSSSNSKPL

SEQ ID NO: 2116387 - protein, 13 aa, Cryptosporidium hominis
LSSVGSKKRVKIA

SEQ ID NO: 2116388 - protein, 7 aa, Cryptosporidium hominis
LSTDSSI

SEQ ID NO: 2116389 - protein, 9 aa, Cryptosporidium hominis
LSTEEEKES

SEQ ID NO: 2116390 - protein, 14 aa, Cryptosporidium hominis
LSTGNSNLKPEDLE

SEQ ID NO: 2116391 - protein, 7 aa, Cryptosporidium hominis
LSTGSDV

SEQ ID NO: 2116392 - protein, 7 aa, Cryptosporidium hominis
LSTHPQK

SEQ ID NO: 2116393 - protein, 8 aa, Cryptosporidium hominis
LSTKQNKS

SEQ ID NO: 2116394 - protein, 5 aa, Cryptosporidium hominis
LSTKT

SEQ ID NO: 2116395 - protein, 16 aa, Cryptosporidium hominis
LSTNFDQDKQEEIETE

SEQ ID NO: 2116396 - protein, 7 aa, Cryptosporidium hominis
LSTNFDR

SEQ ID NO: 2116397 - protein, 8 aa, Cryptosporidium hominis
LSTNQMGS

SEQ ID NO: 2116398 - protein, 10 aa, Cryptosporidium hominis
LSTPISGDSL

SEQ ID NO: 2116399 - protein, 10 aa, Cryptosporidium hominis
LSTSNSVNIS

SEQ ID NO: 2116400 - protein, 5 aa, Cryptosporidium hominis
LSTSP

SEQ ID NO: 2116401 - protein, 6 aa, Cryptosporidium hominis
LSTTPV

SEQ ID NO: 2116402 - protein, 5 aa, Cryptosporidium hominis
LSYSE

SEQ ID NO: 2116403 - protein, 35 aa, Cryptosporidium hominis
LTASDSNGKDVNVSEKLENTTFNEKVKSNSSIEGS

SEQ ID NO: 2116404 - protein, 8 aa, Cryptosporidium hominis
LTDDDYDK

SEQ ID NO: 2116405 - protein, 79 aa, Cryptosporidium hominis
LTDQEEELSQPSQPLQPSQPLQPPQPSQPSQPSQPSQPSQPSQPLQPLQPSQHSQDTQLRPRARRRADESLQDAPTRPT

SEQ ID NO: 2116406 - protein, 8 aa, Cryptosporidium hominis
LTDQSNYY

SEQ ID NO: 2116407 - protein, 5 aa, Cryptosporidium hominis
LTDSD

SEQ ID NO: 2116408 - protein, 29 aa, Cryptosporidium hominis
LTDSKKIDTTESHKCANSEDLQNNQEYNT

SEQ ID NO: 2116409 - protein, 9 aa, Cryptosporidium hominis
LTEEGGNVE

SEQ ID NO: 2116410 - protein, 10 aa, Cryptosporidium hominis
LTESSGIVKQ

SEQ ID NO: 2116411 - protein, 5 aa, Cryptosporidium hominis
LTEST

SEQ ID NO: 2116412 - protein, 10 aa, Cryptosporidium hominis
LTGADGETIT

SEQ ID NO: 2116413 - protein, 5 aa, Cryptosporidium hominis
LTGES

SEQ ID NO: 2116414 - protein, 5 aa, Cryptosporidium hominis
LTGGN

SEQ ID NO: 2116415 - protein, 9 aa, Cryptosporidium hominis
LTGGPTEDL

SEQ ID NO: 2116416 - protein, 13 aa, Cryptosporidium hominis
LTGPINDTTPIKS

SEQ ID NO: 2116417 - protein, 8 aa, Cryptosporidium hominis
LTGPRQDK

SEQ ID NO: 2116418 - protein, 4 aa, Cryptosporidium hominis
LTIE

SEQ ID NO: 2116419 - protein, 12 aa, Cryptosporidium hominis
LTKESNPSIETN

SEQ ID NO: 2116420 - protein, 7 aa, Cryptosporidium hominis
LTKKEKK

SEQ ID NO: 2116421 - protein, 11 aa, Cryptosporidium hominis
LTKPQETNTSY

SEQ ID NO: 2116422 - protein, 12 aa, Cryptosporidium hominis
LTKTGQKVHTTK

SEQ ID NO: 2116423 - protein, 9 aa, Cryptosporidium hominis
LTNEENSTK

SEQ ID NO: 2116424 - protein, 4 aa, Cryptosporidium hominis
LTPN

SEQ ID NO: 2116425 - protein, 10 aa, Cryptosporidium hominis
LTPNYTEDQY

SEQ ID NO: 2116426 - protein, 16 aa, Cryptosporidium hominis
LTQKDRTFSDVQSGTT

SEQ ID NO: 2116427 - protein, 13 aa, Cryptosporidium hominis
LTQNTGKANFSNK

SEQ ID NO: 2116428 - protein, 11 aa, Cryptosporidium hominis
LTQSQNQNQHS

SEQ ID NO: 2116429 - protein, 5 aa, Cryptosporidium hominis
LTREK

SEQ ID NO: 2116430 - protein, 4 aa, Cryptosporidium hominis
LTSD

SEQ ID NO: 2116431 - protein, 4 aa, Cryptosporidium hominis
LTSE

SEQ ID NO: 2116432 - protein, 9 aa, Cryptosporidium hominis
LTSEESNCT

SEQ ID NO: 2116433 - protein, 7 aa, Cryptosporidium hominis
LTSEGSL

SEQ ID NO: 2116434 - protein, 15 aa, Cryptosporidium hominis
LTSPKSDFTNKTQKY

SEQ ID NO: 2116435 - protein, 10 aa, Cryptosporidium hominis
LTSQEETKEL

SEQ ID NO: 2116436 - protein, 5 aa, Cryptosporidium hominis
LTSRG

SEQ ID NO: 2116437 - protein, 15 aa, Cryptosporidium hominis
LTSSQNEGSTRGHEI

SEQ ID NO: 2116438 - protein, 4 aa, Cryptosporidium hominis
LTST

SEQ ID NO: 2116439 - protein, 11 aa, Cryptosporidium hominis
LTTNQSDRNEL

SEQ ID NO: 2116440 - protein, 20 aa, Cryptosporidium hominis
LTTSAEKSSHMESTLSSSGV

SEQ ID NO: 2116441 - protein, 12 aa, Cryptosporidium hominis
LTTSSNSASPTS

SEQ ID NO: 2116442 - protein, 13 aa, Cryptosporidium hominis
LTTSSSKDEEISE

SEQ ID NO: 2116443 - protein, 10 aa, Cryptosporidium hominis
LVPSTGKTFN

SEQ ID NO: 2116444 - protein, 7 aa, Cryptosporidium hominis
LVTSPTP

SEQ ID NO: 2116445 - protein, 8 aa, Cryptosporidium hominis
LYDDPKSA

SEQ ID NO: 2116446 - protein, 5 aa, Cryptosporidium hominis
LYNEK

SEQ ID NO: 2116447 - protein, 12 aa, Cryptosporidium hominis
LYSNAGSLSGSQ

SEQ ID NO: 2116448 - protein, 8 aa, Cryptosporidium hominis
MAGTASQI

SEQ ID NO: 2116449 - protein, 9 aa, Cryptosporidium hominis
MANEQSDST

SEQ ID NO: 2116450 - protein, 10 aa, Cryptosporidium hominis
MANGNQVRKD

SEQ ID NO: 2116451 - protein, 29 aa, Cryptosporidium hominis
MAPSSEKKVINNKDEKSDNELENSSLSDT

SEQ ID NO: 2116452 - protein, 4 aa, Cryptosporidium hominis
MAQN

SEQ ID NO: 2116453 - protein, 4 aa, Cryptosporidium hominis
MASN

SEQ ID NO: 2116454 - protein, 8 aa, Cryptosporidium hominis
MDDTSLSS

SEQ ID NO: 2116455 - protein, 38 aa, Cryptosporidium hominis
MDKTTTGTTTSTDKSYDQTSNVEPTVQGTTMPKQTSKV

SEQ ID NO: 2116456 - protein, 10 aa, Cryptosporidium hominis
MDPKSQKKPL

SEQ ID NO: 2116457 - protein, 19 aa, Cryptosporidium hominis
MDTSSGKSDQLRGQPPSPI

SEQ ID NO: 2116458 - protein, 7 aa, Cryptosporidium hominis
MEDGRGE

SEQ ID NO: 2116459 - protein, 16 aa, Cryptosporidium hominis
MEEDKEKKMNSTAHPF

SEQ ID NO: 2116460 - protein, 14 aa, Cryptosporidium hominis
MEEKGSANGGLGGF

SEQ ID NO: 2116461 - protein, 8 aa, Cryptosporidium hominis
MEEKTNSK

SEQ ID NO: 2116462 - protein, 19 aa, Cryptosporidium hominis
MEESTTGDESSTRASKHIT

SEQ ID NO: 2116463 - protein, 6 aa, Cryptosporidium hominis
MEGETS

SEQ ID NO: 2116464 - protein, 8 aa, Cryptosporidium hominis
MEGKSGQL

SEQ ID NO: 2116465 - protein, 4 aa, Cryptosporidium hominis
MEKD

SEQ ID NO: 2116466 - protein, 7 aa, Cryptosporidium hominis
MEKNESL

SEQ ID NO: 2116467 - protein, 4 aa, Cryptosporidium hominis
MELE

SEQ ID NO: 2116468 - protein, 12 aa, Cryptosporidium hominis
MEQDEDENKNFD

SEQ ID NO: 2116469 - protein, 7 aa, Cryptosporidium hominis
MESEKEQ

SEQ ID NO: 2116470 - protein, 18 aa, Cryptosporidium hominis
MESSAEVSGVSSEKSQAL

SEQ ID NO: 2116471 - protein, 6 aa, Cryptosporidium hominis
METRSK

SEQ ID NO: 2116472 - protein, 10 aa, Cryptosporidium hominis
METTPTHGSG

SEQ ID NO: 2116473 - protein, 4 aa, Cryptosporidium hominis
MFGP

SEQ ID NO: 2116474 - protein, 9 aa, Cryptosporidium hominis
MGGQTDGDK

SEQ ID NO: 2116475 - protein, 12 aa, Cryptosporidium hominis
MGHATSNQKIRG

SEQ ID NO: 2116476 - protein, 10 aa, Cryptosporidium hominis
MGNKKKSLSR

SEQ ID NO: 2116477 - protein, 28 aa, Cryptosporidium hominis
MGSEQSKTNCSKEINTEVENNKSKIKSN

SEQ ID NO: 2116478 - protein, 11 aa, Cryptosporidium hominis
MKDENQDENSF

SEQ ID NO: 2116479 - protein, 15 aa, Cryptosporidium hominis
MKDTSEDQASELTSS

SEQ ID NO: 2116480 - protein, 5 aa, Cryptosporidium hominis
MKERL

SEQ ID NO: 2116481 - protein, 7 aa, Cryptosporidium hominis
MKGEPQL

SEQ ID NO: 2116482 - protein, 19 aa, Cryptosporidium hominis
MKNHSNQRKQQSSRDISKT

SEQ ID NO: 2116483 - protein, 13 aa, Cryptosporidium hominis
MKPEGSSTARPEI

SEQ ID NO: 2116484 - protein, 4 aa, Cryptosporidium hominis
MKPG

SEQ ID NO: 2116485 - protein, 15 aa, Cryptosporidium hominis
MKQEKALEKKRTKDL

SEQ ID NO: 2116486 - protein, 6 aa, Cryptosporidium hominis
MKRQEN

SEQ ID NO: 2116487 - protein, 4 aa, Cryptosporidium hominis
MKSG

SEQ ID NO: 2116488 - protein, 7 aa, Cryptosporidium hominis
MKSGEKI

SEQ ID NO: 2116489 - protein, 30 aa, Cryptosporidium hominis
MKSSEENIERNEDQNMNGKYEKRNSSEIHG

SEQ ID NO: 2116490 - protein, 9 aa, Cryptosporidium hominis
MKSSSTGLR

SEQ ID NO: 2116491 - protein, 18 aa, Cryptosporidium hominis
MKVSPKNQNGSKYSTKNS

SEQ ID NO: 2116492 - protein, 18 aa, Cryptosporidium hominis
MNDYPNQSVPESLSHSNT

SEQ ID NO: 2116493 - protein, 11 aa, Cryptosporidium hominis
MNEFTSSGLEE

SEQ ID NO: 2116494 - protein, 50 aa, Cryptosporidium hominis
MNKDSSENSGDSTNLRKENETRKVNATSTNCTSNENISAKELEAGSNRSI

SEQ ID NO: 2116495 - protein, 4 aa, Cryptosporidium hominis
MNNN

SEQ ID NO: 2116496 - protein, 9 aa, Cryptosporidium hominis
MNQTPKSTM

SEQ ID NO: 2116497 - protein, 7 aa, Cryptosporidium hominis
MNSSKQL

SEQ ID NO: 2116498 - protein, 10 aa, Cryptosporidium hominis
MNSSSTRKLG

SEQ ID NO: 2116499 - protein, 12 aa, Cryptosporidium hominis
MNTSEQKSNGLL

SEQ ID NO: 2116500 - protein, 11 aa, Cryptosporidium hominis
MPGNPSPQIYS

SEQ ID NO: 2116501 - protein, 4 aa, Cryptosporidium hominis
MPKN

SEQ ID NO: 2116502 - protein, 8 aa, Cryptosporidium hominis
MPNTGSYS

SEQ ID NO: 2116503 - protein, 6 aa, Cryptosporidium hominis
MPQSGE

SEQ ID NO: 2116504 - protein, 4 aa, Cryptosporidium hominis
MPRD

SEQ ID NO: 2116505 - protein, 12 aa, Cryptosporidium hominis
MPRPKYSKSQSP

SEQ ID NO: 2116506 - protein, 5 aa, Cryptosporidium hominis
MPSHS

SEQ ID NO: 2116507 - protein, 6 aa, Cryptosporidium hominis
MPSKEM

SEQ ID NO: 2116508 - protein, 4 aa, Cryptosporidium hominis
MPTS

SEQ ID NO: 2116509 - protein, 12 aa, Cryptosporidium hominis
MQEESKTSLYDT

SEQ ID NO: 2116510 - protein, 4 aa, Cryptosporidium hominis
MQIS

SEQ ID NO: 2116511 - protein, 37 aa, Cryptosporidium hominis
MQNNSNNGNGITNTCTEGGATSTNANLGGSSSLRGSN

SEQ ID NO: 2116512 - protein, 18 aa, Cryptosporidium hominis
MQSRGGNGPGDMNSGMGE

SEQ ID NO: 2116513 - protein, 7 aa, Cryptosporidium hominis
MRAPGNL

SEQ ID NO: 2116514 - protein, 13 aa, Cryptosporidium hominis
MREAPKVIKEDPV

SEQ ID NO: 2116515 - protein, 24 aa, Cryptosporidium hominis
MRENDDDMGSFQSNSINAYKDTQP

SEQ ID NO: 2116516 - protein, 7 aa, Cryptosporidium hominis
MRQDTDQ

SEQ ID NO: 2116517 - protein, 11 aa, Cryptosporidium hominis
MRSSSGFSSGQ

SEQ ID NO: 2116518 - protein, 14 aa, Cryptosporidium hominis
MSANSSSNSGSSSQ

SEQ ID NO: 2116519 - protein, 24 aa, Cryptosporidium hominis
MSDNDNTALNKDLEDNDDVNDQSL

SEQ ID NO: 2116520 - protein, 6 aa, Cryptosporidium hominis
MSEGEV

SEQ ID NO: 2116521 - protein, 4 aa, Cryptosporidium hominis
MSEK

SEQ ID NO: 2116522 - protein, 4 aa, Cryptosporidium hominis
MSEP

SEQ ID NO: 2116523 - protein, 5 aa, Cryptosporidium hominis
MSGGP

SEQ ID NO: 2116524 - protein, 6 aa, Cryptosporidium hominis
MSGSNR

SEQ ID NO: 2116525 - protein, 9 aa, Cryptosporidium hominis
MSKEKKRKL

SEQ ID NO: 2116526 - protein, 9 aa, Cryptosporidium hominis
MSKSTYNRE

SEQ ID NO: 2116527 - protein, 7 aa, Cryptosporidium hominis
MSNEDRN

SEQ ID NO: 2116528 - protein, 8 aa, Cryptosporidium hominis
MSPNNKSE

SEQ ID NO: 2116529 - protein, 7 aa, Cryptosporidium hominis
MSPTHNS

SEQ ID NO: 2116530 - protein, 14 aa, Cryptosporidium hominis
MSSNGSIESPMSNG

SEQ ID NO: 2116531 - protein, 4 aa, Cryptosporidium hominis
MSSP

SEQ ID NO: 2116532 - protein, 13 aa, Cryptosporidium hominis
MSSQTQKGLEGED

SEQ ID NO: 2116533 - protein, 10 aa, Cryptosporidium hominis
MSTGGTGFRS

SEQ ID NO: 2116534 - protein, 6 aa, Cryptosporidium hominis
MSTNTE

SEQ ID NO: 2116535 - protein, 10 aa, Cryptosporidium hominis
MTAGTSAATM

SEQ ID NO: 2116536 - protein, 11 aa, Cryptosporidium hominis
MTEKKRGIDTH

SEQ ID NO: 2116537 - protein, 5 aa, Cryptosporidium hominis
MTETG

SEQ ID NO: 2116538 - protein, 5 aa, Cryptosporidium hominis
MTPED

SEQ ID NO: 2116539 - protein, 7 aa, Cryptosporidium hominis
MTPNQNS

SEQ ID NO: 2116540 - protein, 9 aa, Cryptosporidium hominis
MTPPTAQQL

SEQ ID NO: 2116541 - protein, 5 aa, Cryptosporidium hominis
MTPSI

SEQ ID NO: 2116542 - protein, 8 aa, Cryptosporidium hominis
MTQSQRDK

SEQ ID NO: 2116543 - protein, 5 aa, Cryptosporidium hominis
MTSES

SEQ ID NO: 2116544 - protein, 4 aa, Cryptosporidium hominis
MTSP

SEQ ID NO: 2116545 - protein, 8 aa, Cryptosporidium hominis
MTTDSSDI

SEQ ID NO: 2116546 - protein, 77 aa, Cryptosporidium hominis
MTTPGVANPLAGASSAGAAANPMAAAAPGAATAAVSGAVPGATPGAAAGATPGAAAGATPGAAAGATPGAPAAVGGM

SEQ ID NO: 2116547 - protein, 10 aa, Cryptosporidium hominis
MTYPSGSIET

SEQ ID NO: 2116548 - protein, 11 aa, Cryptosporidium hominis
MVNKSKKQQSM

SEQ ID NO: 2116549 - protein, 11 aa, Cryptosporidium hominis
MYESSSRADPL

SEQ ID NO: 2116550 - protein, 5 aa, Cryptosporidium hominis
MYPSQ

SEQ ID NO: 2116551 - protein, 10 aa, Cryptosporidium hominis
NAAINKTTGE

SEQ ID NO: 2116552 - protein, 4 aa, Cryptosporidium hominis
NADA

SEQ ID NO: 2116553 - protein, 10 aa, Cryptosporidium hominis
NADDARDSKK

SEQ ID NO: 2116554 - protein, 8 aa, Cryptosporidium hominis
NADGNNQF

SEQ ID NO: 2116555 - protein, 6 aa, Cryptosporidium hominis
NADSRY

SEQ ID NO: 2116556 - protein, 9 aa, Cryptosporidium hominis
NAEAAANPI

SEQ ID NO: 2116557 - protein, 5 aa, Cryptosporidium hominis
NAEDR

SEQ ID NO: 2116558 - protein, 4 aa, Cryptosporidium hominis
NAEE

SEQ ID NO: 2116559 - protein, 4 aa, Cryptosporidium hominis
NAEF

SEQ ID NO: 2116560 - protein, 7 aa, Cryptosporidium hominis
NAEGYTS

SEQ ID NO: 2116561 - protein, 8 aa, Cryptosporidium hominis
NAENDKET

SEQ ID NO: 2116562 - protein, 4 aa, Cryptosporidium hominis
NAET

SEQ ID NO: 2116563 - protein, 6 aa, Cryptosporidium hominis
NAGETF

SEQ ID NO: 2116564 - protein, 7 aa, Cryptosporidium hominis
NAISEKT

SEQ ID NO: 2116565 - protein, 5 aa, Cryptosporidium hominis
NAKTT

SEQ ID NO: 2116566 - protein, 16 aa, Cryptosporidium hominis
NAMNSNNSSHSSPYQH

SEQ ID NO: 2116567 - protein, 9 aa, Cryptosporidium hominis
NANDEYKRL

SEQ ID NO: 2116568 - protein, 10 aa, Cryptosporidium hominis
NANDLKKKNS

SEQ ID NO: 2116569 - protein, 9 aa, Cryptosporidium hominis
NANKSDKDI

SEQ ID NO: 2116570 - protein, 14 aa, Cryptosporidium hominis
NANNNYYNSPSISN

SEQ ID NO: 2116571 - protein, 11 aa, Cryptosporidium hominis
NANSQVNTSNM

SEQ ID NO: 2116572 - protein, 5 aa, Cryptosporidium hominis
NANTD

SEQ ID NO: 2116573 - protein, 5 aa, Cryptosporidium hominis
NAPDK

SEQ ID NO: 2116574 - protein, 5 aa, Cryptosporidium hominis
NAPEK

SEQ ID NO: 2116575 - protein, 8 aa, Cryptosporidium hominis
NAPGGGKT

SEQ ID NO: 2116576 - protein, 10 aa, Cryptosporidium hominis
NAPGWGGETP

SEQ ID NO: 2116577 - protein, 4 aa, Cryptosporidium hominis
NAPK

SEQ ID NO: 2116578 - protein, 7 aa, Cryptosporidium hominis
NAPYQSL

SEQ ID NO: 2116579 - protein, 5 aa, Cryptosporidium hominis
NAQNR

SEQ ID NO: 2116580 - protein, 27 aa, Cryptosporidium hominis
NARIGSTGKINSKGSSGKEGIQITPSN

SEQ ID NO: 2116581 - protein, 8 aa, Cryptosporidium hominis
NASNPNEY

SEQ ID NO: 2116582 - protein, 6 aa, Cryptosporidium hominis
NASSPL

SEQ ID NO: 2116583 - protein, 4 aa, Cryptosporidium hominis
NAST

SEQ ID NO: 2116584 - protein, 13 aa, Cryptosporidium hominis
NASTGISHNPSEF

SEQ ID NO: 2116585 - protein, 11 aa, Cryptosporidium hominis
NASVKSGAESY

SEQ ID NO: 2116586 - protein, 5 aa, Cryptosporidium hominis
NASYD

SEQ ID NO: 2116587 - protein, 7 aa, Cryptosporidium hominis
NATESIK

SEQ ID NO: 2116588 - protein, 11 aa, Cryptosporidium hominis
NATQQGLKAST

SEQ ID NO: 2116589 - protein, 6 aa, Cryptosporidium hominis
NAYEEG

SEQ ID NO: 2116590 - protein, 4 aa, Cryptosporidium hominis
NCAS

SEQ ID NO: 2116591 - protein, 15 aa, Cryptosporidium hominis
NCDKTSESDISTHPP

SEQ ID NO: 2116592 - protein, 8 aa, Cryptosporidium hominis
NCDQRSTI

SEQ ID NO: 2116593 - protein, 4 aa, Cryptosporidium hominis
NCEC

SEQ ID NO: 2116594 - protein, 7 aa, Cryptosporidium hominis
NCEKKAE

SEQ ID NO: 2116595 - protein, 9 aa, Cryptosporidium hominis
NCKPENIDQ

SEQ ID NO: 2116596 - protein, 11 aa, Cryptosporidium hominis
NCNNDDSSQMA

SEQ ID NO: 2116597 - protein, 18 aa, Cryptosporidium hominis
NCNSGGKSSSQSEVGSEN

SEQ ID NO: 2116598 - protein, 11 aa, Cryptosporidium hominis
NCPKSTPEQLE

SEQ ID NO: 2116599 - protein, 5 aa, Cryptosporidium hominis
NCPTE

SEQ ID NO: 2116600 - protein, 30 aa, Cryptosporidium hominis
NCTPTSSYQINSNGFNQGNNQDFSSTKNIP

SEQ ID NO: 2116601 - protein, 7 aa, Cryptosporidium hominis
NDANSFT

SEQ ID NO: 2116602 - protein, 8 aa, Cryptosporidium hominis
NDCNSEKF

SEQ ID NO: 2116603 - protein, 15 aa, Cryptosporidium hominis
NDDGNQLDDDKKKSH

SEQ ID NO: 2116604 - protein, 10 aa, Cryptosporidium hominis
NDDNESAKEL

SEQ ID NO: 2116605 - protein, 5 aa, Cryptosporidium hominis
NDDPR

SEQ ID NO: 2116606 - protein, 11 aa, Cryptosporidium hominis
NDDQNYHQNNG

SEQ ID NO: 2116607 - protein, 4 aa, Cryptosporidium hominis
NDED

SEQ ID NO: 2116608 - protein, 10 aa, Cryptosporidium hominis
NDEEENNDKV

SEQ ID NO: 2116609 - protein, 8 aa, Cryptosporidium hominis
NDEERREK

SEQ ID NO: 2116610 - protein, 25 aa, Cryptosporidium hominis
NDEISDSSSNSSIVSTTASYSPETA

SEQ ID NO: 2116611 - protein, 8 aa, Cryptosporidium hominis
NDEMDEGN

SEQ ID NO: 2116612 - protein, 7 aa, Cryptosporidium hominis
NDENHPK

SEQ ID NO: 2116613 - protein, 6 aa, Cryptosporidium hominis
NDEQNP

SEQ ID NO: 2116614 - protein, 16 aa, Cryptosporidium hominis
NDGFSPRNKSCSSKVT

SEQ ID NO: 2116615 - protein, 7 aa, Cryptosporidium hominis
NDGQSIK

SEQ ID NO: 2116616 - protein, 11 aa, Cryptosporidium hominis
NDGTSNITPSP

SEQ ID NO: 2116617 - protein, 6 aa, Cryptosporidium hominis
NDHQDE

SEQ ID NO: 2116618 - protein, 20 aa, Cryptosporidium hominis
NDIEDEDEKRELAAEAAKAM

SEQ ID NO: 2116619 - protein, 4 aa, Cryptosporidium hominis
NDIN

SEQ ID NO: 2116620 - protein, 10 aa, Cryptosporidium hominis
NDINSEETEI

SEQ ID NO: 2116621 - protein, 4 aa, Cryptosporidium hominis
NDKK

SEQ ID NO: 2116622 - protein, 8 aa, Cryptosporidium hominis
NDKNKEAT

SEQ ID NO: 2116623 - protein, 10 aa, Cryptosporidium hominis
NDKNVESSYP

SEQ ID NO: 2116624 - protein, 5 aa, Cryptosporidium hominis
NDKPY

SEQ ID NO: 2116625 - protein, 6 aa, Cryptosporidium hominis
NDKRSL

SEQ ID NO: 2116626 - protein, 11 aa, Cryptosporidium hominis
NDKSFRSTSEA

SEQ ID NO: 2116627 - protein, 8 aa, Cryptosporidium hominis
NDKSNKTL

SEQ ID NO: 2116628 - protein, 6 aa, Cryptosporidium hominis
NDKSPN

SEQ ID NO: 2116629 - protein, 16 aa, Cryptosporidium hominis
NDKVKVTNSAVSSPAE

SEQ ID NO: 2116630 - protein, 7 aa, Cryptosporidium hominis
NDLRQRQ

SEQ ID NO: 2116631 - protein, 17 aa, Cryptosporidium hominis
NDLSESKSFKEEFGSKS

SEQ ID NO: 2116632 - protein, 7 aa, Cryptosporidium hominis
NDLSNSI

SEQ ID NO: 2116633 - protein, 7 aa, Cryptosporidium hominis
NDNDHKN

SEQ ID NO: 2116634 - protein, 7 aa, Cryptosporidium hominis
NDNEENP

SEQ ID NO: 2116635 - protein, 6 aa, Cryptosporidium hominis
NDNGDK

SEQ ID NO: 2116636 - protein, 10 aa, Cryptosporidium hominis
NDNKNYQGGI

SEQ ID NO: 2116637 - protein, 20 aa, Cryptosporidium hominis
NDNKRHSGSHHKKRHAPKNT

SEQ ID NO: 2116638 - protein, 9 aa, Cryptosporidium hominis
NDNQTNTEL

SEQ ID NO: 2116639 - protein, 4 aa, Cryptosporidium hominis
NDNS

SEQ ID NO: 2116640 - protein, 4 aa, Cryptosporidium hominis
NDNV

SEQ ID NO: 2116641 - protein, 4 aa, Cryptosporidium hominis
NDNY

SEQ ID NO: 2116642 - protein, 33 aa, Cryptosporidium hominis
NDNYQNYNAPEMNSNGLNGGFGGVNNGGSIPGN

SEQ ID NO: 2116643 - protein, 18 aa, Cryptosporidium hominis
NDPDQNTSSNLNTDSDPI

SEQ ID NO: 2116644 - protein, 8 aa, Cryptosporidium hominis
NDPFSSTI

SEQ ID NO: 2116645 - protein, 5 aa, Cryptosporidium hominis
NDPRR

SEQ ID NO: 2116646 - protein, 6 aa, Cryptosporidium hominis
NDPRYK

SEQ ID NO: 2116647 - protein, 6 aa, Cryptosporidium hominis
NDPTGT

SEQ ID NO: 2116648 - protein, 8 aa, Cryptosporidium hominis
NDQGEAGV

SEQ ID NO: 2116649 - protein, 11 aa, Cryptosporidium hominis
NDQNSGTRNNH

SEQ ID NO: 2116650 - protein, 9 aa, Cryptosporidium hominis
NDQPNERNS

SEQ ID NO: 2116651 - protein, 7 aa, Cryptosporidium hominis
NDQTELQ

SEQ ID NO: 2116652 - protein, 18 aa, Cryptosporidium hominis
NDRKLKSNSLDNEMTDSE

SEQ ID NO: 2116653 - protein, 8 aa, Cryptosporidium hominis
NDRNPNKE

SEQ ID NO: 2116654 - protein, 8 aa, Cryptosporidium hominis
NDRSSNRF

SEQ ID NO: 2116655 - protein, 12 aa, Cryptosporidium hominis
NDSGDNNKNDPK

SEQ ID NO: 2116656 - protein, 5 aa, Cryptosporidium hominis
NDSIV

SEQ ID NO: 2116657 - protein, 22 aa, Cryptosporidium hominis
NDSKKNKAVDKKNVDKLTSKLE

SEQ ID NO: 2116658 - protein, 19 aa, Cryptosporidium hominis
NDSNASDKKRGKFRKDPSI

SEQ ID NO: 2116659 - protein, 8 aa, Cryptosporidium hominis
NDSNCGNN

SEQ ID NO: 2116660 - protein, 11 aa, Cryptosporidium hominis
NDSNKKQCKAG

SEQ ID NO: 2116661 - protein, 5 aa, Cryptosporidium hominis
NDSRL

SEQ ID NO: 2116662 - protein, 8 aa, Cryptosporidium hominis
NDSSNNPN

SEQ ID NO: 2116663 - protein, 4 aa, Cryptosporidium hominis
NDTK

SEQ ID NO: 2116664 - protein, 11 aa, Cryptosporidium hominis
NDTKEISGNVE

SEQ ID NO: 2116665 - protein, 4 aa, Cryptosporidium hominis
NDTN

SEQ ID NO: 2116666 - protein, 4 aa, Cryptosporidium hominis
NDTQ

SEQ ID NO: 2116667 - protein, 6 aa, Cryptosporidium hominis
NDTSNI

SEQ ID NO: 2116668 - protein, 9 aa, Cryptosporidium hominis
NDVERKAND

SEQ ID NO: 2116669 - protein, 6 aa, Cryptosporidium hominis
NEADNK

SEQ ID NO: 2116670 - protein, 8 aa, Cryptosporidium hominis
NEAETTTV

SEQ ID NO: 2116671 - protein, 10 aa, Cryptosporidium hominis
NEAGPKSQSI

SEQ ID NO: 2116672 - protein, 6 aa, Cryptosporidium hominis
NEALQT

SEQ ID NO: 2116673 - protein, 9 aa, Cryptosporidium hominis
NEATNSTGT

SEQ ID NO: 2116674 - protein, 12 aa, Cryptosporidium hominis
NECEKKKSTRNE

SEQ ID NO: 2116675 - protein, 4 aa, Cryptosporidium hominis
NEDE

SEQ ID NO: 2116676 - protein, 7 aa, Cryptosporidium hominis
NEDEQSI

SEQ ID NO: 2116677 - protein, 10 aa, Cryptosporidium hominis
NEDGKTITQT

SEQ ID NO: 2116678 - protein, 4 aa, Cryptosporidium hominis
NEDK

SEQ ID NO: 2116679 - protein, 6 aa, Cryptosporidium hominis
NEDKEE

SEQ ID NO: 2116680 - protein, 7 aa, Cryptosporidium hominis
NEDLAKE

SEQ ID NO: 2116681 - protein, 6 aa, Cryptosporidium hominis
NEDPNI

SEQ ID NO: 2116682 - protein, 7 aa, Cryptosporidium hominis
NEDSHSC

SEQ ID NO: 2116683 - protein, 7 aa, Cryptosporidium hominis
NEECENP

SEQ ID NO: 2116684 - protein, 10 aa, Cryptosporidium hominis
NEEDSNDEIK

SEQ ID NO: 2116685 - protein, 7 aa, Cryptosporidium hominis
NEEEHVD

SEQ ID NO: 2116686 - protein, 8 aa, Cryptosporidium hominis
NEEGRPHG

SEQ ID NO: 2116687 - protein, 4 aa, Cryptosporidium hominis
NEEI

SEQ ID NO: 2116688 - protein, 13 aa, Cryptosporidium hominis
NEEIGPQNQDESF

SEQ ID NO: 2116689 - protein, 5 aa, Cryptosporidium hominis
NEEIN

SEQ ID NO: 2116690 - protein, 8 aa, Cryptosporidium hominis
NEENSPYF

SEQ ID NO: 2116691 - protein, 8 aa, Cryptosporidium hominis
NEESSNSF

SEQ ID NO: 2116692 - protein, 5 aa, Cryptosporidium hominis
NEESW

SEQ ID NO: 2116693 - protein, 19 aa, Cryptosporidium hominis
NEGDLESNTNETKEDSSIF

SEQ ID NO: 2116694 - protein, 4 aa, Cryptosporidium hominis
NEGR

SEQ ID NO: 2116695 - protein, 5 aa, Cryptosporidium hominis
NEGTL

SEQ ID NO: 2116696 - protein, 5 aa, Cryptosporidium hominis
NEGTN

SEQ ID NO: 2116697 - protein, 17 aa, Cryptosporidium hominis
NEHGKLGGEGSFGERSK

SEQ ID NO: 2116698 - protein, 4 aa, Cryptosporidium hominis
NEHM

SEQ ID NO: 2116699 - protein, 11 aa, Cryptosporidium hominis
NEIEDAKNKAS

SEQ ID NO: 2116700 - protein, 18 aa, Cryptosporidium hominis
NEIEDSENERLNSNRNRY

SEQ ID NO: 2116701 - protein, 7 aa, Cryptosporidium hominis
NEIETDL

SEQ ID NO: 2116702 - protein, 12 aa, Cryptosporidium hominis
NEIKGKTSNSSH

SEQ ID NO: 2116703 - protein, 13 aa, Cryptosporidium hominis
NEIQNKNTDCNGK

SEQ ID NO: 2116704 - protein, 6 aa, Cryptosporidium hominis
NEISYS

SEQ ID NO: 2116705 - protein, 6 aa, Cryptosporidium hominis
NEITSA

SEQ ID NO: 2116706 - protein, 11 aa, Cryptosporidium hominis
NEKDEKKSQSI

SEQ ID NO: 2116707 - protein, 8 aa, Cryptosporidium hominis
NEKGASFS

SEQ ID NO: 2116708 - protein, 10 aa, Cryptosporidium hominis
NEKSNSDYNS

SEQ ID NO: 2116709 - protein, 23 aa, Cryptosporidium hominis
NELDSSRTPVDETINNPDDYEEW

SEQ ID NO: 2116710 - protein, 5 aa, Cryptosporidium hominis
NELIE

SEQ ID NO: 2116711 - protein, 8 aa, Cryptosporidium hominis
NELNKDNE

SEQ ID NO: 2116712 - protein, 8 aa, Cryptosporidium hominis
NEMSDGKV

SEQ ID NO: 2116713 - protein, 10 aa, Cryptosporidium hominis
NENATEKEIE

SEQ ID NO: 2116714 - protein, 12 aa, Cryptosporidium hominis
NENDKNSNNKQM

SEQ ID NO: 2116715 - protein, 6 aa, Cryptosporidium hominis
NENESS

SEQ ID NO: 2116716 - protein, 8 aa, Cryptosporidium hominis
NENKNPND

SEQ ID NO: 2116717 - protein, 11 aa, Cryptosporidium hominis
NENKSSGYGNS

SEQ ID NO: 2116718 - protein, 11 aa, Cryptosporidium hominis
NENNDDDNNID

SEQ ID NO: 2116719 - protein, 9 aa, Cryptosporidium hominis
NENNNSSRR

SEQ ID NO: 2116720 - protein, 4 aa, Cryptosporidium hominis
NENP

SEQ ID NO: 2116721 - protein, 10 aa, Cryptosporidium hominis
NENPSKPVIS

SEQ ID NO: 2116722 - protein, 12 aa, Cryptosporidium hominis
NENSKFENNSKN

SEQ ID NO: 2116723 - protein, 11 aa, Cryptosporidium hominis
NENTDDSNNMD

SEQ ID NO: 2116724 - protein, 14 aa, Cryptosporidium hominis
NEPKTGLNNYSNTK

SEQ ID NO: 2116725 - protein, 5 aa, Cryptosporidium hominis
NEQDQ

SEQ ID NO: 2116726 - protein, 14 aa, Cryptosporidium hominis
NEQETNELDGKEGT

SEQ ID NO: 2116727 - protein, 7 aa, Cryptosporidium hominis
NEQGETI

SEQ ID NO: 2116728 - protein, 7 aa, Cryptosporidium hominis
NEQLNDQ

SEQ ID NO: 2116729 - protein, 6 aa, Cryptosporidium hominis
NEQSTS

SEQ ID NO: 2116730 - protein, 4 aa, Cryptosporidium hominis
NEQV

SEQ ID NO: 2116731 - protein, 4 aa, Cryptosporidium hominis
NERI

SEQ ID NO: 2116732 - protein, 6 aa, Cryptosporidium hominis
NERKNQ

SEQ ID NO: 2116733 - protein, 11 aa, Cryptosporidium hominis
NERSGTPNSKE

SEQ ID NO: 2116734 - protein, 7 aa, Cryptosporidium hominis
NERSNSD

SEQ ID NO: 2116735 - protein, 21 aa, Cryptosporidium hominis
NERSTAQNTRYGKNVEGFSNT

SEQ ID NO: 2116736 - protein, 6 aa, Cryptosporidium hominis
NESANS

SEQ ID NO: 2116737 - protein, 81 aa, Cryptosporidium hominis
NESISSYKRSSGLSIDNRTDQTHEGSGKSNYEARRTSIGNNSDNITEESFEDPLDSSNSGGSSEEGSENEGIRSDTDVEEE

SEQ ID NO: 2116738 - protein, 16 aa, Cryptosporidium hominis
NESKNTNTNVSSSTDK

SEQ ID NO: 2116739 - protein, 4 aa, Cryptosporidium hominis
NESL

SEQ ID NO: 2116740 - protein, 7 aa, Cryptosporidium hominis
NESNENH

SEQ ID NO: 2116741 - protein, 14 aa, Cryptosporidium hominis
NESNSWKTRGNMSE

SEQ ID NO: 2116742 - protein, 22 aa, Cryptosporidium hominis
NESPGTGAKESLEEELSKTSKL

SEQ ID NO: 2116743 - protein, 7 aa, Cryptosporidium hominis
NESSELA

SEQ ID NO: 2116744 - protein, 11 aa, Cryptosporidium hominis
NETETSTNLSS

SEQ ID NO: 2116745 - protein, 5 aa, Cryptosporidium hominis
NETGD

SEQ ID NO: 2116746 - protein, 7 aa, Cryptosporidium hominis
NETGNEF

SEQ ID NO: 2116747 - protein, 8 aa, Cryptosporidium hominis
NETKIKGS

SEQ ID NO: 2116748 - protein, 8 aa, Cryptosporidium hominis
NETNENNE

SEQ ID NO: 2116749 - protein, 6 aa, Cryptosporidium hominis
NETNPH

SEQ ID NO: 2116750 - protein, 8 aa, Cryptosporidium hominis
NETNPQSR

SEQ ID NO: 2116751 - protein, 9 aa, Cryptosporidium hominis
NETNSRKTV

SEQ ID NO: 2116752 - protein, 5 aa, Cryptosporidium hominis
NETSD

SEQ ID NO: 2116753 - protein, 4 aa, Cryptosporidium hominis
NEYL

SEQ ID NO: 2116754 - protein, 4 aa, Cryptosporidium hominis
NEYP

SEQ ID NO: 2116755 - protein, 7 aa, Cryptosporidium hominis
NEYSSNL

SEQ ID NO: 2116756 - protein, 8 aa, Cryptosporidium hominis
NEYTSEEI

SEQ ID NO: 2116757 - protein, 4 aa, Cryptosporidium hominis
NFDP

SEQ ID NO: 2116758 - protein, 12 aa, Cryptosporidium hominis
NFEDDQNTEVKK

SEQ ID NO: 2116759 - protein, 4 aa, Cryptosporidium hominis
NFEG

SEQ ID NO: 2116760 - protein, 11 aa, Cryptosporidium hominis
NFESSSDFNNI

SEQ ID NO: 2116761 - protein, 5 aa, Cryptosporidium hominis
NFGGG

SEQ ID NO: 2116762 - protein, 6 aa, Cryptosporidium hominis
NFGQNT

SEQ ID NO: 2116763 - protein, 4 aa, Cryptosporidium hominis
NFGS

SEQ ID NO: 2116764 - protein, 15 aa, Cryptosporidium hominis
NFGSDEFPAISNRAK

SEQ ID NO: 2116765 - protein, 11 aa, Cryptosporidium hominis
NFGSSSSKLNT

SEQ ID NO: 2116766 - protein, 4 aa, Cryptosporidium hominis
NFNS

SEQ ID NO: 2116767 - protein, 7 aa, Cryptosporidium hominis
NFNSKKR

SEQ ID NO: 2116768 - protein, 5 aa, Cryptosporidium hominis
NFNSR

SEQ ID NO: 2116769 - protein, 13 aa, Cryptosporidium hominis
NFPPQASTDKPNL

SEQ ID NO: 2116770 - protein, 5 aa, Cryptosporidium hominis
NFQNK

SEQ ID NO: 2116771 - protein, 8 aa, Cryptosporidium hominis
NFQPSSSN

SEQ ID NO: 2116772 - protein, 14 aa, Cryptosporidium hominis
NFRQQQSRYKPPTL

SEQ ID NO: 2116773 - protein, 4 aa, Cryptosporidium hominis
NFSK

SEQ ID NO: 2116774 - protein, 8 aa, Cryptosporidium hominis
NFSNKNNR

SEQ ID NO: 2116775 - protein, 17 aa, Cryptosporidium hominis
NFSTPARAKADTFSRNA

SEQ ID NO: 2116776 - protein, 4 aa, Cryptosporidium hominis
NFTE

SEQ ID NO: 2116777 - protein, 28 aa, Cryptosporidium hominis
NGANTGALANENTASGANEAGNPSTTNI

SEQ ID NO: 2116778 - protein, 9 aa, Cryptosporidium hominis
NGASTRPWS

SEQ ID NO: 2116779 - protein, 4 aa, Cryptosporidium hominis
NGDD

SEQ ID NO: 2116780 - protein, 5 aa, Cryptosporidium hominis
NGDDG

SEQ ID NO: 2116781 - protein, 8 aa, Cryptosporidium hominis
NGDHSNKD

SEQ ID NO: 2116782 - protein, 13 aa, Cryptosporidium hominis
NGDKGKLSQFFLK

SEQ ID NO: 2116783 - protein, 6 aa, Cryptosporidium hominis
NGDPIP

SEQ ID NO: 2116784 - protein, 8 aa, Cryptosporidium hominis
NGDSTNKS

SEQ ID NO: 2116785 - protein, 4 aa, Cryptosporidium hominis
NGDT

SEQ ID NO: 2116786 - protein, 9 aa, Cryptosporidium hominis
NGDVDSEKI

SEQ ID NO: 2116787 - protein, 6 aa, Cryptosporidium hominis
NGECNA

SEQ ID NO: 2116788 - protein, 13 aa, Cryptosporidium hominis
NGEEEEEEEEGEA

SEQ ID NO: 2116789 - protein, 6 aa, Cryptosporidium hominis
NGEEET

SEQ ID NO: 2116790 - protein, 6 aa, Cryptosporidium hominis
NGEKTI

SEQ ID NO: 2116791 - protein, 7 aa, Cryptosporidium hominis
NGEREEY

SEQ ID NO: 2116792 - protein, 9 aa, Cryptosporidium hominis
NGESYLEKE

SEQ ID NO: 2116793 - protein, 7 aa, Cryptosporidium hominis
NGFGSTN

SEQ ID NO: 2116794 - protein, 16 aa, Cryptosporidium hominis
NGGSGKLGHGTQSDCN

SEQ ID NO: 2116795 - protein, 6 aa, Cryptosporidium hominis
NGGSIK

SEQ ID NO: 2116796 - protein, 4 aa, Cryptosporidium hominis
NGGT

SEQ ID NO: 2116797 - protein, 11 aa, Cryptosporidium hominis
NGGTACPSSNQ

SEQ ID NO: 2116798 - protein, 6 aa, Cryptosporidium hominis
NGGTLA

SEQ ID NO: 2116799 - protein, 11 aa, Cryptosporidium hominis
NGHNSNNNVST

SEQ ID NO: 2116800 - protein, 7 aa, Cryptosporidium hominis
NGIDDSG

SEQ ID NO: 2116801 - protein, 6 aa, Cryptosporidium hominis
NGIDSS

SEQ ID NO: 2116802 - protein, 5 aa, Cryptosporidium hominis
NGIES

SEQ ID NO: 2116803 - protein, 10 aa, Cryptosporidium hominis
NGIKGTLGNT

SEQ ID NO: 2116804 - protein, 8 aa, Cryptosporidium hominis
NGKDSNYA

SEQ ID NO: 2116805 - protein, 8 aa, Cryptosporidium hominis
NGKISKSK

SEQ ID NO: 2116806 - protein, 6 aa, Cryptosporidium hominis
NGKNRC

SEQ ID NO: 2116807 - protein, 6 aa, Cryptosporidium hominis
NGKSGK

SEQ ID NO: 2116808 - protein, 8 aa, Cryptosporidium hominis
NGLGNLNP

SEQ ID NO: 2116809 - protein, 6 aa, Cryptosporidium hominis
NGLKNF

SEQ ID NO: 2116810 - protein, 5 aa, Cryptosporidium hominis
NGLPT

SEQ ID NO: 2116811 - protein, 9 aa, Cryptosporidium hominis
NGLSSEEIS

SEQ ID NO: 2116812 - protein, 5 aa, Cryptosporidium hominis
NGMGR

SEQ ID NO: 2116813 - protein, 11 aa, Cryptosporidium hominis
NGNAGSSIPDD

SEQ ID NO: 2116814 - protein, 10 aa, Cryptosporidium hominis
NGNDKSSIKT

SEQ ID NO: 2116815 - protein, 4 aa, Cryptosporidium hominis
NGNE

SEQ ID NO: 2116816 - protein, 14 aa, Cryptosporidium hominis
NGNEKSQPKGKESI

SEQ ID NO: 2116817 - protein, 13 aa, Cryptosporidium hominis
NGNESNSSIDGSH

SEQ ID NO: 2116818 - protein, 12 aa, Cryptosporidium hominis
NGNKSSRSQREH

SEQ ID NO: 2116819 - protein, 4 aa, Cryptosporidium hominis
NGNQ

SEQ ID NO: 2116820 - protein, 5 aa, Cryptosporidium hominis
NGNQS

SEQ ID NO: 2116821 - protein, 12 aa, Cryptosporidium hominis
NGNTCKESEIVP

SEQ ID NO: 2116822 - protein, 6 aa, Cryptosporidium hominis
NGPFDE

SEQ ID NO: 2116823 - protein, 44 aa, Cryptosporidium hominis
NGPGQAPGVASHQVSTSGRLIPPSSSMDGQRYSNASSNASSMNG

SEQ ID NO: 2116824 - protein, 45 aa, Cryptosporidium hominis
NGPNNVNGEGAKDISDNKSGTCSTSGNPSPKNEFDSESGKQSKAH

SEQ ID NO: 2116825 - protein, 6 aa, Cryptosporidium hominis
NGPSMT

SEQ ID NO: 2116826 - protein, 5 aa, Cryptosporidium hominis
NGPYI

SEQ ID NO: 2116827 - protein, 6 aa, Cryptosporidium hominis
NGQAKI

SEQ ID NO: 2116828 - protein, 4 aa, Cryptosporidium hominis
NGQV

SEQ ID NO: 2116829 - protein, 8 aa, Cryptosporidium hominis
NGRFTEPV

SEQ ID NO: 2116830 - protein, 37 aa, Cryptosporidium hominis
  misc_feature (13)..(14): Xaa can be any naturally occurring amino acid
  misc_feature (16)..(17): Xaa can be any naturally occurring amino acid
NGRIEWRVIGDVXXFXXFVFCLFVFVLVVLVFFFFCW

SEQ ID NO: 2116831 - protein, 5 aa, Cryptosporidium hominis
NGRMP

SEQ ID NO: 2116832 - protein, 11 aa, Cryptosporidium hominis
NGRNKNNEPIS

SEQ ID NO: 2116833 - protein, 6 aa, Cryptosporidium hominis
NGRNPI

SEQ ID NO: 2116834 - protein, 8 aa, Cryptosporidium hominis
NGSASIEL

SEQ ID NO: 2116835 - protein, 14 aa, Cryptosporidium hominis
NGSGPFNSKQINSP

SEQ ID NO: 2116836 - protein, 41 aa, Cryptosporidium hominis
NGSKPGTEVNSDNKSFNGSSKTTIENSTKSSTNNNREDDFN

SEQ ID NO: 2116837 - protein, 9 aa, Cryptosporidium hominis
NGSKSAKFT

SEQ ID NO: 2116838 - protein, 7 aa, Cryptosporidium hominis
NGSLGKF

SEQ ID NO: 2116839 - protein, 6 aa, Cryptosporidium hominis
NGSLSS

SEQ ID NO: 2116840 - protein, 5 aa, Cryptosporidium hominis
NGSNV

SEQ ID NO: 2116841 - protein, 6 aa, Cryptosporidium hominis
NGSSPL

SEQ ID NO: 2116842 - protein, 8 aa, Cryptosporidium hominis
NGSYSDNK

SEQ ID NO: 2116843 - protein, 8 aa, Cryptosporidium hominis
NGTEGPEI

SEQ ID NO: 2116844 - protein, 6 aa, Cryptosporidium hominis
NGTPEL

SEQ ID NO: 2116845 - protein, 17 aa, Cryptosporidium hominis
NGTPVKKKYNKEYSFTQ

SEQ ID NO: 2116846 - protein, 12 aa, Cryptosporidium hominis
NGTRIPSCDEKQ

SEQ ID NO: 2116847 - protein, 7 aa, Cryptosporidium hominis
NGTSGGS

SEQ ID NO: 2116848 - protein, 4 aa, Cryptosporidium hominis
NGTT

SEQ ID NO: 2116849 - protein, 6 aa, Cryptosporidium hominis
NGVGPI

SEQ ID NO: 2116850 - protein, 5 aa, Cryptosporidium hominis
NGYDK

SEQ ID NO: 2116851 - protein, 5 aa, Cryptosporidium hominis
NHAAS

SEQ ID NO: 2116852 - protein, 8 aa, Cryptosporidium hominis
NHDRDNQY

SEQ ID NO: 2116853 - protein, 7 aa, Cryptosporidium hominis
NHEDGNK

SEQ ID NO: 2116854 - protein, 8 aa, Cryptosporidium hominis
NHEEPRNK

SEQ ID NO: 2116855 - protein, 9 aa, Cryptosporidium hominis
NHKDSNDLI

SEQ ID NO: 2116856 - protein, 11 aa, Cryptosporidium hominis
NHKNQNNNRNN

SEQ ID NO: 2116857 - protein, 14 aa, Cryptosporidium hominis
NHKPKKTVDKSNSD

SEQ ID NO: 2116858 - protein, 9 aa, Cryptosporidium hominis
NHKTEHEKV

SEQ ID NO: 2116859 - protein, 13 aa, Cryptosporidium hominis
NHKTNDEKPRLRT

SEQ ID NO: 2116860 - protein, 9 aa, Cryptosporidium hominis
NHNRSDSES

SEQ ID NO: 2116861 - protein, 7 aa, Cryptosporidium hominis
NHQDDHK

SEQ ID NO: 2116862 - protein, 10 aa, Cryptosporidium hominis
NHQKYNQNHD

SEQ ID NO: 2116863 - protein, 15 aa, Cryptosporidium hominis
NHRRDNQEKFFQRTW

SEQ ID NO: 2116864 - protein, 11 aa, Cryptosporidium hominis
NHSRSNNVQKP

SEQ ID NO: 2116865 - protein, 7 aa, Cryptosporidium hominis
NHTRAQR

SEQ ID NO: 2116866 - protein, 4 aa, Cryptosporidium hominis
NHTY

SEQ ID NO: 2116867 - protein, 5 aa, Cryptosporidium hominis
NHYEK

SEQ ID NO: 2116868 - protein, 14 aa, Cryptosporidium hominis
NHYPSKHSSEQESL

SEQ ID NO: 2116869 - protein, 5 aa, Cryptosporidium hominis
NIDEP

SEQ ID NO: 2116870 - protein, 27 aa, Cryptosporidium hominis
NIDSTRSLPESLAKSGTIKDNREDISK

SEQ ID NO: 2116871 - protein, 10 aa, Cryptosporidium hominis
NIEESRPKSS

SEQ ID NO: 2116872 - protein, 11 aa, Cryptosporidium hominis
NIEGSNSSSEG

SEQ ID NO: 2116873 - protein, 7 aa, Cryptosporidium hominis
NIEPNKK

SEQ ID NO: 2116874 - protein, 5 aa, Cryptosporidium hominis
NIETA

SEQ ID NO: 2116875 - protein, 5 aa, Cryptosporidium hominis
NIETR

SEQ ID NO: 2116876 - protein, 5 aa, Cryptosporidium hominis
NIKKK

SEQ ID NO: 2116877 - protein, 9 aa, Cryptosporidium hominis
NIKNNKNKN

SEQ ID NO: 2116878 - protein, 8 aa, Cryptosporidium hominis
NIKTPTPI

SEQ ID NO: 2116879 - protein, 5 aa, Cryptosporidium hominis
NINDS

SEQ ID NO: 2116880 - protein, 5 aa, Cryptosporidium hominis
NINEK

SEQ ID NO: 2116881 - protein, 6 aa, Cryptosporidium hominis
NINNEH

SEQ ID NO: 2116882 - protein, 36 aa, Cryptosporidium hominis
NINSGSSKYTLSNDYPAEGYEGISGGSSASRTQQQA

SEQ ID NO: 2116883 - protein, 7 aa, Cryptosporidium hominis
NIPHGSA

SEQ ID NO: 2116884 - protein, 8 aa, Cryptosporidium hominis
NIPPKTSN

SEQ ID NO: 2116885 - protein, 5 aa, Cryptosporidium hominis
NIPSM

SEQ ID NO: 2116886 - protein, 4 aa, Cryptosporidium hominis
NIQD

SEQ ID NO: 2116887 - protein, 14 aa, Cryptosporidium hominis
NIQGNSPKSIVSDD

SEQ ID NO: 2116888 - protein, 8 aa, Cryptosporidium hominis
NIRNKGNI

SEQ ID NO: 2116889 - protein, 7 aa, Cryptosporidium hominis
NISDEND

SEQ ID NO: 2116890 - protein, 6 aa, Cryptosporidium hominis
NISENS

SEQ ID NO: 2116891 - protein, 7 aa, Cryptosporidium hominis
NISETNN

SEQ ID NO: 2116892 - protein, 21 aa, Cryptosporidium hominis
NISGIREKKEINSSSTEEKPK

SEQ ID NO: 2116893 - protein, 11 aa, Cryptosporidium hominis
NISNGHMNSDK

SEQ ID NO: 2116894 - protein, 6 aa, Cryptosporidium hominis
NISNGL

SEQ ID NO: 2116895 - protein, 5 aa, Cryptosporidium hominis
NISNH

SEQ ID NO: 2116896 - protein, 7 aa, Cryptosporidium hominis
NISNNTM

SEQ ID NO: 2116897 - protein, 13 aa, Cryptosporidium hominis
NISNSTEGIVYEF

SEQ ID NO: 2116898 - protein, 11 aa, Cryptosporidium hominis
NISNTEPSGLD

SEQ ID NO: 2116899 - protein, 5 aa, Cryptosporidium hominis
NISPR

SEQ ID NO: 2116900 - protein, 4 aa, Cryptosporidium hominis
NISQ

SEQ ID NO: 2116901 - protein, 19 aa, Cryptosporidium hominis
NISSEGRVEKQQKQEETPL

SEQ ID NO: 2116902 - protein, 26 aa, Cryptosporidium hominis
NISSESIQYNTDTCSSPSTIKSITFK

SEQ ID NO: 2116903 - protein, 17 aa, Cryptosporidium hominis
NISSNKFNRKSSTSYEI

SEQ ID NO: 2116904 - protein, 13 aa, Cryptosporidium hominis
NISSSSNSRNYTN

SEQ ID NO: 2116905 - protein, 10 aa, Cryptosporidium hominis
NISSSSTSTL

SEQ ID NO: 2116906 - protein, 25 aa, Cryptosporidium hominis
NITATSSANADSNSNLGSNPPTNLN

SEQ ID NO: 2116907 - protein, 5 aa, Cryptosporidium hominis
NITDK

SEQ ID NO: 2116908 - protein, 5 aa, Cryptosporidium hominis
NITKP

SEQ ID NO: 2116909 - protein, 11 aa, Cryptosporidium hominis
NITQGANPVPL

SEQ ID NO: 2116910 - protein, 17 aa, Cryptosporidium hominis
NITSNNEDDHSNNISNS

SEQ ID NO: 2116911 - protein, 16 aa, Cryptosporidium hominis
NITSTQPGNKSSSMTN

SEQ ID NO: 2116912 - protein, 5 aa, Cryptosporidium hominis
NIYKN

SEQ ID NO: 2116913 - protein, 9 aa, Cryptosporidium hominis
NKAARPDTN

SEQ ID NO: 2116914 - protein, 8 aa, Cryptosporidium hominis
NKAAVTKR

SEQ ID NO: 2116915 - protein, 21 aa, Cryptosporidium hominis
NKAHRKKSIKVKSRKEGTTEN

SEQ ID NO: 2116916 - protein, 9 aa, Cryptosporidium hominis
NKAINPNKR

SEQ ID NO: 2116917 - protein, 10 aa, Cryptosporidium hominis
NKANGNNKFD

SEQ ID NO: 2116918 - protein, 15 aa, Cryptosporidium hominis
NKANHASPEEKTSPF

SEQ ID NO: 2116919 - protein, 10 aa, Cryptosporidium hominis
NKDDGQEGLK

SEQ ID NO: 2116920 - protein, 10 aa, Cryptosporidium hominis
NKDDNVDSIH

SEQ ID NO: 2116921 - protein, 13 aa, Cryptosporidium hominis
NKDEVEEPIGQSD

SEQ ID NO: 2116922 - protein, 6 aa, Cryptosporidium hominis
NKDGLQ

SEQ ID NO: 2116923 - protein, 6 aa, Cryptosporidium hominis
NKDKLG

SEQ ID NO: 2116924 - protein, 7 aa, Cryptosporidium hominis
NKDKTQN

SEQ ID NO: 2116925 - protein, 32 aa, Cryptosporidium hominis
NKDNVPHSEEFSNDDDFSYNNNNKYDTTTNNN

SEQ ID NO: 2116926 - protein, 8 aa, Cryptosporidium hominis
NKDPKYTV

SEQ ID NO: 2116927 - protein, 8 aa, Cryptosporidium hominis
NKDSGKMA

SEQ ID NO: 2116928 - protein, 6 aa, Cryptosporidium hominis
NKDSSN

SEQ ID NO: 2116929 - protein, 5 aa, Cryptosporidium hominis
NKDTG

SEQ ID NO: 2116930 - protein, 10 aa, Cryptosporidium hominis
NKDYSKDGKT

SEQ ID NO: 2116931 - protein, 10 aa, Cryptosporidium hominis
NKEADKDHFN

SEQ ID NO: 2116932 - protein, 13 aa, Cryptosporidium hominis
NKEDGSTSFAFIY

SEQ ID NO: 2116933 - protein, 7 aa, Cryptosporidium hominis
NKEENGY

SEQ ID NO: 2116934 - protein, 4 aa, Cryptosporidium hominis
NKEF

SEQ ID NO: 2116935 - protein, 9 aa, Cryptosporidium hominis
NKEGQKPDI

SEQ ID NO: 2116936 - protein, 13 aa, Cryptosporidium hominis
NKEHHFTKSAKDK

SEQ ID NO: 2116937 - protein, 7 aa, Cryptosporidium hominis
NKELSNL

SEQ ID NO: 2116938 - protein, 31 aa, Cryptosporidium hominis
NKENEDKRRKEEEERKIKERKEREKREQEEL

SEQ ID NO: 2116939 - protein, 5 aa, Cryptosporidium hominis
NKEQV

SEQ ID NO: 2116940 - protein, 19 aa, Cryptosporidium hominis
NKESVQKNLRAKRKEYNDR

SEQ ID NO: 2116941 - protein, 13 aa, Cryptosporidium hominis
NKETESKEYNDKG

SEQ ID NO: 2116942 - protein, 4 aa, Cryptosporidium hominis
NKEY

SEQ ID NO: 2116943 - protein, 21 aa, Cryptosporidium hominis
NKEYGNNADSIASNNNSGCYD

SEQ ID NO: 2116944 - protein, 6 aa, Cryptosporidium hominis
NKFERS

SEQ ID NO: 2116945 - protein, 8 aa, Cryptosporidium hominis
NKFNDRNT

SEQ ID NO: 2116946 - protein, 6 aa, Cryptosporidium hominis
NKGHNE

SEQ ID NO: 2116947 - protein, 6 aa, Cryptosporidium hominis
NKGKGY

SEQ ID NO: 2116948 - protein, 10 aa, Cryptosporidium hominis
NKGKNNGDDV

SEQ ID NO: 2116949 - protein, 7 aa, Cryptosporidium hominis
NKGKPRK

SEQ ID NO: 2116950 - protein, 8 aa, Cryptosporidium hominis
NKGPPGSS

SEQ ID NO: 2116951 - protein, 4 aa, Cryptosporidium hominis
NKGQ

SEQ ID NO: 2116952 - protein, 13 aa, Cryptosporidium hominis
NKGRKDVSSSFPV

SEQ ID NO: 2116953 - protein, 4 aa, Cryptosporidium hominis
NKGS

SEQ ID NO: 2116954 - protein, 7 aa, Cryptosporidium hominis
NKGSSKI

SEQ ID NO: 2116955 - protein, 19 aa, Cryptosporidium hominis
NKHEKSSFSTDESEDETSI

SEQ ID NO: 2116956 - protein, 5 aa, Cryptosporidium hominis
NKHNS

SEQ ID NO: 2116957 - protein, 6 aa, Cryptosporidium hominis
NKHQNN

SEQ ID NO: 2116958 - protein, 14 aa, Cryptosporidium hominis
NKIAQENDLEQTKR

SEQ ID NO: 2116959 - protein, 7 aa, Cryptosporidium hominis
NKIKPKN

SEQ ID NO: 2116960 - protein, 7 aa, Cryptosporidium hominis
NKIKTTN

SEQ ID NO: 2116961 - protein, 7 aa, Cryptosporidium hominis
NKIPVTD

SEQ ID NO: 2116962 - protein, 9 aa, Cryptosporidium hominis
NKKDAMENQ

SEQ ID NO: 2116963 - protein, 8 aa, Cryptosporidium hominis
NKKDARKY

SEQ ID NO: 2116964 - protein, 10 aa, Cryptosporidium hominis
NKKDFSGSSI

SEQ ID NO: 2116965 - protein, 8 aa, Cryptosporidium hominis
NKKEYSIE

SEQ ID NO: 2116966 - protein, 9 aa, Cryptosporidium hominis
NKKFATNKR

SEQ ID NO: 2116967 - protein, 25 aa, Cryptosporidium hominis
NKKIENSVNNNTRINGNEEDNSLNE

SEQ ID NO: 2116968 - protein, 7 aa, Cryptosporidium hominis
NKKKDEG

SEQ ID NO: 2116969 - protein, 12 aa, Cryptosporidium hominis
NKKKRNKKQKKK

SEQ ID NO: 2116970 - protein, 7 aa, Cryptosporidium hominis
NKKLPNN

SEQ ID NO: 2116971 - protein, 9 aa, Cryptosporidium hominis
NKKMKKSVN

SEQ ID NO: 2116972 - protein, 16 aa, Cryptosporidium hominis
NKKNHISNNHHISLFG

SEQ ID NO: 2116973 - protein, 10 aa, Cryptosporidium hominis
NKKNQDKLPS

SEQ ID NO: 2116974 - protein, 7 aa, Cryptosporidium hominis
NKKSKGI

SEQ ID NO: 2116975 - protein, 6 aa, Cryptosporidium hominis
NKLINP

SEQ ID NO: 2116976 - protein, 6 aa, Cryptosporidium hominis
NKLPKN

SEQ ID NO: 2116977 - protein, 8 aa, Cryptosporidium hominis
NKLSDEDS

SEQ ID NO: 2116978 - protein, 10 aa, Cryptosporidium hominis
NKLSKDEPIS

SEQ ID NO: 2116979 - protein, 6 aa, Cryptosporidium hominis
NKLSVK

SEQ ID NO: 2116980 - protein, 14 aa, Cryptosporidium hominis
NKNDAISKSPNYNN

SEQ ID NO: 2116981 - protein, 7 aa, Cryptosporidium hominis
NKNDERH

SEQ ID NO: 2116982 - protein, 11 aa, Cryptosporidium hominis
NKNDRLTPKEF

SEQ ID NO: 2116983 - protein, 7 aa, Cryptosporidium hominis
NKNESNP

SEQ ID NO: 2116984 - protein, 14 aa, Cryptosporidium hominis
NKNGDSNSSVRLNS

SEQ ID NO: 2116985 - protein, 17 aa, Cryptosporidium hominis
NKNGNNTNTNSSSKKLK

SEQ ID NO: 2116986 - protein, 7 aa, Cryptosporidium hominis
NKNIETL

SEQ ID NO: 2116987 - protein, 11 aa, Cryptosporidium hominis
NKNINNQNIPT

SEQ ID NO: 2116988 - protein, 8 aa, Cryptosporidium hominis
NKNKINER

SEQ ID NO: 2116989 - protein, 34 aa, Cryptosporidium hominis
NKNKNLENQSEYGNNQQEGETQNSNSNSTGMEDS

SEQ ID NO: 2116990 - protein, 7 aa, Cryptosporidium hominis
NKNNEDL

SEQ ID NO: 2116991 - protein, 13 aa, Cryptosporidium hominis
NKNNTGKNCESGN

SEQ ID NO: 2116992 - protein, 7 aa, Cryptosporidium hominis
NKNQEET

SEQ ID NO: 2116993 - protein, 14 aa, Cryptosporidium hominis
NKNSESSKAGESKY

SEQ ID NO: 2116994 - protein, 6 aa, Cryptosporidium hominis
NKNSSH

SEQ ID NO: 2116995 - protein, 6 aa, Cryptosporidium hominis
NKNSVN

SEQ ID NO: 2116996 - protein, 4 aa, Cryptosporidium hominis
NKNY

SEQ ID NO: 2116997 - protein, 19 aa, Cryptosporidium hominis
NKPKSTPSRSARRTKEEDV

SEQ ID NO: 2116998 - protein, 16 aa, Cryptosporidium hominis
NKPSKKKRVLDSSGNI

SEQ ID NO: 2116999 - protein, 6 aa, Cryptosporidium hominis
NKPSPT

SEQ ID NO: 2117000 - protein, 5 aa, Cryptosporidium hominis
NKPYS

SEQ ID NO: 2117001 - protein, 6 aa, Cryptosporidium hominis
NKQDLK

SEQ ID NO: 2117002 - protein, 10 aa, Cryptosporidium hominis
NKQEKSSLEQ

SEQ ID NO: 2117003 - protein, 6 aa, Cryptosporidium hominis
NKQSEL

SEQ ID NO: 2117004 - protein, 7 aa, Cryptosporidium hominis
NKQSENT

SEQ ID NO: 2117005 - protein, 4 aa, Cryptosporidium hominis
NKRI

SEQ ID NO: 2117006 - protein, 9 aa, Cryptosporidium hominis
NKSAPISNQ

SEQ ID NO: 2117007 - protein, 8 aa, Cryptosporidium hominis
NKSDENNP

SEQ ID NO: 2117008 - protein, 21 aa, Cryptosporidium hominis
NKSIGKSRGEGIKHKSKTRID

SEQ ID NO: 2117009 - protein, 6 aa, Cryptosporidium hominis
NKSKES

SEQ ID NO: 2117010 - protein, 10 aa, Cryptosporidium hominis
NKSNQRDAYI

SEQ ID NO: 2117011 - protein, 7 aa, Cryptosporidium hominis
NKSPELN

SEQ ID NO: 2117012 - protein, 16 aa, Cryptosporidium hominis
NKSPNPEIKLGNSGAT

SEQ ID NO: 2117013 - protein, 5 aa, Cryptosporidium hominis
NKSPR

SEQ ID NO: 2117014 - protein, 11 aa, Cryptosporidium hominis
NKSSDAESENK

SEQ ID NO: 2117015 - protein, 49 aa, Cryptosporidium hominis
NKSSDAWNYSEEADSDEKINDSKESSEEDNSQSKTSTRKNSNELKQKKD

SEQ ID NO: 2117016 - protein, 14 aa, Cryptosporidium hominis
NKSSGDNRNTQYTI

SEQ ID NO: 2117017 - protein, 6 aa, Cryptosporidium hominis
NKSSGF

SEQ ID NO: 2117018 - protein, 5 aa, Cryptosporidium hominis
NKTDL

SEQ ID NO: 2117019 - protein, 8 aa, Cryptosporidium hominis
NKTESNDN

SEQ ID NO: 2117020 - protein, 17 aa, Cryptosporidium hominis
NKTLSKYPKFSNSPNFK

SEQ ID NO: 2117021 - protein, 4 aa, Cryptosporidium hominis
NKTM

SEQ ID NO: 2117022 - protein, 15 aa, Cryptosporidium hominis
NKTNTSTRFSTPSKE

SEQ ID NO: 2117023 - protein, 11 aa, Cryptosporidium hominis
NKTSNSTEAKF

SEQ ID NO: 2117024 - protein, 14 aa, Cryptosporidium hominis
NKTSRKKARKNNQD

SEQ ID NO: 2117025 - protein, 8 aa, Cryptosporidium hominis
NKVGTVQT

SEQ ID NO: 2117026 - protein, 7 aa, Cryptosporidium hominis
NKVHQKS

SEQ ID NO: 2117027 - protein, 7 aa, Cryptosporidium hominis
NKVKNEN

SEQ ID NO: 2117028 - protein, 6 aa, Cryptosporidium hominis
NKVPKS

SEQ ID NO: 2117029 - protein, 13 aa, Cryptosporidium hominis
NKVSYEPKSEGGL

SEQ ID NO: 2117030 - protein, 4 aa, Cryptosporidium hominis
NKYD

SEQ ID NO: 2117031 - protein, 4 aa, Cryptosporidium hominis
NKYN

SEQ ID NO: 2117032 - protein, 14 aa, Cryptosporidium hominis
NKYRQKNNTSFIQN

SEQ ID NO: 2117033 - protein, 7 aa, Cryptosporidium hominis
NLDGEEP

SEQ ID NO: 2117034 - protein, 7 aa, Cryptosporidium hominis
NLEEGSK

SEQ ID NO: 2117035 - protein, 10 aa, Cryptosporidium hominis
NLENPSAATS

SEQ ID NO: 2117036 - protein, 8 aa, Cryptosporidium hominis
NLGDGGEI

SEQ ID NO: 2117037 - protein, 10 aa, Cryptosporidium hominis
NLGKSQNNQC

SEQ ID NO: 2117038 - protein, 9 aa, Cryptosporidium hominis
NLGNTNRSG

SEQ ID NO: 2117039 - protein, 10 aa, Cryptosporidium hominis
NLGSETNKEK

SEQ ID NO: 2117040 - protein, 8 aa, Cryptosporidium hominis
NLKASKTS

SEQ ID NO: 2117041 - protein, 10 aa, Cryptosporidium hominis
NLKENEACGP

SEQ ID NO: 2117042 - protein, 13 aa, Cryptosporidium hominis
NLKKKASKKEATE

SEQ ID NO: 2117043 - protein, 8 aa, Cryptosporidium hominis
NLKNPGKI

SEQ ID NO: 2117044 - protein, 7 aa, Cryptosporidium hominis
NLKPPRT

SEQ ID NO: 2117045 - protein, 16 aa, Cryptosporidium hominis
NLKQDNQDIKDNTGNV

SEQ ID NO: 2117046 - protein, 25 aa, Cryptosporidium hominis
NLLDSNSLNEDSRKETNNKKSKTSD

SEQ ID NO: 2117047 - protein, 6 aa, Cryptosporidium hominis
NLLGPD

SEQ ID NO: 2117048 - protein, 8 aa, Cryptosporidium hominis
NLNEEGST

SEQ ID NO: 2117049 - protein, 10 aa, Cryptosporidium hominis
NLNEKNDSKI

SEQ ID NO: 2117050 - protein, 23 aa, Cryptosporidium hominis
NLNEQNNKKSTIQSSESSSREQA

SEQ ID NO: 2117051 - protein, 19 aa, Cryptosporidium hominis
NLNEQQETNVDQANEGKHL

SEQ ID NO: 2117052 - protein, 6 aa, Cryptosporidium hominis
NLNGNM

SEQ ID NO: 2117053 - protein, 6 aa, Cryptosporidium hominis
NLNHNR

SEQ ID NO: 2117054 - protein, 4 aa, Cryptosporidium hominis
NLNN

SEQ ID NO: 2117055 - protein, 9 aa, Cryptosporidium hominis
NLNNPSKSR

SEQ ID NO: 2117056 - protein, 9 aa, Cryptosporidium hominis
NLNSDEYNH

SEQ ID NO: 2117057 - protein, 7 aa, Cryptosporidium hominis
NLNSEYE

SEQ ID NO: 2117058 - protein, 5 aa, Cryptosporidium hominis
NLNSN

SEQ ID NO: 2117059 - protein, 4 aa, Cryptosporidium hominis
NLPE

SEQ ID NO: 2117060 - protein, 5 aa, Cryptosporidium hominis
NLPET

SEQ ID NO: 2117061 - protein, 6 aa, Cryptosporidium hominis
NLPNGK

SEQ ID NO: 2117062 - protein, 6 aa, Cryptosporidium hominis
NLPQVS

SEQ ID NO: 2117063 - protein, 31 aa, Cryptosporidium hominis
NLPSNAYPQTVKNGISSSNHLPEKKPTLPSS

SEQ ID NO: 2117064 - protein, 13 aa, Cryptosporidium hominis
NLPTTSTSTQGTT

SEQ ID NO: 2117065 - protein, 22 aa, Cryptosporidium hominis
NLQDGKNEDYYPGTGIDRSKSR

SEQ ID NO: 2117066 - protein, 14 aa, Cryptosporidium hominis
NLQSTQDEYESDSS

SEQ ID NO: 2117067 - protein, 9 aa, Cryptosporidium hominis
NLRTPTPDL

SEQ ID NO: 2117068 - protein, 17 aa, Cryptosporidium hominis
NLSAEKEAKSNSNLSSS

SEQ ID NO: 2117069 - protein, 7 aa, Cryptosporidium hominis
NLSDDER

SEQ ID NO: 2117070 - protein, 6 aa, Cryptosporidium hominis
NLSEGM

SEQ ID NO: 2117071 - protein, 9 aa, Cryptosporidium hominis
NLSGGQRQR

SEQ ID NO: 2117072 - protein, 13 aa, Cryptosporidium hominis
NLSPYNNSGVYHQ

SEQ ID NO: 2117073 - protein, 24 aa, Cryptosporidium hominis
NLSQTKNDQKIAKLGSNNSSRESL

SEQ ID NO: 2117074 - protein, 18 aa, Cryptosporidium hominis
NLSTENEKSQLDRSEVRG

SEQ ID NO: 2117075 - protein, 17 aa, Cryptosporidium hominis
NLTKNHGSNYHQKSKSS

SEQ ID NO: 2117076 - protein, 10 aa, Cryptosporidium hominis
NLYNETTSLD

SEQ ID NO: 2117077 - protein, 8 aa, Cryptosporidium hominis
NMASKEKP

SEQ ID NO: 2117078 - protein, 28 aa, Cryptosporidium hominis
NMDVGNTSKSNSSLSSGTNKFSNSSKNY

SEQ ID NO: 2117079 - protein, 4 aa, Cryptosporidium hominis
NMIN

SEQ ID NO: 2117080 - protein, 19 aa, Cryptosporidium hominis
NMIPPNSQPNSMMGPNGVQ

SEQ ID NO: 2117081 - protein, 8 aa, Cryptosporidium hominis
NMKRPSVP

SEQ ID NO: 2117082 - protein, 20 aa, Cryptosporidium hominis
NMNQNTPSIVNSNGNHFNSP

SEQ ID NO: 2117083 - protein, 12 aa, Cryptosporidium hominis
NMNSTSNKKSTL

SEQ ID NO: 2117084 - protein, 6 aa, Cryptosporidium hominis
NMTTNQ

SEQ ID NO: 2117085 - protein, 6 aa, Cryptosporidium hominis
NNAQRD

SEQ ID NO: 2117086 - protein, 7 aa, Cryptosporidium hominis
NNASNAL

SEQ ID NO: 2117087 - protein, 15 aa, Cryptosporidium hominis
NNAYNELSNENATMG

SEQ ID NO: 2117088 - protein, 5 aa, Cryptosporidium hominis
NNCKH

SEQ ID NO: 2117089 - protein, 12 aa, Cryptosporidium hominis
NNDDDKFNENEA

SEQ ID NO: 2117090 - protein, 11 aa, Cryptosporidium hominis
NNDNSNNNSNM

SEQ ID NO: 2117091 - protein, 5 aa, Cryptosporidium hominis
NNDPC

SEQ ID NO: 2117092 - protein, 17 aa, Cryptosporidium hominis
NNDSEHKNSTKINSKSE

SEQ ID NO: 2117093 - protein, 9 aa, Cryptosporidium hominis
NNDSNYSRA

SEQ ID NO: 2117094 - protein, 16 aa, Cryptosporidium hominis
NNDTDNNNHKGNHNFN

SEQ ID NO: 2117095 - protein, 5 aa, Cryptosporidium hominis
NNEDL

SEQ ID NO: 2117096 - protein, 6 aa, Cryptosporidium hominis
NNEEYS

SEQ ID NO: 2117097 - protein, 15 aa, Cryptosporidium hominis
NNEFNSEKSNQTELS

SEQ ID NO: 2117098 - protein, 6 aa, Cryptosporidium hominis
NNEITS

SEQ ID NO: 2117099 - protein, 13 aa, Cryptosporidium hominis
NNEKEADSAVQHR

SEQ ID NO: 2117100 - protein, 8 aa, Cryptosporidium hominis
NNETPKME

SEQ ID NO: 2117101 - protein, 4 aa, Cryptosporidium hominis
NNFE

SEQ ID NO: 2117102 - protein, 19 aa, Cryptosporidium hominis
NNFEDNKTIEGNKQQHNSI

SEQ ID NO: 2117103 - protein, 16 aa, Cryptosporidium hominis
NNFNNSNLDVSMWPVI

SEQ ID NO: 2117104 - protein, 32 aa, Cryptosporidium hominis
NNFSPNERTNYSNIASNRTNFTSRAERRGWRS

SEQ ID NO: 2117105 - protein, 11 aa, Cryptosporidium hominis
NNGGRNNRAGI

SEQ ID NO: 2117106 - protein, 5 aa, Cryptosporidium hominis
NNGKD

SEQ ID NO: 2117107 - protein, 11 aa, Cryptosporidium hominis
NNGKERKISEE

SEQ ID NO: 2117108 - protein, 8 aa, Cryptosporidium hominis
NNGNINGN

SEQ ID NO: 2117109 - protein, 11 aa, Cryptosporidium hominis
NNGNNSNNNNM

SEQ ID NO: 2117110 - protein, 9 aa, Cryptosporidium hominis
NNGNQQFPA

SEQ ID NO: 2117111 - protein, 14 aa, Cryptosporidium hominis
NNHHSGAKTPYKEE

SEQ ID NO: 2117112 - protein, 10 aa, Cryptosporidium hominis
NNHNNNLKSS

SEQ ID NO: 2117113 - protein, 4 aa, Cryptosporidium hominis
NNHP

SEQ ID NO: 2117114 - protein, 22 aa, Cryptosporidium hominis
NNHSRQSNSIKRSSSEHSRLNP

SEQ ID NO: 2117115 - protein, 6 aa, Cryptosporidium hominis
NNIEPN

SEQ ID NO: 2117116 - protein, 5 aa, Cryptosporidium hominis
NNINP

SEQ ID NO: 2117117 - protein, 14 aa, Cryptosporidium hominis
NNINSGSASNSCSN

SEQ ID NO: 2117118 - protein, 22 aa, Cryptosporidium hominis
NNISAGSEITEGESSIKNNKYN

SEQ ID NO: 2117119 - protein, 7 aa, Cryptosporidium hominis
NNISENQ

SEQ ID NO: 2117120 - protein, 41 aa, Cryptosporidium hominis
NNISNSGNSHNNSNNNNINIKNNNNNINNNTINNNNNSGIG

SEQ ID NO: 2117121 - protein, 11 aa, Cryptosporidium hominis
NNKDLEAESEE

SEQ ID NO: 2117122 - protein, 10 aa, Cryptosporidium hominis
NNKEQYINEK

SEQ ID NO: 2117123 - protein, 32 aa, Cryptosporidium hominis
NNKFDSINKANETNGTNGNNSFNKTCRTRRKR

SEQ ID NO: 2117124 - protein, 7 aa, Cryptosporidium hominis
NNKFKDG

SEQ ID NO: 2117125 - protein, 15 aa, Cryptosporidium hominis
NNKKELSNRKLDNEE

SEQ ID NO: 2117126 - protein, 13 aa, Cryptosporidium hominis
NNKKKERKKSSKL

SEQ ID NO: 2117127 - protein, 7 aa, Cryptosporidium hominis
NNKKNKW

SEQ ID NO: 2117128 - protein, 6 aa, Cryptosporidium hominis
NNKKNS

SEQ ID NO: 2117129 - protein, 8 aa, Cryptosporidium hominis
NNKKSNHA

SEQ ID NO: 2117130 - protein, 6 aa, Cryptosporidium hominis
NNKMPE

SEQ ID NO: 2117131 - protein, 9 aa, Cryptosporidium hominis
NNKNGMPSN

SEQ ID NO: 2117132 - protein, 8 aa, Cryptosporidium hominis
NNKNPGCP

SEQ ID NO: 2117133 - protein, 14 aa, Cryptosporidium hominis
NNKPHSHDSENEDC

SEQ ID NO: 2117134 - protein, 15 aa, Cryptosporidium hominis
NNKPPEDGSDDGKMD

SEQ ID NO: 2117135 - protein, 4 aa, Cryptosporidium hominis
NNKR

SEQ ID NO: 2117136 - protein, 9 aa, Cryptosporidium hominis
NNKSDYNSV

SEQ ID NO: 2117137 - protein, 13 aa, Cryptosporidium hominis
NNKSIKISDASNN

SEQ ID NO: 2117138 - protein, 13 aa, Cryptosporidium hominis
NNKSSSNKNPTSI

SEQ ID NO: 2117139 - protein, 11 aa, Cryptosporidium hominis
NNKSTENAENY

SEQ ID NO: 2117140 - protein, 7 aa, Cryptosporidium hominis
NNKTDNE

SEQ ID NO: 2117141 - protein, 8 aa, Cryptosporidium hominis
NNKYPNDQ

SEQ ID NO: 2117142 - protein, 4 aa, Cryptosporidium hominis
NNLG

SEQ ID NO: 2117143 - protein, 59 aa, Cryptosporidium hominis
NNLGTQDDECKEDSNRSRRASESSISSTDFSSSDSESSEYDNSFSSSDESNSDDELPND

SEQ ID NO: 2117144 - protein, 17 aa, Cryptosporidium hominis
NNLNQEKKNMSTKNNLN

SEQ ID NO: 2117145 - protein, 7 aa, Cryptosporidium hominis
NNLQDEY

SEQ ID NO: 2117146 - protein, 9 aa, Cryptosporidium hominis
NNLRDPDAD

SEQ ID NO: 2117147 - protein, 19 aa, Cryptosporidium hominis
NNLSSTDNTSVEKISPNEY

SEQ ID NO: 2117148 - protein, 7 aa, Cryptosporidium hominis
NNNDDGN

SEQ ID NO: 2117149 - protein, 10 aa, Cryptosporidium hominis
NNNDTLESSI

SEQ ID NO: 2117150 - protein, 6 aa, Cryptosporidium hominis
NNNFTR

SEQ ID NO: 2117151 - protein, 24 aa, Cryptosporidium hominis
NNNGAITINGNNSRNSNSQSICDD

SEQ ID NO: 2117152 - protein, 5 aa, Cryptosporidium hominis
NNNIE

SEQ ID NO: 2117153 - protein, 9 aa, Cryptosporidium hominis
NNNKPTKLT

SEQ ID NO: 2117154 - protein, 7 aa, Cryptosporidium hominis
NNNLGSD

SEQ ID NO: 2117155 - protein, 12 aa, Cryptosporidium hominis
NNNMSGQKPQYG

SEQ ID NO: 2117156 - protein, 48 aa, Cryptosporidium hominis
NNNNGKNFKPDRSCSKSSISDSTPNQINKNTVKDSLSAQVNNNSSSNF

SEQ ID NO: 2117157 - protein, 6 aa, Cryptosporidium hominis
NNNNKK

SEQ ID NO: 2117158 - protein, 11 aa, Cryptosporidium hominis
NNNNNNNITGG

SEQ ID NO: 2117159 - protein, 7 aa, Cryptosporidium hominis
NNNNNPI

SEQ ID NO: 2117160 - protein, 8 aa, Cryptosporidium hominis
NNNNNSTD

SEQ ID NO: 2117161 - protein, 7 aa, Cryptosporidium hominis
NNNNQNN

SEQ ID NO: 2117162 - protein, 21 aa, Cryptosporidium hominis
NNNNSGTTTTTTLTDKNDELA

SEQ ID NO: 2117163 - protein, 12 aa, Cryptosporidium hominis
NNNNSNSSRSGD

SEQ ID NO: 2117164 - protein, 11 aa, Cryptosporidium hominis
NNNSINNNVRS

SEQ ID NO: 2117165 - protein, 7 aa, Cryptosporidium hominis
NNNSTSV

SEQ ID NO: 2117166 - protein, 13 aa, Cryptosporidium hominis
NNNVTKEINQTNH

SEQ ID NO: 2117167 - protein, 7 aa, Cryptosporidium hominis
NNPCTEN

SEQ ID NO: 2117168 - protein, 7 aa, Cryptosporidium hominis
NNPESKR

SEQ ID NO: 2117169 - protein, 12 aa, Cryptosporidium hominis
NNPESNQKNNYE

SEQ ID NO: 2117170 - protein, 5 aa, Cryptosporidium hominis
NNPEY

SEQ ID NO: 2117171 - protein, 8 aa, Cryptosporidium hominis
NNPISNDG

SEQ ID NO: 2117172 - protein, 6 aa, Cryptosporidium hominis
NNPNSP

SEQ ID NO: 2117173 - protein, 9 aa, Cryptosporidium hominis
NNPPETISS

SEQ ID NO: 2117174 - protein, 9 aa, Cryptosporidium hominis
NNPSEGGLK

SEQ ID NO: 2117175 - protein, 6 aa, Cryptosporidium hominis
NNPYYK

SEQ ID NO: 2117176 - protein, 9 aa, Cryptosporidium hominis
NNQASKANS

SEQ ID NO: 2117177 - protein, 8 aa, Cryptosporidium hominis
NNQDNSQS

SEQ ID NO: 2117178 - protein, 9 aa, Cryptosporidium hominis
NNQDPESLL

SEQ ID NO: 2117179 - protein, 31 aa, Cryptosporidium hominis
NNQEQPPNPAPAAKEVPNRSRNLEKRPKHRL

SEQ ID NO: 2117180 - protein, 5 aa, Cryptosporidium hominis
NNQNP

SEQ ID NO: 2117181 - protein, 12 aa, Cryptosporidium hominis
NNQSISNGKYLY

SEQ ID NO: 2117182 - protein, 10 aa, Cryptosporidium hominis
NNQSISQNKE

SEQ ID NO: 2117183 - protein, 4 aa, Cryptosporidium hominis
NNQT

SEQ ID NO: 2117184 - protein, 6 aa, Cryptosporidium hominis
NNQVKR

SEQ ID NO: 2117185 - protein, 10 aa, Cryptosporidium hominis
NNQVSEGEYE

SEQ ID NO: 2117186 - protein, 5 aa, Cryptosporidium hominis
NNREM

SEQ ID NO: 2117187 - protein, 11 aa, Cryptosporidium hominis
NNRKEIQKQPN

SEQ ID NO: 2117188 - protein, 7 aa, Cryptosporidium hominis
NNRKSYE

SEQ ID NO: 2117189 - protein, 13 aa, Cryptosporidium hominis
NNRNSEGVPPKGT

SEQ ID NO: 2117190 - protein, 6 aa, Cryptosporidium hominis
NNRPSR

SEQ ID NO: 2117191 - protein, 8 aa, Cryptosporidium hominis
NNRQRNGS

SEQ ID NO: 2117192 - protein, 12 aa, Cryptosporidium hominis
NNRQSQSSNIRG

SEQ ID NO: 2117193 - protein, 6 aa, Cryptosporidium hominis
NNRSRN

SEQ ID NO: 2117194 - protein, 6 aa, Cryptosporidium hominis
NNSDIS

SEQ ID NO: 2117195 - protein, 4 aa, Cryptosporidium hominis
NNSE

SEQ ID NO: 2117196 - protein, 8 aa, Cryptosporidium hominis
NNSEDNIE

SEQ ID NO: 2117197 - protein, 5 aa, Cryptosporidium hominis
NNSHG

SEQ ID NO: 2117198 - protein, 8 aa, Cryptosporidium hominis
NNSHVENQ

SEQ ID NO: 2117199 - protein, 11 aa, Cryptosporidium hominis
NNSIQEESIQN

SEQ ID NO: 2117200 - protein, 5 aa, Cryptosporidium hominis
NNSLQ

SEQ ID NO: 2117201 - protein, 5 aa, Cryptosporidium hominis
NNSLR

SEQ ID NO: 2117202 - protein, 7 aa, Cryptosporidium hominis
NNSMSFS

SEQ ID NO: 2117203 - protein, 10 aa, Cryptosporidium hominis
NNSNKRNQDF

SEQ ID NO: 2117204 - protein, 9 aa, Cryptosporidium hominis
NNSNNNFSK

SEQ ID NO: 2117205 - protein, 14 aa, Cryptosporidium hominis
NNSNSDIGGTNYYE

SEQ ID NO: 2117206 - protein, 14 aa, Cryptosporidium hominis
NNSNSINGSNQQIQ

SEQ ID NO: 2117207 - protein, 23 aa, Cryptosporidium hominis
NNSNSSALSKSKTDNISNNPLLA

SEQ ID NO: 2117208 - protein, 7 aa, Cryptosporidium hominis
NNSPWDK

SEQ ID NO: 2117209 - protein, 6 aa, Cryptosporidium hominis
NNSQTN

SEQ ID NO: 2117210 - protein, 9 aa, Cryptosporidium hominis
NNSRPNINN

SEQ ID NO: 2117211 - protein, 12 aa, Cryptosporidium hominis
NNSRSGSSFSKS

SEQ ID NO: 2117212 - protein, 9 aa, Cryptosporidium hominis
NNSSSSDPV

SEQ ID NO: 2117213 - protein, 11 aa, Cryptosporidium hominis
NNSTNNNSQPA

SEQ ID NO: 2117214 - protein, 14 aa, Cryptosporidium hominis
NNSTPLIDSNSNFN

SEQ ID NO: 2117215 - protein, 6 aa, Cryptosporidium hominis
NNSTRK

SEQ ID NO: 2117216 - protein, 7 aa, Cryptosporidium hominis
NNSWNED

SEQ ID NO: 2117217 - protein, 17 aa, Cryptosporidium hominis
NNTENNTENQENENPNS

SEQ ID NO: 2117218 - protein, 7 aa, Cryptosporidium hominis
NNTGHEQ

SEQ ID NO: 2117219 - protein, 10 aa, Cryptosporidium hominis
NNTIRSKQSQ

SEQ ID NO: 2117220 - protein, 4 aa, Cryptosporidium hominis
NNTK

SEQ ID NO: 2117221 - protein, 6 aa, Cryptosporidium hominis
NNTNKK

SEQ ID NO: 2117222 - protein, 12 aa, Cryptosporidium hominis
NNTNNSINSNSI

SEQ ID NO: 2117223 - protein, 11 aa, Cryptosporidium hominis
NNTNSGSCPNG

SEQ ID NO: 2117224 - protein, 8 aa, Cryptosporidium hominis
NNTPNSDS

SEQ ID NO: 2117225 - protein, 7 aa, Cryptosporidium hominis
NNTPPPL

SEQ ID NO: 2117226 - protein, 6 aa, Cryptosporidium hominis
NNTQCD

SEQ ID NO: 2117227 - protein, 17 aa, Cryptosporidium hominis
NNTQTENNSFKNSPNNL

SEQ ID NO: 2117228 - protein, 4 aa, Cryptosporidium hominis
NNTS

SEQ ID NO: 2117229 - protein, 7 aa, Cryptosporidium hominis
NNTSDKI

SEQ ID NO: 2117230 - protein, 7 aa, Cryptosporidium hominis
NNVNNST

SEQ ID NO: 2117231 - protein, 4 aa, Cryptosporidium hominis
NNVP

SEQ ID NO: 2117232 - protein, 6 aa, Cryptosporidium hominis
NNVSKA

SEQ ID NO: 2117233 - protein, 115 aa, Cryptosporidium hominis
NNVSKGKSGGEDLNSNSRSRSSSTSRSRSVSSTGSTGSTRQTGSTSSTGSTGRTGTTSSTRSTRQTGTTSSTGPTSSTGPTRQTGPTNKANWTNKANWTNKANGTNKANGNNKFD

SEQ ID NO: 2117234 - protein, 9 aa, Cryptosporidium hominis
NNYRDTSSL

SEQ ID NO: 2117235 - protein, 5 aa, Cryptosporidium hominis
NPAIS

SEQ ID NO: 2117236 - protein, 9 aa, Cryptosporidium hominis
NPDDPRGHE

SEQ ID NO: 2117237 - protein, 6 aa, Cryptosporidium hominis
NPDPSF

SEQ ID NO: 2117238 - protein, 5 aa, Cryptosporidium hominis
NPDSE

SEQ ID NO: 2117239 - protein, 12 aa, Cryptosporidium hominis
NPDSIKNDSEFP

SEQ ID NO: 2117240 - protein, 8 aa, Cryptosporidium hominis
NPDSKMED

SEQ ID NO: 2117241 - protein, 13 aa, Cryptosporidium hominis
NPEADNSGANASD

SEQ ID NO: 2117242 - protein, 18 aa, Cryptosporidium hominis
NPEDPNYTNGVPTSTSID

SEQ ID NO: 2117243 - protein, 8 aa, Cryptosporidium hominis
NPEGGGGF

SEQ ID NO: 2117244 - protein, 5 aa, Cryptosporidium hominis
NPEHN

SEQ ID NO: 2117245 - protein, 8 aa, Cryptosporidium hominis
NPENSLNT

SEQ ID NO: 2117246 - protein, 21 aa, Cryptosporidium hominis
NPESAGPRPPGVQATPQTSPF

SEQ ID NO: 2117247 - protein, 6 aa, Cryptosporidium hominis
NPESKI

SEQ ID NO: 2117248 - protein, 7 aa, Cryptosporidium hominis
NPESNYK

SEQ ID NO: 2117249 - protein, 5 aa, Cryptosporidium hominis
NPETG

SEQ ID NO: 2117250 - protein, 4 aa, Cryptosporidium hominis
NPFS

SEQ ID NO: 2117251 - protein, 6 aa, Cryptosporidium hominis
NPGQPF

SEQ ID NO: 2117252 - protein, 5 aa, Cryptosporidium hominis
NPGSV

SEQ ID NO: 2117253 - protein, 5 aa, Cryptosporidium hominis
NPGTV

SEQ ID NO: 2117254 - protein, 10 aa, Cryptosporidium hominis
NPGYSEEDSL

SEQ ID NO: 2117255 - protein, 16 aa, Cryptosporidium hominis
NPKANFDSKFPPNSSK

SEQ ID NO: 2117256 - protein, 5 aa, Cryptosporidium hominis
NPKDK

SEQ ID NO: 2117257 - protein, 4 aa, Cryptosporidium hominis
NPKF

SEQ ID NO: 2117258 - protein, 5 aa, Cryptosporidium hominis
NPKKG

SEQ ID NO: 2117259 - protein, 5 aa, Cryptosporidium hominis
NPKST

SEQ ID NO: 2117260 - protein, 5 aa, Cryptosporidium hominis
NPKTK

SEQ ID NO: 2117261 - protein, 17 aa, Cryptosporidium hominis
NPLLSTNSSPTNRQFKD

SEQ ID NO: 2117262 - protein, 8 aa, Cryptosporidium hominis
NPLSPGQK

SEQ ID NO: 2117263 - protein, 8 aa, Cryptosporidium hominis
NPMNSSKK

SEQ ID NO: 2117264 - protein, 20 aa, Cryptosporidium hominis
NPNDVPDNSGKKECNKPQLD

SEQ ID NO: 2117265 - protein, 13 aa, Cryptosporidium hominis
NPNESNSNENNYF

SEQ ID NO: 2117266 - protein, 25 aa, Cryptosporidium hominis
NPNETQRANLSDGLSSVQVDEAKTF

SEQ ID NO: 2117267 - protein, 7 aa, Cryptosporidium hominis
NPNHSKV

SEQ ID NO: 2117268 - protein, 15 aa, Cryptosporidium hominis
NPNLNQATTGNSNYT

SEQ ID NO: 2117269 - protein, 9 aa, Cryptosporidium hominis
NPNMKGENE

SEQ ID NO: 2117270 - protein, 4 aa, Cryptosporidium hominis
NPNN

SEQ ID NO: 2117271 - protein, 8 aa, Cryptosporidium hominis
NPNPPSPT

SEQ ID NO: 2117272 - protein, 10 aa, Cryptosporidium hominis
NPNPRNKKVD

SEQ ID NO: 2117273 - protein, 5 aa, Cryptosporidium hominis
NPNQI

SEQ ID NO: 2117274 - protein, 9 aa, Cryptosporidium hominis
NPNQSSKIA

SEQ ID NO: 2117275 - protein, 6 aa, Cryptosporidium hominis
NPNYRN

SEQ ID NO: 2117276 - protein, 5 aa, Cryptosporidium hominis
NPPEL

SEQ ID NO: 2117277 - protein, 12 aa, Cryptosporidium hominis
NPPGTSEEQNKV

SEQ ID NO: 2117278 - protein, 8 aa, Cryptosporidium hominis
NPPNYSGN

SEQ ID NO: 2117279 - protein, 4 aa, Cryptosporidium hominis
NPPQ

SEQ ID NO: 2117280 - protein, 5 aa, Cryptosporidium hominis
NPPTV

SEQ ID NO: 2117281 - protein, 4 aa, Cryptosporidium hominis
NPQY

SEQ ID NO: 2117282 - protein, 5 aa, Cryptosporidium hominis
NPRGS

SEQ ID NO: 2117283 - protein, 5 aa, Cryptosporidium hominis
NPRIQ

SEQ ID NO: 2117284 - protein, 10 aa, Cryptosporidium hominis
NPRKGKVENR

SEQ ID NO: 2117285 - protein, 6 aa, Cryptosporidium hominis
NPRMPP

SEQ ID NO: 2117286 - protein, 11 aa, Cryptosporidium hominis
NPRNSNDQNSS

SEQ ID NO: 2117287 - protein, 5 aa, Cryptosporidium hominis
NPRNY

SEQ ID NO: 2117288 - protein, 4 aa, Cryptosporidium hominis
NPSE

SEQ ID NO: 2117289 - protein, 4 aa, Cryptosporidium hominis
NPSI

SEQ ID NO: 2117290 - protein, 5 aa, Cryptosporidium hominis
NPSIS

SEQ ID NO: 2117291 - protein, 5 aa, Cryptosporidium hominis
NPSKF

SEQ ID NO: 2117292 - protein, 8 aa, Cryptosporidium hominis
NPSKHNEQ

SEQ ID NO: 2117293 - protein, 5 aa, Cryptosporidium hominis
NPSKT

SEQ ID NO: 2117294 - protein, 4 aa, Cryptosporidium hominis
NPSL

SEQ ID NO: 2117295 - protein, 6 aa, Cryptosporidium hominis
NPSRKK

SEQ ID NO: 2117296 - protein, 8 aa, Cryptosporidium hominis
NPSRNTPQ

SEQ ID NO: 2117297 - protein, 10 aa, Cryptosporidium hominis
NPTENRNRED

SEQ ID NO: 2117298 - protein, 4 aa, Cryptosporidium hominis
NPTH

SEQ ID NO: 2117299 - protein, 4 aa, Cryptosporidium hominis
NPTI

SEQ ID NO: 2117300 - protein, 5 aa, Cryptosporidium hominis
NPTID

SEQ ID NO: 2117301 - protein, 10 aa, Cryptosporidium hominis
NPTPGGYKAT

SEQ ID NO: 2117302 - protein, 6 aa, Cryptosporidium hominis
NPTPIN

SEQ ID NO: 2117303 - protein, 15 aa, Cryptosporidium hominis
NPTPTPSATSPSKTL

SEQ ID NO: 2117304 - protein, 5 aa, Cryptosporidium hominis
NPTTS

SEQ ID NO: 2117305 - protein, 10 aa, Cryptosporidium hominis
NPYDHTSTNE

SEQ ID NO: 2117306 - protein, 14 aa, Cryptosporidium hominis
NPYQQTQNQGQYHS

SEQ ID NO: 2117307 - protein, 8 aa, Cryptosporidium hominis
NQAEGDVE

SEQ ID NO: 2117308 - protein, 7 aa, Cryptosporidium hominis
NQAESKL

SEQ ID NO: 2117309 - protein, 4 aa, Cryptosporidium hominis
NQAG

SEQ ID NO: 2117310 - protein, 14 aa, Cryptosporidium hominis
NQARMQDGKSLSSS

SEQ ID NO: 2117311 - protein, 4 aa, Cryptosporidium hominis
NQAV

SEQ ID NO: 2117312 - protein, 6 aa, Cryptosporidium hominis
NQDGNG

SEQ ID NO: 2117313 - protein, 11 aa, Cryptosporidium hominis
NQDKNLTKSVA

SEQ ID NO: 2117314 - protein, 4 aa, Cryptosporidium hominis
NQDQ

SEQ ID NO: 2117315 - protein, 9 aa, Cryptosporidium hominis
NQDSKVPKL

SEQ ID NO: 2117316 - protein, 4 aa, Cryptosporidium hominis
NQDT

SEQ ID NO: 2117317 - protein, 4 aa, Cryptosporidium hominis
NQEK

SEQ ID NO: 2117318 - protein, 14 aa, Cryptosporidium hominis
NQETKEAKEAQDGN

SEQ ID NO: 2117319 - protein, 17 aa, Cryptosporidium hominis
NQIEDDNPIQGTTPYIS

SEQ ID NO: 2117320 - protein, 12 aa, Cryptosporidium hominis
NQINGSPSSSFS

SEQ ID NO: 2117321 - protein, 12 aa, Cryptosporidium hominis
NQINKRGKNIEN

SEQ ID NO: 2117322 - protein, 6 aa, Cryptosporidium hominis
NQISSD

SEQ ID NO: 2117323 - protein, 6 aa, Cryptosporidium hominis
NQKEIK

SEQ ID NO: 2117324 - protein, 14 aa, Cryptosporidium hominis
NQKENESSTTESKH

SEQ ID NO: 2117325 - protein, 6 aa, Cryptosporidium hominis
NQKNIS

SEQ ID NO: 2117326 - protein, 9 aa, Cryptosporidium hominis
NQKNSNGDS

SEQ ID NO: 2117327 - protein, 12 aa, Cryptosporidium hominis
NQLNETQNINKA

SEQ ID NO: 2117328 - protein, 6 aa, Cryptosporidium hominis
NQLQNS

SEQ ID NO: 2117329 - protein, 7 aa, Cryptosporidium hominis
NQLSSNN

SEQ ID NO: 2117330 - protein, 5 aa, Cryptosporidium hominis
NQNFD

SEQ ID NO: 2117331 - protein, 15 aa, Cryptosporidium hominis
NQNHEYQSKETEKLL

SEQ ID NO: 2117332 - protein, 8 aa, Cryptosporidium hominis
NQNNQTEI

SEQ ID NO: 2117333 - protein, 6 aa, Cryptosporidium hominis
NQNPGT

SEQ ID NO: 2117334 - protein, 9 aa, Cryptosporidium hominis
NQNSDPKVI

SEQ ID NO: 2117335 - protein, 5 aa, Cryptosporidium hominis
NQNSF

SEQ ID NO: 2117336 - protein, 23 aa, Cryptosporidium hominis
NQNSSSSNYANLRSDQETRQIQT

SEQ ID NO: 2117337 - protein, 10 aa, Cryptosporidium hominis
NQNYSREDQE

SEQ ID NO: 2117338 - protein, 4 aa, Cryptosporidium hominis
NQPA

SEQ ID NO: 2117339 - protein, 52 aa, Cryptosporidium hominis
NQPKTSITSTESTLNIDEENDSDADSSVKTNQSTSSDASSGKLYDGSSGHSQ

SEQ ID NO: 2117340 - protein, 6 aa, Cryptosporidium hominis
NQPNKS

SEQ ID NO: 2117341 - protein, 8 aa, Cryptosporidium hominis
NQPSTNLD

SEQ ID NO: 2117342 - protein, 9 aa, Cryptosporidium hominis
NQRENVSDK

SEQ ID NO: 2117343 - protein, 21 aa, Cryptosporidium hominis
NQSGSGSGSGTGPGSGKDPKV

SEQ ID NO: 2117344 - protein, 9 aa, Cryptosporidium hominis
NQSLSDSHH

SEQ ID NO: 2117345 - protein, 8 aa, Cryptosporidium hominis
NQSNEERM

SEQ ID NO: 2117346 - protein, 16 aa, Cryptosporidium hominis
NQSNNTLPQGYSDSKE

SEQ ID NO: 2117347 - protein, 101 aa, Cryptosporidium hominis
NQSSSESSYEETEGSKAEDSVSTSDLSKSDDKGFTKNEGSVQSTYADDDDEGSGELSSEGEASESEMKDGSKLSEKNSEEIPINQSESQPLNSQTEQKQDI

SEQ ID NO: 2117348 - protein, 5 aa, Cryptosporidium hominis
NQTEA

SEQ ID NO: 2117349 - protein, 6 aa, Cryptosporidium hominis
NQTEPF

SEQ ID NO: 2117350 - protein, 17 aa, Cryptosporidium hominis
NQTLSNRSNSLPPRNNN

SEQ ID NO: 2117351 - protein, 7 aa, Cryptosporidium hominis
NQTSSSQ

SEQ ID NO: 2117352 - protein, 12 aa, Cryptosporidium hominis
NQTTTSTTTSTI

SEQ ID NO: 2117353 - protein, 8 aa, Cryptosporidium hominis
NQTTTTIE

SEQ ID NO: 2117354 - protein, 5 aa, Cryptosporidium hominis
NQTVK

SEQ ID NO: 2117355 - protein, 14 aa, Cryptosporidium hominis
NQVEENSSGRIQAY

SEQ ID NO: 2117356 - protein, 12 aa, Cryptosporidium hominis
NQVVSDPSQVID

SEQ ID NO: 2117357 - protein, 5 aa, Cryptosporidium hominis
NQYCN

SEQ ID NO: 2117358 - protein, 4 aa, Cryptosporidium hominis
NQYN

SEQ ID NO: 2117359 - protein, 7 aa, Cryptosporidium hominis
NRAQDNV

SEQ ID NO: 2117360 - protein, 4 aa, Cryptosporidium hominis
NRAR

SEQ ID NO: 2117361 - protein, 5 aa, Cryptosporidium hominis
NRASN

SEQ ID NO: 2117362 - protein, 4 aa, Cryptosporidium hominis
NRDD

SEQ ID NO: 2117363 - protein, 6 aa, Cryptosporidium hominis
NRDDSV

SEQ ID NO: 2117364 - protein, 12 aa, Cryptosporidium hominis
NRDGKNANFKSS

SEQ ID NO: 2117365 - protein, 6 aa, Cryptosporidium hominis
NRDGNL

SEQ ID NO: 2117366 - protein, 6 aa, Cryptosporidium hominis
NRDPRG

SEQ ID NO: 2117367 - protein, 17 aa, Cryptosporidium hominis
NRDSDYSDSIGLNDQNG

SEQ ID NO: 2117368 - protein, 9 aa, Cryptosporidium hominis
NRDSYQDEL

SEQ ID NO: 2117369 - protein, 5 aa, Cryptosporidium hominis
NRDWG

SEQ ID NO: 2117370 - protein, 5 aa, Cryptosporidium hominis
NREAT

SEQ ID NO: 2117371 - protein, 14 aa, Cryptosporidium hominis
NREDYNTWIELNPE

SEQ ID NO: 2117372 - protein, 7 aa, Cryptosporidium hominis
NREKRDP

SEQ ID NO: 2117373 - protein, 5 aa, Cryptosporidium hominis
NREQQ

SEQ ID NO: 2117374 - protein, 6 aa, Cryptosporidium hominis
NREREN

SEQ ID NO: 2117375 - protein, 4 aa, Cryptosporidium hominis
NREY

SEQ ID NO: 2117376 - protein, 4 aa, Cryptosporidium hominis
NRGA

SEQ ID NO: 2117377 - protein, 5 aa, Cryptosporidium hominis
NRGEQ

SEQ ID NO: 2117378 - protein, 10 aa, Cryptosporidium hominis
NRGKSQVETQ

SEQ ID NO: 2117379 - protein, 8 aa, Cryptosporidium hominis
NRGYSSSE

SEQ ID NO: 2117380 - protein, 12 aa, Cryptosporidium hominis
NRHCNDDDGTVE

SEQ ID NO: 2117381 - protein, 4 aa, Cryptosporidium hominis
NRIK

SEQ ID NO: 2117382 - protein, 8 aa, Cryptosporidium hominis
NRKDTTTG

SEQ ID NO: 2117383 - protein, 18 aa, Cryptosporidium hominis
NRKNKSKKDTEPESCQSV

SEQ ID NO: 2117384 - protein, 8 aa, Cryptosporidium hominis
NRKRQQEL

SEQ ID NO: 2117385 - protein, 4 aa, Cryptosporidium hominis
NRLS

SEQ ID NO: 2117386 - protein, 11 aa, Cryptosporidium hominis
NRNAKKQELRD

SEQ ID NO: 2117387 - protein, 20 aa, Cryptosporidium hominis
NRNGNDPEGKYSNAGTNSGG

SEQ ID NO: 2117388 - protein, 6 aa, Cryptosporidium hominis
NRNKLT

SEQ ID NO: 2117389 - protein, 5 aa, Cryptosporidium hominis
NRNNN

SEQ ID NO: 2117390 - protein, 7 aa, Cryptosporidium hominis
NRNNSTI

SEQ ID NO: 2117391 - protein, 8 aa, Cryptosporidium hominis
NRNQKSGE

SEQ ID NO: 2117392 - protein, 20 aa, Cryptosporidium hominis
NRNSNASLTGLNRQSSSLKK

SEQ ID NO: 2117393 - protein, 9 aa, Cryptosporidium hominis
NRNSPQNNF

SEQ ID NO: 2117394 - protein, 19 aa, Cryptosporidium hominis
NRPIKKNEIKRELTQSQPH

SEQ ID NO: 2117395 - protein, 6 aa, Cryptosporidium hominis
NRPVPR

SEQ ID NO: 2117396 - protein, 13 aa, Cryptosporidium hominis
NRRSIEEDKISQN

SEQ ID NO: 2117397 - protein, 6 aa, Cryptosporidium hominis
NRRTDL

SEQ ID NO: 2117398 - protein, 6 aa, Cryptosporidium hominis
NRSASL

SEQ ID NO: 2117399 - protein, 20 aa, Cryptosporidium hominis
NRSEEEEKKLIENEKSNLMN

SEQ ID NO: 2117400 - protein, 6 aa, Cryptosporidium hominis
NRSEVG

SEQ ID NO: 2117401 - protein, 21 aa, Cryptosporidium hominis
NRSGSKTGSIAPKSSEYGPTV

SEQ ID NO: 2117402 - protein, 15 aa, Cryptosporidium hominis
NRSNLEKLKNVICSL

SEQ ID NO: 2117403 - protein, 8 aa, Cryptosporidium hominis
NRSRSEIQ

SEQ ID NO: 2117404 - protein, 7 aa, Cryptosporidium hominis
NRTGDGV

SEQ ID NO: 2117405 - protein, 7 aa, Cryptosporidium hominis
NRVSGQD

SEQ ID NO: 2117406 - protein, 8 aa, Cryptosporidium hominis
NRYRGDKI

SEQ ID NO: 2117407 - protein, 7 aa, Cryptosporidium hominis
NRYSQEQ

SEQ ID NO: 2117408 - protein, 8 aa, Cryptosporidium hominis
NSAGKKFQ

SEQ ID NO: 2117409 - protein, 14 aa, Cryptosporidium hominis
NSANEFDSEKGSHN

SEQ ID NO: 2117410 - protein, 20 aa, Cryptosporidium hominis
NSASSQQCEAYDQEASLNPK

SEQ ID NO: 2117411 - protein, 8 aa, Cryptosporidium hominis
NSDDELDE

SEQ ID NO: 2117412 - protein, 8 aa, Cryptosporidium hominis
NSDPSLKL

SEQ ID NO: 2117413 - protein, 4 aa, Cryptosporidium hominis
NSDS

SEQ ID NO: 2117414 - protein, 7 aa, Cryptosporidium hominis
NSDSLQE

SEQ ID NO: 2117415 - protein, 12 aa, Cryptosporidium hominis
NSDSSNDSNKKV

SEQ ID NO: 2117416 - protein, 5 aa, Cryptosporidium hominis
NSDTK

SEQ ID NO: 2117417 - protein, 9 aa, Cryptosporidium hominis
NSDYNSNIQ

SEQ ID NO: 2117418 - protein, 6 aa, Cryptosporidium hominis
NSEAGI

SEQ ID NO: 2117419 - protein, 12 aa, Cryptosporidium hominis
NSEANRNDKEKD

SEQ ID NO: 2117420 - protein, 7 aa, Cryptosporidium hominis
NSEDEFE

SEQ ID NO: 2117421 - protein, 5 aa, Cryptosporidium hominis
NSEDL

SEQ ID NO: 2117422 - protein, 6 aa, Cryptosporidium hominis
NSEKGR

SEQ ID NO: 2117423 - protein, 38 aa, Cryptosporidium hominis
NSENNDINQRENDPNQELSSSSADPDLENNDTPTLEGS

SEQ ID NO: 2117424 - protein, 7 aa, Cryptosporidium hominis
NSENYES

SEQ ID NO: 2117425 - protein, 20 aa, Cryptosporidium hominis
NSESPDGSSTITSEKAHKDL

SEQ ID NO: 2117426 - protein, 9 aa, Cryptosporidium hominis
NSESSKNFL

SEQ ID NO: 2117427 - protein, 15 aa, Cryptosporidium hominis
NSETLSSSKKKQIDD

SEQ ID NO: 2117428 - protein, 8 aa, Cryptosporidium hominis
NSETSFSS

SEQ ID NO: 2117429 - protein, 11 aa, Cryptosporidium hominis
NSEVSPSVSGQ

SEQ ID NO: 2117430 - protein, 6 aa, Cryptosporidium hominis
NSFSGN

SEQ ID NO: 2117431 - protein, 17 aa, Cryptosporidium hominis
NSGANSGMAGGQQGTNI

SEQ ID NO: 2117432 - protein, 22 aa, Cryptosporidium hominis
NSGDEPIQEIATSGSKDGGDDV

SEQ ID NO: 2117433 - protein, 12 aa, Cryptosporidium hominis
NSGEGGEAEKTI

SEQ ID NO: 2117434 - protein, 9 aa, Cryptosporidium hominis
NSGGPTETI

SEQ ID NO: 2117435 - protein, 4 aa, Cryptosporidium hominis
NSGI

SEQ ID NO: 2117436 - protein, 5 aa, Cryptosporidium hominis
NSGKT

SEQ ID NO: 2117437 - protein, 7 aa, Cryptosporidium hominis
NSGLPNG

SEQ ID NO: 2117438 - protein, 8 aa, Cryptosporidium hominis
NSGNPIPD

SEQ ID NO: 2117439 - protein, 8 aa, Cryptosporidium hominis
NSGSGKRY

SEQ ID NO: 2117440 - protein, 8 aa, Cryptosporidium hominis
NSGSGKST

SEQ ID NO: 2117441 - protein, 9 aa, Cryptosporidium hominis
NSGSSSDPI

SEQ ID NO: 2117442 - protein, 11 aa, Cryptosporidium hominis
NSGSSVPTTPI

SEQ ID NO: 2117443 - protein, 14 aa, Cryptosporidium hominis
NSGTRNRCQICSTR

SEQ ID NO: 2117444 - protein, 7 aa, Cryptosporidium hominis
NSGTTRY

SEQ ID NO: 2117445 - protein, 6 aa, Cryptosporidium hominis
NSGVER

SEQ ID NO: 2117446 - protein, 4 aa, Cryptosporidium hominis
NSHD

SEQ ID NO: 2117447 - protein, 13 aa, Cryptosporidium hominis
NSHENNNTENYDI

SEQ ID NO: 2117448 - protein, 8 aa, Cryptosporidium hominis
NSHLSTKS

SEQ ID NO: 2117449 - protein, 4 aa, Cryptosporidium hominis
NSHN

SEQ ID NO: 2117450 - protein, 12 aa, Cryptosporidium hominis
NSHSLDSSTKDY

SEQ ID NO: 2117451 - protein, 11 aa, Cryptosporidium hominis
NSHSSEKTNND

SEQ ID NO: 2117452 - protein, 4 aa, Cryptosporidium hominis
NSHY

SEQ ID NO: 2117453 - protein, 6 aa, Cryptosporidium hominis
NSIANP

SEQ ID NO: 2117454 - protein, 7 aa, Cryptosporidium hominis
NSIEDQY

SEQ ID NO: 2117455 - protein, 9 aa, Cryptosporidium hominis
NSINETDQT

SEQ ID NO: 2117456 - protein, 16 aa, Cryptosporidium hominis
NSINKEKPKFSHQDSE

SEQ ID NO: 2117457 - protein, 8 aa, Cryptosporidium hominis
NSINSDSK

SEQ ID NO: 2117458 - protein, 6 aa, Cryptosporidium hominis
NSIPSN

SEQ ID NO: 2117459 - protein, 6 aa, Cryptosporidium hominis
NSIQNK

SEQ ID NO: 2117460 - protein, 12 aa, Cryptosporidium hominis
NSIQSSLSPRFG

SEQ ID NO: 2117461 - protein, 6 aa, Cryptosporidium hominis
NSIRRS

SEQ ID NO: 2117462 - protein, 13 aa, Cryptosporidium hominis
NSKAADLHDSYIN

SEQ ID NO: 2117463 - protein, 8 aa, Cryptosporidium hominis
NSKAPLGF

SEQ ID NO: 2117464 - protein, 9 aa, Cryptosporidium hominis
NSKDDDQAN

SEQ ID NO: 2117465 - protein, 9 aa, Cryptosporidium hominis
NSKDDEKEL

SEQ ID NO: 2117466 - protein, 9 aa, Cryptosporidium hominis
NSKGNEKTI

SEQ ID NO: 2117467 - protein, 6 aa, Cryptosporidium hominis
NSKKKV

SEQ ID NO: 2117468 - protein, 4 aa, Cryptosporidium hominis
NSKN

SEQ ID NO: 2117469 - protein, 12 aa, Cryptosporidium hominis
NSKPGESYEDEI

SEQ ID NO: 2117470 - protein, 9 aa, Cryptosporidium hominis
NSKSENYEE

SEQ ID NO: 2117471 - protein, 7 aa, Cryptosporidium hominis
NSKSKVS

SEQ ID NO: 2117472 - protein, 25 aa, Cryptosporidium hominis
NSKSPDIGTLNSGSNSEPNSNTNSV

SEQ ID NO: 2117473 - protein, 8 aa, Cryptosporidium hominis
NSKSQTVE

SEQ ID NO: 2117474 - protein, 8 aa, Cryptosporidium hominis
NSKTDSEN

SEQ ID NO: 2117475 - protein, 14 aa, Cryptosporidium hominis
NSKTYNESDSDGSL

SEQ ID NO: 2117476 - protein, 9 aa, Cryptosporidium hominis
NSKYSSNER

SEQ ID NO: 2117477 - protein, 14 aa, Cryptosporidium hominis
NSLDDKNTKTTNSV

SEQ ID NO: 2117478 - protein, 10 aa, Cryptosporidium hominis
NSLEDSDNWG

SEQ ID NO: 2117479 - protein, 16 aa, Cryptosporidium hominis
NSLGINSRNGSFGDSC

SEQ ID NO: 2117480 - protein, 6 aa, Cryptosporidium hominis
NSLGSY

SEQ ID NO: 2117481 - protein, 4 aa, Cryptosporidium hominis
NSLL

SEQ ID NO: 2117482 - protein, 20 aa, Cryptosporidium hominis
NSLPQINESSSLSRETNKKT

SEQ ID NO: 2117483 - protein, 7 aa, Cryptosporidium hominis
NSLSDLN

SEQ ID NO: 2117484 - protein, 9 aa, Cryptosporidium hominis
NSMDPSSSR

SEQ ID NO: 2117485 - protein, 8 aa, Cryptosporidium hominis
NSNDKNIY

SEQ ID NO: 2117486 - protein, 9 aa, Cryptosporidium hominis
NSNESNVAN

SEQ ID NO: 2117487 - protein, 8 aa, Cryptosporidium hominis
NSNETETV

SEQ ID NO: 2117488 - protein, 11 aa, Cryptosporidium hominis
NSNEYSYSDSG

SEQ ID NO: 2117489 - protein, 20 aa, Cryptosporidium hominis
NSNGNDLSSQDSGNEDYPNE

SEQ ID NO: 2117490 - protein, 14 aa, Cryptosporidium hominis
NSNGNNGTVGNNHN

SEQ ID NO: 2117491 - protein, 7 aa, Cryptosporidium hominis
NSNGQIN

SEQ ID NO: 2117492 - protein, 9 aa, Cryptosporidium hominis
NSNHGEKKV

SEQ ID NO: 2117493 - protein, 11 aa, Cryptosporidium hominis
NSNHVREEHKN

SEQ ID NO: 2117494 - protein, 20 aa, Cryptosporidium hominis
NSNIDNSNLYNNSNIKQDGQ

SEQ ID NO: 2117495 - protein, 12 aa, Cryptosporidium hominis
NSNIPSNENNYK

SEQ ID NO: 2117496 - protein, 4 aa, Cryptosporidium hominis
NSNK

SEQ ID NO: 2117497 - protein, 8 aa, Cryptosporidium hominis
NSNKNHTD

SEQ ID NO: 2117498 - protein, 8 aa, Cryptosporidium hominis
NSNKTNIP

SEQ ID NO: 2117499 - protein, 9 aa, Cryptosporidium hominis
NSNLDEKAM

SEQ ID NO: 2117500 - protein, 17 aa, Cryptosporidium hominis
NSNLQDKQDNGRNISQE

SEQ ID NO: 2117501 - protein, 4 aa, Cryptosporidium hominis
NSNN

SEQ ID NO: 2117502 - protein, 10 aa, Cryptosporidium hominis
NSNNDENTKD

SEQ ID NO: 2117503 - protein, 6 aa, Cryptosporidium hominis
NSNNKL

SEQ ID NO: 2117504 - protein, 11 aa, Cryptosporidium hominis
NSNNYTSNLPG

SEQ ID NO: 2117505 - protein, 9 aa, Cryptosporidium hominis
NSNPDNNNY

SEQ ID NO: 2117506 - protein, 7 aa, Cryptosporidium hominis
NSNPISS

SEQ ID NO: 2117507 - protein, 6 aa, Cryptosporidium hominis
NSNPNI

SEQ ID NO: 2117508 - protein, 7 aa, Cryptosporidium hominis
NSNQAND

SEQ ID NO: 2117509 - protein, 10 aa, Cryptosporidium hominis
NSNQLQNGRV

SEQ ID NO: 2117510 - protein, 12 aa, Cryptosporidium hominis
NSNQQYYSSSSL

SEQ ID NO: 2117511 - protein, 6 aa, Cryptosporidium hominis
NSNRAT

SEQ ID NO: 2117512 - protein, 6 aa, Cryptosporidium hominis
NSNRLG

SEQ ID NO: 2117513 - protein, 10 aa, Cryptosporidium hominis
NSNSEEKYKN

SEQ ID NO: 2117514 - protein, 6 aa, Cryptosporidium hominis
NSNSHL

SEQ ID NO: 2117515 - protein, 7 aa, Cryptosporidium hominis
NSNSKSF

SEQ ID NO: 2117516 - protein, 10 aa, Cryptosporidium hominis
NSNSSFANDN

SEQ ID NO: 2117517 - protein, 10 aa, Cryptosporidium hominis
NSNSTDSNKL

SEQ ID NO: 2117518 - protein, 12 aa, Cryptosporidium hominis
NSNSVRKYQENL

SEQ ID NO: 2117519 - protein, 21 aa, Cryptosporidium hominis
NSNTHSSNNCNVNAKSNCQRR

SEQ ID NO: 2117520 - protein, 14 aa, Cryptosporidium hominis
NSNTNIDSFGNKRS

SEQ ID NO: 2117521 - protein, 7 aa, Cryptosporidium hominis
NSPEEGI

SEQ ID NO: 2117522 - protein, 11 aa, Cryptosporidium hominis
NSPGRRANGEL

SEQ ID NO: 2117523 - protein, 17 aa, Cryptosporidium hominis
NSPIARTYKSGNVSNEM

SEQ ID NO: 2117524 - protein, 7 aa, Cryptosporidium hominis
NSPIGSP

SEQ ID NO: 2117525 - protein, 12 aa, Cryptosporidium hominis
NSPITSETYDSD

SEQ ID NO: 2117526 - protein, 9 aa, Cryptosporidium hominis
NSPKHSDER

SEQ ID NO: 2117527 - protein, 9 aa, Cryptosporidium hominis
NSPNTSKKL

SEQ ID NO: 2117528 - protein, 6 aa, Cryptosporidium hominis
NSPTVS

SEQ ID NO: 2117529 - protein, 4 aa, Cryptosporidium hominis
NSPY

SEQ ID NO: 2117530 - protein, 8 aa, Cryptosporidium hominis
NSPYGTSY

SEQ ID NO: 2117531 - protein, 10 aa, Cryptosporidium hominis
NSQELNEEYS

SEQ ID NO: 2117532 - protein, 15 aa, Cryptosporidium hominis
NSQIPTTPKQSKSRI

SEQ ID NO: 2117533 - protein, 8 aa, Cryptosporidium hominis
NSQKDPNL

SEQ ID NO: 2117534 - protein, 7 aa, Cryptosporidium hominis
NSQKHNI

SEQ ID NO: 2117535 - protein, 6 aa, Cryptosporidium hominis
NSQKLA

SEQ ID NO: 2117536 - protein, 9 aa, Cryptosporidium hominis
NSQKSLGES

SEQ ID NO: 2117537 - protein, 23 aa, Cryptosporidium hominis
NSQNEENSSNLVNRQQNNSEGTR

SEQ ID NO: 2117538 - protein, 8 aa, Cryptosporidium hominis
NSQPISDK

SEQ ID NO: 2117539 - protein, 5 aa, Cryptosporidium hominis
NSQQA

SEQ ID NO: 2117540 - protein, 7 aa, Cryptosporidium hominis
NSQVGRE

SEQ ID NO: 2117541 - protein, 10 aa, Cryptosporidium hominis
NSRANPNTDF

SEQ ID NO: 2117542 - protein, 5 aa, Cryptosporidium hominis
NSRKF

SEQ ID NO: 2117543 - protein, 4 aa, Cryptosporidium hominis
NSRN

SEQ ID NO: 2117544 - protein, 7 aa, Cryptosporidium hominis
NSRNGGI

SEQ ID NO: 2117545 - protein, 5 aa, Cryptosporidium hominis
NSRNK

SEQ ID NO: 2117546 - protein, 7 aa, Cryptosporidium hominis
NSRNRGP

SEQ ID NO: 2117547 - protein, 6 aa, Cryptosporidium hominis
NSRSIG

SEQ ID NO: 2117548 - protein, 12 aa, Cryptosporidium hominis
NSSESSKMNNDH

SEQ ID NO: 2117549 - protein, 6 aa, Cryptosporidium hominis
NSSFGP

SEQ ID NO: 2117550 - protein, 5 aa, Cryptosporidium hominis
NSSFS

SEQ ID NO: 2117551 - protein, 6 aa, Cryptosporidium hominis
NSSGLK

SEQ ID NO: 2117552 - protein, 8 aa, Cryptosporidium hominis
NSSGNGLG

SEQ ID NO: 2117553 - protein, 11 aa, Cryptosporidium hominis
NSSGNSNNSNL

SEQ ID NO: 2117554 - protein, 51 aa, Cryptosporidium hominis
NSSITAQLGASTTRGQTNLNASNANTPTNLQESQNAFTPKSAASGPKSSSL

SEQ ID NO: 2117555 - protein, 26 aa, Cryptosporidium hominis
NSSKEGEEECKDMKTENQNPNNNDNK

SEQ ID NO: 2117556 - protein, 10 aa, Cryptosporidium hominis
NSSKNNYTTR

SEQ ID NO: 2117557 - protein, 11 aa, Cryptosporidium hominis
NSSKSSSFGLG

SEQ ID NO: 2117558 - protein, 19 aa, Cryptosporidium hominis
NSSLDSKRNIQSDTSLDGF

SEQ ID NO: 2117559 - protein, 14 aa, Cryptosporidium hominis
NSSLENSKRGKRRN

SEQ ID NO: 2117560 - protein, 4 aa, Cryptosporidium hominis
NSSN

SEQ ID NO: 2117561 - protein, 8 aa, Cryptosporidium hominis
NSSNNISE

SEQ ID NO: 2117562 - protein, 11 aa, Cryptosporidium hominis
NSSNNSSGNFQ

SEQ ID NO: 2117563 - protein, 17 aa, Cryptosporidium hominis
NSSNVNNNNQNDSDSSF

SEQ ID NO: 2117564 - protein, 9 aa, Cryptosporidium hominis
NSSQNGENK

SEQ ID NO: 2117565 - protein, 6 aa, Cryptosporidium hominis
NSSSFG

SEQ ID NO: 2117566 - protein, 20 aa, Cryptosporidium hominis
NSSSGNSLEGTSNGSDIKTR

SEQ ID NO: 2117567 - protein, 8 aa, Cryptosporidium hominis
NSSSNSVN

SEQ ID NO: 2117568 - protein, 8 aa, Cryptosporidium hominis
NSSSPRTY

SEQ ID NO: 2117569 - protein, 5 aa, Cryptosporidium hominis
NSSTE

SEQ ID NO: 2117570 - protein, 9 aa, Cryptosporidium hominis
NSSTYGDTG

SEQ ID NO: 2117571 - protein, 9 aa, Cryptosporidium hominis
NSTKPPAII

SEQ ID NO: 2117572 - protein, 5 aa, Cryptosporidium hominis
NSTPE

SEQ ID NO: 2117573 - protein, 10 aa, Cryptosporidium hominis
NSTRKIPAQS

SEQ ID NO: 2117574 - protein, 9 aa, Cryptosporidium hominis
NSTSTSTVV

SEQ ID NO: 2117575 - protein, 5 aa, Cryptosporidium hominis
NSTYS

SEQ ID NO: 2117576 - protein, 13 aa, Cryptosporidium hominis
NSVKVKKSTTGGE

SEQ ID NO: 2117577 - protein, 10 aa, Cryptosporidium hominis
NSVQEEVSKY

SEQ ID NO: 2117578 - protein, 7 aa, Cryptosporidium hominis
NSVSYPG

SEQ ID NO: 2117579 - protein, 5 aa, Cryptosporidium hominis
NSWQE

SEQ ID NO: 2117580 - protein, 31 aa, Cryptosporidium hominis
NSYDDSSNFEEYPDSHEQPTTVTGNADPFVD

SEQ ID NO: 2117581 - protein, 23 aa, Cryptosporidium hominis
NSYGIGENKKAEESRPEASGTKA

SEQ ID NO: 2117582 - protein, 10 aa, Cryptosporidium hominis
NSYGNTSKEM

SEQ ID NO: 2117583 - protein, 14 aa, Cryptosporidium hominis
NSYKTGCGSYSRVD

SEQ ID NO: 2117584 - protein, 10 aa, Cryptosporidium hominis
NSYQDSKAYS

SEQ ID NO: 2117585 - protein, 8 aa, Cryptosporidium hominis
NSYRPTGA

SEQ ID NO: 2117586 - protein, 8 aa, Cryptosporidium hominis
NTAGFSSR

SEQ ID NO: 2117587 - protein, 7 aa, Cryptosporidium hominis
NTAGLVP

SEQ ID NO: 2117588 - protein, 8 aa, Cryptosporidium hominis
NTASEPKI

SEQ ID NO: 2117589 - protein, 8 aa, Cryptosporidium hominis
NTASERPD

SEQ ID NO: 2117590 - protein, 10 aa, Cryptosporidium hominis
NTASTTETEI

SEQ ID NO: 2117591 - protein, 12 aa, Cryptosporidium hominis
NTATDTTNENEY

SEQ ID NO: 2117592 - protein, 9 aa, Cryptosporidium hominis
NTCSESTPN

SEQ ID NO: 2117593 - protein, 17 aa, Cryptosporidium hominis
NTDIQEKSLRKSTGQER

SEQ ID NO: 2117594 - protein, 7 aa, Cryptosporidium hominis
NTDITQE

SEQ ID NO: 2117595 - protein, 9 aa, Cryptosporidium hominis
NTDNDTDIT

SEQ ID NO: 2117596 - protein, 34 aa, Cryptosporidium hominis
NTDSKSNKQTNIQNKVSNSNSQRYSKTVDNLDSG

SEQ ID NO: 2117597 - protein, 10 aa, Cryptosporidium hominis
NTDSVDPLSS

SEQ ID NO: 2117598 - protein, 4 aa, Cryptosporidium hominis
NTDV

SEQ ID NO: 2117599 - protein, 4 aa, Cryptosporidium hominis
NTEN

SEQ ID NO: 2117600 - protein, 10 aa, Cryptosporidium hominis
NTENIGPNYS

SEQ ID NO: 2117601 - protein, 19 aa, Cryptosporidium hominis
NTENSNASNGVNETGEVTN

SEQ ID NO: 2117602 - protein, 8 aa, Cryptosporidium hominis
NTEPGRVP

SEQ ID NO: 2117603 - protein, 7 aa, Cryptosporidium hominis
NTEPKYE

SEQ ID NO: 2117604 - protein, 4 aa, Cryptosporidium hominis
NTEQ

SEQ ID NO: 2117605 - protein, 8 aa, Cryptosporidium hominis
NTETNVSH

SEQ ID NO: 2117606 - protein, 6 aa, Cryptosporidium hominis
NTEVSS

SEQ ID NO: 2117607 - protein, 12 aa, Cryptosporidium hominis
NTEYESEHLPTT

SEQ ID NO: 2117608 - protein, 5 aa, Cryptosporidium hominis
NTFSG

SEQ ID NO: 2117609 - protein, 4 aa, Cryptosporidium hominis
NTFT

SEQ ID NO: 2117610 - protein, 18 aa, Cryptosporidium hominis
NTGGAGGAGGAGGAGGVD

SEQ ID NO: 2117611 - protein, 5 aa, Cryptosporidium hominis
NTGLR

SEQ ID NO: 2117612 - protein, 9 aa, Cryptosporidium hominis
NTGNGNNIN

SEQ ID NO: 2117613 - protein, 5 aa, Cryptosporidium hominis
NTGPK

SEQ ID NO: 2117614 - protein, 5 aa, Cryptosporidium hominis
NTGQI

SEQ ID NO: 2117615 - protein, 5 aa, Cryptosporidium hominis
NTGSV

SEQ ID NO: 2117616 - protein, 4 aa, Cryptosporidium hominis
NTHD

SEQ ID NO: 2117617 - protein, 6 aa, Cryptosporidium hominis
NTHKKR

SEQ ID NO: 2117618 - protein, 18 aa, Cryptosporidium hominis
NTIEEQNETEVNLTEGNP

SEQ ID NO: 2117619 - protein, 7 aa, Cryptosporidium hominis
NTIQPVE

SEQ ID NO: 2117620 - protein, 17 aa, Cryptosporidium hominis
NTISGSAGRSASSSSFS

SEQ ID NO: 2117621 - protein, 14 aa, Cryptosporidium hominis
NTKASNIDGKNNVD

SEQ ID NO: 2117622 - protein, 5 aa, Cryptosporidium hominis
NTKHV

SEQ ID NO: 2117623 - protein, 7 aa, Cryptosporidium hominis
NTKKHNR

SEQ ID NO: 2117624 - protein, 9 aa, Cryptosporidium hominis
NTKKRGWKQ

SEQ ID NO: 2117625 - protein, 7 aa, Cryptosporidium hominis
NTKSKIR

SEQ ID NO: 2117626 - protein, 6 aa, Cryptosporidium hominis
NTKSRS

SEQ ID NO: 2117627 - protein, 9 aa, Cryptosporidium hominis
NTKTESLEI

SEQ ID NO: 2117628 - protein, 6 aa, Cryptosporidium hominis
NTLEQS

SEQ ID NO: 2117629 - protein, 8 aa, Cryptosporidium hominis
NTLKGTNF

SEQ ID NO: 2117630 - protein, 13 aa, Cryptosporidium hominis
NTLNDLNGGDDNE

SEQ ID NO: 2117631 - protein, 11 aa, Cryptosporidium hominis
NTNATATASIS

SEQ ID NO: 2117632 - protein, 19 aa, Cryptosporidium hominis
NTNCTQGHESNLSKSNTVE

SEQ ID NO: 2117633 - protein, 9 aa, Cryptosporidium hominis
NTNDHQSNY

SEQ ID NO: 2117634 - protein, 10 aa, Cryptosporidium hominis
NTNFDSSKAE

SEQ ID NO: 2117635 - protein, 5 aa, Cryptosporidium hominis
NTNGN

SEQ ID NO: 2117636 - protein, 14 aa, Cryptosporidium hominis
NTNKEQNNMGYKNN

SEQ ID NO: 2117637 - protein, 11 aa, Cryptosporidium hominis
NTNNKASSVSH

SEQ ID NO: 2117638 - protein, 6 aa, Cryptosporidium hominis
NTNPDV

SEQ ID NO: 2117639 - protein, 10 aa, Cryptosporidium hominis
NTNPKNIDEN

SEQ ID NO: 2117640 - protein, 6 aa, Cryptosporidium hominis
NTNSAE

SEQ ID NO: 2117641 - protein, 21 aa, Cryptosporidium hominis
NTNSSLYTHENNTTYISGSTT

SEQ ID NO: 2117642 - protein, 11 aa, Cryptosporidium hominis
NTNTESEIPQK

SEQ ID NO: 2117643 - protein, 5 aa, Cryptosporidium hominis
NTPDC

SEQ ID NO: 2117644 - protein, 7 aa, Cryptosporidium hominis
NTPEEYP

SEQ ID NO: 2117645 - protein, 5 aa, Cryptosporidium hominis
NTPIS

SEQ ID NO: 2117646 - protein, 13 aa, Cryptosporidium hominis
NTPKQISGIRTPT

SEQ ID NO: 2117647 - protein, 5 aa, Cryptosporidium hominis
NTPLR

SEQ ID NO: 2117648 - protein, 4 aa, Cryptosporidium hominis
NTPS

SEQ ID NO: 2117649 - protein, 6 aa, Cryptosporidium hominis
NTPSEL

SEQ ID NO: 2117650 - protein, 5 aa, Cryptosporidium hominis
NTPYN

SEQ ID NO: 2117651 - protein, 4 aa, Cryptosporidium hominis
NTQC

SEQ ID NO: 2117652 - protein, 6 aa, Cryptosporidium hominis
NTQEQR

SEQ ID NO: 2117653 - protein, 5 aa, Cryptosporidium hominis
NTQFK

SEQ ID NO: 2117654 - protein, 44 aa, Cryptosporidium hominis
NTQGSHGAVGGIGSVSSSSIVGSNGNSGNSVGIGNNGNGGNMSR

SEQ ID NO: 2117655 - protein, 5 aa, Cryptosporidium hominis
NTQNT

SEQ ID NO: 2117656 - protein, 8 aa, Cryptosporidium hominis
NTQRNTYN

SEQ ID NO: 2117657 - protein, 29 aa, Cryptosporidium hominis
NTQSHGQTSSFGSQNLHSSSSSSSSSYYS

SEQ ID NO: 2117658 - protein, 12 aa, Cryptosporidium hominis
NTRNNEEDLNVS

SEQ ID NO: 2117659 - protein, 10 aa, Cryptosporidium hominis
NTRNSIPGGV

SEQ ID NO: 2117660 - protein, 4 aa, Cryptosporidium hominis
NTRS

SEQ ID NO: 2117661 - protein, 12 aa, Cryptosporidium hominis
NTSELDDSNLSE

SEQ ID NO: 2117662 - protein, 13 aa, Cryptosporidium hominis
NTSESSEDSESFS

SEQ ID NO: 2117663 - protein, 22 aa, Cryptosporidium hominis
NTSGIASGGGSVNNTNNRRGAY

SEQ ID NO: 2117664 - protein, 21 aa, Cryptosporidium hominis
NTSGNWASKTYLSSNSSVPKT

SEQ ID NO: 2117665 - protein, 7 aa, Cryptosporidium hominis
NTSKSGK

SEQ ID NO: 2117666 - protein, 10 aa, Cryptosporidium hominis
NTSKTKKKTT

SEQ ID NO: 2117667 - protein, 4 aa, Cryptosporidium hominis
NTSL

SEQ ID NO: 2117668 - protein, 73 aa, Cryptosporidium hominis
NTSNNTATGSANIGPANTTNSGNNSNVNTTSGNTTGNNTTTGTSGGGLISSSGNLSNSNNNSATGNTNSQANS

SEQ ID NO: 2117669 - protein, 11 aa, Cryptosporidium hominis
NTSNQSESNLQ

SEQ ID NO: 2117670 - protein, 26 aa, Cryptosporidium hominis
NTSNYRDYPSTESKFGSESKLVESET

SEQ ID NO: 2117671 - protein, 7 aa, Cryptosporidium hominis
NTSPLSL

SEQ ID NO: 2117672 - protein, 23 aa, Cryptosporidium hominis
NTSQSEHGPAFEPLPGKNSSNEK

SEQ ID NO: 2117673 - protein, 10 aa, Cryptosporidium hominis
NTSSANEIQE

SEQ ID NO: 2117674 - protein, 8 aa, Cryptosporidium hominis
NTSSDPKF

SEQ ID NO: 2117675 - protein, 9 aa, Cryptosporidium hominis
NTSSGGHGV

SEQ ID NO: 2117676 - protein, 42 aa, Cryptosporidium hominis
NTSSMVKEERSHSDSAPLVKTEQEEEIGQNKRHTYDDATQVN

SEQ ID NO: 2117677 - protein, 5 aa, Cryptosporidium hominis
NTSSN

SEQ ID NO: 2117678 - protein, 8 aa, Cryptosporidium hominis
NTSSQNTF

SEQ ID NO: 2117679 - protein, 6 aa, Cryptosporidium hominis
NTSSQY

SEQ ID NO: 2117680 - protein, 8 aa, Cryptosporidium hominis
NTSSTGYY

SEQ ID NO: 2117681 - protein, 7 aa, Cryptosporidium hominis
NTSTPNI

SEQ ID NO: 2117682 - protein, 5 aa, Cryptosporidium hominis
NTSTR

SEQ ID NO: 2117683 - protein, 10 aa, Cryptosporidium hominis
NTSTSKKRRL

SEQ ID NO: 2117684 - protein, 8 aa, Cryptosporidium hominis
NTSTSNAI

SEQ ID NO: 2117685 - protein, 8 aa, Cryptosporidium hominis
NTSVSDGA

SEQ ID NO: 2117686 - protein, 78 aa, Cryptosporidium hominis
NTTASSDNAFTKNNSTNSSKHTSTSTTTNTTTTTTTTTTTTTTTTTTTTTTTTTTTTATETTTTKKNTTTTKNTTTTL

SEQ ID NO: 2117687 - protein, 5 aa, Cryptosporidium hominis
NTTEF

SEQ ID NO: 2117688 - protein, 21 aa, Cryptosporidium hominis
NTTLSSSYSSKIKKNPKIESL

SEQ ID NO: 2117689 - protein, 6 aa, Cryptosporidium hominis
NTTNED

SEQ ID NO: 2117690 - protein, 7 aa, Cryptosporidium hominis
NTTPDED

SEQ ID NO: 2117691 - protein, 11 aa, Cryptosporidium hominis
NTTQSLSGQNH

SEQ ID NO: 2117692 - protein, 5 aa, Cryptosporidium hominis
NTVSG

SEQ ID NO: 2117693 - protein, 12 aa, Cryptosporidium hominis
NTYNEGSNGALS

SEQ ID NO: 2117694 - protein, 12 aa, Cryptosporidium hominis
NTYSSEESKLRK

SEQ ID NO: 2117695 - protein, 32 aa, Cryptosporidium hominis
NVAQERHDFSGSTNPAEMYGPQKLKSDYKPLP

SEQ ID NO: 2117696 - protein, 4 aa, Cryptosporidium hominis
NVDE

SEQ ID NO: 2117697 - protein, 39 aa, Cryptosporidium hominis
NVEDENQSGNRIERESEYGEEEYEARSLSSRSEASEKSQ

SEQ ID NO: 2117698 - protein, 10 aa, Cryptosporidium hominis
NVERKSNESS

SEQ ID NO: 2117699 - protein, 5 aa, Cryptosporidium hominis
NVGQK

SEQ ID NO: 2117700 - protein, 4 aa, Cryptosporidium hominis
NVGS

SEQ ID NO: 2117701 - protein, 7 aa, Cryptosporidium hominis
NVKDGSS

SEQ ID NO: 2117702 - protein, 8 aa, Cryptosporidium hominis
NVKEVGDH

SEQ ID NO: 2117703 - protein, 15 aa, Cryptosporidium hominis
NVKGKTNEKEKNDDL

SEQ ID NO: 2117704 - protein, 8 aa, Cryptosporidium hominis
NVKSKGQV

SEQ ID NO: 2117705 - protein, 6 aa, Cryptosporidium hominis
NVKYDD

SEQ ID NO: 2117706 - protein, 4 aa, Cryptosporidium hominis
NVLS

SEQ ID NO: 2117707 - protein, 9 aa, Cryptosporidium hominis
NVNGEKSEI

SEQ ID NO: 2117708 - protein, 10 aa, Cryptosporidium hominis
NVNNKDEAIE

SEQ ID NO: 2117709 - protein, 8 aa, Cryptosporidium hominis
NVNSRSSL

SEQ ID NO: 2117710 - protein, 14 aa, Cryptosporidium hominis
NVPSSIKSIKDSND

SEQ ID NO: 2117711 - protein, 12 aa, Cryptosporidium hominis
NVPTSLSVPNTQ

SEQ ID NO: 2117712 - protein, 8 aa, Cryptosporidium hominis
NVQPKDVK

SEQ ID NO: 2117713 - protein, 11 aa, Cryptosporidium hominis
NVSSKNSKSFD

SEQ ID NO: 2117714 - protein, 7 aa, Cryptosporidium hominis
NVSSSRR

SEQ ID NO: 2117715 - protein, 21 aa, Cryptosporidium hominis
NVSTRESSPKYNRSPLDSQEV

SEQ ID NO: 2117716 - protein, 7 aa, Cryptosporidium hominis
NVTYDSN

SEQ ID NO: 2117717 - protein, 13 aa, Cryptosporidium hominis
NWKGSKKKFSNIE

SEQ ID NO: 2117718 - protein, 17 aa, Cryptosporidium hominis
NWTQDDNFTRPTNTDSS

SEQ ID NO: 2117719 - protein, 4 aa, Cryptosporidium hominis
NYAG

SEQ ID NO: 2117720 - protein, 11 aa, Cryptosporidium hominis
NYCTTNEKLKN

SEQ ID NO: 2117721 - protein, 14 aa, Cryptosporidium hominis
NYDQESPSQSNKQE

SEQ ID NO: 2117722 - protein, 8 aa, Cryptosporidium hominis
NYDQNNDS

SEQ ID NO: 2117723 - protein, 6 aa, Cryptosporidium hominis
NYEDGI

SEQ ID NO: 2117724 - protein, 9 aa, Cryptosporidium hominis
NYENPAVGN

SEQ ID NO: 2117725 - protein, 6 aa, Cryptosporidium hominis
NYEPDW

SEQ ID NO: 2117726 - protein, 19 aa, Cryptosporidium hominis
NYEQNTHTHPRASSLNNRI

SEQ ID NO: 2117727 - protein, 12 aa, Cryptosporidium hominis
NYETKRSGSQSQ

SEQ ID NO: 2117728 - protein, 15 aa, Cryptosporidium hominis
NYGNQENVGRDGNTI

SEQ ID NO: 2117729 - protein, 14 aa, Cryptosporidium hominis
NYGSYSQQPSSGYM

SEQ ID NO: 2117730 - protein, 20 aa, Cryptosporidium hominis
NYKPISELGNDKKGKSDEGI

SEQ ID NO: 2117731 - protein, 5 aa, Cryptosporidium hominis
NYNDG

SEQ ID NO: 2117732 - protein, 12 aa, Cryptosporidium hominis
NYNDKNATYYTR

SEQ ID NO: 2117733 - protein, 11 aa, Cryptosporidium hominis
NYNGSDNKNSF

SEQ ID NO: 2117734 - protein, 108 aa, Cryptosporidium hominis
NYNNTGGSNVGNNTATSTNTGGVNTNPNNAGTSNTNAGGNNINGNVNNNIGGGGSIVGNNSNGVINSGSGGPSTSSNMPNHTQGNSGTQMGGGAQLGSSNFTPLPSGI

SEQ ID NO: 2117735 - protein, 7 aa, Cryptosporidium hominis
NYPEEEI

SEQ ID NO: 2117736 - protein, 10 aa, Cryptosporidium hominis
NYPEKSSEIL

SEQ ID NO: 2117737 - protein, 13 aa, Cryptosporidium hominis
NYPKHRKAIVPFF

SEQ ID NO: 2117738 - protein, 5 aa, Cryptosporidium hominis
NYQDD

SEQ ID NO: 2117739 - protein, 9 aa, Cryptosporidium hominis
NYQNSSEYK

SEQ ID NO: 2117740 - protein, 10 aa, Cryptosporidium hominis
NYQPSKKKYI

SEQ ID NO: 2117741 - protein, 5 aa, Cryptosporidium hominis
NYQQR

SEQ ID NO: 2117742 - protein, 7 aa, Cryptosporidium hominis
NYRDTIK

SEQ ID NO: 2117743 - protein, 11 aa, Cryptosporidium hominis
NYRQKANPHSE

SEQ ID NO: 2117744 - protein, 9 aa, Cryptosporidium hominis
NYSKNSRSK

SEQ ID NO: 2117745 - protein, 6 aa, Cryptosporidium hominis
NYSKSN

SEQ ID NO: 2117746 - protein, 15 aa, Cryptosporidium hominis
NYSNANDPNSSTYQN

SEQ ID NO: 2117747 - protein, 7 aa, Cryptosporidium hominis
NYSNPTE

SEQ ID NO: 2117748 - protein, 7 aa, Cryptosporidium hominis
NYSPNSG

SEQ ID NO: 2117749 - protein, 5 aa, Cryptosporidium hominis
NYSRI

SEQ ID NO: 2117750 - protein, 22 aa, Cryptosporidium hominis
NYSSSNNNKSEKKEDFKEQNNC

SEQ ID NO: 2117751 - protein, 16 aa, Cryptosporidium hominis
NYSTPIKSDGAEGERI

SEQ ID NO: 2117752 - protein, 22 aa, Cryptosporidium hominis
NYTNGDKYTRDSPNQNLPQIPD

SEQ ID NO: 2117753 - protein, 8 aa, Cryptosporidium hominis
NYTSENKA

SEQ ID NO: 2117754 - protein, 7 aa, Cryptosporidium hominis
PACRPTA

SEQ ID NO: 2117755 - protein, 18 aa, Cryptosporidium hominis
PADIRPDNVPVEASEPIP

SEQ ID NO: 2117756 - protein, 5 aa, Cryptosporidium hominis
PAGKG

SEQ ID NO: 2117757 - protein, 10 aa, Cryptosporidium hominis
PAKVKDSQNC

SEQ ID NO: 2117758 - protein, 6 aa, Cryptosporidium hominis
PALNKN

SEQ ID NO: 2117759 - protein, 7 aa, Cryptosporidium hominis
PALPATI

SEQ ID NO: 2117760 - protein, 19 aa, Cryptosporidium hominis
PANINKGGYGEMGNQGQSL

SEQ ID NO: 2117761 - protein, 6 aa, Cryptosporidium hominis
PANNYN

SEQ ID NO: 2117762 - protein, 5 aa, Cryptosporidium hominis
PANPI

SEQ ID NO: 2117763 - protein, 10 aa, Cryptosporidium hominis
PANRKDNDPI

SEQ ID NO: 2117764 - protein, 15 aa, Cryptosporidium hominis
PANVKTSQSTAASKG

SEQ ID NO: 2117765 - protein, 9 aa, Cryptosporidium hominis
PAPITETPV

SEQ ID NO: 2117766 - protein, 5 aa, Cryptosporidium hominis
PAPNN

SEQ ID NO: 2117767 - protein, 5 aa, Cryptosporidium hominis
PAPRG

SEQ ID NO: 2117768 - protein, 7 aa, Cryptosporidium hominis
PASESLG

SEQ ID NO: 2117769 - protein, 8 aa, Cryptosporidium hominis
PATSLEEA

SEQ ID NO: 2117770 - protein, 6 aa, Cryptosporidium hominis
PCSSDG

SEQ ID NO: 2117771 - protein, 7 aa, Cryptosporidium hominis
PDAELND

SEQ ID NO: 2117772 - protein, 14 aa, Cryptosporidium hominis
PDANESTNSDESQY

SEQ ID NO: 2117773 - protein, 10 aa, Cryptosporidium hominis
PDENGVSSYE

SEQ ID NO: 2117774 - protein, 6 aa, Cryptosporidium hominis
PDEPPI

SEQ ID NO: 2117775 - protein, 4 aa, Cryptosporidium hominis
PDES

SEQ ID NO: 2117776 - protein, 7 aa, Cryptosporidium hominis
PDGINTQ

SEQ ID NO: 2117777 - protein, 4 aa, Cryptosporidium hominis
PDKG

SEQ ID NO: 2117778 - protein, 10 aa, Cryptosporidium hominis
PDKNSDISAR

SEQ ID NO: 2117779 - protein, 6 aa, Cryptosporidium hominis
PDLEGG

SEQ ID NO: 2117780 - protein, 9 aa, Cryptosporidium hominis
PDLPQNCSN

SEQ ID NO: 2117781 - protein, 14 aa, Cryptosporidium hominis
PDNGIDESEKSIKD

SEQ ID NO: 2117782 - protein, 31 aa, Cryptosporidium hominis
PDNSSGSTYNSNNNNNNISENSSKTEQKSKM

SEQ ID NO: 2117783 - protein, 5 aa, Cryptosporidium hominis
PDPPT

SEQ ID NO: 2117784 - protein, 11 aa, Cryptosporidium hominis
PDPRGNNYPPL

SEQ ID NO: 2117785 - protein, 5 aa, Cryptosporidium hominis
PDPSV

SEQ ID NO: 2117786 - protein, 13 aa, Cryptosporidium hominis
PDQGDGGYYGDSI

SEQ ID NO: 2117787 - protein, 13 aa, Cryptosporidium hominis
PDQIKDELKQNEI

SEQ ID NO: 2117788 - protein, 4 aa, Cryptosporidium hominis
PDSE

SEQ ID NO: 2117789 - protein, 13 aa, Cryptosporidium hominis
PDSILGSTAAQDV

SEQ ID NO: 2117790 - protein, 8 aa, Cryptosporidium hominis
PDSKRTGV

SEQ ID NO: 2117791 - protein, 7 aa, Cryptosporidium hominis
PDSNKIT

SEQ ID NO: 2117792 - protein, 9 aa, Cryptosporidium hominis
PDSSYSLYD

SEQ ID NO: 2117793 - protein, 7 aa, Cryptosporidium hominis
PDTNPYD

SEQ ID NO: 2117794 - protein, 4 aa, Cryptosporidium hominis
PDTS

SEQ ID NO: 2117795 - protein, 9 aa, Cryptosporidium hominis
PEASDKEKI

SEQ ID NO: 2117796 - protein, 5 aa, Cryptosporidium hominis
PEDAT

SEQ ID NO: 2117797 - protein, 6 aa, Cryptosporidium hominis
PEDKKI

SEQ ID NO: 2117798 - protein, 12 aa, Cryptosporidium hominis
PEDLEEVDNGDY

SEQ ID NO: 2117799 - protein, 14 aa, Cryptosporidium hominis
PEEDKERTNEKREH

SEQ ID NO: 2117800 - protein, 10 aa, Cryptosporidium hominis
PEEKNVNKSR

SEQ ID NO: 2117801 - protein, 5 aa, Cryptosporidium hominis
PEEQC

SEQ ID NO: 2117802 - protein, 7 aa, Cryptosporidium hominis
PEEQSKT

SEQ ID NO: 2117803 - protein, 4 aa, Cryptosporidium hominis
PEFE

SEQ ID NO: 2117804 - protein, 16 aa, Cryptosporidium hominis
PEFGSQDEKKVQAPGP

SEQ ID NO: 2117805 - protein, 7 aa, Cryptosporidium hominis
PEGENKV

SEQ ID NO: 2117806 - protein, 5 aa, Cryptosporidium hominis
PEGFE

SEQ ID NO: 2117807 - protein, 4 aa, Cryptosporidium hominis
PEGL

SEQ ID NO: 2117808 - protein, 10 aa, Cryptosporidium hominis
PEGPGYNKIG

SEQ ID NO: 2117809 - protein, 7 aa, Cryptosporidium hominis
PEGTRSK

SEQ ID NO: 2117810 - protein, 6 aa, Cryptosporidium hominis
PEGTSS

SEQ ID NO: 2117811 - protein, 29 aa, Cryptosporidium hominis
PEIDPYEQKSSNVSSQKIKKKNKDNQANI

SEQ ID NO: 2117812 - protein, 19 aa, Cryptosporidium hominis
PEIKEQSQTLSQQKHSKRV

SEQ ID NO: 2117813 - protein, 5 aa, Cryptosporidium hominis
PEIND

SEQ ID NO: 2117814 - protein, 11 aa, Cryptosporidium hominis
PEISKISPKLP

SEQ ID NO: 2117815 - protein, 4 aa, Cryptosporidium hominis
PEIT

SEQ ID NO: 2117816 - protein, 6 aa, Cryptosporidium hominis
PEKHYS

SEQ ID NO: 2117817 - protein, 15 aa, Cryptosporidium hominis
PEKLSSSLDSTESIR

SEQ ID NO: 2117818 - protein, 8 aa, Cryptosporidium hominis
PEKNVPKS

SEQ ID NO: 2117819 - protein, 7 aa, Cryptosporidium hominis
PEKQSDH

SEQ ID NO: 2117820 - protein, 31 aa, Cryptosporidium hominis
PELSKETTDIKNGSNKKKLGHNLSSSNSLNT

SEQ ID NO: 2117821 - protein, 4 aa, Cryptosporidium hominis
PEMK

SEQ ID NO: 2117822 - protein, 11 aa, Cryptosporidium hominis
PENNASSSKSR

SEQ ID NO: 2117823 - protein, 15 aa, Cryptosporidium hominis
PENPQNNTKPEEKGR

SEQ ID NO: 2117824 - protein, 7 aa, Cryptosporidium hominis
PENSRQI

SEQ ID NO: 2117825 - protein, 8 aa, Cryptosporidium hominis
PENYNPTD

SEQ ID NO: 2117826 - protein, 18 aa, Cryptosporidium hominis
PEPENNIQYKNTKDSKVK

SEQ ID NO: 2117827 - protein, 6 aa, Cryptosporidium hominis
PEPQRQ

SEQ ID NO: 2117828 - protein, 20 aa, Cryptosporidium hominis
PEPTKSFQEELGESKDVPQQ

SEQ ID NO: 2117829 - protein, 17 aa, Cryptosporidium hominis
PEQIESGNQEKKIKGKR

SEQ ID NO: 2117830 - protein, 9 aa, Cryptosporidium hominis
PEQKAKNEH

SEQ ID NO: 2117831 - protein, 9 aa, Cryptosporidium hominis
PEQNGGKCD

SEQ ID NO: 2117832 - protein, 17 aa, Cryptosporidium hominis
PEQTQIHDQESKNHNSS

SEQ ID NO: 2117833 - protein, 16 aa, Cryptosporidium hominis
PEQTSSINSKESGKKM

SEQ ID NO: 2117834 - protein, 6 aa, Cryptosporidium hominis
PESEFG

SEQ ID NO: 2117835 - protein, 30 aa, Cryptosporidium hominis
PESGPGQGYESGPRIKSDHSTTKGIQENTR

SEQ ID NO: 2117836 - protein, 7 aa, Cryptosporidium hominis
PESRQKC

SEQ ID NO: 2117837 - protein, 4 aa, Cryptosporidium hominis
PETG

SEQ ID NO: 2117838 - protein, 8 aa, Cryptosporidium hominis
PETKTTNY

SEQ ID NO: 2117839 - protein, 10 aa, Cryptosporidium hominis
PETSSPSTYL

SEQ ID NO: 2117840 - protein, 5 aa, Cryptosporidium hominis
PFENY

SEQ ID NO: 2117841 - protein, 9 aa, Cryptosporidium hominis
PFPKSSDEW

SEQ ID NO: 2117842 - protein, 15 aa, Cryptosporidium hominis
PFQNKQDDLKPSNES

SEQ ID NO: 2117843 - protein, 5 aa, Cryptosporidium hominis
PFSET

SEQ ID NO: 2117844 - protein, 7 aa, Cryptosporidium hominis
PFSPNES

SEQ ID NO: 2117845 - protein, 6 aa, Cryptosporidium hominis
PFTPEK

SEQ ID NO: 2117846 - protein, 7 aa, Cryptosporidium hominis
PFTPGSS

SEQ ID NO: 2117847 - protein, 7 aa, Cryptosporidium hominis
PGASIGR

SEQ ID NO: 2117848 - protein, 10 aa, Cryptosporidium hominis
PGDAAKPAHT

SEQ ID NO: 2117849 - protein, 8 aa, Cryptosporidium hominis
PGDNFPGG

SEQ ID NO: 2117850 - protein, 13 aa, Cryptosporidium hominis
PGDPGKPGSDFSG

SEQ ID NO: 2117851 - protein, 10 aa, Cryptosporidium hominis
PGDPGPPCSD

SEQ ID NO: 2117852 - protein, 32 aa, Cryptosporidium hominis
PGDSIPAVDDNSNILSNDGDQGTRISSSPEIN

SEQ ID NO: 2117853 - protein, 4 aa, Cryptosporidium hominis
PGER

SEQ ID NO: 2117854 - protein, 8 aa, Cryptosporidium hominis
PGESDQDH

SEQ ID NO: 2117855 - protein, 4 aa, Cryptosporidium hominis
PGGY

SEQ ID NO: 2117856 - protein, 11 aa, Cryptosporidium hominis
PGHPGYVTPPQ

SEQ ID NO: 2117857 - protein, 8 aa, Cryptosporidium hominis
PGIEADNG

SEQ ID NO: 2117858 - protein, 4 aa, Cryptosporidium hominis
PGIP

SEQ ID NO: 2117859 - protein, 26 aa, Cryptosporidium hominis
PGIRQKTQSYKYKRSQYSKKSKAKNK

SEQ ID NO: 2117860 - protein, 11 aa, Cryptosporidium hominis
PGKINATGTLS

SEQ ID NO: 2117861 - protein, 8 aa, Cryptosporidium hominis
PGKPSPKI

SEQ ID NO: 2117862 - protein, 35 aa, Cryptosporidium hominis
PGMPGGMPGGMPGMPGGMPGGMPGGMPGMPGGMPM

SEQ ID NO: 2117863 - protein, 17 aa, Cryptosporidium hominis
PGMPGGMPGMPGGMPGM

SEQ ID NO: 2117864 - protein, 9 aa, Cryptosporidium hominis
PGNKPVNND

SEQ ID NO: 2117865 - protein, 12 aa, Cryptosporidium hominis
PGNKTETSEEEV

SEQ ID NO: 2117866 - protein, 4 aa, Cryptosporidium hominis
PGQC

SEQ ID NO: 2117867 - protein, 7 aa, Cryptosporidium hominis
PGQIYGS

SEQ ID NO: 2117868 - protein, 8 aa, Cryptosporidium hominis
PGRNRETR

SEQ ID NO: 2117869 - protein, 21 aa, Cryptosporidium hominis
PGSANKVEHREIGDSDKTKIN

SEQ ID NO: 2117870 - protein, 4 aa, Cryptosporidium hominis
PGSI

SEQ ID NO: 2117871 - protein, 6 aa, Cryptosporidium hominis
PGSLES

SEQ ID NO: 2117872 - protein, 10 aa, Cryptosporidium hominis
PGSTRNLTGC

SEQ ID NO: 2117873 - protein, 11 aa, Cryptosporidium hominis
PGTSGASSDEV

SEQ ID NO: 2117874 - protein, 6 aa, Cryptosporidium hominis
PGVGPN

SEQ ID NO: 2117875 - protein, 14 aa, Cryptosporidium hominis
PGVNTDDLPRLPAN

SEQ ID NO: 2117876 - protein, 5 aa, Cryptosporidium hominis
PGVSE

SEQ ID NO: 2117877 - protein, 14 aa, Cryptosporidium hominis
PGYRHPNENKMNSE

SEQ ID NO: 2117878 - protein, 9 aa, Cryptosporidium hominis
PHEDSSYEV

SEQ ID NO: 2117879 - protein, 5 aa, Cryptosporidium hominis
PHGHG

SEQ ID NO: 2117880 - protein, 8 aa, Cryptosporidium hominis
PHKTGNNQ

SEQ ID NO: 2117881 - protein, 9 aa, Cryptosporidium hominis
PHPNNGDNS

SEQ ID NO: 2117882 - protein, 7 aa, Cryptosporidium hominis
PHQSSQI

SEQ ID NO: 2117883 - protein, 7 aa, Cryptosporidium hominis
PHSERAL

SEQ ID NO: 2117884 - protein, 4 aa, Cryptosporidium hominis
PHSK

SEQ ID NO: 2117885 - protein, 6 aa, Cryptosporidium hominis
PHSSTL

SEQ ID NO: 2117886 - protein, 10 aa, Cryptosporidium hominis
PIAPLTKGPA

SEQ ID NO: 2117887 - protein, 11 aa, Cryptosporidium hominis
PIAPSPSISGF

SEQ ID NO: 2117888 - protein, 10 aa, Cryptosporidium hominis
PIDGSETAME

SEQ ID NO: 2117889 - protein, 13 aa, Cryptosporidium hominis
PIETESNENFDQN

SEQ ID NO: 2117890 - protein, 10 aa, Cryptosporidium hominis
PIGRKEYNED

SEQ ID NO: 2117891 - protein, 5 aa, Cryptosporidium hominis
PIIND

SEQ ID NO: 2117892 - protein, 10 aa, Cryptosporidium hominis
PIKPPPDISK

SEQ ID NO: 2117893 - protein, 8 aa, Cryptosporidium hominis
PIKQRSTS

SEQ ID NO: 2117894 - protein, 4 aa, Cryptosporidium hominis
PILS

SEQ ID NO: 2117895 - protein, 10 aa, Cryptosporidium hominis
PINGGGLRSL

SEQ ID NO: 2117896 - protein, 6 aa, Cryptosporidium hominis
PINSPE

SEQ ID NO: 2117897 - protein, 6 aa, Cryptosporidium hominis
PIPKYS

SEQ ID NO: 2117898 - protein, 11 aa, Cryptosporidium hominis
PIPSSSQEDQF

SEQ ID NO: 2117899 - protein, 10 aa, Cryptosporidium hominis
PIRDKSESNK

SEQ ID NO: 2117900 - protein, 11 aa, Cryptosporidium hominis
PIRSTKNNIPE

SEQ ID NO: 2117901 - protein, 8 aa, Cryptosporidium hominis
PISAKEEL

SEQ ID NO: 2117902 - protein, 8 aa, Cryptosporidium hominis
PISGGTGK

SEQ ID NO: 2117903 - protein, 6 aa, Cryptosporidium hominis
PISQTK

SEQ ID NO: 2117904 - protein, 11 aa, Cryptosporidium hominis
PITAPKDCSPL

SEQ ID NO: 2117905 - protein, 12 aa, Cryptosporidium hominis
PITQPKPKPKQN

SEQ ID NO: 2117906 - protein, 5 aa, Cryptosporidium hominis
PKAQE

SEQ ID NO: 2117907 - protein, 20 aa, Cryptosporidium hominis
PKATDRSSDRISKALTDKEE

SEQ ID NO: 2117908 - protein, 13 aa, Cryptosporidium hominis
PKDENADKRSEYS

SEQ ID NO: 2117909 - protein, 40 aa, Cryptosporidium hominis
PKDLAQDTRNQGPTASRDGTSYSKKGENNPGSSAGGGSLP

SEQ ID NO: 2117910 - protein, 8 aa, Cryptosporidium hominis
PKDNSYES

SEQ ID NO: 2117911 - protein, 8 aa, Cryptosporidium hominis
PKDPNKLE

SEQ ID NO: 2117912 - protein, 13 aa, Cryptosporidium hominis
PKDSPRRNRKGVY

SEQ ID NO: 2117913 - protein, 7 aa, Cryptosporidium hominis
PKETPLD

SEQ ID NO: 2117914 - protein, 4 aa, Cryptosporidium hominis
PKEY

SEQ ID NO: 2117915 - protein, 13 aa, Cryptosporidium hominis
PKGDKDTNNNNSV

SEQ ID NO: 2117916 - protein, 11 aa, Cryptosporidium hominis
PKGSREDSKNE

SEQ ID NO: 2117917 - protein, 7 aa, Cryptosporidium hominis
PKGVSTE

SEQ ID NO: 2117918 - protein, 9 aa, Cryptosporidium hominis
PKHNKNSAP

SEQ ID NO: 2117919 - protein, 5 aa, Cryptosporidium hominis
PKIES

SEQ ID NO: 2117920 - protein, 13 aa, Cryptosporidium hominis
PKISGSDNLSHPS

SEQ ID NO: 2117921 - protein, 11 aa, Cryptosporidium hominis
PKISGYDEKDG

SEQ ID NO: 2117922 - protein, 13 aa, Cryptosporidium hominis
PKISNTNNGLTGS

SEQ ID NO: 2117923 - protein, 6 aa, Cryptosporidium hominis
PKITPE

SEQ ID NO: 2117924 - protein, 14 aa, Cryptosporidium hominis
PKKEFDNKDEDYRE

SEQ ID NO: 2117925 - protein, 5 aa, Cryptosporidium hominis
PKKHL

SEQ ID NO: 2117926 - protein, 5 aa, Cryptosporidium hominis
PKKKD

SEQ ID NO: 2117927 - protein, 7 aa, Cryptosporidium hominis
PKKLPSR

SEQ ID NO: 2117928 - protein, 7 aa, Cryptosporidium hominis
PKKTEFD

SEQ ID NO: 2117929 - protein, 6 aa, Cryptosporidium hominis
PKLGGR

SEQ ID NO: 2117930 - protein, 7 aa, Cryptosporidium hominis
PKLKDQD

SEQ ID NO: 2117931 - protein, 5 aa, Cryptosporidium hominis
PKMSD

SEQ ID NO: 2117932 - protein, 10 aa, Cryptosporidium hominis
PKNDQSDFNS

SEQ ID NO: 2117933 - protein, 8 aa, Cryptosporidium hominis
PKNLQSST

SEQ ID NO: 2117934 - protein, 14 aa, Cryptosporidium hominis
PKNLTSPSSLSSYL

SEQ ID NO: 2117935 - protein, 10 aa, Cryptosporidium hominis
PKNPNHQKGN

SEQ ID NO: 2117936 - protein, 9 aa, Cryptosporidium hominis
PKNSPNSSG

SEQ ID NO: 2117937 - protein, 6 aa, Cryptosporidium hominis
PKNTNT

SEQ ID NO: 2117938 - protein, 5 aa, Cryptosporidium hominis
PKPNF

SEQ ID NO: 2117939 - protein, 7 aa, Cryptosporidium hominis
PKPQPKT

SEQ ID NO: 2117940 - protein, 4 aa, Cryptosporidium hominis
PKPT

SEQ ID NO: 2117941 - protein, 9 aa, Cryptosporidium hominis
PKQNHNESK

SEQ ID NO: 2117942 - protein, 31 aa, Cryptosporidium hominis
PKRISKEEKEKEKEKEKNINDYNEEDNNDEN

SEQ ID NO: 2117943 - protein, 5 aa, Cryptosporidium hominis
PKSCS

SEQ ID NO: 2117944 - protein, 8 aa, Cryptosporidium hominis
PKSESKVN

SEQ ID NO: 2117945 - protein, 10 aa, Cryptosporidium hominis
PKSHENKSSY

SEQ ID NO: 2117946 - protein, 17 aa, Cryptosporidium hominis
PKSIPTQNELAQILTSY

SEQ ID NO: 2117947 - protein, 8 aa, Cryptosporidium hominis
PKSKDGHN

SEQ ID NO: 2117948 - protein, 4 aa, Cryptosporidium hominis
PKSN

SEQ ID NO: 2117949 - protein, 13 aa, Cryptosporidium hominis
PKSQSLSSSITTE

SEQ ID NO: 2117950 - protein, 8 aa, Cryptosporidium hominis
PKSSRPYG

SEQ ID NO: 2117951 - protein, 9 aa, Cryptosporidium hominis
PKTGKRPDY

SEQ ID NO: 2117952 - protein, 9 aa, Cryptosporidium hominis
PKTIEESQA

SEQ ID NO: 2117953 - protein, 7 aa, Cryptosporidium hominis
PKTKEEY

SEQ ID NO: 2117954 - protein, 6 aa, Cryptosporidium hominis
PKTNTT

SEQ ID NO: 2117955 - protein, 9 aa, Cryptosporidium hominis
PKTQTEHNS

SEQ ID NO: 2117956 - protein, 7 aa, Cryptosporidium hominis
PKTSYNQ

SEQ ID NO: 2117957 - protein, 10 aa, Cryptosporidium hominis
PKVRNQKESV

SEQ ID NO: 2117958 - protein, 9 aa, Cryptosporidium hominis
PKYKQSKSY

SEQ ID NO: 2117959 - protein, 6 aa, Cryptosporidium hominis
PKYVGG

SEQ ID NO: 2117960 - protein, 10 aa, Cryptosporidium hominis
PLDPSNARGM

SEQ ID NO: 2117961 - protein, 5 aa, Cryptosporidium hominis
PLEYR

SEQ ID NO: 2117962 - protein, 12 aa, Cryptosporidium hominis
PLFSGKGSKEYK

SEQ ID NO: 2117963 - protein, 46 aa, Cryptosporidium hominis
PLGNSDSSEDKDQSKLNTKAGQEAEDRSKNKLKEGQIADQDSNRIR

SEQ ID NO: 2117964 - protein, 8 aa, Cryptosporidium hominis
PLKENNKC

SEQ ID NO: 2117965 - protein, 73 aa, Cryptosporidium hominis
PLNKSEKSNYTSQVESEDEDDEPEALSSKVKSEKHFSEKDDGEDDYNSNIESSEVESSRNHSQSKKISKEEVN

SEQ ID NO: 2117966 - protein, 9 aa, Cryptosporidium hominis
PLNPSSRLK

SEQ ID NO: 2117967 - protein, 4 aa, Cryptosporidium hominis
PLNS

SEQ ID NO: 2117968 - protein, 17 aa, Cryptosporidium hominis
PLPTSKPSPILLFTDNK

SEQ ID NO: 2117969 - protein, 4 aa, Cryptosporidium hominis
PLQL

SEQ ID NO: 2117970 - protein, 7 aa, Cryptosporidium hominis
PLRSEDV

SEQ ID NO: 2117971 - protein, 4 aa, Cryptosporidium hominis
PLSD

SEQ ID NO: 2117972 - protein, 4 aa, Cryptosporidium hominis
PLSG

SEQ ID NO: 2117973 - protein, 11 aa, Cryptosporidium hominis
PLSRGRKPSRS

SEQ ID NO: 2117974 - protein, 4 aa, Cryptosporidium hominis
PLTT

SEQ ID NO: 2117975 - protein, 11 aa, Cryptosporidium hominis
PLVNRDPSEYY

SEQ ID NO: 2117976 - protein, 8 aa, Cryptosporidium hominis
PMNGQPIR

SEQ ID NO: 2117977 - protein, 17 aa, Cryptosporidium hominis
PMNTSSEEVEEDGGENI

SEQ ID NO: 2117978 - protein, 6 aa, Cryptosporidium hominis
PMPPVT

SEQ ID NO: 2117979 - protein, 4 aa, Cryptosporidium hominis
PMYS

SEQ ID NO: 2117980 - protein, 8 aa, Cryptosporidium hominis
PNAKNGLN

SEQ ID NO: 2117981 - protein, 15 aa, Cryptosporidium hominis
PNATRITEKMGSDDL

SEQ ID NO: 2117982 - protein, 7 aa, Cryptosporidium hominis
PNEADLS

SEQ ID NO: 2117983 - protein, 7 aa, Cryptosporidium hominis
PNEESIN

SEQ ID NO: 2117984 - protein, 45 aa, Cryptosporidium hominis
PNEKSAENVTSQSFNKDYNSESKLGTNERKENWNNHQNEDGDFDE

SEQ ID NO: 2117985 - protein, 4 aa, Cryptosporidium hominis
PNEM

SEQ ID NO: 2117986 - protein, 14 aa, Cryptosporidium hominis
PNEPGQPRSYLSTE

SEQ ID NO: 2117987 - protein, 4 aa, Cryptosporidium hominis
PNFG

SEQ ID NO: 2117988 - protein, 5 aa, Cryptosporidium hominis
PNFNE

SEQ ID NO: 2117989 - protein, 4 aa, Cryptosporidium hominis
PNGF

SEQ ID NO: 2117990 - protein, 9 aa, Cryptosporidium hominis
PNGGNLEQG

SEQ ID NO: 2117991 - protein, 8 aa, Cryptosporidium hominis
PNGHCKDG

SEQ ID NO: 2117992 - protein, 17 aa, Cryptosporidium hominis
PNIANPGFDDNDNNNIN

SEQ ID NO: 2117993 - protein, 4 aa, Cryptosporidium hominis
PNIE

SEQ ID NO: 2117994 - protein, 11 aa, Cryptosporidium hominis
PNISGGEGARI

SEQ ID NO: 2117995 - protein, 48 aa, Cryptosporidium hominis
PNKASTTNQNIGSSALGGTNANTNTSNTGNTVGNSSKSSSNNSAITKY

SEQ ID NO: 2117996 - protein, 5 aa, Cryptosporidium hominis
PNKEY

SEQ ID NO: 2117997 - protein, 5 aa, Cryptosporidium hominis
PNKPL

SEQ ID NO: 2117998 - protein, 11 aa, Cryptosporidium hominis
PNKSKPADSSL

SEQ ID NO: 2117999 - protein, 10 aa, Cryptosporidium hominis
PNLKKTPPVE

SEQ ID NO: 2118000 - protein, 4 aa, Cryptosporidium hominis
PNLN

SEQ ID NO: 2118001 - protein, 9 aa, Cryptosporidium hominis
PNNEISSTD

SEQ ID NO: 2118002 - protein, 4 aa, Cryptosporidium hominis
PNNK

SEQ ID NO: 2118003 - protein, 5 aa, Cryptosporidium hominis
PNNNY

SEQ ID NO: 2118004 - protein, 5 aa, Cryptosporidium hominis
PNNSA

SEQ ID NO: 2118005 - protein, 4 aa, Cryptosporidium hominis
PNPE

SEQ ID NO: 2118006 - protein, 9 aa, Cryptosporidium hominis
PNPGQLQNG

SEQ ID NO: 2118007 - protein, 4 aa, Cryptosporidium hominis
PNPL

SEQ ID NO: 2118008 - protein, 4 aa, Cryptosporidium hominis
PNPN

SEQ ID NO: 2118009 - protein, 11 aa, Cryptosporidium hominis
PNPNDTRPRNS

SEQ ID NO: 2118010 - protein, 6 aa, Cryptosporidium hominis
PNPNPS

SEQ ID NO: 2118011 - protein, 7 aa, Cryptosporidium hominis
PNPPSVV

SEQ ID NO: 2118012 - protein, 8 aa, Cryptosporidium hominis
PNPQSQDD

SEQ ID NO: 2118013 - protein, 6 aa, Cryptosporidium hominis
PNQEPR

SEQ ID NO: 2118014 - protein, 11 aa, Cryptosporidium hominis
PNQNVKTGSSQ

SEQ ID NO: 2118015 - protein, 5 aa, Cryptosporidium hominis
PNQSL

SEQ ID NO: 2118016 - protein, 10 aa, Cryptosporidium hominis
PNQSNLPPVT

SEQ ID NO: 2118017 - protein, 9 aa, Cryptosporidium hominis
PNQTPAEVT

SEQ ID NO: 2118018 - protein, 4 aa, Cryptosporidium hominis
PNSC

SEQ ID NO: 2118019 - protein, 7 aa, Cryptosporidium hominis
PNSDGGG

SEQ ID NO: 2118020 - protein, 6 aa, Cryptosporidium hominis
PNSDSF

SEQ ID NO: 2118021 - protein, 10 aa, Cryptosporidium hominis
PNSFSGTNIT

SEQ ID NO: 2118022 - protein, 4 aa, Cryptosporidium hominis
PNSG

SEQ ID NO: 2118023 - protein, 15 aa, Cryptosporidium hominis
PNSKYYSNSSNFNKV

SEQ ID NO: 2118024 - protein, 5 aa, Cryptosporidium hominis
PNSNF

SEQ ID NO: 2118025 - protein, 7 aa, Cryptosporidium hominis
PNSNFQS

SEQ ID NO: 2118026 - protein, 34 aa, Cryptosporidium hominis
PNSNVNRAGSSYNSFSGNSAQPRAFSGRGFRLGS

SEQ ID NO: 2118027 - protein, 7 aa, Cryptosporidium hominis
PNSRVAT

SEQ ID NO: 2118028 - protein, 5 aa, Cryptosporidium hominis
PNSSD

SEQ ID NO: 2118029 - protein, 7 aa, Cryptosporidium hominis
PNSSNFG

SEQ ID NO: 2118030 - protein, 5 aa, Cryptosporidium hominis
PNSSS

SEQ ID NO: 2118031 - protein, 15 aa, Cryptosporidium hominis
PNTMDPSYAGDGDYA

SEQ ID NO: 2118032 - protein, 28 aa, Cryptosporidium hominis
PNTNKRTSVQSEKNEINSPVSSSSYSNL

SEQ ID NO: 2118033 - protein, 10 aa, Cryptosporidium hominis
PNTNNTVYNE

SEQ ID NO: 2118034 - protein, 4 aa, Cryptosporidium hominis
PNTS

SEQ ID NO: 2118035 - protein, 5 aa, Cryptosporidium hominis
PNTTQ

SEQ ID NO: 2118036 - protein, 4 aa, Cryptosporidium hominis
PNVD

SEQ ID NO: 2118037 - protein, 5 aa, Cryptosporidium hominis
PNYNV

SEQ ID NO: 2118038 - protein, 11 aa, Cryptosporidium hominis
PPAGSDERKNV

SEQ ID NO: 2118039 - protein, 8 aa, Cryptosporidium hominis
PPAIPGPF

SEQ ID NO: 2118040 - protein, 8 aa, Cryptosporidium hominis
PPANFDSE

SEQ ID NO: 2118041 - protein, 7 aa, Cryptosporidium hominis
PPDDEPL

SEQ ID NO: 2118042 - protein, 10 aa, Cryptosporidium hominis
PPDRTALSQD

SEQ ID NO: 2118043 - protein, 5 aa, Cryptosporidium hominis
PPEFP

SEQ ID NO: 2118044 - protein, 12 aa, Cryptosporidium hominis
PPEINKNNEEDF

SEQ ID NO: 2118045 - protein, 7 aa, Cryptosporidium hominis
PPEYSRN

SEQ ID NO: 2118046 - protein, 10 aa, Cryptosporidium hominis
PPFGGQTDQE

SEQ ID NO: 2118047 - protein, 4 aa, Cryptosporidium hominis
PPGR

SEQ ID NO: 2118048 - protein, 6 aa, Cryptosporidium hominis
PPGVTK

SEQ ID NO: 2118049 - protein, 6 aa, Cryptosporidium hominis
PPHPHS

SEQ ID NO: 2118050 - protein, 5 aa, Cryptosporidium hominis
PPHQS

SEQ ID NO: 2118051 - protein, 4 aa, Cryptosporidium hominis
PPKI

SEQ ID NO: 2118052 - protein, 6 aa, Cryptosporidium hominis
PPLPPN

SEQ ID NO: 2118053 - protein, 5 aa, Cryptosporidium hominis
PPNHS

SEQ ID NO: 2118054 - protein, 12 aa, Cryptosporidium hominis
PPNRLPPKISQQ

SEQ ID NO: 2118055 - protein, 5 aa, Cryptosporidium hominis
PPNTN

SEQ ID NO: 2118056 - protein, 16 aa, Cryptosporidium hominis
PPNVGGKHGTESTNIK

SEQ ID NO: 2118057 - protein, 6 aa, Cryptosporidium hominis
PPPAHE

SEQ ID NO: 2118058 - protein, 7 aa, Cryptosporidium hominis
PPPERET

SEQ ID NO: 2118059 - protein, 6 aa, Cryptosporidium hominis
PPPFST

SEQ ID NO: 2118060 - protein, 18 aa, Cryptosporidium hominis
PPPGTPNAPQNPPYNSRA

SEQ ID NO: 2118061 - protein, 12 aa, Cryptosporidium hominis
PPPIPHPPQPQF

SEQ ID NO: 2118062 - protein, 9 aa, Cryptosporidium hominis
PPPKRKSNN

SEQ ID NO: 2118063 - protein, 5 aa, Cryptosporidium hominis
PPPPL

SEQ ID NO: 2118064 - protein, 9 aa, Cryptosporidium hominis
PPPPPMQPE

SEQ ID NO: 2118065 - protein, 7 aa, Cryptosporidium hominis
PPRPGVE

SEQ ID NO: 2118066 - protein, 6 aa, Cryptosporidium hominis
PPRSGL

SEQ ID NO: 2118067 - protein, 4 aa, Cryptosporidium hominis
PPSF

SEQ ID NO: 2118068 - protein, 8 aa, Cryptosporidium hominis
PPSNDQYS

SEQ ID NO: 2118069 - protein, 5 aa, Cryptosporidium hominis
PPSPL

SEQ ID NO: 2118070 - protein, 17 aa, Cryptosporidium hominis
PPSSIESQGPQNTGSTF

SEQ ID NO: 2118071 - protein, 49 aa, Cryptosporidium hominis
PPTETTRKKTTKPSSPKSLSESYSWPPRERTKPSIGQGRVSSAGPQHLD

SEQ ID NO: 2118072 - protein, 8 aa, Cryptosporidium hominis
PPTNGRYT

SEQ ID NO: 2118073 - protein, 5 aa, Cryptosporidium hominis
PPTSA

SEQ ID NO: 2118074 - protein, 4 aa, Cryptosporidium hominis
PPVS

SEQ ID NO: 2118075 - protein, 11 aa, Cryptosporidium hominis
PPYNQKNKQEN

SEQ ID NO: 2118076 - protein, 12 aa, Cryptosporidium hominis
PQANNTNSSVTC

SEQ ID NO: 2118077 - protein, 5 aa, Cryptosporidium hominis
PQDES

SEQ ID NO: 2118078 - protein, 5 aa, Cryptosporidium hominis
PQELS

SEQ ID NO: 2118079 - protein, 12 aa, Cryptosporidium hominis
PQENTENQIQEN

SEQ ID NO: 2118080 - protein, 8 aa, Cryptosporidium hominis
PQETHTGS

SEQ ID NO: 2118081 - protein, 4 aa, Cryptosporidium hominis
PQGT

SEQ ID NO: 2118082 - protein, 4 aa, Cryptosporidium hominis
PQIV

SEQ ID NO: 2118083 - protein, 13 aa, Cryptosporidium hominis
PQLEKKKKLTSIQ

SEQ ID NO: 2118084 - protein, 13 aa, Cryptosporidium hominis
PQNEIPDDVGPKT

SEQ ID NO: 2118085 - protein, 15 aa, Cryptosporidium hominis
PQNRSNITNKNTPGL

SEQ ID NO: 2118086 - protein, 16 aa, Cryptosporidium hominis
PQPPPIPQPQPSSHPQ

SEQ ID NO: 2118087 - protein, 20 aa, Cryptosporidium hominis
PQRDSRSQSGRSFNNNDPGL

SEQ ID NO: 2118088 - protein, 7 aa, Cryptosporidium hominis
PQRENET

SEQ ID NO: 2118089 - protein, 10 aa, Cryptosporidium hominis
PQRNSSKNLL

SEQ ID NO: 2118090 - protein, 9 aa, Cryptosporidium hominis
PQSNERSEG

SEQ ID NO: 2118091 - protein, 12 aa, Cryptosporidium hominis
PQSSDIHKKTDQ

SEQ ID NO: 2118092 - protein, 7 aa, Cryptosporidium hominis
PQSSSNY

SEQ ID NO: 2118093 - protein, 57 aa, Cryptosporidium hominis
PQTLTAPNTSTNKAAPAPAPAPAPAPTPAPAPIPAPAPTPAPAPTLGPALSKDSAPI

SEQ ID NO: 2118094 - protein, 18 aa, Cryptosporidium hominis
PQTQKKARVDSKNDDNLE

SEQ ID NO: 2118095 - protein, 4 aa, Cryptosporidium hominis
PRAM

SEQ ID NO: 2118096 - protein, 4 aa, Cryptosporidium hominis
PRCS

SEQ ID NO: 2118097 - protein, 16 aa, Cryptosporidium hominis
PREDNGKVDGTPGGAE

SEQ ID NO: 2118098 - protein, 5 aa, Cryptosporidium hominis
PRIES

SEQ ID NO: 2118099 - protein, 4 aa, Cryptosporidium hominis
PRKP

SEQ ID NO: 2118100 - protein, 5 aa, Cryptosporidium hominis
PRKVS

SEQ ID NO: 2118101 - protein, 4 aa, Cryptosporidium hominis
PRLG

SEQ ID NO: 2118102 - protein, 7 aa, Cryptosporidium hominis
PRNTQGL

SEQ ID NO: 2118103 - protein, 25 aa, Cryptosporidium hominis
PRPGTPAAKMKPVPNGVSKGRSSEI

SEQ ID NO: 2118104 - protein, 9 aa, Cryptosporidium hominis
PRSSSSSSF

SEQ ID NO: 2118105 - protein, 9 aa, Cryptosporidium hominis
PRTEWPSTV

SEQ ID NO: 2118106 - protein, 4 aa, Cryptosporidium hominis
PRYD

SEQ ID NO: 2118107 - protein, 8 aa, Cryptosporidium hominis
PSAKKKKE

SEQ ID NO: 2118108 - protein, 11 aa, Cryptosporidium hominis
PSAPPLSTLSA

SEQ ID NO: 2118109 - protein, 8 aa, Cryptosporidium hominis
PSASLGSI

SEQ ID NO: 2118110 - protein, 5 aa, Cryptosporidium hominis
PSDEN

SEQ ID NO: 2118111 - protein, 4 aa, Cryptosporidium hominis
PSDI

SEQ ID NO: 2118112 - protein, 13 aa, Cryptosporidium hominis
PSDTKNPQEDTNA

SEQ ID NO: 2118113 - protein, 12 aa, Cryptosporidium hominis
PSEEFDNNINNQ

SEQ ID NO: 2118114 - protein, 4 aa, Cryptosporidium hominis
PSEG

SEQ ID NO: 2118115 - protein, 9 aa, Cryptosporidium hominis
PSEGESLRK

SEQ ID NO: 2118116 - protein, 11 aa, Cryptosporidium hominis
PSELNNNSTEI

SEQ ID NO: 2118117 - protein, 9 aa, Cryptosporidium hominis
PSENGNSVS

SEQ ID NO: 2118118 - protein, 18 aa, Cryptosporidium hominis
PSESDYNYTTSKHSNTGY

SEQ ID NO: 2118119 - protein, 5 aa, Cryptosporidium hominis
PSFTR

SEQ ID NO: 2118120 - protein, 9 aa, Cryptosporidium hominis
PSGNVGRTT

SEQ ID NO: 2118121 - protein, 6 aa, Cryptosporidium hominis
PSGQAL

SEQ ID NO: 2118122 - protein, 11 aa, Cryptosporidium hominis
PSGTFPQPSGI

SEQ ID NO: 2118123 - protein, 6 aa, Cryptosporidium hominis
PSIEYE

SEQ ID NO: 2118124 - protein, 9 aa, Cryptosporidium hominis
PSIGASANS

SEQ ID NO: 2118125 - protein, 21 aa, Cryptosporidium hominis
PSIKANSKNEGIIQSKASKSL

SEQ ID NO: 2118126 - protein, 5 aa, Cryptosporidium hominis
PSIPF

SEQ ID NO: 2118127 - protein, 13 aa, Cryptosporidium hominis
PSIPPPESTDEEK

SEQ ID NO: 2118128 - protein, 10 aa, Cryptosporidium hominis
PSISGNNEFR

SEQ ID NO: 2118129 - protein, 4 aa, Cryptosporidium hominis
PSIY

SEQ ID NO: 2118130 - protein, 4 aa, Cryptosporidium hominis
PSKG

SEQ ID NO: 2118131 - protein, 5 aa, Cryptosporidium hominis
PSKIK

SEQ ID NO: 2118132 - protein, 4 aa, Cryptosporidium hominis
PSKN

SEQ ID NO: 2118133 - protein, 8 aa, Cryptosporidium hominis
PSKSAKSV

SEQ ID NO: 2118134 - protein, 34 aa, Cryptosporidium hominis
PSKSHRSRSESYQKLKEEKDFATTSFESDTNDGL

SEQ ID NO: 2118135 - protein, 5 aa, Cryptosporidium hominis
PSLDV

SEQ ID NO: 2118136 - protein, 6 aa, Cryptosporidium hominis
PSLEQL

SEQ ID NO: 2118137 - protein, 5 aa, Cryptosporidium hominis
PSLLG

SEQ ID NO: 2118138 - protein, 8 aa, Cryptosporidium hominis
PSLPSGVH

SEQ ID NO: 2118139 - protein, 37 aa, Cryptosporidium hominis
PSLSNQNSKSQNNLNEIGQNTNRSFYDKKKGSEDRYT

SEQ ID NO: 2118140 - protein, 11 aa, Cryptosporidium hominis
PSNERMETTSR

SEQ ID NO: 2118141 - protein, 4 aa, Cryptosporidium hominis
PSNP

SEQ ID NO: 2118142 - protein, 4 aa, Cryptosporidium hominis
PSNS

SEQ ID NO: 2118143 - protein, 7 aa, Cryptosporidium hominis
PSNSNLL

SEQ ID NO: 2118144 - protein, 8 aa, Cryptosporidium hominis
PSNSRIKS

SEQ ID NO: 2118145 - protein, 17 aa, Cryptosporidium hominis
PSNYSSQSSTKPVDHRT

SEQ ID NO: 2118146 - protein, 6 aa, Cryptosporidium hominis
PSPEPI

SEQ ID NO: 2118147 - protein, 6 aa, Cryptosporidium hominis
PSPIET

SEQ ID NO: 2118148 - protein, 10 aa, Cryptosporidium hominis
PSPRFSTPGE

SEQ ID NO: 2118149 - protein, 6 aa, Cryptosporidium hominis
PSPSLR

SEQ ID NO: 2118150 - protein, 4 aa, Cryptosporidium hominis
PSRA

SEQ ID NO: 2118151 - protein, 14 aa, Cryptosporidium hominis
PSRSTIRKSSKESF

SEQ ID NO: 2118152 - protein, 6 aa, Cryptosporidium hominis
PSSESF

SEQ ID NO: 2118153 - protein, 4 aa, Cryptosporidium hominis
PSSG

SEQ ID NO: 2118154 - protein, 9 aa, Cryptosporidium hominis
PSSGEEHRL

SEQ ID NO: 2118155 - protein, 26 aa, Cryptosporidium hominis
PSSGNTISTNSNNSGNTLGGQYSEGG

SEQ ID NO: 2118156 - protein, 5 aa, Cryptosporidium hominis
PSSIP

SEQ ID NO: 2118157 - protein, 15 aa, Cryptosporidium hominis
PSSITERAGSISSDQ

SEQ ID NO: 2118158 - protein, 13 aa, Cryptosporidium hominis
PSSPAQGIPPADH

SEQ ID NO: 2118159 - protein, 13 aa, Cryptosporidium hominis
PSSRPFSGPNGSN

SEQ ID NO: 2118160 - protein, 5 aa, Cryptosporidium hominis
PSSSS

SEQ ID NO: 2118161 - protein, 10 aa, Cryptosporidium hominis
PSSSSRTLNT

SEQ ID NO: 2118162 - protein, 4 aa, Cryptosporidium hominis
PSSY

SEQ ID NO: 2118163 - protein, 7 aa, Cryptosporidium hominis
PSTFPSE

SEQ ID NO: 2118164 - protein, 6 aa, Cryptosporidium hominis
PSTKCE

SEQ ID NO: 2118165 - protein, 6 aa, Cryptosporidium hominis
PSTLTV

SEQ ID NO: 2118166 - protein, 8 aa, Cryptosporidium hominis
PSTMPSQA

SEQ ID NO: 2118167 - protein, 6 aa, Cryptosporidium hominis
PSTTEV

SEQ ID NO: 2118168 - protein, 5 aa, Cryptosporidium hominis
PSVGR

SEQ ID NO: 2118169 - protein, 7 aa, Cryptosporidium hominis
PSVQSDD

SEQ ID NO: 2118170 - protein, 9 aa, Cryptosporidium hominis
PSVSGDDIG

SEQ ID NO: 2118171 - protein, 5 aa, Cryptosporidium hominis
PSYKQ

SEQ ID NO: 2118172 - protein, 10 aa, Cryptosporidium hominis
PTAPIGHDSN

SEQ ID NO: 2118173 - protein, 4 aa, Cryptosporidium hominis
PTDD

SEQ ID NO: 2118174 - protein, 14 aa, Cryptosporidium hominis
PTDQQGQPQGGPRT

SEQ ID NO: 2118175 - protein, 16 aa, Cryptosporidium hominis
PTDVEVGHSKSQFEET

SEQ ID NO: 2118176 - protein, 14 aa, Cryptosporidium hominis
PTEAPTTKYSGIES

SEQ ID NO: 2118177 - protein, 22 aa, Cryptosporidium hominis
PTEDPNVQKASDSIKDGISGNA

SEQ ID NO: 2118178 - protein, 7 aa, Cryptosporidium hominis
PTEEEEK

SEQ ID NO: 2118179 - protein, 8 aa, Cryptosporidium hominis
PTEIRSTG

SEQ ID NO: 2118180 - protein, 11 aa, Cryptosporidium hominis
PTEQNSPQGQV

SEQ ID NO: 2118181 - protein, 4 aa, Cryptosporidium hominis
PTFK

SEQ ID NO: 2118182 - protein, 11 aa, Cryptosporidium hominis
PTGLSSKGSQI

SEQ ID NO: 2118183 - protein, 16 aa, Cryptosporidium hominis
PTIDSRGNRINCDESD

SEQ ID NO: 2118184 - protein, 4 aa, Cryptosporidium hominis
PTIS

SEQ ID NO: 2118185 - protein, 6 aa, Cryptosporidium hominis
PTISQT

SEQ ID NO: 2118186 - protein, 16 aa, Cryptosporidium hominis
PTKDSENIPENKAMLA

SEQ ID NO: 2118187 - protein, 6 aa, Cryptosporidium hominis
PTKEVY

SEQ ID NO: 2118188 - protein, 8 aa, Cryptosporidium hominis
PTKSYGNT

SEQ ID NO: 2118189 - protein, 7 aa, Cryptosporidium hominis
PTLECPP

SEQ ID NO: 2118190 - protein, 5 aa, Cryptosporidium hominis
PTPFS

SEQ ID NO: 2118191 - protein, 7 aa, Cryptosporidium hominis
PTPGEGA

SEQ ID NO: 2118192 - protein, 9 aa, Cryptosporidium hominis
PTPSRDGED

SEQ ID NO: 2118193 - protein, 8 aa, Cryptosporidium hominis
PTPTNKEL

SEQ ID NO: 2118194 - protein, 10 aa, Cryptosporidium hominis
PTQNITQNSL

SEQ ID NO: 2118195 - protein, 4 aa, Cryptosporidium hominis
PTSA

SEQ ID NO: 2118196 - protein, 7 aa, Cryptosporidium hominis
PTSCRGG

SEQ ID NO: 2118197 - protein, 16 aa, Cryptosporidium hominis
PTSGGEPTISQRQGGD

SEQ ID NO: 2118198 - protein, 5 aa, Cryptosporidium hominis
PTSGL

SEQ ID NO: 2118199 - protein, 4 aa, Cryptosporidium hominis
PTSI

SEQ ID NO: 2118200 - protein, 15 aa, Cryptosporidium hominis
PTSRTERISAGQIPE

SEQ ID NO: 2118201 - protein, 9 aa, Cryptosporidium hominis
PTSSFGNST

SEQ ID NO: 2118202 - protein, 15 aa, Cryptosporidium hominis
PTSSITEDNTNSEEN

SEQ ID NO: 2118203 - protein, 5 aa, Cryptosporidium hominis
PTTFP

SEQ ID NO: 2118204 - protein, 7 aa, Cryptosporidium hominis
PTTGLDA

SEQ ID NO: 2118205 - protein, 6 aa, Cryptosporidium hominis
PTTSAV

SEQ ID NO: 2118206 - protein, 7 aa, Cryptosporidium hominis
PTVESNS

SEQ ID NO: 2118207 - protein, 8 aa, Cryptosporidium hominis
PVENQELA

SEQ ID NO: 2118208 - protein, 9 aa, Cryptosporidium hominis
PVENSTSSL

SEQ ID NO: 2118209 - protein, 6 aa, Cryptosporidium hominis
PVPQPS

SEQ ID NO: 2118210 - protein, 7 aa, Cryptosporidium hominis
PVQGYSS

SEQ ID NO: 2118211 - protein, 22 aa, Cryptosporidium hominis
PVQSNKSKSEEKRRIGSSIPLS

SEQ ID NO: 2118212 - protein, 4 aa, Cryptosporidium hominis
PVRR

SEQ ID NO: 2118213 - protein, 4 aa, Cryptosporidium hominis
PVSE

SEQ ID NO: 2118214 - protein, 16 aa, Cryptosporidium hominis
PVSEEESGNFSHNGSE

SEQ ID NO: 2118215 - protein, 9 aa, Cryptosporidium hominis
PVSESSNTP

SEQ ID NO: 2118216 - protein, 6 aa, Cryptosporidium hominis
PVTESS

SEQ ID NO: 2118217 - protein, 10 aa, Cryptosporidium hominis
PWTPNSSSFH

SEQ ID NO: 2118218 - protein, 9 aa, Cryptosporidium hominis
PYDEASANF

SEQ ID NO: 2118219 - protein, 7 aa, Cryptosporidium hominis
PYENNNR

SEQ ID NO: 2118220 - protein, 5 aa, Cryptosporidium hominis
PYGSG

SEQ ID NO: 2118221 - protein, 13 aa, Cryptosporidium hominis
PYKPHSYSNAGSS

SEQ ID NO: 2118222 - protein, 7 aa, Cryptosporidium hominis
PYNQGDR

SEQ ID NO: 2118223 - protein, 5 aa, Cryptosporidium hominis
PYNRP

SEQ ID NO: 2118224 - protein, 22 aa, Cryptosporidium hominis
PYPFEDDESSINQSNSENVKPV

SEQ ID NO: 2118225 - protein, 8 aa, Cryptosporidium hominis
PYRDDPKI

SEQ ID NO: 2118226 - protein, 4 aa, Cryptosporidium hominis
PYSA

SEQ ID NO: 2118227 - protein, 6 aa, Cryptosporidium hominis
PYSISN

SEQ ID NO: 2118228 - protein, 5 aa, Cryptosporidium hominis
PYSNQ

SEQ ID NO: 2118229 - protein, 4 aa, Cryptosporidium hominis
PYSP

SEQ ID NO: 2118230 - protein, 7 aa, Cryptosporidium hominis
PYSPAYT

SEQ ID NO: 2118231 - protein, 5 aa, Cryptosporidium hominis
PYSYS

SEQ ID NO: 2118232 - protein, 15 aa, Cryptosporidium hominis
PYTLNNNPTCEGCPK

SEQ ID NO: 2118233 - protein, 7 aa, Cryptosporidium hominis
PYVPPYG

SEQ ID NO: 2118234 - protein, 9 aa, Cryptosporidium hominis
QAKKQFDRQ

SEQ ID NO: 2118235 - protein, 9 aa, Cryptosporidium hominis
QANKLGKNS

SEQ ID NO: 2118236 - protein, 7 aa, Cryptosporidium hominis
QANYSAA

SEQ ID NO: 2118237 - protein, 6 aa, Cryptosporidium hominis
QAQTHF

SEQ ID NO: 2118238 - protein, 4 aa, Cryptosporidium hominis
QARN

SEQ ID NO: 2118239 - protein, 5 aa, Cryptosporidium hominis
QASIQ

SEQ ID NO: 2118240 - protein, 7 aa, Cryptosporidium hominis
QASTYTR

SEQ ID NO: 2118241 - protein, 5 aa, Cryptosporidium hominis
QATND

SEQ ID NO: 2118242 - protein, 7 aa, Cryptosporidium hominis
QAVENNK

SEQ ID NO: 2118243 - protein, 5 aa, Cryptosporidium hominis
QAVGE

SEQ ID NO: 2118244 - protein, 8 aa, Cryptosporidium hominis
QDDARSGN

SEQ ID NO: 2118245 - protein, 8 aa, Cryptosporidium hominis
QDDKPYYK

SEQ ID NO: 2118246 - protein, 21 aa, Cryptosporidium hominis
QDDQEEIKKVNKEPQSKWNAT

SEQ ID NO: 2118247 - protein, 16 aa, Cryptosporidium hominis
QDDVDPESGIVQNENE

SEQ ID NO: 2118248 - protein, 5 aa, Cryptosporidium hominis
QDEEF

SEQ ID NO: 2118249 - protein, 5 aa, Cryptosporidium hominis
QDEVP

SEQ ID NO: 2118250 - protein, 5 aa, Cryptosporidium hominis
QDGVP

SEQ ID NO: 2118251 - protein, 9 aa, Cryptosporidium hominis
QDHEKDGNY

SEQ ID NO: 2118252 - protein, 5 aa, Cryptosporidium hominis
QDKKI

SEQ ID NO: 2118253 - protein, 6 aa, Cryptosporidium hominis
QDKQGD

SEQ ID NO: 2118254 - protein, 6 aa, Cryptosporidium hominis
QDKRGN

SEQ ID NO: 2118255 - protein, 7 aa, Cryptosporidium hominis
QDLSERR

SEQ ID NO: 2118256 - protein, 6 aa, Cryptosporidium hominis
QDNTRE

SEQ ID NO: 2118257 - protein, 9 aa, Cryptosporidium hominis
QDPANRKGL

SEQ ID NO: 2118258 - protein, 13 aa, Cryptosporidium hominis
QDPEFRPSAENTY

SEQ ID NO: 2118259 - protein, 12 aa, Cryptosporidium hominis
QDPFKKTSISYK

SEQ ID NO: 2118260 - protein, 9 aa, Cryptosporidium hominis
QDPSNRKTY

SEQ ID NO: 2118261 - protein, 12 aa, Cryptosporidium hominis
QDPTKDDLNQIN

SEQ ID NO: 2118262 - protein, 5 aa, Cryptosporidium hominis
QDQGI

SEQ ID NO: 2118263 - protein, 11 aa, Cryptosporidium hominis
QDQSTPTSNEF

SEQ ID NO: 2118264 - protein, 8 aa, Cryptosporidium hominis
QDQSYSLE

SEQ ID NO: 2118265 - protein, 5 aa, Cryptosporidium hominis
QDQTS

SEQ ID NO: 2118266 - protein, 8 aa, Cryptosporidium hominis
QDSDDELT

SEQ ID NO: 2118267 - protein, 4 aa, Cryptosporidium hominis
QDSL

SEQ ID NO: 2118268 - protein, 6 aa, Cryptosporidium hominis
QDSPKD

SEQ ID NO: 2118269 - protein, 16 aa, Cryptosporidium hominis
QDSPNGYEGDHESEMD

SEQ ID NO: 2118270 - protein, 7 aa, Cryptosporidium hominis
QDSQTGL

SEQ ID NO: 2118271 - protein, 25 aa, Cryptosporidium hominis
QDSSANTANTVNTASSSNNSNSSTL

SEQ ID NO: 2118272 - protein, 56 aa, Cryptosporidium hominis
QDTNKDNSATSEVKNETTKEEEESKEKKENNEDERMSDNDNGKSEEMVPPETFEWQ

SEQ ID NO: 2118273 - protein, 12 aa, Cryptosporidium hominis
QDVSNESNSTNQ

SEQ ID NO: 2118274 - protein, 7 aa, Cryptosporidium hominis
QDVSPEI

SEQ ID NO: 2118275 - protein, 18 aa, Cryptosporidium hominis
QDVTDYKSSLNKQTDNLP

SEQ ID NO: 2118276 - protein, 14 aa, Cryptosporidium hominis
QDVTKQKNNPEIEK

SEQ ID NO: 2118277 - protein, 15 aa, Cryptosporidium hominis
QDYPKNEANFETQGK

SEQ ID NO: 2118278 - protein, 8 aa, Cryptosporidium hominis
QEANRNSS

SEQ ID NO: 2118279 - protein, 4 aa, Cryptosporidium hominis
QEDP

SEQ ID NO: 2118280 - protein, 28 aa, Cryptosporidium hominis
QEDSSNSNFSGSSSSVNNNNNQLEEENY

SEQ ID NO: 2118281 - protein, 7 aa, Cryptosporidium hominis
QEEANSL

SEQ ID NO: 2118282 - protein, 20 aa, Cryptosporidium hominis
QEEEGNKGICNSNSISSNEQ

SEQ ID NO: 2118283 - protein, 17 aa, Cryptosporidium hominis
QEEIGDQRKKQDSRSGL

SEQ ID NO: 2118284 - protein, 13 aa, Cryptosporidium hominis
QEERVPTGTEEGD

SEQ ID NO: 2118285 - protein, 16 aa, Cryptosporidium hominis
QEETLESDTRSNLGSR

SEQ ID NO: 2118286 - protein, 16 aa, Cryptosporidium hominis
QEEYNSFDEDSIEENS

SEQ ID NO: 2118287 - protein, 4 aa, Cryptosporidium hominis
QEFN

SEQ ID NO: 2118288 - protein, 10 aa, Cryptosporidium hominis
QEKATKLNPV

SEQ ID NO: 2118289 - protein, 6 aa, Cryptosporidium hominis
QEKGGF

SEQ ID NO: 2118290 - protein, 17 aa, Cryptosporidium hominis
QEKGSTQFSKKSGYVTQ

SEQ ID NO: 2118291 - protein, 28 aa, Cryptosporidium hominis
QEKNDRSLQESSENSNSGTSQGSNNSVG

SEQ ID NO: 2118292 - protein, 20 aa, Cryptosporidium hominis
QEKNQNRGSFGRVNQEKGDH

SEQ ID NO: 2118293 - protein, 12 aa, Cryptosporidium hominis
QEKVGGEIEGSS

SEQ ID NO: 2118294 - protein, 12 aa, Cryptosporidium hominis
QENDKSESSGMA

SEQ ID NO: 2118295 - protein, 4 aa, Cryptosporidium hominis
QENI

SEQ ID NO: 2118296 - protein, 7 aa, Cryptosporidium hominis
QENPSPN

SEQ ID NO: 2118297 - protein, 12 aa, Cryptosporidium hominis
QEQNNSSGTSFK

SEQ ID NO: 2118298 - protein, 14 aa, Cryptosporidium hominis
QEQSKGGNVVNGPQ

SEQ ID NO: 2118299 - protein, 4 aa, Cryptosporidium hominis
QEQY

SEQ ID NO: 2118300 - protein, 4 aa, Cryptosporidium hominis
QERA

SEQ ID NO: 2118301 - protein, 5 aa, Cryptosporidium hominis
QERAT

SEQ ID NO: 2118302 - protein, 6 aa, Cryptosporidium hominis
QERKKE

SEQ ID NO: 2118303 - protein, 13 aa, Cryptosporidium hominis
QESDEGFSLSSTD

SEQ ID NO: 2118304 - protein, 5 aa, Cryptosporidium hominis
QESDL

SEQ ID NO: 2118305 - protein, 16 aa, Cryptosporidium hominis
QESEDEQNKQEEYENF

SEQ ID NO: 2118306 - protein, 21 aa, Cryptosporidium hominis
QESKSETESPKSNQDNAGKYE

SEQ ID NO: 2118307 - protein, 5 aa, Cryptosporidium hominis
QESMK

SEQ ID NO: 2118308 - protein, 11 aa, Cryptosporidium hominis
QETINTNTDPI

SEQ ID NO: 2118309 - protein, 20 aa, Cryptosporidium hominis
QEVENEVNPEAKLKTGNTNV

SEQ ID NO: 2118310 - protein, 7 aa, Cryptosporidium hominis
QFAKTNT

SEQ ID NO: 2118311 - protein, 9 aa, Cryptosporidium hominis
QFNNGTESE

SEQ ID NO: 2118312 - protein, 6 aa, Cryptosporidium hominis
QFSAGQ

SEQ ID NO: 2118313 - protein, 9 aa, Cryptosporidium hominis
QFSSEKKKF

SEQ ID NO: 2118314 - protein, 25 aa, Cryptosporidium hominis
QFSTKGSSCSSTNTYSRSSLSSTLD

SEQ ID NO: 2118315 - protein, 15 aa, Cryptosporidium hominis
QGDFTSLDNQTLDKH

SEQ ID NO: 2118316 - protein, 7 aa, Cryptosporidium hominis
QGDLSSK

SEQ ID NO: 2118317 - protein, 11 aa, Cryptosporidium hominis
QGDSSQPSPLK

SEQ ID NO: 2118318 - protein, 10 aa, Cryptosporidium hominis
QGENSKGSKG

SEQ ID NO: 2118319 - protein, 11 aa, Cryptosporidium hominis
QGETNSGPKKT

SEQ ID NO: 2118320 - protein, 7 aa, Cryptosporidium hominis
QGGWQPP

SEQ ID NO: 2118321 - protein, 4 aa, Cryptosporidium hominis
QGHL

SEQ ID NO: 2118322 - protein, 5 aa, Cryptosporidium hominis
QGKNQ

SEQ ID NO: 2118323 - protein, 4 aa, Cryptosporidium hominis
QGLA

SEQ ID NO: 2118324 - protein, 12 aa, Cryptosporidium hominis
QGNNIGNNTGKT

SEQ ID NO: 2118325 - protein, 8 aa, Cryptosporidium hominis
QGNSYYKK

SEQ ID NO: 2118326 - protein, 12 aa, Cryptosporidium hominis
QGNTSDKTKRME

SEQ ID NO: 2118327 - protein, 21 aa, Cryptosporidium hominis
QGPSANTTNEDKLELESSKSS

SEQ ID NO: 2118328 - protein, 16 aa, Cryptosporidium hominis
QGPSYSLREPPSPFKT

SEQ ID NO: 2118329 - protein, 22 aa, Cryptosporidium hominis
QGQQNHNPYGQQYPYYNQQYRG

SEQ ID NO: 2118330 - protein, 4 aa, Cryptosporidium hominis
QGSP

SEQ ID NO: 2118331 - protein, 8 aa, Cryptosporidium hominis
QGSPLNEF

SEQ ID NO: 2118332 - protein, 7 aa, Cryptosporidium hominis
QGSRYDA

SEQ ID NO: 2118333 - protein, 11 aa, Cryptosporidium hominis
QGSSRRRSSLS

SEQ ID NO: 2118334 - protein, 4 aa, Cryptosporidium hominis
QGTM

SEQ ID NO: 2118335 - protein, 7 aa, Cryptosporidium hominis
QGVESSR

SEQ ID NO: 2118336 - protein, 5 aa, Cryptosporidium hominis
QGVGT

SEQ ID NO: 2118337 - protein, 18 aa, Cryptosporidium hominis
QGVNEQNGNSKNDEEMSS

SEQ ID NO: 2118338 - protein, 11 aa, Cryptosporidium hominis
QGVTNNQNSIT

SEQ ID NO: 2118339 - protein, 5 aa, Cryptosporidium hominis
QGWNE

SEQ ID NO: 2118340 - protein, 6 aa, Cryptosporidium hominis
QGYSKE

SEQ ID NO: 2118341 - protein, 8 aa, Cryptosporidium hominis
QHKGELSR

SEQ ID NO: 2118342 - protein, 10 aa, Cryptosporidium hominis
QHNSNNENYE

SEQ ID NO: 2118343 - protein, 12 aa, Cryptosporidium hominis
QHPLNRPQDNRY

SEQ ID NO: 2118344 - protein, 12 aa, Cryptosporidium hominis
QHQPTDSNSIYQ

SEQ ID NO: 2118345 - protein, 14 aa, Cryptosporidium hominis
QHSRLESQGNSNFD

SEQ ID NO: 2118346 - protein, 12 aa, Cryptosporidium hominis
QHYPGSKSETRL

SEQ ID NO: 2118347 - protein, 8 aa, Cryptosporidium hominis
QIDGTEIS

SEQ ID NO: 2118348 - protein, 10 aa, Cryptosporidium hominis
QIDQQEKNGD

SEQ ID NO: 2118349 - protein, 20 aa, Cryptosporidium hominis
QIEEQKKLSYSSPEKNSGVG

SEQ ID NO: 2118350 - protein, 7 aa, Cryptosporidium hominis
QIKENPR

SEQ ID NO: 2118351 - protein, 5 aa, Cryptosporidium hominis
QIKSK

SEQ ID NO: 2118352 - protein, 10 aa, Cryptosporidium hominis
QINDNNSSLL

SEQ ID NO: 2118353 - protein, 18 aa, Cryptosporidium hominis
QINNSSGGSSMGSYGTNK

SEQ ID NO: 2118354 - protein, 8 aa, Cryptosporidium hominis
QINPTNNL

SEQ ID NO: 2118355 - protein, 5 aa, Cryptosporidium hominis
QISEP

SEQ ID NO: 2118356 - protein, 6 aa, Cryptosporidium hominis
QISESE

SEQ ID NO: 2118357 - protein, 5 aa, Cryptosporidium hominis
QISGI

SEQ ID NO: 2118358 - protein, 7 aa, Cryptosporidium hominis
QISHPRN

SEQ ID NO: 2118359 - protein, 5 aa, Cryptosporidium hominis
QISKE

SEQ ID NO: 2118360 - protein, 9 aa, Cryptosporidium hominis
QISKSSSYI

SEQ ID NO: 2118361 - protein, 10 aa, Cryptosporidium hominis
QISPDPRRRY

SEQ ID NO: 2118362 - protein, 7 aa, Cryptosporidium hominis
QISPGEA

SEQ ID NO: 2118363 - protein, 27 aa, Cryptosporidium hominis
QISPLSSSSFHSTKSQEQDIGRDQSMD

SEQ ID NO: 2118364 - protein, 21 aa, Cryptosporidium hominis
QITNDQANSLISTENSYLSNE

SEQ ID NO: 2118365 - protein, 11 aa, Cryptosporidium hominis
QITNNTRESYS

SEQ ID NO: 2118366 - protein, 11 aa, Cryptosporidium hominis
QITSGSGSQIY

SEQ ID NO: 2118367 - protein, 10 aa, Cryptosporidium hominis
QKAHAREKRR

SEQ ID NO: 2118368 - protein, 15 aa, Cryptosporidium hominis
QKASETTEDTPLGKK

SEQ ID NO: 2118369 - protein, 15 aa, Cryptosporidium hominis
QKDETEEIEQDGIQG

SEQ ID NO: 2118370 - protein, 10 aa, Cryptosporidium hominis
QKDGNHSNSQ

SEQ ID NO: 2118371 - protein, 4 aa, Cryptosporidium hominis
QKEE

SEQ ID NO: 2118372 - protein, 9 aa, Cryptosporidium hominis
QKENEKYKF

SEQ ID NO: 2118373 - protein, 8 aa, Cryptosporidium hominis
QKENGYSN

SEQ ID NO: 2118374 - protein, 18 aa, Cryptosporidium hominis
QKENSERLTTPTQGEQDV

SEQ ID NO: 2118375 - protein, 5 aa, Cryptosporidium hominis
QKEQQ

SEQ ID NO: 2118376 - protein, 28 aa, Cryptosporidium hominis
QKESSEASKDSNATTTTVKGKKGEYNNG

SEQ ID NO: 2118377 - protein, 8 aa, Cryptosporidium hominis
QKESSSKG

SEQ ID NO: 2118378 - protein, 12 aa, Cryptosporidium hominis
QKETSESPCKPN

SEQ ID NO: 2118379 - protein, 7 aa, Cryptosporidium hominis
QKGGKTL

SEQ ID NO: 2118380 - protein, 5 aa, Cryptosporidium hominis
QKGHV

SEQ ID NO: 2118381 - protein, 10 aa, Cryptosporidium hominis
QKGSGKETYS

SEQ ID NO: 2118382 - protein, 5 aa, Cryptosporidium hominis
QKIMT

SEQ ID NO: 2118383 - protein, 8 aa, Cryptosporidium hominis
QKIQPHNP

SEQ ID NO: 2118384 - protein, 11 aa, Cryptosporidium hominis
QKISKKSENMD

SEQ ID NO: 2118385 - protein, 18 aa, Cryptosporidium hominis
QKKPETEVSSNNNNRIPI

SEQ ID NO: 2118386 - protein, 13 aa, Cryptosporidium hominis
QKKSPKNSPFQTS

SEQ ID NO: 2118387 - protein, 22 aa, Cryptosporidium hominis
QKLEQEAEKEIRDIENDDNDQI

SEQ ID NO: 2118388 - protein, 4 aa, Cryptosporidium hominis
QKLT

SEQ ID NO: 2118389 - protein, 7 aa, Cryptosporidium hominis
QKNKRTM

SEQ ID NO: 2118390 - protein, 11 aa, Cryptosporidium hominis
QKNNSLVEEDN

SEQ ID NO: 2118391 - protein, 8 aa, Cryptosporidium hominis
QKNPITNG

SEQ ID NO: 2118392 - protein, 10 aa, Cryptosporidium hominis
QKNSQKNTNL

SEQ ID NO: 2118393 - protein, 8 aa, Cryptosporidium hominis
QKPENIEG

SEQ ID NO: 2118394 - protein, 10 aa, Cryptosporidium hominis
QKPENNDSNL

SEQ ID NO: 2118395 - protein, 12 aa, Cryptosporidium hominis
QKPIKKKLPKLS

SEQ ID NO: 2118396 - protein, 15 aa, Cryptosporidium hominis
QKPTDEEISQMKSGQ

SEQ ID NO: 2118397 - protein, 9 aa, Cryptosporidium hominis
QKQESTSKM

SEQ ID NO: 2118398 - protein, 27 aa, Cryptosporidium hominis
QKQEVTETSIKAPSKVKKKSEKKEEAL

SEQ ID NO: 2118399 - protein, 8 aa, Cryptosporidium hominis
QKRDQKME

SEQ ID NO: 2118400 - protein, 7 aa, Cryptosporidium hominis
QKREDLK

SEQ ID NO: 2118401 - protein, 8 aa, Cryptosporidium hominis
QKRESAPE

SEQ ID NO: 2118402 - protein, 8 aa, Cryptosporidium hominis
QKRQNSLP

SEQ ID NO: 2118403 - protein, 9 aa, Cryptosporidium hominis
QKRSCQGGF

SEQ ID NO: 2118404 - protein, 34 aa, Cryptosporidium hominis
QKSEGTTQNPNNMKETSNQNTPSSPTPELPADQC

SEQ ID NO: 2118405 - protein, 9 aa, Cryptosporidium hominis
QKSKKKSKI

SEQ ID NO: 2118406 - protein, 4 aa, Cryptosporidium hominis
QKSN

SEQ ID NO: 2118407 - protein, 12 aa, Cryptosporidium hominis
QKSVNESYTQDR

SEQ ID NO: 2118408 - protein, 14 aa, Cryptosporidium hominis
QKSYGTTSAGHAYG

SEQ ID NO: 2118409 - protein, 8 aa, Cryptosporidium hominis
QKSYPNKN

SEQ ID NO: 2118410 - protein, 23 aa, Cryptosporidium hominis
QKTAQGIQKASTVDRVGNTNRTR

SEQ ID NO: 2118411 - protein, 4 aa, Cryptosporidium hominis
QKTN

SEQ ID NO: 2118412 - protein, 7 aa, Cryptosporidium hominis
QKTPKLE

SEQ ID NO: 2118413 - protein, 10 aa, Cryptosporidium hominis
QKTSSKLNTP

SEQ ID NO: 2118414 - protein, 9 aa, Cryptosporidium hominis
QKYEKSVPK

SEQ ID NO: 2118415 - protein, 8 aa, Cryptosporidium hominis
QKYNQYHS

SEQ ID NO: 2118416 - protein, 5 aa, Cryptosporidium hominis
QLDES

SEQ ID NO: 2118417 - protein, 7 aa, Cryptosporidium hominis
QLDGETD

SEQ ID NO: 2118418 - protein, 11 aa, Cryptosporidium hominis
QLEDSNQEQYY

SEQ ID NO: 2118419 - protein, 6 aa, Cryptosporidium hominis
QLEGKY

SEQ ID NO: 2118420 - protein, 10 aa, Cryptosporidium hominis
QLEKNKENLY

SEQ ID NO: 2118421 - protein, 8 aa, Cryptosporidium hominis
QLGREAKA

SEQ ID NO: 2118422 - protein, 10 aa, Cryptosporidium hominis
QLGSNSTESK

SEQ ID NO: 2118423 - protein, 12 aa, Cryptosporidium hominis
QLKAERKSNPQL

SEQ ID NO: 2118424 - protein, 45 aa, Cryptosporidium hominis
QLNANSNGSFNDKEENGNKLKNKKNKKAKKHTKNKENGLNTKDRD

SEQ ID NO: 2118425 - protein, 5 aa, Cryptosporidium hominis
QLNPN

SEQ ID NO: 2118426 - protein, 4 aa, Cryptosporidium hominis
QLNS

SEQ ID NO: 2118427 - protein, 6 aa, Cryptosporidium hominis
QLQTNQ

SEQ ID NO: 2118428 - protein, 24 aa, Cryptosporidium hominis
QLRKTRSASDLIGEKRGSIEITTR

SEQ ID NO: 2118429 - protein, 12 aa, Cryptosporidium hominis
QLSNTGNASKHT

SEQ ID NO: 2118430 - protein, 5 aa, Cryptosporidium hominis
QLTGF

SEQ ID NO: 2118431 - protein, 7 aa, Cryptosporidium hominis
QMGSNGE

SEQ ID NO: 2118432 - protein, 5 aa, Cryptosporidium hominis
QMNHS

SEQ ID NO: 2118433 - protein, 5 aa, Cryptosporidium hominis
QMRTK

SEQ ID NO: 2118434 - protein, 7 aa, Cryptosporidium hominis
QNAPRKT

SEQ ID NO: 2118435 - protein, 21 aa, Cryptosporidium hominis
QNDCEHTSGVEDNADEIRVTN

SEQ ID NO: 2118436 - protein, 6 aa, Cryptosporidium hominis
QNDPIE

SEQ ID NO: 2118437 - protein, 18 aa, Cryptosporidium hominis
QNDPNDKSKNDKSKKSME

SEQ ID NO: 2118438 - protein, 5 aa, Cryptosporidium hominis
QNDQI

SEQ ID NO: 2118439 - protein, 15 aa, Cryptosporidium hominis
QNDQNSPDENQFRNN

SEQ ID NO: 2118440 - protein, 6 aa, Cryptosporidium hominis
QNDSME

SEQ ID NO: 2118441 - protein, 12 aa, Cryptosporidium hominis
QNEESKDVPNSI

SEQ ID NO: 2118442 - protein, 11 aa, Cryptosporidium hominis
QNEINNENNYS

SEQ ID NO: 2118443 - protein, 14 aa, Cryptosporidium hominis
QNENNQQEQTFSDE

SEQ ID NO: 2118444 - protein, 12 aa, Cryptosporidium hominis
QNESSNDKLSCT

SEQ ID NO: 2118445 - protein, 9 aa, Cryptosporidium hominis
QNGGNPENI

SEQ ID NO: 2118446 - protein, 9 aa, Cryptosporidium hominis
QNGITRGNI

SEQ ID NO: 2118447 - protein, 14 aa, Cryptosporidium hominis
QNGNLGNKQKFNNS

SEQ ID NO: 2118448 - protein, 17 aa, Cryptosporidium hominis
QNGTDTNNTNTQSQSDQ

SEQ ID NO: 2118449 - protein, 8 aa, Cryptosporidium hominis
QNHEDKTT

SEQ ID NO: 2118450 - protein, 10 aa, Cryptosporidium hominis
QNIKEEQNTQ

SEQ ID NO: 2118451 - protein, 4 aa, Cryptosporidium hominis
QNIP

SEQ ID NO: 2118452 - protein, 5 aa, Cryptosporidium hominis
QNISS

SEQ ID NO: 2118453 - protein, 4 aa, Cryptosporidium hominis
QNKD

SEQ ID NO: 2118454 - protein, 7 aa, Cryptosporidium hominis
QNKNLND

SEQ ID NO: 2118455 - protein, 10 aa, Cryptosporidium hominis
QNKNNSNRIS

SEQ ID NO: 2118456 - protein, 19 aa, Cryptosporidium hominis
QNKPQDSKSTTTTTTTKKV

SEQ ID NO: 2118457 - protein, 10 aa, Cryptosporidium hominis
QNKQENAVKS

SEQ ID NO: 2118458 - protein, 4 aa, Cryptosporidium hominis
QNND

SEQ ID NO: 2118459 - protein, 8 aa, Cryptosporidium hominis
QNNDENQI

SEQ ID NO: 2118460 - protein, 5 aa, Cryptosporidium hominis
QNNIG

SEQ ID NO: 2118461 - protein, 9 aa, Cryptosporidium hominis
QNNNVESKF

SEQ ID NO: 2118462 - protein, 11 aa, Cryptosporidium hominis
QNNQKDDDQPC

SEQ ID NO: 2118463 - protein, 7 aa, Cryptosporidium hominis
QNNQNEN

SEQ ID NO: 2118464 - protein, 10 aa, Cryptosporidium hominis
QNNSGSDSWN

SEQ ID NO: 2118465 - protein, 11 aa, Cryptosporidium hominis
QNNSLTPYSST

SEQ ID NO: 2118466 - protein, 13 aa, Cryptosporidium hominis
QNNSSGYATPPTL

SEQ ID NO: 2118467 - protein, 7 aa, Cryptosporidium hominis
QNNTSIN

SEQ ID NO: 2118468 - protein, 7 aa, Cryptosporidium hominis
QNPDSLP

SEQ ID NO: 2118469 - protein, 5 aa, Cryptosporidium hominis
QNPKE

SEQ ID NO: 2118470 - protein, 7 aa, Cryptosporidium hominis
QNQDNNQ

SEQ ID NO: 2118471 - protein, 7 aa, Cryptosporidium hominis
QNQENTM

SEQ ID NO: 2118472 - protein, 8 aa, Cryptosporidium hominis
QNQNNNYQ

SEQ ID NO: 2118473 - protein, 12 aa, Cryptosporidium hominis
QNQSFKNLNEPK

SEQ ID NO: 2118474 - protein, 34 aa, Cryptosporidium hominis
QNQSSNEISSFNSSSVSNSYSNERSQSEQTEKTY

SEQ ID NO: 2118475 - protein, 21 aa, Cryptosporidium hominis
QNQTDLNDREQLNKNKDTNQI

SEQ ID NO: 2118476 - protein, 6 aa, Cryptosporidium hominis
QNRDLN

SEQ ID NO: 2118477 - protein, 6 aa, Cryptosporidium hominis
QNRGKN

SEQ ID NO: 2118478 - protein, 6 aa, Cryptosporidium hominis
QNRNSW

SEQ ID NO: 2118479 - protein, 7 aa, Cryptosporidium hominis
QNSITST

SEQ ID NO: 2118480 - protein, 13 aa, Cryptosporidium hominis
QNSKDDFPSRKQI

SEQ ID NO: 2118481 - protein, 49 aa, Cryptosporidium hominis
QNSNKSEISNPSEHNLPAKSITSTTTNATTAVASTEITTMPSKDNQINQ

SEQ ID NO: 2118482 - protein, 9 aa, Cryptosporidium hominis
QNSNPSISS

SEQ ID NO: 2118483 - protein, 6 aa, Cryptosporidium hominis
QNSPQH

SEQ ID NO: 2118484 - protein, 4 aa, Cryptosporidium hominis
QNSQ

SEQ ID NO: 2118485 - protein, 19 aa, Cryptosporidium hominis
QNSTIKARGTASSYSSSDF

SEQ ID NO: 2118486 - protein, 25 aa, Cryptosporidium hominis
QNSTLNNNNTCNIGRSKSDLGNSRK

SEQ ID NO: 2118487 - protein, 6 aa, Cryptosporidium hominis
QNSVNN

SEQ ID NO: 2118488 - protein, 5 aa, Cryptosporidium hominis
QNTAQ

SEQ ID NO: 2118489 - protein, 5 aa, Cryptosporidium hominis
QNTIQ

SEQ ID NO: 2118490 - protein, 9 aa, Cryptosporidium hominis
QNTNDNYNT

SEQ ID NO: 2118491 - protein, 7 aa, Cryptosporidium hominis
QNVQTDL

SEQ ID NO: 2118492 - protein, 11 aa, Cryptosporidium hominis
QNYDEIRDEEN

SEQ ID NO: 2118493 - protein, 24 aa, Cryptosporidium hominis
QNYGNGQSAVNNSYYQNNQNQNYY

SEQ ID NO: 2118494 - protein, 6 aa, Cryptosporidium hominis
QNYGSN

SEQ ID NO: 2118495 - protein, 7 aa, Cryptosporidium hominis
QNYSKST

SEQ ID NO: 2118496 - protein, 8 aa, Cryptosporidium hominis
QPDFTGES

SEQ ID NO: 2118497 - protein, 4 aa, Cryptosporidium hominis
QPDI

SEQ ID NO: 2118498 - protein, 7 aa, Cryptosporidium hominis
QPDSDTN

SEQ ID NO: 2118499 - protein, 5 aa, Cryptosporidium hominis
QPDSS

SEQ ID NO: 2118500 - protein, 5 aa, Cryptosporidium hominis
QPEDK

SEQ ID NO: 2118501 - protein, 6 aa, Cryptosporidium hominis
QPENSL

SEQ ID NO: 2118502 - protein, 15 aa, Cryptosporidium hominis
QPERNNAQNFTNGNQ

SEQ ID NO: 2118503 - protein, 9 aa, Cryptosporidium hominis
QPESIPSNL

SEQ ID NO: 2118504 - protein, 6 aa, Cryptosporidium hominis
QPFSSQ

SEQ ID NO: 2118505 - protein, 5 aa, Cryptosporidium hominis
QPGHS

SEQ ID NO: 2118506 - protein, 11 aa, Cryptosporidium hominis
QPIQSKREASK

SEQ ID NO: 2118507 - protein, 9 aa, Cryptosporidium hominis
QPKTTEESS

SEQ ID NO: 2118508 - protein, 6 aa, Cryptosporidium hominis
QPPHMK

SEQ ID NO: 2118509 - protein, 5 aa, Cryptosporidium hominis
QPPTT

SEQ ID NO: 2118510 - protein, 7 aa, Cryptosporidium hominis
QPPYGGA

SEQ ID NO: 2118511 - protein, 16 aa, Cryptosporidium hominis
QPQVTHSKRSETRNNT

SEQ ID NO: 2118512 - protein, 11 aa, Cryptosporidium hominis
QPRETKSPIAY

SEQ ID NO: 2118513 - protein, 12 aa, Cryptosporidium hominis
QPSATLDQDSEY

SEQ ID NO: 2118514 - protein, 6 aa, Cryptosporidium hominis
QPSGSI

SEQ ID NO: 2118515 - protein, 23 aa, Cryptosporidium hominis
QPSRPTSISSPSFKSGNSYGSPV

SEQ ID NO: 2118516 - protein, 8 aa, Cryptosporidium hominis
QPSTEEKQ

SEQ ID NO: 2118517 - protein, 5 aa, Cryptosporidium hominis
QPTGS

SEQ ID NO: 2118518 - protein, 5 aa, Cryptosporidium hominis
QPVST

SEQ ID NO: 2118519 - protein, 8 aa, Cryptosporidium hominis
QPWSNGKV

SEQ ID NO: 2118520 - protein, 5 aa, Cryptosporidium hominis
QPYSD

SEQ ID NO: 2118521 - protein, 5 aa, Cryptosporidium hominis
QQASN

SEQ ID NO: 2118522 - protein, 6 aa, Cryptosporidium hominis
QQDPSK

SEQ ID NO: 2118523 - protein, 7 aa, Cryptosporidium hominis
QQEEMEE

SEQ ID NO: 2118524 - protein, 9 aa, Cryptosporidium hominis
QQEHASDDS

SEQ ID NO: 2118525 - protein, 4 aa, Cryptosporidium hominis
QQEM

SEQ ID NO: 2118526 - protein, 6 aa, Cryptosporidium hominis
QQENDD

SEQ ID NO: 2118527 - protein, 9 aa, Cryptosporidium hominis
QQEPIQQEN

SEQ ID NO: 2118528 - protein, 5 aa, Cryptosporidium hominis
QQEVR

SEQ ID NO: 2118529 - protein, 13 aa, Cryptosporidium hominis
QQGFPSSGGYYQS

SEQ ID NO: 2118530 - protein, 15 aa, Cryptosporidium hominis
QQIYGNETNNTRGTC

SEQ ID NO: 2118531 - protein, 8 aa, Cryptosporidium hominis
QQKDQAIQ

SEQ ID NO: 2118532 - protein, 22 aa, Cryptosporidium hominis
QQNQKKDLSKNNLDSDKHLSEN

SEQ ID NO: 2118533 - protein, 8 aa, Cryptosporidium hominis
QQNSSSKV

SEQ ID NO: 2118534 - protein, 7 aa, Cryptosporidium hominis
QQNYNNS

SEQ ID NO: 2118535 - protein, 21 aa, Cryptosporidium hominis
QQPIQGQAHTQHTSHPSLGNS

SEQ ID NO: 2118536 - protein, 6 aa, Cryptosporidium hominis
QQPKDL

SEQ ID NO: 2118537 - protein, 7 aa, Cryptosporidium hominis
QQPPPSY

SEQ ID NO: 2118538 - protein, 6 aa, Cryptosporidium hominis
QQQFNS

SEQ ID NO: 2118539 - protein, 9 aa, Cryptosporidium hominis
QQQQIEEQE

SEQ ID NO: 2118540 - protein, 70 aa, Cryptosporidium hominis
QQQQPGSSSQLQPQQYQAQQYHPQQHPQQHPQQHPQQHPQQQQHPQQQQQHPQQQQQHHQQQIQQNQHSI

SEQ ID NO: 2118541 - protein, 6 aa, Cryptosporidium hominis
QQSGFS

SEQ ID NO: 2118542 - protein, 18 aa, Cryptosporidium hominis
QQSQIQNQVSTKSQRSSS

SEQ ID NO: 2118543 - protein, 8 aa, Cryptosporidium hominis
QQSTENKY

SEQ ID NO: 2118544 - protein, 10 aa, Cryptosporidium hominis
QQTPNLSNNQ

SEQ ID NO: 2118545 - protein, 5 aa, Cryptosporidium hominis
QQTVD

SEQ ID NO: 2118546 - protein, 9 aa, Cryptosporidium hominis
QQVKESNDL

SEQ ID NO: 2118547 - protein, 12 aa, Cryptosporidium hominis
QQVTDPSNYVRV

SEQ ID NO: 2118548 - protein, 14 aa, Cryptosporidium hominis
QQVTPQAQSSHQQH

SEQ ID NO: 2118549 - protein, 5 aa, Cryptosporidium hominis
QQYTD

SEQ ID NO: 2118550 - protein, 8 aa, Cryptosporidium hominis
QRFSSGEK

SEQ ID NO: 2118551 - protein, 15 aa, Cryptosporidium hominis
QRGASENNSTNTNIG

SEQ ID NO: 2118552 - protein, 6 aa, Cryptosporidium hominis
QRGTQS

SEQ ID NO: 2118553 - protein, 5 aa, Cryptosporidium hominis
QRIDP

SEQ ID NO: 2118554 - protein, 6 aa, Cryptosporidium hominis
QRISRD

SEQ ID NO: 2118555 - protein, 9 aa, Cryptosporidium hominis
QRKLNSDEI

SEQ ID NO: 2118556 - protein, 5 aa, Cryptosporidium hominis
QRKPR

SEQ ID NO: 2118557 - protein, 5 aa, Cryptosporidium hominis
QRPSY

SEQ ID NO: 2118558 - protein, 7 aa, Cryptosporidium hominis
QRPTKEQ

SEQ ID NO: 2118559 - protein, 4 aa, Cryptosporidium hominis
QRRG

SEQ ID NO: 2118560 - protein, 5 aa, Cryptosporidium hominis
QRRSK

SEQ ID NO: 2118561 - protein, 4 aa, Cryptosporidium hominis
QRSE

SEQ ID NO: 2118562 - protein, 4 aa, Cryptosporidium hominis
QRST

SEQ ID NO: 2118563 - protein, 12 aa, Cryptosporidium hominis
QSAEEDGFETEI

SEQ ID NO: 2118564 - protein, 9 aa, Cryptosporidium hominis
QSATGSTTG

SEQ ID NO: 2118565 - protein, 6 aa, Cryptosporidium hominis
QSCEPC

SEQ ID NO: 2118566 - protein, 11 aa, Cryptosporidium hominis
QSDESKDSENI

SEQ ID NO: 2118567 - protein, 6 aa, Cryptosporidium hominis
QSDKPD

SEQ ID NO: 2118568 - protein, 22 aa, Cryptosporidium hominis
QSDQEIQISSTKSQNDSFHPYS

SEQ ID NO: 2118569 - protein, 7 aa, Cryptosporidium hominis
QSDSDSF

SEQ ID NO: 2118570 - protein, 4 aa, Cryptosporidium hominis
QSEA

SEQ ID NO: 2118571 - protein, 13 aa, Cryptosporidium hominis
QSEANSKKVGMGR

SEQ ID NO: 2118572 - protein, 5 aa, Cryptosporidium hominis
QSEEA

SEQ ID NO: 2118573 - protein, 13 aa, Cryptosporidium hominis
QSEEESRSSTFSS

SEQ ID NO: 2118574 - protein, 8 aa, Cryptosporidium hominis
QSEKNNKR

SEQ ID NO: 2118575 - protein, 6 aa, Cryptosporidium hominis
QSEPPV

SEQ ID NO: 2118576 - protein, 6 aa, Cryptosporidium hominis
QSEQDV

SEQ ID NO: 2118577 - protein, 13 aa, Cryptosporidium hominis
QSERKSAALTAPI

SEQ ID NO: 2118578 - protein, 11 aa, Cryptosporidium hominis
QSFDTSKIRSQ

SEQ ID NO: 2118579 - protein, 38 aa, Cryptosporidium hominis
QSFGDRNSDENIKSEENGDSLEKSIQSPKSNSSSNHSE

SEQ ID NO: 2118580 - protein, 4 aa, Cryptosporidium hominis
QSGI

SEQ ID NO: 2118581 - protein, 5 aa, Cryptosporidium hominis
QSGSN

SEQ ID NO: 2118582 - protein, 6 aa, Cryptosporidium hominis
QSGSSI

SEQ ID NO: 2118583 - protein, 13 aa, Cryptosporidium hominis
QSGTTGIEKDEQK

SEQ ID NO: 2118584 - protein, 4 aa, Cryptosporidium hominis
QSIK

SEQ ID NO: 2118585 - protein, 8 aa, Cryptosporidium hominis
QSIKEDTK

SEQ ID NO: 2118586 - protein, 5 aa, Cryptosporidium hominis
QSIQQ

SEQ ID NO: 2118587 - protein, 4 aa, Cryptosporidium hominis
QSIR

SEQ ID NO: 2118588 - protein, 6 aa, Cryptosporidium hominis
QSKSIY

SEQ ID NO: 2118589 - protein, 9 aa, Cryptosporidium hominis
QSKSRDARK

SEQ ID NO: 2118590 - protein, 13 aa, Cryptosporidium hominis
QSLASDPNWKSGD

SEQ ID NO: 2118591 - protein, 13 aa, Cryptosporidium hominis
QSLEGSSNNVNNM

SEQ ID NO: 2118592 - protein, 14 aa, Cryptosporidium hominis
QSNDNSLESYNKGR

SEQ ID NO: 2118593 - protein, 10 aa, Cryptosporidium hominis
QSNDSSGSRL

SEQ ID NO: 2118594 - protein, 5 aa, Cryptosporidium hominis
QSNGV

SEQ ID NO: 2118595 - protein, 10 aa, Cryptosporidium hominis
QSNNTDSELN

SEQ ID NO: 2118596 - protein, 5 aa, Cryptosporidium hominis
QSNSY

SEQ ID NO: 2118597 - protein, 6 aa, Cryptosporidium hominis
QSNTGD

SEQ ID NO: 2118598 - protein, 8 aa, Cryptosporidium hominis
QSPRSLST

SEQ ID NO: 2118599 - protein, 5 aa, Cryptosporidium hominis
QSPSA

SEQ ID NO: 2118600 - protein, 20 aa, Cryptosporidium hominis
QSQLTGESTGVLKDSNSLDI

SEQ ID NO: 2118601 - protein, 9 aa, Cryptosporidium hominis
QSQSPSRHR

SEQ ID NO: 2118602 - protein, 12 aa, Cryptosporidium hominis
QSRNQKLTNDDF

SEQ ID NO: 2118603 - protein, 6 aa, Cryptosporidium hominis
QSRPSD

SEQ ID NO: 2118604 - protein, 6 aa, Cryptosporidium hominis
QSSDSI

SEQ ID NO: 2118605 - protein, 7 aa, Cryptosporidium hominis
QSSEEEF

SEQ ID NO: 2118606 - protein, 8 aa, Cryptosporidium hominis
QSSIYSSS

SEQ ID NO: 2118607 - protein, 15 aa, Cryptosporidium hominis
QSSNESLGNVEQDDN

SEQ ID NO: 2118608 - protein, 7 aa, Cryptosporidium hominis
QSSSAEK

SEQ ID NO: 2118609 - protein, 7 aa, Cryptosporidium hominis
QSSSPDE

SEQ ID NO: 2118610 - protein, 18 aa, Cryptosporidium hominis
QSSSRGSGGASGGGGGEM

SEQ ID NO: 2118611 - protein, 8 aa, Cryptosporidium hominis
QSSTEISG

SEQ ID NO: 2118612 - protein, 10 aa, Cryptosporidium hominis
QSTATNTNAS

SEQ ID NO: 2118613 - protein, 31 aa, Cryptosporidium hominis
  misc_feature (14)..(14): Xaa can be any naturally occurring amino acid
  misc_feature (30)..(30): Xaa can be any naturally occurring amino acid
QSTEKKDLILACKXSNLYSESRNPRRNRFXR

SEQ ID NO: 2118614 - protein, 7 aa, Cryptosporidium hominis
QSTGKST

SEQ ID NO: 2118615 - protein, 9 aa, Cryptosporidium hominis
QSTGRQPQN

SEQ ID NO: 2118616 - protein, 14 aa, Cryptosporidium hominis
QSTNNTELSSSLYS

SEQ ID NO: 2118617 - protein, 8 aa, Cryptosporidium hominis
QSTQDKEF

SEQ ID NO: 2118618 - protein, 5 aa, Cryptosporidium hominis
QSTTK

SEQ ID NO: 2118619 - protein, 7 aa, Cryptosporidium hominis
QSVDSSF

SEQ ID NO: 2118620 - protein, 5 aa, Cryptosporidium hominis
QSYLE

SEQ ID NO: 2118621 - protein, 6 aa, Cryptosporidium hominis
QTASNG

SEQ ID NO: 2118622 - protein, 8 aa, Cryptosporidium hominis
QTCESNNY

SEQ ID NO: 2118623 - protein, 10 aa, Cryptosporidium hominis
QTDSNDNKVE

SEQ ID NO: 2118624 - protein, 5 aa, Cryptosporidium hominis
QTENV

SEQ ID NO: 2118625 - protein, 9 aa, Cryptosporidium hominis
QTGGDSKTP

SEQ ID NO: 2118626 - protein, 6 aa, Cryptosporidium hominis
QTGRID

SEQ ID NO: 2118627 - protein, 7 aa, Cryptosporidium hominis
QTGSGAT

SEQ ID NO: 2118628 - protein, 5 aa, Cryptosporidium hominis
QTHGN

SEQ ID NO: 2118629 - protein, 5 aa, Cryptosporidium hominis
QTIHN

SEQ ID NO: 2118630 - protein, 4 aa, Cryptosporidium hominis
QTIR

SEQ ID NO: 2118631 - protein, 5 aa, Cryptosporidium hominis
QTNGG

SEQ ID NO: 2118632 - protein, 6 aa, Cryptosporidium hominis
QTNING

SEQ ID NO: 2118633 - protein, 4 aa, Cryptosporidium hominis
QTNN

SEQ ID NO: 2118634 - protein, 6 aa, Cryptosporidium hominis
QTNQGR

SEQ ID NO: 2118635 - protein, 6 aa, Cryptosporidium hominis
QTNQTK

SEQ ID NO: 2118636 - protein, 13 aa, Cryptosporidium hominis
QTNSLSSLNSTHT

SEQ ID NO: 2118637 - protein, 20 aa, Cryptosporidium hominis
QTNSPGKENLSPNSINSKLG

SEQ ID NO: 2118638 - protein, 4 aa, Cryptosporidium hominis
QTPG

SEQ ID NO: 2118639 - protein, 4 aa, Cryptosporidium hominis
QTPM

SEQ ID NO: 2118640 - protein, 6 aa, Cryptosporidium hominis
QTPNRD

SEQ ID NO: 2118641 - protein, 7 aa, Cryptosporidium hominis
QTPPETM

SEQ ID NO: 2118642 - protein, 9 aa, Cryptosporidium hominis
QTPQQIPSS

SEQ ID NO: 2118643 - protein, 13 aa, Cryptosporidium hominis
QTSAEQNLESQPT

SEQ ID NO: 2118644 - protein, 5 aa, Cryptosporidium hominis
QTSFN

SEQ ID NO: 2118645 - protein, 33 aa, Cryptosporidium hominis
QTSPDIDGIDRNGAVSNPEQKHDEGDRAGNGGA

SEQ ID NO: 2118646 - protein, 9 aa, Cryptosporidium hominis
QTSTRSKER

SEQ ID NO: 2118647 - protein, 41 aa, Cryptosporidium hominis
QTTRRCSKNGQRIAKGRRSIPNISKTNNSAENLDPNRQGSL

SEQ ID NO: 2118648 - protein, 9 aa, Cryptosporidium hominis
QTTTNSLSK

SEQ ID NO: 2118649 - protein, 10 aa, Cryptosporidium hominis
QTVPKPQPKT

SEQ ID NO: 2118650 - protein, 6 aa, Cryptosporidium hominis
QTVSVS

SEQ ID NO: 2118651 - protein, 14 aa, Cryptosporidium hominis
QTYGGEKKKKPMTR

SEQ ID NO: 2118652 - protein, 11 aa, Cryptosporidium hominis
QVDPSSIAANN

SEQ ID NO: 2118653 - protein, 4 aa, Cryptosporidium hominis
QVGD

SEQ ID NO: 2118654 - protein, 8 aa, Cryptosporidium hominis
QVLDPTKK

SEQ ID NO: 2118655 - protein, 8 aa, Cryptosporidium hominis
QVNEIGGE

SEQ ID NO: 2118656 - protein, 7 aa, Cryptosporidium hominis
QVNKEDT

SEQ ID NO: 2118657 - protein, 18 aa, Cryptosporidium hominis
QVPSDLPSSSSSSSSSLP

SEQ ID NO: 2118658 - protein, 11 aa, Cryptosporidium hominis
QVSAKKAADYG

SEQ ID NO: 2118659 - protein, 9 aa, Cryptosporidium hominis
QVSNKGQLS

SEQ ID NO: 2118660 - protein, 5 aa, Cryptosporidium hominis
QVSPY

SEQ ID NO: 2118661 - protein, 8 aa, Cryptosporidium hominis
QVSQVSPT

SEQ ID NO: 2118662 - protein, 10 aa, Cryptosporidium hominis
QVTVSSDSLG

SEQ ID NO: 2118663 - protein, 7 aa, Cryptosporidium hominis
QYAEKSE

SEQ ID NO: 2118664 - protein, 13 aa, Cryptosporidium hominis
QYDENGKKIPAKE

SEQ ID NO: 2118665 - protein, 4 aa, Cryptosporidium hominis
QYGE

SEQ ID NO: 2118666 - protein, 6 aa, Cryptosporidium hominis
QYKPGE

SEQ ID NO: 2118667 - protein, 9 aa, Cryptosporidium hominis
QYNEDDETS

SEQ ID NO: 2118668 - protein, 4 aa, Cryptosporidium hominis
QYPD

SEQ ID NO: 2118669 - protein, 8 aa, Cryptosporidium hominis
QYPGDKSW

SEQ ID NO: 2118670 - protein, 6 aa, Cryptosporidium hominis
QYPYPS

SEQ ID NO: 2118671 - protein, 12 aa, Cryptosporidium hominis
QYQDQNSQIPHK

SEQ ID NO: 2118672 - protein, 24 aa, Cryptosporidium hominis
QYQQQQQQQQQQQQQQQQQQHPHS

SEQ ID NO: 2118673 - protein, 5 aa, Cryptosporidium hominis
QYRAS

SEQ ID NO: 2118674 - protein, 6 aa, Cryptosporidium hominis
QYSDNE

SEQ ID NO: 2118675 - protein, 5 aa, Cryptosporidium hominis
QYSPF

SEQ ID NO: 2118676 - protein, 10 aa, Cryptosporidium hominis
QYSRNNRSKN

SEQ ID NO: 2118677 - protein, 4 aa, Cryptosporidium hominis
QYST

SEQ ID NO: 2118678 - protein, 11 aa, Cryptosporidium hominis
QYTEKGSTQEI

SEQ ID NO: 2118679 - protein, 4 aa, Cryptosporidium hominis
RAAS

SEQ ID NO: 2118680 - protein, 7 aa, Cryptosporidium hominis
RADIQTS

SEQ ID NO: 2118681 - protein, 65 aa, Cryptosporidium hominis
RADQTNSYKTVTPMGTSDDLETEDYTVGKNTYTKSDDGYQKDVTKYQSTSTPTETSTTKHTTFDG

SEQ ID NO: 2118682 - protein, 9 aa, Cryptosporidium hominis
RADSSDIPL

SEQ ID NO: 2118683 - protein, 5 aa, Cryptosporidium hominis
RAENH

SEQ ID NO: 2118684 - protein, 7 aa, Cryptosporidium hominis
RAEYKAD

SEQ ID NO: 2118685 - protein, 9 aa, Cryptosporidium hominis
RAGEEIPDS

SEQ ID NO: 2118686 - protein, 14 aa, Cryptosporidium hominis
RAGENDFDTAQNAR

SEQ ID NO: 2118687 - protein, 10 aa, Cryptosporidium hominis
RAGRRGLDDR

SEQ ID NO: 2118688 - protein, 7 aa, Cryptosporidium hominis
RAKHPGR

SEQ ID NO: 2118689 - protein, 20 aa, Cryptosporidium hominis
RAKSAAKKVANAQGNQENGY

SEQ ID NO: 2118690 - protein, 11 aa, Cryptosporidium hominis
RALETKEPISY

SEQ ID NO: 2118691 - protein, 9 aa, Cryptosporidium hominis
RANGNKESK

SEQ ID NO: 2118692 - protein, 15 aa, Cryptosporidium hominis
RANKEREQALQSQGQ

SEQ ID NO: 2118693 - protein, 6 aa, Cryptosporidium hominis
RANNRG

SEQ ID NO: 2118694 - protein, 13 aa, Cryptosporidium hominis
RAPRQDMSSNTQS

SEQ ID NO: 2118695 - protein, 4 aa, Cryptosporidium hominis
RAQD

SEQ ID NO: 2118696 - protein, 4 aa, Cryptosporidium hominis
RASE

SEQ ID NO: 2118697 - protein, 11 aa, Cryptosporidium hominis
RASKEKNNHST

SEQ ID NO: 2118698 - protein, 14 aa, Cryptosporidium hominis
RAYQRSTRLDKREG

SEQ ID NO: 2118699 - protein, 8 aa, Cryptosporidium hominis
RAYSDSQC

SEQ ID NO: 2118700 - protein, 7 aa, Cryptosporidium hominis
RDAGTKG

SEQ ID NO: 2118701 - protein, 17 aa, Cryptosporidium hominis
RDAKKENKEDVEKLQKG

SEQ ID NO: 2118702 - protein, 7 aa, Cryptosporidium hominis
RDCDSKR

SEQ ID NO: 2118703 - protein, 5 aa, Cryptosporidium hominis
RDDLY

SEQ ID NO: 2118704 - protein, 11 aa, Cryptosporidium hominis
RDDYSSSDIGD

SEQ ID NO: 2118705 - protein, 32 aa, Cryptosporidium hominis
RDEEPEHSATTAEEDNNSPQIPEDQDETNDIK

SEQ ID NO: 2118706 - protein, 6 aa, Cryptosporidium hominis
RDESNC

SEQ ID NO: 2118707 - protein, 10 aa, Cryptosporidium hominis
RDGGNSPEHI

SEQ ID NO: 2118708 - protein, 5 aa, Cryptosporidium hominis
RDGSL

SEQ ID NO: 2118709 - protein, 13 aa, Cryptosporidium hominis
RDKESQEQGKTDI

SEQ ID NO: 2118710 - protein, 8 aa, Cryptosporidium hominis
RDKNVNKD

SEQ ID NO: 2118711 - protein, 6 aa, Cryptosporidium hominis
RDKQQF

SEQ ID NO: 2118712 - protein, 10 aa, Cryptosporidium hominis
RDKRSGKSIL

SEQ ID NO: 2118713 - protein, 28 aa, Cryptosporidium hominis
RDNYSNEDISGEMHASSNDRPKARAYKS

SEQ ID NO: 2118714 - protein, 6 aa, Cryptosporidium hominis
RDPKVL

SEQ ID NO: 2118715 - protein, 7 aa, Cryptosporidium hominis
RDPTNSF

SEQ ID NO: 2118716 - protein, 7 aa, Cryptosporidium hominis
RDQVHRQ

SEQ ID NO: 2118717 - protein, 13 aa, Cryptosporidium hominis
RDRGTKKRGIPYG

SEQ ID NO: 2118718 - protein, 9 aa, Cryptosporidium hominis
RDRTSTPLG

SEQ ID NO: 2118719 - protein, 8 aa, Cryptosporidium hominis
RDSENSPI

SEQ ID NO: 2118720 - protein, 8 aa, Cryptosporidium hominis
RDSKRLNQ

SEQ ID NO: 2118721 - protein, 22 aa, Cryptosporidium hominis
RDSLSTLKSSEMSPEQGSGVPK

SEQ ID NO: 2118722 - protein, 7 aa, Cryptosporidium hominis
RDSNRRE

SEQ ID NO: 2118723 - protein, 8 aa, Cryptosporidium hominis
RDTENTEF

SEQ ID NO: 2118724 - protein, 10 aa, Cryptosporidium hominis
RDTSPTDISG

SEQ ID NO: 2118725 - protein, 7 aa, Cryptosporidium hominis
RDYDQDS

SEQ ID NO: 2118726 - protein, 15 aa, Cryptosporidium hominis
REAGGEDEKEQGREM

SEQ ID NO: 2118727 - protein, 7 aa, Cryptosporidium hominis
RECRSGS

SEQ ID NO: 2118728 - protein, 4 aa, Cryptosporidium hominis
REDE

SEQ ID NO: 2118729 - protein, 5 aa, Cryptosporidium hominis
REDGT

SEQ ID NO: 2118730 - protein, 10 aa, Cryptosporidium hominis
REDNQKTPYG

SEQ ID NO: 2118731 - protein, 25 aa, Cryptosporidium hominis
REDNTLSTQKTDESKGINNNESQEL

SEQ ID NO: 2118732 - protein, 13 aa, Cryptosporidium hominis
REEDKSLEKLGSE

SEQ ID NO: 2118733 - protein, 4 aa, Cryptosporidium hominis
REEN

SEQ ID NO: 2118734 - protein, 8 aa, Cryptosporidium hominis
REENERES

SEQ ID NO: 2118735 - protein, 10 aa, Cryptosporidium hominis
REGGIKGDPY

SEQ ID NO: 2118736 - protein, 9 aa, Cryptosporidium hominis
REGKEKPFR

SEQ ID NO: 2118737 - protein, 14 aa, Cryptosporidium hominis
REGSANESNQISQI

SEQ ID NO: 2118738 - protein, 29 aa, Cryptosporidium hominis
REGTNKKNRSNSKNIKGFTNDSSNNSIPY

SEQ ID NO: 2118739 - protein, 4 aa, Cryptosporidium hominis
REIE

SEQ ID NO: 2118740 - protein, 6 aa, Cryptosporidium hominis
REINQK

SEQ ID NO: 2118741 - protein, 11 aa, Cryptosporidium hominis
REKEEERESKR

SEQ ID NO: 2118742 - protein, 9 aa, Cryptosporidium hominis
REKKPTLGC

SEQ ID NO: 2118743 - protein, 4 aa, Cryptosporidium hominis
REKL

SEQ ID NO: 2118744 - protein, 23 aa, Cryptosporidium hominis
RELENEGLNNNSTSILKSENERV

SEQ ID NO: 2118745 - protein, 23 aa, Cryptosporidium hominis
RELERGSPYNPSFSRSSEKDRLL

SEQ ID NO: 2118746 - protein, 7 aa, Cryptosporidium hominis
RELNKEN

SEQ ID NO: 2118747 - protein, 6 aa, Cryptosporidium hominis
RENGSF

SEQ ID NO: 2118748 - protein, 27 aa, Cryptosporidium hominis
RENREKQRGNIRSSEIPDEYKNEESIN

SEQ ID NO: 2118749 - protein, 12 aa, Cryptosporidium hominis
RESITSDNSKIK

SEQ ID NO: 2118750 - protein, 7 aa, Cryptosporidium hominis
RESNGDG

SEQ ID NO: 2118751 - protein, 7 aa, Cryptosporidium hominis
RESSNSK

SEQ ID NO: 2118752 - protein, 10 aa, Cryptosporidium hominis
RESTDVPKSQ

SEQ ID NO: 2118753 - protein, 28 aa, Cryptosporidium hominis
RETKGRTNSNKKNVSNYNTDLKVFKDPY

SEQ ID NO: 2118754 - protein, 4 aa, Cryptosporidium hominis
REVL

SEQ ID NO: 2118755 - protein, 4 aa, Cryptosporidium hominis
REYN

SEQ ID NO: 2118756 - protein, 7 aa, Cryptosporidium hominis
REYPRGT

SEQ ID NO: 2118757 - protein, 6 aa, Cryptosporidium hominis
RFKGPK

SEQ ID NO: 2118758 - protein, 32 aa, Cryptosporidium hominis
RFPNRSGHSRSHNRTYTTNMNSGGATSDGLHT

SEQ ID NO: 2118759 - protein, 31 aa, Cryptosporidium hominis
RFPTQGPPQVPPQVPPQAPQMPPPTRDNGDF

SEQ ID NO: 2118760 - protein, 5 aa, Cryptosporidium hominis
RFRPD

SEQ ID NO: 2118761 - protein, 5 aa, Cryptosporidium hominis
RFSEA

SEQ ID NO: 2118762 - protein, 8 aa, Cryptosporidium hominis
RGAKGEVG

SEQ ID NO: 2118763 - protein, 8 aa, Cryptosporidium hominis
RGATNESS

SEQ ID NO: 2118764 - protein, 4 aa, Cryptosporidium hominis
RGDK

SEQ ID NO: 2118765 - protein, 10 aa, Cryptosporidium hominis
RGDRGQLGTG

SEQ ID NO: 2118766 - protein, 4 aa, Cryptosporidium hominis
RGEI

SEQ ID NO: 2118767 - protein, 4 aa, Cryptosporidium hominis
RGFG

SEQ ID NO: 2118768 - protein, 7 aa, Cryptosporidium hominis
RGGEEAD

SEQ ID NO: 2118769 - protein, 6 aa, Cryptosporidium hominis
RGGESA

SEQ ID NO: 2118770 - protein, 20 aa, Cryptosporidium hominis
RGGGAGNSGQGSDSDTDDDD

SEQ ID NO: 2118771 - protein, 4 aa, Cryptosporidium hominis
RGHP

SEQ ID NO: 2118772 - protein, 6 aa, Cryptosporidium hominis
RGHSKN

SEQ ID NO: 2118773 - protein, 4 aa, Cryptosporidium hominis
RGIG

SEQ ID NO: 2118774 - protein, 27 aa, Cryptosporidium hominis
RGKEHAEKRLEEGNSNKKKDEKEKKGL

SEQ ID NO: 2118775 - protein, 8 aa, Cryptosporidium hominis
RGKNVSPS

SEQ ID NO: 2118776 - protein, 8 aa, Cryptosporidium hominis
RGKSRRIQ

SEQ ID NO: 2118777 - protein, 10 aa, Cryptosporidium hominis
RGNDESSIKS

SEQ ID NO: 2118778 - protein, 9 aa, Cryptosporidium hominis
RGNSEVSNK

SEQ ID NO: 2118779 - protein, 5 aa, Cryptosporidium hominis
RGNVY

SEQ ID NO: 2118780 - protein, 4 aa, Cryptosporidium hominis
RGNY

SEQ ID NO: 2118781 - protein, 14 aa, Cryptosporidium hominis
RGPEGISDSSSNSG

SEQ ID NO: 2118782 - protein, 11 aa, Cryptosporidium hominis
RGQEARRDDRV

SEQ ID NO: 2118783 - protein, 7 aa, Cryptosporidium hominis
RGRKDDE

SEQ ID NO: 2118784 - protein, 7 aa, Cryptosporidium hominis
RGRLGYT

SEQ ID NO: 2118785 - protein, 11 aa, Cryptosporidium hominis
RGSIFPPNADQ

SEQ ID NO: 2118786 - protein, 14 aa, Cryptosporidium hominis
RGSNINEKGEGKSQ

SEQ ID NO: 2118787 - protein, 4 aa, Cryptosporidium hominis
RGTA

SEQ ID NO: 2118788 - protein, 7 aa, Cryptosporidium hominis
RGTDGTF

SEQ ID NO: 2118789 - protein, 5 aa, Cryptosporidium hominis
RGTVP

SEQ ID NO: 2118790 - protein, 6 aa, Cryptosporidium hominis
RHIDPT

SEQ ID NO: 2118791 - protein, 9 aa, Cryptosporidium hominis
RHKSSNSGL

SEQ ID NO: 2118792 - protein, 6 aa, Cryptosporidium hominis
RHLKPE

SEQ ID NO: 2118793 - protein, 6 aa, Cryptosporidium hominis
RHPTAD

SEQ ID NO: 2118794 - protein, 5 aa, Cryptosporidium hominis
RHQRK

SEQ ID NO: 2118795 - protein, 4 aa, Cryptosporidium hominis
RHRS

SEQ ID NO: 2118796 - protein, 5 aa, Cryptosporidium hominis
RIAET

SEQ ID NO: 2118797 - protein, 4 aa, Cryptosporidium hominis
RIDE

SEQ ID NO: 2118798 - protein, 10 aa, Cryptosporidium hominis
RIDRNYEKHR

SEQ ID NO: 2118799 - protein, 12 aa, Cryptosporidium hominis
RIENSNKLSNSV

SEQ ID NO: 2118800 - protein, 20 aa, Cryptosporidium hominis
RIESSATGMNNSTGGGSNAN

SEQ ID NO: 2118801 - protein, 14 aa, Cryptosporidium hominis
RIGSSGPLSSKEEL

SEQ ID NO: 2118802 - protein, 6 aa, Cryptosporidium hominis
RINELK

SEQ ID NO: 2118803 - protein, 10 aa, Cryptosporidium hominis
RINSNNDSDQ

SEQ ID NO: 2118804 - protein, 8 aa, Cryptosporidium hominis
RIPGPTAT

SEQ ID NO: 2118805 - protein, 5 aa, Cryptosporidium hominis
RIQED

SEQ ID NO: 2118806 - protein, 5 aa, Cryptosporidium hominis
RIQTQ

SEQ ID NO: 2118807 - protein, 5 aa, Cryptosporidium hominis
RIREE

SEQ ID NO: 2118808 - protein, 11 aa, Cryptosporidium hominis
RISGNNNRGRY

SEQ ID NO: 2118809 - protein, 15 aa, Cryptosporidium hominis
RISNGDVDADCPYRT

SEQ ID NO: 2118810 - protein, 26 aa, Cryptosporidium hominis
RISSDSKYYSDNNYSFKGKRKSRNSL

SEQ ID NO: 2118811 - protein, 4 aa, Cryptosporidium hominis
RIYN

SEQ ID NO: 2118812 - protein, 7 aa, Cryptosporidium hominis
RKATNTM

SEQ ID NO: 2118813 - protein, 18 aa, Cryptosporidium hominis
RKDDQTSEDDLKDDPQNY

SEQ ID NO: 2118814 - protein, 9 aa, Cryptosporidium hominis
RKDDSNNIK

SEQ ID NO: 2118815 - protein, 4 aa, Cryptosporidium hominis
RKDE

SEQ ID NO: 2118816 - protein, 16 aa, Cryptosporidium hominis
RKDRGRRPNSLKNQGC

SEQ ID NO: 2118817 - protein, 10 aa, Cryptosporidium hominis
RKDSEDEDPV

SEQ ID NO: 2118818 - protein, 6 aa, Cryptosporidium hominis
RKEAET

SEQ ID NO: 2118819 - protein, 5 aa, Cryptosporidium hominis
RKEAS

SEQ ID NO: 2118820 - protein, 9 aa, Cryptosporidium hominis
RKEASNSGL

SEQ ID NO: 2118821 - protein, 13 aa, Cryptosporidium hominis
RKEIENEQTTIKK

SEQ ID NO: 2118822 - protein, 10 aa, Cryptosporidium hominis
RKENDKRQYE

SEQ ID NO: 2118823 - protein, 4 aa, Cryptosporidium hominis
RKER

SEQ ID NO: 2118824 - protein, 9 aa, Cryptosporidium hominis
RKETESSCK

SEQ ID NO: 2118825 - protein, 7 aa, Cryptosporidium hominis
RKETKPI

SEQ ID NO: 2118826 - protein, 8 aa, Cryptosporidium hominis
RKEVQEKK

SEQ ID NO: 2118827 - protein, 17 aa, Cryptosporidium hominis
RKFDQSFEAKSPKSPSV

SEQ ID NO: 2118828 - protein, 13 aa, Cryptosporidium hominis
RKFDQSSKGLESE

SEQ ID NO: 2118829 - protein, 5 aa, Cryptosporidium hominis
RKHAT

SEQ ID NO: 2118830 - protein, 6 aa, Cryptosporidium hominis
RKHRIN

SEQ ID NO: 2118831 - protein, 17 aa, Cryptosporidium hominis
RKHTSSANNQQQSGNLR

SEQ ID NO: 2118832 - protein, 11 aa, Cryptosporidium hominis
RKISNNGNNPN

SEQ ID NO: 2118833 - protein, 5 aa, Cryptosporidium hominis
RKITR

SEQ ID NO: 2118834 - protein, 18 aa, Cryptosporidium hominis
RKIYDSQEISYTPRSEYL

SEQ ID NO: 2118835 - protein, 10 aa, Cryptosporidium hominis
RKKCNERNKV

SEQ ID NO: 2118836 - protein, 19 aa, Cryptosporidium hominis
RKKDKDKKTTLEKKEGILD

SEQ ID NO: 2118837 - protein, 9 aa, Cryptosporidium hominis
RKKEDSENN

SEQ ID NO: 2118838 - protein, 13 aa, Cryptosporidium hominis
RKKEKSQEEKRGR

SEQ ID NO: 2118839 - protein, 20 aa, Cryptosporidium hominis
RKKHLNSSEISASTSSSSIW

SEQ ID NO: 2118840 - protein, 10 aa, Cryptosporidium hominis
RKKLSKQQRV

SEQ ID NO: 2118841 - protein, 8 aa, Cryptosporidium hominis
RKKNDVEV

SEQ ID NO: 2118842 - protein, 9 aa, Cryptosporidium hominis
RKKQTAECY

SEQ ID NO: 2118843 - protein, 30 aa, Cryptosporidium hominis
RKKRGNGDNSNNNNKGGELGSEEEDEEEDI

SEQ ID NO: 2118844 - protein, 7 aa, Cryptosporidium hominis
RKKSVEV

SEQ ID NO: 2118845 - protein, 14 aa, Cryptosporidium hominis
RKKTRGGDLTGDNI

SEQ ID NO: 2118846 - protein, 94 aa, Cryptosporidium hominis
RKLEYEEEEEEEEEEEEEEEEEEEEEEEEEEEEEEEEEEEEEEEEEEEEEEEEEEEEEEEEEEEEEEEEEEEEEEEEEEKEEEEEKEEEEEEEV

SEQ ID NO: 2118847 - protein, 6 aa, Cryptosporidium hominis
RKLPGP

SEQ ID NO: 2118848 - protein, 8 aa, Cryptosporidium hominis
RKMKQNDS

SEQ ID NO: 2118849 - protein, 6 aa, Cryptosporidium hominis
RKMKSG

SEQ ID NO: 2118850 - protein, 8 aa, Cryptosporidium hominis
RKNEGNDT

SEQ ID NO: 2118851 - protein, 11 aa, Cryptosporidium hominis
RKNEPSTSDIK

SEQ ID NO: 2118852 - protein, 7 aa, Cryptosporidium hominis
RKNGRKG

SEQ ID NO: 2118853 - protein, 8 aa, Cryptosporidium hominis
RKNINDAA

SEQ ID NO: 2118854 - protein, 9 aa, Cryptosporidium hominis
RKNKKSKQI

SEQ ID NO: 2118855 - protein, 6 aa, Cryptosporidium hominis
RKNKND

SEQ ID NO: 2118856 - protein, 7 aa, Cryptosporidium hominis
RKNQEID

SEQ ID NO: 2118857 - protein, 12 aa, Cryptosporidium hominis
RKNQEKENVEKS

SEQ ID NO: 2118858 - protein, 17 aa, Cryptosporidium hominis
RKNSHNKLSDPNLQDPN

SEQ ID NO: 2118859 - protein, 4 aa, Cryptosporidium hominis
RKPC

SEQ ID NO: 2118860 - protein, 10 aa, Cryptosporidium hominis
RKQEKAKQLN

SEQ ID NO: 2118861 - protein, 14 aa, Cryptosporidium hominis
RKQKKASEEESRIR

SEQ ID NO: 2118862 - protein, 54 aa, Cryptosporidium hominis
RKREKEEQLRSSEANQTSSSDKNSSDSEKSKETTVNNEDNKISSNNIRRRKNRA

SEQ ID NO: 2118863 - protein, 33 aa, Cryptosporidium hominis
RKRHESSERDGKKNSSGRKLDTDSGNDADCEST

SEQ ID NO: 2118864 - protein, 22 aa, Cryptosporidium hominis
RKRSIDDGEEPKSSKYLPTPTC

SEQ ID NO: 2118865 - protein, 11 aa, Cryptosporidium hominis
RKSAESPHTHN

SEQ ID NO: 2118866 - protein, 7 aa, Cryptosporidium hominis
RKSEIEI

SEQ ID NO: 2118867 - protein, 4 aa, Cryptosporidium hominis
RKSF

SEQ ID NO: 2118868 - protein, 6 aa, Cryptosporidium hominis
RKSFSY

SEQ ID NO: 2118869 - protein, 7 aa, Cryptosporidium hominis
RKSHMGS

SEQ ID NO: 2118870 - protein, 7 aa, Cryptosporidium hominis
RKSNGIS

SEQ ID NO: 2118871 - protein, 8 aa, Cryptosporidium hominis
RKSRETGH

SEQ ID NO: 2118872 - protein, 4 aa, Cryptosporidium hominis
RKSS

SEQ ID NO: 2118873 - protein, 6 aa, Cryptosporidium hominis
RKSSEL

SEQ ID NO: 2118874 - protein, 18 aa, Cryptosporidium hominis
RKSSNSGVKNKQNNNESI

SEQ ID NO: 2118875 - protein, 5 aa, Cryptosporidium hominis
RKSTE

SEQ ID NO: 2118876 - protein, 7 aa, Cryptosporidium hominis
RKTEESN

SEQ ID NO: 2118877 - protein, 19 aa, Cryptosporidium hominis
RKTVSEKSELRRKFGKFFL

SEQ ID NO: 2118878 - protein, 12 aa, Cryptosporidium hominis
RKVEGDQLSSGV

SEQ ID NO: 2118879 - protein, 4 aa, Cryptosporidium hominis
RKYE

SEQ ID NO: 2118880 - protein, 6 aa, Cryptosporidium hominis
RKYLSS

SEQ ID NO: 2118881 - protein, 25 aa, Cryptosporidium hominis
RLAKEKELEEKKAKEKEKTESNLAN

SEQ ID NO: 2118882 - protein, 4 aa, Cryptosporidium hominis
RLDN

SEQ ID NO: 2118883 - protein, 13 aa, Cryptosporidium hominis
RLESNGSDTLSNR

SEQ ID NO: 2118884 - protein, 13 aa, Cryptosporidium hominis
RLGTNSTKSHSNP

SEQ ID NO: 2118885 - protein, 8 aa, Cryptosporidium hominis
RLKGREYN

SEQ ID NO: 2118886 - protein, 4 aa, Cryptosporidium hominis
RLNN

SEQ ID NO: 2118887 - protein, 17 aa, Cryptosporidium hominis
RLPESSSSSIDESEKID

SEQ ID NO: 2118888 - protein, 6 aa, Cryptosporidium hominis
RLPRQI

SEQ ID NO: 2118889 - protein, 9 aa, Cryptosporidium hominis
RLPTGKEKG

SEQ ID NO: 2118890 - protein, 6 aa, Cryptosporidium hominis
RLRDGT

SEQ ID NO: 2118891 - protein, 8 aa, Cryptosporidium hominis
RLRPSGST

SEQ ID NO: 2118892 - protein, 11 aa, Cryptosporidium hominis
RLSDPTKQLEN

SEQ ID NO: 2118893 - protein, 17 aa, Cryptosporidium hominis
RLSRPLNNNSINNNKAM

SEQ ID NO: 2118894 - protein, 9 aa, Cryptosporidium hominis
RLSSTGNKL

SEQ ID NO: 2118895 - protein, 8 aa, Cryptosporidium hominis
RMDNTTTN

SEQ ID NO: 2118896 - protein, 8 aa, Cryptosporidium hominis
RMKSSTSM

SEQ ID NO: 2118897 - protein, 29 aa, Cryptosporidium hominis
RMNRNSGDISELKDDDKSPENQRNRELST

SEQ ID NO: 2118898 - protein, 7 aa, Cryptosporidium hominis
RMNSNST

SEQ ID NO: 2118899 - protein, 27 aa, Cryptosporidium hominis
RMSPKEQKKYQEKKDKQQARSRIKLKK

SEQ ID NO: 2118900 - protein, 4 aa, Cryptosporidium hominis
RNAA

SEQ ID NO: 2118901 - protein, 4 aa, Cryptosporidium hominis
RNCV

SEQ ID NO: 2118902 - protein, 7 aa, Cryptosporidium hominis
RNDKKHP

SEQ ID NO: 2118903 - protein, 25 aa, Cryptosporidium hominis
RNDNNNNNNNNNNNNSNNNSNSNSF

SEQ ID NO: 2118904 - protein, 5 aa, Cryptosporidium hominis
RNDRY

SEQ ID NO: 2118905 - protein, 6 aa, Cryptosporidium hominis
RNEDNL

SEQ ID NO: 2118906 - protein, 14 aa, Cryptosporidium hominis
RNEKEDEDSGGKTE

SEQ ID NO: 2118907 - protein, 12 aa, Cryptosporidium hominis
RNENDTVKAKMK

SEQ ID NO: 2118908 - protein, 5 aa, Cryptosporidium hominis
RNETG

SEQ ID NO: 2118909 - protein, 7 aa, Cryptosporidium hominis
RNEYYKS

SEQ ID NO: 2118910 - protein, 5 aa, Cryptosporidium hominis
RNFEE

SEQ ID NO: 2118911 - protein, 8 aa, Cryptosporidium hominis
RNFSKTQL

SEQ ID NO: 2118912 - protein, 6 aa, Cryptosporidium hominis
RNGNDQ

SEQ ID NO: 2118913 - protein, 10 aa, Cryptosporidium hominis
RNGPTSSGFG

SEQ ID NO: 2118914 - protein, 14 aa, Cryptosporidium hominis
RNGSNNNTTQNNHQ

SEQ ID NO: 2118915 - protein, 12 aa, Cryptosporidium hominis
RNIEDQDNWDNK

SEQ ID NO: 2118916 - protein, 24 aa, Cryptosporidium hominis
RNISTSQVSLKQESNIQKSKTNST

SEQ ID NO: 2118917 - protein, 7 aa, Cryptosporidium hominis
RNKEYSH

SEQ ID NO: 2118918 - protein, 65 aa, Cryptosporidium hominis
RNKGGKNGKSQENIASSEEELRNKKYSSSEDLKKEVDTDDEDDDEEEAVQKPPNPNLEKISEGDN

SEQ ID NO: 2118919 - protein, 8 aa, Cryptosporidium hominis
RNKNEKFV

SEQ ID NO: 2118920 - protein, 6 aa, Cryptosporidium hominis
RNKPNC

SEQ ID NO: 2118921 - protein, 5 aa, Cryptosporidium hominis
RNKSN

SEQ ID NO: 2118922 - protein, 10 aa, Cryptosporidium hominis
RNKYTTKSTG

SEQ ID NO: 2118923 - protein, 8 aa, Cryptosporidium hominis
RNLENGKQ

SEQ ID NO: 2118924 - protein, 21 aa, Cryptosporidium hominis
RNNSSKRNDIPVKSRKNAPTF

SEQ ID NO: 2118925 - protein, 10 aa, Cryptosporidium hominis
RNNTPNNETD

SEQ ID NO: 2118926 - protein, 6 aa, Cryptosporidium hominis
RNPSAR

SEQ ID NO: 2118927 - protein, 13 aa, Cryptosporidium hominis
RNPTSREPYERTI

SEQ ID NO: 2118928 - protein, 20 aa, Cryptosporidium hominis
RNQANKQKYSGKSQNKYKTY

SEQ ID NO: 2118929 - protein, 14 aa, Cryptosporidium hominis
RNQNINKNRNESEY

SEQ ID NO: 2118930 - protein, 27 aa, Cryptosporidium hominis
RNQRNEGSAQPASESRSRASGTGGNAA

SEQ ID NO: 2118931 - protein, 6 aa, Cryptosporidium hominis
RNRDPL

SEQ ID NO: 2118932 - protein, 6 aa, Cryptosporidium hominis
RNREDP

SEQ ID NO: 2118933 - protein, 28 aa, Cryptosporidium hominis
RNREIQTNPSKKPRNYSSSYTKYKARYD

SEQ ID NO: 2118934 - protein, 5 aa, Cryptosporidium hominis
RNRQH

SEQ ID NO: 2118935 - protein, 17 aa, Cryptosporidium hominis
RNRRNDLNKEKESKVSV

SEQ ID NO: 2118936 - protein, 9 aa, Cryptosporidium hominis
RNSDLNEDL

SEQ ID NO: 2118937 - protein, 14 aa, Cryptosporidium hominis
RNSETKKSRYSQHS

SEQ ID NO: 2118938 - protein, 18 aa, Cryptosporidium hominis
RNSGNASNMIDSEADEDI

SEQ ID NO: 2118939 - protein, 6 aa, Cryptosporidium hominis
RNSIRK

SEQ ID NO: 2118940 - protein, 9 aa, Cryptosporidium hominis
RNSKGSLES

SEQ ID NO: 2118941 - protein, 8 aa, Cryptosporidium hominis
RNSKTNNA

SEQ ID NO: 2118942 - protein, 13 aa, Cryptosporidium hominis
RNSLGSKQKEPGY

SEQ ID NO: 2118943 - protein, 12 aa, Cryptosporidium hominis
RNSPESTGRRAR

SEQ ID NO: 2118944 - protein, 7 aa, Cryptosporidium hominis
RNSSDYH

SEQ ID NO: 2118945 - protein, 6 aa, Cryptosporidium hominis
RNSSNL

SEQ ID NO: 2118946 - protein, 11 aa, Cryptosporidium hominis
RNSSNSGKKLD

SEQ ID NO: 2118947 - protein, 9 aa, Cryptosporidium hominis
RNSSSSSSV

SEQ ID NO: 2118948 - protein, 5 aa, Cryptosporidium hominis
RNTDE

SEQ ID NO: 2118949 - protein, 8 aa, Cryptosporidium hominis
RNTKNSTF

SEQ ID NO: 2118950 - protein, 4 aa, Cryptosporidium hominis
RNTL

SEQ ID NO: 2118951 - protein, 21 aa, Cryptosporidium hominis
RNTPSPDADPNHKENWTTSNY

SEQ ID NO: 2118952 - protein, 7 aa, Cryptosporidium hominis
RNTRTKA

SEQ ID NO: 2118953 - protein, 4 aa, Cryptosporidium hominis
RNTT

SEQ ID NO: 2118954 - protein, 7 aa, Cryptosporidium hominis
RNVRGGK

SEQ ID NO: 2118955 - protein, 6 aa, Cryptosporidium hominis
RNYDSI

SEQ ID NO: 2118956 - protein, 7 aa, Cryptosporidium hominis
RNYPEYG

SEQ ID NO: 2118957 - protein, 6 aa, Cryptosporidium hominis
RNYQSE

SEQ ID NO: 2118958 - protein, 11 aa, Cryptosporidium hominis
RNYSNNSNLQQ

SEQ ID NO: 2118959 - protein, 4 aa, Cryptosporidium hominis
RPAE

SEQ ID NO: 2118960 - protein, 14 aa, Cryptosporidium hominis
RPDTGGADSDTQSV

SEQ ID NO: 2118961 - protein, 4 aa, Cryptosporidium hominis
RPFG

SEQ ID NO: 2118962 - protein, 7 aa, Cryptosporidium hominis
RPGSSSP

SEQ ID NO: 2118963 - protein, 4 aa, Cryptosporidium hominis
RPKA

SEQ ID NO: 2118964 - protein, 10 aa, Cryptosporidium hominis
RPKNNAETPT

SEQ ID NO: 2118965 - protein, 6 aa, Cryptosporidium hominis
RPKTTA

SEQ ID NO: 2118966 - protein, 18 aa, Cryptosporidium hominis
RPLPAKDLPDLPETDSTN

SEQ ID NO: 2118967 - protein, 11 aa, Cryptosporidium hominis
RPNDSNLEDSR

SEQ ID NO: 2118968 - protein, 11 aa, Cryptosporidium hominis
RPNKSKKKNLI

SEQ ID NO: 2118969 - protein, 6 aa, Cryptosporidium hominis
RPPFTT

SEQ ID NO: 2118970 - protein, 4 aa, Cryptosporidium hominis
RPPN

SEQ ID NO: 2118971 - protein, 9 aa, Cryptosporidium hominis
RPPRRKDDN

SEQ ID NO: 2118972 - protein, 9 aa, Cryptosporidium hominis
RPSEESDSS

SEQ ID NO: 2118973 - protein, 9 aa, Cryptosporidium hominis
RPSEKEAKC

SEQ ID NO: 2118974 - protein, 6 aa, Cryptosporidium hominis
RPSIKQ

SEQ ID NO: 2118975 - protein, 9 aa, Cryptosporidium hominis
RPSPPLPMS

SEQ ID NO: 2118976 - protein, 4 aa, Cryptosporidium hominis
RQDA

SEQ ID NO: 2118977 - protein, 8 aa, Cryptosporidium hominis
RQDGFESS

SEQ ID NO: 2118978 - protein, 9 aa, Cryptosporidium hominis
RQDPYSGKP

SEQ ID NO: 2118979 - protein, 10 aa, Cryptosporidium hominis
RQEENPITQS

SEQ ID NO: 2118980 - protein, 8 aa, Cryptosporidium hominis
RQGPLDEP

SEQ ID NO: 2118981 - protein, 15 aa, Cryptosporidium hominis
RQKDKNYANSEFGEE

SEQ ID NO: 2118982 - protein, 8 aa, Cryptosporidium hominis
RQKKISEL

SEQ ID NO: 2118983 - protein, 7 aa, Cryptosporidium hominis
RQKTEQA

SEQ ID NO: 2118984 - protein, 13 aa, Cryptosporidium hominis
RQLNKNEPEQDRF

SEQ ID NO: 2118985 - protein, 8 aa, Cryptosporidium hominis
RQNGETSF

SEQ ID NO: 2118986 - protein, 29 aa, Cryptosporidium hominis
RQNKKEKKRGISGVTNESKNSNFKSKSSI

SEQ ID NO: 2118987 - protein, 6 aa, Cryptosporidium hominis
RQNREG

SEQ ID NO: 2118988 - protein, 18 aa, Cryptosporidium hominis
RQNTSEIDTKFDSSKEKK

SEQ ID NO: 2118989 - protein, 8 aa, Cryptosporidium hominis
RQQAENNL

SEQ ID NO: 2118990 - protein, 24 aa, Cryptosporidium hominis
RQQSQRRVNQSNSSQTTNQRVGNP

SEQ ID NO: 2118991 - protein, 6 aa, Cryptosporidium hominis
RQRGDT

SEQ ID NO: 2118992 - protein, 4 aa, Cryptosporidium hominis
RQRT

SEQ ID NO: 2118993 - protein, 5 aa, Cryptosporidium hominis
RQSLD

SEQ ID NO: 2118994 - protein, 4 aa, Cryptosporidium hominis
RQSR

SEQ ID NO: 2118995 - protein, 11 aa, Cryptosporidium hominis
RQSTMGGRYGG

SEQ ID NO: 2118996 - protein, 8 aa, Cryptosporidium hominis
RQTSGSPM

SEQ ID NO: 2118997 - protein, 10 aa, Cryptosporidium hominis
RQVSDSNSSC

SEQ ID NO: 2118998 - protein, 6 aa, Cryptosporidium hominis
RQYSSK

SEQ ID NO: 2118999 - protein, 7 aa, Cryptosporidium hominis
RRAASGT

SEQ ID NO: 2119000 - protein, 10 aa, Cryptosporidium hominis
RRANSEEYGI

SEQ ID NO: 2119001 - protein, 7 aa, Cryptosporidium hominis
RRDSVTQ

SEQ ID NO: 2119002 - protein, 8 aa, Cryptosporidium hominis
RREGQSRK

SEQ ID NO: 2119003 - protein, 10 aa, Cryptosporidium hominis
RRERTDDNTC

SEQ ID NO: 2119004 - protein, 5 aa, Cryptosporidium hominis
RRESP

SEQ ID NO: 2119005 - protein, 4 aa, Cryptosporidium hominis
RRGP

SEQ ID NO: 2119006 - protein, 6 aa, Cryptosporidium hominis
RRISAQ

SEQ ID NO: 2119007 - protein, 10 aa, Cryptosporidium hominis
RRKNRDRPKL

SEQ ID NO: 2119008 - protein, 7 aa, Cryptosporidium hominis
RRKPNNG

SEQ ID NO: 2119009 - protein, 9 aa, Cryptosporidium hominis
RRKSNSSTL

SEQ ID NO: 2119010 - protein, 6 aa, Cryptosporidium hominis
RRNNYQ

SEQ ID NO: 2119011 - protein, 5 aa, Cryptosporidium hominis
RRNRS

SEQ ID NO: 2119012 - protein, 9 aa, Cryptosporidium hominis
RRPKKKKIP

SEQ ID NO: 2119013 - protein, 13 aa, Cryptosporidium hominis
RRPNSNPADNPDE

SEQ ID NO: 2119014 - protein, 6 aa, Cryptosporidium hominis
RRPSSN

SEQ ID NO: 2119015 - protein, 4 aa, Cryptosporidium hominis
RRPV

SEQ ID NO: 2119016 - protein, 19 aa, Cryptosporidium hominis
RRQDTSEETKGMDVDEETP

SEQ ID NO: 2119017 - protein, 5 aa, Cryptosporidium hominis
RRQIQ

SEQ ID NO: 2119018 - protein, 16 aa, Cryptosporidium hominis
RRQTKKTTYDYGNQGN

SEQ ID NO: 2119019 - protein, 12 aa, Cryptosporidium hominis
RRRNKKENETNL

SEQ ID NO: 2119020 - protein, 8 aa, Cryptosporidium hominis
RRRQSQME

SEQ ID NO: 2119021 - protein, 4 aa, Cryptosporidium hominis
RRSL

SEQ ID NO: 2119022 - protein, 24 aa, Cryptosporidium hominis
RRSTNDNLLPDESNSNKRNSKLRR

SEQ ID NO: 2119023 - protein, 5 aa, Cryptosporidium hominis
RRSTR

SEQ ID NO: 2119024 - protein, 4 aa, Cryptosporidium hominis
RRTC

SEQ ID NO: 2119025 - protein, 8 aa, Cryptosporidium hominis
RRTPNMSK

SEQ ID NO: 2119026 - protein, 8 aa, Cryptosporidium hominis
RRTSTSEM

SEQ ID NO: 2119027 - protein, 16 aa, Cryptosporidium hominis
RRTTRSSTKQKTPSRK

SEQ ID NO: 2119028 - protein, 6 aa, Cryptosporidium hominis
RRYPSK

SEQ ID NO: 2119029 - protein, 4 aa, Cryptosporidium hominis
RSAE

SEQ ID NO: 2119030 - protein, 6 aa, Cryptosporidium hominis
RSAKTN

SEQ ID NO: 2119031 - protein, 6 aa, Cryptosporidium hominis
RSAPHK

SEQ ID NO: 2119032 - protein, 18 aa, Cryptosporidium hominis
RSDDTESAQNVDNSNKEI

SEQ ID NO: 2119033 - protein, 21 aa, Cryptosporidium hominis
RSDPNSESEQEPLEQQEQSEF

SEQ ID NO: 2119034 - protein, 4 aa, Cryptosporidium hominis
RSDS

SEQ ID NO: 2119035 - protein, 20 aa, Cryptosporidium hominis
RSDSKDEENEKQGQIQPNNR

SEQ ID NO: 2119036 - protein, 12 aa, Cryptosporidium hominis
RSEERKYQSSIK

SEQ ID NO: 2119037 - protein, 5 aa, Cryptosporidium hominis
RSEKE

SEQ ID NO: 2119038 - protein, 7 aa, Cryptosporidium hominis
RSENQEK

SEQ ID NO: 2119039 - protein, 5 aa, Cryptosporidium hominis
RSEVT

SEQ ID NO: 2119040 - protein, 11 aa, Cryptosporidium hominis
RSFSGTGDSVV

SEQ ID NO: 2119041 - protein, 18 aa, Cryptosporidium hominis
RSFSPNSKASKGQLTNDR

SEQ ID NO: 2119042 - protein, 8 aa, Cryptosporidium hominis
RSFSTNKN

SEQ ID NO: 2119043 - protein, 12 aa, Cryptosporidium hominis
RSGDQEEDETSY

SEQ ID NO: 2119044 - protein, 4 aa, Cryptosporidium hominis
RSGK

SEQ ID NO: 2119045 - protein, 7 aa, Cryptosporidium hominis
RSGSGKT

SEQ ID NO: 2119046 - protein, 10 aa, Cryptosporidium hominis
RSGTAATAAE

SEQ ID NO: 2119047 - protein, 4 aa, Cryptosporidium hominis
RSIE

SEQ ID NO: 2119048 - protein, 6 aa, Cryptosporidium hominis
RSINDK

SEQ ID NO: 2119049 - protein, 17 aa, Cryptosporidium hominis
RSISGSVSQGGPSTTEG

SEQ ID NO: 2119050 - protein, 7 aa, Cryptosporidium hominis
RSKFSKN

SEQ ID NO: 2119051 - protein, 14 aa, Cryptosporidium hominis
RSKLEESKKLRSSD

SEQ ID NO: 2119052 - protein, 6 aa, Cryptosporidium hominis
RSKNGE

SEQ ID NO: 2119053 - protein, 10 aa, Cryptosporidium hominis
RSKNVKGDYE

SEQ ID NO: 2119054 - protein, 6 aa, Cryptosporidium hominis
RSKQYL

SEQ ID NO: 2119055 - protein, 6 aa, Cryptosporidium hominis
RSKSGW

SEQ ID NO: 2119056 - protein, 6 aa, Cryptosporidium hominis
RSKSSH

SEQ ID NO: 2119057 - protein, 7 aa, Cryptosporidium hominis
RSKYAKD

SEQ ID NO: 2119058 - protein, 7 aa, Cryptosporidium hominis
RSLGKGY

SEQ ID NO: 2119059 - protein, 7 aa, Cryptosporidium hominis
RSLQNQQ

SEQ ID NO: 2119060 - protein, 6 aa, Cryptosporidium hominis
RSNENM

SEQ ID NO: 2119061 - protein, 10 aa, Cryptosporidium hominis
RSNETNESQV

SEQ ID NO: 2119062 - protein, 5 aa, Cryptosporidium hominis
RSNHE

SEQ ID NO: 2119063 - protein, 5 aa, Cryptosporidium hominis
RSNHL

SEQ ID NO: 2119064 - protein, 6 aa, Cryptosporidium hominis
RSNPEH

SEQ ID NO: 2119065 - protein, 8 aa, Cryptosporidium hominis
RSNRNHGD

SEQ ID NO: 2119066 - protein, 5 aa, Cryptosporidium hominis
RSNSF

SEQ ID NO: 2119067 - protein, 15 aa, Cryptosporidium hominis
RSNSSSSYIQGKLIS

SEQ ID NO: 2119068 - protein, 8 aa, Cryptosporidium hominis
RSNTANKR

SEQ ID NO: 2119069 - protein, 4 aa, Cryptosporidium hominis
RSPC

SEQ ID NO: 2119070 - protein, 4 aa, Cryptosporidium hominis
RSPI

SEQ ID NO: 2119071 - protein, 7 aa, Cryptosporidium hominis
RSPLKSS

SEQ ID NO: 2119072 - protein, 11 aa, Cryptosporidium hominis
RSPNKLKNINQ

SEQ ID NO: 2119073 - protein, 6 aa, Cryptosporidium hominis
RSPRIR

SEQ ID NO: 2119074 - protein, 4 aa, Cryptosporidium hominis
RSPS

SEQ ID NO: 2119075 - protein, 6 aa, Cryptosporidium hominis
RSPSDH

SEQ ID NO: 2119076 - protein, 4 aa, Cryptosporidium hominis
RSQD

SEQ ID NO: 2119077 - protein, 9 aa, Cryptosporidium hominis
RSQLEDNAD

SEQ ID NO: 2119078 - protein, 7 aa, Cryptosporidium hominis
RSQPHAA

SEQ ID NO: 2119079 - protein, 5 aa, Cryptosporidium hominis
RSQVS

SEQ ID NO: 2119080 - protein, 8 aa, Cryptosporidium hominis
RSRPANKI

SEQ ID NO: 2119081 - protein, 32 aa, Cryptosporidium hominis
RSRPSEGTVGECPHSTRRSADRARSGRTGQYR

SEQ ID NO: 2119082 - protein, 12 aa, Cryptosporidium hominis
RSRSGYSQSNQV

SEQ ID NO: 2119083 - protein, 4 aa, Cryptosporidium hominis
RSRT

SEQ ID NO: 2119084 - protein, 14 aa, Cryptosporidium hominis
RSRTTIKNERKDAN

SEQ ID NO: 2119085 - protein, 15 aa, Cryptosporidium hominis
RSRYSQLAKDELNDI

SEQ ID NO: 2119086 - protein, 4 aa, Cryptosporidium hominis
RSSA

SEQ ID NO: 2119087 - protein, 12 aa, Cryptosporidium hominis
RSSGETDTYESS

SEQ ID NO: 2119088 - protein, 5 aa, Cryptosporidium hominis
RSSKT

SEQ ID NO: 2119089 - protein, 8 aa, Cryptosporidium hominis
RSSNEIEN

SEQ ID NO: 2119090 - protein, 25 aa, Cryptosporidium hominis
RSSNRSKTTTSNNRVKRDKYSDDEC

SEQ ID NO: 2119091 - protein, 7 aa, Cryptosporidium hominis
RSSPPKR

SEQ ID NO: 2119092 - protein, 6 aa, Cryptosporidium hominis
RSSPYA

SEQ ID NO: 2119093 - protein, 5 aa, Cryptosporidium hominis
RSSRE

SEQ ID NO: 2119094 - protein, 7 aa, Cryptosporidium hominis
RSSSRQV

SEQ ID NO: 2119095 - protein, 6 aa, Cryptosporidium hominis
RSSYGK

SEQ ID NO: 2119096 - protein, 11 aa, Cryptosporidium hominis
RSTGNNNSSGL

SEQ ID NO: 2119097 - protein, 4 aa, Cryptosporidium hominis
RSTI

SEQ ID NO: 2119098 - protein, 4 aa, Cryptosporidium hominis
RSTL

SEQ ID NO: 2119099 - protein, 9 aa, Cryptosporidium hominis
RSTPSRASM

SEQ ID NO: 2119100 - protein, 11 aa, Cryptosporidium hominis
RSTSDLASKIS

SEQ ID NO: 2119101 - protein, 11 aa, Cryptosporidium hominis
RSYADNNENAK

SEQ ID NO: 2119102 - protein, 4 aa, Cryptosporidium hominis
RTAI

SEQ ID NO: 2119103 - protein, 9 aa, Cryptosporidium hominis
RTAQDRPKP

SEQ ID NO: 2119104 - protein, 7 aa, Cryptosporidium hominis
RTATGEC

SEQ ID NO: 2119105 - protein, 4 aa, Cryptosporidium hominis
RTCS

SEQ ID NO: 2119106 - protein, 6 aa, Cryptosporidium hominis
RTETGK

SEQ ID NO: 2119107 - protein, 8 aa, Cryptosporidium hominis
RTGAGKSS

SEQ ID NO: 2119108 - protein, 5 aa, Cryptosporidium hominis
RTGPY

SEQ ID NO: 2119109 - protein, 7 aa, Cryptosporidium hominis
RTGSATL

SEQ ID NO: 2119110 - protein, 8 aa, Cryptosporidium hominis
RTGSGKST

SEQ ID NO: 2119111 - protein, 8 aa, Cryptosporidium hominis
RTGSGKTS

SEQ ID NO: 2119112 - protein, 8 aa, Cryptosporidium hominis
RTGSGKTT

SEQ ID NO: 2119113 - protein, 4 aa, Cryptosporidium hominis
RTHT

SEQ ID NO: 2119114 - protein, 8 aa, Cryptosporidium hominis
RTIPKSEE

SEQ ID NO: 2119115 - protein, 10 aa, Cryptosporidium hominis
RTKESNEEKS

SEQ ID NO: 2119116 - protein, 4 aa, Cryptosporidium hominis
RTKL

SEQ ID NO: 2119117 - protein, 6 aa, Cryptosporidium hominis
RTMRKK

SEQ ID NO: 2119118 - protein, 6 aa, Cryptosporidium hominis
RTNGRS

SEQ ID NO: 2119119 - protein, 11 aa, Cryptosporidium hominis
RTNIENSNTTI

SEQ ID NO: 2119120 - protein, 4 aa, Cryptosporidium hominis
RTNK

SEQ ID NO: 2119121 - protein, 11 aa, Cryptosporidium hominis
RTNQKDKLPEG

SEQ ID NO: 2119122 - protein, 7 aa, Cryptosporidium hominis
RTNSQSS

SEQ ID NO: 2119123 - protein, 4 aa, Cryptosporidium hominis
RTNT

SEQ ID NO: 2119124 - protein, 10 aa, Cryptosporidium hominis
RTPKKDSNNI

SEQ ID NO: 2119125 - protein, 6 aa, Cryptosporidium hominis
RTPPGA

SEQ ID NO: 2119126 - protein, 6 aa, Cryptosporidium hominis
RTPPSL

SEQ ID NO: 2119127 - protein, 13 aa, Cryptosporidium hominis
RTPSISTVSHPSA

SEQ ID NO: 2119128 - protein, 6 aa, Cryptosporidium hominis
RTQSHN

SEQ ID NO: 2119129 - protein, 10 aa, Cryptosporidium hominis
RTQVETAEVT

SEQ ID NO: 2119130 - protein, 4 aa, Cryptosporidium hominis
RTRR

SEQ ID NO: 2119131 - protein, 12 aa, Cryptosporidium hominis
RTSAEEKNINKR

SEQ ID NO: 2119132 - protein, 6 aa, Cryptosporidium hominis
RTSESL

SEQ ID NO: 2119133 - protein, 16 aa, Cryptosporidium hominis
RTSHSDSQAAGGGSGS

SEQ ID NO: 2119134 - protein, 24 aa, Cryptosporidium hominis
RTSKETLGSKSSCSEYTRKHKANG

SEQ ID NO: 2119135 - protein, 6 aa, Cryptosporidium hominis
RTSLGQ

SEQ ID NO: 2119136 - protein, 13 aa, Cryptosporidium hominis
RTSPDSEIEGKLF

SEQ ID NO: 2119137 - protein, 6 aa, Cryptosporidium hominis
RTSPTS

SEQ ID NO: 2119138 - protein, 16 aa, Cryptosporidium hominis
RTSTKKNDNQKKRRQH

SEQ ID NO: 2119139 - protein, 12 aa, Cryptosporidium hominis
RTTIGKSSLERY

SEQ ID NO: 2119140 - protein, 5 aa, Cryptosporidium hominis
RTYDS

SEQ ID NO: 2119141 - protein, 4 aa, Cryptosporidium hominis
RVEY

SEQ ID NO: 2119142 - protein, 19 aa, Cryptosporidium hominis
RVLGQEKETVKQKTSSVAA

SEQ ID NO: 2119143 - protein, 26 aa, Cryptosporidium hominis
RVSKNAQSSNKEDEDKDEVEKNYKYT

SEQ ID NO: 2119144 - protein, 5 aa, Cryptosporidium hominis
RVTDP

SEQ ID NO: 2119145 - protein, 4 aa, Cryptosporidium hominis
RWSE

SEQ ID NO: 2119146 - protein, 9 aa, Cryptosporidium hominis
RYEQQEKAP

SEQ ID NO: 2119147 - protein, 14 aa, Cryptosporidium hominis
RYGESSKSKPISEC

SEQ ID NO: 2119148 - protein, 5 aa, Cryptosporidium hominis
RYGWG

SEQ ID NO: 2119149 - protein, 9 aa, Cryptosporidium hominis
RYSHEQSSA

SEQ ID NO: 2119150 - protein, 11 aa, Cryptosporidium hominis
RYTTSNKGNHL

SEQ ID NO: 2119151 - protein, 23 aa, Cryptosporidium hominis
SAAGSSSSNTAQAGSMDSEFKNK

SEQ ID NO: 2119152 - protein, 9 aa, Cryptosporidium hominis
SAAKDEEKV

SEQ ID NO: 2119153 - protein, 4 aa, Cryptosporidium hominis
SAAS

SEQ ID NO: 2119154 - protein, 8 aa, Cryptosporidium hominis
SADHNLGP

SEQ ID NO: 2119155 - protein, 20 aa, Cryptosporidium hominis
SADTIEQVNNNKESDKPTVN

SEQ ID NO: 2119156 - protein, 7 aa, Cryptosporidium hominis
SAENKMP

SEQ ID NO: 2119157 - protein, 9 aa, Cryptosporidium hominis
SAESAIPQD

SEQ ID NO: 2119158 - protein, 4 aa, Cryptosporidium hominis
SAFS

SEQ ID NO: 2119159 - protein, 10 aa, Cryptosporidium hominis
SAFSTGSYTS

SEQ ID NO: 2119160 - protein, 10 aa, Cryptosporidium hominis
SAGAPIAGSA

SEQ ID NO: 2119161 - protein, 6 aa, Cryptosporidium hominis
SAGFPN

SEQ ID NO: 2119162 - protein, 6 aa, Cryptosporidium hominis
SAGGEY

SEQ ID NO: 2119163 - protein, 7 aa, Cryptosporidium hominis
SAGGGGG

SEQ ID NO: 2119164 - protein, 13 aa, Cryptosporidium hominis
SAGGVTSAGSFSL

SEQ ID NO: 2119165 - protein, 6 aa, Cryptosporidium hominis
SAGKST

SEQ ID NO: 2119166 - protein, 4 aa, Cryptosporidium hominis
SAGS

SEQ ID NO: 2119167 - protein, 6 aa, Cryptosporidium hominis
SAGSLS

SEQ ID NO: 2119168 - protein, 5 aa, Cryptosporidium hominis
SAGVP

SEQ ID NO: 2119169 - protein, 7 aa, Cryptosporidium hominis
SAIGGKD

SEQ ID NO: 2119170 - protein, 10 aa, Cryptosporidium hominis
SAIPGHGGIT

SEQ ID NO: 2119171 - protein, 4 aa, Cryptosporidium hominis
SAIS

SEQ ID NO: 2119172 - protein, 12 aa, Cryptosporidium hominis
SAISQSDRESVE

SEQ ID NO: 2119173 - protein, 7 aa, Cryptosporidium hominis
SAITSKA

SEQ ID NO: 2119174 - protein, 6 aa, Cryptosporidium hominis
SAKNVY

SEQ ID NO: 2119175 - protein, 8 aa, Cryptosporidium hominis
SAKPEENQ

SEQ ID NO: 2119176 - protein, 6 aa, Cryptosporidium hominis
SALEGA

SEQ ID NO: 2119177 - protein, 27 aa, Cryptosporidium hominis
SALSETRRGANSTPSGNSSGNPSGDHD

SEQ ID NO: 2119178 - protein, 6 aa, Cryptosporidium hominis
SALTGL

SEQ ID NO: 2119179 - protein, 20 aa, Cryptosporidium hominis
SANDSANANNSASADITGSV

SEQ ID NO: 2119180 - protein, 10 aa, Cryptosporidium hominis
SANKNEKAVG

SEQ ID NO: 2119181 - protein, 6 aa, Cryptosporidium hominis
SANNTD

SEQ ID NO: 2119182 - protein, 4 aa, Cryptosporidium hominis
SANR

SEQ ID NO: 2119183 - protein, 11 aa, Cryptosporidium hominis
SANSKTAPKDK

SEQ ID NO: 2119184 - protein, 9 aa, Cryptosporidium hominis
SANSSNCKL

SEQ ID NO: 2119185 - protein, 4 aa, Cryptosporidium hominis
SAPL

SEQ ID NO: 2119186 - protein, 4 aa, Cryptosporidium hominis
SAPN

SEQ ID NO: 2119187 - protein, 6 aa, Cryptosporidium hominis
SAPQVP

SEQ ID NO: 2119188 - protein, 19 aa, Cryptosporidium hominis
SAPSGDNNNSQNQSSKEYC

SEQ ID NO: 2119189 - protein, 16 aa, Cryptosporidium hominis
SAPSKQSYENSDVTPE

SEQ ID NO: 2119190 - protein, 10 aa, Cryptosporidium hominis
SARKGAPLSE

SEQ ID NO: 2119191 - protein, 13 aa, Cryptosporidium hominis
SARLPSDRARETE

SEQ ID NO: 2119192 - protein, 7 aa, Cryptosporidium hominis
SARNEEY

SEQ ID NO: 2119193 - protein, 21 aa, Cryptosporidium hominis
SARRNTESRATVTSIPGPSRR

SEQ ID NO: 2119194 - protein, 12 aa, Cryptosporidium hominis
SASASPSVSTSL

SEQ ID NO: 2119195 - protein, 67 aa, Cryptosporidium hominis
SASEEEKNTTDTGAKTNTNSESSYSSQTDDESELKPQNSSQSEEEDGESKKLKSEMQAEESEFSSDF

SEQ ID NO: 2119196 - protein, 5 aa, Cryptosporidium hominis
SASEL

SEQ ID NO: 2119197 - protein, 16 aa, Cryptosporidium hominis
SASGTIPKQSSLYPGN

SEQ ID NO: 2119198 - protein, 7 aa, Cryptosporidium hominis
SASKAYE

SEQ ID NO: 2119199 - protein, 21 aa, Cryptosporidium hominis
SASLSSSETVKAQNKLEGSGS

SEQ ID NO: 2119200 - protein, 17 aa, Cryptosporidium hominis
SASNNAKTSRGEDNDLS

SEQ ID NO: 2119201 - protein, 5 aa, Cryptosporidium hominis
SASSI

SEQ ID NO: 2119202 - protein, 20 aa, Cryptosporidium hominis
SASSTTPKTNTSFSSNKRNS

SEQ ID NO: 2119203 - protein, 5 aa, Cryptosporidium hominis
SASSV

SEQ ID NO: 2119204 - protein, 16 aa, Cryptosporidium hominis
SASYQKEANTPGSAAY

SEQ ID NO: 2119205 - protein, 19 aa, Cryptosporidium hominis
SASYSNSQLGAQPASGSKQ

SEQ ID NO: 2119206 - protein, 5 aa, Cryptosporidium hominis
SATDP

SEQ ID NO: 2119207 - protein, 15 aa, Cryptosporidium hominis
SATKSIGNDDLEKKL

SEQ ID NO: 2119208 - protein, 11 aa, Cryptosporidium hominis
SATNKQLENNH

SEQ ID NO: 2119209 - protein, 5 aa, Cryptosporidium hominis
SATNS

SEQ ID NO: 2119210 - protein, 6 aa, Cryptosporidium hominis
SATNSG

SEQ ID NO: 2119211 - protein, 6 aa, Cryptosporidium hominis
SATNYC

SEQ ID NO: 2119212 - protein, 34 aa, Cryptosporidium hominis
SATSLTSSQISKVEEQPDTSKDEENIANNGKYIP

SEQ ID NO: 2119213 - protein, 8 aa, Cryptosporidium hominis
SAVEETQS

SEQ ID NO: 2119214 - protein, 22 aa, Cryptosporidium hominis
SAVNQDGRSASLTAPNGPAQQK

SEQ ID NO: 2119215 - protein, 57 aa, Cryptosporidium hominis
SAVNSNSSPKAKQVNSPPPPPAQSCYADNKSNNTKYYNSSKSDARATKATSNDDESI

SEQ ID NO: 2119216 - protein, 45 aa, Cryptosporidium hominis
SAVSTDQSTFGNSSYVSPPKNSTKASRNDTSSSDSSDTDDEKNPL

SEQ ID NO: 2119217 - protein, 14 aa, Cryptosporidium hominis
SAVSTGIQSATGSP

SEQ ID NO: 2119218 - protein, 9 aa, Cryptosporidium hominis
SAYDSSSGD

SEQ ID NO: 2119219 - protein, 5 aa, Cryptosporidium hominis
SAYEH

SEQ ID NO: 2119220 - protein, 5 aa, Cryptosporidium hominis
SAYGA

SEQ ID NO: 2119221 - protein, 9 aa, Cryptosporidium hominis
SCAKSGDLA

SEQ ID NO: 2119222 - protein, 28 aa, Cryptosporidium hominis
SCDDSMYSTSTGFPSCDGSSKSSRNYNS

SEQ ID NO: 2119223 - protein, 5 aa, Cryptosporidium hominis
SCGDS

SEQ ID NO: 2119224 - protein, 8 aa, Cryptosporidium hominis
SCGNTKKR

SEQ ID NO: 2119225 - protein, 11 aa, Cryptosporidium hominis
SCGSSTPEAHH

SEQ ID NO: 2119226 - protein, 9 aa, Cryptosporidium hominis
SCGTPGNIT

SEQ ID NO: 2119227 - protein, 5 aa, Cryptosporidium hominis
SCKTC

SEQ ID NO: 2119228 - protein, 5 aa, Cryptosporidium hominis
SCNPV

SEQ ID NO: 2119229 - protein, 12 aa, Cryptosporidium hominis
SCPSTKLKPVDK

SEQ ID NO: 2119230 - protein, 17 aa, Cryptosporidium hominis
SCSNTEWHEPKNNNNFV

SEQ ID NO: 2119231 - protein, 7 aa, Cryptosporidium hominis
SCSNYPK

SEQ ID NO: 2119232 - protein, 7 aa, Cryptosporidium hominis
SCSQVTD

SEQ ID NO: 2119233 - protein, 13 aa, Cryptosporidium hominis
SCSSKDRKGNKNN

SEQ ID NO: 2119234 - protein, 5 aa, Cryptosporidium hominis
SCTQT

SEQ ID NO: 2119235 - protein, 25 aa, Cryptosporidium hominis
SDAEKRKNYDTFGEDGPPMHSASGD

SEQ ID NO: 2119236 - protein, 17 aa, Cryptosporidium hominis
SDALHSSGYNPKNISNS

SEQ ID NO: 2119237 - protein, 7 aa, Cryptosporidium hominis
SDAQNMS

SEQ ID NO: 2119238 - protein, 8 aa, Cryptosporidium hominis
SDAREYGK

SEQ ID NO: 2119239 - protein, 11 aa, Cryptosporidium hominis
SDDDLSPEEVN

SEQ ID NO: 2119240 - protein, 6 aa, Cryptosporidium hominis
SDDEND

SEQ ID NO: 2119241 - protein, 19 aa, Cryptosporidium hominis
SDDGSGRGAAILASTTVNT

SEQ ID NO: 2119242 - protein, 4 aa, Cryptosporidium hominis
SDDI

SEQ ID NO: 2119243 - protein, 7 aa, Cryptosporidium hominis
SDDNKRA

SEQ ID NO: 2119244 - protein, 14 aa, Cryptosporidium hominis
SDDYNPEKGANIPI

SEQ ID NO: 2119245 - protein, 8 aa, Cryptosporidium hominis
SDEDISHN

SEQ ID NO: 2119246 - protein, 10 aa, Cryptosporidium hominis
SDEDLQKRLN

SEQ ID NO: 2119247 - protein, 13 aa, Cryptosporidium hominis
SDEEPELEEPRKE

SEQ ID NO: 2119248 - protein, 6 aa, Cryptosporidium hominis
SDEFGP

SEQ ID NO: 2119249 - protein, 11 aa, Cryptosporidium hominis
SDEIKQDISEE

SEQ ID NO: 2119250 - protein, 17 aa, Cryptosporidium hominis
SDENDSSGTCSEKPTGQ

SEQ ID NO: 2119251 - protein, 21 aa, Cryptosporidium hominis
SDENSDISQDKEKKRKRRVKS

SEQ ID NO: 2119252 - protein, 13 aa, Cryptosporidium hominis
SDENSVKSNPDVP

SEQ ID NO: 2119253 - protein, 12 aa, Cryptosporidium hominis
SDEVKEEKLKKK

SEQ ID NO: 2119254 - protein, 11 aa, Cryptosporidium hominis
SDFSQDLGPQM

SEQ ID NO: 2119255 - protein, 9 aa, Cryptosporidium hominis
SDGKKMSKR

SEQ ID NO: 2119256 - protein, 4 aa, Cryptosporidium hominis
SDGS

SEQ ID NO: 2119257 - protein, 7 aa, Cryptosporidium hominis
SDGSQKL

SEQ ID NO: 2119258 - protein, 23 aa, Cryptosporidium hominis
SDGSSDSCKITTRPRSSSSLPSV

SEQ ID NO: 2119259 - protein, 16 aa, Cryptosporidium hominis
SDHSEGAKESCEQKNL

SEQ ID NO: 2119260 - protein, 12 aa, Cryptosporidium hominis
SDIPLKSKNTTS

SEQ ID NO: 2119261 - protein, 7 aa, Cryptosporidium hominis
SDKDEST

SEQ ID NO: 2119262 - protein, 8 aa, Cryptosporidium hominis
SDKEAENS

SEQ ID NO: 2119263 - protein, 6 aa, Cryptosporidium hominis
SDKNDG

SEQ ID NO: 2119264 - protein, 14 aa, Cryptosporidium hominis
SDKNNLKKYSTIEK

SEQ ID NO: 2119265 - protein, 9 aa, Cryptosporidium hominis
SDKQEEEED

SEQ ID NO: 2119266 - protein, 7 aa, Cryptosporidium hominis
SDKSTKE

SEQ ID NO: 2119267 - protein, 13 aa, Cryptosporidium hominis
SDKYSGRHQIDNP

SEQ ID NO: 2119268 - protein, 8 aa, Cryptosporidium hominis
SDLANKIS

SEQ ID NO: 2119269 - protein, 7 aa, Cryptosporidium hominis
SDLNDEL

SEQ ID NO: 2119270 - protein, 8 aa, Cryptosporidium hominis
SDLRKGNL

SEQ ID NO: 2119271 - protein, 7 aa, Cryptosporidium hominis
SDLSSST

SEQ ID NO: 2119272 - protein, 6 aa, Cryptosporidium hominis
SDLTSL

SEQ ID NO: 2119273 - protein, 8 aa, Cryptosporidium hominis
SDNKNKRT

SEQ ID NO: 2119274 - protein, 7 aa, Cryptosporidium hominis
SDNKRYL

SEQ ID NO: 2119275 - protein, 20 aa, Cryptosporidium hominis
SDNNRESFSEYNGSDTEMEG

SEQ ID NO: 2119276 - protein, 7 aa, Cryptosporidium hominis
SDNYSSS

SEQ ID NO: 2119277 - protein, 5 aa, Cryptosporidium hominis
SDPEG

SEQ ID NO: 2119278 - protein, 8 aa, Cryptosporidium hominis
SDPENIPG

SEQ ID NO: 2119279 - protein, 7 aa, Cryptosporidium hominis
SDPLTSF

SEQ ID NO: 2119280 - protein, 11 aa, Cryptosporidium hominis
SDPNSLPEYHD

SEQ ID NO: 2119281 - protein, 7 aa, Cryptosporidium hominis
SDPRDYS

SEQ ID NO: 2119282 - protein, 31 aa, Cryptosporidium hominis
SDPSTNSIESASKLDQTPNLKSDQLETFEDP

SEQ ID NO: 2119283 - protein, 5 aa, Cryptosporidium hominis
SDQDK

SEQ ID NO: 2119284 - protein, 17 aa, Cryptosporidium hominis
SDQGTNSSKCGQKQKRN

SEQ ID NO: 2119285 - protein, 4 aa, Cryptosporidium hominis
SDRE

SEQ ID NO: 2119286 - protein, 10 aa, Cryptosporidium hominis
SDRKATPQNQ

SEQ ID NO: 2119287 - protein, 8 aa, Cryptosporidium hominis
SDRLHREN

SEQ ID NO: 2119288 - protein, 10 aa, Cryptosporidium hominis
SDRVKSGTVS

SEQ ID NO: 2119289 - protein, 25 aa, Cryptosporidium hominis
SDSAAKLPPPFGNPAVKNEQKFPEY

SEQ ID NO: 2119290 - protein, 20 aa, Cryptosporidium hominis
SDSANNNCSSEINNTQNYEY

SEQ ID NO: 2119291 - protein, 4 aa, Cryptosporidium hominis
SDSE

SEQ ID NO: 2119292 - protein, 8 aa, Cryptosporidium hominis
SDSEEALK

SEQ ID NO: 2119293 - protein, 7 aa, Cryptosporidium hominis
SDSEKAF

SEQ ID NO: 2119294 - protein, 7 aa, Cryptosporidium hominis
SDSENYS

SEQ ID NO: 2119295 - protein, 9 aa, Cryptosporidium hominis
SDSFNNSDT

SEQ ID NO: 2119296 - protein, 6 aa, Cryptosporidium hominis
SDSKEH

SEQ ID NO: 2119297 - protein, 10 aa, Cryptosporidium hominis
SDSNSLRESI

SEQ ID NO: 2119298 - protein, 12 aa, Cryptosporidium hominis
SDSNYSKSEIRE

SEQ ID NO: 2119299 - protein, 4 aa, Cryptosporidium hominis
SDSR

SEQ ID NO: 2119300 - protein, 10 aa, Cryptosporidium hominis
SDSRESLSDL

SEQ ID NO: 2119301 - protein, 6 aa, Cryptosporidium hominis
SDSSKL

SEQ ID NO: 2119302 - protein, 7 aa, Cryptosporidium hominis
SDSSSSL

SEQ ID NO: 2119303 - protein, 7 aa, Cryptosporidium hominis
SDSTPIE

SEQ ID NO: 2119304 - protein, 5 aa, Cryptosporidium hominis
SDSTR

SEQ ID NO: 2119305 - protein, 16 aa, Cryptosporidium hominis
SDTCESGTKYRTRRVS

SEQ ID NO: 2119306 - protein, 11 aa, Cryptosporidium hominis
SDTDDQASINP

SEQ ID NO: 2119307 - protein, 20 aa, Cryptosporidium hominis
SDTINEKQEKIEENPTSKLS

SEQ ID NO: 2119308 - protein, 37 aa, Cryptosporidium hominis
SDTKENEGDITEAKNTQDNEESSKKPESLDDGASSEA

SEQ ID NO: 2119309 - protein, 14 aa, Cryptosporidium hominis
SDTPPHAFPLYAIG

SEQ ID NO: 2119310 - protein, 22 aa, Cryptosporidium hominis
SDTTSNQSYESPDLSDRNETKV

SEQ ID NO: 2119311 - protein, 5 aa, Cryptosporidium hominis
SDVHP

SEQ ID NO: 2119312 - protein, 8 aa, Cryptosporidium hominis
SDVQEKRN

SEQ ID NO: 2119313 - protein, 4 aa, Cryptosporidium hominis
SDVR

SEQ ID NO: 2119314 - protein, 12 aa, Cryptosporidium hominis
SDVRYSEDSETG

SEQ ID NO: 2119315 - protein, 8 aa, Cryptosporidium hominis
SDYGNSEG

SEQ ID NO: 2119316 - protein, 5 aa, Cryptosporidium hominis
SDYPN

SEQ ID NO: 2119317 - protein, 17 aa, Cryptosporidium hominis
SDYQRQKPQEPGQQNHV

SEQ ID NO: 2119318 - protein, 6 aa, Cryptosporidium hominis
SEAEEE

SEQ ID NO: 2119319 - protein, 22 aa, Cryptosporidium hominis
SEAKVETENPLLSSTEDCSNNP

SEQ ID NO: 2119320 - protein, 6 aa, Cryptosporidium hominis
SEASQS

SEQ ID NO: 2119321 - protein, 6 aa, Cryptosporidium hominis
SECSDE

SEQ ID NO: 2119322 - protein, 8 aa, Cryptosporidium hominis
SEDETNYE

SEQ ID NO: 2119323 - protein, 4 aa, Cryptosporidium hominis
SEDG

SEQ ID NO: 2119324 - protein, 8 aa, Cryptosporidium hominis
SEDNDFPK

SEQ ID NO: 2119325 - protein, 4 aa, Cryptosporidium hominis
SEDV

SEQ ID NO: 2119326 - protein, 4 aa, Cryptosporidium hominis
SEEA

SEQ ID NO: 2119327 - protein, 23 aa, Cryptosporidium hominis
SEEGHQNKDDNGIADSDSNTEVT

SEQ ID NO: 2119328 - protein, 15 aa, Cryptosporidium hominis
SEEISSENSFRKSDN

SEQ ID NO: 2119329 - protein, 7 aa, Cryptosporidium hominis
SEEKSLK

SEQ ID NO: 2119330 - protein, 8 aa, Cryptosporidium hominis
SEENSRLK

SEQ ID NO: 2119331 - protein, 7 aa, Cryptosporidium hominis
SEENYED

SEQ ID NO: 2119332 - protein, 11 aa, Cryptosporidium hominis
SEESKLRSSHI

SEQ ID NO: 2119333 - protein, 6 aa, Cryptosporidium hominis
SEESLS

SEQ ID NO: 2119334 - protein, 6 aa, Cryptosporidium hominis
SEESMS

SEQ ID NO: 2119335 - protein, 19 aa, Cryptosporidium hominis
SEESQGNVTNNNQGTEYLT

SEQ ID NO: 2119336 - protein, 14 aa, Cryptosporidium hominis
SEFEKNKSEGSESL

SEQ ID NO: 2119337 - protein, 12 aa, Cryptosporidium hominis
SEFENKNDSIIQ

SEQ ID NO: 2119338 - protein, 4 aa, Cryptosporidium hominis
SEFQ

SEQ ID NO: 2119339 - protein, 21 aa, Cryptosporidium hominis
SEFSAKENFSEKTRKKINKEY

SEQ ID NO: 2119340 - protein, 7 aa, Cryptosporidium hominis
SEGENEQ

SEQ ID NO: 2119341 - protein, 5 aa, Cryptosporidium hominis
SEGGL

SEQ ID NO: 2119342 - protein, 11 aa, Cryptosporidium hominis
SEGGMKYSEGN

SEQ ID NO: 2119343 - protein, 20 aa, Cryptosporidium hominis
SEGGSHDDEANISNTPPTYI

SEQ ID NO: 2119344 - protein, 6 aa, Cryptosporidium hominis
SEGMNN

SEQ ID NO: 2119345 - protein, 6 aa, Cryptosporidium hominis
SEGPTT

SEQ ID NO: 2119346 - protein, 4 aa, Cryptosporidium hominis
SEGS

SEQ ID NO: 2119347 - protein, 7 aa, Cryptosporidium hominis
SEGVECE

SEQ ID NO: 2119348 - protein, 25 aa, Cryptosporidium hominis
SEHEKENSDESMNKDTDENDSMSNS

SEQ ID NO: 2119349 - protein, 15 aa, Cryptosporidium hominis
SEHETVAKSNRKRMK

SEQ ID NO: 2119350 - protein, 6 aa, Cryptosporidium hominis
SEHSTC

SEQ ID NO: 2119351 - protein, 6 aa, Cryptosporidium hominis
SEIING

SEQ ID NO: 2119352 - protein, 4 aa, Cryptosporidium hominis
SEIP

SEQ ID NO: 2119353 - protein, 10 aa, Cryptosporidium hominis
SEIPTQYSKN

SEQ ID NO: 2119354 - protein, 13 aa, Cryptosporidium hominis
SEIRRGKKAPYKI

SEQ ID NO: 2119355 - protein, 10 aa, Cryptosporidium hominis
SEISNSSQID

SEQ ID NO: 2119356 - protein, 7 aa, Cryptosporidium hominis
SEKASKA

SEQ ID NO: 2119357 - protein, 4 aa, Cryptosporidium hominis
SEKE

SEQ ID NO: 2119358 - protein, 7 aa, Cryptosporidium hominis
SEKQRYA

SEQ ID NO: 2119359 - protein, 7 aa, Cryptosporidium hominis
SEKQVNS

SEQ ID NO: 2119360 - protein, 9 aa, Cryptosporidium hominis
SEKSEFEVS

SEQ ID NO: 2119361 - protein, 26 aa, Cryptosporidium hominis
SEKSIDESKSEIKDAPIERDDAANNV

SEQ ID NO: 2119362 - protein, 7 aa, Cryptosporidium hominis
SEKSLSG

SEQ ID NO: 2119363 - protein, 10 aa, Cryptosporidium hominis
SEKSNQGHAN

SEQ ID NO: 2119364 - protein, 17 aa, Cryptosporidium hominis
SEKYSVNSDNIKKDDDL

SEQ ID NO: 2119365 - protein, 9 aa, Cryptosporidium hominis
SELANSIND

SEQ ID NO: 2119366 - protein, 13 aa, Cryptosporidium hominis
SELASQEYSNSPM

SEQ ID NO: 2119367 - protein, 11 aa, Cryptosporidium hominis
SELEDSSPEHI

SEQ ID NO: 2119368 - protein, 8 aa, Cryptosporidium hominis
SELEVDGK

SEQ ID NO: 2119369 - protein, 12 aa, Cryptosporidium hominis
SELNGGTNTECS

SEQ ID NO: 2119370 - protein, 8 aa, Cryptosporidium hominis
SELPGNQK

SEQ ID NO: 2119371 - protein, 7 aa, Cryptosporidium hominis
SELSGPE

SEQ ID NO: 2119372 - protein, 14 aa, Cryptosporidium hominis
SELSYTKSNDDEDN

SEQ ID NO: 2119373 - protein, 6 aa, Cryptosporidium hominis
SELTPS

SEQ ID NO: 2119374 - protein, 8 aa, Cryptosporidium hominis
SENARESQ

SEQ ID NO: 2119375 - protein, 4 aa, Cryptosporidium hominis
SEND

SEQ ID NO: 2119376 - protein, 11 aa, Cryptosporidium hominis
SENDDLTDEEF

SEQ ID NO: 2119377 - protein, 4 aa, Cryptosporidium hominis
SENF

SEQ ID NO: 2119378 - protein, 8 aa, Cryptosporidium hominis
SENGHTGV

SEQ ID NO: 2119379 - protein, 10 aa, Cryptosporidium hominis
SENKQKSPLL

SEQ ID NO: 2119380 - protein, 4 aa, Cryptosporidium hominis
SENL

SEQ ID NO: 2119381 - protein, 19 aa, Cryptosporidium hominis
SENLKSSNFENPNKNQSIT

SEQ ID NO: 2119382 - protein, 12 aa, Cryptosporidium hominis
SENLNKKSNQET

SEQ ID NO: 2119383 - protein, 5 aa, Cryptosporidium hominis
SENRQ

SEQ ID NO: 2119384 - protein, 4 aa, Cryptosporidium hominis
SENS

SEQ ID NO: 2119385 - protein, 7 aa, Cryptosporidium hominis
SENSNIN

SEQ ID NO: 2119386 - protein, 8 aa, Cryptosporidium hominis
SENSSSFA

SEQ ID NO: 2119387 - protein, 10 aa, Cryptosporidium hominis
SENTANLEKK

SEQ ID NO: 2119388 - protein, 6 aa, Cryptosporidium hominis
SENTDI

SEQ ID NO: 2119389 - protein, 10 aa, Cryptosporidium hominis
SENTSKRKCP

SEQ ID NO: 2119390 - protein, 19 aa, Cryptosporidium hominis
SEPDYSQNDENDKETSSEV

SEQ ID NO: 2119391 - protein, 8 aa, Cryptosporidium hominis
SEPGRPNY

SEQ ID NO: 2119392 - protein, 7 aa, Cryptosporidium hominis
SEPQNNS

SEQ ID NO: 2119393 - protein, 7 aa, Cryptosporidium hominis
SEPSTGS

SEQ ID NO: 2119394 - protein, 7 aa, Cryptosporidium hominis
SEPVPTE

SEQ ID NO: 2119395 - protein, 7 aa, Cryptosporidium hominis
SEQEREK

SEQ ID NO: 2119396 - protein, 15 aa, Cryptosporidium hominis
SEQGQNDGRAAKVDQ

SEQ ID NO: 2119397 - protein, 4 aa, Cryptosporidium hominis
SEQL

SEQ ID NO: 2119398 - protein, 7 aa, Cryptosporidium hominis
SEQYGST

SEQ ID NO: 2119399 - protein, 7 aa, Cryptosporidium hominis
SERDETY

SEQ ID NO: 2119400 - protein, 7 aa, Cryptosporidium hominis
SERFTSS

SEQ ID NO: 2119401 - protein, 16 aa, Cryptosporidium hominis
SERGKRRSNQAFKDPR

SEQ ID NO: 2119402 - protein, 42 aa, Cryptosporidium hominis
SERKSNVSERTRKMNERKEKQKACKERERREREEEERRRRDA

SEQ ID NO: 2119403 - protein, 13 aa, Cryptosporidium hominis
SERNIFSSFLVKM

SEQ ID NO: 2119404 - protein, 19 aa, Cryptosporidium hominis
SERQTNQDLSGVSDQEADV

SEQ ID NO: 2119405 - protein, 11 aa, Cryptosporidium hominis
SERSARGSERI

SEQ ID NO: 2119406 - protein, 6 aa, Cryptosporidium hominis
SERSHE

SEQ ID NO: 2119407 - protein, 7 aa, Cryptosporidium hominis
SERVKTS

SEQ ID NO: 2119408 - protein, 8 aa, Cryptosporidium hominis
SESAPEER

SEQ ID NO: 2119409 - protein, 10 aa, Cryptosporidium hominis
SESDTNLQNK

SEQ ID NO: 2119410 - protein, 4 aa, Cryptosporidium hominis
SESE

SEQ ID NO: 2119411 - protein, 7 aa, Cryptosporidium hominis
SESEQYP

SEQ ID NO: 2119412 - protein, 17 aa, Cryptosporidium hominis
SESESEKISPEDGPYSG

SEQ ID NO: 2119413 - protein, 5 aa, Cryptosporidium hominis
SESET

SEQ ID NO: 2119414 - protein, 5 aa, Cryptosporidium hominis
SESIY

SEQ ID NO: 2119415 - protein, 5 aa, Cryptosporidium hominis
SESKD

SEQ ID NO: 2119416 - protein, 10 aa, Cryptosporidium hominis
SESLPDKCTG

SEQ ID NO: 2119417 - protein, 9 aa, Cryptosporidium hominis
SESLSETLS

SEQ ID NO: 2119418 - protein, 7 aa, Cryptosporidium hominis
SESNTRT

SEQ ID NO: 2119419 - protein, 4 aa, Cryptosporidium hominis
SESP

SEQ ID NO: 2119420 - protein, 18 aa, Cryptosporidium hominis
SESPQSNTELSSRASKAR

SEQ ID NO: 2119421 - protein, 22 aa, Cryptosporidium hominis
SESQQEITNNIKDSNSEPQTVR

SEQ ID NO: 2119422 - protein, 6 aa, Cryptosporidium hominis
SESTSR

SEQ ID NO: 2119423 - protein, 17 aa, Cryptosporidium hominis
SESTTLPPEESNNENAV

SEQ ID NO: 2119424 - protein, 5 aa, Cryptosporidium hominis
SETEN

SEQ ID NO: 2119425 - protein, 12 aa, Cryptosporidium hominis
SETEYENSPYKE

SEQ ID NO: 2119426 - protein, 4 aa, Cryptosporidium hominis
SETF

SEQ ID NO: 2119427 - protein, 7 aa, Cryptosporidium hominis
SETGNKI

SEQ ID NO: 2119428 - protein, 10 aa, Cryptosporidium hominis
SETIQQNGTA

SEQ ID NO: 2119429 - protein, 35 aa, Cryptosporidium hominis
SETKTSPETDQRKCTQSSLEISKGDLDSVDDLNSS

SEQ ID NO: 2119430 - protein, 9 aa, Cryptosporidium hominis
SETNISSKT

SEQ ID NO: 2119431 - protein, 4 aa, Cryptosporidium hominis
SETR

SEQ ID NO: 2119432 - protein, 6 aa, Cryptosporidium hominis
SETSNE

SEQ ID NO: 2119433 - protein, 11 aa, Cryptosporidium hominis
SETTELANKET

SEQ ID NO: 2119434 - protein, 43 aa, Cryptosporidium hominis
SETTPAPPPTPTATINPEPTKTPTDIPKENSTPPQPQPPVEES

SEQ ID NO: 2119435 - protein, 80 aa, Cryptosporidium hominis
SETTPAPPPTPTVTTNPKPRKNPKEAPKKNSTPSSPPIPQPSRIQPTSQPQPQPQPQPQPQPQPQPQPQPQPQPQPQPHS

SEQ ID NO: 2119436 - protein, 4 aa, Cryptosporidium hominis
SETY

SEQ ID NO: 2119437 - protein, 7 aa, Cryptosporidium hominis
SEVAEGR

SEQ ID NO: 2119438 - protein, 7 aa, Cryptosporidium hominis
SEVNSDS

SEQ ID NO: 2119439 - protein, 12 aa, Cryptosporidium hominis
SEVSSPKVPASN

SEQ ID NO: 2119440 - protein, 6 aa, Cryptosporidium hominis
SEWRNR

SEQ ID NO: 2119441 - protein, 6 aa, Cryptosporidium hominis
SEYDNS

SEQ ID NO: 2119442 - protein, 25 aa, Cryptosporidium hominis
SEYENKTIDAENIGDIQSKNSENIK

SEQ ID NO: 2119443 - protein, 6 aa, Cryptosporidium hominis
SEYKTE

SEQ ID NO: 2119444 - protein, 4 aa, Cryptosporidium hominis
SEYQ

SEQ ID NO: 2119445 - protein, 7 aa, Cryptosporidium hominis
SEYSDNK

SEQ ID NO: 2119446 - protein, 6 aa, Cryptosporidium hominis
SEYSHE

SEQ ID NO: 2119447 - protein, 8 aa, Cryptosporidium hominis
SEYSNSNE

SEQ ID NO: 2119448 - protein, 30 aa, Cryptosporidium hominis
SEYTSANSKNESSLEEDQKEENKHKKKSKL

SEQ ID NO: 2119449 - protein, 7 aa, Cryptosporidium hominis
SFEIKSD

SEQ ID NO: 2119450 - protein, 6 aa, Cryptosporidium hominis
SFEKPI

SEQ ID NO: 2119451 - protein, 5 aa, Cryptosporidium hominis
SFEKS

SEQ ID NO: 2119452 - protein, 6 aa, Cryptosporidium hominis
SFERPN

SEQ ID NO: 2119453 - protein, 9 aa, Cryptosporidium hominis
SFKSSRSID

SEQ ID NO: 2119454 - protein, 4 aa, Cryptosporidium hominis
SFLG

SEQ ID NO: 2119455 - protein, 5 aa, Cryptosporidium hominis
SFNDR

SEQ ID NO: 2119456 - protein, 11 aa, Cryptosporidium hominis
SFNKKDDWNNV

SEQ ID NO: 2119457 - protein, 8 aa, Cryptosporidium hominis
SFNNNSPS

SEQ ID NO: 2119458 - protein, 5 aa, Cryptosporidium hominis
SFNNS

SEQ ID NO: 2119459 - protein, 4 aa, Cryptosporidium hominis
SFNP

SEQ ID NO: 2119460 - protein, 11 aa, Cryptosporidium hominis
SFPNSNQIDPF

SEQ ID NO: 2119461 - protein, 10 aa, Cryptosporidium hominis
SFPPNSGPKS

SEQ ID NO: 2119462 - protein, 5 aa, Cryptosporidium hominis
SFPSN

SEQ ID NO: 2119463 - protein, 6 aa, Cryptosporidium hominis
SFPSNS

SEQ ID NO: 2119464 - protein, 5 aa, Cryptosporidium hominis
SFQGP

SEQ ID NO: 2119465 - protein, 9 aa, Cryptosporidium hominis
SFQRTTNHK

SEQ ID NO: 2119466 - protein, 9 aa, Cryptosporidium hominis
SFSCPSGSK

SEQ ID NO: 2119467 - protein, 5 aa, Cryptosporidium hominis
SFSKN

SEQ ID NO: 2119468 - protein, 7 aa, Cryptosporidium hominis
SFSNGQD

SEQ ID NO: 2119469 - protein, 19 aa, Cryptosporidium hominis
SFSPSNQNTSRISNEKEQI

SEQ ID NO: 2119470 - protein, 28 aa, Cryptosporidium hominis
SFSRKSKTLRKSIKSSGKNTIQLPSQDN

SEQ ID NO: 2119471 - protein, 6 aa, Cryptosporidium hominis
SFSSSS

SEQ ID NO: 2119472 - protein, 6 aa, Cryptosporidium hominis
SFSTGN

SEQ ID NO: 2119473 - protein, 6 aa, Cryptosporidium hominis
SFSTPS

SEQ ID NO: 2119474 - protein, 9 aa, Cryptosporidium hominis
SFTENTQKN

SEQ ID NO: 2119475 - protein, 5 aa, Cryptosporidium hominis
SFTSK

SEQ ID NO: 2119476 - protein, 34 aa, Cryptosporidium hominis
SGAGTGTGTGTGASGASGSGGEMGSGLTASAQPF

SEQ ID NO: 2119477 - protein, 17 aa, Cryptosporidium hominis
SGAGTKSQFDDQKYENA

SEQ ID NO: 2119478 - protein, 13 aa, Cryptosporidium hominis
SGANSLDDTRNIA

SEQ ID NO: 2119479 - protein, 8 aa, Cryptosporidium hominis
SGAYPIDE

SEQ ID NO: 2119480 - protein, 41 aa, Cryptosporidium hominis
SGDEVQTTDLSGDEVQTAGLSSDEAPTVAELSSDEASATIE

SEQ ID NO: 2119481 - protein, 21 aa, Cryptosporidium hominis
SGDIGDSDSDGSDSSSLFPTE

SEQ ID NO: 2119482 - protein, 10 aa, Cryptosporidium hominis
SGDNRCVKSP

SEQ ID NO: 2119483 - protein, 8 aa, Cryptosporidium hominis
SGDSDNVN

SEQ ID NO: 2119484 - protein, 8 aa, Cryptosporidium hominis
SGDVDDET

SEQ ID NO: 2119485 - protein, 24 aa, Cryptosporidium hominis
SGEAGTFSSCSSQVPDETEFQPGN

SEQ ID NO: 2119486 - protein, 4 aa, Cryptosporidium hominis
SGEG

SEQ ID NO: 2119487 - protein, 9 aa, Cryptosporidium hominis
SGEGNTKLK

SEQ ID NO: 2119488 - protein, 13 aa, Cryptosporidium hominis
SGEHGMDQGGTEF

SEQ ID NO: 2119489 - protein, 9 aa, Cryptosporidium hominis
SGEKTQLEE

SEQ ID NO: 2119490 - protein, 6 aa, Cryptosporidium hominis
SGENPG

SEQ ID NO: 2119491 - protein, 5 aa, Cryptosporidium hominis
SGEPY

SEQ ID NO: 2119492 - protein, 5 aa, Cryptosporidium hominis
SGERK

SEQ ID NO: 2119493 - protein, 4 aa, Cryptosporidium hominis
SGES

SEQ ID NO: 2119494 - protein, 15 aa, Cryptosporidium hominis
SGFQKNSQNLNYGGP

SEQ ID NO: 2119495 - protein, 68 aa, Cryptosporidium hominis
SGFSGSGARNGSPSAGSGSNSPPLPPPSSSSPSPPPPPPPPPPPPSSSSPSPPPPPPPLPPPPPPPPP

SEQ ID NO: 2119496 - protein, 4 aa, Cryptosporidium hominis
SGGF

SEQ ID NO: 2119497 - protein, 26 aa, Cryptosporidium hominis
SGGFSGSGAANANSDTDSNSGIQDAS

SEQ ID NO: 2119498 - protein, 10 aa, Cryptosporidium hominis
SGGGAKGSFS

SEQ ID NO: 2119499 - protein, 10 aa, Cryptosporidium hominis
SGGGGGMHSD

SEQ ID NO: 2119500 - protein, 13 aa, Cryptosporidium hominis
SGGGVSSSPINQV

SEQ ID NO: 2119501 - protein, 5 aa, Cryptosporidium hominis
SGGHT

SEQ ID NO: 2119502 - protein, 8 aa, Cryptosporidium hominis
SGGLNKGP

SEQ ID NO: 2119503 - protein, 13 aa, Cryptosporidium hominis
SGGMISGSSSHES

SEQ ID NO: 2119504 - protein, 6 aa, Cryptosporidium hominis
SGGRNV

SEQ ID NO: 2119505 - protein, 6 aa, Cryptosporidium hominis
SGGSDM

SEQ ID NO: 2119506 - protein, 5 aa, Cryptosporidium hominis
SGGTA

SEQ ID NO: 2119507 - protein, 4 aa, Cryptosporidium hominis
SGGV

SEQ ID NO: 2119508 - protein, 6 aa, Cryptosporidium hominis
SGHTGA

SEQ ID NO: 2119509 - protein, 28 aa, Cryptosporidium hominis
SGINEDTNISGNNSASGEVNSELGPDQI

SEQ ID NO: 2119510 - protein, 12 aa, Cryptosporidium hominis
SGINNNDNNPVI

SEQ ID NO: 2119511 - protein, 8 aa, Cryptosporidium hominis
SGINSGDV

SEQ ID NO: 2119512 - protein, 8 aa, Cryptosporidium hominis
SGIPNSAF

SEQ ID NO: 2119513 - protein, 5 aa, Cryptosporidium hominis
SGIQS

SEQ ID NO: 2119514 - protein, 4 aa, Cryptosporidium hominis
SGIT

SEQ ID NO: 2119515 - protein, 9 aa, Cryptosporidium hominis
SGKAKTDKD

SEQ ID NO: 2119516 - protein, 15 aa, Cryptosporidium hominis
SGKDRNTRVIETLGK

SEQ ID NO: 2119517 - protein, 8 aa, Cryptosporidium hominis
SGKEGNNK

SEQ ID NO: 2119518 - protein, 6 aa, Cryptosporidium hominis
SGKHEE

SEQ ID NO: 2119519 - protein, 18 aa, Cryptosporidium hominis
SGKIRTGDFRGPTSTNYP

SEQ ID NO: 2119520 - protein, 7 aa, Cryptosporidium hominis
SGKKGTC

SEQ ID NO: 2119521 - protein, 7 aa, Cryptosporidium hominis
SGKQIKD

SEQ ID NO: 2119522 - protein, 7 aa, Cryptosporidium hominis
SGLDGGT

SEQ ID NO: 2119523 - protein, 5 aa, Cryptosporidium hominis
SGLEN

SEQ ID NO: 2119524 - protein, 7 aa, Cryptosporidium hominis
SGLEPGT

SEQ ID NO: 2119525 - protein, 7 aa, Cryptosporidium hominis
SGLPSKR

SEQ ID NO: 2119526 - protein, 10 aa, Cryptosporidium hominis
SGLRGDEPAN

SEQ ID NO: 2119527 - protein, 7 aa, Cryptosporidium hominis
SGMDTGG

SEQ ID NO: 2119528 - protein, 17 aa, Cryptosporidium hominis
SGMNKKEAKKKVKELKK

SEQ ID NO: 2119529 - protein, 24 aa, Cryptosporidium hominis
SGMPYSTSSSISSQRIHTDPSGSY

SEQ ID NO: 2119530 - protein, 16 aa, Cryptosporidium hominis
SGMSPPGMGPPGMGPP

SEQ ID NO: 2119531 - protein, 5 aa, Cryptosporidium hominis
SGMTH

SEQ ID NO: 2119532 - protein, 11 aa, Cryptosporidium hominis
SGNEKSYENKN

SEQ ID NO: 2119533 - protein, 5 aa, Cryptosporidium hominis
SGNGE

SEQ ID NO: 2119534 - protein, 8 aa, Cryptosporidium hominis
SGNKDADS

SEQ ID NO: 2119535 - protein, 8 aa, Cryptosporidium hominis
SGNNNNKL

SEQ ID NO: 2119536 - protein, 19 aa, Cryptosporidium hominis
SGNNPATEVATSGSSPTQC

SEQ ID NO: 2119537 - protein, 12 aa, Cryptosporidium hominis
SGNNTNGSLGPV

SEQ ID NO: 2119538 - protein, 8 aa, Cryptosporidium hominis
SGNRDNDL

SEQ ID NO: 2119539 - protein, 7 aa, Cryptosporidium hominis
SGNRDNL

SEQ ID NO: 2119540 - protein, 5 aa, Cryptosporidium hominis
SGNVN

SEQ ID NO: 2119541 - protein, 5 aa, Cryptosporidium hominis
SGPGA

SEQ ID NO: 2119542 - protein, 16 aa, Cryptosporidium hominis
SGPHFEGSDTEESTTI

SEQ ID NO: 2119543 - protein, 5 aa, Cryptosporidium hominis
SGPYY

SEQ ID NO: 2119544 - protein, 7 aa, Cryptosporidium hominis
SGQADRE

SEQ ID NO: 2119545 - protein, 9 aa, Cryptosporidium hominis
SGQAQSKVK

SEQ ID NO: 2119546 - protein, 9 aa, Cryptosporidium hominis
SGQESSTRS

SEQ ID NO: 2119547 - protein, 7 aa, Cryptosporidium hominis
SGQNTIS

SEQ ID NO: 2119548 - protein, 7 aa, Cryptosporidium hominis
SGQPKDA

SEQ ID NO: 2119549 - protein, 25 aa, Cryptosporidium hominis
SGRRGSLESGRGDSLGKNSNESNPG

SEQ ID NO: 2119550 - protein, 13 aa, Cryptosporidium hominis
SGRRRTIEDNPEN

SEQ ID NO: 2119551 - protein, 5 aa, Cryptosporidium hominis
SGRSG

SEQ ID NO: 2119552 - protein, 9 aa, Cryptosporidium hominis
SGSDDQGSM

SEQ ID NO: 2119553 - protein, 6 aa, Cryptosporidium hominis
SGSDHQ

SEQ ID NO: 2119554 - protein, 10 aa, Cryptosporidium hominis
SGSEENKELQ

SEQ ID NO: 2119555 - protein, 11 aa, Cryptosporidium hominis
SGSESTKNNSF

SEQ ID NO: 2119556 - protein, 4 aa, Cryptosporidium hominis
SGSG

SEQ ID NO: 2119557 - protein, 6 aa, Cryptosporidium hominis
SGSGDK

SEQ ID NO: 2119558 - protein, 21 aa, Cryptosporidium hominis
SGSKTINQADTLNDKQSGFQN

SEQ ID NO: 2119559 - protein, 10 aa, Cryptosporidium hominis
SGSNDSENKK

SEQ ID NO: 2119560 - protein, 16 aa, Cryptosporidium hominis
SGSNSDNEDPGPPQSI

SEQ ID NO: 2119561 - protein, 7 aa, Cryptosporidium hominis
SGSNSNQ

SEQ ID NO: 2119562 - protein, 23 aa, Cryptosporidium hominis
SGSPPPFPKKPPVGDPYNPERSA

SEQ ID NO: 2119563 - protein, 12 aa, Cryptosporidium hominis
SGSSAKDVAKQL

SEQ ID NO: 2119564 - protein, 8 aa, Cryptosporidium hominis
SGSSKALQ

SEQ ID NO: 2119565 - protein, 7 aa, Cryptosporidium hominis
SGSSLQD

SEQ ID NO: 2119566 - protein, 9 aa, Cryptosporidium hominis
SGSSRKSFT

SEQ ID NO: 2119567 - protein, 5 aa, Cryptosporidium hominis
SGSVK

SEQ ID NO: 2119568 - protein, 4 aa, Cryptosporidium hominis
SGSY

SEQ ID NO: 2119569 - protein, 6 aa, Cryptosporidium hominis
SGTADP

SEQ ID NO: 2119570 - protein, 13 aa, Cryptosporidium hominis
SGTEHDDHHDQDH

SEQ ID NO: 2119571 - protein, 41 aa, Cryptosporidium hominis
SGTGAGVGSGPGAGAGVGVGQGYGVSPGSGLGVGPGPRVGA

SEQ ID NO: 2119572 - protein, 4 aa, Cryptosporidium hominis
SGTI

SEQ ID NO: 2119573 - protein, 4 aa, Cryptosporidium hominis
SGTN

SEQ ID NO: 2119574 - protein, 8 aa, Cryptosporidium hominis
SGTPDPQS

SEQ ID NO: 2119575 - protein, 8 aa, Cryptosporidium hominis
SGTRNNDF

SEQ ID NO: 2119576 - protein, 8 aa, Cryptosporidium hominis
SGVEPTHT

SEQ ID NO: 2119577 - protein, 5 aa, Cryptosporidium hominis
SGVGI

SEQ ID NO: 2119578 - protein, 6 aa, Cryptosporidium hominis
SGVPSR

SEQ ID NO: 2119579 - protein, 6 aa, Cryptosporidium hominis
SGYCQT

SEQ ID NO: 2119580 - protein, 6 aa, Cryptosporidium hominis
SGYEGS

SEQ ID NO: 2119581 - protein, 10 aa, Cryptosporidium hominis
SGYGGNVETA

SEQ ID NO: 2119582 - protein, 7 aa, Cryptosporidium hominis
SGYGNEE

SEQ ID NO: 2119583 - protein, 7 aa, Cryptosporidium hominis
SGYHESS

SEQ ID NO: 2119584 - protein, 7 aa, Cryptosporidium hominis
SGYPKEY

SEQ ID NO: 2119585 - protein, 7 aa, Cryptosporidium hominis
SGYSNKQ

SEQ ID NO: 2119586 - protein, 5 aa, Cryptosporidium hominis
SGYTF

SEQ ID NO: 2119587 - protein, 8 aa, Cryptosporidium hominis
SHAPTSSH

SEQ ID NO: 2119588 - protein, 7 aa, Cryptosporidium hominis
SHDEGGL

SEQ ID NO: 2119589 - protein, 4 aa, Cryptosporidium hominis
SHDR

SEQ ID NO: 2119590 - protein, 17 aa, Cryptosporidium hominis
SHGQSKSCEDEERSRIE

SEQ ID NO: 2119591 - protein, 5 aa, Cryptosporidium hominis
SHHSS

SEQ ID NO: 2119592 - protein, 47 aa, Cryptosporidium hominis
SHKASSPKNMHNHSSKGKKRNEDDDSRNSHSARSNFSSGSASESSES

SEQ ID NO: 2119593 - protein, 7 aa, Cryptosporidium hominis
SHKSKSY

SEQ ID NO: 2119594 - protein, 13 aa, Cryptosporidium hominis
SHKYEKKSNDKIP

SEQ ID NO: 2119595 - protein, 18 aa, Cryptosporidium hominis
SHLKGDQSSQIGNSNSIS

SEQ ID NO: 2119596 - protein, 5 aa, Cryptosporidium hominis
SHNTE

SEQ ID NO: 2119597 - protein, 9 aa, Cryptosporidium hominis
SHPISSNNN

SEQ ID NO: 2119598 - protein, 7 aa, Cryptosporidium hominis
SHREKEI

SEQ ID NO: 2119599 - protein, 23 aa, Cryptosporidium hominis
SHSNFQQNGSIDSALSSRRSNEF

SEQ ID NO: 2119600 - protein, 5 aa, Cryptosporidium hominis
SHSVS

SEQ ID NO: 2119601 - protein, 8 aa, Cryptosporidium hominis
SHSYGSTS

SEQ ID NO: 2119602 - protein, 5 aa, Cryptosporidium hominis
SHVTR

SEQ ID NO: 2119603 - protein, 13 aa, Cryptosporidium hominis
SHYRKESDSHFSE

SEQ ID NO: 2119604 - protein, 8 aa, Cryptosporidium hominis
SIATSPSS

SEQ ID NO: 2119605 - protein, 5 aa, Cryptosporidium hominis
SIDKN

SEQ ID NO: 2119606 - protein, 4 aa, Cryptosporidium hominis
SIDT

SEQ ID NO: 2119607 - protein, 7 aa, Cryptosporidium hominis
SIEESSF

SEQ ID NO: 2119608 - protein, 18 aa, Cryptosporidium hominis
SIENNEIDNEDDQVSENN

SEQ ID NO: 2119609 - protein, 4 aa, Cryptosporidium hominis
SIER

SEQ ID NO: 2119610 - protein, 6 aa, Cryptosporidium hominis
SIGDST

SEQ ID NO: 2119611 - protein, 8 aa, Cryptosporidium hominis
SIGEPATQ

SEQ ID NO: 2119612 - protein, 13 aa, Cryptosporidium hominis
SIGGDKSNKSIPR

SEQ ID NO: 2119613 - protein, 10 aa, Cryptosporidium hominis
SIGPNSSKSF

SEQ ID NO: 2119614 - protein, 15 aa, Cryptosporidium hominis
SIGSPISTNLSPTSM

SEQ ID NO: 2119615 - protein, 5 aa, Cryptosporidium hominis
SIGTE

SEQ ID NO: 2119616 - protein, 4 aa, Cryptosporidium hominis
SIIG

SEQ ID NO: 2119617 - protein, 5 aa, Cryptosporidium hominis
SIKDL

SEQ ID NO: 2119618 - protein, 15 aa, Cryptosporidium hominis
SIKERSNQVEADSRE

SEQ ID NO: 2119619 - protein, 24 aa, Cryptosporidium hominis
SIKNSEPNLTADEETNSNQCTSTL

SEQ ID NO: 2119620 - protein, 8 aa, Cryptosporidium hominis
SIKQNSQS

SEQ ID NO: 2119621 - protein, 11 aa, Cryptosporidium hominis
SINDDAAHKDC

SEQ ID NO: 2119622 - protein, 5 aa, Cryptosporidium hominis
SINID

SEQ ID NO: 2119623 - protein, 4 aa, Cryptosporidium hominis
SINK

SEQ ID NO: 2119624 - protein, 16 aa, Cryptosporidium hominis
SINKENGSDEKNVDAI

SEQ ID NO: 2119625 - protein, 13 aa, Cryptosporidium hominis
SINRDDYKLQDST

SEQ ID NO: 2119626 - protein, 46 aa, Cryptosporidium hominis
SINSDSLSSSSSSLSSSSSSSSSSSSLSSSSSSSSSSSFQNPTNNY

SEQ ID NO: 2119627 - protein, 8 aa, Cryptosporidium hominis
SINSPIDE

SEQ ID NO: 2119628 - protein, 4 aa, Cryptosporidium hominis
SIPA

SEQ ID NO: 2119629 - protein, 6 aa, Cryptosporidium hominis
SIPAIY

SEQ ID NO: 2119630 - protein, 14 aa, Cryptosporidium hominis
SIPESAEYVSTSGY

SEQ ID NO: 2119631 - protein, 4 aa, Cryptosporidium hominis
SIPI

SEQ ID NO: 2119632 - protein, 5 aa, Cryptosporidium hominis
SIPNN

SEQ ID NO: 2119633 - protein, 9 aa, Cryptosporidium hominis
SIPPKEDLE

SEQ ID NO: 2119634 - protein, 6 aa, Cryptosporidium hominis
SIPSKT

SEQ ID NO: 2119635 - protein, 6 aa, Cryptosporidium hominis
SIPTPR

SEQ ID NO: 2119636 - protein, 10 aa, Cryptosporidium hominis
SIQDKSSLSQ

SEQ ID NO: 2119637 - protein, 8 aa, Cryptosporidium hominis
SIQENGQE

SEQ ID NO: 2119638 - protein, 7 aa, Cryptosporidium hominis
SIRADKS

SEQ ID NO: 2119639 - protein, 10 aa, Cryptosporidium hominis
SIRGGGGGLN

SEQ ID NO: 2119640 - protein, 13 aa, Cryptosporidium hominis
SIRNEDERKESHF

SEQ ID NO: 2119641 - protein, 4 aa, Cryptosporidium hominis
SIRQ

SEQ ID NO: 2119642 - protein, 11 aa, Cryptosporidium hominis
SISDKEAPEDS

SEQ ID NO: 2119643 - protein, 8 aa, Cryptosporidium hominis
SISKKKGF

SEQ ID NO: 2119644 - protein, 7 aa, Cryptosporidium hominis
SISNKLE

SEQ ID NO: 2119645 - protein, 5 aa, Cryptosporidium hominis
SISPY

SEQ ID NO: 2119646 - protein, 6 aa, Cryptosporidium hominis
SISRRD

SEQ ID NO: 2119647 - protein, 5 aa, Cryptosporidium hominis
SISSG

SEQ ID NO: 2119648 - protein, 25 aa, Cryptosporidium hominis
SISSQSSKSASNNSSNTRQKPKSNF

SEQ ID NO: 2119649 - protein, 7 aa, Cryptosporidium hominis
SISTETG

SEQ ID NO: 2119650 - protein, 15 aa, Cryptosporidium hominis
SISYDSNIAPPEKKS

SEQ ID NO: 2119651 - protein, 14 aa, Cryptosporidium hominis
SITDNVESSGSRNN

SEQ ID NO: 2119652 - protein, 7 aa, Cryptosporidium hominis
SITEYPE

SEQ ID NO: 2119653 - protein, 19 aa, Cryptosporidium hominis
SITGAGHNTTNSTNTGVIS

SEQ ID NO: 2119654 - protein, 5 aa, Cryptosporidium hominis
SITSA

SEQ ID NO: 2119655 - protein, 4 aa, Cryptosporidium hominis
SITT

SEQ ID NO: 2119656 - protein, 8 aa, Cryptosporidium hominis
SITTAPGQ

SEQ ID NO: 2119657 - protein, 13 aa, Cryptosporidium hominis
SIYSNSRISGNTF

SEQ ID NO: 2119658 - protein, 9 aa, Cryptosporidium hominis
SKAANRGDH

SEQ ID NO: 2119659 - protein, 9 aa, Cryptosporidium hominis
SKADGNDWE

SEQ ID NO: 2119660 - protein, 8 aa, Cryptosporidium hominis
SKAEENLR

SEQ ID NO: 2119661 - protein, 7 aa, Cryptosporidium hominis
SKAGERE

SEQ ID NO: 2119662 - protein, 8 aa, Cryptosporidium hominis
SKAKNSAS

SEQ ID NO: 2119663 - protein, 8 aa, Cryptosporidium hominis
SKALESQK

SEQ ID NO: 2119664 - protein, 16 aa, Cryptosporidium hominis
SKASGSEEQTTKYYLH

SEQ ID NO: 2119665 - protein, 10 aa, Cryptosporidium hominis
SKCKSNGINN

SEQ ID NO: 2119666 - protein, 22 aa, Cryptosporidium hominis
SKCQQRTNVSNKTLSNRENDTN

SEQ ID NO: 2119667 - protein, 8 aa, Cryptosporidium hominis
SKDDGFLS

SEQ ID NO: 2119668 - protein, 12 aa, Cryptosporidium hominis
SKDDNSETRDEI

SEQ ID NO: 2119669 - protein, 8 aa, Cryptosporidium hominis
SKDKLESA

SEQ ID NO: 2119670 - protein, 7 aa, Cryptosporidium hominis
SKDPSAV

SEQ ID NO: 2119671 - protein, 9 aa, Cryptosporidium hominis
SKDTSQLND

SEQ ID NO: 2119672 - protein, 7 aa, Cryptosporidium hominis
SKECSGI

SEQ ID NO: 2119673 - protein, 21 aa, Cryptosporidium hominis
SKEEEGEKEEEEEDIEKEEEV

SEQ ID NO: 2119674 - protein, 16 aa, Cryptosporidium hominis
SKEELEEIERKDKNGK

SEQ ID NO: 2119675 - protein, 14 aa, Cryptosporidium hominis
SKEENFRSTAKGTL

SEQ ID NO: 2119676 - protein, 5 aa, Cryptosporidium hominis
SKEEW

SEQ ID NO: 2119677 - protein, 12 aa, Cryptosporidium hominis
SKEGNSKELDIT

SEQ ID NO: 2119678 - protein, 6 aa, Cryptosporidium hominis
SKEKDA

SEQ ID NO: 2119679 - protein, 31 aa, Cryptosporidium hominis
SKEKRVSEKIEEEEDDDSTNYNERDRENKGW

SEQ ID NO: 2119680 - protein, 4 aa, Cryptosporidium hominis
SKEL

SEQ ID NO: 2119681 - protein, 7 aa, Cryptosporidium hominis
SKELTNR

SEQ ID NO: 2119682 - protein, 4 aa, Cryptosporidium hominis
SKEQ

SEQ ID NO: 2119683 - protein, 17 aa, Cryptosporidium hominis
SKERKPIKEEKKKQINR

SEQ ID NO: 2119684 - protein, 8 aa, Cryptosporidium hominis
SKESLGRK

SEQ ID NO: 2119685 - protein, 6 aa, Cryptosporidium hominis
SKESNI

SEQ ID NO: 2119686 - protein, 30 aa, Cryptosporidium hominis
SKETEPDTKNIEDKTKSSVKETEDDKAKEI

SEQ ID NO: 2119687 - protein, 6 aa, Cryptosporidium hominis
SKEVSS

SEQ ID NO: 2119688 - protein, 8 aa, Cryptosporidium hominis
SKEYTGAP

SEQ ID NO: 2119689 - protein, 10 aa, Cryptosporidium hominis
SKFEQSTSTC

SEQ ID NO: 2119690 - protein, 8 aa, Cryptosporidium hominis
SKFGKKRG

SEQ ID NO: 2119691 - protein, 4 aa, Cryptosporidium hominis
SKFP

SEQ ID NO: 2119692 - protein, 8 aa, Cryptosporidium hominis
SKFTSENN

SEQ ID NO: 2119693 - protein, 5 aa, Cryptosporidium hominis
SKGER

SEQ ID NO: 2119694 - protein, 7 aa, Cryptosporidium hominis
SKGGESF

SEQ ID NO: 2119695 - protein, 7 aa, Cryptosporidium hominis
SKGIESE

SEQ ID NO: 2119696 - protein, 6 aa, Cryptosporidium hominis
SKGITP

SEQ ID NO: 2119697 - protein, 8 aa, Cryptosporidium hominis
SKGRTEKN

SEQ ID NO: 2119698 - protein, 15 aa, Cryptosporidium hominis
SKGSGGINRQASTIT

SEQ ID NO: 2119699 - protein, 17 aa, Cryptosporidium hominis
SKGSSAQPKRTVFGYDF

SEQ ID NO: 2119700 - protein, 21 aa, Cryptosporidium hominis
SKHPEDDLDYPEGESSKDGFL

SEQ ID NO: 2119701 - protein, 7 aa, Cryptosporidium hominis
SKHSSCE

SEQ ID NO: 2119702 - protein, 7 aa, Cryptosporidium hominis
SKIESND

SEQ ID NO: 2119703 - protein, 6 aa, Cryptosporidium hominis
SKIGGN

SEQ ID NO: 2119704 - protein, 7 aa, Cryptosporidium hominis
SKIKEDK

SEQ ID NO: 2119705 - protein, 10 aa, Cryptosporidium hominis
SKIKNSKTNH

SEQ ID NO: 2119706 - protein, 10 aa, Cryptosporidium hominis
SKILDGQKQD

SEQ ID NO: 2119707 - protein, 14 aa, Cryptosporidium hominis
SKINSANESQPIQW

SEQ ID NO: 2119708 - protein, 23 aa, Cryptosporidium hominis
SKINSDIENADSKNTNSGEEESL

SEQ ID NO: 2119709 - protein, 22 aa, Cryptosporidium hominis
SKINSKKKVKTQKTGSNSNKTL

SEQ ID NO: 2119710 - protein, 13 aa, Cryptosporidium hominis
SKISGTNSKFNQK

SEQ ID NO: 2119711 - protein, 5 aa, Cryptosporidium hominis
SKKAL

SEQ ID NO: 2119712 - protein, 6 aa, Cryptosporidium hominis
SKKDEN

SEQ ID NO: 2119713 - protein, 15 aa, Cryptosporidium hominis
SKKEKNQDGIQGEND

SEQ ID NO: 2119714 - protein, 10 aa, Cryptosporidium hominis
SKKGISGGEM

SEQ ID NO: 2119715 - protein, 8 aa, Cryptosporidium hominis
SKKINDES

SEQ ID NO: 2119716 - protein, 8 aa, Cryptosporidium hominis
SKKKKGKI

SEQ ID NO: 2119717 - protein, 10 aa, Cryptosporidium hominis
SKKKKKNFRK

SEQ ID NO: 2119718 - protein, 33 aa, Cryptosporidium hominis
SKKKSKKKLNKFSKSSNSELEKQQNDKKEYYPT

SEQ ID NO: 2119719 - protein, 4 aa, Cryptosporidium hominis
SKKM

SEQ ID NO: 2119720 - protein, 6 aa, Cryptosporidium hominis
SKKNGW

SEQ ID NO: 2119721 - protein, 7 aa, Cryptosporidium hominis
SKKQNSN

SEQ ID NO: 2119722 - protein, 7 aa, Cryptosporidium hominis
SKKRSIK

SEQ ID NO: 2119723 - protein, 13 aa, Cryptosporidium hominis
SKKSEALNANEEQ

SEQ ID NO: 2119724 - protein, 5 aa, Cryptosporidium hominis
SKKSK

SEQ ID NO: 2119725 - protein, 8 aa, Cryptosporidium hominis
SKKSWQAR

SEQ ID NO: 2119726 - protein, 11 aa, Cryptosporidium hominis
SKLENSNGTQL

SEQ ID NO: 2119727 - protein, 6 aa, Cryptosporidium hominis
SKLGDQ

SEQ ID NO: 2119728 - protein, 4 aa, Cryptosporidium hominis
SKLK

SEQ ID NO: 2119729 - protein, 8 aa, Cryptosporidium hominis
SKLSQDED

SEQ ID NO: 2119730 - protein, 12 aa, Cryptosporidium hominis
SKLTASTLSESA

SEQ ID NO: 2119731 - protein, 12 aa, Cryptosporidium hominis
SKLTDNSNDINE

SEQ ID NO: 2119732 - protein, 5 aa, Cryptosporidium hominis
SKLTG

SEQ ID NO: 2119733 - protein, 15 aa, Cryptosporidium hominis
SKNDEDKNESDSSSW

SEQ ID NO: 2119734 - protein, 13 aa, Cryptosporidium hominis
SKNDESNNDPQDG

SEQ ID NO: 2119735 - protein, 7 aa, Cryptosporidium hominis
SKNENSP

SEQ ID NO: 2119736 - protein, 7 aa, Cryptosporidium hominis
SKNEQTE

SEQ ID NO: 2119737 - protein, 10 aa, Cryptosporidium hominis
SKNKKDKKEH

SEQ ID NO: 2119738 - protein, 8 aa, Cryptosporidium hominis
SKNKNKLY

SEQ ID NO: 2119739 - protein, 5 aa, Cryptosporidium hominis
SKNNL

SEQ ID NO: 2119740 - protein, 23 aa, Cryptosporidium hominis
SKNNNNSNNSEELKESPQNSSNC

SEQ ID NO: 2119741 - protein, 19 aa, Cryptosporidium hominis
SKNNNTNSSIMENNEKSNI

SEQ ID NO: 2119742 - protein, 10 aa, Cryptosporidium hominis
SKNNRKEELY

SEQ ID NO: 2119743 - protein, 7 aa, Cryptosporidium hominis
SKNPCPS

SEQ ID NO: 2119744 - protein, 17 aa, Cryptosporidium hominis
SKNPNSLQQTNNLANQT

SEQ ID NO: 2119745 - protein, 15 aa, Cryptosporidium hominis
SKNPTVISRTGNSDM

SEQ ID NO: 2119746 - protein, 7 aa, Cryptosporidium hominis
SKNQKDR

SEQ ID NO: 2119747 - protein, 8 aa, Cryptosporidium hominis
SKNQKYSL

SEQ ID NO: 2119748 - protein, 14 aa, Cryptosporidium hominis
SKNRNGILPKTTNN

SEQ ID NO: 2119749 - protein, 10 aa, Cryptosporidium hominis
SKNSCNHSQS

SEQ ID NO: 2119750 - protein, 5 aa, Cryptosporidium hominis
SKNSE

SEQ ID NO: 2119751 - protein, 12 aa, Cryptosporidium hominis
SKNSQKTNTYGD

SEQ ID NO: 2119752 - protein, 9 aa, Cryptosporidium hominis
SKNSSMNEQ

SEQ ID NO: 2119753 - protein, 8 aa, Cryptosporidium hominis
SKNTGSVE

SEQ ID NO: 2119754 - protein, 5 aa, Cryptosporidium hominis
SKNTP

SEQ ID NO: 2119755 - protein, 5 aa, Cryptosporidium hominis
SKNTR

SEQ ID NO: 2119756 - protein, 7 aa, Cryptosporidium hominis
SKNTYYS

SEQ ID NO: 2119757 - protein, 10 aa, Cryptosporidium hominis
SKPENDDKLE

SEQ ID NO: 2119758 - protein, 5 aa, Cryptosporidium hominis
SKPLG

SEQ ID NO: 2119759 - protein, 9 aa, Cryptosporidium hominis
SKPSMSPSE

SEQ ID NO: 2119760 - protein, 10 aa, Cryptosporidium hominis
SKPTGGGSIG

SEQ ID NO: 2119761 - protein, 4 aa, Cryptosporidium hominis
SKPY

SEQ ID NO: 2119762 - protein, 7 aa, Cryptosporidium hominis
SKQIGTS

SEQ ID NO: 2119763 - protein, 11 aa, Cryptosporidium hominis
SKQNEGGIKQP

SEQ ID NO: 2119764 - protein, 6 aa, Cryptosporidium hominis
SKQPAN

SEQ ID NO: 2119765 - protein, 7 aa, Cryptosporidium hominis
SKQRIDT

SEQ ID NO: 2119766 - protein, 6 aa, Cryptosporidium hominis
SKRSTR

SEQ ID NO: 2119767 - protein, 4 aa, Cryptosporidium hominis
SKRT

SEQ ID NO: 2119768 - protein, 14 aa, Cryptosporidium hominis
SKSAEENAVSSKKE

SEQ ID NO: 2119769 - protein, 8 aa, Cryptosporidium hominis
SKSASSQI

SEQ ID NO: 2119770 - protein, 10 aa, Cryptosporidium hominis
SKSDSSTIEN

SEQ ID NO: 2119771 - protein, 6 aa, Cryptosporidium hominis
SKSETI

SEQ ID NO: 2119772 - protein, 4 aa, Cryptosporidium hominis
SKSG

SEQ ID NO: 2119773 - protein, 5 aa, Cryptosporidium hominis
SKSIE

SEQ ID NO: 2119774 - protein, 7 aa, Cryptosporidium hominis
SKSKEFS

SEQ ID NO: 2119775 - protein, 5 aa, Cryptosporidium hominis
SKSKK

SEQ ID NO: 2119776 - protein, 10 aa, Cryptosporidium hominis
SKSKTKSLRT

SEQ ID NO: 2119777 - protein, 7 aa, Cryptosporidium hominis
SKSNSRK

SEQ ID NO: 2119778 - protein, 11 aa, Cryptosporidium hominis
SKSNSTESNAM

SEQ ID NO: 2119779 - protein, 5 aa, Cryptosporidium hominis
SKSPM

SEQ ID NO: 2119780 - protein, 7 aa, Cryptosporidium hominis
SKSRSIK

SEQ ID NO: 2119781 - protein, 4 aa, Cryptosporidium hominis
SKSS

SEQ ID NO: 2119782 - protein, 11 aa, Cryptosporidium hominis
SKSSITAAGRV

SEQ ID NO: 2119783 - protein, 7 aa, Cryptosporidium hominis
SKSSNNS

SEQ ID NO: 2119784 - protein, 18 aa, Cryptosporidium hominis
SKSSPEISSPSTKKGLKS

SEQ ID NO: 2119785 - protein, 12 aa, Cryptosporidium hominis
SKSSPTYDAEAS

SEQ ID NO: 2119786 - protein, 9 aa, Cryptosporidium hominis
SKSSRISKS

SEQ ID NO: 2119787 - protein, 9 aa, Cryptosporidium hominis
SKSSRKDAV

SEQ ID NO: 2119788 - protein, 23 aa, Cryptosporidium hominis
SKSVDKDAMRNGERAGKIKPTGI

SEQ ID NO: 2119789 - protein, 20 aa, Cryptosporidium hominis
SKTEEIEEKTIQTTNNTRTA

SEQ ID NO: 2119790 - protein, 5 aa, Cryptosporidium hominis
SKTLN

SEQ ID NO: 2119791 - protein, 9 aa, Cryptosporidium hominis
SKTNASQEI

SEQ ID NO: 2119792 - protein, 9 aa, Cryptosporidium hominis
SKTNKNHSN

SEQ ID NO: 2119793 - protein, 7 aa, Cryptosporidium hominis
SKTNPNI

SEQ ID NO: 2119794 - protein, 18 aa, Cryptosporidium hominis
SKTNSISQNNKTSKIPAN

SEQ ID NO: 2119795 - protein, 7 aa, Cryptosporidium hominis
SKTNTSH

SEQ ID NO: 2119796 - protein, 5 aa, Cryptosporidium hominis
SKTPY

SEQ ID NO: 2119797 - protein, 13 aa, Cryptosporidium hominis
SKTRGKSSSDITE

SEQ ID NO: 2119798 - protein, 6 aa, Cryptosporidium hominis
SKTSKE

SEQ ID NO: 2119799 - protein, 8 aa, Cryptosporidium hominis
SKTTDSKI

SEQ ID NO: 2119800 - protein, 6 aa, Cryptosporidium hominis
SKVNES

SEQ ID NO: 2119801 - protein, 13 aa, Cryptosporidium hominis
SKVSKNEVKHANK

SEQ ID NO: 2119802 - protein, 10 aa, Cryptosporidium hominis
SKVSSFPKTG

SEQ ID NO: 2119803 - protein, 11 aa, Cryptosporidium hominis
SKWSNKNKFEL

SEQ ID NO: 2119804 - protein, 10 aa, Cryptosporidium hominis
SKYDFKTGNI

SEQ ID NO: 2119805 - protein, 8 aa, Cryptosporidium hominis
SKYDQEES

SEQ ID NO: 2119806 - protein, 9 aa, Cryptosporidium hominis
SKYFNDSND

SEQ ID NO: 2119807 - protein, 4 aa, Cryptosporidium hominis
SKYG

SEQ ID NO: 2119808 - protein, 7 aa, Cryptosporidium hominis
SKYKNYT

SEQ ID NO: 2119809 - protein, 6 aa, Cryptosporidium hominis
SKYQTN

SEQ ID NO: 2119810 - protein, 6 aa, Cryptosporidium hominis
SKYRKV

SEQ ID NO: 2119811 - protein, 18 aa, Cryptosporidium hominis
SKYSEAMDSQDLRNYQNS

SEQ ID NO: 2119812 - protein, 5 aa, Cryptosporidium hominis
SKYSS

SEQ ID NO: 2119813 - protein, 15 aa, Cryptosporidium hominis
SLADSRCDSSTNDLN

SEQ ID NO: 2119814 - protein, 14 aa, Cryptosporidium hominis
SLAEGRAKHSAGVS

SEQ ID NO: 2119815 - protein, 24 aa, Cryptosporidium hominis
SLAKASKKNGSRQIPESTEVRDPG

SEQ ID NO: 2119816 - protein, 8 aa, Cryptosporidium hominis
SLAKGGQD

SEQ ID NO: 2119817 - protein, 4 aa, Cryptosporidium hominis
SLAR

SEQ ID NO: 2119818 - protein, 6 aa, Cryptosporidium hominis
SLDEEH

SEQ ID NO: 2119819 - protein, 14 aa, Cryptosporidium hominis
SLDISSPQSRFENN

SEQ ID NO: 2119820 - protein, 11 aa, Cryptosporidium hominis
SLDQDGNGVLT

SEQ ID NO: 2119821 - protein, 25 aa, Cryptosporidium hominis
SLDQSSDSSSYDIEDASQNSNKSFS

SEQ ID NO: 2119822 - protein, 17 aa, Cryptosporidium hominis
SLDSSQQSSSKNSLTQP

SEQ ID NO: 2119823 - protein, 8 aa, Cryptosporidium hominis
SLEDESSS

SEQ ID NO: 2119824 - protein, 28 aa, Cryptosporidium hominis
SLEDGDKNTSESKQNLGSFDKSQSENPL

SEQ ID NO: 2119825 - protein, 8 aa, Cryptosporidium hominis
SLEEPEKT

SEQ ID NO: 2119826 - protein, 8 aa, Cryptosporidium hominis
SLEERPDE

SEQ ID NO: 2119827 - protein, 13 aa, Cryptosporidium hominis
SLEHEKSSFNNSL

SEQ ID NO: 2119828 - protein, 11 aa, Cryptosporidium hominis
SLENGKNKLNN

SEQ ID NO: 2119829 - protein, 12 aa, Cryptosporidium hominis
SLENGNSSTNSI

SEQ ID NO: 2119830 - protein, 4 aa, Cryptosporidium hominis
SLEP

SEQ ID NO: 2119831 - protein, 6 aa, Cryptosporidium hominis
SLGAQY

SEQ ID NO: 2119832 - protein, 6 aa, Cryptosporidium hominis
SLGGSE

SEQ ID NO: 2119833 - protein, 6 aa, Cryptosporidium hominis
SLGLDP

SEQ ID NO: 2119834 - protein, 11 aa, Cryptosporidium hominis
SLGNQSNIDTS

SEQ ID NO: 2119835 - protein, 8 aa, Cryptosporidium hominis
SLGSDNKD

SEQ ID NO: 2119836 - protein, 7 aa, Cryptosporidium hominis
SLGSSTT

SEQ ID NO: 2119837 - protein, 10 aa, Cryptosporidium hominis
SLKDSYNTDP

SEQ ID NO: 2119838 - protein, 5 aa, Cryptosporidium hominis
SLKED

SEQ ID NO: 2119839 - protein, 21 aa, Cryptosporidium hominis
SLKENIKDKKSMNTIKTTKSN

SEQ ID NO: 2119840 - protein, 8 aa, Cryptosporidium hominis
SLLSNSER

SEQ ID NO: 2119841 - protein, 14 aa, Cryptosporidium hominis
SLNDSDLTDYKKGD

SEQ ID NO: 2119842 - protein, 5 aa, Cryptosporidium hominis
SLNEG

SEQ ID NO: 2119843 - protein, 7 aa, Cryptosporidium hominis
SLNKMNK

SEQ ID NO: 2119844 - protein, 16 aa, Cryptosporidium hominis
SLNNGTGKEKKDSSFT

SEQ ID NO: 2119845 - protein, 5 aa, Cryptosporidium hominis
SLNQD

SEQ ID NO: 2119846 - protein, 7 aa, Cryptosporidium hominis
SLNQSAS

SEQ ID NO: 2119847 - protein, 6 aa, Cryptosporidium hominis
SLNSKD

SEQ ID NO: 2119848 - protein, 9 aa, Cryptosporidium hominis
SLNSNNISK

SEQ ID NO: 2119849 - protein, 44 aa, Cryptosporidium hominis
SLNTAASVAAPAQGESASVRAPTDTGSTPSSNTNVSEAYRTSSN

SEQ ID NO: 2119850 - protein, 9 aa, Cryptosporidium hominis
SLPGNKDKT

SEQ ID NO: 2119851 - protein, 13 aa, Cryptosporidium hominis
SLPGRTSSNSLNT

SEQ ID NO: 2119852 - protein, 7 aa, Cryptosporidium hominis
SLPKITG

SEQ ID NO: 2119853 - protein, 7 aa, Cryptosporidium hominis
SLPNDYD

SEQ ID NO: 2119854 - protein, 5 aa, Cryptosporidium hominis
SLPRS

SEQ ID NO: 2119855 - protein, 4 aa, Cryptosporidium hominis
SLQI

SEQ ID NO: 2119856 - protein, 7 aa, Cryptosporidium hominis
SLQSNQI

SEQ ID NO: 2119857 - protein, 4 aa, Cryptosporidium hominis
SLRR

SEQ ID NO: 2119858 - protein, 8 aa, Cryptosporidium hominis
SLRSPKAW

SEQ ID NO: 2119859 - protein, 16 aa, Cryptosporidium hominis
SLRYGPNVKRKTPGKR

SEQ ID NO: 2119860 - protein, 13 aa, Cryptosporidium hominis
SLSHEKNNNQPEL

SEQ ID NO: 2119861 - protein, 9 aa, Cryptosporidium hominis
SLSHSPTNF

SEQ ID NO: 2119862 - protein, 13 aa, Cryptosporidium hominis
SLSKRSQLSRNSD

SEQ ID NO: 2119863 - protein, 6 aa, Cryptosporidium hominis
SLSNIE

SEQ ID NO: 2119864 - protein, 16 aa, Cryptosporidium hominis
SLSNKQCSRKLNDTWQ

SEQ ID NO: 2119865 - protein, 9 aa, Cryptosporidium hominis
SLSNPAGMN

SEQ ID NO: 2119866 - protein, 19 aa, Cryptosporidium hominis
SLSPKSMHQRSDVDSETTE

SEQ ID NO: 2119867 - protein, 11 aa, Cryptosporidium hominis
SLSPQSPEYGR

SEQ ID NO: 2119868 - protein, 7 aa, Cryptosporidium hominis
SLSPTSE

SEQ ID NO: 2119869 - protein, 7 aa, Cryptosporidium hominis
SLSRNGQ

SEQ ID NO: 2119870 - protein, 8 aa, Cryptosporidium hominis
SLSRSSPL

SEQ ID NO: 2119871 - protein, 5 aa, Cryptosporidium hominis
SLSTK

SEQ ID NO: 2119872 - protein, 12 aa, Cryptosporidium hominis
SLSTNQIQNQNQ

SEQ ID NO: 2119873 - protein, 9 aa, Cryptosporidium hominis
SLTDNPQFT

SEQ ID NO: 2119874 - protein, 13 aa, Cryptosporidium hominis
SLTKGKLRKTDDL

SEQ ID NO: 2119875 - protein, 20 aa, Cryptosporidium hominis
SLTNSSKKISRSKSNLLSED

SEQ ID NO: 2119876 - protein, 4 aa, Cryptosporidium hominis
SLTP

SEQ ID NO: 2119877 - protein, 10 aa, Cryptosporidium hominis
SLTQEKIESA

SEQ ID NO: 2119878 - protein, 14 aa, Cryptosporidium hominis
SLYTPKTENVRTSA

SEQ ID NO: 2119879 - protein, 8 aa, Cryptosporidium hominis
SMASNTPI

SEQ ID NO: 2119880 - protein, 7 aa, Cryptosporidium hominis
SMDGETN

SEQ ID NO: 2119881 - protein, 6 aa, Cryptosporidium hominis
SMETQN

SEQ ID NO: 2119882 - protein, 7 aa, Cryptosporidium hominis
SMNTSEY

SEQ ID NO: 2119883 - protein, 6 aa, Cryptosporidium hominis
SMSKDE

SEQ ID NO: 2119884 - protein, 9 aa, Cryptosporidium hominis
SMSPKNSAS

SEQ ID NO: 2119885 - protein, 21 aa, Cryptosporidium hominis
SMTKKSDDSKTASNSDKKAIK

SEQ ID NO: 2119886 - protein, 7 aa, Cryptosporidium hominis
SNAAKHS

SEQ ID NO: 2119887 - protein, 9 aa, Cryptosporidium hominis
SNAEKGVAQ

SEQ ID NO: 2119888 - protein, 10 aa, Cryptosporidium hominis
SNAKNLCESN

SEQ ID NO: 2119889 - protein, 22 aa, Cryptosporidium hominis
SNANENSQKSSSAQVNNNLNSD

SEQ ID NO: 2119890 - protein, 30 aa, Cryptosporidium hominis
SNAPSKKSGKKSSKNDGSNRGQGQNTRTFE

SEQ ID NO: 2119891 - protein, 7 aa, Cryptosporidium hominis
SNAPSTR

SEQ ID NO: 2119892 - protein, 5 aa, Cryptosporidium hominis
SNAQK

SEQ ID NO: 2119893 - protein, 4 aa, Cryptosporidium hominis
SNAT

SEQ ID NO: 2119894 - protein, 25 aa, Cryptosporidium hominis
SNATNNSKEGEGIIGSGKGGGKRRR

SEQ ID NO: 2119895 - protein, 6 aa, Cryptosporidium hominis
SNCAPK

SEQ ID NO: 2119896 - protein, 14 aa, Cryptosporidium hominis
SNCEIPEYSSESSD

SEQ ID NO: 2119897 - protein, 21 aa, Cryptosporidium hominis
SNDEGGNHTSSYKFSQGNDQF

SEQ ID NO: 2119898 - protein, 6 aa, Cryptosporidium hominis
SNDELE

SEQ ID NO: 2119899 - protein, 28 aa, Cryptosporidium hominis
SNDISDKDKRMNDDYDSRSEKDKNNDKV

SEQ ID NO: 2119900 - protein, 17 aa, Cryptosporidium hominis
SNDKKDQNELKNSPKIQ

SEQ ID NO: 2119901 - protein, 4 aa, Cryptosporidium hominis
SNDL

SEQ ID NO: 2119902 - protein, 6 aa, Cryptosporidium hominis
SNDNNV

SEQ ID NO: 2119903 - protein, 12 aa, Cryptosporidium hominis
SNDPERPPNHNN

SEQ ID NO: 2119904 - protein, 13 aa, Cryptosporidium hominis
SNDQKGSVDQHDK

SEQ ID NO: 2119905 - protein, 10 aa, Cryptosporidium hominis
SNDQVSKKES

SEQ ID NO: 2119906 - protein, 4 aa, Cryptosporidium hominis
SNDS

SEQ ID NO: 2119907 - protein, 15 aa, Cryptosporidium hominis
SNDSDSNNNSNNNCE

SEQ ID NO: 2119908 - protein, 5 aa, Cryptosporidium hominis
SNDSG

SEQ ID NO: 2119909 - protein, 5 aa, Cryptosporidium hominis
SNDSP

SEQ ID NO: 2119910 - protein, 8 aa, Cryptosporidium hominis
SNDSQNSL

SEQ ID NO: 2119911 - protein, 8 aa, Cryptosporidium hominis
SNEERKKT

SEQ ID NO: 2119912 - protein, 6 aa, Cryptosporidium hominis
SNEFNQ

SEQ ID NO: 2119913 - protein, 5 aa, Cryptosporidium hominis
SNEHY

SEQ ID NO: 2119914 - protein, 6 aa, Cryptosporidium hominis
SNEKKP

SEQ ID NO: 2119915 - protein, 13 aa, Cryptosporidium hominis
SNEKLERKSNCGE

SEQ ID NO: 2119916 - protein, 8 aa, Cryptosporidium hominis
SNEKNIKQ

SEQ ID NO: 2119917 - protein, 9 aa, Cryptosporidium hominis
SNEKNSGIV

SEQ ID NO: 2119918 - protein, 7 aa, Cryptosporidium hominis
SNENNYF

SEQ ID NO: 2119919 - protein, 22 aa, Cryptosporidium hominis
SNEQELSSTGRINNKSSTGRIS

SEQ ID NO: 2119920 - protein, 4 aa, Cryptosporidium hominis
SNES

SEQ ID NO: 2119921 - protein, 8 aa, Cryptosporidium hominis
SNESSTLG

SEQ ID NO: 2119922 - protein, 14 aa, Cryptosporidium hominis
SNETKSKVFKKIKH

SEQ ID NO: 2119923 - protein, 11 aa, Cryptosporidium hominis
SNETRTRARGL

SEQ ID NO: 2119924 - protein, 4 aa, Cryptosporidium hominis
SNEY

SEQ ID NO: 2119925 - protein, 4 aa, Cryptosporidium hominis
SNFG

SEQ ID NO: 2119926 - protein, 6 aa, Cryptosporidium hominis
SNFKRE

SEQ ID NO: 2119927 - protein, 5 aa, Cryptosporidium hominis
SNFSG

SEQ ID NO: 2119928 - protein, 5 aa, Cryptosporidium hominis
SNFSQ

SEQ ID NO: 2119929 - protein, 14 aa, Cryptosporidium hominis
SNGAKATKKSSSFH

SEQ ID NO: 2119930 - protein, 18 aa, Cryptosporidium hominis
SNGESKRTSVSSKGSEEF

SEQ ID NO: 2119931 - protein, 9 aa, Cryptosporidium hominis
SNGGNNQKY

SEQ ID NO: 2119932 - protein, 7 aa, Cryptosporidium hominis
SNGGSSL

SEQ ID NO: 2119933 - protein, 12 aa, Cryptosporidium hominis
SNGIEKIKKENQ

SEQ ID NO: 2119934 - protein, 18 aa, Cryptosporidium hominis
SNGLKQDTFGYSTSSETL

SEQ ID NO: 2119935 - protein, 8 aa, Cryptosporidium hominis
SNGNTGIN

SEQ ID NO: 2119936 - protein, 6 aa, Cryptosporidium hominis
SNGPLT

SEQ ID NO: 2119937 - protein, 5 aa, Cryptosporidium hominis
SNGPT

SEQ ID NO: 2119938 - protein, 5 aa, Cryptosporidium hominis
SNGQK

SEQ ID NO: 2119939 - protein, 7 aa, Cryptosporidium hominis
SNGQVEQ

SEQ ID NO: 2119940 - protein, 10 aa, Cryptosporidium hominis
SNGRGRDTSC

SEQ ID NO: 2119941 - protein, 24 aa, Cryptosporidium hominis
SNGRQESQYTGNTLTTKSSEQKDL

SEQ ID NO: 2119942 - protein, 13 aa, Cryptosporidium hominis
SNHFSSSSTIPST

SEQ ID NO: 2119943 - protein, 7 aa, Cryptosporidium hominis
SNHPGKN

SEQ ID NO: 2119944 - protein, 5 aa, Cryptosporidium hominis
SNHQR

SEQ ID NO: 2119945 - protein, 4 aa, Cryptosporidium hominis
SNID

SEQ ID NO: 2119946 - protein, 4 aa, Cryptosporidium hominis
SNIE

SEQ ID NO: 2119947 - protein, 21 aa, Cryptosporidium hominis
SNIHRRESGKSEKRSPKLPKG

SEQ ID NO: 2119948 - protein, 9 aa, Cryptosporidium hominis
SNIKNRGEL

SEQ ID NO: 2119949 - protein, 17 aa, Cryptosporidium hominis
SNIPGSPPGTKKNNYTT

SEQ ID NO: 2119950 - protein, 5 aa, Cryptosporidium hominis
SNIPK

SEQ ID NO: 2119951 - protein, 11 aa, Cryptosporidium hominis
SNISESLNDDI

SEQ ID NO: 2119952 - protein, 16 aa, Cryptosporidium hominis
SNISSAIDNKKSNFQE

SEQ ID NO: 2119953 - protein, 63 aa, Cryptosporidium hominis
SNITANPPSSIVTSSSSIATNPPSNITTTTTTSPSKTPGASNPFTENQEEEHGHYKESNYSPE

SEQ ID NO: 2119954 - protein, 8 aa, Cryptosporidium hominis
SNITTKSI

SEQ ID NO: 2119955 - protein, 13 aa, Cryptosporidium hominis
SNKEEKSRSTPIQ

SEQ ID NO: 2119956 - protein, 5 aa, Cryptosporidium hominis
SNKEY

SEQ ID NO: 2119957 - protein, 11 aa, Cryptosporidium hominis
SNKKKLSKNRN

SEQ ID NO: 2119958 - protein, 10 aa, Cryptosporidium hominis
SNKNAGKEFN

SEQ ID NO: 2119959 - protein, 17 aa, Cryptosporidium hominis
SNKNRNNGSDEKINGTV

SEQ ID NO: 2119960 - protein, 10 aa, Cryptosporidium hominis
SNKNYQEDSI

SEQ ID NO: 2119961 - protein, 4 aa, Cryptosporidium hominis
SNKR

SEQ ID NO: 2119962 - protein, 7 aa, Cryptosporidium hominis
SNKRNNQ

SEQ ID NO: 2119963 - protein, 5 aa, Cryptosporidium hominis
SNKTD

SEQ ID NO: 2119964 - protein, 8 aa, Cryptosporidium hominis
SNKTHRLS

SEQ ID NO: 2119965 - protein, 13 aa, Cryptosporidium hominis
SNKTTCPLCISLM

SEQ ID NO: 2119966 - protein, 9 aa, Cryptosporidium hominis
SNKVEQTQI

SEQ ID NO: 2119967 - protein, 5 aa, Cryptosporidium hominis
SNLAN

SEQ ID NO: 2119968 - protein, 5 aa, Cryptosporidium hominis
SNLGD

SEQ ID NO: 2119969 - protein, 10 aa, Cryptosporidium hominis
SNLKSNNSFT

SEQ ID NO: 2119970 - protein, 48 aa, Cryptosporidium hominis
SNLNGKPKDTGESKSPQRTNRGPSYTLRNTSSSQNPQSNAQKAVSPTR

SEQ ID NO: 2119971 - protein, 13 aa, Cryptosporidium hominis
SNLNNTATTSTTT

SEQ ID NO: 2119972 - protein, 17 aa, Cryptosporidium hominis
SNLSKESKKELNSKSNL

SEQ ID NO: 2119973 - protein, 10 aa, Cryptosporidium hominis
SNLTNEPSEL

SEQ ID NO: 2119974 - protein, 17 aa, Cryptosporidium hominis
SNMGSNEHIGERNLSNE

SEQ ID NO: 2119975 - protein, 23 aa, Cryptosporidium hominis
SNMNNNNNNNNNNNIQEKNNNIY

SEQ ID NO: 2119976 - protein, 4 aa, Cryptosporidium hominis
SNND

SEQ ID NO: 2119977 - protein, 13 aa, Cryptosporidium hominis
SNNDASNFSPQLE

SEQ ID NO: 2119978 - protein, 18 aa, Cryptosporidium hominis
SNNEDPTDSQSNNATQTT

SEQ ID NO: 2119979 - protein, 6 aa, Cryptosporidium hominis
SNNEEL

SEQ ID NO: 2119980 - protein, 14 aa, Cryptosporidium hominis
SNNETESQDKNATN

SEQ ID NO: 2119981 - protein, 9 aa, Cryptosporidium hominis
SNNKDNYNM

SEQ ID NO: 2119982 - protein, 6 aa, Cryptosporidium hominis
SNNKKS

SEQ ID NO: 2119983 - protein, 8 aa, Cryptosporidium hominis
SNNKSNIN

SEQ ID NO: 2119984 - protein, 7 aa, Cryptosporidium hominis
SNNKTQA

SEQ ID NO: 2119985 - protein, 6 aa, Cryptosporidium hominis
SNNKTY

SEQ ID NO: 2119986 - protein, 7 aa, Cryptosporidium hominis
SNNLSEL

SEQ ID NO: 2119987 - protein, 5 aa, Cryptosporidium hominis
SNNNK

SEQ ID NO: 2119988 - protein, 9 aa, Cryptosporidium hominis
SNNNKEVNN

SEQ ID NO: 2119989 - protein, 8 aa, Cryptosporidium hominis
SNNNNGQF

SEQ ID NO: 2119990 - protein, 9 aa, Cryptosporidium hominis
SNNNNKPSK

SEQ ID NO: 2119991 - protein, 12 aa, Cryptosporidium hominis
SNNNNNNGSNNE

SEQ ID NO: 2119992 - protein, 13 aa, Cryptosporidium hominis
SNNPFHGNSAGTT

SEQ ID NO: 2119993 - protein, 8 aa, Cryptosporidium hominis
SNNPYSKK

SEQ ID NO: 2119994 - protein, 12 aa, Cryptosporidium hominis
SNNQNSGKSNRI

SEQ ID NO: 2119995 - protein, 11 aa, Cryptosporidium hominis
SNNQPFNQKSS

SEQ ID NO: 2119996 - protein, 4 aa, Cryptosporidium hominis
SNNR

SEQ ID NO: 2119997 - protein, 7 aa, Cryptosporidium hominis
SNNRELG

SEQ ID NO: 2119998 - protein, 20 aa, Cryptosporidium hominis
SNNSNINSSCSSGNISNNNI

SEQ ID NO: 2119999 - protein, 6 aa, Cryptosporidium hominis
SNNSSE

SEQ ID NO: 2120000 - protein, 11 aa, Cryptosporidium hominis
SNNVPNSSFDD

SEQ ID NO: 2120001 - protein, 10 aa, Cryptosporidium hominis
SNNYNSTNYN

SEQ ID NO: 2120002 - protein, 12 aa, Cryptosporidium hominis
SNPDQDQDHKIG

SEQ ID NO: 2120003 - protein, 6 aa, Cryptosporidium hominis
SNPDRK

SEQ ID NO: 2120004 - protein, 6 aa, Cryptosporidium hominis
SNPEAR

SEQ ID NO: 2120005 - protein, 14 aa, Cryptosporidium hominis
SNPEDIEESPAQVN

SEQ ID NO: 2120006 - protein, 5 aa, Cryptosporidium hominis
SNPEF

SEQ ID NO: 2120007 - protein, 9 aa, Cryptosporidium hominis
SNPERKKEF

SEQ ID NO: 2120008 - protein, 4 aa, Cryptosporidium hominis
SNPG

SEQ ID NO: 2120009 - protein, 10 aa, Cryptosporidium hominis
SNPNIPDRNG

SEQ ID NO: 2120010 - protein, 24 aa, Cryptosporidium hominis
SNPPFTSATKPNSGIEKKPPLTHG

SEQ ID NO: 2120011 - protein, 11 aa, Cryptosporidium hominis
SNPSTSISSCG

SEQ ID NO: 2120012 - protein, 12 aa, Cryptosporidium hominis
SNQEEVLPSGSS

SEQ ID NO: 2120013 - protein, 27 aa, Cryptosporidium hominis
SNQEQNHSESPTKKSRTSLNKSNSQGN

SEQ ID NO: 2120014 - protein, 7 aa, Cryptosporidium hominis
SNQIGGE

SEQ ID NO: 2120015 - protein, 9 aa, Cryptosporidium hominis
SNQPDSPLK

SEQ ID NO: 2120016 - protein, 8 aa, Cryptosporidium hominis
SNQPPECQ

SEQ ID NO: 2120017 - protein, 8 aa, Cryptosporidium hominis
SNQTNLAK

SEQ ID NO: 2120018 - protein, 9 aa, Cryptosporidium hominis
SNRDGKSNL

SEQ ID NO: 2120019 - protein, 13 aa, Cryptosporidium hominis
SNRGKKKRKAKKY

SEQ ID NO: 2120020 - protein, 8 aa, Cryptosporidium hominis
SNRKEGKL

SEQ ID NO: 2120021 - protein, 7 aa, Cryptosporidium hominis
SNRNPPN

SEQ ID NO: 2120022 - protein, 7 aa, Cryptosporidium hominis
SNRYYPT

SEQ ID NO: 2120023 - protein, 4 aa, Cryptosporidium hominis
SNSD

SEQ ID NO: 2120024 - protein, 11 aa, Cryptosporidium hominis
SNSDNQNYGEK

SEQ ID NO: 2120025 - protein, 13 aa, Cryptosporidium hominis
SNSDSNKDSDSIT

SEQ ID NO: 2120026 - protein, 7 aa, Cryptosporidium hominis
SNSDTGI

SEQ ID NO: 2120027 - protein, 4 aa, Cryptosporidium hominis
SNSE

SEQ ID NO: 2120028 - protein, 6 aa, Cryptosporidium hominis
SNSEPS

SEQ ID NO: 2120029 - protein, 9 aa, Cryptosporidium hominis
SNSESEYSK

SEQ ID NO: 2120030 - protein, 6 aa, Cryptosporidium hominis
SNSESV

SEQ ID NO: 2120031 - protein, 24 aa, Cryptosporidium hominis
SNSEYSQISSQSNQSLDQEREAMQ

SEQ ID NO: 2120032 - protein, 5 aa, Cryptosporidium hominis
SNSGH

SEQ ID NO: 2120033 - protein, 6 aa, Cryptosporidium hominis
SNSGIG

SEQ ID NO: 2120034 - protein, 9 aa, Cryptosporidium hominis
SNSGSKEKE

SEQ ID NO: 2120035 - protein, 4 aa, Cryptosporidium hominis
SNSI

SEQ ID NO: 2120036 - protein, 5 aa, Cryptosporidium hominis
SNSIQ

SEQ ID NO: 2120037 - protein, 4 aa, Cryptosporidium hominis
SNSL

SEQ ID NO: 2120038 - protein, 7 aa, Cryptosporidium hominis
SNSNEKC

SEQ ID NO: 2120039 - protein, 14 aa, Cryptosporidium hominis
SNSNGRLGTGGSYG

SEQ ID NO: 2120040 - protein, 6 aa, Cryptosporidium hominis
SNSNSW

SEQ ID NO: 2120041 - protein, 5 aa, Cryptosporidium hominis
SNSQS

SEQ ID NO: 2120042 - protein, 14 aa, Cryptosporidium hominis
SNSRRDFTSESISS

SEQ ID NO: 2120043 - protein, 8 aa, Cryptosporidium hominis
SNSSSASL

SEQ ID NO: 2120044 - protein, 8 aa, Cryptosporidium hominis
SNSTNTHK

SEQ ID NO: 2120045 - protein, 9 aa, Cryptosporidium hominis
SNSVDGTEK

SEQ ID NO: 2120046 - protein, 4 aa, Cryptosporidium hominis
SNTA

SEQ ID NO: 2120047 - protein, 4 aa, Cryptosporidium hominis
SNTG

SEQ ID NO: 2120048 - protein, 6 aa, Cryptosporidium hominis
SNTHSN

SEQ ID NO: 2120049 - protein, 10 aa, Cryptosporidium hominis
SNTKDTQAIS

SEQ ID NO: 2120050 - protein, 4 aa, Cryptosporidium hominis
SNTN

SEQ ID NO: 2120051 - protein, 10 aa, Cryptosporidium hominis
SNTNNSFNVG

SEQ ID NO: 2120052 - protein, 18 aa, Cryptosporidium hominis
SNTNTLAKAAETKNSNSR

SEQ ID NO: 2120053 - protein, 13 aa, Cryptosporidium hominis
SNTPEYNNKPPEI

SEQ ID NO: 2120054 - protein, 9 aa, Cryptosporidium hominis
SNTPRTLPT

SEQ ID NO: 2120055 - protein, 10 aa, Cryptosporidium hominis
SNTQAPKIDR

SEQ ID NO: 2120056 - protein, 4 aa, Cryptosporidium hominis
SNTR

SEQ ID NO: 2120057 - protein, 10 aa, Cryptosporidium hominis
SNTRESSSNR

SEQ ID NO: 2120058 - protein, 9 aa, Cryptosporidium hominis
SNTSAPSPV

SEQ ID NO: 2120059 - protein, 9 aa, Cryptosporidium hominis
SNTSSESKL

SEQ ID NO: 2120060 - protein, 12 aa, Cryptosporidium hominis
SNTTNNNNLGDN

SEQ ID NO: 2120061 - protein, 5 aa, Cryptosporidium hominis
SNTYN

SEQ ID NO: 2120062 - protein, 7 aa, Cryptosporidium hominis
SNVASTT

SEQ ID NO: 2120063 - protein, 5 aa, Cryptosporidium hominis
SNVDD

SEQ ID NO: 2120064 - protein, 24 aa, Cryptosporidium hominis
SNVNNLNNSLPSLTHNNANENSEI

SEQ ID NO: 2120065 - protein, 10 aa, Cryptosporidium hominis
SNVPQTPRQS

SEQ ID NO: 2120066 - protein, 4 aa, Cryptosporidium hominis
SNVS

SEQ ID NO: 2120067 - protein, 9 aa, Cryptosporidium hominis
SNVSKDKIN

SEQ ID NO: 2120068 - protein, 6 aa, Cryptosporidium hominis
SNYCEE

SEQ ID NO: 2120069 - protein, 12 aa, Cryptosporidium hominis
SNYDQVANLESE

SEQ ID NO: 2120070 - protein, 23 aa, Cryptosporidium hominis
SNYDSSNDSESAKTQSSYSDNSL

SEQ ID NO: 2120071 - protein, 28 aa, Cryptosporidium hominis
SNYENEPKKDKLITSASNRSQKNSYNKH

SEQ ID NO: 2120072 - protein, 5 aa, Cryptosporidium hominis
SNYIK

SEQ ID NO: 2120073 - protein, 15 aa, Cryptosporidium hominis
SNYKSNNDNSSISTL

SEQ ID NO: 2120074 - protein, 5 aa, Cryptosporidium hominis
SNYLG

SEQ ID NO: 2120075 - protein, 11 aa, Cryptosporidium hominis
SNYQMNSEREN

SEQ ID NO: 2120076 - protein, 5 aa, Cryptosporidium hominis
SPADN

SEQ ID NO: 2120077 - protein, 6 aa, Cryptosporidium hominis
SPALSD

SEQ ID NO: 2120078 - protein, 13 aa, Cryptosporidium hominis
SPAPEPTQPTVEE

SEQ ID NO: 2120079 - protein, 5 aa, Cryptosporidium hominis
SPASE

SEQ ID NO: 2120080 - protein, 5 aa, Cryptosporidium hominis
SPCPN

SEQ ID NO: 2120081 - protein, 16 aa, Cryptosporidium hominis
SPDKYSSSSKGPGFSD

SEQ ID NO: 2120082 - protein, 4 aa, Cryptosporidium hominis
SPDL

SEQ ID NO: 2120083 - protein, 18 aa, Cryptosporidium hominis
SPDLDNPQPPPNDAPEEE

SEQ ID NO: 2120084 - protein, 5 aa, Cryptosporidium hominis
SPEKQ

SEQ ID NO: 2120085 - protein, 4 aa, Cryptosporidium hominis
SPEN

SEQ ID NO: 2120086 - protein, 4 aa, Cryptosporidium hominis
SPEP

SEQ ID NO: 2120087 - protein, 33 aa, Cryptosporidium hominis
SPEQKKANLNDDQETIDGTTASQEDNEEYPTPT

SEQ ID NO: 2120088 - protein, 4 aa, Cryptosporidium hominis
SPFS

SEQ ID NO: 2120089 - protein, 6 aa, Cryptosporidium hominis
SPFSGF

SEQ ID NO: 2120090 - protein, 6 aa, Cryptosporidium hominis
SPGSGK

SEQ ID NO: 2120091 - protein, 8 aa, Cryptosporidium hominis
SPGSGKTS

SEQ ID NO: 2120092 - protein, 4 aa, Cryptosporidium hominis
SPGT

SEQ ID NO: 2120093 - protein, 25 aa, Cryptosporidium hominis
SPHSDNSRRLPSEPKHVQLKNVSVD

SEQ ID NO: 2120094 - protein, 4 aa, Cryptosporidium hominis
SPIE

SEQ ID NO: 2120095 - protein, 9 aa, Cryptosporidium hominis
SPIKGNKES

SEQ ID NO: 2120096 - protein, 5 aa, Cryptosporidium hominis
SPIPG

SEQ ID NO: 2120097 - protein, 4 aa, Cryptosporidium hominis
SPIQ

SEQ ID NO: 2120098 - protein, 5 aa, Cryptosporidium hominis
SPIQT

SEQ ID NO: 2120099 - protein, 6 aa, Cryptosporidium hominis
SPIRPE

SEQ ID NO: 2120100 - protein, 4 aa, Cryptosporidium hominis
SPIS

SEQ ID NO: 2120101 - protein, 5 aa, Cryptosporidium hominis
SPISD

SEQ ID NO: 2120102 - protein, 4 aa, Cryptosporidium hominis
SPKE

SEQ ID NO: 2120103 - protein, 9 aa, Cryptosporidium hominis
SPKEMSSDQ

SEQ ID NO: 2120104 - protein, 7 aa, Cryptosporidium hominis
SPKENIE

SEQ ID NO: 2120105 - protein, 12 aa, Cryptosporidium hominis
SPLGGLSPISQS

SEQ ID NO: 2120106 - protein, 4 aa, Cryptosporidium hominis
SPLL

SEQ ID NO: 2120107 - protein, 4 aa, Cryptosporidium hominis
SPMD

SEQ ID NO: 2120108 - protein, 21 aa, Cryptosporidium hominis
SPMNGGSAKLGASGSSSMSSN

SEQ ID NO: 2120109 - protein, 8 aa, Cryptosporidium hominis
SPNDESLP

SEQ ID NO: 2120110 - protein, 7 aa, Cryptosporidium hominis
SPNKEEI

SEQ ID NO: 2120111 - protein, 9 aa, Cryptosporidium hominis
SPNKSKSIP

SEQ ID NO: 2120112 - protein, 15 aa, Cryptosporidium hominis
SPNLGSSTISANPAL

SEQ ID NO: 2120113 - protein, 7 aa, Cryptosporidium hominis
SPNNKNV

SEQ ID NO: 2120114 - protein, 6 aa, Cryptosporidium hominis
SPNNNT

SEQ ID NO: 2120115 - protein, 13 aa, Cryptosporidium hominis
SPNNNYDPAVQNS

SEQ ID NO: 2120116 - protein, 12 aa, Cryptosporidium hominis
SPNNSSESNTEL

SEQ ID NO: 2120117 - protein, 5 aa, Cryptosporidium hominis
SPNPL

SEQ ID NO: 2120118 - protein, 11 aa, Cryptosporidium hominis
SPNPSLPVNPN

SEQ ID NO: 2120119 - protein, 9 aa, Cryptosporidium hominis
SPNSEEKNV

SEQ ID NO: 2120120 - protein, 6 aa, Cryptosporidium hominis
SPNVKI

SEQ ID NO: 2120121 - protein, 4 aa, Cryptosporidium hominis
SPPD

SEQ ID NO: 2120122 - protein, 5 aa, Cryptosporidium hominis
SPPDL

SEQ ID NO: 2120123 - protein, 5 aa, Cryptosporidium hominis
SPPLS

SEQ ID NO: 2120124 - protein, 5 aa, Cryptosporidium hominis
SPPNS

SEQ ID NO: 2120125 - protein, 9 aa, Cryptosporidium hominis
SPPPQKTVR

SEQ ID NO: 2120126 - protein, 6 aa, Cryptosporidium hominis
SPPTPL

SEQ ID NO: 2120127 - protein, 7 aa, Cryptosporidium hominis
SPPVKAT

SEQ ID NO: 2120128 - protein, 5 aa, Cryptosporidium hominis
SPQEE

SEQ ID NO: 2120129 - protein, 6 aa, Cryptosporidium hominis
SPQNKD

SEQ ID NO: 2120130 - protein, 14 aa, Cryptosporidium hominis
SPQQNTGNLASSNS

SEQ ID NO: 2120131 - protein, 5 aa, Cryptosporidium hominis
SPQRH

SEQ ID NO: 2120132 - protein, 8 aa, Cryptosporidium hominis
SPQSNTTT

SEQ ID NO: 2120133 - protein, 11 aa, Cryptosporidium hominis
SPRKKKSRNSI

SEQ ID NO: 2120134 - protein, 9 aa, Cryptosporidium hominis
SPRPPNSAC

SEQ ID NO: 2120135 - protein, 13 aa, Cryptosporidium hominis
SPSDTYQSKNGKI

SEQ ID NO: 2120136 - protein, 4 aa, Cryptosporidium hominis
SPSE

SEQ ID NO: 2120137 - protein, 7 aa, Cryptosporidium hominis
SPSESMK

SEQ ID NO: 2120138 - protein, 4 aa, Cryptosporidium hominis
SPSF

SEQ ID NO: 2120139 - protein, 7 aa, Cryptosporidium hominis
SPSLSEE

SEQ ID NO: 2120140 - protein, 8 aa, Cryptosporidium hominis
SPSNSQYN

SEQ ID NO: 2120141 - protein, 6 aa, Cryptosporidium hominis
SPSQKK

SEQ ID NO: 2120142 - protein, 4 aa, Cryptosporidium hominis
SPSR

SEQ ID NO: 2120143 - protein, 8 aa, Cryptosporidium hominis
SPSRQREN

SEQ ID NO: 2120144 - protein, 6 aa, Cryptosporidium hominis
SPSSAE

SEQ ID NO: 2120145 - protein, 28 aa, Cryptosporidium hominis
SPSSEYSLTGPINNKKDNIKDSGKSMIN

SEQ ID NO: 2120146 - protein, 8 aa, Cryptosporidium hominis
SPSVPSQA

SEQ ID NO: 2120147 - protein, 5 aa, Cryptosporidium hominis
SPSVS

SEQ ID NO: 2120148 - protein, 16 aa, Cryptosporidium hominis
SPTNNSLDTKTPLLKA

SEQ ID NO: 2120149 - protein, 9 aa, Cryptosporidium hominis
SPTRAARRG

SEQ ID NO: 2120150 - protein, 21 aa, Cryptosporidium hominis
SPTSINSDSNHLDSKNTNSIS

SEQ ID NO: 2120151 - protein, 5 aa, Cryptosporidium hominis
SPTSV

SEQ ID NO: 2120152 - protein, 14 aa, Cryptosporidium hominis
SPTTVNTGRGTEFE

SEQ ID NO: 2120153 - protein, 5 aa, Cryptosporidium hominis
SPVDN

SEQ ID NO: 2120154 - protein, 21 aa, Cryptosporidium hominis
SPVEERTNTSKGEKDCQNEKE

SEQ ID NO: 2120155 - protein, 10 aa, Cryptosporidium hominis
SPVNNNATYA

SEQ ID NO: 2120156 - protein, 4 aa, Cryptosporidium hominis
SPYI

SEQ ID NO: 2120157 - protein, 9 aa, Cryptosporidium hominis
SPYKNGISP

SEQ ID NO: 2120158 - protein, 4 aa, Cryptosporidium hominis
SPYN

SEQ ID NO: 2120159 - protein, 4 aa, Cryptosporidium hominis
SPYS

SEQ ID NO: 2120160 - protein, 11 aa, Cryptosporidium hominis
SPYSGRSQQDL

SEQ ID NO: 2120161 - protein, 4 aa, Cryptosporidium hominis
SPYT

SEQ ID NO: 2120162 - protein, 6 aa, Cryptosporidium hominis
SPYTGT

SEQ ID NO: 2120163 - protein, 17 aa, Cryptosporidium hominis
SPYYDTQEQEINSKDEH

SEQ ID NO: 2120164 - protein, 4 aa, Cryptosporidium hominis
SQAG

SEQ ID NO: 2120165 - protein, 5 aa, Cryptosporidium hominis
SQANT

SEQ ID NO: 2120166 - protein, 20 aa, Cryptosporidium hominis
SQATNTSQMSQGGGKRTFSF

SEQ ID NO: 2120167 - protein, 7 aa, Cryptosporidium hominis
SQDAYHP

SEQ ID NO: 2120168 - protein, 4 aa, Cryptosporidium hominis
SQDE

SEQ ID NO: 2120169 - protein, 6 aa, Cryptosporidium hominis
SQDIPH

SEQ ID NO: 2120170 - protein, 16 aa, Cryptosporidium hominis
SQDSGNLSSTNSNPRE

SEQ ID NO: 2120171 - protein, 7 aa, Cryptosporidium hominis
SQDSSSI

SEQ ID NO: 2120172 - protein, 5 aa, Cryptosporidium hominis
SQEDE

SEQ ID NO: 2120173 - protein, 4 aa, Cryptosporidium hominis
SQEE

SEQ ID NO: 2120174 - protein, 6 aa, Cryptosporidium hominis
SQEEIN

SEQ ID NO: 2120175 - protein, 12 aa, Cryptosporidium hominis
SQEEKINQEKIQ

SEQ ID NO: 2120176 - protein, 6 aa, Cryptosporidium hominis
SQEESM

SEQ ID NO: 2120177 - protein, 18 aa, Cryptosporidium hominis
SQEIASKQDDNEIEWDVV

SEQ ID NO: 2120178 - protein, 7 aa, Cryptosporidium hominis
SQEMNST

SEQ ID NO: 2120179 - protein, 14 aa, Cryptosporidium hominis
SQEPERLDEYKPKD

SEQ ID NO: 2120180 - protein, 6 aa, Cryptosporidium hominis
SQESEL

SEQ ID NO: 2120181 - protein, 13 aa, Cryptosporidium hominis
SQETENKEADQEA

SEQ ID NO: 2120182 - protein, 8 aa, Cryptosporidium hominis
SQETTSIE

SEQ ID NO: 2120183 - protein, 4 aa, Cryptosporidium hominis
SQFS

SEQ ID NO: 2120184 - protein, 11 aa, Cryptosporidium hominis
SQGAANSLKEN

SEQ ID NO: 2120185 - protein, 6 aa, Cryptosporidium hominis
SQGGGF

SEQ ID NO: 2120186 - protein, 9 aa, Cryptosporidium hominis
SQGGVNTNS

SEQ ID NO: 2120187 - protein, 4 aa, Cryptosporidium hominis
SQHP

SEQ ID NO: 2120188 - protein, 20 aa, Cryptosporidium hominis
SQIQKEKIASDESEDGNSIQ

SEQ ID NO: 2120189 - protein, 4 aa, Cryptosporidium hominis
SQKD

SEQ ID NO: 2120190 - protein, 13 aa, Cryptosporidium hominis
SQKFGRKGKFKSK

SEQ ID NO: 2120191 - protein, 6 aa, Cryptosporidium hominis
SQKIAS

SEQ ID NO: 2120192 - protein, 26 aa, Cryptosporidium hominis
SQKPDRDIQNNEHTNGSNNVSNTNTD

SEQ ID NO: 2120193 - protein, 16 aa, Cryptosporidium hominis
SQKTELANDDNKMQEN

SEQ ID NO: 2120194 - protein, 6 aa, Cryptosporidium hominis
SQLPRE

SEQ ID NO: 2120195 - protein, 4 aa, Cryptosporidium hominis
SQNK

SEQ ID NO: 2120196 - protein, 8 aa, Cryptosporidium hominis
SQNQDGIE

SEQ ID NO: 2120197 - protein, 4 aa, Cryptosporidium hominis
SQNS

SEQ ID NO: 2120198 - protein, 8 aa, Cryptosporidium hominis
SQNSELGL

SEQ ID NO: 2120199 - protein, 6 aa, Cryptosporidium hominis
SQPIGS

SEQ ID NO: 2120200 - protein, 5 aa, Cryptosporidium hominis
SQPNF

SEQ ID NO: 2120201 - protein, 7 aa, Cryptosporidium hominis
SQPSRGN

SEQ ID NO: 2120202 - protein, 8 aa, Cryptosporidium hominis
SQQKKVHN

SEQ ID NO: 2120203 - protein, 7 aa, Cryptosporidium hominis
SQQTNSI

SEQ ID NO: 2120204 - protein, 7 aa, Cryptosporidium hominis
SQQTRLS

SEQ ID NO: 2120205 - protein, 6 aa, Cryptosporidium hominis
SQQYGE

SEQ ID NO: 2120206 - protein, 6 aa, Cryptosporidium hominis
SQRDPM

SEQ ID NO: 2120207 - protein, 15 aa, Cryptosporidium hominis
SQRNDDSKNSTYIPS

SEQ ID NO: 2120208 - protein, 10 aa, Cryptosporidium hominis
SQRSKSPVYS

SEQ ID NO: 2120209 - protein, 6 aa, Cryptosporidium hominis
SQSACK

SEQ ID NO: 2120210 - protein, 9 aa, Cryptosporidium hominis
SQSDTWPHE

SEQ ID NO: 2120211 - protein, 10 aa, Cryptosporidium hominis
SQSGETADTV

SEQ ID NO: 2120212 - protein, 9 aa, Cryptosporidium hominis
SQSSASSSS

SEQ ID NO: 2120213 - protein, 15 aa, Cryptosporidium hominis
SQSSIKDVNSYSPNI

SEQ ID NO: 2120214 - protein, 5 aa, Cryptosporidium hominis
SQSSP

SEQ ID NO: 2120215 - protein, 15 aa, Cryptosporidium hominis
SQSTGNIRGYPRKSK

SEQ ID NO: 2120216 - protein, 7 aa, Cryptosporidium hominis
SQSVGKT

SEQ ID NO: 2120217 - protein, 7 aa, Cryptosporidium hominis
SQTGNKE

SEQ ID NO: 2120218 - protein, 4 aa, Cryptosporidium hominis
SQTI

SEQ ID NO: 2120219 - protein, 7 aa, Cryptosporidium hominis
SQTLQPD

SEQ ID NO: 2120220 - protein, 33 aa, Cryptosporidium hominis
SQTNAHCQSQTNMGNVNKAATKSSLKQKKQKTL

SEQ ID NO: 2120221 - protein, 7 aa, Cryptosporidium hominis
SQTPGEN

SEQ ID NO: 2120222 - protein, 11 aa, Cryptosporidium hominis
SQTPNQEIGGL

SEQ ID NO: 2120223 - protein, 4 aa, Cryptosporidium hominis
SQTQ

SEQ ID NO: 2120224 - protein, 10 aa, Cryptosporidium hominis
SQTSKDGNTT

SEQ ID NO: 2120225 - protein, 8 aa, Cryptosporidium hominis
SQTSTEIN

SEQ ID NO: 2120226 - protein, 10 aa, Cryptosporidium hominis
SQTSTPTSNW

SEQ ID NO: 2120227 - protein, 9 aa, Cryptosporidium hominis
SQTTKSSVE

SEQ ID NO: 2120228 - protein, 9 aa, Cryptosporidium hominis
SQVNSGKPF

SEQ ID NO: 2120229 - protein, 8 aa, Cryptosporidium hominis
SQVPPSND

SEQ ID NO: 2120230 - protein, 10 aa, Cryptosporidium hominis
SQVTSGSLNQ

SEQ ID NO: 2120231 - protein, 4 aa, Cryptosporidium hominis
SQYK

SEQ ID NO: 2120232 - protein, 6 aa, Cryptosporidium hominis
SQYNNS

SEQ ID NO: 2120233 - protein, 7 aa, Cryptosporidium hominis
SRAISKS

SEQ ID NO: 2120234 - protein, 4 aa, Cryptosporidium hominis
SRAK

SEQ ID NO: 2120235 - protein, 5 aa, Cryptosporidium hominis
SRASF

SEQ ID NO: 2120236 - protein, 14 aa, Cryptosporidium hominis
SRDDELKASTSENS

SEQ ID NO: 2120237 - protein, 4 aa, Cryptosporidium hominis
SRDI

SEQ ID NO: 2120238 - protein, 41 aa, Cryptosporidium hominis
SRDIKDKEVKAGDATTTTTTTTNVNTKNNIDSDNNLAIVIK

SEQ ID NO: 2120239 - protein, 8 aa, Cryptosporidium hominis
SRDSESCS

SEQ ID NO: 2120240 - protein, 7 aa, Cryptosporidium hominis
SREAGTE

SEQ ID NO: 2120241 - protein, 9 aa, Cryptosporidium hominis
SREEGQRDS

SEQ ID NO: 2120242 - protein, 4 aa, Cryptosporidium hominis
SREF

SEQ ID NO: 2120243 - protein, 7 aa, Cryptosporidium hominis
SREKPES

SEQ ID NO: 2120244 - protein, 6 aa, Cryptosporidium hominis
SRERTG

SEQ ID NO: 2120245 - protein, 6 aa, Cryptosporidium hominis
SRETKE

SEQ ID NO: 2120246 - protein, 5 aa, Cryptosporidium hominis
SRETL

SEQ ID NO: 2120247 - protein, 6 aa, Cryptosporidium hominis
SRETNK

SEQ ID NO: 2120248 - protein, 6 aa, Cryptosporidium hominis
SREVGQ

SEQ ID NO: 2120249 - protein, 5 aa, Cryptosporidium hominis
SRGDA

SEQ ID NO: 2120250 - protein, 4 aa, Cryptosporidium hominis
SRGF

SEQ ID NO: 2120251 - protein, 9 aa, Cryptosporidium hominis
SRGIQDSEA

SEQ ID NO: 2120252 - protein, 6 aa, Cryptosporidium hominis
SRGKSG

SEQ ID NO: 2120253 - protein, 4 aa, Cryptosporidium hominis
SRGN

SEQ ID NO: 2120254 - protein, 12 aa, Cryptosporidium hominis
SRGPNKSSTNQF

SEQ ID NO: 2120255 - protein, 5 aa, Cryptosporidium hominis
SRGSR

SEQ ID NO: 2120256 - protein, 6 aa, Cryptosporidium hominis
SRIEDS

SEQ ID NO: 2120257 - protein, 7 aa, Cryptosporidium hominis
SRIEKSV

SEQ ID NO: 2120258 - protein, 5 aa, Cryptosporidium hominis
SRKLV

SEQ ID NO: 2120259 - protein, 14 aa, Cryptosporidium hominis
SRKNSAKSNNKQMN

SEQ ID NO: 2120260 - protein, 4 aa, Cryptosporidium hominis
SRKS

SEQ ID NO: 2120261 - protein, 11 aa, Cryptosporidium hominis
SRKVDTSGHER

SEQ ID NO: 2120262 - protein, 9 aa, Cryptosporidium hominis
SRLESATKH

SEQ ID NO: 2120263 - protein, 6 aa, Cryptosporidium hominis
SRLSSK

SEQ ID NO: 2120264 - protein, 12 aa, Cryptosporidium hominis
SRLTSQNSTVVR

SEQ ID NO: 2120265 - protein, 4 aa, Cryptosporidium hominis
SRMS

SEQ ID NO: 2120266 - protein, 7 aa, Cryptosporidium hominis
SRNEAEE

SEQ ID NO: 2120267 - protein, 6 aa, Cryptosporidium hominis
SRNETT

SEQ ID NO: 2120268 - protein, 13 aa, Cryptosporidium hominis
SRNGESLRPQSAA

SEQ ID NO: 2120269 - protein, 7 aa, Cryptosporidium hominis
SRNNQSI

SEQ ID NO: 2120270 - protein, 7 aa, Cryptosporidium hominis
SRNNSND

SEQ ID NO: 2120271 - protein, 6 aa, Cryptosporidium hominis
SRNREK

SEQ ID NO: 2120272 - protein, 28 aa, Cryptosporidium hominis
SRNVRSKTENHLENNSGSNNDNSAGSSI

SEQ ID NO: 2120273 - protein, 9 aa, Cryptosporidium hominis
SRNVSKPRI

SEQ ID NO: 2120274 - protein, 6 aa, Cryptosporidium hominis
SRPDKD

SEQ ID NO: 2120275 - protein, 4 aa, Cryptosporidium hominis
SRPL

SEQ ID NO: 2120276 - protein, 8 aa, Cryptosporidium hominis
SRPPHTPQ

SEQ ID NO: 2120277 - protein, 9 aa, Cryptosporidium hominis
SRPSESTIR

SEQ ID NO: 2120278 - protein, 9 aa, Cryptosporidium hominis
SRQDIGNNS

SEQ ID NO: 2120279 - protein, 6 aa, Cryptosporidium hominis
SRQENE

SEQ ID NO: 2120280 - protein, 22 aa, Cryptosporidium hominis
SRQISADEIPNNRTVEASNDNI

SEQ ID NO: 2120281 - protein, 4 aa, Cryptosporidium hominis
SRQM

SEQ ID NO: 2120282 - protein, 7 aa, Cryptosporidium hominis
SRRDEVP

SEQ ID NO: 2120283 - protein, 12 aa, Cryptosporidium hominis
SRRGDVHAGSTK

SEQ ID NO: 2120284 - protein, 4 aa, Cryptosporidium hominis
SRRK

SEQ ID NO: 2120285 - protein, 5 aa, Cryptosporidium hominis
SRRNS

SEQ ID NO: 2120286 - protein, 6 aa, Cryptosporidium hominis
SRRQIA

SEQ ID NO: 2120287 - protein, 5 aa, Cryptosporidium hominis
SRSEG

SEQ ID NO: 2120288 - protein, 7 aa, Cryptosporidium hominis
SRSGRQK

SEQ ID NO: 2120289 - protein, 7 aa, Cryptosporidium hominis
SRSGYKI

SEQ ID NO: 2120290 - protein, 17 aa, Cryptosporidium hominis
SRSIGNNVKKGRSGTNI

SEQ ID NO: 2120291 - protein, 7 aa, Cryptosporidium hominis
SRSIQSN

SEQ ID NO: 2120292 - protein, 6 aa, Cryptosporidium hominis
SRSKCC

SEQ ID NO: 2120293 - protein, 9 aa, Cryptosporidium hominis
SRSKSSLSI

SEQ ID NO: 2120294 - protein, 25 aa, Cryptosporidium hominis
SRSNNSQGQDPNANYNMQGGAPGMM

SEQ ID NO: 2120295 - protein, 8 aa, Cryptosporidium hominis
SRSNSFGP

SEQ ID NO: 2120296 - protein, 7 aa, Cryptosporidium hominis
SRSQQDV

SEQ ID NO: 2120297 - protein, 8 aa, Cryptosporidium hominis
SRSSISSY

SEQ ID NO: 2120298 - protein, 29 aa, Cryptosporidium hominis
SRSSTSESNSDDEDEVEGSSFSRGRSAKR

SEQ ID NO: 2120299 - protein, 8 aa, Cryptosporidium hominis
SRSTQGIS

SEQ ID NO: 2120300 - protein, 12 aa, Cryptosporidium hominis
SRSTSKEEAESC

SEQ ID NO: 2120301 - protein, 8 aa, Cryptosporidium hominis
SRSTSNGK

SEQ ID NO: 2120302 - protein, 5 aa, Cryptosporidium hominis
SRTAS

SEQ ID NO: 2120303 - protein, 15 aa, Cryptosporidium hominis
SRTENVEKDSSSNCL

SEQ ID NO: 2120304 - protein, 8 aa, Cryptosporidium hominis
SRTFDTEL

SEQ ID NO: 2120305 - protein, 6 aa, Cryptosporidium hominis
SRTGNN

SEQ ID NO: 2120306 - protein, 6 aa, Cryptosporidium hominis
SRTLRR

SEQ ID NO: 2120307 - protein, 7 aa, Cryptosporidium hominis
SRTQSGR

SEQ ID NO: 2120308 - protein, 6 aa, Cryptosporidium hominis
SRVASS

SEQ ID NO: 2120309 - protein, 18 aa, Cryptosporidium hominis
SRVESNQNFTENDNKSNV

SEQ ID NO: 2120310 - protein, 8 aa, Cryptosporidium hominis
SRVSASEL

SEQ ID NO: 2120311 - protein, 5 aa, Cryptosporidium hominis
SRYKG

SEQ ID NO: 2120312 - protein, 41 aa, Cryptosporidium hominis
SSAATRERGNHSNTGNSSHLGGAGNTSGSTGGNNSRRNNRI

SEQ ID NO: 2120313 - protein, 8 aa, Cryptosporidium hominis
SSAEDNLS

SEQ ID NO: 2120314 - protein, 7 aa, Cryptosporidium hominis
SSAHEQA

SEQ ID NO: 2120315 - protein, 5 aa, Cryptosporidium hominis
SSAIE

SEQ ID NO: 2120316 - protein, 5 aa, Cryptosporidium hominis
SSANT

SEQ ID NO: 2120317 - protein, 13 aa, Cryptosporidium hominis
SSAPKSSKVTISK

SEQ ID NO: 2120318 - protein, 18 aa, Cryptosporidium hominis
SSAQQGIDKAREYADYEK

SEQ ID NO: 2120319 - protein, 10 aa, Cryptosporidium hominis
SSCNAPPPSG

SEQ ID NO: 2120320 - protein, 5 aa, Cryptosporidium hominis
SSCPS

SEQ ID NO: 2120321 - protein, 4 aa, Cryptosporidium hominis
SSCS

SEQ ID NO: 2120322 - protein, 25 aa, Cryptosporidium hominis
SSCSGCKGSSCTYSNSSNHSCPKNC

SEQ ID NO: 2120323 - protein, 7 aa, Cryptosporidium hominis
SSDCNND

SEQ ID NO: 2120324 - protein, 19 aa, Cryptosporidium hominis
SSDEDFDDDLDDSLEDDFS

SEQ ID NO: 2120325 - protein, 17 aa, Cryptosporidium hominis
SSDEDSESRKKSSFGIK

SEQ ID NO: 2120326 - protein, 7 aa, Cryptosporidium hominis
SSDGISI

SEQ ID NO: 2120327 - protein, 7 aa, Cryptosporidium hominis
SSDGTRE

SEQ ID NO: 2120328 - protein, 10 aa, Cryptosporidium hominis
SSDIENSTKL

SEQ ID NO: 2120329 - protein, 8 aa, Cryptosporidium hominis
SSDKIATN

SEQ ID NO: 2120330 - protein, 42 aa, Cryptosporidium hominis
SSDNISSSLNNNSSQFKNNFPSKNEGSSMQNIGSNNFSTGNI

SEQ ID NO: 2120331 - protein, 10 aa, Cryptosporidium hominis
SSDNNEIENT

SEQ ID NO: 2120332 - protein, 8 aa, Cryptosporidium hominis
SSDNNSDQ

SEQ ID NO: 2120333 - protein, 4 aa, Cryptosporidium hominis
SSDS

SEQ ID NO: 2120334 - protein, 9 aa, Cryptosporidium hominis
SSDSKKKKI

SEQ ID NO: 2120335 - protein, 6 aa, Cryptosporidium hominis
SSEASS

SEQ ID NO: 2120336 - protein, 44 aa, Cryptosporidium hominis
SSEDDENDEELGNNNTNKENSNTIPNESSSQIIQGKRNKGLRSK

SEQ ID NO: 2120337 - protein, 19 aa, Cryptosporidium hominis
SSEDSTNSKEVEIETEGNI

SEQ ID NO: 2120338 - protein, 8 aa, Cryptosporidium hominis
SSEEGDLR

SEQ ID NO: 2120339 - protein, 7 aa, Cryptosporidium hominis
SSEELSS

SEQ ID NO: 2120340 - protein, 4 aa, Cryptosporidium hominis
SSEF

SEQ ID NO: 2120341 - protein, 8 aa, Cryptosporidium hominis
SSEFNEND

SEQ ID NO: 2120342 - protein, 6 aa, Cryptosporidium hominis
SSEGGE

SEQ ID NO: 2120343 - protein, 11 aa, Cryptosporidium hominis
SSEKKSNTITI

SEQ ID NO: 2120344 - protein, 14 aa, Cryptosporidium hominis
SSELNEKYNSTIKN

SEQ ID NO: 2120345 - protein, 9 aa, Cryptosporidium hominis
SSENEQISM

SEQ ID NO: 2120346 - protein, 4 aa, Cryptosporidium hominis
SSEP

SEQ ID NO: 2120347 - protein, 6 aa, Cryptosporidium hominis
SSEQGY

SEQ ID NO: 2120348 - protein, 11 aa, Cryptosporidium hominis
SSESKSPENME

SEQ ID NO: 2120349 - protein, 10 aa, Cryptosporidium hominis
SSESLNVEAG

SEQ ID NO: 2120350 - protein, 22 aa, Cryptosporidium hominis
SSESSNSIDSISESNSSMNKEK

SEQ ID NO: 2120351 - protein, 4 aa, Cryptosporidium hominis
SSET

SEQ ID NO: 2120352 - protein, 15 aa, Cryptosporidium hominis
SSETKRNNYNKYGDF

SEQ ID NO: 2120353 - protein, 4 aa, Cryptosporidium hominis
SSEY

SEQ ID NO: 2120354 - protein, 4 aa, Cryptosporidium hominis
SSFG

SEQ ID NO: 2120355 - protein, 5 aa, Cryptosporidium hominis
SSFGE

SEQ ID NO: 2120356 - protein, 15 aa, Cryptosporidium hominis
SSFNPDDSGSSVNSQ

SEQ ID NO: 2120357 - protein, 6 aa, Cryptosporidium hominis
SSFSDN

SEQ ID NO: 2120358 - protein, 10 aa, Cryptosporidium hominis
SSFSKNSNLN

SEQ ID NO: 2120359 - protein, 6 aa, Cryptosporidium hominis
SSFSKS

SEQ ID NO: 2120360 - protein, 10 aa, Cryptosporidium hominis
SSGALNTGRT

SEQ ID NO: 2120361 - protein, 8 aa, Cryptosporidium hominis
SSGCGKTS

SEQ ID NO: 2120362 - protein, 5 aa, Cryptosporidium hominis
SSGDY

SEQ ID NO: 2120363 - protein, 4 aa, Cryptosporidium hominis
SSGE

SEQ ID NO: 2120364 - protein, 6 aa, Cryptosporidium hominis
SSGEIS

SEQ ID NO: 2120365 - protein, 7 aa, Cryptosporidium hominis
SSGEMDS

SEQ ID NO: 2120366 - protein, 5 aa, Cryptosporidium hominis
SSGFY

SEQ ID NO: 2120367 - protein, 4 aa, Cryptosporidium hominis
SSGG

SEQ ID NO: 2120368 - protein, 9 aa, Cryptosporidium hominis
SSGNDVTGE

SEQ ID NO: 2120369 - protein, 11 aa, Cryptosporidium hominis
SSGNEKDESNF

SEQ ID NO: 2120370 - protein, 14 aa, Cryptosporidium hominis
SSGRYSIPSRKKDK

SEQ ID NO: 2120371 - protein, 11 aa, Cryptosporidium hominis
SSGSEAGKESE

SEQ ID NO: 2120372 - protein, 11 aa, Cryptosporidium hominis
SSGTGDNRNLG

SEQ ID NO: 2120373 - protein, 12 aa, Cryptosporidium hominis
SSGTKKSDKTRR

SEQ ID NO: 2120374 - protein, 15 aa, Cryptosporidium hominis
SSGTSFQSTEFGSPL

SEQ ID NO: 2120375 - protein, 16 aa, Cryptosporidium hominis
SSGYDGLEKEDISTSS

SEQ ID NO: 2120376 - protein, 9 aa, Cryptosporidium hominis
SSGYSKNAN

SEQ ID NO: 2120377 - protein, 10 aa, Cryptosporidium hominis
SSHEKQLKNK

SEQ ID NO: 2120378 - protein, 14 aa, Cryptosporidium hominis
SSHSETPDDERYLS

SEQ ID NO: 2120379 - protein, 22 aa, Cryptosporidium hominis
SSHSNQSSSISINSHKNNKISS

SEQ ID NO: 2120380 - protein, 12 aa, Cryptosporidium hominis
SSHTKTKSSKEI

SEQ ID NO: 2120381 - protein, 5 aa, Cryptosporidium hominis
SSIDG

SEQ ID NO: 2120382 - protein, 5 aa, Cryptosporidium hominis
SSIDH

SEQ ID NO: 2120383 - protein, 6 aa, Cryptosporidium hominis
SSIEER

SEQ ID NO: 2120384 - protein, 11 aa, Cryptosporidium hominis
SSIGGGQSNKK

SEQ ID NO: 2120385 - protein, 7 aa, Cryptosporidium hominis
SSINNQA

SEQ ID NO: 2120386 - protein, 7 aa, Cryptosporidium hominis
SSIPEEL

SEQ ID NO: 2120387 - protein, 6 aa, Cryptosporidium hominis
SSIPNK

SEQ ID NO: 2120388 - protein, 9 aa, Cryptosporidium hominis
SSIRKTRAS

SEQ ID NO: 2120389 - protein, 14 aa, Cryptosporidium hominis
SSIRSNSEKKEPSK

SEQ ID NO: 2120390 - protein, 4 aa, Cryptosporidium hominis
SSIS

SEQ ID NO: 2120391 - protein, 19 aa, Cryptosporidium hominis
SSISETNSRKISTNGTFSD

SEQ ID NO: 2120392 - protein, 11 aa, Cryptosporidium hominis
SSISNGPGMTT

SEQ ID NO: 2120393 - protein, 13 aa, Cryptosporidium hominis
SSISNNSDESKDK

SEQ ID NO: 2120394 - protein, 5 aa, Cryptosporidium hominis
SSISS

SEQ ID NO: 2120395 - protein, 8 aa, Cryptosporidium hominis
SSISSKSA

SEQ ID NO: 2120396 - protein, 15 aa, Cryptosporidium hominis
SSKDTSNKMDQPHLP

SEQ ID NO: 2120397 - protein, 16 aa, Cryptosporidium hominis
SSKGKVSDSSGEVDLE

SEQ ID NO: 2120398 - protein, 5 aa, Cryptosporidium hominis
SSKIL

SEQ ID NO: 2120399 - protein, 7 aa, Cryptosporidium hominis
SSKITEN

SEQ ID NO: 2120400 - protein, 9 aa, Cryptosporidium hominis
SSKKATDLK

SEQ ID NO: 2120401 - protein, 12 aa, Cryptosporidium hominis
SSKKLSGSTSNY

SEQ ID NO: 2120402 - protein, 4 aa, Cryptosporidium hominis
SSKL

SEQ ID NO: 2120403 - protein, 9 aa, Cryptosporidium hominis
SSKNAAHGL

SEQ ID NO: 2120404 - protein, 17 aa, Cryptosporidium hominis
SSKNENGQDEKKMRGNS

SEQ ID NO: 2120405 - protein, 12 aa, Cryptosporidium hominis
SSKNNQPQVGSN

SEQ ID NO: 2120406 - protein, 16 aa, Cryptosporidium hominis
SSKNRSKEKPMNKGDS

SEQ ID NO: 2120407 - protein, 13 aa, Cryptosporidium hominis
SSKQESGKIRDDS

SEQ ID NO: 2120408 - protein, 28 aa, Cryptosporidium hominis
SSKQRKSSKTSGNVSSRNKKAGGAETEI

SEQ ID NO: 2120409 - protein, 4 aa, Cryptosporidium hominis
SSKR

SEQ ID NO: 2120410 - protein, 6 aa, Cryptosporidium hominis
SSKSRT

SEQ ID NO: 2120411 - protein, 7 aa, Cryptosporidium hominis
SSKSSDP

SEQ ID NO: 2120412 - protein, 6 aa, Cryptosporidium hominis
SSKSSK

SEQ ID NO: 2120413 - protein, 10 aa, Cryptosporidium hominis
SSKTENSTSC

SEQ ID NO: 2120414 - protein, 7 aa, Cryptosporidium hominis
SSKTRQL

SEQ ID NO: 2120415 - protein, 5 aa, Cryptosporidium hominis
SSKVS

SEQ ID NO: 2120416 - protein, 16 aa, Cryptosporidium hominis
SSLATDSDRDNEITNT

SEQ ID NO: 2120417 - protein, 15 aa, Cryptosporidium hominis
SSLDSKKREKGEGLD

SEQ ID NO: 2120418 - protein, 5 aa, Cryptosporidium hominis
SSLEY

SEQ ID NO: 2120419 - protein, 12 aa, Cryptosporidium hominis
SSLGNLENPEKK

SEQ ID NO: 2120420 - protein, 4 aa, Cryptosporidium hominis
SSLL

SEQ ID NO: 2120421 - protein, 4 aa, Cryptosporidium hominis
SSLN

SEQ ID NO: 2120422 - protein, 7 aa, Cryptosporidium hominis
SSLNDRS

SEQ ID NO: 2120423 - protein, 5 aa, Cryptosporidium hominis
SSLNT

SEQ ID NO: 2120424 - protein, 8 aa, Cryptosporidium hominis
SSLPSSQD

SEQ ID NO: 2120425 - protein, 8 aa, Cryptosporidium hominis
SSLRNNSE

SEQ ID NO: 2120426 - protein, 36 aa, Cryptosporidium hominis
SSLRSSSPSILSNPISSKQSSSSSGSNNSYNTKDRQ

SEQ ID NO: 2120427 - protein, 6 aa, Cryptosporidium hominis
SSLSGS

SEQ ID NO: 2120428 - protein, 9 aa, Cryptosporidium hominis
SSLSKTNNE

SEQ ID NO: 2120429 - protein, 5 aa, Cryptosporidium hominis
SSLST

SEQ ID NO: 2120430 - protein, 9 aa, Cryptosporidium hominis
SSLTGEATP

SEQ ID NO: 2120431 - protein, 7 aa, Cryptosporidium hominis
SSLVDSN

SEQ ID NO: 2120432 - protein, 5 aa, Cryptosporidium hominis
SSMRN

SEQ ID NO: 2120433 - protein, 4 aa, Cryptosporidium hominis
SSNE

SEQ ID NO: 2120434 - protein, 29 aa, Cryptosporidium hominis
SSNEATINSNSNNESNLNNNNNNNVSSEY

SEQ ID NO: 2120435 - protein, 9 aa, Cryptosporidium hominis
SSNEDPEGL

SEQ ID NO: 2120436 - protein, 6 aa, Cryptosporidium hominis
SSNESF

SEQ ID NO: 2120437 - protein, 8 aa, Cryptosporidium hominis
SSNESKIY

SEQ ID NO: 2120438 - protein, 5 aa, Cryptosporidium hominis
SSNFE

SEQ ID NO: 2120439 - protein, 10 aa, Cryptosporidium hominis
SSNGLQNDAT

SEQ ID NO: 2120440 - protein, 6 aa, Cryptosporidium hominis
SSNGLV

SEQ ID NO: 2120441 - protein, 4 aa, Cryptosporidium hominis
SSNI

SEQ ID NO: 2120442 - protein, 20 aa, Cryptosporidium hominis
SSNIGRNSLTSSQVSSGQYT

SEQ ID NO: 2120443 - protein, 8 aa, Cryptosporidium hominis
SSNIPEKP

SEQ ID NO: 2120444 - protein, 10 aa, Cryptosporidium hominis
SSNKNIPEVS

SEQ ID NO: 2120445 - protein, 4 aa, Cryptosporidium hominis
SSNL

SEQ ID NO: 2120446 - protein, 7 aa, Cryptosporidium hominis
SSNLDNK

SEQ ID NO: 2120447 - protein, 8 aa, Cryptosporidium hominis
SSNMSIPN

SEQ ID NO: 2120448 - protein, 4 aa, Cryptosporidium hominis
SSNN

SEQ ID NO: 2120449 - protein, 15 aa, Cryptosporidium hominis
SSNNELKETNHYKEK

SEQ ID NO: 2120450 - protein, 7 aa, Cryptosporidium hominis
SSNNERR

SEQ ID NO: 2120451 - protein, 20 aa, Cryptosporidium hominis
SSNNNSNKPNQISDNKCPPG

SEQ ID NO: 2120452 - protein, 7 aa, Cryptosporidium hominis
SSNQENH

SEQ ID NO: 2120453 - protein, 8 aa, Cryptosporidium hominis
SSNQNNFL

SEQ ID NO: 2120454 - protein, 11 aa, Cryptosporidium hominis
SSNRKEKTKLK

SEQ ID NO: 2120455 - protein, 6 aa, Cryptosporidium hominis
SSNRNK

SEQ ID NO: 2120456 - protein, 19 aa, Cryptosporidium hominis
SSNSHKHSASHSLKTQSGY

SEQ ID NO: 2120457 - protein, 5 aa, Cryptosporidium hominis
SSNSM

SEQ ID NO: 2120458 - protein, 21 aa, Cryptosporidium hominis
SSNSNGNESEIADNQTHTKYE

SEQ ID NO: 2120459 - protein, 11 aa, Cryptosporidium hominis
SSNSPNNSAVT

SEQ ID NO: 2120460 - protein, 7 aa, Cryptosporidium hominis
SSNSSFW

SEQ ID NO: 2120461 - protein, 29 aa, Cryptosporidium hominis
SSNTALGKTRFGDPITDKNNQSGGSAPTV

SEQ ID NO: 2120462 - protein, 6 aa, Cryptosporidium hominis
SSNVSQ

SEQ ID NO: 2120463 - protein, 10 aa, Cryptosporidium hominis
SSNVTTFGSR

SEQ ID NO: 2120464 - protein, 7 aa, Cryptosporidium hominis
SSPASGL

SEQ ID NO: 2120465 - protein, 13 aa, Cryptosporidium hominis
SSPASLDEDASAQ

SEQ ID NO: 2120466 - protein, 31 aa, Cryptosporidium hominis
SSPCDRTKQDRNSSSSNTNNHCASNSTLNPK

SEQ ID NO: 2120467 - protein, 6 aa, Cryptosporidium hominis
SSPCNA

SEQ ID NO: 2120468 - protein, 4 aa, Cryptosporidium hominis
SSPE

SEQ ID NO: 2120469 - protein, 6 aa, Cryptosporidium hominis
SSPERK

SEQ ID NO: 2120470 - protein, 5 aa, Cryptosporidium hominis
SSPHD

SEQ ID NO: 2120471 - protein, 28 aa, Cryptosporidium hominis
SSPITFKPQQQQQQFQKQSSRNETGPSD

SEQ ID NO: 2120472 - protein, 11 aa, Cryptosporidium hominis
SSPKDVEAQSQ

SEQ ID NO: 2120473 - protein, 7 aa, Cryptosporidium hominis
SSPNQTY

SEQ ID NO: 2120474 - protein, 7 aa, Cryptosporidium hominis
SSPNSDV

SEQ ID NO: 2120475 - protein, 26 aa, Cryptosporidium hominis
SSPRNQSSMSSGKRSRNNEYNETLPP

SEQ ID NO: 2120476 - protein, 6 aa, Cryptosporidium hominis
SSPRRM

SEQ ID NO: 2120477 - protein, 9 aa, Cryptosporidium hominis
SSPSDQSEL

SEQ ID NO: 2120478 - protein, 7 aa, Cryptosporidium hominis
SSPSNWD

SEQ ID NO: 2120479 - protein, 30 aa, Cryptosporidium hominis
SSPSSSCSSSCSSSSSSSSSSSSSFPPSTE

SEQ ID NO: 2120480 - protein, 27 aa, Cryptosporidium hominis
SSPSSSSSNFNNPTVSSTSFSGGRQSS

SEQ ID NO: 2120481 - protein, 5 aa, Cryptosporidium hominis
SSPSY

SEQ ID NO: 2120482 - protein, 5 aa, Cryptosporidium hominis
SSPTE

SEQ ID NO: 2120483 - protein, 6 aa, Cryptosporidium hominis
SSPTMA

SEQ ID NO: 2120484 - protein, 6 aa, Cryptosporidium hominis
SSPTVK

SEQ ID NO: 2120485 - protein, 4 aa, Cryptosporidium hominis
SSPV

SEQ ID NO: 2120486 - protein, 6 aa, Cryptosporidium hominis
SSQGKL

SEQ ID NO: 2120487 - protein, 17 aa, Cryptosporidium hominis
SSQIQYESDSKENSYNY

SEQ ID NO: 2120488 - protein, 11 aa, Cryptosporidium hominis
SSQKLSSRNNS

SEQ ID NO: 2120489 - protein, 8 aa, Cryptosporidium hominis
SSQKSNFT

SEQ ID NO: 2120490 - protein, 6 aa, Cryptosporidium hominis
SSQLYQ

SEQ ID NO: 2120491 - protein, 12 aa, Cryptosporidium hominis
SSQMPSGKMPSG

SEQ ID NO: 2120492 - protein, 7 aa, Cryptosporidium hominis
SSQNDNR

SEQ ID NO: 2120493 - protein, 7 aa, Cryptosporidium hominis
SSQTTAA

SEQ ID NO: 2120494 - protein, 5 aa, Cryptosporidium hominis
SSQVS

SEQ ID NO: 2120495 - protein, 9 aa, Cryptosporidium hominis
SSRASSNQL

SEQ ID NO: 2120496 - protein, 7 aa, Cryptosporidium hominis
SSRDVGK

SEQ ID NO: 2120497 - protein, 8 aa, Cryptosporidium hominis
SSRDYTKF

SEQ ID NO: 2120498 - protein, 5 aa, Cryptosporidium hominis
SSREL

SEQ ID NO: 2120499 - protein, 6 aa, Cryptosporidium hominis
SSREYR

SEQ ID NO: 2120500 - protein, 20 aa, Cryptosporidium hominis
SSRNEEDELPNQNEGDGSGI

SEQ ID NO: 2120501 - protein, 5 aa, Cryptosporidium hominis
SSRNI

SEQ ID NO: 2120502 - protein, 9 aa, Cryptosporidium hominis
SSRNSSKPP

SEQ ID NO: 2120503 - protein, 8 aa, Cryptosporidium hominis
SSRRTSFP

SEQ ID NO: 2120504 - protein, 6 aa, Cryptosporidium hominis
SSRSGY

SEQ ID NO: 2120505 - protein, 5 aa, Cryptosporidium hominis
SSRSK

SEQ ID NO: 2120506 - protein, 9 aa, Cryptosporidium hominis
SSSADPDYF

SEQ ID NO: 2120507 - protein, 9 aa, Cryptosporidium hominis
SSSAESNID

SEQ ID NO: 2120508 - protein, 7 aa, Cryptosporidium hominis
SSSALGS

SEQ ID NO: 2120509 - protein, 15 aa, Cryptosporidium hominis
SSSDDNYSEDTSESE

SEQ ID NO: 2120510 - protein, 10 aa, Cryptosporidium hominis
SSSESNQELT

SEQ ID NO: 2120511 - protein, 4 aa, Cryptosporidium hominis
SSSF

SEQ ID NO: 2120512 - protein, 14 aa, Cryptosporidium hominis
SSSGEKVKKDNLEK

SEQ ID NO: 2120513 - protein, 6 aa, Cryptosporidium hominis
SSSGFN

SEQ ID NO: 2120514 - protein, 13 aa, Cryptosporidium hominis
SSSHTNPDSIQNK

SEQ ID NO: 2120515 - protein, 28 aa, Cryptosporidium hominis
SSSIGQTGRNSSSHGTFAKDDTDPSSHD

SEQ ID NO: 2120516 - protein, 24 aa, Cryptosporidium hominis
SSSILGKKNRRNSDSKTDNYPDPL

SEQ ID NO: 2120517 - protein, 4 aa, Cryptosporidium hominis
SSSK

SEQ ID NO: 2120518 - protein, 14 aa, Cryptosporidium hominis
SSSKFGEKSANEDV

SEQ ID NO: 2120519 - protein, 7 aa, Cryptosporidium hominis
SSSKGED

SEQ ID NO: 2120520 - protein, 11 aa, Cryptosporidium hominis
SSSKISNQKRV

SEQ ID NO: 2120521 - protein, 6 aa, Cryptosporidium hominis
SSSKKK

SEQ ID NO: 2120522 - protein, 10 aa, Cryptosporidium hominis
SSSKTIEGGV

SEQ ID NO: 2120523 - protein, 4 aa, Cryptosporidium hominis
SSSL

SEQ ID NO: 2120524 - protein, 16 aa, Cryptosporidium hominis
SSSLDENNVEKIKETE

SEQ ID NO: 2120525 - protein, 6 aa, Cryptosporidium hominis
SSSNEC

SEQ ID NO: 2120526 - protein, 5 aa, Cryptosporidium hominis
SSSNH

SEQ ID NO: 2120527 - protein, 6 aa, Cryptosporidium hominis
SSSNIL

SEQ ID NO: 2120528 - protein, 12 aa, Cryptosporidium hominis
SSSNNVQPNEDD

SEQ ID NO: 2120529 - protein, 10 aa, Cryptosporidium hominis
SSSNQGSQIS

SEQ ID NO: 2120530 - protein, 7 aa, Cryptosporidium hominis
SSSNTIG

SEQ ID NO: 2120531 - protein, 9 aa, Cryptosporidium hominis
SSSNTSVTS

SEQ ID NO: 2120532 - protein, 17 aa, Cryptosporidium hominis
SSSNVNRSVESKQNIDG

SEQ ID NO: 2120533 - protein, 39 aa, Cryptosporidium hominis
SSSPIQSGTSFSSTTASSSSATSSSYQPTTNKSNSIGKT

SEQ ID NO: 2120534 - protein, 6 aa, Cryptosporidium hominis
SSSPPI

SEQ ID NO: 2120535 - protein, 8 aa, Cryptosporidium hominis
SSSQINGT

SEQ ID NO: 2120536 - protein, 8 aa, Cryptosporidium hominis
SSSQPMDT

SEQ ID NO: 2120537 - protein, 5 aa, Cryptosporidium hominis
SSSQQ

SEQ ID NO: 2120538 - protein, 18 aa, Cryptosporidium hominis
SSSQTSNKVTESNENTEV

SEQ ID NO: 2120539 - protein, 65 aa, Cryptosporidium hominis
SSSRSNSSSSHDSNSEMKSRSKSESCLKSKTSSSSKTRSRSKTRSRSKARSRSESRSRSGSRSRS

SEQ ID NO: 2120540 - protein, 9 aa, Cryptosporidium hominis
SSSSDRLVS

SEQ ID NO: 2120541 - protein, 8 aa, Cryptosporidium hominis
SSSSEHSR

SEQ ID NO: 2120542 - protein, 12 aa, Cryptosporidium hominis
SSSSESNEASLK

SEQ ID NO: 2120543 - protein, 18 aa, Cryptosporidium hominis
SSSSNSQSRSNSRGNNLD

SEQ ID NO: 2120544 - protein, 8 aa, Cryptosporidium hominis
SSSSQNDI

SEQ ID NO: 2120545 - protein, 9 aa, Cryptosporidium hominis
SSSSSALSF

SEQ ID NO: 2120546 - protein, 6 aa, Cryptosporidium hominis
SSSTEL

SEQ ID NO: 2120547 - protein, 7 aa, Cryptosporidium hominis
SSSTGEE

SEQ ID NO: 2120548 - protein, 9 aa, Cryptosporidium hominis
SSSTGNQGI

SEQ ID NO: 2120549 - protein, 4 aa, Cryptosporidium hominis
SSSY

SEQ ID NO: 2120550 - protein, 5 aa, Cryptosporidium hominis
SSSYN

SEQ ID NO: 2120551 - protein, 12 aa, Cryptosporidium hominis
SSTCEEGKITRT

SEQ ID NO: 2120552 - protein, 8 aa, Cryptosporidium hominis
SSTCRKPQ

SEQ ID NO: 2120553 - protein, 10 aa, Cryptosporidium hominis
SSTDEDSSVV

SEQ ID NO: 2120554 - protein, 97 aa, Cryptosporidium hominis
SSTERNNQESLSSNTDANRTTTSTSTGAIANNSANSSATVTGTEGGRSSNINGANMNHSGSNTDSRLNNNSAQAQGNFRGGNGEGIRGDPMNSNPIG

SEQ ID NO: 2120555 - protein, 11 aa, Cryptosporidium hominis
SSTESSIKSTR

SEQ ID NO: 2120556 - protein, 5 aa, Cryptosporidium hominis
SSTGQ

SEQ ID NO: 2120557 - protein, 17 aa, Cryptosporidium hominis
SSTNDQNSKDDPSKRVN

SEQ ID NO: 2120558 - protein, 5 aa, Cryptosporidium hominis
SSTNL

SEQ ID NO: 2120559 - protein, 7 aa, Cryptosporidium hominis
SSTNTRL

SEQ ID NO: 2120560 - protein, 6 aa, Cryptosporidium hominis
SSTPQG

SEQ ID NO: 2120561 - protein, 5 aa, Cryptosporidium hominis
SSTPS

SEQ ID NO: 2120562 - protein, 9 aa, Cryptosporidium hominis
SSTPTSSNF

SEQ ID NO: 2120563 - protein, 5 aa, Cryptosporidium hominis
SSTQH

SEQ ID NO: 2120564 - protein, 7 aa, Cryptosporidium hominis
SSTRGNK

SEQ ID NO: 2120565 - protein, 7 aa, Cryptosporidium hominis
SSTSFSP

SEQ ID NO: 2120566 - protein, 11 aa, Cryptosporidium hominis
SSTSNSDSNLE

SEQ ID NO: 2120567 - protein, 5 aa, Cryptosporidium hominis
SSTTK

SEQ ID NO: 2120568 - protein, 95 aa, Cryptosporidium hominis
SSVDDSSLFDSEESVELEPRPGPGAGPGPGPGPGPGPGPGPGPGPGPGPGPGPGPGAGPRPGAGPGPVLGPGTPGKPTIPAWPGSSGRPSRIPGG

SEQ ID NO: 2120569 - protein, 20 aa, Cryptosporidium hominis
SSVEKDHSFNNSESNSRTVS

SEQ ID NO: 2120570 - protein, 25 aa, Cryptosporidium hominis
SSVKKNSSIRKTSSSELDECSDNES

SEQ ID NO: 2120571 - protein, 10 aa, Cryptosporidium hominis
SSVPSSSSEV

SEQ ID NO: 2120572 - protein, 19 aa, Cryptosporidium hominis
SSVQNHDASLTSQDENTVN

SEQ ID NO: 2120573 - protein, 7 aa, Cryptosporidium hominis
SSVSKNL

SEQ ID NO: 2120574 - protein, 17 aa, Cryptosporidium hominis
SSVTDNSKSLNNNNHNH

SEQ ID NO: 2120575 - protein, 11 aa, Cryptosporidium hominis
SSYASSSPLQK

SEQ ID NO: 2120576 - protein, 7 aa, Cryptosporidium hominis
SSYEGPD

SEQ ID NO: 2120577 - protein, 7 aa, Cryptosporidium hominis
SSYLNTK

SEQ ID NO: 2120578 - protein, 25 aa, Cryptosporidium hominis
SSYNESPSIKGQNSSNFEENQTFNT

SEQ ID NO: 2120579 - protein, 6 aa, Cryptosporidium hominis
SSYSPS

SEQ ID NO: 2120580 - protein, 13 aa, Cryptosporidium hominis
STAGSIESNEEEI

SEQ ID NO: 2120581 - protein, 7 aa, Cryptosporidium hominis
STAPIGG

SEQ ID NO: 2120582 - protein, 38 aa, Cryptosporidium hominis
STASSDEGFGSGISEEDNTSDSESENDSDSNDSTDYDI

SEQ ID NO: 2120583 - protein, 9 aa, Cryptosporidium hominis
STATSNGAL

SEQ ID NO: 2120584 - protein, 7 aa, Cryptosporidium hominis
STCSGHG

SEQ ID NO: 2120585 - protein, 10 aa, Cryptosporidium hominis
STDDNNRNAS

SEQ ID NO: 2120586 - protein, 16 aa, Cryptosporidium hominis
STDKEVNSAQPSPRKS

SEQ ID NO: 2120587 - protein, 4 aa, Cryptosporidium hominis
STDN

SEQ ID NO: 2120588 - protein, 6 aa, Cryptosporidium hominis
STDQNG

SEQ ID NO: 2120589 - protein, 5 aa, Cryptosporidium hominis
STDRA

SEQ ID NO: 2120590 - protein, 23 aa, Cryptosporidium hominis
STDSCNNSLKQQKTIRSLSDDRK

SEQ ID NO: 2120591 - protein, 23 aa, Cryptosporidium hominis
STEASPENSIKTVNNNKKRSIAI

SEQ ID NO: 2120592 - protein, 6 aa, Cryptosporidium hominis
STEEDE

SEQ ID NO: 2120593 - protein, 7 aa, Cryptosporidium hominis
STEGPNL

SEQ ID NO: 2120594 - protein, 8 aa, Cryptosporidium hominis
STENMDNS

SEQ ID NO: 2120595 - protein, 6 aa, Cryptosporidium hominis
STESFE

SEQ ID NO: 2120596 - protein, 6 aa, Cryptosporidium hominis
STETLE

SEQ ID NO: 2120597 - protein, 9 aa, Cryptosporidium hominis
STFGGKNSH

SEQ ID NO: 2120598 - protein, 5 aa, Cryptosporidium hominis
STFQN

SEQ ID NO: 2120599 - protein, 5 aa, Cryptosporidium hominis
STFSS

SEQ ID NO: 2120600 - protein, 6 aa, Cryptosporidium hominis
STGDVT

SEQ ID NO: 2120601 - protein, 4 aa, Cryptosporidium hominis
STGE

SEQ ID NO: 2120602 - protein, 4 aa, Cryptosporidium hominis
STGI

SEQ ID NO: 2120603 - protein, 9 aa, Cryptosporidium hominis
STGNPKDTG

SEQ ID NO: 2120604 - protein, 9 aa, Cryptosporidium hominis
STGQKPTTI

SEQ ID NO: 2120605 - protein, 13 aa, Cryptosporidium hominis
STIDSENKKELKA

SEQ ID NO: 2120606 - protein, 4 aa, Cryptosporidium hominis
STIN

SEQ ID NO: 2120607 - protein, 13 aa, Cryptosporidium hominis
STISNDNNSGDKY

SEQ ID NO: 2120608 - protein, 48 aa, Cryptosporidium hominis
STITTSSISQGEKLDQESSALSRSLGSLPSKSKYSETGTPSATSSKKS

SEQ ID NO: 2120609 - protein, 6 aa, Cryptosporidium hominis
STKETQ

SEQ ID NO: 2120610 - protein, 8 aa, Cryptosporidium hominis
STKNETNN

SEQ ID NO: 2120611 - protein, 13 aa, Cryptosporidium hominis
STKNTGKQISGGI

SEQ ID NO: 2120612 - protein, 9 aa, Cryptosporidium hominis
STKSRAMNK

SEQ ID NO: 2120613 - protein, 4 aa, Cryptosporidium hominis
STKT

SEQ ID NO: 2120614 - protein, 4 aa, Cryptosporidium hominis
STKW

SEQ ID NO: 2120615 - protein, 5 aa, Cryptosporidium hominis
STLER

SEQ ID NO: 2120616 - protein, 8 aa, Cryptosporidium hominis
STLPISTK

SEQ ID NO: 2120617 - protein, 8 aa, Cryptosporidium hominis
STLPKSKK

SEQ ID NO: 2120618 - protein, 41 aa, Cryptosporidium hominis
STLTESENFDDSEKSINGSFGEENFEKDDSFVSEDSVNKQG

SEQ ID NO: 2120619 - protein, 12 aa, Cryptosporidium hominis
STMNESQKKQLQ

SEQ ID NO: 2120620 - protein, 5 aa, Cryptosporidium hominis
STNDL

SEQ ID NO: 2120621 - protein, 9 aa, Cryptosporidium hominis
STNEADSGY

SEQ ID NO: 2120622 - protein, 8 aa, Cryptosporidium hominis
STNEKDSY

SEQ ID NO: 2120623 - protein, 4 aa, Cryptosporidium hominis
STNG

SEQ ID NO: 2120624 - protein, 4 aa, Cryptosporidium hominis
STNI

SEQ ID NO: 2120625 - protein, 6 aa, Cryptosporidium hominis
STNIET

SEQ ID NO: 2120626 - protein, 5 aa, Cryptosporidium hominis
STNIT

SEQ ID NO: 2120627 - protein, 6 aa, Cryptosporidium hominis
STNREA

SEQ ID NO: 2120628 - protein, 16 aa, Cryptosporidium hominis
STNSANIKTSGKNKAF

SEQ ID NO: 2120629 - protein, 8 aa, Cryptosporidium hominis
STNSTSSI

SEQ ID NO: 2120630 - protein, 18 aa, Cryptosporidium hominis
STNTNSNDFGNHSQSNAR

SEQ ID NO: 2120631 - protein, 6 aa, Cryptosporidium hominis
STNYKG

SEQ ID NO: 2120632 - protein, 5 aa, Cryptosporidium hominis
STPIN

SEQ ID NO: 2120633 - protein, 6 aa, Cryptosporidium hominis
STPKIS

SEQ ID NO: 2120634 - protein, 4 aa, Cryptosporidium hominis
STPL

SEQ ID NO: 2120635 - protein, 6 aa, Cryptosporidium hominis
STPLEQ

SEQ ID NO: 2120636 - protein, 5 aa, Cryptosporidium hominis
STPNK

SEQ ID NO: 2120637 - protein, 15 aa, Cryptosporidium hominis
STPQLKYKSGKTDIK

SEQ ID NO: 2120638 - protein, 12 aa, Cryptosporidium hominis
STPSPNCGDEGN

SEQ ID NO: 2120639 - protein, 5 aa, Cryptosporidium hominis
STPTE

SEQ ID NO: 2120640 - protein, 7 aa, Cryptosporidium hominis
STQGRVP

SEQ ID NO: 2120641 - protein, 9 aa, Cryptosporidium hominis
STQIQSGEI

SEQ ID NO: 2120642 - protein, 5 aa, Cryptosporidium hominis
STQLT

SEQ ID NO: 2120643 - protein, 10 aa, Cryptosporidium hominis
STQSNFSLPN

SEQ ID NO: 2120644 - protein, 16 aa, Cryptosporidium hominis
STQTRNTLTDSSRKYG

SEQ ID NO: 2120645 - protein, 5 aa, Cryptosporidium hominis
STRHA

SEQ ID NO: 2120646 - protein, 5 aa, Cryptosporidium hominis
STRHK

SEQ ID NO: 2120647 - protein, 4 aa, Cryptosporidium hominis
STRN

SEQ ID NO: 2120648 - protein, 6 aa, Cryptosporidium hominis
STRNRE

SEQ ID NO: 2120649 - protein, 6 aa, Cryptosporidium hominis
STRSKE

SEQ ID NO: 2120650 - protein, 28 aa, Cryptosporidium hominis
STSCGEGNRVRTREVTKPPLNGDDSTCP

SEQ ID NO: 2120651 - protein, 8 aa, Cryptosporidium hominis
STSDSSRG

SEQ ID NO: 2120652 - protein, 6 aa, Cryptosporidium hominis
STSDVS

SEQ ID NO: 2120653 - protein, 74 aa, Cryptosporidium hominis
STSESKSGQKSKSRSRSKSRTRSRSRTRTRSRSRARSRSRTRSRSRTRSSSRTKSRSRSRSSSRSRSGHGSEPW

SEQ ID NO: 2120654 - protein, 4 aa, Cryptosporidium hominis
STSG

SEQ ID NO: 2120655 - protein, 5 aa, Cryptosporidium hominis
STSHP

SEQ ID NO: 2120656 - protein, 16 aa, Cryptosporidium hominis
STSKNLDSSNLTATGS

SEQ ID NO: 2120657 - protein, 8 aa, Cryptosporidium hominis
STSNIPQS

SEQ ID NO: 2120658 - protein, 7 aa, Cryptosporidium hominis
STSPAAI

SEQ ID NO: 2120659 - protein, 6 aa, Cryptosporidium hominis
STSPYS

SEQ ID NO: 2120660 - protein, 5 aa, Cryptosporidium hominis
STSRN

SEQ ID NO: 2120661 - protein, 5 aa, Cryptosporidium hominis
STSRS

SEQ ID NO: 2120662 - protein, 5 aa, Cryptosporidium hominis
STSSS

SEQ ID NO: 2120663 - protein, 17 aa, Cryptosporidium hominis
STSSSSSAFNRRHNNQT

SEQ ID NO: 2120664 - protein, 4 aa, Cryptosporidium hominis
STST

SEQ ID NO: 2120665 - protein, 27 aa, Cryptosporidium hominis
STSTTTISTREDINKDEDISNGNSISS

SEQ ID NO: 2120666 - protein, 5 aa, Cryptosporidium hominis
STTCG

SEQ ID NO: 2120667 - protein, 5 aa, Cryptosporidium hominis
STTHP

SEQ ID NO: 2120668 - protein, 65 aa, Cryptosporidium hominis
STTPENPKAKIKTAKTTQKNITKNNQQKLKRKASNKLPPKADNEGNKEHENSPQASSSAVPAQET

SEQ ID NO: 2120669 - protein, 14 aa, Cryptosporidium hominis
STTTPSDKDENDNQ

SEQ ID NO: 2120670 - protein, 4 aa, Cryptosporidium hominis
STVE

SEQ ID NO: 2120671 - protein, 10 aa, Cryptosporidium hominis
STVKESEKTK

SEQ ID NO: 2120672 - protein, 4 aa, Cryptosporidium hominis
STVY

SEQ ID NO: 2120673 - protein, 4 aa, Cryptosporidium hominis
STYF

SEQ ID NO: 2120674 - protein, 18 aa, Cryptosporidium hominis
STYNGQPKSKGAALLSDP

SEQ ID NO: 2120675 - protein, 15 aa, Cryptosporidium hominis
SVASENAANGKLNSV

SEQ ID NO: 2120676 - protein, 11 aa, Cryptosporidium hominis
SVASNDKSYPS

SEQ ID NO: 2120677 - protein, 38 aa, Cryptosporidium hominis
SVDSKINSNISSSTQQPSGISNTFPNSLGTSGQTKNLS

SEQ ID NO: 2120678 - protein, 11 aa, Cryptosporidium hominis
SVEESISDTQK

SEQ ID NO: 2120679 - protein, 112 aa, Cryptosporidium hominis
SVEGSSSSSSSSSSSSSSSSSSSSSSSSSTSTVAPAPKKERTVEGGTEGKNEESSPGSEEQDGGKEDGGKENGEGDTVDGEQTGSGSQVTPSGSAGTATESTATTTPKEECG

SEQ ID NO: 2120680 - protein, 7 aa, Cryptosporidium hominis
SVENRKN

SEQ ID NO: 2120681 - protein, 5 aa, Cryptosporidium hominis
SVESS

SEQ ID NO: 2120682 - protein, 27 aa, Cryptosporidium hominis
SVGKGDSSAGLATDKKKNYTKDEGVTT

SEQ ID NO: 2120683 - protein, 10 aa, Cryptosporidium hominis
SVGKTQSIHS

SEQ ID NO: 2120684 - protein, 9 aa, Cryptosporidium hominis
SVGRGASQV

SEQ ID NO: 2120685 - protein, 6 aa, Cryptosporidium hominis
SVKNQQ

SEQ ID NO: 2120686 - protein, 13 aa, Cryptosporidium hominis
SVKPSSPKKKKLR

SEQ ID NO: 2120687 - protein, 38 aa, Cryptosporidium hominis
SVNDPEQEQEQDQDQDQDQNQDQDQVRAQNPGKNLEEQ

SEQ ID NO: 2120688 - protein, 12 aa, Cryptosporidium hominis
SVNEKDEKTLNN

SEQ ID NO: 2120689 - protein, 11 aa, Cryptosporidium hominis
SVNENGCEDDE

SEQ ID NO: 2120690 - protein, 13 aa, Cryptosporidium hominis
SVNNTFSSNYNPN

SEQ ID NO: 2120691 - protein, 15 aa, Cryptosporidium hominis
SVPNLGATETNSKFN

SEQ ID NO: 2120692 - protein, 8 aa, Cryptosporidium hominis
SVQTDRED

SEQ ID NO: 2120693 - protein, 9 aa, Cryptosporidium hominis
SVRPENKNL

SEQ ID NO: 2120694 - protein, 7 aa, Cryptosporidium hominis
SVSENSL

SEQ ID NO: 2120695 - protein, 9 aa, Cryptosporidium hominis
SVSESQISN

SEQ ID NO: 2120696 - protein, 22 aa, Cryptosporidium hominis
SVSPITNNSSYVNSRTQEPSTV

SEQ ID NO: 2120697 - protein, 5 aa, Cryptosporidium hominis
SVSSG

SEQ ID NO: 2120698 - protein, 10 aa, Cryptosporidium hominis
SVSTSSNSKL

SEQ ID NO: 2120699 - protein, 4 aa, Cryptosporidium hominis
SVTK

SEQ ID NO: 2120700 - protein, 9 aa, Cryptosporidium hominis
SVTNKQNEE

SEQ ID NO: 2120701 - protein, 7 aa, Cryptosporidium hominis
SWGSEPR

SEQ ID NO: 2120702 - protein, 30 aa, Cryptosporidium hominis
SWKESDAGKSFNFNESEKSPFQVGKSNSDI

SEQ ID NO: 2120703 - protein, 5 aa, Cryptosporidium hominis
SWPTS

SEQ ID NO: 2120704 - protein, 4 aa, Cryptosporidium hominis
SWQD

SEQ ID NO: 2120705 - protein, 11 aa, Cryptosporidium hominis
SYARSRAEAVE

SEQ ID NO: 2120706 - protein, 6 aa, Cryptosporidium hominis
SYEQTR

SEQ ID NO: 2120707 - protein, 6 aa, Cryptosporidium hominis
SYEYDE

SEQ ID NO: 2120708 - protein, 11 aa, Cryptosporidium hominis
SYGGESSSRDL

SEQ ID NO: 2120709 - protein, 7 aa, Cryptosporidium hominis
SYGGIKS

SEQ ID NO: 2120710 - protein, 4 aa, Cryptosporidium hominis
SYGM

SEQ ID NO: 2120711 - protein, 11 aa, Cryptosporidium hominis
SYKRSAGQGDV

SEQ ID NO: 2120712 - protein, 8 aa, Cryptosporidium hominis
SYKSSNEK

SEQ ID NO: 2120713 - protein, 6 aa, Cryptosporidium hominis
SYKVRK

SEQ ID NO: 2120714 - protein, 11 aa, Cryptosporidium hominis
SYNAKGSGNNQ

SEQ ID NO: 2120715 - protein, 5 aa, Cryptosporidium hominis
SYNDS

SEQ ID NO: 2120716 - protein, 7 aa, Cryptosporidium hominis
SYNSNYT

SEQ ID NO: 2120717 - protein, 5 aa, Cryptosporidium hominis
SYPGT

SEQ ID NO: 2120718 - protein, 4 aa, Cryptosporidium hominis
SYPI

SEQ ID NO: 2120719 - protein, 7 aa, Cryptosporidium hominis
SYPSPYI

SEQ ID NO: 2120720 - protein, 13 aa, Cryptosporidium hominis
SYRRDENKVYKPK

SEQ ID NO: 2120721 - protein, 6 aa, Cryptosporidium hominis
SYSGLR

SEQ ID NO: 2120722 - protein, 5 aa, Cryptosporidium hominis
SYSSA

SEQ ID NO: 2120723 - protein, 13 aa, Cryptosporidium hominis
SYSSCSADDHGSE

SEQ ID NO: 2120724 - protein, 8 aa, Cryptosporidium hominis
SYSSKENL

SEQ ID NO: 2120725 - protein, 8 aa, Cryptosporidium hominis
SYSSVSSR

SEQ ID NO: 2120726 - protein, 5 aa, Cryptosporidium hominis
SYTNN

SEQ ID NO: 2120727 - protein, 5 aa, Cryptosporidium hominis
SYTTN

SEQ ID NO: 2120728 - protein, 10 aa, Cryptosporidium hominis
SYTTSTRNAP

SEQ ID NO: 2120729 - protein, 20 aa, Cryptosporidium hominis
TADENNIQENYSRSKNSYNT

SEQ ID NO: 2120730 - protein, 10 aa, Cryptosporidium hominis
TADGEEEYSW

SEQ ID NO: 2120731 - protein, 21 aa, Cryptosporidium hominis
  misc_feature (21)..(21): Xaa can be any naturally occurring amino acid
TAESAAPPSAATWPVSPSGQX

SEQ ID NO: 2120732 - protein, 8 aa, Cryptosporidium hominis
TAFDDASD

SEQ ID NO: 2120733 - protein, 12 aa, Cryptosporidium hominis
TAFDQNTDISGV

SEQ ID NO: 2120734 - protein, 9 aa, Cryptosporidium hominis
TAKDYTEKA

SEQ ID NO: 2120735 - protein, 8 aa, Cryptosporidium hominis
TAKSSSEN

SEQ ID NO: 2120736 - protein, 7 aa, Cryptosporidium hominis
TAKTSVS

SEQ ID NO: 2120737 - protein, 6 aa, Cryptosporidium hominis
TALGGG

SEQ ID NO: 2120738 - protein, 7 aa, Cryptosporidium hominis
TANASIR

SEQ ID NO: 2120739 - protein, 11 aa, Cryptosporidium hominis
TANNPDLVPNP

SEQ ID NO: 2120740 - protein, 5 aa, Cryptosporidium hominis
TANTV

SEQ ID NO: 2120741 - protein, 7 aa, Cryptosporidium hominis
TASITEG

SEQ ID NO: 2120742 - protein, 60 aa, Cryptosporidium hominis
TASKKKLKKQKATGADTTSDNKDSNSSSSPLSTSKQVVEGEKSGNETGNNLKDGADTKMN

SEQ ID NO: 2120743 - protein, 17 aa, Cryptosporidium hominis
TASPASELEKMSNQESS

SEQ ID NO: 2120744 - protein, 8 aa, Cryptosporidium hominis
TATQNSVE

SEQ ID NO: 2120745 - protein, 15 aa, Cryptosporidium hominis
TAVAAEENIENQNGN

SEQ ID NO: 2120746 - protein, 11 aa, Cryptosporidium hominis
TAYTDTSNEGV

SEQ ID NO: 2120747 - protein, 13 aa, Cryptosporidium hominis
TCAQTNRGLPSLS

SEQ ID NO: 2120748 - protein, 5 aa, Cryptosporidium hominis
TCDRT

SEQ ID NO: 2120749 - protein, 7 aa, Cryptosporidium hominis
TCDSSPF

SEQ ID NO: 2120750 - protein, 8 aa, Cryptosporidium hominis
TCDSSVEQ

SEQ ID NO: 2120751 - protein, 8 aa, Cryptosporidium hominis
TCKKQTKL

SEQ ID NO: 2120752 - protein, 13 aa, Cryptosporidium hominis
TDDISSKSDLDQP

SEQ ID NO: 2120753 - protein, 7 aa, Cryptosporidium hominis
TDDQSVP

SEQ ID NO: 2120754 - protein, 14 aa, Cryptosporidium hominis
TDDRENTSSPDSTR

SEQ ID NO: 2120755 - protein, 8 aa, Cryptosporidium hominis
TDENSNMG

SEQ ID NO: 2120756 - protein, 8 aa, Cryptosporidium hominis
TDESQDDD

SEQ ID NO: 2120757 - protein, 6 aa, Cryptosporidium hominis
TDGNVS

SEQ ID NO: 2120758 - protein, 10 aa, Cryptosporidium hominis
TDGVGKSSKI

SEQ ID NO: 2120759 - protein, 11 aa, Cryptosporidium hominis
TDIGKNGSKEF

SEQ ID NO: 2120760 - protein, 6 aa, Cryptosporidium hominis
TDIGNT

SEQ ID NO: 2120761 - protein, 12 aa, Cryptosporidium hominis
TDINDYDDRKTS

SEQ ID NO: 2120762 - protein, 8 aa, Cryptosporidium hominis
TDITTYSQ

SEQ ID NO: 2120763 - protein, 4 aa, Cryptosporidium hominis
TDKF

SEQ ID NO: 2120764 - protein, 5 aa, Cryptosporidium hominis
TDKHE

SEQ ID NO: 2120765 - protein, 4 aa, Cryptosporidium hominis
TDKK

SEQ ID NO: 2120766 - protein, 7 aa, Cryptosporidium hominis
TDKKSNN

SEQ ID NO: 2120767 - protein, 8 aa, Cryptosporidium hominis
TDKLPNEV

SEQ ID NO: 2120768 - protein, 12 aa, Cryptosporidium hominis
TDMSGKGYSQNN

SEQ ID NO: 2120769 - protein, 5 aa, Cryptosporidium hominis
TDNCR

SEQ ID NO: 2120770 - protein, 6 aa, Cryptosporidium hominis
TDNDGS

SEQ ID NO: 2120771 - protein, 7 aa, Cryptosporidium hominis
TDPGIDP

SEQ ID NO: 2120772 - protein, 14 aa, Cryptosporidium hominis
TDSDMLSDDSLSSV

SEQ ID NO: 2120773 - protein, 7 aa, Cryptosporidium hominis
TDSGSSV

SEQ ID NO: 2120774 - protein, 9 aa, Cryptosporidium hominis
TDSNEYEKN

SEQ ID NO: 2120775 - protein, 8 aa, Cryptosporidium hominis
TDSQGRPV

SEQ ID NO: 2120776 - protein, 9 aa, Cryptosporidium hominis
TDSSNPAPW

SEQ ID NO: 2120777 - protein, 9 aa, Cryptosporidium hominis
TDTFSTKDY

SEQ ID NO: 2120778 - protein, 6 aa, Cryptosporidium hominis
TDTHWD

SEQ ID NO: 2120779 - protein, 14 aa, Cryptosporidium hominis
TDTNLSSEANPSNK

SEQ ID NO: 2120780 - protein, 6 aa, Cryptosporidium hominis
TDTSNV

SEQ ID NO: 2120781 - protein, 6 aa, Cryptosporidium hominis
TDVDGT

SEQ ID NO: 2120782 - protein, 6 aa, Cryptosporidium hominis
TECDQE

SEQ ID NO: 2120783 - protein, 11 aa, Cryptosporidium hominis
TEDSARKIKPE

SEQ ID NO: 2120784 - protein, 10 aa, Cryptosporidium hominis
TEEKQGSFNQ

SEQ ID NO: 2120785 - protein, 11 aa, Cryptosporidium hominis
TEEKSKGNPIK

SEQ ID NO: 2120786 - protein, 5 aa, Cryptosporidium hominis
TEENI

SEQ ID NO: 2120787 - protein, 5 aa, Cryptosporidium hominis
TEETI

SEQ ID NO: 2120788 - protein, 4 aa, Cryptosporidium hominis
TEFP

SEQ ID NO: 2120789 - protein, 30 aa, Cryptosporidium hominis
TEGTEGPNSPTIQSKPINDISSQTNQENSE

SEQ ID NO: 2120790 - protein, 7 aa, Cryptosporidium hominis
TEGTEVS

SEQ ID NO: 2120791 - protein, 4 aa, Cryptosporidium hominis
TEIN

SEQ ID NO: 2120792 - protein, 4 aa, Cryptosporidium hominis
TEIS

SEQ ID NO: 2120793 - protein, 11 aa, Cryptosporidium hominis
TEKHSSVYSEV

SEQ ID NO: 2120794 - protein, 8 aa, Cryptosporidium hominis
TEKKDESV

SEQ ID NO: 2120795 - protein, 9 aa, Cryptosporidium hominis
TELDSTKTV

SEQ ID NO: 2120796 - protein, 9 aa, Cryptosporidium hominis
TELGPNESG

SEQ ID NO: 2120797 - protein, 4 aa, Cryptosporidium hominis
TELS

SEQ ID NO: 2120798 - protein, 8 aa, Cryptosporidium hominis
TENKDDLR

SEQ ID NO: 2120799 - protein, 8 aa, Cryptosporidium hominis
TENNQIQK

SEQ ID NO: 2120800 - protein, 15 aa, Cryptosporidium hominis
TENPTICTMKNSEWF

SEQ ID NO: 2120801 - protein, 6 aa, Cryptosporidium hominis
TENRSV

SEQ ID NO: 2120802 - protein, 5 aa, Cryptosporidium hominis
TENRT

SEQ ID NO: 2120803 - protein, 5 aa, Cryptosporidium hominis
TENSF

SEQ ID NO: 2120804 - protein, 10 aa, Cryptosporidium hominis
TENVNKEVGS

SEQ ID NO: 2120805 - protein, 5 aa, Cryptosporidium hominis
TEPRH

SEQ ID NO: 2120806 - protein, 4 aa, Cryptosporidium hominis
TEQR

SEQ ID NO: 2120807 - protein, 6 aa, Cryptosporidium hominis
TERDAN

SEQ ID NO: 2120808 - protein, 18 aa, Cryptosporidium hominis
TERVGSLGENGETSSEIK

SEQ ID NO: 2120809 - protein, 27 aa, Cryptosporidium hominis
TESETEDEDVETLKTEHKTKIGKVDQP

SEQ ID NO: 2120810 - protein, 21 aa, Cryptosporidium hominis
TESGSTDISEKRDINSQEDGF

SEQ ID NO: 2120811 - protein, 9 aa, Cryptosporidium hominis
TESSTEEEI

SEQ ID NO: 2120812 - protein, 6 aa, Cryptosporidium hominis
TESSYE

SEQ ID NO: 2120813 - protein, 10 aa, Cryptosporidium hominis
TESTNSDFSK

SEQ ID NO: 2120814 - protein, 5 aa, Cryptosporidium hominis
TESVQ

SEQ ID NO: 2120815 - protein, 9 aa, Cryptosporidium hominis
TETGNSRKI

SEQ ID NO: 2120816 - protein, 11 aa, Cryptosporidium hominis
TETKHKSGLTK

SEQ ID NO: 2120817 - protein, 4 aa, Cryptosporidium hominis
TETV

SEQ ID NO: 2120818 - protein, 4 aa, Cryptosporidium hominis
TETY

SEQ ID NO: 2120819 - protein, 5 aa, Cryptosporidium hominis
TEYQK

SEQ ID NO: 2120820 - protein, 9 aa, Cryptosporidium hominis
TEYRTKSSE

SEQ ID NO: 2120821 - protein, 4 aa, Cryptosporidium hominis
TEYS

SEQ ID NO: 2120822 - protein, 9 aa, Cryptosporidium hominis
TFDGENSRI

SEQ ID NO: 2120823 - protein, 8 aa, Cryptosporidium hominis
TFDTSNEK

SEQ ID NO: 2120824 - protein, 5 aa, Cryptosporidium hominis
TFGEA

SEQ ID NO: 2120825 - protein, 8 aa, Cryptosporidium hominis
TFGPPGKQ

SEQ ID NO: 2120826 - protein, 10 aa, Cryptosporidium hominis
TFHNDNSTAA

SEQ ID NO: 2120827 - protein, 9 aa, Cryptosporidium hominis
TFPSNQGRL

SEQ ID NO: 2120828 - protein, 11 aa, Cryptosporidium hominis
TFTNKNNIYDN

SEQ ID NO: 2120829 - protein, 7 aa, Cryptosporidium hominis
TFTREKE

SEQ ID NO: 2120830 - protein, 26 aa, Cryptosporidium hominis
TFTSKSNSNSRKNQVSDAKTKTHQVC

SEQ ID NO: 2120831 - protein, 6 aa, Cryptosporidium hominis
TGADTK

SEQ ID NO: 2120832 - protein, 8 aa, Cryptosporidium hominis
TGANRNHG

SEQ ID NO: 2120833 - protein, 13 aa, Cryptosporidium hominis
TGDGVNDAPALKQ

SEQ ID NO: 2120834 - protein, 4 aa, Cryptosporidium hominis
TGDI

SEQ ID NO: 2120835 - protein, 18 aa, Cryptosporidium hominis
TGDLNSNIGAAATAVGGA

SEQ ID NO: 2120836 - protein, 5 aa, Cryptosporidium hominis
TGDSE

SEQ ID NO: 2120837 - protein, 11 aa, Cryptosporidium hominis
TGEATPQCKTG

SEQ ID NO: 2120838 - protein, 6 aa, Cryptosporidium hominis
TGEFDN

SEQ ID NO: 2120839 - protein, 18 aa, Cryptosporidium hominis
TGEMPNGVEKEVKSRPFE

SEQ ID NO: 2120840 - protein, 5 aa, Cryptosporidium hominis
TGESA

SEQ ID NO: 2120841 - protein, 8 aa, Cryptosporidium hominis
TGESEDVS

SEQ ID NO: 2120842 - protein, 6 aa, Cryptosporidium hominis
TGESNP

SEQ ID NO: 2120843 - protein, 6 aa, Cryptosporidium hominis
TGESQN

SEQ ID NO: 2120844 - protein, 28 aa, Cryptosporidium hominis
TGGAVSTGELTKEEKKKQKKQDKEDEKE

SEQ ID NO: 2120845 - protein, 11 aa, Cryptosporidium hominis
TGGGPTSSQSL

SEQ ID NO: 2120846 - protein, 10 aa, Cryptosporidium hominis
TGGITPEESA

SEQ ID NO: 2120847 - protein, 15 aa, Cryptosporidium hominis
TGGKQNSDLRKGKRY

SEQ ID NO: 2120848 - protein, 6 aa, Cryptosporidium hominis
TGGMDE

SEQ ID NO: 2120849 - protein, 10 aa, Cryptosporidium hominis
TGGSSALNNR

SEQ ID NO: 2120850 - protein, 7 aa, Cryptosporidium hominis
TGHEEPV

SEQ ID NO: 2120851 - protein, 12 aa, Cryptosporidium hominis
TGIATKQGPSIP

SEQ ID NO: 2120852 - protein, 16 aa, Cryptosporidium hominis
TGIDEKSGVPNGDRIP

SEQ ID NO: 2120853 - protein, 4 aa, Cryptosporidium hominis
TGIG

SEQ ID NO: 2120854 - protein, 4 aa, Cryptosporidium hominis
TGIN

SEQ ID NO: 2120855 - protein, 19 aa, Cryptosporidium hominis
TGINKGNKNQFEDYNANGE

SEQ ID NO: 2120856 - protein, 9 aa, Cryptosporidium hominis
TGKKEGTIH

SEQ ID NO: 2120857 - protein, 13 aa, Cryptosporidium hominis
TGKSSESKTLNNS

SEQ ID NO: 2120858 - protein, 10 aa, Cryptosporidium hominis
TGNKDLDTIN

SEQ ID NO: 2120859 - protein, 16 aa, Cryptosporidium hominis
TGNKPHEDETTDPNVE

SEQ ID NO: 2120860 - protein, 12 aa, Cryptosporidium hominis
TGNNEGVVISSS

SEQ ID NO: 2120861 - protein, 12 aa, Cryptosporidium hominis
TGNNGKQELDGS

SEQ ID NO: 2120862 - protein, 8 aa, Cryptosporidium hominis
TGNPQNFS

SEQ ID NO: 2120863 - protein, 6 aa, Cryptosporidium hominis
TGNSLT

SEQ ID NO: 2120864 - protein, 5 aa, Cryptosporidium hominis
TGNSV

SEQ ID NO: 2120865 - protein, 8 aa, Cryptosporidium hominis
TGNTGILN

SEQ ID NO: 2120866 - protein, 4 aa, Cryptosporidium hominis
TGNY

SEQ ID NO: 2120867 - protein, 19 aa, Cryptosporidium hominis
TGNYMSSSVSKSLRGISGR

SEQ ID NO: 2120868 - protein, 13 aa, Cryptosporidium hominis
TGPANSAENLKTQ

SEQ ID NO: 2120869 - protein, 6 aa, Cryptosporidium hominis
TGPDKN

SEQ ID NO: 2120870 - protein, 5 aa, Cryptosporidium hominis
TGPQI

SEQ ID NO: 2120871 - protein, 4 aa, Cryptosporidium hominis
TGRI

SEQ ID NO: 2120872 - protein, 10 aa, Cryptosporidium hominis
TGSDPSSKDY

SEQ ID NO: 2120873 - protein, 10 aa, Cryptosporidium hominis
TGSDTSSYTI

SEQ ID NO: 2120874 - protein, 7 aa, Cryptosporidium hominis
TGSKAQV

SEQ ID NO: 2120875 - protein, 7 aa, Cryptosporidium hominis
TGSNTVN

SEQ ID NO: 2120876 - protein, 4 aa, Cryptosporidium hominis
TGSQ

SEQ ID NO: 2120877 - protein, 9 aa, Cryptosporidium hominis
TGSSSNYGR

SEQ ID NO: 2120878 - protein, 6 aa, Cryptosporidium hominis
TGTLTT

SEQ ID NO: 2120879 - protein, 8 aa, Cryptosporidium hominis
TGTLTTDG

SEQ ID NO: 2120880 - protein, 4 aa, Cryptosporidium hominis
TGTM

SEQ ID NO: 2120881 - protein, 6 aa, Cryptosporidium hominis
TGTNIK

SEQ ID NO: 2120882 - protein, 7 aa, Cryptosporidium hominis
TGTPPRS

SEQ ID NO: 2120883 - protein, 19 aa, Cryptosporidium hominis
TGTTPTSSGTCTSPSTLNN

SEQ ID NO: 2120884 - protein, 26 aa, Cryptosporidium hominis
TGVGTEVGAGSEDRDYNNNNNSNEFY

SEQ ID NO: 2120885 - protein, 5 aa, Cryptosporidium hominis
TGYHI

SEQ ID NO: 2120886 - protein, 10 aa, Cryptosporidium hominis
TGYTIPSTKE

SEQ ID NO: 2120887 - protein, 4 aa, Cryptosporidium hominis
THAN

SEQ ID NO: 2120888 - protein, 5 aa, Cryptosporidium hominis
THDQV

SEQ ID NO: 2120889 - protein, 8 aa, Cryptosporidium hominis
THDSDPDV

SEQ ID NO: 2120890 - protein, 8 aa, Cryptosporidium hominis
THFSTEGA

SEQ ID NO: 2120891 - protein, 16 aa, Cryptosporidium hominis
THGGKTDFNAHPHQDY

SEQ ID NO: 2120892 - protein, 9 aa, Cryptosporidium hominis
THGNGASER

SEQ ID NO: 2120893 - protein, 16 aa, Cryptosporidium hominis
THKQRNDSEVQTSVDT

SEQ ID NO: 2120894 - protein, 6 aa, Cryptosporidium hominis
THNNQQ

SEQ ID NO: 2120895 - protein, 9 aa, Cryptosporidium hominis
THPNPTHPE

SEQ ID NO: 2120896 - protein, 8 aa, Cryptosporidium hominis
THPNQTSY

SEQ ID NO: 2120897 - protein, 21 aa, Cryptosporidium hominis
THQEADDTPELPSKDEDSNSK

SEQ ID NO: 2120898 - protein, 11 aa, Cryptosporidium hominis
THQSTTVTEPV

SEQ ID NO: 2120899 - protein, 7 aa, Cryptosporidium hominis
THSAPGC

SEQ ID NO: 2120900 - protein, 20 aa, Cryptosporidium hominis
THSFGNQYKNENNGAEQSLN

SEQ ID NO: 2120901 - protein, 6 aa, Cryptosporidium hominis
THSKQD

SEQ ID NO: 2120902 - protein, 15 aa, Cryptosporidium hominis
THSPSPSLTNDDLSG

SEQ ID NO: 2120903 - protein, 5 aa, Cryptosporidium hominis
THSTT

SEQ ID NO: 2120904 - protein, 5 aa, Cryptosporidium hominis
THTSG

SEQ ID NO: 2120905 - protein, 13 aa, Cryptosporidium hominis
THVESQPLKNSGY

SEQ ID NO: 2120906 - protein, 7 aa, Cryptosporidium hominis
TIDDQGE

SEQ ID NO: 2120907 - protein, 6 aa, Cryptosporidium hominis
TIDEQQ

SEQ ID NO: 2120908 - protein, 10 aa, Cryptosporidium hominis
TIDNPDQRIG

SEQ ID NO: 2120909 - protein, 23 aa, Cryptosporidium hominis
TIEEPTTKVDSEQKVSASLDTET

SEQ ID NO: 2120910 - protein, 13 aa, Cryptosporidium hominis
TIEKDNAYNQETL

SEQ ID NO: 2120911 - protein, 4 aa, Cryptosporidium hominis
TIEM

SEQ ID NO: 2120912 - protein, 6 aa, Cryptosporidium hominis
TIENAR

SEQ ID NO: 2120913 - protein, 7 aa, Cryptosporidium hominis
TIGGDDQ

SEQ ID NO: 2120914 - protein, 7 aa, Cryptosporidium hominis
TIGGTSS

SEQ ID NO: 2120915 - protein, 5 aa, Cryptosporidium hominis
TIGKG

SEQ ID NO: 2120916 - protein, 9 aa, Cryptosporidium hominis
TIGNNNEGL

SEQ ID NO: 2120917 - protein, 5 aa, Cryptosporidium hominis
TIGPQ

SEQ ID NO: 2120918 - protein, 23 aa, Cryptosporidium hominis
TIGQTKVESENGFGEKNKELSKI

SEQ ID NO: 2120919 - protein, 9 aa, Cryptosporidium hominis
TIKSANSVS

SEQ ID NO: 2120920 - protein, 4 aa, Cryptosporidium hominis
TINQ

SEQ ID NO: 2120921 - protein, 9 aa, Cryptosporidium hominis
TINSPSTSE

SEQ ID NO: 2120922 - protein, 15 aa, Cryptosporidium hominis
TIPGNNTNSTLKMLN

SEQ ID NO: 2120923 - protein, 12 aa, Cryptosporidium hominis
TIPTTNHRVSES

SEQ ID NO: 2120924 - protein, 8 aa, Cryptosporidium hominis
TIQTPRQQ

SEQ ID NO: 2120925 - protein, 10 aa, Cryptosporidium hominis
TISASNKENE

SEQ ID NO: 2120926 - protein, 4 aa, Cryptosporidium hominis
TISE

SEQ ID NO: 2120927 - protein, 5 aa, Cryptosporidium hominis
TISKE

SEQ ID NO: 2120928 - protein, 12 aa, Cryptosporidium hominis
TISNALSQSQQT

SEQ ID NO: 2120929 - protein, 4 aa, Cryptosporidium hominis
TISR

SEQ ID NO: 2120930 - protein, 6 aa, Cryptosporidium hominis
TISSKK

SEQ ID NO: 2120931 - protein, 10 aa, Cryptosporidium hominis
TISSNANDGG

SEQ ID NO: 2120932 - protein, 8 aa, Cryptosporidium hominis
TISSSNIQ

SEQ ID NO: 2120933 - protein, 7 aa, Cryptosporidium hominis
TISTKNN

SEQ ID NO: 2120934 - protein, 12 aa, Cryptosporidium hominis
TITTGNQSFGSE

SEQ ID NO: 2120935 - protein, 5 aa, Cryptosporidium hominis
TKAFS

SEQ ID NO: 2120936 - protein, 10 aa, Cryptosporidium hominis
TKASNSYANE

SEQ ID NO: 2120937 - protein, 12 aa, Cryptosporidium hominis
TKDDENKPERMI

SEQ ID NO: 2120938 - protein, 9 aa, Cryptosporidium hominis
TKDKTSSFD

SEQ ID NO: 2120939 - protein, 10 aa, Cryptosporidium hominis
TKDPNQRKNA

SEQ ID NO: 2120940 - protein, 6 aa, Cryptosporidium hominis
TKDRIN

SEQ ID NO: 2120941 - protein, 7 aa, Cryptosporidium hominis
TKDYPNG

SEQ ID NO: 2120942 - protein, 10 aa, Cryptosporidium hominis
TKEDETPASV

SEQ ID NO: 2120943 - protein, 9 aa, Cryptosporidium hominis
TKEDNKELK

SEQ ID NO: 2120944 - protein, 7 aa, Cryptosporidium hominis
TKEEHTI

SEQ ID NO: 2120945 - protein, 7 aa, Cryptosporidium hominis
TKENPTV

SEQ ID NO: 2120946 - protein, 6 aa, Cryptosporidium hominis
TKEQEE

SEQ ID NO: 2120947 - protein, 8 aa, Cryptosporidium hominis
TKESQGTI

SEQ ID NO: 2120948 - protein, 14 aa, Cryptosporidium hominis
TKESSPISKLRKKT

SEQ ID NO: 2120949 - protein, 5 aa, Cryptosporidium hominis
TKGCE

SEQ ID NO: 2120950 - protein, 10 aa, Cryptosporidium hominis
TKGYESTPIS

SEQ ID NO: 2120951 - protein, 5 aa, Cryptosporidium hominis
TKGYG

SEQ ID NO: 2120952 - protein, 25 aa, Cryptosporidium hominis
TKIEGETNKYISEQPVRDDSQAKEE

SEQ ID NO: 2120953 - protein, 11 aa, Cryptosporidium hominis
TKINSQDKTPI

SEQ ID NO: 2120954 - protein, 13 aa, Cryptosporidium hominis
TKKAKETDKSGIC

SEQ ID NO: 2120955 - protein, 10 aa, Cryptosporidium hominis
TKKEPNFSKK

SEQ ID NO: 2120956 - protein, 8 aa, Cryptosporidium hominis
TKKFGDST

SEQ ID NO: 2120957 - protein, 10 aa, Cryptosporidium hominis
TKKGSSKEKI

SEQ ID NO: 2120958 - protein, 5 aa, Cryptosporidium hominis
TKKHH

SEQ ID NO: 2120959 - protein, 9 aa, Cryptosporidium hominis
TKKKSMEDS

SEQ ID NO: 2120960 - protein, 7 aa, Cryptosporidium hominis
TKKNTHI

SEQ ID NO: 2120961 - protein, 9 aa, Cryptosporidium hominis
TKKSCPSCV

SEQ ID NO: 2120962 - protein, 7 aa, Cryptosporidium hominis
TKKSQMK

SEQ ID NO: 2120963 - protein, 13 aa, Cryptosporidium hominis
TKKYKRKIDKSKL

SEQ ID NO: 2120964 - protein, 6 aa, Cryptosporidium hominis
TKLRRN

SEQ ID NO: 2120965 - protein, 5 aa, Cryptosporidium hominis
TKMGE

SEQ ID NO: 2120966 - protein, 14 aa, Cryptosporidium hominis
TKMGYENKNLQNGI

SEQ ID NO: 2120967 - protein, 16 aa, Cryptosporidium hominis
TKNAAKKKKMSQVKGD

SEQ ID NO: 2120968 - protein, 8 aa, Cryptosporidium hominis
TKNNKNTF

SEQ ID NO: 2120969 - protein, 8 aa, Cryptosporidium hominis
TKNPNNQI

SEQ ID NO: 2120970 - protein, 9 aa, Cryptosporidium hominis
TKNQDKTRN

SEQ ID NO: 2120971 - protein, 5 aa, Cryptosporidium hominis
TKNSP

SEQ ID NO: 2120972 - protein, 10 aa, Cryptosporidium hominis
TKNSSNNNKV

SEQ ID NO: 2120973 - protein, 7 aa, Cryptosporidium hominis
TKNTECP

SEQ ID NO: 2120974 - protein, 8 aa, Cryptosporidium hominis
TKNTSGEI

SEQ ID NO: 2120975 - protein, 15 aa, Cryptosporidium hominis
TKPITTSTANPTKTI

SEQ ID NO: 2120976 - protein, 9 aa, Cryptosporidium hominis
TKPYRKSNE

SEQ ID NO: 2120977 - protein, 11 aa, Cryptosporidium hominis
TKQSRGDLGSY

SEQ ID NO: 2120978 - protein, 7 aa, Cryptosporidium hominis
TKQTGAR

SEQ ID NO: 2120979 - protein, 6 aa, Cryptosporidium hominis
TKREHT

SEQ ID NO: 2120980 - protein, 13 aa, Cryptosporidium hominis
TKRKESSFSTGND

SEQ ID NO: 2120981 - protein, 36 aa, Cryptosporidium hominis
TKRNFNKNKFGQNNHSQNSTRNDSNVQSKKKENEKH

SEQ ID NO: 2120982 - protein, 12 aa, Cryptosporidium hominis
TKRTWNKKNQVN

SEQ ID NO: 2120983 - protein, 7 aa, Cryptosporidium hominis
TKSGFSS

SEQ ID NO: 2120984 - protein, 5 aa, Cryptosporidium hominis
TKSGY

SEQ ID NO: 2120985 - protein, 15 aa, Cryptosporidium hominis
TKSIKPPKETTKFSF

SEQ ID NO: 2120986 - protein, 11 aa, Cryptosporidium hominis
TKSKNYASEVS

SEQ ID NO: 2120987 - protein, 8 aa, Cryptosporidium hominis
TKSLTSSK

SEQ ID NO: 2120988 - protein, 7 aa, Cryptosporidium hominis
TKSNEEI

SEQ ID NO: 2120989 - protein, 20 aa, Cryptosporidium hominis
TKSPEDGNGTSENAARSREM

SEQ ID NO: 2120990 - protein, 31 aa, Cryptosporidium hominis
TKSRIEKSALSDLNDTKNTVTVEKSTDFQPT

SEQ ID NO: 2120991 - protein, 16 aa, Cryptosporidium hominis
TKSRNSLNQENTNNDL

SEQ ID NO: 2120992 - protein, 9 aa, Cryptosporidium hominis
TKSSASRRE

SEQ ID NO: 2120993 - protein, 5 aa, Cryptosporidium hominis
TKSSF

SEQ ID NO: 2120994 - protein, 10 aa, Cryptosporidium hominis
TKSVDPENCR

SEQ ID NO: 2120995 - protein, 5 aa, Cryptosporidium hominis
TKSVE

SEQ ID NO: 2120996 - protein, 8 aa, Cryptosporidium hominis
TKTDPHQP

SEQ ID NO: 2120997 - protein, 10 aa, Cryptosporidium hominis
TKTDYDKQRI

SEQ ID NO: 2120998 - protein, 6 aa, Cryptosporidium hominis
TKTERL

SEQ ID NO: 2120999 - protein, 10 aa, Cryptosporidium hominis
TKTESDVKNS

SEQ ID NO: 2121000 - protein, 9 aa, Cryptosporidium hominis
TKTGKDPFA

SEQ ID NO: 2121001 - protein, 17 aa, Cryptosporidium hominis
TKTLNISPTGNEQSPSF

SEQ ID NO: 2121002 - protein, 9 aa, Cryptosporidium hominis
TKYDNSELS

SEQ ID NO: 2121003 - protein, 6 aa, Cryptosporidium hominis
TKYSNL

SEQ ID NO: 2121004 - protein, 6 aa, Cryptosporidium hominis
TLEESS

SEQ ID NO: 2121005 - protein, 5 aa, Cryptosporidium hominis
TLEGS

SEQ ID NO: 2121006 - protein, 4 aa, Cryptosporidium hominis
TLEQ

SEQ ID NO: 2121007 - protein, 6 aa, Cryptosporidium hominis
TLGSGP

SEQ ID NO: 2121008 - protein, 5 aa, Cryptosporidium hominis
TLKAE

SEQ ID NO: 2121009 - protein, 10 aa, Cryptosporidium hominis
TLKPTSHTSL

SEQ ID NO: 2121010 - protein, 13 aa, Cryptosporidium hominis
TLNDSNPAIGGNS

SEQ ID NO: 2121011 - protein, 14 aa, Cryptosporidium hominis
TLNPDNNKPKPRLG

SEQ ID NO: 2121012 - protein, 4 aa, Cryptosporidium hominis
TLPK

SEQ ID NO: 2121013 - protein, 9 aa, Cryptosporidium hominis
TLPNRSGEL

SEQ ID NO: 2121014 - protein, 4 aa, Cryptosporidium hominis
TLPS

SEQ ID NO: 2121015 - protein, 25 aa, Cryptosporidium hominis
TLSDDEKNMESNSCSIRSKSSYLNG

SEQ ID NO: 2121016 - protein, 10 aa, Cryptosporidium hominis
TLSEGPDSVG

SEQ ID NO: 2121017 - protein, 11 aa, Cryptosporidium hominis
TLSNGQKPWEE

SEQ ID NO: 2121018 - protein, 8 aa, Cryptosporidium hominis
TLSSSSHK

SEQ ID NO: 2121019 - protein, 17 aa, Cryptosporidium hominis
TLTPQSIERKEGTIIDQ

SEQ ID NO: 2121020 - protein, 9 aa, Cryptosporidium hominis
TLTPYDDNH

SEQ ID NO: 2121021 - protein, 8 aa, Cryptosporidium hominis
TNAKISNT

SEQ ID NO: 2121022 - protein, 26 aa, Cryptosporidium hominis
TNANTLSRSNKNNSFASSTSGNGCQT

SEQ ID NO: 2121023 - protein, 10 aa, Cryptosporidium hominis
TNEADGPALE

SEQ ID NO: 2121024 - protein, 5 aa, Cryptosporidium hominis
TNEAE

SEQ ID NO: 2121025 - protein, 5 aa, Cryptosporidium hominis
TNEAL

SEQ ID NO: 2121026 - protein, 11 aa, Cryptosporidium hominis
TNEMKKSSQAR

SEQ ID NO: 2121027 - protein, 8 aa, Cryptosporidium hominis
TNEVSEQE

SEQ ID NO: 2121028 - protein, 4 aa, Cryptosporidium hominis
TNFG

SEQ ID NO: 2121029 - protein, 21 aa, Cryptosporidium hominis
TNFGVDESSQDFQQKKSESIA

SEQ ID NO: 2121030 - protein, 7 aa, Cryptosporidium hominis
TNGDGSI

SEQ ID NO: 2121031 - protein, 9 aa, Cryptosporidium hominis
TNGNSNPGY

SEQ ID NO: 2121032 - protein, 21 aa, Cryptosporidium hominis
TNGRASMSNPFTGSNIGSSGG

SEQ ID NO: 2121033 - protein, 4 aa, Cryptosporidium hominis
TNIE

SEQ ID NO: 2121034 - protein, 20 aa, Cryptosporidium hominis
TNISGNDGQNYLKPSTKEYN

SEQ ID NO: 2121035 - protein, 9 aa, Cryptosporidium hominis
TNKCTENRK

SEQ ID NO: 2121036 - protein, 6 aa, Cryptosporidium hominis
TNKDIT

SEQ ID NO: 2121037 - protein, 9 aa, Cryptosporidium hominis
TNKDYQQNQ

SEQ ID NO: 2121038 - protein, 5 aa, Cryptosporidium hominis
TNKIP

SEQ ID NO: 2121039 - protein, 12 aa, Cryptosporidium hominis
TNKQHKNRETFD

SEQ ID NO: 2121040 - protein, 7 aa, Cryptosporidium hominis
TNKRGKK

SEQ ID NO: 2121041 - protein, 4 aa, Cryptosporidium hominis
TNLE

SEQ ID NO: 2121042 - protein, 6 aa, Cryptosporidium hominis
TNLENL

SEQ ID NO: 2121043 - protein, 23 aa, Cryptosporidium hominis
TNMTKSPQTSQTNKTQTTKDSQD

SEQ ID NO: 2121044 - protein, 5 aa, Cryptosporidium hominis
TNNEY

SEQ ID NO: 2121045 - protein, 15 aa, Cryptosporidium hominis
TNNPNLQAPKTPEEI

SEQ ID NO: 2121046 - protein, 8 aa, Cryptosporidium hominis
TNNQGKDL

SEQ ID NO: 2121047 - protein, 6 aa, Cryptosporidium hominis
TNNSGV

SEQ ID NO: 2121048 - protein, 4 aa, Cryptosporidium hominis
TNPG

SEQ ID NO: 2121049 - protein, 5 aa, Cryptosporidium hominis
TNPKK

SEQ ID NO: 2121050 - protein, 6 aa, Cryptosporidium hominis
TNPPQF

SEQ ID NO: 2121051 - protein, 4 aa, Cryptosporidium hominis
TNPR

SEQ ID NO: 2121052 - protein, 5 aa, Cryptosporidium hominis
TNPSE

SEQ ID NO: 2121053 - protein, 12 aa, Cryptosporidium hominis
TNQVTKNETHTN

SEQ ID NO: 2121054 - protein, 11 aa, Cryptosporidium hominis
TNSDRNLKDSE

SEQ ID NO: 2121055 - protein, 8 aa, Cryptosporidium hominis
TNSEGRKA

SEQ ID NO: 2121056 - protein, 4 aa, Cryptosporidium hominis
TNSG

SEQ ID NO: 2121057 - protein, 9 aa, Cryptosporidium hominis
TNSLEESNS

SEQ ID NO: 2121058 - protein, 9 aa, Cryptosporidium hominis
TNSNVNKVD

SEQ ID NO: 2121059 - protein, 24 aa, Cryptosporidium hominis
TNSPKSISATTSSSVSASNVGNNK

SEQ ID NO: 2121060 - protein, 8 aa, Cryptosporidium hominis
TNSPSIGG

SEQ ID NO: 2121061 - protein, 11 aa, Cryptosporidium hominis
TNSREQNRDKH

SEQ ID NO: 2121062 - protein, 8 aa, Cryptosporidium hominis
TNSRNQKK

SEQ ID NO: 2121063 - protein, 5 aa, Cryptosporidium hominis
TNSSG

SEQ ID NO: 2121064 - protein, 5 aa, Cryptosporidium hominis
TNSTE

SEQ ID NO: 2121065 - protein, 6 aa, Cryptosporidium hominis
TNSTFN

SEQ ID NO: 2121066 - protein, 7 aa, Cryptosporidium hominis
TNTINEN

SEQ ID NO: 2121067 - protein, 7 aa, Cryptosporidium hominis
TNTNAAS

SEQ ID NO: 2121068 - protein, 9 aa, Cryptosporidium hominis
TNTPEDPDH

SEQ ID NO: 2121069 - protein, 12 aa, Cryptosporidium hominis
TNTQGKSSVNIR

SEQ ID NO: 2121070 - protein, 5 aa, Cryptosporidium hominis
TNYSA

SEQ ID NO: 2121071 - protein, 6 aa, Cryptosporidium hominis
TNYTRK

SEQ ID NO: 2121072 - protein, 5 aa, Cryptosporidium hominis
TPASI

SEQ ID NO: 2121073 - protein, 16 aa, Cryptosporidium hominis
TPDDDYRESKKRRRKL

SEQ ID NO: 2121074 - protein, 5 aa, Cryptosporidium hominis
TPDSF

SEQ ID NO: 2121075 - protein, 6 aa, Cryptosporidium hominis
TPENQT

SEQ ID NO: 2121076 - protein, 7 aa, Cryptosporidium hominis
TPEQGGM

SEQ ID NO: 2121077 - protein, 8 aa, Cryptosporidium hominis
TPGSETIQ

SEQ ID NO: 2121078 - protein, 6 aa, Cryptosporidium hominis
TPHKGV

SEQ ID NO: 2121079 - protein, 6 aa, Cryptosporidium hominis
TPIDEP

SEQ ID NO: 2121080 - protein, 4 aa, Cryptosporidium hominis
TPIG

SEQ ID NO: 2121081 - protein, 64 aa, Cryptosporidium hominis
TPINQEQVSTSTSSSGSSSNSSSNSSAAVSSSASTLESTPDSFSSSVQTSTFNHDSASNQADEE

SEQ ID NO: 2121082 - protein, 6 aa, Cryptosporidium hominis
TPKRID

SEQ ID NO: 2121083 - protein, 8 aa, Cryptosporidium hominis
TPKSTAHP

SEQ ID NO: 2121084 - protein, 5 aa, Cryptosporidium hominis
TPKVS

SEQ ID NO: 2121085 - protein, 5 aa, Cryptosporidium hominis
TPKYS

SEQ ID NO: 2121086 - protein, 14 aa, Cryptosporidium hominis
TPLQPPHLTSKEGI

SEQ ID NO: 2121087 - protein, 9 aa, Cryptosporidium hominis
TPNKSNNNI

SEQ ID NO: 2121088 - protein, 4 aa, Cryptosporidium hominis
TPNN

SEQ ID NO: 2121089 - protein, 21 aa, Cryptosporidium hominis
TPPDSIRDVQKADNGNTPDLE

SEQ ID NO: 2121090 - protein, 6 aa, Cryptosporidium hominis
TPPEEY

SEQ ID NO: 2121091 - protein, 11 aa, Cryptosporidium hominis
TPPFTSNEQNI

SEQ ID NO: 2121092 - protein, 5 aa, Cryptosporidium hominis
TPPNK

SEQ ID NO: 2121093 - protein, 7 aa, Cryptosporidium hominis
TPPPDSV

SEQ ID NO: 2121094 - protein, 39 aa, Cryptosporidium hominis
TPQTHGNNTCGIQGEEMKESDAYYKSHPNENIESNNYER

SEQ ID NO: 2121095 - protein, 7 aa, Cryptosporidium hominis
TPRPYSS

SEQ ID NO: 2121096 - protein, 5 aa, Cryptosporidium hominis
TPRSQ

SEQ ID NO: 2121097 - protein, 5 aa, Cryptosporidium hominis
TPSNY

SEQ ID NO: 2121098 - protein, 11 aa, Cryptosporidium hominis
TPSPRARQTAA

SEQ ID NO: 2121099 - protein, 7 aa, Cryptosporidium hominis
TPSPSKE

SEQ ID NO: 2121100 - protein, 8 aa, Cryptosporidium hominis
TPSSNTMS

SEQ ID NO: 2121101 - protein, 9 aa, Cryptosporidium hominis
TPTIPSKIG

SEQ ID NO: 2121102 - protein, 4 aa, Cryptosporidium hominis
TPVA

SEQ ID NO: 2121103 - protein, 5 aa, Cryptosporidium hominis
TPVTP

SEQ ID NO: 2121104 - protein, 5 aa, Cryptosporidium hominis
TPYKC

SEQ ID NO: 2121105 - protein, 10 aa, Cryptosporidium hominis
TPYNPRSSIN

SEQ ID NO: 2121106 - protein, 5 aa, Cryptosporidium hominis
TPYNY

SEQ ID NO: 2121107 - protein, 11 aa, Cryptosporidium hominis
TQDENDEDYST

SEQ ID NO: 2121108 - protein, 10 aa, Cryptosporidium hominis
TQDPHGDYNN

SEQ ID NO: 2121109 - protein, 8 aa, Cryptosporidium hominis
TQDTNPDI

SEQ ID NO: 2121110 - protein, 12 aa, Cryptosporidium hominis
TQENTSLETYDK

SEQ ID NO: 2121111 - protein, 5 aa, Cryptosporidium hominis
TQFSN

SEQ ID NO: 2121112 - protein, 5 aa, Cryptosporidium hominis
TQGNT

SEQ ID NO: 2121113 - protein, 4 aa, Cryptosporidium hominis
TQHN

SEQ ID NO: 2121114 - protein, 5 aa, Cryptosporidium hominis
TQKKY

SEQ ID NO: 2121115 - protein, 8 aa, Cryptosporidium hominis
TQKSNIPE

SEQ ID NO: 2121116 - protein, 8 aa, Cryptosporidium hominis
TQLPSPSL

SEQ ID NO: 2121117 - protein, 11 aa, Cryptosporidium hominis
TQNDNSNNPEN

SEQ ID NO: 2121118 - protein, 12 aa, Cryptosporidium hominis
TQNGVENDSSIS

SEQ ID NO: 2121119 - protein, 9 aa, Cryptosporidium hominis
TQNKNEIST

SEQ ID NO: 2121120 - protein, 23 aa, Cryptosporidium hominis
TQNQAIGNISTGDSLEKDDPELN

SEQ ID NO: 2121121 - protein, 6 aa, Cryptosporidium hominis
TQNSAL

SEQ ID NO: 2121122 - protein, 13 aa, Cryptosporidium hominis
TQPKPKPKPKPVV

SEQ ID NO: 2121123 - protein, 14 aa, Cryptosporidium hominis
TQPKPKPKPKQTVT

SEQ ID NO: 2121124 - protein, 6 aa, Cryptosporidium hominis
TQPQSQ

SEQ ID NO: 2121125 - protein, 9 aa, Cryptosporidium hominis
TQQSEKKEF

SEQ ID NO: 2121126 - protein, 11 aa, Cryptosporidium hominis
TQRDWAESHER

SEQ ID NO: 2121127 - protein, 7 aa, Cryptosporidium hominis
TQRITAP

SEQ ID NO: 2121128 - protein, 10 aa, Cryptosporidium hominis
TQRNPPPAQH

SEQ ID NO: 2121129 - protein, 5 aa, Cryptosporidium hominis
TQSNI

SEQ ID NO: 2121130 - protein, 4 aa, Cryptosporidium hominis
TQSS

SEQ ID NO: 2121131 - protein, 21 aa, Cryptosporidium hominis
TQTDPIKTSKRTGSSKRRARK

SEQ ID NO: 2121132 - protein, 41 aa, Cryptosporidium hominis
TQTSTSSTNEEAPLTRSAAASLSRTRGGRSNEQMENSRMEK

SEQ ID NO: 2121133 - protein, 6 aa, Cryptosporidium hominis
TQYTEI

SEQ ID NO: 2121134 - protein, 8 aa, Cryptosporidium hominis
TRAKETAT

SEQ ID NO: 2121135 - protein, 8 aa, Cryptosporidium hominis
TRDSSAKS

SEQ ID NO: 2121136 - protein, 10 aa, Cryptosporidium hominis
TRENGTNIQS

SEQ ID NO: 2121137 - protein, 12 aa, Cryptosporidium hominis
TREPKKNYKPSN

SEQ ID NO: 2121138 - protein, 7 aa, Cryptosporidium hominis
TREYSKQ

SEQ ID NO: 2121139 - protein, 5 aa, Cryptosporidium hominis
TRGNT

SEQ ID NO: 2121140 - protein, 9 aa, Cryptosporidium hominis
TRGSDPNGG

SEQ ID NO: 2121141 - protein, 10 aa, Cryptosporidium hominis
TRGTGASTGH

SEQ ID NO: 2121142 - protein, 6 aa, Cryptosporidium hominis
TRKANS

SEQ ID NO: 2121143 - protein, 27 aa, Cryptosporidium hominis
TRKIGDEKEFKEENQVKDNTESDGCNS

SEQ ID NO: 2121144 - protein, 4 aa, Cryptosporidium hominis
TRLP

SEQ ID NO: 2121145 - protein, 5 aa, Cryptosporidium hominis
TRNKT

SEQ ID NO: 2121146 - protein, 4 aa, Cryptosporidium hominis
TRNN

SEQ ID NO: 2121147 - protein, 4 aa, Cryptosporidium hominis
TRPD

SEQ ID NO: 2121148 - protein, 13 aa, Cryptosporidium hominis
TRPFSDTYQQGDV

SEQ ID NO: 2121149 - protein, 11 aa, Cryptosporidium hominis
TRPKSLNGEAG

SEQ ID NO: 2121150 - protein, 8 aa, Cryptosporidium hominis
TRPRGTGA

SEQ ID NO: 2121151 - protein, 4 aa, Cryptosporidium hominis
TRQN

SEQ ID NO: 2121152 - protein, 6 aa, Cryptosporidium hominis
TRRGPI

SEQ ID NO: 2121153 - protein, 19 aa, Cryptosporidium hominis
TRRRKSQDGDKNESFLNEP

SEQ ID NO: 2121154 - protein, 26 aa, Cryptosporidium hominis
TRRSEIENQDDMQEGEYDEGEEEDED

SEQ ID NO: 2121155 - protein, 5 aa, Cryptosporidium hominis
TRRTQ

SEQ ID NO: 2121156 - protein, 8 aa, Cryptosporidium hominis
TRSEDELS

SEQ ID NO: 2121157 - protein, 16 aa, Cryptosporidium hominis
TRSFTSEPQTRPLQTQ

SEQ ID NO: 2121158 - protein, 10 aa, Cryptosporidium hominis
TRSSDALNSS

SEQ ID NO: 2121159 - protein, 10 aa, Cryptosporidium hominis
TRTAGNKETG

SEQ ID NO: 2121160 - protein, 4 aa, Cryptosporidium hominis
TRTN

SEQ ID NO: 2121161 - protein, 4 aa, Cryptosporidium hominis
TRTS

SEQ ID NO: 2121162 - protein, 4 aa, Cryptosporidium hominis
TRVE

SEQ ID NO: 2121163 - protein, 14 aa, Cryptosporidium hominis
TSAISQTKAGTSNH

SEQ ID NO: 2121164 - protein, 7 aa, Cryptosporidium hominis
TSALANY

SEQ ID NO: 2121165 - protein, 9 aa, Cryptosporidium hominis
TSARKTSDL

SEQ ID NO: 2121166 - protein, 15 aa, Cryptosporidium hominis
TSDETGIKLPKKSGY

SEQ ID NO: 2121167 - protein, 23 aa, Cryptosporidium hominis
TSDGRDLKTGTEFYDSNSSSLNT

SEQ ID NO: 2121168 - protein, 23 aa, Cryptosporidium hominis
TSDSEENELHTQNNRIDSTNSAS

SEQ ID NO: 2121169 - protein, 10 aa, Cryptosporidium hominis
TSDSKTNGNS

SEQ ID NO: 2121170 - protein, 20 aa, Cryptosporidium hominis
TSDYSEESQNVTISKSRPIS

SEQ ID NO: 2121171 - protein, 4 aa, Cryptosporidium hominis
TSEI

SEQ ID NO: 2121172 - protein, 4 aa, Cryptosporidium hominis
TSEL

SEQ ID NO: 2121173 - protein, 9 aa, Cryptosporidium hominis
TSESLGSES

SEQ ID NO: 2121174 - protein, 11 aa, Cryptosporidium hominis
TSFPESSKTTI

SEQ ID NO: 2121175 - protein, 4 aa, Cryptosporidium hominis
TSFS

SEQ ID NO: 2121176 - protein, 8 aa, Cryptosporidium hominis
TSFSGAQT

SEQ ID NO: 2121177 - protein, 7 aa, Cryptosporidium hominis
TSGDLQY

SEQ ID NO: 2121178 - protein, 14 aa, Cryptosporidium hominis
TSGHSNGNDEHGFT

SEQ ID NO: 2121179 - protein, 8 aa, Cryptosporidium hominis
TSGIPGLN

SEQ ID NO: 2121180 - protein, 6 aa, Cryptosporidium hominis
TSGLDV

SEQ ID NO: 2121181 - protein, 16 aa, Cryptosporidium hominis
TSGRNDSNNNNNGANV

SEQ ID NO: 2121182 - protein, 7 aa, Cryptosporidium hominis
TSGSQAT

SEQ ID NO: 2121183 - protein, 10 aa, Cryptosporidium hominis
TSHEKEYDIG

SEQ ID NO: 2121184 - protein, 4 aa, Cryptosporidium hominis
TSHK

SEQ ID NO: 2121185 - protein, 13 aa, Cryptosporidium hominis
TSHSSSSSHSNLN

SEQ ID NO: 2121186 - protein, 4 aa, Cryptosporidium hominis
TSIQ

SEQ ID NO: 2121187 - protein, 7 aa, Cryptosporidium hominis
TSKFDEK

SEQ ID NO: 2121188 - protein, 7 aa, Cryptosporidium hominis
TSKGGNK

SEQ ID NO: 2121189 - protein, 13 aa, Cryptosporidium hominis
TSKNLDSSSKKEK

SEQ ID NO: 2121190 - protein, 4 aa, Cryptosporidium hominis
TSKQ

SEQ ID NO: 2121191 - protein, 10 aa, Cryptosporidium hominis
TSKRKSNKNS

SEQ ID NO: 2121192 - protein, 6 aa, Cryptosporidium hominis
TSKVSP

SEQ ID NO: 2121193 - protein, 5 aa, Cryptosporidium hominis
TSKWK

SEQ ID NO: 2121194 - protein, 19 aa, Cryptosporidium hominis
TSKYNKDPKYKEKGSDDFS

SEQ ID NO: 2121195 - protein, 5 aa, Cryptosporidium hominis
TSLEE

SEQ ID NO: 2121196 - protein, 11 aa, Cryptosporidium hominis
TSNDIKATRDV

SEQ ID NO: 2121197 - protein, 10 aa, Cryptosporidium hominis
TSNLNPPSNN

SEQ ID NO: 2121198 - protein, 4 aa, Cryptosporidium hominis
TSNP

SEQ ID NO: 2121199 - protein, 8 aa, Cryptosporidium hominis
TSNSINDN

SEQ ID NO: 2121200 - protein, 16 aa, Cryptosporidium hominis
TSNTLSESKPNNFQNN

SEQ ID NO: 2121201 - protein, 12 aa, Cryptosporidium hominis
TSPGNKCKSGSV

SEQ ID NO: 2121202 - protein, 6 aa, Cryptosporidium hominis
TSPSPM

SEQ ID NO: 2121203 - protein, 16 aa, Cryptosporidium hominis
TSPTGRRGRPKKNINQ

SEQ ID NO: 2121204 - protein, 4 aa, Cryptosporidium hominis
TSPV

SEQ ID NO: 2121205 - protein, 22 aa, Cryptosporidium hominis
TSPYISTEQEIKSKKDQDLGSE

SEQ ID NO: 2121206 - protein, 11 aa, Cryptosporidium hominis
TSQDSNPKYKD

SEQ ID NO: 2121207 - protein, 4 aa, Cryptosporidium hominis
TSQE

SEQ ID NO: 2121208 - protein, 9 aa, Cryptosporidium hominis
TSQNEEKIP

SEQ ID NO: 2121209 - protein, 6 aa, Cryptosporidium hominis
TSQRGF

SEQ ID NO: 2121210 - protein, 8 aa, Cryptosporidium hominis
TSRAPLTD

SEQ ID NO: 2121211 - protein, 7 aa, Cryptosporidium hominis
TSRDGHN

SEQ ID NO: 2121212 - protein, 5 aa, Cryptosporidium hominis
TSREN

SEQ ID NO: 2121213 - protein, 5 aa, Cryptosporidium hominis
TSREY

SEQ ID NO: 2121214 - protein, 5 aa, Cryptosporidium hominis
TSRNV

SEQ ID NO: 2121215 - protein, 7 aa, Cryptosporidium hominis
TSSATSN

SEQ ID NO: 2121216 - protein, 13 aa, Cryptosporidium hominis
TSSCSESSRAMPI

SEQ ID NO: 2121217 - protein, 8 aa, Cryptosporidium hominis
TSSDMESS

SEQ ID NO: 2121218 - protein, 10 aa, Cryptosporidium hominis
TSSESTQGFY

SEQ ID NO: 2121219 - protein, 12 aa, Cryptosporidium hominis
TSSIINSSNHSK

SEQ ID NO: 2121220 - protein, 4 aa, Cryptosporidium hominis
TSSK

SEQ ID NO: 2121221 - protein, 15 aa, Cryptosporidium hominis
TSSKTQIKPSNTKDD

SEQ ID NO: 2121222 - protein, 5 aa, Cryptosporidium hominis
TSSMD

SEQ ID NO: 2121223 - protein, 8 aa, Cryptosporidium hominis
TSSNDSIG

SEQ ID NO: 2121224 - protein, 9 aa, Cryptosporidium hominis
TSSNNANIG

SEQ ID NO: 2121225 - protein, 18 aa, Cryptosporidium hominis
TSSQKKKKKRLPFKNEKN

SEQ ID NO: 2121226 - protein, 11 aa, Cryptosporidium hominis
TSSSKNNKNAA

SEQ ID NO: 2121227 - protein, 8 aa, Cryptosporidium hominis
TSSYRNKR

SEQ ID NO: 2121228 - protein, 5 aa, Cryptosporidium hominis
TSTEE

SEQ ID NO: 2121229 - protein, 7 aa, Cryptosporidium hominis
TSTGRFS

SEQ ID NO: 2121230 - protein, 53 aa, Cryptosporidium hominis
TSTMTTTTRKSFTPKTSTSIPINNNNNNNNNTIKLPTNKGREKEENTDSDIGK

SEQ ID NO: 2121231 - protein, 4 aa, Cryptosporidium hominis
TSTN

SEQ ID NO: 2121232 - protein, 28 aa, Cryptosporidium hominis
TSTQNKNSSKSKNKSNISNSNTEQVPEQ

SEQ ID NO: 2121233 - protein, 9 aa, Cryptosporidium hominis
TSTRETKEY

SEQ ID NO: 2121234 - protein, 10 aa, Cryptosporidium hominis
TSTSEWNHKP

SEQ ID NO: 2121235 - protein, 17 aa, Cryptosporidium hominis
TSTTTTATTTNTKNESI

SEQ ID NO: 2121236 - protein, 8 aa, Cryptosporidium hominis
TSTTTTTT

SEQ ID NO: 2121237 - protein, 4 aa, Cryptosporidium hominis
TSVA

SEQ ID NO: 2121238 - protein, 8 aa, Cryptosporidium hominis
TSVEKKEI

SEQ ID NO: 2121239 - protein, 4 aa, Cryptosporidium hominis
TSWI

SEQ ID NO: 2121240 - protein, 11 aa, Cryptosporidium hominis
TSWKKRPDPIC

SEQ ID NO: 2121241 - protein, 6 aa, Cryptosporidium hominis
TSWNSD

SEQ ID NO: 2121242 - protein, 15 aa, Cryptosporidium hominis
TSYGNKDKSTISSTV

SEQ ID NO: 2121243 - protein, 22 aa, Cryptosporidium hominis
TSYNSQIKHSTSNYHKDTSKSL

SEQ ID NO: 2121244 - protein, 11 aa, Cryptosporidium hominis
TSYSSSSSKYF

SEQ ID NO: 2121245 - protein, 8 aa, Cryptosporidium hominis
TSYTVSGD

SEQ ID NO: 2121246 - protein, 10 aa, Cryptosporidium hominis
TTAENVSQMN

SEQ ID NO: 2121247 - protein, 8 aa, Cryptosporidium hominis
TTAGSTKH

SEQ ID NO: 2121248 - protein, 6 aa, Cryptosporidium hominis
TTAPRG

SEQ ID NO: 2121249 - protein, 6 aa, Cryptosporidium hominis
TTCPRL

SEQ ID NO: 2121250 - protein, 20 aa, Cryptosporidium hominis
TTDADTKNSEQDNFHENDSF

SEQ ID NO: 2121251 - protein, 29 aa, Cryptosporidium hominis
TTDYQKKARKRSRSRTEKSKISLRSKYSF

SEQ ID NO: 2121252 - protein, 7 aa, Cryptosporidium hominis
TTEDGGY

SEQ ID NO: 2121253 - protein, 10 aa, Cryptosporidium hominis
TTEEGYGSNI

SEQ ID NO: 2121254 - protein, 7 aa, Cryptosporidium hominis
TTEIHNR

SEQ ID NO: 2121255 - protein, 5 aa, Cryptosporidium hominis
TTENK

SEQ ID NO: 2121256 - protein, 5 aa, Cryptosporidium hominis
TTFGD

SEQ ID NO: 2121257 - protein, 14 aa, Cryptosporidium hominis
TTFPEDSQTPSTIT

SEQ ID NO: 2121258 - protein, 24 aa, Cryptosporidium hominis
TTFSNTTKQTNKSVPKLESSNINP

SEQ ID NO: 2121259 - protein, 6 aa, Cryptosporidium hominis
TTFSPE

SEQ ID NO: 2121260 - protein, 17 aa, Cryptosporidium hominis
TTGFQEGRFSNQQKQQV

SEQ ID NO: 2121261 - protein, 6 aa, Cryptosporidium hominis
TTGNIA

SEQ ID NO: 2121262 - protein, 10 aa, Cryptosporidium hominis
TTGTKYSHPK

SEQ ID NO: 2121263 - protein, 6 aa, Cryptosporidium hominis
TTIRES

SEQ ID NO: 2121264 - protein, 12 aa, Cryptosporidium hominis
TTIRNSNQLNEV

SEQ ID NO: 2121265 - protein, 7 aa, Cryptosporidium hominis
TTKAPPK

SEQ ID NO: 2121266 - protein, 7 aa, Cryptosporidium hominis
TTKKEEE

SEQ ID NO: 2121267 - protein, 12 aa, Cryptosporidium hominis
TTKPTGQLCASY

SEQ ID NO: 2121268 - protein, 5 aa, Cryptosporidium hominis
TTKTC

SEQ ID NO: 2121269 - protein, 8 aa, Cryptosporidium hominis
TTKTSTVA

SEQ ID NO: 2121270 - protein, 6 aa, Cryptosporidium hominis
TTMGSD

SEQ ID NO: 2121271 - protein, 21 aa, Cryptosporidium hominis
TTNAPNLDGSYHGDDEFPSVS

SEQ ID NO: 2121272 - protein, 5 aa, Cryptosporidium hominis
TTNPN

SEQ ID NO: 2121273 - protein, 19 aa, Cryptosporidium hominis
TTNSDVSEQNKPNSMPSAI

SEQ ID NO: 2121274 - protein, 6 aa, Cryptosporidium hominis
TTNSQG

SEQ ID NO: 2121275 - protein, 9 aa, Cryptosporidium hominis
TTNSRSPQL

SEQ ID NO: 2121276 - protein, 4 aa, Cryptosporidium hominis
TTPE

SEQ ID NO: 2121277 - protein, 6 aa, Cryptosporidium hominis
TTPNNG

SEQ ID NO: 2121278 - protein, 10 aa, Cryptosporidium hominis
TTQQREPNKK

SEQ ID NO: 2121279 - protein, 9 aa, Cryptosporidium hominis
TTRDTRASI

SEQ ID NO: 2121280 - protein, 5 aa, Cryptosporidium hominis
TTRST

SEQ ID NO: 2121281 - protein, 5 aa, Cryptosporidium hominis
TTSAV

SEQ ID NO: 2121282 - protein, 6 aa, Cryptosporidium hominis
TTSDGV

SEQ ID NO: 2121283 - protein, 23 aa, Cryptosporidium hominis
TTSDNSPKDSNNSSNNHRSSSDS

SEQ ID NO: 2121284 - protein, 49 aa, Cryptosporidium hominis
TTSEKVSKHTRGKHTKRKQTKRNREREEEYSDASSTQSWSPSSRISKNC

SEQ ID NO: 2121285 - protein, 5 aa, Cryptosporidium hominis
TTSGI

SEQ ID NO: 2121286 - protein, 16 aa, Cryptosporidium hominis
TTSKTGISADLNSETF

SEQ ID NO: 2121287 - protein, 9 aa, Cryptosporidium hominis
TTSNNSDFQ

SEQ ID NO: 2121288 - protein, 6 aa, Cryptosporidium hominis
TTSPFS

SEQ ID NO: 2121289 - protein, 9 aa, Cryptosporidium hominis
TTTASNSEF

SEQ ID NO: 2121290 - protein, 15 aa, Cryptosporidium hominis
TTTDPGVMPNNGDKG

SEQ ID NO: 2121291 - protein, 6 aa, Cryptosporidium hominis
TTTSKQ

SEQ ID NO: 2121292 - protein, 8 aa, Cryptosporidium hominis
TTTSTISG

SEQ ID NO: 2121293 - protein, 27 aa, Cryptosporidium hominis
TTTTAKTTTTTSTTKPTTTTTTTTTTK

SEQ ID NO: 2121294 - protein, 229 aa, Cryptosporidium hominis
TTTTTTTTTTTTTTTTTTTTTTTTTTTTTTTTTTTKQTTTTTTTTTTTKTTTTTVNSTTTSTTTNPTTTTTTNTSTTTTTTTTTTTTKPTTTTTTTTTTTKPNTTTTTTTTATTTTTTTTTTTTTTTAKPTTTTTTSTIKPTTTATTTTTTTTTTTTTTTTTTTTKPATTTTTSTTATTTKSTTTTTTTTTTTKPNTTTTTSTIKPTTTTTTTTTTTTTTTKPTTTTTV

SEQ ID NO: 2121295 - protein, 62 aa, Cryptosporidium hominis
TTTTVTTTTTTTTTTTTTTTTTITTTKPNTTTTTTNTNTTNTTTTATTTATTTASNSATSTV

SEQ ID NO: 2121296 - protein, 14 aa, Cryptosporidium hominis
TTVNEKAKQKRNSI

SEQ ID NO: 2121297 - protein, 7 aa, Cryptosporidium hominis
TTYEEEE

SEQ ID NO: 2121298 - protein, 4 aa, Cryptosporidium hominis
TVES

SEQ ID NO: 2121299 - protein, 5 aa, Cryptosporidium hominis
TVNIK

SEQ ID NO: 2121300 - protein, 9 aa, Cryptosporidium hominis
TVNPPSDVS

SEQ ID NO: 2121301 - protein, 12 aa, Cryptosporidium hominis
TVNSPTSTNSLS

SEQ ID NO: 2121302 - protein, 4 aa, Cryptosporidium hominis
TVPE

SEQ ID NO: 2121303 - protein, 18 aa, Cryptosporidium hominis
TVQNPQKKVVNSQIGFKS

SEQ ID NO: 2121304 - protein, 8 aa, Cryptosporidium hominis
TVSAKDAS

SEQ ID NO: 2121305 - protein, 27 aa, Cryptosporidium hominis
TVSGSSSNINISSSTNSVRNSTYNNSS

SEQ ID NO: 2121306 - protein, 6 aa, Cryptosporidium hominis
TVSNTT

SEQ ID NO: 2121307 - protein, 6 aa, Cryptosporidium hominis
TVSQSG

SEQ ID NO: 2121308 - protein, 7 aa, Cryptosporidium hominis
TVSYSNK

SEQ ID NO: 2121309 - protein, 5 aa, Cryptosporidium hominis
TWDTS

SEQ ID NO: 2121310 - protein, 5 aa, Cryptosporidium hominis
TWSGE

SEQ ID NO: 2121311 - protein, 10 aa, Cryptosporidium hominis
TYDSNADSFP

SEQ ID NO: 2121312 - protein, 4 aa, Cryptosporidium hominis
TYEQ

SEQ ID NO: 2121313 - protein, 6 aa, Cryptosporidium hominis
TYESKS

SEQ ID NO: 2121314 - protein, 7 aa, Cryptosporidium hominis
TYKGKGI

SEQ ID NO: 2121315 - protein, 4 aa, Cryptosporidium hominis
TYKN

SEQ ID NO: 2121316 - protein, 19 aa, Cryptosporidium hominis
TYKSSNPPPKANDKGITQR

SEQ ID NO: 2121317 - protein, 13 aa, Cryptosporidium hominis
TYSINDNDSNFEE

SEQ ID NO: 2121318 - protein, 7 aa, Cryptosporidium hominis
TYSKETI

SEQ ID NO: 2121319 - protein, 5 aa, Cryptosporidium hominis
TYSPA

SEQ ID NO: 2121320 - protein, 12 aa, Cryptosporidium hominis
TYSTKTNTPLPE

SEQ ID NO: 2121321 - protein, 22 aa, Cryptosporidium hominis
TYTEKLGDDSLNKMNTQKEQLD

SEQ ID NO: 2121322 - protein, 8 aa, Cryptosporidium hominis
VAENSNSP

SEQ ID NO: 2121323 - protein, 5 aa, Cryptosporidium hominis
VAENT

SEQ ID NO: 2121324 - protein, 8 aa, Cryptosporidium hominis
VAGSYDNE

SEQ ID NO: 2121325 - protein, 5 aa, Cryptosporidium hominis
VANPM

SEQ ID NO: 2121326 - protein, 6 aa, Cryptosporidium hominis
VAPQNV

SEQ ID NO: 2121327 - protein, 11 aa, Cryptosporidium hominis
VAQNPSNIDYT

SEQ ID NO: 2121328 - protein, 18 aa, Cryptosporidium hominis
VAQNQSSSGSKNESDIHS

SEQ ID NO: 2121329 - protein, 18 aa, Cryptosporidium hominis
VARSNYEKYGNPDGPTSM

SEQ ID NO: 2121330 - protein, 5 aa, Cryptosporidium hominis
VASGL

SEQ ID NO: 2121331 - protein, 19 aa, Cryptosporidium hominis
VASNDGHIKSSTEKISSKI

SEQ ID NO: 2121332 - protein, 6 aa, Cryptosporidium hominis
VASRSA

SEQ ID NO: 2121333 - protein, 11 aa, Cryptosporidium hominis
VASTSTSSVVS

SEQ ID NO: 2121334 - protein, 16 aa, Cryptosporidium hominis
VCSTSSKNNANHLQSE

SEQ ID NO: 2121335 - protein, 13 aa, Cryptosporidium hominis
VDDGSVGEDFTSS

SEQ ID NO: 2121336 - protein, 4 aa, Cryptosporidium hominis
VDEE

SEQ ID NO: 2121337 - protein, 12 aa, Cryptosporidium hominis
VDEEEEEEEEEG

SEQ ID NO: 2121338 - protein, 7 aa, Cryptosporidium hominis
VDENEDL

SEQ ID NO: 2121339 - protein, 5 aa, Cryptosporidium hominis
VDESK

SEQ ID NO: 2121340 - protein, 15 aa, Cryptosporidium hominis
VDESVTDNDGITEEV

SEQ ID NO: 2121341 - protein, 4 aa, Cryptosporidium hominis
VDET

SEQ ID NO: 2121342 - protein, 6 aa, Cryptosporidium hominis
VDKDNV

SEQ ID NO: 2121343 - protein, 13 aa, Cryptosporidium hominis
VDPATQRDSGYYS

SEQ ID NO: 2121344 - protein, 7 aa, Cryptosporidium hominis
VDPPDPN

SEQ ID NO: 2121345 - protein, 6 aa, Cryptosporidium hominis
VDPPYI

SEQ ID NO: 2121346 - protein, 6 aa, Cryptosporidium hominis
VDPQSY

SEQ ID NO: 2121347 - protein, 13 aa, Cryptosporidium hominis
VDSNNKSSCNSDN

SEQ ID NO: 2121348 - protein, 10 aa, Cryptosporidium hominis
VDSNTRELDT

SEQ ID NO: 2121349 - protein, 6 aa, Cryptosporidium hominis
VDTSSM

SEQ ID NO: 2121350 - protein, 7 aa, Cryptosporidium hominis
VDYQENS

SEQ ID NO: 2121351 - protein, 11 aa, Cryptosporidium hominis
VEDNKTSCKTS

SEQ ID NO: 2121352 - protein, 9 aa, Cryptosporidium hominis
VEDPNTASD

SEQ ID NO: 2121353 - protein, 4 aa, Cryptosporidium hominis
VEDR

SEQ ID NO: 2121354 - protein, 7 aa, Cryptosporidium hominis
VEEKNSR

SEQ ID NO: 2121355 - protein, 11 aa, Cryptosporidium hominis
VEENGQGSKAE

SEQ ID NO: 2121356 - protein, 11 aa, Cryptosporidium hominis
VEESSGHSDPT

SEQ ID NO: 2121357 - protein, 12 aa, Cryptosporidium hominis
VEETGNSIESYS

SEQ ID NO: 2121358 - protein, 57 aa, Cryptosporidium hominis
VEGIQEGATRSEGRVSQAGTGTGTGLETGARADVGSGANQTGTSDRTSGNTTSQDIR

SEQ ID NO: 2121359 - protein, 9 aa, Cryptosporidium hominis
VEGQNYDDC

SEQ ID NO: 2121360 - protein, 8 aa, Cryptosporidium hominis
VEIPPPKI

SEQ ID NO: 2121361 - protein, 5 aa, Cryptosporidium hominis
VEISH

SEQ ID NO: 2121362 - protein, 9 aa, Cryptosporidium hominis
VEKPSSSLE

SEQ ID NO: 2121363 - protein, 10 aa, Cryptosporidium hominis
VENDEKQSES

SEQ ID NO: 2121364 - protein, 14 aa, Cryptosporidium hominis
VENEDIEKEETYNI

SEQ ID NO: 2121365 - protein, 6 aa, Cryptosporidium hominis
VENELN

SEQ ID NO: 2121366 - protein, 7 aa, Cryptosporidium hominis
VENGEDE

SEQ ID NO: 2121367 - protein, 5 aa, Cryptosporidium hominis
VENKD

SEQ ID NO: 2121368 - protein, 9 aa, Cryptosporidium hominis
VENQEQIGG

SEQ ID NO: 2121369 - protein, 6 aa, Cryptosporidium hominis
VENQNI

SEQ ID NO: 2121370 - protein, 9 aa, Cryptosporidium hominis
VENRESSLQ

SEQ ID NO: 2121371 - protein, 7 aa, Cryptosporidium hominis
VEQASPS

SEQ ID NO: 2121372 - protein, 21 aa, Cryptosporidium hominis
VEQISDSAEKAGEKDQEETQE

SEQ ID NO: 2121373 - protein, 17 aa, Cryptosporidium hominis
VEQKNERKSNLEESESL

SEQ ID NO: 2121374 - protein, 16 aa, Cryptosporidium hominis
VERKKSSLKEGSTNSA

SEQ ID NO: 2121375 - protein, 4 aa, Cryptosporidium hominis
VESL

SEQ ID NO: 2121376 - protein, 4 aa, Cryptosporidium hominis
VESR

SEQ ID NO: 2121377 - protein, 7 aa, Cryptosporidium hominis
VESSDNR

SEQ ID NO: 2121378 - protein, 17 aa, Cryptosporidium hominis
VFEEKKEEEEEEDESET

SEQ ID NO: 2121379 - protein, 10 aa, Cryptosporidium hominis
VFGSTQSEPC

SEQ ID NO: 2121380 - protein, 7 aa, Cryptosporidium hominis
VFSSNDI

SEQ ID NO: 2121381 - protein, 8 aa, Cryptosporidium hominis
VGEDEPRT

SEQ ID NO: 2121382 - protein, 22 aa, Cryptosporidium hominis
VGEEKDKEEERRVEKEKEIEEK

SEQ ID NO: 2121383 - protein, 5 aa, Cryptosporidium hominis
VGEEL

SEQ ID NO: 2121384 - protein, 5 aa, Cryptosporidium hominis
VGGGI

SEQ ID NO: 2121385 - protein, 7 aa, Cryptosporidium hominis
VGGGVGS

SEQ ID NO: 2121386 - protein, 4 aa, Cryptosporidium hominis
VGGI

SEQ ID NO: 2121387 - protein, 10 aa, Cryptosporidium hominis
VGGSERNNPY

SEQ ID NO: 2121388 - protein, 10 aa, Cryptosporidium hominis
VGGSGPSAGI

SEQ ID NO: 2121389 - protein, 5 aa, Cryptosporidium hominis
VGHSL

SEQ ID NO: 2121390 - protein, 8 aa, Cryptosporidium hominis
VGKEEKKI

SEQ ID NO: 2121391 - protein, 8 aa, Cryptosporidium hominis
VGKGSTLS

SEQ ID NO: 2121392 - protein, 5 aa, Cryptosporidium hominis
VGKKT

SEQ ID NO: 2121393 - protein, 9 aa, Cryptosporidium hominis
VGKPVEVSN

SEQ ID NO: 2121394 - protein, 10 aa, Cryptosporidium hominis
VGKTNEKIYT

SEQ ID NO: 2121395 - protein, 23 aa, Cryptosporidium hominis
VGLGTNSESPKLPELESENGSNS

SEQ ID NO: 2121396 - protein, 7 aa, Cryptosporidium hominis
VGNPTAL

SEQ ID NO: 2121397 - protein, 8 aa, Cryptosporidium hominis
VGNSKKEK

SEQ ID NO: 2121398 - protein, 8 aa, Cryptosporidium hominis
VGPAARGL

SEQ ID NO: 2121399 - protein, 29 aa, Cryptosporidium hominis
VGPGSSGDKNLDGEHTKDETLKSSKREEY

SEQ ID NO: 2121400 - protein, 5 aa, Cryptosporidium hominis
VGPGV

SEQ ID NO: 2121401 - protein, 5 aa, Cryptosporidium hominis
VGPND

SEQ ID NO: 2121402 - protein, 9 aa, Cryptosporidium hominis
VGPNKQRTE

SEQ ID NO: 2121403 - protein, 4 aa, Cryptosporidium hominis
VGPW

SEQ ID NO: 2121404 - protein, 8 aa, Cryptosporidium hominis
VGPYGQEK

SEQ ID NO: 2121405 - protein, 11 aa, Cryptosporidium hominis
VGQAGNPRKIT

SEQ ID NO: 2121406 - protein, 6 aa, Cryptosporidium hominis
VGQVSN

SEQ ID NO: 2121407 - protein, 17 aa, Cryptosporidium hominis
VGSCTGEEAQGTKHTTI

SEQ ID NO: 2121408 - protein, 7 aa, Cryptosporidium hominis
VGSGKSG

SEQ ID NO: 2121409 - protein, 5 aa, Cryptosporidium hominis
VGSGQ

SEQ ID NO: 2121410 - protein, 8 aa, Cryptosporidium hominis
VGSKKGKE

SEQ ID NO: 2121411 - protein, 6 aa, Cryptosporidium hominis
VGSSGG

SEQ ID NO: 2121412 - protein, 8 aa, Cryptosporidium hominis
VGSSSPLM

SEQ ID NO: 2121413 - protein, 10 aa, Cryptosporidium hominis
VGSTSNSKIP

SEQ ID NO: 2121414 - protein, 12 aa, Cryptosporidium hominis
VGTGAGLTRNTS

SEQ ID NO: 2121415 - protein, 20 aa, Cryptosporidium hominis
VGTPNSTKFNHNNETQDTKV

SEQ ID NO: 2121416 - protein, 6 aa, Cryptosporidium hominis
VGTPPR

SEQ ID NO: 2121417 - protein, 9 aa, Cryptosporidium hominis
VGYSSPPES

SEQ ID NO: 2121418 - protein, 29 aa, Cryptosporidium hominis
VHGGNSTAGAYGQNMGTKRGVQPGGMNHP

SEQ ID NO: 2121419 - protein, 8 aa, Cryptosporidium hominis
VHNSDKAE

SEQ ID NO: 2121420 - protein, 77 aa, Cryptosporidium hominis
VHPKGEAKVMGEKKSQEKSKASGVSSLGRSKRKSEGESEDGETTASSNNSEEKKNPESGAIEDSDTLSDKAKIKTEN

SEQ ID NO: 2121421 - protein, 6 aa, Cryptosporidium hominis
VHTNSS

SEQ ID NO: 2121422 - protein, 28 aa, Cryptosporidium hominis
VIEGDEKGNDHSSLPINKPNDPNKKSKI

SEQ ID NO: 2121423 - protein, 7 aa, Cryptosporidium hominis
VISPGSS

SEQ ID NO: 2121424 - protein, 18 aa, Cryptosporidium hominis
VISRENNSSPFRKLNTQK

SEQ ID NO: 2121425 - protein, 5 aa, Cryptosporidium hominis
VISTA

SEQ ID NO: 2121426 - protein, 5 aa, Cryptosporidium hominis
VKARG

SEQ ID NO: 2121427 - protein, 88 aa, Cryptosporidium hominis
VKDSKSEEGGDEEKEEKKEKDEKDKKSENKESEDKKEEGKNEDKEKENENKEEKSESNEENKETGENTDEKHIKEEEDSTSTSNKRSI

SEQ ID NO: 2121428 - protein, 6 aa, Cryptosporidium hominis
VKEEKE

SEQ ID NO: 2121429 - protein, 5 aa, Cryptosporidium hominis
VKEFD

SEQ ID NO: 2121430 - protein, 52 aa, Cryptosporidium hominis
VKEQTEDRAVDQENSDLPKSQINSSNGVSEDEPSQEAPPNEDFDDGSSVIST

SEQ ID NO: 2121431 - protein, 10 aa, Cryptosporidium hominis
VKETTARENR

SEQ ID NO: 2121432 - protein, 12 aa, Cryptosporidium hominis
VKETTGLNSEKI

SEQ ID NO: 2121433 - protein, 13 aa, Cryptosporidium hominis
VKEVPTAPASPSI

SEQ ID NO: 2121434 - protein, 19 aa, Cryptosporidium hominis
VKGIGSKDVKGQNTDYDEN

SEQ ID NO: 2121435 - protein, 11 aa, Cryptosporidium hominis
VKGNDGKIIEN

SEQ ID NO: 2121436 - protein, 5 aa, Cryptosporidium hominis
VKGNK

SEQ ID NO: 2121437 - protein, 9 aa, Cryptosporidium hominis
VKGPSQDSC

SEQ ID NO: 2121438 - protein, 12 aa, Cryptosporidium hominis
VKKNSNSLTGNN

SEQ ID NO: 2121439 - protein, 12 aa, Cryptosporidium hominis
VKKNTNINPTIQ

SEQ ID NO: 2121440 - protein, 28 aa, Cryptosporidium hominis
VKNKETNDTKNGNSSNNNNKSNSDIDHG

SEQ ID NO: 2121441 - protein, 5 aa, Cryptosporidium hominis
VKRRK

SEQ ID NO: 2121442 - protein, 7 aa, Cryptosporidium hominis
VKTGQMA

SEQ ID NO: 2121443 - protein, 7 aa, Cryptosporidium hominis
VKTPKEF

SEQ ID NO: 2121444 - protein, 8 aa, Cryptosporidium hominis
VLEDTERN

SEQ ID NO: 2121445 - protein, 10 aa, Cryptosporidium hominis
VLGGSSENSY

SEQ ID NO: 2121446 - protein, 12 aa, Cryptosporidium hominis
VLSSNSNSNSIS

SEQ ID NO: 2121447 - protein, 9 aa, Cryptosporidium hominis
VMKTNSEES

SEQ ID NO: 2121448 - protein, 14 aa, Cryptosporidium hominis
VMSPKNKKSKQIKT

SEQ ID NO: 2121449 - protein, 10 aa, Cryptosporidium hominis
VNDHGTSSRV

SEQ ID NO: 2121450 - protein, 4 aa, Cryptosporidium hominis
VNDN

SEQ ID NO: 2121451 - protein, 4 aa, Cryptosporidium hominis
VNDP

SEQ ID NO: 2121452 - protein, 8 aa, Cryptosporidium hominis
VNDSEDHA

SEQ ID NO: 2121453 - protein, 13 aa, Cryptosporidium hominis
VNDSGKNQHNDIK

SEQ ID NO: 2121454 - protein, 22 aa, Cryptosporidium hominis
VNEEDGNIVGGTTGNGTEVESK

SEQ ID NO: 2121455 - protein, 23 aa, Cryptosporidium hominis
VNEPLSSNAVGTSSNPSQGVPTS

SEQ ID NO: 2121456 - protein, 14 aa, Cryptosporidium hominis
VNETPTNQIQNSDS

SEQ ID NO: 2121457 - protein, 9 aa, Cryptosporidium hominis
VNEVSNSSV

SEQ ID NO: 2121458 - protein, 9 aa, Cryptosporidium hominis
VNGEKGNEL

SEQ ID NO: 2121459 - protein, 7 aa, Cryptosporidium hominis
VNGEKIK

SEQ ID NO: 2121460 - protein, 7 aa, Cryptosporidium hominis
VNGNGID

SEQ ID NO: 2121461 - protein, 6 aa, Cryptosporidium hominis
VNGNYS

SEQ ID NO: 2121462 - protein, 6 aa, Cryptosporidium hominis
VNGPNS

SEQ ID NO: 2121463 - protein, 20 aa, Cryptosporidium hominis
VNGSNNGNGLSSSVQTSRIK

SEQ ID NO: 2121464 - protein, 4 aa, Cryptosporidium hominis
VNIE

SEQ ID NO: 2121465 - protein, 20 aa, Cryptosporidium hominis
VNKGRKSRTRMKKKRNRTKI

SEQ ID NO: 2121466 - protein, 7 aa, Cryptosporidium hominis
VNKGSKK

SEQ ID NO: 2121467 - protein, 10 aa, Cryptosporidium hominis
VNKLDKKQFE

SEQ ID NO: 2121468 - protein, 8 aa, Cryptosporidium hominis
VNNDNSTY

SEQ ID NO: 2121469 - protein, 9 aa, Cryptosporidium hominis
VNNNESSVD

SEQ ID NO: 2121470 - protein, 11 aa, Cryptosporidium hominis
VNNNSSRDFSE

SEQ ID NO: 2121471 - protein, 7 aa, Cryptosporidium hominis
VNNSENK

SEQ ID NO: 2121472 - protein, 8 aa, Cryptosporidium hominis
VNNSKANS

SEQ ID NO: 2121473 - protein, 5 aa, Cryptosporidium hominis
VNPNL

SEQ ID NO: 2121474 - protein, 6 aa, Cryptosporidium hominis
VNPYKQ

SEQ ID NO: 2121475 - protein, 7 aa, Cryptosporidium hominis
VNQEERI

SEQ ID NO: 2121476 - protein, 5 aa, Cryptosporidium hominis
VNRED

SEQ ID NO: 2121477 - protein, 7 aa, Cryptosporidium hominis
VNRNGNT

SEQ ID NO: 2121478 - protein, 4 aa, Cryptosporidium hominis
VNSA

SEQ ID NO: 2121479 - protein, 6 aa, Cryptosporidium hominis
VNSEEA

SEQ ID NO: 2121480 - protein, 7 aa, Cryptosporidium hominis
VNSEENS

SEQ ID NO: 2121481 - protein, 13 aa, Cryptosporidium hominis
VNSGSAHHTPKQI

SEQ ID NO: 2121482 - protein, 10 aa, Cryptosporidium hominis
VNSLNTSNGM

SEQ ID NO: 2121483 - protein, 9 aa, Cryptosporidium hominis
VNSNNGNSL

SEQ ID NO: 2121484 - protein, 9 aa, Cryptosporidium hominis
VNSNQKNYE

SEQ ID NO: 2121485 - protein, 8 aa, Cryptosporidium hominis
VNSRPRGS

SEQ ID NO: 2121486 - protein, 14 aa, Cryptosporidium hominis
VNSSNSKSNNRENC

SEQ ID NO: 2121487 - protein, 10 aa, Cryptosporidium hominis
VNSSPEGRSC

SEQ ID NO: 2121488 - protein, 16 aa, Cryptosporidium hominis
VNTASRMKSSCETGKI

SEQ ID NO: 2121489 - protein, 10 aa, Cryptosporidium hominis
VNTEQKNQEI

SEQ ID NO: 2121490 - protein, 46 aa, Cryptosporidium hominis
VNTGNDSVATTKDYQKSVTMDTTDSTKKPTDNQGDHDNDDEDDQES

SEQ ID NO: 2121491 - protein, 6 aa, Cryptosporidium hominis
VNTINT

SEQ ID NO: 2121492 - protein, 10 aa, Cryptosporidium hominis
VNTNDNKKSI

SEQ ID NO: 2121493 - protein, 17 aa, Cryptosporidium hominis
VNTNSSSNMGYDQNNEE

SEQ ID NO: 2121494 - protein, 12 aa, Cryptosporidium hominis
VNVEKDGEGNFS

SEQ ID NO: 2121495 - protein, 9 aa, Cryptosporidium hominis
VNVTNQSSN

SEQ ID NO: 2121496 - protein, 8 aa, Cryptosporidium hominis
VNYSRSNK

SEQ ID NO: 2121497 - protein, 37 aa, Cryptosporidium hominis
VPASAQTPVPTPAPAPNSIQTRSSSNGNINKSSGMNN

SEQ ID NO: 2121498 - protein, 5 aa, Cryptosporidium hominis
VPENE

SEQ ID NO: 2121499 - protein, 5 aa, Cryptosporidium hominis
VPENS

SEQ ID NO: 2121500 - protein, 7 aa, Cryptosporidium hominis
VPEYNDA

SEQ ID NO: 2121501 - protein, 6 aa, Cryptosporidium hominis
VPGDAS

SEQ ID NO: 2121502 - protein, 4 aa, Cryptosporidium hominis
VPGK

SEQ ID NO: 2121503 - protein, 12 aa, Cryptosporidium hominis
VPKDADDAAIKK

SEQ ID NO: 2121504 - protein, 7 aa, Cryptosporidium hominis
VPKDAKV

SEQ ID NO: 2121505 - protein, 8 aa, Cryptosporidium hominis
VPKPQPKT

SEQ ID NO: 2121506 - protein, 18 aa, Cryptosporidium hominis
VPKPTIRRNQKNQEKSRG

SEQ ID NO: 2121507 - protein, 5 aa, Cryptosporidium hominis
VPKSI

SEQ ID NO: 2121508 - protein, 8 aa, Cryptosporidium hominis
VPKSQPKT

SEQ ID NO: 2121509 - protein, 21 aa, Cryptosporidium hominis
VPKTRGVKNYSSRSKKELNGD

SEQ ID NO: 2121510 - protein, 8 aa, Cryptosporidium hominis
VPLDQQSK

SEQ ID NO: 2121511 - protein, 7 aa, Cryptosporidium hominis
VPLSGNE

SEQ ID NO: 2121512 - protein, 18 aa, Cryptosporidium hominis
VPLSGQSLDSFPKPKGRY

SEQ ID NO: 2121513 - protein, 5 aa, Cryptosporidium hominis
VPNIS

SEQ ID NO: 2121514 - protein, 10 aa, Cryptosporidium hominis
VPNVSASRKA

SEQ ID NO: 2121515 - protein, 4 aa, Cryptosporidium hominis
VPPQ

SEQ ID NO: 2121516 - protein, 6 aa, Cryptosporidium hominis
VPPRKV

SEQ ID NO: 2121517 - protein, 11 aa, Cryptosporidium hominis
VPPRPKKSPIM

SEQ ID NO: 2121518 - protein, 7 aa, Cryptosporidium hominis
VPQPKPA

SEQ ID NO: 2121519 - protein, 8 aa, Cryptosporidium hominis
VPQPKPTM

SEQ ID NO: 2121520 - protein, 109 aa, Cryptosporidium hominis
VPREGGNTQSQTPSPPSMPSSQQSPPKQSSPQPAPPPQQSSSQQSSSQQSSSQQSPPKQSPPKQSSFQPAPPPQNSSSQPSSSTPSSKPSQTQMDSQKPNSQKISPQKV

SEQ ID NO: 2121521 - protein, 5 aa, Cryptosporidium hominis
VPREV

SEQ ID NO: 2121522 - protein, 9 aa, Cryptosporidium hominis
VPRTSRAQT

SEQ ID NO: 2121523 - protein, 8 aa, Cryptosporidium hominis
VPRTTRAQ

SEQ ID NO: 2121524 - protein, 5 aa, Cryptosporidium hominis
VPSEH

SEQ ID NO: 2121525 - protein, 15 aa, Cryptosporidium hominis
VPSEIQKSQESEELE

SEQ ID NO: 2121526 - protein, 8 aa, Cryptosporidium hominis
VPSGQSCS

SEQ ID NO: 2121527 - protein, 7 aa, Cryptosporidium hominis
VPSTSLN

SEQ ID NO: 2121528 - protein, 9 aa, Cryptosporidium hominis
VPTLEDSNK

SEQ ID NO: 2121529 - protein, 12 aa, Cryptosporidium hominis
VQEIGPESQNWA

SEQ ID NO: 2121530 - protein, 12 aa, Cryptosporidium hominis
VQGAPDAVTLIK

SEQ ID NO: 2121531 - protein, 11 aa, Cryptosporidium hominis
VQGETEYRQPM

SEQ ID NO: 2121532 - protein, 5 aa, Cryptosporidium hominis
VQGSK

SEQ ID NO: 2121533 - protein, 9 aa, Cryptosporidium hominis
VQNEKDGAR

SEQ ID NO: 2121534 - protein, 18 aa, Cryptosporidium hominis
VQPKSEENIEGKSSLKNE

SEQ ID NO: 2121535 - protein, 4 aa, Cryptosporidium hominis
VQQI

SEQ ID NO: 2121536 - protein, 9 aa, Cryptosporidium hominis
VQQQGKGCP

SEQ ID NO: 2121537 - protein, 6 aa, Cryptosporidium hominis
VQQSNT

SEQ ID NO: 2121538 - protein, 4 aa, Cryptosporidium hominis
VQRR

SEQ ID NO: 2121539 - protein, 5 aa, Cryptosporidium hominis
VQSPE

SEQ ID NO: 2121540 - protein, 5 aa, Cryptosporidium hominis
VQSPT

SEQ ID NO: 2121541 - protein, 11 aa, Cryptosporidium hominis
VQSSEINERYK

SEQ ID NO: 2121542 - protein, 5 aa, Cryptosporidium hominis
VQYTE

SEQ ID NO: 2121543 - protein, 9 aa, Cryptosporidium hominis
VRAAAQQPR

SEQ ID NO: 2121544 - protein, 5 aa, Cryptosporidium hominis
VRAAS

SEQ ID NO: 2121545 - protein, 8 aa, Cryptosporidium hominis
VRAPNSNV

SEQ ID NO: 2121546 - protein, 21 aa, Cryptosporidium hominis
VRDFGTPGKNTNEKKYESNEL

SEQ ID NO: 2121547 - protein, 51 aa, Cryptosporidium hominis
VRDQEKEQENEQEQGQDQEQEQEQDEDDEDQEQLDDKDQEQEDQEQIEKES

SEQ ID NO: 2121548 - protein, 6 aa, Cryptosporidium hominis
VRDSRS

SEQ ID NO: 2121549 - protein, 20 aa, Cryptosporidium hominis
VRKGGTSNPSFKEILMDDLH

SEQ ID NO: 2121550 - protein, 17 aa, Cryptosporidium hominis
VRNSDSSGNSSGGSNNF

SEQ ID NO: 2121551 - protein, 7 aa, Cryptosporidium hominis
VRNSLPG

SEQ ID NO: 2121552 - protein, 32 aa, Cryptosporidium hominis
VRSDNTSSQMPSSNHSQMNTSSSTIVQPPEPV

SEQ ID NO: 2121553 - protein, 8 aa, Cryptosporidium hominis
VRSKEESK

SEQ ID NO: 2121554 - protein, 7 aa, Cryptosporidium hominis
VSAPESS

SEQ ID NO: 2121555 - protein, 12 aa, Cryptosporidium hominis
VSAPNQKSIFSL

SEQ ID NO: 2121556 - protein, 32 aa, Cryptosporidium hominis
VSASPVGSKDISVEKSGEVGSNETSTMAPTEV

SEQ ID NO: 2121557 - protein, 10 aa, Cryptosporidium hominis
VSDNPEIDSE

SEQ ID NO: 2121558 - protein, 6 aa, Cryptosporidium hominis
VSDPPV

SEQ ID NO: 2121559 - protein, 6 aa, Cryptosporidium hominis
VSDRWN

SEQ ID NO: 2121560 - protein, 4 aa, Cryptosporidium hominis
VSED

SEQ ID NO: 2121561 - protein, 14 aa, Cryptosporidium hominis
VSEPENVPTNEENL

SEQ ID NO: 2121562 - protein, 6 aa, Cryptosporidium hominis
VSESTD

SEQ ID NO: 2121563 - protein, 6 aa, Cryptosporidium hominis
VSETEL

SEQ ID NO: 2121564 - protein, 5 aa, Cryptosporidium hominis
VSFGE

SEQ ID NO: 2121565 - protein, 7 aa, Cryptosporidium hominis
VSGEDAT

SEQ ID NO: 2121566 - protein, 7 aa, Cryptosporidium hominis
VSGENGF

SEQ ID NO: 2121567 - protein, 26 aa, Cryptosporidium hominis
VSGFPENNYYSNNPSMSYSQNGHLSG

SEQ ID NO: 2121568 - protein, 8 aa, Cryptosporidium hominis
VSGIPPFP

SEQ ID NO: 2121569 - protein, 4 aa, Cryptosporidium hominis
VSGQ

SEQ ID NO: 2121570 - protein, 9 aa, Cryptosporidium hominis
VSGSAYPNY

SEQ ID NO: 2121571 - protein, 10 aa, Cryptosporidium hominis
VSGSQLGMSP

SEQ ID NO: 2121572 - protein, 12 aa, Cryptosporidium hominis
VSGYSGESSISS

SEQ ID NO: 2121573 - protein, 5 aa, Cryptosporidium hominis
VSIPS

SEQ ID NO: 2121574 - protein, 6 aa, Cryptosporidium hominis
VSKDEI

SEQ ID NO: 2121575 - protein, 5 aa, Cryptosporidium hominis
VSKET

SEQ ID NO: 2121576 - protein, 5 aa, Cryptosporidium hominis
VSKNQ

SEQ ID NO: 2121577 - protein, 11 aa, Cryptosporidium hominis
VSNDSNGNPNW

SEQ ID NO: 2121578 - protein, 8 aa, Cryptosporidium hominis
VSNKTPLK

SEQ ID NO: 2121579 - protein, 8 aa, Cryptosporidium hominis
VSNNQSIG

SEQ ID NO: 2121580 - protein, 7 aa, Cryptosporidium hominis
VSNPDTD

SEQ ID NO: 2121581 - protein, 20 aa, Cryptosporidium hominis
VSNPGYIGGGNTGTMGGNNS

SEQ ID NO: 2121582 - protein, 7 aa, Cryptosporidium hominis
VSNPSVT

SEQ ID NO: 2121583 - protein, 4 aa, Cryptosporidium hominis
VSNQ

SEQ ID NO: 2121584 - protein, 5 aa, Cryptosporidium hominis
VSNQN

SEQ ID NO: 2121585 - protein, 18 aa, Cryptosporidium hominis
VSNRNNKPKFTRSDVYNG

SEQ ID NO: 2121586 - protein, 7 aa, Cryptosporidium hominis
VSNSENM

SEQ ID NO: 2121587 - protein, 21 aa, Cryptosporidium hominis
VSNSESGIKKNAISKHRQSSI

SEQ ID NO: 2121588 - protein, 16 aa, Cryptosporidium hominis
VSNTNNNTNTNNNTNI

SEQ ID NO: 2121589 - protein, 10 aa, Cryptosporidium hominis
VSPDPNNPFP

SEQ ID NO: 2121590 - protein, 9 aa, Cryptosporidium hominis
VSPEQYSSV

SEQ ID NO: 2121591 - protein, 6 aa, Cryptosporidium hominis
VSPKTA

SEQ ID NO: 2121592 - protein, 15 aa, Cryptosporidium hominis
VSPPTPKTKSSSWIP

SEQ ID NO: 2121593 - protein, 10 aa, Cryptosporidium hominis
VSQASSEPVT

SEQ ID NO: 2121594 - protein, 7 aa, Cryptosporidium hominis
VSQDSSK

SEQ ID NO: 2121595 - protein, 4 aa, Cryptosporidium hominis
VSQE

SEQ ID NO: 2121596 - protein, 12 aa, Cryptosporidium hominis
VSQGNNEKDQLE

SEQ ID NO: 2121597 - protein, 25 aa, Cryptosporidium hominis
VSQGNSNSNSNKAGVHSQSGSGLAP

SEQ ID NO: 2121598 - protein, 10 aa, Cryptosporidium hominis
VSQPKEITDR

SEQ ID NO: 2121599 - protein, 11 aa, Cryptosporidium hominis
VSQPPSSFTPS

SEQ ID NO: 2121600 - protein, 12 aa, Cryptosporidium hominis
VSQPRQTIPITQ

SEQ ID NO: 2121601 - protein, 8 aa, Cryptosporidium hominis
VSQRIQED

SEQ ID NO: 2121602 - protein, 12 aa, Cryptosporidium hominis
VSQSETHSSEMK

SEQ ID NO: 2121603 - protein, 7 aa, Cryptosporidium hominis
VSQSNLS

SEQ ID NO: 2121604 - protein, 8 aa, Cryptosporidium hominis
VSQTNKTK

SEQ ID NO: 2121605 - protein, 5 aa, Cryptosporidium hominis
VSRDD

SEQ ID NO: 2121606 - protein, 50 aa, Cryptosporidium hominis
VSRNDDSKASDEDKEHGCENSTSNNHNDDDINQRSNQVNQEDENSQYKSK

SEQ ID NO: 2121607 - protein, 5 aa, Cryptosporidium hominis
VSSAF

SEQ ID NO: 2121608 - protein, 4 aa, Cryptosporidium hominis
VSSD

SEQ ID NO: 2121609 - protein, 10 aa, Cryptosporidium hominis
VSSDSQINKA

SEQ ID NO: 2121610 - protein, 5 aa, Cryptosporidium hominis
VSSET

SEQ ID NO: 2121611 - protein, 11 aa, Cryptosporidium hominis
VSSEYSSDEDS

SEQ ID NO: 2121612 - protein, 8 aa, Cryptosporidium hominis
VSSKAEKE

SEQ ID NO: 2121613 - protein, 8 aa, Cryptosporidium hominis
VSSPDRRV

SEQ ID NO: 2121614 - protein, 6 aa, Cryptosporidium hominis
VSSQSD

SEQ ID NO: 2121615 - protein, 11 aa, Cryptosporidium hominis
VSSQSYSNSPW

SEQ ID NO: 2121616 - protein, 17 aa, Cryptosporidium hominis
VSSTGKVVNGNKISKID

SEQ ID NO: 2121617 - protein, 7 aa, Cryptosporidium hominis
VSSTNYG

SEQ ID NO: 2121618 - protein, 6 aa, Cryptosporidium hominis
VSTISS

SEQ ID NO: 2121619 - protein, 9 aa, Cryptosporidium hominis
VSTKEPANI

SEQ ID NO: 2121620 - protein, 10 aa, Cryptosporidium hominis
VSYEEEDPLI

SEQ ID NO: 2121621 - protein, 7 aa, Cryptosporidium hominis
VTAQREA

SEQ ID NO: 2121622 - protein, 8 aa, Cryptosporidium hominis
VTDNTGTG

SEQ ID NO: 2121623 - protein, 12 aa, Cryptosporidium hominis
VTDPESEGCPCS

SEQ ID NO: 2121624 - protein, 92 aa, Cryptosporidium hominis
VTDPPTTATSPTTTTSPTTTTTTTETTTETTTEATTTEATTTKTSPPTTTPTTMPTTAQTSTQQTTAPSTVSTELTTTTAAATTKSSVDPGV

SEQ ID NO: 2121625 - protein, 13 aa, Cryptosporidium hominis
VTDSDEVRGGSKL

SEQ ID NO: 2121626 - protein, 14 aa, Cryptosporidium hominis
VTEEDSDEETGPVT

SEQ ID NO: 2121627 - protein, 6 aa, Cryptosporidium hominis
VTENTS

SEQ ID NO: 2121628 - protein, 15 aa, Cryptosporidium hominis
VTERNENKTMISEEA

SEQ ID NO: 2121629 - protein, 4 aa, Cryptosporidium hominis
VTGG

SEQ ID NO: 2121630 - protein, 7 aa, Cryptosporidium hominis
VTISKSN

SEQ ID NO: 2121631 - protein, 7 aa, Cryptosporidium hominis
VTKGGNI

SEQ ID NO: 2121632 - protein, 23 aa, Cryptosporidium hominis
VTKNSKTSKRNTVKQTTKTQAPT

SEQ ID NO: 2121633 - protein, 6 aa, Cryptosporidium hominis
VTNQDY

SEQ ID NO: 2121634 - protein, 6 aa, Cryptosporidium hominis
VTNSRA

SEQ ID NO: 2121635 - protein, 7 aa, Cryptosporidium hominis
VTPQQKA

SEQ ID NO: 2121636 - protein, 7 aa, Cryptosporidium hominis
VTPTEMS

SEQ ID NO: 2121637 - protein, 24 aa, Cryptosporidium hominis
VTSEYDNGSEKSNKIAHTYDSGHY

SEQ ID NO: 2121638 - protein, 11 aa, Cryptosporidium hominis
VTSKNHGYRGK

SEQ ID NO: 2121639 - protein, 17 aa, Cryptosporidium hominis
VTSQPDSSSNFSSPNTA

SEQ ID NO: 2121640 - protein, 7 aa, Cryptosporidium hominis
VTSSSAD

SEQ ID NO: 2121641 - protein, 4 aa, Cryptosporidium hominis
VTST

SEQ ID NO: 2121642 - protein, 4 aa, Cryptosporidium hominis
VTTS

SEQ ID NO: 2121643 - protein, 8 aa, Cryptosporidium hominis
VTTTESSK

SEQ ID NO: 2121644 - protein, 78 aa, Cryptosporidium hominis
VVQGTENSNVTGSANTNSNSDNNINNNNSSSIEQSSELEQALPEQRNEREATEESEARIENSNNGAGYSTLRTPPHPL

SEQ ID NO: 2121645 - protein, 4 aa, Cryptosporidium hominis
VVSG

SEQ ID NO: 2121646 - protein, 16 aa, Cryptosporidium hominis
VVSNESKFGCKTSSIS

SEQ ID NO: 2121647 - protein, 8 aa, Cryptosporidium hominis
VVTRERGE

SEQ ID NO: 2121648 - protein, 7 aa, Cryptosporidium hominis
VYNSNNK

SEQ ID NO: 2121649 - protein, 11 aa, Cryptosporidium hominis
VYSDESSQFEV

SEQ ID NO: 2121650 - protein, 29 aa, Cryptosporidium hominis
VYTPAPAPTPTSAPTPPPAYGEASGFNSP

SEQ ID NO: 2121651 - protein, 5 aa, Cryptosporidium hominis
WEENR

SEQ ID NO: 2121652 - protein, 9 aa, Cryptosporidium hominis
WEKSNNMND

SEQ ID NO: 2121653 - protein, 7 aa, Cryptosporidium hominis
WENYNSE

SEQ ID NO: 2121654 - protein, 27 aa, Cryptosporidium hominis
WERAQEHKEDLKTEKSMEDKNNDETRF

SEQ ID NO: 2121655 - protein, 8 aa, Cryptosporidium hominis
WERGGTRF

SEQ ID NO: 2121656 - protein, 15 aa, Cryptosporidium hominis
WGDPSRGKLGQQDIR

SEQ ID NO: 2121657 - protein, 23 aa, Cryptosporidium hominis
WGKQSSAYQSTSSSASPPSYYAK

SEQ ID NO: 2121658 - protein, 12 aa, Cryptosporidium hominis
WGTTTQRVYSKS

SEQ ID NO: 2121659 - protein, 4 aa, Cryptosporidium hominis
WGVS

SEQ ID NO: 2121660 - protein, 4 aa, Cryptosporidium hominis
WKES

SEQ ID NO: 2121661 - protein, 7 aa, Cryptosporidium hominis
WKNSSLQ

SEQ ID NO: 2121662 - protein, 4 aa, Cryptosporidium hominis
WKPP

SEQ ID NO: 2121663 - protein, 6 aa, Cryptosporidium hominis
WKPYGD

SEQ ID NO: 2121664 - protein, 10 aa, Cryptosporidium hominis
WNPSKSNGYL

SEQ ID NO: 2121665 - protein, 11 aa, Cryptosporidium hominis
WNSEKAEQDED

SEQ ID NO: 2121666 - protein, 5 aa, Cryptosporidium hominis
WPNPS

SEQ ID NO: 2121667 - protein, 17 aa, Cryptosporidium hominis
WRGSTTAQIDRTNYANN

SEQ ID NO: 2121668 - protein, 12 aa, Cryptosporidium hominis
WRNPVKKKPKEY

SEQ ID NO: 2121669 - protein, 9 aa, Cryptosporidium hominis
WRRPSNNSF

SEQ ID NO: 2121670 - protein, 17 aa, Cryptosporidium hominis
WSGSAINRSPDGNQPVI

SEQ ID NO: 2121671 - protein, 8 aa, Cryptosporidium hominis
WSKDGSSL

SEQ ID NO: 2121672 - protein, 14 aa, Cryptosporidium hominis
WSPGSHSNKCPTRI

SEQ ID NO: 2121673 - protein, 10 aa, Cryptosporidium hominis
WTGSDSSEKC

SEQ ID NO: 2121674 - protein, 9 aa, Cryptosporidium hominis
WTTDYGGDL

SEQ ID NO: 2121675 - protein, 10 aa, Cryptosporidium hominis
YASKSGDLPE

SEQ ID NO: 2121676 - protein, 5 aa, Cryptosporidium hominis
YCSSE

SEQ ID NO: 2121677 - protein, 11 aa, Cryptosporidium hominis
YDDCNDGTSFR

SEQ ID NO: 2121678 - protein, 4 aa, Cryptosporidium hominis
YDDN

SEQ ID NO: 2121679 - protein, 4 aa, Cryptosporidium hominis
YDEQ

SEQ ID NO: 2121680 - protein, 50 aa, Cryptosporidium hominis
YDESKTSKSDMSKQTGTSKDTNTTSQTYNSSSESDIYENESTASTQDFET

SEQ ID NO: 2121681 - protein, 6 aa, Cryptosporidium hominis
YDGNTP

SEQ ID NO: 2121682 - protein, 6 aa, Cryptosporidium hominis
YDGTKR

SEQ ID NO: 2121683 - protein, 10 aa, Cryptosporidium hominis
YDKENNEESH

SEQ ID NO: 2121684 - protein, 7 aa, Cryptosporidium hominis
YDKRVSE

SEQ ID NO: 2121685 - protein, 6 aa, Cryptosporidium hominis
YDLGSK

SEQ ID NO: 2121686 - protein, 17 aa, Cryptosporidium hominis
YDNQDISSSGYNSLDDF

SEQ ID NO: 2121687 - protein, 7 aa, Cryptosporidium hominis
YDNSDVN

SEQ ID NO: 2121688 - protein, 18 aa, Cryptosporidium hominis
YDNSNEGYLVNNDEGNWM

SEQ ID NO: 2121689 - protein, 7 aa, Cryptosporidium hominis
YDPTTAG

SEQ ID NO: 2121690 - protein, 8 aa, Cryptosporidium hominis
YDQTTENS

SEQ ID NO: 2121691 - protein, 7 aa, Cryptosporidium hominis
YDSGTSF

SEQ ID NO: 2121692 - protein, 11 aa, Cryptosporidium hominis
YDSQQSGFSSP

SEQ ID NO: 2121693 - protein, 12 aa, Cryptosporidium hominis
YDSSSASADANY

SEQ ID NO: 2121694 - protein, 8 aa, Cryptosporidium hominis
YDSTSLSA

SEQ ID NO: 2121695 - protein, 24 aa, Cryptosporidium hominis
YDSYGSSFSTNHSGDSGYSEDGLS

SEQ ID NO: 2121696 - protein, 11 aa, Cryptosporidium hominis
YDYTNYSNNGY

SEQ ID NO: 2121697 - protein, 8 aa, Cryptosporidium hominis
YEANPNEE

SEQ ID NO: 2121698 - protein, 12 aa, Cryptosporidium hominis
YEAPSKTVQERI

SEQ ID NO: 2121699 - protein, 36 aa, Cryptosporidium hominis
YEDEEGTEKKNIKQGSNNQKSSNTENKLRNNENKRH

SEQ ID NO: 2121700 - protein, 22 aa, Cryptosporidium hominis
YEENGDKMSIGGTNIDGSSIGG

SEQ ID NO: 2121701 - protein, 15 aa, Cryptosporidium hominis
YEEQSISPARGSFRT

SEQ ID NO: 2121702 - protein, 10 aa, Cryptosporidium hominis
YEESDSKNLG

SEQ ID NO: 2121703 - protein, 9 aa, Cryptosporidium hominis
YEESENNVS

SEQ ID NO: 2121704 - protein, 4 aa, Cryptosporidium hominis
YEGL

SEQ ID NO: 2121705 - protein, 5 aa, Cryptosporidium hominis
YEGNI

SEQ ID NO: 2121706 - protein, 4 aa, Cryptosporidium hominis
YEIN

SEQ ID NO: 2121707 - protein, 9 aa, Cryptosporidium hominis
YEITEGRSS

SEQ ID NO: 2121708 - protein, 11 aa, Cryptosporidium hominis
YEKATEESNSE

SEQ ID NO: 2121709 - protein, 7 aa, Cryptosporidium hominis
YEKTSFK

SEQ ID NO: 2121710 - protein, 8 aa, Cryptosporidium hominis
YEKYPDEY

SEQ ID NO: 2121711 - protein, 9 aa, Cryptosporidium hominis
YENDLDSDV

SEQ ID NO: 2121712 - protein, 8 aa, Cryptosporidium hominis
YENPSPNS

SEQ ID NO: 2121713 - protein, 4 aa, Cryptosporidium hominis
YENR

SEQ ID NO: 2121714 - protein, 6 aa, Cryptosporidium hominis
YENREY

SEQ ID NO: 2121715 - protein, 29 aa, Cryptosporidium hominis
YERENNQENENNRGNHSEKPRDIDKGSKI

SEQ ID NO: 2121716 - protein, 5 aa, Cryptosporidium hominis
YERKK

SEQ ID NO: 2121717 - protein, 4 aa, Cryptosporidium hominis
YESE

SEQ ID NO: 2121718 - protein, 9 aa, Cryptosporidium hominis
YESGDVDGA

SEQ ID NO: 2121719 - protein, 24 aa, Cryptosporidium hominis
YESKKDKVKNEANDSNISSSSNTF

SEQ ID NO: 2121720 - protein, 9 aa, Cryptosporidium hominis
YESNDSDGY

SEQ ID NO: 2121721 - protein, 8 aa, Cryptosporidium hominis
YESNRDTF

SEQ ID NO: 2121722 - protein, 7 aa, Cryptosporidium hominis
YESSSLD

SEQ ID NO: 2121723 - protein, 6 aa, Cryptosporidium hominis
YESTEY

SEQ ID NO: 2121724 - protein, 5 aa, Cryptosporidium hominis
YESYK

SEQ ID NO: 2121725 - protein, 11 aa, Cryptosporidium hominis
YETDNRNNNYG

SEQ ID NO: 2121726 - protein, 6 aa, Cryptosporidium hominis
YEYRPE

SEQ ID NO: 2121727 - protein, 5 aa, Cryptosporidium hominis
YEYSS

SEQ ID NO: 2121728 - protein, 4 aa, Cryptosporidium hominis
YFDE

SEQ ID NO: 2121729 - protein, 4 aa, Cryptosporidium hominis
YGAD

SEQ ID NO: 2121730 - protein, 6 aa, Cryptosporidium hominis
YGAHSN

SEQ ID NO: 2121731 - protein, 5 aa, Cryptosporidium hominis
YGASK

SEQ ID NO: 2121732 - protein, 13 aa, Cryptosporidium hominis
YGDSTEKDRSERI

SEQ ID NO: 2121733 - protein, 8 aa, Cryptosporidium hominis
YGDYTPSN

SEQ ID NO: 2121734 - protein, 10 aa, Cryptosporidium hominis
YGENVKKGID

SEQ ID NO: 2121735 - protein, 13 aa, Cryptosporidium hominis
YGGDKPLNNPFGA

SEQ ID NO: 2121736 - protein, 10 aa, Cryptosporidium hominis
YGGPNTQNSA

SEQ ID NO: 2121737 - protein, 4 aa, Cryptosporidium hominis
YGGV

SEQ ID NO: 2121738 - protein, 8 aa, Cryptosporidium hominis
YGKSASIL

SEQ ID NO: 2121739 - protein, 4 aa, Cryptosporidium hominis
YGLG

SEQ ID NO: 2121740 - protein, 7 aa, Cryptosporidium hominis
YGLGQSQ

SEQ ID NO: 2121741 - protein, 4 aa, Cryptosporidium hominis
YGNE

SEQ ID NO: 2121742 - protein, 18 aa, Cryptosporidium hominis
YGNHDTVDHEYENDDGYR

SEQ ID NO: 2121743 - protein, 12 aa, Cryptosporidium hominis
YGPLTTGSIESD

SEQ ID NO: 2121744 - protein, 4 aa, Cryptosporidium hominis
YGPP

SEQ ID NO: 2121745 - protein, 14 aa, Cryptosporidium hominis
YGQRGPQKASDSPF

SEQ ID NO: 2121746 - protein, 4 aa, Cryptosporidium hominis
YGRG

SEQ ID NO: 2121747 - protein, 6 aa, Cryptosporidium hominis
YGSGNY

SEQ ID NO: 2121748 - protein, 6 aa, Cryptosporidium hominis
YGSGVG

SEQ ID NO: 2121749 - protein, 19 aa, Cryptosporidium hominis
YGSPGEGTSSGSRRLNPYD

SEQ ID NO: 2121750 - protein, 14 aa, Cryptosporidium hominis
YGSTETSSSKEDNL

SEQ ID NO: 2121751 - protein, 8 aa, Cryptosporidium hominis
YGVNDGGK

SEQ ID NO: 2121752 - protein, 8 aa, Cryptosporidium hominis
YGVSGKLK

SEQ ID NO: 2121753 - protein, 16 aa, Cryptosporidium hominis
YHKAHQKSGSFASSNI

SEQ ID NO: 2121754 - protein, 10 aa, Cryptosporidium hominis
YHPKSPRPKF

SEQ ID NO: 2121755 - protein, 9 aa, Cryptosporidium hominis
YIDDKDNTA

SEQ ID NO: 2121756 - protein, 5 aa, Cryptosporidium hominis
YIGEE

SEQ ID NO: 2121757 - protein, 4 aa, Cryptosporidium hominis
YISG

SEQ ID NO: 2121758 - protein, 4 aa, Cryptosporidium hominis
YKFP

SEQ ID NO: 2121759 - protein, 11 aa, Cryptosporidium hominis
YKGDSSSKKPL

SEQ ID NO: 2121760 - protein, 11 aa, Cryptosporidium hominis
YKGYNSNTIEH

SEQ ID NO: 2121761 - protein, 7 aa, Cryptosporidium hominis
YKKGSMT

SEQ ID NO: 2121762 - protein, 9 aa, Cryptosporidium hominis
YKKSKKISN

SEQ ID NO: 2121763 - protein, 26 aa, Cryptosporidium hominis
YKKTRRKATHGQDIGPSGKNNSRTLR

SEQ ID NO: 2121764 - protein, 19 aa, Cryptosporidium hominis
YKKTSQKKNSQNTINNHTE

SEQ ID NO: 2121765 - protein, 8 aa, Cryptosporidium hominis
YKNDTNRI

SEQ ID NO: 2121766 - protein, 14 aa, Cryptosporidium hominis
YKNGEDGAKNTGII

SEQ ID NO: 2121767 - protein, 17 aa, Cryptosporidium hominis
YKNSNNSRNLEDETTDL

SEQ ID NO: 2121768 - protein, 7 aa, Cryptosporidium hominis
YKPDRTH

SEQ ID NO: 2121769 - protein, 4 aa, Cryptosporidium hominis
YKPE

SEQ ID NO: 2121770 - protein, 5 aa, Cryptosporidium hominis
YKPGS

SEQ ID NO: 2121771 - protein, 4 aa, Cryptosporidium hominis
YKPL

SEQ ID NO: 2121772 - protein, 15 aa, Cryptosporidium hominis
YKPSVSKRYPCKKCC

SEQ ID NO: 2121773 - protein, 5 aa, Cryptosporidium hominis
YKSER

SEQ ID NO: 2121774 - protein, 5 aa, Cryptosporidium hominis
YKSGS

SEQ ID NO: 2121775 - protein, 5 aa, Cryptosporidium hominis
YKSPK

SEQ ID NO: 2121776 - protein, 6 aa, Cryptosporidium hominis
YKTIGT

SEQ ID NO: 2121777 - protein, 15 aa, Cryptosporidium hominis
YKVDNKSGNIILKQQ

SEQ ID NO: 2121778 - protein, 9 aa, Cryptosporidium hominis
YLETDNSNY

SEQ ID NO: 2121779 - protein, 17 aa, Cryptosporidium hominis
YLSDSGHYTVGKDASNA

SEQ ID NO: 2121780 - protein, 7 aa, Cryptosporidium hominis
YLTEPST

SEQ ID NO: 2121781 - protein, 5 aa, Cryptosporidium hominis
YNEDN

SEQ ID NO: 2121782 - protein, 18 aa, Cryptosporidium hominis
YNEEDITSEFQNNQNSLY

SEQ ID NO: 2121783 - protein, 7 aa, Cryptosporidium hominis
YNEEGCT

SEQ ID NO: 2121784 - protein, 19 aa, Cryptosporidium hominis
YNEFSSTNKASDLNGRESK

SEQ ID NO: 2121785 - protein, 6 aa, Cryptosporidium hominis
YNEKGK

SEQ ID NO: 2121786 - protein, 11 aa, Cryptosporidium hominis
YNGEESGGTLN

SEQ ID NO: 2121787 - protein, 7 aa, Cryptosporidium hominis
YNGNKQN

SEQ ID NO: 2121788 - protein, 15 aa, Cryptosporidium hominis
YNGRKEDLQPACTKE

SEQ ID NO: 2121789 - protein, 10 aa, Cryptosporidium hominis
YNIGQSNVPP

SEQ ID NO: 2121790 - protein, 5 aa, Cryptosporidium hominis
YNKPS

SEQ ID NO: 2121791 - protein, 23 aa, Cryptosporidium hominis
YNKYQEESKFSSFNSQAKSNESK

SEQ ID NO: 2121792 - protein, 10 aa, Cryptosporidium hominis
YNNENKEVTF

SEQ ID NO: 2121793 - protein, 7 aa, Cryptosporidium hominis
YNNGFGG

SEQ ID NO: 2121794 - protein, 10 aa, Cryptosporidium hominis
YNNSSINNTS

SEQ ID NO: 2121795 - protein, 5 aa, Cryptosporidium hominis
YNPDE

SEQ ID NO: 2121796 - protein, 8 aa, Cryptosporidium hominis
YNPETQKC

SEQ ID NO: 2121797 - protein, 7 aa, Cryptosporidium hominis
YNPNSND

SEQ ID NO: 2121798 - protein, 5 aa, Cryptosporidium hominis
YNPSL

SEQ ID NO: 2121799 - protein, 12 aa, Cryptosporidium hominis
YNQNLTKENEME

SEQ ID NO: 2121800 - protein, 6 aa, Cryptosporidium hominis
YNQQND

SEQ ID NO: 2121801 - protein, 13 aa, Cryptosporidium hominis
YNQSQNSKSSNSL

SEQ ID NO: 2121802 - protein, 21 aa, Cryptosporidium hominis
YNQSTKNSGPLEIEDSGNNIV

SEQ ID NO: 2121803 - protein, 17 aa, Cryptosporidium hominis
YNSNKSNNNNNKSVNKD

SEQ ID NO: 2121804 - protein, 12 aa, Cryptosporidium hominis
YNSQLKQNQTKV

SEQ ID NO: 2121805 - protein, 7 aa, Cryptosporidium hominis
YNSQPPP

SEQ ID NO: 2121806 - protein, 33 aa, Cryptosporidium hominis
YNSYSESAYTDIKSSEAKDSDSDYSDIKDSSEI

SEQ ID NO: 2121807 - protein, 4 aa, Cryptosporidium hominis
YNTP

SEQ ID NO: 2121808 - protein, 9 aa, Cryptosporidium hominis
YPASDGKQY

SEQ ID NO: 2121809 - protein, 6 aa, Cryptosporidium hominis
YPDGKK

SEQ ID NO: 2121810 - protein, 5 aa, Cryptosporidium hominis
YPDRK

SEQ ID NO: 2121811 - protein, 5 aa, Cryptosporidium hominis
YPGNN

SEQ ID NO: 2121812 - protein, 4 aa, Cryptosporidium hominis
YPGT

SEQ ID NO: 2121813 - protein, 4 aa, Cryptosporidium hominis
YPKN

SEQ ID NO: 2121814 - protein, 9 aa, Cryptosporidium hominis
YPKNTPYHE

SEQ ID NO: 2121815 - protein, 8 aa, Cryptosporidium hominis
YPKYPNPE

SEQ ID NO: 2121816 - protein, 8 aa, Cryptosporidium hominis
YPNAISPP

SEQ ID NO: 2121817 - protein, 5 aa, Cryptosporidium hominis
YPNIP

SEQ ID NO: 2121818 - protein, 6 aa, Cryptosporidium hominis
YPPPGY

SEQ ID NO: 2121819 - protein, 6 aa, Cryptosporidium hominis
YPSPIE

SEQ ID NO: 2121820 - protein, 10 aa, Cryptosporidium hominis
YPTGRKIGGS

SEQ ID NO: 2121821 - protein, 4 aa, Cryptosporidium hominis
YPTL

SEQ ID NO: 2121822 - protein, 10 aa, Cryptosporidium hominis
YPTPSASQLT

SEQ ID NO: 2121823 - protein, 4 aa, Cryptosporidium hominis
YPTS

SEQ ID NO: 2121824 - protein, 5 aa, Cryptosporidium hominis
YPYPS

SEQ ID NO: 2121825 - protein, 10 aa, Cryptosporidium hominis
YQDKENSQDQ

SEQ ID NO: 2121826 - protein, 8 aa, Cryptosporidium hominis
YQDSSEQF

SEQ ID NO: 2121827 - protein, 33 aa, Cryptosporidium hominis
YQENNRKESKEDNKISQSQYKKTEIRQRRANKI

SEQ ID NO: 2121828 - protein, 20 aa, Cryptosporidium hominis
YQESKENSPSKDRESYHSVG

SEQ ID NO: 2121829 - protein, 4 aa, Cryptosporidium hominis
YQFG

SEQ ID NO: 2121830 - protein, 9 aa, Cryptosporidium hominis
YQGPSKSSV

SEQ ID NO: 2121831 - protein, 8 aa, Cryptosporidium hominis
YQNQGKKM

SEQ ID NO: 2121832 - protein, 19 aa, Cryptosporidium hominis
YQSKSKLKEIQNRSKPNCD

SEQ ID NO: 2121833 - protein, 7 aa, Cryptosporidium hominis
YQSSSGS

SEQ ID NO: 2121834 - protein, 7 aa, Cryptosporidium hominis
YQSYGKN

SEQ ID NO: 2121835 - protein, 6 aa, Cryptosporidium hominis
YQTTHA

SEQ ID NO: 2121836 - protein, 6 aa, Cryptosporidium hominis
YREESM

SEQ ID NO: 2121837 - protein, 9 aa, Cryptosporidium hominis
YRKKDPYKS

SEQ ID NO: 2121838 - protein, 5 aa, Cryptosporidium hominis
YRKSE

SEQ ID NO: 2121839 - protein, 10 aa, Cryptosporidium hominis
YRNDSQLSYE

SEQ ID NO: 2121840 - protein, 10 aa, Cryptosporidium hominis
YRNRKEGGLG

SEQ ID NO: 2121841 - protein, 13 aa, Cryptosporidium hominis
YRNSEATQEEQNK

SEQ ID NO: 2121842 - protein, 5 aa, Cryptosporidium hominis
YRQNG

SEQ ID NO: 2121843 - protein, 13 aa, Cryptosporidium hominis
YRRKSRQRKLHLV

SEQ ID NO: 2121844 - protein, 10 aa, Cryptosporidium hominis
YRSTNRGKNW

SEQ ID NO: 2121845 - protein, 4 aa, Cryptosporidium hominis
YRYR

SEQ ID NO: 2121846 - protein, 5 aa, Cryptosporidium hominis
YSADP

SEQ ID NO: 2121847 - protein, 8 aa, Cryptosporidium hominis
YSDPDGER

SEQ ID NO: 2121848 - protein, 14 aa, Cryptosporidium hominis
YSDRKTASESTIPS

SEQ ID NO: 2121849 - protein, 12 aa, Cryptosporidium hominis
YSDSNFGKEEIQ

SEQ ID NO: 2121850 - protein, 10 aa, Cryptosporidium hominis
YSDTNKQTGE

SEQ ID NO: 2121851 - protein, 7 aa, Cryptosporidium hominis
YSEAQKP

SEQ ID NO: 2121852 - protein, 13 aa, Cryptosporidium hominis
YSEDSKSFKNDQS

SEQ ID NO: 2121853 - protein, 6 aa, Cryptosporidium hominis
YSEEKT

SEQ ID NO: 2121854 - protein, 7 aa, Cryptosporidium hominis
YSEERKY

SEQ ID NO: 2121855 - protein, 7 aa, Cryptosporidium hominis
YSEGNSY

SEQ ID NO: 2121856 - protein, 9 aa, Cryptosporidium hominis
YSESENRDL

SEQ ID NO: 2121857 - protein, 9 aa, Cryptosporidium hominis
YSESSEETL

SEQ ID NO: 2121858 - protein, 9 aa, Cryptosporidium hominis
YSETSNPWY

SEQ ID NO: 2121859 - protein, 21 aa, Cryptosporidium hominis
YSGFTNTKTTHPPSKPDPPQF

SEQ ID NO: 2121860 - protein, 22 aa, Cryptosporidium hominis
YSGTPAQKTDFTRYGKRTKKGV

SEQ ID NO: 2121861 - protein, 10 aa, Cryptosporidium hominis
YSHNNNNEYD

SEQ ID NO: 2121862 - protein, 6 aa, Cryptosporidium hominis
YSIDSS

SEQ ID NO: 2121863 - protein, 12 aa, Cryptosporidium hominis
YSISSSSLASPS

SEQ ID NO: 2121864 - protein, 9 aa, Cryptosporidium hominis
YSKDDAPKF

SEQ ID NO: 2121865 - protein, 6 aa, Cryptosporidium hominis
YSKGEG

SEQ ID NO: 2121866 - protein, 7 aa, Cryptosporidium hominis
YSKHSKN

SEQ ID NO: 2121867 - protein, 5 aa, Cryptosporidium hominis
YSKIS

SEQ ID NO: 2121868 - protein, 9 aa, Cryptosporidium hominis
YSKKCAPTK

SEQ ID NO: 2121869 - protein, 9 aa, Cryptosporidium hominis
YSKKDREEK

SEQ ID NO: 2121870 - protein, 7 aa, Cryptosporidium hominis
YSKNSGS

SEQ ID NO: 2121871 - protein, 9 aa, Cryptosporidium hominis
YSKSNNSRY

SEQ ID NO: 2121872 - protein, 4 aa, Cryptosporidium hominis
YSND

SEQ ID NO: 2121873 - protein, 5 aa, Cryptosporidium hominis
YSNDE

SEQ ID NO: 2121874 - protein, 7 aa, Cryptosporidium hominis
YSNEKEI

SEQ ID NO: 2121875 - protein, 9 aa, Cryptosporidium hominis
YSNKRKKSL

SEQ ID NO: 2121876 - protein, 10 aa, Cryptosporidium hominis
YSNKRRQEKN

SEQ ID NO: 2121877 - protein, 4 aa, Cryptosporidium hominis
YSNN

SEQ ID NO: 2121878 - protein, 9 aa, Cryptosporidium hominis
YSNNSSKSI

SEQ ID NO: 2121879 - protein, 8 aa, Cryptosporidium hominis
YSNPSHDK

SEQ ID NO: 2121880 - protein, 6 aa, Cryptosporidium hominis
YSNPVK

SEQ ID NO: 2121881 - protein, 11 aa, Cryptosporidium hominis
YSNRSTETENY

SEQ ID NO: 2121882 - protein, 6 aa, Cryptosporidium hominis
YSNSAV

SEQ ID NO: 2121883 - protein, 9 aa, Cryptosporidium hominis
YSNSTENSS

SEQ ID NO: 2121884 - protein, 4 aa, Cryptosporidium hominis
YSNT

SEQ ID NO: 2121885 - protein, 5 aa, Cryptosporidium hominis
YSPAR

SEQ ID NO: 2121886 - protein, 8 aa, Cryptosporidium hominis
YSPNKATC

SEQ ID NO: 2121887 - protein, 7 aa, Cryptosporidium hominis
YSPPDSF

SEQ ID NO: 2121888 - protein, 8 aa, Cryptosporidium hominis
YSQNDIDQ

SEQ ID NO: 2121889 - protein, 5 aa, Cryptosporidium hominis
YSQSL

SEQ ID NO: 2121890 - protein, 9 aa, Cryptosporidium hominis
YSRETNSSL

SEQ ID NO: 2121891 - protein, 19 aa, Cryptosporidium hominis
YSRPETEYSEAMSSNQGNN

SEQ ID NO: 2121892 - protein, 4 aa, Cryptosporidium hominis
YSRS

SEQ ID NO: 2121893 - protein, 14 aa, Cryptosporidium hominis
YSRSPLDYPSSGIN

SEQ ID NO: 2121894 - protein, 10 aa, Cryptosporidium hominis
YSSDKEENIS

SEQ ID NO: 2121895 - protein, 9 aa, Cryptosporidium hominis
YSSITARKS

SEQ ID NO: 2121896 - protein, 8 aa, Cryptosporidium hominis
YSSKNFSK

SEQ ID NO: 2121897 - protein, 4 aa, Cryptosporidium hominis
YSSN

SEQ ID NO: 2121898 - protein, 31 aa, Cryptosporidium hominis
YSSNSNNLSGFTGSSIGDSKTSFSSGTKYSK

SEQ ID NO: 2121899 - protein, 18 aa, Cryptosporidium hominis
YSSRESEEEEDDDDDDFN

SEQ ID NO: 2121900 - protein, 5 aa, Cryptosporidium hominis
YSSSE

SEQ ID NO: 2121901 - protein, 10 aa, Cryptosporidium hominis
YSSSEPDRQA

SEQ ID NO: 2121902 - protein, 10 aa, Cryptosporidium hominis
YSSSGFFSSP

SEQ ID NO: 2121903 - protein, 5 aa, Cryptosporidium hominis
YSSSI

SEQ ID NO: 2121904 - protein, 10 aa, Cryptosporidium hominis
YSSSITAPSK

SEQ ID NO: 2121905 - protein, 5 aa, Cryptosporidium hominis
YSSSN

SEQ ID NO: 2121906 - protein, 6 aa, Cryptosporidium hominis
YSSSNT

SEQ ID NO: 2121907 - protein, 8 aa, Cryptosporidium hominis
YSSSTTNK

SEQ ID NO: 2121908 - protein, 8 aa, Cryptosporidium hominis
YSSTKKEM

SEQ ID NO: 2121909 - protein, 8 aa, Cryptosporidium hominis
YSSTPSCG

SEQ ID NO: 2121910 - protein, 5 aa, Cryptosporidium hominis
YSTDR

SEQ ID NO: 2121911 - protein, 9 aa, Cryptosporidium hominis
YSTEEQNNP

SEQ ID NO: 2121912 - protein, 14 aa, Cryptosporidium hominis
YSTNHLKSSKNTIS

SEQ ID NO: 2121913 - protein, 13 aa, Cryptosporidium hominis
YSTNKMPKSEFGE

SEQ ID NO: 2121914 - protein, 21 aa, Cryptosporidium hominis
YSVNGNESGVSRALKQEKDDH

SEQ ID NO: 2121915 - protein, 7 aa, Cryptosporidium hominis
YSYKSGG

SEQ ID NO: 2121916 - protein, 4 aa, Cryptosporidium hominis
YSYN

SEQ ID NO: 2121917 - protein, 8 aa, Cryptosporidium hominis
YTDKNDEL

SEQ ID NO: 2121918 - protein, 5 aa, Cryptosporidium hominis
YTDNP

SEQ ID NO: 2121919 - protein, 7 aa, Cryptosporidium hominis
YTEDEKR

SEQ ID NO: 2121920 - protein, 6 aa, Cryptosporidium hominis
YTETSE

SEQ ID NO: 2121921 - protein, 5 aa, Cryptosporidium hominis
YTGAG

SEQ ID NO: 2121922 - protein, 13 aa, Cryptosporidium hominis
YTGPEVPNQPKVA

SEQ ID NO: 2121923 - protein, 6 aa, Cryptosporidium hominis
YTGSGD

SEQ ID NO: 2121924 - protein, 46 aa, Cryptosporidium hominis
YTKAEKGEGTFTNESNNEHSTGNKELSKKAVGSRKKLGKTVVEEDQ

SEQ ID NO: 2121925 - protein, 7 aa, Cryptosporidium hominis
YTKKHNQ

SEQ ID NO: 2121926 - protein, 10 aa, Cryptosporidium hominis
YTKSQKSNKI

SEQ ID NO: 2121927 - protein, 4 aa, Cryptosporidium hominis
YTLD

SEQ ID NO: 2121928 - protein, 11 aa, Cryptosporidium hominis
YTNHRNGKKGF

SEQ ID NO: 2121929 - protein, 7 aa, Cryptosporidium hominis
YTNPLTA

SEQ ID NO: 2121930 - protein, 6 aa, Cryptosporidium hominis
YTNPNN

SEQ ID NO: 2121931 - protein, 13 aa, Cryptosporidium hominis
YTPNEYKYREWNR

SEQ ID NO: 2121932 - protein, 9 aa, Cryptosporidium hominis
YTSRATSGV

SEQ ID NO: 2121933 - protein, 11 aa, Cryptosporidium hominis
YTSSKVNNGIG

SEQ ID NO: 2121934 - protein, 5 aa, Cryptosporidium hominis
YTTCG

SEQ ID NO: 2121935 - protein, 4 aa, Cryptosporidium hominis
YTTS

SEQ ID NO: 2121936 - protein, 4 aa, Cryptosporidium hominis
YTTY

SEQ ID NO: 2121937 - protein, 21 aa, Cryptosporidium hominis
YTWNKETRKRNKYNNDTANEH

SEQ ID NO: 2121938 - protein, 14 aa, Cryptosporidium hominis
YVNSESDDPQETQE

SEQ ID NO: 2121939 - protein, 12 aa, Cryptosporidium hominis
YYEKGLSQDYSE

SEQ ID NO: 2121940 - protein, 5 aa, Cryptosporidium hominis
YYGKD

SEQ ID NO: 2121941 - protein, 20 aa, Cryptosporidium hominis
YYPNNTNNNGNDSKSAPYEI

SEQ ID NO: 2121942 - protein, 7 aa, Cryptosporidium hominis
YYPPNPW

SEQ ID NO: 2121943 - protein, 7 aa, Cryptosporidium hominis
YYTGTAE

SEQ ID NO: 2121944 - protein, 24 aa, Cryptosporidium hominis
AAGVGIYFGWKLFKKGKVCSMIKE

SEQ ID NO: 2121945 - protein, 20 aa, Cryptosporidium hominis
AAKLPPPFGNPAVKNEQKFP

SEQ ID NO: 2121946 - protein, 17 aa, Cryptosporidium hominis
AALKWQGHVTVYNYSNG

SEQ ID NO: 2121947 - protein, 17 aa, Cryptosporidium hominis
AALTSTIQSFQFFVLYI

SEQ ID NO: 2121948 - protein, 18 aa, Cryptosporidium hominis
AASIPTIFSTVKVSLNQY

SEQ ID NO: 2121949 - protein, 19 aa, Cryptosporidium hominis
AASSLNHYFIVAKLKNKGQ

SEQ ID NO: 2121950 - protein, 25 aa, Cryptosporidium hominis
AASVPRESCSLGFSCQPTSCRGGSV

SEQ ID NO: 2121951 - protein, 19 aa, Cryptosporidium hominis
AATLYEIFYFRVFVLLTRF

SEQ ID NO: 2121952 - protein, 20 aa, Cryptosporidium hominis
AAVLKYADNILKCFGNSFSI

SEQ ID NO: 2121953 - protein, 24 aa, Cryptosporidium hominis
AAYMVMAFLAIYWQSALFSLGLKS

SEQ ID NO: 2121954 - protein, 21 aa, Cryptosporidium hominis
ACFILIRYFWLAKLIKINKRK

SEQ ID NO: 2121955 - protein, 25 aa, Cryptosporidium hominis
ACKDLSLKAFHHFHNVSNLSFIQSH

SEQ ID NO: 2121956 - protein, 22 aa, Cryptosporidium hominis
ACNGFEREQFGILMDPNIMRNE

SEQ ID NO: 2121957 - protein, 25 aa, Cryptosporidium hominis
ACTCPPFYGGETCDQFEFPWWFYSV

SEQ ID NO: 2121958 - protein, 22 aa, Cryptosporidium hominis
ADFRNRIKLGVSEHEKENSDES

SEQ ID NO: 2121959 - protein, 19 aa, Cryptosporidium hominis
ADGIIRVYLFLSNLIDIFF

SEQ ID NO: 2121960 - protein, 24 aa, Cryptosporidium hominis
ADGILKCFCNALSIVLITLISWLF

SEQ ID NO: 2121961 - protein, 26 aa, Cryptosporidium hominis
ADIRLVGSVWLHFSVQLLDGYDAPIY

SEQ ID NO: 2121962 - protein, 35 aa, Cryptosporidium hominis
ADNILKCFGNSFSIIMSCILSWYLGDYSITLNFFA

SEQ ID NO: 2121963 - protein, 21 aa, Cryptosporidium hominis
ADNRIMLAIAVNILIMVAIFG

SEQ ID NO: 2121964 - protein, 24 aa, Cryptosporidium hominis
ADRLKLSLKMVEDFSKLDKNQDDY

SEQ ID NO: 2121965 - protein, 20 aa, Cryptosporidium hominis
ADSAIPWWAVILGIVPERFS

SEQ ID NO: 2121966 - protein, 23 aa, Cryptosporidium hominis
ADSCDMFWYPGIIRQLSSESLPD

SEQ ID NO: 2121967 - protein, 26 aa, Cryptosporidium hominis
ADSRYKLVPIKWSWSVQEISEIFILQ

SEQ ID NO: 2121968 - protein, 20 aa, Cryptosporidium hominis
AEAKLGAWLPPGKNEFLMLI

SEQ ID NO: 2121969 - protein, 33 aa, Cryptosporidium hominis
AECTLKIVKMLWGFLDPELFRFHEPTTNLLIDL

SEQ ID NO: 2121970 - protein, 25 aa, Cryptosporidium hominis
AEECIRYIYRYGLYIYNGLILDFKI

SEQ ID NO: 2121971 - protein, 21 aa, Cryptosporidium hominis
AEERLNFIGLMVFANKLRPST

SEQ ID NO: 2121972 - protein, 22 aa, Cryptosporidium hominis
AEESSWFSGWFGASETTPAPPP

SEQ ID NO: 2121973 - protein, 17 aa, Cryptosporidium hominis
AEFRKQLILGEEGIPRL

SEQ ID NO: 2121974 - protein, 23 aa, Cryptosporidium hominis
AEGELNCPVGYEINELDMSCHKT

SEQ ID NO: 2121975 - protein, 22 aa, Cryptosporidium hominis
AEGLVFWLFRVHNLVTLRVATE

SEQ ID NO: 2121976 - protein, 21 aa, Cryptosporidium hominis
AEILSAFLVVVLFSFFFFHLW

SEQ ID NO: 2121977 - protein, 26 aa, Cryptosporidium hominis
AEIRSRLLAKTALCPGFSTLLTNLFN

SEQ ID NO: 2121978 - protein, 23 aa, Cryptosporidium hominis
AEKKKCSFYSIWQEFTNQVNNMC

SEQ ID NO: 2121979 - protein, 23 aa, Cryptosporidium hominis
AEQLRSTLILSLGHSIGEVPILL

SEQ ID NO: 2121980 - protein, 33 aa, Cryptosporidium hominis
AETLLLFEEAFLWIADISFLYKILGEISLLSRG

SEQ ID NO: 2121981 - protein, 18 aa, Cryptosporidium hominis
AEVACRKSTIAWMDNPKL

SEQ ID NO: 2121982 - protein, 23 aa, Cryptosporidium hominis
AEYRSMLIRDLINIARNDSDFLN

SEQ ID NO: 2121983 - protein, 21 aa, Cryptosporidium hominis
AEYYGQVLFSLWIKTKLHAIA

SEQ ID NO: 2121984 - protein, 17 aa, Cryptosporidium hominis
AFFAHTLLLIGLLFNSP

SEQ ID NO: 2121985 - protein, 20 aa, Cryptosporidium hominis
AFFIHLKRFHRDISNVFPEL

SEQ ID NO: 2121986 - protein, 19 aa, Cryptosporidium hominis
AFHIMGWIFCFFLDKTWFY

SEQ ID NO: 2121987 - protein, 21 aa, Cryptosporidium hominis
AFHVYSCLFGLFLSFPSIFRK

SEQ ID NO: 2121988 - protein, 28 aa, Cryptosporidium hominis
AFIIAWNASDAFVFSGIACWSHVNNQII

SEQ ID NO: 2121989 - protein, 18 aa, Cryptosporidium hominis
AFILDIFLIISGIITSIV

SEQ ID NO: 2121990 - protein, 19 aa, Cryptosporidium hominis
AFLSFIFGPFFFRFFSNNS

SEQ ID NO: 2121991 - protein, 17 aa, Cryptosporidium hominis
AFMAFQILQLLIKLAKT

SEQ ID NO: 2121992 - protein, 20 aa, Cryptosporidium hominis
AFNIEWWELYSFIYEAIISL

SEQ ID NO: 2121993 - protein, 22 aa, Cryptosporidium hominis
AFPDSVWSYAYSCVYILDENDE

SEQ ID NO: 2121994 - protein, 22 aa, Cryptosporidium hominis
AFTMAEWKFYKLASVLRFISFL

SEQ ID NO: 2121995 - protein, 19 aa, Cryptosporidium hominis
AGFVSKWATTFIGKYLENV

SEQ ID NO: 2121996 - protein, 19 aa, Cryptosporidium hominis
AGGLSAWLYLDSREKPESY

SEQ ID NO: 2121997 - protein, 26 aa, Cryptosporidium hominis
AGGNTLWSKLFFTWLSPWMSKFLGPG

SEQ ID NO: 2121998 - protein, 17 aa, Cryptosporidium hominis
AGIFDCLRRVSKEQGIL

SEQ ID NO: 2121999 - protein, 17 aa, Cryptosporidium hominis
AGIIIAIVVVAIIIIAG

SEQ ID NO: 2122000 - protein, 27 aa, Cryptosporidium hominis
AGKYEPRSKFGYRFFLVCNRVQNIGFG

SEQ ID NO: 2122001 - protein, 20 aa, Cryptosporidium hominis
AGLLFKYIVLFDLLIMFLIL

SEQ ID NO: 2122002 - protein, 27 aa, Cryptosporidium hominis
AGQKQLLCLARALLRQSKLVLLDEATS

SEQ ID NO: 2122003 - protein, 18 aa, Cryptosporidium hominis
AGRMPGHMNVLLAEADVP

SEQ ID NO: 2122004 - protein, 17 aa, Cryptosporidium hominis
AGVFLSYSFSYVLSSFS

SEQ ID NO: 2122005 - protein, 31 aa, Cryptosporidium hominis
AGYLEGMSIIYLYIYWHIQFRAKNERKTPES

SEQ ID NO: 2122006 - protein, 33 aa, Cryptosporidium hominis
AHACRLKIWLYCLRHFSASLLLKSRNKIKTTNK

SEQ ID NO: 2122007 - protein, 22 aa, Cryptosporidium hominis
AHARLYLARVTMRLESGLTGII

SEQ ID NO: 2122008 - protein, 21 aa, Cryptosporidium hominis
AHGSKRVAYCRLKITDIPHYI

SEQ ID NO: 2122009 - protein, 20 aa, Cryptosporidium hominis
AHHCTTCNICIFKMDHHCML

SEQ ID NO: 2122010 - protein, 21 aa, Cryptosporidium hominis
AHSYIQFTWVTKWIYLGSRRP

SEQ ID NO: 2122011 - protein, 25 aa, Cryptosporidium hominis
AIAACREPLRVAFTAQLRQVLHPTP

SEQ ID NO: 2122012 - protein, 30 aa, Cryptosporidium hominis
AIAIAFQCSVSFTQLVLWMIRNISETENNF

SEQ ID NO: 2122013 - protein, 27 aa, Cryptosporidium hominis
AIALIPRYAKRFGFKSRRDEVPIEQEC

SEQ ID NO: 2122014 - protein, 18 aa, Cryptosporidium hominis
AIASILVFWDCYSTYQPF

SEQ ID NO: 2122015 - protein, 18 aa, Cryptosporidium hominis
AIEKELFGFDAIKETAED

SEQ ID NO: 2122016 - protein, 25 aa, Cryptosporidium hominis
AIFEAICVLSVLIISMYTSLGVFQR

SEQ ID NO: 2122017 - protein, 23 aa, Cryptosporidium hominis
AIFGRKLPLCNFPLLDNNAYNID

SEQ ID NO: 2122018 - protein, 23 aa, Cryptosporidium hominis
AIFLLTFWFCYRTRRVRQSIFML

SEQ ID NO: 2122019 - protein, 21 aa, Cryptosporidium hominis
AIFQVCNYSGFKIFSNSETIQ

SEQ ID NO: 2122020 - protein, 20 aa, Cryptosporidium hominis
AIGIAFRTGIYSSYGQLLYK

SEQ ID NO: 2122021 - protein, 20 aa, Cryptosporidium hominis
AIGKSARKSIILRHAESRGI

SEQ ID NO: 2122022 - protein, 17 aa, Cryptosporidium hominis
AIHRVPISVGVSLQAKD

SEQ ID NO: 2122023 - protein, 19 aa, Cryptosporidium hominis
AIIIDVYRQHVWNDAQAVN

SEQ ID NO: 2122024 - protein, 18 aa, Cryptosporidium hominis
AIIKKGLTSFPLRPNATR

SEQ ID NO: 2122025 - protein, 18 aa, Cryptosporidium hominis
AINGYPFFYTKNIVPSEH

SEQ ID NO: 2122026 - protein, 24 aa, Cryptosporidium hominis
AIRIIFCLVYFFIYGRFVYSFSFD

SEQ ID NO: 2122027 - protein, 34 aa, Cryptosporidium hominis
AISAWKLWKTKIFILSRRFPFFSIKDDSDAHLDS

SEQ ID NO: 2122028 - protein, 22 aa, Cryptosporidium hominis
AISIVIGIIWLISLRYESRIAD

SEQ ID NO: 2122029 - protein, 26 aa, Cryptosporidium hominis
AISKIFPELVCRKGHDIIVELLSLLH

SEQ ID NO: 2122030 - protein, 17 aa, Cryptosporidium hominis
AISLRRGTNFGVDESSQ

SEQ ID NO: 2122031 - protein, 19 aa, Cryptosporidium hominis
AISTACSNLFYSRPKCKFE

SEQ ID NO: 2122032 - protein, 17 aa, Cryptosporidium hominis
AISYSIRIFIFPIKIAS

SEQ ID NO: 2122033 - protein, 20 aa, Cryptosporidium hominis
AIYFSFVYEVNWEYDSLKNL

SEQ ID NO: 2122034 - protein, 20 aa, Cryptosporidium hominis
AIYSLFGLRITNFVNSCLQL

SEQ ID NO: 2122035 - protein, 23 aa, Cryptosporidium hominis
AIYYLKIAVALAVAAIPEGLPAV

SEQ ID NO: 2122036 - protein, 17 aa, Cryptosporidium hominis
AKDEETRTSTSTDKISK

SEQ ID NO: 2122037 - protein, 23 aa, Cryptosporidium hominis
AKEFGDRIGYFHGVFSDSNSKSC

SEQ ID NO: 2122038 - protein, 19 aa, Cryptosporidium hominis
AKERFSLPQKYVFGYLKGK

SEQ ID NO: 2122039 - protein, 17 aa, Cryptosporidium hominis
AKERGFLLLALIRLSLF

SEQ ID NO: 2122040 - protein, 27 aa, Cryptosporidium hominis
AKFSVLTHFLIRIFGYLDRNSCHVFSN

SEQ ID NO: 2122041 - protein, 20 aa, Cryptosporidium hominis
AKHINSFLSYGLICTLTDLI

SEQ ID NO: 2122042 - protein, 25 aa, Cryptosporidium hominis
AKIIYKLCYNISYLSPYSMIDTLNN

SEQ ID NO: 2122043 - protein, 25 aa, Cryptosporidium hominis
AKKQELRDGLQIGYKYSVIGSLLRS

SEQ ID NO: 2122044 - protein, 23 aa, Cryptosporidium hominis
AKMIKHALCTLNISAKILEEEYI

SEQ ID NO: 2122045 - protein, 18 aa, Cryptosporidium hominis
AKMLPEPEIQHLISVLSS

SEQ ID NO: 2122046 - protein, 21 aa, Cryptosporidium hominis
AKQIFGRLCIIIVSIIWGIQI

SEQ ID NO: 2122047 - protein, 45 aa, Cryptosporidium hominis
AKQKRNSIKFSTEMKKLLKILPMSICFVGLVAFGNICLKYVQVST

SEQ ID NO: 2122048 - protein, 19 aa, Cryptosporidium hominis
AKQTLNYIRLCLQGKTKLI

SEQ ID NO: 2122049 - protein, 26 aa, Cryptosporidium hominis
AKRLKEFILLIKRLIHRNGESFLSKV

SEQ ID NO: 2122050 - protein, 22 aa, Cryptosporidium hominis
AKSLITISLWAYITLVLQFLTI

SEQ ID NO: 2122051 - protein, 25 aa, Cryptosporidium hominis
AKSSSENWLALQFIKQYNVSIYIDH

SEQ ID NO: 2122052 - protein, 18 aa, Cryptosporidium hominis
AKVGELIFYNDFKGEPDV

SEQ ID NO: 2122053 - protein, 17 aa, Cryptosporidium hominis
AKYKPDRTHHCRVCRTC

SEQ ID NO: 2122054 - protein, 18 aa, Cryptosporidium hominis
ALAIYGIIVSLVLISSPS

SEQ ID NO: 2122055 - protein, 26 aa, Cryptosporidium hominis
ALAKETIEKFLLGYLVRKNADSRYKL

SEQ ID NO: 2122056 - protein, 24 aa, Cryptosporidium hominis
ALAYHFKSALSYYFNEEVPRSIIP

SEQ ID NO: 2122057 - protein, 20 aa, Cryptosporidium hominis
ALDAFRVALGPGVILSYLLQ

SEQ ID NO: 2122058 - protein, 17 aa, Cryptosporidium hominis
ALELMSLLFELEFPINE

SEQ ID NO: 2122059 - protein, 25 aa, Cryptosporidium hominis
ALFPIFCVVASIILIFSLTGYSILG

SEQ ID NO: 2122060 - protein, 20 aa, Cryptosporidium hominis
ALFPILTVNAVINFLIFYLI

SEQ ID NO: 2122061 - protein, 32 aa, Cryptosporidium hominis
ALFSLGLKSSHFWKGGGYWLAGSGGLGIFVGM

SEQ ID NO: 2122062 - protein, 27 aa, Cryptosporidium hominis
ALGRQRLRMILTLQQGILLLCFNEEKM

SEQ ID NO: 2122063 - protein, 17 aa, Cryptosporidium hominis
ALHPERLVGTVGVQTNY

SEQ ID NO: 2122064 - protein, 18 aa, Cryptosporidium hominis
ALHSGKKGTCGILVEPVY

SEQ ID NO: 2122065 - protein, 23 aa, Cryptosporidium hominis
ALINFDFKKCLNDSFQIQIERIQ

SEQ ID NO: 2122066 - protein, 17 aa, Cryptosporidium hominis
ALIRKSFWLDSWSQFDI

SEQ ID NO: 2122067 - protein, 25 aa, Cryptosporidium hominis
ALKLKEVGTLFGFDARLLNFDLKIF

SEQ ID NO: 2122068 - protein, 21 aa, Cryptosporidium hominis
ALKLRDLRQVVSMGSSQRPSI

SEQ ID NO: 2122069 - protein, 25 aa, Cryptosporidium hominis
ALLAFIGGAGLCYLAGLEHTSTASA

SEQ ID NO: 2122070 - protein, 19 aa, Cryptosporidium hominis
ALLCCGEVVHLFLSIIGVE

SEQ ID NO: 2122071 - protein, 22 aa, Cryptosporidium hominis
ALLEGIAGFLFNSTACQNGQMH

SEQ ID NO: 2122072 - protein, 28 aa, Cryptosporidium hominis
ALLFKLPRGRYLLESGVEMVADHLLKDI

SEQ ID NO: 2122073 - protein, 17 aa, Cryptosporidium hominis
ALLSFLYSLGVSIVCRV

SEQ ID NO: 2122074 - protein, 19 aa, Cryptosporidium hominis
ALMGGSIIRAFRCGHVFLN

SEQ ID NO: 2122075 - protein, 17 aa, Cryptosporidium hominis
ALNAIFISRSYRKNLLE

SEQ ID NO: 2122076 - protein, 22 aa, Cryptosporidium hominis
ALNICGVTNYLLERETMNNLNH

SEQ ID NO: 2122077 - protein, 26 aa, Cryptosporidium hominis
ALQICTTCTLLGFLPACLNLLNNPSR

SEQ ID NO: 2122078 - protein, 19 aa, Cryptosporidium hominis
ALRAVLCVISGIFLTLGPF

SEQ ID NO: 2122079 - protein, 21 aa, Cryptosporidium hominis
ALRLFSTLLLILGTEKCPNTV

SEQ ID NO: 2122080 - protein, 27 aa, Cryptosporidium hominis
ALRPIWLKIRIVYIIFAILLFFIIGAV

SEQ ID NO: 2122081 - protein, 28 aa, Cryptosporidium hominis
ALRPSSTCMFILMSIFDHMVLFGEILNK

SEQ ID NO: 2122082 - protein, 17 aa, Cryptosporidium hominis
ALTWKNKIPEIFVDFIT

SEQ ID NO: 2122083 - protein, 23 aa, Cryptosporidium hominis
ALVSYKLAVVFLKSVSSFLSKKS

SEQ ID NO: 2122084 - protein, 17 aa, Cryptosporidium hominis
ALYAVRIAQGFLYMGKG

SEQ ID NO: 2122085 - protein, 22 aa, Cryptosporidium hominis
ALYGSGLFPFFVHSSTQVKPIF

SEQ ID NO: 2122086 - protein, 19 aa, Cryptosporidium hominis
ALYHFDWNIFVRKKALLSI

SEQ ID NO: 2122087 - protein, 25 aa, Cryptosporidium hominis
AMLLRRLAKRIDLFRSAEESLSAIM

SEQ ID NO: 2122088 - protein, 26 aa, Cryptosporidium hominis
ANFIPYCFLSHLFGIVICVFCYSYFI

SEQ ID NO: 2122089 - protein, 23 aa, Cryptosporidium hominis
ANGKLKLFLTKTINIENFDTSCN

SEQ ID NO: 2122090 - protein, 23 aa, Cryptosporidium hominis
ANKEVLNKIAFIFTGQGSQFENM

SEQ ID NO: 2122091 - protein, 27 aa, Cryptosporidium hominis
ANKNEKEWFLYWSSIFGKLCGKEPILR

SEQ ID NO: 2122092 - protein, 19 aa, Cryptosporidium hominis
ANLGEFGFVLASKGISLGI

SEQ ID NO: 2122093 - protein, 20 aa, Cryptosporidium hominis
ANNVLEFWNDWFSPDSNKIT

SEQ ID NO: 2122094 - protein, 17 aa, Cryptosporidium hominis
ANRFKYPKNWSITEKIQ

SEQ ID NO: 2122095 - protein, 20 aa, Cryptosporidium hominis
ANRLTWIVIILLAIDCFFSF

SEQ ID NO: 2122096 - protein, 45 aa, Cryptosporidium hominis
ANSNDVFIGIKWRNHRLILVFKRLIRQLILYWKSIINYFMPKSIS

SEQ ID NO: 2122097 - protein, 26 aa, Cryptosporidium hominis
ANSNLCIICLQGILSLLKNYELQALK

SEQ ID NO: 2122098 - protein, 23 aa, Cryptosporidium hominis
ANSRSLYLFMIMYGFTIVICKNI

SEQ ID NO: 2122099 - protein, 18 aa, Cryptosporidium hominis
APFDPEWYAQVVDACCLV

SEQ ID NO: 2122100 - protein, 19 aa, Cryptosporidium hominis
APFFTGMLMSYSLQDIIGA

SEQ ID NO: 2122101 - protein, 17 aa, Cryptosporidium hominis
APGLMIFILTQRIQVLR

SEQ ID NO: 2122102 - protein, 25 aa, Cryptosporidium hominis
APIEESSWFSSWFGGTTEPAKVNDL

SEQ ID NO: 2122103 - protein, 17 aa, Cryptosporidium hominis
APLSIFYNARRALSDEL

SEQ ID NO: 2122104 - protein, 18 aa, Cryptosporidium hominis
APNVPFFLSLNRYERKKN

SEQ ID NO: 2122105 - protein, 17 aa, Cryptosporidium hominis
APSCIQFSLNKSVERLV

SEQ ID NO: 2122106 - protein, 20 aa, Cryptosporidium hominis
APSFFWKNYLEDVVDDSLVG

SEQ ID NO: 2122107 - protein, 24 aa, Cryptosporidium hominis
APTFQPRSGFVVGMGSGAGTGTGT

SEQ ID NO: 2122108 - protein, 19 aa, Cryptosporidium hominis
APTWLLVLYFRGSKKKIRP

SEQ ID NO: 2122109 - protein, 20 aa, Cryptosporidium hominis
APVYVWFNWINNNSIVRILA

SEQ ID NO: 2122110 - protein, 36 aa, Cryptosporidium hominis
APYWNNRALVFISLWLECFFLCFFYRSTKSSFEQFF

SEQ ID NO: 2122111 - protein, 25 aa, Cryptosporidium hominis
AQALLHYMIVWRGDYSGCRRLSQML

SEQ ID NO: 2122112 - protein, 35 aa, Cryptosporidium hominis
AQIRYHAGTAYRWLFVRLEIMGCIAVFTAGTLGVI

SEQ ID NO: 2122113 - protein, 23 aa, Cryptosporidium hominis
AQKYIFSAEFLKLLLELYKLTSE

SEQ ID NO: 2122114 - protein, 20 aa, Cryptosporidium hominis
AQLFRLRWYGSNSGSKEKEI

SEQ ID NO: 2122115 - protein, 25 aa, Cryptosporidium hominis
AQLIISFVFILLCRFNYKVEISLLF

SEQ ID NO: 2122116 - protein, 18 aa, Cryptosporidium hominis
AQSFGLWYGSKMTVEQKI

SEQ ID NO: 2122117 - protein, 21 aa, Cryptosporidium hominis
AQSSYLFSRIVEYFESESFSP

SEQ ID NO: 2122118 - protein, 26 aa, Cryptosporidium hominis
AQVPSIFHQRCCILLLNSVRSIIDTF

SEQ ID NO: 2122119 - protein, 21 aa, Cryptosporidium hominis
ARDVLEISALVSVRKKDLFGF

SEQ ID NO: 2122120 - protein, 18 aa, Cryptosporidium hominis
ARELSWRIIAPNYPTLGR

SEQ ID NO: 2122121 - protein, 17 aa, Cryptosporidium hominis
ARGRTLIRKEARFLTHL

SEQ ID NO: 2122122 - protein, 18 aa, Cryptosporidium hominis
ARILCSFELISVDEVKQY

SEQ ID NO: 2122123 - protein, 22 aa, Cryptosporidium hominis
ARLFWSFWLHTGFIHLFINLSC

SEQ ID NO: 2122124 - protein, 25 aa, Cryptosporidium hominis
ARSKIKYKFFRNFQLSPFLPENSKK

SEQ ID NO: 2122125 - protein, 17 aa, Cryptosporidium hominis
ARSTIFSQVQFSRGQKV

SEQ ID NO: 2122126 - protein, 24 aa, Cryptosporidium hominis
ARVMFRSVLESVFFSNSFSELEDV

SEQ ID NO: 2122127 - protein, 24 aa, Cryptosporidium hominis
ASENRAIIRWGISVEPAINIVMYP

SEQ ID NO: 2122128 - protein, 24 aa, Cryptosporidium hominis
ASFIFLLFICLSFGIIVACIDYFG

SEQ ID NO: 2122129 - protein, 18 aa, Cryptosporidium hominis
ASFNLAFMAQFGIGIVQD

SEQ ID NO: 2122130 - protein, 26 aa, Cryptosporidium hominis
ASFSCKCLIRVLFIESMESTRNLGIL

SEQ ID NO: 2122131 - protein, 19 aa, Cryptosporidium hominis
ASFSIGSDVYTIWIPLYNN

SEQ ID NO: 2122132 - protein, 18 aa, Cryptosporidium hominis
ASIALDLIKRHHLLLVTL

SEQ ID NO: 2122133 - protein, 22 aa, Cryptosporidium hominis
ASKELKNIFLLLLNSEQLASLN

SEQ ID NO: 2122134 - protein, 23 aa, Cryptosporidium hominis
ASLQNCKKVWVLGKGRILFETDL

SEQ ID NO: 2122135 - protein, 19 aa, Cryptosporidium hominis
ASLSCSKMLILISLIVKFY

SEQ ID NO: 2122136 - protein, 23 aa, Cryptosporidium hominis
ASNIKRRKTNMIPPNSQPNSMMG

SEQ ID NO: 2122137 - protein, 21 aa, Cryptosporidium hominis
ASNSFFYPAIDLMKTEKKDES

SEQ ID NO: 2122138 - protein, 18 aa, Cryptosporidium hominis
ASPRCMYILHALYEELSL

SEQ ID NO: 2122139 - protein, 25 aa, Cryptosporidium hominis
ASQSIFKFYLLESIGHQMAPSVKIV

SEQ ID NO: 2122140 - protein, 19 aa, Cryptosporidium hominis
ASSIVFIFMMYSRNYQITG

SEQ ID NO: 2122141 - protein, 19 aa, Cryptosporidium hominis
ASTAARFLLGRNCSMEELE

SEQ ID NO: 2122142 - protein, 25 aa, Cryptosporidium hominis
ASYLNWTCWYAWMIQSFLLPTGLIV

SEQ ID NO: 2122143 - protein, 17 aa, Cryptosporidium hominis
ASYMRWVAKQELKPVTL

SEQ ID NO: 2122144 - protein, 17 aa, Cryptosporidium hominis
ATALLYIISCMYVNAIR

SEQ ID NO: 2122145 - protein, 18 aa, Cryptosporidium hominis
ATCQIFKYFKAISQRKLN

SEQ ID NO: 2122146 - protein, 19 aa, Cryptosporidium hominis
ATDCHCLSELLSLPCLKSR

SEQ ID NO: 2122147 - protein, 17 aa, Cryptosporidium hominis
ATFGFYFLSVVICTLST

SEQ ID NO: 2122148 - protein, 25 aa, Cryptosporidium hominis
ATGECEFDRVMSLEGVYIANVKDDE

SEQ ID NO: 2122149 - protein, 20 aa, Cryptosporidium hominis
ATHWSRFSTAASLGVIHMGH

SEQ ID NO: 2122150 - protein, 20 aa, Cryptosporidium hominis
ATIFFRKYFVVFFIIPSYLK

SEQ ID NO: 2122151 - protein, 23 aa, Cryptosporidium hominis
ATIQVPLLLSRLIDNVGAISSSN

SEQ ID NO: 2122152 - protein, 18 aa, Cryptosporidium hominis
ATLDNTWAVSRQKTEQAA

SEQ ID NO: 2122153 - protein, 17 aa, Cryptosporidium hominis
ATSILKQFCSAFDSIQL

SEQ ID NO: 2122154 - protein, 33 aa, Cryptosporidium hominis
ATVGLKICFSSKVFKDLILFFGSKVPTCSDIFE

SEQ ID NO: 2122155 - protein, 25 aa, Cryptosporidium hominis
ATVRRFACAKPAIGLTAESAAPPSA

SEQ ID NO: 2122156 - protein, 17 aa, Cryptosporidium hominis
AVFELFKAIINFPNSGF

SEQ ID NO: 2122157 - protein, 17 aa, Cryptosporidium hominis
AVGGRRVGVKVGPGSSG

SEQ ID NO: 2122158 - protein, 25 aa, Cryptosporidium hominis
AVGNPRGSIDYIWYGAILQNLCGCI

SEQ ID NO: 2122159 - protein, 20 aa, Cryptosporidium hominis
AVGVVFGFLISVWLRAAQAL

SEQ ID NO: 2122160 - protein, 21 aa, Cryptosporidium hominis
AVIYRHFYPINLFNTISHHNI

SEQ ID NO: 2122161 - protein, 17 aa, Cryptosporidium hominis
AVLKYADGILKCFCNAL

SEQ ID NO: 2122162 - protein, 22 aa, Cryptosporidium hominis
AVLRYIEIFLFSGMNGSSPLIT

SEQ ID NO: 2122163 - protein, 25 aa, Cryptosporidium hominis
AVMNEFCGNFALAVKQYIAAWDNIM

SEQ ID NO: 2122164 - protein, 22 aa, Cryptosporidium hominis
AVSLGFVLCRVMNDRVVSFEET

SEQ ID NO: 2122165 - protein, 19 aa, Cryptosporidium hominis
AVSSAAFINKLFRIGVIPS

SEQ ID NO: 2122166 - protein, 20 aa, Cryptosporidium hominis
AVTFVINWVFVFYVIYPLMW

SEQ ID NO: 2122167 - protein, 18 aa, Cryptosporidium hominis
AVYPCILALAVVLHHIFR

SEQ ID NO: 2122168 - protein, 19 aa, Cryptosporidium hominis
AYEQGHLPSAYALSQLNLN

SEQ ID NO: 2122169 - protein, 19 aa, Cryptosporidium hominis
AYGGFIVVGVLKYSDSIMK

SEQ ID NO: 2122170 - protein, 18 aa, Cryptosporidium hominis
AYGYACIENELFTCERTR

SEQ ID NO: 2122171 - protein, 25 aa, Cryptosporidium hominis
AYISLAIFCVVVFFFLSDGDFSFLL

SEQ ID NO: 2122172 - protein, 25 aa, Cryptosporidium hominis
AYKCNELGIRECISITWIEMMKSSF

SEQ ID NO: 2122173 - protein, 26 aa, Cryptosporidium hominis
AYLNDRLKVILIYKHANKNYFSFHPK

SEQ ID NO: 2122174 - protein, 34 aa, Cryptosporidium hominis
AYRKLPGDDCIGGWLPPPVAIPCPSHAPTSSHAR

SEQ ID NO: 2122175 - protein, 19 aa, Cryptosporidium hominis
AYRSKGWSYLDIVSKAPQC

SEQ ID NO: 2122176 - protein, 33 aa, Cryptosporidium hominis
AYSYYGSLHFHWRENFCRIIKEKGLSGLGEKSL

SEQ ID NO: 2122177 - protein, 23 aa, Cryptosporidium hominis
AYVILRMIYEWVAPDDYSSMIGA

SEQ ID NO: 2122178 - protein, 17 aa, Cryptosporidium hominis
CAEKLCTIFGECGEPAR

SEQ ID NO: 2122179 - protein, 19 aa, Cryptosporidium hominis
CAFFHYMCAYLFILTVISF

SEQ ID NO: 2122180 - protein, 20 aa, Cryptosporidium hominis
CAFSALRSFIFGSLNCFIGD

SEQ ID NO: 2122181 - protein, 17 aa, Cryptosporidium hominis
CAIFKLVPNVSFQLLTF

SEQ ID NO: 2122182 - protein, 29 aa, Cryptosporidium hominis
CALGGPLLGFLFGWGVHLFLKVAQATNDV

SEQ ID NO: 2122183 - protein, 17 aa, Cryptosporidium hominis
CALWMDFQILPDGDQTL

SEQ ID NO: 2122184 - protein, 22 aa, Cryptosporidium hominis
CANQCYWSKYTVFGNCQRSVYN

SEQ ID NO: 2122185 - protein, 23 aa, Cryptosporidium hominis
CAPFNIRGSDCFIQGGEGNTIIP

SEQ ID NO: 2122186 - protein, 25 aa, Cryptosporidium hominis
CAVIKEPWSILSLDISFKEKKKNSK

SEQ ID NO: 2122187 - protein, 22 aa, Cryptosporidium hominis
CCGILSIICFFFMKETKGCSVS

SEQ ID NO: 2122188 - protein, 18 aa, Cryptosporidium hominis
CDHFSKRGGLPCLSVLRL

SEQ ID NO: 2122189 - protein, 26 aa, Cryptosporidium hominis
CDIFMGFSRILSCISLCVIIPLFTVS

SEQ ID NO: 2122190 - protein, 21 aa, Cryptosporidium hominis
CDIQSLFGIYDWYSDYSRVFC

SEQ ID NO: 2122191 - protein, 19 aa, Cryptosporidium hominis
CDLSNFQAALVIATMLAGS

SEQ ID NO: 2122192 - protein, 24 aa, Cryptosporidium hominis
CDMFFGIIMSIYWNGVLVNELVEC

SEQ ID NO: 2122193 - protein, 24 aa, Cryptosporidium hominis
CDQFEFPWWFYSVIIVLVVLAIGI

SEQ ID NO: 2122194 - protein, 21 aa, Cryptosporidium hominis
CDSALFKRMDVNLVNKQNEIN

SEQ ID NO: 2122195 - protein, 19 aa, Cryptosporidium hominis
CDSESFSILSDILILIRQL

SEQ ID NO: 2122196 - protein, 22 aa, Cryptosporidium hominis
CDSSPFSTCCNSESPDGSSTIT

SEQ ID NO: 2122197 - protein, 17 aa, Cryptosporidium hominis
CEEKKKIGFCDCNSVWT

SEQ ID NO: 2122198 - protein, 27 aa, Cryptosporidium hominis
CEFINMFSLCIVCKLYTEISICQASTP

SEQ ID NO: 2122199 - protein, 23 aa, Cryptosporidium hominis
CEGFERNFRLAFHHFNESAFHLF

SEQ ID NO: 2122200 - protein, 17 aa, Cryptosporidium hominis
CELDFHPLISSNVFIER

SEQ ID NO: 2122201 - protein, 17 aa, Cryptosporidium hominis
CELEAIDLLCEVEQMET

SEQ ID NO: 2122202 - protein, 18 aa, Cryptosporidium hominis
CERTRMLLGDSRETLQQV

SEQ ID NO: 2122203 - protein, 23 aa, Cryptosporidium hominis
CFEKIPNIFFISSLELFNQIIVN

SEQ ID NO: 2122204 - protein, 20 aa, Cryptosporidium hominis
CFENEILDYMVVKCMDSFSR

SEQ ID NO: 2122205 - protein, 31 aa, Cryptosporidium hominis
CFFLIVCGWVINVFWPFVEGIGIRDLETHGA

SEQ ID NO: 2122206 - protein, 21 aa, Cryptosporidium hominis
CFFSILWMIGFYFIIPKHPFV

SEQ ID NO: 2122207 - protein, 17 aa, Cryptosporidium hominis
CFGRLSKYLKLKLCGTN

SEQ ID NO: 2122208 - protein, 26 aa, Cryptosporidium hominis
CFGWIRKKLFAFSVIVKRSFMNNARN

SEQ ID NO: 2122209 - protein, 18 aa, Cryptosporidium hominis
CFLGCIIFILTYVASRAL

SEQ ID NO: 2122210 - protein, 25 aa, Cryptosporidium hominis
CFLWLTILIELFWFNKECRKNVDLF

SEQ ID NO: 2122211 - protein, 18 aa, Cryptosporidium hominis
CFSDFKFKQRPSYFSTVP

SEQ ID NO: 2122212 - protein, 18 aa, Cryptosporidium hominis
CFVIGLLAVLVSGGSLGS

SEQ ID NO: 2122213 - protein, 18 aa, Cryptosporidium hominis
CGAIAALLAFIGGAGLCY

SEQ ID NO: 2122214 - protein, 21 aa, Cryptosporidium hominis
CGAKIKMKPALHISKSHLIFQ

SEQ ID NO: 2122215 - protein, 19 aa, Cryptosporidium hominis
CGALKYKKRHPGTKWPLAI

SEQ ID NO: 2122216 - protein, 17 aa, Cryptosporidium hominis
CGGLFLNNCIHKFQNNY

SEQ ID NO: 2122217 - protein, 21 aa, Cryptosporidium hominis
CGINRILRVLIRYIYIYIYIY

SEQ ID NO: 2122218 - protein, 22 aa, Cryptosporidium hominis
CGTESFNSPILIWDVEGTDSLE

SEQ ID NO: 2122219 - protein, 27 aa, Cryptosporidium hominis
CHLAICLSRATGLWSHLDTVERLASVI

SEQ ID NO: 2122220 - protein, 20 aa, Cryptosporidium hominis
CHYIKEISPVLVREFGSQDD

SEQ ID NO: 2122221 - protein, 25 aa, Cryptosporidium hominis
CIDECIKHKGLFRIIKNKSFIQAFT

SEQ ID NO: 2122222 - protein, 17 aa, Cryptosporidium hominis
CIDYELRCYLYACRNLN

SEQ ID NO: 2122223 - protein, 19 aa, Cryptosporidium hominis
CIFAFTYISGKSFTTSILT

SEQ ID NO: 2122224 - protein, 23 aa, Cryptosporidium hominis
CIGICYGAIILPVILTVFGPMDV

SEQ ID NO: 2122225 - protein, 26 aa, Cryptosporidium hominis
CIGSIKLNPLIALRMRLILHGFHSNR

SEQ ID NO: 2122226 - protein, 21 aa, Cryptosporidium hominis
CILALAVVLHHIFRYLFCDQR

SEQ ID NO: 2122227 - protein, 18 aa, Cryptosporidium hominis
CILLTSLIFITIYLFIHY

SEQ ID NO: 2122228 - protein, 19 aa, Cryptosporidium hominis
CILNSVTVGIFFTKFSEST

SEQ ID NO: 2122229 - protein, 17 aa, Cryptosporidium hominis
CILTCIIISYIQDNHTR

SEQ ID NO: 2122230 - protein, 17 aa, Cryptosporidium hominis
CINEAWVQILNCDDTLA

SEQ ID NO: 2122231 - protein, 19 aa, Cryptosporidium hominis
CINYRGSCININIFNIISI

SEQ ID NO: 2122232 - protein, 21 aa, Cryptosporidium hominis
CIRFYKCISYSLPNPSDINDS

SEQ ID NO: 2122233 - protein, 26 aa, Cryptosporidium hominis
CKAYFELFCVRYWYSENLKRFTCVED

SEQ ID NO: 2122234 - protein, 22 aa, Cryptosporidium hominis
CKDETPCFLLSKGRFSEAEELL

SEQ ID NO: 2122235 - protein, 18 aa, Cryptosporidium hominis
CKEQERKKELSLLLDNII

SEQ ID NO: 2122236 - protein, 24 aa, Cryptosporidium hominis
CKIEIEAFYKWIQVLYYKVLNNNI

SEQ ID NO: 2122237 - protein, 17 aa, Cryptosporidium hominis
CKIFDQFHFNTIQPYNL

SEQ ID NO: 2122238 - protein, 19 aa, Cryptosporidium hominis
CKIQAIPFVEHIRNLNNSA

SEQ ID NO: 2122239 - protein, 19 aa, Cryptosporidium hominis
CKKSLFCGIWLLFHSWSIS

SEQ ID NO: 2122240 - protein, 17 aa, Cryptosporidium hominis
CKLFFIYVDELVKILMN

SEQ ID NO: 2122241 - protein, 19 aa, Cryptosporidium hominis
CKLPFEPIKIFRLVTQAGL

SEQ ID NO: 2122242 - protein, 23 aa, Cryptosporidium hominis
CKPKLQLCICRILTMIPVYAIIS

SEQ ID NO: 2122243 - protein, 21 aa, Cryptosporidium hominis
CKQDPFCVAWSYNATLSEGPD

SEQ ID NO: 2122244 - protein, 17 aa, Cryptosporidium hominis
CKQLEAILSDLKSSCNA

SEQ ID NO: 2122245 - protein, 20 aa, Cryptosporidium hominis
CKTNRLPRQIPRQKWYNSQK

SEQ ID NO: 2122246 - protein, 24 aa, Cryptosporidium hominis
CKVGLHPWIRVNRVIRDIPNQSII

SEQ ID NO: 2122247 - protein, 25 aa, Cryptosporidium hominis
CKYAKFLFQFLIFFIDNVCNLVLCG

SEQ ID NO: 2122248 - protein, 18 aa, Cryptosporidium hominis
CLGEICVNCSQNLHNDSE

SEQ ID NO: 2122249 - protein, 19 aa, Cryptosporidium hominis
CLGLAFRILGYFLTAFTLR

SEQ ID NO: 2122250 - protein, 18 aa, Cryptosporidium hominis
CLHYCLSKSLTNAHLLFI

SEQ ID NO: 2122251 - protein, 19 aa, Cryptosporidium hominis
CLKGTKIGDSCLVESFIDV

SEQ ID NO: 2122252 - protein, 37 aa, Cryptosporidium hominis
CLLNSCKIIDKWYEEVLPKWGTHWNCNSIPVSIHNLS

SEQ ID NO: 2122253 - protein, 24 aa, Cryptosporidium hominis
CLNLISLLSLCSFLVITGLQGTIE

SEQ ID NO: 2122254 - protein, 21 aa, Cryptosporidium hominis
CLQILKYRSNMKVFKEKKLMN

SEQ ID NO: 2122255 - protein, 18 aa, Cryptosporidium hominis
CLREGIDRKYCKAISNSI

SEQ ID NO: 2122256 - protein, 32 aa, Cryptosporidium hominis
CLRIVEFIYKLFFRSIEDWHYPITKKLPSTTK

SEQ ID NO: 2122257 - protein, 18 aa, Cryptosporidium hominis
CLSVLRLLPPNLLGARTL

SEQ ID NO: 2122258 - protein, 22 aa, Cryptosporidium hominis
CLTFCGSASYTAFNHFGSKPSM

SEQ ID NO: 2122259 - protein, 26 aa, Cryptosporidium hominis
CLVFPAVVYLKLFKYIFICDKYLSRP

SEQ ID NO: 2122260 - protein, 20 aa, Cryptosporidium hominis
CLVLYSPLCGVFSEAMSGGP

SEQ ID NO: 2122261 - protein, 18 aa, Cryptosporidium hominis
CLYNYSGFCGYKVFTFSS

SEQ ID NO: 2122262 - protein, 25 aa, Cryptosporidium hominis
CMEALPLFLDRIIPSWVAVICSVTA

SEQ ID NO: 2122263 - protein, 19 aa, Cryptosporidium hominis
CMFAGGSLIFFKKFGKKKR

SEQ ID NO: 2122264 - protein, 26 aa, Cryptosporidium hominis
CMFKAVLPLMKIRWKTLNLINTSKMD

SEQ ID NO: 2122265 - protein, 17 aa, Cryptosporidium hominis
CMILVRFIFGIRSSTYF

SEQ ID NO: 2122266 - protein, 23 aa, Cryptosporidium hominis
CMLKHRLQRSSAFDELLFMLKPT

SEQ ID NO: 2122267 - protein, 17 aa, Cryptosporidium hominis
CMLTLKSGILVQIASNF

SEQ ID NO: 2122268 - protein, 18 aa, Cryptosporidium hominis
CMVSPWKNLEFICVMDTV

SEQ ID NO: 2122269 - protein, 25 aa, Cryptosporidium hominis
CNKNSNIKFCWFDFHSECSKMRWSN

SEQ ID NO: 2122270 - protein, 21 aa, Cryptosporidium hominis
CNLPIEPNDISILKGILLDTN

SEQ ID NO: 2122271 - protein, 27 aa, Cryptosporidium hominis
CNLSKVKLPKLLRRVSGRRQIQYNNKY

SEQ ID NO: 2122272 - protein, 31 aa, Cryptosporidium hominis
CNMTICGNILRLGRIVAYISYCIGNYKELYI

SEQ ID NO: 2122273 - protein, 20 aa, Cryptosporidium hominis
CNNIFHSECIYKWFRTSNKT

SEQ ID NO: 2122274 - protein, 25 aa, Cryptosporidium hominis
CNSFVDLLLLKRIYRFSQISLDENI

SEQ ID NO: 2122275 - protein, 25 aa, Cryptosporidium hominis
CNSSFLVDICLSGAISHILLSEDQC

SEQ ID NO: 2122276 - protein, 19 aa, Cryptosporidium hominis
CNSSNMLLRGCKLRNTSWA

SEQ ID NO: 2122277 - protein, 18 aa, Cryptosporidium hominis
CNTIEIYRSYALSDPLFG

SEQ ID NO: 2122278 - protein, 17 aa, Cryptosporidium hominis
CPCDPLLETRPTFYDFL

SEQ ID NO: 2122279 - protein, 19 aa, Cryptosporidium hominis
CPITFLPINVFAMYKHLSC

SEQ ID NO: 2122280 - protein, 20 aa, Cryptosporidium hominis
CPSKHYIKMLEHFFNTIYLK

SEQ ID NO: 2122281 - protein, 19 aa, Cryptosporidium hominis
CPTRITSQLFLFDSDANLC

SEQ ID NO: 2122282 - protein, 19 aa, Cryptosporidium hominis
CQERSYLPIIVFSFSKKDC

SEQ ID NO: 2122283 - protein, 32 aa, Cryptosporidium hominis
CQKIARLSPIPGPIRFCREVKYLTKRILLNTW

SEQ ID NO: 2122284 - protein, 20 aa, Cryptosporidium hominis
CQMKSFLKNRRCISGCATAF

SEQ ID NO: 2122285 - protein, 17 aa, Cryptosporidium hominis
CQSGIMATNTNFCRKGK

SEQ ID NO: 2122286 - protein, 18 aa, Cryptosporidium hominis
CRATFHRSYLKHFRQEDI

SEQ ID NO: 2122287 - protein, 20 aa, Cryptosporidium hominis
CRPESLDIVFDDVKFGQCTS

SEQ ID NO: 2122288 - protein, 17 aa, Cryptosporidium hominis
CRSFCSVMVNCTHFIMD

SEQ ID NO: 2122289 - protein, 17 aa, Cryptosporidium hominis
CRTKHQPCHVVYTDYRP

SEQ ID NO: 2122290 - protein, 20 aa, Cryptosporidium hominis
CSAQCIFGKIILLIASIILL

SEQ ID NO: 2122291 - protein, 23 aa, Cryptosporidium hominis
CSDLKRSLAVIILLFEFDSKLLS

SEQ ID NO: 2122292 - protein, 21 aa, Cryptosporidium hominis
CSECGKCVLNMDHHCPWINNC

SEQ ID NO: 2122293 - protein, 21 aa, Cryptosporidium hominis
CSFAIKYRPLVFDNILTETIK

SEQ ID NO: 2122294 - protein, 34 aa, Cryptosporidium hominis
CSFNFPSIRMPLFLKWLRYSAFAVLYPIGIFSEV

SEQ ID NO: 2122295 - protein, 19 aa, Cryptosporidium hominis
CSGKEAWKNISNCNKLRRL

SEQ ID NO: 2122296 - protein, 20 aa, Cryptosporidium hominis
CSIIFKKCIVESVMPNLQSQ

SEQ ID NO: 2122297 - protein, 26 aa, Cryptosporidium hominis
CSIIIKELPFMLAIEPPNTNCVPIKA

SEQ ID NO: 2122298 - protein, 18 aa, Cryptosporidium hominis
CSILISLAILSISLFYFL

SEQ ID NO: 2122299 - protein, 23 aa, Cryptosporidium hominis
CSKCIKWKVLMVLSCLVQSNYNI

SEQ ID NO: 2122300 - protein, 17 aa, Cryptosporidium hominis
CSKGELKSTLIDYPEIE

SEQ ID NO: 2122301 - protein, 25 aa, Cryptosporidium hominis
CSKLYPALCFDLYGSPGFHNIYVGL

SEQ ID NO: 2122302 - protein, 20 aa, Cryptosporidium hominis
CSKMLILISLIVKFYSTFVF

SEQ ID NO: 2122303 - protein, 24 aa, Cryptosporidium hominis
CSLHSHMALIFGMGGYHREPFYKN

SEQ ID NO: 2122304 - protein, 26 aa, Cryptosporidium hominis
CSQILRYVDSIAFIIAWNASDAFVFS

SEQ ID NO: 2122305 - protein, 19 aa, Cryptosporidium hominis
CSRTLAGLIDFPPFKSNDL

SEQ ID NO: 2122306 - protein, 21 aa, Cryptosporidium hominis
CSSCQYSEWTMWGECSATCGS

SEQ ID NO: 2122307 - protein, 21 aa, Cryptosporidium hominis
CSSFLKNLFCTLACNEESSDI

SEQ ID NO: 2122308 - protein, 23 aa, Cryptosporidium hominis
CSSLKVTIFGAGSFGSAISCVVG

SEQ ID NO: 2122309 - protein, 19 aa, Cryptosporidium hominis
CSSNLTISVLLPLLIAIYY

SEQ ID NO: 2122310 - protein, 18 aa, Cryptosporidium hominis
CSWNEYPYIDSISSCKAS

SEQ ID NO: 2122311 - protein, 18 aa, Cryptosporidium hominis
CTILKRIRLSEIVENYKV

SEQ ID NO: 2122312 - protein, 19 aa, Cryptosporidium hominis
CTLITLLGVSSVWFNDKSI

SEQ ID NO: 2122313 - protein, 24 aa, Cryptosporidium hominis
CVFPYKEYIWKLLNWESQLHSLFA

SEQ ID NO: 2122314 - protein, 17 aa, Cryptosporidium hominis
CVGEKNFMCTLWLVILR

SEQ ID NO: 2122315 - protein, 23 aa, Cryptosporidium hominis
CVGVYFLGVGVVGSVLYIPISLM

SEQ ID NO: 2122316 - protein, 21 aa, Cryptosporidium hominis
CVIKVLLLLGQVLAFDAEGHS

SEQ ID NO: 2122317 - protein, 18 aa, Cryptosporidium hominis
CVIQLTFLIINIMVVSKQ

SEQ ID NO: 2122318 - protein, 26 aa, Cryptosporidium hominis
CVQMLCGILSICLLIIIVLLVVLSIR

SEQ ID NO: 2122319 - protein, 28 aa, Cryptosporidium hominis
CYKATARTGVKIIYVPAILVSSSESLNV

SEQ ID NO: 2122320 - protein, 20 aa, Cryptosporidium hominis
CYKMISGYDSEVHWQYVFDL

SEQ ID NO: 2122321 - protein, 17 aa, Cryptosporidium hominis
CYNSLDFVYRGLDRLIE

SEQ ID NO: 2122322 - protein, 20 aa, Cryptosporidium hominis
CYVFILTIFFGFFFLYLERI

SEQ ID NO: 2122323 - protein, 22 aa, Cryptosporidium hominis
DAAMLIAIFPRQIRFLIAEASF

SEQ ID NO: 2122324 - protein, 19 aa, Cryptosporidium hominis
DAFLRERAKAHWLICLVDG

SEQ ID NO: 2122325 - protein, 21 aa, Cryptosporidium hominis
DAFVKYKGILFIGALIGTRTA

SEQ ID NO: 2122326 - protein, 17 aa, Cryptosporidium hominis
DALLLIDFRLKVTIEEF

SEQ ID NO: 2122327 - protein, 24 aa, Cryptosporidium hominis
DANAYRPPILQMYIFISALGTLFC

SEQ ID NO: 2122328 - protein, 20 aa, Cryptosporidium hominis
DARIRLGAIILLSKNWGLLE

SEQ ID NO: 2122329 - protein, 21 aa, Cryptosporidium hominis
DASCIRSEIFYPIRNLYHPPI

SEQ ID NO: 2122330 - protein, 24 aa, Cryptosporidium hominis
DAVNHLKLGSAMPTVCESLSKSCQ

SEQ ID NO: 2122331 - protein, 17 aa, Cryptosporidium hominis
DCCGGISIAKFAAGNLL

SEQ ID NO: 2122332 - protein, 26 aa, Cryptosporidium hominis
DCILLPVNIWITWKLLSKQVGLIAAL

SEQ ID NO: 2122333 - protein, 19 aa, Cryptosporidium hominis
DCISWWFLGSSPEYILLIQ

SEQ ID NO: 2122334 - protein, 23 aa, Cryptosporidium hominis
DCLFIVPCLLIFLSDFLIPINIL

SEQ ID NO: 2122335 - protein, 17 aa, Cryptosporidium hominis
DCLSHIYKTMGLSDQTL

SEQ ID NO: 2122336 - protein, 23 aa, Cryptosporidium hominis
DCMEFTLRIDRMLNAVANVDIGA

SEQ ID NO: 2122337 - protein, 25 aa, Cryptosporidium hominis
DCRSGIWPLYLIIMLICTFRIIFMV

SEQ ID NO: 2122338 - protein, 20 aa, Cryptosporidium hominis
DCVLGSWSHWSSCSVECGKG

SEQ ID NO: 2122339 - protein, 22 aa, Cryptosporidium hominis
DDARSGNKLIWPSTSASLITAD

SEQ ID NO: 2122340 - protein, 24 aa, Cryptosporidium hominis
DDIFKSKLPKIGIFHTKGSCGLLI

SEQ ID NO: 2122341 - protein, 47 aa, Cryptosporidium hominis
DDIFSFIIDMPWMHRMACFRDDIIFIIYIYQRWIYRSKKGYQSGIER

SEQ ID NO: 2122342 - protein, 24 aa, Cryptosporidium hominis
DDIIFEILYGWRALLGYEKGRAVF

SEQ ID NO: 2122343 - protein, 19 aa, Cryptosporidium hominis
DDIIGCLHISKPVFSNLIL

SEQ ID NO: 2122344 - protein, 19 aa, Cryptosporidium hominis
DDIKNAILSGVKLKTSSQQ

SEQ ID NO: 2122345 - protein, 26 aa, Cryptosporidium hominis
DDILRYRPDFRIHLAEFFRVPINFNF

SEQ ID NO: 2122346 - protein, 22 aa, Cryptosporidium hominis
DDKLSIGYSARFGNLSLASDSS

SEQ ID NO: 2122347 - protein, 24 aa, Cryptosporidium hominis
DDNFPFKTIEELSRCSIKHWLKKV

SEQ ID NO: 2122348 - protein, 24 aa, Cryptosporidium hominis
DDNKRAAVFALGLVMCRNTQQIPQ

SEQ ID NO: 2122349 - protein, 21 aa, Cryptosporidium hominis
DDRCLKSTMLKHLLIGLLSPL

SEQ ID NO: 2122350 - protein, 24 aa, Cryptosporidium hominis
DDYYGEILVGFWKNGHPVGPFKTR

SEQ ID NO: 2122351 - protein, 22 aa, Cryptosporidium hominis
DEARSGSIIKRTILPYNCQQPQ

SEQ ID NO: 2122352 - protein, 22 aa, Cryptosporidium hominis
DECKCKRILIIGSNDLEDNLET

SEQ ID NO: 2122353 - protein, 21 aa, Cryptosporidium hominis
DEICQIYNLLLVTYMLFCGLE

SEQ ID NO: 2122354 - protein, 22 aa, Cryptosporidium hominis
DEIDLYLQYFIFKRPYLSAFSL

SEQ ID NO: 2122355 - protein, 24 aa, Cryptosporidium hominis
DEIKACGSMEIVVLPIIGVSNKIN

SEQ ID NO: 2122356 - protein, 17 aa, Cryptosporidium hominis
DEIKPKLCVSAPVKAIS

SEQ ID NO: 2122357 - protein, 21 aa, Cryptosporidium hominis
DEIKSACKLAGVHENILKMKN

SEQ ID NO: 2122358 - protein, 20 aa, Cryptosporidium hominis
DEIMNLLSLGEIQFQNFSTL

SEQ ID NO: 2122359 - protein, 25 aa, Cryptosporidium hominis
DEKCDVWSIGVILFILLAGYPPFGG

SEQ ID NO: 2122360 - protein, 38 aa, Cryptosporidium hominis
DELLRQYYNEYSFPDYMYIIVLGNLKNSVKIKNNPGEF

SEQ ID NO: 2122361 - protein, 18 aa, Cryptosporidium hominis
DELPILFNKVLKDVLSIV

SEQ ID NO: 2122362 - protein, 17 aa, Cryptosporidium hominis
DELRNVLYMDNAVAGEA

SEQ ID NO: 2122363 - protein, 20 aa, Cryptosporidium hominis
DENKVIFVVNLREKFILVEI

SEQ ID NO: 2122364 - protein, 23 aa, Cryptosporidium hominis
DESFPPSLAPLYMWVLKPYHIRK

SEQ ID NO: 2122365 - protein, 27 aa, Cryptosporidium hominis
DESMLIERWKWVLAIFAIHNIIGGLLF

SEQ ID NO: 2122366 - protein, 24 aa, Cryptosporidium hominis
DESSSLIKILVCTNYYVILLNIIK

SEQ ID NO: 2122367 - protein, 21 aa, Cryptosporidium hominis
DETWMKYIKLFGVLTQLDPFS

SEQ ID NO: 2122368 - protein, 19 aa, Cryptosporidium hominis
DEVMSMVYIMLNFIEEERS

SEQ ID NO: 2122369 - protein, 19 aa, Cryptosporidium hominis
DEYDFLISPHHLLKNSELT

SEQ ID NO: 2122370 - protein, 38 aa, Cryptosporidium hominis
DEYKRLTSEFPWFTSAWLRRACLALERNDYQLAAQYCE

SEQ ID NO: 2122371 - protein, 18 aa, Cryptosporidium hominis
DEYLSIIKIILLLLLSTI

SEQ ID NO: 2122372 - protein, 23 aa, Cryptosporidium hominis
DFEMKIPFSILKSIIESELNGIN

SEQ ID NO: 2122373 - protein, 19 aa, Cryptosporidium hominis
DFFTYDMMNRVCLFKAAKS

SEQ ID NO: 2122374 - protein, 23 aa, Cryptosporidium hominis
DFICSSLEFSIRIIIGNPLKNES

SEQ ID NO: 2122375 - protein, 18 aa, Cryptosporidium hominis
DFLVVLVIYSKLWLNGSI

SEQ ID NO: 2122376 - protein, 26 aa, Cryptosporidium hominis
DFPEFLCDYSCSFCDVLPVNCIQIRN

SEQ ID NO: 2122377 - protein, 21 aa, Cryptosporidium hominis
DFQRTITLIGFLTMGFMSIYF

SEQ ID NO: 2122378 - protein, 19 aa, Cryptosporidium hominis
DFTIKLSEFCGPPYSVDFS

SEQ ID NO: 2122379 - protein, 26 aa, Cryptosporidium hominis
DFVDPWKSLISMILYDPVRRSSLKFD

SEQ ID NO: 2122380 - protein, 18 aa, Cryptosporidium hominis
DFVKRVYSLLSISIAITF

SEQ ID NO: 2122381 - protein, 17 aa, Cryptosporidium hominis
DGFELRNKCYLEEYKSF

SEQ ID NO: 2122382 - protein, 24 aa, Cryptosporidium hominis
DGGLNISASIPFLSSLGGNVGARS

SEQ ID NO: 2122383 - protein, 18 aa, Cryptosporidium hominis
DGHLLICIGDTCFASTEI

SEQ ID NO: 2122384 - protein, 19 aa, Cryptosporidium hominis
DGIFTYSFDTRLLLGKTAV

SEQ ID NO: 2122385 - protein, 18 aa, Cryptosporidium hominis
DGILKARGRFTIRNNESL

SEQ ID NO: 2122386 - protein, 37 aa, Cryptosporidium hominis
DGIPGFRILWTVRIIYISSVFLSWLVLFSTYTNYQIQ

SEQ ID NO: 2122387 - protein, 25 aa, Cryptosporidium hominis
DGKKYPKLHHGRAIYKKEGKTNGNT

SEQ ID NO: 2122388 - protein, 22 aa, Cryptosporidium hominis
DGLTCWRMLNGISTDKFPNIKV

SEQ ID NO: 2122389 - protein, 19 aa, Cryptosporidium hominis
DGQNCKEKVFSVIDDIMSY

SEQ ID NO: 2122390 - protein, 24 aa, Cryptosporidium hominis
DGRGKCECNPGFKLHEDRKTCVDI

SEQ ID NO: 2122391 - protein, 21 aa, Cryptosporidium hominis
DGSGIPVLLAYNPISNTDESN

SEQ ID NO: 2122392 - protein, 28 aa, Cryptosporidium hominis
DGTAIFNWRFVFNIPVPCHFPILRLQVW

SEQ ID NO: 2122393 - protein, 28 aa, Cryptosporidium hominis
DGTGIFNWRFVFDIKIPTQYPILKLQLW

SEQ ID NO: 2122394 - protein, 24 aa, Cryptosporidium hominis
DGVEDCLICYSIVHPQYRSLPRKR

SEQ ID NO: 2122395 - protein, 21 aa, Cryptosporidium hominis
DGVFQGFSWLTILVIFLNAYG

SEQ ID NO: 2122396 - protein, 18 aa, Cryptosporidium hominis
DHHCKWLNTCIGEKNYRH

SEQ ID NO: 2122397 - protein, 18 aa, Cryptosporidium hominis
DHHCPWINNCVGINNQKH

SEQ ID NO: 2122398 - protein, 18 aa, Cryptosporidium hominis
DHHCPWVGTCIGAGNYKL

SEQ ID NO: 2122399 - protein, 23 aa, Cryptosporidium hominis
DHICNALLRISRQTFIGRGLSND

SEQ ID NO: 2122400 - protein, 19 aa, Cryptosporidium hominis
DHLYFLSLQGHENQHIKLV

SEQ ID NO: 2122401 - protein, 29 aa, Cryptosporidium hominis
DHQIFRPLLWKVQTAYVSYLYYLGFSYMM

SEQ ID NO: 2122402 - protein, 17 aa, Cryptosporidium hominis
DICCGVGAIGLTLLDIF

SEQ ID NO: 2122403 - protein, 33 aa, Cryptosporidium hominis
DIEINEIFIQWNILRAGLKYILHQIKNNRKSYE

SEQ ID NO: 2122404 - protein, 22 aa, Cryptosporidium hominis
DIFWMNIFFPAWSVSSEEGDLR

SEQ ID NO: 2122405 - protein, 19 aa, Cryptosporidium hominis
DIFYKSWIHAIAVTVIAFL

SEQ ID NO: 2122406 - protein, 20 aa, Cryptosporidium hominis
DIIQMCRPWQIHGVLYWIGD

SEQ ID NO: 2122407 - protein, 24 aa, Cryptosporidium hominis
DIITPRILIHANIFLLWNSTLKDF

SEQ ID NO: 2122408 - protein, 20 aa, Cryptosporidium hominis
DILDNIYFFLSEVIFSELIT

SEQ ID NO: 2122409 - protein, 23 aa, Cryptosporidium hominis
DIPDLLKTLNWVENVNLFEKEIL

SEQ ID NO: 2122410 - protein, 29 aa, Cryptosporidium hominis
DIQLKTWCIVWLSRFLLTSVIRSMTIIIS

SEQ ID NO: 2122411 - protein, 23 aa, Cryptosporidium hominis
DISFNLPMELFRYNIEDISNTYN

SEQ ID NO: 2122412 - protein, 22 aa, Cryptosporidium hominis
DISKSIFLSLNFDDKPANMRKL

SEQ ID NO: 2122413 - protein, 24 aa, Cryptosporidium hominis
DITMIKLRFKYIFDPINRKILEFE

SEQ ID NO: 2122414 - protein, 19 aa, Cryptosporidium hominis
DIYSCRIWILILLAVFEST

SEQ ID NO: 2122415 - protein, 26 aa, Cryptosporidium hominis
DKAASFKVFAARVVRRNLSLGSSQLY

SEQ ID NO: 2122416 - protein, 40 aa, Cryptosporidium hominis
DKGIKLASRCPIWFEYFCLILWRLLPIFEQSIPVSESSNT

SEQ ID NO: 2122417 - protein, 21 aa, Cryptosporidium hominis
DKIMPRYKISSAKIISNSEYS

SEQ ID NO: 2122418 - protein, 24 aa, Cryptosporidium hominis
DKIPKLSMMLSRWWSQSISPNFIK

SEQ ID NO: 2122419 - protein, 23 aa, Cryptosporidium hominis
DKKIDFASSLSIVANNFVVVSLS

SEQ ID NO: 2122420 - protein, 20 aa, Cryptosporidium hominis
DKKSEILRIYSTLPSELYYL

SEQ ID NO: 2122421 - protein, 23 aa, Cryptosporidium hominis
DKLIDRIGSLIIMNNQELINGDM

SEQ ID NO: 2122422 - protein, 27 aa, Cryptosporidium hominis
DKNGKLVVVRKMFKLNIASLIQNSNKS

SEQ ID NO: 2122423 - protein, 23 aa, Cryptosporidium hominis
DKPSEIMGFALITVGIFAPGDSI

SEQ ID NO: 2122424 - protein, 23 aa, Cryptosporidium hominis
DKSSCLMGIFILLLSMLLSKINL

SEQ ID NO: 2122425 - protein, 20 aa, Cryptosporidium hominis
DKSTKECIYEILSMINQESS

SEQ ID NO: 2122426 - protein, 25 aa, Cryptosporidium hominis
DKTQNIACMCMGNTLGGGLGVLYRL

SEQ ID NO: 2122427 - protein, 23 aa, Cryptosporidium hominis
DKVDLYLPIFLLFLETFSFEDLN

SEQ ID NO: 2122428 - protein, 17 aa, Cryptosporidium hominis
DKWSLYRSLAIQLYGNL

SEQ ID NO: 2122429 - protein, 18 aa, Cryptosporidium hominis
DKYECVFPSINSEVINRI

SEQ ID NO: 2122430 - protein, 19 aa, Cryptosporidium hominis
DLEILKGRIFSKSDEYSRE

SEQ ID NO: 2122431 - protein, 19 aa, Cryptosporidium hominis
DLFEKGVKFLVFIQDTNAL

SEQ ID NO: 2122432 - protein, 20 aa, Cryptosporidium hominis
DLFPHLRPSVPLSGQSLDSF

SEQ ID NO: 2122433 - protein, 25 aa, Cryptosporidium hominis
DLGPLISRSKLYGMMNKHPICDKSS

SEQ ID NO: 2122434 - protein, 21 aa, Cryptosporidium hominis
DLGSKCNCCFNGENEGFGSNG

SEQ ID NO: 2122435 - protein, 18 aa, Cryptosporidium hominis
DLIADFPNMMVFKDTNSI

SEQ ID NO: 2122436 - protein, 20 aa, Cryptosporidium hominis
DLIFCFGSDVLFNISIALLD

SEQ ID NO: 2122437 - protein, 18 aa, Cryptosporidium hominis
DLIREFLRSAKINSRGNA

SEQ ID NO: 2122438 - protein, 43 aa, Cryptosporidium hominis
DLKPLLSINLKKYFRFTAIELTDFSRFLVLLLSIYIFSRLDIS

SEQ ID NO: 2122439 - protein, 24 aa, Cryptosporidium hominis
DLLARPIVNIEIHFKQIFDYIRNG

SEQ ID NO: 2122440 - protein, 22 aa, Cryptosporidium hominis
DLMAKAKLGVKILETTALLANR

SEQ ID NO: 2122441 - protein, 27 aa, Cryptosporidium hominis
DLMRSLDIFIFKTIINKCYKNLLDDRN

SEQ ID NO: 2122442 - protein, 21 aa, Cryptosporidium hominis
DLNTILPFFILLEFNSNGQKH

SEQ ID NO: 2122443 - protein, 23 aa, Cryptosporidium hominis
DLPSEKLVAIAPNFVKKLRKLGF

SEQ ID NO: 2122444 - protein, 26 aa, Cryptosporidium hominis
DLQRGFRSGYYWNICNSELRRVNQKC

SEQ ID NO: 2122445 - protein, 19 aa, Cryptosporidium hominis
DLRQLEHILGRYGEAEAKL

SEQ ID NO: 2122446 - protein, 19 aa, Cryptosporidium hominis
DLSDISFIFSEPHFLFICS

SEQ ID NO: 2122447 - protein, 17 aa, Cryptosporidium hominis
DLSLPNMEAESMNFGID

SEQ ID NO: 2122448 - protein, 18 aa, Cryptosporidium hominis
DLSMTLGFHPYNFNIYQL

SEQ ID NO: 2122449 - protein, 24 aa, Cryptosporidium hominis
DLSTMINHSWIYQGLIHDVYNLKL

SEQ ID NO: 2122450 - protein, 22 aa, Cryptosporidium hominis
DLTRTPSWCDRVLVLSNNSKLP

SEQ ID NO: 2122451 - protein, 17 aa, Cryptosporidium hominis
DLVIKIEIDIVCNNNKV

SEQ ID NO: 2122452 - protein, 22 aa, Cryptosporidium hominis
DLVKTWHLFLGISIKVDEKFQP

SEQ ID NO: 2122453 - protein, 23 aa, Cryptosporidium hominis
DLYFSKKMVRYWISKPKKKDIII

SEQ ID NO: 2122454 - protein, 27 aa, Cryptosporidium hominis
DMAKQSFKLFMTFLRTPIRNISFPPYL

SEQ ID NO: 2122455 - protein, 24 aa, Cryptosporidium hominis
DMLFKELMPSLAYHFDLLSITSDT

SEQ ID NO: 2122456 - protein, 22 aa, Cryptosporidium hominis
DMLKSAIFGQEFANFDTMIYKM

SEQ ID NO: 2122457 - protein, 18 aa, Cryptosporidium hominis
DMVNSYRLFSIDYIDIKL

SEQ ID NO: 2122458 - protein, 24 aa, Cryptosporidium hominis
DNAPKICNILKCVPFKEAPNEVIK

SEQ ID NO: 2122459 - protein, 20 aa, Cryptosporidium hominis
DNCRSRYLINDAAVYYKKPV

SEQ ID NO: 2122460 - protein, 25 aa, Cryptosporidium hominis
DNFWRVRYCSIILLILSLYKLLSSY

SEQ ID NO: 2122461 - protein, 27 aa, Cryptosporidium hominis
DNGCKGEELPLLWGQRATILHENMIKG

SEQ ID NO: 2122462 - protein, 18 aa, Cryptosporidium hominis
DNGRLFRLLTKINTIADR

SEQ ID NO: 2122463 - protein, 22 aa, Cryptosporidium hominis
DNMEIPKIYPFNRFIVDVRVLV

SEQ ID NO: 2122464 - protein, 21 aa, Cryptosporidium hominis
DNMPIILSILFSLMLACQYLV

SEQ ID NO: 2122465 - protein, 26 aa, Cryptosporidium hominis
DNNFIWLRNFCKNGSLQLLVNSLSCP

SEQ ID NO: 2122466 - protein, 19 aa, Cryptosporidium hominis
DNRAEIIWILVHSFFSTLT

SEQ ID NO: 2122467 - protein, 36 aa, Cryptosporidium hominis
DNSLRSIEAFALFFDWRFCIDLTGYLIKLLRLFPQR

SEQ ID NO: 2122468 - protein, 24 aa, Cryptosporidium hominis
DNVKPCIRISCRKQKKKGSNNKNG

SEQ ID NO: 2122469 - protein, 19 aa, Cryptosporidium hominis
DNYLKRRWELQTMLDTCFR

SEQ ID NO: 2122470 - protein, 22 aa, Cryptosporidium hominis
DPATCVKDWWLIHISQSSRVLK

SEQ ID NO: 2122471 - protein, 19 aa, Cryptosporidium hominis
DPDSIFSFLSSFLTTKELD

SEQ ID NO: 2122472 - protein, 26 aa, Cryptosporidium hominis
DPIHLPGIRYFALFIFSKQVNVCMSK

SEQ ID NO: 2122473 - protein, 23 aa, Cryptosporidium hominis
DPKDKIVTYGFGGGPVAPPASTT

SEQ ID NO: 2122474 - protein, 23 aa, Cryptosporidium hominis
DPKFPWPNCSQVPINSPEYDVLK

SEQ ID NO: 2122475 - protein, 21 aa, Cryptosporidium hominis
DPKLKLDDFWELTGSSIVNIH

SEQ ID NO: 2122476 - protein, 31 aa, Cryptosporidium hominis
DPMTCIPIGFLFLLFIYWNYLSYFINTCRTL

SEQ ID NO: 2122477 - protein, 20 aa, Cryptosporidium hominis
DPPVCCSILEKLFNYENGLL

SEQ ID NO: 2122478 - protein, 20 aa, Cryptosporidium hominis
DPPVISWPNNHIVFIHSQVK

SEQ ID NO: 2122479 - protein, 19 aa, Cryptosporidium hominis
DPRIFSLSSGHILVSTVGI

SEQ ID NO: 2122480 - protein, 31 aa, Cryptosporidium hominis
DPRNIWLKLFLPDWSPLGGFLLVIVSVGASI

SEQ ID NO: 2122481 - protein, 33 aa, Cryptosporidium hominis
DPSMIYLYIFRMMNVRMRQVWGLYLEEENYEIT

SEQ ID NO: 2122482 - protein, 24 aa, Cryptosporidium hominis
DPVIVPCIIFPIIGWNPNNLFQEC

SEQ ID NO: 2122483 - protein, 33 aa, Cryptosporidium hominis
DQCLTSWPEKCQIWKSKCEDNLIYGYKNPQCVP

SEQ ID NO: 2122484 - protein, 24 aa, Cryptosporidium hominis
DQCPEILNFYSVIQCNLDTILNPR

SEQ ID NO: 2122485 - protein, 28 aa, Cryptosporidium hominis
DQDKMKRFSFRWEEQFMKYCEKVQRRLQ

SEQ ID NO: 2122486 - protein, 25 aa, Cryptosporidium hominis
DQEAISFPVIIRINPEYITGNKPHE

SEQ ID NO: 2122487 - protein, 17 aa, Cryptosporidium hominis
DQFDLWTNDIWLNIIVA

SEQ ID NO: 2122488 - protein, 17 aa, Cryptosporidium hominis
DQFRVPKSFSMKCNSSK

SEQ ID NO: 2122489 - protein, 25 aa, Cryptosporidium hominis
DQGKCGGCYAFVVSASISISNCIQK

SEQ ID NO: 2122490 - protein, 25 aa, Cryptosporidium hominis
DQISFKSALFIFGFIIALIIGNYFV

SEQ ID NO: 2122491 - protein, 28 aa, Cryptosporidium hominis
DQLRRSAWLLGCIFEFSSPNMALAIVDN

SEQ ID NO: 2122492 - protein, 22 aa, Cryptosporidium hominis
DQSKVYASICNLLLGSVPSTSL

SEQ ID NO: 2122493 - protein, 17 aa, Cryptosporidium hominis
DREKFSILVSAYSNTRF

SEQ ID NO: 2122494 - protein, 20 aa, Cryptosporidium hominis
DREYNLKMLYNWDLWGPCII

SEQ ID NO: 2122495 - protein, 27 aa, Cryptosporidium hominis
DRHRRTKILKMRRYMEKTGKKLTGNSF

SEQ ID NO: 2122496 - protein, 23 aa, Cryptosporidium hominis
DRRKRIAKIVLYLTTFLILVIIF

SEQ ID NO: 2122497 - protein, 20 aa, Cryptosporidium hominis
DRTLDCISPIYSPILNINLS

SEQ ID NO: 2122498 - protein, 18 aa, Cryptosporidium hominis
DSDGRTPLFYAISQLDIG

SEQ ID NO: 2122499 - protein, 23 aa, Cryptosporidium hominis
DSEHFIRYGAMHVLGLAYCGTGS

SEQ ID NO: 2122500 - protein, 17 aa, Cryptosporidium hominis
DSEPVVLCVLQRSTNDL

SEQ ID NO: 2122501 - protein, 25 aa, Cryptosporidium hominis
DSFPKPKGRYAFGAWEVGLSMKFGQ

SEQ ID NO: 2122502 - protein, 25 aa, Cryptosporidium hominis
DSFVPHSIQLFWGVDYFAAKELLIE

SEQ ID NO: 2122503 - protein, 24 aa, Cryptosporidium hominis
DSFYIEFIELLFLSQGESYDGQVQ

SEQ ID NO: 2122504 - protein, 25 aa, Cryptosporidium hominis
DSIIKDVYIKWIWNDSDSANNNCSS

SEQ ID NO: 2122505 - protein, 18 aa, Cryptosporidium hominis
DSIIKECRSLINSTNLNP

SEQ ID NO: 2122506 - protein, 21 aa, Cryptosporidium hominis
DSLPSLLKILLLIWESIGLSL

SEQ ID NO: 2122507 - protein, 22 aa, Cryptosporidium hominis
DSMLRISLKLSESKDMFDTIGA

SEQ ID NO: 2122508 - protein, 25 aa, Cryptosporidium hominis
DSQPLFPWGPLYSYQHPVVTVSQIR

SEQ ID NO: 2122509 - protein, 18 aa, Cryptosporidium hominis
DSQTQFGILSNMDGVGPT

SEQ ID NO: 2122510 - protein, 21 aa, Cryptosporidium hominis
DSSAFRKFLIWTIFLVILLNF

SEQ ID NO: 2122511 - protein, 20 aa, Cryptosporidium hominis
DSSRTRLLFYANKENKNNRS

SEQ ID NO: 2122512 - protein, 23 aa, Cryptosporidium hominis
DSTLRLWVFFESVSLLVSCSTSI

SEQ ID NO: 2122513 - protein, 33 aa, Cryptosporidium hominis
DSTMPLFYILSCWKLLWCLSINELIGESLRNMI

SEQ ID NO: 2122514 - protein, 25 aa, Cryptosporidium hominis
DSTNKELNCGLVLDSLEVRSIPNLS

SEQ ID NO: 2122515 - protein, 20 aa, Cryptosporidium hominis
DSWNPFSITRIKLFHASNSC

SEQ ID NO: 2122516 - protein, 23 aa, Cryptosporidium hominis
DTDEFDMVYGLSIQLSYINIAII

SEQ ID NO: 2122517 - protein, 19 aa, Cryptosporidium hominis
DTHLKYYIMRVRARVIGAI

SEQ ID NO: 2122518 - protein, 20 aa, Cryptosporidium hominis
DTISICSILSELDVLEKCFT

SEQ ID NO: 2122519 - protein, 24 aa, Cryptosporidium hominis
DTQCGFKLFSRRLARVIFPSLHIK

SEQ ID NO: 2122520 - protein, 25 aa, Cryptosporidium hominis
DTWDTSEDIILVYFVSQYSSTPSCG

SEQ ID NO: 2122521 - protein, 22 aa, Cryptosporidium hominis
DVECLPCGFTDWGSWSPCSASC

SEQ ID NO: 2122522 - protein, 22 aa, Cryptosporidium hominis
DVFSSSSSFGFSQPSNENGNTS

SEQ ID NO: 2122523 - protein, 19 aa, Cryptosporidium hominis
DVILIDWNTMRSFGRVTWG

SEQ ID NO: 2122524 - protein, 18 aa, Cryptosporidium hominis
DVLLLTGMSLKYPTWSGE

SEQ ID NO: 2122525 - protein, 19 aa, Cryptosporidium hominis
DVLNVMGLYPGDPGPPCSD

SEQ ID NO: 2122526 - protein, 20 aa, Cryptosporidium hominis
DVLRSMAIIIDVYRQHVWND

SEQ ID NO: 2122527 - protein, 17 aa, Cryptosporidium hominis
DVNFPLKNLYQMDASLR

SEQ ID NO: 2122528 - protein, 17 aa, Cryptosporidium hominis
DVQLDFNMRYFLGSISY

SEQ ID NO: 2122529 - protein, 21 aa, Cryptosporidium hominis
DVRTYCRYILKKTMDEINEDY

SEQ ID NO: 2122530 - protein, 23 aa, Cryptosporidium hominis
DVSDRWNSDWGYYYENKVRKNYI

SEQ ID NO: 2122531 - protein, 25 aa, Cryptosporidium hominis
DVSTPRFVDLLLFSTWDSMDLLSNG

SEQ ID NO: 2122532 - protein, 18 aa, Cryptosporidium hominis
DVVISGKFFVDGSVRIVA

SEQ ID NO: 2122533 - protein, 18 aa, Cryptosporidium hominis
DWEGGWWSKEFLSRRDVR

SEQ ID NO: 2122534 - protein, 23 aa, Cryptosporidium hominis
DWGRARISFSAFRSRDDELKAST

SEQ ID NO: 2122535 - protein, 19 aa, Cryptosporidium hominis
DWWNAGNFGEYWRKWNLPV

SEQ ID NO: 2122536 - protein, 18 aa, Cryptosporidium hominis
DWYQWLIMHQEISKNNNT

SEQ ID NO: 2122537 - protein, 34 aa, Cryptosporidium hominis
DYECAPWRCYCLIQRWLGIHIDILGACVISSLGI

SEQ ID NO: 2122538 - protein, 27 aa, Cryptosporidium hominis
DYFEFPIQILFWFGYEDTRLIAYKIKS

SEQ ID NO: 2122539 - protein, 20 aa, Cryptosporidium hominis
DYIISKEITFFWTTLLLLGE

SEQ ID NO: 2122540 - protein, 34 aa, Cryptosporidium hominis
DYLKECLVCLRYLVCLISKISIGFSLQFIPEHPT

SEQ ID NO: 2122541 - protein, 17 aa, Cryptosporidium hominis
DYMPFFVRQCISVTTAF

SEQ ID NO: 2122542 - protein, 27 aa, Cryptosporidium hominis
DYNARRRFTWVYVVAITFVFMLATSFA

SEQ ID NO: 2122543 - protein, 19 aa, Cryptosporidium hominis
DYNSGIIKSDFQHILDPSK

SEQ ID NO: 2122544 - protein, 17 aa, Cryptosporidium hominis
DYRVCVSNGIIDNHGTN

SEQ ID NO: 2122545 - protein, 19 aa, Cryptosporidium hominis
DYTRRIPLEGLEMYCKTVW

SEQ ID NO: 2122546 - protein, 27 aa, Cryptosporidium hominis
DYVWITCSFLSFLLVNYYITKWIWGSN

SEQ ID NO: 2122547 - protein, 23 aa, Cryptosporidium hominis
DYYPDRFVYRQGNLCKPDDSTER

SEQ ID NO: 2122548 - protein, 17 aa, Cryptosporidium hominis
EACEDCNLMIFVIPSQF

SEQ ID NO: 2122549 - protein, 18 aa, Cryptosporidium hominis
EADLLFERLNEYTETSEL

SEQ ID NO: 2122550 - protein, 18 aa, Cryptosporidium hominis
EAELDLAKSASRTSKLAM

SEQ ID NO: 2122551 - protein, 20 aa, Cryptosporidium hominis
EAHIIFMFRQYYKLYNTLLK

SEQ ID NO: 2122552 - protein, 27 aa, Cryptosporidium hominis
EAKHLGRIIFYLGLRFIKNEKVRAELT

SEQ ID NO: 2122553 - protein, 36 aa, Cryptosporidium hominis
EALECIYRNGLSIQILESFLGYSLDYIISKEITFFW

SEQ ID NO: 2122554 - protein, 19 aa, Cryptosporidium hominis
EALISFNRFQSFLRSRPLD

SEQ ID NO: 2122555 - protein, 24 aa, Cryptosporidium hominis
EALSIKGLLNDGGQFTITSLDQNN

SEQ ID NO: 2122556 - protein, 24 aa, Cryptosporidium hominis
EAPNEVIKIIGLLRPTILQRLIWF

SEQ ID NO: 2122557 - protein, 19 aa, Cryptosporidium hominis
EARNWKGKIDILYNNAGIG

SEQ ID NO: 2122558 - protein, 20 aa, Cryptosporidium hominis
EASLKYCRTSFLSNVLGTEK

SEQ ID NO: 2122559 - protein, 19 aa, Cryptosporidium hominis
EAVIRFLFENIDIKSANRL

SEQ ID NO: 2122560 - protein, 23 aa, Cryptosporidium hominis
EAVIWSHLMRKWIFLPRRVSFDE

SEQ ID NO: 2122561 - protein, 26 aa, Cryptosporidium hominis
EAVSALLSFGAFPWIRNYAGFDPVTL

SEQ ID NO: 2122562 - protein, 24 aa, Cryptosporidium hominis
ECDVWSAGVVMYFLLAGTLPFTGR

SEQ ID NO: 2122563 - protein, 25 aa, Cryptosporidium hominis
ECIRPFTRYRLYLENGYGQLQEIMR

SEQ ID NO: 2122564 - protein, 33 aa, Cryptosporidium hominis
ECISPNLLTIFGFLCSLIAMLLTMMTCPMLDSA

SEQ ID NO: 2122565 - protein, 31 aa, Cryptosporidium hominis
ECKGIKRIPLFSLSNTFSFVRFPTSQYHFIE

SEQ ID NO: 2122566 - protein, 20 aa, Cryptosporidium hominis
ECLDIRKTLINFFDRIKQYG

SEQ ID NO: 2122567 - protein, 21 aa, Cryptosporidium hominis
ECLIVKSIIVSSTFGVIKMIT

SEQ ID NO: 2122568 - protein, 19 aa, Cryptosporidium hominis
ECSNAHCELLASLKPFVNS

SEQ ID NO: 2122569 - protein, 17 aa, Cryptosporidium hominis
ECTCPFCKEDIVTQVEL

SEQ ID NO: 2122570 - protein, 25 aa, Cryptosporidium hominis
ECVRYKERLKEGGLGNFLLGLAGSA

SEQ ID NO: 2122571 - protein, 20 aa, Cryptosporidium hominis
EDEICLPPEMTHGIIDEFLY

SEQ ID NO: 2122572 - protein, 17 aa, Cryptosporidium hominis
EDFLWLSLEAVNFRMLP

SEQ ID NO: 2122573 - protein, 19 aa, Cryptosporidium hominis
EDGFKYIIFEITKINTESL

SEQ ID NO: 2122574 - protein, 33 aa, Cryptosporidium hominis
EDIKKGNFLLEWLREMKTFIPSNHFVFDLNSKA

SEQ ID NO: 2122575 - protein, 27 aa, Cryptosporidium hominis
EDINFLRIWPAYFMMVTTIGWGMVMIS

SEQ ID NO: 2122576 - protein, 24 aa, Cryptosporidium hominis
EDLIRSGLFYAHSIVVCSSNSINS

SEQ ID NO: 2122577 - protein, 23 aa, Cryptosporidium hominis
EDLSNLFLEFSWLEESGELIKES

SEQ ID NO: 2122578 - protein, 18 aa, Cryptosporidium hominis
EDNARFTLRYATDLCQKK

SEQ ID NO: 2122579 - protein, 18 aa, Cryptosporidium hominis
EDNLRISANLAQETQHIG

SEQ ID NO: 2122580 - protein, 24 aa, Cryptosporidium hominis
EDQWKYKMLHSFRQFISGAISSKF

SEQ ID NO: 2122581 - protein, 18 aa, Cryptosporidium hominis
EDSPCLRTYCECLCEIED

SEQ ID NO: 2122582 - protein, 25 aa, Cryptosporidium hominis
EDVLIETRGPFIIVNEEGEENKTNS

SEQ ID NO: 2122583 - protein, 24 aa, Cryptosporidium hominis
EEEELKKLLGYSGLFGQNYGNGQS

SEQ ID NO: 2122584 - protein, 25 aa, Cryptosporidium hominis
EEEERLRYLIFLAEVQMRRLINMIQ

SEQ ID NO: 2122585 - protein, 18 aa, Cryptosporidium hominis
EEEFYKFLNEWRNRKVFK

SEQ ID NO: 2122586 - protein, 26 aa, Cryptosporidium hominis
EEFGDSPLHWAVRLELPKVVHRLVKS

SEQ ID NO: 2122587 - protein, 22 aa, Cryptosporidium hominis
EEFKANGLYFFLSFSSSKQLSG

SEQ ID NO: 2122588 - protein, 21 aa, Cryptosporidium hominis
EEFLELLLDYGASMTDLTLEG

SEQ ID NO: 2122589 - protein, 22 aa, Cryptosporidium hominis
EEFVCSRFNYFNGKTFGEATAA

SEQ ID NO: 2122590 - protein, 21 aa, Cryptosporidium hominis
EEGRPHGFGRWREDDYYGEIL

SEQ ID NO: 2122591 - protein, 25 aa, Cryptosporidium hominis
EEGSKYRIGIGFKDKAINLLIENPY

SEQ ID NO: 2122592 - protein, 19 aa, Cryptosporidium hominis
EEKELSRESGLFSESSRNE

SEQ ID NO: 2122593 - protein, 21 aa, Cryptosporidium hominis
EEKINLVLSRFLAHSIMDHSH

SEQ ID NO: 2122594 - protein, 25 aa, Cryptosporidium hominis
EEKRRIGSSIPLSSSVELSRKRKRR

SEQ ID NO: 2122595 - protein, 29 aa, Cryptosporidium hominis
EELCNSKVMFPWSMGNRVPINSVSCSESI

SEQ ID NO: 2122596 - protein, 19 aa, Cryptosporidium hominis
EELFWRSFVYKELIISLGV

SEQ ID NO: 2122597 - protein, 30 aa, Cryptosporidium hominis
EELIRRAALMKAKRFISNSIISGQVVPKMA

SEQ ID NO: 2122598 - protein, 23 aa, Cryptosporidium hominis
EELLRLANSYAFNVYIGNECIES

SEQ ID NO: 2122599 - protein, 18 aa, Cryptosporidium hominis
EELMKSKTPLTVEEIEAA

SEQ ID NO: 2122600 - protein, 23 aa, Cryptosporidium hominis
EENKCFYSSSSILSFYYDEYKLL

SEQ ID NO: 2122601 - protein, 22 aa, Cryptosporidium hominis
EENWIKQCVQFDFNRDLYSSRE

SEQ ID NO: 2122602 - protein, 25 aa, Cryptosporidium hominis
EESKLRKGEIVFKNVFFSYSDNIDN

SEQ ID NO: 2122603 - protein, 24 aa, Cryptosporidium hominis
EESPWIHGGRLIWYKTGKNSSNNY

SEQ ID NO: 2122604 - protein, 26 aa, Cryptosporidium hominis
EEVCSSIQLMSFWKLYNDVFDLVESE

SEQ ID NO: 2122605 - protein, 25 aa, Cryptosporidium hominis
EEVGPALFWFITWGLILLCAAGAIV

SEQ ID NO: 2122606 - protein, 23 aa, Cryptosporidium hominis
EEVLEYWRKINILKLTLEKTKGR

SEQ ID NO: 2122607 - protein, 22 aa, Cryptosporidium hominis
EEWRFLCYDFEKFDLEKDHSKI

SEQ ID NO: 2122608 - protein, 22 aa, Cryptosporidium hominis
EFADLRPLFLWHGRHAYQNSAK

SEQ ID NO: 2122609 - protein, 22 aa, Cryptosporidium hominis
EFEIALKIFANMFINLNTNDNV

SEQ ID NO: 2122610 - protein, 19 aa, Cryptosporidium hominis
EFHLYQWIFVIDFFNTKDT

SEQ ID NO: 2122611 - protein, 20 aa, Cryptosporidium hominis
EFLEYDWSKSTLWQQYYNNL

SEQ ID NO: 2122612 - protein, 27 aa, Cryptosporidium hominis
EFLNALVCAWTLFSLLIICTLKGISSG

SEQ ID NO: 2122613 - protein, 19 aa, Cryptosporidium hominis
EFLNDFKSIIGIFDGAEIG

SEQ ID NO: 2122614 - protein, 19 aa, Cryptosporidium hominis
EFLTEFYLGIGSTFEDLVR

SEQ ID NO: 2122615 - protein, 19 aa, Cryptosporidium hominis
EFNFPMKVNFFSALEVFQV

SEQ ID NO: 2122616 - protein, 20 aa, Cryptosporidium hominis
EFNGIVLMRILHHDRYYYSD

SEQ ID NO: 2122617 - protein, 19 aa, Cryptosporidium hominis
EFSTRVGIKAKKEQCLKLF

SEQ ID NO: 2122618 - protein, 24 aa, Cryptosporidium hominis
EFVLVSLIFICRLIYNCINGQFPV

SEQ ID NO: 2122619 - protein, 23 aa, Cryptosporidium hominis
EFVLYRKTCRMLSSGTKKSDKTR

SEQ ID NO: 2122620 - protein, 23 aa, Cryptosporidium hominis
EGCCSMVLCRFDERENVGFDKKT

SEQ ID NO: 2122621 - protein, 25 aa, Cryptosporidium hominis
EGEVFPEYIIAQVICNFQDLDINAP

SEQ ID NO: 2122622 - protein, 17 aa, Cryptosporidium hominis
EGFTIESWHSLALHLYN

SEQ ID NO: 2122623 - protein, 19 aa, Cryptosporidium hominis
EGFVPGIAKIMVKNFGCNH

SEQ ID NO: 2122624 - protein, 20 aa, Cryptosporidium hominis
EGGLKIRGKPVVTHHGVIDV

SEQ ID NO: 2122625 - protein, 24 aa, Cryptosporidium hominis
EGGYFRIYDTFTWENIQICHKFGL

SEQ ID NO: 2122626 - protein, 30 aa, Cryptosporidium hominis
EGIKGGRYKGGEGWLGYMEEVPKLSIQELR

SEQ ID NO: 2122627 - protein, 26 aa, Cryptosporidium hominis
EGILVPWPWELSKYRVLDVISYNNNI

SEQ ID NO: 2122628 - protein, 21 aa, Cryptosporidium hominis
EGIQSFRIMTMIKHSPSNSQY

SEQ ID NO: 2122629 - protein, 29 aa, Cryptosporidium hominis
EGLILTYGGPRKWSLGFQILECKKIYYHQ

SEQ ID NO: 2122630 - protein, 19 aa, Cryptosporidium hominis
EGLKWICMDIEKNFDNYVE

SEQ ID NO: 2122631 - protein, 24 aa, Cryptosporidium hominis
EGLMLTECRVLYSSNLEDLNKKEN

SEQ ID NO: 2122632 - protein, 17 aa, Cryptosporidium hominis
EGMSLEITFLISSIIIC

SEQ ID NO: 2122633 - protein, 21 aa, Cryptosporidium hominis
EGNIIRDCCEYANFSNLQNIS

SEQ ID NO: 2122634 - protein, 25 aa, Cryptosporidium hominis
EGNTIIPIRTMVAINCRRWVTKDNP

SEQ ID NO: 2122635 - protein, 20 aa, Cryptosporidium hominis
EGQNIWQFIVSRSKLLYNID

SEQ ID NO: 2122636 - protein, 25 aa, Cryptosporidium hominis
EGRSCKSVIYRRADFFRRKNHKTEH

SEQ ID NO: 2122637 - protein, 24 aa, Cryptosporidium hominis
EGSPDQWLNLDWIHPMEPSCSNTE

SEQ ID NO: 2122638 - protein, 22 aa, Cryptosporidium hominis
EGTHFMLPWIERPVIFDIRARP

SEQ ID NO: 2122639 - protein, 22 aa, Cryptosporidium hominis
EGTLLKEFVKLAVDFSFLSGSS

SEQ ID NO: 2122640 - protein, 20 aa, Cryptosporidium hominis
EGVGCPNLTITSTFQFSNKN

SEQ ID NO: 2122641 - protein, 27 aa, Cryptosporidium hominis
EHDLYLKLCFELLLSFEKHSWAVSIAL

SEQ ID NO: 2122642 - protein, 18 aa, Cryptosporidium hominis
EHERRTCCKKSHSEAISR

SEQ ID NO: 2122643 - protein, 22 aa, Cryptosporidium hominis
EHFPHITLSFNPPICILYAKLY

SEQ ID NO: 2122644 - protein, 19 aa, Cryptosporidium hominis
EHFSSWKRYLNSTLTTHLH

SEQ ID NO: 2122645 - protein, 24 aa, Cryptosporidium hominis
EHILGNKCLFRLDSSNALIKKASN

SEQ ID NO: 2122646 - protein, 23 aa, Cryptosporidium hominis
EHKKYSWWVYFVVCIATQIIIGA

SEQ ID NO: 2122647 - protein, 23 aa, Cryptosporidium hominis
EHLIRFDLPDGRSLELLRDTMQE

SEQ ID NO: 2122648 - protein, 24 aa, Cryptosporidium hominis
EHMPASQFLAVFGLDDQMFVKGTC

SEQ ID NO: 2122649 - protein, 20 aa, Cryptosporidium hominis
EIAIICFDFFNLLEFYTDQY

SEQ ID NO: 2122650 - protein, 20 aa, Cryptosporidium hominis
EIALKISFHSSYTRELYYTS

SEQ ID NO: 2122651 - protein, 25 aa, Cryptosporidium hominis
EIDYNSRCFWDFDMPIPFTATSVLI

SEQ ID NO: 2122652 - protein, 25 aa, Cryptosporidium hominis
EIENALRLSQAWDFVNSFRDGLETL

SEQ ID NO: 2122653 - protein, 20 aa, Cryptosporidium hominis
EIEYSFDFVKHEWIKQTINQ

SEQ ID NO: 2122654 - protein, 24 aa, Cryptosporidium hominis
EIFDLSLLCGSLFSAFNNIKIYDL

SEQ ID NO: 2122655 - protein, 21 aa, Cryptosporidium hominis
EIFIGIAISAWKLWKTKIFIL

SEQ ID NO: 2122656 - protein, 25 aa, Cryptosporidium hominis
EIFKKWKFSIFFTLCSVLCHFTSAD

SEQ ID NO: 2122657 - protein, 18 aa, Cryptosporidium hominis
EIFMKLNLEGSQSDSTNE

SEQ ID NO: 2122658 - protein, 30 aa, Cryptosporidium hominis
EIFPSGALKLPGRHFLNALMVAGLIALGSV

SEQ ID NO: 2122659 - protein, 19 aa, Cryptosporidium hominis
EIFRECLLNGMGVVTLKDS

SEQ ID NO: 2122660 - protein, 20 aa, Cryptosporidium hominis
EIGGATALNIADLVNLPTPI

SEQ ID NO: 2122661 - protein, 19 aa, Cryptosporidium hominis
EIIIPLGGFSNENVLQTRH

SEQ ID NO: 2122662 - protein, 25 aa, Cryptosporidium hominis
EIIQGRRALGCNVFGLHYGAIGSFS

SEQ ID NO: 2122663 - protein, 25 aa, Cryptosporidium hominis
EIITFKELILLKILAFVEINKRSSQ

SEQ ID NO: 2122664 - protein, 21 aa, Cryptosporidium hominis
EILCSDLIIEFGKRISSKDRG

SEQ ID NO: 2122665 - protein, 21 aa, Cryptosporidium hominis
EILKMRKRCFGSYIENVLPEL

SEQ ID NO: 2122666 - protein, 17 aa, Cryptosporidium hominis
EILKYYLGWSSSSALGS

SEQ ID NO: 2122667 - protein, 18 aa, Cryptosporidium hominis
EILLELPSEYSWLLSNNI

SEQ ID NO: 2122668 - protein, 27 aa, Cryptosporidium hominis
EILSTRFRAFLSYFLPMVYGISLFSVA

SEQ ID NO: 2122669 - protein, 19 aa, Cryptosporidium hominis
EILYKLIKKKGLNLITSLD

SEQ ID NO: 2122670 - protein, 22 aa, Cryptosporidium hominis
EIPFRLKKDFISPLSSPVSSQA

SEQ ID NO: 2122671 - protein, 21 aa, Cryptosporidium hominis
EIPYVKGLYEKAERLGISCVA

SEQ ID NO: 2122672 - protein, 26 aa, Cryptosporidium hominis
EIRDFCEYQNNWICTKYEMLVLKLLQ

SEQ ID NO: 2122673 - protein, 27 aa, Cryptosporidium hominis
EISFYWNRPEAWEYPKNTPYHEEVENV

SEQ ID NO: 2122674 - protein, 20 aa, Cryptosporidium hominis
EISHLRIPLTENVNTKFKNT

SEQ ID NO: 2122675 - protein, 25 aa, Cryptosporidium hominis
EITEGRSSIPFGIIPDLNFHLRRYT

SEQ ID NO: 2122676 - protein, 29 aa, Cryptosporidium hominis
EITQDFGIRCPYFLTSILRSGRVGHSLKG

SEQ ID NO: 2122677 - protein, 24 aa, Cryptosporidium hominis
EITTFYKYCFNWVSQILIYSKEEI

SEQ ID NO: 2122678 - protein, 26 aa, Cryptosporidium hominis
EIVELLFGESFIKVLFSTETFSMGIN

SEQ ID NO: 2122679 - protein, 22 aa, Cryptosporidium hominis
EIWKGDIPFWKHSLAGSIAGVM

SEQ ID NO: 2122680 - protein, 27 aa, Cryptosporidium hominis
EIYKRGYCILFMRLLEIPGESVPISAI

SEQ ID NO: 2122681 - protein, 20 aa, Cryptosporidium hominis
EIYLPDGGIEFVKIGSNESN

SEQ ID NO: 2122682 - protein, 23 aa, Cryptosporidium hominis
EIYWMELIAFWVLLIMVIVLLRG

SEQ ID NO: 2122683 - protein, 32 aa, Cryptosporidium hominis
EKATLRWPSDLTFKIGLTYCLERLVYSEMGDM

SEQ ID NO: 2122684 - protein, 24 aa, Cryptosporidium hominis
EKEAKCMKQRQILICNMHISQYQD

SEQ ID NO: 2122685 - protein, 28 aa, Cryptosporidium hominis
EKEYDIGPRFGVIMQIIFASSEKHRNGN

SEQ ID NO: 2122686 - protein, 26 aa, Cryptosporidium hominis
EKFRKVGSCILGIFLFMIHNFVPDSC

SEQ ID NO: 2122687 - protein, 22 aa, Cryptosporidium hominis
EKGRNMFSFGFAGKNLNEQNNK

SEQ ID NO: 2122688 - protein, 19 aa, Cryptosporidium hominis
EKHSWAVSIALKLDGQNCK

SEQ ID NO: 2122689 - protein, 25 aa, Cryptosporidium hominis
EKIEIKVRNAGLIIDDNNSNSNNKL

SEQ ID NO: 2122690 - protein, 20 aa, Cryptosporidium hominis
EKIGPSWLKKAVSKVMSPKN

SEQ ID NO: 2122691 - protein, 23 aa, Cryptosporidium hominis
EKIIEILDIMGLRHVQDTYVGGI

SEQ ID NO: 2122692 - protein, 19 aa, Cryptosporidium hominis
EKISDLMSLTLGFKDNEIE

SEQ ID NO: 2122693 - protein, 17 aa, Cryptosporidium hominis
EKIWDRRIDNLVSDSNS

SEQ ID NO: 2122694 - protein, 26 aa, Cryptosporidium hominis
EKKEFHKEIKLCIDYYIQIITMDIFT

SEQ ID NO: 2122695 - protein, 26 aa, Cryptosporidium hominis
EKKKFNFCKSFPLFFYPLSIIMQNKM

SEQ ID NO: 2122696 - protein, 18 aa, Cryptosporidium hominis
EKKKIGFCDCNSVWTGGD

SEQ ID NO: 2122697 - protein, 18 aa, Cryptosporidium hominis
EKKMWTPFNALRSRKVGF

SEQ ID NO: 2122698 - protein, 17 aa, Cryptosporidium hominis
EKLCTIFGECGEPARER

SEQ ID NO: 2122699 - protein, 19 aa, Cryptosporidium hominis
EKLFKESYGWEIVDIGRKF

SEQ ID NO: 2122700 - protein, 25 aa, Cryptosporidium hominis
EKLLEIRTPFYLFILHTLRQHGVEY

SEQ ID NO: 2122701 - protein, 20 aa, Cryptosporidium hominis
EKLLRCESCGRNFHLDCIRN

SEQ ID NO: 2122702 - protein, 21 aa, Cryptosporidium hominis
EKLPNLEIFPLETVNSSNSKS

SEQ ID NO: 2122703 - protein, 23 aa, Cryptosporidium hominis
EKLRMKISILFASVLLDHISLQK

SEQ ID NO: 2122704 - protein, 20 aa, Cryptosporidium hominis
EKLVLMQFIRLLSSDPILSE

SEQ ID NO: 2122705 - protein, 20 aa, Cryptosporidium hominis
EKNFMCTLWLVILRTTQVRY

SEQ ID NO: 2122706 - protein, 19 aa, Cryptosporidium hominis
EKQKACKERERREREEEER

SEQ ID NO: 2122707 - protein, 21 aa, Cryptosporidium hominis
EKRALNLITVFILVLTTSCAI

SEQ ID NO: 2122708 - protein, 28 aa, Cryptosporidium hominis
EKRIYRRKYDVFPFLKFKLNNKRSKYLF

SEQ ID NO: 2122709 - protein, 19 aa, Cryptosporidium hominis
EKRLLKLKRLEEQTAALLE

SEQ ID NO: 2122710 - protein, 18 aa, Cryptosporidium hominis
EKSFKFYSHPAINISSSI

SEQ ID NO: 2122711 - protein, 18 aa, Cryptosporidium hominis
EKSSFLFIRPLRNLTSKE

SEQ ID NO: 2122712 - protein, 22 aa, Cryptosporidium hominis
EKTFLLCLSDSITSNHSIYITK

SEQ ID NO: 2122713 - protein, 26 aa, Cryptosporidium hominis
EKWYFEDLVKLCFTGFVISMVHLTYL

SEQ ID NO: 2122714 - protein, 22 aa, Cryptosporidium hominis
EKYNIWDIFSIVCDPKYKESIL

SEQ ID NO: 2122715 - protein, 22 aa, Cryptosporidium hominis
EKYWWYENEFTWSREILSRKAA

SEQ ID NO: 2122716 - protein, 18 aa, Cryptosporidium hominis
ELACGSAISTHRLSSISL

SEQ ID NO: 2122717 - protein, 18 aa, Cryptosporidium hominis
ELADPWAIKSMLTGQPLR

SEQ ID NO: 2122718 - protein, 26 aa, Cryptosporidium hominis
ELDLCLRILHIFKYESVVIVDEIDMI

SEQ ID NO: 2122719 - protein, 20 aa, Cryptosporidium hominis
ELEPRPGPGAGPGPGPGPGP

SEQ ID NO: 2122720 - protein, 24 aa, Cryptosporidium hominis
ELEQRDLFGFFGRISNFSIHTVLS

SEQ ID NO: 2122721 - protein, 25 aa, Cryptosporidium hominis
ELFDFSGEINIAFVINSGINNKLHN

SEQ ID NO: 2122722 - protein, 21 aa, Cryptosporidium hominis
ELFNIMNIYWLYKVVKNVFNP

SEQ ID NO: 2122723 - protein, 19 aa, Cryptosporidium hominis
ELFSRGLLFESLRISSNMR

SEQ ID NO: 2122724 - protein, 25 aa, Cryptosporidium hominis
ELIKESRISFDFKVFDQERKCYEIY

SEQ ID NO: 2122725 - protein, 21 aa, Cryptosporidium hominis
ELIKNIKFKNWEKIIFVIDNF

SEQ ID NO: 2122726 - protein, 19 aa, Cryptosporidium hominis
ELILCWKSLIKQDNTREAV

SEQ ID NO: 2122727 - protein, 26 aa, Cryptosporidium hominis
ELIQIFNLICYFLDLKEEIILDKNLD

SEQ ID NO: 2122728 - protein, 23 aa, Cryptosporidium hominis
ELIRKIKAIICRENRKDTTTGLF

SEQ ID NO: 2122729 - protein, 19 aa, Cryptosporidium hominis
ELIYGNGFHLYKKLDLSSE

SEQ ID NO: 2122730 - protein, 18 aa, Cryptosporidium hominis
ELIYRLASFHPSIIFVLD

SEQ ID NO: 2122731 - protein, 25 aa, Cryptosporidium hominis
ELLKSKYSTLWVRSEYQIFVTPNTV

SEQ ID NO: 2122732 - protein, 24 aa, Cryptosporidium hominis
ELNFKLKISLNHINLRYEIFSLII

SEQ ID NO: 2122733 - protein, 17 aa, Cryptosporidium hominis
ELNLRFLHLNNQPDLGI

SEQ ID NO: 2122734 - protein, 22 aa, Cryptosporidium hominis
ELNRIVKQKGLFRDRTNQIHQL

SEQ ID NO: 2122735 - protein, 20 aa, Cryptosporidium hominis
ELNSIFPLVLTFIIVLFTFF

SEQ ID NO: 2122736 - protein, 20 aa, Cryptosporidium hominis
ELNSLICLSPAFDKIIHPKI

SEQ ID NO: 2122737 - protein, 18 aa, Cryptosporidium hominis
ELPILVDYYADWCNPCKK

SEQ ID NO: 2122738 - protein, 20 aa, Cryptosporidium hominis
ELPPHPKKVLLPIIENQFVF

SEQ ID NO: 2122739 - protein, 20 aa, Cryptosporidium hominis
ELPSEYSWLLSNNITMMSKT

SEQ ID NO: 2122740 - protein, 19 aa, Cryptosporidium hominis
ELQAIFVKCGLKHQKQLNI

SEQ ID NO: 2122741 - protein, 20 aa, Cryptosporidium hominis
ELSFSDGIFTYSFDTRLLLG

SEQ ID NO: 2122742 - protein, 19 aa, Cryptosporidium hominis
ELSNLVWIQRLRKGEKKVD

SEQ ID NO: 2122743 - protein, 19 aa, Cryptosporidium hominis
ELTEKFCLREGIDRKYCKA

SEQ ID NO: 2122744 - protein, 20 aa, Cryptosporidium hominis
ELTHMGIGFITVFKAAIGTG

SEQ ID NO: 2122745 - protein, 19 aa, Cryptosporidium hominis
ELTIINWIAVFSSLYVAAV

SEQ ID NO: 2122746 - protein, 19 aa, Cryptosporidium hominis
ELVGKLYLISAGNILKTGH

SEQ ID NO: 2122747 - protein, 25 aa, Cryptosporidium hominis
ELVSLGNLCGWEFEKKNFYSQNDID

SEQ ID NO: 2122748 - protein, 25 aa, Cryptosporidium hominis
ELVYCIWSALCLVLTMGEMNVTIDP

SEQ ID NO: 2122749 - protein, 22 aa, Cryptosporidium hominis
EMARCLPCNHVFHDDCIDMWLL

SEQ ID NO: 2122750 - protein, 17 aa, Cryptosporidium hominis
EMCRRKANIRKLPAVET

SEQ ID NO: 2122751 - protein, 19 aa, Cryptosporidium hominis
EMDYVIAAVYYYFIRWQGI

SEQ ID NO: 2122752 - protein, 31 aa, Cryptosporidium hominis
EMGVTYPYYYRPFFGYGFPLLGTEPYFQSGY

SEQ ID NO: 2122753 - protein, 22 aa, Cryptosporidium hominis
EMIPFLDCYLTYLDIISTKNIE

SEQ ID NO: 2122754 - protein, 18 aa, Cryptosporidium hominis
EMNNALCECKLNKRDKSI

SEQ ID NO: 2122755 - protein, 26 aa, Cryptosporidium hominis
EMRSRTRSVLSFPRYDYEYCPHLIEY

SEQ ID NO: 2122756 - protein, 20 aa, Cryptosporidium hominis
EMSRFPTITLGFPGLKVEWE

SEQ ID NO: 2122757 - protein, 20 aa, Cryptosporidium hominis
EMTFAALTLDGWELLIDPTI

SEQ ID NO: 2122758 - protein, 18 aa, Cryptosporidium hominis
ENALKPSNFIIFITSKAF

SEQ ID NO: 2122759 - protein, 17 aa, Cryptosporidium hominis
ENCWKDHTERVGSLGEN

SEQ ID NO: 2122760 - protein, 23 aa, Cryptosporidium hominis
ENDKLRVVLSLLLHERHGQNLNQ

SEQ ID NO: 2122761 - protein, 18 aa, Cryptosporidium hominis
ENDYLFYVNVLIKTLLKS

SEQ ID NO: 2122762 - protein, 34 aa, Cryptosporidium hominis
ENEFNNKYGKIILWKRNIDNINNEHNPFCQASLK

SEQ ID NO: 2122763 - protein, 19 aa, Cryptosporidium hominis
ENEIYPFVHFFFQNLDISN

SEQ ID NO: 2122764 - protein, 22 aa, Cryptosporidium hominis
ENERESISILKLFKAISKSPMR

SEQ ID NO: 2122765 - protein, 25 aa, Cryptosporidium hominis
ENFPSAFYFEPCIKEFCVSKKSFSK

SEQ ID NO: 2122766 - protein, 21 aa, Cryptosporidium hominis
ENGICTYLMIILLNQELRNCN

SEQ ID NO: 2122767 - protein, 18 aa, Cryptosporidium hominis
ENGIWLPLNEQLSAMNPQ

SEQ ID NO: 2122768 - protein, 20 aa, Cryptosporidium hominis
ENIMIWQILFPKLIYEFFFC

SEQ ID NO: 2122769 - protein, 28 aa, Cryptosporidium hominis
ENINKWYLPQMFLEFSIYNENVDSIIRY

SEQ ID NO: 2122770 - protein, 17 aa, Cryptosporidium hominis
ENIPSPESILFSPFCNI

SEQ ID NO: 2122771 - protein, 25 aa, Cryptosporidium hominis
ENIRRIILCFIVWTLSCGILLRFDR

SEQ ID NO: 2122772 - protein, 27 aa, Cryptosporidium hominis
ENKEMPRIPLLILIRANIGVIEDESIL

SEQ ID NO: 2122773 - protein, 23 aa, Cryptosporidium hominis
ENKFAVLILPPFCNIAHWTYNSK

SEQ ID NO: 2122774 - protein, 22 aa, Cryptosporidium hominis
ENKYDYGFSFEVFKKDDNMKIT

SEQ ID NO: 2122775 - protein, 21 aa, Cryptosporidium hominis
ENLFSVIEIRSWREMTRPKSL

SEQ ID NO: 2122776 - protein, 19 aa, Cryptosporidium hominis
ENMLYKWIIAQTVTTSAGI

SEQ ID NO: 2122777 - protein, 19 aa, Cryptosporidium hominis
ENMRAAVFLSVNSVSLTLF

SEQ ID NO: 2122778 - protein, 34 aa, Cryptosporidium hominis
ENPEYLFPWGNDYLNSCLSFQCHRVREHKSWYRF

SEQ ID NO: 2122779 - protein, 20 aa, Cryptosporidium hominis
ENQTSVWLFLTASLLTSLLL

SEQ ID NO: 2122780 - protein, 20 aa, Cryptosporidium hominis
ENSLLGFGAGEYVNSESDDP

SEQ ID NO: 2122781 - protein, 25 aa, Cryptosporidium hominis
ENSPLWRIRMMRLGKCGNTYRTCFI

SEQ ID NO: 2122782 - protein, 25 aa, Cryptosporidium hominis
ENVRYELVNRITLFIDFDSDKYQFM

SEQ ID NO: 2122783 - protein, 25 aa, Cryptosporidium hominis
ENWRNSRWQFLYVLLVIIASLIGIS

SEQ ID NO: 2122784 - protein, 18 aa, Cryptosporidium hominis
EPEFNIIDTIVLEKVNHE

SEQ ID NO: 2122785 - protein, 21 aa, Cryptosporidium hominis
EPIKIFLDDYIIHFNNIDYLC

SEQ ID NO: 2122786 - protein, 25 aa, Cryptosporidium hominis
EPIQDPRLFLSLCVTQYYKHLHLYI

SEQ ID NO: 2122787 - protein, 18 aa, Cryptosporidium hominis
EPRVAQLNLLFTNLTNFP

SEQ ID NO: 2122788 - protein, 26 aa, Cryptosporidium hominis
EPYLSIRNFCLFSAASIIFTYLYVFL

SEQ ID NO: 2122789 - protein, 17 aa, Cryptosporidium hominis
EQFARKGIIPNKNNNLS

SEQ ID NO: 2122790 - protein, 19 aa, Cryptosporidium hominis
EQLELLSSIVSKFGANMRK

SEQ ID NO: 2122791 - protein, 20 aa, Cryptosporidium hominis
EQLFEHRLSVIFKQENIGVN

SEQ ID NO: 2122792 - protein, 25 aa, Cryptosporidium hominis
EQNHKFCLVLIYGHLVIMRIENICV

SEQ ID NO: 2122793 - protein, 27 aa, Cryptosporidium hominis
EQRIKFLISSKCMEMFILNLQFQDNKM

SEQ ID NO: 2122794 - protein, 24 aa, Cryptosporidium hominis
EQSFRIWLCGGEIHVVRNSLVGHI

SEQ ID NO: 2122795 - protein, 21 aa, Cryptosporidium hominis
EQVILCLRVLLLKVHYQSLMP

SEQ ID NO: 2122796 - protein, 19 aa, Cryptosporidium hominis
EQVLEAWVMVSISAKNFVS

SEQ ID NO: 2122797 - protein, 23 aa, Cryptosporidium hominis
EQWKCDSCTINLIFDEINTNFGI

SEQ ID NO: 2122798 - protein, 24 aa, Cryptosporidium hominis
EQYIFDIFCSQVLVSVIWENPSRN

SEQ ID NO: 2122799 - protein, 18 aa, Cryptosporidium hominis
ERAIKIIRKTSVSTSSNS

SEQ ID NO: 2122800 - protein, 21 aa, Cryptosporidium hominis
ERAKAHWLICLVDGMDSYLYP

SEQ ID NO: 2122801 - protein, 20 aa, Cryptosporidium hominis
ERALRLCISLLFYNFYYLSG

SEQ ID NO: 2122802 - protein, 30 aa, Cryptosporidium hominis
EREHPGRTFNCFCGYGIGLVDLTAIDGTVK

SEQ ID NO: 2122803 - protein, 18 aa, Cryptosporidium hominis
ERGFLLLALIRLSLFLPF

SEQ ID NO: 2122804 - protein, 24 aa, Cryptosporidium hominis
ERIHEILSTLSLRCIEDKHSITVR

SEQ ID NO: 2122805 - protein, 24 aa, Cryptosporidium hominis
ERILPPYWYMNWVEQTSTRSKERF

SEQ ID NO: 2122806 - protein, 23 aa, Cryptosporidium hominis
ERKCYEIYKFFGGLDKFSKIDHG

SEQ ID NO: 2122807 - protein, 19 aa, Cryptosporidium hominis
ERKMIIDHFCKLCETHKKL

SEQ ID NO: 2122808 - protein, 24 aa, Cryptosporidium hominis
ERLLNCLHYLFFILDRMDDINSKQ

SEQ ID NO: 2122809 - protein, 19 aa, Cryptosporidium hominis
ERLVALISMENINIIQVFF

SEQ ID NO: 2122810 - protein, 19 aa, Cryptosporidium hominis
ERNLRYFLLNYIVIILGMT

SEQ ID NO: 2122811 - protein, 19 aa, Cryptosporidium hominis
ERRKELWIISKSLGAITLV

SEQ ID NO: 2122812 - protein, 20 aa, Cryptosporidium hominis
ERRSGEIIFLESYQQLNYTG

SEQ ID NO: 2122813 - protein, 44 aa, Cryptosporidium hominis
ERTVNKKLIIGVVIGILLILLILMFCCVFFLRRRSDDTESAQNV

SEQ ID NO: 2122814 - protein, 21 aa, Cryptosporidium hominis
ERWTKCYLTNVSLSFHCTFFT

SEQ ID NO: 2122815 - protein, 20 aa, Cryptosporidium hominis
ESAIFSLEYFKQIGSKKDYE

SEQ ID NO: 2122816 - protein, 29 aa, Cryptosporidium hominis
ESAPELWKKLWAEKRISDVIKNCGEEEIP

SEQ ID NO: 2122817 - protein, 19 aa, Cryptosporidium hominis
ESCKSLAFNFMDSGDFYKS

SEQ ID NO: 2122818 - protein, 23 aa, Cryptosporidium hominis
ESFLEFLSNSFPMTLGLLNSEKS

SEQ ID NO: 2122819 - protein, 18 aa, Cryptosporidium hominis
ESFPIRYQLGYFSILGLL

SEQ ID NO: 2122820 - protein, 17 aa, Cryptosporidium hominis
ESGALCINMLLNILEYN

SEQ ID NO: 2122821 - protein, 18 aa, Cryptosporidium hominis
ESHFHFVKIFAHLANHLI

SEQ ID NO: 2122822 - protein, 28 aa, Cryptosporidium hominis
ESIDYYHWWFLCIDIVFSGISISQNSEL

SEQ ID NO: 2122823 - protein, 19 aa, Cryptosporidium hominis
ESILISLLERLFKCILSRK

SEQ ID NO: 2122824 - protein, 25 aa, Cryptosporidium hominis
ESILTRFRAFVAISVILEYMEPLIL

SEQ ID NO: 2122825 - protein, 24 aa, Cryptosporidium hominis
ESIQLSWNSIVFFNSSALGRFKAI

SEQ ID NO: 2122826 - protein, 17 aa, Cryptosporidium hominis
ESKCTEWERCMSQNPTI

SEQ ID NO: 2122827 - protein, 19 aa, Cryptosporidium hominis
ESKNGFVLDSVLFPCKYSF

SEQ ID NO: 2122828 - protein, 18 aa, Cryptosporidium hominis
ESLILPEFSNFSELLTAY

SEQ ID NO: 2122829 - protein, 52 aa, Cryptosporidium hominis
ESLKMLLEHYPRWIPKFFFLLNFRIPRSRFDMVMISLFWAIITFGAFKANSF

SEQ ID NO: 2122830 - protein, 19 aa, Cryptosporidium hominis
ESLLCWRFSGNLRVDSFIP

SEQ ID NO: 2122831 - protein, 24 aa, Cryptosporidium hominis
ESLLLRWVDDFLFLTSDLESAKKF

SEQ ID NO: 2122832 - protein, 45 aa, Cryptosporidium hominis
ESLRPQSAAGFSLFFQFWFWFPLVHCISLSYIPTCIVGLDDQFRV

SEQ ID NO: 2122833 - protein, 36 aa, Cryptosporidium hominis
ESLVLHKYEVPLIFACETKKLICHNTSTSNAITIQG

SEQ ID NO: 2122834 - protein, 24 aa, Cryptosporidium hominis
ESMISSCINMFFSMDMDSGEGLCL

SEQ ID NO: 2122835 - protein, 20 aa, Cryptosporidium hominis
ESMRRLKRKKSVEVEQIQIR

SEQ ID NO: 2122836 - protein, 19 aa, Cryptosporidium hominis
ESNALHWSVYYRWDDVSIH

SEQ ID NO: 2122837 - protein, 20 aa, Cryptosporidium hominis
ESNKSITFHEMWIGDQCPEI

SEQ ID NO: 2122838 - protein, 22 aa, Cryptosporidium hominis
ESNYSPEIIGVVLDPKEVTEVS

SEQ ID NO: 2122839 - protein, 25 aa, Cryptosporidium hominis
ESQMVYRILERFSVNYIRDNPTTLY

SEQ ID NO: 2122840 - protein, 24 aa, Cryptosporidium hominis
ESRPKSSLLRIVLDYIGLILYYFI

SEQ ID NO: 2122841 - protein, 22 aa, Cryptosporidium hominis
ESSELKKFVSIVFPHPKKFKPI

SEQ ID NO: 2122842 - protein, 18 aa, Cryptosporidium hominis
ESSLSYLLVQLLPGSFVN

SEQ ID NO: 2122843 - protein, 31 aa, Cryptosporidium hominis
ESTSGISRRNWLGQRFPEFKTIKSEKDITKT

SEQ ID NO: 2122844 - protein, 17 aa, Cryptosporidium hominis
ESVMPNYLNVDWDARHN

SEQ ID NO: 2122845 - protein, 21 aa, Cryptosporidium hominis
ESYETCWSIFTTILGYITMFQ

SEQ ID NO: 2122846 - protein, 19 aa, Cryptosporidium hominis
ESYNIFPTYNFLLENKEKV

SEQ ID NO: 2122847 - protein, 19 aa, Cryptosporidium hominis
ESYPEVVKNISFESINDLN

SEQ ID NO: 2122848 - protein, 17 aa, Cryptosporidium hominis
ETCGISFVVSGKQVNEI

SEQ ID NO: 2122849 - protein, 18 aa, Cryptosporidium hominis
ETDVKWELLGFQRCDQPY

SEQ ID NO: 2122850 - protein, 23 aa, Cryptosporidium hominis
ETDWKVKRALGITQHLETLDDIF

SEQ ID NO: 2122851 - protein, 21 aa, Cryptosporidium hominis
ETFGLAGLMSVQGFQTLLSTS

SEQ ID NO: 2122852 - protein, 18 aa, Cryptosporidium hominis
ETFTLAAIMPESFCSDVS

SEQ ID NO: 2122853 - protein, 20 aa, Cryptosporidium hominis
ETFYVSRYLYLVVSLLDLPY

SEQ ID NO: 2122854 - protein, 25 aa, Cryptosporidium hominis
ETGDRYICKLFREYLFQQTDSQGRP

SEQ ID NO: 2122855 - protein, 17 aa, Cryptosporidium hominis
ETGFCRNRCRIISSKSC

SEQ ID NO: 2122856 - protein, 25 aa, Cryptosporidium hominis
ETGFSLELRGCRELLMQLFHDTMDL

SEQ ID NO: 2122857 - protein, 26 aa, Cryptosporidium hominis
ETIFLTMGIVMFIFSSYVIRLLYQIN

SEQ ID NO: 2122858 - protein, 19 aa, Cryptosporidium hominis
ETIKTKLLVFSNFIEDCLK

SEQ ID NO: 2122859 - protein, 20 aa, Cryptosporidium hominis
ETISFPRLVIIRPKGLNNLK

SEQ ID NO: 2122860 - protein, 20 aa, Cryptosporidium hominis
ETLKFLLALFTISSYISGFV

SEQ ID NO: 2122861 - protein, 22 aa, Cryptosporidium hominis
ETLRKTASDWNVFFSDKNTLII

SEQ ID NO: 2122862 - protein, 22 aa, Cryptosporidium hominis
ETLSSNILPDFVKFTDFQQTLI

SEQ ID NO: 2122863 - protein, 19 aa, Cryptosporidium hominis
ETMDIVAGLRLPHYSKKDR

SEQ ID NO: 2122864 - protein, 20 aa, Cryptosporidium hominis
ETMKSLKSLINIITFLIEEN

SEQ ID NO: 2122865 - protein, 24 aa, Cryptosporidium hominis
ETPSFKFSCWRISSSSILAIQEAI

SEQ ID NO: 2122866 - protein, 26 aa, Cryptosporidium hominis
ETRIIVLRIFERLALVLFNTGLLPYF

SEQ ID NO: 2122867 - protein, 17 aa, Cryptosporidium hominis
ETRSVAVNQTTTTIENN

SEQ ID NO: 2122868 - protein, 18 aa, Cryptosporidium hominis
ETVSCFFGGHLIEKFGRR

SEQ ID NO: 2122869 - protein, 17 aa, Cryptosporidium hominis
EVCDVCNNYDLKSNKRK

SEQ ID NO: 2122870 - protein, 19 aa, Cryptosporidium hominis
EVDDFRQIIGWIKNQPWSN

SEQ ID NO: 2122871 - protein, 19 aa, Cryptosporidium hominis
EVEIRIRAIGLNFRDVLNV

SEQ ID NO: 2122872 - protein, 17 aa, Cryptosporidium hominis
EVFEIYPNTSFDLLPYD

SEQ ID NO: 2122873 - protein, 18 aa, Cryptosporidium hominis
EVFLALCNQISYYSSKFW

SEQ ID NO: 2122874 - protein, 26 aa, Cryptosporidium hominis
EVGRLNSQLSLHCRIRRVNYIPQNYE

SEQ ID NO: 2122875 - protein, 29 aa, Cryptosporidium hominis
EVIFKNVHWARTYIVGVNWIRNQLPFPNV

SEQ ID NO: 2122876 - protein, 20 aa, Cryptosporidium hominis
EVILSIPYIFERTGEEYPPI

SEQ ID NO: 2122877 - protein, 29 aa, Cryptosporidium hominis
EVKHKPILKRKFEDLKHYLEYHLYPENPQ

SEQ ID NO: 2122878 - protein, 27 aa, Cryptosporidium hominis
EVKKLYKILRKMLIKFYIEEFGIILTY

SEQ ID NO: 2122879 - protein, 17 aa, Cryptosporidium hominis
EVKSRPFEGLDISYDDF

SEQ ID NO: 2122880 - protein, 25 aa, Cryptosporidium hominis
EVKYLNEIVHAFVLIQKGFYRSAKE

SEQ ID NO: 2122881 - protein, 20 aa, Cryptosporidium hominis
EVLYECIHFGKVTIPISSVF

SEQ ID NO: 2122882 - protein, 21 aa, Cryptosporidium hominis
EVMLYWKFNISKMLNSSIGAE

SEQ ID NO: 2122883 - protein, 29 aa, Cryptosporidium hominis
EVMRRWGRLRLLADYGIHFIRHGLTPVEV

SEQ ID NO: 2122884 - protein, 25 aa, Cryptosporidium hominis
EVNCVCHLILLGFLFSIIFESIADE

SEQ ID NO: 2122885 - protein, 27 aa, Cryptosporidium hominis
EVRIPRVVIITFVFIIWIRRTNQQVIN

SEQ ID NO: 2122886 - protein, 25 aa, Cryptosporidium hominis
EVRKNSCLLPCLIYNKEGIKFISDI

SEQ ID NO: 2122887 - protein, 24 aa, Cryptosporidium hominis
EVSPAPLRRRIASQGNNYLDDMMM

SEQ ID NO: 2122888 - protein, 21 aa, Cryptosporidium hominis
EVVRKLSGSGFHWNLETELIN

SEQ ID NO: 2122889 - protein, 18 aa, Cryptosporidium hominis
EWDRICFDLLDSLKANKK

SEQ ID NO: 2122890 - protein, 19 aa, Cryptosporidium hominis
EWEGINFCINKNGKISKSK

SEQ ID NO: 2122891 - protein, 20 aa, Cryptosporidium hominis
EWGEPTNSYFGARINGEEET

SEQ ID NO: 2122892 - protein, 19 aa, Cryptosporidium hominis
EWRSGSFSLLTTILIIILK

SEQ ID NO: 2122893 - protein, 19 aa, Cryptosporidium hominis
EWVRFCVGIYDSRKKILRA

SEQ ID NO: 2122894 - protein, 20 aa, Cryptosporidium hominis
EYFCEAIYACILRVEGENGL

SEQ ID NO: 2122895 - protein, 20 aa, Cryptosporidium hominis
EYFLENWENIYLIEGVSQRI

SEQ ID NO: 2122896 - protein, 20 aa, Cryptosporidium hominis
EYIDLVAFGTIRGRTASFIA

SEQ ID NO: 2122897 - protein, 17 aa, Cryptosporidium hominis
EYILPRKTRNIFVRYYN

SEQ ID NO: 2122898 - protein, 21 aa, Cryptosporidium hominis
EYIVHITHLFLLTKRNSGVER

SEQ ID NO: 2122899 - protein, 24 aa, Cryptosporidium hominis
EYKRCKINLCNKKDRFTLFMQRIQ

SEQ ID NO: 2122900 - protein, 28 aa, Cryptosporidium hominis
EYLFFYVVKFTCIFVLLLGSFINTLQYI

SEQ ID NO: 2122901 - protein, 21 aa, Cryptosporidium hominis
EYLHPFTLKFRSEILEKKFEK

SEQ ID NO: 2122902 - protein, 19 aa, Cryptosporidium hominis
EYLPHVFQLVHRVSYGLLD

SEQ ID NO: 2122903 - protein, 20 aa, Cryptosporidium hominis
EYNIKGSVAINGFTDIDLGY

SEQ ID NO: 2122904 - protein, 22 aa, Cryptosporidium hominis
EYPGNSLYLWSFINESNAISWI

SEQ ID NO: 2122905 - protein, 25 aa, Cryptosporidium hominis
EYQIWRLATCFFFFGTFSLHFFWNA

SEQ ID NO: 2122906 - protein, 23 aa, Cryptosporidium hominis
EYSFKLDTFQAVSIGCLEIGESV

SEQ ID NO: 2122907 - protein, 23 aa, Cryptosporidium hominis
EYSKQRWTGIHNVGFYTNPKANF

SEQ ID NO: 2122908 - protein, 18 aa, Cryptosporidium hominis
FAASLGLRLVSRSNENMD

SEQ ID NO: 2122909 - protein, 20 aa, Cryptosporidium hominis
FAASLRFFASIFGYGHSYQG

SEQ ID NO: 2122910 - protein, 19 aa, Cryptosporidium hominis
FACKMCYRDYIDSLTRYDI

SEQ ID NO: 2122911 - protein, 23 aa, Cryptosporidium hominis
FAEKRNLILVFAILVNIILISMA

SEQ ID NO: 2122912 - protein, 19 aa, Cryptosporidium hominis
FAFAATIVVCAVTIYSLDK

SEQ ID NO: 2122913 - protein, 26 aa, Cryptosporidium hominis
FAFSDSFLKSVCWFAIGADAFSNGNI

SEQ ID NO: 2122914 - protein, 23 aa, Cryptosporidium hominis
FAFTLDGGRRIEVAVPKDENADK

SEQ ID NO: 2122915 - protein, 17 aa, Cryptosporidium hominis
FAGNIFLWPSFFYGSMT

SEQ ID NO: 2122916 - protein, 31 aa, Cryptosporidium hominis
FAKFKDKVLRFTLCFFDIFGLAHGKNRVNVA

SEQ ID NO: 2122917 - protein, 25 aa, Cryptosporidium hominis
FARVRSTTIPVRWYNFYGNSALNIE

SEQ ID NO: 2122918 - protein, 19 aa, Cryptosporidium hominis
FASIFIMEIVNLIYVYNLF

SEQ ID NO: 2122919 - protein, 18 aa, Cryptosporidium hominis
FASLDFSQGSLIAVYDYI

SEQ ID NO: 2122920 - protein, 20 aa, Cryptosporidium hominis
FASSFLQMLTLLCFMGAFLS

SEQ ID NO: 2122921 - protein, 18 aa, Cryptosporidium hominis
FATASSWFCAYLALFLKL

SEQ ID NO: 2122922 - protein, 24 aa, Cryptosporidium hominis
FAYGYLKFIILYFLSLVLWGLYRH

SEQ ID NO: 2122923 - protein, 17 aa, Cryptosporidium hominis
FCCKILPIIIRILNLFF

SEQ ID NO: 2122924 - protein, 17 aa, Cryptosporidium hominis
FCIPYIFCHSDVENNIF

SEQ ID NO: 2122925 - protein, 21 aa, Cryptosporidium hominis
FCKVVLELINLFSASHPSMLI

SEQ ID NO: 2122926 - protein, 33 aa, Cryptosporidium hominis
FCLHDRFHVMLSMGWGSLILFIFLIYILLAIIL

SEQ ID NO: 2122927 - protein, 17 aa, Cryptosporidium hominis
FCLISMVLSVVYRNKSS

SEQ ID NO: 2122928 - protein, 17 aa, Cryptosporidium hominis
FCLLAIIISRLRVLALP

SEQ ID NO: 2122929 - protein, 17 aa, Cryptosporidium hominis
FCMVSAIFATLFGALAL

SEQ ID NO: 2122930 - protein, 18 aa, Cryptosporidium hominis
FCNFGLLISYLFLESYLL

SEQ ID NO: 2122931 - protein, 17 aa, Cryptosporidium hominis
FCNYGKITLSAYWLPQM

SEQ ID NO: 2122932 - protein, 24 aa, Cryptosporidium hominis
FCQILKLIYNNVINKKWFEKEYQL

SEQ ID NO: 2122933 - protein, 18 aa, Cryptosporidium hominis
FCRFFQHYLQIMINPYLQ

SEQ ID NO: 2122934 - protein, 20 aa, Cryptosporidium hominis
FCRNRCRIISSKSCKTCKKA

SEQ ID NO: 2122935 - protein, 23 aa, Cryptosporidium hominis
FCVHPAPILRKHASKVFNAILEQ

SEQ ID NO: 2122936 - protein, 20 aa, Cryptosporidium hominis
FCYPFSWIDIEGIKEIPNFG

SEQ ID NO: 2122937 - protein, 23 aa, Cryptosporidium hominis
FDDLCLSGFLAVREHADLLLSLT

SEQ ID NO: 2122938 - protein, 18 aa, Cryptosporidium hominis
FDDLECFTVANVFSIFFV

SEQ ID NO: 2122939 - protein, 25 aa, Cryptosporidium hominis
FDDLYRKLPFNFKPIKLKSGSKNQS

SEQ ID NO: 2122940 - protein, 17 aa, Cryptosporidium hominis
FDFRIKNGLLYDCKINS

SEQ ID NO: 2122941 - protein, 18 aa, Cryptosporidium hominis
FDGLRIPPPKSILIHPHQ

SEQ ID NO: 2122942 - protein, 17 aa, Cryptosporidium hominis
FDHDYSSFMFDKHHTKL

SEQ ID NO: 2122943 - protein, 18 aa, Cryptosporidium hominis
FDIVFWLDIILDISNLFK

SEQ ID NO: 2122944 - protein, 29 aa, Cryptosporidium hominis
FDIYLKLELCGGCIEHFILAFQMISSIIT

SEQ ID NO: 2122945 - protein, 17 aa, Cryptosporidium hominis
FDKEFLIQMLLSFLEEN

SEQ ID NO: 2122946 - protein, 17 aa, Cryptosporidium hominis
FDLKASNIIPLIHVINY

SEQ ID NO: 2122947 - protein, 20 aa, Cryptosporidium hominis
FDLRSRISIIPQDPIIFSGT

SEQ ID NO: 2122948 - protein, 21 aa, Cryptosporidium hominis
FDLSTGFAFAAFGMIWIVLLP

SEQ ID NO: 2122949 - protein, 18 aa, Cryptosporidium hominis
FDMILRIQLQQMAERPEI

SEQ ID NO: 2122950 - protein, 18 aa, Cryptosporidium hominis
FDMPIPFTATSVLINNVL

SEQ ID NO: 2122951 - protein, 19 aa, Cryptosporidium hominis
FDNIQEIDDLLGLLKLLTT

SEQ ID NO: 2122952 - protein, 19 aa, Cryptosporidium hominis
FDNYWKFNMLLDMNNEESS

SEQ ID NO: 2122953 - protein, 19 aa, Cryptosporidium hominis
FDPVWKGAVNEMSFLNSFK

SEQ ID NO: 2122954 - protein, 19 aa, Cryptosporidium hominis
FDQNLVYRAYRVMPYSTAC

SEQ ID NO: 2122955 - protein, 25 aa, Cryptosporidium hominis
FDSRVSEHAIFCFGNNIEVIVEYLT

SEQ ID NO: 2122956 - protein, 25 aa, Cryptosporidium hominis
FDSYFKISLEVAIILLMIAYIVVFF

SEQ ID NO: 2122957 - protein, 18 aa, Cryptosporidium hominis
FDSYYKWSVQLESWDYSA

SEQ ID NO: 2122958 - protein, 19 aa, Cryptosporidium hominis
FDTHFIYILTMFIDQIKEI

SEQ ID NO: 2122959 - protein, 21 aa, Cryptosporidium hominis
FDVVACYQLIPIIGIEDNELV

SEQ ID NO: 2122960 - protein, 26 aa, Cryptosporidium hominis
FDYLKIFKIPLILFILSLISVLFVDL

SEQ ID NO: 2122961 - protein, 18 aa, Cryptosporidium hominis
FDYNRRLMSIIVHCKHND

SEQ ID NO: 2122962 - protein, 18 aa, Cryptosporidium hominis
FEDGDYGKTSGFETSSDE

SEQ ID NO: 2122963 - protein, 20 aa, Cryptosporidium hominis
FEELEILKVYEFCSKLRRMT

SEQ ID NO: 2122964 - protein, 17 aa, Cryptosporidium hominis
FEGWMIYLGYVVYTEKS

SEQ ID NO: 2122965 - protein, 18 aa, Cryptosporidium hominis
FEIDFIKKYLSKFSNKNC

SEQ ID NO: 2122966 - protein, 24 aa, Cryptosporidium hominis
FEIHYLKRRINMLSTTKRYLRDFG

SEQ ID NO: 2122967 - protein, 19 aa, Cryptosporidium hominis
FEIIEYLRFKADMKDPLII

SEQ ID NO: 2122968 - protein, 25 aa, Cryptosporidium hominis
FEILGKLPGTLIFKSLDKFPQAVQL

SEQ ID NO: 2122969 - protein, 17 aa, Cryptosporidium hominis
FEIPGVITIWNPEQLEG

SEQ ID NO: 2122970 - protein, 31 aa, Cryptosporidium hominis
FEIPNPLLFLRCLCGWLLIQSIIKEFEQNQL

SEQ ID NO: 2122971 - protein, 17 aa, Cryptosporidium hominis
FEITRATIYLGEKLTLG

SEQ ID NO: 2122972 - protein, 25 aa, Cryptosporidium hominis
FEKFPIPSWLYKLFSRLIEVDFTEY

SEQ ID NO: 2122973 - protein, 19 aa, Cryptosporidium hominis
FEKIRVLRSLFTCVLIISF

SEQ ID NO: 2122974 - protein, 17 aa, Cryptosporidium hominis
FELFLKRISSIQENGQE

SEQ ID NO: 2122975 - protein, 25 aa, Cryptosporidium hominis
FELLMVPLVLRFDNNLTYEQPFCLM

SEQ ID NO: 2122976 - protein, 26 aa, Cryptosporidium hominis
FEQYGSPLLHFLKTVAYYPFKLVVAF

SEQ ID NO: 2122977 - protein, 22 aa, Cryptosporidium hominis
FEVFKKFISYILLFLNASRTAS

SEQ ID NO: 2122978 - protein, 18 aa, Cryptosporidium hominis
FEVKKDWWRLIPTESTNS

SEQ ID NO: 2122979 - protein, 17 aa, Cryptosporidium hominis
FEWSLVLILLLAVFISY

SEQ ID NO: 2122980 - protein, 27 aa, Cryptosporidium hominis
FFAILSIVGYCIFPFTVISLISLIIPY

SEQ ID NO: 2122981 - protein, 26 aa, Cryptosporidium hominis
FFCIDRRTFRCWTNIISKLVSYDSTS

SEQ ID NO: 2122982 - protein, 17 aa, Cryptosporidium hominis
FFCLNRNGASLLPIVEQ

SEQ ID NO: 2122983 - protein, 29 aa, Cryptosporidium hominis
FFFFACALQRFVILLALLEIYSRHMGSEQ

SEQ ID NO: 2122984 - protein, 18 aa, Cryptosporidium hominis
FFFFLKFLTISFFLYYYL

SEQ ID NO: 2122985 - protein, 18 aa, Cryptosporidium hominis
FFFFLKVIWVAGQLYFLF

SEQ ID NO: 2122986 - protein, 17 aa, Cryptosporidium hominis
FFFKISVDRINSVLKPR

SEQ ID NO: 2122987 - protein, 25 aa, Cryptosporidium hominis
FFFNPESFIKMMIDSAYEIGYLLIV

SEQ ID NO: 2122988 - protein, 17 aa, Cryptosporidium hominis
FFGGHLIEKFGRRNVAI

SEQ ID NO: 2122989 - protein, 23 aa, Cryptosporidium hominis
FFGGKSRMQSPCPSSNSTNTGLK

SEQ ID NO: 2122990 - protein, 23 aa, Cryptosporidium hominis
FFGKRKARIWEIVNPQMTNTCFQ

SEQ ID NO: 2122991 - protein, 24 aa, Cryptosporidium hominis
FFGTIVICILIFWTYNVLSKVLCP

SEQ ID NO: 2122992 - protein, 20 aa, Cryptosporidium hominis
FFIFSRKILSMILLLNHILI

SEQ ID NO: 2122993 - protein, 19 aa, Cryptosporidium hominis
FFKFIQRLKFDSVSKISRV

SEQ ID NO: 2122994 - protein, 27 aa, Cryptosporidium hominis
FFKRGFLNTILFKWLSPIINSAEKGII

SEQ ID NO: 2122995 - protein, 19 aa, Cryptosporidium hominis
FFKSQRISIMLKMSGIKMY

SEQ ID NO: 2122996 - protein, 24 aa, Cryptosporidium hominis
FFLFLKSIVDFCVIEEDLKNKGFL

SEQ ID NO: 2122997 - protein, 25 aa, Cryptosporidium hominis
FFLILKLGHLLLFLLILKLLVYIYT

SEQ ID NO: 2122998 - protein, 25 aa, Cryptosporidium hominis
FFLQIFRYLLFYSLTLLSFSSSVIW

SEQ ID NO: 2122999 - protein, 25 aa, Cryptosporidium hominis
FFLSIPLFISYVVLYNLIFKIIIHH

SEQ ID NO: 2123000 - protein, 17 aa, Cryptosporidium hominis
FFNAYALLGVWRYDKGI

SEQ ID NO: 2123001 - protein, 17 aa, Cryptosporidium hominis
FFPECAVPVDMFPFTKH

SEQ ID NO: 2123002 - protein, 17 aa, Cryptosporidium hominis
FFPLEFINLVKNVNLLP

SEQ ID NO: 2123003 - protein, 23 aa, Cryptosporidium hominis
FFRGFPLCHIYPAPSIGMNRSGS

SEQ ID NO: 2123004 - protein, 17 aa, Cryptosporidium hominis
FFRKNLSLSKGFNIEPE

SEQ ID NO: 2123005 - protein, 18 aa, Cryptosporidium hominis
FFSICFLLISAATGMGVL

SEQ ID NO: 2123006 - protein, 35 aa, Cryptosporidium hominis
FFSIPRLFDFLVFLDCLFCIPLFLIVLSDLIPALI

SEQ ID NO: 2123007 - protein, 18 aa, Cryptosporidium hominis
FFVIIVHFISFSIGEQQP

SEQ ID NO: 2123008 - protein, 25 aa, Cryptosporidium hominis
FFVNLPIFFAMAITLPCFLIIWCSC

SEQ ID NO: 2123009 - protein, 19 aa, Cryptosporidium hominis
FFVQACLRSLFSPKMSDKN

SEQ ID NO: 2123010 - protein, 17 aa, Cryptosporidium hominis
FGAGEYVNSESDDPQET

SEQ ID NO: 2123011 - protein, 20 aa, Cryptosporidium hominis
FGAIRLDGETGLPLEAEDLM

SEQ ID NO: 2123012 - protein, 19 aa, Cryptosporidium hominis
FGDPLPAVFNDSYKSFKYS

SEQ ID NO: 2123013 - protein, 22 aa, Cryptosporidium hominis
FGEIRKIFLMEFIRRIKQDDAR

SEQ ID NO: 2123014 - protein, 17 aa, Cryptosporidium hominis
FGGEQYLAAVICLFIAI

SEQ ID NO: 2123015 - protein, 17 aa, Cryptosporidium hominis
FGILGGIIYERPWYFIL

SEQ ID NO: 2123016 - protein, 18 aa, Cryptosporidium hominis
FGKILFKTSYSLVYLNSK

SEQ ID NO: 2123017 - protein, 24 aa, Cryptosporidium hominis
FGKLSSLIVTWKYQKEYIQNKEFE

SEQ ID NO: 2123018 - protein, 17 aa, Cryptosporidium hominis
FGLKINNLPTIWRDSIS

SEQ ID NO: 2123019 - protein, 20 aa, Cryptosporidium hominis
FGLLPIKTIQMLKGICYLIN

SEQ ID NO: 2123020 - protein, 17 aa, Cryptosporidium hominis
FGPTFKSKARVCIFFPI

SEQ ID NO: 2123021 - protein, 20 aa, Cryptosporidium hominis
FGQFWTCRNSLDKRTSKLVI

SEQ ID NO: 2123022 - protein, 18 aa, Cryptosporidium hominis
FGRVMLGLYHIFRISINI

SEQ ID NO: 2123023 - protein, 25 aa, Cryptosporidium hominis
FGSIASFRFALAFLAPITTYIIGYF

SEQ ID NO: 2123024 - protein, 28 aa, Cryptosporidium hominis
FGTNHPKFKFLSSLWLSQTLQKLASVLF

SEQ ID NO: 2123025 - protein, 17 aa, Cryptosporidium hominis
FGYEDTRLIAYKIKSQV

SEQ ID NO: 2123026 - protein, 25 aa, Cryptosporidium hominis
FGYITCLTILLGVLCIDARLEEKKM

SEQ ID NO: 2123027 - protein, 28 aa, Cryptosporidium hominis
FGYNRAEILGALLSILLIWFMTIMLVYE

SEQ ID NO: 2123028 - protein, 24 aa, Cryptosporidium hominis
FHAEKSSKCGLNARFSSDEYDNSF

SEQ ID NO: 2123029 - protein, 17 aa, Cryptosporidium hominis
FHCSHIIMYNGVIFPVA

SEQ ID NO: 2123030 - protein, 21 aa, Cryptosporidium hominis
FHDLCELTRQLIETGSFRRKV

SEQ ID NO: 2123031 - protein, 20 aa, Cryptosporidium hominis
FHFLSKLIQIEWLYIIIMCK

SEQ ID NO: 2123032 - protein, 24 aa, Cryptosporidium hominis
FHFPLETLAGFIIAFFGLFGIFWM

SEQ ID NO: 2123033 - protein, 24 aa, Cryptosporidium hominis
FHIILPGAFKLFPDYEVKSSRIWG

SEQ ID NO: 2123034 - protein, 24 aa, Cryptosporidium hominis
FHIPQIKLVLSWISRIYGSNLTLL

SEQ ID NO: 2123035 - protein, 17 aa, Cryptosporidium hominis
FHLNNCRPIISNTNSAE

SEQ ID NO: 2123036 - protein, 19 aa, Cryptosporidium hominis
FHPLRMPKSKLEWKINPNF

SEQ ID NO: 2123037 - protein, 26 aa, Cryptosporidium hominis
FHPNKAKFALFSSWTEGCNKSFLQTL

SEQ ID NO: 2123038 - protein, 26 aa, Cryptosporidium hominis
FHPWNPEFLLSAGIDSIIKLSIITKD

SEQ ID NO: 2123039 - protein, 17 aa, Cryptosporidium hominis
FHQKCLKQWMSVKLECP

SEQ ID NO: 2123040 - protein, 27 aa, Cryptosporidium hominis
FIAKFFIAVSMVFSFPIQCHPCRRSLS

SEQ ID NO: 2123041 - protein, 26 aa, Cryptosporidium hominis
FICRKESISFIDWINRLISSKFSLDL

SEQ ID NO: 2123042 - protein, 24 aa, Cryptosporidium hominis
FIDIFCTLLPLLLFSFSRPKEYKI

SEQ ID NO: 2123043 - protein, 18 aa, Cryptosporidium hominis
FIDLKVIYYQYLIILWHY

SEQ ID NO: 2123044 - protein, 19 aa, Cryptosporidium hominis
FIDLPFMYNNAWWDSYSSI

SEQ ID NO: 2123045 - protein, 20 aa, Cryptosporidium hominis
FIDNVCNLVLCGKRSQLEDN

SEQ ID NO: 2123046 - protein, 17 aa, Cryptosporidium hominis
FIDQCWTQISAFPDSVW

SEQ ID NO: 2123047 - protein, 23 aa, Cryptosporidium hominis
FIDSIKMSGIRPVILTGDSAFTA

SEQ ID NO: 2123048 - protein, 18 aa, Cryptosporidium hominis
FIFGYVIYRGYEVCPTYS

SEQ ID NO: 2123049 - protein, 17 aa, Cryptosporidium hominis
FIFIPILICTEVFTGYI

SEQ ID NO: 2123050 - protein, 17 aa, Cryptosporidium hominis
FIFKMADIFPNKLSSLS

SEQ ID NO: 2123051 - protein, 17 aa, Cryptosporidium hominis
FIGIFIWILIKSKFHRD

SEQ ID NO: 2123052 - protein, 17 aa, Cryptosporidium hominis
FIHQLIETVEFLIGSIS

SEQ ID NO: 2123053 - protein, 17 aa, Cryptosporidium hominis
FIIYFLVIYNNEWNSLD

SEQ ID NO: 2123054 - protein, 27 aa, Cryptosporidium hominis
FIKPFLKRVNSIYSMSALILLAPTPLG

SEQ ID NO: 2123055 - protein, 25 aa, Cryptosporidium hominis
FIKRLHIEFIIPIFIYVLFYLVSIL

SEQ ID NO: 2123056 - protein, 26 aa, Cryptosporidium hominis
FIKSFTRFNPLIGRLQWNSSSPRTYR

SEQ ID NO: 2123057 - protein, 17 aa, Cryptosporidium hominis
FILRLTVFNSKPIFHNY

SEQ ID NO: 2123058 - protein, 19 aa, Cryptosporidium hominis
FILSIVVSFLYFLFNYKKN

SEQ ID NO: 2123059 - protein, 19 aa, Cryptosporidium hominis
FILVEIGGLFSVYIEILDS

SEQ ID NO: 2123060 - protein, 22 aa, Cryptosporidium hominis
FIMYIATAWRTYLELQINKGPI

SEQ ID NO: 2123061 - protein, 23 aa, Cryptosporidium hominis
FINISSFLSRIGYKFGKSKHSET

SEQ ID NO: 2123062 - protein, 19 aa, Cryptosporidium hominis
FINKVFKFNPQINWEDLPH

SEQ ID NO: 2123063 - protein, 24 aa, Cryptosporidium hominis
FINLMIKYEFLWKSWKNNNCVDIS

SEQ ID NO: 2123064 - protein, 20 aa, Cryptosporidium hominis
FINNVKLIFHYILNPRLNTL

SEQ ID NO: 2123065 - protein, 20 aa, Cryptosporidium hominis
FINPRFLVKVLEWISNACCY

SEQ ID NO: 2123066 - protein, 30 aa, Cryptosporidium hominis
FINSNDCYLLFQRWFLYFVNACKNHDRDNQ

SEQ ID NO: 2123067 - protein, 22 aa, Cryptosporidium hominis
FINTCRTLRLLFLNSQTAISDI

SEQ ID NO: 2123068 - protein, 18 aa, Cryptosporidium hominis
FINYNSICKDFGDPLNSH

SEQ ID NO: 2123069 - protein, 17 aa, Cryptosporidium hominis
FIQGFFVLFSLLLPNKI

SEQ ID NO: 2123070 - protein, 18 aa, Cryptosporidium hominis
FIRCALGGPLLGFLFGWG

SEQ ID NO: 2123071 - protein, 17 aa, Cryptosporidium hominis
FIRYFINGCRTLRSCYI

SEQ ID NO: 2123072 - protein, 21 aa, Cryptosporidium hominis
FISIIIMLLIIFVGEYNNSVI

SEQ ID NO: 2123073 - protein, 17 aa, Cryptosporidium hominis
FISIILFYIDIFQSFSY

SEQ ID NO: 2123074 - protein, 18 aa, Cryptosporidium hominis
FISLRYDFMDEVAAYDSY

SEQ ID NO: 2123075 - protein, 17 aa, Cryptosporidium hominis
FISNGWLAMYSMHFLCM

SEQ ID NO: 2123076 - protein, 21 aa, Cryptosporidium hominis
FISYLPRFIRNYFFGQSQSFI

SEQ ID NO: 2123077 - protein, 26 aa, Cryptosporidium hominis
FITHFPVIVMYLLDEWDPILRLDKFI

SEQ ID NO: 2123078 - protein, 19 aa, Cryptosporidium hominis
FITPAIYILLSFRAAPQLY

SEQ ID NO: 2123079 - protein, 18 aa, Cryptosporidium hominis
FIVNVEWFATIPKIIKNN

SEQ ID NO: 2123080 - protein, 19 aa, Cryptosporidium hominis
FIVSISWVAAMFVSPIVGF

SEQ ID NO: 2123081 - protein, 18 aa, Cryptosporidium hominis
FIVSRSKLLYNIDSPTRA

SEQ ID NO: 2123082 - protein, 22 aa, Cryptosporidium hominis
FIWYICTWFVGAHLLRIETKEG

SEQ ID NO: 2123083 - protein, 17 aa, Cryptosporidium hominis
FIYHFLVAMVMYPIICL

SEQ ID NO: 2123084 - protein, 20 aa, Cryptosporidium hominis
FIYRYHGIKLRWDVTSGVSI

SEQ ID NO: 2123085 - protein, 25 aa, Cryptosporidium hominis
FKCHGFEWLWFLALLIVISVVMFPF

SEQ ID NO: 2123086 - protein, 24 aa, Cryptosporidium hominis
FKDKLCGICMSNLVVFGLDFSLKC

SEQ ID NO: 2123087 - protein, 21 aa, Cryptosporidium hominis
FKEPFPISWVNLYWTQPPYGG

SEQ ID NO: 2123088 - protein, 28 aa, Cryptosporidium hominis
FKERRIRGKFLLILMVQLFCFFCACGSV

SEQ ID NO: 2123089 - protein, 21 aa, Cryptosporidium hominis
FKERVLWTLISLFVFLVCCQI

SEQ ID NO: 2123090 - protein, 18 aa, Cryptosporidium hominis
FKFFSRIPRSYFFSPSKR

SEQ ID NO: 2123091 - protein, 19 aa, Cryptosporidium hominis
FKFQAAISEIFRKCIQPQK

SEQ ID NO: 2123092 - protein, 20 aa, Cryptosporidium hominis
FKGQDIAPIVGMYNTLEPFV

SEQ ID NO: 2123093 - protein, 23 aa, Cryptosporidium hominis
FKGVYPLLPYFGLKADFSKKYPN

SEQ ID NO: 2123094 - protein, 17 aa, Cryptosporidium hominis
FKHLFNINSKVSRSSVI

SEQ ID NO: 2123095 - protein, 23 aa, Cryptosporidium hominis
FKIANVLCKVSFSPIPLKFDPNE

SEQ ID NO: 2123096 - protein, 26 aa, Cryptosporidium hominis
FKIGAILLCGLFVYDIFWVFGTDVMV

SEQ ID NO: 2123097 - protein, 17 aa, Cryptosporidium hominis
FKILNDFNIPILQENEK

SEQ ID NO: 2123098 - protein, 21 aa, Cryptosporidium hominis
FKILNELGLMYQVKFVSIYLM

SEQ ID NO: 2123099 - protein, 19 aa, Cryptosporidium hominis
FKINLYVRYLLLIKLIEHF

SEQ ID NO: 2123100 - protein, 24 aa, Cryptosporidium hominis
FKIQVLTLVCPISLLISSLYYLLR

SEQ ID NO: 2123101 - protein, 24 aa, Cryptosporidium hominis
FKKISVIFLFIIVILLFLNLELLY

SEQ ID NO: 2123102 - protein, 19 aa, Cryptosporidium hominis
FKKKFRSMLASDLIENIPY

SEQ ID NO: 2123103 - protein, 21 aa, Cryptosporidium hominis
FKKSLYIEIDFGKFANKKEDF

SEQ ID NO: 2123104 - protein, 25 aa, Cryptosporidium hominis
FKLGPKEEMKRLPLGDYVTYNNDLA

SEQ ID NO: 2123105 - protein, 18 aa, Cryptosporidium hominis
FKLLLLLKKDIHFLILGI

SEQ ID NO: 2123106 - protein, 22 aa, Cryptosporidium hominis
FKLNKKLIIFFEGRRVKGNKIN

SEQ ID NO: 2123107 - protein, 18 aa, Cryptosporidium hominis
FKLPAPRVQQIISEAVEV

SEQ ID NO: 2123108 - protein, 29 aa, Cryptosporidium hominis
FKMFKLGLNIQLFWFLRLNSLKFDFVSDN

SEQ ID NO: 2123109 - protein, 20 aa, Cryptosporidium hominis
FKMMVMVVGFGIFHGAVVLP

SEQ ID NO: 2123110 - protein, 20 aa, Cryptosporidium hominis
FKNEGIGGVGFVVEASESSS

SEQ ID NO: 2123111 - protein, 37 aa, Cryptosporidium hominis
FKNQHGRLGYFKSIFRITKELKLFYIALQETFYNNKS

SEQ ID NO: 2123112 - protein, 23 aa, Cryptosporidium hominis
FKPIFKGSLLIPNTNMETGIFTI

SEQ ID NO: 2123113 - protein, 21 aa, Cryptosporidium hominis
FKPNRVEYWFKLLSAKVIPKI

SEQ ID NO: 2123114 - protein, 27 aa, Cryptosporidium hominis
FKQGRQSWRLKEWHHLQSILYLIYGAG

SEQ ID NO: 2123115 - protein, 19 aa, Cryptosporidium hominis
FKQVWDFAQTTMIQDCLLR

SEQ ID NO: 2123116 - protein, 19 aa, Cryptosporidium hominis
FKRGYLYITALNSISVSLS

SEQ ID NO: 2123117 - protein, 17 aa, Cryptosporidium hominis
FKSIIGIFDGAEIGQGT

SEQ ID NO: 2123118 - protein, 22 aa, Cryptosporidium hominis
FKTSLFIVIFILNYVNINTSKS

SEQ ID NO: 2123119 - protein, 20 aa, Cryptosporidium hominis
FKTVKIGFPSIVIYEESVDK

SEQ ID NO: 2123120 - protein, 21 aa, Cryptosporidium hominis
FKVTGEFEGLMDIYLRNCHQR

SEQ ID NO: 2123121 - protein, 21 aa, Cryptosporidium hominis
FKVYIYSAYYDWRIDRIRINS

SEQ ID NO: 2123122 - protein, 22 aa, Cryptosporidium hominis
FKWRLELDESFIGGPLLDDFFE

SEQ ID NO: 2123123 - protein, 20 aa, Cryptosporidium hominis
FLAFCSSFIFGYVIYRGYEV

SEQ ID NO: 2123124 - protein, 18 aa, Cryptosporidium hominis
FLASIKFSKAMVEISSEK

SEQ ID NO: 2123125 - protein, 21 aa, Cryptosporidium hominis
FLCCSGEEILQFCKKHNITLS

SEQ ID NO: 2123126 - protein, 20 aa, Cryptosporidium hominis
FLDGKWLFNKDMRKNKNDYI

SEQ ID NO: 2123127 - protein, 20 aa, Cryptosporidium hominis
FLDILISLIDNCRRLQSEYK

SEQ ID NO: 2123128 - protein, 17 aa, Cryptosporidium hominis
FLECKKLKNKQGLCILD

SEQ ID NO: 2123129 - protein, 21 aa, Cryptosporidium hominis
FLEFIHEFGRDLVVLTHRCVN

SEQ ID NO: 2123130 - protein, 26 aa, Cryptosporidium hominis
FLEMEDISLILSLFVLAVDHLPAFLN

SEQ ID NO: 2123131 - protein, 18 aa, Cryptosporidium hominis
FLEPSLILTSGWIFIRCA

SEQ ID NO: 2123132 - protein, 27 aa, Cryptosporidium hominis
FLEQLRLPIKVKYGCIETINISIPYSN

SEQ ID NO: 2123133 - protein, 25 aa, Cryptosporidium hominis
FLFCAYSLILICIRFYKCISYSLPN

SEQ ID NO: 2123134 - protein, 26 aa, Cryptosporidium hominis
FLFKRNGPAILLRWFQASYFLQLILI

SEQ ID NO: 2123135 - protein, 23 aa, Cryptosporidium hominis
FLFSDICGFTQWAMTVEAESVVY

SEQ ID NO: 2123136 - protein, 24 aa, Cryptosporidium hominis
FLGYFMVMIPWFFSILSPQPMLLV

SEQ ID NO: 2123137 - protein, 32 aa, Cryptosporidium hominis
FLHILIGWNKFVLKKFMVYTVNSLRNLLASLD

SEQ ID NO: 2123138 - protein, 19 aa, Cryptosporidium hominis
FLIENFVIHFYLDRKIIID

SEQ ID NO: 2123139 - protein, 25 aa, Cryptosporidium hominis
FLIFVSRLSKIYIILTLTISSLSIS

SEQ ID NO: 2123140 - protein, 20 aa, Cryptosporidium hominis
FLIGCAEIYFTINSKRRVGI

SEQ ID NO: 2123141 - protein, 23 aa, Cryptosporidium hominis
FLIIICISFPFTECERIHELTKL

SEQ ID NO: 2123142 - protein, 20 aa, Cryptosporidium hominis
FLINAIECFIFPFRLIIAYF

SEQ ID NO: 2123143 - protein, 17 aa, Cryptosporidium hominis
FLINICLTKGAHYLQFI

SEQ ID NO: 2123144 - protein, 24 aa, Cryptosporidium hominis
FLISEYDYIWFLIGVIITAALCSS

SEQ ID NO: 2123145 - protein, 20 aa, Cryptosporidium hominis
FLLEYIRFLPEAVLGAIISQ

SEQ ID NO: 2123146 - protein, 24 aa, Cryptosporidium hominis
FLLIIEFMTLIILFVLVPTGGTVW

SEQ ID NO: 2123147 - protein, 17 aa, Cryptosporidium hominis
FLLSLLFFIVFLSGIYF

SEQ ID NO: 2123148 - protein, 25 aa, Cryptosporidium hominis
FLLTFKILFCIGTKQIFPIGCPLNS

SEQ ID NO: 2123149 - protein, 17 aa, Cryptosporidium hominis
FLLTSVIRSMTIIISKV

SEQ ID NO: 2123150 - protein, 24 aa, Cryptosporidium hominis
FLMFRTRRRLGLITSLLAYDDAVR

SEQ ID NO: 2123151 - protein, 23 aa, Cryptosporidium hominis
FLMTLCAAAMFPFSLRKELQTTR

SEQ ID NO: 2123152 - protein, 18 aa, Cryptosporidium hominis
FLNAMGIVLEARRSDLLI

SEQ ID NO: 2123153 - protein, 29 aa, Cryptosporidium hominis
FLNFPIERWCIGDTWPINNPKISVGQIYA

SEQ ID NO: 2123154 - protein, 19 aa, Cryptosporidium hominis
FLNGIVLNRSIPVGWDSFR

SEQ ID NO: 2123155 - protein, 26 aa, Cryptosporidium hominis
FLNLIFRKYLSLSFGDIQTVALIGSC

SEQ ID NO: 2123156 - protein, 17 aa, Cryptosporidium hominis
FLNQFGLVLATLCVSLS

SEQ ID NO: 2123157 - protein, 33 aa, Cryptosporidium hominis
FLNTLPYSLFRLRDFAEIFPVSASGKVIDSVLL

SEQ ID NO: 2123158 - protein, 24 aa, Cryptosporidium hominis
FLNVLRHLGYWLGQITIGINRPII

SEQ ID NO: 2123159 - protein, 24 aa, Cryptosporidium hominis
FLPPKIRQLLTFYIVKLCVDNHNI

SEQ ID NO: 2123160 - protein, 24 aa, Cryptosporidium hominis
FLQYPCKILPLNFADIKSKIKNSK

SEQ ID NO: 2123161 - protein, 27 aa, Cryptosporidium hominis
FLRFFTWSFCWSALILYTNLFSFFKDI

SEQ ID NO: 2123162 - protein, 26 aa, Cryptosporidium hominis
FLSFLFSIFLYKSCIEHAFQQKGGKT

SEQ ID NO: 2123163 - protein, 17 aa, Cryptosporidium hominis
FLSGRSHIGFFQSRSAL

SEQ ID NO: 2123164 - protein, 17 aa, Cryptosporidium hominis
FLSGVACSIIIKELPFM

SEQ ID NO: 2123165 - protein, 23 aa, Cryptosporidium hominis
FLSLLGTCFSFYYIVMTRLLNSP

SEQ ID NO: 2123166 - protein, 19 aa, Cryptosporidium hominis
FLSNSFPLPALAIAYACND

SEQ ID NO: 2123167 - protein, 20 aa, Cryptosporidium hominis
FLSYYNLCKSFILNNKTSIF

SEQ ID NO: 2123168 - protein, 25 aa, Cryptosporidium hominis
FLTIFCPVLLFIRGIISGVQCIYSI

SEQ ID NO: 2123169 - protein, 19 aa, Cryptosporidium hominis
FLVDLDASCIRSEIFYPIR

SEQ ID NO: 2123170 - protein, 25 aa, Cryptosporidium hominis
FLVFIPFLIVILIKRLNNHSVKIKK

SEQ ID NO: 2123171 - protein, 25 aa, Cryptosporidium hominis
FLVFPSIWLMILCKPKKYINSYRPT

SEQ ID NO: 2123172 - protein, 17 aa, Cryptosporidium hominis
FLYERLIQALKLPSPVI

SEQ ID NO: 2123173 - protein, 18 aa, Cryptosporidium hominis
FLYFDPKQPCMHDQDSSK

SEQ ID NO: 2123174 - protein, 20 aa, Cryptosporidium hominis
FLYFILRIITSFTRLFSKKN

SEQ ID NO: 2123175 - protein, 19 aa, Cryptosporidium hominis
FLYMREIRFMNVDSVQLIT

SEQ ID NO: 2123176 - protein, 18 aa, Cryptosporidium hominis
FMDKGRLSTNFDQDKQEE

SEQ ID NO: 2123177 - protein, 24 aa, Cryptosporidium hominis
FMEFIPQFIFMVGFIGYLNFLIFF

SEQ ID NO: 2123178 - protein, 17 aa, Cryptosporidium hominis
FMGFCVSGPDSILGSTA

SEQ ID NO: 2123179 - protein, 22 aa, Cryptosporidium hominis
FMGSLRLTYGIAGIIGIVLYRI

SEQ ID NO: 2123180 - protein, 18 aa, Cryptosporidium hominis
FMIFFGRNFFGFICSVFS

SEQ ID NO: 2123181 - protein, 18 aa, Cryptosporidium hominis
FMKMKRILYFILIHILIF

SEQ ID NO: 2123182 - protein, 25 aa, Cryptosporidium hominis
FMQRIRFLQHTSLIWCNTRIQFFIL

SEQ ID NO: 2123183 - protein, 20 aa, Cryptosporidium hominis
FMTSDPWFALIMFNSIMNIP

SEQ ID NO: 2123184 - protein, 18 aa, Cryptosporidium hominis
FMYYCNFFTFTIITLIMM

SEQ ID NO: 2123185 - protein, 31 aa, Cryptosporidium hominis
FNCSWIIPQWFLIYLRLSVFLYLLIMLGLDV

SEQ ID NO: 2123186 - protein, 18 aa, Cryptosporidium hominis
FNDLNRMIYLWGLITTSA

SEQ ID NO: 2123187 - protein, 22 aa, Cryptosporidium hominis
FNDRIPKNFLNEVYQVPKKLEY

SEQ ID NO: 2123188 - protein, 25 aa, Cryptosporidium hominis
FNEMIKGKSFFLGRSLTIVDLVIYI

SEQ ID NO: 2123189 - protein, 17 aa, Cryptosporidium hominis
FNFIMYIATAWRTYLEL

SEQ ID NO: 2123190 - protein, 19 aa, Cryptosporidium hominis
FNFKADFPTLTTFRVKSLM

SEQ ID NO: 2123191 - protein, 17 aa, Cryptosporidium hominis
FNFKRAPHRGGCGQDKD

SEQ ID NO: 2123192 - protein, 26 aa, Cryptosporidium hominis
FNFVWKIILFFIIWKSRNDFIKFQQY

SEQ ID NO: 2123193 - protein, 17 aa, Cryptosporidium hominis
FNFWFFGSHWLNQNTSM

SEQ ID NO: 2123194 - protein, 19 aa, Cryptosporidium hominis
FNIEYYPLWVYPALLMTIE

SEQ ID NO: 2123195 - protein, 20 aa, Cryptosporidium hominis
FNIILKIKYSSYFLALNQIL

SEQ ID NO: 2123196 - protein, 19 aa, Cryptosporidium hominis
FNKIIKCLGKYSINIYTRS

SEQ ID NO: 2123197 - protein, 17 aa, Cryptosporidium hominis
FNKSWKTLRGYNFEFFK

SEQ ID NO: 2123198 - protein, 18 aa, Cryptosporidium hominis
FNLLVLLIMIPFGYYLVE

SEQ ID NO: 2123199 - protein, 18 aa, Cryptosporidium hominis
FNNIELENTFSFLLYHYH

SEQ ID NO: 2123200 - protein, 20 aa, Cryptosporidium hominis
FNNLYFKNYVDFFMEFIPQF

SEQ ID NO: 2123201 - protein, 20 aa, Cryptosporidium hominis
FNNSLLLLSYTPFYMIEMHK

SEQ ID NO: 2123202 - protein, 27 aa, Cryptosporidium hominis
FNRKLSGEFPKFFVINSHFNENLQEWL

SEQ ID NO: 2123203 - protein, 18 aa, Cryptosporidium hominis
FNSLQIIGLILLLIKPIC

SEQ ID NO: 2123204 - protein, 18 aa, Cryptosporidium hominis
FNSNLMLSVFERYNRERE

SEQ ID NO: 2123205 - protein, 20 aa, Cryptosporidium hominis
FNSPCRRLAAARPFGSIASF

SEQ ID NO: 2123206 - protein, 17 aa, Cryptosporidium hominis
FNVHPIIQFLSYYSVSV

SEQ ID NO: 2123207 - protein, 21 aa, Cryptosporidium hominis
FNYEILCSIFEAIERIVLPPS

SEQ ID NO: 2123208 - protein, 27 aa, Cryptosporidium hominis
FNYTIFSISISFAFLAKYYFQNIRKQL

SEQ ID NO: 2123209 - protein, 25 aa, Cryptosporidium hominis
FPCDDLTGMYAFCVGSINNKNGMPS

SEQ ID NO: 2123210 - protein, 21 aa, Cryptosporidium hominis
FPDEAALCYGAQYLGVSLICL

SEQ ID NO: 2123211 - protein, 17 aa, Cryptosporidium hominis
FPEKACEKGELSSANQQ

SEQ ID NO: 2123212 - protein, 19 aa, Cryptosporidium hominis
FPGAMMFGAIRLDGETGLP

SEQ ID NO: 2123213 - protein, 25 aa, Cryptosporidium hominis
FPGITWKHSIIWISLVQFIVYIATC

SEQ ID NO: 2123214 - protein, 17 aa, Cryptosporidium hominis
FPGLIVAIARFGVGVIG

SEQ ID NO: 2123215 - protein, 18 aa, Cryptosporidium hominis
FPGSCRFSKNNIWCKLFG

SEQ ID NO: 2123216 - protein, 17 aa, Cryptosporidium hominis
FPICIPSGCFNWVGLTF

SEQ ID NO: 2123217 - protein, 20 aa, Cryptosporidium hominis
FPKKDLKHYFQLRDEVAPQN

SEQ ID NO: 2123218 - protein, 20 aa, Cryptosporidium hominis
FPKNKFKHVCNKLLTNIVLK

SEQ ID NO: 2123219 - protein, 22 aa, Cryptosporidium hominis
FPLFRLVLMGIFVLWGSGISIC

SEQ ID NO: 2123220 - protein, 17 aa, Cryptosporidium hominis
FPLNDILQTSISLYNSG

SEQ ID NO: 2123221 - protein, 26 aa, Cryptosporidium hominis
FPLPKNLEIFSWWYRFILSTPSRVFN

SEQ ID NO: 2123222 - protein, 24 aa, Cryptosporidium hominis
FPMYRIPSSSLFYVTGSWIIVFVL

SEQ ID NO: 2123223 - protein, 22 aa, Cryptosporidium hominis
FPQDEIVAIIGHEIGHWKNWDN

SEQ ID NO: 2123224 - protein, 17 aa, Cryptosporidium hominis
FPSLYFINVKRPKFVEF

SEQ ID NO: 2123225 - protein, 19 aa, Cryptosporidium hominis
FPSYSSAATRERGNHSNTG

SEQ ID NO: 2123226 - protein, 19 aa, Cryptosporidium hominis
FPTLTTFRVKSLMSGENPG

SEQ ID NO: 2123227 - protein, 25 aa, Cryptosporidium hominis
FPTTKYEEWWIFAVTKGSNPQIIGY

SEQ ID NO: 2123228 - protein, 26 aa, Cryptosporidium hominis
FPVFVSCAQQLVGMIIMSIFGLIRMA

SEQ ID NO: 2123229 - protein, 20 aa, Cryptosporidium hominis
FPVNLLPRFNPYNSGMPNFM

SEQ ID NO: 2123230 - protein, 22 aa, Cryptosporidium hominis
FPVPLFIRDEIDYQISTRMYTN

SEQ ID NO: 2123231 - protein, 25 aa, Cryptosporidium hominis
FPYIQRCPEIFYQVLNYFCVLHSIK

SEQ ID NO: 2123232 - protein, 19 aa, Cryptosporidium hominis
FPYNVYRLISKSGRFRDII

SEQ ID NO: 2123233 - protein, 22 aa, Cryptosporidium hominis
FPYSLIYYFKWFLLDTKMVSLI

SEQ ID NO: 2123234 - protein, 18 aa, Cryptosporidium hominis
FQDLKLTLFEALDSLFDS

SEQ ID NO: 2123235 - protein, 26 aa, Cryptosporidium hominis
FQDQGVVYMCGFKSYTVEKDLIELKN

SEQ ID NO: 2123236 - protein, 22 aa, Cryptosporidium hominis
FQEKKSILVFSIIVAVNIWFSN

SEQ ID NO: 2123237 - protein, 25 aa, Cryptosporidium hominis
FQFNRNSICTPELYRRLVHAKEQKA

SEQ ID NO: 2123238 - protein, 17 aa, Cryptosporidium hominis
FQFVQIFVPILLPIILC

SEQ ID NO: 2123239 - protein, 17 aa, Cryptosporidium hominis
FQGYVLFAVKWVPMMII

SEQ ID NO: 2123240 - protein, 17 aa, Cryptosporidium hominis
FQIFKNCFDHCRREKKP

SEQ ID NO: 2123241 - protein, 17 aa, Cryptosporidium hominis
FQIFPLFSLVFALLTGY

SEQ ID NO: 2123242 - protein, 21 aa, Cryptosporidium hominis
FQIVIYLPFIFLRDIENLGFL

SEQ ID NO: 2123243 - protein, 24 aa, Cryptosporidium hominis
FQIYYSEVFDLFFTEWNERKSKIL

SEQ ID NO: 2123244 - protein, 21 aa, Cryptosporidium hominis
FQLGNFFTFSGFLVGGNFLSS

SEQ ID NO: 2123245 - protein, 26 aa, Cryptosporidium hominis
FQLLPARLLITYILFWYSIPFLVFAN

SEQ ID NO: 2123246 - protein, 17 aa, Cryptosporidium hominis
FQMISLSFAEYLFEENY

SEQ ID NO: 2123247 - protein, 19 aa, Cryptosporidium hominis
FQNTFMLPDIIYLEVAMLL

SEQ ID NO: 2123248 - protein, 25 aa, Cryptosporidium hominis
FQPLAIKAFLGRLVFPELLEYSEKQ

SEQ ID NO: 2123249 - protein, 25 aa, Cryptosporidium hominis
FQQELPRLIKIIIEVILFGMKPNNQ

SEQ ID NO: 2123250 - protein, 21 aa, Cryptosporidium hominis
FQQGRCHVAILTNYVDEYTYS

SEQ ID NO: 2123251 - protein, 18 aa, Cryptosporidium hominis
FQTTVWGRNVILALVGII

SEQ ID NO: 2123252 - protein, 25 aa, Cryptosporidium hominis
FQWFALEWFLCFFVTSLPLKSIMEI

SEQ ID NO: 2123253 - protein, 18 aa, Cryptosporidium hominis
FRDDRIILMLAENIPCNT

SEQ ID NO: 2123254 - protein, 20 aa, Cryptosporidium hominis
FRDTCAMAREPMKICQEPYK

SEQ ID NO: 2123255 - protein, 33 aa, Cryptosporidium hominis
FRFFFPDSAPLSWLFFLACSSIAAYVNYLIDNN

SEQ ID NO: 2123256 - protein, 18 aa, Cryptosporidium hominis
FRFKGVKGKGRRADFQLR

SEQ ID NO: 2123257 - protein, 20 aa, Cryptosporidium hominis
FRIKNGLLYDCKINSLFTVS

SEQ ID NO: 2123258 - protein, 22 aa, Cryptosporidium hominis
FRILDKYIPLELHDSNYYENIW

SEQ ID NO: 2123259 - protein, 20 aa, Cryptosporidium hominis
FRILSGILLLFYFIIGWLGT

SEQ ID NO: 2123260 - protein, 18 aa, Cryptosporidium hominis
FRKMRKSFIWRLIPMGSM

SEQ ID NO: 2123261 - protein, 23 aa, Cryptosporidium hominis
FRKRTEIGIFWIGLLTLFLIILD

SEQ ID NO: 2123262 - protein, 22 aa, Cryptosporidium hominis
FRLDVFPFITIYIVLISILLGE

SEQ ID NO: 2123263 - protein, 19 aa, Cryptosporidium hominis
FRLIACKVSAGSIFTTGVS

SEQ ID NO: 2123264 - protein, 20 aa, Cryptosporidium hominis
FRLLSLLVILSLVFLLELTE

SEQ ID NO: 2123265 - protein, 27 aa, Cryptosporidium hominis
FRNGELLFPRLSKISIPINGPLNIRLA

SEQ ID NO: 2123266 - protein, 19 aa, Cryptosporidium hominis
FRNGNKLYPVQNLRNNSSK

SEQ ID NO: 2123267 - protein, 19 aa, Cryptosporidium hominis
FRNKIPINLLINGNLTIDT

SEQ ID NO: 2123268 - protein, 23 aa, Cryptosporidium hominis
FRQAACIFVSLAISYCMLTSRLI

SEQ ID NO: 2123269 - protein, 18 aa, Cryptosporidium hominis
FRQIIGWIKNQPWSNGKV

SEQ ID NO: 2123270 - protein, 18 aa, Cryptosporidium hominis
FRRVVHWKTSAISFEESA

SEQ ID NO: 2123271 - protein, 19 aa, Cryptosporidium hominis
FRTSSGIIFSYERKFHNEV

SEQ ID NO: 2123272 - protein, 20 aa, Cryptosporidium hominis
FRVPKSFSMKCNSSKEKFDY

SEQ ID NO: 2123273 - protein, 20 aa, Cryptosporidium hominis
FRVWMCGGFIECAPCSRVFH

SEQ ID NO: 2123274 - protein, 17 aa, Cryptosporidium hominis
FRWSSCICDRNIMIGVR

SEQ ID NO: 2123275 - protein, 20 aa, Cryptosporidium hominis
FRYEHGLGVPRSCEAAISNY

SEQ ID NO: 2123276 - protein, 18 aa, Cryptosporidium hominis
FRYIVPSVFAIFAALFVL

SEQ ID NO: 2123277 - protein, 21 aa, Cryptosporidium hominis
FRYLFCDQRNLLSFKTVLITA

SEQ ID NO: 2123278 - protein, 23 aa, Cryptosporidium hominis
FSCILNVRLLFFIFIVVNAANNS

SEQ ID NO: 2123279 - protein, 17 aa, Cryptosporidium hominis
FSDEDLDSFSYLKSTNF

SEQ ID NO: 2123280 - protein, 27 aa, Cryptosporidium hominis
FSDNSPFRIACQFSLIKCTLANIKSKC

SEQ ID NO: 2123281 - protein, 22 aa, Cryptosporidium hominis
FSEFGMPIFFYVSGRASFLSST

SEQ ID NO: 2123282 - protein, 20 aa, Cryptosporidium hominis
FSEFYYYWSKFKYNIRKFSY

SEQ ID NO: 2123283 - protein, 19 aa, Cryptosporidium hominis
FSEGFIFVCQDINIRNRIF

SEQ ID NO: 2123284 - protein, 22 aa, Cryptosporidium hominis
FSELFESCFEFKLFKKFNIDSL

SEQ ID NO: 2123285 - protein, 18 aa, Cryptosporidium hominis
FSEREEIDIAQKESSEAS

SEQ ID NO: 2123286 - protein, 26 aa, Cryptosporidium hominis
FSESTSRKWSICFSKELCGIGFKSIT

SEQ ID NO: 2123287 - protein, 18 aa, Cryptosporidium hominis
FSGFSIASIKAFAIFGIL

SEQ ID NO: 2123288 - protein, 17 aa, Cryptosporidium hominis
FSGIACWSHVNNQIIKT

SEQ ID NO: 2123289 - protein, 21 aa, Cryptosporidium hominis
FSGIHFLHAALLCRKTREWRG

SEQ ID NO: 2123290 - protein, 17 aa, Cryptosporidium hominis
FSHHLGYSHFPSDENKV

SEQ ID NO: 2123291 - protein, 27 aa, Cryptosporidium hominis
FSIASIKAFAIFGILFVFEEPYLLVST

SEQ ID NO: 2123292 - protein, 19 aa, Cryptosporidium hominis
FSIFLCYADRIIMPSCIKS

SEQ ID NO: 2123293 - protein, 25 aa, Cryptosporidium hominis
FSIIICAFLFFLSILCFPHIFHIPE

SEQ ID NO: 2123294 - protein, 17 aa, Cryptosporidium hominis
FSIYIIFYLIFFYIQVV

SEQ ID NO: 2123295 - protein, 31 aa, Cryptosporidium hominis
FSKDDIWDALNLCGLSSLIRSLPGGKMLDAV

SEQ ID NO: 2123296 - protein, 35 aa, Cryptosporidium hominis
FSKEFYSRIRIILRLSCAISPSWLQVLYHPYTCII

SEQ ID NO: 2123297 - protein, 18 aa, Cryptosporidium hominis
FSKGCIFNAAKQIIYNAY

SEQ ID NO: 2123298 - protein, 20 aa, Cryptosporidium hominis
FSKTQLQTRCRLFKTIRSAV

SEQ ID NO: 2123299 - protein, 17 aa, Cryptosporidium hominis
FSKYIVILIVLFSLNNQ

SEQ ID NO: 2123300 - protein, 24 aa, Cryptosporidium hominis
FSLIKISFWYEWIMIKIHLQLGND

SEQ ID NO: 2123301 - protein, 17 aa, Cryptosporidium hominis
FSLKSIKRISGIFEPCI

SEQ ID NO: 2123302 - protein, 23 aa, Cryptosporidium hominis
FSLLERCLQMLISRSVGKGSTLS

SEQ ID NO: 2123303 - protein, 20 aa, Cryptosporidium hominis
FSLRIFSYFRSIGVYNTIPD

SEQ ID NO: 2123304 - protein, 20 aa, Cryptosporidium hominis
FSLRKWSPLLEKFNGEVSSF

SEQ ID NO: 2123305 - protein, 19 aa, Cryptosporidium hominis
FSLSGSVLLLSTRITSPWV

SEQ ID NO: 2123306 - protein, 17 aa, Cryptosporidium hominis
FSLSSMRNFNGQPKDLD

SEQ ID NO: 2123307 - protein, 25 aa, Cryptosporidium hominis
FSLTWILYLGFYWYWIPPKSISFPI

SEQ ID NO: 2123308 - protein, 19 aa, Cryptosporidium hominis
FSLYPKHHRVREYKKTELL

SEQ ID NO: 2123309 - protein, 21 aa, Cryptosporidium hominis
FSMDDSLRFYSLINLNLMGNK

SEQ ID NO: 2123310 - protein, 22 aa, Cryptosporidium hominis
FSMSTYWMVLGKIIGKHNTENV

SEQ ID NO: 2123311 - protein, 23 aa, Cryptosporidium hominis
FSNCIRNEAPFIIKEIKDLGIKP

SEQ ID NO: 2123312 - protein, 24 aa, Cryptosporidium hominis
FSNFSELLTAYAYFLHFSGYKVIC

SEQ ID NO: 2123313 - protein, 21 aa, Cryptosporidium hominis
FSNLETCTALLFSNNLLQVPH

SEQ ID NO: 2123314 - protein, 17 aa, Cryptosporidium hominis
FSRDFFLQYQFDFTESN

SEQ ID NO: 2123315 - protein, 26 aa, Cryptosporidium hominis
FSSHIIYFSWIIFKKILWTIFYSSYS

SEQ ID NO: 2123316 - protein, 19 aa, Cryptosporidium hominis
FSSILGTRFVPLVFQSKKK

SEQ ID NO: 2123317 - protein, 23 aa, Cryptosporidium hominis
FSSNYKLFSIINMMIINENNSNI

SEQ ID NO: 2123318 - protein, 27 aa, Cryptosporidium hominis
FSSTFKIPEVWGVYKFVINHKRIGYNT

SEQ ID NO: 2123319 - protein, 21 aa, Cryptosporidium hominis
FSSVVSLGFCTLIYILMGSSG

SEQ ID NO: 2123320 - protein, 22 aa, Cryptosporidium hominis
FSSYVIRLLYQINRTSVRTHSW

SEQ ID NO: 2123321 - protein, 24 aa, Cryptosporidium hominis
FSTACICCAVTLYVLGYVKGKFCN

SEQ ID NO: 2123322 - protein, 17 aa, Cryptosporidium hominis
FSTCPTVISGRVLTTDM

SEQ ID NO: 2123323 - protein, 32 aa, Cryptosporidium hominis
FSTFFKFGSPLFRVKNIPLRFSCSRMEDSCNP

SEQ ID NO: 2123324 - protein, 25 aa, Cryptosporidium hominis
FSTLQCFSFIFSLMNGFIMDKIGVS

SEQ ID NO: 2123325 - protein, 18 aa, Cryptosporidium hominis
FSTPVCILENDFVTICNA

SEQ ID NO: 2123326 - protein, 25 aa, Cryptosporidium hominis
FSTSESFKVFLWITTIVLCVSATAG

SEQ ID NO: 2123327 - protein, 27 aa, Cryptosporidium hominis
FSTVFKEMLRISGIITVGVVRTIGNNV

SEQ ID NO: 2123328 - protein, 24 aa, Cryptosporidium hominis
FSVLCIYFGYKMKVSWYAPTFYPP

SEQ ID NO: 2123329 - protein, 20 aa, Cryptosporidium hominis
FSVTQNALWNSIEIHNKAYQ

SEQ ID NO: 2123330 - protein, 19 aa, Cryptosporidium hominis
FTAAFSMIVAGIWWILALF

SEQ ID NO: 2123331 - protein, 21 aa, Cryptosporidium hominis
FTDDLKNIWLFINNSEESLSK

SEQ ID NO: 2123332 - protein, 20 aa, Cryptosporidium hominis
FTDFVICCIVFFIGCASVLV

SEQ ID NO: 2123333 - protein, 26 aa, Cryptosporidium hominis
FTEYLSKLWPPFNMEGFKADVKTLCW

SEQ ID NO: 2123334 - protein, 18 aa, Cryptosporidium hominis
FTFCGSIYVFDSVLNKFI

SEQ ID NO: 2123335 - protein, 20 aa, Cryptosporidium hominis
FTFIFDYEIQQILNFGFFNI

SEQ ID NO: 2123336 - protein, 17 aa, Cryptosporidium hominis
FTFKNIYLPTSLLVDKS

SEQ ID NO: 2123337 - protein, 24 aa, Cryptosporidium hominis
FTFLPRYLSISVFSVVINDIDIFK

SEQ ID NO: 2123338 - protein, 19 aa, Cryptosporidium hominis
FTFQTIFRHFPLRRSFVFE

SEQ ID NO: 2123339 - protein, 23 aa, Cryptosporidium hominis
FTGESFPEFKMEKVVIPNEKSAE

SEQ ID NO: 2123340 - protein, 22 aa, Cryptosporidium hominis
FTIDGKLLRRSIVCEVKTSFET

SEQ ID NO: 2123341 - protein, 26 aa, Cryptosporidium hominis
FTIEPFKGSLGWGFYLLLLANSLLIV

SEQ ID NO: 2123342 - protein, 17 aa, Cryptosporidium hominis
FTLFMCLLQGFSERLFV

SEQ ID NO: 2123343 - protein, 20 aa, Cryptosporidium hominis
FTLSKIRNAYSYIQNPMNSS

SEQ ID NO: 2123344 - protein, 23 aa, Cryptosporidium hominis
FTLVSFPFLFGIMYGDVGHGFIV

SEQ ID NO: 2123345 - protein, 17 aa, Cryptosporidium hominis
FTNGVPIASEAKVETEN

SEQ ID NO: 2123346 - protein, 24 aa, Cryptosporidium hominis
FTPGSSWRLGGMFLSSLHVPVNPS

SEQ ID NO: 2123347 - protein, 18 aa, Cryptosporidium hominis
FTRHVYKVRSEVVKNYQR

SEQ ID NO: 2123348 - protein, 19 aa, Cryptosporidium hominis
FTSLLAHIILYWTGLSVDF

SEQ ID NO: 2123349 - protein, 18 aa, Cryptosporidium hominis
FTTIPFFISQAFYSFLYC

SEQ ID NO: 2123350 - protein, 17 aa, Cryptosporidium hominis
FTTKWLYFNGLKNIILL

SEQ ID NO: 2123351 - protein, 25 aa, Cryptosporidium hominis
FTTQHFFLHIAFCISQQFIHRSKKE

SEQ ID NO: 2123352 - protein, 17 aa, Cryptosporidium hominis
FTTSISFLFDIKYVNRL

SEQ ID NO: 2123353 - protein, 19 aa, Cryptosporidium hominis
FTVENMLIWNFLTNLIYQN

SEQ ID NO: 2123354 - protein, 19 aa, Cryptosporidium hominis
FTVISCIIVMIGFTISAFD

SEQ ID NO: 2123355 - protein, 26 aa, Cryptosporidium hominis
FTYCFTRVTIYIGYFIYLDYRFIIVF

SEQ ID NO: 2123356 - protein, 23 aa, Cryptosporidium hominis
FTYEYRKAIFYSMLEVFSHGIIP

SEQ ID NO: 2123357 - protein, 17 aa, Cryptosporidium hominis
FVCSGLLTFAHKSGGPE

SEQ ID NO: 2123358 - protein, 17 aa, Cryptosporidium hominis
FVDLFFPGITWKHSIIW

SEQ ID NO: 2123359 - protein, 23 aa, Cryptosporidium hominis
FVFDYKSKIPIFYHILEEINIIK

SEQ ID NO: 2123360 - protein, 18 aa, Cryptosporidium hominis
FVGDLAVSIFGYNSSKKL

SEQ ID NO: 2123361 - protein, 25 aa, Cryptosporidium hominis
FVGTAAYLWVCAPVTLSYYSSINNQ

SEQ ID NO: 2123362 - protein, 17 aa, Cryptosporidium hominis
FVIFLFYIINAYKSAVE

SEQ ID NO: 2123363 - protein, 18 aa, Cryptosporidium hominis
FVIIRWFMLISRMVMQLW

SEQ ID NO: 2123364 - protein, 20 aa, Cryptosporidium hominis
FVILEIKYPIAVNYLYPKKI

SEQ ID NO: 2123365 - protein, 26 aa, Cryptosporidium hominis
FVISEIYLRYLYACRIILYSKNYNLI

SEQ ID NO: 2123366 - protein, 22 aa, Cryptosporidium hominis
FVISLKPSYKFPDYNKCIDILL

SEQ ID NO: 2123367 - protein, 24 aa, Cryptosporidium hominis
FVKDQILILWGREIIGPVFELLKS

SEQ ID NO: 2123368 - protein, 22 aa, Cryptosporidium hominis
FVKKLRKLGFRVLVESGAGTKS

SEQ ID NO: 2123369 - protein, 24 aa, Cryptosporidium hominis
FVKQRKRLCIVLVQHIPTQFKYSN

SEQ ID NO: 2123370 - protein, 19 aa, Cryptosporidium hominis
FVKTLKFNNLIKCAIKGDK

SEQ ID NO: 2123371 - protein, 18 aa, Cryptosporidium hominis
FVLWGSGISICIMEYYGV

SEQ ID NO: 2123372 - protein, 18 aa, Cryptosporidium hominis
FVNMLLFGYIWRKSAGYL

SEQ ID NO: 2123373 - protein, 21 aa, Cryptosporidium hominis
FVNRPRLTVLKSFQNLKGYSM

SEQ ID NO: 2123374 - protein, 27 aa, Cryptosporidium hominis
FVPIICIFGIILPSYVYALFCHIYNST

SEQ ID NO: 2123375 - protein, 19 aa, Cryptosporidium hominis
FVQSCINSSVSILKNDKNV

SEQ ID NO: 2123376 - protein, 17 aa, Cryptosporidium hominis
FVRQCISVTTAFVRFQI

SEQ ID NO: 2123377 - protein, 18 aa, Cryptosporidium hominis
FVSALTMLVVIPMHVIPF

SEQ ID NO: 2123378 - protein, 18 aa, Cryptosporidium hominis
FVSCFNILCRSVTKEELI

SEQ ID NO: 2123379 - protein, 30 aa, Cryptosporidium hominis
FVSTCLLGSALLEWILSVVFVRQPPTTVAL

SEQ ID NO: 2123380 - protein, 17 aa, Cryptosporidium hominis
FVTRYFLIYYISPDSSY

SEQ ID NO: 2123381 - protein, 18 aa, Cryptosporidium hominis
FVVLSCYISAIGPILSSI

SEQ ID NO: 2123382 - protein, 21 aa, Cryptosporidium hominis
FWFNKECRKNVDLFHSNPSFI

SEQ ID NO: 2123383 - protein, 21 aa, Cryptosporidium hominis
FWGKICVLTSISWGPILLYKL

SEQ ID NO: 2123384 - protein, 18 aa, Cryptosporidium hominis
FWITFCFCGQPIAVLLYY

SEQ ID NO: 2123385 - protein, 25 aa, Cryptosporidium hominis
FWNVSSDTYIYWGYQNKTRTIYILG

SEQ ID NO: 2123386 - protein, 19 aa, Cryptosporidium hominis
FYAFWNWFDSRSWYPLGRI

SEQ ID NO: 2123387 - protein, 17 aa, Cryptosporidium hominis
FYATRLPYFDYQEDSSN

SEQ ID NO: 2123388 - protein, 24 aa, Cryptosporidium hominis
FYCRTRPTLMPSLNTATYGVIIEI

SEQ ID NO: 2123389 - protein, 23 aa, Cryptosporidium hominis
FYDLLFKKNRLFFKFNNISDILL

SEQ ID NO: 2123390 - protein, 24 aa, Cryptosporidium hominis
FYEGSVIRCLRRLEELLRQVASAT

SEQ ID NO: 2123391 - protein, 19 aa, Cryptosporidium hominis
FYFSMVVTISLRNSSNSGK

SEQ ID NO: 2123392 - protein, 17 aa, Cryptosporidium hominis
FYIGYNMLLNLLRLEGA

SEQ ID NO: 2123393 - protein, 19 aa, Cryptosporidium hominis
FYIVWKLLLYITLGVSIML

SEQ ID NO: 2123394 - protein, 19 aa, Cryptosporidium hominis
FYKLASVLRFISFLYCIVI

SEQ ID NO: 2123395 - protein, 18 aa, Cryptosporidium hominis
FYKNASIYRYEGYTSCNP

SEQ ID NO: 2123396 - protein, 32 aa, Cryptosporidium hominis
FYKSLSIEEFEIFKSSFLGLGKKFLNINESCR

SEQ ID NO: 2123397 - protein, 25 aa, Cryptosporidium hominis
FYMIPEFPKPSFLDSIIPSSPAQGI

SEQ ID NO: 2123398 - protein, 26 aa, Cryptosporidium hominis
FYNTLRFEVFNSFKTNILVGVPGLLY

SEQ ID NO: 2123399 - protein, 17 aa, Cryptosporidium hominis
FYPCGVATLTIFNDTFT

SEQ ID NO: 2123400 - protein, 20 aa, Cryptosporidium hominis
FYPFIPQLFLMMGREQVISS

SEQ ID NO: 2123401 - protein, 19 aa, Cryptosporidium hominis
FYQILSISFINNGPNNVNG

SEQ ID NO: 2123402 - protein, 19 aa, Cryptosporidium hominis
FYRDVLFIFVTRGILLTLC

SEQ ID NO: 2123403 - protein, 19 aa, Cryptosporidium hominis
FYRSLPITLFMNIPQTGLF

SEQ ID NO: 2123404 - protein, 18 aa, Cryptosporidium hominis
FYSHPAINISSSILVYPK

SEQ ID NO: 2123405 - protein, 18 aa, Cryptosporidium hominis
FYSQLIIRMIYLCTWMIV

SEQ ID NO: 2123406 - protein, 23 aa, Cryptosporidium hominis
FYVKSIIFLLMLDFPNNRMDKTL

SEQ ID NO: 2123407 - protein, 33 aa, Cryptosporidium hominis
GAATSAALWKAYFYRPEEMDDFTTYSMYIVTVL

SEQ ID NO: 2123408 - protein, 17 aa, Cryptosporidium hominis
GACFLLFIMTMIALLYA

SEQ ID NO: 2123409 - protein, 24 aa, Cryptosporidium hominis
GADRCILDSSFIDGKFTKINIRFI

SEQ ID NO: 2123410 - protein, 21 aa, Cryptosporidium hominis
GAIMSEHKWEIEIQSLKNDIC

SEQ ID NO: 2123411 - protein, 18 aa, Cryptosporidium hominis
GAIYQLVIFSSYFFVVHS

SEQ ID NO: 2123412 - protein, 30 aa, Cryptosporidium hominis
GAKGEVGLRLAAIYMYRFICQSNLVCGYIL

SEQ ID NO: 2123413 - protein, 26 aa, Cryptosporidium hominis
GAKPLKRLSCPAIFFDCTHDNETPCE

SEQ ID NO: 2123414 - protein, 19 aa, Cryptosporidium hominis
GALGLFGMIVGFYQLSLAD

SEQ ID NO: 2123415 - protein, 29 aa, Cryptosporidium hominis
GALVKHIPFLIALCTICNGIICITGVIYI

SEQ ID NO: 2123416 - protein, 24 aa, Cryptosporidium hominis
GAPDRIVKHIGFMLNTDWKNEEPM

SEQ ID NO: 2123417 - protein, 23 aa, Cryptosporidium hominis
GAQCVLEIKEMVAWGEFALQHTK

SEQ ID NO: 2123418 - protein, 18 aa, Cryptosporidium hominis
GAVNEMSFLNSFKMKFSV

SEQ ID NO: 2123419 - protein, 19 aa, Cryptosporidium hominis
GCEILKIFDFNGVSRSMSV

SEQ ID NO: 2123420 - protein, 19 aa, Cryptosporidium hominis
GCIAAVFGPIIIYSYNFHP

SEQ ID NO: 2123421 - protein, 17 aa, Cryptosporidium hominis
GCIGGFITSFFKGMKYS

SEQ ID NO: 2123422 - protein, 21 aa, Cryptosporidium hominis
GCLEIGESVLISAHTSAGKTC

SEQ ID NO: 2123423 - protein, 20 aa, Cryptosporidium hominis
GCMSTCKQDPFCVAWSYNAT

SEQ ID NO: 2123424 - protein, 25 aa, Cryptosporidium hominis
GCYGACVFLLLFGFGSSVFVRAIQL

SEQ ID NO: 2123425 - protein, 22 aa, Cryptosporidium hominis
GDEELIRILVSFYKFQTNTGVL

SEQ ID NO: 2123426 - protein, 25 aa, Cryptosporidium hominis
GDFMLPLRIKHWFIEIMKKNANIPL

SEQ ID NO: 2123427 - protein, 23 aa, Cryptosporidium hominis
GDIECLNLLLKRSPNLDLCDEEF

SEQ ID NO: 2123428 - protein, 21 aa, Cryptosporidium hominis
GDIPLLMNFLLRRHESNSAIS

SEQ ID NO: 2123429 - protein, 27 aa, Cryptosporidium hominis
GDIQYKFFLQLIAACICNRKLVYSDGS

SEQ ID NO: 2123430 - protein, 17 aa, Cryptosporidium hominis
GDLFDCSIIFKKCIVES

SEQ ID NO: 2123431 - protein, 23 aa, Cryptosporidium hominis
GDNIGMSKLRGTDGTFKTIDVTD

SEQ ID NO: 2123432 - protein, 24 aa, Cryptosporidium hominis
GDPFIVKWLTTRVDPNYKLETMPR

SEQ ID NO: 2123433 - protein, 32 aa, Cryptosporidium hominis
GDQPGEFKWEYGILSLCLINGDWLLIENIQDS

SEQ ID NO: 2123434 - protein, 28 aa, Cryptosporidium hominis
GDRNTLAMYMEWIWLNDHIQSVIEQGYD

SEQ ID NO: 2123435 - protein, 21 aa, Cryptosporidium hominis
GDRRKLFGINIEKLLEWSSIL

SEQ ID NO: 2123436 - protein, 20 aa, Cryptosporidium hominis
GDVESFLSFDSEFEKNEMEE

SEQ ID NO: 2123437 - protein, 25 aa, Cryptosporidium hominis
GDYSARILIDLGYFYYLYMLCLTVF

SEQ ID NO: 2123438 - protein, 29 aa, Cryptosporidium hominis
GDYSGCRRLSQMLYHYVRVTLKEPRVAQL

SEQ ID NO: 2123439 - protein, 25 aa, Cryptosporidium hominis
GECSKEFYYRIHTFVGGLEISVEDV

SEQ ID NO: 2123440 - protein, 19 aa, Cryptosporidium hominis
GEECIRWTMMNCNYKNIKV

SEQ ID NO: 2123441 - protein, 25 aa, Cryptosporidium hominis
GEEITEFFCNFFLITKKKCFIHSTS

SEQ ID NO: 2123442 - protein, 18 aa, Cryptosporidium hominis
GEELFDYNAVKNCRLAWK

SEQ ID NO: 2123443 - protein, 17 aa, Cryptosporidium hominis
GEFSLRIFSYFRSIGVY

SEQ ID NO: 2123444 - protein, 18 aa, Cryptosporidium hominis
GEGVSFPALNSIVGHHIP

SEQ ID NO: 2123445 - protein, 21 aa, Cryptosporidium hominis
GEIEIQWIIPAFYSSLSSSNS

SEQ ID NO: 2123446 - protein, 18 aa, Cryptosporidium hominis
GELLTIITRGFKSVSKLL

SEQ ID NO: 2123447 - protein, 18 aa, Cryptosporidium hominis
GELLYGLYQSYRLTNITS

SEQ ID NO: 2123448 - protein, 18 aa, Cryptosporidium hominis
GELRKAYNSSSYKFSLIA

SEQ ID NO: 2123449 - protein, 18 aa, Cryptosporidium hominis
GELVRLLYHLGVLEKYEE

SEQ ID NO: 2123450 - protein, 18 aa, Cryptosporidium hominis
GEMEIEISILPLSLAESS

SEQ ID NO: 2123451 - protein, 17 aa, Cryptosporidium hominis
GENRKQKFILFLLGILL

SEQ ID NO: 2123452 - protein, 21 aa, Cryptosporidium hominis
GENVFTWEFLEIVSQVNKLIR

SEQ ID NO: 2123453 - protein, 20 aa, Cryptosporidium hominis
GEQYLAAVICLFIAIVYALI

SEQ ID NO: 2123454 - protein, 21 aa, Cryptosporidium hominis
GESKYLWFLPLRNIIRPNFNE

SEQ ID NO: 2123455 - protein, 27 aa, Cryptosporidium hominis
GESVLPARLKYIWNCIKEFEPIDLSKI

SEQ ID NO: 2123456 - protein, 23 aa, Cryptosporidium hominis
GEYICLPDLLSITSTISNDNNSG

SEQ ID NO: 2123457 - protein, 25 aa, Cryptosporidium hominis
GEYNRCKFWWLSLVQFPECIWILYC

SEQ ID NO: 2123458 - protein, 18 aa, Cryptosporidium hominis
GFAPLPLPSLEAILEHSE

SEQ ID NO: 2123459 - protein, 28 aa, Cryptosporidium hominis
GFCGYKVFTFSSERLFIIPLCNRKTFLE

SEQ ID NO: 2123460 - protein, 19 aa, Cryptosporidium hominis
GFFSAIYSLFGLRITNFVN

SEQ ID NO: 2123461 - protein, 20 aa, Cryptosporidium hominis
GFFTGIGVTNIFSRSSNRSK

SEQ ID NO: 2123462 - protein, 20 aa, Cryptosporidium hominis
GFGFEYRGVYYFSNAHFNAN

SEQ ID NO: 2123463 - protein, 25 aa, Cryptosporidium hominis
GFIECAPCSRVFHVFRKGGVGYSSP

SEQ ID NO: 2123464 - protein, 18 aa, Cryptosporidium hominis
GFITVFKAAIGTGILFSP

SEQ ID NO: 2123465 - protein, 26 aa, Cryptosporidium hominis
GFKGRKRKNGMIGIDIDKEYIDDKDN

SEQ ID NO: 2123466 - protein, 20 aa, Cryptosporidium hominis
GFLFWSLVCNYLKPQIVLSI

SEQ ID NO: 2123467 - protein, 20 aa, Cryptosporidium hominis
GFLIGCLLTGLFLPVLKSKV

SEQ ID NO: 2123468 - protein, 18 aa, Cryptosporidium hominis
GFLSFEFLALLDLSLLSI

SEQ ID NO: 2123469 - protein, 19 aa, Cryptosporidium hominis
GFNNTKCGISIYSRPSEST

SEQ ID NO: 2123470 - protein, 21 aa, Cryptosporidium hominis
GFSRIVVISGVGVREYYANNG

SEQ ID NO: 2123471 - protein, 27 aa, Cryptosporidium hominis
GFWILSSMFFICFSLVYGTKTESDVKN

SEQ ID NO: 2123472 - protein, 19 aa, Cryptosporidium hominis
GGADMPVAISMLNSYSGWA

SEQ ID NO: 2123473 - protein, 27 aa, Cryptosporidium hominis
GGAILFGCSFSRVEARIQMKAYGSIVS

SEQ ID NO: 2123474 - protein, 22 aa, Cryptosporidium hominis
GGEAEKTIPYYVAQSQANTLQL

SEQ ID NO: 2123475 - protein, 18 aa, Cryptosporidium hominis
GGEMKRLSIALELIQNPP

SEQ ID NO: 2123476 - protein, 30 aa, Cryptosporidium hominis
GGGSGSWIQWLFKFHRISSVPLNSADDVFF

SEQ ID NO: 2123477 - protein, 21 aa, Cryptosporidium hominis
GGGSLPPMIAFSETYLEKYCY

SEQ ID NO: 2123478 - protein, 25 aa, Cryptosporidium hominis
GGIIKDSRLSKIYKIDIPYRSTFLY

SEQ ID NO: 2123479 - protein, 20 aa, Cryptosporidium hominis
GGKHPYFGILYIISGILFIL

SEQ ID NO: 2123480 - protein, 22 aa, Cryptosporidium hominis
GGKRRRKIMGGRKREMRNLRSK

SEQ ID NO: 2123481 - protein, 23 aa, Cryptosporidium hominis
GGQRSRLTLARALYGFLSDQEEY

SEQ ID NO: 2123482 - protein, 21 aa, Cryptosporidium hominis
GGTGKFWPGHTLIYIVQNEEN

SEQ ID NO: 2123483 - protein, 24 aa, Cryptosporidium hominis
GGTLPSLLLLKVIEEEFAKFSVLT

SEQ ID NO: 2123484 - protein, 27 aa, Cryptosporidium hominis
GGTRWPHQLPIRSWRVWGPSDENIKIN

SEQ ID NO: 2123485 - protein, 18 aa, Cryptosporidium hominis
GGVSLALAMSLESEDYID

SEQ ID NO: 2123486 - protein, 26 aa, Cryptosporidium hominis
GHEGCARCVCVLKDNRIVTGGLDNQI

SEQ ID NO: 2123487 - protein, 26 aa, Cryptosporidium hominis
GHLFVLHCYLVFRGVTTYEYLTKIVI

SEQ ID NO: 2123488 - protein, 33 aa, Cryptosporidium hominis
GHLQARLRLDQELRDTIDLIFQLLFGFSKHSFG

SEQ ID NO: 2123489 - protein, 24 aa, Cryptosporidium hominis
GHRAIKFSRIHGVQKRIYGEGTHF

SEQ ID NO: 2123490 - protein, 25 aa, Cryptosporidium hominis
GHSNEFDSRLGFQYFGGTRWPHQLP

SEQ ID NO: 2123491 - protein, 21 aa, Cryptosporidium hominis
GHSNFTPLLLLFEILNSPIVQ

SEQ ID NO: 2123492 - protein, 24 aa, Cryptosporidium hominis
GHWYEMAEYLGSIESCFEDEMFPN

SEQ ID NO: 2123493 - protein, 18 aa, Cryptosporidium hominis
GIAGFIICRIFLGVGEGV

SEQ ID NO: 2123494 - protein, 17 aa, Cryptosporidium hominis
GICKWIIIIAHFFCLNR

SEQ ID NO: 2123495 - protein, 17 aa, Cryptosporidium hominis
GICLCAIASVIPTEAPT

SEQ ID NO: 2123496 - protein, 18 aa, Cryptosporidium hominis
GIDCSREAINSAKKNAEN

SEQ ID NO: 2123497 - protein, 18 aa, Cryptosporidium hominis
GIEIPALMIISIFQTLST

SEQ ID NO: 2123498 - protein, 20 aa, Cryptosporidium hominis
GIFAFSGMIDIFFFKFLSSV

SEQ ID NO: 2123499 - protein, 22 aa, Cryptosporidium hominis
GIFRFYYKIILERERMNSNSTR

SEQ ID NO: 2123500 - protein, 17 aa, Cryptosporidium hominis
GIFVYRAAYFGLYDTTK

SEQ ID NO: 2123501 - protein, 23 aa, Cryptosporidium hominis
GIGCTLGFLWKLIEHAFPQQISP

SEQ ID NO: 2123502 - protein, 17 aa, Cryptosporidium hominis
GIGDLFYEPIYAVTSGR

SEQ ID NO: 2123503 - protein, 17 aa, Cryptosporidium hominis
GIIEFPIFVSWFQQLVG

SEQ ID NO: 2123504 - protein, 19 aa, Cryptosporidium hominis
GIIFPFIFYYLEFIESFNL

SEQ ID NO: 2123505 - protein, 19 aa, Cryptosporidium hominis
GIIILLIISVATLRIGVIL

SEQ ID NO: 2123506 - protein, 18 aa, Cryptosporidium hominis
GIIKYILPFYSFQMFLKD

SEQ ID NO: 2123507 - protein, 18 aa, Cryptosporidium hominis
GIISFYLSVIMCSNSPYK

SEQ ID NO: 2123508 - protein, 17 aa, Cryptosporidium hominis
GILFIGALIGTRTAGNK

SEQ ID NO: 2123509 - protein, 18 aa, Cryptosporidium hominis
GILIEPYDTYGLEDDELD

SEQ ID NO: 2123510 - protein, 18 aa, Cryptosporidium hominis
GILLEFKGRYIYFCKGAE

SEQ ID NO: 2123511 - protein, 25 aa, Cryptosporidium hominis
GILNGTFCTRGFFIGSIINVHVVGD

SEQ ID NO: 2123512 - protein, 25 aa, Cryptosporidium hominis
GILVGWIAYCILNISKITLDTAMGF

SEQ ID NO: 2123513 - protein, 17 aa, Cryptosporidium hominis
GINICFDTHFIYILTMF

SEQ ID NO: 2123514 - protein, 17 aa, Cryptosporidium hominis
GINSCLRGRKDDEIFSL

SEQ ID NO: 2123515 - protein, 19 aa, Cryptosporidium hominis
GIPEILPQEFLRLSNPSIS

SEQ ID NO: 2123516 - protein, 26 aa, Cryptosporidium hominis
GIPSCLVIGFFFCNFGLLISYLFLES

SEQ ID NO: 2123517 - protein, 23 aa, Cryptosporidium hominis
GIPSFPLVHWSQRECQTLFRLKS

SEQ ID NO: 2123518 - protein, 28 aa, Cryptosporidium hominis
GIPSTRSKLFLILRIRYRILKLKNEDKD

SEQ ID NO: 2123519 - protein, 18 aa, Cryptosporidium hominis
GISAILASTFIKYISTEL

SEQ ID NO: 2123520 - protein, 22 aa, Cryptosporidium hominis
GISNIHSLIGFAERNKSNIEIC

SEQ ID NO: 2123521 - protein, 22 aa, Cryptosporidium hominis
GISSFIPLVSIFKVKRNITPRC

SEQ ID NO: 2123522 - protein, 17 aa, Cryptosporidium hominis
GITKCLFVTEAEFITEI

SEQ ID NO: 2123523 - protein, 27 aa, Cryptosporidium hominis
GIVICVFCYSYFIGCSFSLFTSAFGYT

SEQ ID NO: 2123524 - protein, 17 aa, Cryptosporidium hominis
GIVSLAFQEWVEGIGIL

SEQ ID NO: 2123525 - protein, 20 aa, Cryptosporidium hominis
GIYLCMVVGIGLPLMQEGLL

SEQ ID NO: 2123526 - protein, 25 aa, Cryptosporidium hominis
GIYPSIKMILGRSGRRRTIEDNPEN

SEQ ID NO: 2123527 - protein, 20 aa, Cryptosporidium hominis
GKALALRLAKLSKESNITLS

SEQ ID NO: 2123528 - protein, 19 aa, Cryptosporidium hominis
GKDYCGWIVSDLFSPIGMN

SEQ ID NO: 2123529 - protein, 28 aa, Cryptosporidium hominis
GKETLGELAERVWGRSGLILVDTSIFLS

SEQ ID NO: 2123530 - protein, 30 aa, Cryptosporidium hominis
GKFKEYRMAVYLSICFEMVSLFILTQFIFQ

SEQ ID NO: 2123531 - protein, 21 aa, Cryptosporidium hominis
GKFPTNYIKLIVILMITIFVV

SEQ ID NO: 2123532 - protein, 23 aa, Cryptosporidium hominis
GKFSCYFYYWSFCQCSKPWKLKF

SEQ ID NO: 2123533 - protein, 24 aa, Cryptosporidium hominis
GKGRRGTRFSIIWRKPEEDKERTN

SEQ ID NO: 2123534 - protein, 22 aa, Cryptosporidium hominis
GKGVLFFGVMFWSLCMIFTSFL

SEQ ID NO: 2123535 - protein, 28 aa, Cryptosporidium hominis
GKHKLRAGMICWIECFFVLFQGGANYLY

SEQ ID NO: 2123536 - protein, 31 aa, Cryptosporidium hominis
GKINIQYLPSCIMISVGCPSKHYIKMLEHFF

SEQ ID NO: 2123537 - protein, 28 aa, Cryptosporidium hominis
GKLCGKEPILRFDFLVSQLMSSSSQNDI

SEQ ID NO: 2123538 - protein, 17 aa, Cryptosporidium hominis
GKLPLSEEVELNQTAEC

SEQ ID NO: 2123539 - protein, 21 aa, Cryptosporidium hominis
GKLPRYPVPGMRYDELSESDG

SEQ ID NO: 2123540 - protein, 20 aa, Cryptosporidium hominis
GKNFDILKCICVCIFTSVFG

SEQ ID NO: 2123541 - protein, 30 aa, Cryptosporidium hominis
GKRSQFMLSKSFLFKILLLVLNLIPVTLLT

SEQ ID NO: 2123542 - protein, 19 aa, Cryptosporidium hominis
GKSSILKLILRLYDPDKGK

SEQ ID NO: 2123543 - protein, 19 aa, Cryptosporidium hominis
GKVLLGFALYNKAKYQSQS

SEQ ID NO: 2123544 - protein, 20 aa, Cryptosporidium hominis
GKVRLPLSVVLFGYGIMMDY

SEQ ID NO: 2123545 - protein, 23 aa, Cryptosporidium hominis
GLCSSAVEWERFLILVNKKDFLP

SEQ ID NO: 2123546 - protein, 18 aa, Cryptosporidium hominis
GLFAGWPGIGACRPILCE

SEQ ID NO: 2123547 - protein, 21 aa, Cryptosporidium hominis
GLFCVPISIILPALFHLTLFK

SEQ ID NO: 2123548 - protein, 23 aa, Cryptosporidium hominis
GLFCVPLNILLPALFHFIIFRKE

SEQ ID NO: 2123549 - protein, 23 aa, Cryptosporidium hominis
GLFSYEDFMDWHSKKGLTRRALS

SEQ ID NO: 2123550 - protein, 20 aa, Cryptosporidium hominis
GLGDRGRLGYTRGHTEFGNE

SEQ ID NO: 2123551 - protein, 19 aa, Cryptosporidium hominis
GLGERLAFEGIKIGIELSM

SEQ ID NO: 2123552 - protein, 25 aa, Cryptosporidium hominis
GLGIGWKLLAAVGFTAIVLQIISII

SEQ ID NO: 2123553 - protein, 17 aa, Cryptosporidium hominis
GLIFICIDYLIRTSNFS

SEQ ID NO: 2123554 - protein, 23 aa, Cryptosporidium hominis
GLIPSLLTILSCEYSIHSQSFRR

SEQ ID NO: 2123555 - protein, 18 aa, Cryptosporidium hominis
GLIQRCLIHQIRAYSELK

SEQ ID NO: 2123556 - protein, 18 aa, Cryptosporidium hominis
GLISLLRIRTFISSHPDN

SEQ ID NO: 2123557 - protein, 17 aa, Cryptosporidium hominis
GLKVEWEPAQYLYKKYR

SEQ ID NO: 2123558 - protein, 27 aa, Cryptosporidium hominis
GLLDGFFEFCDFFRQLLMTPIMFILYL

SEQ ID NO: 2123559 - protein, 23 aa, Cryptosporidium hominis
GLLGDCLNRISADHGRPLVGQIS

SEQ ID NO: 2123560 - protein, 18 aa, Cryptosporidium hominis
GLLILPIITARTMFELLE

SEQ ID NO: 2123561 - protein, 18 aa, Cryptosporidium hominis
GLLKSDLPPKVLDLNSER

SEQ ID NO: 2123562 - protein, 18 aa, Cryptosporidium hominis
GLLLGLFVHLLSVYDFYF

SEQ ID NO: 2123563 - protein, 18 aa, Cryptosporidium hominis
GLLLNPRKPHFETIQEQG

SEQ ID NO: 2123564 - protein, 31 aa, Cryptosporidium hominis
GLLMPRIYTLFIHILGLRCMVPVSHSDLEDL

SEQ ID NO: 2123565 - protein, 23 aa, Cryptosporidium hominis
GLLPCALIGHILSIFGYTLMFLL

SEQ ID NO: 2123566 - protein, 19 aa, Cryptosporidium hominis
GLMDIYLRNCHQRLADQRI

SEQ ID NO: 2123567 - protein, 24 aa, Cryptosporidium hominis
GLMLEFINSYLFLGANKFYLYQNY

SEQ ID NO: 2123568 - protein, 19 aa, Cryptosporidium hominis
GLMLTAALMRYIAHQLGLL

SEQ ID NO: 2123569 - protein, 18 aa, Cryptosporidium hominis
GLMTLCYAGAHPEKVLKV

SEQ ID NO: 2123570 - protein, 24 aa, Cryptosporidium hominis
GLNFRDVLNVMGLYPGDPGKPGSD

SEQ ID NO: 2123571 - protein, 18 aa, Cryptosporidium hominis
GLNLRRVIFNDIGTSSGT

SEQ ID NO: 2123572 - protein, 17 aa, Cryptosporidium hominis
GLPCPKLLDSSPCNADI

SEQ ID NO: 2123573 - protein, 21 aa, Cryptosporidium hominis
GLSHTLSGLSLDDMKDTSEDQ

SEQ ID NO: 2123574 - protein, 24 aa, Cryptosporidium hominis
GLSKFLSYFQWRDFIFGQEHILGN

SEQ ID NO: 2123575 - protein, 17 aa, Cryptosporidium hominis
GLSTIFGGITHETNLFF

SEQ ID NO: 2123576 - protein, 22 aa, Cryptosporidium hominis
GLTICSIFSGFGLHITKFLSPF

SEQ ID NO: 2123577 - protein, 36 aa, Cryptosporidium hominis
GLTWQEVHKGAFIYELGDFGGLIVMANDLKHTNQVI

SEQ ID NO: 2123578 - protein, 28 aa, Cryptosporidium hominis
GLYHIFRISINIILFIWSSLLLRLSLWI

SEQ ID NO: 2123579 - protein, 22 aa, Cryptosporidium hominis
GLYWAFIFFFIFLKTGQLTNIS

SEQ ID NO: 2123580 - protein, 20 aa, Cryptosporidium hominis
GMIDIFFFKFLSSVNKYRQK

SEQ ID NO: 2123581 - protein, 23 aa, Cryptosporidium hominis
GMNRSGSIFARIGAKGKAALDDT

SEQ ID NO: 2123582 - protein, 19 aa, Cryptosporidium hominis
GMQSRGGNGPGDMNSGMGE

SEQ ID NO: 2123583 - protein, 21 aa, Cryptosporidium hominis
GMRHFPIKKLIALIQSHSDSR

SEQ ID NO: 2123584 - protein, 26 aa, Cryptosporidium hominis
GMRNAEVIKAFIWNKDYKKLTPQPVP

SEQ ID NO: 2123585 - protein, 32 aa, Cryptosporidium hominis
GMSICTPIEFGGSFDIPKGWVSIATASLQLNK

SEQ ID NO: 2123586 - protein, 20 aa, Cryptosporidium hominis
GMVGAMLRHFSSLRKMKRDN

SEQ ID NO: 2123587 - protein, 19 aa, Cryptosporidium hominis
GNDTFPLFKIIQDEKKYYV

SEQ ID NO: 2123588 - protein, 25 aa, Cryptosporidium hominis
GNFRYICSWAKLLGLTISSFLFIWV

SEQ ID NO: 2123589 - protein, 17 aa, Cryptosporidium hominis
GNGPGDMNSGMGEGVMG

SEQ ID NO: 2123590 - protein, 19 aa, Cryptosporidium hominis
GNIFLWPSFFYGSMTVKIY

SEQ ID NO: 2123591 - protein, 24 aa, Cryptosporidium hominis
GNIIRYKYTFYKYVKYSLIIDLIL

SEQ ID NO: 2123592 - protein, 17 aa, Cryptosporidium hominis
GNINFGYGIEEEQEEEN

SEQ ID NO: 2123593 - protein, 23 aa, Cryptosporidium hominis
GNINRPLLFHFLRQLISENRNQN

SEQ ID NO: 2123594 - protein, 27 aa, Cryptosporidium hominis
GNIVTRLKSYLALKLPEKFTQPSNSLR

SEQ ID NO: 2123595 - protein, 17 aa, Cryptosporidium hominis
GNKFLASNGYIFVAKIL

SEQ ID NO: 2123596 - protein, 24 aa, Cryptosporidium hominis
GNLHPLNVGLVFKVYKELNYHDIQ

SEQ ID NO: 2123597 - protein, 20 aa, Cryptosporidium hominis
GNLRFDVIYRNELITQITWY

SEQ ID NO: 2123598 - protein, 21 aa, Cryptosporidium hominis
GNNSIFMWVILGFIVLLLTLI

SEQ ID NO: 2123599 - protein, 22 aa, Cryptosporidium hominis
GNPGRRWCWKFVKHAQVSYFAF

SEQ ID NO: 2123600 - protein, 17 aa, Cryptosporidium hominis
GNSDWALMQGNQISESE

SEQ ID NO: 2123601 - protein, 18 aa, Cryptosporidium hominis
GNSGKLWVRGDISAGEVV

SEQ ID NO: 2123602 - protein, 22 aa, Cryptosporidium hominis
GNSIKFGKRFLSLFKQDFGIPQ

SEQ ID NO: 2123603 - protein, 20 aa, Cryptosporidium hominis
GNSLLSMLLGIHLVASIGGA

SEQ ID NO: 2123604 - protein, 31 aa, Cryptosporidium hominis
GNTAFQICWTRKNYWLALMLNFWYYHNKLFG

SEQ ID NO: 2123605 - protein, 28 aa, Cryptosporidium hominis
GNTGRIPIPIKFGFGPLFDSVFQDELQE

SEQ ID NO: 2123606 - protein, 24 aa, Cryptosporidium hominis
GNTLKSSDILSMFGTQSLTVVIAK

SEQ ID NO: 2123607 - protein, 18 aa, Cryptosporidium hominis
GNVETVFELLMVPLVLRF

SEQ ID NO: 2123608 - protein, 17 aa, Cryptosporidium hominis
GNVHKYGYYFIKVNVGF

SEQ ID NO: 2123609 - protein, 18 aa, Cryptosporidium hominis
GNVNYKLPYILKSSFTSD

SEQ ID NO: 2123610 - protein, 24 aa, Cryptosporidium hominis
GPAKKCFKVLIKYIPVFVSSDNEL

SEQ ID NO: 2123611 - protein, 17 aa, Cryptosporidium hominis
GPDSVGFSREYRPCYTH

SEQ ID NO: 2123612 - protein, 18 aa, Cryptosporidium hominis
GPFFFRFFSNNSFILTFF

SEQ ID NO: 2123613 - protein, 23 aa, Cryptosporidium hominis
GPGPRVGAVGPGFTMNQSGSGSG

SEQ ID NO: 2123614 - protein, 24 aa, Cryptosporidium hominis
GPIIRAFRAQDHYMLQGTEIIDMV

SEQ ID NO: 2123615 - protein, 19 aa, Cryptosporidium hominis
GPLPLRRVVTILSSITLAF

SEQ ID NO: 2123616 - protein, 23 aa, Cryptosporidium hominis
GPNGRINYALSFPNIEKAAYKGP

SEQ ID NO: 2123617 - protein, 23 aa, Cryptosporidium hominis
GPTSMKVGIGLPSFLVSKKYQLF

SEQ ID NO: 2123618 - protein, 21 aa, Cryptosporidium hominis
GPTYFPHFHPLRMPKSKLEWK

SEQ ID NO: 2123619 - protein, 24 aa, Cryptosporidium hominis
GQFCDQCLNLIRYLDSNDFRVKSY

SEQ ID NO: 2123620 - protein, 25 aa, Cryptosporidium hominis
GQGLSKLYVILNMLGIFELLFRSFG

SEQ ID NO: 2123621 - protein, 19 aa, Cryptosporidium hominis
GQILWDMASKFSHIPQHFS

SEQ ID NO: 2123622 - protein, 19 aa, Cryptosporidium hominis
GQLLYKTVHSFSNISQYSV

SEQ ID NO: 2123623 - protein, 17 aa, Cryptosporidium hominis
GQLSFISFFLLTGGSWS

SEQ ID NO: 2123624 - protein, 19 aa, Cryptosporidium hominis
GQTPLHLAVLIGNEEVIME

SEQ ID NO: 2123625 - protein, 17 aa, Cryptosporidium hominis
GRGYKRCLLLQTGELLR

SEQ ID NO: 2123626 - protein, 24 aa, Cryptosporidium hominis
GRKKIEDFAPFAFFTTSKGSGGIN

SEQ ID NO: 2123627 - protein, 27 aa, Cryptosporidium hominis
GRLIVFAFLWFFGFDFWILPNLFDEDT

SEQ ID NO: 2123628 - protein, 21 aa, Cryptosporidium hominis
GRLNFDFCRWVISNIDGNSIG

SEQ ID NO: 2123629 - protein, 23 aa, Cryptosporidium hominis
GRMRELFKVGNLIEVVYNQEEEG

SEQ ID NO: 2123630 - protein, 24 aa, Cryptosporidium hominis
GRPYSPAYTRGWYVQPRKFSAHDI

SEQ ID NO: 2123631 - protein, 17 aa, Cryptosporidium hominis
GRSDRIFHYKRHGKKLS

SEQ ID NO: 2123632 - protein, 17 aa, Cryptosporidium hominis
GRSGLILVDTSIFLSQL

SEQ ID NO: 2123633 - protein, 22 aa, Cryptosporidium hominis
GRSSIDFENKFAIKLLELSEKG

SEQ ID NO: 2123634 - protein, 37 aa, Cryptosporidium hominis
GRTCDSCLYVRLIAFECIKECMKRCIWTQKIDLSQIM

SEQ ID NO: 2123635 - protein, 19 aa, Cryptosporidium hominis
GRTPLFYAISQLDIGLVNY

SEQ ID NO: 2123636 - protein, 25 aa, Cryptosporidium hominis
GRVGIQRYFVWSIVQLGEFPDELYN

SEQ ID NO: 2123637 - protein, 26 aa, Cryptosporidium hominis
GRVKYWMMLCEAVGNFYHWLSIIKET

SEQ ID NO: 2123638 - protein, 18 aa, Cryptosporidium hominis
GSAAYFIDKIQKILRLIS

SEQ ID NO: 2123639 - protein, 17 aa, Cryptosporidium hominis
GSEIGLKTSDKWTKYLI

SEQ ID NO: 2123640 - protein, 18 aa, Cryptosporidium hominis
GSFFALGLINAGYMDQKS

SEQ ID NO: 2123641 - protein, 20 aa, Cryptosporidium hominis
GSFGKVFLVRERCSGLTRVC

SEQ ID NO: 2123642 - protein, 19 aa, Cryptosporidium hominis
GSFSFKRGYLYITALNSIS

SEQ ID NO: 2123643 - protein, 19 aa, Cryptosporidium hominis
GSFVKPWVPFVMGLSTEKH

SEQ ID NO: 2123644 - protein, 20 aa, Cryptosporidium hominis
GSGATFWSSPSFTRASFTRV

SEQ ID NO: 2123645 - protein, 21 aa, Cryptosporidium hominis
GSGFYTLIGILSLTFAELIVL

SEQ ID NO: 2123646 - protein, 27 aa, Cryptosporidium hominis
GSIEFYLCILFSIALIFFGGILSGLTT

SEQ ID NO: 2123647 - protein, 25 aa, Cryptosporidium hominis
GSIIRAFRCGHVFLNRNINYIDNLQ

SEQ ID NO: 2123648 - protein, 17 aa, Cryptosporidium hominis
GSIPSIIRAMSINMGML

SEQ ID NO: 2123649 - protein, 25 aa, Cryptosporidium hominis
GSIQILLCTISLYLTQSTYFSLMSL

SEQ ID NO: 2123650 - protein, 24 aa, Cryptosporidium hominis
GSKIKDLRLFDAKWNMWQWKVTAN

SEQ ID NO: 2123651 - protein, 21 aa, Cryptosporidium hominis
GSKYKDIFTLIPYVKDKKEIQ

SEQ ID NO: 2123652 - protein, 31 aa, Cryptosporidium hominis
GSLRKMYRYVMDFLEEFGMRYCDYVFVNSIF

SEQ ID NO: 2123653 - protein, 21 aa, Cryptosporidium hominis
GSLSMKSSSTGLRYSVSNSIQ

SEQ ID NO: 2123654 - protein, 20 aa, Cryptosporidium hominis
GSNFKHLNWYHLYPRTSEMV

SEQ ID NO: 2123655 - protein, 18 aa, Cryptosporidium hominis
GSNPDFIKWCESKGSSAQ

SEQ ID NO: 2123656 - protein, 17 aa, Cryptosporidium hominis
GSQIASRIHQDFLTRIN

SEQ ID NO: 2123657 - protein, 24 aa, Cryptosporidium hominis
GSRFREFTLEYALREINKLTSALC

SEQ ID NO: 2123658 - protein, 22 aa, Cryptosporidium hominis
GSRGKSGVLYHLDFNTLGQVQC

SEQ ID NO: 2123659 - protein, 28 aa, Cryptosporidium hominis
GSSDFYFKLSLIELKAVGGFGAGQAESS

SEQ ID NO: 2123660 - protein, 24 aa, Cryptosporidium hominis
GSSISYILCCLYYNFLDLNPEIQN

SEQ ID NO: 2123661 - protein, 19 aa, Cryptosporidium hominis
GSSLLRFLECKKLKNKQGL

SEQ ID NO: 2123662 - protein, 28 aa, Cryptosporidium hominis
GSYISGLTCMGFLFANFRLRLLSRISSL

SEQ ID NO: 2123663 - protein, 22 aa, Cryptosporidium hominis
GTEILRVFCGSPSVPSQAMEMT

SEQ ID NO: 2123664 - protein, 17 aa, Cryptosporidium hominis
GTEMAFRALDNVLQYSS

SEQ ID NO: 2123665 - protein, 34 aa, Cryptosporidium hominis
GTGALGLIIAEWLIKYKKIRNIILLSRSGLPSKR

SEQ ID NO: 2123666 - protein, 21 aa, Cryptosporidium hominis
GTHTIYWWLYILAIGAGFLNM

SEQ ID NO: 2123667 - protein, 24 aa, Cryptosporidium hominis
GTILKCFKPKINGIYEGVISSSAD

SEQ ID NO: 2123668 - protein, 18 aa, Cryptosporidium hominis
GTLYFKTKYPWYDYLAVI

SEQ ID NO: 2123669 - protein, 17 aa, Cryptosporidium hominis
GTMGGNNSEMWVGGGNV

SEQ ID NO: 2123670 - protein, 17 aa, Cryptosporidium hominis
GTNYRVATLEGNEKNVN

SEQ ID NO: 2123671 - protein, 19 aa, Cryptosporidium hominis
GTPVYLSDWIFIYELLTGY

SEQ ID NO: 2123672 - protein, 23 aa, Cryptosporidium hominis
GTYKRIPAQLVDRILAEEANWSL

SEQ ID NO: 2123673 - protein, 21 aa, Cryptosporidium hominis
GVFSLPTFHFWILDNNSYILV

SEQ ID NO: 2123674 - protein, 24 aa, Cryptosporidium hominis
GVFVSIRISPRWIINNDVRQSRIS

SEQ ID NO: 2123675 - protein, 19 aa, Cryptosporidium hominis
GVICIMVQFGCRNQLQAAG

SEQ ID NO: 2123676 - protein, 18 aa, Cryptosporidium hominis
GVIKPCRENFFLIVCMMS

SEQ ID NO: 2123677 - protein, 26 aa, Cryptosporidium hominis
GVKFYAFECGKGYSECSIWGIDGLPN

SEQ ID NO: 2123678 - protein, 24 aa, Cryptosporidium hominis
GVKHLKCGDEVYAMVPGCLNTFIV

SEQ ID NO: 2123679 - protein, 17 aa, Cryptosporidium hominis
GVLDCFFSDVDLISKIY

SEQ ID NO: 2123680 - protein, 20 aa, Cryptosporidium hominis
GVLPIGRPGLAVATIPISNF

SEQ ID NO: 2123681 - protein, 22 aa, Cryptosporidium hominis
GVLQLLLPFVGWIWAIVWGIAI

SEQ ID NO: 2123682 - protein, 17 aa, Cryptosporidium hominis
GVLREHIIILIGKISPK

SEQ ID NO: 2123683 - protein, 24 aa, Cryptosporidium hominis
GVLSRLDILLLFILPFNNITLFNS

SEQ ID NO: 2123684 - protein, 19 aa, Cryptosporidium hominis
GVMAPHIQSSVSMPHGVSG

SEQ ID NO: 2123685 - protein, 21 aa, Cryptosporidium hominis
GVPPKGTWVSWMHCIALVLGR

SEQ ID NO: 2123686 - protein, 26 aa, Cryptosporidium hominis
GVRLIAIENIEAFFLQVFELANSNKE

SEQ ID NO: 2123687 - protein, 21 aa, Cryptosporidium hominis
GVVGSVLYIPISLMRAIEYYH

SEQ ID NO: 2123688 - protein, 18 aa, Cryptosporidium hominis
GVVGWEFHPTLMEFDFPS

SEQ ID NO: 2123689 - protein, 18 aa, Cryptosporidium hominis
GVVYSFRLSILYTAITFL

SEQ ID NO: 2123690 - protein, 17 aa, Cryptosporidium hominis
GWGGFYCSYPYLSSQSI

SEQ ID NO: 2123691 - protein, 20 aa, Cryptosporidium hominis
GWISLKRFSHHLGYSHFPSD

SEQ ID NO: 2123692 - protein, 26 aa, Cryptosporidium hominis
GWIVSDLFSPIGMNWISTVSPELGMI

SEQ ID NO: 2123693 - protein, 18 aa, Cryptosporidium hominis
GWMIYLGYVVYTEKSPCA

SEQ ID NO: 2123694 - protein, 17 aa, Cryptosporidium hominis
GWRSSKWRSTKFSSEAS

SEQ ID NO: 2123695 - protein, 23 aa, Cryptosporidium hominis
GYFSNLIPYELLFTSLMSHCDVN

SEQ ID NO: 2123696 - protein, 24 aa, Cryptosporidium hominis
GYGSPRSPCCLITNYFTPITVISG

SEQ ID NO: 2123697 - protein, 18 aa, Cryptosporidium hominis
GYGYKCTHILSIDDILRY

SEQ ID NO: 2123698 - protein, 18 aa, Cryptosporidium hominis
GYIKLALHSGKKGTCGIL

SEQ ID NO: 2123699 - protein, 30 aa, Cryptosporidium hominis
GYITYSCAYLLCIILICFFLYPSWSLYVHI

SEQ ID NO: 2123700 - protein, 20 aa, Cryptosporidium hominis
GYKMRYDGVITLTTLYEYMF

SEQ ID NO: 2123701 - protein, 26 aa, Cryptosporidium hominis
GYKNPQCVPLTILENGCPMKQVGFKV

SEQ ID NO: 2123702 - protein, 23 aa, Cryptosporidium hominis
GYLIFRISVIVGLLIVAIILYIY

SEQ ID NO: 2123703 - protein, 34 aa, Cryptosporidium hominis
GYLSSLLHPIAHKMWGCVKYGHYYDSAGNNPLHL

SEQ ID NO: 2123704 - protein, 26 aa, Cryptosporidium hominis
GYLTWEWEPCVSLRSIIHPLIFTICY

SEQ ID NO: 2123705 - protein, 18 aa, Cryptosporidium hominis
GYNFSRCYVFILTIFFGF

SEQ ID NO: 2123706 - protein, 18 aa, Cryptosporidium hominis
GYTIVFALDNCEPIIIGA

SEQ ID NO: 2123707 - protein, 21 aa, Cryptosporidium hominis
GYTSSILNWIDSIGIWNRIVF

SEQ ID NO: 2123708 - protein, 26 aa, Cryptosporidium hominis
HANEVCGLIKLIRIIFSIFTYSVFIL

SEQ ID NO: 2123709 - protein, 20 aa, Cryptosporidium hominis
HASLTFRIIYYYGGGAADFL

SEQ ID NO: 2123710 - protein, 17 aa, Cryptosporidium hominis
HAVFAAFFFFNYRSNSY

SEQ ID NO: 2123711 - protein, 24 aa, Cryptosporidium hominis
HAYKNNLLMVSCIFISSNYEELDP

SEQ ID NO: 2123712 - protein, 17 aa, Cryptosporidium hominis
HCLIPKLRFEIAPNQNV

SEQ ID NO: 2123713 - protein, 21 aa, Cryptosporidium hominis
HCLSELLSLPCLKSRSICPSE

SEQ ID NO: 2123714 - protein, 25 aa, Cryptosporidium hominis
HDHHCPWLGVCIGEYNRCKFWWLSL

SEQ ID NO: 2123715 - protein, 23 aa, Cryptosporidium hominis
HDLDLAYYLAHCFEGQATMLYYF

SEQ ID NO: 2123716 - protein, 18 aa, Cryptosporidium hominis
HDPHIYNGVLAYWSLQCL

SEQ ID NO: 2123717 - protein, 18 aa, Cryptosporidium hominis
HDQFNAVCTVAFDTYGKS

SEQ ID NO: 2123718 - protein, 17 aa, Cryptosporidium hominis
HDTERFFMTLSIAEAEL

SEQ ID NO: 2123719 - protein, 26 aa, Cryptosporidium hominis
HEDCIRLSSFLTRFISDSIEIIFEPE

SEQ ID NO: 2123720 - protein, 23 aa, Cryptosporidium hominis
HEFNISTYFLWKVLSNDLIINIY

SEQ ID NO: 2123721 - protein, 23 aa, Cryptosporidium hominis
HELSVCVRPWWGEPIQNGNLGNK

SEQ ID NO: 2123722 - protein, 17 aa, Cryptosporidium hominis
HEMCKKYNLSNRVELLG

SEQ ID NO: 2123723 - protein, 19 aa, Cryptosporidium hominis
HEVLEKWNLPIIGILNKNH

SEQ ID NO: 2123724 - protein, 20 aa, Cryptosporidium hominis
HFCKLCETHKKLLINQNDVK

SEQ ID NO: 2123725 - protein, 24 aa, Cryptosporidium hominis
HFDSLKYKLECISFSKTCKNYTKI

SEQ ID NO: 2123726 - protein, 23 aa, Cryptosporidium hominis
HFFLQVVILLSINGSSLGKEPDL

SEQ ID NO: 2123727 - protein, 19 aa, Cryptosporidium hominis
HFIEVCYRWTGPDKNQVFV

SEQ ID NO: 2123728 - protein, 24 aa, Cryptosporidium hominis
HFIQIKNSWAFFIYLIFFTSIFLI

SEQ ID NO: 2123729 - protein, 25 aa, Cryptosporidium hominis
HFPLFMAAITFIWAVSDSLCLYFTH

SEQ ID NO: 2123730 - protein, 20 aa, Cryptosporidium hominis
HFPVFPGFNPWIMKNILFIP

SEQ ID NO: 2123731 - protein, 23 aa, Cryptosporidium hominis
HFSSCTILSIAHRIHTIIDYDLI

SEQ ID NO: 2123732 - protein, 20 aa, Cryptosporidium hominis
HFVYLLIRNVVSFKFQAAIS

SEQ ID NO: 2123733 - protein, 22 aa, Cryptosporidium hominis
HGDFPKTATWHIMKLGDVTLFL

SEQ ID NO: 2123734 - protein, 22 aa, Cryptosporidium hominis
HGEKKVEYEITDGLNNEQSLDI

SEQ ID NO: 2123735 - protein, 25 aa, Cryptosporidium hominis
HGISCCLLRIFGLAHFVDFLSDSVL

SEQ ID NO: 2123736 - protein, 23 aa, Cryptosporidium hominis
HGMGACIMTAIWLVQDLKSNLGD

SEQ ID NO: 2123737 - protein, 31 aa, Cryptosporidium hominis
HGNVIRYMFCKGLQYPTSGWLRLNHLNCGVT

SEQ ID NO: 2123738 - protein, 34 aa, Cryptosporidium hominis
HGPHARLASILLPLIKKYRVDFIISGHDHHSEIL

SEQ ID NO: 2123739 - protein, 25 aa, Cryptosporidium hominis
HGSTFRYKKLVGMLLESRGEIEKAL

SEQ ID NO: 2123740 - protein, 21 aa, Cryptosporidium hominis
HGTFFWILKRYILPWDTYSDY

SEQ ID NO: 2123741 - protein, 24 aa, Cryptosporidium hominis
HGTYMAHIPLMFSRKYIQEKKEEM

SEQ ID NO: 2123742 - protein, 17 aa, Cryptosporidium hominis
HHCPWIGQCVGLYNRKY

SEQ ID NO: 2123743 - protein, 17 aa, Cryptosporidium hominis
HHFRFSTQIKYFLISIF

SEQ ID NO: 2123744 - protein, 23 aa, Cryptosporidium hominis
HHHHHHHHHGYKPHKTTTTTTTS

SEQ ID NO: 2123745 - protein, 19 aa, Cryptosporidium hominis
HHSALRALISYSLVLLCGI

SEQ ID NO: 2123746 - protein, 24 aa, Cryptosporidium hominis
HIATRFGAILGLGLMDSGGRNVKA

SEQ ID NO: 2123747 - protein, 19 aa, Cryptosporidium hominis
HIILYWTGLSVDFFGFITA

SEQ ID NO: 2123748 - protein, 18 aa, Cryptosporidium hominis
HIIRTCLRIKYMKNYIKF

SEQ ID NO: 2123749 - protein, 25 aa, Cryptosporidium hominis
HIITFSGTFLISFLVFIPFLIVILI

SEQ ID NO: 2123750 - protein, 21 aa, Cryptosporidium hominis
HIKESSSFFFNTYRNFKSKEY

SEQ ID NO: 2123751 - protein, 21 aa, Cryptosporidium hominis
HIKRLKFPIYSIITQFTENYQ

SEQ ID NO: 2123752 - protein, 17 aa, Cryptosporidium hominis
HILIRYRYEIHSFYCNI

SEQ ID NO: 2123753 - protein, 22 aa, Cryptosporidium hominis
HINLLKILRQVELMTCLSSAYL

SEQ ID NO: 2123754 - protein, 17 aa, Cryptosporidium hominis
HINLRYEIFSLIINHVL

SEQ ID NO: 2123755 - protein, 24 aa, Cryptosporidium hominis
HIRQMAFYRYLRCLEAGGKEAQTI

SEQ ID NO: 2123756 - protein, 17 aa, Cryptosporidium hominis
HIYCFNLLVLLIMIPFG

SEQ ID NO: 2123757 - protein, 24 aa, Cryptosporidium hominis
HIYTSMKMLLERNQSVFSAESSNH

SEQ ID NO: 2123758 - protein, 25 aa, Cryptosporidium hominis
HKDDSVYEIFKWIDSLALDENNLIS

SEQ ID NO: 2123759 - protein, 23 aa, Cryptosporidium hominis
HKDPFIVSGSYSFQGVESGLIYR

SEQ ID NO: 2123760 - protein, 25 aa, Cryptosporidium hominis
HKEELRKLFGPESVTVPILYSNKGP

SEQ ID NO: 2123761 - protein, 17 aa, Cryptosporidium hominis
HKFNDWLPKDIFPGRIE

SEQ ID NO: 2123762 - protein, 25 aa, Cryptosporidium hominis
HKKSAYCWNYEISIQFSDLEVFCQS

SEQ ID NO: 2123763 - protein, 20 aa, Cryptosporidium hominis
HKKYPILRPKYNIREKNKVK

SEQ ID NO: 2123764 - protein, 23 aa, Cryptosporidium hominis
HKPLYRLVDEVSYNTPYEYFNVV

SEQ ID NO: 2123765 - protein, 27 aa, Cryptosporidium hominis
HLDNELGWYWYHLGIYNLILIKIIYLN

SEQ ID NO: 2123766 - protein, 32 aa, Cryptosporidium hominis
HLDTAYIWLYLRLEVIGCMTLVVTGIFSVLLS

SEQ ID NO: 2123767 - protein, 19 aa, Cryptosporidium hominis
HLELCLHCISHFQYWQYLA

SEQ ID NO: 2123768 - protein, 22 aa, Cryptosporidium hominis
HLFKDIAIRKSIYMLAFNIILK

SEQ ID NO: 2123769 - protein, 23 aa, Cryptosporidium hominis
HLGLVKEIFCSRSECSDEKLFEP

SEQ ID NO: 2123770 - protein, 25 aa, Cryptosporidium hominis
HLIFYEIPRYSPIGLLSSLGAIYDD

SEQ ID NO: 2123771 - protein, 17 aa, Cryptosporidium hominis
HLIIYSIAPFIVYIYNR

SEQ ID NO: 2123772 - protein, 18 aa, Cryptosporidium hominis
HLKIHCRTLREFGTNHPK

SEQ ID NO: 2123773 - protein, 21 aa, Cryptosporidium hominis
HLKLIMIAQSLLFVINNAIDT

SEQ ID NO: 2123774 - protein, 19 aa, Cryptosporidium hominis
HLKVHSCLGDHDWRGSTTA

SEQ ID NO: 2123775 - protein, 17 aa, Cryptosporidium hominis
HLLFSYFWVHYGSSLFT

SEQ ID NO: 2123776 - protein, 25 aa, Cryptosporidium hominis
HLLGVRCSINLLPEDFLVQIITKLL

SEQ ID NO: 2123777 - protein, 18 aa, Cryptosporidium hominis
HLLKQIDSLFSLKHSFLW

SEQ ID NO: 2123778 - protein, 48 aa, Cryptosporidium hominis
HLNTLKLKKCFKVFLSVCGTSLSAIFGFFKTLFCVPNLNNRAQDNVSI

SEQ ID NO: 2123779 - protein, 17 aa, Cryptosporidium hominis
HLNTSFFRLRTCSKSLR

SEQ ID NO: 2123780 - protein, 19 aa, Cryptosporidium hominis
HLQPLVLIHGRLCYRRTSI

SEQ ID NO: 2123781 - protein, 17 aa, Cryptosporidium hominis
HLRECIMDINAWKMKAY

SEQ ID NO: 2123782 - protein, 26 aa, Cryptosporidium hominis
HLTNLTCPYCNTFSNIIFPFKYFKNE

SEQ ID NO: 2123783 - protein, 24 aa, Cryptosporidium hominis
HLVFPSNGLIQFFYRLISKIFTKN

SEQ ID NO: 2123784 - protein, 17 aa, Cryptosporidium hominis
HLYYRLIGDNSKFKINY

SEQ ID NO: 2123785 - protein, 27 aa, Cryptosporidium hominis
HNFNECFRFPVVVPIVEDIIILKLWDN

SEQ ID NO: 2123786 - protein, 17 aa, Cryptosporidium hominis
HNQLYRYLIREMNKTSR

SEQ ID NO: 2123787 - protein, 28 aa, Cryptosporidium hominis
HNWRSEYVNSYFLLNILQYLIVLLQVYP

SEQ ID NO: 2123788 - protein, 23 aa, Cryptosporidium hominis
HPFSPGCILAIISISSQYKTTLQ

SEQ ID NO: 2123789 - protein, 20 aa, Cryptosporidium hominis
HPHQDYKKRISIVHNGTIDN

SEQ ID NO: 2123790 - protein, 24 aa, Cryptosporidium hominis
HPNSSFLLRSGFYDIIPLVHCFVD

SEQ ID NO: 2123791 - protein, 34 aa, Cryptosporidium hominis
HPNVLDLSEYCRRVRGWNLPFLRTIPQMNAITQI

SEQ ID NO: 2123792 - protein, 18 aa, Cryptosporidium hominis
HRATLFAMFSLFETIGSA

SEQ ID NO: 2123793 - protein, 17 aa, Cryptosporidium hominis
HRHNFSVFFYLFYLTMY

SEQ ID NO: 2123794 - protein, 27 aa, Cryptosporidium hominis
HRLYISNEVVHRFLPWDSLNELMDILE

SEQ ID NO: 2123795 - protein, 18 aa, Cryptosporidium hominis
HRNMMRMKLDLDKIRKDE

SEQ ID NO: 2123796 - protein, 21 aa, Cryptosporidium hominis
HRTPPGAGIYIVIEKVLLVIN

SEQ ID NO: 2123797 - protein, 17 aa, Cryptosporidium hominis
HSDFCVFCHEPIHIEQD

SEQ ID NO: 2123798 - protein, 23 aa, Cryptosporidium hominis
HSEGYSAGALKHGPFALIDKDSQ

SEQ ID NO: 2123799 - protein, 24 aa, Cryptosporidium hominis
HSELPRLITQLIMALKSKDREIRR

SEQ ID NO: 2123800 - protein, 18 aa, Cryptosporidium hominis
HSGLEFITSIDLTNNHLF

SEQ ID NO: 2123801 - protein, 29 aa, Cryptosporidium hominis
HSIKIKVVKLMPIWSIRNKSNFNIRITYG

SEQ ID NO: 2123802 - protein, 19 aa, Cryptosporidium hominis
HSIRCFRSNDLILAGIIRL

SEQ ID NO: 2123803 - protein, 30 aa, Cryptosporidium hominis
HSISLVGLFCVIFVRRSFHHFVKSVESNSI

SEQ ID NO: 2123804 - protein, 18 aa, Cryptosporidium hominis
HSLIIGYIKLNWDEFREL

SEQ ID NO: 2123805 - protein, 17 aa, Cryptosporidium hominis
HSMKMCRSSSCPSLGHI

SEQ ID NO: 2123806 - protein, 17 aa, Cryptosporidium hominis
HSVGRGASQVRNIPVQN

SEQ ID NO: 2123807 - protein, 22 aa, Cryptosporidium hominis
HSVGSKVTRYICILLSENTFTR

SEQ ID NO: 2123808 - protein, 17 aa, Cryptosporidium hominis
HSVTPLLSVFLRESDWF

SEQ ID NO: 2123809 - protein, 18 aa, Cryptosporidium hominis
HTDISAWIIKRVILDQMN

SEQ ID NO: 2123810 - protein, 18 aa, Cryptosporidium hominis
HTGIRIVQQIAILHGSSV

SEQ ID NO: 2123811 - protein, 23 aa, Cryptosporidium hominis
HTIPQCIWGCIVGIFIGIFAFIM

SEQ ID NO: 2123812 - protein, 25 aa, Cryptosporidium hominis
HTLDPYRMFLMIVARGGYSRVNKNS

SEQ ID NO: 2123813 - protein, 18 aa, Cryptosporidium hominis
HTNMSRRGIFNIGPRITR

SEQ ID NO: 2123814 - protein, 22 aa, Cryptosporidium hominis
HTQVKWLMSFPAGFKLNQNLTT

SEQ ID NO: 2123815 - protein, 19 aa, Cryptosporidium hominis
HVASKFLIILSDIFELETN

SEQ ID NO: 2123816 - protein, 22 aa, Cryptosporidium hominis
HVKNRYPVHFFNGSKHIVISQS

SEQ ID NO: 2123817 - protein, 21 aa, Cryptosporidium hominis
HVLDHRSGVISFFPKDMGLKE

SEQ ID NO: 2123818 - protein, 18 aa, Cryptosporidium hominis
HVQCELGEWSSWSPCSVT

SEQ ID NO: 2123819 - protein, 25 aa, Cryptosporidium hominis
HVSEYRKNMSLDYFIEIYKDLYSEP

SEQ ID NO: 2123820 - protein, 26 aa, Cryptosporidium hominis
HVVCTLQGMQCCVPQKSAKGWRKKPP

SEQ ID NO: 2123821 - protein, 19 aa, Cryptosporidium hominis
HWLEINGKVIISSKLFDLF

SEQ ID NO: 2123822 - protein, 19 aa, Cryptosporidium hominis
HWRLFWDAFSFMPPCSAQQ

SEQ ID NO: 2123823 - protein, 37 aa, Cryptosporidium hominis
IAAVFCEMLRAYTVRTWDWFTKPLFNNPWLHFACSLS

SEQ ID NO: 2123824 - protein, 36 aa, Cryptosporidium hominis
IACLNARRWLLNKILNIRKGRYFVLSLFHMPHISES

SEQ ID NO: 2123825 - protein, 21 aa, Cryptosporidium hominis
IACSILCLIAEVGLFMIYDIK

SEQ ID NO: 2123826 - protein, 22 aa, Cryptosporidium hominis
IADPLCTILFSFFVLATTIKIL

SEQ ID NO: 2123827 - protein, 23 aa, Cryptosporidium hominis
IAEIIDVFYRVCIDDKQNNTFYI

SEQ ID NO: 2123828 - protein, 17 aa, Cryptosporidium hominis
IAHTRWATHGGKTDFNA

SEQ ID NO: 2123829 - protein, 23 aa, Cryptosporidium hominis
IAILICVEKGYISLDDPICHYWD

SEQ ID NO: 2123830 - protein, 17 aa, Cryptosporidium hominis
IAILKCRATFHRSYLKH

SEQ ID NO: 2123831 - protein, 22 aa, Cryptosporidium hominis
IAIRTLGKIFIKIREYHTFNHQ

SEQ ID NO: 2123832 - protein, 24 aa, Cryptosporidium hominis
IAISTCIFIFFILYIVLNALSRNR

SEQ ID NO: 2123833 - protein, 20 aa, Cryptosporidium hominis
IAKKRLMFFSPFISAVPSIM

SEQ ID NO: 2123834 - protein, 21 aa, Cryptosporidium hominis
IAKLGFLSLFSFIIFLLSVLY

SEQ ID NO: 2123835 - protein, 26 aa, Cryptosporidium hominis
IAKVFKRMVSIVLWFFSSLFILIIIG

SEQ ID NO: 2123836 - protein, 19 aa, Cryptosporidium hominis
IALFLFWFQFVQIFVPILL

SEQ ID NO: 2123837 - protein, 20 aa, Cryptosporidium hominis
IALIISYLFCDIYAAEAPEE

SEQ ID NO: 2123838 - protein, 19 aa, Cryptosporidium hominis
IALQLVLKFIQLIQQQSKY

SEQ ID NO: 2123839 - protein, 20 aa, Cryptosporidium hominis
IALRYFLSRFFLPGESQMVY

SEQ ID NO: 2123840 - protein, 26 aa, Cryptosporidium hominis
IALSHNYFFGALYGRMKTAKQCQERW

SEQ ID NO: 2123841 - protein, 27 aa, Cryptosporidium hominis
IANTNCYRRWKWKKRVKRRKMKKIKDE

SEQ ID NO: 2123842 - protein, 18 aa, Cryptosporidium hominis
IAPPEKKSIVSVEDTTFS

SEQ ID NO: 2123843 - protein, 22 aa, Cryptosporidium hominis
IARICLTSVLLFFSIPTNSQYV

SEQ ID NO: 2123844 - protein, 24 aa, Cryptosporidium hominis
IARYLKCVIMFKSIKEYSGNNNIC

SEQ ID NO: 2123845 - protein, 20 aa, Cryptosporidium hominis
IASAKLVIWTKEIETGRLTD

SEQ ID NO: 2123846 - protein, 20 aa, Cryptosporidium hominis
IASEVLASCEIVRRNIKSLI

SEQ ID NO: 2123847 - protein, 23 aa, Cryptosporidium hominis
IASVCIFLYLVRYFLEIVLNVSR

SEQ ID NO: 2123848 - protein, 21 aa, Cryptosporidium hominis
IASVLPFICKILENIKGSYYY

SEQ ID NO: 2123849 - protein, 19 aa, Cryptosporidium hominis
IATELEWGKAAIQVLKDNN

SEQ ID NO: 2123850 - protein, 19 aa, Cryptosporidium hominis
IATVIGVFIMLPPLFYISR

SEQ ID NO: 2123851 - protein, 18 aa, Cryptosporidium hominis
IAVSGIFSLIGTIWEGGY

SEQ ID NO: 2123852 - protein, 22 aa, Cryptosporidium hominis
IAWPCIHIVGNILKDGFSSNKS

SEQ ID NO: 2123853 - protein, 25 aa, Cryptosporidium hominis
IAYSFPFSFCLSNFDFRDITSNIYY

SEQ ID NO: 2123854 - protein, 37 aa, Cryptosporidium hominis
ICDKYRFTCIFIHAMCFCMQPFFLFQEVQGILFKLNI

SEQ ID NO: 2123855 - protein, 19 aa, Cryptosporidium hominis
ICFPSSCYCNICNPFENMK

SEQ ID NO: 2123856 - protein, 21 aa, Cryptosporidium hominis
ICGLIMAPVAIFFIAYSYYIY

SEQ ID NO: 2123857 - protein, 18 aa, Cryptosporidium hominis
ICHYWDGFIRYGKRNITL

SEQ ID NO: 2123858 - protein, 24 aa, Cryptosporidium hominis
ICIFGCGIVILGFIIGSLDSSTLG

SEQ ID NO: 2123859 - protein, 18 aa, Cryptosporidium hominis
ICKPRQDLLTGILFQPLL

SEQ ID NO: 2123860 - protein, 18 aa, Cryptosporidium hominis
ICLLVWSCILFIACGTVA

SEQ ID NO: 2123861 - protein, 17 aa, Cryptosporidium hominis
ICLRKIYNIKKGDRVLI

SEQ ID NO: 2123862 - protein, 34 aa, Cryptosporidium hominis
ICSAEGQCIWTLAKRLKELSAMFWNNKYIGDFMP

SEQ ID NO: 2123863 - protein, 20 aa, Cryptosporidium hominis
ICSILHFMLPISFMSILIYS

SEQ ID NO: 2123864 - protein, 19 aa, Cryptosporidium hominis
ICSQIPSYLWYLPSDKIFP

SEQ ID NO: 2123865 - protein, 19 aa, Cryptosporidium hominis
ICSVLCSVVARIEQTSFNE

SEQ ID NO: 2123866 - protein, 18 aa, Cryptosporidium hominis
IDCWFPLVDECISYIFSG

SEQ ID NO: 2123867 - protein, 18 aa, Cryptosporidium hominis
IDDLLGLLKLLTTIRNSL

SEQ ID NO: 2123868 - protein, 23 aa, Cryptosporidium hominis
IDDRRMMLAIIFYISFFAVGFID

SEQ ID NO: 2123869 - protein, 18 aa, Cryptosporidium hominis
IDELKEFLEKNEIIVILK

SEQ ID NO: 2123870 - protein, 18 aa, Cryptosporidium hominis
IDGESCPEIYEKHQGGKF

SEQ ID NO: 2123871 - protein, 17 aa, Cryptosporidium hominis
IDGFPLSEFEAVRPLLE

SEQ ID NO: 2123872 - protein, 17 aa, Cryptosporidium hominis
IDIEGIKEIPNFGNNSL

SEQ ID NO: 2123873 - protein, 19 aa, Cryptosporidium hominis
IDIGLFGFMYYWNVKLNMV

SEQ ID NO: 2123874 - protein, 25 aa, Cryptosporidium hominis
IDILLKGGEFLSVYPTPNFLNLLIK

SEQ ID NO: 2123875 - protein, 18 aa, Cryptosporidium hominis
IDISLVFKYYGLLSKDST

SEQ ID NO: 2123876 - protein, 30 aa, Cryptosporidium hominis
IDKGWIYCYKLWKETMVYHFLYTVLVTSSF

SEQ ID NO: 2123877 - protein, 21 aa, Cryptosporidium hominis
IDLITLLPIIFFLIQSIHFHI

SEQ ID NO: 2123878 - protein, 17 aa, Cryptosporidium hominis
IDLKENILFQEIMNSIQ

SEQ ID NO: 2123879 - protein, 19 aa, Cryptosporidium hominis
IDLLTKCSETLRKTASDWN

SEQ ID NO: 2123880 - protein, 23 aa, Cryptosporidium hominis
IDLRGAVHRCLQSGKAKTDKDIV

SEQ ID NO: 2123881 - protein, 19 aa, Cryptosporidium hominis
IDLVKEIFPLYDVIVDATD

SEQ ID NO: 2123882 - protein, 18 aa, Cryptosporidium hominis
IDMHDIWIGRLMVESSKA

SEQ ID NO: 2123883 - protein, 17 aa, Cryptosporidium hominis
IDMMNGPAICVGIRNRK

SEQ ID NO: 2123884 - protein, 23 aa, Cryptosporidium hominis
IDMPGHGLSSWNYFGKLTTDDFI

SEQ ID NO: 2123885 - protein, 18 aa, Cryptosporidium hominis
IDNGRFSKNFEIVKLIGS

SEQ ID NO: 2123886 - protein, 18 aa, Cryptosporidium hominis
IDNRIPRKPYYIAKANIY

SEQ ID NO: 2123887 - protein, 17 aa, Cryptosporidium hominis
IDPERYYSLLLSQRRGP

SEQ ID NO: 2123888 - protein, 24 aa, Cryptosporidium hominis
IDPQQRLSLMLAVKSIEDAKLNLS

SEQ ID NO: 2123889 - protein, 22 aa, Cryptosporidium hominis
IDQICLLWPLDVINLQDHEQLE

SEQ ID NO: 2123890 - protein, 18 aa, Cryptosporidium hominis
IDRGKLPLSEEVELNQTA

SEQ ID NO: 2123891 - protein, 19 aa, Cryptosporidium hominis
IDRVSSWKNYIALFNHLLF

SEQ ID NO: 2123892 - protein, 31 aa, Cryptosporidium hominis
IDRWSKELCIRVCLTSASLCFSGSGDKQILM

SEQ ID NO: 2123893 - protein, 17 aa, Cryptosporidium hominis
IDSELLIDEHSQRNNSS

SEQ ID NO: 2123894 - protein, 35 aa, Cryptosporidium hominis
IDTCASLLYWSLRVTRYFFPLTIALVLLSFTIFSL

SEQ ID NO: 2123895 - protein, 23 aa, Cryptosporidium hominis
IDTCIVCRDTLYIGSKKIPCGHV

SEQ ID NO: 2123896 - protein, 25 aa, Cryptosporidium hominis
IDTFQLKSCHGVSCASDCIVTEWSD

SEQ ID NO: 2123897 - protein, 17 aa, Cryptosporidium hominis
IDVPKYLLDLPYLYNSS

SEQ ID NO: 2123898 - protein, 18 aa, Cryptosporidium hominis
IEADNGWQKLILGVNSAY

SEQ ID NO: 2123899 - protein, 21 aa, Cryptosporidium hominis
IEAVSALGLMGLIYELRENRM

SEQ ID NO: 2123900 - protein, 26 aa, Cryptosporidium hominis
IECFIFPFRLIIAYFVLKDSLGSSTT

SEQ ID NO: 2123901 - protein, 26 aa, Cryptosporidium hominis
IEDFFKCLKIIIDLLFNSNLFSKEEF

SEQ ID NO: 2123902 - protein, 22 aa, Cryptosporidium hominis
IEDFSGIPLFMIFVQSNSLILS

SEQ ID NO: 2123903 - protein, 19 aa, Cryptosporidium hominis
IEELTYEFIEFEKARLSDP

SEQ ID NO: 2123904 - protein, 19 aa, Cryptosporidium hominis
IEENKCFVFSYVVKSQTYF

SEQ ID NO: 2123905 - protein, 20 aa, Cryptosporidium hominis
IEERLKQFMKLFSCNYSSSN

SEQ ID NO: 2123906 - protein, 24 aa, Cryptosporidium hominis
IEILFLFVCCIIFRILGDHSEILI

SEQ ID NO: 2123907 - protein, 18 aa, Cryptosporidium hominis
IEIRSWREMTRPKSLNGE

SEQ ID NO: 2123908 - protein, 23 aa, Cryptosporidium hominis
IEITELRFNKLFTDPFSKITHST

SEQ ID NO: 2123909 - protein, 18 aa, Cryptosporidium hominis
IEKLFSLNIGNLILNHKN

SEQ ID NO: 2123910 - protein, 22 aa, Cryptosporidium hominis
IEKLIKINFNFSKGTEMSEFNE

SEQ ID NO: 2123911 - protein, 17 aa, Cryptosporidium hominis
IEKPEWLLETYFSLFKS

SEQ ID NO: 2123912 - protein, 24 aa, Cryptosporidium hominis
IEKRKTMLLPEHYLYGVKDLSRHL

SEQ ID NO: 2123913 - protein, 22 aa, Cryptosporidium hominis
IEKSCLKPLIYFLKSIPSGFAP

SEQ ID NO: 2123914 - protein, 20 aa, Cryptosporidium hominis
IEKYALFELIITKLLPLCSS

SEQ ID NO: 2123915 - protein, 18 aa, Cryptosporidium hominis
IELIDTFFIIARKKSLSF

SEQ ID NO: 2123916 - protein, 24 aa, Cryptosporidium hominis
IELLNRKLLSLGILKVQLDDHFIT

SEQ ID NO: 2123917 - protein, 31 aa, Cryptosporidium hominis
IELQSNPLLLNWKAFFPNIIFDENKSEFIIA

SEQ ID NO: 2123918 - protein, 24 aa, Cryptosporidium hominis
IENKYCQMCYSLLKILNNLTGKVI

SEQ ID NO: 2123919 - protein, 25 aa, Cryptosporidium hominis
IENLCSTSLHPNHFSLIFKSRYPNY

SEQ ID NO: 2123920 - protein, 21 aa, Cryptosporidium hominis
IESCGVKSYLGNPIRAVREFE

SEQ ID NO: 2123921 - protein, 26 aa, Cryptosporidium hominis
IESIKKLCKVWLLSPFNALDVLLTDS

SEQ ID NO: 2123922 - protein, 22 aa, Cryptosporidium hominis
IESIYPWIGRQALAQTAILLRI

SEQ ID NO: 2123923 - protein, 18 aa, Cryptosporidium hominis
IETPILVFCHKVDPRLGG

SEQ ID NO: 2123924 - protein, 17 aa, Cryptosporidium hominis
IEVTCLDFISLLNVLIQ

SEQ ID NO: 2123925 - protein, 25 aa, Cryptosporidium hominis
IEWFAVRDGILWVGSFGKEFVSNGI

SEQ ID NO: 2123926 - protein, 17 aa, Cryptosporidium hominis
IEYLLNMDINISFEDLV

SEQ ID NO: 2123927 - protein, 17 aa, Cryptosporidium hominis
IEYRPLYRDCTSNVNYG

SEQ ID NO: 2123928 - protein, 29 aa, Cryptosporidium hominis
IFAHCYWYLLWLRKHWRSLFHSEEIPYSK

SEQ ID NO: 2123929 - protein, 18 aa, Cryptosporidium hominis
IFCFFLDKTWFYFPYIGI

SEQ ID NO: 2123930 - protein, 17 aa, Cryptosporidium hominis
IFCKLCGIIHNKVIENK

SEQ ID NO: 2123931 - protein, 25 aa, Cryptosporidium hominis
IFEFNEYFIFNGFLLYILLCSFNEL

SEQ ID NO: 2123932 - protein, 17 aa, Cryptosporidium hominis
IFFCLLAIIISRLRVLA

SEQ ID NO: 2123933 - protein, 18 aa, Cryptosporidium hominis
IFFGFFFLYLERIKTEKV

SEQ ID NO: 2123934 - protein, 24 aa, Cryptosporidium hominis
IFFIYWKIIKQISIYFSTHSIDYF

SEQ ID NO: 2123935 - protein, 25 aa, Cryptosporidium hominis
IFFNKIFFLNSMICFYRCSGSFLTT

SEQ ID NO: 2123936 - protein, 17 aa, Cryptosporidium hominis
IFFSCIFAFTYISGKSF

SEQ ID NO: 2123937 - protein, 22 aa, Cryptosporidium hominis
IFGACGQLALFQAKNYNIEDVN

SEQ ID NO: 2123938 - protein, 17 aa, Cryptosporidium hominis
IFGNGLLIFLLFEIHYL

SEQ ID NO: 2123939 - protein, 24 aa, Cryptosporidium hominis
IFGSILAILGIHFSKKRKLSFKSK

SEQ ID NO: 2123940 - protein, 23 aa, Cryptosporidium hominis
IFHKMCYFLGCSMSKKVFSIHES

SEQ ID NO: 2123941 - protein, 17 aa, Cryptosporidium hominis
IFIYNSWSFYLLVYTIG

SEQ ID NO: 2123942 - protein, 24 aa, Cryptosporidium hominis
IFKRPYLSAFSLVFSKSQMDMVNK

SEQ ID NO: 2123943 - protein, 17 aa, Cryptosporidium hominis
IFLFFNILNLLNGEEID

SEQ ID NO: 2123944 - protein, 27 aa, Cryptosporidium hominis
IFLFLFVLRFYFWVRGRFSFNVGSNEK

SEQ ID NO: 2123945 - protein, 17 aa, Cryptosporidium hominis
IFLFYIINAYKSAVEKL

SEQ ID NO: 2123946 - protein, 26 aa, Cryptosporidium hominis
IFLIFFFKRRLVIDLLLIVELILIDI

SEQ ID NO: 2123947 - protein, 18 aa, Cryptosporidium hominis
IFLKIPFYQKICNKYELD

SEQ ID NO: 2123948 - protein, 17 aa, Cryptosporidium hominis
IFLPLSPLFDPRLTIRI

SEQ ID NO: 2123949 - protein, 31 aa, Cryptosporidium hominis
IFLSFPITVLMQFLSCIAPIGYGMFNVIQST

SEQ ID NO: 2123950 - protein, 18 aa, Cryptosporidium hominis
IFLSIIILFISCSTQLEL

SEQ ID NO: 2123951 - protein, 18 aa, Cryptosporidium hominis
IFLSIPPLHFAYLGVVLC

SEQ ID NO: 2123952 - protein, 18 aa, Cryptosporidium hominis
IFLTCFIYILPVYLMVIS

SEQ ID NO: 2123953 - protein, 19 aa, Cryptosporidium hominis
IFLVILLNFCFYKKKRNYY

SEQ ID NO: 2123954 - protein, 17 aa, Cryptosporidium hominis
IFMRHLLQNRKRFKGPK

SEQ ID NO: 2123955 - protein, 18 aa, Cryptosporidium hominis
IFNCLSFIDGFYNIGASR

SEQ ID NO: 2123956 - protein, 18 aa, Cryptosporidium hominis
IFNHLRDTIALTIGLIQL

SEQ ID NO: 2123957 - protein, 29 aa, Cryptosporidium hominis
IFNNFNSRFSWIVGMSIFTSSIFGLSYLR

SEQ ID NO: 2123958 - protein, 21 aa, Cryptosporidium hominis
IFPIGCPLNSISDSLVNVIQK

SEQ ID NO: 2123959 - protein, 17 aa, Cryptosporidium hominis
IFPLFSLVFALLTGYFV

SEQ ID NO: 2123960 - protein, 20 aa, Cryptosporidium hominis
IFPSHPALVLYASNAEFYLG

SEQ ID NO: 2123961 - protein, 24 aa, Cryptosporidium hominis
IFQPLRYLFISAMNYGRRVVIPKL

SEQ ID NO: 2123962 - protein, 20 aa, Cryptosporidium hominis
IFRAVCLEKALHVTERDANK

SEQ ID NO: 2123963 - protein, 19 aa, Cryptosporidium hominis
IFRQIKIVYPDATQSAIES

SEQ ID NO: 2123964 - protein, 26 aa, Cryptosporidium hominis
IFVCILRLYAYYPVWLLLNNTSNDWY

SEQ ID NO: 2123965 - protein, 17 aa, Cryptosporidium hominis
IFVLKFVAIAANQDKNL

SEQ ID NO: 2123966 - protein, 24 aa, Cryptosporidium hominis
IFVRLKISLWAPLFEDVTDQKLFR

SEQ ID NO: 2123967 - protein, 18 aa, Cryptosporidium hominis
IFYQAFKGQWGVSGRDFV

SEQ ID NO: 2123968 - protein, 23 aa, Cryptosporidium hominis
IFYSSFCAYCHMASNPLKKVAES

SEQ ID NO: 2123969 - protein, 23 aa, Cryptosporidium hominis
IFYYLEFIESFNLPHIMNGTAIL

SEQ ID NO: 2123970 - protein, 23 aa, Cryptosporidium hominis
IGAPKCRCPNGFQGDGLIGGTGC

SEQ ID NO: 2123971 - protein, 23 aa, Cryptosporidium hominis
IGFCSEDPWIPIGTIRSVILFER

SEQ ID NO: 2123972 - protein, 21 aa, Cryptosporidium hominis
IGFIAICFGPPISKSLISILF

SEQ ID NO: 2123973 - protein, 17 aa, Cryptosporidium hominis
IGFPSIVIYEESVDKHC

SEQ ID NO: 2123974 - protein, 25 aa, Cryptosporidium hominis
IGFQPCLINYLSVFLMYMDPPSAFK

SEQ ID NO: 2123975 - protein, 17 aa, Cryptosporidium hominis
IGGCDSALFKRMDVNLV

SEQ ID NO: 2123976 - protein, 25 aa, Cryptosporidium hominis
IGGEILPPLSLGCFEELSSPETFLE

SEQ ID NO: 2123977 - protein, 18 aa, Cryptosporidium hominis
IGGFVVGILYTFATMKAC

SEQ ID NO: 2123978 - protein, 22 aa, Cryptosporidium hominis
IGGLIFWKVYVTIIPDEKNALN

SEQ ID NO: 2123979 - protein, 20 aa, Cryptosporidium hominis
IGGLLPFEKIRVLRSLFTCV

SEQ ID NO: 2123980 - protein, 24 aa, Cryptosporidium hominis
IGGTSSWKHIWIMSFFIFLVFLLM

SEQ ID NO: 2123981 - protein, 18 aa, Cryptosporidium hominis
IGIELSMASNITFFQLYT

SEQ ID NO: 2123982 - protein, 19 aa, Cryptosporidium hominis
IGIIFRLLYIIVYLAINLL

SEQ ID NO: 2123983 - protein, 17 aa, Cryptosporidium hominis
IGIKGEFISHVRTATNA

SEQ ID NO: 2123984 - protein, 18 aa, Cryptosporidium hominis
IGIKLVKCDSEFEKNKSE

SEQ ID NO: 2123985 - protein, 21 aa, Cryptosporidium hominis
IGILCPSGLAIRSTIPLLAME

SEQ ID NO: 2123986 - protein, 18 aa, Cryptosporidium hominis
IGILLVLASICIELGFEC

SEQ ID NO: 2123987 - protein, 18 aa, Cryptosporidium hominis
IGISFYFALDRLNKSIKG

SEQ ID NO: 2123988 - protein, 17 aa, Cryptosporidium hominis
IGKVLSEQFELGKLITY

SEQ ID NO: 2123989 - protein, 17 aa, Cryptosporidium hominis
IGLGIYYAVARYFSRSS

SEQ ID NO: 2123990 - protein, 19 aa, Cryptosporidium hominis
IGLSIMIFINFSSCNDNYS

SEQ ID NO: 2123991 - protein, 20 aa, Cryptosporidium hominis
IGPRITRILPKIKQLLRDNI

SEQ ID NO: 2123992 - protein, 17 aa, Cryptosporidium hominis
IGQKIHKDFKWLERNLI

SEQ ID NO: 2123993 - protein, 19 aa, Cryptosporidium hominis
IGRQCALLFTGFVSNKHQI

SEQ ID NO: 2123994 - protein, 25 aa, Cryptosporidium hominis
IGSFELSYKWCFQVFSYDNRYCDAL

SEQ ID NO: 2123995 - protein, 22 aa, Cryptosporidium hominis
IGSKRLYILGLILVIFSYIPIC

SEQ ID NO: 2123996 - protein, 38 aa, Cryptosporidium hominis
IGSMSKLLVGFLLKYRFLRLINCNWTKLRPHIVEGLRM

SEQ ID NO: 2123997 - protein, 19 aa, Cryptosporidium hominis
IGSNLKYAACSNSEITNIW

SEQ ID NO: 2123998 - protein, 17 aa, Cryptosporidium hominis
IGSSVIMTMFILSIILL

SEQ ID NO: 2123999 - protein, 17 aa, Cryptosporidium hominis
IGSTAMDLTDRWHSKEW

SEQ ID NO: 2124000 - protein, 18 aa, Cryptosporidium hominis
IGSYECECLSGFRKHEQR

SEQ ID NO: 2124001 - protein, 25 aa, Cryptosporidium hominis
IGTAGAKMMIEWNFAFHWYDDGLPE

SEQ ID NO: 2124002 - protein, 20 aa, Cryptosporidium hominis
IGTDIANKVKPLFFSRNSSL

SEQ ID NO: 2124003 - protein, 18 aa, Cryptosporidium hominis
IGVCRAIDDCIYHSNSIL

SEQ ID NO: 2124004 - protein, 17 aa, Cryptosporidium hominis
IGWTGWVVLAFVFQVPL

SEQ ID NO: 2124005 - protein, 17 aa, Cryptosporidium hominis
IGYLLITLIRLIAFMTD

SEQ ID NO: 2124006 - protein, 26 aa, Cryptosporidium hominis
IHAASLSPAVVWCRCSPSQKKDLVLL

SEQ ID NO: 2124007 - protein, 21 aa, Cryptosporidium hominis
IHCILILTLFINFKVSGDLIF

SEQ ID NO: 2124008 - protein, 23 aa, Cryptosporidium hominis
IHEFPKRKALFLNVCSQIKFIDA

SEQ ID NO: 2124009 - protein, 22 aa, Cryptosporidium hominis
IHFLNLLLFFGISNNLHYTVGI

SEQ ID NO: 2124010 - protein, 36 aa, Cryptosporidium hominis
IHFLRCNYSLSMAAKWSIAEAFVLGGISVFGIAIIA

SEQ ID NO: 2124011 - protein, 17 aa, Cryptosporidium hominis
IHGCVPPKIHLFPSKSH

SEQ ID NO: 2124012 - protein, 28 aa, Cryptosporidium hominis
IHGRLCYRRTSILVLYNLYKCFTLNIVS

SEQ ID NO: 2124013 - protein, 19 aa, Cryptosporidium hominis
IHIIQRYWRIYIYRNQIMR

SEQ ID NO: 2124014 - protein, 19 aa, Cryptosporidium hominis
IHLFLFFVLFSEFKYDEIN

SEQ ID NO: 2124015 - protein, 24 aa, Cryptosporidium hominis
IHPFLLQLLFDFIKLYNIEEIIKG

SEQ ID NO: 2124016 - protein, 21 aa, Cryptosporidium hominis
IHPVLTRKNALAIFYSFIPYI

SEQ ID NO: 2124017 - protein, 26 aa, Cryptosporidium hominis
IHRMKFNEVDAAVIIKQVLSGVTYLH

SEQ ID NO: 2124018 - protein, 24 aa, Cryptosporidium hominis
IHSKRRCIIRKGLTVRGSMILPFS

SEQ ID NO: 2124019 - protein, 20 aa, Cryptosporidium hominis
IHSLMKYFSGIHFLHAALLC

SEQ ID NO: 2124020 - protein, 22 aa, Cryptosporidium hominis
IIACSEFCLYFNLKTIEELHEL

SEQ ID NO: 2124021 - protein, 23 aa, Cryptosporidium hominis
IIAILFSFLIIFHKFFRKLNFSE

SEQ ID NO: 2124022 - protein, 17 aa, Cryptosporidium hominis
IICGSLLSLNGLIEDIS

SEQ ID NO: 2124023 - protein, 18 aa, Cryptosporidium hominis
IICLSVWLLHGTHLGCSL

SEQ ID NO: 2124024 - protein, 25 aa, Cryptosporidium hominis
IICNIKPLNICSGVLSRIISIFGQF

SEQ ID NO: 2124025 - protein, 18 aa, Cryptosporidium hominis
IICSSFGLLGFYSITKNN

SEQ ID NO: 2124026 - protein, 17 aa, Cryptosporidium hominis
IIDGFRYIQHANHIGKV

SEQ ID NO: 2124027 - protein, 24 aa, Cryptosporidium hominis
IIDITGKETIVWYDAIAGNNMVIS

SEQ ID NO: 2124028 - protein, 25 aa, Cryptosporidium hominis
IIEALRKGHWTKMFCFGVFAMEMFI

SEQ ID NO: 2124029 - protein, 26 aa, Cryptosporidium hominis
IIEEFKRISRSEGFQECIMYFMKQIS

SEQ ID NO: 2124030 - protein, 25 aa, Cryptosporidium hominis
IIEEVCSFIKIILAKITIYSIFEES

SEQ ID NO: 2124031 - protein, 26 aa, Cryptosporidium hominis
IIEILLFPIIRNFCCDEQEGVRLIAI

SEQ ID NO: 2124032 - protein, 18 aa, Cryptosporidium hominis
IIERGKTLLQYRFHINDS

SEQ ID NO: 2124033 - protein, 17 aa, Cryptosporidium hominis
IIFISSIIFTFKLSLKF

SEQ ID NO: 2124034 - protein, 27 aa, Cryptosporidium hominis
IIFMLKQGMFGDWTRFGELGYDAYRNV

SEQ ID NO: 2124035 - protein, 23 aa, Cryptosporidium hominis
IIFTFKLSLKFLSGTMIFQNIRS

SEQ ID NO: 2124036 - protein, 33 aa, Cryptosporidium hominis
IIGFCAVEGILFSGSFCAIFWLKKRGLMPGLTF

SEQ ID NO: 2124037 - protein, 26 aa, Cryptosporidium hominis
IIGTLKIFYLYARWTLYFNTQVIAGK

SEQ ID NO: 2124038 - protein, 17 aa, Cryptosporidium hominis
IIGTWVWLELFRITGTQ

SEQ ID NO: 2124039 - protein, 23 aa, Cryptosporidium hominis
IIHLGDSCGFSLKKCGFYSIKGN

SEQ ID NO: 2124040 - protein, 26 aa, Cryptosporidium hominis
IIIIGIWLAWIFRYKRQTEIYDMDHL

SEQ ID NO: 2124041 - protein, 19 aa, Cryptosporidium hominis
IIIIVVFGLVVWKKVKDIE

SEQ ID NO: 2124042 - protein, 17 aa, Cryptosporidium hominis
IIINCFFSILWMIGFYF

SEQ ID NO: 2124043 - protein, 18 aa, Cryptosporidium hominis
IIKDKFGKILFKTSYSLV

SEQ ID NO: 2124044 - protein, 17 aa, Cryptosporidium hominis
IIKPERVLYMGIHETEE

SEQ ID NO: 2124045 - protein, 27 aa, Cryptosporidium hominis
IILFGVCLAAFIFGIGIFMIANFGGNL

SEQ ID NO: 2124046 - protein, 25 aa, Cryptosporidium hominis
IILLAIDCFFSFFRHILLNHPHNVS

SEQ ID NO: 2124047 - protein, 25 aa, Cryptosporidium hominis
IILLDRLASLWFGSYIHITNLKRLP

SEQ ID NO: 2124048 - protein, 24 aa, Cryptosporidium hominis
IILLSLLAFVVWFLLAYYDKVDPA

SEQ ID NO: 2124049 - protein, 17 aa, Cryptosporidium hominis
IILMVTFMTYKIVCQRY

SEQ ID NO: 2124050 - protein, 24 aa, Cryptosporidium hominis
IILNDLYDIWFLKFTENEPEMTKY

SEQ ID NO: 2124051 - protein, 17 aa, Cryptosporidium hominis
IILYDIFTEIKIWRIEN

SEQ ID NO: 2124052 - protein, 19 aa, Cryptosporidium hominis
IIMFKRISFDKVNSILSYF

SEQ ID NO: 2124053 - protein, 17 aa, Cryptosporidium hominis
IIMGGVFFSLPRAGEND

SEQ ID NO: 2124054 - protein, 28 aa, Cryptosporidium hominis
IINCFECFAKFLGHFLIAFVFFAISFLY

SEQ ID NO: 2124055 - protein, 17 aa, Cryptosporidium hominis
IINEVMYILDFFLQLPK

SEQ ID NO: 2124056 - protein, 21 aa, Cryptosporidium hominis
IINFFKKIVKFFCKNNYQCLY

SEQ ID NO: 2124057 - protein, 17 aa, Cryptosporidium hominis
IINKCYKNLLDDRNKDH

SEQ ID NO: 2124058 - protein, 25 aa, Cryptosporidium hominis
IINNYKLGKNRNFSNSTVTNNINDI

SEQ ID NO: 2124059 - protein, 22 aa, Cryptosporidium hominis
IINRFDYPYLLGVITSKKKVLL

SEQ ID NO: 2124060 - protein, 22 aa, Cryptosporidium hominis
IIPEVLYSSTFTRQNISKPLLY

SEQ ID NO: 2124061 - protein, 23 aa, Cryptosporidium hominis
IIPISLRVNLEMAKIVFSSQINS

SEQ ID NO: 2124062 - protein, 18 aa, Cryptosporidium hominis
IIRDGVFQGFSWLTILVI

SEQ ID NO: 2124063 - protein, 22 aa, Cryptosporidium hominis
IIRYFPPGMKWMDGSISQDIPH

SEQ ID NO: 2124064 - protein, 20 aa, Cryptosporidium hominis
IISAFPAIITNLLFGIFDIV

SEQ ID NO: 2124065 - protein, 19 aa, Cryptosporidium hominis
IISSIEILDVDWTVKEFLL

SEQ ID NO: 2124066 - protein, 17 aa, Cryptosporidium hominis
IITAISYWKLSSDYGNS

SEQ ID NO: 2124067 - protein, 17 aa, Cryptosporidium hominis
IITQGKFSFARVRSTTI

SEQ ID NO: 2124068 - protein, 17 aa, Cryptosporidium hominis
IITTGVVGWEFHPTLME

SEQ ID NO: 2124069 - protein, 18 aa, Cryptosporidium hominis
IIVILKLGFGINHFEVLF

SEQ ID NO: 2124070 - protein, 20 aa, Cryptosporidium hominis
IIVKSCKCKAHYQLQTIKSS

SEQ ID NO: 2124071 - protein, 17 aa, Cryptosporidium hominis
IIVSSTFGVIKMITFPN

SEQ ID NO: 2124072 - protein, 23 aa, Cryptosporidium hominis
IIYKGELFETAFLTVDQSGLGIL

SEQ ID NO: 2124073 - protein, 29 aa, Cryptosporidium hominis
IIYYNHWLFDKVAPFPVFATWVQQIVGVF

SEQ ID NO: 2124074 - protein, 23 aa, Cryptosporidium hominis
IKALAGSIYRPAESRFMDLLNHE

SEQ ID NO: 2124075 - protein, 18 aa, Cryptosporidium hominis
IKALLRYASILNDVSSFL

SEQ ID NO: 2124076 - protein, 19 aa, Cryptosporidium hominis
IKANIFALINSNLVSQGNN

SEQ ID NO: 2124077 - protein, 17 aa, Cryptosporidium hominis
IKAYNKDICIVRDNEGR

SEQ ID NO: 2124078 - protein, 21 aa, Cryptosporidium hominis
IKDELKWAYLDHLITTPIGAS

SEQ ID NO: 2124079 - protein, 25 aa, Cryptosporidium hominis
IKDPSLRYGPNVKRKTPGKRIIPIF

SEQ ID NO: 2124080 - protein, 28 aa, Cryptosporidium hominis
IKDVLLPWYHCYRFFVQEAIRYENTNHN

SEQ ID NO: 2124081 - protein, 17 aa, Cryptosporidium hominis
IKEALKVLSTCLPSSGN

SEQ ID NO: 2124082 - protein, 22 aa, Cryptosporidium hominis
IKETQHLFKYCIMLLEKENNIN

SEQ ID NO: 2124083 - protein, 24 aa, Cryptosporidium hominis
IKEYEERSIFPLAEGLKLIKKLDI

SEQ ID NO: 2124084 - protein, 17 aa, Cryptosporidium hominis
IKFILVYFICQFLLIYV

SEQ ID NO: 2124085 - protein, 20 aa, Cryptosporidium hominis
IKFVLRIFIILSLTILPLIN

SEQ ID NO: 2124086 - protein, 19 aa, Cryptosporidium hominis
IKGALLVAKKPLYFDEIID

SEQ ID NO: 2124087 - protein, 26 aa, Cryptosporidium hominis
IKGKCIYKNPFFYSFFPINSICREFT

SEQ ID NO: 2124088 - protein, 17 aa, Cryptosporidium hominis
IKGKVVLKNPFPFNHLS

SEQ ID NO: 2124089 - protein, 17 aa, Cryptosporidium hominis
IKGNIVFETNNNPLIIS

SEQ ID NO: 2124090 - protein, 19 aa, Cryptosporidium hominis
IKHIEIFVRTWFKFLELSV

SEQ ID NO: 2124091 - protein, 20 aa, Cryptosporidium hominis
IKHPFLVRMFGTFKDDRYLY

SEQ ID NO: 2124092 - protein, 25 aa, Cryptosporidium hominis
IKIDATRSTLIFTFLTEQTNKFFDC

SEQ ID NO: 2124093 - protein, 22 aa, Cryptosporidium hominis
IKIGDFGLARLMFDGDSKTNNG

SEQ ID NO: 2124094 - protein, 17 aa, Cryptosporidium hominis
IKIIRYIYNSQIQTKNS

SEQ ID NO: 2124095 - protein, 38 aa, Cryptosporidium hominis
IKILAKRHFPELISTILLRCCSTLGYINMGALESSNAL

SEQ ID NO: 2124096 - protein, 24 aa, Cryptosporidium hominis
IKIMQGCVWEIAIELSIKKEESSE

SEQ ID NO: 2124097 - protein, 21 aa, Cryptosporidium hominis
IKIPGNDAIQMIISGDQNKYL

SEQ ID NO: 2124098 - protein, 21 aa, Cryptosporidium hominis
IKIPNCEPELLSPTISQTKQL

SEQ ID NO: 2124099 - protein, 24 aa, Cryptosporidium hominis
IKIRNIRELAEMTGCDNVKVIRDG

SEQ ID NO: 2124100 - protein, 18 aa, Cryptosporidium hominis
IKKCYNCYESCEYEYGII

SEQ ID NO: 2124101 - protein, 23 aa, Cryptosporidium hominis
IKKILLIICPYITFFTQNKRKSF

SEQ ID NO: 2124102 - protein, 20 aa, Cryptosporidium hominis
IKKLLIPLLVRLEGPTLELS

SEQ ID NO: 2124103 - protein, 18 aa, Cryptosporidium hominis
IKLEELICHKYLKYENGA

SEQ ID NO: 2124104 - protein, 23 aa, Cryptosporidium hominis
IKLELPIYINILFITITSLLLTQ

SEQ ID NO: 2124105 - protein, 29 aa, Cryptosporidium hominis
IKLIYKTIKCIFIYMIFALLLRKLEDNNH

SEQ ID NO: 2124106 - protein, 21 aa, Cryptosporidium hominis
IKLLFLLLLEVCAYKFTNGVP

SEQ ID NO: 2124107 - protein, 19 aa, Cryptosporidium hominis
IKLLPCIKMLTVSCFTFSN

SEQ ID NO: 2124108 - protein, 22 aa, Cryptosporidium hominis
IKLLSPNLWLPLGIFPSKCLFK

SEQ ID NO: 2124109 - protein, 36 aa, Cryptosporidium hominis
IKLRQQMWLRRPRWFVYEIIPLIILFTKIFSSVDYY

SEQ ID NO: 2124110 - protein, 19 aa, Cryptosporidium hominis
IKLSPIALKDSEPVVLCVL

SEQ ID NO: 2124111 - protein, 26 aa, Cryptosporidium hominis
IKMYFLSILVLFSWISIVIGGEGNLD

SEQ ID NO: 2124112 - protein, 17 aa, Cryptosporidium hominis
IKNDFAFEYIHLDDTPI

SEQ ID NO: 2124113 - protein, 24 aa, Cryptosporidium hominis
IKNFCILTFVGLLFGYITCLTILL

SEQ ID NO: 2124114 - protein, 22 aa, Cryptosporidium hominis
IKNGAPILRRKAMKQIVETARD

SEQ ID NO: 2124115 - protein, 24 aa, Cryptosporidium hominis
IKNQRIIEWSKLHLSDNIIIIDDL

SEQ ID NO: 2124116 - protein, 18 aa, Cryptosporidium hominis
IKNYSVNIFDEFTLASLP

SEQ ID NO: 2124117 - protein, 25 aa, Cryptosporidium hominis
IKPGIVIRPGDEWQKMANLENVNIE

SEQ ID NO: 2124118 - protein, 20 aa, Cryptosporidium hominis
IKPKLCVSAPVKAISCYLLS

SEQ ID NO: 2124119 - protein, 19 aa, Cryptosporidium hominis
IKQLDPFKGTFAMFSHNIL

SEQ ID NO: 2124120 - protein, 25 aa, Cryptosporidium hominis
IKRLRAECFYSMLYQDIKFHEQPNQ

SEQ ID NO: 2124121 - protein, 20 aa, Cryptosporidium hominis
IKRSRGIELFQEVICKTLDM

SEQ ID NO: 2124122 - protein, 18 aa, Cryptosporidium hominis
IKSAFSYMLSRLLYSFAN

SEQ ID NO: 2124123 - protein, 26 aa, Cryptosporidium hominis
IKSALNICGFGSYLERSDSLNFESEL

SEQ ID NO: 2124124 - protein, 32 aa, Cryptosporidium hominis
IKSGLDGGTVFKGEFPAGGPFSSPSDSSTFPS

SEQ ID NO: 2124125 - protein, 22 aa, Cryptosporidium hominis
IKSPMMAGGLFAMKRDYFWHLG

SEQ ID NO: 2124126 - protein, 19 aa, Cryptosporidium hominis
IKSYSWERYFIKNIDSHRE

SEQ ID NO: 2124127 - protein, 21 aa, Cryptosporidium hominis
IKTLPKQGIVFIIGGGNFTEA

SEQ ID NO: 2124128 - protein, 18 aa, Cryptosporidium hominis
IKTSIITFFTWIIVLANL

SEQ ID NO: 2124129 - protein, 17 aa, Cryptosporidium hominis
IKVNFELLINVPKSPIT

SEQ ID NO: 2124130 - protein, 27 aa, Cryptosporidium hominis
IKVQEGFWKKHFIYIGMNPPQIVTNSG

SEQ ID NO: 2124131 - protein, 25 aa, Cryptosporidium hominis
IKYFIKLLKMRSIDSIFWMIAFIGT

SEQ ID NO: 2124132 - protein, 17 aa, Cryptosporidium hominis
IKYPIAVNYLYPKKIIS

SEQ ID NO: 2124133 - protein, 19 aa, Cryptosporidium hominis
IKYQILIDKLNPMYITEKK

SEQ ID NO: 2124134 - protein, 17 aa, Cryptosporidium hominis
IKYSSYFLALNQILRQV

SEQ ID NO: 2124135 - protein, 18 aa, Cryptosporidium hominis
IKYYRGTNSFHYLFDLRQ

SEQ ID NO: 2124136 - protein, 17 aa, Cryptosporidium hominis
ILACIISYNIFKNIHFV

SEQ ID NO: 2124137 - protein, 24 aa, Cryptosporidium hominis
ILAQEFLLMLNWYIYNAMGSDPII

SEQ ID NO: 2124138 - protein, 25 aa, Cryptosporidium hominis
ILAVSILCLVFWYNLMKVTNVEFSD

SEQ ID NO: 2124139 - protein, 17 aa, Cryptosporidium hominis
ILCILISTIILRAGEEF

SEQ ID NO: 2124140 - protein, 25 aa, Cryptosporidium hominis
ILCNCCYKESYNLNTFDLIFYIQNQ

SEQ ID NO: 2124141 - protein, 17 aa, Cryptosporidium hominis
ILCNSIYIICSFCHLSC

SEQ ID NO: 2124142 - protein, 18 aa, Cryptosporidium hominis
ILDIKSIILKFNYKQKSP

SEQ ID NO: 2124143 - protein, 18 aa, Cryptosporidium hominis
ILDIYAKLIIVVSPFGAI

SEQ ID NO: 2124144 - protein, 19 aa, Cryptosporidium hominis
ILDRNVLFSRLFWLDIAYS

SEQ ID NO: 2124145 - protein, 18 aa, Cryptosporidium hominis
ILDYMVVKCMDSFSRLFS

SEQ ID NO: 2124146 - protein, 19 aa, Cryptosporidium hominis
ILEEQVWALLPGFFDEPLD

SEQ ID NO: 2124147 - protein, 18 aa, Cryptosporidium hominis
ILEFNWLNPNLKKLRYTL

SEQ ID NO: 2124148 - protein, 25 aa, Cryptosporidium hominis
ILEKLEPRASISLAKTKTKATGWAG

SEQ ID NO: 2124149 - protein, 26 aa, Cryptosporidium hominis
ILEKVEYRWNFLINILDFVDKNEGNK

SEQ ID NO: 2124150 - protein, 27 aa, Cryptosporidium hominis
ILERDCGWRRPRITIPPPVDSIDASPL

SEQ ID NO: 2124151 - protein, 19 aa, Cryptosporidium hominis
ILESNSFIISRNRNQKSGE

SEQ ID NO: 2124152 - protein, 19 aa, Cryptosporidium hominis
ILFCLCMTGSLLTYKYIFD

SEQ ID NO: 2124153 - protein, 28 aa, Cryptosporidium hominis
ILFELFSSYFLEHIIKLLKIHKLINGET

SEQ ID NO: 2124154 - protein, 17 aa, Cryptosporidium hominis
ILFKLGTMGLIPVNRGD

SEQ ID NO: 2124155 - protein, 18 aa, Cryptosporidium hominis
ILFQLVAYIFAARVLSTL

SEQ ID NO: 2124156 - protein, 30 aa, Cryptosporidium hominis
ILFWMPFYYLFKLCFLFWLFLPQTTGAVTL

SEQ ID NO: 2124157 - protein, 18 aa, Cryptosporidium hominis
ILFYKYSFNILVFLFIQI

SEQ ID NO: 2124158 - protein, 20 aa, Cryptosporidium hominis
ILFYLCRVLYSIGKSASQRE

SEQ ID NO: 2124159 - protein, 18 aa, Cryptosporidium hominis
ILGLCIIAGSLFLIGGRS

SEQ ID NO: 2124160 - protein, 19 aa, Cryptosporidium hominis
ILGLLRLHALLGSYYIAIE

SEQ ID NO: 2124161 - protein, 18 aa, Cryptosporidium hominis
ILGNIPNIALYIFNSATE

SEQ ID NO: 2124162 - protein, 24 aa, Cryptosporidium hominis
ILGSPFWMAPEIILGTGTGIRTKA

SEQ ID NO: 2124163 - protein, 18 aa, Cryptosporidium hominis
ILHMAIFLAIFMNKTQNS

SEQ ID NO: 2124164 - protein, 18 aa, Cryptosporidium hominis
ILHSCFELNPGYIYINHL

SEQ ID NO: 2124165 - protein, 18 aa, Cryptosporidium hominis
ILHYIYFVEIINHIFVEA

SEQ ID NO: 2124166 - protein, 18 aa, Cryptosporidium hominis
ILIDLADILPNWMKPNNS

SEQ ID NO: 2124167 - protein, 17 aa, Cryptosporidium hominis
ILIELAWIPSTFRNLFW

SEQ ID NO: 2124168 - protein, 18 aa, Cryptosporidium hominis
ILIKKWETTKGIILMLKY

SEQ ID NO: 2124169 - protein, 17 aa, Cryptosporidium hominis
ILILKLLSIQNYEKSIE

SEQ ID NO: 2124170 - protein, 20 aa, Cryptosporidium hominis
ILILLSLFKIIPIWNKLSKI

SEQ ID NO: 2124171 - protein, 25 aa, Cryptosporidium hominis
ILINKCPFLALLLLYISSHKRHLKE

SEQ ID NO: 2124172 - protein, 23 aa, Cryptosporidium hominis
ILIYEMVVGFPPFYDDEPMGIYQ

SEQ ID NO: 2124173 - protein, 21 aa, Cryptosporidium hominis
ILKKTHLFMSTKYYSKHSKNI

SEQ ID NO: 2124174 - protein, 17 aa, Cryptosporidium hominis
ILKMISFTPTSWKKRPD

SEQ ID NO: 2124175 - protein, 17 aa, Cryptosporidium hominis
ILKQFCSAFDSIQLSPK

SEQ ID NO: 2124176 - protein, 17 aa, Cryptosporidium hominis
ILLCAAGAIVVLTTFRK

SEQ ID NO: 2124177 - protein, 18 aa, Cryptosporidium hominis
ILLCTSVGQMADKIVLEQ

SEQ ID NO: 2124178 - protein, 17 aa, Cryptosporidium hominis
ILLCYALNIFLSLVFCQ

SEQ ID NO: 2124179 - protein, 24 aa, Cryptosporidium hominis
ILLELLCPRFTTAMERIHVLDSFR

SEQ ID NO: 2124180 - protein, 17 aa, Cryptosporidium hominis
ILLFPSFIVNLIGCMIF

SEQ ID NO: 2124181 - protein, 18 aa, Cryptosporidium hominis
ILLIEIFIGIAISAWKLW

SEQ ID NO: 2124182 - protein, 26 aa, Cryptosporidium hominis
ILLIIYCVFCGLTTSAIQQSICIRFI

SEQ ID NO: 2124183 - protein, 18 aa, Cryptosporidium hominis
ILLIWFMTIMLVYEAIQR

SEQ ID NO: 2124184 - protein, 17 aa, Cryptosporidium hominis
ILLKAIWISCFLVSSSA

SEQ ID NO: 2124185 - protein, 21 aa, Cryptosporidium hominis
ILLLFRWVILLMYIVAQLFLP

SEQ ID NO: 2124186 - protein, 18 aa, Cryptosporidium hominis
ILLLFYFIIGWLGTFYPP

SEQ ID NO: 2124187 - protein, 18 aa, Cryptosporidium hominis
ILLPLIGLLTEISMFRDW

SEQ ID NO: 2124188 - protein, 24 aa, Cryptosporidium hominis
ILLRIIFMIILLRYIPWGSHYFFY

SEQ ID NO: 2124189 - protein, 19 aa, Cryptosporidium hominis
ILLSIPVIILWVFSELFSR

SEQ ID NO: 2124190 - protein, 24 aa, Cryptosporidium hominis
ILLTFFILRIIIRLFVTPIIKTLS

SEQ ID NO: 2124191 - protein, 27 aa, Cryptosporidium hominis
ILLTLCFTWASLGVFVSHIAFMIFYGI

SEQ ID NO: 2124192 - protein, 19 aa, Cryptosporidium hominis
ILMNLSCKSFCTKKQNLDN

SEQ ID NO: 2124193 - protein, 23 aa, Cryptosporidium hominis
ILNGWRVAPAITYQYYQKSTLKS

SEQ ID NO: 2124194 - protein, 18 aa, Cryptosporidium hominis
ILNIPDLYIQATAKKILK

SEQ ID NO: 2124195 - protein, 21 aa, Cryptosporidium hominis
ILNLFFKVVISISRILVHIPI

SEQ ID NO: 2124196 - protein, 36 aa, Cryptosporidium hominis
ILNNRLFSLWLFVQKRLTTIQIAIKIMKESKELTNR

SEQ ID NO: 2124197 - protein, 24 aa, Cryptosporidium hominis
ILNREEIKVDINIYIRDEGTDGLI

SEQ ID NO: 2124198 - protein, 26 aa, Cryptosporidium hominis
ILPHISCPICKVWCLDKEDFSDHVRN

SEQ ID NO: 2124199 - protein, 22 aa, Cryptosporidium hominis
ILPIFLELFIIKNIYANNIEPN

SEQ ID NO: 2124200 - protein, 17 aa, Cryptosporidium hominis
ILQCNLLKNDAYNQNHN

SEQ ID NO: 2124201 - protein, 22 aa, Cryptosporidium hominis
ILQIKLPFIGRKSMENLEKIET

SEQ ID NO: 2124202 - protein, 25 aa, Cryptosporidium hominis
ILQYSEIFLPFVMLAYVILRMIYEW

SEQ ID NO: 2124203 - protein, 33 aa, Cryptosporidium hominis
ILRLGSLWQGIFLRFYIWAILWAIMIIFTTFKT

SEQ ID NO: 2124204 - protein, 21 aa, Cryptosporidium hominis
ILRLISLMFSLFILGFIITSR

SEQ ID NO: 2124205 - protein, 20 aa, Cryptosporidium hominis
ILRLQVWNRGLLVFGDAISE

SEQ ID NO: 2124206 - protein, 20 aa, Cryptosporidium hominis
ILRVQFLVLLLFLNNLACEN

SEQ ID NO: 2124207 - protein, 18 aa, Cryptosporidium hominis
ILSEPTLISGYEFYVTIF

SEQ ID NO: 2124208 - protein, 23 aa, Cryptosporidium hominis
ILSGEALRVLGIAILPLTSEDFF

SEQ ID NO: 2124209 - protein, 18 aa, Cryptosporidium hominis
ILSKEIFAPVSNRELQCR

SEQ ID NO: 2124210 - protein, 18 aa, Cryptosporidium hominis
ILSKHSINILIPVSNEFR

SEQ ID NO: 2124211 - protein, 17 aa, Cryptosporidium hominis
ILSKMAMKARYFLIDIA

SEQ ID NO: 2124212 - protein, 27 aa, Cryptosporidium hominis
ILSKVIAVICLIVWVINFRNFQDPAHG

SEQ ID NO: 2124213 - protein, 23 aa, Cryptosporidium hominis
ILSLCIKYCPFLLIHAASLSPAV

SEQ ID NO: 2124214 - protein, 31 aa, Cryptosporidium hominis
ILSLYLSIIKFCFKFGIFYILKSQLNKKQEI

SEQ ID NO: 2124215 - protein, 24 aa, Cryptosporidium hominis
ILTELFPSIVIVVSFWQKISPSTL

SEQ ID NO: 2124216 - protein, 18 aa, Cryptosporidium hominis
ILTHFPGINGSTSMAVLG

SEQ ID NO: 2124217 - protein, 21 aa, Cryptosporidium hominis
ILTNRIKIWSNIDVKQKDYFI

SEQ ID NO: 2124218 - protein, 19 aa, Cryptosporidium hominis
ILVETNKYYLIFSLAFFIL

SEQ ID NO: 2124219 - protein, 18 aa, Cryptosporidium hominis
ILVKRYLLDFLISHVPIN

SEQ ID NO: 2124220 - protein, 18 aa, Cryptosporidium hominis
ILVPCIFFVQGWLKALEI

SEQ ID NO: 2124221 - protein, 26 aa, Cryptosporidium hominis
ILVPVILCYISLPLFVKFVAKANLNE

SEQ ID NO: 2124222 - protein, 18 aa, Cryptosporidium hominis
ILVTVCTTVQLILKEEYR

SEQ ID NO: 2124223 - protein, 18 aa, Cryptosporidium hominis
ILVVCMFAGGSLIFFKKF

SEQ ID NO: 2124224 - protein, 22 aa, Cryptosporidium hominis
ILYEFCGRIEFSRNCEALLEEI

SEQ ID NO: 2124225 - protein, 24 aa, Cryptosporidium hominis
ILYGLCLGLLFLGKREACETTLEA

SEQ ID NO: 2124226 - protein, 17 aa, Cryptosporidium hominis
ILYPSKYSFGLYDQLPI

SEQ ID NO: 2124227 - protein, 21 aa, Cryptosporidium hominis
ILYRIFACITFALFFRNLGLE

SEQ ID NO: 2124228 - protein, 17 aa, Cryptosporidium hominis
ILYVVAVVFFRLMYSVR

SEQ ID NO: 2124229 - protein, 23 aa, Cryptosporidium hominis
IMFLIEGLLCFFLGMTSDLKSKK

SEQ ID NO: 2124230 - protein, 20 aa, Cryptosporidium hominis
IMLETSKGERCWKLRDPNEM

SEQ ID NO: 2124231 - protein, 20 aa, Cryptosporidium hominis
IMLYFFSLSSMRNFNGQPKD

SEQ ID NO: 2124232 - protein, 32 aa, Cryptosporidium hominis
IMMIIIRLGVYSSIFYYKMVLFKSKIDTDEFD

SEQ ID NO: 2124233 - protein, 17 aa, Cryptosporidium hominis
IMSLRTSSNIGISYYSL

SEQ ID NO: 2124234 - protein, 19 aa, Cryptosporidium hominis
IMTVIPWILTIALFGLLRL

SEQ ID NO: 2124235 - protein, 25 aa, Cryptosporidium hominis
IMYMLLISLGWRVLRDSLLSMEAKL

SEQ ID NO: 2124236 - protein, 17 aa, Cryptosporidium hominis
IMYPNYWLIDQSISNES

SEQ ID NO: 2124237 - protein, 22 aa, Cryptosporidium hominis
INAKDGRFCLYNSKFNIFDCLP

SEQ ID NO: 2124238 - protein, 21 aa, Cryptosporidium hominis
INAPSIFGIIWNFLKPLIDER

SEQ ID NO: 2124239 - protein, 22 aa, Cryptosporidium hominis
INCIQSSWKMVEFNWKNQNVQT

SEQ ID NO: 2124240 - protein, 17 aa, Cryptosporidium hominis
INCLYFLLVSLYLFRFV

SEQ ID NO: 2124241 - protein, 17 aa, Cryptosporidium hominis
INCRRWVTKDNPSVRPE

SEQ ID NO: 2124242 - protein, 27 aa, Cryptosporidium hominis
INDSMKCAFDFLFRGIRRVQRLVELSQ

SEQ ID NO: 2124243 - protein, 19 aa, Cryptosporidium hominis
INELLRLLKIESLNKDGIK

SEQ ID NO: 2124244 - protein, 18 aa, Cryptosporidium hominis
INEREGYNFSRCYVFILT

SEQ ID NO: 2124245 - protein, 19 aa, Cryptosporidium hominis
INERTCIEILYKLIKKKGL

SEQ ID NO: 2124246 - protein, 17 aa, Cryptosporidium hominis
INFCINKNGKISKSKDL

SEQ ID NO: 2124247 - protein, 17 aa, Cryptosporidium hominis
INFGYGIEEEQEEENEE

SEQ ID NO: 2124248 - protein, 23 aa, Cryptosporidium hominis
INFNKYFLLVVTIIVYFNNLMFN

SEQ ID NO: 2124249 - protein, 23 aa, Cryptosporidium hominis
INFRKKLRLNLKYIHNATKSRYL

SEQ ID NO: 2124250 - protein, 18 aa, Cryptosporidium hominis
INGVTMQVLVRWLTSIDY

SEQ ID NO: 2124251 - protein, 18 aa, Cryptosporidium hominis
INIAIIWIFILRLFGQFS

SEQ ID NO: 2124252 - protein, 23 aa, Cryptosporidium hominis
INIEEVKKFISFQKLKIERLENM

SEQ ID NO: 2124253 - protein, 18 aa, Cryptosporidium hominis
INIEEYLFFYVVKFTCIF

SEQ ID NO: 2124254 - protein, 17 aa, Cryptosporidium hominis
INIFNGWADFLESRTQS

SEQ ID NO: 2124255 - protein, 20 aa, Cryptosporidium hominis
INIIKIRLPILYNAFNNKDS

SEQ ID NO: 2124256 - protein, 20 aa, Cryptosporidium hominis
INILRRRHKVAPSKAQIIRV

SEQ ID NO: 2124257 - protein, 18 aa, Cryptosporidium hominis
INKICELERDIIRNSKTN

SEQ ID NO: 2124258 - protein, 25 aa, Cryptosporidium hominis
INKKFKEYLGLAVDYRFISSDKDES

SEQ ID NO: 2124259 - protein, 19 aa, Cryptosporidium hominis
INLDNIVLRGCILRSTEWA

SEQ ID NO: 2124260 - protein, 20 aa, Cryptosporidium hominis
INLHIPFHFIIVAEGKTTDK

SEQ ID NO: 2124261 - protein, 19 aa, Cryptosporidium hominis
INLLAIVISLYIISISSVV

SEQ ID NO: 2124262 - protein, 19 aa, Cryptosporidium hominis
INLLPKFIENGLINKLNIL

SEQ ID NO: 2124263 - protein, 17 aa, Cryptosporidium hominis
INLLRDIIKTVVTDDKI

SEQ ID NO: 2124264 - protein, 17 aa, Cryptosporidium hominis
INLLRFALQIHKIGSSF

SEQ ID NO: 2124265 - protein, 26 aa, Cryptosporidium hominis
INLPLFLIFLCVFRVLSNFFLTVILL

SEQ ID NO: 2124266 - protein, 19 aa, Cryptosporidium hominis
INLRMQLEFPKLPCDILGV

SEQ ID NO: 2124267 - protein, 23 aa, Cryptosporidium hominis
INMFKDCIERCKSNLKQAQYKSG

SEQ ID NO: 2124268 - protein, 33 aa, Cryptosporidium hominis
INNEHNPFCQASLKTTNNIKFMCINNPIYCIHN

SEQ ID NO: 2124269 - protein, 26 aa, Cryptosporidium hominis
INNKEKFNGILTDLFSKNLNRSQNNI

SEQ ID NO: 2124270 - protein, 24 aa, Cryptosporidium hominis
INNRIPCMAFDIIMHTVSPQNKDI

SEQ ID NO: 2124271 - protein, 28 aa, Cryptosporidium hominis
INPFYFWDLRFGQSIVCDNAPKICNILK

SEQ ID NO: 2124272 - protein, 25 aa, Cryptosporidium hominis
INPIKARELLLLFFINLGRTSAEEK

SEQ ID NO: 2124273 - protein, 28 aa, Cryptosporidium hominis
INPLSWFKHRHTIGSLKGDLLVPPTSAS

SEQ ID NO: 2124274 - protein, 19 aa, Cryptosporidium hominis
INPPISIKDYFTRLSEYFL

SEQ ID NO: 2124275 - protein, 24 aa, Cryptosporidium hominis
INRNILCGLPIYSLFTDEFELTKK

SEQ ID NO: 2124276 - protein, 19 aa, Cryptosporidium hominis
INSELKIYSQRNVQQCAES

SEQ ID NO: 2124277 - protein, 24 aa, Cryptosporidium hominis
INSKSKVSWTRVLQKIRILNIPDL

SEQ ID NO: 2124278 - protein, 38 aa, Cryptosporidium hominis
INSVLKPRFAQICLDAWFKMRIKILLTIPITLINILLP

SEQ ID NO: 2124279 - protein, 25 aa, Cryptosporidium hominis
INTFKNFLLRISLRNQNTIQTLETD

SEQ ID NO: 2124280 - protein, 18 aa, Cryptosporidium hominis
INTNFGINGEEILSKNSE

SEQ ID NO: 2124281 - protein, 24 aa, Cryptosporidium hominis
INTPKSQFCELNFMHLEELLSISC

SEQ ID NO: 2124282 - protein, 25 aa, Cryptosporidium hominis
INTYLGNCLIELPNICNIMQIKEVL

SEQ ID NO: 2124283 - protein, 28 aa, Cryptosporidium hominis
INVEDYSAYCLRRIDGFPLSEFEAVRPL

SEQ ID NO: 2124284 - protein, 24 aa, Cryptosporidium hominis
INYSISTWIAGFIVTFLSLFLQPL

SEQ ID NO: 2124285 - protein, 17 aa, Cryptosporidium hominis
INYSLGEYVPVVTRAKY

SEQ ID NO: 2124286 - protein, 21 aa, Cryptosporidium hominis
IPANLLLLIGIYYLPMEEICN

SEQ ID NO: 2124287 - protein, 26 aa, Cryptosporidium hominis
IPCEAVGALCKLRYPDGKKITINTEY

SEQ ID NO: 2124288 - protein, 20 aa, Cryptosporidium hominis
IPCSILFLKALESCIDDENI

SEQ ID NO: 2124289 - protein, 29 aa, Cryptosporidium hominis
IPDRIIIMIHHFPTFLNVFINSRMETTLV

SEQ ID NO: 2124290 - protein, 22 aa, Cryptosporidium hominis
IPEKHYSSSHFIQFNGKQILRT

SEQ ID NO: 2124291 - protein, 21 aa, Cryptosporidium hominis
IPFFISQAFYSFLYCLIYLIF

SEQ ID NO: 2124292 - protein, 18 aa, Cryptosporidium hominis
IPGLSRYLLYTLLFGSLK

SEQ ID NO: 2124293 - protein, 19 aa, Cryptosporidium hominis
IPGQPRWSAKFRSDIRRQA

SEQ ID NO: 2124294 - protein, 17 aa, Cryptosporidium hominis
IPGTFLILFSIIIDTAN

SEQ ID NO: 2124295 - protein, 24 aa, Cryptosporidium hominis
IPIKCGVLKLFLSLALSSSKKKFI

SEQ ID NO: 2124296 - protein, 20 aa, Cryptosporidium hominis
IPIMFLIIISMFRMIRHSSM

SEQ ID NO: 2124297 - protein, 17 aa, Cryptosporidium hominis
IPIPKGNLVTSVRPENK

SEQ ID NO: 2124298 - protein, 17 aa, Cryptosporidium hominis
IPKDFSEKFILDISVKV

SEQ ID NO: 2124299 - protein, 23 aa, Cryptosporidium hominis
IPKYRGCYVKGILQPSRAIGDFR

SEQ ID NO: 2124300 - protein, 17 aa, Cryptosporidium hominis
IPLAFIIYYRRQKKYAS

SEQ ID NO: 2124301 - protein, 26 aa, Cryptosporidium hominis
IPLEGLEMYCKTVWKCIVDCQELNIP

SEQ ID NO: 2124302 - protein, 17 aa, Cryptosporidium hominis
IPLKDLLLKSFIALQDQ

SEQ ID NO: 2124303 - protein, 26 aa, Cryptosporidium hominis
IPLMNCFTIILSRIIYWYNTTKLYSE

SEQ ID NO: 2124304 - protein, 18 aa, Cryptosporidium hominis
IPLPNYLIGMQFLQIVSY

SEQ ID NO: 2124305 - protein, 20 aa, Cryptosporidium hominis
IPLQLIAYYLAIKRGINPDK

SEQ ID NO: 2124306 - protein, 25 aa, Cryptosporidium hominis
IPLRWISFFLFKWRLELDESFIGGP

SEQ ID NO: 2124307 - protein, 19 aa, Cryptosporidium hominis
IPLSFLILNSLTFVPNTSN

SEQ ID NO: 2124308 - protein, 30 aa, Cryptosporidium hominis
IPLTLRISALEFIIRYCHVYSRMTPEDKAM

SEQ ID NO: 2124309 - protein, 17 aa, Cryptosporidium hominis
IPLWKDKLNTVLENVND

SEQ ID NO: 2124310 - protein, 27 aa, Cryptosporidium hominis
IPMELKEELLRSMTLCYTNIGNPQIIR

SEQ ID NO: 2124311 - protein, 21 aa, Cryptosporidium hominis
IPNHCSILILSYLIISNSLER

SEQ ID NO: 2124312 - protein, 23 aa, Cryptosporidium hominis
IPNLLFQFYCEWSGTLLQLLDIV

SEQ ID NO: 2124313 - protein, 18 aa, Cryptosporidium hominis
IPNSRYSPVLPLQKSGFI

SEQ ID NO: 2124314 - protein, 27 aa, Cryptosporidium hominis
IPQAICSRYGLYIGGFFSPFIRLIQII

SEQ ID NO: 2124315 - protein, 32 aa, Cryptosporidium hominis
IPRHSLNFTMMWLQYCGLSPLLATTVYSSSWI

SEQ ID NO: 2124316 - protein, 17 aa, Cryptosporidium hominis
IPRSFICIDHVVIFVTL

SEQ ID NO: 2124317 - protein, 18 aa, Cryptosporidium hominis
IPSLLSLRNSSFIHKTRQ

SEQ ID NO: 2124318 - protein, 22 aa, Cryptosporidium hominis
IPSPESILFSPFCNISDANEDA

SEQ ID NO: 2124319 - protein, 18 aa, Cryptosporidium hominis
IPSYLWYLPSDKIFPFPI

SEQ ID NO: 2124320 - protein, 30 aa, Cryptosporidium hominis
IPTIALPLICMLCFSAAQAAYEDWKRHKAD

SEQ ID NO: 2124321 - protein, 28 aa, Cryptosporidium hominis
IPTILVCIFKKKWLVAFLAFIAGLISSI

SEQ ID NO: 2124322 - protein, 22 aa, Cryptosporidium hominis
IPVEKFSTVALIGFLVSQYKHF

SEQ ID NO: 2124323 - protein, 18 aa, Cryptosporidium hominis
IPVERWFQRQDNFEASVT

SEQ ID NO: 2124324 - protein, 20 aa, Cryptosporidium hominis
IPVFIYGFFTLWSGTRLYFD

SEQ ID NO: 2124325 - protein, 17 aa, Cryptosporidium hominis
IPVFRDIISRDELIEKG

SEQ ID NO: 2124326 - protein, 17 aa, Cryptosporidium hominis
IPVLACASTCGYKSGFI

SEQ ID NO: 2124327 - protein, 19 aa, Cryptosporidium hominis
IPVSCLMLSQYIIYISSEL

SEQ ID NO: 2124328 - protein, 19 aa, Cryptosporidium hominis
IPVWIRWLGWISTVRYTYT

SEQ ID NO: 2124329 - protein, 20 aa, Cryptosporidium hominis
IPWKSESKVLISDNNTFLNT

SEQ ID NO: 2124330 - protein, 17 aa, Cryptosporidium hominis
IPYERWDVDKLFGNYND

SEQ ID NO: 2124331 - protein, 17 aa, Cryptosporidium hominis
IPYFPSNFYYIEQVHVS

SEQ ID NO: 2124332 - protein, 28 aa, Cryptosporidium hominis
IQDESYLRFEILREFIKNNVKSFQRTTN

SEQ ID NO: 2124333 - protein, 17 aa, Cryptosporidium hominis
IQDGLPISSSSSLYYGN

SEQ ID NO: 2124334 - protein, 19 aa, Cryptosporidium hominis
IQDKFKLAFLSIKSCTSLS

SEQ ID NO: 2124335 - protein, 25 aa, Cryptosporidium hominis
IQETCLMLRMLLHLYSGMRTRTQFL

SEQ ID NO: 2124336 - protein, 26 aa, Cryptosporidium hominis
IQFILLPCRIFVASLLMYRNIGESAI

SEQ ID NO: 2124337 - protein, 17 aa, Cryptosporidium hominis
IQGEITDSLGLIVDENG

SEQ ID NO: 2124338 - protein, 23 aa, Cryptosporidium hominis
IQHTDYWVLKLINRGCYMRQIVK

SEQ ID NO: 2124339 - protein, 20 aa, Cryptosporidium hominis
IQIAIVFLYFILRIITSFTR

SEQ ID NO: 2124340 - protein, 18 aa, Cryptosporidium hominis
IQIILFPLLKPISVILDK

SEQ ID NO: 2124341 - protein, 26 aa, Cryptosporidium hominis
IQINIKAWFFWIVYSFLVFIIYFSAD

SEQ ID NO: 2124342 - protein, 24 aa, Cryptosporidium hominis
IQIQICIIDLLKLVQDNSLILLSI

SEQ ID NO: 2124343 - protein, 19 aa, Cryptosporidium hominis
IQKLLVIKKKIFSLNFDEI

SEQ ID NO: 2124344 - protein, 18 aa, Cryptosporidium hominis
IQLFLNLVIDSIVALSPN

SEQ ID NO: 2124345 - protein, 24 aa, Cryptosporidium hominis
IQLICSLCVIIIIFNKDWISGQNT

SEQ ID NO: 2124346 - protein, 22 aa, Cryptosporidium hominis
IQLKSGQLFTIYLIIILISSIF

SEQ ID NO: 2124347 - protein, 24 aa, Cryptosporidium hominis
IQLLEPRIQLILSEQRQISQLATL

SEQ ID NO: 2124348 - protein, 23 aa, Cryptosporidium hominis
IQLSALKCYFSLSLQGFTETMAV

SEQ ID NO: 2124349 - protein, 18 aa, Cryptosporidium hominis
IQNSRLILLNSIEDFSGI

SEQ ID NO: 2124350 - protein, 20 aa, Cryptosporidium hominis
IQPIVFCLFSDLKNQILYGK

SEQ ID NO: 2124351 - protein, 25 aa, Cryptosporidium hominis
IQPSLRPLVPLALDRSIREILQVVI

SEQ ID NO: 2124352 - protein, 22 aa, Cryptosporidium hominis
IQQVCGMIFYLIAYATLNLFGI

SEQ ID NO: 2124353 - protein, 25 aa, Cryptosporidium hominis
IQRVAFCKEYGLIAIIVGIPDNAKH

SEQ ID NO: 2124354 - protein, 18 aa, Cryptosporidium hominis
IQSGCYISTFSPSRQREN

SEQ ID NO: 2124355 - protein, 24 aa, Cryptosporidium hominis
IQSHGRIGMMQGIPQHMGGAGQGI

SEQ ID NO: 2124356 - protein, 17 aa, Cryptosporidium hominis
IQTRRAILKSLDEDSLG

SEQ ID NO: 2124357 - protein, 17 aa, Cryptosporidium hominis
IQTWWKYTCKITGESQN

SEQ ID NO: 2124358 - protein, 17 aa, Cryptosporidium hominis
IQVDRWAPRTELVQAIR

SEQ ID NO: 2124359 - protein, 18 aa, Cryptosporidium hominis
IQVLEDFTILTQLIENKL

SEQ ID NO: 2124360 - protein, 19 aa, Cryptosporidium hominis
IQVSIAIGVTTWKILALNI

SEQ ID NO: 2124361 - protein, 24 aa, Cryptosporidium hominis
IQYCKCSGCVSNIENIRRKHRSFS

SEQ ID NO: 2124362 - protein, 18 aa, Cryptosporidium hominis
IQYNNKYLGFSWDQQYLS

SEQ ID NO: 2124363 - protein, 21 aa, Cryptosporidium hominis
IREIFKNEIFNSMKMGRYYHC

SEQ ID NO: 2124364 - protein, 19 aa, Cryptosporidium hominis
IRETFKIQHAMNGIEVSNW

SEQ ID NO: 2124365 - protein, 17 aa, Cryptosporidium hominis
IRFTFIFDYEIQQILNF

SEQ ID NO: 2124366 - protein, 19 aa, Cryptosporidium hominis
IRGKLRTTFYGYLISNNET

SEQ ID NO: 2124367 - protein, 27 aa, Cryptosporidium hominis
IRGKPMILCPYRWTKLQNIIQKINIRR

SEQ ID NO: 2124368 - protein, 22 aa, Cryptosporidium hominis
IRGVMKYSNYRGFGTNQFTFQS

SEQ ID NO: 2124369 - protein, 19 aa, Cryptosporidium hominis
IRHVKSIMSNVTFYEYYKK

SEQ ID NO: 2124370 - protein, 17 aa, Cryptosporidium hominis
IRIFHSGSYSGLRTSFD

SEQ ID NO: 2124371 - protein, 19 aa, Cryptosporidium hominis
IRIFLLRLNADLMWNYTQN

SEQ ID NO: 2124372 - protein, 20 aa, Cryptosporidium hominis
IRIGQWSAIVHLHALDSEDG

SEQ ID NO: 2124373 - protein, 18 aa, Cryptosporidium hominis
IRIKSFYISIVYGSKEEN

SEQ ID NO: 2124374 - protein, 25 aa, Cryptosporidium hominis
IRILQEPHCSFVIQVFSEIKWSRLS

SEQ ID NO: 2124375 - protein, 17 aa, Cryptosporidium hominis
IRKAMKYNISSNYIQKL

SEQ ID NO: 2124376 - protein, 20 aa, Cryptosporidium hominis
IRKAPKYMKFHFPEFSDRYE

SEQ ID NO: 2124377 - protein, 17 aa, Cryptosporidium hominis
IRKEARFLTHLTGKSLC

SEQ ID NO: 2124378 - protein, 28 aa, Cryptosporidium hominis
IRKEEIRHLGIWRFLNQFGLVLATLCVS

SEQ ID NO: 2124379 - protein, 17 aa, Cryptosporidium hominis
IRKQSLRQYVSQVCMRS

SEQ ID NO: 2124380 - protein, 18 aa, Cryptosporidium hominis
IRKYIEFRGKRKGYSGKN

SEQ ID NO: 2124381 - protein, 19 aa, Cryptosporidium hominis
IRKYSSFGGAEFFISVESK

SEQ ID NO: 2124382 - protein, 25 aa, Cryptosporidium hominis
IRLILEGGGIPSVFLQSISDWTGSD

SEQ ID NO: 2124383 - protein, 17 aa, Cryptosporidium hominis
IRLPILYNAFNNKDSTN

SEQ ID NO: 2124384 - protein, 19 aa, Cryptosporidium hominis
IRMVKKAVIPKEIKENDIY

SEQ ID NO: 2124385 - protein, 19 aa, Cryptosporidium hominis
IRNKCLISLNCADPNHEQL

SEQ ID NO: 2124386 - protein, 19 aa, Cryptosporidium hominis
IRNTELFIGPLSFFQTNTK

SEQ ID NO: 2124387 - protein, 18 aa, Cryptosporidium hominis
IRNTLSLIGNWIGYQMSG

SEQ ID NO: 2124388 - protein, 21 aa, Cryptosporidium hominis
IRNVVSFKFQAAISEIFRKCI

SEQ ID NO: 2124389 - protein, 17 aa, Cryptosporidium hominis
IRPEAKLVLKLLKNGNF

SEQ ID NO: 2124390 - protein, 22 aa, Cryptosporidium hominis
IRPERCKMPYWIRIMNNKFYHN

SEQ ID NO: 2124391 - protein, 25 aa, Cryptosporidium hominis
IRPKSVEWFNGLFFDHSMKKTTLFY

SEQ ID NO: 2124392 - protein, 20 aa, Cryptosporidium hominis
IRPLKSGSFIKERIDHKKTD

SEQ ID NO: 2124393 - protein, 21 aa, Cryptosporidium hominis
IRRLILAFIMFFFMLDFIGSM

SEQ ID NO: 2124394 - protein, 23 aa, Cryptosporidium hominis
IRSAGFPTALSIRLNELANVFTN

SEQ ID NO: 2124395 - protein, 21 aa, Cryptosporidium hominis
IRSGVKIIDLEVRYRRPNSNP

SEQ ID NO: 2124396 - protein, 18 aa, Cryptosporidium hominis
IRSRFKYINENSFIDSVI

SEQ ID NO: 2124397 - protein, 25 aa, Cryptosporidium hominis
IRSVLPIIFSESIKNCHLEAFNTSF

SEQ ID NO: 2124398 - protein, 17 aa, Cryptosporidium hominis
IRVKQVKSILEVINTTF

SEQ ID NO: 2124399 - protein, 20 aa, Cryptosporidium hominis
IRVLPCDSRHIFHLECIDGW

SEQ ID NO: 2124400 - protein, 21 aa, Cryptosporidium hominis
IRYFPTQAFGFAFKDMIRDMM

SEQ ID NO: 2124401 - protein, 25 aa, Cryptosporidium hominis
IRYRMRIAGIYLVLGSPISSAMYYN

SEQ ID NO: 2124402 - protein, 21 aa, Cryptosporidium hominis
ISALGTLFCTIYFAVSLSIAG

SEQ ID NO: 2124403 - protein, 20 aa, Cryptosporidium hominis
ISAMPYYSAFILTIISFCYF

SEQ ID NO: 2124404 - protein, 17 aa, Cryptosporidium hominis
ISCGCIAAVFGPIIIYS

SEQ ID NO: 2124405 - protein, 17 aa, Cryptosporidium hominis
ISCSSCQYSEWTMWGEC

SEQ ID NO: 2124406 - protein, 25 aa, Cryptosporidium hominis
ISCVAGKHGWCIPQQKITNDEYIDL

SEQ ID NO: 2124407 - protein, 18 aa, Cryptosporidium hominis
ISDILEFGCNVILNITSG

SEQ ID NO: 2124408 - protein, 25 aa, Cryptosporidium hominis
ISDNKCPPGFNFAYDIWRKQKNKRT

SEQ ID NO: 2124409 - protein, 19 aa, Cryptosporidium hominis
ISEKAVLFLLSLVSNNTKI

SEQ ID NO: 2124410 - protein, 18 aa, Cryptosporidium hominis
ISELLRDHCIYLPQCLIH

SEQ ID NO: 2124411 - protein, 25 aa, Cryptosporidium hominis
ISERLRLIEHWNIHFMAELAEDEYF

SEQ ID NO: 2124412 - protein, 22 aa, Cryptosporidium hominis
ISFDFFSRAPLNSELKPESIVL

SEQ ID NO: 2124413 - protein, 24 aa, Cryptosporidium hominis
ISFGIFCGVLGYIGCTISNSRCVY

SEQ ID NO: 2124414 - protein, 26 aa, Cryptosporidium hominis
ISFIIFRLGFIPGVYVTIIGFLSVVI

SEQ ID NO: 2124415 - protein, 20 aa, Cryptosporidium hominis
ISFIRFLKIEFEKIDKNYSN

SEQ ID NO: 2124416 - protein, 26 aa, Cryptosporidium hominis
ISFLSFILGFSFKFFSRIPRSYFFSP

SEQ ID NO: 2124417 - protein, 17 aa, Cryptosporidium hominis
ISFVPVVRFCTWIVLLA

SEQ ID NO: 2124418 - protein, 19 aa, Cryptosporidium hominis
ISFYSLFLFAFGSPFSETE

SEQ ID NO: 2124419 - protein, 22 aa, Cryptosporidium hominis
ISGDSRFIWNRNISLPVLISGV

SEQ ID NO: 2124420 - protein, 27 aa, Cryptosporidium hominis
ISGFIFSRNMFWLANWTGRKKHLNSSE

SEQ ID NO: 2124421 - protein, 30 aa, Cryptosporidium hominis
ISGNNEFRGSLFLICIRFLCNMFHNSTNRE

SEQ ID NO: 2124422 - protein, 17 aa, Cryptosporidium hominis
ISGNNFISYLPRFIRNY

SEQ ID NO: 2124423 - protein, 23 aa, Cryptosporidium hominis
ISGRSMKVFRCLIKGNCINTTNE

SEQ ID NO: 2124424 - protein, 20 aa, Cryptosporidium hominis
ISGTIPWSSLTFMTMYLQYC

SEQ ID NO: 2124425 - protein, 20 aa, Cryptosporidium hominis
ISIICFLSMAYAVPVYFILL

SEQ ID NO: 2124426 - protein, 23 aa, Cryptosporidium hominis
ISIISCYYKTISFQRVQDLLNLD

SEQ ID NO: 2124427 - protein, 26 aa, Cryptosporidium hominis
ISIKRLAAYLLLCFVIGNGLGPLILF

SEQ ID NO: 2124428 - protein, 27 aa, Cryptosporidium hominis
ISILHLFLVWICEFVFDYKSKIPIFYH

SEQ ID NO: 2124429 - protein, 24 aa, Cryptosporidium hominis
ISILNCLYGLFPPQLEYVEVFETK

SEQ ID NO: 2124430 - protein, 24 aa, Cryptosporidium hominis
ISILRGNNLLTIFFTNLFNQCIEQ

SEQ ID NO: 2124431 - protein, 32 aa, Cryptosporidium hominis
ISIRFKSNIITFIWKPLYYLLTFFTFNFILKA

SEQ ID NO: 2124432 - protein, 19 aa, Cryptosporidium hominis
ISIYCIYDSLVILVYICKL

SEQ ID NO: 2124433 - protein, 24 aa, Cryptosporidium hominis
ISKAGQLFIGFMVFIGSVISFTSV

SEQ ID NO: 2124434 - protein, 17 aa, Cryptosporidium hominis
ISKELLKKLMSKCKERK

SEQ ID NO: 2124435 - protein, 18 aa, Cryptosporidium hominis
ISKEVPLECYKKKHPTIL

SEQ ID NO: 2124436 - protein, 21 aa, Cryptosporidium hominis
ISKQVLSKCFIPQKSGHLINT

SEQ ID NO: 2124437 - protein, 19 aa, Cryptosporidium hominis
ISKYCNSIIHGHESVRDIL

SEQ ID NO: 2124438 - protein, 20 aa, Cryptosporidium hominis
ISLICVFASFGLGIVPTAWK

SEQ ID NO: 2124439 - protein, 21 aa, Cryptosporidium hominis
ISLKKLRSFITIIPQEPNILT

SEQ ID NO: 2124440 - protein, 17 aa, Cryptosporidium hominis
ISLLIATSFSYMKAQNE

SEQ ID NO: 2124441 - protein, 17 aa, Cryptosporidium hominis
ISLLILYFLIFLGNVKS

SEQ ID NO: 2124442 - protein, 22 aa, Cryptosporidium hominis
ISLPLCFIGGLFGQRRSKNYFK

SEQ ID NO: 2124443 - protein, 22 aa, Cryptosporidium hominis
ISLPSSLILYGRVTKEDTYING

SEQ ID NO: 2124444 - protein, 20 aa, Cryptosporidium hominis
ISLRYESRIADSIIEMEQSS

SEQ ID NO: 2124445 - protein, 18 aa, Cryptosporidium hominis
ISLTYRFGSQIASRIHQD

SEQ ID NO: 2124446 - protein, 29 aa, Cryptosporidium hominis
ISMAVVRTCSYISFFWGMIIILFFLTSTL

SEQ ID NO: 2124447 - protein, 39 aa, Cryptosporidium hominis
ISMGTLDWIHCIQARIAILSGIIWGLGIVFAGKRNIELK

SEQ ID NO: 2124448 - protein, 20 aa, Cryptosporidium hominis
ISNFFASFVYYSFGDDTTSP

SEQ ID NO: 2124449 - protein, 17 aa, Cryptosporidium hominis
ISNIIGEKIWNTILISF

SEQ ID NO: 2124450 - protein, 23 aa, Cryptosporidium hominis
ISNLFKVHGLVAFTKWICGCFEE

SEQ ID NO: 2124451 - protein, 29 aa, Cryptosporidium hominis
ISNLIFEILKGLIILLFFVKQRKRLCIVL

SEQ ID NO: 2124452 - protein, 20 aa, Cryptosporidium hominis
ISNLKWKVIVSSSRKYLSST

SEQ ID NO: 2124453 - protein, 24 aa, Cryptosporidium hominis
ISNSEIPSWFVGILTLPTLKEGIS

SEQ ID NO: 2124454 - protein, 18 aa, Cryptosporidium hominis
ISPAIGRDPLFVEFLNDF

SEQ ID NO: 2124455 - protein, 19 aa, Cryptosporidium hominis
ISPGYHFWVAELVKRRNSI

SEQ ID NO: 2124456 - protein, 23 aa, Cryptosporidium hominis
ISPIKIIGVWVLLQRNMGFSANL

SEQ ID NO: 2124457 - protein, 26 aa, Cryptosporidium hominis
ISPIVSMCLIELTNIYDILELEYNSI

SEQ ID NO: 2124458 - protein, 17 aa, Cryptosporidium hominis
ISPLALKGSNRFPILTV

SEQ ID NO: 2124459 - protein, 17 aa, Cryptosporidium hominis
ISPWKPVFIDSSDLRFW

SEQ ID NO: 2124460 - protein, 20 aa, Cryptosporidium hominis
ISQLQLWFPQTIASLRSHFA

SEQ ID NO: 2124461 - protein, 29 aa, Cryptosporidium hominis
ISRFTLYYIKHNIALIFAILVGLTCAIVY

SEQ ID NO: 2124462 - protein, 21 aa, Cryptosporidium hominis
ISRTEMSVGMYIDDLVDENER

SEQ ID NO: 2124463 - protein, 25 aa, Cryptosporidium hominis
ISSCKASACNGCLTISKYNVFTGLA

SEQ ID NO: 2124464 - protein, 23 aa, Cryptosporidium hominis
ISSDFLRKISVLKLCVYVTNSDF

SEQ ID NO: 2124465 - protein, 20 aa, Cryptosporidium hominis
ISSHPLYIVFLIVEIIIQSE

SEQ ID NO: 2124466 - protein, 25 aa, Cryptosporidium hominis
ISSKCSALIQSFWLGIADNVDPELI

SEQ ID NO: 2124467 - protein, 29 aa, Cryptosporidium hominis
ISSLLAQGACWGFAAACHAVVFHALLFTI

SEQ ID NO: 2124468 - protein, 20 aa, Cryptosporidium hominis
ISSLMIKLAECLSLSDTFAG

SEQ ID NO: 2124469 - protein, 18 aa, Cryptosporidium hominis
ISSMCIAVAHFWGMAQIT

SEQ ID NO: 2124470 - protein, 18 aa, Cryptosporidium hominis
ISSSFVAFFAHTLLLIGL

SEQ ID NO: 2124471 - protein, 18 aa, Cryptosporidium hominis
ISSSLLVYMMLKVISTRS

SEQ ID NO: 2124472 - protein, 23 aa, Cryptosporidium hominis
ISSTDGYFWVKLDSLMKLFQGLN

SEQ ID NO: 2124473 - protein, 18 aa, Cryptosporidium hominis
ISSVLMFPYNVYRLISKS

SEQ ID NO: 2124474 - protein, 19 aa, Cryptosporidium hominis
ISTCIKGQIPAPLNEIISE

SEQ ID NO: 2124475 - protein, 27 aa, Cryptosporidium hominis
ISTILLIPCIFLARELELIMGSAAFNT

SEQ ID NO: 2124476 - protein, 22 aa, Cryptosporidium hominis
ISTMLGYYCVWDVDPKLHTPLM

SEQ ID NO: 2124477 - protein, 20 aa, Cryptosporidium hominis
ISTSVSISRYFSRKRSTITI

SEQ ID NO: 2124478 - protein, 19 aa, Cryptosporidium hominis
ISTTLGFSLHYLQLIYNIL

SEQ ID NO: 2124479 - protein, 23 aa, Cryptosporidium hominis
ISTTLPIFTGWSLNDKSPNYFIR

SEQ ID NO: 2124480 - protein, 21 aa, Cryptosporidium hominis
ISVILEYMEPLILLHEQNTDY

SEQ ID NO: 2124481 - protein, 23 aa, Cryptosporidium hominis
ISVPKALKFLGIHYETLKEFCDS

SEQ ID NO: 2124482 - protein, 19 aa, Cryptosporidium hominis
ISVSCTFASRSRFMQMFPK

SEQ ID NO: 2124483 - protein, 36 aa, Cryptosporidium hominis
ISYIFKEPRKLPGPLLPYGFSILILLSLFKIIPIWN

SEQ ID NO: 2124484 - protein, 23 aa, Cryptosporidium hominis
ISYLKVFYIKNMINDWSKEKIKK

SEQ ID NO: 2124485 - protein, 17 aa, Cryptosporidium hominis
ISYNLGLNGPSMTVDTA

SEQ ID NO: 2124486 - protein, 27 aa, Cryptosporidium hominis
ITAFYINFLFIWSCVYISLVLLFFTIS

SEQ ID NO: 2124487 - protein, 18 aa, Cryptosporidium hominis
ITAIKRGFDKKVIFSLLL

SEQ ID NO: 2124488 - protein, 18 aa, Cryptosporidium hominis
ITCSVIYGILLYNRENLP

SEQ ID NO: 2124489 - protein, 18 aa, Cryptosporidium hominis
ITDILMYCDMFFGIIMSI

SEQ ID NO: 2124490 - protein, 18 aa, Cryptosporidium hominis
ITDSLGLIVDENGIKRRT

SEQ ID NO: 2124491 - protein, 24 aa, Cryptosporidium hominis
ITECCAIIGGIFAFSGMIDIFFFK

SEQ ID NO: 2124492 - protein, 27 aa, Cryptosporidium hominis
ITESCCLPEMITFSSFVHLLSSLVDNI

SEQ ID NO: 2124493 - protein, 29 aa, Cryptosporidium hominis
ITFGAFKANSFFFFSWIFMVILPLLISLT

SEQ ID NO: 2124494 - protein, 24 aa, Cryptosporidium hominis
ITFMLSCITLLYLLLERYLEKCIS

SEQ ID NO: 2124495 - protein, 23 aa, Cryptosporidium hominis
ITFPILLGCTILVYEISKFASLC

SEQ ID NO: 2124496 - protein, 23 aa, Cryptosporidium hominis
ITFYFRLDFIMSINPQVSQFLRQ

SEQ ID NO: 2124497 - protein, 25 aa, Cryptosporidium hominis
ITGFSLNYHNGWRYSLLAPCLLLLI

SEQ ID NO: 2124498 - protein, 25 aa, Cryptosporidium hominis
ITGICLTLAGSVWYGFAKSLNCNSG

SEQ ID NO: 2124499 - protein, 24 aa, Cryptosporidium hominis
ITGQCLRLLHKLHNTFELEYLDLS

SEQ ID NO: 2124500 - protein, 23 aa, Cryptosporidium hominis
ITHHLKLCWVFIFCLSLFGMLDI

SEQ ID NO: 2124501 - protein, 26 aa, Cryptosporidium hominis
ITILEICLAFFKWTYLVRRDERMNLM

SEQ ID NO: 2124502 - protein, 22 aa, Cryptosporidium hominis
ITILGVFFMLLAFFGVSFLLLL

SEQ ID NO: 2124503 - protein, 23 aa, Cryptosporidium hominis
ITKYNSFCSYYFNIINNIEYKND

SEQ ID NO: 2124504 - protein, 17 aa, Cryptosporidium hominis
ITLALLESSFCEERKDN

SEQ ID NO: 2124505 - protein, 17 aa, Cryptosporidium hominis
ITLCSTIQYIGYCENHE

SEQ ID NO: 2124506 - protein, 18 aa, Cryptosporidium hominis
ITLFWILKLDKQISEPFD

SEQ ID NO: 2124507 - protein, 18 aa, Cryptosporidium hominis
ITLLKNLQAYIGFDNAQT

SEQ ID NO: 2124508 - protein, 19 aa, Cryptosporidium hominis
ITLPCFLIIWCSCIEQLIP

SEQ ID NO: 2124509 - protein, 22 aa, Cryptosporidium hominis
ITLPKYPKYISMLYGFLAGLIG

SEQ ID NO: 2124510 - protein, 17 aa, Cryptosporidium hominis
ITLPYDYHEPLYLLGIT

SEQ ID NO: 2124511 - protein, 20 aa, Cryptosporidium hominis
ITNFLWPRIVFAISSSSSSA

SEQ ID NO: 2124512 - protein, 27 aa, Cryptosporidium hominis
ITNIQLWWKEVLTNYYLDMAHNNWLIF

SEQ ID NO: 2124513 - protein, 24 aa, Cryptosporidium hominis
ITQYIYKPWMGFLYLEADNNNSSE

SEQ ID NO: 2124514 - protein, 22 aa, Cryptosporidium hominis
ITRYNPYFLGWILSELIALLTN

SEQ ID NO: 2124515 - protein, 24 aa, Cryptosporidium hominis
ITSQGCLMISSLSKFPVDTIHPLT

SEQ ID NO: 2124516 - protein, 23 aa, Cryptosporidium hominis
ITTKICPPEGCTLRNIIDSIRIC

SEQ ID NO: 2124517 - protein, 23 aa, Cryptosporidium hominis
ITTQFYRRLYVFLFGIVLFFILL

SEQ ID NO: 2124518 - protein, 19 aa, Cryptosporidium hominis
ITTSILLLDFLSFIENSEF

SEQ ID NO: 2124519 - protein, 24 aa, Cryptosporidium hominis
ITVYIIECIFTYWISNLIFEILKG

SEQ ID NO: 2124520 - protein, 72 aa, Cryptosporidium hominis
ITYPMTNECKTIISCTNDITLPIIPRCSTSPYSIGCPCNLNPYSKLCGCYINPFNPGCHCTYNPNSNDCKCL

SEQ ID NO: 2124521 - protein, 23 aa, Cryptosporidium hominis
ITYYPDRMWGITVPIYMLFLPFM

SEQ ID NO: 2124522 - protein, 23 aa, Cryptosporidium hominis
IVCDPKYKESILYPIVLFLADAI

SEQ ID NO: 2124523 - protein, 21 aa, Cryptosporidium hominis
IVDILIYLGSFGKNLLGKDSS

SEQ ID NO: 2124524 - protein, 18 aa, Cryptosporidium hominis
IVDREVWKEKLFSKEQIE

SEQ ID NO: 2124525 - protein, 24 aa, Cryptosporidium hominis
IVFITLYIIFGIIFVIKNDIESKI

SEQ ID NO: 2124526 - protein, 26 aa, Cryptosporidium hominis
IVGEPLEMCMFEFSGWVLCDDYNRNH

SEQ ID NO: 2124527 - protein, 18 aa, Cryptosporidium hominis
IVGIFLYFELVIFNEMTF

SEQ ID NO: 2124528 - protein, 25 aa, Cryptosporidium hominis
IVGTIRPKISFGIFDTISLCLDSCN

SEQ ID NO: 2124529 - protein, 26 aa, Cryptosporidium hominis
IVILFSCLKYLIVNCNSLPSPRDSER

SEQ ID NO: 2124530 - protein, 26 aa, Cryptosporidium hominis
IVIQRFPPVILVFDIVEQGRLYYKQL

SEQ ID NO: 2124531 - protein, 17 aa, Cryptosporidium hominis
IVKSIYAWIKYTIFHYL

SEQ ID NO: 2124532 - protein, 17 aa, Cryptosporidium hominis
IVLGLFYFCMGESLSEI

SEQ ID NO: 2124533 - protein, 17 aa, Cryptosporidium hominis
IVLPGLYYKPYSYTTNL

SEQ ID NO: 2124534 - protein, 19 aa, Cryptosporidium hominis
IVLPHHRATLFAMFSLFET

SEQ ID NO: 2124535 - protein, 23 aa, Cryptosporidium hominis
IVLRFCRKRSIEYTKLIIKKIPY

SEQ ID NO: 2124536 - protein, 18 aa, Cryptosporidium hominis
IVMFCSFLTLLINQEHFA

SEQ ID NO: 2124537 - protein, 18 aa, Cryptosporidium hominis
IVNLHIRETFKIQHAMNG

SEQ ID NO: 2124538 - protein, 33 aa, Cryptosporidium hominis
IVNVLFLKLIFLFSCSLCSIVFTQTVSNNQSIG

SEQ ID NO: 2124539 - protein, 24 aa, Cryptosporidium hominis
IVPFLMDHLIHYSILVKNNYIGIS

SEQ ID NO: 2124540 - protein, 17 aa, Cryptosporidium hominis
IVPKKYLDYTFRLRWYG

SEQ ID NO: 2124541 - protein, 17 aa, Cryptosporidium hominis
IVQRHSFVMKRSTGNNN

SEQ ID NO: 2124542 - protein, 27 aa, Cryptosporidium hominis
IVQVFRRMISIFSWFFTGIVILLMVGI

SEQ ID NO: 2124543 - protein, 18 aa, Cryptosporidium hominis
IVRIKGINLFMSKFPQNQ

SEQ ID NO: 2124544 - protein, 32 aa, Cryptosporidium hominis
IVRLIIFRLILPWLCPEGRIFAALSGTADPEL

SEQ ID NO: 2124545 - protein, 21 aa, Cryptosporidium hominis
IVRQICDKFSIIFSTINQNLK

SEQ ID NO: 2124546 - protein, 26 aa, Cryptosporidium hominis
IVSCFLLGIIVYYSFKDVEILNSQDE

SEQ ID NO: 2124547 - protein, 17 aa, Cryptosporidium hominis
IVVCAGFLIGSLDRSTL

SEQ ID NO: 2124548 - protein, 19 aa, Cryptosporidium hominis
IVVSFLYFLFNYKKNENNQ

SEQ ID NO: 2124549 - protein, 19 aa, Cryptosporidium hominis
IVVVSVFDFDVTKSESLSK

SEQ ID NO: 2124550 - protein, 17 aa, Cryptosporidium hominis
IVWNLIIVILLMLSIIF

SEQ ID NO: 2124551 - protein, 24 aa, Cryptosporidium hominis
IWFVKFYAPWCGHCRHLYPEILKV

SEQ ID NO: 2124552 - protein, 19 aa, Cryptosporidium hominis
IWGGLRGGVSLALAMSLES

SEQ ID NO: 2124553 - protein, 25 aa, Cryptosporidium hominis
IWSILELLLSFGLVAIQVYYIKSYF

SEQ ID NO: 2124554 - protein, 25 aa, Cryptosporidium hominis
IWSSLLLRLSLWIRSFHTARDELYY

SEQ ID NO: 2124555 - protein, 17 aa, Cryptosporidium hominis
IWTKIIVQFFLAFTNGL

SEQ ID NO: 2124556 - protein, 24 aa, Cryptosporidium hominis
IYAIKRLKKSVVIRQKQVDHITNE

SEQ ID NO: 2124557 - protein, 18 aa, Cryptosporidium hominis
IYCQGVNIFSIFRRKNSF

SEQ ID NO: 2124558 - protein, 22 aa, Cryptosporidium hominis
IYCSCYPGWGGFYCSYPYLSSQ

SEQ ID NO: 2124559 - protein, 18 aa, Cryptosporidium hominis
IYDHQLLESKAWWICGIP

SEQ ID NO: 2124560 - protein, 18 aa, Cryptosporidium hominis
IYEEIRFKMCGTSQDSNP

SEQ ID NO: 2124561 - protein, 18 aa, Cryptosporidium hominis
IYEYLDFRFHTEKSSFLF

SEQ ID NO: 2124562 - protein, 20 aa, Cryptosporidium hominis
IYFAFLFGGLIQRCLIHQIR

SEQ ID NO: 2124563 - protein, 21 aa, Cryptosporidium hominis
IYFEKEFTEYIIIEISQTPLI

SEQ ID NO: 2124564 - protein, 23 aa, Cryptosporidium hominis
IYFNSLKCIRIFLLRLNADLMWN

SEQ ID NO: 2124565 - protein, 17 aa, Cryptosporidium hominis
IYFPPAINKMNACTGPN

SEQ ID NO: 2124566 - protein, 20 aa, Cryptosporidium hominis
IYGNYLPSLNFYHFNNFCEF

SEQ ID NO: 2124567 - protein, 18 aa, Cryptosporidium hominis
IYHSNSILEHCNKNKVVK

SEQ ID NO: 2124568 - protein, 25 aa, Cryptosporidium hominis
IYIFSRLDISFFYHYIRGQGLSKLY

SEQ ID NO: 2124569 - protein, 19 aa, Cryptosporidium hominis
IYIGLCCCHNIVPQITNNG

SEQ ID NO: 2124570 - protein, 30 aa, Cryptosporidium hominis
IYIGSCICYTWNLLAKKICYCLPIHVLVKS

SEQ ID NO: 2124571 - protein, 18 aa, Cryptosporidium hominis
IYILLSFRAAPQLYGSPI

SEQ ID NO: 2124572 - protein, 17 aa, Cryptosporidium hominis
IYIPSFIHLSNLFPKGR

SEQ ID NO: 2124573 - protein, 19 aa, Cryptosporidium hominis
IYKALKFKLPAPRVQQIIS

SEQ ID NO: 2124574 - protein, 23 aa, Cryptosporidium hominis
IYKFKWVLIYLILFIFSVYIQLN

SEQ ID NO: 2124575 - protein, 19 aa, Cryptosporidium hominis
IYKIIKNWWIKNRRDKQQF

SEQ ID NO: 2124576 - protein, 21 aa, Cryptosporidium hominis
IYKNKISDFLGHPFSPGCILA

SEQ ID NO: 2124577 - protein, 23 aa, Cryptosporidium hominis
IYKNKTEIFGIIEIDPLNREIDT

SEQ ID NO: 2124578 - protein, 18 aa, Cryptosporidium hominis
IYKSQGLSGFFKGYLTYY

SEQ ID NO: 2124579 - protein, 23 aa, Cryptosporidium hominis
IYLDYRFIIVFIPISYFFNKFRI

SEQ ID NO: 2124580 - protein, 19 aa, Cryptosporidium hominis
IYLIKIIVNNVFKYIDSGE

SEQ ID NO: 2124581 - protein, 18 aa, Cryptosporidium hominis
IYLLLNYNNEYFKSSLLI

SEQ ID NO: 2124582 - protein, 18 aa, Cryptosporidium hominis
IYLMKLLYTECGYTFISK

SEQ ID NO: 2124583 - protein, 29 aa, Cryptosporidium hominis
IYLSAEMSYRLWSIVYFIMTGIRISEYKY

SEQ ID NO: 2124584 - protein, 17 aa, Cryptosporidium hominis
IYMRSGALVYKNIEELI

SEQ ID NO: 2124585 - protein, 19 aa, Cryptosporidium hominis
IYNSTKFFAINTFSYESEI

SEQ ID NO: 2124586 - protein, 23 aa, Cryptosporidium hominis
IYRVEDLLFKKGLRDPFITVEFS

SEQ ID NO: 2124587 - protein, 21 aa, Cryptosporidium hominis
IYSAALILLELLCPRFTTAME

SEQ ID NO: 2124588 - protein, 24 aa, Cryptosporidium hominis
IYSKNCQFIPPGIEEGFPLLRKLE

SEQ ID NO: 2124589 - protein, 18 aa, Cryptosporidium hominis
IYSLERLVALISMENINI

SEQ ID NO: 2124590 - protein, 20 aa, Cryptosporidium hominis
IYSNVSFGFFVFISVLVSIG

SEQ ID NO: 2124591 - protein, 17 aa, Cryptosporidium hominis
IYVSLFLFLIPQILNDL

SEQ ID NO: 2124592 - protein, 24 aa, Cryptosporidium hominis
IYWNSRLYFWSPITFYTIGVLILA

SEQ ID NO: 2124593 - protein, 24 aa, Cryptosporidium hominis
IYYENEIIFWNWSKDDPIYSVQTE

SEQ ID NO: 2124594 - protein, 34 aa, Cryptosporidium hominis
KADVIMRLMCNFTFRLFACLFFIVVVILGILFGK

SEQ ID NO: 2124595 - protein, 22 aa, Cryptosporidium hominis
KAFKEDYCRYVILTFLLIALDA

SEQ ID NO: 2124596 - protein, 17 aa, Cryptosporidium hominis
KAFKEYIKDGNMFENYH

SEQ ID NO: 2124597 - protein, 19 aa, Cryptosporidium hominis
KAFNKICVYDVEIILIYCK

SEQ ID NO: 2124598 - protein, 18 aa, Cryptosporidium hominis
KAFTPRPYSSVNVDEQME

SEQ ID NO: 2124599 - protein, 24 aa, Cryptosporidium hominis
KAFVDDCIFYMGFNLVDYKGNKVS

SEQ ID NO: 2124600 - protein, 21 aa, Cryptosporidium hominis
KAGALIAFGLISIRIKNDCDP

SEQ ID NO: 2124601 - protein, 23 aa, Cryptosporidium hominis
KAGCAPWRGAILNNYIDQILSTW

SEQ ID NO: 2124602 - protein, 28 aa, Cryptosporidium hominis
KAGRVMSTKTFFCWVWKSLYQGTVIMLG

SEQ ID NO: 2124603 - protein, 19 aa, Cryptosporidium hominis
KAIYGDNLLYFKKKIIPKM

SEQ ID NO: 2124604 - protein, 26 aa, Cryptosporidium hominis
KAKDCFPMSLSCTIFILLSNLCLKYV

SEQ ID NO: 2124605 - protein, 19 aa, Cryptosporidium hominis
KALETYGGIFGKIGKNELS

SEQ ID NO: 2124606 - protein, 27 aa, Cryptosporidium hominis
KALIEDFSKLLLCFEINVEDLFYNIND

SEQ ID NO: 2124607 - protein, 22 aa, Cryptosporidium hominis
KALNCFHCSTSMFRNSEISSQN

SEQ ID NO: 2124608 - protein, 20 aa, Cryptosporidium hominis
KALQIWSIICIIFNILIYQI

SEQ ID NO: 2124609 - protein, 24 aa, Cryptosporidium hominis
KALSRLQGTWGIAVLHKDYKDLMI

SEQ ID NO: 2124610 - protein, 24 aa, Cryptosporidium hominis
KAPRCSKLRSLLCCCSASSRNEED

SEQ ID NO: 2124611 - protein, 21 aa, Cryptosporidium hominis
KASDSPFVISGSGSGGGGGGG

SEQ ID NO: 2124612 - protein, 19 aa, Cryptosporidium hominis
KASNGRTILQFFITEDQLG

SEQ ID NO: 2124613 - protein, 18 aa, Cryptosporidium hominis
KASRVLSLNGSFPSNLDF

SEQ ID NO: 2124614 - protein, 20 aa, Cryptosporidium hominis
KASSNSTLEISKLDNSTSTI

SEQ ID NO: 2124615 - protein, 22 aa, Cryptosporidium hominis
KCDDFLGLFGWMLLLLYCGVLI

SEQ ID NO: 2124616 - protein, 17 aa, Cryptosporidium hominis
KCIPDILNEISLSSQGK

SEQ ID NO: 2124617 - protein, 17 aa, Cryptosporidium hominis
KCIPPVKPIFCMLICIL

SEQ ID NO: 2124618 - protein, 18 aa, Cryptosporidium hominis
KCLNDSFQIQIERIQKTL

SEQ ID NO: 2124619 - protein, 18 aa, Cryptosporidium hominis
KCTVIRSGIINIIPAYNL

SEQ ID NO: 2124620 - protein, 25 aa, Cryptosporidium hominis
KDDNLISAWVFVRFLIVGLYVGIAT

SEQ ID NO: 2124621 - protein, 24 aa, Cryptosporidium hominis
KDEFCFCSCRAIPIVYTNYDYHQK

SEQ ID NO: 2124622 - protein, 22 aa, Cryptosporidium hominis
KDFKRIGALTEVFFALSKTQKK

SEQ ID NO: 2124623 - protein, 25 aa, Cryptosporidium hominis
KDFLRICIYLELFVQSILLSECVIR

SEQ ID NO: 2124624 - protein, 25 aa, Cryptosporidium hominis
KDFSEKFILDISVKVGKLITQDPYF

SEQ ID NO: 2124625 - protein, 18 aa, Cryptosporidium hominis
KDGLFLLYFQKRANKLKN

SEQ ID NO: 2124626 - protein, 17 aa, Cryptosporidium hominis
KDGYLDFYGDLHILLTP

SEQ ID NO: 2124627 - protein, 23 aa, Cryptosporidium hominis
KDIARLALYIVCISDFSSIIQAS

SEQ ID NO: 2124628 - protein, 23 aa, Cryptosporidium hominis
KDIQILSSWSFFTGQHTEFKNID

SEQ ID NO: 2124629 - protein, 28 aa, Cryptosporidium hominis
KDIVNLGIIVWLKLIVRFQNIYMKEKNK

SEQ ID NO: 2124630 - protein, 20 aa, Cryptosporidium hominis
KDKILRIITAIKRGFDKKVI

SEQ ID NO: 2124631 - protein, 19 aa, Cryptosporidium hominis
KDLAPPDKYECVFPSINSE

SEQ ID NO: 2124632 - protein, 23 aa, Cryptosporidium hominis
KDMVRLGKRFVYYNSFKQFPKNK

SEQ ID NO: 2124633 - protein, 17 aa, Cryptosporidium hominis
KDQIETILREYGVIDRA

SEQ ID NO: 2124634 - protein, 24 aa, Cryptosporidium hominis
KDQLSEIWKIITLDSGKCPVNSLK

SEQ ID NO: 2124635 - protein, 24 aa, Cryptosporidium hominis
KDRHLLRTLTFIFLFICTTVTYFV

SEQ ID NO: 2124636 - protein, 23 aa, Cryptosporidium hominis
KDRVVELWIEMDLSGIRKGFVRN

SEQ ID NO: 2124637 - protein, 18 aa, Cryptosporidium hominis
KDTELINLLNIYYKNNIN

SEQ ID NO: 2124638 - protein, 30 aa, Cryptosporidium hominis
KDTQPWYLQSTFIFSFVGIIFLLIVGAIAI

SEQ ID NO: 2124639 - protein, 18 aa, Cryptosporidium hominis
KDVMIGYILNILLNLVIP

SEQ ID NO: 2124640 - protein, 19 aa, Cryptosporidium hominis
KDVQYSYFIWKFAVKNRIN

SEQ ID NO: 2124641 - protein, 25 aa, Cryptosporidium hominis
KDYIDFRLVLVFCGLLMIIFAIILL

SEQ ID NO: 2124642 - protein, 28 aa, Cryptosporidium hominis
KDYYEERRWKIYAARRLSQMVQNYWRKK

SEQ ID NO: 2124643 - protein, 19 aa, Cryptosporidium hominis
KDYYLRYIRNNNFEHLPAI

SEQ ID NO: 2124644 - protein, 30 aa, Cryptosporidium hominis
KEECGTSFVMWFEKGTPVATLKCGDYTIVY

SEQ ID NO: 2124645 - protein, 19 aa, Cryptosporidium hominis
KEEDLDCIYLTSTDMKTEI

SEQ ID NO: 2124646 - protein, 18 aa, Cryptosporidium hominis
KEEFTWDIIISVYTHTNS

SEQ ID NO: 2124647 - protein, 20 aa, Cryptosporidium hominis
KEEGLECFDIPQTFSNIKLT

SEQ ID NO: 2124648 - protein, 18 aa, Cryptosporidium hominis
KEEILKWTKNYPICALNT

SEQ ID NO: 2124649 - protein, 22 aa, Cryptosporidium hominis
KEEMWPILKLYYSKKPLLFTLH

SEQ ID NO: 2124650 - protein, 17 aa, Cryptosporidium hominis
KEFFFKISVDRINSVLK

SEQ ID NO: 2124651 - protein, 21 aa, Cryptosporidium hominis
KEFRSNGLSHFGRVDVGKIDI

SEQ ID NO: 2124652 - protein, 17 aa, Cryptosporidium hominis
KEGNSEMILVASVSQKP

SEQ ID NO: 2124653 - protein, 20 aa, Cryptosporidium hominis
KEIFNSVILGIEISSKISIS

SEQ ID NO: 2124654 - protein, 18 aa, Cryptosporidium hominis
KEIIRLILEGGGIPSVFL

SEQ ID NO: 2124655 - protein, 24 aa, Cryptosporidium hominis
KEILKCLRLKIKSKIKNQNNNNTI

SEQ ID NO: 2124656 - protein, 19 aa, Cryptosporidium hominis
KEISICFLNLLNSIANFEN

SEQ ID NO: 2124657 - protein, 18 aa, Cryptosporidium hominis
KEITFFWTTLLLLGETDT

SEQ ID NO: 2124658 - protein, 21 aa, Cryptosporidium hominis
KEKKMTVCFELTQKEFIEKRD

SEQ ID NO: 2124659 - protein, 20 aa, Cryptosporidium hominis
KELKNLILINHNMFLVNNKL

SEQ ID NO: 2124660 - protein, 23 aa, Cryptosporidium hominis
KELLHPINILRLGSLWQGIFLRF

SEQ ID NO: 2124661 - protein, 21 aa, Cryptosporidium hominis
KELVPRLTPILKNRHEKVQEN

SEQ ID NO: 2124662 - protein, 22 aa, Cryptosporidium hominis
KEMELGLSYKLLSDKIVGISKM

SEQ ID NO: 2124663 - protein, 19 aa, Cryptosporidium hominis
KENAEWVFELALQGQMLVS

SEQ ID NO: 2124664 - protein, 19 aa, Cryptosporidium hominis
KEPSKVFGICKKKRILNPS

SEQ ID NO: 2124665 - protein, 22 aa, Cryptosporidium hominis
KEQLKSWWYNNSKDYIDFRLVL

SEQ ID NO: 2124666 - protein, 19 aa, Cryptosporidium hominis
KEQRIVLNYPKSSRPYGFS

SEQ ID NO: 2124667 - protein, 17 aa, Cryptosporidium hominis
KEQWNFIYEYSLQSRNQ

SEQ ID NO: 2124668 - protein, 26 aa, Cryptosporidium hominis
KESFWSFKLPLIIKNIIFFIYWKIIK

SEQ ID NO: 2124669 - protein, 18 aa, Cryptosporidium hominis
KESHGILQASNWEQNLAS

SEQ ID NO: 2124670 - protein, 24 aa, Cryptosporidium hominis
KESRFSFSVIWDCILSVMNDFKND

SEQ ID NO: 2124671 - protein, 21 aa, Cryptosporidium hominis
KETIINLSILLLILCILISTI

SEQ ID NO: 2124672 - protein, 19 aa, Cryptosporidium hominis
KEVQRILLINSGTNHSETL

SEQ ID NO: 2124673 - protein, 18 aa, Cryptosporidium hominis
KEVSRIHLLTGKKEIISL

SEQ ID NO: 2124674 - protein, 31 aa, Cryptosporidium hominis
KEWKNPDIQALFLLKICKTSYEINNRSYNLH

SEQ ID NO: 2124675 - protein, 19 aa, Cryptosporidium hominis
KEYEMYAKLLSNIDTNQGQ

SEQ ID NO: 2124676 - protein, 21 aa, Cryptosporidium hominis
KFCFLYILYFFTFYFSMVVTI

SEQ ID NO: 2124677 - protein, 20 aa, Cryptosporidium hominis
KFFRCRSILKSSKYDFKTGN

SEQ ID NO: 2124678 - protein, 22 aa, Cryptosporidium hominis
KFHSELLYGCLLTYGIYLAYLI

SEQ ID NO: 2124679 - protein, 30 aa, Cryptosporidium hominis
KFIDRMSWLMLFCQLLSYGNSSNFNRMEES

SEQ ID NO: 2124680 - protein, 22 aa, Cryptosporidium hominis
KFIHPINRLFACIKNKKILNRE

SEQ ID NO: 2124681 - protein, 18 aa, Cryptosporidium hominis
KFILLSYQLTHFLLFFIF

SEQ ID NO: 2124682 - protein, 18 aa, Cryptosporidium hominis
KFIRFRAIYSQIQPVLQF

SEQ ID NO: 2124683 - protein, 19 aa, Cryptosporidium hominis
KFISISFPGSCRFSKNNIW

SEQ ID NO: 2124684 - protein, 19 aa, Cryptosporidium hominis
KFKIIIMGQVFRFWNAFLV

SEQ ID NO: 2124685 - protein, 39 aa, Cryptosporidium hominis
KFKRFKKRYAGVLGFAILICFLIGFYLILFSAKHPTSKI

SEQ ID NO: 2124686 - protein, 25 aa, Cryptosporidium hominis
KFLQNRLNLLASRNLLNHYVNSNEN

SEQ ID NO: 2124687 - protein, 25 aa, Cryptosporidium hominis
KFNIWRFLLSTAILLVSIFLSHVAK

SEQ ID NO: 2124688 - protein, 19 aa, Cryptosporidium hominis
KFNNLIKCAIKGDKSFANL

SEQ ID NO: 2124689 - protein, 18 aa, Cryptosporidium hominis
KFPTSLVSIWGFTLQAYQ

SEQ ID NO: 2124690 - protein, 19 aa, Cryptosporidium hominis
KFPVTKLCRIIKRSEPINF

SEQ ID NO: 2124691 - protein, 21 aa, Cryptosporidium hominis
KFQAKEFFNFFVSETSSKLNW

SEQ ID NO: 2124692 - protein, 19 aa, Cryptosporidium hominis
KFSIGFYAAIFVALLPIGI

SEQ ID NO: 2124693 - protein, 19 aa, Cryptosporidium hominis
KFSKLDSLISRYEYLSKTK

SEQ ID NO: 2124694 - protein, 29 aa, Cryptosporidium hominis
KFSLIANYGLPGFLLLILALILTLYFLHV

SEQ ID NO: 2124695 - protein, 19 aa, Cryptosporidium hominis
KFTSFNLKQVLDCFHPEGG

SEQ ID NO: 2124696 - protein, 17 aa, Cryptosporidium hominis
KFVKNVTKYNCYRMKNT

SEQ ID NO: 2124697 - protein, 20 aa, Cryptosporidium hominis
KFVNSFPIIFEKLIPEYCIA

SEQ ID NO: 2124698 - protein, 33 aa, Cryptosporidium hominis
KFVSKEVLKIIPMESSLFLEWGLSIASQTSPNI

SEQ ID NO: 2124699 - protein, 20 aa, Cryptosporidium hominis
KFYIEEFGIILTYHMSQIEE

SEQ ID NO: 2124700 - protein, 22 aa, Cryptosporidium hominis
KGELKINSILLLHSGSKIRIGG

SEQ ID NO: 2124701 - protein, 20 aa, Cryptosporidium hominis
KGERCWKLRDPNEMSRFPTI

SEQ ID NO: 2124702 - protein, 21 aa, Cryptosporidium hominis
KGFDTLWYVSFARFMLLLSSI

SEQ ID NO: 2124703 - protein, 19 aa, Cryptosporidium hominis
KGGELFDEIIHRMKFNEVD

SEQ ID NO: 2124704 - protein, 20 aa, Cryptosporidium hominis
KGILDWGQEYVRNIVGEITL

SEQ ID NO: 2124705 - protein, 23 aa, Cryptosporidium hominis
KGIPAQFRGFFWMKLAEVENIKS

SEQ ID NO: 2124706 - protein, 20 aa, Cryptosporidium hominis
KGKFKSKSFEFFVTLYKKNL

SEQ ID NO: 2124707 - protein, 18 aa, Cryptosporidium hominis
KGKIELFNYNSIKEFWKI

SEQ ID NO: 2124708 - protein, 26 aa, Cryptosporidium hominis
KGKNSSRQTLMWLFISIIIMLLIIFV

SEQ ID NO: 2124709 - protein, 22 aa, Cryptosporidium hominis
KGKSLRIYKPLIKVFWLQCLMV

SEQ ID NO: 2124710 - protein, 20 aa, Cryptosporidium hominis
KGLKSQLLKMFKRRNKGGKN

SEQ ID NO: 2124711 - protein, 25 aa, Cryptosporidium hominis
KGLLEFYLKIERIWKRSFIEDEKIR

SEQ ID NO: 2124712 - protein, 17 aa, Cryptosporidium hominis
KGLRPLINLSKVGSGQI

SEQ ID NO: 2124713 - protein, 20 aa, Cryptosporidium hominis
KGLSGIFIPALVLGNINPET

SEQ ID NO: 2124714 - protein, 24 aa, Cryptosporidium hominis
KGLSLKNAFEIIAKIFPSHPALVL

SEQ ID NO: 2124715 - protein, 19 aa, Cryptosporidium hominis
KGPGSIIGTCILMPDKQGS

SEQ ID NO: 2124716 - protein, 21 aa, Cryptosporidium hominis
KGPLVICFHGLLSSISSFKQL

SEQ ID NO: 2124717 - protein, 18 aa, Cryptosporidium hominis
KGQKSFRVLSQVATANLF

SEQ ID NO: 2124718 - protein, 18 aa, Cryptosporidium hominis
KGRIKLMVFSPYSHNTLR

SEQ ID NO: 2124719 - protein, 19 aa, Cryptosporidium hominis
KGRSSEITNIFQSFNHNEY

SEQ ID NO: 2124720 - protein, 19 aa, Cryptosporidium hominis
KHCIIICLLNYYKYIKKTT

SEQ ID NO: 2124721 - protein, 25 aa, Cryptosporidium hominis
KHDFVFKLFYKKGYYYLDSSFTSLT

SEQ ID NO: 2124722 - protein, 17 aa, Cryptosporidium hominis
KHEPIWRIFLSQFTSLV

SEQ ID NO: 2124723 - protein, 19 aa, Cryptosporidium hominis
KHFLLFLAYVFLFCAYSLI

SEQ ID NO: 2124724 - protein, 17 aa, Cryptosporidium hominis
KHLEVIFTSTTIITTIL

SEQ ID NO: 2124725 - protein, 17 aa, Cryptosporidium hominis
KHRIRIGQWSAIVHLHA

SEQ ID NO: 2124726 - protein, 25 aa, Cryptosporidium hominis
KHRLSCLRVFLQLIKKIDEKEFALY

SEQ ID NO: 2124727 - protein, 29 aa, Cryptosporidium hominis
KHRSFSNRFSLKMILQVALLGIMWSLTYY

SEQ ID NO: 2124728 - protein, 19 aa, Cryptosporidium hominis
KHTLVLCYSEIIKLDDSIL

SEQ ID NO: 2124729 - protein, 19 aa, Cryptosporidium hominis
KHYQLSYEFALLIQNKLFK

SEQ ID NO: 2124730 - protein, 17 aa, Cryptosporidium hominis
KIALSQILGLRFAIVLV

SEQ ID NO: 2124731 - protein, 20 aa, Cryptosporidium hominis
KIASRTPILRDFLEYLSHEY

SEQ ID NO: 2124732 - protein, 18 aa, Cryptosporidium hominis
KICVLDFVREKALYMSDV

SEQ ID NO: 2124733 - protein, 21 aa, Cryptosporidium hominis
KIDFKVGIRVQFVYNPEGLND

SEQ ID NO: 2124734 - protein, 18 aa, Cryptosporidium hominis
KIDKRLVSEIDQLSIDSY

SEQ ID NO: 2124735 - protein, 18 aa, Cryptosporidium hominis
KIEIPFDLIADFPNMMVF

SEQ ID NO: 2124736 - protein, 22 aa, Cryptosporidium hominis
KIELEMFSFLPKILEFQVKDGI

SEQ ID NO: 2124737 - protein, 17 aa, Cryptosporidium hominis
KIFNRIRVKQVKSILEV

SEQ ID NO: 2124738 - protein, 20 aa, Cryptosporidium hominis
KIHINSRFVLKNSKDDEKEL

SEQ ID NO: 2124739 - protein, 22 aa, Cryptosporidium hominis
KIIAFIIISFVINFKDPMTCIP

SEQ ID NO: 2124740 - protein, 32 aa, Cryptosporidium hominis
KIICVNRAVFFLHWWLITWPKIPFYANDFVLA

SEQ ID NO: 2124741 - protein, 24 aa, Cryptosporidium hominis
KIIDIVYLLPLWFDLMRLPDKILR

SEQ ID NO: 2124742 - protein, 24 aa, Cryptosporidium hominis
KIIKPAYLFYGCRTENEIIYKDEL

SEQ ID NO: 2124743 - protein, 17 aa, Cryptosporidium hominis
KIIPKMTILNLIEKSRN

SEQ ID NO: 2124744 - protein, 25 aa, Cryptosporidium hominis
KIIQELYRYGGLRTFWTGLLPTMMF

SEQ ID NO: 2124745 - protein, 18 aa, Cryptosporidium hominis
KIISEFWNNSLLAFRNKL

SEQ ID NO: 2124746 - protein, 17 aa, Cryptosporidium hominis
KIKCNKIQISFIMIYLI

SEQ ID NO: 2124747 - protein, 19 aa, Cryptosporidium hominis
KIKIYFKNRIKSLREKKLL

SEQ ID NO: 2124748 - protein, 19 aa, Cryptosporidium hominis
KILGFPILITRSIILSICL

SEQ ID NO: 2124749 - protein, 17 aa, Cryptosporidium hominis
KILLKKPSGDKFQVKTE

SEQ ID NO: 2124750 - protein, 18 aa, Cryptosporidium hominis
KILSCHIIPLILEQKRLS

SEQ ID NO: 2124751 - protein, 18 aa, Cryptosporidium hominis
KIMPEIDSELLIDEHSQR

SEQ ID NO: 2124752 - protein, 21 aa, Cryptosporidium hominis
KINTIWAILRVQFLVLLLFLN

SEQ ID NO: 2124753 - protein, 27 aa, Cryptosporidium hominis
KIPGVLRLLVRLNMMYYYECRINTLIL

SEQ ID NO: 2124754 - protein, 17 aa, Cryptosporidium hominis
KIPIAIEYIEPILKNGL

SEQ ID NO: 2124755 - protein, 17 aa, Cryptosporidium hominis
KIPKFNYEEVRTLVEAL

SEQ ID NO: 2124756 - protein, 22 aa, Cryptosporidium hominis
KIPRIYVIFIIFIIFFSNVECL

SEQ ID NO: 2124757 - protein, 20 aa, Cryptosporidium hominis
KIPVCPEGFVSKGSECYLAE

SEQ ID NO: 2124758 - protein, 19 aa, Cryptosporidium hominis
KIQTCLKTSIFKRLIESKS

SEQ ID NO: 2124759 - protein, 18 aa, Cryptosporidium hominis
KIRLSVSGSVVFSSITLT

SEQ ID NO: 2124760 - protein, 19 aa, Cryptosporidium hominis
KISDIYVCVCCNSGDKIPK

SEQ ID NO: 2124761 - protein, 33 aa, Cryptosporidium hominis
KISIGCTIKIISWVKELCEILGIQTDENSNMGR

SEQ ID NO: 2124762 - protein, 19 aa, Cryptosporidium hominis
KISMIKMKSGILVGILFAA

SEQ ID NO: 2124763 - protein, 21 aa, Cryptosporidium hominis
KISQQSIAWSFLLIKKPSNIL

SEQ ID NO: 2124764 - protein, 19 aa, Cryptosporidium hominis
KISRIQGFDYSKIISKKQI

SEQ ID NO: 2124765 - protein, 21 aa, Cryptosporidium hominis
KIVFDEFVNFFLINLTKHEPY

SEQ ID NO: 2124766 - protein, 17 aa, Cryptosporidium hominis
KIVKFFCKNNYQCLYHT

SEQ ID NO: 2124767 - protein, 21 aa, Cryptosporidium hominis
KIVRACSVALGFVMYSRGGEE

SEQ ID NO: 2124768 - protein, 17 aa, Cryptosporidium hominis
KIVRLYLDNTIDSKSLL

SEQ ID NO: 2124769 - protein, 17 aa, Cryptosporidium hominis
KIVSLYLYIFLSFPITV

SEQ ID NO: 2124770 - protein, 18 aa, Cryptosporidium hominis
KIYGRICGTAVNQDGKSA

SEQ ID NO: 2124771 - protein, 24 aa, Cryptosporidium hominis
KIYKNHLRFGLTEFTHFNHFEWET

SEQ ID NO: 2124772 - protein, 20 aa, Cryptosporidium hominis
KIYVSYPLFYLIALLLSSII

SEQ ID NO: 2124773 - protein, 18 aa, Cryptosporidium hominis
KKAIEAYGSIPKEILNKK

SEQ ID NO: 2124774 - protein, 23 aa, Cryptosporidium hominis
KKALDMASRLGISHSLLSNIERR

SEQ ID NO: 2124775 - protein, 18 aa, Cryptosporidium hominis
KKALDVCGSEISRLNSEV

SEQ ID NO: 2124776 - protein, 26 aa, Cryptosporidium hominis
KKAPVRRCGRNCLCFETSQGDFTSLD

SEQ ID NO: 2124777 - protein, 20 aa, Cryptosporidium hominis
KKDRFTLFMQRIQERNISII

SEQ ID NO: 2124778 - protein, 28 aa, Cryptosporidium hominis
KKEEELKCYWIILESELIHLLKAAKSVS

SEQ ID NO: 2124779 - protein, 26 aa, Cryptosporidium hominis
KKEKCSWNELMVLNFFLTSFKGFAML

SEQ ID NO: 2124780 - protein, 31 aa, Cryptosporidium hominis
KKEQCLKLFKSRSFPIKDFRGTANKVFYHYN

SEQ ID NO: 2124781 - protein, 35 aa, Cryptosporidium hominis
KKESIALNWNSWYFFPEQIIDLSLVKIQDFLILDR

SEQ ID NO: 2124782 - protein, 25 aa, Cryptosporidium hominis
KKFKENLCIDGLFIGNLDRAELEKL

SEQ ID NO: 2124783 - protein, 32 aa, Cryptosporidium hominis
KKFTLFYFFFRWITYYVEMEIAANYERIIISL

SEQ ID NO: 2124784 - protein, 19 aa, Cryptosporidium hominis
KKGLTRRALSLLQPSRPTS

SEQ ID NO: 2124785 - protein, 25 aa, Cryptosporidium hominis
KKILPRFYRYLGLYYSLICISRMKR

SEQ ID NO: 2124786 - protein, 31 aa, Cryptosporidium hominis
KKIPCGHVFHLDCLKSWFIQQQTCPICRAPI

SEQ ID NO: 2124787 - protein, 25 aa, Cryptosporidium hominis
KKIWKPPETFLRNTTKYWVHPNNVV

SEQ ID NO: 2124788 - protein, 18 aa, Cryptosporidium hominis
KKKLFGITGNLFKSKSSP

SEQ ID NO: 2124789 - protein, 22 aa, Cryptosporidium hominis
KKKLGESILSFNSRNELVEFVL

SEQ ID NO: 2124790 - protein, 25 aa, Cryptosporidium hominis
KKKYQNWLAVQFVKQYSALFYLDDQ

SEQ ID NO: 2124791 - protein, 18 aa, Cryptosporidium hominis
KKLGIIFEKHYVPGKLYL

SEQ ID NO: 2124792 - protein, 19 aa, Cryptosporidium hominis
KKLKLHLMLEKKVLLVLYM

SEQ ID NO: 2124793 - protein, 19 aa, Cryptosporidium hominis
KKLLDEISIEANVREINSI

SEQ ID NO: 2124794 - protein, 21 aa, Cryptosporidium hominis
KKLLWTFRILSGILLLFYFII

SEQ ID NO: 2124795 - protein, 21 aa, Cryptosporidium hominis
KKLPLSVKVFPAIFIITNGYQ

SEQ ID NO: 2124796 - protein, 23 aa, Cryptosporidium hominis
KKLQPLFPVFGIILGIAKNDQSD

SEQ ID NO: 2124797 - protein, 31 aa, Cryptosporidium hominis
KKLSKLIVFSERFEAIILCKLLIKKFNSEKG

SEQ ID NO: 2124798 - protein, 22 aa, Cryptosporidium hominis
KKLTILIHVFIIYFLVIYNNEW

SEQ ID NO: 2124799 - protein, 24 aa, Cryptosporidium hominis
KKNLKEWFIYLFNALYDFIIYQLP

SEQ ID NO: 2124800 - protein, 26 aa, Cryptosporidium hominis
KKNSLWKRFICLFIICWSVIASTRSI

SEQ ID NO: 2124801 - protein, 17 aa, Cryptosporidium hominis
KKQIKFPVFVSCAQQLV

SEQ ID NO: 2124802 - protein, 28 aa, Cryptosporidium hominis
KKRSQLKKVISYIIQLFLNLVIDSIVAL

SEQ ID NO: 2124803 - protein, 21 aa, Cryptosporidium hominis
KKSFYEFILIIIKEIDCIKND

SEQ ID NO: 2124804 - protein, 23 aa, Cryptosporidium hominis
KKSKLSLIIWMFISSIFTISQPL

SEQ ID NO: 2124805 - protein, 18 aa, Cryptosporidium hominis
KKSLGFKDFVNFVREALE

SEQ ID NO: 2124806 - protein, 21 aa, Cryptosporidium hominis
KKTDLKSFWISIDSNYIKLTS

SEQ ID NO: 2124807 - protein, 22 aa, Cryptosporidium hominis
KKTPFREILLWTTLFSIPIYIL

SEQ ID NO: 2124808 - protein, 21 aa, Cryptosporidium hominis
KKTSLKYSLKIMLGSVLAVLL

SEQ ID NO: 2124809 - protein, 21 aa, Cryptosporidium hominis
KKTTFLKKLFSRISNDDVNLI

SEQ ID NO: 2124810 - protein, 22 aa, Cryptosporidium hominis
KKVEYLKSIGIKFVSSSRDYTK

SEQ ID NO: 2124811 - protein, 18 aa, Cryptosporidium hominis
KKVFSIAVGNVIFKQSFD

SEQ ID NO: 2124812 - protein, 22 aa, Cryptosporidium hominis
KKWQFHKKCFAWFYKRSDSKIT

SEQ ID NO: 2124813 - protein, 25 aa, Cryptosporidium hominis
KKYIEPRFLFSVGTEILVLGVINIV

SEQ ID NO: 2124814 - protein, 19 aa, Cryptosporidium hominis
KKYLDYTFRLRWYGENEGS

SEQ ID NO: 2124815 - protein, 52 aa, Cryptosporidium hominis
KKYSINPWERYHISILMKAIFVFMFFDVSREFYIVLISLYFLYIRGLFDGLQ

SEQ ID NO: 2124816 - protein, 18 aa, Cryptosporidium hominis
KKYVIKMDPLRQVILKNE

SEQ ID NO: 2124817 - protein, 23 aa, Cryptosporidium hominis
KLAFKLTNLLPFVKRGSIQKLFD

SEQ ID NO: 2124818 - protein, 22 aa, Cryptosporidium hominis
KLDFFVKYLLEYILINQALNIK

SEQ ID NO: 2124819 - protein, 19 aa, Cryptosporidium hominis
KLDTVDCIKLHKDANDNVQ

SEQ ID NO: 2124820 - protein, 19 aa, Cryptosporidium hominis
KLEETFGIVGPATVFHKMK

SEQ ID NO: 2124821 - protein, 19 aa, Cryptosporidium hominis
KLEGFIVGNLNPLQSINII

SEQ ID NO: 2124822 - protein, 25 aa, Cryptosporidium hominis
KLEKKHRKSSCKHNHMSKHKDKYKH

SEQ ID NO: 2124823 - protein, 23 aa, Cryptosporidium hominis
KLEVAYNLGFSKLASVGACTTVS

SEQ ID NO: 2124824 - protein, 18 aa, Cryptosporidium hominis
KLEYKKEAHIIFMFRQYY

SEQ ID NO: 2124825 - protein, 24 aa, Cryptosporidium hominis
KLFISAIIYSCFGTFLTAKLGMNI

SEQ ID NO: 2124826 - protein, 17 aa, Cryptosporidium hominis
KLFKILNDFNIPILQEN

SEQ ID NO: 2124827 - protein, 17 aa, Cryptosporidium hominis
KLFSRISNDDVNLISTL

SEQ ID NO: 2124828 - protein, 28 aa, Cryptosporidium hominis
KLFYQVYRPSILIFGIFLYLCVSNSNQA

SEQ ID NO: 2124829 - protein, 18 aa, Cryptosporidium hominis
KLGCIMVSGSCQINQQDL

SEQ ID NO: 2124830 - protein, 26 aa, Cryptosporidium hominis
KLGMVGYNFFYRDISLELQLNGNIAR

SEQ ID NO: 2124831 - protein, 23 aa, Cryptosporidium hominis
KLGYHMVDFGSFVIWDGLEYQII

SEQ ID NO: 2124832 - protein, 25 aa, Cryptosporidium hominis
KLHSKCKIKNGCCCTSDSEENELHT

SEQ ID NO: 2124833 - protein, 19 aa, Cryptosporidium hominis
KLICFQIVIYLPFIFLRDI

SEQ ID NO: 2124834 - protein, 18 aa, Cryptosporidium hominis
KLICRDIDRSLVKKKGHA

SEQ ID NO: 2124835 - protein, 20 aa, Cryptosporidium hominis
KLKKIPCCHLCRSPIEIAWQ

SEQ ID NO: 2124836 - protein, 23 aa, Cryptosporidium hominis
KLKKKINILFERLFSNDGISHIY

SEQ ID NO: 2124837 - protein, 17 aa, Cryptosporidium hominis
KLKQFYQILSISFINNG

SEQ ID NO: 2124838 - protein, 19 aa, Cryptosporidium hominis
KLLKEMLVLVSPDQLALSK

SEQ ID NO: 2124839 - protein, 18 aa, Cryptosporidium hominis
KLLPNDWYQWLIMHQEIS

SEQ ID NO: 2124840 - protein, 18 aa, Cryptosporidium hominis
KLLQISIAFSNSLSNYLI

SEQ ID NO: 2124841 - protein, 19 aa, Cryptosporidium hominis
KLLRSSAISVFYVTSISLS

SEQ ID NO: 2124842 - protein, 23 aa, Cryptosporidium hominis
KLLSQPITIAWGISKCLSLAENA

SEQ ID NO: 2124843 - protein, 18 aa, Cryptosporidium hominis
KLLYYMAITPKEIIENFE

SEQ ID NO: 2124844 - protein, 23 aa, Cryptosporidium hominis
KLNFKSRINNVTFKNHIREENQN

SEQ ID NO: 2124845 - protein, 18 aa, Cryptosporidium hominis
KLNIIFISSIIFTFKLSL

SEQ ID NO: 2124846 - protein, 23 aa, Cryptosporidium hominis
KLNKSAFYFVRFNLLLHLAAIVI

SEQ ID NO: 2124847 - protein, 19 aa, Cryptosporidium hominis
KLNLYSYIRWLKTSMQKAY

SEQ ID NO: 2124848 - protein, 24 aa, Cryptosporidium hominis
KLNSNMSKLAFIIRRMTRGGGAGN

SEQ ID NO: 2124849 - protein, 18 aa, Cryptosporidium hominis
KLPLTIIVIAHRLSSVRN

SEQ ID NO: 2124850 - protein, 19 aa, Cryptosporidium hominis
KLPTNKGREKEENTDSDIG

SEQ ID NO: 2124851 - protein, 28 aa, Cryptosporidium hominis
KLQCDQWKLYPCEVVPFSKIEEWYENKA

SEQ ID NO: 2124852 - protein, 21 aa, Cryptosporidium hominis
KLQKWKKYTGMVLEKYLYLLD

SEQ ID NO: 2124853 - protein, 18 aa, Cryptosporidium hominis
KLQPKLAEVLRCGIWSEI

SEQ ID NO: 2124854 - protein, 26 aa, Cryptosporidium hominis
KLSKWYTWCLHCHHGGCFKHISEWFE

SEQ ID NO: 2124855 - protein, 19 aa, Cryptosporidium hominis
KLSQIFYNYNFISFYDNNN

SEQ ID NO: 2124856 - protein, 23 aa, Cryptosporidium hominis
KLTISPLYLLGMNLKGKNITELS

SEQ ID NO: 2124857 - protein, 20 aa, Cryptosporidium hominis
KLVLGTLCWMWIDKERTKLE

SEQ ID NO: 2124858 - protein, 18 aa, Cryptosporidium hominis
KLYCWFIIHKKFDRYSHE

SEQ ID NO: 2124859 - protein, 19 aa, Cryptosporidium hominis
KLYIERSVMESLNLDIPPK

SEQ ID NO: 2124860 - protein, 17 aa, Cryptosporidium hominis
KLYPVIYGFPFIFFINP

SEQ ID NO: 2124861 - protein, 26 aa, Cryptosporidium hominis
KLYSEFHKKKCLGYALISFSDIKEKP

SEQ ID NO: 2124862 - protein, 24 aa, Cryptosporidium hominis
KMASCILNGRIGRISVDDTISNAL

SEQ ID NO: 2124863 - protein, 21 aa, Cryptosporidium hominis
KMCRSSSCPSLGHISSSRSNS

SEQ ID NO: 2124864 - protein, 17 aa, Cryptosporidium hominis
KMEFSSISFKQVLEKLK

SEQ ID NO: 2124865 - protein, 25 aa, Cryptosporidium hominis
KMHKHYRLFFGLIFLFMGCGYIGSI

SEQ ID NO: 2124866 - protein, 18 aa, Cryptosporidium hominis
KMIDGIRINKQRALLTTS

SEQ ID NO: 2124867 - protein, 18 aa, Cryptosporidium hominis
KMIFLLGLIEFWENRGHS

SEQ ID NO: 2124868 - protein, 23 aa, Cryptosporidium hominis
KMIYTKLGICYNGRSDTSTSVTN

SEQ ID NO: 2124869 - protein, 20 aa, Cryptosporidium hominis
KMMICGVAGRVFGISCLLII

SEQ ID NO: 2124870 - protein, 18 aa, Cryptosporidium hominis
KMPQKLIISFAMLENHKL

SEQ ID NO: 2124871 - protein, 19 aa, Cryptosporidium hominis
KMSISRDLLIEKFHLSLFP

SEQ ID NO: 2124872 - protein, 17 aa, Cryptosporidium hominis
KMTKSSLVFNRINTSSQ

SEQ ID NO: 2124873 - protein, 20 aa, Cryptosporidium hominis
KMTPRFAFAATIVVCAVTIY

SEQ ID NO: 2124874 - protein, 17 aa, Cryptosporidium hominis
KNAELIKNIGYLLEKLF

SEQ ID NO: 2124875 - protein, 25 aa, Cryptosporidium hominis
KNANFLLKHPFILLKAKRPNSLGTF

SEQ ID NO: 2124876 - protein, 17 aa, Cryptosporidium hominis
KNCKCCTQFELSEDELV

SEQ ID NO: 2124877 - protein, 35 aa, Cryptosporidium hominis
KNCYFFCDLCPIGMVGYFCSLKILVDETIGRNIEN

SEQ ID NO: 2124878 - protein, 21 aa, Cryptosporidium hominis
KNDVFCLAMVFLSLSLVYEPK

SEQ ID NO: 2124879 - protein, 18 aa, Cryptosporidium hominis
KNEIKDEYDFLISPHHLL

SEQ ID NO: 2124880 - protein, 23 aa, Cryptosporidium hominis
KNELTLLGLIGFLDPPRPGVEKA

SEQ ID NO: 2124881 - protein, 25 aa, Cryptosporidium hominis
KNFISEWFLLVTFYSFFSFIHIYFL

SEQ ID NO: 2124882 - protein, 18 aa, Cryptosporidium hominis
KNFMRLTNEFSFNTISEL

SEQ ID NO: 2124883 - protein, 29 aa, Cryptosporidium hominis
KNFPVRLSFKILACFPFCSSSKRMGILLE

SEQ ID NO: 2124884 - protein, 18 aa, Cryptosporidium hominis
KNGHPVGPFKTRECRSGS

SEQ ID NO: 2124885 - protein, 25 aa, Cryptosporidium hominis
KNGRKGGWWLFHSFFQVVSKDWLLG

SEQ ID NO: 2124886 - protein, 19 aa, Cryptosporidium hominis
KNHVLRKALSSNIPEKPLL

SEQ ID NO: 2124887 - protein, 19 aa, Cryptosporidium hominis
KNILKFILHRSIAFINFIS

SEQ ID NO: 2124888 - protein, 23 aa, Cryptosporidium hominis
KNILKYTRKAFLNTLPYSLFRLR

SEQ ID NO: 2124889 - protein, 23 aa, Cryptosporidium hominis
KNISSTFCLPSFINYYRNKVKSK

SEQ ID NO: 2124890 - protein, 17 aa, Cryptosporidium hominis
KNKEKFNIWRFLLSTAI

SEQ ID NO: 2124891 - protein, 17 aa, Cryptosporidium hominis
KNKSWKILLKKPSGDKF

SEQ ID NO: 2124892 - protein, 31 aa, Cryptosporidium hominis
KNLEVRKTWRLNNVFWGYKFSSIIKKQVYHG

SEQ ID NO: 2124893 - protein, 23 aa, Cryptosporidium hominis
KNLFRFKIFVVTLLYISRSIIET

SEQ ID NO: 2124894 - protein, 21 aa, Cryptosporidium hominis
KNLNCIFLMVIIVKSCKCKAH

SEQ ID NO: 2124895 - protein, 29 aa, Cryptosporidium hominis
KNNELKHLFKIPMNYLPYIPKDTGENDEK

SEQ ID NO: 2124896 - protein, 33 aa, Cryptosporidium hominis
KNNLLLFPRLNKFRYIISILLCSSIIAYTIVSK

SEQ ID NO: 2124897 - protein, 29 aa, Cryptosporidium hominis
KNRFLLTLGLIGVVIGGVWYITKNNKKEL

SEQ ID NO: 2124898 - protein, 19 aa, Cryptosporidium hominis
KNRIILGSMTDYLYTELLE

SEQ ID NO: 2124899 - protein, 22 aa, Cryptosporidium hominis
KNRNHFWLPLLQVYGRSIVNVL

SEQ ID NO: 2124900 - protein, 18 aa, Cryptosporidium hominis
KNRPGICCCCNTDDFCRQ

SEQ ID NO: 2124901 - protein, 28 aa, Cryptosporidium hominis
KNRYCLYLFKEIYWKRSKVTIHYLTLIH

SEQ ID NO: 2124902 - protein, 23 aa, Cryptosporidium hominis
KNSDDICCGINFNGNNLGNDLNY

SEQ ID NO: 2124903 - protein, 22 aa, Cryptosporidium hominis
KNSRWFVFGKPMGIDIPEGKQQ

SEQ ID NO: 2124904 - protein, 26 aa, Cryptosporidium hominis
KNSVKIKNNPGEFIINNYKLGKNRNF

SEQ ID NO: 2124905 - protein, 19 aa, Cryptosporidium hominis
KNWLEFQSLISIVQLHSLE

SEQ ID NO: 2124906 - protein, 17 aa, Cryptosporidium hominis
KNYFATYVFRPEGENKV

SEQ ID NO: 2124907 - protein, 19 aa, Cryptosporidium hominis
KNYPICALNTFLVTSTLIM

SEQ ID NO: 2124908 - protein, 18 aa, Cryptosporidium hominis
KNYRHFFLLLFFVTMLLI

SEQ ID NO: 2124909 - protein, 32 aa, Cryptosporidium hominis
KPCPYCKGCNDSRLDSLPIWVSPILHRQIKRV

SEQ ID NO: 2124910 - protein, 17 aa, Cryptosporidium hominis
KPESCKISFIKELVQKI

SEQ ID NO: 2124911 - protein, 19 aa, Cryptosporidium hominis
KPFLSRIVSVLIQDVRLKF

SEQ ID NO: 2124912 - protein, 20 aa, Cryptosporidium hominis
KPISEFRIKTAFGGYLTILS

SEQ ID NO: 2124913 - protein, 18 aa, Cryptosporidium hominis
KPIVARCYILSARGLLPP

SEQ ID NO: 2124914 - protein, 25 aa, Cryptosporidium hominis
KPKKHLGKYLARIKRAIPTKKPSKP

SEQ ID NO: 2124915 - protein, 17 aa, Cryptosporidium hominis
KPLESRLIIASDDDARI

SEQ ID NO: 2124916 - protein, 19 aa, Cryptosporidium hominis
KPLSHICGGWNLGKFERIS

SEQ ID NO: 2124917 - protein, 18 aa, Cryptosporidium hominis
KPRAMRGITSNGMLLCAS

SEQ ID NO: 2124918 - protein, 18 aa, Cryptosporidium hominis
KPRKKEEAVLKFNLTNEG

SEQ ID NO: 2124919 - protein, 19 aa, Cryptosporidium hominis
KPRYDRIVGNISIDPRPYG

SEQ ID NO: 2124920 - protein, 19 aa, Cryptosporidium hominis
KPYSFEFLLNQLFVTQSLK

SEQ ID NO: 2124921 - protein, 23 aa, Cryptosporidium hominis
KQGSVALPNFQSGALGCPVSASI

SEQ ID NO: 2124922 - protein, 28 aa, Cryptosporidium hominis
KQIDSLFSLKHSFLWPHNNATLISAISM

SEQ ID NO: 2124923 - protein, 24 aa, Cryptosporidium hominis
KQKDYFIIWGCNYLSQISTYLSIP

SEQ ID NO: 2124924 - protein, 24 aa, Cryptosporidium hominis
KQKVIERLMLYFIIFVLLLANIYV

SEQ ID NO: 2124925 - protein, 19 aa, Cryptosporidium hominis
KQLFPGMGFIQYVQTSYMT

SEQ ID NO: 2124926 - protein, 23 aa, Cryptosporidium hominis
KQLIFHRIYFDLGTYPDRKLTQV

SEQ ID NO: 2124927 - protein, 18 aa, Cryptosporidium hominis
KQLISMLVLFCVYLTGRS

SEQ ID NO: 2124928 - protein, 17 aa, Cryptosporidium hominis
KQLKCHIFSDILFDKDT

SEQ ID NO: 2124929 - protein, 26 aa, Cryptosporidium hominis
KQPVYECIKLIITKFLLLILVSIVGG

SEQ ID NO: 2124930 - protein, 27 aa, Cryptosporidium hominis
KQRLGFARMLIKKSPIWILDEPTSALD

SEQ ID NO: 2124931 - protein, 23 aa, Cryptosporidium hominis
KQSPCYYLFFSVKAIKASMTTET

SEQ ID NO: 2124932 - protein, 28 aa, Cryptosporidium hominis
KQYPDSLWKKSPLKTWVHSVEKTRYCTL

SEQ ID NO: 2124933 - protein, 24 aa, Cryptosporidium hominis
KRDKFFRKMVVPILKSVNFMASPG

SEQ ID NO: 2124934 - protein, 18 aa, Cryptosporidium hominis
KRDMFKLFNHLHCICQFN

SEQ ID NO: 2124935 - protein, 20 aa, Cryptosporidium hominis
KRELDKFFEIEESFDNIPTV

SEQ ID NO: 2124936 - protein, 21 aa, Cryptosporidium hominis
KRFKGPKWNALAYHFKSALSY

SEQ ID NO: 2124937 - protein, 29 aa, Cryptosporidium hominis
KRFRNLLEASFCRLPIRMLIHSANISTHY

SEQ ID NO: 2124938 - protein, 20 aa, Cryptosporidium hominis
KRGGLPCLSVLRLLPPNLLG

SEQ ID NO: 2124939 - protein, 20 aa, Cryptosporidium hominis
KRGHPHFGQMWNFTKLDDEF

SEQ ID NO: 2124940 - protein, 28 aa, Cryptosporidium hominis
KRGWKLILHRFVWEYKLSRAINRITFTF

SEQ ID NO: 2124941 - protein, 20 aa, Cryptosporidium hominis
KRHPGTKWPLAINTTLQKRQ

SEQ ID NO: 2124942 - protein, 18 aa, Cryptosporidium hominis
KRIIMLFLAGTFILSIYI

SEQ ID NO: 2124943 - protein, 21 aa, Cryptosporidium hominis
KRILKAKNFYDTLGVPKDADD

SEQ ID NO: 2124944 - protein, 17 aa, Cryptosporidium hominis
KRILSPKFGEFNNGTQI

SEQ ID NO: 2124945 - protein, 22 aa, Cryptosporidium hominis
KRKIPGWSALILLISFIFSVLC

SEQ ID NO: 2124946 - protein, 20 aa, Cryptosporidium hominis
KRKISLVDFDRLVERFYNDE

SEQ ID NO: 2124947 - protein, 19 aa, Cryptosporidium hominis
KRKLSFKSKKKIMPSYENE

SEQ ID NO: 2124948 - protein, 30 aa, Cryptosporidium hominis
KRKLSLTRWFACFLLIFGVIMIPKKSKHSS

SEQ ID NO: 2124949 - protein, 20 aa, Cryptosporidium hominis
KRKVTVREVIAFSISTVGII

SEQ ID NO: 2124950 - protein, 22 aa, Cryptosporidium hominis
KRLFSSLIEQCCRYIIRNLRTM

SEQ ID NO: 2124951 - protein, 17 aa, Cryptosporidium hominis
KRLLQFIKISTAVIDLR

SEQ ID NO: 2124952 - protein, 21 aa, Cryptosporidium hominis
KRLLYHRMNPFNIIYRHFSNS

SEQ ID NO: 2124953 - protein, 22 aa, Cryptosporidium hominis
KRLNNSIFRLDVFPFITIYIVL

SEQ ID NO: 2124954 - protein, 38 aa, Cryptosporidium hominis
KRLVLWVICCHIFLLYLCISSPNALTCLFRVNCTDQID

SEQ ID NO: 2124955 - protein, 18 aa, Cryptosporidium hominis
KRRFTKEGFELNSNDSSN

SEQ ID NO: 2124956 - protein, 17 aa, Cryptosporidium hominis
KRRLFEIDSSTRGNKMV

SEQ ID NO: 2124957 - protein, 19 aa, Cryptosporidium hominis
KRRLPWSTFFSIKQNGLPT

SEQ ID NO: 2124958 - protein, 20 aa, Cryptosporidium hominis
KRSAEIQVGSVFDIFPVLYP

SEQ ID NO: 2124959 - protein, 24 aa, Cryptosporidium hominis
KRSDLYGPFWLNITLAMLIGTYST

SEQ ID NO: 2124960 - protein, 17 aa, Cryptosporidium hominis
KRSNIFLKILISVKKIF

SEQ ID NO: 2124961 - protein, 18 aa, Cryptosporidium hominis
KRTFSFEGSKALVSSKTL

SEQ ID NO: 2124962 - protein, 23 aa, Cryptosporidium hominis
KRTYFPIVLVSGIAYIATQILNK

SEQ ID NO: 2124963 - protein, 19 aa, Cryptosporidium hominis
KRYLLDFLISHVPINQRTS

SEQ ID NO: 2124964 - protein, 17 aa, Cryptosporidium hominis
KRYQCYFDQIKGGYYFQ

SEQ ID NO: 2124965 - protein, 18 aa, Cryptosporidium hominis
KSAIIRQAFKSEDVTLDL

SEQ ID NO: 2124966 - protein, 22 aa, Cryptosporidium hominis
KSANRLSTMFILSNVIEDIPFE

SEQ ID NO: 2124967 - protein, 26 aa, Cryptosporidium hominis
KSCGRKWNKFIIFINFISFFSIITKI

SEQ ID NO: 2124968 - protein, 19 aa, Cryptosporidium hominis
KSCKTCKKAFGRKEKCKAI

SEQ ID NO: 2124969 - protein, 20 aa, Cryptosporidium hominis
KSDYSFGAYERFTTYQNSTL

SEQ ID NO: 2124970 - protein, 22 aa, Cryptosporidium hominis
KSELHWPIGEKIPLDLSGDLDQ

SEQ ID NO: 2124971 - protein, 18 aa, Cryptosporidium hominis
KSEVDWPAERGMELEPDG

SEQ ID NO: 2124972 - protein, 24 aa, Cryptosporidium hominis
KSFCFTFLVLFYLRIYLYLYEEKI

SEQ ID NO: 2124973 - protein, 24 aa, Cryptosporidium hominis
KSFKCCWKEKRIIFVRQRENYLFI

SEQ ID NO: 2124974 - protein, 23 aa, Cryptosporidium hominis
KSFNEWSQYHILQLIFQNLSNIL

SEQ ID NO: 2124975 - protein, 18 aa, Cryptosporidium hominis
KSFNNGFTLFNIQQPFES

SEQ ID NO: 2124976 - protein, 25 aa, Cryptosporidium hominis
KSFSFERLDYVLAHCKSNLTICSGN

SEQ ID NO: 2124977 - protein, 19 aa, Cryptosporidium hominis
KSFTPKTSTSIPINNNNNN

SEQ ID NO: 2124978 - protein, 19 aa, Cryptosporidium hominis
KSGDLHSGELVQLNGDVDL

SEQ ID NO: 2124979 - protein, 22 aa, Cryptosporidium hominis
KSGLLPILIGISGWLRNNDDIF

SEQ ID NO: 2124980 - protein, 25 aa, Cryptosporidium hominis
KSGLLYWISMHFSWGKTFRTENNSA

SEQ ID NO: 2124981 - protein, 17 aa, Cryptosporidium hominis
KSGRGPVDYLLTGTASI

SEQ ID NO: 2124982 - protein, 18 aa, Cryptosporidium hominis
KSHWGVFWYILPIILILF

SEQ ID NO: 2124983 - protein, 17 aa, Cryptosporidium hominis
KSIAVLKIIPTFNVDSS

SEQ ID NO: 2124984 - protein, 25 aa, Cryptosporidium hominis
KSIDSFRPKSCFPCDKYLELKCMTY

SEQ ID NO: 2124985 - protein, 20 aa, Cryptosporidium hominis
KSIILCLCMELVVSISNKNY

SEQ ID NO: 2124986 - protein, 30 aa, Cryptosporidium hominis
KSIKDPIIRWRCDRLYKRIHLDRLNELSDI

SEQ ID NO: 2124987 - protein, 33 aa, Cryptosporidium hominis
KSIMGTWMITCVIFAHKWIEILIVYMTLVSKGI

SEQ ID NO: 2124988 - protein, 30 aa, Cryptosporidium hominis
KSIRTILDYGIKPWFLFSVSSVNSIRLIHK

SEQ ID NO: 2124989 - protein, 27 aa, Cryptosporidium hominis
KSITLPFLCFPLSIFIMNNVIKIKSDE

SEQ ID NO: 2124990 - protein, 20 aa, Cryptosporidium hominis
KSITTSGIWFSSNGLFSKSV

SEQ ID NO: 2124991 - protein, 20 aa, Cryptosporidium hominis
KSIYPSWYYFLVAFYNLIGR

SEQ ID NO: 2124992 - protein, 19 aa, Cryptosporidium hominis
KSKAKLCNWANYKDFTQKK

SEQ ID NO: 2124993 - protein, 22 aa, Cryptosporidium hominis
KSKARKVGFGFSDFDTSIKQNS

SEQ ID NO: 2124994 - protein, 22 aa, Cryptosporidium hominis
KSKGIVVKQIFGIVKLFSSFID

SEQ ID NO: 2124995 - protein, 21 aa, Cryptosporidium hominis
KSKIFEFLDVISLPNEISLLS

SEQ ID NO: 2124996 - protein, 23 aa, Cryptosporidium hominis
KSLDNKIDENWSLDKGYEKEQEM

SEQ ID NO: 2124997 - protein, 21 aa, Cryptosporidium hominis
KSLEFKLNFSTGIASKSLKNC

SEQ ID NO: 2124998 - protein, 24 aa, Cryptosporidium hominis
KSLISILFGPKWVRPENIQLFSAN

SEQ ID NO: 2124999 - protein, 18 aa, Cryptosporidium hominis
KSLLFPFSIFSILSSEHI

SEQ ID NO: 2125000 - protein, 20 aa, Cryptosporidium hominis
KSLWKEKNFLSVSLEKSEFI

SEQ ID NO: 2125001 - protein, 22 aa, Cryptosporidium hominis
KSMIDFIILRSIFGNGLLIFLL

SEQ ID NO: 2125002 - protein, 20 aa, Cryptosporidium hominis
KSMLILLVRLIQFTFKNIYL

SEQ ID NO: 2125003 - protein, 21 aa, Cryptosporidium hominis
KSNKLVKDWYIHPNYLSYLVL

SEQ ID NO: 2125004 - protein, 19 aa, Cryptosporidium hominis
KSNQLFSYELCYFEALNMN

SEQ ID NO: 2125005 - protein, 23 aa, Cryptosporidium hominis
KSNTCSFASFTFSKDIAVSRIFS

SEQ ID NO: 2125006 - protein, 17 aa, Cryptosporidium hominis
KSPIAYASQIPWIPNGS

SEQ ID NO: 2125007 - protein, 18 aa, Cryptosporidium hominis
KSPIPKYSSELFDFEKDN

SEQ ID NO: 2125008 - protein, 27 aa, Cryptosporidium hominis
KSQMIKDRHFLGAYTIFGSLLTALLLL

SEQ ID NO: 2125009 - protein, 21 aa, Cryptosporidium hominis
KSQVGFLNFVCLPLFQELCYV

SEQ ID NO: 2125010 - protein, 20 aa, Cryptosporidium hominis
KSRLLDGFGKMKNLWDKYGY

SEQ ID NO: 2125011 - protein, 31 aa, Cryptosporidium hominis
KSRLLEALLEVIPYEFLVIWINSHTISKEQY

SEQ ID NO: 2125012 - protein, 23 aa, Cryptosporidium hominis
KSRSTSYTNMWFKGYMHSFKQVF

SEQ ID NO: 2125013 - protein, 20 aa, Cryptosporidium hominis
KSSAKFLYERLIQALKLPSP

SEQ ID NO: 2125014 - protein, 19 aa, Cryptosporidium hominis
KSSCNAPPPSGFILKDKHL

SEQ ID NO: 2125015 - protein, 18 aa, Cryptosporidium hominis
KSSDPFYWVRVILASNRG

SEQ ID NO: 2125016 - protein, 21 aa, Cryptosporidium hominis
KSSFTSDVIKDFIQQIVSVSV

SEQ ID NO: 2125017 - protein, 17 aa, Cryptosporidium hominis
KSSINLPAYFPCSDSNL

SEQ ID NO: 2125018 - protein, 19 aa, Cryptosporidium hominis
KSSKFKYWILVAIILIGQV

SEQ ID NO: 2125019 - protein, 18 aa, Cryptosporidium hominis
KSSKILRKGKVCSTSSKN

SEQ ID NO: 2125020 - protein, 21 aa, Cryptosporidium hominis
KSSLESFEFLVPERKKEKSQE

SEQ ID NO: 2125021 - protein, 19 aa, Cryptosporidium hominis
KSSLFSAILRLFDPSFGAI

SEQ ID NO: 2125022 - protein, 22 aa, Cryptosporidium hominis
KSSRFSLSIMHLLGDLKVFDST

SEQ ID NO: 2125023 - protein, 26 aa, Cryptosporidium hominis
KSSRYRYYVVEGFTFQTIFRHFPLRR

SEQ ID NO: 2125024 - protein, 26 aa, Cryptosporidium hominis
KSVAFRVYPIFKYFGFFFKFIQRLKF

SEQ ID NO: 2125025 - protein, 26 aa, Cryptosporidium hominis
KSVDHLPWRFLVYKALNTFIDDIFSF

SEQ ID NO: 2125026 - protein, 17 aa, Cryptosporidium hominis
KSVFDRYSDTFISYNDS

SEQ ID NO: 2125027 - protein, 21 aa, Cryptosporidium hominis
KSVIFTLLWKLFLRMTKKTSL

SEQ ID NO: 2125028 - protein, 17 aa, Cryptosporidium hominis
KSYELDAILPLNALLTI

SEQ ID NO: 2125029 - protein, 25 aa, Cryptosporidium hominis
KSYKFPIKFPLAMYKINIENFGLRF

SEQ ID NO: 2125030 - protein, 18 aa, Cryptosporidium hominis
KSYKVIVQYCIKNEDGKT

SEQ ID NO: 2125031 - protein, 18 aa, Cryptosporidium hominis
KSYQLWMEVEILIKNTTP

SEQ ID NO: 2125032 - protein, 18 aa, Cryptosporidium hominis
KSYREYLDGIYLGYFYTW

SEQ ID NO: 2125033 - protein, 25 aa, Cryptosporidium hominis
KSYYKTASLFSFGGIACSELLKKAY

SEQ ID NO: 2125034 - protein, 30 aa, Cryptosporidium hominis
KTAFLLRGFLLIKFIRWVITKDPFNNVQLE

SEQ ID NO: 2125035 - protein, 24 aa, Cryptosporidium hominis
KTAKQCQERWNFLNRDEIDGSSIE

SEQ ID NO: 2125036 - protein, 21 aa, Cryptosporidium hominis
KTCVAEYAIAMALKSNQRVVY

SEQ ID NO: 2125037 - protein, 21 aa, Cryptosporidium hominis
KTDQGWWLLALILNVVDLISI

SEQ ID NO: 2125038 - protein, 20 aa, Cryptosporidium hominis
KTDYLWDEMIDFINNNKKSK

SEQ ID NO: 2125039 - protein, 18 aa, Cryptosporidium hominis
KTFKRFYGIYFLLFSINL

SEQ ID NO: 2125040 - protein, 19 aa, Cryptosporidium hominis
KTFPNFPGFLHSIVLLYNG

SEQ ID NO: 2125041 - protein, 25 aa, Cryptosporidium hominis
KTFWNEFIFCLALKVLMVVLTTCLN

SEQ ID NO: 2125042 - protein, 22 aa, Cryptosporidium hominis
KTFYLRIINILLFKLIYDIIQM

SEQ ID NO: 2125043 - protein, 26 aa, Cryptosporidium hominis
KTGLNLPILFGIAFMGFCVSGPDSIL

SEQ ID NO: 2125044 - protein, 23 aa, Cryptosporidium hominis
KTGRFLPKLLSPIIAAYNEFEER

SEQ ID NO: 2125045 - protein, 17 aa, Cryptosporidium hominis
KTIHLLGRIGDDSVVNG

SEQ ID NO: 2125046 - protein, 25 aa, Cryptosporidium hominis
KTKKLFIERFWLLNPFHFSINISND

SEQ ID NO: 2125047 - protein, 22 aa, Cryptosporidium hominis
KTKLHAIAVLLLFIRLLEISLF

SEQ ID NO: 2125048 - protein, 24 aa, Cryptosporidium hominis
KTLEKTGGVVPEFVNPKYLDSTKT

SEQ ID NO: 2125049 - protein, 17 aa, Cryptosporidium hominis
KTLFKEEYPLINVIKPI

SEQ ID NO: 2125050 - protein, 24 aa, Cryptosporidium hominis
KTLLRAAEYLALIHGFSRIVVISG

SEQ ID NO: 2125051 - protein, 29 aa, Cryptosporidium hominis
KTLRGYNFEFFKTISLDIFLPLSPLFDPR

SEQ ID NO: 2125052 - protein, 19 aa, Cryptosporidium hominis
KTLTCPKGFIRCALSQPSR

SEQ ID NO: 2125053 - protein, 34 aa, Cryptosporidium hominis
KTPKVSIQELFGFVLSVLHLGGFNVSSFVLSVIN

SEQ ID NO: 2125054 - protein, 26 aa, Cryptosporidium hominis
KTRECRSGSGFICLKLGFCRTEANLT

SEQ ID NO: 2125055 - protein, 19 aa, Cryptosporidium hominis
KTSSFDGLVAFFKIFSDIH

SEQ ID NO: 2125056 - protein, 19 aa, Cryptosporidium hominis
KTTPEVFIRAFKFQSTKYL

SEQ ID NO: 2125057 - protein, 28 aa, Cryptosporidium hominis
KTVAYYPFKLVVAFLLVIGNVSPVQGYS

SEQ ID NO: 2125058 - protein, 17 aa, Cryptosporidium hominis
KTYCRLEKFSSEELSSH

SEQ ID NO: 2125059 - protein, 17 aa, Cryptosporidium hominis
KTYYGICFIINILLLVY

SEQ ID NO: 2125060 - protein, 19 aa, Cryptosporidium hominis
KVAIGYDYMKNYILTNILI

SEQ ID NO: 2125061 - protein, 20 aa, Cryptosporidium hominis
KVDNIPFISIESNEKNSGIV

SEQ ID NO: 2125062 - protein, 17 aa, Cryptosporidium hominis
KVEIGVASIDRFTHFSL

SEQ ID NO: 2125063 - protein, 18 aa, Cryptosporidium hominis
KVELVRCLADVADALRSS

SEQ ID NO: 2125064 - protein, 23 aa, Cryptosporidium hominis
KVGAMWIPMYFHFLEWESDKNNL

SEQ ID NO: 2125065 - protein, 20 aa, Cryptosporidium hominis
KVIFKHRMLFVSFLVLGLAL

SEQ ID NO: 2125066 - protein, 20 aa, Cryptosporidium hominis
KVIKDKMKGIKEFDYSSRES

SEQ ID NO: 2125067 - protein, 24 aa, Cryptosporidium hominis
KVITTCWRIHSLINMKIQAEIVLL

SEQ ID NO: 2125068 - protein, 17 aa, Cryptosporidium hominis
KVLDFYKEMNLNGTESS

SEQ ID NO: 2125069 - protein, 17 aa, Cryptosporidium hominis
KVLFSILSVSAFAITPI

SEQ ID NO: 2125070 - protein, 22 aa, Cryptosporidium hominis
KVLGDTYCPILIDFNKDKDTNC

SEQ ID NO: 2125071 - protein, 20 aa, Cryptosporidium hominis
KVLIEFKRGLVFAINTVDIE

SEQ ID NO: 2125072 - protein, 26 aa, Cryptosporidium hominis
KVLKVASLCPACFCRPLSGIQKLVLK

SEQ ID NO: 2125073 - protein, 25 aa, Cryptosporidium hominis
KVLSEQFELGKLITYKTLSKEDKKS

SEQ ID NO: 2125074 - protein, 23 aa, Cryptosporidium hominis
KVNELKYTFVIFSLFLSNSNLTE

SEQ ID NO: 2125075 - protein, 19 aa, Cryptosporidium hominis
KVNLLRKALKLFLIREWSL

SEQ ID NO: 2125076 - protein, 29 aa, Cryptosporidium hominis
KVPPRPKKSPIMTRDWWIFGNIPHAIFEA

SEQ ID NO: 2125077 - protein, 20 aa, Cryptosporidium hominis
KVPVILILELFQFIKEETST

SEQ ID NO: 2125078 - protein, 24 aa, Cryptosporidium hominis
KVQLKRFDFISIINEVMKEFEGIN

SEQ ID NO: 2125079 - protein, 29 aa, Cryptosporidium hominis
KVRLYRLGKIFKVWRLIKKNNKSIKISDA

SEQ ID NO: 2125080 - protein, 17 aa, Cryptosporidium hominis
KVSVGKMHKCLESSLIE

SEQ ID NO: 2125081 - protein, 20 aa, Cryptosporidium hominis
KVTASLWYQAKLIFGFDDEL

SEQ ID NO: 2125082 - protein, 23 aa, Cryptosporidium hominis
KVTFPILFGALLVLFFFSSYGII

SEQ ID NO: 2125083 - protein, 17 aa, Cryptosporidium hominis
KVTVCDFEDLKNGVGPI

SEQ ID NO: 2125084 - protein, 26 aa, Cryptosporidium hominis
KVVPKFLICIPVLAYLFFQVSKKYAP

SEQ ID NO: 2125085 - protein, 22 aa, Cryptosporidium hominis
KVWKSSPIWLHLKPSDTKNPQE

SEQ ID NO: 2125086 - protein, 27 aa, Cryptosporidium hominis
KVYHSDFTWRLNSIMQRNLSDSITKDT

SEQ ID NO: 2125087 - protein, 26 aa, Cryptosporidium hominis
KWETTKGIILMLKYSIEMKMFSVAKI

SEQ ID NO: 2125088 - protein, 22 aa, Cryptosporidium hominis
KWKAECERFGKFKVFENKNGNN

SEQ ID NO: 2125089 - protein, 31 aa, Cryptosporidium hominis
KWLFEGGHLPPCFFPAIIADIRFEESLPLLD

SEQ ID NO: 2125090 - protein, 20 aa, Cryptosporidium hominis
KWNYIYSVDLFKLNSISWSK

SEQ ID NO: 2125091 - protein, 17 aa, Cryptosporidium hominis
KWRSITWEVQMHGMGLI

SEQ ID NO: 2125092 - protein, 22 aa, Cryptosporidium hominis
KYAFWSCSFVHLAPEVEKLFQS

SEQ ID NO: 2125093 - protein, 23 aa, Cryptosporidium hominis
KYEVKLRGSFTCKPWQEHLKLNW

SEQ ID NO: 2125094 - protein, 23 aa, Cryptosporidium hominis
KYFKGKSVSILELLCYQNFSFQE

SEQ ID NO: 2125095 - protein, 31 aa, Cryptosporidium hominis
KYFNSINCCFNLVVYLCWMFIPDEYLNQINI

SEQ ID NO: 2125096 - protein, 18 aa, Cryptosporidium hominis
KYIFYMNVLNGFSQNQYL

SEQ ID NO: 2125097 - protein, 17 aa, Cryptosporidium hominis
KYIRGEYIYDLTRTPSW

SEQ ID NO: 2125098 - protein, 18 aa, Cryptosporidium hominis
KYISFCFFLGIMGSLHLM

SEQ ID NO: 2125099 - protein, 18 aa, Cryptosporidium hominis
KYIVYLIFWVVVKFFESI

SEQ ID NO: 2125100 - protein, 28 aa, Cryptosporidium hominis
KYKRKYMYWIWRRWRYLLSAKERMPILV

SEQ ID NO: 2125101 - protein, 19 aa, Cryptosporidium hominis
KYLFIPEEPKFVGSNNSQQ

SEQ ID NO: 2125102 - protein, 21 aa, Cryptosporidium hominis
KYLKKPRNLYIYDNVGNKELN

SEQ ID NO: 2125103 - protein, 28 aa, Cryptosporidium hominis
KYLKQAKWTWPNVICDFFCGLAEAALSI

SEQ ID NO: 2125104 - protein, 24 aa, Cryptosporidium hominis
KYLLPGFVYWLLIFVIKNFDKFEL

SEQ ID NO: 2125105 - protein, 23 aa, Cryptosporidium hominis
KYMHYCSVILLNFVITIFLEIYI

SEQ ID NO: 2125106 - protein, 19 aa, Cryptosporidium hominis
KYNICSTITQIIIVQLIKI

SEQ ID NO: 2125107 - protein, 21 aa, Cryptosporidium hominis
KYPIDPFVQYAFRVANSQING

SEQ ID NO: 2125108 - protein, 18 aa, Cryptosporidium hominis
KYSDFCVHPAPILRKHAS

SEQ ID NO: 2125109 - protein, 19 aa, Cryptosporidium hominis
KYSVDIVIGALRYDLISSD

SEQ ID NO: 2125110 - protein, 17 aa, Cryptosporidium hominis
KYTGMVLEKYLYLLDRL

SEQ ID NO: 2125111 - protein, 18 aa, Cryptosporidium hominis
KYVRPVPGITEYGLSNPI

SEQ ID NO: 2125112 - protein, 18 aa, Cryptosporidium hominis
KYVYSPKVQGLWNIHQIT

SEQ ID NO: 2125113 - protein, 17 aa, Cryptosporidium hominis
KYYKFGRIHAKKENSLL

SEQ ID NO: 2125114 - protein, 19 aa, Cryptosporidium hominis
KYYLIFSLAFFILHSSFQM

SEQ ID NO: 2125115 - protein, 19 aa, Cryptosporidium hominis
KYYREFLAFVYYRCIYGAE

SEQ ID NO: 2125116 - protein, 24 aa, Cryptosporidium hominis
LAEFFRVPINFNFTQIDSIFSNNK

SEQ ID NO: 2125117 - protein, 19 aa, Cryptosporidium hominis
LAEGLKLIKKLDILNKADC

SEQ ID NO: 2125118 - protein, 18 aa, Cryptosporidium hominis
LAENATCLMADYVQLEKE

SEQ ID NO: 2125119 - protein, 20 aa, Cryptosporidium hominis
LAENVILNIFCKFNSIINKY

SEQ ID NO: 2125120 - protein, 21 aa, Cryptosporidium hominis
LAFEGIKIGIELSMASNITFF

SEQ ID NO: 2125121 - protein, 25 aa, Cryptosporidium hominis
LAGGPSYFIPFAIFGYYKTRADVNA

SEQ ID NO: 2125122 - protein, 19 aa, Cryptosporidium hominis
LAHNMLALVALQFTIMKAL

SEQ ID NO: 2125123 - protein, 24 aa, Cryptosporidium hominis
LAHTICIIYAFFIYFGPKIMEKRK

SEQ ID NO: 2125124 - protein, 19 aa, Cryptosporidium hominis
LAIIISRLRVLALPYIALV

SEQ ID NO: 2125125 - protein, 26 aa, Cryptosporidium hominis
LAISCSSYEGPDCKFTSFNLKQVLDC

SEQ ID NO: 2125126 - protein, 20 aa, Cryptosporidium hominis
LAKNRGHYITSILFFMEANL

SEQ ID NO: 2125127 - protein, 18 aa, Cryptosporidium hominis
LALECLFHATTMGYRVVF

SEQ ID NO: 2125128 - protein, 22 aa, Cryptosporidium hominis
LALIRLSLFLPFVPSNCLLGLT

SEQ ID NO: 2125129 - protein, 20 aa, Cryptosporidium hominis
LALLESSFCEERKDNYKQIT

SEQ ID NO: 2125130 - protein, 21 aa, Cryptosporidium hominis
LALPLISGYFILLPITHYVAN

SEQ ID NO: 2125131 - protein, 18 aa, Cryptosporidium hominis
LAMPFQFESEILLVLFCL

SEQ ID NO: 2125132 - protein, 23 aa, Cryptosporidium hominis
LANIEHFRFYTIRNITGNITDVI

SEQ ID NO: 2125133 - protein, 18 aa, Cryptosporidium hominis
LAPIKLRQQMWLRRPRWF

SEQ ID NO: 2125134 - protein, 26 aa, Cryptosporidium hominis
LAPVEYKEEISLLWRLLTLLVGNSSK

SEQ ID NO: 2125135 - protein, 18 aa, Cryptosporidium hominis
LARTCLKAADIGHGALKW

SEQ ID NO: 2125136 - protein, 23 aa, Cryptosporidium hominis
LASCIFIYLEVMRKYRYRELTKL

SEQ ID NO: 2125137 - protein, 29 aa, Cryptosporidium hominis
LASCIPAYCLRPLCQHILPSFHDADKITA

SEQ ID NO: 2125138 - protein, 18 aa, Cryptosporidium hominis
LASICIELGFECRELNGS

SEQ ID NO: 2125139 - protein, 23 aa, Cryptosporidium hominis
LASQRFANGFIHMSPDAYGDGPW

SEQ ID NO: 2125140 - protein, 18 aa, Cryptosporidium hominis
LATFTIWVIFGIQHLCLP

SEQ ID NO: 2125141 - protein, 20 aa, Cryptosporidium hominis
LCACALIHVILWNGIKESFK

SEQ ID NO: 2125142 - protein, 18 aa, Cryptosporidium hominis
LCAIASVIPTEAPTTKYS

SEQ ID NO: 2125143 - protein, 21 aa, Cryptosporidium hominis
LCGISNYLSFEYKDLSNLKEE

SEQ ID NO: 2125144 - protein, 19 aa, Cryptosporidium hominis
LCGTPEYIAPEVLLNKGHG

SEQ ID NO: 2125145 - protein, 19 aa, Cryptosporidium hominis
LCIGFECINYRGSCININI

SEQ ID NO: 2125146 - protein, 19 aa, Cryptosporidium hominis
LCIPNNFSAVKLVSVLSVF

SEQ ID NO: 2125147 - protein, 22 aa, Cryptosporidium hominis
LCIVSWMPLMLENCSPALSDSE

SEQ ID NO: 2125148 - protein, 25 aa, Cryptosporidium hominis
LCIVVWNVVCATSFEVQPYWTTRAK

SEQ ID NO: 2125149 - protein, 20 aa, Cryptosporidium hominis
LCKLPYNQHFNAAKTFGQVF

SEQ ID NO: 2125150 - protein, 17 aa, Cryptosporidium hominis
LCKNSVLFFSTRNYYRY

SEQ ID NO: 2125151 - protein, 20 aa, Cryptosporidium hominis
LCMTGSLLTYKYIFDGVFDH

SEQ ID NO: 2125152 - protein, 18 aa, Cryptosporidium hominis
LCNTELPNAVSLSNKEVL

SEQ ID NO: 2125153 - protein, 26 aa, Cryptosporidium hominis
LCRFNYKVEISLLFAQIIVLVLLTLL

SEQ ID NO: 2125154 - protein, 19 aa, Cryptosporidium hominis
LCSIIPFEGYLPYDRSGDW

SEQ ID NO: 2125155 - protein, 19 aa, Cryptosporidium hominis
LCSLRTALVQWILSSSSNQ

SEQ ID NO: 2125156 - protein, 19 aa, Cryptosporidium hominis
LCSSTFWGQDCNHPTIKSS

SEQ ID NO: 2125157 - protein, 28 aa, Cryptosporidium hominis
LCTLKQYRFFSIYALKCLKNQVNLLDKL

SEQ ID NO: 2125158 - protein, 17 aa, Cryptosporidium hominis
LCTLLSFIGFIISMAVV

SEQ ID NO: 2125159 - protein, 20 aa, Cryptosporidium hominis
LCYALNIFLSLVFCQELTSI

SEQ ID NO: 2125160 - protein, 17 aa, Cryptosporidium hominis
LDCLICMSNPKDVILLP

SEQ ID NO: 2125161 - protein, 19 aa, Cryptosporidium hominis
LDDLMAIPVTLLVRLIILS

SEQ ID NO: 2125162 - protein, 27 aa, Cryptosporidium hominis
LDDPTRIALRVGRILSVERHPTADKLY

SEQ ID NO: 2125163 - protein, 24 aa, Cryptosporidium hominis
LDELCIRSSVLPLSRQSWKESDAG

SEQ ID NO: 2125164 - protein, 19 aa, Cryptosporidium hominis
LDEVIEWERQYSIEVIEPD

SEQ ID NO: 2125165 - protein, 17 aa, Cryptosporidium hominis
LDFIGFSKSIFWTLYII

SEQ ID NO: 2125166 - protein, 30 aa, Cryptosporidium hominis
LDFSLKCFHAICWCCTLRLRYLLKSKECPF

SEQ ID NO: 2125167 - protein, 25 aa, Cryptosporidium hominis
LDGQMSLKLGIVVNLLYGNQSVLVL

SEQ ID NO: 2125168 - protein, 25 aa, Cryptosporidium hominis
LDIFKPRPVLVYNMSSYYIPEHLLL

SEQ ID NO: 2125169 - protein, 17 aa, Cryptosporidium hominis
LDIFLPLSPLFDPRLTI

SEQ ID NO: 2125170 - protein, 18 aa, Cryptosporidium hominis
LDIPAPRGPLFVLGNNFI

SEQ ID NO: 2125171 - protein, 19 aa, Cryptosporidium hominis
LDLICRVPIQCKLTINQTF

SEQ ID NO: 2125172 - protein, 18 aa, Cryptosporidium hominis
LDLKIRIYLPYSSELHVE

SEQ ID NO: 2125173 - protein, 21 aa, Cryptosporidium hominis
LDLLFLLPIIYNFLSIPNRTL

SEQ ID NO: 2125174 - protein, 20 aa, Cryptosporidium hominis
LDQIKETRSVAVNQTTTTIE

SEQ ID NO: 2125175 - protein, 21 aa, Cryptosporidium hominis
LDSCNGALCELLFDILPNNIQ

SEQ ID NO: 2125176 - protein, 17 aa, Cryptosporidium hominis
LDSLPAQVPSIFHQRCC

SEQ ID NO: 2125177 - protein, 17 aa, Cryptosporidium hominis
LDTKFSIENLFKLLNEE

SEQ ID NO: 2125178 - protein, 20 aa, Cryptosporidium hominis
LDTMLPSFIVERLLIDQKNN

SEQ ID NO: 2125179 - protein, 25 aa, Cryptosporidium hominis
LDTSMMFCPLTKIGMSQSLLPRFEA

SEQ ID NO: 2125180 - protein, 19 aa, Cryptosporidium hominis
LDVFNIFKEPFPISWVNLY

SEQ ID NO: 2125181 - protein, 24 aa, Cryptosporidium hominis
LDVIKHVIQLILIVAPTLDPGNED

SEQ ID NO: 2125182 - protein, 21 aa, Cryptosporidium hominis
LDVPGSPRWSARGRTLIRKEA

SEQ ID NO: 2125183 - protein, 20 aa, Cryptosporidium hominis
LDYFIWFFLEFFYPKESIEH

SEQ ID NO: 2125184 - protein, 25 aa, Cryptosporidium hominis
LDYGKCTKFLLSMDTWLDESAINNL

SEQ ID NO: 2125185 - protein, 24 aa, Cryptosporidium hominis
LEAYYWKEGWILPKTTLDLQKSEL

SEQ ID NO: 2125186 - protein, 18 aa, Cryptosporidium hominis
LECGPVILFTDFQVYSFL

SEQ ID NO: 2125187 - protein, 25 aa, Cryptosporidium hominis
LECVFILYCSFALPSLLFSSFSLMI

SEQ ID NO: 2125188 - protein, 19 aa, Cryptosporidium hominis
LEDFRMLIQNGIISDYLNV

SEQ ID NO: 2125189 - protein, 24 aa, Cryptosporidium hominis
LEEFFPKVMLKLSKDLTHLIIEEI

SEQ ID NO: 2125190 - protein, 21 aa, Cryptosporidium hominis
LEEFNLGIDLIRATISLNIPE

SEQ ID NO: 2125191 - protein, 23 aa, Cryptosporidium hominis
LEENIKLIVSRSFVIASQKMSLS

SEQ ID NO: 2125192 - protein, 24 aa, Cryptosporidium hominis
LEFSIFFIRFYKNIARHDSIPYII

SEQ ID NO: 2125193 - protein, 24 aa, Cryptosporidium hominis
LEGLITRWSNILVDMFIQSDNYRD

SEQ ID NO: 2125194 - protein, 21 aa, Cryptosporidium hominis
LEGSPRITGVLINGSEYQAPL

SEQ ID NO: 2125195 - protein, 22 aa, Cryptosporidium hominis
LEGVSSLLFRGTYIMDRADKVW

SEQ ID NO: 2125196 - protein, 21 aa, Cryptosporidium hominis
LEIFRSRILIAGARLSIILND

SEQ ID NO: 2125197 - protein, 18 aa, Cryptosporidium hominis
LEIIHCMHMGMAPFFTGM

SEQ ID NO: 2125198 - protein, 21 aa, Cryptosporidium hominis
LEILFRYICMKSVKKIFLSWT

SEQ ID NO: 2125199 - protein, 23 aa, Cryptosporidium hominis
LEILFWIAFCLLLMVGYKYLSDG

SEQ ID NO: 2125200 - protein, 24 aa, Cryptosporidium hominis
LEINSLPPSFSWTKAWKDITSEGL

SEQ ID NO: 2125201 - protein, 19 aa, Cryptosporidium hominis
LEIPILKLICFQIVIYLPF

SEQ ID NO: 2125202 - protein, 17 aa, Cryptosporidium hominis
LEISTTLGFSLHYLQLI

SEQ ID NO: 2125203 - protein, 21 aa, Cryptosporidium hominis
LEKCPTYYKITAKMLEHPFHQ

SEQ ID NO: 2125204 - protein, 18 aa, Cryptosporidium hominis
LEKFQGYWVLLRSNSDSL

SEQ ID NO: 2125205 - protein, 19 aa, Cryptosporidium hominis
LEKIIPCSEKLEALLGEYV

SEQ ID NO: 2125206 - protein, 24 aa, Cryptosporidium hominis
LEKIKKKRNLGLTNEEMDKFSERE

SEQ ID NO: 2125207 - protein, 23 aa, Cryptosporidium hominis
LEKKCLICKIIRTIFESLETELF

SEQ ID NO: 2125208 - protein, 24 aa, Cryptosporidium hominis
LELERARLMLILSNIKQEDNDLKE

SEQ ID NO: 2125209 - protein, 19 aa, Cryptosporidium hominis
LELGIKQISIFPGEVPGAA

SEQ ID NO: 2125210 - protein, 17 aa, Cryptosporidium hominis
LELILKYIDDLSLMYEV

SEQ ID NO: 2125211 - protein, 17 aa, Cryptosporidium hominis
LELLIPILMDPFSSLEC

SEQ ID NO: 2125212 - protein, 22 aa, Cryptosporidium hominis
LELLKCELDDFGFKNNLLAQIF

SEQ ID NO: 2125213 - protein, 21 aa, Cryptosporidium hominis
LELRYKPEMPLVLNSISCNIH

SEQ ID NO: 2125214 - protein, 23 aa, Cryptosporidium hominis
LELSRSVWRSVQLILSIILDEHE

SEQ ID NO: 2125215 - protein, 18 aa, Cryptosporidium hominis
LELVKYRYLAPLTVDIER

SEQ ID NO: 2125216 - protein, 28 aa, Cryptosporidium hominis
LENICWKSQCYVDILPLDFCDVNHSLLN

SEQ ID NO: 2125217 - protein, 31 aa, Cryptosporidium hominis
LENINALGFVSGFLFKLSIILITAPVPWARW

SEQ ID NO: 2125218 - protein, 18 aa, Cryptosporidium hominis
LENLKIILPNTLVMEKLK

SEQ ID NO: 2125219 - protein, 24 aa, Cryptosporidium hominis
LEQFAHTFGLVFSSLIRSITTIED

SEQ ID NO: 2125220 - protein, 23 aa, Cryptosporidium hominis
LEQMRLSLLCKDFVRLQIFAKKI

SEQ ID NO: 2125221 - protein, 21 aa, Cryptosporidium hominis
LERKFLYRPNVPVIGNAKLWW

SEQ ID NO: 2125222 - protein, 22 aa, Cryptosporidium hominis
LESEVKVSVSMLKEHFSSVTNK

SEQ ID NO: 2125223 - protein, 25 aa, Cryptosporidium hominis
LESFTRFRIIFSRERAKGLYGPATY

SEQ ID NO: 2125224 - protein, 19 aa, Cryptosporidium hominis
LESICIPARHILLSLQVHS

SEQ ID NO: 2125225 - protein, 23 aa, Cryptosporidium hominis
LESKISVKLVENFPLQRKHPFDF

SEQ ID NO: 2125226 - protein, 25 aa, Cryptosporidium hominis
LESYKLLEISLIFAGIVTGILIFVP

SEQ ID NO: 2125227 - protein, 24 aa, Cryptosporidium hominis
LETECLKSGLAVLRIDMPGHGLSS

SEQ ID NO: 2125228 - protein, 20 aa, Cryptosporidium hominis
LEVCAYKFTNGVPIASEAKV

SEQ ID NO: 2125229 - protein, 43 aa, Cryptosporidium hominis
LEVIPGESSHVWGVLLARSLPAWDWKSPSILVSILRLLILNPR

SEQ ID NO: 2125230 - protein, 23 aa, Cryptosporidium hominis
LEVKIEIIHFTRECSVEERTILQ

SEQ ID NO: 2125231 - protein, 17 aa, Cryptosporidium hominis
LEVKNWIHSDGLHAAEA

SEQ ID NO: 2125232 - protein, 22 aa, Cryptosporidium hominis
LEYETIKLFNIIGSTGNPKDTG

SEQ ID NO: 2125233 - protein, 22 aa, Cryptosporidium hominis
LEYNQRMDLILSKEYIIDYLKI

SEQ ID NO: 2125234 - protein, 20 aa, Cryptosporidium hominis
LFAAICVIRGIMVFILSPLL

SEQ ID NO: 2125235 - protein, 17 aa, Cryptosporidium hominis
LFAFFTFIHALLISIYV

SEQ ID NO: 2125236 - protein, 23 aa, Cryptosporidium hominis
LFASRKYLSFIFNYYKPILLWIF

SEQ ID NO: 2125237 - protein, 24 aa, Cryptosporidium hominis
LFCKFSQTFFTQGLISYFHFNASD

SEQ ID NO: 2125238 - protein, 22 aa, Cryptosporidium hominis
LFEHSKESFKYVYSPKVQGLWN

SEQ ID NO: 2125239 - protein, 18 aa, Cryptosporidium hominis
LFELIFRATAQDVILESE

SEQ ID NO: 2125240 - protein, 26 aa, Cryptosporidium hominis
LFESKNGLKYFCWDIQAVREIITAHY

SEQ ID NO: 2125241 - protein, 19 aa, Cryptosporidium hominis
LFFNIIFSIFILKQQISTI

SEQ ID NO: 2125242 - protein, 17 aa, Cryptosporidium hominis
LFGYIWRKSAGYLNSEW

SEQ ID NO: 2125243 - protein, 18 aa, Cryptosporidium hominis
LFHFSMSTYWMVLGKIIG

SEQ ID NO: 2125244 - protein, 20 aa, Cryptosporidium hominis
LFICSEFILETSILTMFHSS

SEQ ID NO: 2125245 - protein, 22 aa, Cryptosporidium hominis
LFIFFCGISIILGTVPSFPILP

SEQ ID NO: 2125246 - protein, 17 aa, Cryptosporidium hominis
LFIFHWLIFLPSFVLDE

SEQ ID NO: 2125247 - protein, 27 aa, Cryptosporidium hominis
LFIHSLVLLCIICYIITEFKNDNDHKN

SEQ ID NO: 2125248 - protein, 23 aa, Cryptosporidium hominis
LFIKRYRLKLSKELDKSAIETKN

SEQ ID NO: 2125249 - protein, 18 aa, Cryptosporidium hominis
LFIQRECIYDQSISLQSL

SEQ ID NO: 2125250 - protein, 23 aa, Cryptosporidium hominis
LFITDYRLGISLFSYFNIEYYPL

SEQ ID NO: 2125251 - protein, 24 aa, Cryptosporidium hominis
LFIYNFWRCSILVSKSEYIVTSVL

SEQ ID NO: 2125252 - protein, 23 aa, Cryptosporidium hominis
LFKKGKVCSMIKEIYSKNKKDKK

SEQ ID NO: 2125253 - protein, 27 aa, Cryptosporidium hominis
LFKTLKYIRSLECSNQFKGHNCNNIIP

SEQ ID NO: 2125254 - protein, 31 aa, Cryptosporidium hominis
LFLCKDLDMEGRFVLISAITNFLGYPNSYTY

SEQ ID NO: 2125255 - protein, 17 aa, Cryptosporidium hominis
LFLIISFFVNFLNKHLE

SEQ ID NO: 2125256 - protein, 17 aa, Cryptosporidium hominis
LFLKSYLLTLLFSLVQI

SEQ ID NO: 2125257 - protein, 17 aa, Cryptosporidium hominis
LFLLLIAFIIFYVIFLT

SEQ ID NO: 2125258 - protein, 17 aa, Cryptosporidium hominis
LFLNVCSQIKFIDAKEL

SEQ ID NO: 2125259 - protein, 17 aa, Cryptosporidium hominis
LFLSLALSSSKKKFIKQ

SEQ ID NO: 2125260 - protein, 23 aa, Cryptosporidium hominis
LFMSAWGPTCFRPKAQESHFHFV

SEQ ID NO: 2125261 - protein, 24 aa, Cryptosporidium hominis
LFNEKRLATSILKTVPLIFVFLDI

SEQ ID NO: 2125262 - protein, 17 aa, Cryptosporidium hominis
LFNFHLIILDHAKIMET

SEQ ID NO: 2125263 - protein, 25 aa, Cryptosporidium hominis
LFNPDFKMSFLIGICVVLLVNLFVI

SEQ ID NO: 2125264 - protein, 19 aa, Cryptosporidium hominis
LFPDYEVKSSRIWGITISL

SEQ ID NO: 2125265 - protein, 18 aa, Cryptosporidium hominis
LFPGTVIFIDKAMRIPAD

SEQ ID NO: 2125266 - protein, 17 aa, Cryptosporidium hominis
LFPSMGIIEKYILQIKL

SEQ ID NO: 2125267 - protein, 26 aa, Cryptosporidium hominis
LFQGFLCALLFIGEAIGGVKASNIAH

SEQ ID NO: 2125268 - protein, 23 aa, Cryptosporidium hominis
LFRILFGKILCEILGMFIADRLK

SEQ ID NO: 2125269 - protein, 21 aa, Cryptosporidium hominis
LFRQLLCTLITLLGVSSVWFN

SEQ ID NO: 2125270 - protein, 19 aa, Cryptosporidium hominis
LFSGNLLSLISELGPTSDR

SEQ ID NO: 2125271 - protein, 18 aa, Cryptosporidium hominis
LFSGTGIALAQSIGALNI

SEQ ID NO: 2125272 - protein, 19 aa, Cryptosporidium hominis
LFSKSCLNISLIENINAMK

SEQ ID NO: 2125273 - protein, 20 aa, Cryptosporidium hominis
LFSVAWLKVSSPIFIAVCLA

SEQ ID NO: 2125274 - protein, 20 aa, Cryptosporidium hominis
LFTVCIERAIYLSLNHDSDS

SEQ ID NO: 2125275 - protein, 22 aa, Cryptosporidium hominis
LFVFSWPISKFLDYFIGENGKT

SEQ ID NO: 2125276 - protein, 24 aa, Cryptosporidium hominis
LFVILQIYIKFEFAGANSVGKLGY

SEQ ID NO: 2125277 - protein, 19 aa, Cryptosporidium hominis
LFYIFNWIYRFYAQHYVNW

SEQ ID NO: 2125278 - protein, 28 aa, Cryptosporidium hominis
LFYIIYKYIFRYFIHSCRLLHNTYISEI

SEQ ID NO: 2125279 - protein, 18 aa, Cryptosporidium hominis
LFYISRVSFEMIMPLTRN

SEQ ID NO: 2125280 - protein, 18 aa, Cryptosporidium hominis
LFYSFIVWPLCWSIITFY

SEQ ID NO: 2125281 - protein, 26 aa, Cryptosporidium hominis
LFYVVFTILIGFIFIIGILGAFFYLG

SEQ ID NO: 2125282 - protein, 28 aa, Cryptosporidium hominis
LGACVISSLGIFCISAKGFVSVGAIAIA

SEQ ID NO: 2125283 - protein, 19 aa, Cryptosporidium hominis
LGAIKTSCGLQKWDVSTQY

SEQ ID NO: 2125284 - protein, 24 aa, Cryptosporidium hominis
LGCRPCYLMFGAVFILVLIVSMGY

SEQ ID NO: 2125285 - protein, 17 aa, Cryptosporidium hominis
LGCWNFILPKLISEDFV

SEQ ID NO: 2125286 - protein, 20 aa, Cryptosporidium hominis
LGDIRRGIHFGMLRTDASRG

SEQ ID NO: 2125287 - protein, 24 aa, Cryptosporidium hominis
LGDVTLFLLRLIRFRSEEFSLYHI

SEQ ID NO: 2125288 - protein, 19 aa, Cryptosporidium hominis
LGEGWKYKSHKVLDFSGQN

SEQ ID NO: 2125289 - protein, 26 aa, Cryptosporidium hominis
LGERKWDVMESIALATFHFRVKYEND

SEQ ID NO: 2125290 - protein, 21 aa, Cryptosporidium hominis
LGFTLILSIWILKSQDWYNLD

SEQ ID NO: 2125291 - protein, 19 aa, Cryptosporidium hominis
LGIIVSFLFLFNASHIVRI

SEQ ID NO: 2125292 - protein, 25 aa, Cryptosporidium hominis
LGIKVKLTSLISCAIIISGVLIGAF

SEQ ID NO: 2125293 - protein, 26 aa, Cryptosporidium hominis
LGKHVLRATLILTILLPFILEIYYLI

SEQ ID NO: 2125294 - protein, 20 aa, Cryptosporidium hominis
LGKLFKRPKVRNQKESVKFK

SEQ ID NO: 2125295 - protein, 23 aa, Cryptosporidium hominis
LGKYKFSGLYLPGLPLLNTHLEK

SEQ ID NO: 2125296 - protein, 17 aa, Cryptosporidium hominis
LGLESLFYWKINKSRIN

SEQ ID NO: 2125297 - protein, 20 aa, Cryptosporidium hominis
LGLFLKLNQFLLLKENDIVD

SEQ ID NO: 2125298 - protein, 23 aa, Cryptosporidium hominis
LGLMGFGSCDAELYDELRNVLYM

SEQ ID NO: 2125299 - protein, 17 aa, Cryptosporidium hominis
LGLMKLYPFHLDVNGSL

SEQ ID NO: 2125300 - protein, 29 aa, Cryptosporidium hominis
LGMLILAILFWFRRYKWKKNFEDDQNTEV

SEQ ID NO: 2125301 - protein, 18 aa, Cryptosporidium hominis
LGNVLFWITFCFCGQPIA

SEQ ID NO: 2125302 - protein, 27 aa, Cryptosporidium hominis
LGQGGWQPPPCYWSLMKHPAVVNSIQK

SEQ ID NO: 2125303 - protein, 17 aa, Cryptosporidium hominis
LGRKATVMIIGNVSAGK

SEQ ID NO: 2125304 - protein, 25 aa, Cryptosporidium hominis
LGRKHLRLATPFSKKQWIVNKIPVN

SEQ ID NO: 2125305 - protein, 20 aa, Cryptosporidium hominis
LGSLCGVFVGRYVSNLVSIF

SEQ ID NO: 2125306 - protein, 17 aa, Cryptosporidium hominis
LGSSPEYILLIQVFVWL

SEQ ID NO: 2125307 - protein, 19 aa, Cryptosporidium hominis
LGTVLFFFGFNGEKTNLER

SEQ ID NO: 2125308 - protein, 21 aa, Cryptosporidium hominis
LGVQISWRLVFFIEYLGPIII

SEQ ID NO: 2125309 - protein, 21 aa, Cryptosporidium hominis
LGVSFCSILVIYLSQSLQDIL

SEQ ID NO: 2125310 - protein, 18 aa, Cryptosporidium hominis
LGYFYTWIILFAAAQLFW

SEQ ID NO: 2125311 - protein, 26 aa, Cryptosporidium hominis
LHDLEHSRPWYVGECITVNSIIPKMD

SEQ ID NO: 2125312 - protein, 23 aa, Cryptosporidium hominis
LHFNSLRKYVCMASEIFDNWITL

SEQ ID NO: 2125313 - protein, 22 aa, Cryptosporidium hominis
LHGIAECMYSIYQKNGICGLYS

SEQ ID NO: 2125314 - protein, 17 aa, Cryptosporidium hominis
LHILSRIGMSHFFISFK

SEQ ID NO: 2125315 - protein, 32 aa, Cryptosporidium hominis
LHLAAIVIQCYFRRYLCKKYLYFRKYGPIKLL

SEQ ID NO: 2125316 - protein, 23 aa, Cryptosporidium hominis
LHLISHIRINHMFELDRPKTTAI

SEQ ID NO: 2125317 - protein, 18 aa, Cryptosporidium hominis
LHLPNLILDIWKTFDDLQ

SEQ ID NO: 2125318 - protein, 26 aa, Cryptosporidium hominis
LHNHAIEIVNWFKHLFNINSKVSRSS

SEQ ID NO: 2125319 - protein, 23 aa, Cryptosporidium hominis
LHNKRYAHIFSIILMGASVLFIK

SEQ ID NO: 2125320 - protein, 24 aa, Cryptosporidium hominis
LHNSLRLLFLSSITTVIVDYLLGV

SEQ ID NO: 2125321 - protein, 18 aa, Cryptosporidium hominis
LHRPLKYALKNAIEIAKQ

SEQ ID NO: 2125322 - protein, 19 aa, Cryptosporidium hominis
LHSIWELACGSAISTHRLS

SEQ ID NO: 2125323 - protein, 18 aa, Cryptosporidium hominis
LHTTRFLILVLVILSNIG

SEQ ID NO: 2125324 - protein, 25 aa, Cryptosporidium hominis
LHYIGHSLPFPVVIYLLSNQFSSEK

SEQ ID NO: 2125325 - protein, 20 aa, Cryptosporidium hominis
LHYLDWLKTLAVWLVVFVHV

SEQ ID NO: 2125326 - protein, 23 aa, Cryptosporidium hominis
LIAALPGIITFLFFFISSFGFQV

SEQ ID NO: 2125327 - protein, 20 aa, Cryptosporidium hominis
LIACMQFTFTFYIPVSTCKY

SEQ ID NO: 2125328 - protein, 18 aa, Cryptosporidium hominis
LIAEVGLFMIYDIKRDMR

SEQ ID NO: 2125329 - protein, 18 aa, Cryptosporidium hominis
LIALAFPFTQEFWKVHGV

SEQ ID NO: 2125330 - protein, 18 aa, Cryptosporidium hominis
LIALFSCFTIAATTQYLS

SEQ ID NO: 2125331 - protein, 17 aa, Cryptosporidium hominis
LIALPILCLCIPAKILE

SEQ ID NO: 2125332 - protein, 19 aa, Cryptosporidium hominis
LIDNCRRLQSEYKYLTKKL

SEQ ID NO: 2125333 - protein, 23 aa, Cryptosporidium hominis
LIDYPTYNDIERITLIENEFNNK

SEQ ID NO: 2125334 - protein, 17 aa, Cryptosporidium hominis
LIFPFGLNLRRVIFNDI

SEQ ID NO: 2125335 - protein, 18 aa, Cryptosporidium hominis
LIFPKIGQFFYGKRLYSL

SEQ ID NO: 2125336 - protein, 18 aa, Cryptosporidium hominis
LIFSCSFAIKYRPLVFDN

SEQ ID NO: 2125337 - protein, 24 aa, Cryptosporidium hominis
LIFTLWEFFWFLSVKISRKHATSI

SEQ ID NO: 2125338 - protein, 21 aa, Cryptosporidium hominis
LIGCALIHWSLGFANTFGNTV

SEQ ID NO: 2125339 - protein, 25 aa, Cryptosporidium hominis
LIGIQCFIFLIFLILVIYNFYRKRL

SEQ ID NO: 2125340 - protein, 22 aa, Cryptosporidium hominis
LIGYCIPTYFILFTDYVEELFI

SEQ ID NO: 2125341 - protein, 26 aa, Cryptosporidium hominis
LIGYRCFIEAGMLRSFVFSILPSNQA

SEQ ID NO: 2125342 - protein, 17 aa, Cryptosporidium hominis
LIIGILFCQDQDHELFI

SEQ ID NO: 2125343 - protein, 23 aa, Cryptosporidium hominis
LIINCIFGILFILFKQGIIVRWI

SEQ ID NO: 2125344 - protein, 24 aa, Cryptosporidium hominis
LIIPFRMILVITMLTRTMGDSVLS

SEQ ID NO: 2125345 - protein, 26 aa, Cryptosporidium hominis
LIISCIIGGFCFCGATGANRNHGNMP

SEQ ID NO: 2125346 - protein, 17 aa, Cryptosporidium hominis
LIISFAMLENHKLLNKY

SEQ ID NO: 2125347 - protein, 21 aa, Cryptosporidium hominis
LIITFPRYVLWELIFTSRWIW

SEQ ID NO: 2125348 - protein, 22 aa, Cryptosporidium hominis
LIIVIACSIAILYSPIYTLLKN

SEQ ID NO: 2125349 - protein, 19 aa, Cryptosporidium hominis
LIIVILLMLSIIFYLAVTT

SEQ ID NO: 2125350 - protein, 18 aa, Cryptosporidium hominis
LIKGELWVQTKNRNNGYC

SEQ ID NO: 2125351 - protein, 24 aa, Cryptosporidium hominis
LILDNIRVLWDYRQKTLGMEVTMD

SEQ ID NO: 2125352 - protein, 17 aa, Cryptosporidium hominis
LILESITSFGMSIIFYI

SEQ ID NO: 2125353 - protein, 20 aa, Cryptosporidium hominis
LILLSFSFVWFFKTLSFHHV

SEQ ID NO: 2125354 - protein, 18 aa, Cryptosporidium hominis
LILTCLIATYLAFLSFST

SEQ ID NO: 2125355 - protein, 20 aa, Cryptosporidium hominis
LILVIYNFYRKRLLRKRLMN

SEQ ID NO: 2125356 - protein, 25 aa, Cryptosporidium hominis
LILYFLEPFFETFFYLRETLDKCAY

SEQ ID NO: 2125357 - protein, 21 aa, Cryptosporidium hominis
LIMSRKLYSRFEELLPIVEQV

SEQ ID NO: 2125358 - protein, 17 aa, Cryptosporidium hominis
LINGIVLISGGTGALGL

SEQ ID NO: 2125359 - protein, 22 aa, Cryptosporidium hominis
LINISEKFLLITAINLIGIIYT

SEQ ID NO: 2125360 - protein, 23 aa, Cryptosporidium hominis
LINLSGCLLRLGMPSDYPNAVMR

SEQ ID NO: 2125361 - protein, 18 aa, Cryptosporidium hominis
LINRGCYMRQIVKSIRLL

SEQ ID NO: 2125362 - protein, 17 aa, Cryptosporidium hominis
LIPFRIFPLEAQMFTHL

SEQ ID NO: 2125363 - protein, 18 aa, Cryptosporidium hominis
LIPMGSMVFHSLLLLIAS

SEQ ID NO: 2125364 - protein, 21 aa, Cryptosporidium hominis
LIQICICIFYAIPLILIYEML

SEQ ID NO: 2125365 - protein, 17 aa, Cryptosporidium hominis
LIQLKIESFQLFHFDIK

SEQ ID NO: 2125366 - protein, 18 aa, Cryptosporidium hominis
LIQLRDIICFLSSIQDEL

SEQ ID NO: 2125367 - protein, 26 aa, Cryptosporidium hominis
LIQMSFWPWNFLITITLQLIFMGMCF

SEQ ID NO: 2125368 - protein, 19 aa, Cryptosporidium hominis
LIRIWDISPAIGRDPLFVE

SEQ ID NO: 2125369 - protein, 24 aa, Cryptosporidium hominis
LISDSKLTLTRYIGMNPQKVKITL

SEQ ID NO: 2125370 - protein, 25 aa, Cryptosporidium hominis
LISGVDPRWITPLIQGYFCNQAIII

SEQ ID NO: 2125371 - protein, 17 aa, Cryptosporidium hominis
LISGYEFYVTIFKTKED

SEQ ID NO: 2125372 - protein, 19 aa, Cryptosporidium hominis
LISMTFRRVVHWKTSAISF

SEQ ID NO: 2125373 - protein, 20 aa, Cryptosporidium hominis
LISNRISYNLGLNGPSMTVD

SEQ ID NO: 2125374 - protein, 19 aa, Cryptosporidium hominis
LISTLGYKYTSIVLCDFAL

SEQ ID NO: 2125375 - protein, 25 aa, Cryptosporidium hominis
LISVCFIVFVNICYILYKNSSIERY

SEQ ID NO: 2125376 - protein, 18 aa, Cryptosporidium hominis
LITYDMINRLLISQISSK

SEQ ID NO: 2125377 - protein, 19 aa, Cryptosporidium hominis
LIVTCTWAFQFEPLLESNS

SEQ ID NO: 2125378 - protein, 17 aa, Cryptosporidium hominis
LIYCLLMVLLYDSLLDF

SEQ ID NO: 2125379 - protein, 27 aa, Cryptosporidium hominis
LIYCLWAGQISLLWKLQLTLNKEENGY

SEQ ID NO: 2125380 - protein, 20 aa, Cryptosporidium hominis
LIYCSYCSIQRAGVKQINTL

SEQ ID NO: 2125381 - protein, 24 aa, Cryptosporidium hominis
LIYGEAIGLLGYMHALGLGTSPDL

SEQ ID NO: 2125382 - protein, 23 aa, Cryptosporidium hominis
LKAAVFENVDWIILVTHYSIYSS

SEQ ID NO: 2125383 - protein, 18 aa, Cryptosporidium hominis
LKAIKTFFYIFRGLKSNI

SEQ ID NO: 2125384 - protein, 18 aa, Cryptosporidium hominis
LKALIALHRRTGEFDNAP

SEQ ID NO: 2125385 - protein, 19 aa, Cryptosporidium hominis
LKAPLYFQLLPARLLITYI

SEQ ID NO: 2125386 - protein, 19 aa, Cryptosporidium hominis
LKARGRFTIRNNESLNELI

SEQ ID NO: 2125387 - protein, 19 aa, Cryptosporidium hominis
LKASTRFGLLPIKTIQMLK

SEQ ID NO: 2125388 - protein, 19 aa, Cryptosporidium hominis
LKAVGGFGAGQAESSTEGS

SEQ ID NO: 2125389 - protein, 23 aa, Cryptosporidium hominis
LKCNICDLNSLFNIINKIKGKYN

SEQ ID NO: 2125390 - protein, 25 aa, Cryptosporidium hominis
LKDRPSVLEFNKWVKLSGGRVRGTK

SEQ ID NO: 2125391 - protein, 29 aa, Cryptosporidium hominis
LKDYSIIWKLCLIFLLGATDSQLSFMRTQ

SEQ ID NO: 2125392 - protein, 18 aa, Cryptosporidium hominis
LKEAFGEDIVIPLLIMTS

SEQ ID NO: 2125393 - protein, 17 aa, Cryptosporidium hominis
LKENILFQEIMNSIQEL

SEQ ID NO: 2125394 - protein, 23 aa, Cryptosporidium hominis
LKESEIWIQMLIGFVTVVKATVG

SEQ ID NO: 2125395 - protein, 24 aa, Cryptosporidium hominis
LKEYEFKFKVDRIIDQEHKLIREL

SEQ ID NO: 2125396 - protein, 26 aa, Cryptosporidium hominis
LKHILKCKPFEWYIGKFRPAFERQGE

SEQ ID NO: 2125397 - protein, 24 aa, Cryptosporidium hominis
LKILPQDIMIRIGMTNPPYILDQI

SEQ ID NO: 2125398 - protein, 17 aa, Cryptosporidium hominis
LKILSRRAQQFLYLESI

SEQ ID NO: 2125399 - protein, 17 aa, Cryptosporidium hominis
LKINNFLRDIIKENENL

SEQ ID NO: 2125400 - protein, 19 aa, Cryptosporidium hominis
LKINSFILILVISIFFSSL

SEQ ID NO: 2125401 - protein, 20 aa, Cryptosporidium hominis
LKIPKWPKRLCVTSNQNFDE

SEQ ID NO: 2125402 - protein, 17 aa, Cryptosporidium hominis
LKKCHQENLELLSKKKA

SEQ ID NO: 2125403 - protein, 17 aa, Cryptosporidium hominis
LKKGIYGLDCGDISLEL

SEQ ID NO: 2125404 - protein, 19 aa, Cryptosporidium hominis
LKKIFEMFIELQIINQDLK

SEQ ID NO: 2125405 - protein, 21 aa, Cryptosporidium hominis
LKKKLIFHSRLLNTLVIILIG

SEQ ID NO: 2125406 - protein, 25 aa, Cryptosporidium hominis
LKKKLKCKPFRWFLDNVAPETYITQ

SEQ ID NO: 2125407 - protein, 22 aa, Cryptosporidium hominis
LKKLYLEILRRYYLKIFEEKKS

SEQ ID NO: 2125408 - protein, 17 aa, Cryptosporidium hominis
LKKNLIFLVENLHKTNI

SEQ ID NO: 2125409 - protein, 22 aa, Cryptosporidium hominis
LKKRQNFVVSVLFILLVVIIIY

SEQ ID NO: 2125410 - protein, 21 aa, Cryptosporidium hominis
LKKYKSLIINYSFNDQDYEKD

SEQ ID NO: 2125411 - protein, 17 aa, Cryptosporidium hominis
LKLDHCVLNGPENHSSI

SEQ ID NO: 2125412 - protein, 22 aa, Cryptosporidium hominis
LKLENFWTKFWLWPNQLFLTYT

SEQ ID NO: 2125413 - protein, 21 aa, Cryptosporidium hominis
LKLFMLRNLSVIKMTAFAFAL

SEQ ID NO: 2125414 - protein, 19 aa, Cryptosporidium hominis
LKLLTSLFMIFQISGGNSI

SEQ ID NO: 2125415 - protein, 17 aa, Cryptosporidium hominis
LKLLVYIYTKWTKTREN

SEQ ID NO: 2125416 - protein, 27 aa, Cryptosporidium hominis
LKLMIEKRICLLDIALIQKHLLASSSN

SEQ ID NO: 2125417 - protein, 17 aa, Cryptosporidium hominis
LKLPEKFTQPSNSLRTK

SEQ ID NO: 2125418 - protein, 19 aa, Cryptosporidium hominis
LKLSPKILKEEKFDEDMIN

SEQ ID NO: 2125419 - protein, 18 aa, Cryptosporidium hominis
LKMLKAIGLVPIKNSLGL

SEQ ID NO: 2125420 - protein, 20 aa, Cryptosporidium hominis
LKMLYNWDLWGPCIILLVLS

SEQ ID NO: 2125421 - protein, 25 aa, Cryptosporidium hominis
LKNAELLKPFFGSKFHIILNRTSIS

SEQ ID NO: 2125422 - protein, 27 aa, Cryptosporidium hominis
LKNEFFKFMVHFIFSSIIFQIVNNINM

SEQ ID NO: 2125423 - protein, 23 aa, Cryptosporidium hominis
LKNFTNFCIKLFISESTDQRNIN

SEQ ID NO: 2125424 - protein, 25 aa, Cryptosporidium hominis
LKNHKRLKISAMKFVDLASLLDIPE

SEQ ID NO: 2125425 - protein, 19 aa, Cryptosporidium hominis
LKNKGFKLPITRIHILINN

SEQ ID NO: 2125426 - protein, 17 aa, Cryptosporidium hominis
LKNKLYIERSVMESLNL

SEQ ID NO: 2125427 - protein, 24 aa, Cryptosporidium hominis
LKNQGCSINSWYLGEINEEGRPHG

SEQ ID NO: 2125428 - protein, 25 aa, Cryptosporidium hominis
LKPFRDFCLEWAKFLTVPAGKGTLY

SEQ ID NO: 2125429 - protein, 25 aa, Cryptosporidium hominis
LKPIFDISAGYTFNVLASIVILPAN

SEQ ID NO: 2125430 - protein, 17 aa, Cryptosporidium hominis
LKPLLSPSEKVYGRLSR

SEQ ID NO: 2125431 - protein, 17 aa, Cryptosporidium hominis
LKPPILPHISCPICKVW

SEQ ID NO: 2125432 - protein, 20 aa, Cryptosporidium hominis
LKPPKIITGKITYKSPKLIK

SEQ ID NO: 2125433 - protein, 25 aa, Cryptosporidium hominis
LKRIRLKHIFLIFIFTVLYVSCFLM

SEQ ID NO: 2125434 - protein, 20 aa, Cryptosporidium hominis
LKRYRSINIQKLFDQLILTV

SEQ ID NO: 2125435 - protein, 18 aa, Cryptosporidium hominis
LKSDIVFHSLQCYVNQMI

SEQ ID NO: 2125436 - protein, 18 aa, Cryptosporidium hominis
LKSIRTVSMLNISKELSE

SEQ ID NO: 2125437 - protein, 18 aa, Cryptosporidium hominis
LKSSGGFKLITKNVPILK

SEQ ID NO: 2125438 - protein, 17 aa, Cryptosporidium hominis
LKSSLFLSNIVKHKRET

SEQ ID NO: 2125439 - protein, 23 aa, Cryptosporidium hominis
LKTKIKSFCAMLGKPSTEIEHFK

SEQ ID NO: 2125440 - protein, 23 aa, Cryptosporidium hominis
LKTKLEYLGHVGIEYRIQNKVPK

SEQ ID NO: 2125441 - protein, 21 aa, Cryptosporidium hominis
LKTRSRTICEFIARILNPNFY

SEQ ID NO: 2125442 - protein, 18 aa, Cryptosporidium hominis
LKTSDKWTKYLIDANVCN

SEQ ID NO: 2125443 - protein, 21 aa, Cryptosporidium hominis
LKVVELISPVGKWLKVTKTVS

SEQ ID NO: 2125444 - protein, 30 aa, Cryptosporidium hominis
LKWAKPSLDVSKDFWPFEALLAGNAMLSIG

SEQ ID NO: 2125445 - protein, 19 aa, Cryptosporidium hominis
LKYFPSLNGMFFEKNEDNI

SEQ ID NO: 2125446 - protein, 38 aa, Cryptosporidium hominis
LKYLELIFCEELDWKITFKLDTIKSFISKIVDSKLDPE

SEQ ID NO: 2125447 - protein, 25 aa, Cryptosporidium hominis
LKYLKGDFFIYYQLRNFYQNNKSFI

SEQ ID NO: 2125448 - protein, 17 aa, Cryptosporidium hominis
LKYSVYLGGINTFKNFL

SEQ ID NO: 2125449 - protein, 29 aa, Cryptosporidium hominis
LKYVIGMLLGVFFGIWILSICFKGETKKQ

SEQ ID NO: 2125450 - protein, 18 aa, Cryptosporidium hominis
LKYVKFTLENALKPSNFI

SEQ ID NO: 2125451 - protein, 19 aa, Cryptosporidium hominis
LKYWPSRFSKQLYHDNVQE

SEQ ID NO: 2125452 - protein, 17 aa, Cryptosporidium hominis
LKYYLGWSSSSALGSNI

SEQ ID NO: 2125453 - protein, 26 aa, Cryptosporidium hominis
LLAFSARIATYYSYIINDWNDQIDNL

SEQ ID NO: 2125454 - protein, 17 aa, Cryptosporidium hominis
LLCDLYYILDWNLNKGV

SEQ ID NO: 2125455 - protein, 19 aa, Cryptosporidium hominis
LLDVIPYPIGVTFSQLLVG

SEQ ID NO: 2125456 - protein, 19 aa, Cryptosporidium hominis
LLEANVIRFWNKILAKELK

SEQ ID NO: 2125457 - protein, 17 aa, Cryptosporidium hominis
LLEENFFLNSNMMDMGF

SEQ ID NO: 2125458 - protein, 21 aa, Cryptosporidium hominis
LLEKLSRFKIQFENESPGTGA

SEQ ID NO: 2125459 - protein, 24 aa, Cryptosporidium hominis
LLERLFKCILSRKIKKYSKSSDYE

SEQ ID NO: 2125460 - protein, 18 aa, Cryptosporidium hominis
LLERWQKLAQHPCIVSYR

SEQ ID NO: 2125461 - protein, 28 aa, Cryptosporidium hominis
LLESKAWWICGIPLSVYSLLAEISLLIA

SEQ ID NO: 2125462 - protein, 22 aa, Cryptosporidium hominis
LLETRPTFYDFLPSDCSCYDSQ

SEQ ID NO: 2125463 - protein, 18 aa, Cryptosporidium hominis
LLFESLRISSNMRVACGV

SEQ ID NO: 2125464 - protein, 24 aa, Cryptosporidium hominis
LLFFRLDCLDGIISEILLLNYISK

SEQ ID NO: 2125465 - protein, 25 aa, Cryptosporidium hominis
LLFPTIIWINVIRSFILPKDYKLNF

SEQ ID NO: 2125466 - protein, 17 aa, Cryptosporidium hominis
LLFSDGKIELCNKSNSL

SEQ ID NO: 2125467 - protein, 18 aa, Cryptosporidium hominis
LLGISLIFVCAEEVQNVS

SEQ ID NO: 2125468 - protein, 23 aa, Cryptosporidium hominis
LLGRAACTFGGSSFDISINKINR

SEQ ID NO: 2125469 - protein, 23 aa, Cryptosporidium hominis
LLGSPRFEDYFGLPEKINSSQKK

SEQ ID NO: 2125470 - protein, 18 aa, Cryptosporidium hominis
LLGYLFGIHRWYKYLTGD

SEQ ID NO: 2125471 - protein, 26 aa, Cryptosporidium hominis
LLHEIRGSSFITVWNMKISKENANEN

SEQ ID NO: 2125472 - protein, 39 aa, Cryptosporidium hominis
LLHKEKEKMASCKYLTFLLNELLKLFQLFGNSVKNLIKD

SEQ ID NO: 2125473 - protein, 17 aa, Cryptosporidium hominis
LLIATSFSYMKAQNEIE

SEQ ID NO: 2125474 - protein, 19 aa, Cryptosporidium hominis
LLICFSHTINQFFFSMCFW

SEQ ID NO: 2125475 - protein, 26 aa, Cryptosporidium hominis
LLIDFRLKVTIEEFVKFSYSLRFLGE

SEQ ID NO: 2125476 - protein, 19 aa, Cryptosporidium hominis
LLIFLLFEIHYLKRRINML

SEQ ID NO: 2125477 - protein, 28 aa, Cryptosporidium hominis
LLIHYDDCPIIWKSMPFHIYKNDTLHIE

SEQ ID NO: 2125478 - protein, 25 aa, Cryptosporidium hominis
LLIITCLFSYFSIQIVYSLYLVQLA

SEQ ID NO: 2125479 - protein, 23 aa, Cryptosporidium hominis
LLILNPRLALSSRMPRFSEEVKK

SEQ ID NO: 2125480 - protein, 28 aa, Cryptosporidium hominis
LLILQEKWKIMVLIIHLFYILNKDLGIL

SEQ ID NO: 2125481 - protein, 20 aa, Cryptosporidium hominis
LLIQLLEAIFKFLTSENTTM

SEQ ID NO: 2125482 - protein, 18 aa, Cryptosporidium hominis
LLIRLLGINICFDTHFIY

SEQ ID NO: 2125483 - protein, 25 aa, Cryptosporidium hominis
LLISSYYLNINWGYIYKLIPGISNF

SEQ ID NO: 2125484 - protein, 34 aa, Cryptosporidium hominis
LLIYVYVCTYWGLFYFKIPKKYGIYLNKHTDGPC

SEQ ID NO: 2125485 - protein, 23 aa, Cryptosporidium hominis
LLKAKRPNSLGTFIQTISGVQQN

SEQ ID NO: 2125486 - protein, 18 aa, Cryptosporidium hominis
LLKLWKDEICSITILSHL

SEQ ID NO: 2125487 - protein, 25 aa, Cryptosporidium hominis
LLKSKECPFCKNTIETLFFTSNPRY

SEQ ID NO: 2125488 - protein, 26 aa, Cryptosporidium hominis
LLLEIRIGFRAARYFHNSLLLGYLGA

SEQ ID NO: 2125489 - protein, 21 aa, Cryptosporidium hominis
LLLERYLEKCISRKNSHNKLS

SEQ ID NO: 2125490 - protein, 18 aa, Cryptosporidium hominis
LLLFEMLGIILSIPDSSL

SEQ ID NO: 2125491 - protein, 21 aa, Cryptosporidium hominis
LLLICRCIDNLFDFFVYSILL

SEQ ID NO: 2125492 - protein, 20 aa, Cryptosporidium hominis
LLLIMSICLVFTKSEYFNVK

SEQ ID NO: 2125493 - protein, 17 aa, Cryptosporidium hominis
LLLLFLWFLFREKNLLV

SEQ ID NO: 2125494 - protein, 17 aa, Cryptosporidium hominis
LLLLKRYETTFCDIDTT

SEQ ID NO: 2125495 - protein, 17 aa, Cryptosporidium hominis
LLLLLSVYSPYELLLFL

SEQ ID NO: 2125496 - protein, 19 aa, Cryptosporidium hominis
LLLQWKPLNYRNSEATQEE

SEQ ID NO: 2125497 - protein, 18 aa, Cryptosporidium hominis
LLLSFFVILFICFGVIDM

SEQ ID NO: 2125498 - protein, 44 aa, Cryptosporidium hominis
LLMADHIHYLLGFAVAFSLFSWICTLFVCAASFSIGSDVYTIWI

SEQ ID NO: 2125499 - protein, 26 aa, Cryptosporidium hominis
LLMDNFVNECCRPEVIVVGLNTIREI

SEQ ID NO: 2125500 - protein, 18 aa, Cryptosporidium hominis
LLMFKVKQLVSVNEEDGN

SEQ ID NO: 2125501 - protein, 27 aa, Cryptosporidium hominis
LLMIPPICLFAWFWLFQYYRHASRELF

SEQ ID NO: 2125502 - protein, 17 aa, Cryptosporidium hominis
LLNEAWIAQGHELLFFY

SEQ ID NO: 2125503 - protein, 30 aa, Cryptosporidium hominis
LLNFCPASFWGLGWDRHARLLLSTLEEFSY

SEQ ID NO: 2125504 - protein, 24 aa, Cryptosporidium hominis
LLNKAGIELCVRKVASIYGDCRRT

SEQ ID NO: 2125505 - protein, 26 aa, Cryptosporidium hominis
LLNKGHGKPVDWWTLGILIYEMVVGF

SEQ ID NO: 2125506 - protein, 17 aa, Cryptosporidium hominis
LLNLFFFTVYLNSCKSL

SEQ ID NO: 2125507 - protein, 22 aa, Cryptosporidium hominis
LLNLSSLLVRRSFLTSNSKQFL

SEQ ID NO: 2125508 - protein, 18 aa, Cryptosporidium hominis
LLNSFKPLSHICGGWNLG

SEQ ID NO: 2125509 - protein, 18 aa, Cryptosporidium hominis
LLNVICTILMFKCADEVN

SEQ ID NO: 2125510 - protein, 20 aa, Cryptosporidium hominis
LLPFILEIYYLIPNFVSFYS

SEQ ID NO: 2125511 - protein, 24 aa, Cryptosporidium hominis
LLPRVIFIFVIPCLSLIIVANSLP

SEQ ID NO: 2125512 - protein, 17 aa, Cryptosporidium hominis
LLPVFYGIYGIDVPKYL

SEQ ID NO: 2125513 - protein, 17 aa, Cryptosporidium hominis
LLRDLSMNIALKCSPKE

SEQ ID NO: 2125514 - protein, 22 aa, Cryptosporidium hominis
LLRNCNRSLLSFQVYANHQYTE

SEQ ID NO: 2125515 - protein, 23 aa, Cryptosporidium hominis
LLRPTILQRLIWFVASQVAAGAY

SEQ ID NO: 2125516 - protein, 17 aa, Cryptosporidium hominis
LLRSGVKNKAVFKASNV

SEQ ID NO: 2125517 - protein, 17 aa, Cryptosporidium hominis
LLSGKFVNLSGVEYCAL

SEQ ID NO: 2125518 - protein, 27 aa, Cryptosporidium hominis
LLSIEYIKKLQIVFECEHNIDVLLQLA

SEQ ID NO: 2125519 - protein, 17 aa, Cryptosporidium hominis
LLSILGFGTNYGLVNAD

SEQ ID NO: 2125520 - protein, 18 aa, Cryptosporidium hominis
LLSQRIVYYFTNNRIGFG

SEQ ID NO: 2125521 - protein, 25 aa, Cryptosporidium hominis
LLSRSMGTYSFCKSIIYDSKNTRNL

SEQ ID NO: 2125522 - protein, 17 aa, Cryptosporidium hominis
LLTALLTMHMVKIKEIK

SEQ ID NO: 2125523 - protein, 24 aa, Cryptosporidium hominis
LLTMLPPKFSRNSWINHLSENLQN

SEQ ID NO: 2125524 - protein, 25 aa, Cryptosporidium hominis
LLTQSWRFPMSFSSSFNMVKPEKLY

SEQ ID NO: 2125525 - protein, 17 aa, Cryptosporidium hominis
LLTSKLLYYMAITPKEI

SEQ ID NO: 2125526 - protein, 21 aa, Cryptosporidium hominis
LLVAMLPRKVLVDFQEDKLKL

SEQ ID NO: 2125527 - protein, 25 aa, Cryptosporidium hominis
LLVFERRIKEEFIFVAINIDTKSVE

SEQ ID NO: 2125528 - protein, 19 aa, Cryptosporidium hominis
LLVGISIPIFKEFLLRKDI

SEQ ID NO: 2125529 - protein, 17 aa, Cryptosporidium hominis
LLVGNVMAASPCPNMEN

SEQ ID NO: 2125530 - protein, 23 aa, Cryptosporidium hominis
LLVIPSPFLKKLGLQLILEVSDN

SEQ ID NO: 2125531 - protein, 28 aa, Cryptosporidium hominis
LLVRILLGAALMSFFFALIGDNAYEEGI

SEQ ID NO: 2125532 - protein, 33 aa, Cryptosporidium hominis
LLVVLSYQLPFYFACWFHFQYGKLIIGNSISKT

SEQ ID NO: 2125533 - protein, 19 aa, Cryptosporidium hominis
LLYDCKINSLFTVSFKYNS

SEQ ID NO: 2125534 - protein, 18 aa, Cryptosporidium hominis
LLYFKKKIIPKMTILNLI

SEQ ID NO: 2125535 - protein, 17 aa, Cryptosporidium hominis
LLYLVLAIILLWALSFT

SEQ ID NO: 2125536 - protein, 25 aa, Cryptosporidium hominis
LLYRRFKSNMLVNILGQWQELDVGG

SEQ ID NO: 2125537 - protein, 18 aa, Cryptosporidium hominis
LLYYLWSGILAWYTILTL

SEQ ID NO: 2125538 - protein, 27 aa, Cryptosporidium hominis
LMDPFEFKQCFPNVEFRFFGIGRLDNF

SEQ ID NO: 2125539 - protein, 24 aa, Cryptosporidium hominis
LMEYAEGGSLYGLYSKYGSFPEEL

SEQ ID NO: 2125540 - protein, 21 aa, Cryptosporidium hominis
LMFFISVIIFGLFILAIALIP

SEQ ID NO: 2125541 - protein, 29 aa, Cryptosporidium hominis
LMFGFLCKLSRFLPFSSLVFQKIADNLSL

SEQ ID NO: 2125542 - protein, 18 aa, Cryptosporidium hominis
LMHCISMGTLDWIHCIQA

SEQ ID NO: 2125543 - protein, 27 aa, Cryptosporidium hominis
LMHEIEKRLGIVIARDEVMSMVYIMLN

SEQ ID NO: 2125544 - protein, 18 aa, Cryptosporidium hominis
LMLENCSPALSDSEIIMP

SEQ ID NO: 2125545 - protein, 24 aa, Cryptosporidium hominis
LMLIPELMSGLFVIILMACIDIGL

SEQ ID NO: 2125546 - protein, 21 aa, Cryptosporidium hominis
LMLKLHPAISVTILGFGYTLF

SEQ ID NO: 2125547 - protein, 24 aa, Cryptosporidium hominis
LMMFCFENWGYFLLGNNFQLLDHI

SEQ ID NO: 2125548 - protein, 23 aa, Cryptosporidium hominis
LMNICPLCCPISEKAVLFLLSLV

SEQ ID NO: 2125549 - protein, 19 aa, Cryptosporidium hominis
LMPLWPIVLAELIKIFRLK

SEQ ID NO: 2125550 - protein, 23 aa, Cryptosporidium hominis
LMSRRSWERGGTRFNARGIDENA

SEQ ID NO: 2125551 - protein, 19 aa, Cryptosporidium hominis
LMTAYSFLLQCLKTMGELN

SEQ ID NO: 2125552 - protein, 26 aa, Cryptosporidium hominis
LMVQLFCFFCACGSVIYKEFREEFKA

SEQ ID NO: 2125553 - protein, 17 aa, Cryptosporidium hominis
LMVYSIISFIIGLFAGW

SEQ ID NO: 2125554 - protein, 28 aa, Cryptosporidium hominis
LMYMDPPSAFKCILNLINSFDFLFISSD

SEQ ID NO: 2125555 - protein, 19 aa, Cryptosporidium hominis
LMYQVKFVSIYLMFLMRNF

SEQ ID NO: 2125556 - protein, 17 aa, Cryptosporidium hominis
LNADLMWNYTQNIISNI

SEQ ID NO: 2125557 - protein, 19 aa, Cryptosporidium hominis
LNALFWLFFISNGWLAMYS

SEQ ID NO: 2125558 - protein, 19 aa, Cryptosporidium hominis
LNCIIPFIIYSEILRDGSL

SEQ ID NO: 2125559 - protein, 19 aa, Cryptosporidium hominis
LNEIFKVATFATSFDHSLF

SEQ ID NO: 2125560 - protein, 18 aa, Cryptosporidium hominis
LNENPQILVCIKLQTSKQ

SEQ ID NO: 2125561 - protein, 20 aa, Cryptosporidium hominis
LNEWKKIVLLILFLSQVFTA

SEQ ID NO: 2125562 - protein, 21 aa, Cryptosporidium hominis
LNFLIFFKWLTPIEGYNKPSI

SEQ ID NO: 2125563 - protein, 20 aa, Cryptosporidium hominis
LNFVCLPLFQELCYVDVEGD

SEQ ID NO: 2125564 - protein, 24 aa, Cryptosporidium hominis
LNGGLIYRFFRIVANRVYGNQYGS

SEQ ID NO: 2125565 - protein, 18 aa, Cryptosporidium hominis
LNGILRSLILTKFELLEK

SEQ ID NO: 2125566 - protein, 19 aa, Cryptosporidium hominis
LNGLAFIYRYHGIKLRWDV

SEQ ID NO: 2125567 - protein, 17 aa, Cryptosporidium hominis
LNHAVIMIGYGINDNGD

SEQ ID NO: 2125568 - protein, 19 aa, Cryptosporidium hominis
LNHHLILIFLLKNELIIPY

SEQ ID NO: 2125569 - protein, 24 aa, Cryptosporidium hominis
LNHIMLWFGLIIFWAITQIYGKSP

SEQ ID NO: 2125570 - protein, 17 aa, Cryptosporidium hominis
LNHNMIFLIKFVSITCG

SEQ ID NO: 2125571 - protein, 26 aa, Cryptosporidium hominis
LNHPSIFHLLKLIIGILFCQDQDHEL

SEQ ID NO: 2125572 - protein, 18 aa, Cryptosporidium hominis
LNIAVNIIREGKFDPYSS

SEQ ID NO: 2125573 - protein, 19 aa, Cryptosporidium hominis
LNICTKAFNKICVYDVEII

SEQ ID NO: 2125574 - protein, 18 aa, Cryptosporidium hominis
LNIFCKFNSIINKYIDKG

SEQ ID NO: 2125575 - protein, 18 aa, Cryptosporidium hominis
LNIIKYTLLTIFIIMFIT

SEQ ID NO: 2125576 - protein, 28 aa, Cryptosporidium hominis
LNIIPCLEWTSTMSYTFTPYFFDVINKL

SEQ ID NO: 2125577 - protein, 26 aa, Cryptosporidium hominis
LNILPPIRIYELWKGTPMDIRQILFN

SEQ ID NO: 2125578 - protein, 17 aa, Cryptosporidium hominis
LNILPRWISTRKIPGLI

SEQ ID NO: 2125579 - protein, 24 aa, Cryptosporidium hominis
LNIPSQIKLVSRFRCEQAKDDILD

SEQ ID NO: 2125580 - protein, 28 aa, Cryptosporidium hominis
LNITALLYFYKCVFFPLSSSFTAALLNI

SEQ ID NO: 2125581 - protein, 17 aa, Cryptosporidium hominis
LNIYLSAEMSYRLWSIV

SEQ ID NO: 2125582 - protein, 22 aa, Cryptosporidium hominis
LNIYQLWSGLWITILRDVPFTA

SEQ ID NO: 2125583 - protein, 20 aa, Cryptosporidium hominis
LNKKLKFIFHKNMTGNSVRV

SEQ ID NO: 2125584 - protein, 22 aa, Cryptosporidium hominis
LNKRSPILYNFFVKLKAKDDKE

SEQ ID NO: 2125585 - protein, 18 aa, Cryptosporidium hominis
LNKSGFSGSGARNGSPSA

SEQ ID NO: 2125586 - protein, 18 aa, Cryptosporidium hominis
LNLFIWKFTNTEYLKSNE

SEQ ID NO: 2125587 - protein, 24 aa, Cryptosporidium hominis
LNLLIKRIRGNYTFDVGIGDFSKK

SEQ ID NO: 2125588 - protein, 17 aa, Cryptosporidium hominis
LNLPLNFPNAFDNNLKI

SEQ ID NO: 2125589 - protein, 17 aa, Cryptosporidium hominis
LNLPMQIQRLLLFTHYF

SEQ ID NO: 2125590 - protein, 17 aa, Cryptosporidium hominis
LNLRNELFFSVNNSDIY

SEQ ID NO: 2125591 - protein, 27 aa, Cryptosporidium hominis
LNLSPCMIFHYSVLFSYLVFILKTTPW

SEQ ID NO: 2125592 - protein, 34 aa, Cryptosporidium hominis
LNNKELRWNFYWCIMTLLCLIHFSSYSASFAKNE

SEQ ID NO: 2125593 - protein, 24 aa, Cryptosporidium hominis
LNNLPKYWDPISIYWSEPKQSGFV

SEQ ID NO: 2125594 - protein, 32 aa, Cryptosporidium hominis
LNNQSMFCIFECFFEPLLYYKNKHNLPPNLPK

SEQ ID NO: 2125595 - protein, 17 aa, Cryptosporidium hominis
LNNRLNLVTCAFEKEKS

SEQ ID NO: 2125596 - protein, 19 aa, Cryptosporidium hominis
LNPIPILTIILSWSSEVMR

SEQ ID NO: 2125597 - protein, 24 aa, Cryptosporidium hominis
LNPIRLDLLLTFRTRKDRGRRPNS

SEQ ID NO: 2125598 - protein, 18 aa, Cryptosporidium hominis
LNPNLKKLRYTLNNFPYN

SEQ ID NO: 2125599 - protein, 21 aa, Cryptosporidium hominis
LNPSNCIKCPPNGHCKDGNLK

SEQ ID NO: 2125600 - protein, 27 aa, Cryptosporidium hominis
LNRFCQEIYFPIGIIISIYCIYDSLVI

SEQ ID NO: 2125601 - protein, 22 aa, Cryptosporidium hominis
LNSETRYSWAILSSTINSLNHL

SEQ ID NO: 2125602 - protein, 22 aa, Cryptosporidium hominis
LNSKLLIVKVVQLFNLFFMFFA

SEQ ID NO: 2125603 - protein, 25 aa, Cryptosporidium hominis
LNSYFPADFAWTFSLYLETTAMLPQ

SEQ ID NO: 2125604 - protein, 18 aa, Cryptosporidium hominis
LNTCIGEKNYRHFFLLLF

SEQ ID NO: 2125605 - protein, 18 aa, Cryptosporidium hominis
LNVCVDIDECMELSVCPS

SEQ ID NO: 2125606 - protein, 24 aa, Cryptosporidium hominis
LNVIKTARYSLLFFLPKNLYDQFN

SEQ ID NO: 2125607 - protein, 22 aa, Cryptosporidium hominis
LNVRPILFLWIFFLISMVYTFS

SEQ ID NO: 2125608 - protein, 18 aa, Cryptosporidium hominis
LNWESQLHSLFALSIIWY

SEQ ID NO: 2125609 - protein, 20 aa, Cryptosporidium hominis
LPAYFPCSDSNLLFELWNGE

SEQ ID NO: 2125610 - protein, 24 aa, Cryptosporidium hominis
LPDHALIPIRHVGPYGAHSNSTWV

SEQ ID NO: 2125611 - protein, 18 aa, Cryptosporidium hominis
LPDLCSGSLDATYSSQST

SEQ ID NO: 2125612 - protein, 26 aa, Cryptosporidium hominis
LPEKKPTLPSSMPWTPNSSSFHVPQN

SEQ ID NO: 2125613 - protein, 20 aa, Cryptosporidium hominis
LPELEFPGLNIRDLGRLYFY

SEQ ID NO: 2125614 - protein, 19 aa, Cryptosporidium hominis
LPENCEIIGIATLEDIIEE

SEQ ID NO: 2125615 - protein, 21 aa, Cryptosporidium hominis
LPFIFLRDIENLGFLSVLANI

SEQ ID NO: 2125616 - protein, 20 aa, Cryptosporidium hominis
LPGIIDIFSRYFVPSIILLS

SEQ ID NO: 2125617 - protein, 22 aa, Cryptosporidium hominis
LPIILCVLILYILHRNGIRTEK

SEQ ID NO: 2125618 - protein, 22 aa, Cryptosporidium hominis
LPIKDHYSWITTYRELEHKFDS

SEQ ID NO: 2125619 - protein, 18 aa, Cryptosporidium hominis
LPILGSIGGFIGDLEGMT

SEQ ID NO: 2125620 - protein, 17 aa, Cryptosporidium hominis
LPINSMIALLKLFLLIF

SEQ ID NO: 2125621 - protein, 19 aa, Cryptosporidium hominis
LPIPCFETSSTRVVNFLRL

SEQ ID NO: 2125622 - protein, 18 aa, Cryptosporidium hominis
LPKAFCGYEKKLFNEHNS

SEQ ID NO: 2125623 - protein, 21 aa, Cryptosporidium hominis
LPKFDYKWTISKNISEKLLNR

SEQ ID NO: 2125624 - protein, 17 aa, Cryptosporidium hominis
LPKGVDMVNSYRLFSID

SEQ ID NO: 2125625 - protein, 25 aa, Cryptosporidium hominis
LPKKSGYKFEYLWYPPISQGKLIDS

SEQ ID NO: 2125626 - protein, 18 aa, Cryptosporidium hominis
LPLIDRYLELSISSQKSN

SEQ ID NO: 2125627 - protein, 18 aa, Cryptosporidium hominis
LPLISIFLSFLFPPIGCI

SEQ ID NO: 2125628 - protein, 22 aa, Cryptosporidium hominis
LPLLEIPTIFSFTPNLELLGST

SEQ ID NO: 2125629 - protein, 20 aa, Cryptosporidium hominis
LPLRTDHRIFSFMKQSINTK

SEQ ID NO: 2125630 - protein, 18 aa, Cryptosporidium hominis
LPMSCVFSLKSEEVNRLV

SEQ ID NO: 2125631 - protein, 25 aa, Cryptosporidium hominis
LPNYLCSTYPMLIFMRHLLQNRKRF

SEQ ID NO: 2125632 - protein, 25 aa, Cryptosporidium hominis
LPPLMALVPRAFRYRQGQDILAPHD

SEQ ID NO: 2125633 - protein, 24 aa, Cryptosporidium hominis
LPQISSIIRWRLNTPSPRARQTAA

SEQ ID NO: 2125634 - protein, 17 aa, Cryptosporidium hominis
LPRCVICLTEMSINVIS

SEQ ID NO: 2125635 - protein, 21 aa, Cryptosporidium hominis
LPRIRFGYKTLPTVVDITRYN

SEQ ID NO: 2125636 - protein, 19 aa, Cryptosporidium hominis
LPRYENWLYREMVVEEHDI

SEQ ID NO: 2125637 - protein, 21 aa, Cryptosporidium hominis
LPSCINLSIRLLETSFSSDWI

SEQ ID NO: 2125638 - protein, 20 aa, Cryptosporidium hominis
LPSDWFLAALQQLSQMNAEL

SEQ ID NO: 2125639 - protein, 17 aa, Cryptosporidium hominis
LPSELLISQGFLRNQKN

SEQ ID NO: 2125640 - protein, 17 aa, Cryptosporidium hominis
LPSFWMMISCIFITFLG

SEQ ID NO: 2125641 - protein, 22 aa, Cryptosporidium hominis
LPSGIPPHLLAPGNLPSATSVE

SEQ ID NO: 2125642 - protein, 18 aa, Cryptosporidium hominis
LPSLGLRNPKIWMMGIIL

SEQ ID NO: 2125643 - protein, 17 aa, Cryptosporidium hominis
LPSLVYLSSYSVVVLFW

SEQ ID NO: 2125644 - protein, 19 aa, Cryptosporidium hominis
LPSTFFAVFFVFKLFTSEL

SEQ ID NO: 2125645 - protein, 21 aa, Cryptosporidium hominis
LPTDGWMLLGMKRYLMRQMAK

SEQ ID NO: 2125646 - protein, 26 aa, Cryptosporidium hominis
LPTFSSRFGWRRVEEIIKSNISDLSR

SEQ ID NO: 2125647 - protein, 28 aa, Cryptosporidium hominis
LPTLEFSNWLLTNWVFRTISNLPILFSD

SEQ ID NO: 2125648 - protein, 17 aa, Cryptosporidium hominis
LPVLLGLISDEFGLDEM

SEQ ID NO: 2125649 - protein, 26 aa, Cryptosporidium hominis
LQDLEAITAMLDRLCVNNINSISNST

SEQ ID NO: 2125650 - protein, 19 aa, Cryptosporidium hominis
LQDYLLEMIHTWRQNKPIC

SEQ ID NO: 2125651 - protein, 18 aa, Cryptosporidium hominis
LQILKVFIYERYFKAQSA

SEQ ID NO: 2125652 - protein, 26 aa, Cryptosporidium hominis
LQIQLVLCIIKADPSCFGVLREHIII

SEQ ID NO: 2125653 - protein, 17 aa, Cryptosporidium hominis
LQKLDTVDCIKLHKDAN

SEQ ID NO: 2125654 - protein, 22 aa, Cryptosporidium hominis
LQKSLLKWLLGVGLVSSSFEVQ

SEQ ID NO: 2125655 - protein, 30 aa, Cryptosporidium hominis
LQLASIKPILARKGSKIVHMSQKSISYDSN

SEQ ID NO: 2125656 - protein, 19 aa, Cryptosporidium hominis
LQLDPLVFVKTAIPPTASS

SEQ ID NO: 2125657 - protein, 19 aa, Cryptosporidium hominis
LQLLDIVSLYIIFWTVLLP

SEQ ID NO: 2125658 - protein, 24 aa, Cryptosporidium hominis
LQLLHFRLSMITYWLFAHPSMVPP

SEQ ID NO: 2125659 - protein, 17 aa, Cryptosporidium hominis
LQLSKLVNYNKKRLSRP

SEQ ID NO: 2125660 - protein, 19 aa, Cryptosporidium hominis
LQMRMLLFVNFFLKREKLR

SEQ ID NO: 2125661 - protein, 24 aa, Cryptosporidium hominis
LQNALRIFLRRALYKDGVAIRDNK

SEQ ID NO: 2125662 - protein, 19 aa, Cryptosporidium hominis
LQPFIFILYNDVSWRIRSN

SEQ ID NO: 2125663 - protein, 22 aa, Cryptosporidium hominis
LQQRLSAILNDFCRQVTELKQV

SEQ ID NO: 2125664 - protein, 27 aa, Cryptosporidium hominis
LQRFLFWNFREFYRFHESYYFTVNHTY

SEQ ID NO: 2125665 - protein, 28 aa, Cryptosporidium hominis
LQSGLRPMPHLKIEEMQSLLVLIEKHYK

SEQ ID NO: 2125666 - protein, 25 aa, Cryptosporidium hominis
LQSKVLLIRYCIKSAVMNEFCGNFA

SEQ ID NO: 2125667 - protein, 20 aa, Cryptosporidium hominis
LQSSELFSGNLLSLISELGP

SEQ ID NO: 2125668 - protein, 24 aa, Cryptosporidium hominis
LQSSLSSAIIRWYDSIDYSKLLLN

SEQ ID NO: 2125669 - protein, 22 aa, Cryptosporidium hominis
LQYSSIFIRRAVPISLAALSIG

SEQ ID NO: 2125670 - protein, 21 aa, Cryptosporidium hominis
LRALISYSLVLLCGILAYNFE

SEQ ID NO: 2125671 - protein, 17 aa, Cryptosporidium hominis
LRALLILLSLILGFLSI

SEQ ID NO: 2125672 - protein, 22 aa, Cryptosporidium hominis
LREAMLQSFWCIHALQHALITA

SEQ ID NO: 2125673 - protein, 26 aa, Cryptosporidium hominis
LREFGCTRVQLGIQHTDYWVLKLINR

SEQ ID NO: 2125674 - protein, 23 aa, Cryptosporidium hominis
LREINKLTSALCDDFYGESEERD

SEQ ID NO: 2125675 - protein, 29 aa, Cryptosporidium hominis
LRERIFSGQNLYIAMGILATVSIIVIVLM

SEQ ID NO: 2125676 - protein, 26 aa, Cryptosporidium hominis
LRFISFLYCIVIFISIGRVRHLLFTL

SEQ ID NO: 2125677 - protein, 21 aa, Cryptosporidium hominis
LRGGVSMALAMVFEGDTSVPG

SEQ ID NO: 2125678 - protein, 19 aa, Cryptosporidium hominis
LRHSGCVALNGILRSLILT

SEQ ID NO: 2125679 - protein, 20 aa, Cryptosporidium hominis
LRIITSFTRLFSKKNSKAKS

SEQ ID NO: 2125680 - protein, 20 aa, Cryptosporidium hominis
LRISDFNGVLKILITMNSIL

SEQ ID NO: 2125681 - protein, 19 aa, Cryptosporidium hominis
LRITDLLNQCIGWASKGLQ

SEQ ID NO: 2125682 - protein, 21 aa, Cryptosporidium hominis
LRKAFSKPFVCSEKDLPWLKP

SEQ ID NO: 2125683 - protein, 21 aa, Cryptosporidium hominis
LRKALKLFLIREWSLTRRLIQ

SEQ ID NO: 2125684 - protein, 24 aa, Cryptosporidium hominis
LRKRQKFIRRGCDLSDSIQIRRLC

SEQ ID NO: 2125685 - protein, 25 aa, Cryptosporidium hominis
LRKSKSCLGISCKMQEIYLIVFCSR

SEQ ID NO: 2125686 - protein, 20 aa, Cryptosporidium hominis
LRKSLKTVRGISVVSLGRGI

SEQ ID NO: 2125687 - protein, 17 aa, Cryptosporidium hominis
LRLALPLISGYFILLPI

SEQ ID NO: 2125688 - protein, 19 aa, Cryptosporidium hominis
LRLNCVGILDLTRVDESKT

SEQ ID NO: 2125689 - protein, 22 aa, Cryptosporidium hominis
LRNEAKIFLNWSKPTISVNRNI

SEQ ID NO: 2125690 - protein, 17 aa, Cryptosporidium hominis
LRPIYIYFNSFKDRINS

SEQ ID NO: 2125691 - protein, 17 aa, Cryptosporidium hominis
LRPSVPLSGQSLDSFPK

SEQ ID NO: 2125692 - protein, 19 aa, Cryptosporidium hominis
LRQILKKMLDHLLNLTLKE

SEQ ID NO: 2125693 - protein, 19 aa, Cryptosporidium hominis
LRQYCNLITMYGDSQDGAL

SEQ ID NO: 2125694 - protein, 25 aa, Cryptosporidium hominis
LRRTPRIRDEYEFNYIYQMNNQTNI

SEQ ID NO: 2125695 - protein, 23 aa, Cryptosporidium hominis
LRSISILVLYQLILFNILNSSSQ

SEQ ID NO: 2125696 - protein, 20 aa, Cryptosporidium hominis
LRSLFTCVLIISFVYASNYY

SEQ ID NO: 2125697 - protein, 17 aa, Cryptosporidium hominis
LRSMEFLISILIIIIIP

SEQ ID NO: 2125698 - protein, 17 aa, Cryptosporidium hominis
LRSMLYRGSELVREIAW

SEQ ID NO: 2125699 - protein, 19 aa, Cryptosporidium hominis
LRSPKAWNRTLFQVQFDYS

SEQ ID NO: 2125700 - protein, 22 aa, Cryptosporidium hominis
LRSRPLDLRHCDSHSITSNNFH

SEQ ID NO: 2125701 - protein, 18 aa, Cryptosporidium hominis
LRVLDPYSNQTCLANSEF

SEQ ID NO: 2125702 - protein, 19 aa, Cryptosporidium hominis
LRVLLLKVHYQSLMPLWPI

SEQ ID NO: 2125703 - protein, 20 aa, Cryptosporidium hominis
LRVMYILLMMFVLEVFSIVW

SEQ ID NO: 2125704 - protein, 20 aa, Cryptosporidium hominis
LRYEIFSLIINHVLLDLRYF

SEQ ID NO: 2125705 - protein, 19 aa, Cryptosporidium hominis
LRYFYLKLFLFVYKLSIGL

SEQ ID NO: 2125706 - protein, 17 aa, Cryptosporidium hominis
LRYKLSPKLLENSSNSN

SEQ ID NO: 2125707 - protein, 17 aa, Cryptosporidium hominis
LRYLLKSKECPFCKNTI

SEQ ID NO: 2125708 - protein, 20 aa, Cryptosporidium hominis
LRYLLSSYRLFDPLENSSFS

SEQ ID NO: 2125709 - protein, 19 aa, Cryptosporidium hominis
LRYSGRSGGFYVFNSETLN

SEQ ID NO: 2125710 - protein, 22 aa, Cryptosporidium hominis
LRYSRRQLIKLIAKLAEGSYTD

SEQ ID NO: 2125711 - protein, 21 aa, Cryptosporidium hominis
LSAAPRSAFTIDIPDVSIILD

SEQ ID NO: 2125712 - protein, 18 aa, Cryptosporidium hominis
LSALIIITLLLSFGSALF

SEQ ID NO: 2125713 - protein, 24 aa, Cryptosporidium hominis
LSAPLRASVLFGHLQTIMPGGFSI

SEQ ID NO: 2125714 - protein, 20 aa, Cryptosporidium hominis
LSCKAQEHFGVARSLLIGTA

SEQ ID NO: 2125715 - protein, 20 aa, Cryptosporidium hominis
LSCLCSTTLRANNRGPMIIS

SEQ ID NO: 2125716 - protein, 37 aa, Cryptosporidium hominis
LSDDCTFFGFEILKVLFPWKWISWLPTISQLLLMDKN

SEQ ID NO: 2125717 - protein, 18 aa, Cryptosporidium hominis
LSDEDFSTLILKKVKDDS

SEQ ID NO: 2125718 - protein, 33 aa, Cryptosporidium hominis
LSEKGFIYFITCLVCQICLVLSDLLSKTDSFRD

SEQ ID NO: 2125719 - protein, 22 aa, Cryptosporidium hominis
LSELLPILVFTFIQFMLYLFRL

SEQ ID NO: 2125720 - protein, 26 aa, Cryptosporidium hominis
LSENLVFYIFKLVPLFKYTRQAIEKN

SEQ ID NO: 2125721 - protein, 17 aa, Cryptosporidium hominis
LSESFNVIRGFCLCEGY

SEQ ID NO: 2125722 - protein, 17 aa, Cryptosporidium hominis
LSESILQPHMASIVCEA

SEQ ID NO: 2125723 - protein, 31 aa, Cryptosporidium hominis
LSFAWYCLFVLYFTGCVKFLEKWIRYADETD

SEQ ID NO: 2125724 - protein, 21 aa, Cryptosporidium hominis
LSFDLLCFVPLVISGIKLPSI

SEQ ID NO: 2125725 - protein, 23 aa, Cryptosporidium hominis
LSFEIPSTVPFNIPVKDQLRNKL

SEQ ID NO: 2125726 - protein, 17 aa, Cryptosporidium hominis
LSFFESIVRKIALKYIY

SEQ ID NO: 2125727 - protein, 17 aa, Cryptosporidium hominis
LSFGIIVACIDYFGGPE

SEQ ID NO: 2125728 - protein, 19 aa, Cryptosporidium hominis
LSFKEGTNFVYFEKSKFDS

SEQ ID NO: 2125729 - protein, 30 aa, Cryptosporidium hominis
LSFNTGGICSFLWIMAKFPDYVYCDKGEVL

SEQ ID NO: 2125730 - protein, 23 aa, Cryptosporidium hominis
LSFSRPLLLVPFSLPLLLVPFSL

SEQ ID NO: 2125731 - protein, 22 aa, Cryptosporidium hominis
LSFSSSVIWSCISNFPFIQTLI

SEQ ID NO: 2125732 - protein, 20 aa, Cryptosporidium hominis
LSFSWMKWSMHVRGYQITNN

SEQ ID NO: 2125733 - protein, 17 aa, Cryptosporidium hominis
LSGFEFVLLTNKRLQYK

SEQ ID NO: 2125734 - protein, 26 aa, Cryptosporidium hominis
LSGFKLFLDRCHCIFSNVFQDQDTIS

SEQ ID NO: 2125735 - protein, 24 aa, Cryptosporidium hominis
LSGFYGHLYFIFALLLIGISFYFA

SEQ ID NO: 2125736 - protein, 20 aa, Cryptosporidium hominis
LSGISLRSQILYSIALISKL

SEQ ID NO: 2125737 - protein, 17 aa, Cryptosporidium hominis
LSGLNCGKGCFEYNNNS

SEQ ID NO: 2125738 - protein, 19 aa, Cryptosporidium hominis
LSGSSLNGAVCMFKAVLPL

SEQ ID NO: 2125739 - protein, 17 aa, Cryptosporidium hominis
LSGVFRITSKDQRFVQE

SEQ ID NO: 2125740 - protein, 18 aa, Cryptosporidium hominis
LSHLNSWIQKIFIPLIKT

SEQ ID NO: 2125741 - protein, 18 aa, Cryptosporidium hominis
LSHPWFRYSKSNNEPICI

SEQ ID NO: 2125742 - protein, 22 aa, Cryptosporidium hominis
LSIAKYILFFSIIYKSYTQFSN

SEQ ID NO: 2125743 - protein, 23 aa, Cryptosporidium hominis
LSICTEYPIITSFILMLNSGLTI

SEQ ID NO: 2125744 - protein, 22 aa, Cryptosporidium hominis
LSIESSCALSIINKRTKESNEE

SEQ ID NO: 2125745 - protein, 24 aa, Cryptosporidium hominis
LSIICCMIGFFLINSLGNFVNLVG

SEQ ID NO: 2125746 - protein, 18 aa, Cryptosporidium hominis
LSIILITAPVPWARWYVE

SEQ ID NO: 2125747 - protein, 25 aa, Cryptosporidium hominis
LSIIYIFFSFIFEKIFVLSTHISKN

SEQ ID NO: 2125748 - protein, 24 aa, Cryptosporidium hominis
LSIKERRRIIGVLPQIPLLLKGWT

SEQ ID NO: 2125749 - protein, 18 aa, Cryptosporidium hominis
LSILRSGNAIPYPEPQGS

SEQ ID NO: 2125750 - protein, 17 aa, Cryptosporidium hominis
LSIPYFPSNFYYIEQVH

SEQ ID NO: 2125751 - protein, 18 aa, Cryptosporidium hominis
LSIRGGGGGLNLAKDLAI

SEQ ID NO: 2125752 - protein, 30 aa, Cryptosporidium hominis
LSISLCKILFKREKFSLLYSFTSGIISLAL

SEQ ID NO: 2125753 - protein, 18 aa, Cryptosporidium hominis
LSIVPGRRLHIFSESLNV

SEQ ID NO: 2125754 - protein, 30 aa, Cryptosporidium hominis
LSKDNFYIWSACLIHIVYLFFSALISFTFT

SEQ ID NO: 2125755 - protein, 19 aa, Cryptosporidium hominis
LSKIRWLSLLLLTIGAVLV

SEQ ID NO: 2125756 - protein, 17 aa, Cryptosporidium hominis
LSKLTNMTTNQASLVDT

SEQ ID NO: 2125757 - protein, 18 aa, Cryptosporidium hominis
LSKYREAITLLRNSNDLG

SEQ ID NO: 2125758 - protein, 26 aa, Cryptosporidium hominis
LSLDWPTNGNIVFKNVVFRYNPDEPP

SEQ ID NO: 2125759 - protein, 22 aa, Cryptosporidium hominis
LSLGSYENFNFVLLSTSIIRFQ

SEQ ID NO: 2125760 - protein, 25 aa, Cryptosporidium hominis
LSLIKDKISFIIIIWCPLIIVNYSN

SEQ ID NO: 2125761 - protein, 20 aa, Cryptosporidium hominis
LSLITIQVLEDFTILTQLIE

SEQ ID NO: 2125762 - protein, 24 aa, Cryptosporidium hominis
LSLKEIELIPCISNDLVLSYSDPL

SEQ ID NO: 2125763 - protein, 31 aa, Cryptosporidium hominis
LSLPELSMRIGLHYGGCIGGIVGSSRLRYEV

SEQ ID NO: 2125764 - protein, 17 aa, Cryptosporidium hominis
LSLSKGFNIEPERYESV

SEQ ID NO: 2125765 - protein, 21 aa, Cryptosporidium hominis
LSNDLRRSWYRRFGTVENNLD

SEQ ID NO: 2125766 - protein, 23 aa, Cryptosporidium hominis
LSNEISMDLQVFFTDGLFSSRVL

SEQ ID NO: 2125767 - protein, 23 aa, Cryptosporidium hominis
LSNQRWVVITIKYLLGTEFTSRI

SEQ ID NO: 2125768 - protein, 21 aa, Cryptosporidium hominis
LSNYKLLALFHEYSIQQINLL

SEQ ID NO: 2125769 - protein, 18 aa, Cryptosporidium hominis
LSNYRWMQTIALALPYEI

SEQ ID NO: 2125770 - protein, 18 aa, Cryptosporidium hominis
LSPIIGIVQGHYSSSDNE

SEQ ID NO: 2125771 - protein, 17 aa, Cryptosporidium hominis
LSPLAISECDSIAWPCI

SEQ ID NO: 2125772 - protein, 19 aa, Cryptosporidium hominis
LSQDMGWVSFMCLLSTFMT

SEQ ID NO: 2125773 - protein, 29 aa, Cryptosporidium hominis
LSRMLWSRYIFCCLLFFIWYICTWFVGAH

SEQ ID NO: 2125774 - protein, 23 aa, Cryptosporidium hominis
LSRSSPLNRCRIIISELQSKCFL

SEQ ID NO: 2125775 - protein, 26 aa, Cryptosporidium hominis
LSRSYLWKFLDSEWKTLPQFYKMNVS

SEQ ID NO: 2125776 - protein, 18 aa, Cryptosporidium hominis
LSRVCVKNSAGKKFQRNF

SEQ ID NO: 2125777 - protein, 18 aa, Cryptosporidium hominis
LSSAFLGRKHLRLATPFS

SEQ ID NO: 2125778 - protein, 21 aa, Cryptosporidium hominis
LSSAFQCFAFLLLASKVNTQC

SEQ ID NO: 2125779 - protein, 24 aa, Cryptosporidium hominis
LSSGIICCAAFGSLLLIFRKYIPH

SEQ ID NO: 2125780 - protein, 17 aa, Cryptosporidium hominis
LSSIPILVSIINYGLTK

SEQ ID NO: 2125781 - protein, 27 aa, Cryptosporidium hominis
LSSSIAIKHGFDLIPIYIAGAKDGTYL

SEQ ID NO: 2125782 - protein, 17 aa, Cryptosporidium hominis
LSSTFPMDIPLAGKLKV

SEQ ID NO: 2125783 - protein, 17 aa, Cryptosporidium hominis
LSSVSGYALLLDDDSVE

SEQ ID NO: 2125784 - protein, 21 aa, Cryptosporidium hominis
LSVIVSAVFSAPAVPLRGTLK

SEQ ID NO: 2125785 - protein, 17 aa, Cryptosporidium hominis
LSVKSQLPLLVMISVSS

SEQ ID NO: 2125786 - protein, 20 aa, Cryptosporidium hominis
LSVLYRYFISPFDGVMGTPA

SEQ ID NO: 2125787 - protein, 24 aa, Cryptosporidium hominis
LSYYFICFNFYFSMTTLPAIYFLC

SEQ ID NO: 2125788 - protein, 25 aa, Cryptosporidium hominis
LSYYLEWGALATFWFNFIALIPLAN

SEQ ID NO: 2125789 - protein, 39 aa, Cryptosporidium hominis
LTDEEIKCGFCFSKCCCWPVWSGSIISFAAYMVMAFLAI

SEQ ID NO: 2125790 - protein, 23 aa, Cryptosporidium hominis
LTEDFLLVFMNFSLVRILSSNSY

SEQ ID NO: 2125791 - protein, 18 aa, Cryptosporidium hominis
LTELQIFLFFGSRFSSSS

SEQ ID NO: 2125792 - protein, 18 aa, Cryptosporidium hominis
LTFGSTCFDQTKMMNYPF

SEQ ID NO: 2125793 - protein, 24 aa, Cryptosporidium hominis
LTFSWNELYLSFGFSLDPKLGGRN

SEQ ID NO: 2125794 - protein, 21 aa, Cryptosporidium hominis
LTFTYLCAFAYGESTLSAITL

SEQ ID NO: 2125795 - protein, 28 aa, Cryptosporidium hominis
LTGYLIKLLRLFPQRKTYIIKGICSLLN

SEQ ID NO: 2125796 - protein, 18 aa, Cryptosporidium hominis
LTICGHLIHYKCVGQYYK

SEQ ID NO: 2125797 - protein, 19 aa, Cryptosporidium hominis
LTIGMDFSLLFPLLQDKLS

SEQ ID NO: 2125798 - protein, 19 aa, Cryptosporidium hominis
LTIISFCYFTLLFITKNSI

SEQ ID NO: 2125799 - protein, 19 aa, Cryptosporidium hominis
LTISDGWASIDLPNLQDSG

SEQ ID NO: 2125800 - protein, 23 aa, Cryptosporidium hominis
LTISIYGIMLIYWPSKEALQPYQ

SEQ ID NO: 2125801 - protein, 20 aa, Cryptosporidium hominis
LTISKYNVFTGLALNGDDGW

SEQ ID NO: 2125802 - protein, 27 aa, Cryptosporidium hominis
LTISSFLFIWVLYCFSIIKYLKGDQHI

SEQ ID NO: 2125803 - protein, 19 aa, Cryptosporidium hominis
LTIVGAFYVISSIRKREKE

SEQ ID NO: 2125804 - protein, 18 aa, Cryptosporidium hominis
LTLDGWELLIDPTIYLRN

SEQ ID NO: 2125805 - protein, 23 aa, Cryptosporidium hominis
LTLEGKDAISFIIESGNKKLLNK

SEQ ID NO: 2125806 - protein, 19 aa, Cryptosporidium hominis
LTLPWAFRQTGLFLGIVVL

SEQ ID NO: 2125807 - protein, 18 aa, Cryptosporidium hominis
LTLQGCSGIEDILQYRAQ

SEQ ID NO: 2125808 - protein, 25 aa, Cryptosporidium hominis
LTLSFFLWKCMDEIASDDISTFTII

SEQ ID NO: 2125809 - protein, 17 aa, Cryptosporidium hominis
LTLWLMLIALSGYSVKN

SEQ ID NO: 2125810 - protein, 24 aa, Cryptosporidium hominis
LTMLELNLALGCFETNYRKSESII

SEQ ID NO: 2125811 - protein, 23 aa, Cryptosporidium hominis
LTMYCIMGTLFSFLIKIKSFSTS

SEQ ID NO: 2125812 - protein, 20 aa, Cryptosporidium hominis
LTNITSLSHLNSWIQKIFIP

SEQ ID NO: 2125813 - protein, 17 aa, Cryptosporidium hominis
LTSFPTVAPITISVFSR

SEQ ID NO: 2125814 - protein, 18 aa, Cryptosporidium hominis
LTSISWGPILLYKLIKKT

SEQ ID NO: 2125815 - protein, 19 aa, Cryptosporidium hominis
LTYSTARLGIFRLLCDYYK

SEQ ID NO: 2125816 - protein, 17 aa, Cryptosporidium hominis
LTYYFRIAPHAMITLLC

SEQ ID NO: 2125817 - protein, 19 aa, Cryptosporidium hominis
LVAMFLLEYIRFLPEAVLG

SEQ ID NO: 2125818 - protein, 22 aa, Cryptosporidium hominis
LVDKLKFAITIATPVLSILACI

SEQ ID NO: 2125819 - protein, 20 aa, Cryptosporidium hominis
LVEISELITSVTIPSVEDIY

SEQ ID NO: 2125820 - protein, 19 aa, Cryptosporidium hominis
LVENGHPFLISKIIEEELG

SEQ ID NO: 2125821 - protein, 18 aa, Cryptosporidium hominis
LVFAWGIGQYGCLGTGEL

SEQ ID NO: 2125822 - protein, 28 aa, Cryptosporidium hominis
LVFCHKVDPRLGGAIYNVISFGKISISN

SEQ ID NO: 2125823 - protein, 21 aa, Cryptosporidium hominis
LVFGEALAIYGVIIGIIMGTT

SEQ ID NO: 2125824 - protein, 18 aa, Cryptosporidium hominis
LVFSFPVSCHSFRKSLAI

SEQ ID NO: 2125825 - protein, 22 aa, Cryptosporidium hominis
LVGLTCAIVYISLNFKSGNPDS

SEQ ID NO: 2125826 - protein, 24 aa, Cryptosporidium hominis
LVHFPRLLIYFLIAMHRVIFLHII

SEQ ID NO: 2125827 - protein, 29 aa, Cryptosporidium hominis
LVIAILMGLRISCYKCDNQAVKNVKPIIS

SEQ ID NO: 2125828 - protein, 18 aa, Cryptosporidium hominis
LVIDSGTTLSYFPEHIFI

SEQ ID NO: 2125829 - protein, 23 aa, Cryptosporidium hominis
LVIFCLPIMFKLIVNLSSDSKKK

SEQ ID NO: 2125830 - protein, 24 aa, Cryptosporidium hominis
LVIFYFVCYDLQKLDTVDCIKLHK

SEQ ID NO: 2125831 - protein, 24 aa, Cryptosporidium hominis
LVIREFPVSFGIPVITLQKLNVRP

SEQ ID NO: 2125832 - protein, 24 aa, Cryptosporidium hominis
LVIYSKLWLNGSITIYNIAKKRLM

SEQ ID NO: 2125833 - protein, 27 aa, Cryptosporidium hominis
LVKIRGLICLSFFKLMRFKEVSEEIYK

SEQ ID NO: 2125834 - protein, 26 aa, Cryptosporidium hominis
LVLAACTRISWQLFKELMLCSPLITG

SEQ ID NO: 2125835 - protein, 18 aa, Cryptosporidium hominis
LVLLCGILAYNFEDELGS

SEQ ID NO: 2125836 - protein, 25 aa, Cryptosporidium hominis
LVLYMEFISYILLAMPFQFESEILL

SEQ ID NO: 2125837 - protein, 26 aa, Cryptosporidium hominis
LVMNICLLIALAPWTLPIFLIMMGLI

SEQ ID NO: 2125838 - protein, 26 aa, Cryptosporidium hominis
LVNNVGVFKLCFKRRIINEEDSNDEI

SEQ ID NO: 2125839 - protein, 19 aa, Cryptosporidium hominis
LVNSFIMEIFKSCRTCSQF

SEQ ID NO: 2125840 - protein, 18 aa, Cryptosporidium hominis
LVPFCLISMVLSVVYRNK

SEQ ID NO: 2125841 - protein, 25 aa, Cryptosporidium hominis
LVPLPCLGFLTSVFEGEVFPEYIIA

SEQ ID NO: 2125842 - protein, 30 aa, Cryptosporidium hominis
LVQFPECIWILYCISICLFKADLNGSRLTI

SEQ ID NO: 2125843 - protein, 24 aa, Cryptosporidium hominis
LVRRPESIYIYSYLQYRGSIPIVW

SEQ ID NO: 2125844 - protein, 17 aa, Cryptosporidium hominis
LVSLGIVMFCSFLTLLI

SEQ ID NO: 2125845 - protein, 23 aa, Cryptosporidium hominis
LVSTRVISCLDISKIKRNYDSIN

SEQ ID NO: 2125846 - protein, 19 aa, Cryptosporidium hominis
LVSYLFLVAFFFTRNIILP

SEQ ID NO: 2125847 - protein, 19 aa, Cryptosporidium hominis
LVTLNLLWERVIPIRDYLK

SEQ ID NO: 2125848 - protein, 17 aa, Cryptosporidium hominis
LVVAKLLSILGFGTNYG

SEQ ID NO: 2125849 - protein, 20 aa, Cryptosporidium hominis
LVVLLLIWHFMHAIIFGGDI

SEQ ID NO: 2125850 - protein, 17 aa, Cryptosporidium hominis
LVVNYGRMMSYVPFFGS

SEQ ID NO: 2125851 - protein, 19 aa, Cryptosporidium hominis
LVYISSIFIAFLSLINSVE

SEQ ID NO: 2125852 - protein, 17 aa, Cryptosporidium hominis
LVYRAYRVMPYSTACAT

SEQ ID NO: 2125853 - protein, 27 aa, Cryptosporidium hominis
LWEFQFSRLYFKLARGDCRIIFSNSWL

SEQ ID NO: 2125854 - protein, 18 aa, Cryptosporidium hominis
LWERVIPIRDYLKSNHKL

SEQ ID NO: 2125855 - protein, 18 aa, Cryptosporidium hominis
LWFDLMRLPDKILRSKLL

SEQ ID NO: 2125856 - protein, 18 aa, Cryptosporidium hominis
LWIAKYLLSLSWLFLGIG

SEQ ID NO: 2125857 - protein, 18 aa, Cryptosporidium hominis
LWIIFFFHCSHIIMYNGV

SEQ ID NO: 2125858 - protein, 20 aa, Cryptosporidium hominis
LWKDEICSITILSHLSDILP

SEQ ID NO: 2125859 - protein, 29 aa, Cryptosporidium hominis
LWKRYPARIYRHMMKTSSTWIVPFLMDHL

SEQ ID NO: 2125860 - protein, 21 aa, Cryptosporidium hominis
LWNEVKQVFELNGQKIKKFSE

SEQ ID NO: 2125861 - protein, 18 aa, Cryptosporidium hominis
LWNICTMFLLELPNFLST

SEQ ID NO: 2125862 - protein, 25 aa, Cryptosporidium hominis
LWPQRRGAGVLALLAFLTSVAVAGV

SEQ ID NO: 2125863 - protein, 20 aa, Cryptosporidium hominis
LWYLPSDKIFPFPITSNKYS

SEQ ID NO: 2125864 - protein, 23 aa, Cryptosporidium hominis
LYDFTSNCIFEILSEKDIPLLTE

SEQ ID NO: 2125865 - protein, 17 aa, Cryptosporidium hominis
LYDPRFLVFEFAYSILL

SEQ ID NO: 2125866 - protein, 19 aa, Cryptosporidium hominis
LYFLLVSLYLFRFVISESS

SEQ ID NO: 2125867 - protein, 23 aa, Cryptosporidium hominis
LYFTRPVEYLFIRDCNQCNIYCL

SEQ ID NO: 2125868 - protein, 22 aa, Cryptosporidium hominis
LYFTYFVCIVLAILSVVASGIL

SEQ ID NO: 2125869 - protein, 22 aa, Cryptosporidium hominis
LYGLGCNLLLFSKYHEIEHEHL

SEQ ID NO: 2125870 - protein, 18 aa, Cryptosporidium hominis
LYGWYLSKVGIVFFISVC

SEQ ID NO: 2125871 - protein, 17 aa, Cryptosporidium hominis
LYIFLKEEILKWTKNYP

SEQ ID NO: 2125872 - protein, 25 aa, Cryptosporidium hominis
LYIILKFFVLFIFFVYLKTRHDLVK

SEQ ID NO: 2125873 - protein, 19 aa, Cryptosporidium hominis
LYIIPCILFLIAHSRFESQ

SEQ ID NO: 2125874 - protein, 24 aa, Cryptosporidium hominis
LYILPLWCGCCILNHFNRDGRSFQ

SEQ ID NO: 2125875 - protein, 20 aa, Cryptosporidium hominis
LYISLKNILKMISFTPTSWK

SEQ ID NO: 2125876 - protein, 17 aa, Cryptosporidium hominis
LYIVFLIVEIIIQSETK

SEQ ID NO: 2125877 - protein, 31 aa, Cryptosporidium hominis
LYKHVKTVYVWPRNASGLFKSLFDRSEFERT

SEQ ID NO: 2125878 - protein, 29 aa, Cryptosporidium hominis
LYKIKFMKFRDIRILKCHEYLSSLPIIRN

SEQ ID NO: 2125879 - protein, 24 aa, Cryptosporidium hominis
LYLMLWRFLEQQFESVLSVLDIAT

SEQ ID NO: 2125880 - protein, 18 aa, Cryptosporidium hominis
LYLNIGIIDPERYYSLLL

SEQ ID NO: 2125881 - protein, 18 aa, Cryptosporidium hominis
LYLSCLLGAIKTSCGLQK

SEQ ID NO: 2125882 - protein, 18 aa, Cryptosporidium hominis
LYMLDGLVFNLRKQGFLP

SEQ ID NO: 2125883 - protein, 23 aa, Cryptosporidium hominis
LYPGNFAKYSFWLTIINLLILNI

SEQ ID NO: 2125884 - protein, 23 aa, Cryptosporidium hominis
LYQELDFVLLAPIFSFLKTFDFS

SEQ ID NO: 2125885 - protein, 23 aa, Cryptosporidium hominis
LYREIMPSMLHRSLMSKDAAMNM

SEQ ID NO: 2125886 - protein, 20 aa, Cryptosporidium hominis
LYRPKFEILGKLPGTLIFKS

SEQ ID NO: 2125887 - protein, 18 aa, Cryptosporidium hominis
LYSACIVACITTGNKDLD

SEQ ID NO: 2125888 - protein, 24 aa, Cryptosporidium hominis
LYSAELRLPFLSAKERREKVRILL

SEQ ID NO: 2125889 - protein, 26 aa, Cryptosporidium hominis
LYSFYRIGIIVPEGFWVAEQRGTQSY

SEQ ID NO: 2125890 - protein, 20 aa, Cryptosporidium hominis
LYSKKFIKYVIEPNKDTFFN

SEQ ID NO: 2125891 - protein, 21 aa, Cryptosporidium hominis
LYTECGYTFISKSNFVIKDWF

SEQ ID NO: 2125892 - protein, 26 aa, Cryptosporidium hominis
LYTLDFGEFIIKFGPILISGILNFFL

SEQ ID NO: 2125893 - protein, 17 aa, Cryptosporidium hominis
LYTLPLIIFILFIPVES

SEQ ID NO: 2125894 - protein, 23 aa, Cryptosporidium hominis
LYVLKEKVLWIGNLEISFNSTKL

SEQ ID NO: 2125895 - protein, 24 aa, Cryptosporidium hominis
LYWLKNLHFQFCIGFINNENFGQN

SEQ ID NO: 2125896 - protein, 23 aa, Cryptosporidium hominis
MAELSFTITVCRVISNISYDFNN

SEQ ID NO: 2125897 - protein, 18 aa, Cryptosporidium hominis
MAGPILLIACLGFFLLLA

SEQ ID NO: 2125898 - protein, 24 aa, Cryptosporidium hominis
MAIYSAQEFIIFPISKIVATSHEK

SEQ ID NO: 2125899 - protein, 26 aa, Cryptosporidium hominis
MALKQLKLKIGIHSGRVISGVVGTNK

SEQ ID NO: 2125900 - protein, 18 aa, Cryptosporidium hominis
MAQITFLWGFGLVAIPLK

SEQ ID NO: 2125901 - protein, 21 aa, Cryptosporidium hominis
MAQKLLRFPIKSCERQLNKNE

SEQ ID NO: 2125902 - protein, 21 aa, Cryptosporidium hominis
MASKFSHIPQHFSLVCKCLAA

SEQ ID NO: 2125903 - protein, 19 aa, Cryptosporidium hominis
MASTMTLTIIAFLLFILLI

SEQ ID NO: 2125904 - protein, 18 aa, Cryptosporidium hominis
MAYKSITTSGIWFSSNGL

SEQ ID NO: 2125905 - protein, 19 aa, Cryptosporidium hominis
MCIFIPINWLWTEDSSLEY

SEQ ID NO: 2125906 - protein, 19 aa, Cryptosporidium hominis
MDCALKGICWENQDKNIHF

SEQ ID NO: 2125907 - protein, 23 aa, Cryptosporidium hominis
MDHHCPWINNCVGFYNRKFFIQL

SEQ ID NO: 2125908 - protein, 24 aa, Cryptosporidium hominis
MDHHCPWISNCVGWGNHKHLLLLI

SEQ ID NO: 2125909 - protein, 17 aa, Cryptosporidium hominis
MDITEGIQFRLKNIDPI

SEQ ID NO: 2125910 - protein, 17 aa, Cryptosporidium hominis
MDLISDFALGIVTFKNL

SEQ ID NO: 2125911 - protein, 24 aa, Cryptosporidium hominis
MDQIKSGLLVSVFGTILISVMIYI

SEQ ID NO: 2125912 - protein, 25 aa, Cryptosporidium hominis
MDSLECFLHGLRLQWVEFQNKFYKG

SEQ ID NO: 2125913 - protein, 18 aa, Cryptosporidium hominis
MDTLEIYFPIIIPNQNSV

SEQ ID NO: 2125914 - protein, 18 aa, Cryptosporidium hominis
MECYKGGELFDEIIHRMK

SEQ ID NO: 2125915 - protein, 25 aa, Cryptosporidium hominis
MEECTNLARLGLRTLVFSYKIISKE

SEQ ID NO: 2125916 - protein, 26 aa, Cryptosporidium hominis
MEIFKSCRTCSQFSIPSLTNCMREVR

SEQ ID NO: 2125917 - protein, 17 aa, Cryptosporidium hominis
MEKTGKKLTGNSFESLS

SEQ ID NO: 2125918 - protein, 18 aa, Cryptosporidium hominis
MESSFSMEGEWSSEEKQL

SEQ ID NO: 2125919 - protein, 19 aa, Cryptosporidium hominis
MFCFGVFAMEMFIDRFISF

SEQ ID NO: 2125920 - protein, 17 aa, Cryptosporidium hominis
MFDEITQDFGIRCPYFL

SEQ ID NO: 2125921 - protein, 17 aa, Cryptosporidium hominis
MFFEKVFIYSNDMEQDE

SEQ ID NO: 2125922 - protein, 17 aa, Cryptosporidium hominis
MFGSAMILNSIKTEAHN

SEQ ID NO: 2125923 - protein, 22 aa, Cryptosporidium hominis
MFKSCAQTAGGFIIFHDHASVH

SEQ ID NO: 2125924 - protein, 21 aa, Cryptosporidium hominis
MFNKKFRGLLYVLYLNSDIDV

SEQ ID NO: 2125925 - protein, 26 aa, Cryptosporidium hominis
MFQILEILSIVGFIAVYMLLILQEKW

SEQ ID NO: 2125926 - protein, 24 aa, Cryptosporidium hominis
MFSDLRIQVIILNIILPIFLELFI

SEQ ID NO: 2125927 - protein, 23 aa, Cryptosporidium hominis
MFTRKMIVLFLFAGFLGLFPGSF

SEQ ID NO: 2125928 - protein, 23 aa, Cryptosporidium hominis
MFVLEVFSIVWTFWNPEWDEDEQ

SEQ ID NO: 2125929 - protein, 18 aa, Cryptosporidium hominis
MGGLPLHTLQMALHYLNT

SEQ ID NO: 2125930 - protein, 21 aa, Cryptosporidium hominis
MGGNNSEMWVGGGNVDLVTGG

SEQ ID NO: 2125931 - protein, 26 aa, Cryptosporidium hominis
MGIVLEARRSDLLIKILKQVLEIINI

SEQ ID NO: 2125932 - protein, 22 aa, Cryptosporidium hominis
MGKFGKFLLEFSLISTAISFGS

SEQ ID NO: 2125933 - protein, 24 aa, Cryptosporidium hominis
MGLLFELMCYLGLTMISYNYTNQF

SEQ ID NO: 2125934 - protein, 24 aa, Cryptosporidium hominis
MGLYPICYFSPLTILSDLVQNLQI

SEQ ID NO: 2125935 - protein, 20 aa, Cryptosporidium hominis
MGQVFRFWNAFLVIWTNPFW

SEQ ID NO: 2125936 - protein, 17 aa, Cryptosporidium hominis
MGRDIPNRFPKLVTPSV

SEQ ID NO: 2125937 - protein, 26 aa, Cryptosporidium hominis
MGTLNCIFGLISINLLAIVISLYIIS

SEQ ID NO: 2125938 - protein, 17 aa, Cryptosporidium hominis
MHERWTKCYLTNVSLSF

SEQ ID NO: 2125939 - protein, 20 aa, Cryptosporidium hominis
MHHLEIFEVMQFIYKIPIMV

SEQ ID NO: 2125940 - protein, 23 aa, Cryptosporidium hominis
MHLEELLSISCLFLQDQNVSSKN

SEQ ID NO: 2125941 - protein, 19 aa, Cryptosporidium hominis
MHMGMAPFFTGMLMSYSLQ

SEQ ID NO: 2125942 - protein, 24 aa, Cryptosporidium hominis
MIALLKLFLLIFLNITNIFMFLIT

SEQ ID NO: 2125943 - protein, 34 aa, Cryptosporidium hominis
MICIYISVLLLCFSLTIWLRAWLIKRQLQPRNIL

SEQ ID NO: 2125944 - protein, 19 aa, Cryptosporidium hominis
MIEASFTFRTDIGGGGNGY

SEQ ID NO: 2125945 - protein, 28 aa, Cryptosporidium hominis
MIEPDWGILRFFLLFFLSGVGGNLAVAV

SEQ ID NO: 2125946 - protein, 22 aa, Cryptosporidium hominis
MIGILVCHIISGFIFSRNMFWL

SEQ ID NO: 2125947 - protein, 19 aa, Cryptosporidium hominis
MIGLAEFLINNGFDKNALN

SEQ ID NO: 2125948 - protein, 22 aa, Cryptosporidium hominis
MIGVLLYFCLTGEYYSFESKND

SEQ ID NO: 2125949 - protein, 21 aa, Cryptosporidium hominis
MIHQIRMIWLFIKFLCLIKDK

SEQ ID NO: 2125950 - protein, 19 aa, Cryptosporidium hominis
MIITTLIFGLIVYIKRINS

SEQ ID NO: 2125951 - protein, 17 aa, Cryptosporidium hominis
MILRYSRRQLIKLIAKL

SEQ ID NO: 2125952 - protein, 28 aa, Cryptosporidium hominis
MINVFSRSDWVLAFFYRYMQWGFHVAGI

SEQ ID NO: 2125953 - protein, 26 aa, Cryptosporidium hominis
MIPGLKRINPVFVDRFILYSFISIEQ

SEQ ID NO: 2125954 - protein, 20 aa, Cryptosporidium hominis
MIPSIWYLEIIHCMHMGMAP

SEQ ID NO: 2125955 - protein, 18 aa, Cryptosporidium hominis
MIQDCLLRNIGKTKYLLF

SEQ ID NO: 2125956 - protein, 22 aa, Cryptosporidium hominis
MIQMELCIGVTLRSWLGDASRS

SEQ ID NO: 2125957 - protein, 23 aa, Cryptosporidium hominis
MISIMCIFIFIGVSLHVVKLKKI

SEQ ID NO: 2125958 - protein, 24 aa, Cryptosporidium hominis
MISRLTAILLSFTYVLFLFFQLYT

SEQ ID NO: 2125959 - protein, 26 aa, Cryptosporidium hominis
MITIENSFPWFIPVKTSVQFFDLNST

SEQ ID NO: 2125960 - protein, 18 aa, Cryptosporidium hominis
MITLCVFAGIVVILMFRR

SEQ ID NO: 2125961 - protein, 20 aa, Cryptosporidium hominis
MIVAGIWWILALFSRSYHYL

SEQ ID NO: 2125962 - protein, 22 aa, Cryptosporidium hominis
MIYCCVSSLLTILKLLSNGNKY

SEQ ID NO: 2125963 - protein, 21 aa, Cryptosporidium hominis
MKAFEELKCHWLFGNHTNALD

SEQ ID NO: 2125964 - protein, 23 aa, Cryptosporidium hominis
MKAHKRFKKIFIISETCQASTLH

SEQ ID NO: 2125965 - protein, 21 aa, Cryptosporidium hominis
MKELIDFLSKYIFECSINQII

SEQ ID NO: 2125966 - protein, 21 aa, Cryptosporidium hominis
MKGDLLLEENLELLLDKIAEY

SEQ ID NO: 2125967 - protein, 26 aa, Cryptosporidium hominis
MKHPRAVRFVFAWMLIAQVLRNYDTG

SEQ ID NO: 2125968 - protein, 23 aa, Cryptosporidium hominis
MKIFSGLKLLFWNLDKIGDIFGK

SEQ ID NO: 2125969 - protein, 18 aa, Cryptosporidium hominis
MKIQEFYAPITSSLDSKK

SEQ ID NO: 2125970 - protein, 23 aa, Cryptosporidium hominis
MKMGRYYHCEIVLESLSFNIIQG

SEQ ID NO: 2125971 - protein, 17 aa, Cryptosporidium hominis
MKPALHISKSHLIFQTK

SEQ ID NO: 2125972 - protein, 20 aa, Cryptosporidium hominis
MKRYLMRQMAKKLCGEDLVK

SEQ ID NO: 2125973 - protein, 25 aa, Cryptosporidium hominis
MKSGEKIIRKQVHILERLAWELTGF

SEQ ID NO: 2125974 - protein, 25 aa, Cryptosporidium hominis
MKSSQRPSSLVWIPANKETESKEYN

SEQ ID NO: 2125975 - protein, 23 aa, Cryptosporidium hominis
MKSSRFTKRMLLISIPLLIQLLE

SEQ ID NO: 2125976 - protein, 17 aa, Cryptosporidium hominis
MKTYLVPLPCLGFLTSV

SEQ ID NO: 2125977 - protein, 20 aa, Cryptosporidium hominis
MLALVALQFTIMKALNSKLL

SEQ ID NO: 2125978 - protein, 23 aa, Cryptosporidium hominis
MLEIARIGSIFFDINNNDSILLV

SEQ ID NO: 2125979 - protein, 19 aa, Cryptosporidium hominis
MLESLYWFFNFYSFTETYQ

SEQ ID NO: 2125980 - protein, 23 aa, Cryptosporidium hominis
MLFCGLEAFFSSIFPCKYRPYSY

SEQ ID NO: 2125981 - protein, 18 aa, Cryptosporidium hominis
MLFSRKYILPTFVTLVIT

SEQ ID NO: 2125982 - protein, 17 aa, Cryptosporidium hominis
MLGPCSKTLSALGGLVV

SEQ ID NO: 2125983 - protein, 26 aa, Cryptosporidium hominis
MLICTFRIIFMVSFFYFIFPTVVSSE

SEQ ID NO: 2125984 - protein, 20 aa, Cryptosporidium hominis
MLIILKVSWEACLYLNNSVI

SEQ ID NO: 2125985 - protein, 23 aa, Cryptosporidium hominis
MLINSGIPCFRGETIKKLKERLL

SEQ ID NO: 2125986 - protein, 20 aa, Cryptosporidium hominis
MLITCSWMLLLLSYFFGAGY

SEQ ID NO: 2125987 - protein, 22 aa, Cryptosporidium hominis
MLKELREFVDQYIFIANKDQFD

SEQ ID NO: 2125988 - protein, 17 aa, Cryptosporidium hominis
MLLDYPISLAFDLYYTF

SEQ ID NO: 2125989 - protein, 18 aa, Cryptosporidium hominis
MLLLQLYFKDGQFIDSAI

SEQ ID NO: 2125990 - protein, 17 aa, Cryptosporidium hominis
MLLQVFYYLSFIFSLIN

SEQ ID NO: 2125991 - protein, 17 aa, Cryptosporidium hominis
MLMNLFLLFAAICVIRG

SEQ ID NO: 2125992 - protein, 17 aa, Cryptosporidium hominis
MLRILDINIHIRKDNEN

SEQ ID NO: 2125993 - protein, 26 aa, Cryptosporidium hominis
MLRSFMWSSYLPFVYVAGRYYGHESI

SEQ ID NO: 2125994 - protein, 22 aa, Cryptosporidium hominis
MLSCGIAIELITLMLIPELMSG

SEQ ID NO: 2125995 - protein, 23 aa, Cryptosporidium hominis
MLTLLCFMGAFLSLMGPLTQSVI

SEQ ID NO: 2125996 - protein, 17 aa, Cryptosporidium hominis
MMNRVCLFKAAKSEPKE

SEQ ID NO: 2125997 - protein, 17 aa, Cryptosporidium hominis
MMVPDLDSTLKFKHDTE

SEQ ID NO: 2125998 - protein, 23 aa, Cryptosporidium hominis
MNILRRYYFFVAIVYEIISTSNC

SEQ ID NO: 2125999 - protein, 34 aa, Cryptosporidium hominis
MNLDPGDLFKMIEYRIQNFIFFNFLLYLASIGPQ

SEQ ID NO: 2126000 - protein, 18 aa, Cryptosporidium hominis
MNPKFIISVGDNFYQRGV

SEQ ID NO: 2126001 - protein, 18 aa, Cryptosporidium hominis
MNQIPSLLFDGANCLFLK

SEQ ID NO: 2126002 - protein, 24 aa, Cryptosporidium hominis
MNVIKELIEPGGLICKPLVEDYYS

SEQ ID NO: 2126003 - protein, 18 aa, Cryptosporidium hominis
MNVSDCLSQILSRDKLDL

SEQ ID NO: 2126004 - protein, 19 aa, Cryptosporidium hominis
MPCNFRLVADLDMKSKPGS

SEQ ID NO: 2126005 - protein, 19 aa, Cryptosporidium hominis
MPNSECLAAIKEGSLDSKV

SEQ ID NO: 2126006 - protein, 23 aa, Cryptosporidium hominis
MPSFFGYNVLSFWFSFYNTALII

SEQ ID NO: 2126007 - protein, 18 aa, Cryptosporidium hominis
MPSGKMPSGLSIVTISTL

SEQ ID NO: 2126008 - protein, 29 aa, Cryptosporidium hominis
MPVLLACWSVCIILSILDLYYLNNMDKNW

SEQ ID NO: 2126009 - protein, 19 aa, Cryptosporidium hominis
MQVLVRWLTSIDYLNWISS

SEQ ID NO: 2126010 - protein, 19 aa, Cryptosporidium hominis
MRFSQDWSGSAINRSPDGN

SEQ ID NO: 2126011 - protein, 18 aa, Cryptosporidium hominis
MRPDLIMRSIIPAVMAGI

SEQ ID NO: 2126012 - protein, 36 aa, Cryptosporidium hominis
MRREKQIRIMPNFNKRYIISSTLLKHLKEFSKSLED

SEQ ID NO: 2126013 - protein, 17 aa, Cryptosporidium hominis
MRSGALVYKNIEELIKE

SEQ ID NO: 2126014 - protein, 26 aa, Cryptosporidium hominis
MRWSNLKFLIKRLVDIGMDDLGITSL

SEQ ID NO: 2126015 - protein, 19 aa, Cryptosporidium hominis
MRYCDYVFVNSIFTRKVYI

SEQ ID NO: 2126016 - protein, 34 aa, Cryptosporidium hominis
MSKFRPQIMPIILKWSKGESFASILENTSFYEGS

SEQ ID NO: 2126017 - protein, 21 aa, Cryptosporidium hominis
MSLIKCCFDMNMWEDARKLLE

SEQ ID NO: 2126018 - protein, 20 aa, Cryptosporidium hominis
MSLLFYIIFQKFREINQKTE

SEQ ID NO: 2126019 - protein, 27 aa, Cryptosporidium hominis
MSLLMNCIMYLLSHYYRKVSISYNEEG

SEQ ID NO: 2126020 - protein, 18 aa, Cryptosporidium hominis
MSNARLNYNILLNSILEN

SEQ ID NO: 2126021 - protein, 24 aa, Cryptosporidium hominis
MSPFIARLLWFVCYITGTIYMFIW

SEQ ID NO: 2126022 - protein, 21 aa, Cryptosporidium hominis
MSPLGIIIGQLFSYINSPLIN

SEQ ID NO: 2126023 - protein, 19 aa, Cryptosporidium hominis
MSYYNCFHEFLKIILSSDD

SEQ ID NO: 2126024 - protein, 20 aa, Cryptosporidium hominis
MTDKGRFSVVSLYETRTSNC

SEQ ID NO: 2126025 - protein, 25 aa, Cryptosporidium hominis
MTLKCGSCAVVLTRRYVITIFLIFF

SEQ ID NO: 2126026 - protein, 25 aa, Cryptosporidium hominis
MTPPGRLGVGLGFGNYNIGIGINSG

SEQ ID NO: 2126027 - protein, 18 aa, Cryptosporidium hominis
MTSNMFKSFSMEDLQSGL

SEQ ID NO: 2126028 - protein, 20 aa, Cryptosporidium hominis
MTTEILRSMLYRGSELVREI

SEQ ID NO: 2126029 - protein, 18 aa, Cryptosporidium hominis
MTVCAIIYGIAFTIKKDF

SEQ ID NO: 2126030 - protein, 17 aa, Cryptosporidium hominis
MTVVCLFGICAPSSAFL

SEQ ID NO: 2126031 - protein, 20 aa, Cryptosporidium hominis
MVCNNICNRTQLTLEKKCLI

SEQ ID NO: 2126032 - protein, 24 aa, Cryptosporidium hominis
MVETLKARMLDITRDFKDTLQKRT

SEQ ID NO: 2126033 - protein, 25 aa, Cryptosporidium hominis
MVIELMYLKNIRIIFFSIFLNGLSR

SEQ ID NO: 2126034 - protein, 21 aa, Cryptosporidium hominis
MVIGFSIRKYRKLRKGGEQVR

SEQ ID NO: 2126035 - protein, 17 aa, Cryptosporidium hominis
MVSLFILTQFIFQNQST

SEQ ID NO: 2126036 - protein, 17 aa, Cryptosporidium hominis
MVSMINLLLSMGFAVDY

SEQ ID NO: 2126037 - protein, 27 aa, Cryptosporidium hominis
MWSVLGIKLIRYFDFRIKNGLLYDCKI

SEQ ID NO: 2126038 - protein, 26 aa, Cryptosporidium hominis
MWVKTSFPGIIFAFLQLEKNWIIDFL

SEQ ID NO: 2126039 - protein, 19 aa, Cryptosporidium hominis
MYCRNILKHFCTDIITPRI

SEQ ID NO: 2126040 - protein, 20 aa, Cryptosporidium hominis
MYDQPSFRGMSILNKLEANN

SEQ ID NO: 2126041 - protein, 24 aa, Cryptosporidium hominis
MYGEKMKYFNVLASLNIPIINYLE

SEQ ID NO: 2126042 - protein, 17 aa, Cryptosporidium hominis
MYILHALYEELSLFPQF

SEQ ID NO: 2126043 - protein, 22 aa, Cryptosporidium hominis
MYIPSRFLLGLIPQIFLETHEF

SEQ ID NO: 2126044 - protein, 25 aa, Cryptosporidium hominis
MYKHLSCNFCGKVIFVPTEMTNQAR

SEQ ID NO: 2126045 - protein, 22 aa, Cryptosporidium hominis
MYLGEFYFNLLYELFPSTNEAD

SEQ ID NO: 2126046 - protein, 23 aa, Cryptosporidium hominis
MYLNKCRYYFPKEVWEITETAFS

SEQ ID NO: 2126047 - protein, 18 aa, Cryptosporidium hominis
MYSSRIMPALPWGEVNLD

SEQ ID NO: 2126048 - protein, 26 aa, Cryptosporidium hominis
MYTQWLQFYSCNTIEHSLHYILLSCI

SEQ ID NO: 2126049 - protein, 27 aa, Cryptosporidium hominis
MYYDDYCLMCFLIRPLINSLAARLRNT

SEQ ID NO: 2126050 - protein, 18 aa, Cryptosporidium hominis
NAECYYNRISRFEDAQLF

SEQ ID NO: 2126051 - protein, 21 aa, Cryptosporidium hominis
NAFSKVCICNYVPNIFLPLSV

SEQ ID NO: 2126052 - protein, 18 aa, Cryptosporidium hominis
NAKRSGIVGARLAGINAC

SEQ ID NO: 2126053 - protein, 17 aa, Cryptosporidium hominis
NAKVEWNSIPIARISSP

SEQ ID NO: 2126054 - protein, 23 aa, Cryptosporidium hominis
NALRLRDIYVEFAIHPVAGRMPG

SEQ ID NO: 2126055 - protein, 26 aa, Cryptosporidium hominis
NANDGGVCLPTLFSDLYIPLMGFITY

SEQ ID NO: 2126056 - protein, 26 aa, Cryptosporidium hominis
NAPSTRSVWGFFPVNLLPRFNPYNSG

SEQ ID NO: 2126057 - protein, 20 aa, Cryptosporidium hominis
NARLVFNLMLVIMSPVSRVI

SEQ ID NO: 2126058 - protein, 26 aa, Cryptosporidium hominis
NASHIVRIVSFFIFFSYASCIYSTAY

SEQ ID NO: 2126059 - protein, 24 aa, Cryptosporidium hominis
NASKRRLYNYCIRQFERSLYECGK

SEQ ID NO: 2126060 - protein, 19 aa, Cryptosporidium hominis
NCDKLKWLRDKYPSIYRQT

SEQ ID NO: 2126061 - protein, 29 aa, Cryptosporidium hominis
NCMTSMPTCTCKKCKQAGSPSSGTEENSP

SEQ ID NO: 2126062 - protein, 21 aa, Cryptosporidium hominis
NCNIQDFVSCFNILCRSVTKE

SEQ ID NO: 2126063 - protein, 23 aa, Cryptosporidium hominis
NCRFDGCRMKRCSNIPEIRSLII

SEQ ID NO: 2126064 - protein, 19 aa, Cryptosporidium hominis
NCSECKICHLFFEENSKHC

SEQ ID NO: 2126065 - protein, 25 aa, Cryptosporidium hominis
NCSSRSKRFLGFCVNGIKEIHGSFA

SEQ ID NO: 2126066 - protein, 18 aa, Cryptosporidium hominis
NCTIPIEYLLNMDINISF

SEQ ID NO: 2126067 - protein, 27 aa, Cryptosporidium hominis
NDACIKLFPKHSIKMFKVLGVNLTGEE

SEQ ID NO: 2126068 - protein, 23 aa, Cryptosporidium hominis
NDCISLRMKFFIKALYKKLGKFK

SEQ ID NO: 2126069 - protein, 22 aa, Cryptosporidium hominis
NDCIYDLGFVIPIINSRFKLAY

SEQ ID NO: 2126070 - protein, 25 aa, Cryptosporidium hominis
NDDFKISNVFSRIFLSYYNLCKSFI

SEQ ID NO: 2126071 - protein, 19 aa, Cryptosporidium hominis
NDFALLKDQIETILREYGV

SEQ ID NO: 2126072 - protein, 18 aa, Cryptosporidium hominis
NDFYAFFMITWSSCMIIT

SEQ ID NO: 2126073 - protein, 20 aa, Cryptosporidium hominis
NDGISHIYLLLVIILLVNLG

SEQ ID NO: 2126074 - protein, 23 aa, Cryptosporidium hominis
NDGKDIWTWFSVYLVILKTFKRF

SEQ ID NO: 2126075 - protein, 22 aa, Cryptosporidium hominis
NDICLSCDLTAAVYLLLFALKQ

SEQ ID NO: 2126076 - protein, 19 aa, Cryptosporidium hominis
NDILIRNGMQIKQKPFLIW

SEQ ID NO: 2126077 - protein, 17 aa, Cryptosporidium hominis
NDIPLLWLLALSVASVV

SEQ ID NO: 2126078 - protein, 24 aa, Cryptosporidium hominis
NDKNCSIDKFLLLFEMLGIILSIP

SEQ ID NO: 2126079 - protein, 19 aa, Cryptosporidium hominis
NDKRYGWGGTVAVFTSDQS

SEQ ID NO: 2126080 - protein, 18 aa, Cryptosporidium hominis
NDLCYAYSSQTSWIPQGT

SEQ ID NO: 2126081 - protein, 18 aa, Cryptosporidium hominis
NDLTFSILGPLWTHILNY

SEQ ID NO: 2126082 - protein, 17 aa, Cryptosporidium hominis
NDMEFIHNLILKTVYGI

SEQ ID NO: 2126083 - protein, 20 aa, Cryptosporidium hominis
NDMLKYAALSIFSEFYYYWS

SEQ ID NO: 2126084 - protein, 24 aa, Cryptosporidium hominis
NDNSEKLPVFALVDIFHVPPESRQ

SEQ ID NO: 2126085 - protein, 18 aa, Cryptosporidium hominis
NDRAREYIDILGREVNLQ

SEQ ID NO: 2126086 - protein, 21 aa, Cryptosporidium hominis
NDRIKNLFCTKIGINDIHKGT

SEQ ID NO: 2126087 - protein, 25 aa, Cryptosporidium hominis
NDSWFNLDLLREFLMDENVTSSSAD

SEQ ID NO: 2126088 - protein, 32 aa, Cryptosporidium hominis
NDVNMLFIFCELFSFIFLKFHSFWMERKPKNI

SEQ ID NO: 2126089 - protein, 22 aa, Cryptosporidium hominis
NDYRKYLENWADTVQVLLQGPG

SEQ ID NO: 2126090 - protein, 19 aa, Cryptosporidium hominis
NEELGCLKEVGNFQIGELY

SEQ ID NO: 2126091 - protein, 17 aa, Cryptosporidium hominis
NEFMLKELREFVDQYIF

SEQ ID NO: 2126092 - protein, 22 aa, Cryptosporidium hominis
NEGFCPNTLLELHKDLRPIYIY

SEQ ID NO: 2126093 - protein, 17 aa, Cryptosporidium hominis
NEIRYLLMVSAGMFAVA

SEQ ID NO: 2126094 - protein, 21 aa, Cryptosporidium hominis
NEKQGRIGLFQNTPKQISGIR

SEQ ID NO: 2126095 - protein, 22 aa, Cryptosporidium hominis
NELELIFNHSLEIFQKLANSDI

SEQ ID NO: 2126096 - protein, 20 aa, Cryptosporidium hominis
NELFLYLYRLKVICTEKLGY

SEQ ID NO: 2126097 - protein, 25 aa, Cryptosporidium hominis
NELGLSLFINFGIRFFGKLESDKYY

SEQ ID NO: 2126098 - protein, 20 aa, Cryptosporidium hominis
NENEIGWIFYAFPRLYQAFV

SEQ ID NO: 2126099 - protein, 25 aa, Cryptosporidium hominis
NEPPMTRYLLWIDIYEISCRPAFDG

SEQ ID NO: 2126100 - protein, 17 aa, Cryptosporidium hominis
NESIPILKILSRRAQQF

SEQ ID NO: 2126101 - protein, 22 aa, Cryptosporidium hominis
NESRLSALLEEFFPKVMLKLSK

SEQ ID NO: 2126102 - protein, 19 aa, Cryptosporidium hominis
NEVLLFCDLNLGSISITRF

SEQ ID NO: 2126103 - protein, 29 aa, Cryptosporidium hominis
NEVLLRICSVGLNFRDVLNVMGLYPGDPG

SEQ ID NO: 2126104 - protein, 18 aa, Cryptosporidium hominis
NEVPRLSLLHDLQQRKHF

SEQ ID NO: 2126105 - protein, 22 aa, Cryptosporidium hominis
NEVTRFPFAILEVKLQSEQPIW

SEQ ID NO: 2126106 - protein, 23 aa, Cryptosporidium hominis
NEYKYSIIIKVNFELLINVPKSP

SEQ ID NO: 2126107 - protein, 25 aa, Cryptosporidium hominis
NEYLSKFYLFLAKELEVLEPKTPEE

SEQ ID NO: 2126108 - protein, 17 aa, Cryptosporidium hominis
NFDSLEELLEYILRSPP

SEQ ID NO: 2126109 - protein, 18 aa, Cryptosporidium hominis
NFFFPTIIAIIINSFILI

SEQ ID NO: 2126110 - protein, 23 aa, Cryptosporidium hominis
NFFKRKQISVPFPCANYPKNLQS

SEQ ID NO: 2126111 - protein, 25 aa, Cryptosporidium hominis
NFHLDCIRNGTYLEIYEQWKCDSCT

SEQ ID NO: 2126112 - protein, 23 aa, Cryptosporidium hominis
NFHLRRYTCSEGMNNSFDMNCFI

SEQ ID NO: 2126113 - protein, 29 aa, Cryptosporidium hominis
NFIEDCLKLNFKGSLIFQSIESNKVEQTQ

SEQ ID NO: 2126114 - protein, 21 aa, Cryptosporidium hominis
NFLSDRRKFLLTKLLKLPNPL

SEQ ID NO: 2126115 - protein, 23 aa, Cryptosporidium hominis
NFPCMATSMIFNLIPILRDENKI

SEQ ID NO: 2126116 - protein, 20 aa, Cryptosporidium hominis
NFSKVFTFFNFVWKIILFFI

SEQ ID NO: 2126117 - protein, 25 aa, Cryptosporidium hominis
NFTPEPLWILCFMYGTFIALTDSYT

SEQ ID NO: 2126118 - protein, 19 aa, Cryptosporidium hominis
NFVIKDWFASQSIFKFYLL

SEQ ID NO: 2126119 - protein, 18 aa, Cryptosporidium hominis
NFYECWWDHIILDIFGCN

SEQ ID NO: 2126120 - protein, 22 aa, Cryptosporidium hominis
NGAMAPAMLFARVRAAIASQGE

SEQ ID NO: 2126121 - protein, 17 aa, Cryptosporidium hominis
NGDIQLKKIFKFDNESN

SEQ ID NO: 2126122 - protein, 20 aa, Cryptosporidium hominis
NGESEIKGNIVFETNNNPLI

SEQ ID NO: 2126123 - protein, 26 aa, Cryptosporidium hominis
NGESKPTLIGKFKLDVFNIFKEPFPI

SEQ ID NO: 2126124 - protein, 19 aa, Cryptosporidium hominis
NGGYLCLGALVISIIVGIV

SEQ ID NO: 2126125 - protein, 19 aa, Cryptosporidium hominis
NGIIFPPFIIFGIQVIILA

SEQ ID NO: 2126126 - protein, 22 aa, Cryptosporidium hominis
NGIPMDFRILVLNSLASACQNM

SEQ ID NO: 2126127 - protein, 25 aa, Cryptosporidium hominis
NGKCLPFSCLFILQILVALATITWV

SEQ ID NO: 2126128 - protein, 18 aa, Cryptosporidium hominis
NGLTPFYFLLKDGMSTNT

SEQ ID NO: 2126129 - protein, 22 aa, Cryptosporidium hominis
NGLWKVKLSIYILSTLLCGLCV

SEQ ID NO: 2126130 - protein, 24 aa, Cryptosporidium hominis
NGMGYVYFHGCEGFERNFRLAFHH

SEQ ID NO: 2126131 - protein, 35 aa, Cryptosporidium hominis
NGNDSQLFASKEDKLLLKLPILITTTTSTMTTTTR

SEQ ID NO: 2126132 - protein, 26 aa, Cryptosporidium hominis
NGNFIAKLFIRFGMKPEQTQIHDQES

SEQ ID NO: 2126133 - protein, 31 aa, Cryptosporidium hominis
NGPEVLYKYVIFISFLLQWIASATRSCYLDS

SEQ ID NO: 2126134 - protein, 31 aa, Cryptosporidium hominis
NGSNIMPFSWRIEFVIICLTTMFLTVSLFSL

SEQ ID NO: 2126135 - protein, 18 aa, Cryptosporidium hominis
NGSRGFDTFEEYKSRHGT

SEQ ID NO: 2126136 - protein, 22 aa, Cryptosporidium hominis
NGTISHRFGLWLAAQRLSEQKT

SEQ ID NO: 2126137 - protein, 17 aa, Cryptosporidium hominis
NGYFPKKIKQAILNNLK

SEQ ID NO: 2126138 - protein, 19 aa, Cryptosporidium hominis
NGYRTLCFAKKELSENEVI

SEQ ID NO: 2126139 - protein, 30 aa, Cryptosporidium hominis
NHALKEGFNWSVCGFRHFFYNLKYTNSLIQ

SEQ ID NO: 2126140 - protein, 24 aa, Cryptosporidium hominis
NHCKLRKDFYMDIKKCRRRNKKEN

SEQ ID NO: 2126141 - protein, 18 aa, Cryptosporidium hominis
NHCYSVFTIVKSKGGESF

SEQ ID NO: 2126142 - protein, 22 aa, Cryptosporidium hominis
NHDAWIPLLRSMTYQDPEFRPS

SEQ ID NO: 2126143 - protein, 30 aa, Cryptosporidium hominis
NHFRLDEQTIRWSIENMLSRGIIQIVTKEE

SEQ ID NO: 2126144 - protein, 25 aa, Cryptosporidium hominis
NHHLKIARFYSFIKLGVLQFVTLKP

SEQ ID NO: 2126145 - protein, 19 aa, Cryptosporidium hominis
NHIHSRISLLYLSKKPVMN

SEQ ID NO: 2126146 - protein, 18 aa, Cryptosporidium hominis
NHILNVFIQGLGHEFFSM

SEQ ID NO: 2126147 - protein, 19 aa, Cryptosporidium hominis
NHKLYEIIEKFMLNLQNYK

SEQ ID NO: 2126148 - protein, 24 aa, Cryptosporidium hominis
NHKTIDILKLWSIGSESTILSLIK

SEQ ID NO: 2126149 - protein, 27 aa, Cryptosporidium hominis
NIAQGFEFWHIIAMIIVAIVALKLINY

SEQ ID NO: 2126150 - protein, 36 aa, Cryptosporidium hominis
NICNSCTRQECLSCTSMAYCPQCPGLEDLSSCSNCL

SEQ ID NO: 2126151 - protein, 17 aa, Cryptosporidium hominis
NIDDIFESLSLLLYSTN

SEQ ID NO: 2126152 - protein, 20 aa, Cryptosporidium hominis
NIDFKYLLLFFGSRMGLAAE

SEQ ID NO: 2126153 - protein, 18 aa, Cryptosporidium hominis
NIETRFLTSNSMAFAGEV

SEQ ID NO: 2126154 - protein, 17 aa, Cryptosporidium hominis
NIFVRKKALLSIIKIHN

SEQ ID NO: 2126155 - protein, 17 aa, Cryptosporidium hominis
NIGKVLLGFALYNKAKY

SEQ ID NO: 2126156 - protein, 19 aa, Cryptosporidium hominis
NIGYYRWGFSNGSNVKYSV

SEQ ID NO: 2126157 - protein, 29 aa, Cryptosporidium hominis
NIIFCSFIISLACCAVGNFASSFIYKELP

SEQ ID NO: 2126158 - protein, 18 aa, Cryptosporidium hominis
NIIKCYKMISGYDSEVHW

SEQ ID NO: 2126159 - protein, 19 aa, Cryptosporidium hominis
NIIPSCFDDASIHVRSSAC

SEQ ID NO: 2126160 - protein, 26 aa, Cryptosporidium hominis
NIKANVCDYIVWFDLDIVITNKFFSI

SEQ ID NO: 2126161 - protein, 25 aa, Cryptosporidium hominis
NIKFPRILERLLYKACKLVNLMEIP

SEQ ID NO: 2126162 - protein, 20 aa, Cryptosporidium hominis
NILFGAPFDPEWYAQVVDAC

SEQ ID NO: 2126163 - protein, 17 aa, Cryptosporidium hominis
NILPEFKKRSFNNNSPS

SEQ ID NO: 2126164 - protein, 21 aa, Cryptosporidium hominis
NILPMKSIIIVFLNYHIFNQH

SEQ ID NO: 2126165 - protein, 22 aa, Cryptosporidium hominis
NILRMFDYLINIVFLASYSIVI

SEQ ID NO: 2126166 - protein, 23 aa, Cryptosporidium hominis
NINFPDRRGEFINDCKIVQVSQE

SEQ ID NO: 2126167 - protein, 22 aa, Cryptosporidium hominis
NIPEVPALYFIKPTEENIDKLC

SEQ ID NO: 2126168 - protein, 23 aa, Cryptosporidium hominis
NISENQPLIGIVVGTGVNACYLE

SEQ ID NO: 2126169 - protein, 25 aa, Cryptosporidium hominis
NISKRCSNFYCSLEAHFHIAKRLHL

SEQ ID NO: 2126170 - protein, 25 aa, Cryptosporidium hominis
NISPRNCSLESFLQTNCLNKNQDPS

SEQ ID NO: 2126171 - protein, 24 aa, Cryptosporidium hominis
NISQKELFGAIVMGDAENMRAAVF

SEQ ID NO: 2126172 - protein, 24 aa, Cryptosporidium hominis
NISSLRLSTAFSFAAFLICSLTLC

SEQ ID NO: 2126173 - protein, 22 aa, Cryptosporidium hominis
NITCTRKYFVLGYLKSSLFLSN

SEQ ID NO: 2126174 - protein, 39 aa, Cryptosporidium hominis
NIVYKQLMGIFRFKLCYVWKFSILNSYCLPLINDQQNEF

SEQ ID NO: 2126175 - protein, 21 aa, Cryptosporidium hominis
NIYFKMMDIIEDFENYNKFQC

SEQ ID NO: 2126176 - protein, 18 aa, Cryptosporidium hominis
NIYKLFFLIFVSRLSKIY

SEQ ID NO: 2126177 - protein, 26 aa, Cryptosporidium hominis
NIYKMNRYKLLVTHWLEINGKVIISS

SEQ ID NO: 2126178 - protein, 23 aa, Cryptosporidium hominis
NIYNKECRFCFGVETDHSPLITP

SEQ ID NO: 2126179 - protein, 19 aa, Cryptosporidium hominis
NIYTVRWRQYHAVAASALT

SEQ ID NO: 2126180 - protein, 21 aa, Cryptosporidium hominis
NKAILTFNSFVHIIKYFCSNF

SEQ ID NO: 2126181 - protein, 17 aa, Cryptosporidium hominis
NKDEIMNLLSLGEIQFQ

SEQ ID NO: 2126182 - protein, 21 aa, Cryptosporidium hominis
NKEIFWNSDIINFNKNNIDSS

SEQ ID NO: 2126183 - protein, 23 aa, Cryptosporidium hominis
NKEINRPFLAICDILQIENYISN

SEQ ID NO: 2126184 - protein, 26 aa, Cryptosporidium hominis
NKEQLFRKELEKCIIEQGLDLVKQLP

SEQ ID NO: 2126185 - protein, 23 aa, Cryptosporidium hominis
NKESDFWKFFGVNMLSGGLAGAA

SEQ ID NO: 2126186 - protein, 19 aa, Cryptosporidium hominis
NKFLFPLFSPRSSSSSSFF

SEQ ID NO: 2126187 - protein, 23 aa, Cryptosporidium hominis
NKFLLRLTCEFYMKAMREIQDYL

SEQ ID NO: 2126188 - protein, 18 aa, Cryptosporidium hominis
NKHLKVIGDFGCGTAKIG

SEQ ID NO: 2126189 - protein, 18 aa, Cryptosporidium hominis
NKILFWFILISIFAFCIS

SEQ ID NO: 2126190 - protein, 24 aa, Cryptosporidium hominis
NKKLFPTFLRLSLSPVNFDISESP

SEQ ID NO: 2126191 - protein, 21 aa, Cryptosporidium hominis
NKKLWIIEQMDTFSSQEDIPF

SEQ ID NO: 2126192 - protein, 30 aa, Cryptosporidium hominis
NKKNSMLYKWGIEYDKPYLIALPHIFKDSD

SEQ ID NO: 2126193 - protein, 22 aa, Cryptosporidium hominis
NKKQCAYTIHYLEGSSLSGSYF

SEQ ID NO: 2126194 - protein, 17 aa, Cryptosporidium hominis
NKKSFFNSIKFKRFKKR

SEQ ID NO: 2126195 - protein, 20 aa, Cryptosporidium hominis
NKLLIFGILLLRQGTEYLGE

SEQ ID NO: 2126196 - protein, 32 aa, Cryptosporidium hominis
NKLLLRLYDPLIWRYISVANWKVRLNTTALLA

SEQ ID NO: 2126197 - protein, 17 aa, Cryptosporidium hominis
NKLRLKAEISEKSEKIR

SEQ ID NO: 2126198 - protein, 24 aa, Cryptosporidium hominis
NKLRYFYGRHLWLFSSKVNLINLC

SEQ ID NO: 2126199 - protein, 25 aa, Cryptosporidium hominis
NKMSRRMALGSSISMFDQLKLKEKN

SEQ ID NO: 2126200 - protein, 17 aa, Cryptosporidium hominis
NKNAILFYLEVFGDICS

SEQ ID NO: 2126201 - protein, 22 aa, Cryptosporidium hominis
NKNINVLCRIHLDINKILKTPN

SEQ ID NO: 2126202 - protein, 19 aa, Cryptosporidium hominis
NKNNCIIYPMIENISVSAP

SEQ ID NO: 2126203 - protein, 24 aa, Cryptosporidium hominis
NKNPEYCHWFAFYLVKNRASKEKN

SEQ ID NO: 2126204 - protein, 26 aa, Cryptosporidium hominis
NKNYKKSMWLFFGIGIVQMTLSLFLD

SEQ ID NO: 2126205 - protein, 17 aa, Cryptosporidium hominis
NKPICAKTMYNINNKTD

SEQ ID NO: 2126206 - protein, 17 aa, Cryptosporidium hominis
NKQDLKPLLSINLKKYF

SEQ ID NO: 2126207 - protein, 17 aa, Cryptosporidium hominis
NKREFPDYFQVREAETP

SEQ ID NO: 2126208 - protein, 21 aa, Cryptosporidium hominis
NKRFKSVLSNYCNRIKNTQQI

SEQ ID NO: 2126209 - protein, 21 aa, Cryptosporidium hominis
NKRIRFVAIRPIGNIIAIGYS

SEQ ID NO: 2126210 - protein, 23 aa, Cryptosporidium hominis
NKRKVMVLIIVYRYLVIIQNDIA

SEQ ID NO: 2126211 - protein, 21 aa, Cryptosporidium hominis
NKRSGAFSFFGKSLAVVQAEQ

SEQ ID NO: 2126212 - protein, 25 aa, Cryptosporidium hominis
NKRVIEVILLLTFYKRIEKYNNAKK

SEQ ID NO: 2126213 - protein, 23 aa, Cryptosporidium hominis
NKSIYRYLLVQYLIRKNRSRSEI

SEQ ID NO: 2126214 - protein, 18 aa, Cryptosporidium hominis
NKSLIFVYLLLSTVPFLS

SEQ ID NO: 2126215 - protein, 19 aa, Cryptosporidium hominis
NKSMRYLKVAGATILGGVV

SEQ ID NO: 2126216 - protein, 20 aa, Cryptosporidium hominis
NKSRISKIWKALSNSEPSII

SEQ ID NO: 2126217 - protein, 17 aa, Cryptosporidium hominis
NKSRSFLIFDNFLSQIN

SEQ ID NO: 2126218 - protein, 28 aa, Cryptosporidium hominis
NKTLSCKLVRLLVERELPPGFYQGVFKT

SEQ ID NO: 2126219 - protein, 24 aa, Cryptosporidium hominis
NKVALNFLCFILVFYTSYQPDISK

SEQ ID NO: 2126220 - protein, 17 aa, Cryptosporidium hominis
NKVVKLVLWLLGWLSVT

SEQ ID NO: 2126221 - protein, 19 aa, Cryptosporidium hominis
NLAKAVGLATMIATMRPDI

SEQ ID NO: 2126222 - protein, 22 aa, Cryptosporidium hominis
NLALKCVKMINVPHLVESVIAL

SEQ ID NO: 2126223 - protein, 21 aa, Cryptosporidium hominis
NLCIVIGLLSYFMAYSGHEIE

SEQ ID NO: 2126224 - protein, 23 aa, Cryptosporidium hominis
NLDLLRYAYIKGTEYRTKSSEYI

SEQ ID NO: 2126225 - protein, 24 aa, Cryptosporidium hominis
NLEFPISKFWMMGFFDAFSSILTL

SEQ ID NO: 2126226 - protein, 24 aa, Cryptosporidium hominis
NLESIAITCRWIKSTANASIRPLR

SEQ ID NO: 2126227 - protein, 18 aa, Cryptosporidium hominis
NLFLDIEVLFSFITARVD

SEQ ID NO: 2126228 - protein, 19 aa, Cryptosporidium hominis
NLFLLFAAICVIRGIMVFI

SEQ ID NO: 2126229 - protein, 20 aa, Cryptosporidium hominis
NLGCDGGFYSNGWSYLLEQN

SEQ ID NO: 2126230 - protein, 24 aa, Cryptosporidium hominis
NLGREFNNILAIVILSFAWYCLFV

SEQ ID NO: 2126231 - protein, 23 aa, Cryptosporidium hominis
NLHSKYCFFTHLNAPQDFQISIG

SEQ ID NO: 2126232 - protein, 24 aa, Cryptosporidium hominis
NLIKSANFQTHFDLKLIAKENDTL

SEQ ID NO: 2126233 - protein, 20 aa, Cryptosporidium hominis
NLIPEMTILISIRELNGDNK

SEQ ID NO: 2126234 - protein, 21 aa, Cryptosporidium hominis
NLKVDKQLSFMISKEAVDIGF

SEQ ID NO: 2126235 - protein, 22 aa, Cryptosporidium hominis
NLLESKGRISIHDISKTMKISI

SEQ ID NO: 2126236 - protein, 23 aa, Cryptosporidium hominis
NLLEVLDFTIGIFPTVLLISKLD

SEQ ID NO: 2126237 - protein, 19 aa, Cryptosporidium hominis
NLLGARTLLRFIIQTDHIF

SEQ ID NO: 2126238 - protein, 24 aa, Cryptosporidium hominis
NLLQVPHWFNFMAIESESQQEITN

SEQ ID NO: 2126239 - protein, 30 aa, Cryptosporidium hominis
NLLYKQKLIWLRIHLTVGIIDSEGFLNKVH

SEQ ID NO: 2126240 - protein, 18 aa, Cryptosporidium hominis
NLPHAISTIASRIKEFPN

SEQ ID NO: 2126241 - protein, 24 aa, Cryptosporidium hominis
NLPRPAFSRPVLRRNQQDWMKFAI

SEQ ID NO: 2126242 - protein, 25 aa, Cryptosporidium hominis
NLPSSLRKAYSMHILQLMSFLQQVT

SEQ ID NO: 2126243 - protein, 21 aa, Cryptosporidium hominis
NLQKFRVVPMEGEVEIRIRAI

SEQ ID NO: 2126244 - protein, 17 aa, Cryptosporidium hominis
NLQKLHCKSSREIAIGI

SEQ ID NO: 2126245 - protein, 20 aa, Cryptosporidium hominis
NLRALWGILQCNLLKNDAYN

SEQ ID NO: 2126246 - protein, 18 aa, Cryptosporidium hominis
NLREKFILVEIGGLFSVY

SEQ ID NO: 2126247 - protein, 26 aa, Cryptosporidium hominis
NLRIYSKYVHEFMGPILMGLLDGGFG

SEQ ID NO: 2126248 - protein, 28 aa, Cryptosporidium hominis
NLSVVCLIFPFFLSWTVVGTVWLKNIES

SEQ ID NO: 2126249 - protein, 18 aa, Cryptosporidium hominis
NLTLKWAKPSLDVSKDFW

SEQ ID NO: 2126250 - protein, 20 aa, Cryptosporidium hominis
NLTPRLKILGSLGIATSIYY

SEQ ID NO: 2126251 - protein, 24 aa, Cryptosporidium hominis
NLVLKTLLLLLLEYLIINFPGVSS

SEQ ID NO: 2126252 - protein, 25 aa, Cryptosporidium hominis
NLVNRPSNLFSILITSCCRLLFDSP

SEQ ID NO: 2126253 - protein, 19 aa, Cryptosporidium hominis
NLWDKYGYASIFTYFTIYL

SEQ ID NO: 2126254 - protein, 27 aa, Cryptosporidium hominis
  misc_feature (24)..(24): Xaa can be any naturally occurring amino acid
NLYNKFKLPNHILYAIKYMNKIIXNIH

SEQ ID NO: 2126255 - protein, 38 aa, Cryptosporidium hominis
NMARLMCYTLHFGEAMRWIYSCHHELKIIQLQWVLYLA

SEQ ID NO: 2126256 - protein, 23 aa, Cryptosporidium hominis
NMHQCLRLLVVSKKTSCNIENIF

SEQ ID NO: 2126257 - protein, 31 aa, Cryptosporidium hominis
NMIKGFKMVKYRGKYGPGHFVSMDDICYILE

SEQ ID NO: 2126258 - protein, 20 aa, Cryptosporidium hominis
NMILSIFRRGGFYFSTNPNV

SEQ ID NO: 2126259 - protein, 29 aa, Cryptosporidium hominis
NMKLLSFFKLFSIISILSLIYEHALGSHI

SEQ ID NO: 2126260 - protein, 19 aa, Cryptosporidium hominis
NMRALFMVVMYFNILFTSL

SEQ ID NO: 2126261 - protein, 19 aa, Cryptosporidium hominis
NMVEPMAMLIERYFNTETL

SEQ ID NO: 2126262 - protein, 18 aa, Cryptosporidium hominis
NMVWLYCYLMSANTPSKL

SEQ ID NO: 2126263 - protein, 19 aa, Cryptosporidium hominis
NMWTKWGLLKVEPETQEIQ

SEQ ID NO: 2126264 - protein, 19 aa, Cryptosporidium hominis
NNDKFPIIFNSFYTSLNNS

SEQ ID NO: 2126265 - protein, 18 aa, Cryptosporidium hominis
NNDLDWDTIIHIIDTDVI

SEQ ID NO: 2126266 - protein, 19 aa, Cryptosporidium hominis
NNDPRRVALLQVIVSLVFL

SEQ ID NO: 2126267 - protein, 21 aa, Cryptosporidium hominis
NNEYFKSSLLIFDSLQMLTFN

SEQ ID NO: 2126268 - protein, 26 aa, Cryptosporidium hominis
NNFKRLCLNLLKILYLFTLLLFILSD

SEQ ID NO: 2126269 - protein, 24 aa, Cryptosporidium hominis
NNHVGDILLCIDIIKLCDSKMVPP

SEQ ID NO: 2126270 - protein, 17 aa, Cryptosporidium hominis
NNIFKLFLLIIPNLLFQ

SEQ ID NO: 2126271 - protein, 19 aa, Cryptosporidium hominis
NNIPCSYRGILWNIAVGNN

SEQ ID NO: 2126272 - protein, 17 aa, Cryptosporidium hominis
NNIPIVDLLISFYDKSL

SEQ ID NO: 2126273 - protein, 24 aa, Cryptosporidium hominis
NNIQVYFFLCFSIHILYFSRMVRH

SEQ ID NO: 2126274 - protein, 20 aa, Cryptosporidium hominis
NNKKFCKIFDQFHFNTIQPY

SEQ ID NO: 2126275 - protein, 23 aa, Cryptosporidium hominis
NNKYRIEAIIMKFLKHKQKSSLL

SEQ ID NO: 2126276 - protein, 26 aa, Cryptosporidium hominis
NNLGECPLRRVIYGFMTKIRLLLIES

SEQ ID NO: 2126277 - protein, 18 aa, Cryptosporidium hominis
NNLIKEFPDRSSFLNREN

SEQ ID NO: 2126278 - protein, 22 aa, Cryptosporidium hominis
NNLKSSISYGVFPYLWEGLLEM

SEQ ID NO: 2126279 - protein, 27 aa, Cryptosporidium hominis
NNLLICISCGSILCTEYNCCNETETST

SEQ ID NO: 2126280 - protein, 24 aa, Cryptosporidium hominis
NNLPAPMFMFIFSLFSLIIGMILS

SEQ ID NO: 2126281 - protein, 24 aa, Cryptosporidium hominis
NNLRRFPWININPHPLVKLETDRK

SEQ ID NO: 2126282 - protein, 29 aa, Cryptosporidium hominis
NNLTQQFPFNGSLLLNGKVANITTFDILP

SEQ ID NO: 2126283 - protein, 22 aa, Cryptosporidium hominis
NNMPYLITFGLIKFNPVDYENF

SEQ ID NO: 2126284 - protein, 25 aa, Cryptosporidium hominis
NNNINELWPFFYLNYNYTQKKLIIS

SEQ ID NO: 2126285 - protein, 25 aa, Cryptosporidium hominis
NNNKWKVSSIWVIFTLENNSRVYPI

SEQ ID NO: 2126286 - protein, 28 aa, Cryptosporidium hominis
NNNLKKLVFLLRWCCDRNFASISKQALY

SEQ ID NO: 2126287 - protein, 26 aa, Cryptosporidium hominis
NNNNGKSNWKSIVSTSTTTISTREDI

SEQ ID NO: 2126288 - protein, 40 aa, Cryptosporidium hominis
NNNYFSIVKFFWKLAYLVLFILCWVIFPILLEYELSGDFD

SEQ ID NO: 2126289 - protein, 39 aa, Cryptosporidium hominis
NNPIYCIHNNEYKCYTNPMGIDCFCYNDQSIYNHIQNNQ

SEQ ID NO: 2126290 - protein, 20 aa, Cryptosporidium hominis
NNQCSLKFRIYVRKVLISLI

SEQ ID NO: 2126291 - protein, 23 aa, Cryptosporidium hominis
NNQSSSWFSSWFGNTSSANEIQE

SEQ ID NO: 2126292 - protein, 23 aa, Cryptosporidium hominis
NNRFYSKIKVILKYVKFTLENAL

SEQ ID NO: 2126293 - protein, 19 aa, Cryptosporidium hominis
NNRPVLILLDRDIDLSTMI

SEQ ID NO: 2126294 - protein, 28 aa, Cryptosporidium hominis
NNSLSVPIIDLWRILALHPQSSDIHKKT

SEQ ID NO: 2126295 - protein, 23 aa, Cryptosporidium hominis
NNSQPAFGWHFHNDISLPTEHPF

SEQ ID NO: 2126296 - protein, 25 aa, Cryptosporidium hominis
NNTRTADIWNLYGMIDADPLSSTES

SEQ ID NO: 2126297 - protein, 23 aa, Cryptosporidium hominis
NNVKMFLPKDLIRVKICMTRTQY

SEQ ID NO: 2126298 - protein, 23 aa, Cryptosporidium hominis
NNYLKEIFYIVGPNMNICNGSCC

SEQ ID NO: 2126299 - protein, 24 aa, Cryptosporidium hominis
NNYSEILLFPSILILKLLSIQNYE

SEQ ID NO: 2126300 - protein, 26 aa, Cryptosporidium hominis
NNYYCKGLNLLKKREIKAINNDCNSE

SEQ ID NO: 2126301 - protein, 25 aa, Cryptosporidium hominis
NNYYWKLLLFIIIRRHSLLFFIIIK

SEQ ID NO: 2126302 - protein, 17 aa, Cryptosporidium hominis
NPFLFSLMKRVLNKQLL

SEQ ID NO: 2126303 - protein, 21 aa, Cryptosporidium hominis
NPFWEFFAYQIPECISPNLLT

SEQ ID NO: 2126304 - protein, 18 aa, Cryptosporidium hominis
NPIGLPFLVYTADKTTFY

SEQ ID NO: 2126305 - protein, 23 aa, Cryptosporidium hominis
NPILFDDCIPILGKMVIEELNRI

SEQ ID NO: 2126306 - protein, 26 aa, Cryptosporidium hominis
NPKGGYPLTWVVHSKYWFNSVGSELN

SEQ ID NO: 2126307 - protein, 22 aa, Cryptosporidium hominis
NPKPSGSCGMVIIETSEHLIFQ

SEQ ID NO: 2126308 - protein, 22 aa, Cryptosporidium hominis
NPKRNICVHIDNNLKIMPEIDS

SEQ ID NO: 2126309 - protein, 27 aa, Cryptosporidium hominis
NPLQIFRKRVEFLRKAFSKPFVCSEKD

SEQ ID NO: 2126310 - protein, 18 aa, Cryptosporidium hominis
NPNPIAFLPDHGVMPVKG

SEQ ID NO: 2126311 - protein, 20 aa, Cryptosporidium hominis
NPNSCKYFSFYPRSFTLNYK

SEQ ID NO: 2126312 - protein, 20 aa, Cryptosporidium hominis
NPPICILYAKLYWKENKSPV

SEQ ID NO: 2126313 - protein, 24 aa, Cryptosporidium hominis
NPSNRYPYIYNFTLSFAGSCGDSR

SEQ ID NO: 2126314 - protein, 19 aa, Cryptosporidium hominis
NPWRKELYRSISERTSNTN

SEQ ID NO: 2126315 - protein, 17 aa, Cryptosporidium hominis
NQCSLAFNSIVEDISIL

SEQ ID NO: 2126316 - protein, 17 aa, Cryptosporidium hominis
NQITIAIDGSVWTKIPK

SEQ ID NO: 2126317 - protein, 18 aa, Cryptosporidium hominis
NQQISWGFIFSRSIKSLN

SEQ ID NO: 2126318 - protein, 17 aa, Cryptosporidium hominis
NQWMALDTLFAIISIGR

SEQ ID NO: 2126319 - protein, 22 aa, Cryptosporidium hominis
NQYFKHCITFIVSHDIRSLQYV

SEQ ID NO: 2126320 - protein, 17 aa, Cryptosporidium hominis
NQYKFLIEYFNIVRHKR

SEQ ID NO: 2126321 - protein, 22 aa, Cryptosporidium hominis
NRARKELFRIYNIIHDNLIKDE

SEQ ID NO: 2126322 - protein, 29 aa, Cryptosporidium hominis
NRCNHIKRLAFLIFCCPENTFQLQLSLIL

SEQ ID NO: 2126323 - protein, 19 aa, Cryptosporidium hominis
NREGFKMIETRSIVPSYKL

SEQ ID NO: 2126324 - protein, 23 aa, Cryptosporidium hominis
NRESFKFRKRTAFDDASDNFFKR

SEQ ID NO: 2126325 - protein, 33 aa, Cryptosporidium hominis
NREYNSIVYKLYWKLMLTCGVATICTLAAVAII

SEQ ID NO: 2126326 - protein, 26 aa, Cryptosporidium hominis
NRFFPYLLRHVKGWQPYQALLLQIFI

SEQ ID NO: 2126327 - protein, 23 aa, Cryptosporidium hominis
NRFTYKHFVVYIVFYVIGTILNL

SEQ ID NO: 2126328 - protein, 19 aa, Cryptosporidium hominis
NRIILSIPASINFMSTSIL

SEQ ID NO: 2126329 - protein, 27 aa, Cryptosporidium hominis
NRIKREEFIPILKCLDFSKMISKKEFL

SEQ ID NO: 2126330 - protein, 18 aa, Cryptosporidium hominis
NRISCCFICEGIDSSNMS

SEQ ID NO: 2126331 - protein, 23 aa, Cryptosporidium hominis
NRISSNWRLLGFQNDDPRFDFKC

SEQ ID NO: 2126332 - protein, 24 aa, Cryptosporidium hominis
NRKIKIHPNFRIFSSCIYTKQNNY

SEQ ID NO: 2126333 - protein, 21 aa, Cryptosporidium hominis
NRKQKFILFLLGILLVSIINI

SEQ ID NO: 2126334 - protein, 29 aa, Cryptosporidium hominis
NRKVSRLYEIWRLPSNGLERAIIHRNMMR

SEQ ID NO: 2126335 - protein, 21 aa, Cryptosporidium hominis
NRNRILDFARYFASSASAIGI

SEQ ID NO: 2126336 - protein, 23 aa, Cryptosporidium hominis
NRPTALPKSVCKYFPSSLKVRLL

SEQ ID NO: 2126337 - protein, 17 aa, Cryptosporidium hominis
NRPVPRPMLPFPGNKTE

SEQ ID NO: 2126338 - protein, 18 aa, Cryptosporidium hominis
NRRIKCPSIKSEIMTLKC

SEQ ID NO: 2126339 - protein, 21 aa, Cryptosporidium hominis
NRSGIWRLLLIRLSETNKEIM

SEQ ID NO: 2126340 - protein, 19 aa, Cryptosporidium hominis
NRSLLFAYVLHLWLNLTII

SEQ ID NO: 2126341 - protein, 19 aa, Cryptosporidium hominis
NRTGMTIVYGFSGLGVIVN

SEQ ID NO: 2126342 - protein, 23 aa, Cryptosporidium hominis
NRTRRNYFKLLRNYTNIFNSENY

SEQ ID NO: 2126343 - protein, 20 aa, Cryptosporidium hominis
NRVAPKFSINNRVLLLSPHP

SEQ ID NO: 2126344 - protein, 23 aa, Cryptosporidium hominis
NRVIKPLFNRYFKLISSEDQNML

SEQ ID NO: 2126345 - protein, 25 aa, Cryptosporidium hominis
NSDLFKLEMERLLKGEKLDVVINCL

SEQ ID NO: 2126346 - protein, 18 aa, Cryptosporidium hominis
NSFFKSEIPDLICSTLSV

SEQ ID NO: 2126347 - protein, 27 aa, Cryptosporidium hominis
NSFKKMKPACFVSSIFSLIKISFWYEW

SEQ ID NO: 2126348 - protein, 25 aa, Cryptosporidium hominis
NSGFLTRLPIEWDISTKLENDLLSL

SEQ ID NO: 2126349 - protein, 22 aa, Cryptosporidium hominis
NSHSKLPWFPTLSSALYLTEDA

SEQ ID NO: 2126350 - protein, 25 aa, Cryptosporidium hominis
NSIIPSYRRPLIFIYLLNVILFILR

SEQ ID NO: 2126351 - protein, 17 aa, Cryptosporidium hominis
NSILGIVEINYLFYSFK

SEQ ID NO: 2126352 - protein, 17 aa, Cryptosporidium hominis
NSILNWFTISPKATDRS

SEQ ID NO: 2126353 - protein, 19 aa, Cryptosporidium hominis
NSIRRSSSFFKFDKSINDY

SEQ ID NO: 2126354 - protein, 25 aa, Cryptosporidium hominis
NSKEARSAILLGLRVNKSSLILWRG

SEQ ID NO: 2126355 - protein, 24 aa, Cryptosporidium hominis
NSKFCKDIFLWSFQQKGLIKIGEI

SEQ ID NO: 2126356 - protein, 30 aa, Cryptosporidium hominis
NSKKCYYFSYKLCLIYINFILKCDHPGSSE

SEQ ID NO: 2126357 - protein, 17 aa, Cryptosporidium hominis
NSKQCYIIVFLLQKITT

SEQ ID NO: 2126358 - protein, 24 aa, Cryptosporidium hominis
NSKRRVGIILIKLSQLFNQNKIYN

SEQ ID NO: 2126359 - protein, 22 aa, Cryptosporidium hominis
NSLDPFVCKIVIERLFSKNGLL

SEQ ID NO: 2126360 - protein, 24 aa, Cryptosporidium hominis
NSLLSYFQSFKWAELKETIINLSI

SEQ ID NO: 2126361 - protein, 17 aa, Cryptosporidium hominis
NSLNIYVHYELVWETST

SEQ ID NO: 2126362 - protein, 19 aa, Cryptosporidium hominis
NSLNRIICLVIIHDRLDGM

SEQ ID NO: 2126363 - protein, 21 aa, Cryptosporidium hominis
NSLQVVDFVLRLIKDPVEIKI

SEQ ID NO: 2126364 - protein, 27 aa, Cryptosporidium hominis
NSNSPFGCLMFRLARTTLEQGLDYSIA

SEQ ID NO: 2126365 - protein, 21 aa, Cryptosporidium hominis
NSPIMPIKLSPIALKDSEPVV

SEQ ID NO: 2126366 - protein, 18 aa, Cryptosporidium hominis
NSPRACLCSGEKKSENFK

SEQ ID NO: 2126367 - protein, 20 aa, Cryptosporidium hominis
NSRIICKFQDFVFSKLENII

SEQ ID NO: 2126368 - protein, 22 aa, Cryptosporidium hominis
NSRNGGITTIRFNVNSSGNGLG

SEQ ID NO: 2126369 - protein, 19 aa, Cryptosporidium hominis
NSRRKAFSLIHERENLDIK

SEQ ID NO: 2126370 - protein, 26 aa, Cryptosporidium hominis
NSSNLKLGVSCFCLNLQKSLSTIDSE

SEQ ID NO: 2126371 - protein, 22 aa, Cryptosporidium hominis
NSTAAFGLYWGCRNKDTIVSKH

SEQ ID NO: 2126372 - protein, 31 aa, Cryptosporidium hominis
NSTIKVELPSSGRISDILSVDNLETTNNALN

SEQ ID NO: 2126373 - protein, 18 aa, Cryptosporidium hominis
NSTKCFRDNIANYIVNDD

SEQ ID NO: 2126374 - protein, 20 aa, Cryptosporidium hominis
NSTPPLLKICGFDITEKLSG

SEQ ID NO: 2126375 - protein, 17 aa, Cryptosporidium hominis
NSVELFLNLVIGMISIT

SEQ ID NO: 2126376 - protein, 20 aa, Cryptosporidium hominis
NSVIEFIERSTITTGNQSFG

SEQ ID NO: 2126377 - protein, 25 aa, Cryptosporidium hominis
NSVIFRYALEIQYIFYNKKKNSNIG

SEQ ID NO: 2126378 - protein, 21 aa, Cryptosporidium hominis
NSWGVSWGIGGFMNVSADSCD

SEQ ID NO: 2126379 - protein, 20 aa, Cryptosporidium hominis
NSWIKRKVQKISGFIHNDNQ

SEQ ID NO: 2126380 - protein, 25 aa, Cryptosporidium hominis
NSWMPADIAWTFALYLESVVVLPQL

SEQ ID NO: 2126381 - protein, 24 aa, Cryptosporidium hominis
NSYKFIGSDIWGLVRSARYELDKY

SEQ ID NO: 2126382 - protein, 24 aa, Cryptosporidium hominis
NSYPWKMHGDLGFLPNGERAWTPS

SEQ ID NO: 2126383 - protein, 18 aa, Cryptosporidium hominis
NSYSTLFFYILKAANRFK

SEQ ID NO: 2126384 - protein, 18 aa, Cryptosporidium hominis
NTCLPPLDTSMMFCPLTK

SEQ ID NO: 2126385 - protein, 19 aa, Cryptosporidium hominis
NTEGSFKCECLDRELIFDQ

SEQ ID NO: 2126386 - protein, 26 aa, Cryptosporidium hominis
NTEPGRVPAKWGFRVGDESKRRRYCK

SEQ ID NO: 2126387 - protein, 29 aa, Cryptosporidium hominis
NTFLSQMCCLFQFIKVIGLFLAEFEGPHN

SEQ ID NO: 2126388 - protein, 18 aa, Cryptosporidium hominis
NTFQSDIVKREHITAEQY

SEQ ID NO: 2126389 - protein, 17 aa, Cryptosporidium hominis
NTIKLPTNKGREKEENT

SEQ ID NO: 2126390 - protein, 25 aa, Cryptosporidium hominis
NTISELFSVCAIRFHAEWLDIVKFL

SEQ ID NO: 2126391 - protein, 20 aa, Cryptosporidium hominis
NTKCKTHYILARSLPRELNK

SEQ ID NO: 2126392 - protein, 18 aa, Cryptosporidium hominis
NTLEQSGIEFGQENSGVN

SEQ ID NO: 2126393 - protein, 36 aa, Cryptosporidium hominis
NTNLRFTALSAFNWYLISMGFEFSVLVLYLLEGLYI

SEQ ID NO: 2126394 - protein, 22 aa, Cryptosporidium hominis
NTNPSQILAIWRRPSNSRIKSE

SEQ ID NO: 2126395 - protein, 35 aa, Cryptosporidium hominis
NTNSPEFFRLWTLLILCGLLSMLLNYFTFLVVGYT

SEQ ID NO: 2126396 - protein, 25 aa, Cryptosporidium hominis
NTSFPRFSFGNLQSSIEIERLKIHP

SEQ ID NO: 2126397 - protein, 26 aa, Cryptosporidium hominis
NTTFCCRITLVTLVFVSVSLIIVLIF

SEQ ID NO: 2126398 - protein, 17 aa, Cryptosporidium hominis
NTVFQIFPLFSLVFALL

SEQ ID NO: 2126399 - protein, 25 aa, Cryptosporidium hominis
NTVLKFSLNLDQIFDDLCQYGYKEK

SEQ ID NO: 2126400 - protein, 24 aa, Cryptosporidium hominis
NTYRYRPTKIFKIISTSFVIIRWF

SEQ ID NO: 2126401 - protein, 21 aa, Cryptosporidium hominis
NVFMKKCMNYFNGDAIQLMKY

SEQ ID NO: 2126402 - protein, 27 aa, Cryptosporidium hominis
NVFPLAWKVEFIFWNYFSILSMSLIYW

SEQ ID NO: 2126403 - protein, 19 aa, Cryptosporidium hominis
NVFSLIPIIYLNSKLWNVQ

SEQ ID NO: 2126404 - protein, 18 aa, Cryptosporidium hominis
NVGFCKDKLIGEDDSSWL

SEQ ID NO: 2126405 - protein, 27 aa, Cryptosporidium hominis
NVGNLPLEVGFTFSFPIVQSKIASAKL

SEQ ID NO: 2126406 - protein, 20 aa, Cryptosporidium hominis
NVICNVFSVLVLKHGTASTG

SEQ ID NO: 2126407 - protein, 17 aa, Cryptosporidium hominis
NVIRYSRQIALKEVGVS

SEQ ID NO: 2126408 - protein, 23 aa, Cryptosporidium hominis
NVKKGRSGTNISIYDYDKNTNLD

SEQ ID NO: 2126409 - protein, 17 aa, Cryptosporidium hominis
NVLEFRKKKFAHKKQNK

SEQ ID NO: 2126410 - protein, 17 aa, Cryptosporidium hominis
NVLELFKTNTLDIFIAK

SEQ ID NO: 2126411 - protein, 24 aa, Cryptosporidium hominis
NVLGITLLILVIWILITSFVIIFS

SEQ ID NO: 2126412 - protein, 36 aa, Cryptosporidium hominis
NVLQVIFSRLFLRGYKEILCRIMVGWSNNIDKSLFE

SEQ ID NO: 2126413 - protein, 26 aa, Cryptosporidium hominis
NVLVSSFFFVKACFLFVSAIGRVHSR

SEQ ID NO: 2126414 - protein, 19 aa, Cryptosporidium hominis
NVPDAFGVHYSRDVLMSMN

SEQ ID NO: 2126415 - protein, 26 aa, Cryptosporidium hominis
NVQEHLRPSPPLPMSNSIKDFQKFDP

SEQ ID NO: 2126416 - protein, 25 aa, Cryptosporidium hominis
NVSERFKQLVLLLSTMRFDWDTHYY

SEQ ID NO: 2126417 - protein, 17 aa, Cryptosporidium hominis
NVVKLHKQFVIFLNKID

SEQ ID NO: 2126418 - protein, 24 aa, Cryptosporidium hominis
NVWILEGPHIWKVLIYDKMGQTIL

SEQ ID NO: 2126419 - protein, 24 aa, Cryptosporidium hominis
NVYELRYYLLFPHLETFENSCNDI

SEQ ID NO: 2126420 - protein, 22 aa, Cryptosporidium hominis
NVYRYNLFLSNGIHQVVFKVYY

SEQ ID NO: 2126421 - protein, 23 aa, Cryptosporidium hominis
NWCDRLVFHNCIGFELESMEISI

SEQ ID NO: 2126422 - protein, 44 aa, Cryptosporidium hominis
NWIDSIGIWNRIVFMMTNFIAIVSCYFLFIGLFEYNTRSVTFLL

SEQ ID NO: 2126423 - protein, 24 aa, Cryptosporidium hominis
NWLPESWRAYCLFIGENMMNKSSK

SEQ ID NO: 2126424 - protein, 25 aa, Cryptosporidium hominis
NWQFSFKSNHHFFSILLLLPFTASS

SEQ ID NO: 2126425 - protein, 29 aa, Cryptosporidium hominis
NWSLKRRVIDLIMEFPRSKSSILDLYITM

SEQ ID NO: 2126426 - protein, 18 aa, Cryptosporidium hominis
NWVVDVCWIIYDVKDGEG

SEQ ID NO: 2126427 - protein, 18 aa, Cryptosporidium hominis
NWYTLKPIFDISAGYTFN

SEQ ID NO: 2126428 - protein, 17 aa, Cryptosporidium hominis
NYALVFSYFITKVLEKP

SEQ ID NO: 2126429 - protein, 21 aa, Cryptosporidium hominis
NYARFPFKIFQDLRMDSKSGI

SEQ ID NO: 2126430 - protein, 24 aa, Cryptosporidium hominis
NYERIIISLINIFSLQGREYNAKF

SEQ ID NO: 2126431 - protein, 22 aa, Cryptosporidium hominis
NYFVLSSAFCFNRNINHTRNSL

SEQ ID NO: 2126432 - protein, 17 aa, Cryptosporidium hominis
NYGKITLSAYWLPQMHA

SEQ ID NO: 2126433 - protein, 17 aa, Cryptosporidium hominis
NYHYFWDPALLLNAFYS

SEQ ID NO: 2126434 - protein, 23 aa, Cryptosporidium hominis
NYIKRSRILNHINSLDLFREELL

SEQ ID NO: 2126435 - protein, 19 aa, Cryptosporidium hominis
NYIRLCLQGKTKLINNKLI

SEQ ID NO: 2126436 - protein, 33 aa, Cryptosporidium hominis
NYKQITMALKEHISNILGIHIQDIVIDEIYAEN

SEQ ID NO: 2126437 - protein, 17 aa, Cryptosporidium hominis
NYLNLFHSVFPYYRGEV

SEQ ID NO: 2126438 - protein, 22 aa, Cryptosporidium hominis
NYMVKKMLKYGFVLQDSDRKAT

SEQ ID NO: 2126439 - protein, 20 aa, Cryptosporidium hominis
NYNSIKEFWKITSVSNIILF

SEQ ID NO: 2126440 - protein, 20 aa, Cryptosporidium hominis
NYPIIYFASFIYKIKVKSSG

SEQ ID NO: 2126441 - protein, 17 aa, Cryptosporidium hominis
NYPKSSRPYGFSDVIYV

SEQ ID NO: 2126442 - protein, 19 aa, Cryptosporidium hominis
NYSCKILAFINLNGCILVK

SEQ ID NO: 2126443 - protein, 17 aa, Cryptosporidium hominis
NYSGFKIFSNSETIQQN

SEQ ID NO: 2126444 - protein, 22 aa, Cryptosporidium hominis
NYSLFRYCLNFNKITANLIRDI

SEQ ID NO: 2126445 - protein, 22 aa, Cryptosporidium hominis
NYYEEFLILIGYSLALEYFCEA

SEQ ID NO: 2126446 - protein, 20 aa, Cryptosporidium hominis
NYYHLFLFNFSYRYLQNPKT

SEQ ID NO: 2126447 - protein, 21 aa, Cryptosporidium hominis
NYYKPILLWIFRIKYNKNKAI

SEQ ID NO: 2126448 - protein, 42 aa, Cryptosporidium hominis
PADHLKPDFFYAFNSMPGWIQNRFIFASAFMEEFLVKHGNFV

SEQ ID NO: 2126449 - protein, 26 aa, Cryptosporidium hominis
PADVRLFVIGVRMFRSLNSPTVSVSY

SEQ ID NO: 2126450 - protein, 24 aa, Cryptosporidium hominis
PAEKSSWFSGWFGASETTPAPPPT

SEQ ID NO: 2126451 - protein, 23 aa, Cryptosporidium hominis
PAFDGEVILEFCIGPHSATTIAM

SEQ ID NO: 2126452 - protein, 30 aa, Cryptosporidium hominis
PAFDIIPFWVLICLLFCNYGKITLSAYWLP

SEQ ID NO: 2126453 - protein, 19 aa, Cryptosporidium hominis
PANMSVPIASFQNVIGRIH

SEQ ID NO: 2126454 - protein, 23 aa, Cryptosporidium hominis
PAQETSWFTGWFGIGAESSPPPP

SEQ ID NO: 2126455 - protein, 25 aa, Cryptosporidium hominis
PAVSIPCSIGIFFLLFLTSNIIWFF

SEQ ID NO: 2126456 - protein, 19 aa, Cryptosporidium hominis
PCAFFLFITISFVRGILLS

SEQ ID NO: 2126457 - protein, 22 aa, Cryptosporidium hominis
PCCHLCRSPIEIAWQLNPNESN

SEQ ID NO: 2126458 - protein, 29 aa, Cryptosporidium hominis
PCEQVHYWFLAYWAFRIGSGQILWDMASK

SEQ ID NO: 2126459 - protein, 17 aa, Cryptosporidium hominis
PCILYFISTSKWLFMQH

SEQ ID NO: 2126460 - protein, 18 aa, Cryptosporidium hominis
PCLSLIIVANSLPWIPDY

SEQ ID NO: 2126461 - protein, 20 aa, Cryptosporidium hominis
PCRENFFLIVCMMSLLISSV

SEQ ID NO: 2126462 - protein, 21 aa, Cryptosporidium hominis
PCSDSNLLFELWNGESKPTLI

SEQ ID NO: 2126463 - protein, 25 aa, Cryptosporidium hominis
PCSEYLLKLKLILKRNSRNKIIAKY

SEQ ID NO: 2126464 - protein, 20 aa, Cryptosporidium hominis
PCVRDSKFLVEMLLATECSS

SEQ ID NO: 2126465 - protein, 25 aa, Cryptosporidium hominis
PDADCELKWALSDSELALITKELIY

SEQ ID NO: 2126466 - protein, 17 aa, Cryptosporidium hominis
PDCEPCLEKFRDISKAY

SEQ ID NO: 2126467 - protein, 23 aa, Cryptosporidium hominis
PDDRIPYKFINYNSICKDFGDPL

SEQ ID NO: 2126468 - protein, 26 aa, Cryptosporidium hominis
PDFIKEWAEYEAESFIDRFRCLESEF

SEQ ID NO: 2126469 - protein, 25 aa, Cryptosporidium hominis
PDGIFKDYFCIQAINLWSDDQIVPN

SEQ ID NO: 2126470 - protein, 25 aa, Cryptosporidium hominis
PDIFIKEEILFLINYFKNNGFLEIE

SEQ ID NO: 2126471 - protein, 18 aa, Cryptosporidium hominis
PDIIKGLIPRYAGIFDCL

SEQ ID NO: 2126472 - protein, 18 aa, Cryptosporidium hominis
PDIRPLKNTLIEYCKNEL

SEQ ID NO: 2126473 - protein, 24 aa, Cryptosporidium hominis
PDITRLTMSFSYIFTSLAITCSVI

SEQ ID NO: 2126474 - protein, 19 aa, Cryptosporidium hominis
PDKILRSKLLKHIVSSIVN

SEQ ID NO: 2126475 - protein, 20 aa, Cryptosporidium hominis
PDLLWPLLIDAVNHLKLGSA

SEQ ID NO: 2126476 - protein, 20 aa, Cryptosporidium hominis
PDPLRINSVIVFNGENADFK

SEQ ID NO: 2126477 - protein, 17 aa, Cryptosporidium hominis
PDPRVMRRPPRRKDDNL

SEQ ID NO: 2126478 - protein, 27 aa, Cryptosporidium hominis
PDRTHHCRVCRTCVLKMDHHCPWISNC

SEQ ID NO: 2126479 - protein, 23 aa, Cryptosporidium hominis
PDSDECKCLSGLSSLDEEHDRMC

SEQ ID NO: 2126480 - protein, 25 aa, Cryptosporidium hominis
PDVGYCQGMGFIVGVLLMYMSEEDS

SEQ ID NO: 2126481 - protein, 20 aa, Cryptosporidium hominis
PDVVFACMATLLSICNRNEQ

SEQ ID NO: 2126482 - protein, 19 aa, Cryptosporidium hominis
PDVVIGLTILAYRYNGLRR

SEQ ID NO: 2126483 - protein, 21 aa, Cryptosporidium hominis
PDYFKNNILFYLNRGNHTYNL

SEQ ID NO: 2126484 - protein, 20 aa, Cryptosporidium hominis
PEACQFKLLSYFLTPSEFVF

SEQ ID NO: 2126485 - protein, 19 aa, Cryptosporidium hominis
PEAKLVLKLLKNGNFRCPI

SEQ ID NO: 2126486 - protein, 20 aa, Cryptosporidium hominis
PECLEEFLNGIVLNRSIPVG

SEQ ID NO: 2126487 - protein, 33 aa, Cryptosporidium hominis
PEDRLDRYNRMAALPLFRLFMKQDKEWINRQLE

SEQ ID NO: 2126488 - protein, 22 aa, Cryptosporidium hominis
PEDWPSQGKIEFRNVDMTFYPN

SEQ ID NO: 2126489 - protein, 19 aa, Cryptosporidium hominis
PEEQLLCTCLCKAIYSMLE

SEQ ID NO: 2126490 - protein, 21 aa, Cryptosporidium hominis
PEFLEFIFKFIDTINFASNSK

SEQ ID NO: 2126491 - protein, 18 aa, Cryptosporidium hominis
PEFLSRYEFYVEIKCNGT

SEQ ID NO: 2126492 - protein, 31 aa, Cryptosporidium hominis
PEGLPMVVTICLSIGCSEMCRRKANIRKLPA

SEQ ID NO: 2126493 - protein, 19 aa, Cryptosporidium hominis
PEIRKKLAKDSVNWHCNTC

SEQ ID NO: 2126494 - protein, 17 aa, Cryptosporidium hominis
PEKLLQISIAFSNSLSN

SEQ ID NO: 2126495 - protein, 17 aa, Cryptosporidium hominis
PELNNRLNLVTCAFEKE

SEQ ID NO: 2126496 - protein, 22 aa, Cryptosporidium hominis
PELPEVRYAASYLNNRPSRFPL

SEQ ID NO: 2126497 - protein, 25 aa, Cryptosporidium hominis
PEQLLDCFYFIFIVFIFETISDTGF

SEQ ID NO: 2126498 - protein, 28 aa, Cryptosporidium hominis
PERFSSSIACKGFAYIFAMTTLIIAYAI

SEQ ID NO: 2126499 - protein, 25 aa, Cryptosporidium hominis
PESRILWKTLRNQKRFYSLDWAFNV

SEQ ID NO: 2126500 - protein, 25 aa, Cryptosporidium hominis
PESRQKCSTILGWLATKYPNNYVLM

SEQ ID NO: 2126501 - protein, 21 aa, Cryptosporidium hominis
PETFEVKALNGYFPKKIKQAI

SEQ ID NO: 2126502 - protein, 28 aa, Cryptosporidium hominis
PETIILDGCIKDIVFAGSLFVPNYTSVY

SEQ ID NO: 2126503 - protein, 18 aa, Cryptosporidium hominis
PETMGVCNIGVYDESIFE

SEQ ID NO: 2126504 - protein, 22 aa, Cryptosporidium hominis
PEVLIFMSLAKVVIEWEESSIP

SEQ ID NO: 2126505 - protein, 19 aa, Cryptosporidium hominis
PEVQLSFKTRKFITDILMY

SEQ ID NO: 2126506 - protein, 28 aa, Cryptosporidium hominis
PEYLVSAFLLYLLICSFRELAFGSFSTS

SEQ ID NO: 2126507 - protein, 21 aa, Cryptosporidium hominis
PEYVGLIGLDGFHLIISQLLV

SEQ ID NO: 2126508 - protein, 25 aa, Cryptosporidium hominis
PFAELPFDGLVGLGFPDKNSKKNNI

SEQ ID NO: 2126509 - protein, 19 aa, Cryptosporidium hominis
PFERNYCTVYFNFFSIDEL

SEQ ID NO: 2126510 - protein, 27 aa, Cryptosporidium hominis
PFFARAWIAALPLTFISFFTHYSAAQS

SEQ ID NO: 2126511 - protein, 18 aa, Cryptosporidium hominis
PFGNLRGCVGVMGGHIIT

SEQ ID NO: 2126512 - protein, 17 aa, Cryptosporidium hominis
PFIFLGLFQSIFLCCSG

SEQ ID NO: 2126513 - protein, 26 aa, Cryptosporidium hominis
PFIQPSDEMLFFFKDYIENDVPLNDK

SEQ ID NO: 2126514 - protein, 21 aa, Cryptosporidium hominis
PFSMSLFRLNIIHFSFIYNLK

SEQ ID NO: 2126515 - protein, 23 aa, Cryptosporidium hominis
PFSVIVGWLLGKPMTLSFTPVSA

SEQ ID NO: 2126516 - protein, 24 aa, Cryptosporidium hominis
PFTKKLKYALAFILVLQLIVLLMR

SEQ ID NO: 2126517 - protein, 17 aa, Cryptosporidium hominis
PGAGPGPVLGPGTPGKP

SEQ ID NO: 2126518 - protein, 27 aa, Cryptosporidium hominis
PGDNFPGGIDFKHCFENIYSEKSLQIP

SEQ ID NO: 2126519 - protein, 19 aa, Cryptosporidium hominis
PGEECPILITKEAVRKMKS

SEQ ID NO: 2126520 - protein, 20 aa, Cryptosporidium hominis
PGFGMMSSWILLNISGIILS

SEQ ID NO: 2126521 - protein, 25 aa, Cryptosporidium hominis
PGGAEIFGVLGMMVGVIGCLQSTEV

SEQ ID NO: 2126522 - protein, 27 aa, Cryptosporidium hominis
PGHVVTAVASMEWRLLPKVRPDILNLF

SEQ ID NO: 2126523 - protein, 21 aa, Cryptosporidium hominis
PGIHINYDFTPFLVKMTESRR

SEQ ID NO: 2126524 - protein, 20 aa, Cryptosporidium hominis
PGILSFSFKPMRFSDNSPFR

SEQ ID NO: 2126525 - protein, 22 aa, Cryptosporidium hominis
PGKKVMGIYGFCDIRNFTDATE

SEQ ID NO: 2126526 - protein, 20 aa, Cryptosporidium hominis
PGPSRRRLSMMIATAGENSS

SEQ ID NO: 2126527 - protein, 22 aa, Cryptosporidium hominis
PGTCIPICFGSLILEVSNSIER

SEQ ID NO: 2126528 - protein, 20 aa, Cryptosporidium hominis
PGTYISILTCSVDNKGRTIL

SEQ ID NO: 2126529 - protein, 26 aa, Cryptosporidium hominis
PHALARMFRSIFCMCREGSANHGINN

SEQ ID NO: 2126530 - protein, 32 aa, Cryptosporidium hominis
PHKTKCAIEFWARDRPDLISAPSLGLDPDSIF

SEQ ID NO: 2126531 - protein, 24 aa, Cryptosporidium hominis
PIAKWLKVIVPLVVDCSDKSTKEC

SEQ ID NO: 2126532 - protein, 17 aa, Cryptosporidium hominis
PICRAPITIRDEEPEHS

SEQ ID NO: 2126533 - protein, 24 aa, Cryptosporidium hominis
PICRRLYLEKVYLIFQIFTLGIIS

SEQ ID NO: 2126534 - protein, 24 aa, Cryptosporidium hominis
PIEMKGWKLLHGDIFRSPKYRMIL

SEQ ID NO: 2126535 - protein, 19 aa, Cryptosporidium hominis
PIERYMLSYGLLNEYPIQD

SEQ ID NO: 2126536 - protein, 26 aa, Cryptosporidium hominis
PIFLIMMGLILFKIFLPMISASRNLQ

SEQ ID NO: 2126537 - protein, 26 aa, Cryptosporidium hominis
PIFSNYHILQSLLIIFLNMMILYTSA

SEQ ID NO: 2126538 - protein, 18 aa, Cryptosporidium hominis
PIFYAFYCVAKKYPPILR

SEQ ID NO: 2126539 - protein, 19 aa, Cryptosporidium hominis
PIILRIFSIILKRRNSNIP

SEQ ID NO: 2126540 - protein, 28 aa, Cryptosporidium hominis
PIINSRFKLAYSVLRERGFQNSKNKNRN

SEQ ID NO: 2126541 - protein, 17 aa, Cryptosporidium hominis
PIIPFKQVWDFAQTTMI

SEQ ID NO: 2126542 - protein, 22 aa, Cryptosporidium hominis
PIISAKLGWTAFIGLLVSAVLA

SEQ ID NO: 2126543 - protein, 23 aa, Cryptosporidium hominis
PILCQSYCNLWYDACYEDYFDNI

SEQ ID NO: 2126544 - protein, 31 aa, Cryptosporidium hominis
PILFKEMKSPIVGVGDICFGNNCNYYQESKE

SEQ ID NO: 2126545 - protein, 18 aa, Cryptosporidium hominis
PILRDFLEYLSHEYELER

SEQ ID NO: 2126546 - protein, 30 aa, Cryptosporidium hominis
PILSCFCLHYLWKYFEKEFGIITSLLSISI

SEQ ID NO: 2126547 - protein, 17 aa, Cryptosporidium hominis
PILVFCHKVDPRLGGAI

SEQ ID NO: 2126548 - protein, 25 aa, Cryptosporidium hominis
PILYKIKQPIGWMLYDPLLPIKFFG

SEQ ID NO: 2126549 - protein, 19 aa, Cryptosporidium hominis
PIPLIVILFSCLKYLIVNC

SEQ ID NO: 2126550 - protein, 18 aa, Cryptosporidium hominis
PIQVLRYLSISPLIFVVL

SEQ ID NO: 2126551 - protein, 17 aa, Cryptosporidium hominis
PITDCDYSMDWFSDNRG

SEQ ID NO: 2126552 - protein, 24 aa, Cryptosporidium hominis
PITDDLWYLMAHFRNPDSKMEDKI

SEQ ID NO: 2126553 - protein, 17 aa, Cryptosporidium hominis
PIVCTLTTIIFRVGGVG

SEQ ID NO: 2126554 - protein, 20 aa, Cryptosporidium hominis
PIVIILRSFDLFTIVAPPAL

SEQ ID NO: 2126555 - protein, 27 aa, Cryptosporidium hominis
PIVRYYCIHAGFGILYLFIFHWLIFLP

SEQ ID NO: 2126556 - protein, 20 aa, Cryptosporidium hominis
PKAFARFAILTTILNIQNNK

SEQ ID NO: 2126557 - protein, 31 aa, Cryptosporidium hominis
PKDQWFILICVVGFFLSMFGTFLIDAKSPFS

SEQ ID NO: 2126558 - protein, 35 aa, Cryptosporidium hominis
PKDVILLPCRHCISCESCLRSLRQDKCPLCRTTFS

SEQ ID NO: 2126559 - protein, 18 aa, Cryptosporidium hominis
PKESPGMISGPKYCNYKK

SEQ ID NO: 2126560 - protein, 39 aa, Cryptosporidium hominis
PKFCNSLCTLPFPGNDNWLLRRAFLPEVVIQRVAFCKEY

SEQ ID NO: 2126561 - protein, 19 aa, Cryptosporidium hominis
PKFVEFFFDSSIPIFFPSR

SEQ ID NO: 2126562 - protein, 20 aa, Cryptosporidium hominis
PKGLFFLSGDVHWGQIFESN

SEQ ID NO: 2126563 - protein, 23 aa, Cryptosporidium hominis
PKHRLKSKFPIRRNKGKNTNINH

SEQ ID NO: 2126564 - protein, 21 aa, Cryptosporidium hominis
PKIADFYPKEEISYIFKEPRK

SEQ ID NO: 2126565 - protein, 17 aa, Cryptosporidium hominis
PKIGRLVRLVVGVESRR

SEQ ID NO: 2126566 - protein, 20 aa, Cryptosporidium hominis
PKIIEAYVVSLFELCRNGNA

SEQ ID NO: 2126567 - protein, 18 aa, Cryptosporidium hominis
PKIIEKFIDLKVIYYQYL

SEQ ID NO: 2126568 - protein, 18 aa, Cryptosporidium hominis
PKINAIVVYKGSKDEIPK

SEQ ID NO: 2126569 - protein, 17 aa, Cryptosporidium hominis
PKKECLLENGFKYDSSI

SEQ ID NO: 2126570 - protein, 29 aa, Cryptosporidium hominis
PKKLEYLLNFSMLLCFDTILYDLTFLPIN

SEQ ID NO: 2126571 - protein, 19 aa, Cryptosporidium hominis
PKLDMNFILKINDENIRRM

SEQ ID NO: 2126572 - protein, 20 aa, Cryptosporidium hominis
PKLIKITFLLSILISTILCL

SEQ ID NO: 2126573 - protein, 19 aa, Cryptosporidium hominis
PKLIYEFFFCFSFSIYFLF

SEQ ID NO: 2126574 - protein, 19 aa, Cryptosporidium hominis
PKLSSGMCKSEMNLSLQKK

SEQ ID NO: 2126575 - protein, 19 aa, Cryptosporidium hominis
PKMKIDLFSYLEIMDKLGE

SEQ ID NO: 2126576 - protein, 18 aa, Cryptosporidium hominis
PKPKTILIQTAPITQPKP

SEQ ID NO: 2126577 - protein, 25 aa, Cryptosporidium hominis
PKPLRALCFVGGIFLSLASLLGIFS

SEQ ID NO: 2126578 - protein, 17 aa, Cryptosporidium hominis
PKQKCHYYLEDFKISLN

SEQ ID NO: 2126579 - protein, 17 aa, Cryptosporidium hominis
PKQPCMHDQDSSKVSRI

SEQ ID NO: 2126580 - protein, 17 aa, Cryptosporidium hominis
PKSEFGEDLGFEYTILE

SEQ ID NO: 2126581 - protein, 24 aa, Cryptosporidium hominis
PKSIIQFRFIFPLDKITDNFSEFS

SEQ ID NO: 2126582 - protein, 25 aa, Cryptosporidium hominis
PKSIKEMYSYIVVYLKDFRQFKSEV

SEQ ID NO: 2126583 - protein, 27 aa, Cryptosporidium hominis
PKSLFAAERVMLYWVRKTIYISTFVIL

SEQ ID NO: 2126584 - protein, 18 aa, Cryptosporidium hominis
PKSLKYLELIFCEELDWK

SEQ ID NO: 2126585 - protein, 24 aa, Cryptosporidium hominis
PKVKFSSLIFPWSAFLAVIISYVL

SEQ ID NO: 2126586 - protein, 20 aa, Cryptosporidium hominis
PKVNWKRTIVYFVRLNYLPR

SEQ ID NO: 2126587 - protein, 18 aa, Cryptosporidium hominis
PKVSSFKLLLLLKKDIHF

SEQ ID NO: 2126588 - protein, 17 aa, Cryptosporidium hominis
PKYKISIIALYFGSLLS

SEQ ID NO: 2126589 - protein, 26 aa, Cryptosporidium hominis
PLDFSNVRIWSGFCGLKNFEYLSYRS

SEQ ID NO: 2126590 - protein, 40 aa, Cryptosporidium hominis
PLDKLRSTMKWMACIEISLAVCSCCFALVQAVVLPFISPI

SEQ ID NO: 2126591 - protein, 18 aa, Cryptosporidium hominis
PLDSRLGTYYEFENEVKM

SEQ ID NO: 2126592 - protein, 18 aa, Cryptosporidium hominis
PLDVIKNYWIYKDSNEVF

SEQ ID NO: 2126593 - protein, 20 aa, Cryptosporidium hominis
PLEAETSWNRNSIFFNRTNS

SEQ ID NO: 2126594 - protein, 19 aa, Cryptosporidium hominis
PLEAWFVMRSQKALVLSGG

SEQ ID NO: 2126595 - protein, 18 aa, Cryptosporidium hominis
PLFGCYFASIASAYNEQL

SEQ ID NO: 2126596 - protein, 19 aa, Cryptosporidium hominis
PLFRSELCLVKSSNGIEKI

SEQ ID NO: 2126597 - protein, 20 aa, Cryptosporidium hominis
PLIPCGLSSITFYNDKFEIY

SEQ ID NO: 2126598 - protein, 24 aa, Cryptosporidium hominis
PLIRLHVFKLYLILITKFFLIFKF

SEQ ID NO: 2126599 - protein, 20 aa, Cryptosporidium hominis
PLIWIYRLRESFSKNRNHFW

SEQ ID NO: 2126600 - protein, 18 aa, Cryptosporidium hominis
PLKEAFFIHLKRFHRDIS

SEQ ID NO: 2126601 - protein, 17 aa, Cryptosporidium hominis
PLKLALEMFLKEGLTHI

SEQ ID NO: 2126602 - protein, 25 aa, Cryptosporidium hominis
PLKMAGWQLNLDWQTYNLKCMPNLS

SEQ ID NO: 2126603 - protein, 17 aa, Cryptosporidium hominis
PLKSSLKDLLILKNEYL

SEQ ID NO: 2126604 - protein, 25 aa, Cryptosporidium hominis
PLLILEFSSSLFLTLWLMLIALSGY

SEQ ID NO: 2126605 - protein, 17 aa, Cryptosporidium hominis
PLLPQHIPLVLSSCLTI

SEQ ID NO: 2126606 - protein, 18 aa, Cryptosporidium hominis
PLLPTGNILFCYYCEQPL

SEQ ID NO: 2126607 - protein, 23 aa, Cryptosporidium hominis
PLLTELRSLYGPPEFLNSENNIE

SEQ ID NO: 2126608 - protein, 18 aa, Cryptosporidium hominis
PLLYSYLFNMLGSFGPNQ

SEQ ID NO: 2126609 - protein, 19 aa, Cryptosporidium hominis
PLNNVDIWQLYPLAVIQKY

SEQ ID NO: 2126610 - protein, 17 aa, Cryptosporidium hominis
PLTNCAKNLSSLYKNLK

SEQ ID NO: 2126611 - protein, 42 aa, Cryptosporidium hominis
PLVARISKHLSFLLRKEPRLVYRECWRGDYFRQIGVHLIIEL

SEQ ID NO: 2126612 - protein, 33 aa, Cryptosporidium hominis
PLYCQNMMFAWLRLRLDFLLPVALTSINVLFSI

SEQ ID NO: 2126613 - protein, 19 aa, Cryptosporidium hominis
PLYGFPDKQFILLYLQEVL

SEQ ID NO: 2126614 - protein, 19 aa, Cryptosporidium hominis
PLYIMGDIFHVLKALYSKL

SEQ ID NO: 2126615 - protein, 18 aa, Cryptosporidium hominis
PLYTKFNLVLGHLSFSGI

SEQ ID NO: 2126616 - protein, 19 aa, Cryptosporidium hominis
PMEEICNLIEIIIRKMAQN

SEQ ID NO: 2126617 - protein, 26 aa, Cryptosporidium hominis
PMILSLGWRGPFYIFGLIGVIWSIVW

SEQ ID NO: 2126618 - protein, 17 aa, Cryptosporidium hominis
PMKEIFSKYSFGLSQKI

SEQ ID NO: 2126619 - protein, 23 aa, Cryptosporidium hominis
PMRASANMSSWCISPARTCSPLS

SEQ ID NO: 2126620 - protein, 24 aa, Cryptosporidium hominis
PMVFSWPSGNSFLEYFKARKSAES

SEQ ID NO: 2126621 - protein, 18 aa, Cryptosporidium hominis
PNCKEIFDKPDGDNRPAS

SEQ ID NO: 2126622 - protein, 19 aa, Cryptosporidium hominis
PNCRPKFPTKDSEDLHSNL

SEQ ID NO: 2126623 - protein, 17 aa, Cryptosporidium hominis
PNDKLVIIFSRRLKHVY

SEQ ID NO: 2126624 - protein, 21 aa, Cryptosporidium hominis
PNIFLPLSVMMLRVPYFTLKG

SEQ ID NO: 2126625 - protein, 18 aa, Cryptosporidium hominis
PNIKDLWEYPDLIMYAKM

SEQ ID NO: 2126626 - protein, 42 aa, Cryptosporidium hominis
PNILNIAISYYFIKLIRYSMLFWLPYYLIRELNYGPSVAGYS

SEQ ID NO: 2126627 - protein, 19 aa, Cryptosporidium hominis
PNPHLSKFSGLTKYKISSC

SEQ ID NO: 2126628 - protein, 21 aa, Cryptosporidium hominis
PPAPMKIVIPKSMIIFVSAAT

SEQ ID NO: 2126629 - protein, 24 aa, Cryptosporidium hominis
PPDWEYNFEKPIVCQNVTFYNKVD

SEQ ID NO: 2126630 - protein, 25 aa, Cryptosporidium hominis
PPFLFARLMAWLPLDCPEYSINNDK

SEQ ID NO: 2126631 - protein, 26 aa, Cryptosporidium hominis
PPFNLKSVPIMLGISLIPISHNISKN

SEQ ID NO: 2126632 - protein, 24 aa, Cryptosporidium hominis
PPFTLEIFQNIILITSFHSNHKVP

SEQ ID NO: 2126633 - protein, 22 aa, Cryptosporidium hominis
PPIGSCFDCYRPNQTPAEVTNQ

SEQ ID NO: 2126634 - protein, 25 aa, Cryptosporidium hominis
PPIVQRIFYGLCLLDDSNVASTTRF

SEQ ID NO: 2126635 - protein, 17 aa, Cryptosporidium hominis
PPKISQQSIAWSFLLIK

SEQ ID NO: 2126636 - protein, 24 aa, Cryptosporidium hominis
PPKSELYVALGFGFYSHALLNLLS

SEQ ID NO: 2126637 - protein, 17 aa, Cryptosporidium hominis
PPLDTSMMFCPLTKIGM

SEQ ID NO: 2126638 - protein, 21 aa, Cryptosporidium hominis
PPLIFKHSFISISLTKISSTF

SEQ ID NO: 2126639 - protein, 17 aa, Cryptosporidium hominis
PPLYWPNPIGVISFSDG

SEQ ID NO: 2126640 - protein, 18 aa, Cryptosporidium hominis
PPRNWPYQGRIEFHDLEL

SEQ ID NO: 2126641 - protein, 17 aa, Cryptosporidium hominis
PQFLIKCRIELNTYKKS

SEQ ID NO: 2126642 - protein, 20 aa, Cryptosporidium hominis
PQFWFGGWTHILAIRDIFDK

SEQ ID NO: 2126643 - protein, 20 aa, Cryptosporidium hominis
PQIPGCPCDPLLETRPTFYD

SEQ ID NO: 2126644 - protein, 19 aa, Cryptosporidium hominis
PQKSGHLINTLSIQSYVVL

SEQ ID NO: 2126645 - protein, 17 aa, Cryptosporidium hominis
PQMKCPLGTNLMNSYCI

SEQ ID NO: 2126646 - protein, 19 aa, Cryptosporidium hominis
PREILKDILGLASVSEVNG

SEQ ID NO: 2126647 - protein, 25 aa, Cryptosporidium hominis
PRFLVFEFAYSILLRKDQVELIHKL

SEQ ID NO: 2126648 - protein, 19 aa, Cryptosporidium hominis
PRGECRAFDELSDGFLRGE

SEQ ID NO: 2126649 - protein, 19 aa, Cryptosporidium hominis
PRGFGCFGMNTAYTVKKNS

SEQ ID NO: 2126650 - protein, 17 aa, Cryptosporidium hominis
PRGPLFVLGNNFIRKYY

SEQ ID NO: 2126651 - protein, 22 aa, Cryptosporidium hominis
PRIPVHITKATHNWHIKHHRET

SEQ ID NO: 2126652 - protein, 21 aa, Cryptosporidium hominis
PRKDQLIPLSGRFSNLFDKII

SEQ ID NO: 2126653 - protein, 19 aa, Cryptosporidium hominis
PRKRCHTCNNIFHSECIYK

SEQ ID NO: 2126654 - protein, 20 aa, Cryptosporidium hominis
PRLLHFKTLFVVLYIFPETG

SEQ ID NO: 2126655 - protein, 25 aa, Cryptosporidium hominis
PRNSLFLTMFCCIGGDSSVTRLKVS

SEQ ID NO: 2126656 - protein, 19 aa, Cryptosporidium hominis
PRPKFTVNKVVKLVLWLLG

SEQ ID NO: 2126657 - protein, 23 aa, Cryptosporidium hominis
PRRIEGISSLPFVQLTLGAFNSM

SEQ ID NO: 2126658 - protein, 20 aa, Cryptosporidium hominis
PRRLPQLLVLSIIGGLTVLG

SEQ ID NO: 2126659 - protein, 21 aa, Cryptosporidium hominis
PRSPLMGGWQFDYIVEYNLPL

SEQ ID NO: 2126660 - protein, 25 aa, Cryptosporidium hominis
PRTHHCSVCKRCIFKMDHHCPWINN

SEQ ID NO: 2126661 - protein, 17 aa, Cryptosporidium hominis
PRYKKRCVQQIAAFSKT

SEQ ID NO: 2126662 - protein, 25 aa, Cryptosporidium hominis
PRYTLECLKLLILNKSLFCNRELPE

SEQ ID NO: 2126663 - protein, 18 aa, Cryptosporidium hominis
PSAEEAFKRIALAFQTLS

SEQ ID NO: 2126664 - protein, 27 aa, Cryptosporidium hominis
PSCMKETGIILGLLIMFFSCFVLFMTQ

SEQ ID NO: 2126665 - protein, 18 aa, Cryptosporidium hominis
PSCNDFFKGCESISKQYF

SEQ ID NO: 2126666 - protein, 23 aa, Cryptosporidium hominis
PSDFDLVLEKYIFGIITFLSEKI

SEQ ID NO: 2126667 - protein, 25 aa, Cryptosporidium hominis
PSECGILDWYCILNRIYIAGQTLGY

SEQ ID NO: 2126668 - protein, 33 aa, Cryptosporidium hominis
PSEWNYKVLFLFLRILGLTLFVEHLLIHTIKIE

SEQ ID NO: 2126669 - protein, 23 aa, Cryptosporidium hominis
PSEYKFSILQVKAPRCSKLRSLL

SEQ ID NO: 2126670 - protein, 25 aa, Cryptosporidium hominis
PSIFRKSRGLFPVYSIAVFCAELHM

SEQ ID NO: 2126671 - protein, 26 aa, Cryptosporidium hominis
PSIICSSLECSNCNEIIDMNISHNHE

SEQ ID NO: 2126672 - protein, 18 aa, Cryptosporidium hominis
PSILFLCRVFTLQPNGFD

SEQ ID NO: 2126673 - protein, 34 aa, Cryptosporidium hominis
PSKDFLLKFVNICFTNVIGSLLFRRETNKTTRGN

SEQ ID NO: 2126674 - protein, 19 aa, Cryptosporidium hominis
PSKPCSWETVGPAARGLTC

SEQ ID NO: 2126675 - protein, 21 aa, Cryptosporidium hominis
PSLHIKRWAFDIEIVIIAQIL

SEQ ID NO: 2126676 - protein, 20 aa, Cryptosporidium hominis
PSLILTSGWIFIRCALGGPL

SEQ ID NO: 2126677 - protein, 20 aa, Cryptosporidium hominis
PSLLDGCFQLFALFIENHEN

SEQ ID NO: 2126678 - protein, 31 aa, Cryptosporidium hominis
PSLMALNLMEYRSLRISEWVVIVDQLEIDKK

SEQ ID NO: 2126679 - protein, 18 aa, Cryptosporidium hominis
PSLSYFTCIGSWLRHSRT

SEQ ID NO: 2126680 - protein, 18 aa, Cryptosporidium hominis
PSNFFYFHLFYVISSFIM

SEQ ID NO: 2126681 - protein, 26 aa, Cryptosporidium hominis
PSNSIDISYQFLFLIYRKILVSKTKC

SEQ ID NO: 2126682 - protein, 24 aa, Cryptosporidium hominis
PSPNEFLQYFSIAAGINSLIFSLS

SEQ ID NO: 2126683 - protein, 24 aa, Cryptosporidium hominis
PSPRKSLRLQPDYNKDEDLNERRH

SEQ ID NO: 2126684 - protein, 18 aa, Cryptosporidium hominis
PSPYVVGLSTIFGGITHE

SEQ ID NO: 2126685 - protein, 23 aa, Cryptosporidium hominis
PSQIRFVHYFSFLLKHTFPESVI

SEQ ID NO: 2126686 - protein, 18 aa, Cryptosporidium hominis
PSSAFLESFFGHRTIFNG

SEQ ID NO: 2126687 - protein, 18 aa, Cryptosporidium hominis
PSSFKIFFSPSPEPITIF

SEQ ID NO: 2126688 - protein, 24 aa, Cryptosporidium hominis
PSSRLKYSSEFLGQLSEYILPKLS

SEQ ID NO: 2126689 - protein, 17 aa, Cryptosporidium hominis
PSTINWNFGEIKSNNSN

SEQ ID NO: 2126690 - protein, 24 aa, Cryptosporidium hominis
PSTLGRLALMFKDSIREFSIQGNP

SEQ ID NO: 2126691 - protein, 18 aa, Cryptosporidium hominis
PSVYESHYPWSIVSGKFW

SEQ ID NO: 2126692 - protein, 17 aa, Cryptosporidium hominis
PSWGLLLFWLFSALESS

SEQ ID NO: 2126693 - protein, 22 aa, Cryptosporidium hominis
PTACAIARSIGLLADEREYNNS

SEQ ID NO: 2126694 - protein, 24 aa, Cryptosporidium hominis
PTCEGCPKSNLEIMTDAMSIISNS

SEQ ID NO: 2126695 - protein, 17 aa, Cryptosporidium hominis
PTCSDIFERAIKIRKNQ

SEQ ID NO: 2126696 - protein, 21 aa, Cryptosporidium hominis
PTEKSSPVQLCYPDLSMTLGF

SEQ ID NO: 2126697 - protein, 21 aa, Cryptosporidium hominis
PTIDVLLCLFICFNATQISTF

SEQ ID NO: 2126698 - protein, 18 aa, Cryptosporidium hominis
PTIIEFGILLIITVINII

SEQ ID NO: 2126699 - protein, 21 aa, Cryptosporidium hominis
PTILLIPAIVRKDITIGGRAA

SEQ ID NO: 2126700 - protein, 17 aa, Cryptosporidium hominis
PTIPAWPGSSGRPSRIP

SEQ ID NO: 2126701 - protein, 19 aa, Cryptosporidium hominis
PTLDFFPYMFKDCSKKDEN

SEQ ID NO: 2126702 - protein, 23 aa, Cryptosporidium hominis
PTMCFQFWYPRTGGIRWLQVIKH

SEQ ID NO: 2126703 - protein, 25 aa, Cryptosporidium hominis
PTNKELRKGIEINYKNLSPIKEELL

SEQ ID NO: 2126704 - protein, 26 aa, Cryptosporidium hominis
PTQLISIELFGSVLIDEVSILTFVIS

SEQ ID NO: 2126705 - protein, 17 aa, Cryptosporidium hominis
PTQYPILKLQLWSYGLI

SEQ ID NO: 2126706 - protein, 23 aa, Cryptosporidium hominis
PTRAARRGEWAFVVISGNQTPAE

SEQ ID NO: 2126707 - protein, 32 aa, Cryptosporidium hominis
PTSIKSLFLKTVFLFRILRYWNNDITSSSGLK

SEQ ID NO: 2126708 - protein, 24 aa, Cryptosporidium hominis
PTTAEFLMVLGILLHKVGSEVALI

SEQ ID NO: 2126709 - protein, 27 aa, Cryptosporidium hominis
PVAKDGGLPCIVWLLLAIVHCSVNGNK

SEQ ID NO: 2126710 - protein, 23 aa, Cryptosporidium hominis
PVEESSWFSGWFGASETTPAPPP

SEQ ID NO: 2126711 - protein, 22 aa, Cryptosporidium hominis
PVESNWRYLALLYSLLISDTTG

SEQ ID NO: 2126712 - protein, 21 aa, Cryptosporidium hominis
PVFYGIYGIDVPKYLLDLPYL

SEQ ID NO: 2126713 - protein, 21 aa, Cryptosporidium hominis
PVKEYYRFLDMESIAKESPYW

SEQ ID NO: 2126714 - protein, 26 aa, Cryptosporidium hominis
PVLKFFCIKLIIFMSFWQSIILSVLS

SEQ ID NO: 2126715 - protein, 26 aa, Cryptosporidium hominis
PVLRLLKYWLHIRRLPVAKDGGLPCI

SEQ ID NO: 2126716 - protein, 20 aa, Cryptosporidium hominis
PVNINRISKVPILSICNENN

SEQ ID NO: 2126717 - protein, 17 aa, Cryptosporidium hominis
PVPRPMLPFPGNKTETS

SEQ ID NO: 2126718 - protein, 26 aa, Cryptosporidium hominis
PVSNEFRNEFGIYFDPLWFIDLPFMY

SEQ ID NO: 2126719 - protein, 17 aa, Cryptosporidium hominis
PVTKLLLSFFVILFICF

SEQ ID NO: 2126720 - protein, 19 aa, Cryptosporidium hominis
PVTTLVFFSPRLVGKEATE

SEQ ID NO: 2126721 - protein, 19 aa, Cryptosporidium hominis
PWLHEFLNALVCAWTLFSL

SEQ ID NO: 2126722 - protein, 24 aa, Cryptosporidium hominis
PWRFSEIVSVALFFVFGVIFFECD

SEQ ID NO: 2126723 - protein, 23 aa, Cryptosporidium hominis
PWVSSKYSYKWNVISGTYGDVIC

SEQ ID NO: 2126724 - protein, 23 aa, Cryptosporidium hominis
PWYSMPDFIALLLEDILKITSIM

SEQ ID NO: 2126725 - protein, 17 aa, Cryptosporidium hominis
PYFILSIIEVTSKNIKN

SEQ ID NO: 2126726 - protein, 17 aa, Cryptosporidium hominis
PYFLSTFSIGIIFRLLY

SEQ ID NO: 2126727 - protein, 18 aa, Cryptosporidium hominis
PYGAHSNSTWVFRNNNGI

SEQ ID NO: 2126728 - protein, 25 aa, Cryptosporidium hominis
PYHGLRSPIGLTFLNGFAVSLACTP

SEQ ID NO: 2126729 - protein, 20 aa, Cryptosporidium hominis
PYLSSLRIFVALRIFHFNNK

SEQ ID NO: 2126730 - protein, 18 aa, Cryptosporidium hominis
PYPIGVTFSQLLVGMMLA

SEQ ID NO: 2126731 - protein, 21 aa, Cryptosporidium hominis
PYPRYWGLLTVIGRRTQSHNE

SEQ ID NO: 2126732 - protein, 32 aa, Cryptosporidium hominis
PYSDFRGVGILALICLLYFSLAHPFESKLIHR

SEQ ID NO: 2126733 - protein, 29 aa, Cryptosporidium hominis
PYSDLSNIILFCMKNLIYSRSVMMPNSEC

SEQ ID NO: 2126734 - protein, 21 aa, Cryptosporidium hominis
PYSKNCIGFKLGPKEEMKRLP

SEQ ID NO: 2126735 - protein, 34 aa, Cryptosporidium hominis
PYSPKKLEVIFSIISFLFLRSFEDIKYYYNKLST

SEQ ID NO: 2126736 - protein, 24 aa, Cryptosporidium hominis
PYVKSEPMLHLFFYNSLNNNLSST

SEQ ID NO: 2126737 - protein, 17 aa, Cryptosporidium hominis
PYYWLQYFVNNVSVIPI

SEQ ID NO: 2126738 - protein, 21 aa, Cryptosporidium hominis
QADREIPIFFGSSRNSLYLKN

SEQ ID NO: 2126739 - protein, 20 aa, Cryptosporidium hominis
QAFMAFRMAIQKAVYFDTSS

SEQ ID NO: 2126740 - protein, 26 aa, Cryptosporidium hominis
QAIIRKGRIESIGYFKPLKVPFLSWS

SEQ ID NO: 2126741 - protein, 19 aa, Cryptosporidium hominis
QAIQFRLQFIQQWSDIIAK

SEQ ID NO: 2126742 - protein, 25 aa, Cryptosporidium hominis
QALKETRIQLYLGNFQDSPKIMPKK

SEQ ID NO: 2126743 - protein, 25 aa, Cryptosporidium hominis
QAMFFLNIIRIIFIIHFFTLIHGTE

SEQ ID NO: 2126744 - protein, 22 aa, Cryptosporidium hominis
QAMIPAMAWLFIDIFCTLLPLL

SEQ ID NO: 2126745 - protein, 18 aa, Cryptosporidium hominis
QANGFVFLDIGIDGFYNG

SEQ ID NO: 2126746 - protein, 25 aa, Cryptosporidium hominis
QAQMSVLIRCVRYYYGAHNGTRIPS

SEQ ID NO: 2126747 - protein, 19 aa, Cryptosporidium hominis
QAQYKSGGISPLIVSELNT

SEQ ID NO: 2126748 - protein, 26 aa, Cryptosporidium hominis
QCGNFGGGEKVLWCIIYEVLNTNIKN

SEQ ID NO: 2126749 - protein, 25 aa, Cryptosporidium hominis
QCNAYCTYFYFPLITDMRIMSSIQL

SEQ ID NO: 2126750 - protein, 23 aa, Cryptosporidium hominis
QCQQCGTHLDAYYDPFKSITKRE

SEQ ID NO: 2126751 - protein, 23 aa, Cryptosporidium hominis
QCSKPWKLKFLNYFIPPLYDCYP

SEQ ID NO: 2126752 - protein, 19 aa, Cryptosporidium hominis
QCSSIMILLELLKVEAETF

SEQ ID NO: 2126753 - protein, 20 aa, Cryptosporidium hominis
QDHHVKCCYVCIEKRKTMLL

SEQ ID NO: 2126754 - protein, 19 aa, Cryptosporidium hominis
QDLLTGILFQPLLRNYDKV

SEQ ID NO: 2126755 - protein, 22 aa, Cryptosporidium hominis
QDSRSGLKLVSYIEYWNQKEFE

SEQ ID NO: 2126756 - protein, 23 aa, Cryptosporidium hominis
QDVWRCDIIFQIFQSFVDLSEVR

SEQ ID NO: 2126757 - protein, 26 aa, Cryptosporidium hominis
QEDIPFISGFLYGISLTGFFKADKSD

SEQ ID NO: 2126758 - protein, 21 aa, Cryptosporidium hominis
QEEASRLSKLTNMTTNQASLV

SEQ ID NO: 2126759 - protein, 28 aa, Cryptosporidium hominis
QEGLRMIKRSALMGSLRSFGLEFIQSDS

SEQ ID NO: 2126760 - protein, 20 aa, Cryptosporidium hominis
QEHYCSIGYIPLDIPAPRGP

SEQ ID NO: 2126761 - protein, 24 aa, Cryptosporidium hominis
QEIKEPAGMVWACCFANEIDFPMI

SEQ ID NO: 2126762 - protein, 18 aa, Cryptosporidium hominis
QEKGGFSLKNIWNYDKDA

SEQ ID NO: 2126763 - protein, 24 aa, Cryptosporidium hominis
QELNKFKYPWLHIPNLKNFKENIQ

SEQ ID NO: 2126764 - protein, 17 aa, Cryptosporidium hominis
QEYKSGSLITYSRNYST

SEQ ID NO: 2126765 - protein, 19 aa, Cryptosporidium hominis
QFAKFFWHLLNSIREKYYP

SEQ ID NO: 2126766 - protein, 19 aa, Cryptosporidium hominis
QFIGISAFIGYIIIVLSLF

SEQ ID NO: 2126767 - protein, 39 aa, Cryptosporidium hominis
QFIQEFKSLVSFSIFYIWSLSCVYLLFGLTTSKCSIFPK

SEQ ID NO: 2126768 - protein, 22 aa, Cryptosporidium hominis
QFLDILLKFSIIYLLIQMSFWP

SEQ ID NO: 2126769 - protein, 17 aa, Cryptosporidium hominis
QFLISFVSFFYSKLRPI

SEQ ID NO: 2126770 - protein, 17 aa, Cryptosporidium hominis
QFLNCIIPFIIYSEILR

SEQ ID NO: 2126771 - protein, 26 aa, Cryptosporidium hominis
QFMKIIDYILRFKLPQIYTLIEGNPF

SEQ ID NO: 2126772 - protein, 32 aa, Cryptosporidium hominis
QFMRDFISQIAFCYRISSVFLISKLNSLSRSY

SEQ ID NO: 2126773 - protein, 19 aa, Cryptosporidium hominis
QFSASFIVSISWVAAMFVS

SEQ ID NO: 2126774 - protein, 25 aa, Cryptosporidium hominis
QFVILCNIISLRLYHIHVINGEIQK

SEQ ID NO: 2126775 - protein, 17 aa, Cryptosporidium hominis
QGEILKYYLGWSSSSAL

SEQ ID NO: 2126776 - protein, 17 aa, Cryptosporidium hominis
QGFSVTQNALWNSIEIH

SEQ ID NO: 2126777 - protein, 20 aa, Cryptosporidium hominis
QGISDPYFILSIIEVTSKNI

SEQ ID NO: 2126778 - protein, 20 aa, Cryptosporidium hominis
QGNSFSWGLFTFFFALGSMN

SEQ ID NO: 2126779 - protein, 21 aa, Cryptosporidium hominis
QHAPKLLSVYLQILNSLLSKK

SEQ ID NO: 2126780 - protein, 22 aa, Cryptosporidium hominis
QHELKLGLEFEKYLEKVDINDI

SEQ ID NO: 2126781 - protein, 17 aa, Cryptosporidium hominis
QHIPLVLSSCLTILVTV

SEQ ID NO: 2126782 - protein, 21 aa, Cryptosporidium hominis
QHLIGCIGFLFWSLVCNYLKP

SEQ ID NO: 2126783 - protein, 21 aa, Cryptosporidium hominis
QHLLYTIGINFESVVTPWFRH

SEQ ID NO: 2126784 - protein, 24 aa, Cryptosporidium hominis
QHRFIGRRAALRFQESIQGGESSS

SEQ ID NO: 2126785 - protein, 22 aa, Cryptosporidium hominis
QHWIYRNWVPLILGDKPSEIMG

SEQ ID NO: 2126786 - protein, 25 aa, Cryptosporidium hominis
QIECTPCSRVFHIFRKKGVGYSSPP

SEQ ID NO: 2126787 - protein, 24 aa, Cryptosporidium hominis
QIEFPRLHLSFVRRERDRSNTLLT

SEQ ID NO: 2126788 - protein, 29 aa, Cryptosporidium hominis
QIELSSLFLKEGILIWILSKEIFAPVSNR

SEQ ID NO: 2126789 - protein, 25 aa, Cryptosporidium hominis
QIFLKLIIYLIKWVKHNKFLLQDSL

SEQ ID NO: 2126790 - protein, 26 aa, Cryptosporidium hominis
QIGLNRLGGFIGFMSLIVLVIIVIVA

SEQ ID NO: 2126791 - protein, 34 aa, Cryptosporidium hominis
QIKGGYYFQYDFVLRYIFLNSLKISTIAQFDSLK

SEQ ID NO: 2126792 - protein, 19 aa, Cryptosporidium hominis
QIKTEVILQLLLSQTQIVA

SEQ ID NO: 2126793 - protein, 19 aa, Cryptosporidium hominis
QILGLRFAIVLVLSALLYP

SEQ ID NO: 2126794 - protein, 21 aa, Cryptosporidium hominis
QILVYGCILLTSLIFITIYLF

SEQ ID NO: 2126795 - protein, 34 aa, Cryptosporidium hominis
QIMLLNCFIDFIQFRKLGPFSHLWFHRTTFANPK

SEQ ID NO: 2126796 - protein, 17 aa, Cryptosporidium hominis
QINPGILSFSFKPMRFS

SEQ ID NO: 2126797 - protein, 18 aa, Cryptosporidium hominis
QIPEARMYYAFQMSIEQI

SEQ ID NO: 2126798 - protein, 18 aa, Cryptosporidium hominis
QIQACWRSFLTRFGASLC

SEQ ID NO: 2126799 - protein, 31 aa, Cryptosporidium hominis
QIQKSECILIYKIHSNWGYFRSIFITSDGIE

SEQ ID NO: 2126800 - protein, 18 aa, Cryptosporidium hominis
QIQPRSPLMGGWQFDYIV

SEQ ID NO: 2126801 - protein, 28 aa, Cryptosporidium hominis
QIQPVLQFIYRKCVELRFTVNNENLNLN

SEQ ID NO: 2126802 - protein, 34 aa, Cryptosporidium hominis
QIRRLCDDESYIISRGWKHICKKITQCLIESPYG

SEQ ID NO: 2126803 - protein, 22 aa, Cryptosporidium hominis
QISEALRFYSFLHLFNSGSEEN

SEQ ID NO: 2126804 - protein, 17 aa, Cryptosporidium hominis
QISFKIRNTELFIGPLS

SEQ ID NO: 2126805 - protein, 33 aa, Cryptosporidium hominis
QISIFPGEVPGAALLRKRVYRRLNNIEDIVNTF

SEQ ID NO: 2126806 - protein, 24 aa, Cryptosporidium hominis
QISNKRAKFIVFIDEIDLARSNRN

SEQ ID NO: 2126807 - protein, 20 aa, Cryptosporidium hominis
QITEEEWVRFCVGIYDSRKK

SEQ ID NO: 2126808 - protein, 18 aa, Cryptosporidium hominis
QIVLRIRKYSSFGGAEFF

SEQ ID NO: 2126809 - protein, 25 aa, Cryptosporidium hominis
QKEPSSYWCAFPINMDEPYEWHFTI

SEQ ID NO: 2126810 - protein, 18 aa, Cryptosporidium hominis
QKIFPFQLSPNISLVAPE

SEQ ID NO: 2126811 - protein, 21 aa, Cryptosporidium hominis
QKITTCLLFRGRRTIRRSDYN

SEQ ID NO: 2126812 - protein, 21 aa, Cryptosporidium hominis
QKKPLSIFIENFFLNFLSQDE

SEQ ID NO: 2126813 - protein, 19 aa, Cryptosporidium hominis
QKLHCKSSREIAIGILSPF

SEQ ID NO: 2126814 - protein, 17 aa, Cryptosporidium hominis
QKLIISFAMLENHKLLN

SEQ ID NO: 2126815 - protein, 19 aa, Cryptosporidium hominis
QKLKAYPSRYEMLALITMI

SEQ ID NO: 2126816 - protein, 23 aa, Cryptosporidium hominis
QKNICATISQAAYRIKNQRNWII

SEQ ID NO: 2126817 - protein, 21 aa, Cryptosporidium hominis
QKQLICLARAILRKSKIILLD

SEQ ID NO: 2126818 - protein, 22 aa, Cryptosporidium hominis
QKRITFSKSLPWVIFQNNKHFS

SEQ ID NO: 2126819 - protein, 18 aa, Cryptosporidium hominis
QKSLCSYCDADIGVGKKV

SEQ ID NO: 2126820 - protein, 24 aa, Cryptosporidium hominis
QLAKSCTNLGLISLFEEQICRLNI

SEQ ID NO: 2126821 - protein, 29 aa, Cryptosporidium hominis
QLDFSINFWERFCNFLRKSINKKFTLFYF

SEQ ID NO: 2126822 - protein, 18 aa, Cryptosporidium hominis
QLFFLSVVLIFSSITTSN

SEQ ID NO: 2126823 - protein, 25 aa, Cryptosporidium hominis
QLFILCFLSLIILFVIPLAFIIYYR

SEQ ID NO: 2126824 - protein, 17 aa, Cryptosporidium hominis
QLFIPAIELTFFTFCGS

SEQ ID NO: 2126825 - protein, 25 aa, Cryptosporidium hominis
QLFSYEYFTFMALFIYNFWRCSILV

SEQ ID NO: 2126826 - protein, 19 aa, Cryptosporidium hominis
QLIICYKSLYSPVISSINS

SEQ ID NO: 2126827 - protein, 19 aa, Cryptosporidium hominis
QLILIRFTFIFDYEIQQIL

SEQ ID NO: 2126828 - protein, 26 aa, Cryptosporidium hominis
QLIPELRTGPLFTYIAPLLLVLSITI

SEQ ID NO: 2126829 - protein, 18 aa, Cryptosporidium hominis
QLIRLSIPDWEPMKKLFN

SEQ ID NO: 2126830 - protein, 26 aa, Cryptosporidium hominis
QLNRLKRKLFNTKFPTEMIGHSNFTP

SEQ ID NO: 2126831 - protein, 25 aa, Cryptosporidium hominis
QLSVGIKQLFCLTRAILRKSRILLL

SEQ ID NO: 2126832 - protein, 24 aa, Cryptosporidium hominis
QLTLWEIMKQFYLINNLFFILKVL

SEQ ID NO: 2126833 - protein, 22 aa, Cryptosporidium hominis
QMIMLRDGFRIIEISQCGVSLE

SEQ ID NO: 2126834 - protein, 18 aa, Cryptosporidium hominis
QMLISRSVGKGSTLSKLL

SEQ ID NO: 2126835 - protein, 24 aa, Cryptosporidium hominis
QNDILKLRWTNPLGEDVNDWESPG

SEQ ID NO: 2126836 - protein, 23 aa, Cryptosporidium hominis
QNELACLDEPFLPKSNNLSLYSY

SEQ ID NO: 2126837 - protein, 18 aa, Cryptosporidium hominis
QNGLPLLVGNVMAASPCP

SEQ ID NO: 2126838 - protein, 19 aa, Cryptosporidium hominis
QNIDFCLKSGSSKALQRSL

SEQ ID NO: 2126839 - protein, 25 aa, Cryptosporidium hominis
QNIPKEIFQLMIFIAQTCPYYYKYG

SEQ ID NO: 2126840 - protein, 23 aa, Cryptosporidium hominis
QNKLCKNEVNFYITIEAPYKTML

SEQ ID NO: 2126841 - protein, 23 aa, Cryptosporidium hominis
QNLFKVRWVIRGIYENNPWYSNL

SEQ ID NO: 2126842 - protein, 18 aa, Cryptosporidium hominis
QNLRWKKSDISILIGVNL

SEQ ID NO: 2126843 - protein, 22 aa, Cryptosporidium hominis
QNSCLFSIIILDVISESLRSME

SEQ ID NO: 2126844 - protein, 23 aa, Cryptosporidium hominis
QPDIPFNHGYIWGPLPITCFIDV

SEQ ID NO: 2126845 - protein, 20 aa, Cryptosporidium hominis
QPFNSLPIFHKLVTNNIKFN

SEQ ID NO: 2126846 - protein, 28 aa, Cryptosporidium hominis
QPQGGPRTHLMMLIFFGGNILRGLFTNS

SEQ ID NO: 2126847 - protein, 18 aa, Cryptosporidium hominis
QPQNIPWWIYLLIIILGF

SEQ ID NO: 2126848 - protein, 22 aa, Cryptosporidium hominis
QPTSCRGGSVIGLCSSKLANGY

SEQ ID NO: 2126849 - protein, 20 aa, Cryptosporidium hominis
QPYGFSFRRRFMDLMFKGTS

SEQ ID NO: 2126850 - protein, 28 aa, Cryptosporidium hominis
QPYQGGWKFGILVIQSFLIIVIDSIIKL

SEQ ID NO: 2126851 - protein, 24 aa, Cryptosporidium hominis
QQAAYSYFRLWSIWLTSSFCILIT

SEQ ID NO: 2126852 - protein, 31 aa, Cryptosporidium hominis
QQIPSWWVVFWPCWFWCGVIFSFSTVFCVLG

SEQ ID NO: 2126853 - protein, 17 aa, Cryptosporidium hominis
QQISTICIFGCGIVILG

SEQ ID NO: 2126854 - protein, 32 aa, Cryptosporidium hominis
QQLINRFGIVAVPSFRFFRNGKMYTYTGMRNA

SEQ ID NO: 2126855 - protein, 18 aa, Cryptosporidium hominis
QQMRGCYNSNIVQNSHSN

SEQ ID NO: 2126856 - protein, 20 aa, Cryptosporidium hominis
QQQTCPICRAPITIRDEEPE

SEQ ID NO: 2126857 - protein, 19 aa, Cryptosporidium hominis
QQRMFPSYSSAATRERGNH

SEQ ID NO: 2126858 - protein, 25 aa, Cryptosporidium hominis
QQVYKILKGCAGFVPRQYIDSRVTE

SEQ ID NO: 2126859 - protein, 17 aa, Cryptosporidium hominis
QQYRFPFLNAPSRMEFI

SEQ ID NO: 2126860 - protein, 26 aa, Cryptosporidium hominis
QRFARIRHPGIINVSFLWPAVDCEPS

SEQ ID NO: 2126861 - protein, 17 aa, Cryptosporidium hominis
QRIMILKNTLAILNKSI

SEQ ID NO: 2126862 - protein, 23 aa, Cryptosporidium hominis
QRKTYIIKGICSLLNSFDFQINE

SEQ ID NO: 2126863 - protein, 22 aa, Cryptosporidium hominis
QRLADLPLLISTIVEGNNSKIR

SEQ ID NO: 2126864 - protein, 17 aa, Cryptosporidium hominis
QRLVCKFISSFNKIVYD

SEQ ID NO: 2126865 - protein, 23 aa, Cryptosporidium hominis
QSFRTDMWLSPIGMEHEKKTDHV

SEQ ID NO: 2126866 - protein, 21 aa, Cryptosporidium hominis
QSFSYARSRAEAVENVQRMIG

SEQ ID NO: 2126867 - protein, 21 aa, Cryptosporidium hominis
QSHDIPMYWLVPLLVSCLGSK

SEQ ID NO: 2126868 - protein, 26 aa, Cryptosporidium hominis
QSIFSHPLVIIFIFILVVCMFAGGSL

SEQ ID NO: 2126869 - protein, 18 aa, Cryptosporidium hominis
QSIIKYLFFFIQIISLIY

SEQ ID NO: 2126870 - protein, 24 aa, Cryptosporidium hominis
QSIRQRLKIILSILSKDISKDYKS

SEQ ID NO: 2126871 - protein, 18 aa, Cryptosporidium hominis
QSIRWIIHRICSDTDDGE

SEQ ID NO: 2126872 - protein, 18 aa, Cryptosporidium hominis
QSISPNFIKPYGIISSSY

SEQ ID NO: 2126873 - protein, 19 aa, Cryptosporidium hominis
QSKLFSFQFPWSHQSHDIP

SEQ ID NO: 2126874 - protein, 18 aa, Cryptosporidium hominis
QSLIPCSILFLKALESCI

SEQ ID NO: 2126875 - protein, 24 aa, Cryptosporidium hominis
QSLLKLRQRIIFSSLNILPRWIST

SEQ ID NO: 2126876 - protein, 25 aa, Cryptosporidium hominis
QSLREKLHIIWKISEGCDSEKKLVD

SEQ ID NO: 2126877 - protein, 25 aa, Cryptosporidium hominis
QSPSARFQILISLIILIDSTKTLKE

SEQ ID NO: 2126878 - protein, 18 aa, Cryptosporidium hominis
QSTMGGRYGGTGILMSTS

SEQ ID NO: 2126879 - protein, 29 aa, Cryptosporidium hominis
QSTYQSICYIWLWDLFVEYFGGSEQIVTA

SEQ ID NO: 2126880 - protein, 27 aa, Cryptosporidium hominis
QSYVVLPGRCAYGASKRACLSFFQALR

SEQ ID NO: 2126881 - protein, 24 aa, Cryptosporidium hominis
QTAAWACKHLALGVAGTGCNDALI

SEQ ID NO: 2126882 - protein, 24 aa, Cryptosporidium hominis
QTENLFFRAIEYLDKFTNTFQSIL

SEQ ID NO: 2126883 - protein, 18 aa, Cryptosporidium hominis
QTLFRLKSDIVFHSLQCY

SEQ ID NO: 2126884 - protein, 23 aa, Cryptosporidium hominis
QTLQKLASVLFFHLVNKSFIQDQ

SEQ ID NO: 2126885 - protein, 17 aa, Cryptosporidium hominis
QTNTGVLDFELCELHEP

SEQ ID NO: 2126886 - protein, 26 aa, Cryptosporidium hominis
QVKKAGKFQLCLLQFYQDPNISGGEG

SEQ ID NO: 2126887 - protein, 24 aa, Cryptosporidium hominis
QVLNARRGLVRMIIDIILGKDTTK

SEQ ID NO: 2126888 - protein, 18 aa, Cryptosporidium hominis
QVLSPVIMGLELVSESFP

SEQ ID NO: 2126889 - protein, 17 aa, Cryptosporidium hominis
QVSGLLFSSNREVSFKS

SEQ ID NO: 2126890 - protein, 23 aa, Cryptosporidium hominis
QVTESRILLYQGISEQVKAFENQ

SEQ ID NO: 2126891 - protein, 26 aa, Cryptosporidium hominis
QVVHPFCCKLLLRQRKDLFNASKMPI

SEQ ID NO: 2126892 - protein, 18 aa, Cryptosporidium hominis
QYCHGWTQFGFVTWMPIY

SEQ ID NO: 2126893 - protein, 30 aa, Cryptosporidium hominis
QYEILNYFEAFAFICLALFIADIPNSSDLR

SEQ ID NO: 2126894 - protein, 18 aa, Cryptosporidium hominis
QYEQLSFMLEFRKVVEEL

SEQ ID NO: 2126895 - protein, 17 aa, Cryptosporidium hominis
QYFIFKRPYLSAFSLVF

SEQ ID NO: 2126896 - protein, 19 aa, Cryptosporidium hominis
QYFWTELLGLCALSNEFPD

SEQ ID NO: 2126897 - protein, 22 aa, Cryptosporidium hominis
QYILRIESLNSFSSYEEHEILL

SEQ ID NO: 2126898 - protein, 22 aa, Cryptosporidium hominis
QYNLNVCIFKGQDIAPIVGMYN

SEQ ID NO: 2126899 - protein, 18 aa, Cryptosporidium hominis
QYSESIINIFGLLLGTTF

SEQ ID NO: 2126900 - protein, 18 aa, Cryptosporidium hominis
RAAPRILRHIMRRTSREN

SEQ ID NO: 2126901 - protein, 17 aa, Cryptosporidium hominis
RACLSFFQALRKELNYI

SEQ ID NO: 2126902 - protein, 22 aa, Cryptosporidium hominis
RACNFHSLPDLCSGSLDATYSS

SEQ ID NO: 2126903 - protein, 26 aa, Cryptosporidium hominis
RADFQLRPKLTIKDLEWLNSDKNDGF

SEQ ID NO: 2126904 - protein, 18 aa, Cryptosporidium hominis
RAERRGWRSSKWRSTKFS

SEQ ID NO: 2126905 - protein, 24 aa, Cryptosporidium hominis
RAFQEAMAFLQLESMVDIKLDFNK

SEQ ID NO: 2126906 - protein, 20 aa, Cryptosporidium hominis
RAIDDCIYHSNSILEHCNKN

SEQ ID NO: 2126907 - protein, 17 aa, Cryptosporidium hominis
RAILRKSKIILLDEATS

SEQ ID NO: 2126908 - protein, 26 aa, Cryptosporidium hominis
RALWKCLYGQFIMLIILKVSWEACLY

SEQ ID NO: 2126909 - protein, 24 aa, Cryptosporidium hominis
RANIQSSINICWLSIVSTCILSLI

SEQ ID NO: 2126910 - protein, 18 aa, Cryptosporidium hominis
RAPHRGGCGQDKDNYSEL

SEQ ID NO: 2126911 - protein, 25 aa, Cryptosporidium hominis
RARSTVFCFFNYIFTDLSRAHDIVI

SEQ ID NO: 2126912 - protein, 19 aa, Cryptosporidium hominis
RASKYFPYYKNIESSFSYQ

SEQ ID NO: 2126913 - protein, 25 aa, Cryptosporidium hominis
RAVNDGRILSSFFAALAYNYMTMSW

SEQ ID NO: 2126914 - protein, 20 aa, Cryptosporidium hominis
RAYFFLRRPIDFEDIPLSLQ

SEQ ID NO: 2126915 - protein, 17 aa, Cryptosporidium hominis
RCISGCATAFLAGGLSA

SEQ ID NO: 2126916 - protein, 18 aa, Cryptosporidium hominis
RCKLSMIRQELMKIEDVK

SEQ ID NO: 2126917 - protein, 26 aa, Cryptosporidium hominis
RCTLKEYYLLFDFVIFLFYIINAYKS

SEQ ID NO: 2126918 - protein, 25 aa, Cryptosporidium hominis
RCVIMSCIFLCILLFNTVDKYTNFG

SEQ ID NO: 2126919 - protein, 19 aa, Cryptosporidium hominis
RDEALKCGTKYSFPIITGL

SEQ ID NO: 2126920 - protein, 17 aa, Cryptosporidium hominis
RDEFLFKWNRRRYSYRM

SEQ ID NO: 2126921 - protein, 17 aa, Cryptosporidium hominis
RDFTLSKIRNAYSYIQN

SEQ ID NO: 2126922 - protein, 17 aa, Cryptosporidium hominis
RDGSNFLAFSNELDIHS

SEQ ID NO: 2126923 - protein, 18 aa, Cryptosporidium hominis
RDHCIYLPQCLIHPINVF

SEQ ID NO: 2126924 - protein, 25 aa, Cryptosporidium hominis
RDIAMSLCDLVLICIDPSGQALSKR

SEQ ID NO: 2126925 - protein, 17 aa, Cryptosporidium hominis
RDIGRFINISSFLSRIG

SEQ ID NO: 2126926 - protein, 18 aa, Cryptosporidium hominis
RDIKSLTVLNEYIVTRRL

SEQ ID NO: 2126927 - protein, 22 aa, Cryptosporidium hominis
RDILSFHSCLIFGLVRLLWNIV

SEQ ID NO: 2126928 - protein, 21 aa, Cryptosporidium hominis
RDIPFSIIQFSLWEKLNRTGD

SEQ ID NO: 2126929 - protein, 20 aa, Cryptosporidium hominis
RDIPNRFPKLVTPSVGRNWE

SEQ ID NO: 2126930 - protein, 19 aa, Cryptosporidium hominis
RDISLELQLNGNIARVLIG

SEQ ID NO: 2126931 - protein, 20 aa, Cryptosporidium hominis
RDKLSIPFFPLEFINLVKNV

SEQ ID NO: 2126932 - protein, 23 aa, Cryptosporidium hominis
RDKSIHGSGTWEYSVQAVQAAMS

SEQ ID NO: 2126933 - protein, 20 aa, Cryptosporidium hominis
RDLLKTGLFVDGTWDDHDYG

SEQ ID NO: 2126934 - protein, 23 aa, Cryptosporidium hominis
RDLSELFRFGKTPKVSIQELFGF

SEQ ID NO: 2126935 - protein, 20 aa, Cryptosporidium hominis
RDNYFPGLMTHIPKVSMHSG

SEQ ID NO: 2126936 - protein, 17 aa, Cryptosporidium hominis
RDPNEMSRFPTITLGFP

SEQ ID NO: 2126937 - protein, 19 aa, Cryptosporidium hominis
RDRIFPYLLTIIVFSASIE

SEQ ID NO: 2126938 - protein, 17 aa, Cryptosporidium hominis
RDYLIQLKEAFAVFDGD

SEQ ID NO: 2126939 - protein, 20 aa, Cryptosporidium hominis
RDYQKCMIPGLKRINPVFVD

SEQ ID NO: 2126940 - protein, 17 aa, Cryptosporidium hominis
RDYQVGYSLRWTSNNKS

SEQ ID NO: 2126941 - protein, 20 aa, Cryptosporidium hominis
REAAKFPITESRSFINHGER

SEQ ID NO: 2126942 - protein, 24 aa, Cryptosporidium hominis
REDIRLGWNSSVFVEGVNKIMKIQ

SEQ ID NO: 2126943 - protein, 27 aa, Cryptosporidium hominis
REEIKGLFSQEFWDFIDSCLTKDPNQR

SEQ ID NO: 2126944 - protein, 24 aa, Cryptosporidium hominis
REIASCIIFGISIFTFIAVSLGFV

SEQ ID NO: 2126945 - protein, 19 aa, Cryptosporidium hominis
REILGFASILLCKVSGIFM

SEQ ID NO: 2126946 - protein, 17 aa, Cryptosporidium hominis
REILSLPSSEFLVIREF

SEQ ID NO: 2126947 - protein, 17 aa, Cryptosporidium hominis
REKIASIVRPLTTQIMI

SEQ ID NO: 2126948 - protein, 18 aa, Cryptosporidium hominis
RENLPITLIFTIYGYSSL

SEQ ID NO: 2126949 - protein, 22 aa, Cryptosporidium hominis
RERIVPIARLYKISDLMRSLDI

SEQ ID NO: 2126950 - protein, 21 aa, Cryptosporidium hominis
RESLSYYQLYILLVFLIESSD

SEQ ID NO: 2126951 - protein, 17 aa, Cryptosporidium hominis
RETSCRMIYSLFNKDDK

SEQ ID NO: 2126952 - protein, 18 aa, Cryptosporidium hominis
REYLLKVLINDSCGNTKK

SEQ ID NO: 2126953 - protein, 23 aa, Cryptosporidium hominis
REYRKRIIFSLLSLGVAKLATIQ

SEQ ID NO: 2126954 - protein, 19 aa, Cryptosporidium hominis
REYRPCYTHRFASGCQALA

SEQ ID NO: 2126955 - protein, 20 aa, Cryptosporidium hominis
RFDFKCAELLTLENLVYFAE

SEQ ID NO: 2126956 - protein, 20 aa, Cryptosporidium hominis
RFDHHCVWIDSCVGYGNQRA

SEQ ID NO: 2126957 - protein, 17 aa, Cryptosporidium hominis
RFDVVLCQWVRVRYAIM

SEQ ID NO: 2126958 - protein, 28 aa, Cryptosporidium hominis
RFEDIITFLSLYSFGGFVGKYSKNCQYY

SEQ ID NO: 2126959 - protein, 19 aa, Cryptosporidium hominis
RFFLVCNRVQNIGFGFEYR

SEQ ID NO: 2126960 - protein, 26 aa, Cryptosporidium hominis
RFFMVYSRFVFRHSIAVIIAVTLICL

SEQ ID NO: 2126961 - protein, 17 aa, Cryptosporidium hominis
RFISFPQFLSAIINMSQ

SEQ ID NO: 2126962 - protein, 25 aa, Cryptosporidium hominis
RFKADMKDPLIIGGEIRTISSRDFS

SEQ ID NO: 2126963 - protein, 18 aa, Cryptosporidium hominis
RFLELFALAIDRQEENPI

SEQ ID NO: 2126964 - protein, 21 aa, Cryptosporidium hominis
RFLFIDIWIGLLLFQIFLRIS

SEQ ID NO: 2126965 - protein, 17 aa, Cryptosporidium hominis
RFLFRESTIDWIFFSII

SEQ ID NO: 2126966 - protein, 20 aa, Cryptosporidium hominis
RFLLEAVDSQTQFGILSNMD

SEQ ID NO: 2126967 - protein, 19 aa, Cryptosporidium hominis
RFLLGRNCSMEELENDIED

SEQ ID NO: 2126968 - protein, 20 aa, Cryptosporidium hominis
RFLTFSYRRSFLPLFLVFIF

SEQ ID NO: 2126969 - protein, 18 aa, Cryptosporidium hominis
RFNWHTCRNGLGGQEYDH

SEQ ID NO: 2126970 - protein, 20 aa, Cryptosporidium hominis
RFNYVYCFIHYLLHILSRIG

SEQ ID NO: 2126971 - protein, 20 aa, Cryptosporidium hominis
RFPFLNAPSRMEFIEYLNSG

SEQ ID NO: 2126972 - protein, 20 aa, Cryptosporidium hominis
RFSDKLQLIKSIKISTNSTD

SEQ ID NO: 2126973 - protein, 22 aa, Cryptosporidium hominis
RFTQLKTLSARTYNVFSQFTSD

SEQ ID NO: 2126974 - protein, 20 aa, Cryptosporidium hominis
RGDCRIIFSNSWLPYVNHSK

SEQ ID NO: 2126975 - protein, 22 aa, Cryptosporidium hominis
RGDDWFMLSIRVFCAIFLAGAI

SEQ ID NO: 2126976 - protein, 19 aa, Cryptosporidium hominis
RGFDKKVIFSLLLPEIKAY

SEQ ID NO: 2126977 - protein, 17 aa, Cryptosporidium hominis
RGGNGPGDMNSGMGEGV

SEQ ID NO: 2126978 - protein, 20 aa, Cryptosporidium hominis
RGICAELNESIPILKILSRR

SEQ ID NO: 2126979 - protein, 33 aa, Cryptosporidium hominis
RGILLSLIAFEWIKRNTLVFSEIKLVDKLKFAI

SEQ ID NO: 2126980 - protein, 20 aa, Cryptosporidium hominis
RGLMRGDLLLWRKSFEKSSS

SEQ ID NO: 2126981 - protein, 17 aa, Cryptosporidium hominis
RGNRACSGNSLYDVFFP

SEQ ID NO: 2126982 - protein, 19 aa, Cryptosporidium hominis
RGPQKASDSPFVISGSGSG

SEQ ID NO: 2126983 - protein, 18 aa, Cryptosporidium hominis
RGQLKALIALHRRTGEFD

SEQ ID NO: 2126984 - protein, 22 aa, Cryptosporidium hominis
RGSMILPFSNLIVIGKLIVGKN

SEQ ID NO: 2126985 - protein, 17 aa, Cryptosporidium hominis
RGTLFRILFGKILCEIL

SEQ ID NO: 2126986 - protein, 19 aa, Cryptosporidium hominis
RGTVPQVLSSLFYPLNPED

SEQ ID NO: 2126987 - protein, 20 aa, Cryptosporidium hominis
RGTYYAIKFLRLGIGANDDI

SEQ ID NO: 2126988 - protein, 20 aa, Cryptosporidium hominis
RGVTTYEYLTKIVIEDETSK

SEQ ID NO: 2126989 - protein, 24 aa, Cryptosporidium hominis
RGYPVCELKCIIRDLQNRVQWTRK

SEQ ID NO: 2126990 - protein, 18 aa, Cryptosporidium hominis
RHARLLLSTLEEFSYSSS

SEQ ID NO: 2126991 - protein, 33 aa, Cryptosporidium hominis
RHCFSSFKYKYGFKLYWIRKVSKTLKFLKLTNQ

SEQ ID NO: 2126992 - protein, 28 aa, Cryptosporidium hominis
RHIFHLECIDGWFKQNCVCPICRSDIVQ

SEQ ID NO: 2126993 - protein, 20 aa, Cryptosporidium hominis
RHLESYYKSSAEWSNYEKRQ

SEQ ID NO: 2126994 - protein, 27 aa, Cryptosporidium hominis
RHSWGKRFIGLCTCIYDRINGRNKNNE

SEQ ID NO: 2126995 - protein, 25 aa, Cryptosporidium hominis
RHYISPCQISHSLLFTRAANNLGTQ

SEQ ID NO: 2126996 - protein, 25 aa, Cryptosporidium hominis
RIDRIRINSLIPLNFYDRIEMECAI

SEQ ID NO: 2126997 - protein, 25 aa, Cryptosporidium hominis
RIFIFPIKIASTFAIAIKTFDDHSM

SEQ ID NO: 2126998 - protein, 20 aa, Cryptosporidium hominis
RIFIGIACSILCLIAEVGLF

SEQ ID NO: 2126999 - protein, 19 aa, Cryptosporidium hominis
RIFIILSLTILPLINEIHS

SEQ ID NO: 2127000 - protein, 17 aa, Cryptosporidium hominis
RIFPKNLLKTLCACALI

SEQ ID NO: 2127001 - protein, 26 aa, Cryptosporidium hominis
RIGDLPVLMKLVGFEHLWKKRVVYLL

SEQ ID NO: 2127002 - protein, 20 aa, Cryptosporidium hominis
RIGEDISLFSSHLLLLICRC

SEQ ID NO: 2127003 - protein, 17 aa, Cryptosporidium hominis
RIGSGQILWDMASKFSH

SEQ ID NO: 2127004 - protein, 20 aa, Cryptosporidium hominis
RIHAYTIWRNIVQKGIKDMS

SEQ ID NO: 2127005 - protein, 17 aa, Cryptosporidium hominis
RIHIFEIQNMLLLISSY

SEQ ID NO: 2127006 - protein, 27 aa, Cryptosporidium hominis
RIIDNFIPLRLNLEIPKFEGEEAKHLG

SEQ ID NO: 2127007 - protein, 20 aa, Cryptosporidium hominis
RIIGVYPCYVFIQTKELRDY

SEQ ID NO: 2127008 - protein, 20 aa, Cryptosporidium hominis
RIISFSALSYLFFKLAISGS

SEQ ID NO: 2127009 - protein, 27 aa, Cryptosporidium hominis
RIKHNVCITCSLLSLRSMEFLISILII

SEQ ID NO: 2127010 - protein, 27 aa, Cryptosporidium hominis
RIKIVELKLGFLLQLAFFRLWSVNLAA

SEQ ID NO: 2127011 - protein, 19 aa, Cryptosporidium hominis
RIKKSFKTRVEDFKQGRQS

SEQ ID NO: 2127012 - protein, 18 aa, Cryptosporidium hominis
RIKLRDIKSLTVLNEYIV

SEQ ID NO: 2127013 - protein, 25 aa, Cryptosporidium hominis
RILGLRAPFYRLAMNTTTFPEDSQT

SEQ ID NO: 2127014 - protein, 18 aa, Cryptosporidium hominis
RILLLWWYSIPDIREIQH

SEQ ID NO: 2127015 - protein, 22 aa, Cryptosporidium hominis
RILNSLRCLVLLLYSRSNETNE

SEQ ID NO: 2127016 - protein, 17 aa, Cryptosporidium hominis
RIMCFDKTGTLTNDHLD

SEQ ID NO: 2127017 - protein, 19 aa, Cryptosporidium hominis
RIMVTLIKSFIGTGIIFLP

SEQ ID NO: 2127018 - protein, 19 aa, Cryptosporidium hominis
RINNPTGFWLLFIPTFGSL

SEQ ID NO: 2127019 - protein, 21 aa, Cryptosporidium hominis
RIQTFLFSRIYDYPILKDREF

SEQ ID NO: 2127020 - protein, 20 aa, Cryptosporidium hominis
RIRLIKYWYHYYSIYLNNYY

SEQ ID NO: 2127021 - protein, 18 aa, Cryptosporidium hominis
RIRLSEIVENYKVFEDKE

SEQ ID NO: 2127022 - protein, 36 aa, Cryptosporidium hominis
RIRQYALIWMTWCLWLLGSFLFSFGRVMLGLYHIFR

SEQ ID NO: 2127023 - protein, 19 aa, Cryptosporidium hominis
RISFDKVNSILSYFLRLLK

SEQ ID NO: 2127024 - protein, 18 aa, Cryptosporidium hominis
RISGSTLGFTRLSYLQKE

SEQ ID NO: 2127025 - protein, 25 aa, Cryptosporidium hominis
RISMPICLNEPLSFIQRLSEDLEYH

SEQ ID NO: 2127026 - protein, 18 aa, Cryptosporidium hominis
RITCGTWLVYLYELKRCH

SEQ ID NO: 2127027 - protein, 18 aa, Cryptosporidium hominis
RITSPWVNSCFITIISQS

SEQ ID NO: 2127028 - protein, 26 aa, Cryptosporidium hominis
RIWMHGAWLPSFKMVWGQISHGLKRG

SEQ ID NO: 2127029 - protein, 18 aa, Cryptosporidium hominis
RKFGFNVFVDGTRRTQLD

SEQ ID NO: 2127030 - protein, 21 aa, Cryptosporidium hominis
RKFNKEFFHLTTLDELINGSI

SEQ ID NO: 2127031 - protein, 21 aa, Cryptosporidium hominis
RKGCLCLSLRLAVFLHGLLNI

SEQ ID NO: 2127032 - protein, 17 aa, Cryptosporidium hominis
RKGILMSPIKICRGIDN

SEQ ID NO: 2127033 - protein, 18 aa, Cryptosporidium hominis
RKHFPRIRIFHSGSYSGL

SEQ ID NO: 2127034 - protein, 19 aa, Cryptosporidium hominis
RKICNKHSSSLRINQLNKD

SEQ ID NO: 2127035 - protein, 22 aa, Cryptosporidium hominis
RKIFKKRIPNLYNHFRNENVDE

SEQ ID NO: 2127036 - protein, 19 aa, Cryptosporidium hominis
RKILEEGTFYPSRVFYDRG

SEQ ID NO: 2127037 - protein, 20 aa, Cryptosporidium hominis
RKINVCRSVFNNDEDFKSVI

SEQ ID NO: 2127038 - protein, 21 aa, Cryptosporidium hominis
RKKDPYKSIAVLKIIPTFNVD

SEQ ID NO: 2127039 - protein, 25 aa, Cryptosporidium hominis
RKKFPWIKPGHPYIGPKISGSDNLS

SEQ ID NO: 2127040 - protein, 21 aa, Cryptosporidium hominis
RKLCLITVIFLVLCASEGDAI

SEQ ID NO: 2127041 - protein, 19 aa, Cryptosporidium hominis
RKLDIDFSRAVRAVSLTKG

SEQ ID NO: 2127042 - protein, 23 aa, Cryptosporidium hominis
RKLIPSLYAYSSLHGCIDQLIPT

SEQ ID NO: 2127043 - protein, 24 aa, Cryptosporidium hominis
RKLKGESNNIFFLDHKIKVYHINS

SEQ ID NO: 2127044 - protein, 18 aa, Cryptosporidium hominis
RKLLEPKITLYDIPEPTK

SEQ ID NO: 2127045 - protein, 24 aa, Cryptosporidium hominis
RKLLKESYMILALMELLFGLFGII

SEQ ID NO: 2127046 - protein, 20 aa, Cryptosporidium hominis
RKLQRFIPVHFHPILMEPLS

SEQ ID NO: 2127047 - protein, 19 aa, Cryptosporidium hominis
RKNHFLKRHFNITELNDTF

SEQ ID NO: 2127048 - protein, 18 aa, Cryptosporidium hominis
RKNILMLIATVFGIFGAV

SEQ ID NO: 2127049 - protein, 17 aa, Cryptosporidium hominis
RKNLLEYLAASYSITLI

SEQ ID NO: 2127050 - protein, 23 aa, Cryptosporidium hominis
RKPRFLPNLMMTIVFSTCTDLLA

SEQ ID NO: 2127051 - protein, 17 aa, Cryptosporidium hominis
RKRERIRLIKYWYHYYS

SEQ ID NO: 2127052 - protein, 22 aa, Cryptosporidium hominis
RKRPLIVYFRRAMNLLTVSEAH

SEQ ID NO: 2127053 - protein, 17 aa, Cryptosporidium hominis
RKSFIIFQSISSVLYST

SEQ ID NO: 2127054 - protein, 20 aa, Cryptosporidium hominis
RKSFIWRLIPMGSMVFHSLL

SEQ ID NO: 2127055 - protein, 24 aa, Cryptosporidium hominis
RKSIKGKELYSVKSIGIKKQNGLE

SEQ ID NO: 2127056 - protein, 18 aa, Cryptosporidium hominis
RKSNGISEFGLFIRYFEI

SEQ ID NO: 2127057 - protein, 24 aa, Cryptosporidium hominis
RKTPGKRIIPIFIKNRTPKKDSNN

SEQ ID NO: 2127058 - protein, 19 aa, Cryptosporidium hominis
RKTSFLLTKIDEIPTEEDR

SEQ ID NO: 2127059 - protein, 25 aa, Cryptosporidium hominis
RKVNLDIRVGDFIGIVGRTGSGKTS

SEQ ID NO: 2127060 - protein, 34 aa, Cryptosporidium hominis
RKWIILLIIIEFVIKINLLYGLRNNVFGSLDPNT

SEQ ID NO: 2127061 - protein, 20 aa, Cryptosporidium hominis
RLAGIQAFTCFIFFQIMNFL

SEQ ID NO: 2127062 - protein, 18 aa, Cryptosporidium hominis
RLAQCLNPSLPSGVHTKA

SEQ ID NO: 2127063 - protein, 19 aa, Cryptosporidium hominis
RLENPIFIFKNGVIVAWSN

SEQ ID NO: 2127064 - protein, 19 aa, Cryptosporidium hominis
RLFARRITKNYSNEYPYIN

SEQ ID NO: 2127065 - protein, 23 aa, Cryptosporidium hominis
RLFLRNIWGSCIVKSLDWMFQPL

SEQ ID NO: 2127066 - protein, 17 aa, Cryptosporidium hominis
RLFSLRYQTLSSISDKE

SEQ ID NO: 2127067 - protein, 30 aa, Cryptosporidium hominis
RLGVQLPIRLTLKMIYELSVFANHSSLLRR

SEQ ID NO: 2127068 - protein, 19 aa, Cryptosporidium hominis
RLIFNIIIVFITLYIIFGI

SEQ ID NO: 2127069 - protein, 19 aa, Cryptosporidium hominis
RLIQSICIPNGIVSGDNIH

SEQ ID NO: 2127070 - protein, 20 aa, Cryptosporidium hominis
RLKFRRIHIKLGDSTNKELN

SEQ ID NO: 2127071 - protein, 26 aa, Cryptosporidium hominis
RLKSAAEVFLAFDIVKILRTTISELS

SEQ ID NO: 2127072 - protein, 18 aa, Cryptosporidium hominis
RLLAMALNDHMGLILDYT

SEQ ID NO: 2127073 - protein, 22 aa, Cryptosporidium hominis
RLLELLQHLIFYEIPRYSPIGL

SEQ ID NO: 2127074 - protein, 26 aa, Cryptosporidium hominis
RLLISKAVMFSSLFVRKLNESSIPNK

SEQ ID NO: 2127075 - protein, 24 aa, Cryptosporidium hominis
RLLKNLKTILCINGSPNVKITPIN

SEQ ID NO: 2127076 - protein, 18 aa, Cryptosporidium hominis
RLLTGMILILVFGEALAI

SEQ ID NO: 2127077 - protein, 20 aa, Cryptosporidium hominis
RLNIIHFSFIYNLKVLMEIR

SEQ ID NO: 2127078 - protein, 21 aa, Cryptosporidium hominis
RLNLIKTLPLHQQYVIMGIIL

SEQ ID NO: 2127079 - protein, 37 aa, Cryptosporidium hominis
RLNSIVRFYLSINILRGNFGKIWLWLVKLLNKKSPHR

SEQ ID NO: 2127080 - protein, 23 aa, Cryptosporidium hominis
RLPINCFHYWFIFGASVGYYTFH

SEQ ID NO: 2127081 - protein, 26 aa, Cryptosporidium hominis
RLPRFLEFYNLIGVNIFAVSYRGYGD

SEQ ID NO: 2127082 - protein, 23 aa, Cryptosporidium hominis
RLQYKDGLDFARIIYSLERLVAL

SEQ ID NO: 2127083 - protein, 20 aa, Cryptosporidium hominis
RLRITSLQLLRQIILYGKDQ

SEQ ID NO: 2127084 - protein, 17 aa, Cryptosporidium hominis
RLRVFTAAFSMIVAGIW

SEQ ID NO: 2127085 - protein, 20 aa, Cryptosporidium hominis
RLSLFEIWESGIARKLKTEK

SEQ ID NO: 2127086 - protein, 29 aa, Cryptosporidium hominis
RLSQMVQNYWRKKMLNLERHISSKCSALI

SEQ ID NO: 2127087 - protein, 25 aa, Cryptosporidium hominis
RLSTTRWFACFLLFVGVLLVQKTNI

SEQ ID NO: 2127088 - protein, 17 aa, Cryptosporidium hominis
RLYSILEEQVWALLPGF

SEQ ID NO: 2127089 - protein, 25 aa, Cryptosporidium hominis
RMGLAAEVLLAFDILKEAIRLATYL

SEQ ID NO: 2127090 - protein, 19 aa, Cryptosporidium hominis
RMIGELAQIFQKVAGMVTQ

SEQ ID NO: 2127091 - protein, 23 aa, Cryptosporidium hominis
RMINLRYEWFISKLMDLTMMKKL

SEQ ID NO: 2127092 - protein, 23 aa, Cryptosporidium hominis
RMKSSTSMKNWSIFEERNHLVIN

SEQ ID NO: 2127093 - protein, 28 aa, Cryptosporidium hominis
RMNFNDHWRKGAGILPLNMLYNAPLKSL

SEQ ID NO: 2127094 - protein, 21 aa, Cryptosporidium hominis
RMPFHCSDPLLARDLLSVRNL

SEQ ID NO: 2127095 - protein, 27 aa, Cryptosporidium hominis
RMPNYRVKLGFGLHYGWAIEGAIGSEY

SEQ ID NO: 2127096 - protein, 17 aa, Cryptosporidium hominis
RMPPSMLEQPQLQRRVS

SEQ ID NO: 2127097 - protein, 25 aa, Cryptosporidium hominis
RMQAFRIWLSSVLPRMPFHCSDPLL

SEQ ID NO: 2127098 - protein, 20 aa, Cryptosporidium hominis
RMVTISGGILFFAFAIGGIV

SEQ ID NO: 2127099 - protein, 25 aa, Cryptosporidium hominis
RNAASCKIASIWKGYKTRKFMDSII

SEQ ID NO: 2127100 - protein, 24 aa, Cryptosporidium hominis
RNAICPNCKTLVRYGKTETGTSPC

SEQ ID NO: 2127101 - protein, 19 aa, Cryptosporidium hominis
RNDPDFGRISFQMQATMEQ

SEQ ID NO: 2127102 - protein, 22 aa, Cryptosporidium hominis
RNEKDFTRFGTKLSKLTLKELG

SEQ ID NO: 2127103 - protein, 28 aa, Cryptosporidium hominis
RNIFDYPLTCELLRGLPHSVLLENDDGD

SEQ ID NO: 2127104 - protein, 23 aa, Cryptosporidium hominis
RNKSIDLIRPWLGKMDVIIIGCG

SEQ ID NO: 2127105 - protein, 21 aa, Cryptosporidium hominis
RNLHFKELIPIKTINYLPIKD

SEQ ID NO: 2127106 - protein, 17 aa, Cryptosporidium hominis
RNNEIISAFPAIITNLL

SEQ ID NO: 2127107 - protein, 24 aa, Cryptosporidium hominis
RNNLKLITCYIEFLNECLLIGHSK

SEQ ID NO: 2127108 - protein, 25 aa, Cryptosporidium hominis
RNNPIMRLFFFIFILAMFSPANISN

SEQ ID NO: 2127109 - protein, 21 aa, Cryptosporidium hominis
RNPKIWMMGIILSKYLFTVLG

SEQ ID NO: 2127110 - protein, 17 aa, Cryptosporidium hominis
RNQEHWDYFNTLNDVSD

SEQ ID NO: 2127111 - protein, 25 aa, Cryptosporidium hominis
RNQKNCGSCWAFSAVAALEGATCAQ

SEQ ID NO: 2127112 - protein, 22 aa, Cryptosporidium hominis
RNQKRFYSLDWAFNVDKSAISQ

SEQ ID NO: 2127113 - protein, 20 aa, Cryptosporidium hominis
RNRIFCLAFETAFEDIMISI

SEQ ID NO: 2127114 - protein, 23 aa, Cryptosporidium hominis
RNRKSEFLLAFLQDLHNFSKTNP

SEQ ID NO: 2127115 - protein, 24 aa, Cryptosporidium hominis
RNSEKCMLGKQLVYTRKKQTAECY

SEQ ID NO: 2127116 - protein, 26 aa, Cryptosporidium hominis
RNTLEIYWWYFSLVGRTWCIVLLISC

SEQ ID NO: 2127117 - protein, 29 aa, Cryptosporidium hominis
RNYKLWITFILLCFFSVWISILESGILFS

SEQ ID NO: 2127118 - protein, 17 aa, Cryptosporidium hominis
RPDMMKIPVLFETIKLI

SEQ ID NO: 2127119 - protein, 23 aa, Cryptosporidium hominis
RPFRGHHCSDCGYCIQRFDHHCV

SEQ ID NO: 2127120 - protein, 19 aa, Cryptosporidium hominis
RPGVEKAITKCCEAGVRVI

SEQ ID NO: 2127121 - protein, 21 aa, Cryptosporidium hominis
RPKPWIEREFVIKIFGYESPQ

SEQ ID NO: 2127122 - protein, 26 aa, Cryptosporidium hominis
RPLILQELLCLFKRSTSPYISTEQEI

SEQ ID NO: 2127123 - protein, 17 aa, Cryptosporidium hominis
RPLQLVLRIPKDFSEKF

SEQ ID NO: 2127124 - protein, 17 aa, Cryptosporidium hominis
RPNYSFYDGPPFATGLP

SEQ ID NO: 2127125 - protein, 18 aa, Cryptosporidium hominis
RPTAREVLSHPWFRYSKS

SEQ ID NO: 2127126 - protein, 25 aa, Cryptosporidium hominis
RPVIFDIRARPRVVVSLTGSKDLQM

SEQ ID NO: 2127127 - protein, 25 aa, Cryptosporidium hominis
RPYWSDGRMWFNLVLVYIAMNIVRG

SEQ ID NO: 2127128 - protein, 22 aa, Cryptosporidium hominis
RQDKCPLCRTTFSGFVVLPIKN

SEQ ID NO: 2127129 - protein, 22 aa, Cryptosporidium hominis
RQEKNHLFEVYDFGSNEKKDWI

SEQ ID NO: 2127130 - protein, 18 aa, Cryptosporidium hominis
RQFVYRLLEENFFLNSNM

SEQ ID NO: 2127131 - protein, 23 aa, Cryptosporidium hominis
RQGIMDLRMLLLQLYFKDGQFID

SEQ ID NO: 2127132 - protein, 23 aa, Cryptosporidium hominis
RQHIRFATAPFKADIRLVGSVWL

SEQ ID NO: 2127133 - protein, 19 aa, Cryptosporidium hominis
RQILNFAKVILLNRSIFAI

SEQ ID NO: 2127134 - protein, 17 aa, Cryptosporidium hominis
RQIRFLIAEASFKRPII

SEQ ID NO: 2127135 - protein, 17 aa, Cryptosporidium hominis
RQISFDFFSRAPLNSEL

SEQ ID NO: 2127136 - protein, 17 aa, Cryptosporidium hominis
RQLCIRQNNKFGMFPTI

SEQ ID NO: 2127137 - protein, 21 aa, Cryptosporidium hominis
RQLRVCTTIAIAIISEICMPY

SEQ ID NO: 2127138 - protein, 19 aa, Cryptosporidium hominis
RQVYWLRILLPEIRTNQKD

SEQ ID NO: 2127139 - protein, 18 aa, Cryptosporidium hominis
RRAFLLKVMEGIDDEYMK

SEQ ID NO: 2127140 - protein, 23 aa, Cryptosporidium hominis
RRARSLNFFGRFSKFSFEKFGKD

SEQ ID NO: 2127141 - protein, 21 aa, Cryptosporidium hominis
RRDCRRQGVRYLCRGANSDGN

SEQ ID NO: 2127142 - protein, 25 aa, Cryptosporidium hominis
RRFELKILFQKILRDIVKEDTIIPN

SEQ ID NO: 2127143 - protein, 19 aa, Cryptosporidium hominis
RRGPALIELIAFSRIYNFK

SEQ ID NO: 2127144 - protein, 23 aa, Cryptosporidium hominis
RRIRAKLLAERDVNWITRSEQFE

SEQ ID NO: 2127145 - protein, 18 aa, Cryptosporidium hominis
RRIRFVIIILNSVIISVI

SEQ ID NO: 2127146 - protein, 17 aa, Cryptosporidium hominis
RRKIPIALISLGLNSPF

SEQ ID NO: 2127147 - protein, 29 aa, Cryptosporidium hominis
RRLTTNRAWKIGKVLSFIYYTWFMFGFYW

SEQ ID NO: 2127148 - protein, 20 aa, Cryptosporidium hominis
RRNGISIAILIGFLQVLFVI

SEQ ID NO: 2127149 - protein, 18 aa, Cryptosporidium hominis
RRPIKELPDRSMEKTFRS

SEQ ID NO: 2127150 - protein, 19 aa, Cryptosporidium hominis
RRQSILIFYGIGVQLETEY

SEQ ID NO: 2127151 - protein, 19 aa, Cryptosporidium hominis
RRSLIKLFLFLAAISACSV

SEQ ID NO: 2127152 - protein, 22 aa, Cryptosporidium hominis
RRTLETFPILIFAFTCQQNIFT

SEQ ID NO: 2127153 - protein, 34 aa, Cryptosporidium hominis
RRVACGSWHSLCCDIKGNCFSWGRGDRGQLGTGA

SEQ ID NO: 2127154 - protein, 22 aa, Cryptosporidium hominis
RRVALLQVIVSLVFLIPDKLIE

SEQ ID NO: 2127155 - protein, 18 aa, Cryptosporidium hominis
RRVYMLVALQVLFDLALS

SEQ ID NO: 2127156 - protein, 19 aa, Cryptosporidium hominis
RSGDFIFSRKWKLEIQTNF

SEQ ID NO: 2127157 - protein, 23 aa, Cryptosporidium hominis
RSGHGSEPWLGGTLQNQENTMEE

SEQ ID NO: 2127158 - protein, 21 aa, Cryptosporidium hominis
RSGNAIPYPEPQGSVRSQWDF

SEQ ID NO: 2127159 - protein, 20 aa, Cryptosporidium hominis
RSGSLIFTVIVSYFMLGQKQ

SEQ ID NO: 2127160 - protein, 18 aa, Cryptosporidium hominis
RSIKRLFENAFFYNTVSN

SEQ ID NO: 2127161 - protein, 23 aa, Cryptosporidium hominis
RSKCCSSEIQFLISDTTSPFSIE

SEQ ID NO: 2127162 - protein, 19 aa, Cryptosporidium hominis
RSKERFKPLFQPCLGSLYT

SEQ ID NO: 2127163 - protein, 20 aa, Cryptosporidium hominis
RSKIIGVLWLFRGASMSIIP

SEQ ID NO: 2127164 - protein, 19 aa, Cryptosporidium hominis
RSKLLKHIVSSIVNANIKK

SEQ ID NO: 2127165 - protein, 18 aa, Cryptosporidium hominis
RSKMQALLQACYYIQYYL

SEQ ID NO: 2127166 - protein, 25 aa, Cryptosporidium hominis
RSKSGWRSFLSIIIKSIRSFFQNES

SEQ ID NO: 2127167 - protein, 17 aa, Cryptosporidium hominis
RSLLKFTTIIRNNADDA

SEQ ID NO: 2127168 - protein, 18 aa, Cryptosporidium hominis
RSLLRTSMYFLKRSINFN

SEQ ID NO: 2127169 - protein, 24 aa, Cryptosporidium hominis
RSLLTVIFCIVFLKLLKAKYGSFE

SEQ ID NO: 2127170 - protein, 18 aa, Cryptosporidium hominis
RSLRRFVFEKGAEFDLEN

SEQ ID NO: 2127171 - protein, 20 aa, Cryptosporidium hominis
RSLTFPSVFFYLSQHLADMI

SEQ ID NO: 2127172 - protein, 19 aa, Cryptosporidium hominis
RSMGYFCYGIISIYVWYNH

SEQ ID NO: 2127173 - protein, 29 aa, Cryptosporidium hominis
RSMISTSYFLSCRILPYLWSFYESYPTYK

SEQ ID NO: 2127174 - protein, 17 aa, Cryptosporidium hominis
RSQLGMKSISIQWGPWG

SEQ ID NO: 2127175 - protein, 24 aa, Cryptosporidium hominis
RSQWDFLLQEMTWMSKDYYEERRW

SEQ ID NO: 2127176 - protein, 17 aa, Cryptosporidium hominis
RSRAEAVENVQRMIGEL

SEQ ID NO: 2127177 - protein, 23 aa, Cryptosporidium hominis
RSRKVGFLVVFLLNIIFFDVNIG

SEQ ID NO: 2127178 - protein, 18 aa, Cryptosporidium hominis
RSRSEIQDGLPISSSSSL

SEQ ID NO: 2127179 - protein, 19 aa, Cryptosporidium hominis
RSSILTVICFVSVIGINLG

SEQ ID NO: 2127180 - protein, 18 aa, Cryptosporidium hominis
RSSIMTRVFFESCGIADL

SEQ ID NO: 2127181 - protein, 26 aa, Cryptosporidium hominis
RSSLEILDLLDLFGLVDKKKNLLFDQ

SEQ ID NO: 2127182 - protein, 19 aa, Cryptosporidium hominis
RSSSSLPSVQAFTEAMEES

SEQ ID NO: 2127183 - protein, 21 aa, Cryptosporidium hominis
RSTISEIFLFSELSLSGKGGY

SEQ ID NO: 2127184 - protein, 25 aa, Cryptosporidium hominis
RSTKRPGFFFNMWQSDFEKILHDME

SEQ ID NO: 2127185 - protein, 17 aa, Cryptosporidium hominis
RSTRKMLLFLIIVIACS

SEQ ID NO: 2127186 - protein, 19 aa, Cryptosporidium hominis
RTDMSIRIQIDLRMWLTNL

SEQ ID NO: 2127187 - protein, 25 aa, Cryptosporidium hominis
RTFSMRFLLGVSESFSARKLFEPIQ

SEQ ID NO: 2127188 - protein, 18 aa, Cryptosporidium hominis
RTGGIRWLQVIKHTIELI

SEQ ID NO: 2127189 - protein, 19 aa, Cryptosporidium hominis
RTHHCSICNKCILNMDHHC

SEQ ID NO: 2127190 - protein, 17 aa, Cryptosporidium hominis
RTIGAWNAILIIIQLFF

SEQ ID NO: 2127191 - protein, 18 aa, Cryptosporidium hominis
RTIVYFVRLNYLPRVLAN

SEQ ID NO: 2127192 - protein, 19 aa, Cryptosporidium hominis
RTLLRFIIQTDHIFKDHNR

SEQ ID NO: 2127193 - protein, 18 aa, Cryptosporidium hominis
RTLWCTIRLEWEQVHLNS

SEQ ID NO: 2127194 - protein, 35 aa, Cryptosporidium hominis
RTNCLDCLDRTNALQWYIAWTWFVDLILSISTCSF

SEQ ID NO: 2127195 - protein, 19 aa, Cryptosporidium hominis
RTRLAMALSSKSSFLQSAK

SEQ ID NO: 2127196 - protein, 20 aa, Cryptosporidium hominis
RTSPTSKWIDCFKSDAKSIP

SEQ ID NO: 2127197 - protein, 19 aa, Cryptosporidium hominis
RVAVNQLKNFSIFFKGLIT

SEQ ID NO: 2127198 - protein, 18 aa, Cryptosporidium hominis
RVEFLYKKCVPNKSKPAD

SEQ ID NO: 2127199 - protein, 24 aa, Cryptosporidium hominis
RVEIKCILFRQEIFNFKNDSFFNN

SEQ ID NO: 2127200 - protein, 18 aa, Cryptosporidium hominis
RVFLLGNFITWILFVSIV

SEQ ID NO: 2127201 - protein, 27 aa, Cryptosporidium hominis
RVGESIWFTVLLCFILILLITSSIFEF

SEQ ID NO: 2127202 - protein, 22 aa, Cryptosporidium hominis
RVILLCFGCIWISENLDKNTKS

SEQ ID NO: 2127203 - protein, 20 aa, Cryptosporidium hominis
RVIPIWRGAWENHVASFWFA

SEQ ID NO: 2127204 - protein, 33 aa, Cryptosporidium hominis
RVIQCSDCEGFLKKGALFGGMSICTPIEFGGSF

SEQ ID NO: 2127205 - protein, 22 aa, Cryptosporidium hominis
RVQDLLRVMEWLYLQGYSLEEQ

SEQ ID NO: 2127206 - protein, 27 aa, Cryptosporidium hominis
RVQGGSCRRPSGILWMYKDTKDFGKPI

SEQ ID NO: 2127207 - protein, 27 aa, Cryptosporidium hominis
RVREYKKTELLECYTIFIDEYNISLEL

SEQ ID NO: 2127208 - protein, 25 aa, Cryptosporidium hominis
RVSFSNVNPSFEWEKLLEIRTPFYL

SEQ ID NO: 2127209 - protein, 19 aa, Cryptosporidium hominis
RVYERLFRQLLCTLITLLG

SEQ ID NO: 2127210 - protein, 31 aa, Cryptosporidium hominis
RVYSKSGALAFEAFNNIKLVKSYCLESFMFN

SEQ ID NO: 2127211 - protein, 19 aa, Cryptosporidium hominis
RVYSLLSISIAITFGIVSL

SEQ ID NO: 2127212 - protein, 23 aa, Cryptosporidium hominis
RWVIWRYAILYLLGGISGNLASA

SEQ ID NO: 2127213 - protein, 19 aa, Cryptosporidium hominis
RWYLPGYWWYEKVTFTSEV

SEQ ID NO: 2127214 - protein, 18 aa, Cryptosporidium hominis
RYDIVLMSRRSWERGGTR

SEQ ID NO: 2127215 - protein, 17 aa, Cryptosporidium hominis
RYESVGVVGTGRIRGIT

SEQ ID NO: 2127216 - protein, 25 aa, Cryptosporidium hominis
RYETPALYILCFDWQKYPINTNNSN

SEQ ID NO: 2127217 - protein, 20 aa, Cryptosporidium hominis
RYFINGCRTLRSCYISEYSP

SEQ ID NO: 2127218 - protein, 32 aa, Cryptosporidium hominis
RYHIPEIMCYGRIKCYIPCFFQNNNSIFTSIF

SEQ ID NO: 2127219 - protein, 24 aa, Cryptosporidium hominis
RYIFKELPQVFMILNTLKNTVSGT

SEQ ID NO: 2127220 - protein, 19 aa, Cryptosporidium hominis
RYIIMVLFIFIEYLIILKE

SEQ ID NO: 2127221 - protein, 17 aa, Cryptosporidium hominis
RYIPVSFILNRISLDQL

SEQ ID NO: 2127222 - protein, 27 aa, Cryptosporidium hominis
RYKLSLPELLRLLIIMIESWDELVIIY

SEQ ID NO: 2127223 - protein, 25 aa, Cryptosporidium hominis
RYLHQLGYLRSCGGMDLVYNPPYNQ

SEQ ID NO: 2127224 - protein, 19 aa, Cryptosporidium hominis
RYLYIMMEFVIGGEFFTYL

SEQ ID NO: 2127225 - protein, 20 aa, Cryptosporidium hominis
RYNIHLSSFLVLRDCIYIVF

SEQ ID NO: 2127226 - protein, 18 aa, Cryptosporidium hominis
RYQHCILGSILVSNSSNM

SEQ ID NO: 2127227 - protein, 19 aa, Cryptosporidium hominis
RYQLGYFSILGLLRLHALL

SEQ ID NO: 2127228 - protein, 25 aa, Cryptosporidium hominis
RYRLIYNWMQQYFIYKLRKIPKFNY

SEQ ID NO: 2127229 - protein, 19 aa, Cryptosporidium hominis
RYSNSYIDYAGWSEICFYN

SEQ ID NO: 2127230 - protein, 20 aa, Cryptosporidium hominis
SAFILYKSHTPYKCTKEQYR

SEQ ID NO: 2127231 - protein, 20 aa, Cryptosporidium hominis
SAFNSFKFITMILSYILVIS

SEQ ID NO: 2127232 - protein, 17 aa, Cryptosporidium hominis
SAFTIDIPDVSIILDNF

SEQ ID NO: 2127233 - protein, 25 aa, Cryptosporidium hominis
SAGLLKYVQMWSILFFFIPMFGTGE

SEQ ID NO: 2127234 - protein, 22 aa, Cryptosporidium hominis
SAGSSACFFALLAGIIVLLLEN

SEQ ID NO: 2127235 - protein, 17 aa, Cryptosporidium hominis
SAIKILAKRHFPELIST

SEQ ID NO: 2127236 - protein, 21 aa, Cryptosporidium hominis
SAILCVIVFTLGWKVTAINPG

SEQ ID NO: 2127237 - protein, 21 aa, Cryptosporidium hominis
SAIPGVVLMISMIVFMIILDI

SEQ ID NO: 2127238 - protein, 18 aa, Cryptosporidium hominis
SAIPIVLPGLYYKPYSYT

SEQ ID NO: 2127239 - protein, 25 aa, Cryptosporidium hominis
SAISGGLQWFWYSLILTLKMVFLVW

SEQ ID NO: 2127240 - protein, 19 aa, Cryptosporidium hominis
SAISLKVAIGYDYMKNYIL

SEQ ID NO: 2127241 - protein, 17 aa, Cryptosporidium hominis
SAKSSVSSLEFIRQYTD

SEQ ID NO: 2127242 - protein, 17 aa, Cryptosporidium hominis
SALPLIACMQFTFTFYI

SEQ ID NO: 2127243 - protein, 26 aa, Cryptosporidium hominis
SARLWCTSRTYPIRIFTGHFGDVRSV

SEQ ID NO: 2127244 - protein, 24 aa, Cryptosporidium hominis
SASFLSKFTFSWFTPIIDSAYDHI

SEQ ID NO: 2127245 - protein, 23 aa, Cryptosporidium hominis
SASFYKVAPWIPVYLETKNKFLI

SEQ ID NO: 2127246 - protein, 31 aa, Cryptosporidium hominis
SASICLKLGWRSVFYIPSIFVFLFGIIVLKY

SEQ ID NO: 2127247 - protein, 24 aa, Cryptosporidium hominis
SASLPIVAAAGFLITKIHRSWGTT

SEQ ID NO: 2127248 - protein, 19 aa, Cryptosporidium hominis
SAVHAIEMFIGEAISAITF

SEQ ID NO: 2127249 - protein, 17 aa, Cryptosporidium hominis
SAWHIFVVFTIPYILFR

SEQ ID NO: 2127250 - protein, 30 aa, Cryptosporidium hominis
SAYGSCLIVRLSAYIAFKKKFRSMLASDLI

SEQ ID NO: 2127251 - protein, 26 aa, Cryptosporidium hominis
SAYSNTRFGDILTFPTKDYPNGLALE

SEQ ID NO: 2127252 - protein, 19 aa, Cryptosporidium hominis
SCAAYQWYSSIYSGTNNFD

SEQ ID NO: 2127253 - protein, 28 aa, Cryptosporidium hominis
SCDMRFYKFCLRLSCSRMLESQLAQYKI

SEQ ID NO: 2127254 - protein, 17 aa, Cryptosporidium hominis
SCFQSNDGYFVFKEGKM

SEQ ID NO: 2127255 - protein, 22 aa, Cryptosporidium hominis
SCGELAIRVLIGLLKNELLQEE

SEQ ID NO: 2127256 - protein, 18 aa, Cryptosporidium hominis
SCGVMRPDLVMRSIIPAV

SEQ ID NO: 2127257 - protein, 18 aa, Cryptosporidium hominis
SCININIFNIISIINISG

SEQ ID NO: 2127258 - protein, 19 aa, Cryptosporidium hominis
SCITLRTGTLLQCASLLVL

SEQ ID NO: 2127259 - protein, 19 aa, Cryptosporidium hominis
SCIWACIPSQRLQSLIEIA

SEQ ID NO: 2127260 - protein, 25 aa, Cryptosporidium hominis
SCKIIYKIILWLLKYSKNIDEPLSV

SEQ ID NO: 2127261 - protein, 19 aa, Cryptosporidium hominis
SCKKVIFSCFLLVIFLANI

SEQ ID NO: 2127262 - protein, 20 aa, Cryptosporidium hominis
SCKYLIMLLNPWDLPIDCIS

SEQ ID NO: 2127263 - protein, 22 aa, Cryptosporidium hominis
SCLPLNFLECELFSKYNGNIDI

SEQ ID NO: 2127264 - protein, 22 aa, Cryptosporidium hominis
SCLPNLRYLNGRELTALQRKRN

SEQ ID NO: 2127265 - protein, 18 aa, Cryptosporidium hominis
SCLRKVNLDIRVGDFIGI

SEQ ID NO: 2127266 - protein, 17 aa, Cryptosporidium hominis
SCLYLLNQLLKVVNNVN

SEQ ID NO: 2127267 - protein, 21 aa, Cryptosporidium hominis
SCMDKRSSFEILIKTLNQAAS

SEQ ID NO: 2127268 - protein, 17 aa, Cryptosporidium hominis
SCRYCKKTSNSTGMEKI

SEQ ID NO: 2127269 - protein, 20 aa, Cryptosporidium hominis
SCSGCKGSSCTYSNSSNHSC

SEQ ID NO: 2127270 - protein, 24 aa, Cryptosporidium hominis
SCSPFGKSISCFEPALYYDLVRFM

SEQ ID NO: 2127271 - protein, 30 aa, Cryptosporidium hominis
SDCSICNDCPHSKSGIILGYIDLDQLSKQN

SEQ ID NO: 2127272 - protein, 20 aa, Cryptosporidium hominis
SDDGSWVYWGTVWSTMSFGP

SEQ ID NO: 2127273 - protein, 23 aa, Cryptosporidium hominis
SDDPSSICQMILKSKSIVAQNPS

SEQ ID NO: 2127274 - protein, 17 aa, Cryptosporidium hominis
SDEGFSLSSTDDHFITS

SEQ ID NO: 2127275 - protein, 21 aa, Cryptosporidium hominis
SDELITWAGRHQWKDPHLLAF

SEQ ID NO: 2127276 - protein, 22 aa, Cryptosporidium hominis
SDEVRGGSKLSLRNVAITSDIP

SEQ ID NO: 2127277 - protein, 26 aa, Cryptosporidium hominis
SDFKIRRKHCIGGLSVVCKNKLNPKV

SEQ ID NO: 2127278 - protein, 31 aa, Cryptosporidium hominis
SDGECKRTVNIKRLWEFGRLYNELNKNSESS

SEQ ID NO: 2127279 - protein, 19 aa, Cryptosporidium hominis
SDIQFFWGYSLAILAFLTS

SEQ ID NO: 2127280 - protein, 19 aa, Cryptosporidium hominis
SDIVLIIIRVLRCLPSKQF

SEQ ID NO: 2127281 - protein, 20 aa, Cryptosporidium hominis
SDLFFKRPSKVFEEKKEEEE

SEQ ID NO: 2127282 - protein, 21 aa, Cryptosporidium hominis
SDLHLKILLVCLIQKSITVEI

SEQ ID NO: 2127283 - protein, 24 aa, Cryptosporidium hominis
SDLSYIKVRSWRLFSKSHMYYGSS

SEQ ID NO: 2127284 - protein, 17 aa, Cryptosporidium hominis
SDLYYIFLLASNTKLNY

SEQ ID NO: 2127285 - protein, 17 aa, Cryptosporidium hominis
SDMNLDLICRVPIQCKL

SEQ ID NO: 2127286 - protein, 24 aa, Cryptosporidium hominis
SDPFKIFIWLCMYAHDPHIYNGVL

SEQ ID NO: 2127287 - protein, 24 aa, Cryptosporidium hominis
SDPKFIIQPKFKWVPLKVNNAKIP

SEQ ID NO: 2127288 - protein, 30 aa, Cryptosporidium hominis
SDQRFPWYVEPIIRPVYRRIYPEPSLYIFF

SEQ ID NO: 2127289 - protein, 20 aa, Cryptosporidium hominis
SDSIMKCFFNALTIIIITIL

SEQ ID NO: 2127290 - protein, 17 aa, Cryptosporidium hominis
SDSVLMFGMGSGNNTNG

SEQ ID NO: 2127291 - protein, 17 aa, Cryptosporidium hominis
SDVLAIDLFTGRILSNS

SEQ ID NO: 2127292 - protein, 20 aa, Cryptosporidium hominis
SDVNCWKFKSVFKRKNKKSK

SEQ ID NO: 2127293 - protein, 18 aa, Cryptosporidium hominis
SDYSRVFCLPNSDIIEQE

SEQ ID NO: 2127294 - protein, 17 aa, Cryptosporidium hominis
SEAFPTILNSISSKSDQ

SEQ ID NO: 2127295 - protein, 25 aa, Cryptosporidium hominis
SEEACRIFRGFNYLREGGFIIRFTN

SEQ ID NO: 2127296 - protein, 20 aa, Cryptosporidium hominis
SEECKLEYILKILSTHQANL

SEQ ID NO: 2127297 - protein, 20 aa, Cryptosporidium hominis
SEFDHLFILDNCFRSIDVPV

SEQ ID NO: 2127298 - protein, 17 aa, Cryptosporidium hominis
SEFELIKNIKFKNWEKI

SEQ ID NO: 2127299 - protein, 19 aa, Cryptosporidium hominis
SEFGEDLGFEYTILESNKI

SEQ ID NO: 2127300 - protein, 20 aa, Cryptosporidium hominis
SEFGNTCLLLIITAISIIIL

SEQ ID NO: 2127301 - protein, 23 aa, Cryptosporidium hominis
SEFKGCTILTIAHRIKTIINYDK

SEQ ID NO: 2127302 - protein, 27 aa, Cryptosporidium hominis
SEGQFCMGMVYTLFPFLDSLECITNSH

SEQ ID NO: 2127303 - protein, 22 aa, Cryptosporidium hominis
SEGRKALKRYFIDLCDSAEVVI

SEQ ID NO: 2127304 - protein, 22 aa, Cryptosporidium hominis
SEGSRILGYFFEDFVEFENKLS

SEQ ID NO: 2127305 - protein, 22 aa, Cryptosporidium hominis
SEHLALFVVFEFILKVLALFYW

SEQ ID NO: 2127306 - protein, 19 aa, Cryptosporidium hominis
SEICMPYTVLPAIMNEYRI

SEQ ID NO: 2127307 - protein, 20 aa, Cryptosporidium hominis
SEINLVLILSTSMFDLPDFF

SEQ ID NO: 2127308 - protein, 26 aa, Cryptosporidium hominis
SEKDLPWLKPGLEYSGVSFQQFNFIM

SEQ ID NO: 2127309 - protein, 26 aa, Cryptosporidium hominis
SEKGKEIFSSYGFLIVERYKYFSRKY

SEQ ID NO: 2127310 - protein, 19 aa, Cryptosporidium hominis
SEKISYPLVNGFNINQSRI

SEQ ID NO: 2127311 - protein, 22 aa, Cryptosporidium hominis
SEKNCLPNICMVSDFFYPGLGG

SEQ ID NO: 2127312 - protein, 22 aa, Cryptosporidium hominis
SEKSENCYFVLGKYYKLKKSVG

SEQ ID NO: 2127313 - protein, 28 aa, Cryptosporidium hominis
SEKSTYWFKCIQSLCYYAKIEEIYLSIY

SEQ ID NO: 2127314 - protein, 21 aa, Cryptosporidium hominis
SELDFLGWFSVASFFTLATVI

SEQ ID NO: 2127315 - protein, 23 aa, Cryptosporidium hominis
SELFERKPGFFFFLEEKQTGIVF

SEQ ID NO: 2127316 - protein, 19 aa, Cryptosporidium hominis
SELFKKLLDEISIEANVRE

SEQ ID NO: 2127317 - protein, 19 aa, Cryptosporidium hominis
SELLISQGFLRNQKNSNGD

SEQ ID NO: 2127318 - protein, 28 aa, Cryptosporidium hominis
SELPSLEICRVGGILIFFYLISNYWKNQ

SEQ ID NO: 2127319 - protein, 22 aa, Cryptosporidium hominis
SELQSKCFLGSLYTLYSSNSGI

SEQ ID NO: 2127320 - protein, 18 aa, Cryptosporidium hominis
SELVREIAWVIFDEIHYM

SEQ ID NO: 2127321 - protein, 17 aa, Cryptosporidium hominis
SEMIHQIRMIWLFIKFL

SEQ ID NO: 2127322 - protein, 18 aa, Cryptosporidium hominis
SEMIKANIFALINSNLVS

SEQ ID NO: 2127323 - protein, 25 aa, Cryptosporidium hominis
SEMSRFSLYEGYTWDNLEVTSKINS

SEQ ID NO: 2127324 - protein, 19 aa, Cryptosporidium hominis
SEMVKYVRPVPGITEYGLS

SEQ ID NO: 2127325 - protein, 19 aa, Cryptosporidium hominis
SERIKLLSIELGKEAESIA

SEQ ID NO: 2127326 - protein, 17 aa, Cryptosporidium hominis
SERIVRKKLLAGDVETL

SEQ ID NO: 2127327 - protein, 24 aa, Cryptosporidium hominis
SESDYKLFFRFLKARQFNVEKSTE

SEQ ID NO: 2127328 - protein, 20 aa, Cryptosporidium hominis
SESFPWVIEEVVGRYFYMTL

SEQ ID NO: 2127329 - protein, 23 aa, Cryptosporidium hominis
SESYCLYSNIALGSYEETKMFYS

SEQ ID NO: 2127330 - protein, 23 aa, Cryptosporidium hominis
SETWIYTVFRFFFPDSAPLSWLF

SEQ ID NO: 2127331 - protein, 18 aa, Cryptosporidium hominis
SEVLRARWNELSNNKNDQ

SEQ ID NO: 2127332 - protein, 26 aa, Cryptosporidium hominis
SEWRFSENFIGVILLPLVGNAAEHIT

SEQ ID NO: 2127333 - protein, 26 aa, Cryptosporidium hominis
SEYRSRWMIAMHPFRVTVSYNEKGKQ

SEQ ID NO: 2127334 - protein, 19 aa, Cryptosporidium hominis
SEYYILRVPFSRFVSLHTS

SEQ ID NO: 2127335 - protein, 27 aa, Cryptosporidium hominis
SFEDWKRRVIFHANIVWSPKQIYMQSV

SEQ ID NO: 2127336 - protein, 19 aa, Cryptosporidium hominis
SFEEFPIRIATFVELCNLS

SEQ ID NO: 2127337 - protein, 18 aa, Cryptosporidium hominis
SFEFTIITLLNFALYLTG

SEQ ID NO: 2127338 - protein, 19 aa, Cryptosporidium hominis
SFFNSIKFKRFKKRYAGVL

SEQ ID NO: 2127339 - protein, 18 aa, Cryptosporidium hominis
SFFPGRHYTPALDFGFMI

SEQ ID NO: 2127340 - protein, 20 aa, Cryptosporidium hominis
SFFSIKLLKRVFLLGNFITW

SEQ ID NO: 2127341 - protein, 19 aa, Cryptosporidium hominis
SFFTNFFVVLSCYISAIGP

SEQ ID NO: 2127342 - protein, 38 aa, Cryptosporidium hominis
SFFYSKLRPIIAVYYFKHPWFLKSWKFVNIEPVELKLL

SEQ ID NO: 2127343 - protein, 26 aa, Cryptosporidium hominis
SFGNRCIFESEFFRDWKKPLLQQCSE

SEQ ID NO: 2127344 - protein, 18 aa, Cryptosporidium hominis
SFILGNRMLYNFKSKKCL

SEQ ID NO: 2127345 - protein, 19 aa, Cryptosporidium hominis
SFIPMIITTLIFGLIVYIK

SEQ ID NO: 2127346 - protein, 25 aa, Cryptosporidium hominis
SFIPYIIGLVLFVWLLIGDSFVPAY

SEQ ID NO: 2127347 - protein, 18 aa, Cryptosporidium hominis
SFISFILFYSEIESLDTQ

SEQ ID NO: 2127348 - protein, 27 aa, Cryptosporidium hominis
SFITTCLFCLLGIIVVLYYFKEYRFYP

SEQ ID NO: 2127349 - protein, 20 aa, Cryptosporidium hominis
SFIVWPLCWSIITFYTISWS

SEQ ID NO: 2127350 - protein, 26 aa, Cryptosporidium hominis
SFLNSFKMKFSVIIAFFQMTLGVILK

SEQ ID NO: 2127351 - protein, 27 aa, Cryptosporidium hominis
SFLVLRDCIYIVFSLIYYSKSRELDDF

SEQ ID NO: 2127352 - protein, 18 aa, Cryptosporidium hominis
SFPLPALAIAYACNDVYS

SEQ ID NO: 2127353 - protein, 19 aa, Cryptosporidium hominis
SFSIFSFFNSLLFKPSLSY

SEQ ID NO: 2127354 - protein, 37 aa, Cryptosporidium hominis
SFSLMILFKWIHIFYIEIKYLFWIWKSNYLQNAPSSE

SEQ ID NO: 2127355 - protein, 17 aa, Cryptosporidium hominis
SFSPPAILVCFRSANPN

SEQ ID NO: 2127356 - protein, 18 aa, Cryptosporidium hominis
SFSSLKIPIAIEYIEPIL

SEQ ID NO: 2127357 - protein, 26 aa, Cryptosporidium hominis
SFTSFKHPLLRITALELMSLLFELEF

SEQ ID NO: 2127358 - protein, 22 aa, Cryptosporidium hominis
SFVLLFCLFFYQLDKLHAEVIY

SEQ ID NO: 2127359 - protein, 24 aa, Cryptosporidium hominis
SFVLSVINMAKFVEKIKIPICQHN

SEQ ID NO: 2127360 - protein, 30 aa, Cryptosporidium hominis
SFVVRCFCKPLKRYSIPTPRSIPIIGTSEY

SEQ ID NO: 2127361 - protein, 23 aa, Cryptosporidium hominis
SFWMMISCIFITFLGYILHDSLS

SEQ ID NO: 2127362 - protein, 18 aa, Cryptosporidium hominis
SFYAKFLRLVEFKNRNTE

SEQ ID NO: 2127363 - protein, 27 aa, Cryptosporidium hominis
SGAILSHIMCLGMNRSLLNVMLGGWEC

SEQ ID NO: 2127364 - protein, 22 aa, Cryptosporidium hominis
SGAILSYIMCKGMNRDFISVLL

SEQ ID NO: 2127365 - protein, 18 aa, Cryptosporidium hominis
SGALGCPVSASIAYAQAM

SEQ ID NO: 2127366 - protein, 19 aa, Cryptosporidium hominis
SGDQKLLVHKDWDSIIKAA

SEQ ID NO: 2127367 - protein, 24 aa, Cryptosporidium hominis
SGEDATEFLIKFLGRSTISKMISN

SEQ ID NO: 2127368 - protein, 23 aa, Cryptosporidium hominis
SGEFFNIRYEKISKFSQNLISLR

SEQ ID NO: 2127369 - protein, 20 aa, Cryptosporidium hominis
SGELITWGAGYYGRLGTNST

SEQ ID NO: 2127370 - protein, 18 aa, Cryptosporidium hominis
SGERKGLFVRIYRDLSRL

SEQ ID NO: 2127371 - protein, 27 aa, Cryptosporidium hominis
SGGQRARICLARALYSLPDYLFYNQES

SEQ ID NO: 2127372 - protein, 25 aa, Cryptosporidium hominis
SGGRQSSLWNALNFLSSFSNKEEKS

SEQ ID NO: 2127373 - protein, 18 aa, Cryptosporidium hominis
SGGSFLLQRFLLILFSKQ

SEQ ID NO: 2127374 - protein, 18 aa, Cryptosporidium hominis
SGHLLGNVYFRLNPEDAT

SEQ ID NO: 2127375 - protein, 23 aa, Cryptosporidium hominis
SGILNFFLGIIIIWCIHTTSPIA

SEQ ID NO: 2127376 - protein, 17 aa, Cryptosporidium hominis
SGILVQIASNFFVNGFR

SEQ ID NO: 2127377 - protein, 19 aa, Cryptosporidium hominis
SGISSLPFFARAWIAALPL

SEQ ID NO: 2127378 - protein, 19 aa, Cryptosporidium hominis
SGITSVQCLSRILREYREI

SEQ ID NO: 2127379 - protein, 32 aa, Cryptosporidium hominis
SGIVKNIKENIPFKHILLPFTTTTTTVTTTTT

SEQ ID NO: 2127380 - protein, 22 aa, Cryptosporidium hominis
SGKDPKVRWEEIRQGIMDLRML

SEQ ID NO: 2127381 - protein, 26 aa, Cryptosporidium hominis
SGKESHHLRKSCSFLVDEFFQSELFE

SEQ ID NO: 2127382 - protein, 18 aa, Cryptosporidium hominis
SGLPGVFIVYDFQPFLLQ

SEQ ID NO: 2127383 - protein, 19 aa, Cryptosporidium hominis
SGLSKCGYTIVFALDNCEP

SEQ ID NO: 2127384 - protein, 24 aa, Cryptosporidium hominis
SGLTKEWDEFLTLYQHRNEEINND

SEQ ID NO: 2127385 - protein, 19 aa, Cryptosporidium hominis
SGNARLLFDDNLAKKVNEL

SEQ ID NO: 2127386 - protein, 20 aa, Cryptosporidium hominis
SGPYYPCHSIVYSNVNKLTF

SEQ ID NO: 2127387 - protein, 22 aa, Cryptosporidium hominis
SGQIFFAISILLSFPLMIFPVK

SEQ ID NO: 2127388 - protein, 18 aa, Cryptosporidium hominis
SGSGFHWNLETELINFEN

SEQ ID NO: 2127389 - protein, 20 aa, Cryptosporidium hominis
SGSIGGFFIVFSLSIGIIHY

SEQ ID NO: 2127390 - protein, 22 aa, Cryptosporidium hominis
SGSYILHMMFILIGSLDYYNLD

SEQ ID NO: 2127391 - protein, 23 aa, Cryptosporidium hominis
SGVQCIYSIIGFPTYFKIFDKTP

SEQ ID NO: 2127392 - protein, 23 aa, Cryptosporidium hominis
SGYDSEVHWQYVFDLDETISVYS

SEQ ID NO: 2127393 - protein, 26 aa, Cryptosporidium hominis
SGYFEMFEIIGVFLIITYLSIIFIYS

SEQ ID NO: 2127394 - protein, 23 aa, Cryptosporidium hominis
SGYMAAVCKYGCGEMGVTYPYYY

SEQ ID NO: 2127395 - protein, 23 aa, Cryptosporidium hominis
SHCMAFLVVCVIVLNSSKYILST

SEQ ID NO: 2127396 - protein, 25 aa, Cryptosporidium hominis
SHFDLQFIFTFIFWGKICVLTSISW

SEQ ID NO: 2127397 - protein, 26 aa, Cryptosporidium hominis
SHGVSLRSLFSISIFNFLTYNLIGEQ

SEQ ID NO: 2127398 - protein, 27 aa, Cryptosporidium hominis
SHHLSDLFVYFGISRFTLYYIKHNIAL

SEQ ID NO: 2127399 - protein, 26 aa, Cryptosporidium hominis
SHISAHIGSLLAWLFQNMAQHVEQDG

SEQ ID NO: 2127400 - protein, 21 aa, Cryptosporidium hominis
SHMNYMYGLIIIFIFGILTHL

SEQ ID NO: 2127401 - protein, 22 aa, Cryptosporidium hominis
SHNDTWIKGGMEFYLMLLQFIY

SEQ ID NO: 2127402 - protein, 25 aa, Cryptosporidium hominis
SHQLWKFIIDSSILFSISCFSSTPT

SEQ ID NO: 2127403 - protein, 18 aa, Cryptosporidium hominis
SHTPYKCTKEQYRILKGK

SEQ ID NO: 2127404 - protein, 21 aa, Cryptosporidium hominis
SHVEKLLCCNIPSFLGISPNP

SEQ ID NO: 2127405 - protein, 18 aa, Cryptosporidium hominis
SIAGLVGTAAFLWVSGPV

SEQ ID NO: 2127406 - protein, 21 aa, Cryptosporidium hominis
SIAHLAVPFGFNISEIENINE

SEQ ID NO: 2127407 - protein, 33 aa, Cryptosporidium hominis
SIAMYCMHVTFMLVFRSGGCMALLISNGLVMLL

SEQ ID NO: 2127408 - protein, 26 aa, Cryptosporidium hominis
SICIALRLLFRCCGIKCGSSCTNKKN

SEQ ID NO: 2127409 - protein, 24 aa, Cryptosporidium hominis
SIDDEMILYLSLEHQLKINNETMV

SEQ ID NO: 2127410 - protein, 18 aa, Cryptosporidium hominis
SIDIDFWITNSFSNFSGI

SEQ ID NO: 2127411 - protein, 24 aa, Cryptosporidium hominis
SIDYFPFAIALTILAKNLFSVINS

SEQ ID NO: 2127412 - protein, 19 aa, Cryptosporidium hominis
SIEISKLLLKFGANPNEKD

SEQ ID NO: 2127413 - protein, 25 aa, Cryptosporidium hominis
SIETCKTCLVGGWSEWSDCSTSCGE

SEQ ID NO: 2127414 - protein, 22 aa, Cryptosporidium hominis
SIFCIFIYLFGKVEASLTDIPW

SEQ ID NO: 2127415 - protein, 18 aa, Cryptosporidium hominis
SIFEAIERIVLPPSNDQY

SEQ ID NO: 2127416 - protein, 22 aa, Cryptosporidium hominis
SIFKPHAMSAIFIGKLNNSSLI

SEQ ID NO: 2127417 - protein, 25 aa, Cryptosporidium hominis
SIFPKIAIHEKVQWLLWICVLITTI

SEQ ID NO: 2127418 - protein, 26 aa, Cryptosporidium hominis
SIFSESCFKSSIKLNVELPKYSRQIV

SEQ ID NO: 2127419 - protein, 23 aa, Cryptosporidium hominis
SIFVNFPSVWGIKRSRPANKIKK

SEQ ID NO: 2127420 - protein, 26 aa, Cryptosporidium hominis
SIGENGKILWKRKILEEGTFYPSRVF

SEQ ID NO: 2127421 - protein, 17 aa, Cryptosporidium hominis
SIIARLAKNRGHYITSI

SEQ ID NO: 2127422 - protein, 19 aa, Cryptosporidium hominis
SIIICIVVSLISIVTQGKN

SEQ ID NO: 2127423 - protein, 20 aa, Cryptosporidium hominis
SIIKKCKRIYHLSDGILKEI

SEQ ID NO: 2127424 - protein, 19 aa, Cryptosporidium hominis
SIILLKFLNEYYKICSKSL

SEQ ID NO: 2127425 - protein, 24 aa, Cryptosporidium hominis
SIILLPDTVRLVFLSATIPNHLEF

SEQ ID NO: 2127426 - protein, 17 aa, Cryptosporidium hominis
SIISLGLEFDFWEYPED

SEQ ID NO: 2127427 - protein, 24 aa, Cryptosporidium hominis
SIISNRLSFIYGIKGPSVTIDTAC

SEQ ID NO: 2127428 - protein, 24 aa, Cryptosporidium hominis
SIKKLKISVFNWFIFIIFVIYIRL

SEQ ID NO: 2127429 - protein, 32 aa, Cryptosporidium hominis
SIKMLLDILILKSFYILHIWKVKDPSLLGRPC

SEQ ID NO: 2127430 - protein, 23 aa, Cryptosporidium hominis
SIKSRLEVGVGYSMYQDVYILNS

SEQ ID NO: 2127431 - protein, 20 aa, Cryptosporidium hominis
SIKTYLLFLDICVLNVIKND

SEQ ID NO: 2127432 - protein, 20 aa, Cryptosporidium hominis
SILCFPHIFHIPELELAAKR

SEQ ID NO: 2127433 - protein, 17 aa, Cryptosporidium hominis
SILCLCNLLMENEKGLN

SEQ ID NO: 2127434 - protein, 26 aa, Cryptosporidium hominis
SILECLRFSLFGEISIPVFRDIISRD

SEQ ID NO: 2127435 - protein, 18 aa, Cryptosporidium hominis
SILFHMLLFIIGKTDEIW

SEQ ID NO: 2127436 - protein, 33 aa, Cryptosporidium hominis
SILGLDYTRLFSAFCHYHGLLVGSGTGAGVGSG

SEQ ID NO: 2127437 - protein, 30 aa, Cryptosporidium hominis
SILLFTMFLFRPFKSLKLFSNVLAKHNNES

SEQ ID NO: 2127438 - protein, 18 aa, Cryptosporidium hominis
SILQEIYLLLNYNNEYFK

SEQ ID NO: 2127439 - protein, 18 aa, Cryptosporidium hominis
SILRSGRVGHSLKGEELF

SEQ ID NO: 2127440 - protein, 21 aa, Cryptosporidium hominis
SILRYSLCELTVFSIGDWGEK

SEQ ID NO: 2127441 - protein, 18 aa, Cryptosporidium hominis
SILSELDVLEKCFTRIRL

SEQ ID NO: 2127442 - protein, 23 aa, Cryptosporidium hominis
SILSLLFKIMYLIRILNSLRCLV

SEQ ID NO: 2127443 - protein, 24 aa, Cryptosporidium hominis
SILSNLLLVLGMSFFAGGIFHHVQ

SEQ ID NO: 2127444 - protein, 25 aa, Cryptosporidium hominis
SILSRNGFCTVPIFINLTFEAIENI

SEQ ID NO: 2127445 - protein, 25 aa, Cryptosporidium hominis
SILVCLLAIISIRFLVKCCQGKETL

SEQ ID NO: 2127446 - protein, 23 aa, Cryptosporidium hominis
SILYCPLRIFVLCLTTIVVITIL

SEQ ID NO: 2127447 - protein, 20 aa, Cryptosporidium hominis
SIMLCIIQNPLTGIFIGLVV

SEQ ID NO: 2127448 - protein, 20 aa, Cryptosporidium hominis
SINIPRVLPLGINEERLPES

SEQ ID NO: 2127449 - protein, 23 aa, Cryptosporidium hominis
SINLCNYCLNFGFNHKIEDIKLI

SEQ ID NO: 2127450 - protein, 23 aa, Cryptosporidium hominis
SINTLIFFCIGKIMLVAIYNKKN

SEQ ID NO: 2127451 - protein, 23 aa, Cryptosporidium hominis
SIPIFKEFLLRKDIQDFDIVSAT

SEQ ID NO: 2127452 - protein, 18 aa, Cryptosporidium hominis
SIPLQLFPSMGIIEKYIL

SEQ ID NO: 2127453 - protein, 17 aa, Cryptosporidium hominis
SIPSGFAPLPLPSLEAI

SEQ ID NO: 2127454 - protein, 23 aa, Cryptosporidium hominis
SIQSSVFPWAFIYNNSGKMIEKD

SEQ ID NO: 2127455 - protein, 19 aa, Cryptosporidium hominis
SIQWGPWVGEGMASNNLSL

SEQ ID NO: 2127456 - protein, 18 aa, Cryptosporidium hominis
SIRIDIHELRDLKFNDGT

SEQ ID NO: 2127457 - protein, 21 aa, Cryptosporidium hominis
SIRLILNLLKKEESLLFMISS

SEQ ID NO: 2127458 - protein, 35 aa, Cryptosporidium hominis
SISDPGLLRKASIYNILSKLYVKLPYSDLSNIILF

SEQ ID NO: 2127459 - protein, 24 aa, Cryptosporidium hominis
SISEKKNKCEIIYSFKVKNSINKL

SEQ ID NO: 2127460 - protein, 19 aa, Cryptosporidium hominis
SISPEVIYGLILESFSECN

SEQ ID NO: 2127461 - protein, 21 aa, Cryptosporidium hominis
SISPSNLFAFFTFIHALLISI

SEQ ID NO: 2127462 - protein, 20 aa, Cryptosporidium hominis
SITLAFSIFQIFTAMSFPGL

SEQ ID NO: 2127463 - protein, 19 aa, Cryptosporidium hominis
SIVSGKFWSSYLIMEQFAG

SEQ ID NO: 2127464 - protein, 20 aa, Cryptosporidium hominis
SIVVCGALAMVALLLIPKNS

SEQ ID NO: 2127465 - protein, 21 aa, Cryptosporidium hominis
SIVYFPKTIHLLGRIGDDSVV

SEQ ID NO: 2127466 - protein, 21 aa, Cryptosporidium hominis
SIYAWIKYTIFHYLKHFFTII

SEQ ID NO: 2127467 - protein, 19 aa, Cryptosporidium hominis
SIYMLAFNIILKIKYSSYF

SEQ ID NO: 2127468 - protein, 26 aa, Cryptosporidium hominis
SIYNISGRMISIFLVIFGFIQFLKFK

SEQ ID NO: 2127469 - protein, 19 aa, Cryptosporidium hominis
SIYTEKLLRCESCGRNFHL

SEQ ID NO: 2127470 - protein, 20 aa, Cryptosporidium hominis
SIYYFFIRYFINGCRTLRSC

SEQ ID NO: 2127471 - protein, 26 aa, Cryptosporidium hominis
SKALFPSRNQFVWCLLWTTTEYTRTF

SEQ ID NO: 2127472 - protein, 20 aa, Cryptosporidium hominis
SKAPMKLLFCREDPYNRPIY

SEQ ID NO: 2127473 - protein, 23 aa, Cryptosporidium hominis
SKARVCIFFPIGELFNIMNIYWL

SEQ ID NO: 2127474 - protein, 17 aa, Cryptosporidium hominis
SKCKSNGINNFKKPKNL

SEQ ID NO: 2127475 - protein, 24 aa, Cryptosporidium hominis
SKCLHGYFRIHWLEIPKLAFKLTN

SEQ ID NO: 2127476 - protein, 18 aa, Cryptosporidium hominis
SKELFPGTVIFIDKAMRI

SEQ ID NO: 2127477 - protein, 19 aa, Cryptosporidium hominis
SKERCKGIGNPNVVYCEPG

SEQ ID NO: 2127478 - protein, 20 aa, Cryptosporidium hominis
SKETCIRLTLLGYISEANCA

SEQ ID NO: 2127479 - protein, 19 aa, Cryptosporidium hominis
SKFFDPFVFNFSIDVHQCI

SEQ ID NO: 2127480 - protein, 19 aa, Cryptosporidium hominis
SKFGKKRGINSCLRGRKDD

SEQ ID NO: 2127481 - protein, 24 aa, Cryptosporidium hominis
SKFPIKYDLNGLLFWNVSSDTYIY

SEQ ID NO: 2127482 - protein, 27 aa, Cryptosporidium hominis
SKFWLKLRKEAIGWFIYTIEDPKYSVD

SEQ ID NO: 2127483 - protein, 23 aa, Cryptosporidium hominis
SKGGESFLPLSLNIQALNPSEPS

SEQ ID NO: 2127484 - protein, 30 aa, Cryptosporidium hominis
SKGINSRKSMPRCCKMNKYQIYRILITILG

SEQ ID NO: 2127485 - protein, 20 aa, Cryptosporidium hominis
SKGRWSEQVDLLAREEDKSL

SEQ ID NO: 2127486 - protein, 26 aa, Cryptosporidium hominis
SKHDCPYISYKIPNSFSAFPTSNNTI

SEQ ID NO: 2127487 - protein, 17 aa, Cryptosporidium hominis
SKHKKKKLFGITGNLFK

SEQ ID NO: 2127488 - protein, 21 aa, Cryptosporidium hominis
SKIEPIWIHRNRVQCVRFHPW

SEQ ID NO: 2127489 - protein, 23 aa, Cryptosporidium hominis
SKIFSRLFGHKGFLNSPYSRTIL

SEQ ID NO: 2127490 - protein, 19 aa, Cryptosporidium hominis
SKIGRFFFEDQIAILEFSI

SEQ ID NO: 2127491 - protein, 19 aa, Cryptosporidium hominis
SKILIALMIATAFGSLSRI

SEQ ID NO: 2127492 - protein, 26 aa, Cryptosporidium hominis
SKINGMPVIEVWRASKVIVSKRSLGK

SEQ ID NO: 2127493 - protein, 26 aa, Cryptosporidium hominis
SKIQITSLFSWITIFVVVLFAISIIN

SEQ ID NO: 2127494 - protein, 25 aa, Cryptosporidium hominis
SKISGMPVINVWKAKQVVVSKRSLA

SEQ ID NO: 2127495 - protein, 32 aa, Cryptosporidium hominis
SKKGVIPIHLACKIQDFDILRLLLRCEDLDVN

SEQ ID NO: 2127496 - protein, 25 aa, Cryptosporidium hominis
SKKIGRWDLLDIFNKNLLIIMDGVI

SEQ ID NO: 2127497 - protein, 21 aa, Cryptosporidium hominis
SKKIIKGLCSSFLFEFDLNSP

SEQ ID NO: 2127498 - protein, 17 aa, Cryptosporidium hominis
SKKKFKVPTLEVLYKET

SEQ ID NO: 2127499 - protein, 24 aa, Cryptosporidium hominis
SKKLRSSDLLDMNKLRLPSELNNN

SEQ ID NO: 2127500 - protein, 25 aa, Cryptosporidium hominis
SKKPEAINIIGIFNVWNFKKNSPEN

SEQ ID NO: 2127501 - protein, 17 aa, Cryptosporidium hominis
SKKSFKMFEEFDQINEF

SEQ ID NO: 2127502 - protein, 28 aa, Cryptosporidium hominis
SKKVGFFEVWLLLSLWKRYPARIYRHMM

SEQ ID NO: 2127503 - protein, 24 aa, Cryptosporidium hominis
SKNIKASYFFFIWSVWLFTISFLF

SEQ ID NO: 2127504 - protein, 17 aa, Cryptosporidium hominis
SKPIVGIIHAAGVLDDR

SEQ ID NO: 2127505 - protein, 19 aa, Cryptosporidium hominis
SKPRIGLAVVSILFSILAL

SEQ ID NO: 2127506 - protein, 18 aa, Cryptosporidium hominis
SKRCKSIWERILILDSNI

SEQ ID NO: 2127507 - protein, 31 aa, Cryptosporidium hominis
SKRKGSCGSCGRCFGSLFIILFAFICTSCCY

SEQ ID NO: 2127508 - protein, 22 aa, Cryptosporidium hominis
SKRKSRRRAASNTKKISGVMAP

SEQ ID NO: 2127509 - protein, 36 aa, Cryptosporidium hominis
SKRTGSSKRRARKIMTKKGLSLLIKEFNTSKTKKKT

SEQ ID NO: 2127510 - protein, 24 aa, Cryptosporidium hominis
SKRVKNCLTYLLVAAFTTIALILI

SEQ ID NO: 2127511 - protein, 30 aa, Cryptosporidium hominis
SKSGDLPEDRFCWNYNFLMPLYEGGSSTSK

SEQ ID NO: 2127512 - protein, 20 aa, Cryptosporidium hominis
SKSGFLASFSFVAWMICIPS

SEQ ID NO: 2127513 - protein, 21 aa, Cryptosporidium hominis
SKSIIEYSVNPCFPPNNSKIE

SEQ ID NO: 2127514 - protein, 21 aa, Cryptosporidium hominis
SKSKLLLFILHTLRQLGIQYT

SEQ ID NO: 2127515 - protein, 18 aa, Cryptosporidium hominis
SKSQRGLRGYKEEAHPEL

SEQ ID NO: 2127516 - protein, 19 aa, Cryptosporidium hominis
SKSSLSIKDISNFNPLSVN

SEQ ID NO: 2127517 - protein, 24 aa, Cryptosporidium hominis
SKTSGILKFFSIVICELISGSILQ

SEQ ID NO: 2127518 - protein, 18 aa, Cryptosporidium hominis
SKTSLDFIPSGYKDIRSD

SEQ ID NO: 2127519 - protein, 22 aa, Cryptosporidium hominis
SKTWQILSKFWASYLEKNKKSP

SEQ ID NO: 2127520 - protein, 17 aa, Cryptosporidium hominis
SKVCTYYIFSVVIKSVI

SEQ ID NO: 2127521 - protein, 25 aa, Cryptosporidium hominis
SKVLLFRLFCLVFFCTIILYDIFTE

SEQ ID NO: 2127522 - protein, 17 aa, Cryptosporidium hominis
SKVSPRFISPSVPLITP

SEQ ID NO: 2127523 - protein, 20 aa, Cryptosporidium hominis
SKWIDCFKSDAKSIPSSIKN

SEQ ID NO: 2127524 - protein, 21 aa, Cryptosporidium hominis
SKWKSCSKWSNKNKFELENDR

SEQ ID NO: 2127525 - protein, 26 aa, Cryptosporidium hominis
SKWSIYRLVFIYSFLLIIYQFLDILL

SEQ ID NO: 2127526 - protein, 25 aa, Cryptosporidium hominis
SKYAKDAILSLCFSSEGGMISFGGY

SEQ ID NO: 2127527 - protein, 19 aa, Cryptosporidium hominis
SKYFIYPFLFQYNTRSNID

SEQ ID NO: 2127528 - protein, 34 aa, Cryptosporidium hominis
SLAGLGLLGGLGYGFKRKKTRGGDLTGDNIGMSK

SEQ ID NO: 2127529 - protein, 17 aa, Cryptosporidium hominis
SLAIFNNIFKLFLLIIP

SEQ ID NO: 2127530 - protein, 18 aa, Cryptosporidium hominis
SLARTNLNFTLGVKSPLH

SEQ ID NO: 2127531 - protein, 23 aa, Cryptosporidium hominis
SLCNICLKISPGERIGIVGRTGA

SEQ ID NO: 2127532 - protein, 20 aa, Cryptosporidium hominis
SLDIFKYCCCCTSSTTKALY

SEQ ID NO: 2127533 - protein, 36 aa, Cryptosporidium hominis
SLDSFFRMEFNSVELTESILLMIITNIQLWWKEVLT

SEQ ID NO: 2127534 - protein, 27 aa, Cryptosporidium hominis
SLDSTFPSLLIWIRFFHQTILKNQETK

SEQ ID NO: 2127535 - protein, 27 aa, Cryptosporidium hominis
SLEAWLKIRLQVGIIIPLTFFNVFSSY

SEQ ID NO: 2127536 - protein, 25 aa, Cryptosporidium hominis
SLENIWRKKSFRRMVNEHIQWEEDC

SEQ ID NO: 2127537 - protein, 31 aa, Cryptosporidium hominis
SLESLYFRINFAYRFSFIVCCQLNQVIDGCK

SEQ ID NO: 2127538 - protein, 27 aa, Cryptosporidium hominis
SLFIILCYWHTLNIFQFMYIFTPAICI

SEQ ID NO: 2127539 - protein, 17 aa, Cryptosporidium hominis
SLGGLYNRAVLPLMSNY

SEQ ID NO: 2127540 - protein, 18 aa, Cryptosporidium hominis
SLHNFSIAVINSAALNTI

SEQ ID NO: 2127541 - protein, 18 aa, Cryptosporidium hominis
SLIARAVAYSVIRKKRQI

SEQ ID NO: 2127542 - protein, 20 aa, Cryptosporidium hominis
SLIEEWRLFCIKEKSIYATL

SEQ ID NO: 2127543 - protein, 17 aa, Cryptosporidium hominis
SLIELAIQVIRIMNINI

SEQ ID NO: 2127544 - protein, 22 aa, Cryptosporidium hominis
SLIHAGCKIIKVFGGDESNNSL

SEQ ID NO: 2127545 - protein, 29 aa, Cryptosporidium hominis
SLIKLKFELLRTGKIEIEYSFDFVKHEWI

SEQ ID NO: 2127546 - protein, 24 aa, Cryptosporidium hominis
SLILGFLSILAFAWISESNSEYSQ

SEQ ID NO: 2127547 - protein, 18 aa, Cryptosporidium hominis
SLIMVIGFSIRKYRKLRK

SEQ ID NO: 2127548 - protein, 22 aa, Cryptosporidium hominis
SLIPLVLVSQATSFLRDAVSSK

SEQ ID NO: 2127549 - protein, 36 aa, Cryptosporidium hominis
SLIVKFYSTFVFSWSCSLVWFGNHLLKLFCNIDSIA

SEQ ID NO: 2127550 - protein, 24 aa, Cryptosporidium hominis
SLKKADDIESIFSFDKKIGEGSFG

SEQ ID NO: 2127551 - protein, 20 aa, Cryptosporidium hominis
SLKLGADLCHIFCTPEAAVP

SEQ ID NO: 2127552 - protein, 21 aa, Cryptosporidium hominis
SLKNDICCLFDSFEKEVDLLN

SEQ ID NO: 2127553 - protein, 22 aa, Cryptosporidium hominis
SLKYYKYKGWYSFIISTLAGTV

SEQ ID NO: 2127554 - protein, 23 aa, Cryptosporidium hominis
SLLDTFVAWLFKNNINRYINYIY

SEQ ID NO: 2127555 - protein, 19 aa, Cryptosporidium hominis
SLLDYIPLLIMFSSISALI

SEQ ID NO: 2127556 - protein, 18 aa, Cryptosporidium hominis
SLLIIGNVMGLMFGLIVA

SEQ ID NO: 2127557 - protein, 19 aa, Cryptosporidium hominis
SLLILVLSLYFLILSLDLS

SEQ ID NO: 2127558 - protein, 19 aa, Cryptosporidium hominis
SLLLCCSSQIIPISETQMT

SEQ ID NO: 2127559 - protein, 19 aa, Cryptosporidium hominis
SLLNICIFAFFAQFNIIQA

SEQ ID NO: 2127560 - protein, 26 aa, Cryptosporidium hominis
SLLNSQLSHFGWFKLILNSGEKTQLE

SEQ ID NO: 2127561 - protein, 18 aa, Cryptosporidium hominis
SLLTALLTMHMVKIKEIK

SEQ ID NO: 2127562 - protein, 21 aa, Cryptosporidium hominis
SLLTCINKANLVISLNMLNIL

SEQ ID NO: 2127563 - protein, 23 aa, Cryptosporidium hominis
SLLTFAALIIFSGFICFILENDW

SEQ ID NO: 2127564 - protein, 20 aa, Cryptosporidium hominis
SLLWRLVLIHDLNKCIQVVG

SEQ ID NO: 2127565 - protein, 17 aa, Cryptosporidium hominis
SLMAYCLSYLVLALAIL

SEQ ID NO: 2127566 - protein, 20 aa, Cryptosporidium hominis
SLMHILKYYFDLMTLPPHSV

SEQ ID NO: 2127567 - protein, 19 aa, Cryptosporidium hominis
SLNGAVCMFKAVLPLMKIR

SEQ ID NO: 2127568 - protein, 20 aa, Cryptosporidium hominis
SLNKKCFRRVALSEPIGSVT

SEQ ID NO: 2127569 - protein, 26 aa, Cryptosporidium hominis
SLNNFWKVIIGFIMSVLSGISIPLFL

SEQ ID NO: 2127570 - protein, 26 aa, Cryptosporidium hominis
SLNSLKIINEFLRYQIIIENIDDLFE

SEQ ID NO: 2127571 - protein, 23 aa, Cryptosporidium hominis
SLPFNFLLLFTLLVFSIGVVSVK

SEQ ID NO: 2127572 - protein, 18 aa, Cryptosporidium hominis
SLQLQFTGFLFLKTICNT

SEQ ID NO: 2127573 - protein, 23 aa, Cryptosporidium hominis
SLRGITGVCFFLGLYDDMVPADL

SEQ ID NO: 2127574 - protein, 21 aa, Cryptosporidium hominis
SLRGVARILLCLRESTKETQF

SEQ ID NO: 2127575 - protein, 19 aa, Cryptosporidium hominis
SLSESYSWPPRERTKPSIG

SEQ ID NO: 2127576 - protein, 18 aa, Cryptosporidium hominis
SLSLIFSFGGKFRERVTK

SEQ ID NO: 2127577 - protein, 22 aa, Cryptosporidium hominis
SLSLKPTQIISGFMESHNPGGH

SEQ ID NO: 2127578 - protein, 26 aa, Cryptosporidium hominis
SLSLKWKTEFPSVISRQHLISPIKEK

SEQ ID NO: 2127579 - protein, 28 aa, Cryptosporidium hominis
SLSSSLRCPWVILRFLFIDIWIGLLLFQ

SEQ ID NO: 2127580 - protein, 24 aa, Cryptosporidium hominis
SLSYKRLMKFFRPIEMNYFGDNRV

SEQ ID NO: 2127581 - protein, 18 aa, Cryptosporidium hominis
SLSYSERSIHLSGRTLPS

SEQ ID NO: 2127582 - protein, 23 aa, Cryptosporidium hominis
SLTGFACSDCIYCGTHENKPFNI

SEQ ID NO: 2127583 - protein, 21 aa, Cryptosporidium hominis
SLTYFPGILLIILFNHTILNW

SEQ ID NO: 2127584 - protein, 20 aa, Cryptosporidium hominis
SLVFRSIFLYFLIARVPTAV

SEQ ID NO: 2127585 - protein, 24 aa, Cryptosporidium hominis
SLVREGECIMAIFCQTVLFVAFNK

SEQ ID NO: 2127586 - protein, 25 aa, Cryptosporidium hominis
SLWCDEEILELLLLATVHHNAGLLF

SEQ ID NO: 2127587 - protein, 19 aa, Cryptosporidium hominis
SLWHNRLRTARVWMDEFYQ

SEQ ID NO: 2127588 - protein, 18 aa, Cryptosporidium hominis
SLWKSVVASTVFNAFMIF

SEQ ID NO: 2127589 - protein, 22 aa, Cryptosporidium hominis
SLYHIMDLILFFLPNKVNKHNS

SEQ ID NO: 2127590 - protein, 27 aa, Cryptosporidium hominis
SLYNIPPRCELARCIDNGRFSKNFEIV

SEQ ID NO: 2127591 - protein, 24 aa, Cryptosporidium hominis
SLYSCFNFWGAFLILKAESNSHKF

SEQ ID NO: 2127592 - protein, 26 aa, Cryptosporidium hominis
SMDLLIPLYIGFWFINSILDAIVYIL

SEQ ID NO: 2127593 - protein, 19 aa, Cryptosporidium hominis
SMFIPFDLITNLNVNKLFL

SEQ ID NO: 2127594 - protein, 27 aa, Cryptosporidium hominis
SMFRDWCWYFIFSWVIYYFNIWSDNSM

SEQ ID NO: 2127595 - protein, 24 aa, Cryptosporidium hominis
SMRFVKFCFFIGIIGSIITASIGL

SEQ ID NO: 2127596 - protein, 22 aa, Cryptosporidium hominis
SMVVKCIDEFIKVCKTHYNNIN

SEQ ID NO: 2127597 - protein, 20 aa, Cryptosporidium hominis
SNAFEIYLGKDLVYSAIQNN

SEQ ID NO: 2127598 - protein, 17 aa, Cryptosporidium hominis
SNAISWIISRQLGNTNP

SEQ ID NO: 2127599 - protein, 24 aa, Cryptosporidium hominis
SNDSRKGTILSIFTRHVYKVRSEV

SEQ ID NO: 2127600 - protein, 20 aa, Cryptosporidium hominis
SNFFSAVIFVIFLNPYNVGD

SEQ ID NO: 2127601 - protein, 19 aa, Cryptosporidium hominis
SNFQLPIVFNEASGIIVFG

SEQ ID NO: 2127602 - protein, 27 aa, Cryptosporidium hominis
SNFSGIGCRLGFKYSILEQATLTGPIN

SEQ ID NO: 2127603 - protein, 20 aa, Cryptosporidium hominis
SNFWCGINAIQPGHSATVYM

SEQ ID NO: 2127604 - protein, 19 aa, Cryptosporidium hominis
SNIEFARSRFEDYISSLQF

SEQ ID NO: 2127605 - protein, 17 aa, Cryptosporidium hominis
SNIFLKILISVKKIFFG

SEQ ID NO: 2127606 - protein, 25 aa, Cryptosporidium hominis
SNIIISELCYLNFPGFSQNSKLTIE

SEQ ID NO: 2127607 - protein, 20 aa, Cryptosporidium hominis
SNIILRNGFHTNILRLYIPF

SEQ ID NO: 2127608 - protein, 19 aa, Cryptosporidium hominis
SNIPEIRSLIIKRENLSEQ

SEQ ID NO: 2127609 - protein, 20 aa, Cryptosporidium hominis
SNKHWDILRKILLGETKDIN

SEQ ID NO: 2127610 - protein, 24 aa, Cryptosporidium hominis
SNKLPWYSGVSFRIVGKFNAENDK

SEQ ID NO: 2127611 - protein, 19 aa, Cryptosporidium hominis
SNLELFGFDNLVSSGDYSQ

SEQ ID NO: 2127612 - protein, 17 aa, Cryptosporidium hominis
SNLFWFLVIPYWIIYFI

SEQ ID NO: 2127613 - protein, 17 aa, Cryptosporidium hominis
SNLGSRYDAWVIHPKTI

SEQ ID NO: 2127614 - protein, 21 aa, Cryptosporidium hominis
SNLKACFAVILSVELGFNEDI

SEQ ID NO: 2127615 - protein, 19 aa, Cryptosporidium hominis
SNLVKCLREKIASIVRPLT

SEQ ID NO: 2127616 - protein, 25 aa, Cryptosporidium hominis
SNMDGRFALASGMPLSRGRKPSRSL

SEQ ID NO: 2127617 - protein, 25 aa, Cryptosporidium hominis
SNNDIFPRFSFPNYFYHYVSHYTDT

SEQ ID NO: 2127618 - protein, 23 aa, Cryptosporidium hominis
SNNPNFIWIYTFIVLFQGFLCAL

SEQ ID NO: 2127619 - protein, 25 aa, Cryptosporidium hominis
SNNSFIYECHRIIKSHLCNPENSLN

SEQ ID NO: 2127620 - protein, 25 aa, Cryptosporidium hominis
SNPIGRIGTIVSRIFQAFNQPVEGI

SEQ ID NO: 2127621 - protein, 19 aa, Cryptosporidium hominis
SNQAGICRKAFTPRPYSSV

SEQ ID NO: 2127622 - protein, 23 aa, Cryptosporidium hominis
SNQEIWKDTDWQTSILYCSSTSK

SEQ ID NO: 2127623 - protein, 20 aa, Cryptosporidium hominis
SNQGLSCLTLLVSNEEFEIL

SEQ ID NO: 2127624 - protein, 17 aa, Cryptosporidium hominis
SNRLFYVVFTILIGFIF

SEQ ID NO: 2127625 - protein, 17 aa, Cryptosporidium hominis
SNSGIWVFSFVLIGIQC

SEQ ID NO: 2127626 - protein, 26 aa, Cryptosporidium hominis
SNSLPWFKLQIFKLLKLKQENLKEFS

SEQ ID NO: 2127627 - protein, 19 aa, Cryptosporidium hominis
SNSTWVFRNNNGILKDSSV

SEQ ID NO: 2127628 - protein, 20 aa, Cryptosporidium hominis
SNSWLLPLLRVHINRTELSF

SEQ ID NO: 2127629 - protein, 23 aa, Cryptosporidium hominis
SNTFLSLLIVRFLNCNSENARES

SEQ ID NO: 2127630 - protein, 17 aa, Cryptosporidium hominis
SNTGSIVRREGGISGND

SEQ ID NO: 2127631 - protein, 17 aa, Cryptosporidium hominis
SNVKWGAKLMTWLITAV

SEQ ID NO: 2127632 - protein, 23 aa, Cryptosporidium hominis
SNVKYSVCLNRIYSEGVCINTSV

SEQ ID NO: 2127633 - protein, 32 aa, Cryptosporidium hominis
SNVQEFIQIVSYWRSAIQHILYKNTKLWTSFL

SEQ ID NO: 2127634 - protein, 26 aa, Cryptosporidium hominis
SNVSQFLFGFIVGFYRGWKMALVMSA

SEQ ID NO: 2127635 - protein, 30 aa, Cryptosporidium hominis
SNYFRVIATFVFLLFCIFFALSAKNAAQYV

SEQ ID NO: 2127636 - protein, 19 aa, Cryptosporidium hominis
SNYKQFSFDFVWKERELIT

SEQ ID NO: 2127637 - protein, 19 aa, Cryptosporidium hominis
SPDFPNWYTFKYKGLEELK

SEQ ID NO: 2127638 - protein, 25 aa, Cryptosporidium hominis
SPETAKLFGAVSCYKSFGSFLSIAV

SEQ ID NO: 2127639 - protein, 18 aa, Cryptosporidium hominis
SPEYFKDKVVWITGASSG

SEQ ID NO: 2127640 - protein, 24 aa, Cryptosporidium hominis
SPGMNLPCFCCIQSELDGTSLFYR

SEQ ID NO: 2127641 - protein, 24 aa, Cryptosporidium hominis
SPHDFKLLICHIIDKILLNYNILA

SEQ ID NO: 2127642 - protein, 25 aa, Cryptosporidium hominis
SPISRRFALGVGFGAGLGWGVKSAN

SEQ ID NO: 2127643 - protein, 18 aa, Cryptosporidium hominis
SPQIIRIISKFVSLQGAE

SEQ ID NO: 2127644 - protein, 25 aa, Cryptosporidium hominis
SPSGIPRIYSIHAFGDVSYAITQSG

SEQ ID NO: 2127645 - protein, 23 aa, Cryptosporidium hominis
SQAKCKRLIVISRFYSDSEEALK

SEQ ID NO: 2127646 - protein, 17 aa, Cryptosporidium hominis
SQCYAVVHGKCWSKWSS

SEQ ID NO: 2127647 - protein, 17 aa, Cryptosporidium hominis
SQELLRMIIHQTEANLN

SEQ ID NO: 2127648 - protein, 18 aa, Cryptosporidium hominis
SQFCHLQPLVLIHGRLCY

SEQ ID NO: 2127649 - protein, 18 aa, Cryptosporidium hominis
SQGFLWINSLISFSSSIT

SEQ ID NO: 2127650 - protein, 18 aa, Cryptosporidium hominis
SQIFLCIVVWNVVCATSF

SEQ ID NO: 2127651 - protein, 37 aa, Cryptosporidium hominis
SQLHSLFALSIIWYLSFNPKYIFSFVFSLGLIILFIS

SEQ ID NO: 2127652 - protein, 24 aa, Cryptosporidium hominis
SQLNPLCLLLFALEITKLSGSRDI

SEQ ID NO: 2127653 - protein, 17 aa, Cryptosporidium hominis
SQLVFYTAIQIISIILA

SEQ ID NO: 2127654 - protein, 24 aa, Cryptosporidium hominis
SQPLKVGCHFIRTNGVFACLMYIS

SEQ ID NO: 2127655 - protein, 22 aa, Cryptosporidium hominis
SQPNFRSLASFHELNHNEINYR

SEQ ID NO: 2127656 - protein, 20 aa, Cryptosporidium hominis
SQPTIIHWLIILLTALFSCY

SEQ ID NO: 2127657 - protein, 23 aa, Cryptosporidium hominis
SQTKGDWCLYNFGIVCEAVSLIM

SEQ ID NO: 2127658 - protein, 29 aa, Cryptosporidium hominis
SQYLKLSQSVLFFLVRLSFLVIQVRSFLA

SEQ ID NO: 2127659 - protein, 24 aa, Cryptosporidium hominis
SRAIGDFRLKSMDFNYNWEKDLST

SEQ ID NO: 2127660 - protein, 23 aa, Cryptosporidium hominis
SRCGMRILGFAVGHINCPNEYPT

SEQ ID NO: 2127661 - protein, 21 aa, Cryptosporidium hominis
SRDLLNYFFLVALISPFVVVS

SEQ ID NO: 2127662 - protein, 17 aa, Cryptosporidium hominis
SREIAIGILSPFIDILI

SEQ ID NO: 2127663 - protein, 18 aa, Cryptosporidium hominis
SRELQRMCLVLYSPLCGV

SEQ ID NO: 2127664 - protein, 23 aa, Cryptosporidium hominis
SREVIRSWEFLVDFEMEDEVLSN

SEQ ID NO: 2127665 - protein, 22 aa, Cryptosporidium hominis
SRFHEIVDIIFFSYLSSQYLKL

SEQ ID NO: 2127666 - protein, 18 aa, Cryptosporidium hominis
SRFISVSTHLSFKNYDKL

SEQ ID NO: 2127667 - protein, 22 aa, Cryptosporidium hominis
SRFYAAQVVLMFEYLHGKNIIY

SEQ ID NO: 2127668 - protein, 18 aa, Cryptosporidium hominis
SRGGTNCLKEIRNYVEEL

SEQ ID NO: 2127669 - protein, 23 aa, Cryptosporidium hominis
SRHRSGILNFIFMNRFANNVNSY

SEQ ID NO: 2127670 - protein, 19 aa, Cryptosporidium hominis
SRIGFDRVTKLLLEQIFRT

SEQ ID NO: 2127671 - protein, 19 aa, Cryptosporidium hominis
SRIHQDFLTRINIEEQKRK

SEQ ID NO: 2127672 - protein, 24 aa, Cryptosporidium hominis
SRIIPKKMLNIIIENGRNSLQTNT

SEQ ID NO: 2127673 - protein, 18 aa, Cryptosporidium hominis
SRIIRIFTHPNFLSIKTV

SEQ ID NO: 2127674 - protein, 20 aa, Cryptosporidium hominis
SRIMPALPWGEVNLDEDPLQ

SEQ ID NO: 2127675 - protein, 19 aa, Cryptosporidium hominis
SRIPILLRRMVLYSEIGDI

SEQ ID NO: 2127676 - protein, 21 aa, Cryptosporidium hominis
SRISKSTVLATYRIVLPKTQN

SEQ ID NO: 2127677 - protein, 25 aa, Cryptosporidium hominis
SRISLPEIYFVLTVDGTLWSIGENG

SEQ ID NO: 2127678 - protein, 24 aa, Cryptosporidium hominis
SRITSRIRRAFGMDISDLSCILLD

SEQ ID NO: 2127679 - protein, 24 aa, Cryptosporidium hominis
SRKSSKYRRILGLHDDSINVRIKT

SEQ ID NO: 2127680 - protein, 19 aa, Cryptosporidium hominis
SRKTVGMGWELQGKLTKLG

SEQ ID NO: 2127681 - protein, 20 aa, Cryptosporidium hominis
SRKYILPTFVTLVITVGVSG

SEQ ID NO: 2127682 - protein, 17 aa, Cryptosporidium hominis
SRLGTYYEFENEVKMSI

SEQ ID NO: 2127683 - protein, 22 aa, Cryptosporidium hominis
SRLILLNSIEDFSGIPLFMIFV

SEQ ID NO: 2127684 - protein, 18 aa, Cryptosporidium hominis
SRLLESFHIPNFNKPALD

SEQ ID NO: 2127685 - protein, 23 aa, Cryptosporidium hominis
SRLLNLLKLLAVVEVSEYIRHLL

SEQ ID NO: 2127686 - protein, 19 aa, Cryptosporidium hominis
SRLLSHGFFLPLVFLLFSI

SEQ ID NO: 2127687 - protein, 20 aa, Cryptosporidium hominis
SRNLPSALLLAGPGAILTMV

SEQ ID NO: 2127688 - protein, 21 aa, Cryptosporidium hominis
SRRNERCPAEDYCTENETFLN

SEQ ID NO: 2127689 - protein, 21 aa, Cryptosporidium hominis
SRRVINWKLVKEIIKIHLNTS

SEQ ID NO: 2127690 - protein, 26 aa, Cryptosporidium hominis
SRSFLDRYDIPLLFNLLYSEDANDHN

SEQ ID NO: 2127691 - protein, 25 aa, Cryptosporidium hominis
SRSLKICLSILVLINLVCIEKNILM

SEQ ID NO: 2127692 - protein, 21 aa, Cryptosporidium hominis
SRSRLDIFGFIPKYSSSEPDR

SEQ ID NO: 2127693 - protein, 22 aa, Cryptosporidium hominis
SRSRQYFCLALNIQKSNLRALW

SEQ ID NO: 2127694 - protein, 18 aa, Cryptosporidium hominis
SRTFDLSTGFAFAAFGMI

SEQ ID NO: 2127695 - protein, 20 aa, Cryptosporidium hominis
SRTPIVVTMPVRIAELAVFR

SEQ ID NO: 2127696 - protein, 36 aa, Cryptosporidium hominis
SRYAMAYSPIFRVVLGVLRWLRWESRVNPYKQNDIV

SEQ ID NO: 2127697 - protein, 24 aa, Cryptosporidium hominis
SRYKPPTLYTHQTFDMVDRQIAQE

SEQ ID NO: 2127698 - protein, 18 aa, Cryptosporidium hominis
SRYLYLVVSLLDLPYFVD

SEQ ID NO: 2127699 - protein, 20 aa, Cryptosporidium hominis
SRYSPVLPLQKSGFIILNDS

SEQ ID NO: 2127700 - protein, 21 aa, Cryptosporidium hominis
SRYTLDPSISCFLSLIPSRKT

SEQ ID NO: 2127701 - protein, 23 aa, Cryptosporidium hominis
SSADELFKFIGVTERFFSTFDDD

SEQ ID NO: 2127702 - protein, 17 aa, Cryptosporidium hominis
SSAFYWIRRGFYLPRSY

SEQ ID NO: 2127703 - protein, 25 aa, Cryptosporidium hominis
SSCPKLKRIAMRSEIQERMPNYRVK

SEQ ID NO: 2127704 - protein, 18 aa, Cryptosporidium hominis
SSEIYTLLSNLKDCTLKI

SEQ ID NO: 2127705 - protein, 19 aa, Cryptosporidium hominis
SSENCKICVLDFVREKALY

SEQ ID NO: 2127706 - protein, 33 aa, Cryptosporidium hominis
SSEVMRICIVIIWTIACVVLGFSGAMMIIESPK

SEQ ID NO: 2127707 - protein, 18 aa, Cryptosporidium hominis
SSEWQMRMYGYKKGIKEI

SEQ ID NO: 2127708 - protein, 19 aa, Cryptosporidium hominis
SSFAFKVSTNLYISVIFVL

SEQ ID NO: 2127709 - protein, 26 aa, Cryptosporidium hominis
SSFNILDELWRWYSRLVNDQFVDFDN

SEQ ID NO: 2127710 - protein, 17 aa, Cryptosporidium hominis
SSFVLNNPFRVIKPQEQ

SEQ ID NO: 2127711 - protein, 20 aa, Cryptosporidium hominis
SSGCGPCYDASINNDLGVVN

SEQ ID NO: 2127712 - protein, 19 aa, Cryptosporidium hominis
SSGDIVHLGYFFTDGHLLI

SEQ ID NO: 2127713 - protein, 20 aa, Cryptosporidium hominis
SSGFNAYFLVSLAFLQMLVS

SEQ ID NO: 2127714 - protein, 21 aa, Cryptosporidium hominis
SSGRRFACQMKSFLKNRRCIS

SEQ ID NO: 2127715 - protein, 19 aa, Cryptosporidium hominis
SSHCVTSYSILIWLLLENI

SEQ ID NO: 2127716 - protein, 23 aa, Cryptosporidium hominis
SSHKICSPSLLADTFIQAADIAR

SEQ ID NO: 2127717 - protein, 26 aa, Cryptosporidium hominis
SSIEKLFVQMCCKCRTVVFARFAPSQ

SEQ ID NO: 2127718 - protein, 24 aa, Cryptosporidium hominis
SSIFPCKYRPYSYVILTIGAEKFS

SEQ ID NO: 2127719 - protein, 17 aa, Cryptosporidium hominis
SSIICFFESPVMLAKYL

SEQ ID NO: 2127720 - protein, 18 aa, Cryptosporidium hominis
SSIKNGGFIGFSSYTGPE

SEQ ID NO: 2127721 - protein, 18 aa, Cryptosporidium hominis
SSILRIEILSGKTISIES

SEQ ID NO: 2127722 - protein, 20 aa, Cryptosporidium hominis
SSINIIRLFIQRECIYDQSI

SEQ ID NO: 2127723 - protein, 22 aa, Cryptosporidium hominis
SSINKLRFKIQVLTLVCPISLL

SEQ ID NO: 2127724 - protein, 20 aa, Cryptosporidium hominis
SSKQRLSFFESIVRKIALKY

SEQ ID NO: 2127725 - protein, 44 aa, Cryptosporidium hominis
SSKYKRISICVSSQIGCRMGCMFCATGSMGLRGSLLSGEILQQL

SEQ ID NO: 2127726 - protein, 26 aa, Cryptosporidium hominis
SSLFFERPELLLIHKKKVLRDMLNGN

SEQ ID NO: 2127727 - protein, 21 aa, Cryptosporidium hominis
SSLFIIIGWITSYTCSCVLPK

SEQ ID NO: 2127728 - protein, 18 aa, Cryptosporidium hominis
SSLFKLLDLVFATLHNYS

SEQ ID NO: 2127729 - protein, 17 aa, Cryptosporidium hominis
SSLFLSNIVKHKRETWI

SEQ ID NO: 2127730 - protein, 25 aa, Cryptosporidium hominis
SSLKGLCCNFGHLVFPSNGLIQFFY

SEQ ID NO: 2127731 - protein, 27 aa, Cryptosporidium hominis
SSLKVRLLKPFYSWRATAAHGVCLYRK

SEQ ID NO: 2127732 - protein, 21 aa, Cryptosporidium hominis
SSLLRRAFCTESLKKIINFKI

SEQ ID NO: 2127733 - protein, 17 aa, Cryptosporidium hominis
SSLPLRENFALPFIWIN

SEQ ID NO: 2127734 - protein, 18 aa, Cryptosporidium hominis
SSLPRSSIMMQVLSSKGL

SEQ ID NO: 2127735 - protein, 23 aa, Cryptosporidium hominis
SSLSPRFGRNSFFSAVNSSSNSV

SEQ ID NO: 2127736 - protein, 25 aa, Cryptosporidium hominis
SSLSSWTWCIPRHFQGENSKGSKGK

SEQ ID NO: 2127737 - protein, 22 aa, Cryptosporidium hominis
SSNFKREIATSFIYMLNDTSKY

SEQ ID NO: 2127738 - protein, 17 aa, Cryptosporidium hominis
SSNFKTSLFIVIFILNY

SEQ ID NO: 2127739 - protein, 27 aa, Cryptosporidium hominis
SSNHFKAIHKYWGFLYLYKSVITNEID

SEQ ID NO: 2127740 - protein, 23 aa, Cryptosporidium hominis
SSNILRDVWFSEISREMLNYVNG

SEQ ID NO: 2127741 - protein, 20 aa, Cryptosporidium hominis
SSNLPLLITLSFLLEDKKKS

SEQ ID NO: 2127742 - protein, 19 aa, Cryptosporidium hominis
SSNSKYWYSFAVTGINITS

SEQ ID NO: 2127743 - protein, 20 aa, Cryptosporidium hominis
SSPCPVDCVLSFWSPWTDCS

SEQ ID NO: 2127744 - protein, 20 aa, Cryptosporidium hominis
SSPSPYLHWTLKEIYDQPHA

SEQ ID NO: 2127745 - protein, 19 aa, Cryptosporidium hominis
SSQAAFKIIFGEITALKSM

SEQ ID NO: 2127746 - protein, 23 aa, Cryptosporidium hominis
SSQIKNIICKESDLVFSNTETNV

SEQ ID NO: 2127747 - protein, 17 aa, Cryptosporidium hominis
SSQRPSIEVRRNCILVN

SEQ ID NO: 2127748 - protein, 18 aa, Cryptosporidium hominis
SSRFIKKLVLSWCNSIKT

SEQ ID NO: 2127749 - protein, 21 aa, Cryptosporidium hominis
SSRPYGFSDVIYVNYRIFNEK

SEQ ID NO: 2127750 - protein, 34 aa, Cryptosporidium hominis
SSRYKGQILRPTYHIRRLLDIFTVLQLKEEAIQS

SEQ ID NO: 2127751 - protein, 19 aa, Cryptosporidium hominis
SSSCISLSFLNPIKQEKAQ

SEQ ID NO: 2127752 - protein, 17 aa, Cryptosporidium hominis
SSSEEWRSGSFSLLTTI

SEQ ID NO: 2127753 - protein, 28 aa, Cryptosporidium hominis
SSSEWSEFDFAIAAVVHFFSIILGVPIL

SEQ ID NO: 2127754 - protein, 20 aa, Cryptosporidium hominis
SSSFSRHYISPCQISHSLLF

SEQ ID NO: 2127755 - protein, 19 aa, Cryptosporidium hominis
SSSIFDININFPKGDKDTN

SEQ ID NO: 2127756 - protein, 22 aa, Cryptosporidium hominis
SSSIYNFVFIFSIIISTIYLLQ

SEQ ID NO: 2127757 - protein, 18 aa, Cryptosporidium hominis
SSSKRMGILLEFKGRYIY

SEQ ID NO: 2127758 - protein, 17 aa, Cryptosporidium hominis
SSSMEFLLYGSRGKSGV

SEQ ID NO: 2127759 - protein, 24 aa, Cryptosporidium hominis
SSSMKLFVALLIRPKSVEWFNGLF

SEQ ID NO: 2127760 - protein, 19 aa, Cryptosporidium hominis
SSSTGLRYSVSNSIQSSLS

SEQ ID NO: 2127761 - protein, 21 aa, Cryptosporidium hominis
SSSVVFPFTFYVKSSDNNSDQ

SEQ ID NO: 2127762 - protein, 17 aa, Cryptosporidium hominis
SSTIIGVISIIFSILHT

SEQ ID NO: 2127763 - protein, 21 aa, Cryptosporidium hominis
SSVALAHFWLHPALIHTSSHS

SEQ ID NO: 2127764 - protein, 28 aa, Cryptosporidium hominis
SSVGLRLSRGALRFPIEINEENGFLMSN

SEQ ID NO: 2127765 - protein, 18 aa, Cryptosporidium hominis
SSVLEVHDLHVWSVSVGV

SEQ ID NO: 2127766 - protein, 19 aa, Cryptosporidium hominis
SSVMIRLMLVFGPAACCLS

SEQ ID NO: 2127767 - protein, 17 aa, Cryptosporidium hominis
SSVSSLINKCFDTISET

SEQ ID NO: 2127768 - protein, 19 aa, Cryptosporidium hominis
SSYKWNISYDQPFSSQISQ

SEQ ID NO: 2127769 - protein, 21 aa, Cryptosporidium hominis
STAWYFNPDFENILSNSCVIT

SEQ ID NO: 2127770 - protein, 18 aa, Cryptosporidium hominis
STCEFLVDLFEGFLDLTQ

SEQ ID NO: 2127771 - protein, 19 aa, Cryptosporidium hominis
STEGASIWSNFTHKNVHDC

SEQ ID NO: 2127772 - protein, 18 aa, Cryptosporidium hominis
STFKSYVAVEAFFLLICI

SEQ ID NO: 2127773 - protein, 18 aa, Cryptosporidium hominis
STFWQSKKVWSFSSQSND

SEQ ID NO: 2127774 - protein, 22 aa, Cryptosporidium hominis
STGEYGIYCLIDDVALDVKSIC

SEQ ID NO: 2127775 - protein, 25 aa, Cryptosporidium hominis
STGQRIRISFARSLYCKLIQSSVYR

SEQ ID NO: 2127776 - protein, 17 aa, Cryptosporidium hominis
STIEYLPQVVLRFKEYI

SEQ ID NO: 2127777 - protein, 34 aa, Cryptosporidium hominis
STIFCACCKMGWSYKFFIFLSIVQFKMFSFIWLE

SEQ ID NO: 2127778 - protein, 17 aa, Cryptosporidium hominis
STIFSQVQFSRGQKVRL

SEQ ID NO: 2127779 - protein, 17 aa, Cryptosporidium hominis
STIPGIIILLIISVATL

SEQ ID NO: 2127780 - protein, 17 aa, Cryptosporidium hominis
STISRMIMKLTIEQDEN

SEQ ID NO: 2127781 - protein, 18 aa, Cryptosporidium hominis
STLEGSRTIFLLKNSEYF

SEQ ID NO: 2127782 - protein, 25 aa, Cryptosporidium hominis
STLLCGLCVIYITLSIVIIVNFFAF

SEQ ID NO: 2127783 - protein, 28 aa, Cryptosporidium hominis
STLQCARFILLFVCNDFFTLFSKLYNKK

SEQ ID NO: 2127784 - protein, 18 aa, Cryptosporidium hominis
STLSGLFIYNKAYSSSIN

SEQ ID NO: 2127785 - protein, 18 aa, Cryptosporidium hominis
STLSGPAIRITRSNTANK

SEQ ID NO: 2127786 - protein, 27 aa, Cryptosporidium hominis
STLSIKYRIWISLALTIIILTLIALLR

SEQ ID NO: 2127787 - protein, 19 aa, Cryptosporidium hominis
STMRFDWDTHYYLVDEIPQ

SEQ ID NO: 2127788 - protein, 23 aa, Cryptosporidium hominis
STPLPHYRWIECSNRSNLEKLKN

SEQ ID NO: 2127789 - protein, 21 aa, Cryptosporidium hominis
STSLLLSWFFNGLFHAGVYPM

SEQ ID NO: 2127790 - protein, 18 aa, Cryptosporidium hominis
STSMLVAILFKLCSILLI

SEQ ID NO: 2127791 - protein, 18 aa, Cryptosporidium hominis
STSYKFQNLHAWNTLLSK

SEQ ID NO: 2127792 - protein, 26 aa, Cryptosporidium hominis
STYTESFRLFGIVVASSIVFIFMMYS

SEQ ID NO: 2127793 - protein, 23 aa, Cryptosporidium hominis
SVACSFILEMIAKLKLGNKNLEK

SEQ ID NO: 2127794 - protein, 21 aa, Cryptosporidium hominis
SVADLKPSIIVNSPIHDSINS

SEQ ID NO: 2127795 - protein, 18 aa, Cryptosporidium hominis
SVAIWKLSNNFEVILLQN

SEQ ID NO: 2127796 - protein, 19 aa, Cryptosporidium hominis
SVDFPRIPVHITKATHNWH

SEQ ID NO: 2127797 - protein, 19 aa, Cryptosporidium hominis
SVEAGRCLDLLVNQLISSQ

SEQ ID NO: 2127798 - protein, 31 aa, Cryptosporidium hominis
SVFKRLIAYSKWKCLLENSIYMLSITTLSVI

SEQ ID NO: 2127799 - protein, 25 aa, Cryptosporidium hominis
SVGFVLVCALFFHSLFEGMVVGTSK

SEQ ID NO: 2127800 - protein, 26 aa, Cryptosporidium hominis
SVHFKEPIGEPLLWNYIIQIVLALVH

SEQ ID NO: 2127801 - protein, 19 aa, Cryptosporidium hominis
SVHTCPRCLNKISRNRRIK

SEQ ID NO: 2127802 - protein, 19 aa, Cryptosporidium hominis
SVICIWKISDYLNEIEASS

SEQ ID NO: 2127803 - protein, 23 aa, Cryptosporidium hominis
SVISCCGFGFSLSGSVLLLSTRI

SEQ ID NO: 2127804 - protein, 18 aa, Cryptosporidium hominis
SVLLLSTRITSPWVNSCF

SEQ ID NO: 2127805 - protein, 25 aa, Cryptosporidium hominis
SVLLTLICSIGFIPGIPKWVDSAEH

SEQ ID NO: 2127806 - protein, 20 aa, Cryptosporidium hominis
SVLPHLKSLVQIISHGLSDE

SEQ ID NO: 2127807 - protein, 23 aa, Cryptosporidium hominis
SVLPILRIVILAVWDPGKLHSSG

SEQ ID NO: 2127808 - protein, 31 aa, Cryptosporidium hominis
SVLRCICIHVVYCLLCEAPLVEIFQQSQIIQ

SEQ ID NO: 2127809 - protein, 23 aa, Cryptosporidium hominis
SVLSRPAMFCIIFISLLITILEI

SEQ ID NO: 2127810 - protein, 21 aa, Cryptosporidium hominis
SVLTCGKIYGLVIYTGIESRS

SEQ ID NO: 2127811 - protein, 22 aa, Cryptosporidium hominis
SVNWRLDESLEIIKLKDDPLYI

SEQ ID NO: 2127812 - protein, 25 aa, Cryptosporidium hominis
SVRMLEFLSGIAYVPIKVDFPGNLK

SEQ ID NO: 2127813 - protein, 18 aa, Cryptosporidium hominis
SVSAAFHLFFALFLISFY

SEQ ID NO: 2127814 - protein, 24 aa, Cryptosporidium hominis
SVSFPLIRINLIKDWDWKNKQLTG

SEQ ID NO: 2127815 - protein, 26 aa, Cryptosporidium hominis
SVSQSLIYYRRILKYYFGDNFDNYWK

SEQ ID NO: 2127816 - protein, 18 aa, Cryptosporidium hominis
SVSSLEFIRQYTDKKEAI

SEQ ID NO: 2127817 - protein, 25 aa, Cryptosporidium hominis
SVTDWSYYIWWLFSRRPEISKISPK

SEQ ID NO: 2127818 - protein, 17 aa, Cryptosporidium hominis
SVTELNSRLEVLQQHAQ

SEQ ID NO: 2127819 - protein, 20 aa, Cryptosporidium hominis
SVTEVFRLSGASVIASFLTL

SEQ ID NO: 2127820 - protein, 18 aa, Cryptosporidium hominis
SVVLIIVLEYLYRKTAMT

SEQ ID NO: 2127821 - protein, 24 aa, Cryptosporidium hominis
SVVTPWFRHIFMDTLSLPVVLIIW

SEQ ID NO: 2127822 - protein, 35 aa, Cryptosporidium hominis
SWERPNCIIHNIIFGSTWLEWLGDVNVTSKNHGYR

SEQ ID NO: 2127823 - protein, 30 aa, Cryptosporidium hominis
SWETVGPAARGLTCNRNVHMTTRMEKGSTV

SEQ ID NO: 2127824 - protein, 25 aa, Cryptosporidium hominis
SWFTHCLQKYFPLWFSDEDLDSFSY

SEQ ID NO: 2127825 - protein, 17 aa, Cryptosporidium hominis
SWMLLLLSYFFGAGYLF

SEQ ID NO: 2127826 - protein, 20 aa, Cryptosporidium hominis
SWSVPYRFGLISIFIYHFLV

SEQ ID NO: 2127827 - protein, 26 aa, Cryptosporidium hominis
SWSVQEISEIFILQKIRNRWSEPKKM

SEQ ID NO: 2127828 - protein, 18 aa, Cryptosporidium hominis
SWTKNALIPTEQVTYNMK

SEQ ID NO: 2127829 - protein, 24 aa, Cryptosporidium hominis
SWYLARLARESFMNINLDLLLESL

SEQ ID NO: 2127830 - protein, 24 aa, Cryptosporidium hominis
SWYTPIPCIVNFPFNAKISRISCG

SEQ ID NO: 2127831 - protein, 25 aa, Cryptosporidium hominis
SYFFNKFRIRAMFANRQLKRIFHSR

SEQ ID NO: 2127832 - protein, 22 aa, Cryptosporidium hominis
SYFPQVLIYLSFIRIICFPITE

SEQ ID NO: 2127833 - protein, 22 aa, Cryptosporidium hominis
SYFTCIGSWLRHSRTLIYNTPN

SEQ ID NO: 2127834 - protein, 26 aa, Cryptosporidium hominis
SYGFMLMVCHWLLFDSIQCIITLLIG

SEQ ID NO: 2127835 - protein, 17 aa, Cryptosporidium hominis
SYGWEIVDIGRKFEPEM

SEQ ID NO: 2127836 - protein, 24 aa, Cryptosporidium hominis
SYIGWRNVEFFEYLASILRFLEVF

SEQ ID NO: 2127837 - protein, 23 aa, Cryptosporidium hominis
SYIPICLLLFFSNNLIPMSQPFI

SEQ ID NO: 2127838 - protein, 26 aa, Cryptosporidium hominis
SYKGMADCIITMFKREGIRSFYRSLP

SEQ ID NO: 2127839 - protein, 22 aa, Cryptosporidium hominis
SYLEAYQSFLIIKESILSRNGF

SEQ ID NO: 2127840 - protein, 19 aa, Cryptosporidium hominis
SYLSIISFLLVIVAILVCF

SEQ ID NO: 2127841 - protein, 28 aa, Cryptosporidium hominis
SYNPHVRYAAALTLGITCCGMESPKVTA

SEQ ID NO: 2127842 - protein, 27 aa, Cryptosporidium hominis
SYPFCWRSDTPLQYRAVPSWFINVESL

SEQ ID NO: 2127843 - protein, 17 aa, Cryptosporidium hominis
SYQIISSLFERFPNLII

SEQ ID NO: 2127844 - protein, 30 aa, Cryptosporidium hominis
SYQLRVVIWRVRHIPLEPNTTISLYVSGIY

SEQ ID NO: 2127845 - protein, 25 aa, Cryptosporidium hominis
SYSILSIRILFIIPIIFSLILSLIW

SEQ ID NO: 2127846 - protein, 17 aa, Cryptosporidium hominis
SYSKICISNEKFHSDHL

SEQ ID NO: 2127847 - protein, 25 aa, Cryptosporidium hominis
SYSLECIRKIISLAISCSSYEGPDC

SEQ ID NO: 2127848 - protein, 19 aa, Cryptosporidium hominis
SYSNAWRVGASHTMLQIQP

SEQ ID NO: 2127849 - protein, 19 aa, Cryptosporidium hominis
SYTEFLAACYEWRDSELGV

SEQ ID NO: 2127850 - protein, 25 aa, Cryptosporidium hominis
SYTTSTRNAPTFFNTTTKPITTSTA

SEQ ID NO: 2127851 - protein, 24 aa, Cryptosporidium hominis
TAACKISGEIGYFFVSHLLSLGAS

SEQ ID NO: 2127852 - protein, 20 aa, Cryptosporidium hominis
TAALCSSVRIYYTHEFVSNY

SEQ ID NO: 2127853 - protein, 19 aa, Cryptosporidium hominis
TAALSWPITIMQYAATLDN

SEQ ID NO: 2127854 - protein, 18 aa, Cryptosporidium hominis
TACATPLSNFECNLNYKD

SEQ ID NO: 2127855 - protein, 25 aa, Cryptosporidium hominis
TAELIKICRCLSIPIVVDADGLYVI

SEQ ID NO: 2127856 - protein, 25 aa, Cryptosporidium hominis
TAEVTKGRFLASVSHELRTPLNSII

SEQ ID NO: 2127857 - protein, 17 aa, Cryptosporidium hominis
TAFFSKDFVQISLFLIN

SEQ ID NO: 2127858 - protein, 22 aa, Cryptosporidium hominis
TAFHIICCLLSFSPLLAVTEGC

SEQ ID NO: 2127859 - protein, 21 aa, Cryptosporidium hominis
TAGLWGLALVFVMSYALLIND

SEQ ID NO: 2127860 - protein, 18 aa, Cryptosporidium hominis
TAISYWKLSSDYGNSEGQ

SEQ ID NO: 2127861 - protein, 25 aa, Cryptosporidium hominis
TAKKILKFNIYIYRIYTDKYKRKII

SEQ ID NO: 2127862 - protein, 17 aa, Cryptosporidium hominis
TALFHAVLMEDDGMVES

SEQ ID NO: 2127863 - protein, 23 aa, Cryptosporidium hominis
TALHLAYMYGMIGLAEFLINNGF

SEQ ID NO: 2127864 - protein, 24 aa, Cryptosporidium hominis
TALIISMVSICFALLLEIRIGFRA

SEQ ID NO: 2127865 - protein, 19 aa, Cryptosporidium hominis
TAMSFPGLIVAIARFGVGV

SEQ ID NO: 2127866 - protein, 22 aa, Cryptosporidium hominis
TAPVPWARWYVEDHTIPQCIWG

SEQ ID NO: 2127867 - protein, 24 aa, Cryptosporidium hominis
TAPYKFMRGLMCFLTVSLSMLYLI

SEQ ID NO: 2127868 - protein, 19 aa, Cryptosporidium hominis
TASFIAAVFCEMLRAYTVR

SEQ ID NO: 2127869 - protein, 24 aa, Cryptosporidium hominis
TAVIPICLSLLMWNDQENIRRIIL

SEQ ID NO: 2127870 - protein, 19 aa, Cryptosporidium hominis
TAYDISPLVRMTSIRILRA

SEQ ID NO: 2127871 - protein, 20 aa, Cryptosporidium hominis
TCGMSVSVALIWDILNIYSF

SEQ ID NO: 2127872 - protein, 26 aa, Cryptosporidium hominis
TCIGIKAIFYLKFSRLISTDGNVSNL

SEQ ID NO: 2127873 - protein, 22 aa, Cryptosporidium hominis
TCINCLKYVLFDTFEKDIQQMG

SEQ ID NO: 2127874 - protein, 22 aa, Cryptosporidium hominis
TCISSGALLYVALGEMILDEFN

SEQ ID NO: 2127875 - protein, 17 aa, Cryptosporidium hominis
TCKIACCSKKFYCATKQ

SEQ ID NO: 2127876 - protein, 22 aa, Cryptosporidium hominis
TCPYYYKYGVCNKFIEKLLDEL

SEQ ID NO: 2127877 - protein, 17 aa, Cryptosporidium hominis
TCRICAVGDGGNDVGMI

SEQ ID NO: 2127878 - protein, 17 aa, Cryptosporidium hominis
TCSILLLISAILGYFFP

SEQ ID NO: 2127879 - protein, 21 aa, Cryptosporidium hominis
TCSSPLCIWYSHKCDAYRIVK

SEQ ID NO: 2127880 - protein, 17 aa, Cryptosporidium hominis
TCTYKRCIKVISASFTF

SEQ ID NO: 2127881 - protein, 17 aa, Cryptosporidium hominis
TDCDIQSLFGIYDWYSD

SEQ ID NO: 2127882 - protein, 18 aa, Cryptosporidium hominis
TDCSLLSIEYIKKLQIVF

SEQ ID NO: 2127883 - protein, 25 aa, Cryptosporidium hominis
TDICPIKYICLMLSNSFYGLDPKSP

SEQ ID NO: 2127884 - protein, 23 aa, Cryptosporidium hominis
TDIPTHLGVYYNFINSEGPTTFK

SEQ ID NO: 2127885 - protein, 23 aa, Cryptosporidium hominis
TDIPWSVSTPYILSSLEKAQQVI

SEQ ID NO: 2127886 - protein, 20 aa, Cryptosporidium hominis
TDIWNEWFILIKKWETTKGI

SEQ ID NO: 2127887 - protein, 18 aa, Cryptosporidium hominis
TDKILVLHLFSAKEWSDY

SEQ ID NO: 2127888 - protein, 25 aa, Cryptosporidium hominis
TDKYKRKIIKRVQGILRNLKIVNKS

SEQ ID NO: 2127889 - protein, 26 aa, Cryptosporidium hominis
TDRLPISYMRFCPVSIRIHDYLQSGR

SEQ ID NO: 2127890 - protein, 36 aa, Cryptosporidium hominis
TDSIFYIRRISCLPIFWCSHDPWIPSGTIRSIILCG

SEQ ID NO: 2127891 - protein, 29 aa, Cryptosporidium hominis
TEAPSLKINSLRRLRGLSEDNSQDVEEVN

SEQ ID NO: 2127892 - protein, 21 aa, Cryptosporidium hominis
TEDQLGLSIHNPMTIRDNNGH

SEQ ID NO: 2127893 - protein, 18 aa, Cryptosporidium hominis
TEFFKLIFENTVSICDHD

SEQ ID NO: 2127894 - protein, 24 aa, Cryptosporidium hominis
TEIRTEKQLGYVVGASYEDIVDHV

SEQ ID NO: 2127895 - protein, 22 aa, Cryptosporidium hominis
TEKLSGFYLYIFTPLAILTFFK

SEQ ID NO: 2127896 - protein, 26 aa, Cryptosporidium hominis
TEKPITRWILPSGFEPQYFQMYAESL

SEQ ID NO: 2127897 - protein, 25 aa, Cryptosporidium hominis
TELCIFSLNNLRAFKEINNNDTLES

SEQ ID NO: 2127898 - protein, 21 aa, Cryptosporidium hominis
TELELPLLYECDWNLVMRARN

SEQ ID NO: 2127899 - protein, 25 aa, Cryptosporidium hominis
TEMLNKYFEWRGKKKVAELINTTQI

SEQ ID NO: 2127900 - protein, 22 aa, Cryptosporidium hominis
TEPRLFAKDIKQWVNTNILDHK

SEQ ID NO: 2127901 - protein, 23 aa, Cryptosporidium hominis
TETKRLLERLAINLELPPIDDKM

SEQ ID NO: 2127902 - protein, 32 aa, Cryptosporidium hominis
TETSELPFSYVEFYEKLGVFVIDVRSSIKEYE

SEQ ID NO: 2127903 - protein, 21 aa, Cryptosporidium hominis
TETYFQPKIVIVSYILMIQFL

SEQ ID NO: 2127904 - protein, 18 aa, Cryptosporidium hominis
TEWERCMSQNPTIIARKS

SEQ ID NO: 2127905 - protein, 27 aa, Cryptosporidium hominis
TFFAETIPSIALIYGFWSSKNSFLGDT

SEQ ID NO: 2127906 - protein, 17 aa, Cryptosporidium hominis
TFFASSIIFVFIQELVI

SEQ ID NO: 2127907 - protein, 30 aa, Cryptosporidium hominis
TFFMYYFVGGIFDWTCSLLISSILSATDPV

SEQ ID NO: 2127908 - protein, 20 aa, Cryptosporidium hominis
TFFSQSFLNLSLKNNVSKGK

SEQ ID NO: 2127909 - protein, 21 aa, Cryptosporidium hominis
TFGGLGYGQRGPQKASDSPFV

SEQ ID NO: 2127910 - protein, 22 aa, Cryptosporidium hominis
TFGQILCGIAFVSYGLGFLLLE

SEQ ID NO: 2127911 - protein, 19 aa, Cryptosporidium hominis
TFGYLRGYILLALPGVLDE

SEQ ID NO: 2127912 - protein, 26 aa, Cryptosporidium hominis
TFILSIYIILAFNCGGLFLNNCIHKF

SEQ ID NO: 2127913 - protein, 19 aa, Cryptosporidium hominis
TFLECLFLRVKIESDPLTS

SEQ ID NO: 2127914 - protein, 17 aa, Cryptosporidium hominis
TFLLSDTHLKYYIMRVR

SEQ ID NO: 2127915 - protein, 20 aa, Cryptosporidium hominis
TFLMCSIIRAFDLSNVFKPL

SEQ ID NO: 2127916 - protein, 19 aa, Cryptosporidium hominis
TFLNSRRVINWKLVKEIIK

SEQ ID NO: 2127917 - protein, 19 aa, Cryptosporidium hominis
TFLVIFGIFYTITLCSTIQ

SEQ ID NO: 2127918 - protein, 19 aa, Cryptosporidium hominis
TFPLMGYLIGKFVTSGVLP

SEQ ID NO: 2127919 - protein, 25 aa, Cryptosporidium hominis
TFPTKDYPNGLALELSLTKLPEKLS

SEQ ID NO: 2127920 - protein, 20 aa, Cryptosporidium hominis
TFQFKKALSLILYGLVSVTL

SEQ ID NO: 2127921 - protein, 17 aa, Cryptosporidium hominis
TFRKSWRKLSTSLEEID

SEQ ID NO: 2127922 - protein, 28 aa, Cryptosporidium hominis
TFRWPCYAFWKIMMGMNILYFMLLTFLL

SEQ ID NO: 2127923 - protein, 18 aa, Cryptosporidium hominis
TFSTCIRSAFAYFTKNNS

SEQ ID NO: 2127924 - protein, 21 aa, Cryptosporidium hominis
TFSTCISLYCKIIQDKENLNF

SEQ ID NO: 2127925 - protein, 18 aa, Cryptosporidium hominis
TFVRCLIICLFVFSWPIS

SEQ ID NO: 2127926 - protein, 18 aa, Cryptosporidium hominis
TFWFNFIALIPLANLLGI

SEQ ID NO: 2127927 - protein, 24 aa, Cryptosporidium hominis
TFYGKGLMSLRIFGILLNNINVDR

SEQ ID NO: 2127928 - protein, 25 aa, Cryptosporidium hominis
TGDLSSLKVLFGWFSTSNQTNLAKN

SEQ ID NO: 2127929 - protein, 21 aa, Cryptosporidium hominis
TGEPVFNWRLVYPHLVTPISG

SEQ ID NO: 2127930 - protein, 24 aa, Cryptosporidium hominis
TGGIKTYLFWALFIYFSISSSLLV

SEQ ID NO: 2127931 - protein, 30 aa, Cryptosporidium hominis
TGGNLSFCFPEIDLSIAILTNDYVKGSYIS

SEQ ID NO: 2127932 - protein, 20 aa, Cryptosporidium hominis
TGGTGFRSGWGNVISNAISL

SEQ ID NO: 2127933 - protein, 25 aa, Cryptosporidium hominis
TGIPCVALSLFGLFMINESSGIFSE

SEQ ID NO: 2127934 - protein, 34 aa, Cryptosporidium hominis
TGLSVDFFGFITALRMVFAYVHLFDGVILGIYLC

SEQ ID NO: 2127935 - protein, 23 aa, Cryptosporidium hominis
TGNILFCYYCEQPLCQTYFEQSC

SEQ ID NO: 2127936 - protein, 19 aa, Cryptosporidium hominis
TGNSLTRYGLKVVKHKNPN

SEQ ID NO: 2127937 - protein, 20 aa, Cryptosporidium hominis
TGRKCGIFRTFSCSPTSVSL

SEQ ID NO: 2127938 - protein, 23 aa, Cryptosporidium hominis
TGTPLPSVCYIDFELKCNNPSEG

SEQ ID NO: 2127939 - protein, 26 aa, Cryptosporidium hominis
TGTTISIFPARLFKKITRGLFNNVSK

SEQ ID NO: 2127940 - protein, 34 aa, Cryptosporidium hominis
THFNHFEWETGRHMIPLALCFIGMVSLSNICLKH

SEQ ID NO: 2127941 - protein, 21 aa, Cryptosporidium hominis
THFPWEFKYVYKADLLKVPII

SEQ ID NO: 2127942 - protein, 18 aa, Cryptosporidium hominis
THPTICLFQVLFKVLAFL

SEQ ID NO: 2127943 - protein, 21 aa, Cryptosporidium hominis
THRGFKFIAEQVMHHPPVAAY

SEQ ID NO: 2127944 - protein, 19 aa, Cryptosporidium hominis
THSELNHAVIMIGYGINDN

SEQ ID NO: 2127945 - protein, 22 aa, Cryptosporidium hominis
THYASCALFFIFGLKSLYEGLF

SEQ ID NO: 2127946 - protein, 26 aa, Cryptosporidium hominis
TIADYLRWIALVLFPSFIYIRNTMNS

SEQ ID NO: 2127947 - protein, 20 aa, Cryptosporidium hominis
TIAFYRLVVNYGRMMSYVPF

SEQ ID NO: 2127948 - protein, 18 aa, Cryptosporidium hominis
TICFYATRLPYFDYQEDS

SEQ ID NO: 2127949 - protein, 19 aa, Cryptosporidium hominis
TICNGIICITGVIYILIGL

SEQ ID NO: 2127950 - protein, 18 aa, Cryptosporidium hominis
TIDTVEWCWDNCTRENGT

SEQ ID NO: 2127951 - protein, 17 aa, Cryptosporidium hominis
TIFFLEFFVQRLVFDKL

SEQ ID NO: 2127952 - protein, 25 aa, Cryptosporidium hominis
TIFRHFPLRRSFVFELMDHVNTLHF

SEQ ID NO: 2127953 - protein, 26 aa, Cryptosporidium hominis
TIGDYSIIRLIHFIFKRALRKFPSDE

SEQ ID NO: 2127954 - protein, 18 aa, Cryptosporidium hominis
TIHMSLIKCCFDMNMWED

SEQ ID NO: 2127955 - protein, 24 aa, Cryptosporidium hominis
TIIHPVSFCLTSNLQVLGAVVNLK

SEQ ID NO: 2127956 - protein, 23 aa, Cryptosporidium hominis
TIKKSNIKDVHFMEMDHFIYFLH

SEQ ID NO: 2127957 - protein, 26 aa, Cryptosporidium hominis
TILDCLRLPVCYSFTTLNTRQQLFFD

SEQ ID NO: 2127958 - protein, 23 aa, Cryptosporidium hominis
TILEYLDRIPLIQMPLSIASTIR

SEQ ID NO: 2127959 - protein, 23 aa, Cryptosporidium hominis
TILKLSSTCIGFYSFLKDEENFK

SEQ ID NO: 2127960 - protein, 17 aa, Cryptosporidium hominis
TILRLLRVEFPKYKKIL

SEQ ID NO: 2127961 - protein, 29 aa, Cryptosporidium hominis
TILWWACKLHYPKLIFRLLEFYIQAKNLP

SEQ ID NO: 2127962 - protein, 28 aa, Cryptosporidium hominis
TINQFFFSMCFWGLFSAVLGPLSQKIAS

SEQ ID NO: 2127963 - protein, 19 aa, Cryptosporidium hominis
TIPDLPKRNQLDWITGLQY

SEQ ID NO: 2127964 - protein, 17 aa, Cryptosporidium hominis
TIPEYVGLIGLDGFHLI

SEQ ID NO: 2127965 - protein, 26 aa, Cryptosporidium hominis
TIQGSRKGSALFASFDSSMIRNSGIN

SEQ ID NO: 2127966 - protein, 17 aa, Cryptosporidium hominis
TIRAEFHNSTILAVAHR

SEQ ID NO: 2127967 - protein, 22 aa, Cryptosporidium hominis
TIRDLLVKRAQEFNIILDDVSL

SEQ ID NO: 2127968 - protein, 28 aa, Cryptosporidium hominis
TIRNPMHILWCKLISLATNIFVSLEKSS

SEQ ID NO: 2127969 - protein, 24 aa, Cryptosporidium hominis
TIRTCKGLRTSTREHRIICNLSQS

SEQ ID NO: 2127970 - protein, 18 aa, Cryptosporidium hominis
TISISFYSLFLFAFGSPF

SEQ ID NO: 2127971 - protein, 19 aa, Cryptosporidium hominis
TITMTSIMLYFFSLSSMRN

SEQ ID NO: 2127972 - protein, 24 aa, Cryptosporidium hominis
TIVKIMLGIPFFKYFEEKESMISS

SEQ ID NO: 2127973 - protein, 25 aa, Cryptosporidium hominis
TIVRGIEILVFFAFKKNYHSIFFFD

SEQ ID NO: 2127974 - protein, 23 aa, Cryptosporidium hominis
TIYILIGLLMKIEISYSKFEFLR

SEQ ID NO: 2127975 - protein, 19 aa, Cryptosporidium hominis
TIYSFLMKVLENILVIDLH

SEQ ID NO: 2127976 - protein, 24 aa, Cryptosporidium hominis
TKALYRFISFWSGFLLIFNILILL

SEQ ID NO: 2127977 - protein, 17 aa, Cryptosporidium hominis
TKATGWAGRGGGGGGKK

SEQ ID NO: 2127978 - protein, 17 aa, Cryptosporidium hominis
TKFLLPIEIGNIPEDSG

SEQ ID NO: 2127979 - protein, 17 aa, Cryptosporidium hominis
TKFNLFMFITYDKYIDL

SEQ ID NO: 2127980 - protein, 18 aa, Cryptosporidium hominis
TKFVCIIWSIISSMDPES

SEQ ID NO: 2127981 - protein, 23 aa, Cryptosporidium hominis
TKGMLVKWGLVVLIFQLFFSLLI

SEQ ID NO: 2127982 - protein, 25 aa, Cryptosporidium hominis
TKILLEAFTSWSLVLFSIIICAFLF

SEQ ID NO: 2127983 - protein, 22 aa, Cryptosporidium hominis
TKKWRAKGMRSLQFAQSLRKFS

SEQ ID NO: 2127984 - protein, 20 aa, Cryptosporidium hominis
TKLFWILIPIIICIISLSIN

SEQ ID NO: 2127985 - protein, 26 aa, Cryptosporidium hominis
TKPFFSLKIFGIWSMNAVFHAAVSLF

SEQ ID NO: 2127986 - protein, 31 aa, Cryptosporidium hominis
TKPFRLSLFTNKLFVIQIFFIIISTIAIILV

SEQ ID NO: 2127987 - protein, 24 aa, Cryptosporidium hominis
TKRIKIKRLIDGKCEEVSSDAVLN

SEQ ID NO: 2127988 - protein, 24 aa, Cryptosporidium hominis
TKRVFRESIIRGCCKQLELLLSSD

SEQ ID NO: 2127989 - protein, 17 aa, Cryptosporidium hominis
TKTPVCMYPCMDLDLII

SEQ ID NO: 2127990 - protein, 24 aa, Cryptosporidium hominis
TKYFIPGFFILYFIQPFSYYISSE

SEQ ID NO: 2127991 - protein, 27 aa, Cryptosporidium hominis
TKYSFPIITGLLLYIGIYLPNGNESNS

SEQ ID NO: 2127992 - protein, 32 aa, Cryptosporidium hominis
TKYTCKLRLILKNYRRKKCNERNKVTSVLVGC

SEQ ID NO: 2127993 - protein, 25 aa, Cryptosporidium hominis
TLAKEIMRGFSILIHHILVRSYNFH

SEQ ID NO: 2127994 - protein, 18 aa, Cryptosporidium hominis
TLASLPSMDYFDTLEPSQ

SEQ ID NO: 2127995 - protein, 17 aa, Cryptosporidium hominis
TLDEIKSACKLAGVHEN

SEQ ID NO: 2127996 - protein, 21 aa, Cryptosporidium hominis
TLDIKYIFKYGYGEFFEIDFR

SEQ ID NO: 2127997 - protein, 26 aa, Cryptosporidium hominis
TLEAFRYAGIKIWLLTGDKLETALCI

SEQ ID NO: 2127998 - protein, 18 aa, Cryptosporidium hominis
TLEILKMEKAIMAPNYFD

SEQ ID NO: 2127999 - protein, 21 aa, Cryptosporidium hominis
TLFLKNYCDWGQLDKIVQQVL

SEQ ID NO: 2128000 - protein, 23 aa, Cryptosporidium hominis
TLFMLGFLRYFRVLNPIPILTII

SEQ ID NO: 2128001 - protein, 32 aa, Cryptosporidium hominis
TLGIISIICHWFPNFYRWMNFKASTISECDSF

SEQ ID NO: 2128002 - protein, 24 aa, Cryptosporidium hominis
TLHFSKGVELFLSYYYERNERIIG

SEQ ID NO: 2128003 - protein, 18 aa, Cryptosporidium hominis
TLIGPIIRIWAFELAPCV

SEQ ID NO: 2128004 - protein, 24 aa, Cryptosporidium hominis
TLIRRFSLKFPQPYLSLIENINRE

SEQ ID NO: 2128005 - protein, 20 aa, Cryptosporidium hominis
TLLITFGMLNPWYILFDWEY

SEQ ID NO: 2128006 - protein, 18 aa, Cryptosporidium hominis
TLLMKLKNSLNFEDPLLP

SEQ ID NO: 2128007 - protein, 17 aa, Cryptosporidium hominis
TLLQYRFHINDSMKCAF

SEQ ID NO: 2128008 - protein, 17 aa, Cryptosporidium hominis
TLLVMCLIISLTSVLLL

SEQ ID NO: 2128009 - protein, 23 aa, Cryptosporidium hominis
TLMGSAIGKYKCRVGETSCYGSE

SEQ ID NO: 2128010 - protein, 25 aa, Cryptosporidium hominis
TLNFFAGSVLVIWSIFIYGLESAFP

SEQ ID NO: 2128011 - protein, 17 aa, Cryptosporidium hominis
TLSDLLLCYSKSTNYKG

SEQ ID NO: 2128012 - protein, 23 aa, Cryptosporidium hominis
TLSSRINSVLSRFHSGEGNTKLK

SEQ ID NO: 2128013 - protein, 18 aa, Cryptosporidium hominis
TLYSKWLMNNYFPYPITM

SEQ ID NO: 2128014 - protein, 23 aa, Cryptosporidium hominis
TMDSHILGLCWGFGQAIQNTAQS

SEQ ID NO: 2128015 - protein, 17 aa, Cryptosporidium hominis
TMEKCCMYLARCVSNQE

SEQ ID NO: 2128016 - protein, 18 aa, Cryptosporidium hominis
TMGLIPVNRGDFFSDTPP

SEQ ID NO: 2128017 - protein, 27 aa, Cryptosporidium hominis
TMIDWLAVLICSLPVILIDEVLKAFSR

SEQ ID NO: 2128018 - protein, 21 aa, Cryptosporidium hominis
TMRYCRLFEKFSIFVVQDLFK

SEQ ID NO: 2128019 - protein, 22 aa, Cryptosporidium hominis
TMSIKKAYRLMSLKYHPDKNPN

SEQ ID NO: 2128020 - protein, 17 aa, Cryptosporidium hominis
TMTPFGTCSVQNVIEAG

SEQ ID NO: 2128021 - protein, 23 aa, Cryptosporidium hominis
TMYDENLPVWAIFLINATCLTLS

SEQ ID NO: 2128022 - protein, 17 aa, Cryptosporidium hominis
TNARAAMATSYFIGLGS

SEQ ID NO: 2128023 - protein, 23 aa, Cryptosporidium hominis
TNASIKLIRAWNSHMILRSKRRK

SEQ ID NO: 2128024 - protein, 22 aa, Cryptosporidium hominis
TNCVPIKAFFLLLDKLSNTNWH

SEQ ID NO: 2128025 - protein, 20 aa, Cryptosporidium hominis
TNEILLFMGKWKYRQKDKNY

SEQ ID NO: 2128026 - protein, 25 aa, Cryptosporidium hominis
TNEQESSFWGWFGYSTTPENPKAKI

SEQ ID NO: 2128027 - protein, 17 aa, Cryptosporidium hominis
TNFPFPSQLVVIIMANV

SEQ ID NO: 2128028 - protein, 17 aa, Cryptosporidium hominis
TNICFASTAITNGTGKA

SEQ ID NO: 2128029 - protein, 17 aa, Cryptosporidium hominis
TNIKSYELLTYFCQEVI

SEQ ID NO: 2128030 - protein, 17 aa, Cryptosporidium hominis
TNKLCVICMVNVSIFKD

SEQ ID NO: 2128031 - protein, 20 aa, Cryptosporidium hominis
TNLECIDMMNGPAICVGIRN

SEQ ID NO: 2128032 - protein, 27 aa, Cryptosporidium hominis
TNLNIKLSFPIARSFERKLEASIYVSN

SEQ ID NO: 2128033 - protein, 19 aa, Cryptosporidium hominis
TNLRCVRVNLLGNGQSETK

SEQ ID NO: 2128034 - protein, 26 aa, Cryptosporidium hominis
TNPNFWASVVHELWLFIIVSQHNNLK

SEQ ID NO: 2128035 - protein, 21 aa, Cryptosporidium hominis
TNRFISLIGEHVFSQYYTING

SEQ ID NO: 2128036 - protein, 24 aa, Cryptosporidium hominis
TNSASLRLARFIFESKAPKKSKRN

SEQ ID NO: 2128037 - protein, 24 aa, Cryptosporidium hominis
TNTLKGTNFTGVVEDSILKNNLTQ

SEQ ID NO: 2128038 - protein, 18 aa, Cryptosporidium hominis
TPAEFLYMREIRFMNVDS

SEQ ID NO: 2128039 - protein, 17 aa, Cryptosporidium hominis
TPDCRYYSYGAFLKGPG

SEQ ID NO: 2128040 - protein, 28 aa, Cryptosporidium hominis
TPDLYLFPRFLSFYKLAPIKLRQQMWLR

SEQ ID NO: 2128041 - protein, 31 aa, Cryptosporidium hominis
TPDPQSCVTCFRRNHFPELQAIFVKCGLKHQ

SEQ ID NO: 2128042 - protein, 17 aa, Cryptosporidium hominis
TPEIIIPLGGFSNENVL

SEQ ID NO: 2128043 - protein, 26 aa, Cryptosporidium hominis
TPFGELRLGLKIPYDNKVVSIFFDDQ

SEQ ID NO: 2128044 - protein, 24 aa, Cryptosporidium hominis
TPFMAFRVLLRETKLEVVLRDEFA

SEQ ID NO: 2128045 - protein, 17 aa, Cryptosporidium hominis
TPFNALRSRKVGFLVVF

SEQ ID NO: 2128046 - protein, 19 aa, Cryptosporidium hominis
TPLLLKEIILFYVDNFLLN

SEQ ID NO: 2128047 - protein, 19 aa, Cryptosporidium hominis
TPRGILFAIVDFVSYSSLF

SEQ ID NO: 2128048 - protein, 23 aa, Cryptosporidium hominis
TPRVSLFDWYRCINHPSYDDMLH

SEQ ID NO: 2128049 - protein, 17 aa, Cryptosporidium hominis
TPSCIWACIPSQRLQSL

SEQ ID NO: 2128050 - protein, 18 aa, Cryptosporidium hominis
TPSEIKSMVLAIIHTILL

SEQ ID NO: 2128051 - protein, 19 aa, Cryptosporidium hominis
TPTCSDVIEKFEWNKDLIG

SEQ ID NO: 2128052 - protein, 25 aa, Cryptosporidium hominis
TPVATLKCGDYTIVYAPIKDQTDPA

SEQ ID NO: 2128053 - protein, 19 aa, Cryptosporidium hominis
TPWGPLCMAEVSLGPRTEC

SEQ ID NO: 2128054 - protein, 21 aa, Cryptosporidium hominis
TPYEYFNVVIICKILSCIVAM

SEQ ID NO: 2128055 - protein, 24 aa, Cryptosporidium hominis
TQERLQRVYLFQGFINSRIKAYSN

SEQ ID NO: 2128056 - protein, 20 aa, Cryptosporidium hominis
TQGKFSFARVRSTTIPVRWY

SEQ ID NO: 2128057 - protein, 26 aa, Cryptosporidium hominis
TQKKMLWIILCIFILILVVLLPMIIG

SEQ ID NO: 2128058 - protein, 22 aa, Cryptosporidium hominis
TQSCSFSTLSGGFVPPLTDVSS

SEQ ID NO: 2128059 - protein, 28 aa, Cryptosporidium hominis
TQSLKINFLPFIFRNIASYIVMNSINCM

SEQ ID NO: 2128060 - protein, 26 aa, Cryptosporidium hominis
TQSSDFCRIWLLTALVRLIHIPSGGL

SEQ ID NO: 2128061 - protein, 17 aa, Cryptosporidium hominis
TRFGILGGIIYERPWYF

SEQ ID NO: 2128062 - protein, 21 aa, Cryptosporidium hominis
TRKMLLFLIIVIACSIAILYS

SEQ ID NO: 2128063 - protein, 22 aa, Cryptosporidium hominis
TRLNILNSYFLWEAGKRSKHNL

SEQ ID NO: 2128064 - protein, 20 aa, Cryptosporidium hominis
TRLQGSLFRKINEFLYTSDS

SEQ ID NO: 2128065 - protein, 18 aa, Cryptosporidium hominis
TRLYCSFQGKIFFGTSSE

SEQ ID NO: 2128066 - protein, 28 aa, Cryptosporidium hominis
TRSNACMFEFIIPLVLEPIMIRLITVLA

SEQ ID NO: 2128067 - protein, 24 aa, Cryptosporidium hominis
TRSTMKSILGYSILISVFLFIVFI

SEQ ID NO: 2128068 - protein, 26 aa, Cryptosporidium hominis
TRVVNFLRLYLIKVLPKNILGTFKNF

SEQ ID NO: 2128069 - protein, 17 aa, Cryptosporidium hominis
TRYCSLTGREFEELSEA

SEQ ID NO: 2128070 - protein, 22 aa, Cryptosporidium hominis
TRYSRHLVCDYIYIHEKFPEAA

SEQ ID NO: 2128071 - protein, 18 aa, Cryptosporidium hominis
TSAIPLLYVLIQFISNSN

SEQ ID NO: 2128072 - protein, 20 aa, Cryptosporidium hominis
TSASKLLLFNYLKLNSTKTT

SEQ ID NO: 2128073 - protein, 20 aa, Cryptosporidium hominis
TSCFLIFTIILYRNISFTFK

SEQ ID NO: 2128074 - protein, 19 aa, Cryptosporidium hominis
TSCGLQKWDVSTQYIHKAF

SEQ ID NO: 2128075 - protein, 19 aa, Cryptosporidium hominis
TSDRFKCDLNNEIISKMCV

SEQ ID NO: 2128076 - protein, 33 aa, Cryptosporidium hominis
TSEILLKVVCIYILNMLRFIAIINPELSSSLFK

SEQ ID NO: 2128077 - protein, 25 aa, Cryptosporidium hominis
TSEMCCVQFFVPRSFISIDKYTVEG

SEQ ID NO: 2128078 - protein, 23 aa, Cryptosporidium hominis
TSFITGFFYWDWIELQSTNIRTY

SEQ ID NO: 2128079 - protein, 20 aa, Cryptosporidium hominis
TSFKDSVCKNTFLVFLVVYI

SEQ ID NO: 2128080 - protein, 21 aa, Cryptosporidium hominis
TSGNIWKMFQPILNIKYHSSL

SEQ ID NO: 2128081 - protein, 23 aa, Cryptosporidium hominis
TSHTIRLLALRRFELKILFQKIL

SEQ ID NO: 2128082 - protein, 29 aa, Cryptosporidium hominis
TSIFSLPLLSSWFGLEWTKNQLWSKNILP

SEQ ID NO: 2128083 - protein, 24 aa, Cryptosporidium hominis
TSIHSRILFKIIMSIYNNENILLV

SEQ ID NO: 2128084 - protein, 22 aa, Cryptosporidium hominis
TSKDLKSRCSYVMQHEMTIPYL

SEQ ID NO: 2128085 - protein, 29 aa, Cryptosporidium hominis
TSKLKAYEWANCCWNYLGTITEINNLSSK

SEQ ID NO: 2128086 - protein, 26 aa, Cryptosporidium hominis
TSLLFQLAIPLNFIGMIYRESKLTLI

SEQ ID NO: 2128087 - protein, 22 aa, Cryptosporidium hominis
TSLSSIFSMDSFINPIGNLLKG

SEQ ID NO: 2128088 - protein, 21 aa, Cryptosporidium hominis
TSNKYPLFLKYLFPKLSEALS

SEQ ID NO: 2128089 - protein, 18 aa, Cryptosporidium hominis
TSNLNILIPLAIYGLNKP

SEQ ID NO: 2128090 - protein, 24 aa, Cryptosporidium hominis
TSNSILRWFPLSFILNRLTNDQLH

SEQ ID NO: 2128091 - protein, 20 aa, Cryptosporidium hominis
TSNTWLKSNQNLFGQYGDLI

SEQ ID NO: 2128092 - protein, 17 aa, Cryptosporidium hominis
TSRENGILFALPTGNNG

SEQ ID NO: 2128093 - protein, 17 aa, Cryptosporidium hominis
TSSFCILITIVLSVLTI

SEQ ID NO: 2128094 - protein, 21 aa, Cryptosporidium hominis
TSSGEIGFYFEVTDNSYKTGC

SEQ ID NO: 2128095 - protein, 25 aa, Cryptosporidium hominis
TSSHARIVLVIALFIIIFMLKQGMF

SEQ ID NO: 2128096 - protein, 24 aa, Cryptosporidium hominis
TSSLEVLRIFPFDYNRRLMSIIVH

SEQ ID NO: 2128097 - protein, 18 aa, Cryptosporidium hominis
TSSNKSIMNNAFITTTTT

SEQ ID NO: 2128098 - protein, 28 aa, Cryptosporidium hominis
TSSTCRKPQLPEFLLQRSVINSGANSGM

SEQ ID NO: 2128099 - protein, 18 aa, Cryptosporidium hominis
TSVIEVWRIRNLKYDNSD

SEQ ID NO: 2128100 - protein, 24 aa, Cryptosporidium hominis
TSVILLEFWQFSAFVISTQILSVY

SEQ ID NO: 2128101 - protein, 18 aa, Cryptosporidium hominis
TSVLFKSKIHRFFSHQLM

SEQ ID NO: 2128102 - protein, 23 aa, Cryptosporidium hominis
TSVSFPYPFGFDPVWKGAVNEMS

SEQ ID NO: 2128103 - protein, 23 aa, Cryptosporidium hominis
TTCENCPFIISFRLFNISQEPFF

SEQ ID NO: 2128104 - protein, 28 aa, Cryptosporidium hominis
TTFDGEGFLKAVSKLVNIRKRVNTGNDS

SEQ ID NO: 2128105 - protein, 19 aa, Cryptosporidium hominis
TTGCGVYLNAGREVAVAST

SEQ ID NO: 2128106 - protein, 18 aa, Cryptosporidium hominis
TTLAKLIYRIFEPNSGKI

SEQ ID NO: 2128107 - protein, 28 aa, Cryptosporidium hominis
TTLEQGLDYSIAFILCKIICELSQHGFL

SEQ ID NO: 2128108 - protein, 25 aa, Cryptosporidium hominis
TTLKVLFSLLGPCRNLSMYSFATIE

SEQ ID NO: 2128109 - protein, 17 aa, Cryptosporidium hominis
TTLRFLLEAVDSQTQFG

SEQ ID NO: 2128110 - protein, 24 aa, Cryptosporidium hominis
TTLSYFPEHIFIQILNVINQRIAE

SEQ ID NO: 2128111 - protein, 18 aa, Cryptosporidium hominis
TTNAPNLDGSYHGDDEFP

SEQ ID NO: 2128112 - protein, 41 aa, Cryptosporidium hominis
TTNNPESLLLLSRLTTKAPPKFLISSIKASSNSTLEISKLD

SEQ ID NO: 2128113 - protein, 23 aa, Cryptosporidium hominis
TTNYENICFWSLKLENTQFKDSN

SEQ ID NO: 2128114 - protein, 25 aa, Cryptosporidium hominis
TTRTRKLLSAAYFIESCIDTFQLKS

SEQ ID NO: 2128115 - protein, 21 aa, Cryptosporidium hominis
TTSGACYRRLVRFERNKVQNC

SEQ ID NO: 2128116 - protein, 21 aa, Cryptosporidium hominis
TVAIICVVMFLIFGVYTMLFS

SEQ ID NO: 2128117 - protein, 23 aa, Cryptosporidium hominis
TVALFCYGMFLSYICESFSLGTL

SEQ ID NO: 2128118 - protein, 23 aa, Cryptosporidium hominis
TVCFIICAFGVLVVHYLESKAAM

SEQ ID NO: 2128119 - protein, 17 aa, Cryptosporidium hominis
TVDTYWFFHSIWHIMAF

SEQ ID NO: 2128120 - protein, 23 aa, Cryptosporidium hominis
TVEESSWFSGWFGASETTPAPPP

SEQ ID NO: 2128121 - protein, 25 aa, Cryptosporidium hominis
TVFGIFGAVVFKFPKDQWFILICVV

SEQ ID NO: 2128122 - protein, 19 aa, Cryptosporidium hominis
TVFPWCISLLLYSLLHFTY

SEQ ID NO: 2128123 - protein, 19 aa, Cryptosporidium hominis
TVISFLCWDGFTEILEMNQ

SEQ ID NO: 2128124 - protein, 24 aa, Cryptosporidium hominis
TVSWCLLSDVVIRIVHIIGLLSRG

SEQ ID NO: 2128125 - protein, 26 aa, Cryptosporidium hominis
TVVFVIICRFLFFPVSTLRRIKMQIN

SEQ ID NO: 2128126 - protein, 21 aa, Cryptosporidium hominis
TWELQSRYGLGQSQKDIMMIK

SEQ ID NO: 2128127 - protein, 25 aa, Cryptosporidium hominis
TWFCNREFGAEFLLNSVIVNQIAAN

SEQ ID NO: 2128128 - protein, 20 aa, Cryptosporidium hominis
TWFYCFLLIILNVQYSKLHL

SEQ ID NO: 2128129 - protein, 22 aa, Cryptosporidium hominis
TWKNKIPEIFVDFITNSDMDVN

SEQ ID NO: 2128130 - protein, 27 aa, Cryptosporidium hominis
TWVSWMHCIALVLGRTCDSCLYVRLIA

SEQ ID NO: 2128131 - protein, 17 aa, Cryptosporidium hominis
TYCGLIYNDFFAAGLDI

SEQ ID NO: 2128132 - protein, 20 aa, Cryptosporidium hominis
TYDFDWKKNYIDYAEKLTYQ

SEQ ID NO: 2128133 - protein, 22 aa, Cryptosporidium hominis
TYFPRILREIWLRNSNNKTQAI

SEQ ID NO: 2128134 - protein, 22 aa, Cryptosporidium hominis
TYGDFFFIILISTFLKEVSRIH

SEQ ID NO: 2128135 - protein, 27 aa, Cryptosporidium hominis
TYIIIMCLRHIITLYTLSRFGEGRFFA

SEQ ID NO: 2128136 - protein, 24 aa, Cryptosporidium hominis
TYIMIRIALTYPVNINRISKVPIL

SEQ ID NO: 2128137 - protein, 18 aa, Cryptosporidium hominis
TYLMYGNSLLSMLLGIHL

SEQ ID NO: 2128138 - protein, 20 aa, Cryptosporidium hominis
TYLRRCRHFDNETSRFYAAQ

SEQ ID NO: 2128139 - protein, 22 aa, Cryptosporidium hominis
TYNFNFKNIWMIQSSQTTKSSV

SEQ ID NO: 2128140 - protein, 18 aa, Cryptosporidium hominis
TYNLKCMPNLSTIKKSNI

SEQ ID NO: 2128141 - protein, 17 aa, Cryptosporidium hominis
TYQNFLDWFKQIYNNSN

SEQ ID NO: 2128142 - protein, 17 aa, Cryptosporidium hominis
TYYPRNPYVPPYGNPYY

SEQ ID NO: 2128143 - protein, 21 aa, Cryptosporidium hominis
VAEALKAFSQILYKHITEATP

SEQ ID NO: 2128144 - protein, 20 aa, Cryptosporidium hominis
VAENELKPLLSPSEKVYGRL

SEQ ID NO: 2128145 - protein, 19 aa, Cryptosporidium hominis
VAGLIALGSVFIIITDYAN

SEQ ID NO: 2128146 - protein, 24 aa, Cryptosporidium hominis
VAGLTVFCCLIFFGDLADSYLLHD

SEQ ID NO: 2128147 - protein, 19 aa, Cryptosporidium hominis
VAGRMPGHMNVLLAESGVP

SEQ ID NO: 2128148 - protein, 18 aa, Cryptosporidium hominis
VAGRVFGISCLLIILVGL

SEQ ID NO: 2128149 - protein, 21 aa, Cryptosporidium hominis
VAILFKLCSILLITLLFSIKK

SEQ ID NO: 2128150 - protein, 20 aa, Cryptosporidium hominis
VAKEAILVIIHDWISFIRFL

SEQ ID NO: 2128151 - protein, 29 aa, Cryptosporidium hominis
VAKFFSVMIPMWLSMKIPRYKKRCVQQIA

SEQ ID NO: 2128152 - protein, 18 aa, Cryptosporidium hominis
VALFQGWLAVGYATYYTM

SEQ ID NO: 2128153 - protein, 17 aa, Cryptosporidium hominis
VALGFVMYSRGGEEADE

SEQ ID NO: 2128154 - protein, 18 aa, Cryptosporidium hominis
VALGPGVILSYLLQGLFH

SEQ ID NO: 2128155 - protein, 17 aa, Cryptosporidium hominis
VALLRLNHVNSRAISKS

SEQ ID NO: 2128156 - protein, 18 aa, Cryptosporidium hominis
VALPGWLRYSIFTVGEFE

SEQ ID NO: 2128157 - protein, 29 aa, Cryptosporidium hominis
VASGVSWFIFRYFFDFIRYFIEENKCFVF

SEQ ID NO: 2128158 - protein, 24 aa, Cryptosporidium hominis
VASRLLGSLPPEFPNLDDLMAIPV

SEQ ID NO: 2128159 - protein, 22 aa, Cryptosporidium hominis
VATICTLAAVAIIDSREIYQIY

SEQ ID NO: 2128160 - protein, 26 aa, Cryptosporidium hominis
VAWMICIPSAFLIRPIWILENSLDSN

SEQ ID NO: 2128161 - protein, 21 aa, Cryptosporidium hominis
VCDLLRRGNVETVFELLMVPL

SEQ ID NO: 2128162 - protein, 26 aa, Cryptosporidium hominis
VCEQHSGLYLSWRNIFDYPLTCELLR

SEQ ID NO: 2128163 - protein, 20 aa, Cryptosporidium hominis
VCFILLCLLANITRTISIII

SEQ ID NO: 2128164 - protein, 21 aa, Cryptosporidium hominis
VCISGKFPKRSRVLLSSTVVM

SEQ ID NO: 2128165 - protein, 18 aa, Cryptosporidium hominis
VCLFGICAPSSAFLESFF

SEQ ID NO: 2128166 - protein, 18 aa, Cryptosporidium hominis
VCLLASGEVVSWGDPSRG

SEQ ID NO: 2128167 - protein, 34 aa, Cryptosporidium hominis
VCLRWLQNRICYVFKFGCVVGWDLTRAERVAIVN

SEQ ID NO: 2128168 - protein, 19 aa, Cryptosporidium hominis
VCMYPCMDLDLIIEKNIIA

SEQ ID NO: 2128169 - protein, 19 aa, Cryptosporidium hominis
VCNYLKPQIVLSISFIVCG

SEQ ID NO: 2128170 - protein, 23 aa, Cryptosporidium hominis
VCREQFAKLAFITVRMKSNLILV

SEQ ID NO: 2128171 - protein, 24 aa, Cryptosporidium hominis
VCSKSCDPSPCLNGGICSELPKSN

SEQ ID NO: 2128172 - protein, 20 aa, Cryptosporidium hominis
VCVYIVLSLELVGKLYLISA

SEQ ID NO: 2128173 - protein, 19 aa, Cryptosporidium hominis
VCYFLPAVLHLKLFSDSPW

SEQ ID NO: 2128174 - protein, 17 aa, Cryptosporidium hominis
VDADWGKLVSNIPPKTS

SEQ ID NO: 2128175 - protein, 17 aa, Cryptosporidium hominis
VDCSDKSTKECIYEILS

SEQ ID NO: 2128176 - protein, 21 aa, Cryptosporidium hominis
VDCSYELAICIIKSIYSSSYF

SEQ ID NO: 2128177 - protein, 28 aa, Cryptosporidium hominis
VDIPLLILRTYIWLHFPVFPGFNPWIMK

SEQ ID NO: 2128178 - protein, 27 aa, Cryptosporidium hominis
VDKHFPLFRSCFKIAYTGTPPRSLIDI

SEQ ID NO: 2128179 - protein, 20 aa, Cryptosporidium hominis
VDLIFKISIAILKILKNSLF

SEQ ID NO: 2128180 - protein, 19 aa, Cryptosporidium hominis
VDLTFHFVKKLMAVKTRPS

SEQ ID NO: 2128181 - protein, 17 aa, Cryptosporidium hominis
VDLYSEYGFTPLLLACK

SEQ ID NO: 2128182 - protein, 19 aa, Cryptosporidium hominis
VDSFSLFWCKEQERKKELS

SEQ ID NO: 2128183 - protein, 18 aa, Cryptosporidium hominis
VDTHLFFNLELGICEKCK

SEQ ID NO: 2128184 - protein, 19 aa, Cryptosporidium hominis
VDVTLEFAWLEIFRSRILI

SEQ ID NO: 2128185 - protein, 27 aa, Cryptosporidium hominis
VDWKKVCRKYSYNFAKSIAIRKNISIR

SEQ ID NO: 2128186 - protein, 17 aa, Cryptosporidium hominis
VEAEFRKQLILGEEGIP

SEQ ID NO: 2128187 - protein, 25 aa, Cryptosporidium hominis
VEAETIKKLGFVGGKIKMISSHLSN

SEQ ID NO: 2128188 - protein, 23 aa, Cryptosporidium hominis
VEDIVRFSAKFYKFSNDKWENYN

SEQ ID NO: 2128189 - protein, 33 aa, Cryptosporidium hominis
VEEVFKIAFMLLRKGCRMQLDAFLRERAKAHWL

SEQ ID NO: 2128190 - protein, 18 aa, Cryptosporidium hominis
VEGKRLLQFIKISTAVID

SEQ ID NO: 2128191 - protein, 24 aa, Cryptosporidium hominis
VEHFSKFHLNICNLPRPAFSRPVL

SEQ ID NO: 2128192 - protein, 17 aa, Cryptosporidium hominis
VEILKLLTSLFMIFQIS

SEQ ID NO: 2128193 - protein, 17 aa, Cryptosporidium hominis
VEILLKYFLFPDYTRDS

SEQ ID NO: 2128194 - protein, 17 aa, Cryptosporidium hominis
VEIVIRFNSAICHELKG

SEQ ID NO: 2128195 - protein, 32 aa, Cryptosporidium hominis
VEKIKIPICQHNWRPIFITSLILSDKLWDDSC

SEQ ID NO: 2128196 - protein, 24 aa, Cryptosporidium hominis
VEKLRWPGGFYFYISGSGPYYPCH

SEQ ID NO: 2128197 - protein, 20 aa, Cryptosporidium hominis
VELGLDFYLCDCSTALLSAV

SEQ ID NO: 2128198 - protein, 19 aa, Cryptosporidium hominis
VELMTCLSSAYLQVKDENK

SEQ ID NO: 2128199 - protein, 17 aa, Cryptosporidium hominis
VELRWPSGALLMKDLSF

SEQ ID NO: 2128200 - protein, 26 aa, Cryptosporidium hominis
VEMKEFKSNFNLIKSFQYSILKFEKL

SEQ ID NO: 2128201 - protein, 20 aa, Cryptosporidium hominis
VEPKKILSITLIYNLQNALR

SEQ ID NO: 2128202 - protein, 23 aa, Cryptosporidium hominis
VESICPRGGCLAQETFPPVLSCP

SEQ ID NO: 2128203 - protein, 17 aa, Cryptosporidium hominis
VESLFFLLVSPYSICPT

SEQ ID NO: 2128204 - protein, 20 aa, Cryptosporidium hominis
VESLFRIPLNRPEFVDRIKI

SEQ ID NO: 2128205 - protein, 28 aa, Cryptosporidium hominis
VESSIRFPTIRSFFSWFGSFNSLYVKYQ

SEQ ID NO: 2128206 - protein, 25 aa, Cryptosporidium hominis
VETQMFCFLPLFILSHNIIKQYYQS

SEQ ID NO: 2128207 - protein, 20 aa, Cryptosporidium hominis
VEVRYSVALLVLKISRIQGF

SEQ ID NO: 2128208 - protein, 18 aa, Cryptosporidium hominis
VFAIYSMISLPLCFIGGL

SEQ ID NO: 2128209 - protein, 20 aa, Cryptosporidium hominis
VFAMEMFIDRFISFPQFLSA

SEQ ID NO: 2128210 - protein, 18 aa, Cryptosporidium hominis
VFASFGLGIVPTAWKLVS

SEQ ID NO: 2128211 - protein, 18 aa, Cryptosporidium hominis
VFCSQCLLNSFKPLSHIC

SEQ ID NO: 2128212 - protein, 30 aa, Cryptosporidium hominis
VFDCKDIKESTRFLFWIIRHFDLNYLSPAI

SEQ ID NO: 2128213 - protein, 24 aa, Cryptosporidium hominis
VFEAPVLIPHSWLSSQMIYNESRS

SEQ ID NO: 2128214 - protein, 25 aa, Cryptosporidium hominis
VFFQELKIEYIVAILSSLLYDEKCP

SEQ ID NO: 2128215 - protein, 25 aa, Cryptosporidium hominis
VFGDICSLITYLLFIILFLVLNPSR

SEQ ID NO: 2128216 - protein, 24 aa, Cryptosporidium hominis
VFGIICKKASWFIVIYQEETVDTF

SEQ ID NO: 2128217 - protein, 19 aa, Cryptosporidium hominis
VFILLTFICSLGCFTASIS

SEQ ID NO: 2128218 - protein, 19 aa, Cryptosporidium hominis
VFITYFLVIYTVSATELDS

SEQ ID NO: 2128219 - protein, 18 aa, Cryptosporidium hominis
VFLSGIYFLWKKYPANNY

SEQ ID NO: 2128220 - protein, 17 aa, Cryptosporidium hominis
VFLSYSFSYVLSSFSTS

SEQ ID NO: 2128221 - protein, 17 aa, Cryptosporidium hominis
VFMNEFRHEIDLEEVIK

SEQ ID NO: 2128222 - protein, 35 aa, Cryptosporidium hominis
VFRDVARAWTLILLVLCGFFSNLLFFSSCPNLGDI

SEQ ID NO: 2128223 - protein, 17 aa, Cryptosporidium hominis
VFRRRLARKKAFKERNI

SEQ ID NO: 2128224 - protein, 32 aa, Cryptosporidium hominis
VFSEIKWSRLSIIPREIIALYLPEPEAGQNFK

SEQ ID NO: 2128225 - protein, 19 aa, Cryptosporidium hominis
VFSGFIIDFIGGYKSERGL

SEQ ID NO: 2128226 - protein, 20 aa, Cryptosporidium hominis
VFSIFQWQLIWMSRKLSFSS

SEQ ID NO: 2128227 - protein, 17 aa, Cryptosporidium hominis
VFSRHSWGKRFIGLCTC

SEQ ID NO: 2128228 - protein, 19 aa, Cryptosporidium hominis
VFTIVLKFSEIHFKEPGKK

SEQ ID NO: 2128229 - protein, 17 aa, Cryptosporidium hominis
VFVSFGIGIVSLVIFSS

SEQ ID NO: 2128230 - protein, 23 aa, Cryptosporidium hominis
VFWLQCLMVLLLKVFFDVLQTLA

SEQ ID NO: 2128231 - protein, 24 aa, Cryptosporidium hominis
VFWPGKSKFLYYLSSVVLRGPDLR

SEQ ID NO: 2128232 - protein, 20 aa, Cryptosporidium hominis
VFYNTRFDSLLAKYKMNFLI

SEQ ID NO: 2128233 - protein, 17 aa, Cryptosporidium hominis
VFYYLSFIFSLINPVLP

SEQ ID NO: 2128234 - protein, 20 aa, Cryptosporidium hominis
VFYYSCFVASVIILHLWYFQ

SEQ ID NO: 2128235 - protein, 25 aa, Cryptosporidium hominis
VGAIELKQALKMIINRSKILEKSNI

SEQ ID NO: 2128236 - protein, 17 aa, Cryptosporidium hominis
VGAIGLTLLDIFRDLGR

SEQ ID NO: 2128237 - protein, 20 aa, Cryptosporidium hominis
VGALCGFGNEVIRLSDRSYM

SEQ ID NO: 2128238 - protein, 21 aa, Cryptosporidium hominis
VGDISTCIKVTTIFWKNQGIK

SEQ ID NO: 2128239 - protein, 25 aa, Cryptosporidium hominis
VGDYLRLPFQAIMFLIEGLLCFFLG

SEQ ID NO: 2128240 - protein, 23 aa, Cryptosporidium hominis
VGERCKLLTISVGFLALAHALML

SEQ ID NO: 2128241 - protein, 27 aa, Cryptosporidium hominis
VGFEHLWKKRVVYLLKIQSVNAVLFLE

SEQ ID NO: 2128242 - protein, 19 aa, Cryptosporidium hominis
VGFLPKIIEAYVVSLFELC

SEQ ID NO: 2128243 - protein, 20 aa, Cryptosporidium hominis
VGFQGWRFAFLLVGVLSAIL

SEQ ID NO: 2128244 - protein, 26 aa, Cryptosporidium hominis
VGFYRGWKMALVMSASLPIVAAAGFL

SEQ ID NO: 2128245 - protein, 24 aa, Cryptosporidium hominis
VGGSFFPLWAPIRYIPAFMAERHR

SEQ ID NO: 2128246 - protein, 26 aa, Cryptosporidium hominis
VGIATVGIFVWWYVWGIDPSDGNTLV

SEQ ID NO: 2128247 - protein, 20 aa, Cryptosporidium hominis
VGIIRYVPYLIFGISNSELE

SEQ ID NO: 2128248 - protein, 26 aa, Cryptosporidium hominis
VGILSIIFCLAIFMNFVLSYTYGKNK

SEQ ID NO: 2128249 - protein, 17 aa, Cryptosporidium hominis
VGIPVFIYGFFTLWSGT

SEQ ID NO: 2128250 - protein, 18 aa, Cryptosporidium hominis
VGKLRSSISYVQQNPILF

SEQ ID NO: 2128251 - protein, 24 aa, Cryptosporidium hominis
VGKMHKCLESSLIEFNQLDLKDSS

SEQ ID NO: 2128252 - protein, 21 aa, Cryptosporidium hominis
VGNIMLIRFFSIIIILISLVF

SEQ ID NO: 2128253 - protein, 26 aa, Cryptosporidium hominis
VGNVIFKQSFDIYKEVGFGVPMEEYI

SEQ ID NO: 2128254 - protein, 17 aa, Cryptosporidium hominis
VGRTWCIVLLISCILKS

SEQ ID NO: 2128255 - protein, 19 aa, Cryptosporidium hominis
VGRVKCWIPNQSIELPLRR

SEQ ID NO: 2128256 - protein, 29 aa, Cryptosporidium hominis
VGSIFYLLFKDCRGIVLSSFDHYKINKYI

SEQ ID NO: 2128257 - protein, 20 aa, Cryptosporidium hominis
VGSLRCWIQVLPPEIAIIRP

SEQ ID NO: 2128258 - protein, 17 aa, Cryptosporidium hominis
VGTFSCSIREYKFGNDG

SEQ ID NO: 2128259 - protein, 17 aa, Cryptosporidium hominis
VGYYCIWNVTPSLHTPL

SEQ ID NO: 2128260 - protein, 20 aa, Cryptosporidium hominis
VHDLHVWSVSVGVPALSCHI

SEQ ID NO: 2128261 - protein, 20 aa, Cryptosporidium hominis
VHECIRPCGYVAPTDSKLRV

SEQ ID NO: 2128262 - protein, 17 aa, Cryptosporidium hominis
VHFDLAILLLVISVICT

SEQ ID NO: 2128263 - protein, 18 aa, Cryptosporidium hominis
VHMLWLEVTMSYIIIPLQ

SEQ ID NO: 2128264 - protein, 26 aa, Cryptosporidium hominis
VHPEKALEFPLVLYSSVTTPLILENI

SEQ ID NO: 2128265 - protein, 19 aa, Cryptosporidium hominis
VHPSFPISYVPKILNFIDR

SEQ ID NO: 2128266 - protein, 24 aa, Cryptosporidium hominis
VHRPHPWGLLITFIELIKNPKYAF

SEQ ID NO: 2128267 - protein, 20 aa, Cryptosporidium hominis
VHSVLKICGIYKYVINTLNG

SEQ ID NO: 2128268 - protein, 19 aa, Cryptosporidium hominis
VIALARFVSALTMLVVIPM

SEQ ID NO: 2128269 - protein, 22 aa, Cryptosporidium hominis
VIDGHGGWQVAEYVQNNFIRIF

SEQ ID NO: 2128270 - protein, 18 aa, Cryptosporidium hominis
VIDPRLLHFKTLFVVLYI

SEQ ID NO: 2128271 - protein, 18 aa, Cryptosporidium hominis
VIEKFEWNKDLIGTSSQA

SEQ ID NO: 2128272 - protein, 23 aa, Cryptosporidium hominis
VIFSWNEGLSWYDFELGSKTLQV

SEQ ID NO: 2128273 - protein, 19 aa, Cryptosporidium hominis
VIGDFGCGTAKIGQTFGHI

SEQ ID NO: 2128274 - protein, 17 aa, Cryptosporidium hominis
VIGIFRFFCEKIDFQSD

SEQ ID NO: 2128275 - protein, 27 aa, Cryptosporidium hominis
VIGNAKLWWRYAIGCIIRDRRADISSI

SEQ ID NO: 2128276 - protein, 27 aa, Cryptosporidium hominis
VIGSLLISCQWLYSRHILYKSYVREFK

SEQ ID NO: 2128277 - protein, 17 aa, Cryptosporidium hominis
VIKACALWMDFQILPDG

SEQ ID NO: 2128278 - protein, 21 aa, Cryptosporidium hominis
VILFESWRTSNRFDYFISCLF

SEQ ID NO: 2128279 - protein, 18 aa, Cryptosporidium hominis
VILFKILSKHSINILIPV

SEQ ID NO: 2128280 - protein, 25 aa, Cryptosporidium hominis
VILKSLRPSLDFGENTSHHIPIKSF

SEQ ID NO: 2128281 - protein, 23 aa, Cryptosporidium hominis
VILLFLNLELLYASDTKENEGDI

SEQ ID NO: 2128282 - protein, 26 aa, Cryptosporidium hominis
VILPKKIAEMIFEFHYLLEISLKYLL

SEQ ID NO: 2128283 - protein, 18 aa, Cryptosporidium hominis
VILQCSFNFPSIRMPLFL

SEQ ID NO: 2128284 - protein, 19 aa, Cryptosporidium hominis
VILSLICCRYSVPKEEDFT

SEQ ID NO: 2128285 - protein, 43 aa, Cryptosporidium hominis
VIPIEGISIGDLVERCPFHSSLFPGLYLTGSRTSDVLAIDLFT

SEQ ID NO: 2128286 - protein, 18 aa, Cryptosporidium hominis
VIQTEFGISWTLESYSTN

SEQ ID NO: 2128287 - protein, 22 aa, Cryptosporidium hominis
VIRALSRYKGFREYLRTSEIQS

SEQ ID NO: 2128288 - protein, 24 aa, Cryptosporidium hominis
VIRGFCLCEGYNLESIRSALDKHN

SEQ ID NO: 2128289 - protein, 18 aa, Cryptosporidium hominis
VISAVIDGHGGWQVAEYV

SEQ ID NO: 2128290 - protein, 28 aa, Cryptosporidium hominis
VISITVTISLDWILKIYKRSLYPEISHL

SEQ ID NO: 2128291 - protein, 27 aa, Cryptosporidium hominis
VISVRFNDCNGIRAWEMNRICSMLEVM

SEQ ID NO: 2128292 - protein, 17 aa, Cryptosporidium hominis
VIVGYYCIWNVTPSLHT

SEQ ID NO: 2128293 - protein, 24 aa, Cryptosporidium hominis
VIVVIIGVSIALYFQNKNKESQRI

SEQ ID NO: 2128294 - protein, 20 aa, Cryptosporidium hominis
VIVYSHMRLLFSYFSNYSKD

SEQ ID NO: 2128295 - protein, 25 aa, Cryptosporidium hominis
VIWVAGQLYFLFGITGHYPTGKLPI

SEQ ID NO: 2128296 - protein, 21 aa, Cryptosporidium hominis
VIYLIKFLYRPKFEILGKLPG

SEQ ID NO: 2128297 - protein, 18 aa, Cryptosporidium hominis
VKATPSFVLFRGSQEPER

SEQ ID NO: 2128298 - protein, 17 aa, Cryptosporidium hominis
VKCDSEFEKNKSEGSES

SEQ ID NO: 2128299 - protein, 25 aa, Cryptosporidium hominis
VKCRMKEALERCLLLIENGNDYIPL

SEQ ID NO: 2128300 - protein, 21 aa, Cryptosporidium hominis
VKDGSSWIWDAILPVYDSITN

SEQ ID NO: 2128301 - protein, 28 aa, Cryptosporidium hominis
VKFARSHPLWKFTCTSAQAIVQDKDLAI

SEQ ID NO: 2128302 - protein, 21 aa, Cryptosporidium hominis
VKFVSIYLMFLMRNFWDQVLL

SEQ ID NO: 2128303 - protein, 28 aa, Cryptosporidium hominis
VKGVGRHGCKAQHYWYFREKTSDNSHKL

SEQ ID NO: 2128304 - protein, 19 aa, Cryptosporidium hominis
VKIEFLRCKLSMIRQELMK

SEQ ID NO: 2128305 - protein, 24 aa, Cryptosporidium hominis
VKKIFLSWTGFIFVLREIIEKAIF

SEQ ID NO: 2128306 - protein, 19 aa, Cryptosporidium hominis
VKKKPLPVISFWLSQTDSN

SEQ ID NO: 2128307 - protein, 27 aa, Cryptosporidium hominis
VKKYKFNFSHVCARVQGGSCRRPSGIL

SEQ ID NO: 2128308 - protein, 22 aa, Cryptosporidium hominis
VKLGESLLLIILREESIQLSWN

SEQ ID NO: 2128309 - protein, 25 aa, Cryptosporidium hominis
VKLLKICIVVAFITIPVMLYLDYLF

SEQ ID NO: 2128310 - protein, 26 aa, Cryptosporidium hominis
VKNVTGRILVGMRWWYEITKDGETVW

SEQ ID NO: 2128311 - protein, 20 aa, Cryptosporidium hominis
VKNYCLQNQILKYSLIKIKL

SEQ ID NO: 2128312 - protein, 20 aa, Cryptosporidium hominis
VKPFRPILVINQSGYDIQLI

SEQ ID NO: 2128313 - protein, 24 aa, Cryptosporidium hominis
VKPIFVRKLFQSVSMFVGAGCQLS

SEQ ID NO: 2128314 - protein, 25 aa, Cryptosporidium hominis
VKQLLTCLLGCFIFGNIVTDKLLLG

SEQ ID NO: 2128315 - protein, 24 aa, Cryptosporidium hominis
VKSMSGFLSRFPLNDILQTSISLY

SEQ ID NO: 2128316 - protein, 17 aa, Cryptosporidium hominis
VKSNCPQIAHARRTSTS

SEQ ID NO: 2128317 - protein, 21 aa, Cryptosporidium hominis
VKSQLPLLVMISVSSILTSSH

SEQ ID NO: 2128318 - protein, 19 aa, Cryptosporidium hominis
VKSSFPIRVDMVRDATQKM

SEQ ID NO: 2128319 - protein, 18 aa, Cryptosporidium hominis
VKSWSLFDIYLKLELCGG

SEQ ID NO: 2128320 - protein, 18 aa, Cryptosporidium hominis
VKSYCLESFMFNKYYKVI

SEQ ID NO: 2128321 - protein, 17 aa, Cryptosporidium hominis
VKVALIFITISLIMVIG

SEQ ID NO: 2128322 - protein, 39 aa, Cryptosporidium hominis
VLACASTCGYKSGFINSGCICRFRNLLLIFNHEKNELKL

SEQ ID NO: 2128323 - protein, 18 aa, Cryptosporidium hominis
VLASYRILVIIALLPILT

SEQ ID NO: 2128324 - protein, 24 aa, Cryptosporidium hominis
VLAVDHLPAFLNRYMASSPSNVVY

SEQ ID NO: 2128325 - protein, 24 aa, Cryptosporidium hominis
VLAYWSLQCLQWISPMVVSTPSCI

SEQ ID NO: 2128326 - protein, 19 aa, Cryptosporidium hominis
VLCGVGVGFSCNLVPSYIF

SEQ ID NO: 2128327 - protein, 18 aa, Cryptosporidium hominis
VLCSWFPFTSLLAAPGVC

SEQ ID NO: 2128328 - protein, 21 aa, Cryptosporidium hominis
VLCVISGIFLTLGPFSVNVSN

SEQ ID NO: 2128329 - protein, 19 aa, Cryptosporidium hominis
VLECIPERLFTTLRPNKSK

SEQ ID NO: 2128330 - protein, 22 aa, Cryptosporidium hominis
VLERFPVIIFGLIEDIFKEGIE

SEQ ID NO: 2128331 - protein, 17 aa, Cryptosporidium hominis
VLEYLYRKTAMTVSQAS

SEQ ID NO: 2128332 - protein, 17 aa, Cryptosporidium hominis
VLHGSLFSPIPLSFSHL

SEQ ID NO: 2128333 - protein, 20 aa, Cryptosporidium hominis
VLIDLYICFGNKNSSNLFED

SEQ ID NO: 2128334 - protein, 23 aa, Cryptosporidium hominis
VLILPCAIFWFVFYSEMVPQSSS

SEQ ID NO: 2128335 - protein, 26 aa, Cryptosporidium hominis
VLIMGLCIFVRLFAVVRYEAIIHEFD

SEQ ID NO: 2128336 - protein, 25 aa, Cryptosporidium hominis
VLIRFHLFIVLSIWNLYLKELQGKL

SEQ ID NO: 2128337 - protein, 23 aa, Cryptosporidium hominis
VLKKACFGEVLWGKDQDQPAKEG

SEQ ID NO: 2128338 - protein, 23 aa, Cryptosporidium hominis
VLLACFTSGLAGVFVEKLLKDSK

SEQ ID NO: 2128339 - protein, 23 aa, Cryptosporidium hominis
VLLCVCPAVLTLLFNYFPLSSAF

SEQ ID NO: 2128340 - protein, 32 aa, Cryptosporidium hominis
VLLLAHGRLAYRRICKLALYMFYKNLTVGIPV

SEQ ID NO: 2128341 - protein, 17 aa, Cryptosporidium hominis
VLLLSILILVMFYTMWY

SEQ ID NO: 2128342 - protein, 18 aa, Cryptosporidium hominis
VLLPICLYESSSQLNYHI

SEQ ID NO: 2128343 - protein, 19 aa, Cryptosporidium hominis
VLLVICLNAGTGFVVVAVL

SEQ ID NO: 2128344 - protein, 24 aa, Cryptosporidium hominis
VLNLKWRYKMVLPVFAALPTLVSY

SEQ ID NO: 2128345 - protein, 24 aa, Cryptosporidium hominis
VLNRAVLFREWLIRIWDISPAIGR

SEQ ID NO: 2128346 - protein, 18 aa, Cryptosporidium hominis
VLNRFGLNAVNLMNKYLP

SEQ ID NO: 2128347 - protein, 19 aa, Cryptosporidium hominis
VLNYFCVLHSIKTGNESSS

SEQ ID NO: 2128348 - protein, 23 aa, Cryptosporidium hominis
VLPDCTYSLCYVNLALNSQKFGR

SEQ ID NO: 2128349 - protein, 29 aa, Cryptosporidium hominis
VLPMLVIASNFCWDCIKSSKGKVSDSSGE

SEQ ID NO: 2128350 - protein, 23 aa, Cryptosporidium hominis
VLPPPPLRQIPMPSISVESLVIT

SEQ ID NO: 2128351 - protein, 18 aa, Cryptosporidium hominis
VLQSKWPQVPLEASLIEF

SEQ ID NO: 2128352 - protein, 19 aa, Cryptosporidium hominis
VLRIYKANVIVILLNAILI

SEQ ID NO: 2128353 - protein, 23 aa, Cryptosporidium hominis
VLSGICNYAIIAMFYASDNLFRK

SEQ ID NO: 2128354 - protein, 18 aa, Cryptosporidium hominis
VLSLKMNLINSFTDLDEL

SEQ ID NO: 2128355 - protein, 21 aa, Cryptosporidium hominis
VLSLYFLILSLDLSFINGDNY

SEQ ID NO: 2128356 - protein, 22 aa, Cryptosporidium hominis
VLSNFFLTVILLNWRNYESKYL

SEQ ID NO: 2128357 - protein, 22 aa, Cryptosporidium hominis
VLSRIISIFGQFFILSNKILLN

SEQ ID NO: 2128358 - protein, 18 aa, Cryptosporidium hominis
VLSSCLTILVTVSSRIQF

SEQ ID NO: 2128359 - protein, 22 aa, Cryptosporidium hominis
VLTHRCVNAFWSKAPCVRDSKF

SEQ ID NO: 2128360 - protein, 31 aa, Cryptosporidium hominis
VLTITLVIIAHKWVEGIAVSAGIKKHTEISK

SEQ ID NO: 2128361 - protein, 25 aa, Cryptosporidium hominis
VLYRLPKTAYFDGILQVLSLITIQV

SEQ ID NO: 2128362 - protein, 22 aa, Cryptosporidium hominis
VMEHSCFFPLDTIKTCLQSGKV

SEQ ID NO: 2128363 - protein, 23 aa, Cryptosporidium hominis
VMKVKVLLAKIVPLVSIGLLNVE

SEQ ID NO: 2128364 - protein, 18 aa, Cryptosporidium hominis
VMRFLCLRGYGLTSEESN

SEQ ID NO: 2128365 - protein, 18 aa, Cryptosporidium hominis
VMSEILKLLSSLLIVLYS

SEQ ID NO: 2128366 - protein, 24 aa, Cryptosporidium hominis
VMVHICTVLSYILPHVGDLEVETI

SEQ ID NO: 2128367 - protein, 23 aa, Cryptosporidium hominis
VMYAIPVAFFFSFNISFNNICLT

SEQ ID NO: 2128368 - protein, 19 aa, Cryptosporidium hominis
VMYILDFFLQLPKHRADTK

SEQ ID NO: 2128369 - protein, 23 aa, Cryptosporidium hominis
VNDSLMCPGVEFLSKGFIEKLIV

SEQ ID NO: 2128370 - protein, 30 aa, Cryptosporidium hominis
VNELRQGEMIRMFWAMWMHTGFIHIGFNVI

SEQ ID NO: 2128371 - protein, 17 aa, Cryptosporidium hominis
VNENLLLQWKPLNYRNS

SEQ ID NO: 2128372 - protein, 19 aa, Cryptosporidium hominis
VNFISKVELVRCLADVADA

SEQ ID NO: 2128373 - protein, 17 aa, Cryptosporidium hominis
VNFKKCSFAKFKDKVLR

SEQ ID NO: 2128374 - protein, 34 aa, Cryptosporidium hominis
VNFLYCGYHALSIFSIVCAVFFKQTMLYFIPAFA

SEQ ID NO: 2128375 - protein, 26 aa, Cryptosporidium hominis
VNGKIFIPSCVWTFVKDRDDYSSSDI

SEQ ID NO: 2128376 - protein, 24 aa, Cryptosporidium hominis
VNGRDGVRIELERRDILGVNDQKI

SEQ ID NO: 2128377 - protein, 19 aa, Cryptosporidium hominis
VNIFDEFTLASLPSMDYFD

SEQ ID NO: 2128378 - protein, 20 aa, Cryptosporidium hominis
VNKDEIVKMSKEKKNNGEKI

SEQ ID NO: 2128379 - protein, 21 aa, Cryptosporidium hominis
VNKTHTCYILGDKNNKLFDEL

SEQ ID NO: 2128380 - protein, 20 aa, Cryptosporidium hominis
VNNILSRISNIIGEKIWNTI

SEQ ID NO: 2128381 - protein, 20 aa, Cryptosporidium hominis
VNQHLCSILISLAILSISLF

SEQ ID NO: 2128382 - protein, 17 aa, Cryptosporidium hominis
VNSLKHRLSCLRVFLQL

SEQ ID NO: 2128383 - protein, 22 aa, Cryptosporidium hominis
VNSTQFIFLNWFYLVYHGSNDL

SEQ ID NO: 2128384 - protein, 22 aa, Cryptosporidium hominis
VNVFRAVFNVLRGTLFRILFGK

SEQ ID NO: 2128385 - protein, 17 aa, Cryptosporidium hominis
VNVGFPISQQQTLIIDT

SEQ ID NO: 2128386 - protein, 18 aa, Cryptosporidium hominis
VNVILLFVLLSKRKHTSS

SEQ ID NO: 2128387 - protein, 17 aa, Cryptosporidium hominis
VPCEAMSVGTCVIACNS

SEQ ID NO: 2128388 - protein, 24 aa, Cryptosporidium hominis
VPFAEFGLPFVIKLFPNMLPSTFA

SEQ ID NO: 2128389 - protein, 25 aa, Cryptosporidium hominis
VPGDASSVFKFWKNMISLVTCISEI

SEQ ID NO: 2128390 - protein, 19 aa, Cryptosporidium hominis
VPGLEVLESIIYPFKIKYL

SEQ ID NO: 2128391 - protein, 17 aa, Cryptosporidium hominis
VPICPITFLPINVFAMY

SEQ ID NO: 2128392 - protein, 20 aa, Cryptosporidium hominis
VPIKYIVAIFITILINLLTF

SEQ ID NO: 2128393 - protein, 17 aa, Cryptosporidium hominis
VPIMYPNYWLIDQSISN

SEQ ID NO: 2128394 - protein, 25 aa, Cryptosporidium hominis
VPKLSSNLLICYGNILFILWLEYNN

SEQ ID NO: 2128395 - protein, 29 aa, Cryptosporidium hominis
VPLQWSRKEFILEFAVRVCKKHFSWKDCN

SEQ ID NO: 2128396 - protein, 19 aa, Cryptosporidium hominis
VPNAFYLEQVHCMYTGIKP

SEQ ID NO: 2128397 - protein, 27 aa, Cryptosporidium hominis
VPNDIWRIKLIISRLFKIDSTTHPNLF

SEQ ID NO: 2128398 - protein, 19 aa, Cryptosporidium hominis
VPNREFLGLPILNRNGQLI

SEQ ID NO: 2128399 - protein, 30 aa, Cryptosporidium hominis
VPQKSAKGWRKKPPSFLRVEDPSCEAIYVS

SEQ ID NO: 2128400 - protein, 17 aa, Cryptosporidium hominis
VPREVSRELQLGRQIVF

SEQ ID NO: 2128401 - protein, 22 aa, Cryptosporidium hominis
VPSGQSCSDFKLILLSNQKNPI

SEQ ID NO: 2128402 - protein, 31 aa, Cryptosporidium hominis
VPSINTIRCIPVHWCRIVNYRSLPCIGSLQQ

SEQ ID NO: 2128403 - protein, 26 aa, Cryptosporidium hominis
VPSSFFLDKRLLCIFEDKKMIKNLNN

SEQ ID NO: 2128404 - protein, 24 aa, Cryptosporidium hominis
VPTLGSLFIICFLVLNYLVSDRKN

SEQ ID NO: 2128405 - protein, 25 aa, Cryptosporidium hominis
VPVFICIPCLIWVWCSDHCLQILKY

SEQ ID NO: 2128406 - protein, 21 aa, Cryptosporidium hominis
VPVPFEMFFEKVFIYSNDMEQ

SEQ ID NO: 2128407 - protein, 21 aa, Cryptosporidium hominis
VPVVRFCTWIVLLANIIPIAL

SEQ ID NO: 2128408 - protein, 17 aa, Cryptosporidium hominis
VPYCIYVSLFLFLIPQI

SEQ ID NO: 2128409 - protein, 21 aa, Cryptosporidium hominis
VPYSLPIILMVTFMTYKIVCQ

SEQ ID NO: 2128410 - protein, 24 aa, Cryptosporidium hominis
VQECLKLKRFESLSIIQHTILVAL

SEQ ID NO: 2128411 - protein, 26 aa, Cryptosporidium hominis
VQGILFKLNIGFLFLSIILFELFIFL

SEQ ID NO: 2128412 - protein, 28 aa, Cryptosporidium hominis
VQIIKCSELILTAILAFFVLKRKVTVRE

SEQ ID NO: 2128413 - protein, 21 aa, Cryptosporidium hominis
VQKNYLFSFLCRMAQNKCGAL

SEQ ID NO: 2128414 - protein, 23 aa, Cryptosporidium hominis
VQKRLIYAIFFCLVFTLIEVVVG

SEQ ID NO: 2128415 - protein, 26 aa, Cryptosporidium hominis
VQKVLYCLYSLLGIAFILFKLGTMGL

SEQ ID NO: 2128416 - protein, 17 aa, Cryptosporidium hominis
VQLKGRIACEISTSDEL

SEQ ID NO: 2128417 - protein, 18 aa, Cryptosporidium hominis
VQNDEIFNDLTLNNTNYL

SEQ ID NO: 2128418 - protein, 26 aa, Cryptosporidium hominis
VQSPELYKRFLVSTGVYALFGTIISG

SEQ ID NO: 2128419 - protein, 20 aa, Cryptosporidium hominis
VQVAEFLLRNGLKDIDAVVF

SEQ ID NO: 2128420 - protein, 18 aa, Cryptosporidium hominis
VRDAVLIQTYLETCINCL

SEQ ID NO: 2128421 - protein, 19 aa, Cryptosporidium hominis
VRDPICRNMIYPIKDLDDA

SEQ ID NO: 2128422 - protein, 18 aa, Cryptosporidium hominis
VRIAQGFLYMGKGLVTVN

SEQ ID NO: 2128423 - protein, 22 aa, Cryptosporidium hominis
VRISSLFYILGLGLHLYDISIK

SEQ ID NO: 2128424 - protein, 20 aa, Cryptosporidium hominis
VRNLLPAFVNFGFSKDSNIL

SEQ ID NO: 2128425 - protein, 17 aa, Cryptosporidium hominis
VRREMFLPIKFSESETP

SEQ ID NO: 2128426 - protein, 18 aa, Cryptosporidium hominis
VRRIKWDLKDAGTSISRL

SEQ ID NO: 2128427 - protein, 20 aa, Cryptosporidium hominis
VRYLLLIKLIEHFKVKRILS

SEQ ID NO: 2128428 - protein, 18 aa, Cryptosporidium hominis
VRYYTWWCEEPEALQNYV

SEQ ID NO: 2128429 - protein, 24 aa, Cryptosporidium hominis
VSAEPSVVFLFPMIGLGIYYAVAR

SEQ ID NO: 2128430 - protein, 25 aa, Cryptosporidium hominis
VSAYLETFSSLVLELGIRDNILSQS

SEQ ID NO: 2128431 - protein, 19 aa, Cryptosporidium hominis
VSCHSFRKSLAIIIKSGED

SEQ ID NO: 2128432 - protein, 19 aa, Cryptosporidium hominis
VSDLKGIWFKDSDKIIKQE

SEQ ID NO: 2128433 - protein, 23 aa, Cryptosporidium hominis
VSDSCIFKFFMFVSVIILTLSVG

SEQ ID NO: 2128434 - protein, 30 aa, Cryptosporidium hominis
VSEMLKRCNATLVYKFSKFQHGMAILHEDK

SEQ ID NO: 2128435 - protein, 26 aa, Cryptosporidium hominis
VSESYFKLIEFWPINRELLCETKTID

SEQ ID NO: 2128436 - protein, 19 aa, Cryptosporidium hominis
VSFKYASKMLILALVAILE

SEQ ID NO: 2128437 - protein, 17 aa, Cryptosporidium hominis
VSFNSIFVRNLRKKFTN

SEQ ID NO: 2128438 - protein, 17 aa, Cryptosporidium hominis
VSFYKFQTNTGVLDFEL

SEQ ID NO: 2128439 - protein, 23 aa, Cryptosporidium hominis
VSGYSGTVLSVFNSYALVYITQN

SEQ ID NO: 2128440 - protein, 20 aa, Cryptosporidium hominis
VSHDLCKKVNQIFKKIEQLN

SEQ ID NO: 2128441 - protein, 40 aa, Cryptosporidium hominis
VSIDRKTMFRICNFVSIFLEILIRGGFIIFVFPWLLLMIP

SEQ ID NO: 2128442 - protein, 20 aa, Cryptosporidium hominis
VSILCIYNIIMLARNKPFII

SEQ ID NO: 2128443 - protein, 23 aa, Cryptosporidium hominis
VSILHICVFTGPIISSLTALASY

SEQ ID NO: 2128444 - protein, 24 aa, Cryptosporidium hominis
VSILTFLIFFNFVNSSSIDHAQVK

SEQ ID NO: 2128445 - protein, 25 aa, Cryptosporidium hominis
VSIMICLYLNFIPSIYKIPGVPNVS

SEQ ID NO: 2128446 - protein, 25 aa, Cryptosporidium hominis
VSISLCILGIIKPWIFMAWLTTAVT

SEQ ID NO: 2128447 - protein, 21 aa, Cryptosporidium hominis
VSKGFRLSERYVAHIMRQIMA

SEQ ID NO: 2128448 - protein, 19 aa, Cryptosporidium hominis
VSKKTYYWYFSKLKWSWTI

SEQ ID NO: 2128449 - protein, 28 aa, Cryptosporidium hominis
VSLAFQEWVEGIGILFIVLINASLATYM

SEQ ID NO: 2128450 - protein, 19 aa, Cryptosporidium hominis
VSLGICFSAVLLIIVVPFF

SEQ ID NO: 2128451 - protein, 22 aa, Cryptosporidium hominis
VSLLSLKLSQIVSIDDSSNSLS

SEQ ID NO: 2128452 - protein, 21 aa, Cryptosporidium hominis
VSNMHGHRWFPPLLDQIRHFL

SEQ ID NO: 2128453 - protein, 20 aa, Cryptosporidium hominis
VSNMSLQLSKLVNYNKKRLS

SEQ ID NO: 2128454 - protein, 19 aa, Cryptosporidium hominis
VSNPFDWMDLISLQGKTNF

SEQ ID NO: 2128455 - protein, 19 aa, Cryptosporidium hominis
VSNVPVVRWDHKKYFSLNL

SEQ ID NO: 2128456 - protein, 20 aa, Cryptosporidium hominis
VSSLGDLWVWGKAENVLSEK

SEQ ID NO: 2128457 - protein, 28 aa, Cryptosporidium hominis
VSVALIWDILNIYSFLLFFIYTIMAKLY

SEQ ID NO: 2128458 - protein, 20 aa, Cryptosporidium hominis
VSWEACLYLNNSVIRGFIQY

SEQ ID NO: 2128459 - protein, 38 aa, Cryptosporidium hominis
VSYIYKFANCFISSFSGPFMLFYSVLRTIDGMAENIQH

SEQ ID NO: 2128460 - protein, 18 aa, Cryptosporidium hominis
VSYLYRIISFSALSYLFF

SEQ ID NO: 2128461 - protein, 25 aa, Cryptosporidium hominis
VTAIRRTGPYQVWKVPPFMIPTSTE

SEQ ID NO: 2128462 - protein, 23 aa, Cryptosporidium hominis
VTENCKKPFWVVVHERSQPHAAQ

SEQ ID NO: 2128463 - protein, 27 aa, Cryptosporidium hominis
VTFLLKSSVIGLALILTWIPGVLSTYT

SEQ ID NO: 2128464 - protein, 40 aa, Cryptosporidium hominis
VTGCDCDRFPEGVACPMVLSGEANVECIGYKVWNSARKGA

SEQ ID NO: 2128465 - protein, 23 aa, Cryptosporidium hominis
VTGFPREHAGAIAISQSGETADT

SEQ ID NO: 2128466 - protein, 21 aa, Cryptosporidium hominis
VTGRIIAFITKYTCKLRLILK

SEQ ID NO: 2128467 - protein, 19 aa, Cryptosporidium hominis
VTIMVFKQVVGLSILFIPS

SEQ ID NO: 2128468 - protein, 19 aa, Cryptosporidium hominis
VTIVGVWGLLFFGSFLVPP

SEQ ID NO: 2128469 - protein, 18 aa, Cryptosporidium hominis
VTKSLAIPLFSNSIENQY

SEQ ID NO: 2128470 - protein, 25 aa, Cryptosporidium hominis
VTKYNCYRMKNTLALFYLIFGNDPE

SEQ ID NO: 2128471 - protein, 32 aa, Cryptosporidium hominis
VTQWHPKKRICVFHLLRLCLEHGLQDQTSISV

SEQ ID NO: 2128472 - protein, 24 aa, Cryptosporidium hominis
VTSLDLPNSLSFNKSIYRYLLVQY

SEQ ID NO: 2128473 - protein, 17 aa, Cryptosporidium hominis
VTTRMLYMFTDNQVGSC

SEQ ID NO: 2128474 - protein, 20 aa, Cryptosporidium hominis
VVAAIRYDLTTSILPKDYTR

SEQ ID NO: 2128475 - protein, 17 aa, Cryptosporidium hominis
VVADRFALDAARTQVET

SEQ ID NO: 2128476 - protein, 20 aa, Cryptosporidium hominis
VVAICSLFLIISFFVNFLNK

SEQ ID NO: 2128477 - protein, 26 aa, Cryptosporidium hominis
VVCSLAKCRYMLKIDKIRSFSTPSNI

SEQ ID NO: 2128478 - protein, 19 aa, Cryptosporidium hominis
VVFFLECKKFTKIYRNSPE

SEQ ID NO: 2128479 - protein, 25 aa, Cryptosporidium hominis
VVGIHKLRFLPAIIYIESTKQFITS

SEQ ID NO: 2128480 - protein, 25 aa, Cryptosporidium hominis
VVGMLPLLRRGIGIHHGGLLPVVKE

SEQ ID NO: 2128481 - protein, 24 aa, Cryptosporidium hominis
VVICTLSTIVFFLWKSDGEVNTKK

SEQ ID NO: 2128482 - protein, 20 aa, Cryptosporidium hominis
VVIIMCLYLIYTFYHIIPLI

SEQ ID NO: 2128483 - protein, 17 aa, Cryptosporidium hominis
VVIQRVAFCKEYGLIAI

SEQ ID NO: 2128484 - protein, 21 aa, Cryptosporidium hominis
VVLHHIFRYLFCDQRNLLSFK

SEQ ID NO: 2128485 - protein, 22 aa, Cryptosporidium hominis
VVLPFISPIPFGSRIQPMNGQP

SEQ ID NO: 2128486 - protein, 19 aa, Cryptosporidium hominis
VVPGHYLILILNGTKNFVN

SEQ ID NO: 2128487 - protein, 17 aa, Cryptosporidium hominis
VVPMEGEVEIRIRAIGL

SEQ ID NO: 2128488 - protein, 23 aa, Cryptosporidium hominis
VVSMLCVYFIGVLFLAGFQEFIA

SEQ ID NO: 2128489 - protein, 23 aa, Cryptosporidium hominis
VVTLKDSFSLLWAENGDVISEHY

SEQ ID NO: 2128490 - protein, 18 aa, Cryptosporidium hominis
VVYCVALLVNIIAAYSRE

SEQ ID NO: 2128491 - protein, 25 aa, Cryptosporidium hominis
VVYIPFPLSYSFKGMLQRGIESNPN

SEQ ID NO: 2128492 - protein, 24 aa, Cryptosporidium hominis
VVYPSLFTLFPLFRQILIREKIDI

SEQ ID NO: 2128493 - protein, 24 aa, Cryptosporidium hominis
VWDSSNLYFTWLLATRIILSLTTY

SEQ ID NO: 2128494 - protein, 19 aa, Cryptosporidium hominis
VWEDYFRPRDIFIHNDLNI

SEQ ID NO: 2128495 - protein, 18 aa, Cryptosporidium hominis
VWFIFLLNSCIQRSEGKF

SEQ ID NO: 2128496 - protein, 24 aa, Cryptosporidium hominis
VWTLSCGILLRFDRNGNDFLHLFP

SEQ ID NO: 2128497 - protein, 31 aa, Cryptosporidium hominis
VWVHDACSWFHALMCITCYGVITFKVYSDRS

SEQ ID NO: 2128498 - protein, 17 aa, Cryptosporidium hominis
VYFLDRFAEEMVEEVEE

SEQ ID NO: 2128499 - protein, 21 aa, Cryptosporidium hominis
VYHPGDFPVPLFIRDEIDYQI

SEQ ID NO: 2128500 - protein, 25 aa, Cryptosporidium hominis
VYISESRPWCKFLIPNIYSSVQDEY

SEQ ID NO: 2128501 - protein, 23 aa, Cryptosporidium hominis
VYLFFSALISFTFTGSLMYQHCD

SEQ ID NO: 2128502 - protein, 17 aa, Cryptosporidium hominis
VYLFLSNLIDIFFKDIK

SEQ ID NO: 2128503 - protein, 17 aa, Cryptosporidium hominis
VYLLLRLIQSICIPNGI

SEQ ID NO: 2128504 - protein, 28 aa, Cryptosporidium hominis
VYLSYPNCYRLLFFLIHVIRRLYEEVFI

SEQ ID NO: 2128505 - protein, 20 aa, Cryptosporidium hominis
VYPKEKWRSITWEVQMHGMG

SEQ ID NO: 2128506 - protein, 21 aa, Cryptosporidium hominis
VYPYLACKILGLLNQEKKEDV

SEQ ID NO: 2128507 - protein, 24 aa, Cryptosporidium hominis
VYRRIYPEPSLYIFFLNFPIERWC

SEQ ID NO: 2128508 - protein, 17 aa, Cryptosporidium hominis
VYSDRSALGISMQTLCA

SEQ ID NO: 2128509 - protein, 25 aa, Cryptosporidium hominis
VYYMMIYDLEWTWKYILSTKNGVFL

SEQ ID NO: 2128510 - protein, 29 aa, Cryptosporidium hominis
VYYSSPIVCDIMLKFSPLLKKINMLEKVL

SEQ ID NO: 2128511 - protein, 19 aa, Cryptosporidium hominis
WALLWVVIIVFQFLSLKFQ

SEQ ID NO: 2128512 - protein, 21 aa, Cryptosporidium hominis
WALTRFFSFAIFDTTRNEACF

SEQ ID NO: 2128513 - protein, 22 aa, Cryptosporidium hominis
WANSCITMIWPLLVVGDYLRLP

SEQ ID NO: 2128514 - protein, 25 aa, Cryptosporidium hominis
WATKRGNYGIIQWLISHGANIGHRD

SEQ ID NO: 2128515 - protein, 18 aa, Cryptosporidium hominis
WCILLKISIEDINRKISI

SEQ ID NO: 2128516 - protein, 26 aa, Cryptosporidium hominis
WDDAVVIFRRIIRLFPSTNLSITSAT

SEQ ID NO: 2128517 - protein, 28 aa, Cryptosporidium hominis
WDDSCAKSGDLARTIGFISPKSLKYLEL

SEQ ID NO: 2128518 - protein, 19 aa, Cryptosporidium hominis
WDEFRELYLNIGIIDPERY

SEQ ID NO: 2128519 - protein, 23 aa, Cryptosporidium hominis
WDLLFKCDPEWVTVVFEVSAVQR

SEQ ID NO: 2128520 - protein, 21 aa, Cryptosporidium hominis
WDLWGPCIILLVLSSCLYIKA

SEQ ID NO: 2128521 - protein, 17 aa, Cryptosporidium hominis
WDSFRHINKNFKTSVPT

SEQ ID NO: 2128522 - protein, 17 aa, Cryptosporidium hominis
WELLLLQYMEIIKSNKR

SEQ ID NO: 2128523 - protein, 21 aa, Cryptosporidium hominis
WEMNRICSMLEVMNKKLIKTG

SEQ ID NO: 2128524 - protein, 17 aa, Cryptosporidium hominis
WERYFIKNIDSHREKEI

SEQ ID NO: 2128525 - protein, 27 aa, Cryptosporidium hominis
WEYIFRKAQIWRFLTSFFFVGPFSIGW

SEQ ID NO: 2128526 - protein, 27 aa, Cryptosporidium hominis
WFAFTQIRGSIPLFWEQTGVNSCAITC

SEQ ID NO: 2128527 - protein, 19 aa, Cryptosporidium hominis
WFMLISRMVMQLWSFNTFF

SEQ ID NO: 2128528 - protein, 26 aa, Cryptosporidium hominis
WFPVSKEFYAPRFGDNSCTLSIYGVC

SEQ ID NO: 2128529 - protein, 23 aa, Cryptosporidium hominis
WFRDLKQKIFRFLDFGKQTYGGE

SEQ ID NO: 2128530 - protein, 19 aa, Cryptosporidium hominis
WGFLTFTVIFSFLVFALFA

SEQ ID NO: 2128531 - protein, 18 aa, Cryptosporidium hominis
WGIKSGTIEPMFKRCAEL

SEQ ID NO: 2128532 - protein, 23 aa, Cryptosporidium hominis
WGIPFNYCCFIYSISTLLSCLHY

SEQ ID NO: 2128533 - protein, 22 aa, Cryptosporidium hominis
WGSGISICIMEYYGVNYKYMIG

SEQ ID NO: 2128534 - protein, 22 aa, Cryptosporidium hominis
WGSLCNSLRISSSCSSYLEDLL

SEQ ID NO: 2128535 - protein, 18 aa, Cryptosporidium hominis
WHIFKETFAKDIGLIIFL

SEQ ID NO: 2128536 - protein, 19 aa, Cryptosporidium hominis
WHIFVVFTIPYILFRVNST

SEQ ID NO: 2128537 - protein, 17 aa, Cryptosporidium hominis
WHSKKGLTRRALSLLQP

SEQ ID NO: 2128538 - protein, 17 aa, Cryptosporidium hominis
WIAQGHELLFFYLTYYS

SEQ ID NO: 2128539 - protein, 19 aa, Cryptosporidium hominis
WIIIIAHFFCLNRNGASLL

SEQ ID NO: 2128540 - protein, 18 aa, Cryptosporidium hominis
WIISILLFYFITREGQKI

SEQ ID NO: 2128541 - protein, 20 aa, Cryptosporidium hominis
WILLLRITIFNGVGGSERNN

SEQ ID NO: 2128542 - protein, 26 aa, Cryptosporidium hominis
WISSDSKFFCWKKVRSKSSHLLNPSN

SEQ ID NO: 2128543 - protein, 18 aa, Cryptosporidium hominis
WIVLLKLAQNGMLATDVV

SEQ ID NO: 2128544 - protein, 23 aa, Cryptosporidium hominis
WIVSEILWSFSIWLESVAILPQL

SEQ ID NO: 2128545 - protein, 30 aa, Cryptosporidium hominis
WKDPHLLAFSKSRFNGFSKWLQEDLASPWV

SEQ ID NO: 2128546 - protein, 19 aa, Cryptosporidium hominis
WKERGIEMIDDWAKENFEI

SEQ ID NO: 2128547 - protein, 19 aa, Cryptosporidium hominis
WKFKSVFKRKNKKSKQIRV

SEQ ID NO: 2128548 - protein, 23 aa, Cryptosporidium hominis
WKILDSPFRARSFYTFDPTLDFF

SEQ ID NO: 2128549 - protein, 25 aa, Cryptosporidium hominis
WKILKKDSFMLLSFVPIPTTAITYV

SEQ ID NO: 2128550 - protein, 19 aa, Cryptosporidium hominis
WKKSDISILIGVNLLISPQ

SEQ ID NO: 2128551 - protein, 21 aa, Cryptosporidium hominis
WKMKAYYLLTYTLEYESALFC

SEQ ID NO: 2128552 - protein, 19 aa, Cryptosporidium hominis
WKNKFWIRHVSPVITNSDR

SEQ ID NO: 2128553 - protein, 19 aa, Cryptosporidium hominis
WKPLNYRNSEATQEEQNKY

SEQ ID NO: 2128554 - protein, 21 aa, Cryptosporidium hominis
WKRNDFKYLVPHATQSLASDP

SEQ ID NO: 2128555 - protein, 18 aa, Cryptosporidium hominis
WKVFKVTCSRGYEAKIEP

SEQ ID NO: 2128556 - protein, 17 aa, Cryptosporidium hominis
WKYKSHKVLDFSGQNFK

SEQ ID NO: 2128557 - protein, 24 aa, Cryptosporidium hominis
WLAKISRYQTWSMWDQQFLNETDV

SEQ ID NO: 2128558 - protein, 26 aa, Cryptosporidium hominis
WLAMYSMHFLCMFFIPTFFYGLQYLT

SEQ ID NO: 2128559 - protein, 20 aa, Cryptosporidium hominis
WLCVSAIFVVLGIQTVFSRK

SEQ ID NO: 2128560 - protein, 19 aa, Cryptosporidium hominis
WLDIVKFLGHKVAISEFDK

SEQ ID NO: 2128561 - protein, 17 aa, Cryptosporidium hominis
WLFISIIIMLLIIFVGE

SEQ ID NO: 2128562 - protein, 19 aa, Cryptosporidium hominis
WLFKSDLYYIFLLASNTKL

SEQ ID NO: 2128563 - protein, 17 aa, Cryptosporidium hominis
WLFSQFYLTFASNAKTT

SEQ ID NO: 2128564 - protein, 19 aa, Cryptosporidium hominis
WLHFACSLSASSTLIVTFT

SEQ ID NO: 2128565 - protein, 19 aa, Cryptosporidium hominis
WLIRDCFLSISLKRKKEID

SEQ ID NO: 2128566 - protein, 19 aa, Cryptosporidium hominis
WLNILPGLFLIILQLFSII

SEQ ID NO: 2128567 - protein, 28 aa, Cryptosporidium hominis
WLPLGIFPSKCLFKLFPIIMQSVGQLNL

SEQ ID NO: 2128568 - protein, 19 aa, Cryptosporidium hominis
WLQMHFLNLGLAMGDATLV

SEQ ID NO: 2128569 - protein, 32 aa, Cryptosporidium hominis
WLRNNDDIFIPWKIAFNGIEWMESYTVEFEPE

SEQ ID NO: 2128570 - protein, 25 aa, Cryptosporidium hominis
WLRVIPILMIFLIYYRKVRVRRQSI

SEQ ID NO: 2128571 - protein, 20 aa, Cryptosporidium hominis
WLSIVSTCILSLILSLIWIA

SEQ ID NO: 2128572 - protein, 20 aa, Cryptosporidium hominis
WLTSIDYLNWISSAKTIKEL

SEQ ID NO: 2128573 - protein, 24 aa, Cryptosporidium hominis
WLVNRLSKIVEFYEMIRIIQEEGK

SEQ ID NO: 2128574 - protein, 19 aa, Cryptosporidium hominis
WLYFNGLKNIILLSRNSNN

SEQ ID NO: 2128575 - protein, 19 aa, Cryptosporidium hominis
WLYPYRILPMMFKDINNSV

SEQ ID NO: 2128576 - protein, 18 aa, Cryptosporidium hominis
WNIFRMILKDSEFSDSFY

SEQ ID NO: 2128577 - protein, 18 aa, Cryptosporidium hominis
WNKDYKKLTPQPVPDPLS

SEQ ID NO: 2128578 - protein, 24 aa, Cryptosporidium hominis
WNLDIPLFGGYIIKNWGIPFNYCC

SEQ ID NO: 2128579 - protein, 26 aa, Cryptosporidium hominis
WNLKFKSIICFSKIKKKSNGTCTSLN

SEQ ID NO: 2128580 - protein, 20 aa, Cryptosporidium hominis
WNLKNNTLFFIGRYTDTSRL

SEQ ID NO: 2128581 - protein, 21 aa, Cryptosporidium hominis
WNLNKGVLFPTLIQFLMNQKQ

SEQ ID NO: 2128582 - protein, 20 aa, Cryptosporidium hominis
WNQKFFSRRSHAILNPPFFL

SEQ ID NO: 2128583 - protein, 27 aa, Cryptosporidium hominis
WNRRRYSYRMGWYYSMLSIVSGLIILV

SEQ ID NO: 2128584 - protein, 22 aa, Cryptosporidium hominis
WNSSSPRTYRWLSYTASTSLSH

SEQ ID NO: 2128585 - protein, 26 aa, Cryptosporidium hominis
WNWFDSRSWYPLGRIIGQTLFPGLML

SEQ ID NO: 2128586 - protein, 18 aa, Cryptosporidium hominis
WPFPEVFVETAGFPFALI

SEQ ID NO: 2128587 - protein, 24 aa, Cryptosporidium hominis
WPILWCICQLLALVFVSYLLEKYL

SEQ ID NO: 2128588 - protein, 21 aa, Cryptosporidium hominis
WPIVLAELIKIFRLKNHKRLK

SEQ ID NO: 2128589 - protein, 19 aa, Cryptosporidium hominis
WPVVIDLWFKYFQFEMDML

SEQ ID NO: 2128590 - protein, 33 aa, Cryptosporidium hominis
WQERFARLDIPRLCYTVHLLALISHISAHIGSL

SEQ ID NO: 2128591 - protein, 17 aa, Cryptosporidium hominis
WQVAEYVQNNFIRIFQK

SEQ ID NO: 2128592 - protein, 30 aa, Cryptosporidium hominis
WRKKAEVFLVEYVVALVICIGRKLFTQRIR

SEQ ID NO: 2128593 - protein, 17 aa, Cryptosporidium hominis
WRLFCIKEKSIYATLNL

SEQ ID NO: 2128594 - protein, 26 aa, Cryptosporidium hominis
WRMNKLLPRREYKLFLFDLARCGRVS

SEQ ID NO: 2128595 - protein, 25 aa, Cryptosporidium hominis
WRTKHECYQDMAINCIQSSWKMVEF

SEQ ID NO: 2128596 - protein, 31 aa, Cryptosporidium hominis
WRTSNRFDYFISCLFIILMGCFTMFISSINK

SEQ ID NO: 2128597 - protein, 17 aa, Cryptosporidium hominis
WRVLLALENKDNFNQVL

SEQ ID NO: 2128598 - protein, 33 aa, Cryptosporidium hominis
WSDPYYLIYIIFCFICALAVLIVINNEEAKYNE

SEQ ID NO: 2128599 - protein, 21 aa, Cryptosporidium hominis
WSEICFYNIGSYLSLLISRLT

SEQ ID NO: 2128600 - protein, 19 aa, Cryptosporidium hominis
WSLCLQFLILGIKVKLTSL

SEQ ID NO: 2128601 - protein, 19 aa, Cryptosporidium hominis
WSLDKGYEKEQEMKISSFN

SEQ ID NO: 2128602 - protein, 26 aa, Cryptosporidium hominis
WSNRLRMLMLTGKLNIIFISSIIFTF

SEQ ID NO: 2128603 - protein, 21 aa, Cryptosporidium hominis
WSSEEKQLWQVFNSLGHAWDC

SEQ ID NO: 2128604 - protein, 18 aa, Cryptosporidium hominis
WSTQILVWISSLLRISDF

SEQ ID NO: 2128605 - protein, 24 aa, Cryptosporidium hominis
WTKKRWMPWITMVFTSFFTVSGGS

SEQ ID NO: 2128606 - protein, 20 aa, Cryptosporidium hominis
WTMMNCNYKNIKVFNSIQEI

SEQ ID NO: 2128607 - protein, 24 aa, Cryptosporidium hominis
WVAYFLHRSVIWASLKLLDDCLDN

SEQ ID NO: 2128608 - protein, 18 aa, Cryptosporidium hominis
WVYWGTVWSTMSFGPNSL

SEQ ID NO: 2128609 - protein, 17 aa, Cryptosporidium hominis
WWELYSFIYEAIISLIL

SEQ ID NO: 2128610 - protein, 23 aa, Cryptosporidium hominis
WYRFWEKKPKYVHKNIYGSERVI

SEQ ID NO: 2128611 - protein, 23 aa, Cryptosporidium hominis
WYSKNEFFEVFFWIIDSELNSKQ

SEQ ID NO: 2128612 - protein, 25 aa, Cryptosporidium hominis
WYSNLFSFESFCVLNYNNLTRNNYS

SEQ ID NO: 2128613 - protein, 18 aa, Cryptosporidium hominis
WYYFLVAFYNLIGRLTWA

SEQ ID NO: 2128614 - protein, 19 aa, Cryptosporidium hominis
YACNCYPKINGMHRYCTTL

SEQ ID NO: 2128615 - protein, 21 aa, Cryptosporidium hominis
YAEKVLDCFKSIPLSDIIENV

SEQ ID NO: 2128616 - protein, 47 aa, Cryptosporidium hominis
YAENSNKLFSGYEKCNLPNGKLKGIIFDLSIIKNILIDYPTYNDIER

SEQ ID NO: 2128617 - protein, 25 aa, Cryptosporidium hominis
YAFPRLYQAFVLIDLYICFGNKNSS

SEQ ID NO: 2128618 - protein, 17 aa, Cryptosporidium hominis
YAIAMALKSNQRVVYTS

SEQ ID NO: 2128619 - protein, 19 aa, Cryptosporidium hominis
YAIMKRMHRRFTVASKPYN

SEQ ID NO: 2128620 - protein, 21 aa, Cryptosporidium hominis
YALDRLGLWKKFADGNHSDCM

SEQ ID NO: 2128621 - protein, 23 aa, Cryptosporidium hominis
YANSFIYYIFSYKMIIFIIAAHF

SEQ ID NO: 2128622 - protein, 17 aa, Cryptosporidium hominis
YAVRIAQGFLYMGKGLV

SEQ ID NO: 2128623 - protein, 20 aa, Cryptosporidium hominis
YCLESFMFNKYYKVITEVEN

SEQ ID NO: 2128624 - protein, 23 aa, Cryptosporidium hominis
YCNFKSCITKHYYSELDQLIGDK

SEQ ID NO: 2128625 - protein, 19 aa, Cryptosporidium hominis
YCQSMNFIAAILLINMKEE

SEQ ID NO: 2128626 - protein, 24 aa, Cryptosporidium hominis
YCSDSEWSNRLILILIINLVQYGA

SEQ ID NO: 2128627 - protein, 25 aa, Cryptosporidium hominis
YCTTLKMLFLKYLVDNIIKLLFDCL

SEQ ID NO: 2128628 - protein, 20 aa, Cryptosporidium hominis
YDCIKECPTQLISIELFGSV

SEQ ID NO: 2128629 - protein, 17 aa, Cryptosporidium hominis
YDKIPLIRLDRLPLKNK

SEQ ID NO: 2128630 - protein, 22 aa, Cryptosporidium hominis
YDLSNGDGYICLARTLNNSLLG

SEQ ID NO: 2128631 - protein, 25 aa, Cryptosporidium hominis
YDNSWAVSVTDAFKVPSIMEKPNEG

SEQ ID NO: 2128632 - protein, 26 aa, Cryptosporidium hominis
YDSDFTFRLYALYAQHSYIFFLSIPL

SEQ ID NO: 2128633 - protein, 17 aa, Cryptosporidium hominis
YDYEYCPHLIEYSNCVV

SEQ ID NO: 2128634 - protein, 17 aa, Cryptosporidium hominis
YECLSSIDILNAHAEVH

SEQ ID NO: 2128635 - protein, 23 aa, Cryptosporidium hominis
YEEHGFSVLKNVAFVLVAGGLGE

SEQ ID NO: 2128636 - protein, 20 aa, Cryptosporidium hominis
YEFWKLLRDLSMNIALKCSP

SEQ ID NO: 2128637 - protein, 18 aa, Cryptosporidium hominis
YEGVTCLCIDAWKQSYYT

SEQ ID NO: 2128638 - protein, 21 aa, Cryptosporidium hominis
YEIFYFRVFVLLTRFQNVKTI

SEQ ID NO: 2128639 - protein, 23 aa, Cryptosporidium hominis
YEIPGCPVFSVFIATVVGILWLF

SEQ ID NO: 2128640 - protein, 17 aa, Cryptosporidium hominis
YEKASGFLFPHPLGKVG

SEQ ID NO: 2128641 - protein, 34 aa, Cryptosporidium hominis
YEKEIKPLLIRWIIFVIRLHKFSGLSDELCELYL

SEQ ID NO: 2128642 - protein, 20 aa, Cryptosporidium hominis
YEKPFFMLKKIFEMFIELQI

SEQ ID NO: 2128643 - protein, 21 aa, Cryptosporidium hominis
YEKWRLKININETGNEFEFGD

SEQ ID NO: 2128644 - protein, 21 aa, Cryptosporidium hominis
YELDAILPLNALLTITVFHKN

SEQ ID NO: 2128645 - protein, 22 aa, Cryptosporidium hominis
YELIKRKLIPGQKFGFGTKRNF

SEQ ID NO: 2128646 - protein, 20 aa, Cryptosporidium hominis
YELLHYPKIVYLEILLPSLL

SEQ ID NO: 2128647 - protein, 18 aa, Cryptosporidium hominis
YELRCYLYACRNLNETGK

SEQ ID NO: 2128648 - protein, 27 aa, Cryptosporidium hominis
YENIKTRFNWDLSLFQTEFGYVKNINL

SEQ ID NO: 2128649 - protein, 18 aa, Cryptosporidium hominis
YEQARYNFISSLAGYSIA

SEQ ID NO: 2128650 - protein, 24 aa, Cryptosporidium hominis
YESFACRWVFERILEYRCWFPNCR

SEQ ID NO: 2128651 - protein, 22 aa, Cryptosporidium hominis
YESHYPWSIVSGKFWSSYLIME

SEQ ID NO: 2128652 - protein, 18 aa, Cryptosporidium hominis
YESKMFINKVFKFNPQIN

SEQ ID NO: 2128653 - protein, 24 aa, Cryptosporidium hominis
YESNELRTSLILNSKTRSIEKPAP

SEQ ID NO: 2128654 - protein, 24 aa, Cryptosporidium hominis
YEYYSAEMILSFQRSGLKLTETDM

SEQ ID NO: 2128655 - protein, 17 aa, Cryptosporidium hominis
YFADLTLAYLTRLFQTQ

SEQ ID NO: 2128656 - protein, 17 aa, Cryptosporidium hominis
YFATYVFRPEGENKVQA

SEQ ID NO: 2128657 - protein, 23 aa, Cryptosporidium hominis
YFDILLVNIVMDFIFTLNEFNRK

SEQ ID NO: 2128658 - protein, 34 aa, Cryptosporidium hominis
YFDSNFWLFLKRVCTRILECLSIQNLNLEERKNI

SEQ ID NO: 2128659 - protein, 20 aa, Cryptosporidium hominis
YFERYLKFSHLIISNETINN

SEQ ID NO: 2128660 - protein, 20 aa, Cryptosporidium hominis
YFESIIYLFKCSNYKDYFQK

SEQ ID NO: 2128661 - protein, 18 aa, Cryptosporidium hominis
YFEVFCGAIYQLVIFSSY

SEQ ID NO: 2128662 - protein, 25 aa, Cryptosporidium hominis
YFFIYGRFVYSFSFDGLRIPPPKSI

SEQ ID NO: 2128663 - protein, 19 aa, Cryptosporidium hominis
YFFLSEVIFSELITRIQNF

SEQ ID NO: 2128664 - protein, 23 aa, Cryptosporidium hominis
YFIWKLKKKKNMRQISNKGGDDQ

SEQ ID NO: 2128665 - protein, 19 aa, Cryptosporidium hominis
YFIYKLRKIPKFNYEEVRT

SEQ ID NO: 2128666 - protein, 18 aa, Cryptosporidium hominis
YFIYWRWISKSIFSSNLA

SEQ ID NO: 2128667 - protein, 19 aa, Cryptosporidium hominis
YFKEYRFYPRMADYITYKI

SEQ ID NO: 2128668 - protein, 24 aa, Cryptosporidium hominis
YFKNIEFYKAYLLLDSFYAIEKEL

SEQ ID NO: 2128669 - protein, 25 aa, Cryptosporidium hominis
YFLCSPSLFVLMFIYIKRIIDNNPS

SEQ ID NO: 2128670 - protein, 19 aa, Cryptosporidium hominis
YFLIVYLVFPILRRHFYAT

SEQ ID NO: 2128671 - protein, 25 aa, Cryptosporidium hominis
YFLRIKEVEREGGYLKSKDEAQECK

SEQ ID NO: 2128672 - protein, 24 aa, Cryptosporidium hominis
YFLRMGFKLKNEFNSFIIVFCIYF

SEQ ID NO: 2128673 - protein, 25 aa, Cryptosporidium hominis
YFLYLKDYWSFKAYNFVTFNWYQRK

SEQ ID NO: 2128674 - protein, 20 aa, Cryptosporidium hominis
YFNLTIWAFTIICLSQKLNK

SEQ ID NO: 2128675 - protein, 21 aa, Cryptosporidium hominis
YFQCSINFFLANNFQFDELSV

SEQ ID NO: 2128676 - protein, 17 aa, Cryptosporidium hominis
YFQGFRVDLAVKYQKVR

SEQ ID NO: 2128677 - protein, 18 aa, Cryptosporidium hominis
YFSILSMSLIYWWISSNS

SEQ ID NO: 2128678 - protein, 21 aa, Cryptosporidium hominis
YFTHGFWTILFYFGLTANILA

SEQ ID NO: 2128679 - protein, 25 aa, Cryptosporidium hominis
YFVQLKFGPKCLIPKIFRPRPYNYF

SEQ ID NO: 2128680 - protein, 22 aa, Cryptosporidium hominis
YGADSLRLFLINSPVVRAETLR

SEQ ID NO: 2128681 - protein, 22 aa, Cryptosporidium hominis
YGAILWGCWISYKVFMSRYLAG

SEQ ID NO: 2128682 - protein, 17 aa, Cryptosporidium hominis
YGCIETINISIPYSNIL

SEQ ID NO: 2128683 - protein, 18 aa, Cryptosporidium hominis
YGGLRGGVSMALAMVFEG

SEQ ID NO: 2128684 - protein, 21 aa, Cryptosporidium hominis
YGNLPIGHLIYKINYQEELML

SEQ ID NO: 2128685 - protein, 17 aa, Cryptosporidium hominis
YGSIVLTNVHLVSGEQY

SEQ ID NO: 2128686 - protein, 22 aa, Cryptosporidium hominis
YGYYFIKVNVGFPISQQQTLII

SEQ ID NO: 2128687 - protein, 19 aa, Cryptosporidium hominis
YHDGVCLTLLLLLQNLTNL

SEQ ID NO: 2128688 - protein, 19 aa, Cryptosporidium hominis
YHFLYTVLVTSSFSNGQDE

SEQ ID NO: 2128689 - protein, 20 aa, Cryptosporidium hominis
YHLDSQWRVLLALENKDNFN

SEQ ID NO: 2128690 - protein, 23 aa, Cryptosporidium hominis
YHPELWQPAWGIRTMLDALHAFF

SEQ ID NO: 2128691 - protein, 19 aa, Cryptosporidium hominis
YICDCFKSAGYMTSPINNK

SEQ ID NO: 2128692 - protein, 28 aa, Cryptosporidium hominis
YICDESFCIKSLFGIRTTESMITIENSF

SEQ ID NO: 2128693 - protein, 24 aa, Cryptosporidium hominis
YIDPELKGQIAFYVAGTVLLTLLI

SEQ ID NO: 2128694 - protein, 19 aa, Cryptosporidium hominis
YIFGRIVNRYSEFVSKADG

SEQ ID NO: 2128695 - protein, 26 aa, Cryptosporidium hominis
YIFTSKFSAIFARILLLWWYSIPDIR

SEQ ID NO: 2128696 - protein, 18 aa, Cryptosporidium hominis
YIGLILYYFINNVKLIFH

SEQ ID NO: 2128697 - protein, 19 aa, Cryptosporidium hominis
YIHLEKLVLMQFIRLLSSD

SEQ ID NO: 2128698 - protein, 21 aa, Cryptosporidium hominis
YIISPKYSHRFVGYLEEEAVS

SEQ ID NO: 2128699 - protein, 17 aa, Cryptosporidium hominis
YIKLNWDEFRELYLNIG

SEQ ID NO: 2128700 - protein, 18 aa, Cryptosporidium hominis
YILDWNLNKGVLFPTLIQ

SEQ ID NO: 2128701 - protein, 25 aa, Cryptosporidium hominis
YILFLLKLVMLIGFGSYYFNKRKQE

SEQ ID NO: 2128702 - protein, 18 aa, Cryptosporidium hominis
YILSALALVVPIDYSENI

SEQ ID NO: 2128703 - protein, 18 aa, Cryptosporidium hominis
YIMRVRARVIGAINGISL

SEQ ID NO: 2128704 - protein, 25 aa, Cryptosporidium hominis
YIPHPSEFFPFSWFFLKFGVHKHEN

SEQ ID NO: 2128705 - protein, 25 aa, Cryptosporidium hominis
YIRSCILCSISGIIYISGSPGTGKT

SEQ ID NO: 2128706 - protein, 19 aa, Cryptosporidium hominis
YIRSMVKYRDISIGSFESL

SEQ ID NO: 2128707 - protein, 21 aa, Cryptosporidium hominis
YITFEIGRGYKRCLLLQTGEL

SEQ ID NO: 2128708 - protein, 18 aa, Cryptosporidium hominis
YITMEYLNPISLFKQHLS

SEQ ID NO: 2128709 - protein, 26 aa, Cryptosporidium hominis
YITTSFGFLCIFSLIQFTQDLFQEKF

SEQ ID NO: 2128710 - protein, 17 aa, Cryptosporidium hominis
YIYDLTRTPSWCDRVLV

SEQ ID NO: 2128711 - protein, 18 aa, Cryptosporidium hominis
YIYFVEIINHIFVEALVN

SEQ ID NO: 2128712 - protein, 32 aa, Cryptosporidium hominis
YKASVPKSTFSWKIMSIFSFLKLKKPKYAPPS

SEQ ID NO: 2128713 - protein, 23 aa, Cryptosporidium hominis
YKETFLQVCVTFFVGLVNSGLLE

SEQ ID NO: 2128714 - protein, 21 aa, Cryptosporidium hominis
YKFQNLHAWNTLLSKIGPIEI

SEQ ID NO: 2128715 - protein, 26 aa, Cryptosporidium hominis
YKIGQSMSIAAFFGCLVILIVLVNNV

SEQ ID NO: 2128716 - protein, 19 aa, Cryptosporidium hominis
YKISDLMRSLDIFIFKTII

SEQ ID NO: 2128717 - protein, 20 aa, Cryptosporidium hominis
YKIVCQRYISTYIRAQKVAL

SEQ ID NO: 2128718 - protein, 21 aa, Cryptosporidium hominis
YKKEMWESFKSWHSDYSVLAG

SEQ ID NO: 2128719 - protein, 22 aa, Cryptosporidium hominis
YKKLLMNWVRLSSMKQLPLSLM

SEQ ID NO: 2128720 - protein, 22 aa, Cryptosporidium hominis
YKKNADIWLNMVSELIKAKEQN

SEQ ID NO: 2128721 - protein, 20 aa, Cryptosporidium hominis
YKLGEFSMLIFIPLALPIIT

SEQ ID NO: 2128722 - protein, 21 aa, Cryptosporidium hominis
YKLHSSYPLYTFPIIDRGVRF

SEQ ID NO: 2128723 - protein, 18 aa, Cryptosporidium hominis
YKLIPGISNFNCSNDAYY

SEQ ID NO: 2128724 - protein, 19 aa, Cryptosporidium hominis
YKLVFSSVVSLGFCTLIYI

SEQ ID NO: 2128725 - protein, 17 aa, Cryptosporidium hominis
YKMKVSWYAPTFYPPPG

SEQ ID NO: 2128726 - protein, 21 aa, Cryptosporidium hominis
YKPHLINWCGLNIREGTNKKN

SEQ ID NO: 2128727 - protein, 18 aa, Cryptosporidium hominis
YKSGSLITYSRNYSTNHL

SEQ ID NO: 2128728 - protein, 18 aa, Cryptosporidium hominis
YKSLKSCNRIWVLSGGVK

SEQ ID NO: 2128729 - protein, 17 aa, Cryptosporidium hominis
YKSSRKFILLSYQLTHF

SEQ ID NO: 2128730 - protein, 18 aa, Cryptosporidium hominis
YKTVHSFSNISQYSVSNV

SEQ ID NO: 2128731 - protein, 19 aa, Cryptosporidium hominis
YKYILKFKPFLTLISTLPL

SEQ ID NO: 2128732 - protein, 21 aa, Cryptosporidium hominis
YKYKSEVFALSSYFENLEERF

SEQ ID NO: 2128733 - protein, 17 aa, Cryptosporidium hominis
YKYSFNILVFLFIQIIQ

SEQ ID NO: 2128734 - protein, 19 aa, Cryptosporidium hominis
YLDGIYLGYFYTWIILFAA

SEQ ID NO: 2128735 - protein, 20 aa, Cryptosporidium hominis
YLEKYCYFTTPSVLDQQDNG

SEQ ID NO: 2128736 - protein, 17 aa, Cryptosporidium hominis
YLETCINCLKYVLFDTF

SEQ ID NO: 2128737 - protein, 22 aa, Cryptosporidium hominis
YLGEISRLLIINFLKNKTPEIF

SEQ ID NO: 2128738 - protein, 17 aa, Cryptosporidium hominis
YLHHYRKAKGIVNNDPK

SEQ ID NO: 2128739 - protein, 20 aa, Cryptosporidium hominis
YLIIAEIWTIISSKILENKK

SEQ ID NO: 2128740 - protein, 18 aa, Cryptosporidium hominis
YLIINFPGVSSIDEKVQE

SEQ ID NO: 2128741 - protein, 37 aa, Cryptosporidium hominis
YLIKNEILHPFFIFQVCAVCIWFRNSYVEYAIFIILI

SEQ ID NO: 2128742 - protein, 20 aa, Cryptosporidium hominis
YLIQLKEAFAVFDGDSTGKI

SEQ ID NO: 2128743 - protein, 18 aa, Cryptosporidium hominis
YLKAFPIRIKDFEKYIQL

SEQ ID NO: 2128744 - protein, 20 aa, Cryptosporidium hominis
YLKDSINWNPNWDGNYKHEN

SEQ ID NO: 2128745 - protein, 17 aa, Cryptosporidium hominis
YLKEVLKSIRTVSMLNI

SEQ ID NO: 2128746 - protein, 22 aa, Cryptosporidium hominis
YLKKREEIYIIHPLLKSISLLV

SEQ ID NO: 2128747 - protein, 21 aa, Cryptosporidium hominis
YLLEISLKYLLGNRYDSLELK

SEQ ID NO: 2128748 - protein, 17 aa, Cryptosporidium hominis
YLLHFFNYYILLTPLPQ

SEQ ID NO: 2128749 - protein, 18 aa, Cryptosporidium hominis
YLLITLIRLIAFMTDKLL

SEQ ID NO: 2128750 - protein, 17 aa, Cryptosporidium hominis
YLLLFFGSRMGLAAEVL

SEQ ID NO: 2128751 - protein, 17 aa, Cryptosporidium hominis
YLLNKILFWFILISIFA

SEQ ID NO: 2128752 - protein, 18 aa, Cryptosporidium hominis
YLPNCQQSQMSLAELDKL

SEQ ID NO: 2128753 - protein, 26 aa, Cryptosporidium hominis
YLPQVVLRFKEYISIIPSLLGLQINS

SEQ ID NO: 2128754 - protein, 26 aa, Cryptosporidium hominis
YLQDKSRFPLLRILRGKDYGPATKFL

SEQ ID NO: 2128755 - protein, 18 aa, Cryptosporidium hominis
YLRLWALSLAHNMLALVA

SEQ ID NO: 2128756 - protein, 21 aa, Cryptosporidium hominis
YLSRLPGIDIQLKLIDYSLDR

SEQ ID NO: 2128757 - protein, 18 aa, Cryptosporidium hominis
YLSRPVFILLTFICSLGC

SEQ ID NO: 2128758 - protein, 27 aa, Cryptosporidium hominis
YLSSCGKRPKWGMIITILQIVQMIIGT

SEQ ID NO: 2128759 - protein, 22 aa, Cryptosporidium hominis
YLSTFSSLIFKSIAFNKSNMDF

SEQ ID NO: 2128760 - protein, 18 aa, Cryptosporidium hominis
YLSYRSVLISVIKNLSMK

SEQ ID NO: 2128761 - protein, 23 aa, Cryptosporidium hominis
YLTKKLWKSIEIDSSEDYQYTFS

SEQ ID NO: 2128762 - protein, 17 aa, Cryptosporidium hominis
YLTLGKFVFERQSQIQK

SEQ ID NO: 2128763 - protein, 19 aa, Cryptosporidium hominis
YLVVVPLDIGWTGWVVLAF

SEQ ID NO: 2128764 - protein, 23 aa, Cryptosporidium hominis
YLYILVIFKVNYVISIRNNKSSS

SEQ ID NO: 2128765 - protein, 33 aa, Cryptosporidium hominis
YLYKKYRNTYCLGFDSDKSFLVLGASFFINKDV

SEQ ID NO: 2128766 - protein, 22 aa, Cryptosporidium hominis
YLYSHGWELVKIRVMNFQYYLN

SEQ ID NO: 2128767 - protein, 17 aa, Cryptosporidium hominis
YMEPLILLHEQNTDYLT

SEQ ID NO: 2128768 - protein, 24 aa, Cryptosporidium hominis
YMFIWDIYMDWGLMKERSSFLRSK

SEQ ID NO: 2128769 - protein, 17 aa, Cryptosporidium hominis
YMISPGYHFWVAELVKR

SEQ ID NO: 2128770 - protein, 19 aa, Cryptosporidium hominis
YMKPKALYLPCSLFDENPQ

SEQ ID NO: 2128771 - protein, 24 aa, Cryptosporidium hominis
YMKTRIYIRVPFHYLPLLNPKYVR

SEQ ID NO: 2128772 - protein, 17 aa, Cryptosporidium hominis
YMWAFPMYRIPSSSLFY

SEQ ID NO: 2128773 - protein, 22 aa, Cryptosporidium hominis
YMYSFRRIGKVLSEQFELGKLI

SEQ ID NO: 2128774 - protein, 17 aa, Cryptosporidium hominis
YNEECLIVKSIIVSSTF

SEQ ID NO: 2128775 - protein, 24 aa, Cryptosporidium hominis
YNEEKFSSFWGYKPSPYKKDLRKS

SEQ ID NO: 2128776 - protein, 22 aa, Cryptosporidium hominis
YNEVTWWIGVISYAFGAIVHII

SEQ ID NO: 2128777 - protein, 17 aa, Cryptosporidium hominis
YNEYFLYDMNKLASTQH

SEQ ID NO: 2128778 - protein, 24 aa, Cryptosporidium hominis
YNHPLEIHGKYAIYGTSIEKLKLN

SEQ ID NO: 2128779 - protein, 17 aa, Cryptosporidium hominis
YNIKILIYESFNQVEDP

SEQ ID NO: 2128780 - protein, 18 aa, Cryptosporidium hominis
YNIRLAVPRSVIGSIIGI

SEQ ID NO: 2128781 - protein, 17 aa, Cryptosporidium hominis
YNISLELVEEFGELSPW

SEQ ID NO: 2128782 - protein, 28 aa, Cryptosporidium hominis
YNKLEAYSNFKWVFAIFVLKPSILFLCR

SEQ ID NO: 2128783 - protein, 24 aa, Cryptosporidium hominis
YNLIILCVEIGMIVTTSFWLLMTQ

SEQ ID NO: 2128784 - protein, 20 aa, Cryptosporidium hominis
YNLMVCLIYLITDEAASIEN

SEQ ID NO: 2128785 - protein, 21 aa, Cryptosporidium hominis
YNLPIEYLYEFLIPTISLVIM

SEQ ID NO: 2128786 - protein, 24 aa, Cryptosporidium hominis
YNLPSFNCAFSILKKLSKIIRPRE

SEQ ID NO: 2128787 - protein, 37 aa, Cryptosporidium hominis
YNPNSNDCKCLLNPEECKHENGLDIIDYEIIDRGPFD

SEQ ID NO: 2128788 - protein, 28 aa, Cryptosporidium hominis
YNRRMDVHWPFTLFSLWGEPKSVSMNIW

SEQ ID NO: 2128789 - protein, 23 aa, Cryptosporidium hominis
YNSGSSCSCHICNKHNTHDKMID

SEQ ID NO: 2128790 - protein, 20 aa, Cryptosporidium hominis
YNTWCSIIGIISRFHEIVDI

SEQ ID NO: 2128791 - protein, 21 aa, Cryptosporidium hominis
YNVAEGIYLPIIYPSDFWCIE

SEQ ID NO: 2128792 - protein, 36 aa, Cryptosporidium hominis
YNVFTGLALNGDDGWDFVTTILPKVGSISLSINSNL

SEQ ID NO: 2128793 - protein, 19 aa, Cryptosporidium hominis
YNYFSEWGVLNMIGILVCH

SEQ ID NO: 2128794 - protein, 17 aa, Cryptosporidium hominis
YNYLLKWLSIIITFFSL

SEQ ID NO: 2128795 - protein, 18 aa, Cryptosporidium hominis
YPCSDPAQRYGLIGDGIS

SEQ ID NO: 2128796 - protein, 18 aa, Cryptosporidium hominis
YPDAELNDQSFLTFNQEP

SEQ ID NO: 2128797 - protein, 19 aa, Cryptosporidium hominis
YPEPQGSVRSQWDFLLQEM

SEQ ID NO: 2128798 - protein, 19 aa, Cryptosporidium hominis
YPISLAFDLYYTFVLEEKY

SEQ ID NO: 2128799 - protein, 24 aa, Cryptosporidium hominis
YPISSFKHTLVWVKKSMELYNHNF

SEQ ID NO: 2128800 - protein, 17 aa, Cryptosporidium hominis
YPIYSAIIFTCLVFTKH

SEQ ID NO: 2128801 - protein, 19 aa, Cryptosporidium hominis
YPLAVIRKYIEFRGKRKGY

SEQ ID NO: 2128802 - protein, 17 aa, Cryptosporidium hominis
YPLFVYSIIWGRKKSFF

SEQ ID NO: 2128803 - protein, 17 aa, Cryptosporidium hominis
YPLMPISNGFRLFKTPK

SEQ ID NO: 2128804 - protein, 17 aa, Cryptosporidium hominis
YPLVNGFNINQSRIQET

SEQ ID NO: 2128805 - protein, 31 aa, Cryptosporidium hominis
YPLWWKTKLHFTRSSPYLNHYIPEIEITTGL

SEQ ID NO: 2128806 - protein, 25 aa, Cryptosporidium hominis
YPMLHFPLTNGIKMNDYFLRRDFEK

SEQ ID NO: 2128807 - protein, 20 aa, Cryptosporidium hominis
YPMVIHLTFNLNLLKSSINS

SEQ ID NO: 2128808 - protein, 26 aa, Cryptosporidium hominis
YPRGTWKAVSSRAFIRDPYALVLLSG

SEQ ID NO: 2128809 - protein, 18 aa, Cryptosporidium hominis
YPSRYEMLALITMIESSI

SEQ ID NO: 2128810 - protein, 28 aa, Cryptosporidium hominis
YPTGRKIGGSSLIFGIIYYWSKKFPTSL

SEQ ID NO: 2128811 - protein, 17 aa, Cryptosporidium hominis
YPWYDYLAVIVITISLS

SEQ ID NO: 2128812 - protein, 22 aa, Cryptosporidium hominis
YPYFFSQKCGFAREFDYSTFKY

SEQ ID NO: 2128813 - protein, 17 aa, Cryptosporidium hominis
YPYINPFIPIRSQETEN

SEQ ID NO: 2128814 - protein, 20 aa, Cryptosporidium hominis
YQDLRMIAGFYKKKTTLPLL

SEQ ID NO: 2128815 - protein, 26 aa, Cryptosporidium hominis
YQDVPVCALLRVLEERIGLSRNRILE

SEQ ID NO: 2128816 - protein, 32 aa, Cryptosporidium hominis
YQEKSKYDVPDWYKHICIIYASLKEKNRILFE

SEQ ID NO: 2128817 - protein, 17 aa, Cryptosporidium hominis
YQLSFLMLVKMGIIEPV

SEQ ID NO: 2128818 - protein, 18 aa, Cryptosporidium hominis
YQYTFSCLIFQKKKSELL

SEQ ID NO: 2128819 - protein, 17 aa, Cryptosporidium hominis
YRARYPLVENGPFDEQD

SEQ ID NO: 2128820 - protein, 18 aa, Cryptosporidium hominis
YRCIIFFCVIVFLLCIPN

SEQ ID NO: 2128821 - protein, 20 aa, Cryptosporidium hominis
YRCSGSFLTTALLFKLPRGR

SEQ ID NO: 2128822 - protein, 21 aa, Cryptosporidium hominis
YRDLFELLSKIFISKLKNKKI

SEQ ID NO: 2128823 - protein, 25 aa, Cryptosporidium hominis
YRELSCIRKIFSLPFIAFFIYMLFF

SEQ ID NO: 2128824 - protein, 17 aa, Cryptosporidium hominis
YRGIGGLIWSSSSDVRI

SEQ ID NO: 2128825 - protein, 19 aa, Cryptosporidium hominis
YRGYEVCPTYSMVNYHLGK

SEQ ID NO: 2128826 - protein, 19 aa, Cryptosporidium hominis
YRILKEMNGNFFLENHERG

SEQ ID NO: 2128827 - protein, 17 aa, Cryptosporidium hominis
YRLASFHPSIIFVLDQE

SEQ ID NO: 2128828 - protein, 18 aa, Cryptosporidium hominis
YRNCFAVLPQEVLLLNMS

SEQ ID NO: 2128829 - protein, 38 aa, Cryptosporidium hominis
YRREVHYLMCCLSLITLRGSSEFILLSISAWGSLCNSL

SEQ ID NO: 2128830 - protein, 25 aa, Cryptosporidium hominis
YRRSFLPLFLVFIFLALQFIGLSIM

SEQ ID NO: 2128831 - protein, 18 aa, Cryptosporidium hominis
YRSELLYRAQFLLETHTN

SEQ ID NO: 2128832 - protein, 17 aa, Cryptosporidium hominis
YRSISYEIKNMVECNKI

SEQ ID NO: 2128833 - protein, 19 aa, Cryptosporidium hominis
YRSKIKYNKLIATQWDESH

SEQ ID NO: 2128834 - protein, 17 aa, Cryptosporidium hominis
YRSNMKVFKEKKLMNEI

SEQ ID NO: 2128835 - protein, 17 aa, Cryptosporidium hominis
YRTCFIGSFHHAIMDGL

SEQ ID NO: 2128836 - protein, 22 aa, Cryptosporidium hominis
YRTVPILKPVVWSGIKELLDVS

SEQ ID NO: 2128837 - protein, 21 aa, Cryptosporidium hominis
YSDILTLKFVRIVSTSLFFTG

SEQ ID NO: 2128838 - protein, 17 aa, Cryptosporidium hominis
YSDLGTWVIEDRNDLSE

SEQ ID NO: 2128839 - protein, 17 aa, Cryptosporidium hominis
YSECSIWGIDGLPNLRL

SEQ ID NO: 2128840 - protein, 24 aa, Cryptosporidium hominis
YSEIKHIFYFLSFFFFVLSIFLFE

SEQ ID NO: 2128841 - protein, 17 aa, Cryptosporidium hominis
YSEKYMYGEKMKYFNVL

SEQ ID NO: 2128842 - protein, 17 aa, Cryptosporidium hominis
YSFHSNIEFARSRFEDY

SEQ ID NO: 2128843 - protein, 25 aa, Cryptosporidium hominis
YSFSNWRFNVPWLLWADSAFIGIQN

SEQ ID NO: 2128844 - protein, 17 aa, Cryptosporidium hominis
YSIPSIVDREVWKEKLF

SEQ ID NO: 2128845 - protein, 25 aa, Cryptosporidium hominis
YSKIEMLKSAFLMKEESLNCDKTSE

SEQ ID NO: 2128846 - protein, 30 aa, Cryptosporidium hominis
YSKKSGFIFFQWYFWYCLESRRYPSKDFLL

SEQ ID NO: 2128847 - protein, 25 aa, Cryptosporidium hominis
YSKLKKGDCVLIHVASGGVGLAAIQ

SEQ ID NO: 2128848 - protein, 23 aa, Cryptosporidium hominis
YSLFKFAYCIILDIKSIILKFNY

SEQ ID NO: 2128849 - protein, 24 aa, Cryptosporidium hominis
YSLLSLSAIILFSGKESHHLRKSC

SEQ ID NO: 2128850 - protein, 21 aa, Cryptosporidium hominis
YSLMWFVRLYFTVNMKSILLD

SEQ ID NO: 2128851 - protein, 21 aa, Cryptosporidium hominis
YSNDLKKLVLILLSKPALNKN

SEQ ID NO: 2128852 - protein, 25 aa, Cryptosporidium hominis
YSNHIYGFIQFRLFLMSNLIIAYTL

SEQ ID NO: 2128853 - protein, 18 aa, Cryptosporidium hominis
YSNKVMCFKQFCKSSDGI

SEQ ID NO: 2128854 - protein, 20 aa, Cryptosporidium hominis
YSNSYKWDWSSIPNNFVNFN

SEQ ID NO: 2128855 - protein, 22 aa, Cryptosporidium hominis
YSQTCLKNLIFKENLQIKKTIH

SEQ ID NO: 2128856 - protein, 20 aa, Cryptosporidium hominis
YSSASFLASIKFSKAMVEIS

SEQ ID NO: 2128857 - protein, 29 aa, Cryptosporidium hominis
YSSTLDSIGMRWLIPWYLIEALLTKPNQI

SEQ ID NO: 2128858 - protein, 22 aa, Cryptosporidium hominis
YSTFKCTFFFQYLYVSANEIAF

SEQ ID NO: 2128859 - protein, 23 aa, Cryptosporidium hominis
YSTKRFGFILLIYCPILINHYFA

SEQ ID NO: 2128860 - protein, 25 aa, Cryptosporidium hominis
YSTPECSYCKSFPVIVDEKYNIINR

SEQ ID NO: 2128861 - protein, 26 aa, Cryptosporidium hominis
YSYLQYRGSIPIVWRQPPNLKKTPPV

SEQ ID NO: 2128862 - protein, 18 aa, Cryptosporidium hominis
YTFFDYMIDYSILLFTMF

SEQ ID NO: 2128863 - protein, 19 aa, Cryptosporidium hominis
YTIFHYLKHFFTIIWNHSL

SEQ ID NO: 2128864 - protein, 20 aa, Cryptosporidium hominis
YTIYAKIIFREDAEIELQEI

SEQ ID NO: 2128865 - protein, 34 aa, Cryptosporidium hominis
YTLPETIDLLLYVTFCFGFMMAILFFNSSGSVKH

SEQ ID NO: 2128866 - protein, 18 aa, Cryptosporidium hominis
YTNWLSVICILYVVAVVF

SEQ ID NO: 2128867 - protein, 17 aa, Cryptosporidium hominis
YTPFYMIEMHKNKDKTQ

SEQ ID NO: 2128868 - protein, 18 aa, Cryptosporidium hominis
YTQEWKSTVERVGRLIDF

SEQ ID NO: 2128869 - protein, 22 aa, Cryptosporidium hominis
YTSIVLCDFALLSTGGIKTYLF

SEQ ID NO: 2128870 - protein, 23 aa, Cryptosporidium hominis
YVFGFWPSLLFKQHYNNILRSKK

SEQ ID NO: 2128871 - protein, 25 aa, Cryptosporidium hominis
YVGGSELWWKNWVFDQNKFDDLYDS

SEQ ID NO: 2128872 - protein, 17 aa, Cryptosporidium hominis
YVHKNIYGSERVIQCSD

SEQ ID NO: 2128873 - protein, 18 aa, Cryptosporidium hominis
YVIASGRNGSFFSIKLTN

SEQ ID NO: 2128874 - protein, 25 aa, Cryptosporidium hominis
YVLHLWLNLTIIWVWNLVYFFKKFN

SEQ ID NO: 2128875 - protein, 18 aa, Cryptosporidium hominis
YVQFCLRNPSLSYFTCIG

SEQ ID NO: 2128876 - protein, 24 aa, Cryptosporidium hominis
YVRIARFEGPLTFINAERFVKNLE

SEQ ID NO: 2128877 - protein, 18 aa, Cryptosporidium hominis
YVSFARFMLLLSSIIPIS

SEQ ID NO: 2128878 - protein, 22 aa, Cryptosporidium hominis
YVSRFNWSFVYEKIRNSLGAQY

SEQ ID NO: 2128879 - protein, 23 aa, Cryptosporidium hominis
YVVAESRLEWVLSELKIKEYNII

SEQ ID NO: 2128880 - protein, 18 aa, Cryptosporidium hominis
YVVAVVFFRLMYSVRTTY

SEQ ID NO: 2128881 - protein, 17 aa, Cryptosporidium hominis
YWCGRVSLRIQASLISM

SEQ ID NO: 2128882 - protein, 25 aa, Cryptosporidium hominis
YWFFHSIWHIMAFLASTFIIHGCVP

SEQ ID NO: 2128883 - protein, 23 aa, Cryptosporidium hominis
YWSNHIVCPVLFYDAINHALNKF

SEQ ID NO: 2128884 - protein, 20 aa, Cryptosporidium hominis
YYCKCAEGFYGRNCTISSDN

SEQ ID NO: 2128885 - protein, 25 aa, Cryptosporidium hominis
YYDEYKLLMLRNGDPFYIQDIKLDL

SEQ ID NO: 2128886 - protein, 19 aa, Cryptosporidium hominis
YYFSSLILWLFSKSNDSIV

SEQ ID NO: 2128887 - protein, 24 aa, Cryptosporidium hominis
YYGWSALFLCLLLFSTFSFLILIP

SEQ ID NO: 2128888 - protein, 20 aa, Cryptosporidium hominis
YYKIASFFYTINFINIILDR

SEQ ID NO: 2128889 - protein, 17 aa, Cryptosporidium hominis
YYKLDPFLKEWKNPDIQ

SEQ ID NO: 2128890 - protein, 26 aa, Cryptosporidium hominis
YYKVNLLVALLICFLLCDTVLTSNST

SEQ ID NO: 2128891 - protein, 37 aa, Cryptosporidium hominis
YYLDMAHNNWLIFYPIRCLSSTFKIMLHIFDIQSDSF

SEQ ID NO: 2128892 - protein, 23 aa, Cryptosporidium hominis
YYLLYPSCRIFEPLDNLKDEAFV

SEQ ID NO: 2128893 - protein, 18 aa, Cryptosporidium hominis
YYLNWLREYEKALDDSIK

SEQ ID NO: 2128894 - protein, 17 aa, Cryptosporidium hominis
YYMKSRWPNPSVVENLI

SEQ ID NO: 2128895 - protein, 19 aa, Cryptosporidium hominis
YYNSLGLTEDFLLVFMNFS

SEQ ID NO: 2128896 - protein, 19 aa, Cryptosporidium hominis
YYSNGLYYLAIFKGRYNIQ

SEQ ID NO: 2128897 - protein, 24 aa, Cryptosporidium hominis
YYTNRLKSNIAFIPAQSFSDMISD

SEQ ID NO: 2128898 - protein, 32 aa, Cryptosporidium hominis
YYWKYVLEPIRYIIYIIFYFIWGIELTPKKEF

SEQ ID NO: 2128899 - protein, 29 aa, Cryptosporidium hominis
YYWYFSKLKWSWTIALLILCYSKTMFDKG

SEQ ID NO: 2128900 - protein, 29 aa, Cryptosporidium hominis
YYYLFQQYCSFRFKFSASLKKISSTDSNN

SEQ ID NO: 2128901 - protein, 19 aa, Cryptosporidium hominis
ACTRISWQLFKELMLCSPL

SEQ ID NO: 2128902 - protein, 18 aa, Cryptosporidium hominis
ADHLKPDFFYAFNSMPGW

SEQ ID NO: 2128903 - protein, 17 aa, Cryptosporidium hominis
ADMKDPLIIGGEIRTIS

SEQ ID NO: 2128904 - protein, 19 aa, Cryptosporidium hominis
ADYLRWIALVLFPSFIYIR

SEQ ID NO: 2128905 - protein, 20 aa, Cryptosporidium hominis
AETIKKLGFVGGKIKMISSH

SEQ ID NO: 2128906 - protein, 21 aa, Cryptosporidium hominis
AETIPSIALIYGFWSSKNSFL

SEQ ID NO: 2128907 - protein, 17 aa, Cryptosporidium hominis
AEVLLAFDILKEAIRLA

SEQ ID NO: 2128908 - protein, 20 aa, Cryptosporidium hominis
AFECIKECMKRCIWTQKIDL

SEQ ID NO: 2128909 - protein, 23 aa, Cryptosporidium hominis
AFQEWVEGIGILFIVLINASLAT

SEQ ID NO: 2128910 - protein, 17 aa, Cryptosporidium hominis
AGAKMMIEWNFAFHWYD

SEQ ID NO: 2128911 - protein, 17 aa, Cryptosporidium hominis
AHIPLMFSRKYIQEKKE

SEQ ID NO: 2128912 - protein, 17 aa, Cryptosporidium hominis
AIFNWRFVFNIPVPCHF

SEQ ID NO: 2128913 - protein, 18 aa, Cryptosporidium hominis
AIGLLGYMHALGLGTSPD

SEQ ID NO: 2128914 - protein, 23 aa, Cryptosporidium hominis
AIVSCYFLFIGLFEYNTRSVTFL

SEQ ID NO: 2128915 - protein, 18 aa, Cryptosporidium hominis
AKMMIEWNFAFHWYDDGL

SEQ ID NO: 2128916 - protein, 23 aa, Cryptosporidium hominis
AKPLKRLSCPAIFFDCTHDNETP

SEQ ID NO: 2128917 - protein, 18 aa, Cryptosporidium hominis
ALIQSFWLGIADNVDPEL

SEQ ID NO: 2128918 - protein, 22 aa, Cryptosporidium hominis
ALPLICMLCFSAAQAAYEDWKR

SEQ ID NO: 2128919 - protein, 19 aa, Cryptosporidium hominis
ALSIFSIVCAVFFKQTMLY

SEQ ID NO: 2128920 - protein, 17 aa, Cryptosporidium hominis
ANFQTHFDLKLIAKEND

SEQ ID NO: 2128921 - protein, 17 aa, Cryptosporidium hominis
APLRRRIASQGNNYLDD

SEQ ID NO: 2128922 - protein, 17 aa, Cryptosporidium hominis
APLSWLFFLACSSIAAY

SEQ ID NO: 2128923 - protein, 17 aa, Cryptosporidium hominis
ASIKAFAIFGILFVFEE

SEQ ID NO: 2128924 - protein, 18 aa, Cryptosporidium hominis
AWKLWKTKIFILSRRFPF

SEQ ID NO: 2128925 - protein, 17 aa, Cryptosporidium hominis
AWLKIRLQVGIIIPLTF

SEQ ID NO: 2128926 - protein, 17 aa, Cryptosporidium hominis
AWTLFSLLIICTLKGIS

SEQ ID NO: 2128927 - protein, 20 aa, Cryptosporidium hominis
AYEWANCCWNYLGTITEINN

SEQ ID NO: 2128928 - protein, 17 aa, Cryptosporidium hominis
AYFYRPEEMDDFTTYSM

SEQ ID NO: 2128929 - protein, 18 aa, Cryptosporidium hominis
CALQRFVILLALLEIYSR

SEQ ID NO: 2128930 - protein, 30 aa, Cryptosporidium hominis
CDRFPEGVACPMVLSGEANVECIGYKVWNS

SEQ ID NO: 2128931 - protein, 17 aa, Cryptosporidium hominis
CEGCPKSNLEIMTDAMS

SEQ ID NO: 2128932 - protein, 21 aa, Cryptosporidium hominis
CFIFPFRLIIAYFVLKDSLGS

SEQ ID NO: 2128933 - protein, 19 aa, Cryptosporidium hominis
CGILSICLLIIIVLLVVLS

SEQ ID NO: 2128934 - protein, 18 aa, Cryptosporidium hominis
CGLCVIYITLSIVIIVNF

SEQ ID NO: 2128935 - protein, 19 aa, Cryptosporidium hominis
CGYKSGFINSGCICRFRNL

SEQ ID NO: 2128936 - protein, 18 aa, Cryptosporidium hominis
CHGFEWLWFLALLIVISV

SEQ ID NO: 2128937 - protein, 22 aa, Cryptosporidium hominis
CHKVDPRLGGAIYNVISFGKIS

SEQ ID NO: 2128938 - protein, 22 aa, Cryptosporidium hominis
CIALRLLFRCCGIKCGSSCTNK

SEQ ID NO: 2128939 - protein, 19 aa, Cryptosporidium hominis
CIFECFFEPLLYYKNKHNL

SEQ ID NO: 2128940 - protein, 18 aa, Cryptosporidium hominis
CKAQHYWYFREKTSDNSH

SEQ ID NO: 2128941 - protein, 18 aa, Cryptosporidium hominis
CKDLSLKAFHHFHNVSNL

SEQ ID NO: 2128942 - protein, 21 aa, Cryptosporidium hominis
CKGEELPLLWGQRATILHENM

SEQ ID NO: 2128943 - protein, 17 aa, Cryptosporidium hominis
CKSVIYRRADFFRRKNH

SEQ ID NO: 2128944 - protein, 20 aa, Cryptosporidium hominis
CLVCQICLVLSDLLSKTDSF

SEQ ID NO: 2128945 - protein, 20 aa, Cryptosporidium hominis
CPKLKRIAMRSEIQERMPNY

SEQ ID NO: 2128946 - protein, 19 aa, Cryptosporidium hominis
CPLRRVIYGFMTKIRLLLI

SEQ ID NO: 2128947 - protein, 18 aa, Cryptosporidium hominis
CPPGFNFAYDIWRKQKNK

SEQ ID NO: 2128948 - protein, 18 aa, Cryptosporidium hominis
CPYISYKIPNSFSAFPTS

SEQ ID NO: 2128949 - protein, 17 aa, Cryptosporidium hominis
CSEDPWIPIGTIRSVIL

SEQ ID NO: 2128950 - protein, 23 aa, Cryptosporidium hominis
CSKLYPALCFDLYGSPGFHNIYV

SEQ ID NO: 2128951 - protein, 20 aa, Cryptosporidium hominis
CSSLECSNCNEIIDMNISHN

SEQ ID NO: 2128952 - protein, 17 aa, Cryptosporidium hominis
CVGVYFLGVGVVGSVLY

SEQ ID NO: 2128953 - protein, 17 aa, Cryptosporidium hominis
CVIKVLLLLGQVLAFDA

SEQ ID NO: 2128954 - protein, 20 aa, Cryptosporidium hominis
CYFFCDLCPIGMVGYFCSLK

SEQ ID NO: 2128955 - protein, 18 aa, Cryptosporidium hominis
DCELKWALSDSELALITK

SEQ ID NO: 2128956 - protein, 20 aa, Cryptosporidium hominis
DCGWRRPRITIPPPVDSIDA

SEQ ID NO: 2128957 - protein, 18 aa, Cryptosporidium hominis
DCIITMFKREGIRSFYRS

SEQ ID NO: 2128958 - protein, 29 aa, Cryptosporidium hominis
DCTFFGFEILKVLFPWKWISWLPTISQLL

SEQ ID NO: 2128959 - protein, 18 aa, Cryptosporidium hominis
DCYLLFQRWFLYFVNACK

SEQ ID NO: 2128960 - protein, 25 aa, Cryptosporidium hominis
DEEIKCGFCFSKCCCWPVWSGSIIS

SEQ ID NO: 2128961 - protein, 22 aa, Cryptosporidium hominis
DESYLRFEILREFIKNNVKSFQ

SEQ ID NO: 2128962 - protein, 22 aa, Cryptosporidium hominis
DFLRICIYLELFVQSILLSECV

SEQ ID NO: 2128963 - protein, 18 aa, Cryptosporidium hominis
DFSGEINIAFVINSGINN

SEQ ID NO: 2128964 - protein, 22 aa, Cryptosporidium hominis
DGEGFLKAVSKLVNIRKRVNTG

SEQ ID NO: 2128965 - protein, 22 aa, Cryptosporidium hominis
DIGPRFGVIMQIIFASSEKHRN

SEQ ID NO: 2128966 - protein, 18 aa, Cryptosporidium hominis
DILLCIDIIKLCDSKMVP

SEQ ID NO: 2128967 - protein, 18 aa, Cryptosporidium hominis
DILLKGGEFLSVYPTPNF

SEQ ID NO: 2128968 - protein, 24 aa, Cryptosporidium hominis
DKMKRFSFRWEEQFMKYCEKVQRR

SEQ ID NO: 2128969 - protein, 18 aa, Cryptosporidium hominis
DLLIPLYIGFWFINSILD

SEQ ID NO: 2128970 - protein, 23 aa, Cryptosporidium hominis
DLPEDRFCWNYNFLMPLYEGGSS

SEQ ID NO: 2128971 - protein, 22 aa, Cryptosporidium hominis
DLSNIILFCMKNLIYSRSVMMP

SEQ ID NO: 2128972 - protein, 24 aa, Cryptosporidium hominis
DMRFYKFCLRLSCSRMLESQLAQY

SEQ ID NO: 2128973 - protein, 20 aa, Cryptosporidium hominis
DPPSAFKCILNLINSFDFLF

SEQ ID NO: 2128974 - protein, 21 aa, Cryptosporidium hominis
DPTRIALRVGRILSVERHPTA

SEQ ID NO: 2128975 - protein, 23 aa, Cryptosporidium hominis
DRNTLAMYMEWIWLNDHIQSVIE

SEQ ID NO: 2128976 - protein, 18 aa, Cryptosporidium hominis
DSIGMRWLIPWYLIEALL

SEQ ID NO: 2128977 - protein, 19 aa, Cryptosporidium hominis
DSKFFCWKKVRSKSSHLLN

SEQ ID NO: 2128978 - protein, 21 aa, Cryptosporidium hominis
DSVYEIFKWIDSLALDENNLI

SEQ ID NO: 2128979 - protein, 18 aa, Cryptosporidium hominis
DVHWPFTLFSLWGEPKSV

SEQ ID NO: 2128980 - protein, 18 aa, Cryptosporidium hominis
DVRLFVIGVRMFRSLNSP

SEQ ID NO: 2128981 - protein, 19 aa, Cryptosporidium hominis
DYCLMCFLIRPLINSLAAR

SEQ ID NO: 2128982 - protein, 23 aa, Cryptosporidium hominis
DYYHWWFLCIDIVFSGISISQNS

SEQ ID NO: 2128983 - protein, 18 aa, Cryptosporidium hominis
ECIDGWFKQNCVCPICRS

SEQ ID NO: 2128984 - protein, 22 aa, Cryptosporidium hominis
EDCIRLSSFLTRFISDSIEIIF

SEQ ID NO: 2128985 - protein, 22 aa, Cryptosporidium hominis
EDKLLLKLPILITTTTSTMTTT

SEQ ID NO: 2128986 - protein, 22 aa, Cryptosporidium hominis
EDYSAYCLRRIDGFPLSEFEAV

SEQ ID NO: 2128987 - protein, 22 aa, Cryptosporidium hominis
EECIRYIYRYGLYIYNGLILDF

SEQ ID NO: 2128988 - protein, 26 aa, Cryptosporidium hominis
EFNNKYGKIILWKRNIDNINNEHNPF

SEQ ID NO: 2128989 - protein, 17 aa, Cryptosporidium hominis
EGLKWICMDIEKNFDNY

SEQ ID NO: 2128990 - protein, 17 aa, Cryptosporidium hominis
EHLRPSPPLPMSNSIKD

SEQ ID NO: 2128991 - protein, 18 aa, Cryptosporidium hominis
EIFQLMIFIAQTCPYYYK

SEQ ID NO: 2128992 - protein, 21 aa, Cryptosporidium hominis
EKCSWNELMVLNFFLTSFKGF

SEQ ID NO: 2128993 - protein, 21 aa, Cryptosporidium hominis
EKKHRKSSCKHNHMSKHKDKY

SEQ ID NO: 2128994 - protein, 20 aa, Cryptosporidium hominis
EKKPTLPSSMPWTPNSSSFH

SEQ ID NO: 2128995 - protein, 19 aa, Cryptosporidium hominis
EKMASCKYLTFLLNELLKL

SEQ ID NO: 2128996 - protein, 21 aa, Cryptosporidium hominis
EKVEYRWNFLINILDFVDKNE

SEQ ID NO: 2128997 - protein, 20 aa, Cryptosporidium hominis
EKWKIMVLIIHLFYILNKDL

SEQ ID NO: 2128998 - protein, 19 aa, Cryptosporidium hominis
ELCIRVCLTSASLCFSGSG

SEQ ID NO: 2128999 - protein, 19 aa, Cryptosporidium hominis
ELFSSYFLEHIIKLLKIHK

SEQ ID NO: 2129000 - protein, 17 aa, Cryptosporidium hominis
ELGIRECISITWIEMMK

SEQ ID NO: 2129001 - protein, 25 aa, Cryptosporidium hominis
ELKHLFKIPMNYLPYIPKDTGENDE

SEQ ID NO: 2129002 - protein, 21 aa, Cryptosporidium hominis
ELSCIRKIFSLPFIAFFIYML

SEQ ID NO: 2129003 - protein, 19 aa, Cryptosporidium hominis
ELVNRITLFIDFDSDKYQF

SEQ ID NO: 2129004 - protein, 21 aa, Cryptosporidium hominis
EMKEFKSNFNLIKSFQYSILK

SEQ ID NO: 2129005 - protein, 17 aa, Cryptosporidium hominis
EMLFFFKDYIENDVPLN

SEQ ID NO: 2129006 - protein, 17 aa, Cryptosporidium hominis
EMSYRLWSIVYFIMTGI

SEQ ID NO: 2129007 - protein, 21 aa, Cryptosporidium hominis
EPGRVPAKWGFRVGDESKRRR

SEQ ID NO: 2129008 - protein, 19 aa, Cryptosporidium hominis
EPILRFDFLVSQLMSSSSQ

SEQ ID NO: 2129009 - protein, 17 aa, Cryptosporidium hominis
EPLRVAFTAQLRQVLHP

SEQ ID NO: 2129010 - protein, 20 aa, Cryptosporidium hominis
EPRKLPGPLLPYGFSILILL

SEQ ID NO: 2129011 - protein, 18 aa, Cryptosporidium hominis
EQTIRWSIENMLSRGIIQ

SEQ ID NO: 2129012 - protein, 19 aa, Cryptosporidium hominis
ERLRYLIFLAEVQMRRLIN

SEQ ID NO: 2129013 - protein, 18 aa, Cryptosporidium hominis
ERRRIIGVLPQIPLLLKG

SEQ ID NO: 2129014 - protein, 18 aa, Cryptosporidium hominis
ESFTRFRIIFSRERAKGL

SEQ ID NO: 2129015 - protein, 18 aa, Cryptosporidium hominis
ESIALNWNSWYFFPEQII

SEQ ID NO: 2129016 - protein, 22 aa, Cryptosporidium hominis
ESKNGLKYFCWDIQAVREIITA

SEQ ID NO: 2129017 - protein, 19 aa, Cryptosporidium hominis
ESYFKLIEFWPINRELLCE

SEQ ID NO: 2129018 - protein, 18 aa, Cryptosporidium hominis
ETCKTCLVGGWSEWSDCS

SEQ ID NO: 2129019 - protein, 25 aa, Cryptosporidium hominis
ETIDLLLYVTFCFGFMMAILFFNSS

SEQ ID NO: 2129020 - protein, 20 aa, Cryptosporidium hominis
EVFKIAFMLLRKGCRMQLDA

SEQ ID NO: 2129021 - protein, 19 aa, Cryptosporidium hominis
EVMRICIVIIWTIACVVLG

SEQ ID NO: 2129022 - protein, 17 aa, Cryptosporidium hominis
EYLGLAVDYRFISSDKD

SEQ ID NO: 2129023 - protein, 18 aa, Cryptosporidium hominis
FASKEDKLLLKLPILITT

SEQ ID NO: 2129024 - protein, 18 aa, Cryptosporidium hominis
FAYRFSFIVCCQLNQVID

SEQ ID NO: 2129025 - protein, 22 aa, Cryptosporidium hominis
FCQEIYFPIGIIISIYCIYDSL

SEQ ID NO: 2129026 - protein, 17 aa, Cryptosporidium hominis
FDFAIAAVVHFFSIILG

SEQ ID NO: 2129027 - protein, 26 aa, Cryptosporidium hominis
FDKYGIPEYVFWIIVYTVPVLFVLLL

SEQ ID NO: 2129028 - protein, 17 aa, Cryptosporidium hominis
FDSRSWYPLGRIIGQTL

SEQ ID NO: 2129029 - protein, 20 aa, Cryptosporidium hominis
FEAFAFICLALFIADIPNSS

SEQ ID NO: 2129030 - protein, 18 aa, Cryptosporidium hominis
FFCACGSVIYKEFREEFK

SEQ ID NO: 2129031 - protein, 18 aa, Cryptosporidium hominis
FFEFCDFFRQLLMTPIMF

SEQ ID NO: 2129032 - protein, 17 aa, Cryptosporidium hominis
FFFPDSAPLSWLFFLAC

SEQ ID NO: 2129033 - protein, 19 aa, Cryptosporidium hominis
FFKCLKIIIDLLFNSNLFS

SEQ ID NO: 2129034 - protein, 20 aa, Cryptosporidium hominis
FFKLFSIISILSLIYEHALG

SEQ ID NO: 2129035 - protein, 17 aa, Cryptosporidium hominis
FFVLFIFFVYLKTRHDL

SEQ ID NO: 2129036 - protein, 20 aa, Cryptosporidium hominis
FGGGEKVLWCIIYEVLNTNI

SEQ ID NO: 2129037 - protein, 17 aa, Cryptosporidium hominis
FGLISINLLAIVISLYI

SEQ ID NO: 2129038 - protein, 19 aa, Cryptosporidium hominis
FHKEIKLCIDYYIQIITMD

SEQ ID NO: 2129039 - protein, 17 aa, Cryptosporidium hominis
FHWRENFCRIIKEKGLS

SEQ ID NO: 2129040 - protein, 21 aa, Cryptosporidium hominis
FIAKLFIRFGMKPEQTQIHDQ

SEQ ID NO: 2129041 - protein, 23 aa, Cryptosporidium hominis
FIFSRNMFWLANWTGRKKHLNSS

SEQ ID NO: 2129042 - protein, 23 aa, Cryptosporidium hominis
FIILCYWHTLNIFQFMYIFTPAI

SEQ ID NO: 2129043 - protein, 18 aa, Cryptosporidium hominis
FIPWKIAFNGIEWMESYT

SEQ ID NO: 2129044 - protein, 24 aa, Cryptosporidium hominis
FISLWLECFFLCFFYRSTKSSFEQ

SEQ ID NO: 2129045 - protein, 17 aa, Cryptosporidium hominis
FISYILLAMPFQFESEI

SEQ ID NO: 2129046 - protein, 18 aa, Cryptosporidium hominis
FITCLVCQICLVLSDLLS

SEQ ID NO: 2129047 - protein, 25 aa, Cryptosporidium hominis
FITTCLFCLLGIIVVLYYFKEYRFY

SEQ ID NO: 2129048 - protein, 17 aa, Cryptosporidium hominis
FIVPCLLIFLSDFLIPI

SEQ ID NO: 2129049 - protein, 21 aa, Cryptosporidium hominis
FIYELGDFGGLIVMANDLKHT

SEQ ID NO: 2129050 - protein, 17 aa, Cryptosporidium hominis
FIYRKCVELRFTVNNEN

SEQ ID NO: 2129051 - protein, 21 aa, Cryptosporidium hominis
FKANSFFFFSWIFMVILPLLI

SEQ ID NO: 2129052 - protein, 19 aa, Cryptosporidium hominis
FKENLCIDGLFIGNLDRAE

SEQ ID NO: 2129053 - protein, 23 aa, Cryptosporidium hominis
FKEYRMAVYLSICFEMVSLFILT

SEQ ID NO: 2129054 - protein, 17 aa, Cryptosporidium hominis
FKILACFPFCSSSKRMG

SEQ ID NO: 2129055 - protein, 22 aa, Cryptosporidium hominis
FKKISVIFLFIIVILLFLNLEL

SEQ ID NO: 2129056 - protein, 17 aa, Cryptosporidium hominis
FKLAYSVLRERGFQNSK

SEQ ID NO: 2129057 - protein, 17 aa, Cryptosporidium hominis
FKLFSRRLARVIFPSLH

SEQ ID NO: 2129058 - protein, 18 aa, Cryptosporidium hominis
FKMKFSVIIAFFQMTLGV

SEQ ID NO: 2129059 - protein, 26 aa, Cryptosporidium hominis
FKRFKKRYAGVLGFAILICFLIGFYL

SEQ ID NO: 2129060 - protein, 21 aa, Cryptosporidium hominis
FKSLVSFSIFYIWSLSCVYLL

SEQ ID NO: 2129061 - protein, 17 aa, Cryptosporidium hominis
FLDCLFCIPLFLIVLSD

SEQ ID NO: 2129062 - protein, 18 aa, Cryptosporidium hominis
FLFGFIVGFYRGWKMALV

SEQ ID NO: 2129063 - protein, 17 aa, Cryptosporidium hominis
FLFSIFLYKSCIEHAFQ

SEQ ID NO: 2129064 - protein, 17 aa, Cryptosporidium hominis
FLICIPVLAYLFFQVSK

SEQ ID NO: 2129065 - protein, 17 aa, Cryptosporidium hominis
FLKLIIYLIKWVKHNKF

SEQ ID NO: 2129066 - protein, 17 aa, Cryptosporidium hominis
FLLRLTCEFYMKAMREI

SEQ ID NO: 2129067 - protein, 17 aa, Cryptosporidium hominis
FLLSTAILLVSIFLSHV

SEQ ID NO: 2129068 - protein, 21 aa, Cryptosporidium hominis
FLQIFRYLLFYSLTLLSFSSS

SEQ ID NO: 2129069 - protein, 20 aa, Cryptosporidium hominis
FLQNRLNLLASRNLLNHYVN

SEQ ID NO: 2129070 - protein, 17 aa, Cryptosporidium hominis
FLYCGYHALSIFSIVCA

SEQ ID NO: 2129071 - protein, 27 aa, Cryptosporidium hominis
FMRDFISQIAFCYRISSVFLISKLNSL

SEQ ID NO: 2129072 - protein, 23 aa, Cryptosporidium hominis
FNECFRFPVVVPIVEDIIILKLW

SEQ ID NO: 2129073 - protein, 18 aa, Cryptosporidium hominis
FNIWRFLLSTAILLVSIF

SEQ ID NO: 2129074 - protein, 17 aa, Cryptosporidium hominis
FNKECRKNVDLFHSNPS

SEQ ID NO: 2129075 - protein, 18 aa, Cryptosporidium hominis
FNNILAIVILSFAWYCLF

SEQ ID NO: 2129076 - protein, 26 aa, Cryptosporidium hominis
FPGEVPGAALLRKRVYRRLNNIEDIV

SEQ ID NO: 2129077 - protein, 24 aa, Cryptosporidium hominis
FPIERWCIGDTWPINNPKISVGQI

SEQ ID NO: 2129078 - protein, 17 aa, Cryptosporidium hominis
FPKTATWHIMKLGDVTL

SEQ ID NO: 2129079 - protein, 17 aa, Cryptosporidium hominis
FPLAWKVEFIFWNYFSI

SEQ ID NO: 2129080 - protein, 20 aa, Cryptosporidium hominis
FPLFRSCFKIAYTGTPPRSL

SEQ ID NO: 2129081 - protein, 18 aa, Cryptosporidium hominis
FPNFYRWMNFKASTISEC

SEQ ID NO: 2129082 - protein, 17 aa, Cryptosporidium hominis
FPVSFGIPVITLQKLNV

SEQ ID NO: 2129083 - protein, 18 aa, Cryptosporidium hominis
FQFSRLYFKLARGDCRII

SEQ ID NO: 2129084 - protein, 21 aa, Cryptosporidium hominis
FQLRPKLTIKDLEWLNSDKND

SEQ ID NO: 2129085 - protein, 17 aa, Cryptosporidium hominis
FRAFLSYFLPMVYGISL

SEQ ID NO: 2129086 - protein, 18 aa, Cryptosporidium hominis
FRGVGILALICLLYFSLA

SEQ ID NO: 2129087 - protein, 19 aa, Cryptosporidium hominis
FRHFPLRRSFVFELMDHVN

SEQ ID NO: 2129088 - protein, 17 aa, Cryptosporidium hominis
FRIACQFSLIKCTLANI

SEQ ID NO: 2129089 - protein, 23 aa, Cryptosporidium hominis
FRKVGSCILGIFLFMIHNFVPDS

SEQ ID NO: 2129090 - protein, 17 aa, Cryptosporidium hominis
FRMILVITMLTRTMGDS

SEQ ID NO: 2129091 - protein, 17 aa, Cryptosporidium hominis
FRPKSCFPCDKYLELKC

SEQ ID NO: 2129092 - protein, 21 aa, Cryptosporidium hominis
FRYICSWAKLLGLTISSFLFI

SEQ ID NO: 2129093 - protein, 19 aa, Cryptosporidium hominis
FSAFCHYHGLLVGSGTGAG

SEQ ID NO: 2129094 - protein, 17 aa, Cryptosporidium hominis
FSAIFARILLLWWYSIP

SEQ ID NO: 2129095 - protein, 18 aa, Cryptosporidium hominis
FSFCLSNFDFRDITSNIY

SEQ ID NO: 2129096 - protein, 17 aa, Cryptosporidium hominis
FSFERLDYVLAHCKSNL

SEQ ID NO: 2129097 - protein, 17 aa, Cryptosporidium hominis
FSFIFLKFHSFWMERKP

SEQ ID NO: 2129098 - protein, 17 aa, Cryptosporidium hominis
FSFIFSLMNGFIMDKIG

SEQ ID NO: 2129099 - protein, 17 aa, Cryptosporidium hominis
FTLEIFQNIILITSFHS

SEQ ID NO: 2129100 - protein, 22 aa, Cryptosporidium hominis
FTQIRGSIPLFWEQTGVNSCAI

SEQ ID NO: 2129101 - protein, 17 aa, Cryptosporidium hominis
FVFNIPVPCHFPILRLQ

SEQ ID NO: 2129102 - protein, 17 aa, Cryptosporidium hominis
FVLISAITNFLGYPNSY

SEQ ID NO: 2129103 - protein, 22 aa, Cryptosporidium hominis
FVWKIILFFIIWKSRNDFIKFQ

SEQ ID NO: 2129104 - protein, 18 aa, Cryptosporidium hominis
FWFWFPLVHCISLSYIPT

SEQ ID NO: 2129105 - protein, 22 aa, Cryptosporidium hominis
FWNEFIFCLALKVLMVVLTTCL

SEQ ID NO: 2129106 - protein, 29 aa, Cryptosporidium hominis
FYIRRISCLPIFWCSHDPWIPSGTIRSII

SEQ ID NO: 2129107 - protein, 23 aa, Cryptosporidium hominis
FYIWSLSCVYLLFGLTTSKCSIF

SEQ ID NO: 2129108 - protein, 17 aa, Cryptosporidium hominis
FYLLESIGHQMAPSVKI

SEQ ID NO: 2129109 - protein, 17 aa, Cryptosporidium hominis
FYLYARWTLYFNTQVIA

SEQ ID NO: 2129110 - protein, 17 aa, Cryptosporidium hominis
FYRGWKMALVMSASLPI

SEQ ID NO: 2129111 - protein, 20 aa, Cryptosporidium hominis
FYRIGIIVPEGFWVAEQRGT

SEQ ID NO: 2129112 - protein, 19 aa, Cryptosporidium hominis
FYSRIRIILRLSCAISPSW

SEQ ID NO: 2129113 - protein, 17 aa, Cryptosporidium hominis
GCDCDRFPEGVACPMVL

SEQ ID NO: 2129114 - protein, 17 aa, Cryptosporidium hominis
GDDGWDFVTTILPKVGS

SEQ ID NO: 2129115 - protein, 23 aa, Cryptosporidium hominis
GDLSSLKVLFGWFSTSNQTNLAK

SEQ ID NO: 2129116 - protein, 21 aa, Cryptosporidium hominis
GDSPLHWAVRLELPKVVHRLV

SEQ ID NO: 2129117 - protein, 17 aa, Cryptosporidium hominis
GECPLRRVIYGFMTKIR

SEQ ID NO: 2129118 - protein, 19 aa, Cryptosporidium hominis
GESSHVWGVLLARSLPAWD

SEQ ID NO: 2129119 - protein, 25 aa, Cryptosporidium hominis
GEVGLRLAAIYMYRFICQSNLVCGY

SEQ ID NO: 2129120 - protein, 24 aa, Cryptosporidium hominis
GFAILICFLIGFYLILFSAKHPTS

SEQ ID NO: 2129121 - protein, 18 aa, Cryptosporidium hominis
GFAVAFSLFSWICTLFVC

SEQ ID NO: 2129122 - protein, 25 aa, Cryptosporidium hominis
GFEHLWKKRVVYLLKIQSVNAVLFL

SEQ ID NO: 2129123 - protein, 24 aa, Cryptosporidium hominis
GGRYKGGEGWLGYMEEVPKLSIQE

SEQ ID NO: 2129124 - protein, 25 aa, Cryptosporidium hominis
GGTVFKGEFPAGGPFSSPSDSSTFP

SEQ ID NO: 2129125 - protein, 21 aa, Cryptosporidium hominis
GGWKFGILVIQSFLIIVIDSI

SEQ ID NO: 2129126 - protein, 20 aa, Cryptosporidium hominis
GHGKPVDWWTLGILIYEMVV

SEQ ID NO: 2129127 - protein, 25 aa, Cryptosporidium hominis
GHVFHLDCLKSWFIQQQTCPICRAP

SEQ ID NO: 2129128 - protein, 19 aa, Cryptosporidium hominis
GIHKLRFLPAIIYIESTKQ

SEQ ID NO: 2129129 - protein, 17 aa, Cryptosporidium hominis
GILKCFCNALSIVLITL

SEQ ID NO: 2129130 - protein, 22 aa, Cryptosporidium hominis
GKESHHLRKSCSFLVDEFFQSE

SEQ ID NO: 2129131 - protein, 17 aa, Cryptosporidium hominis
GKETIVWYDAIAGNNMV

SEQ ID NO: 2129132 - protein, 23 aa, Cryptosporidium hominis
GKPMILCPYRWTKLQNIIQKINI

SEQ ID NO: 2129133 - protein, 18 aa, Cryptosporidium hominis
GLAAEVLLAFDILKEAIR

SEQ ID NO: 2129134 - protein, 20 aa, Cryptosporidium hominis
GLIIKLFLLLIAFIIFYVIF

SEQ ID NO: 2129135 - protein, 24 aa, Cryptosporidium hominis
GLLGGLGYGFKRKKTRGGDLTGDN

SEQ ID NO: 2129136 - protein, 22 aa, Cryptosporidium hominis
GLNLPILFGIAFMGFCVSGPDS

SEQ ID NO: 2129137 - protein, 19 aa, Cryptosporidium hominis
GNFGKIWLWLVKLLNKKSP

SEQ ID NO: 2129138 - protein, 22 aa, Cryptosporidium hominis
GNLPLEVGFTFSFPIVQSKIAS

SEQ ID NO: 2129139 - protein, 17 aa, Cryptosporidium hominis
GNPRGSIDYIWYGAILQ

SEQ ID NO: 2129140 - protein, 18 aa, Cryptosporidium hominis
GNRCIFESEFFRDWKKPL

SEQ ID NO: 2129141 - protein, 18 aa, Cryptosporidium hominis
GPAILLRWFQASYFLQLI

SEQ ID NO: 2129142 - protein, 17 aa, Cryptosporidium hominis
GPLISRSKLYGMMNKHP

SEQ ID NO: 2129143 - protein, 17 aa, Cryptosporidium hominis
GQFCMGMVYTLFPFLDS

SEQ ID NO: 2129144 - protein, 19 aa, Cryptosporidium hominis
GQMSLKLGIVVNLLYGNQS

SEQ ID NO: 2129145 - protein, 17 aa, Cryptosporidium hominis
GRIGMMQGIPQHMGGAG

SEQ ID NO: 2129146 - protein, 21 aa, Cryptosporidium hominis
GRIPIPIKFGFGPLFDSVFQD

SEQ ID NO: 2129147 - protein, 22 aa, Cryptosporidium hominis
GRLAYRRICKLALYMFYKNLTV

SEQ ID NO: 2129148 - protein, 22 aa, Cryptosporidium hominis
GRTFNCFCGYGIGLVDLTAIDG

SEQ ID NO: 2129149 - protein, 17 aa, Cryptosporidium hominis
GSCWAFSAVAALEGATC

SEQ ID NO: 2129150 - protein, 18 aa, Cryptosporidium hominis
GSLGWGFYLLLLANSLLI

SEQ ID NO: 2129151 - protein, 22 aa, Cryptosporidium hominis
GSTFRYKKLVGMLLESRGEIEK

SEQ ID NO: 2129152 - protein, 19 aa, Cryptosporidium hominis
GSTWLEWLGDVNVTSKNHG

SEQ ID NO: 2129153 - protein, 22 aa, Cryptosporidium hominis
GSWIQWLFKFHRISSVPLNSAD

SEQ ID NO: 2129154 - protein, 17 aa, Cryptosporidium hominis
GTILSIFTRHVYKVRSE

SEQ ID NO: 2129155 - protein, 20 aa, Cryptosporidium hominis
GTLKIFYLYARWTLYFNTQV

SEQ ID NO: 2129156 - protein, 17 aa, Cryptosporidium hominis
GVLLARSLPAWDWKSPS

SEQ ID NO: 2129157 - protein, 24 aa, Cryptosporidium hominis
HEIEKRLGIVIARDEVMSMVYIML

SEQ ID NO: 2129158 - protein, 20 aa, Cryptosporidium hominis
HFFLHIAFCISQQFIHRSKK

SEQ ID NO: 2129159 - protein, 17 aa, Cryptosporidium hominis
HHCPWLGVCIGEYNRCK

SEQ ID NO: 2129160 - protein, 20 aa, Cryptosporidium hominis
HLPWRFLVYKALNTFIDDIF

SEQ ID NO: 2129161 - protein, 31 aa, Cryptosporidium hominis
HNNEYKCYTNPMGIDCFCYNDQSIYNHIQNN

SEQ ID NO: 2129162 - protein, 20 aa, Cryptosporidium hominis
HSDFTWRLNSIMQRNLSDSI

SEQ ID NO: 2129163 - protein, 20 aa, Cryptosporidium hominis
HSLFALSIIWYLSFNPKYIF

SEQ ID NO: 2129164 - protein, 18 aa, Cryptosporidium hominis
IAALPLTFISFFTHYSAA

SEQ ID NO: 2129165 - protein, 21 aa, Cryptosporidium hominis
IAIKHGFDLIPIYIAGAKDGT

SEQ ID NO: 2129166 - protein, 18 aa, Cryptosporidium hominis
IAITCRWIKSTANASIRP

SEQ ID NO: 2129167 - protein, 20 aa, Cryptosporidium hominis
IALIPRYAKRFGFKSRRDEV

SEQ ID NO: 2129168 - protein, 17 aa, Cryptosporidium hominis
IATFVFLLFCIFFALSA

SEQ ID NO: 2129169 - protein, 17 aa, Cryptosporidium hominis
IATYYSYIINDWNDQID

SEQ ID NO: 2129170 - protein, 25 aa, Cryptosporidium hominis
ICDESFCIKSLFGIRTTESMITIEN

SEQ ID NO: 2129171 - protein, 20 aa, Cryptosporidium hominis
ICIPSAFLIRPIWILENSLD

SEQ ID NO: 2129172 - protein, 20 aa, Cryptosporidium hominis
ICLAFFKWTYLVRRDERMNL

SEQ ID NO: 2129173 - protein, 18 aa, Cryptosporidium hominis
IDCFFSFFRHILLNHPHN

SEQ ID NO: 2129174 - protein, 17 aa, Cryptosporidium hominis
IDILKLWSIGSESTILS

SEQ ID NO: 2129175 - protein, 17 aa, Cryptosporidium hominis
IDITGKETIVWYDAIAG

SEQ ID NO: 2129176 - protein, 25 aa, Cryptosporidium hominis
IDSLFSLKHSFLWPHNNATLISAIS

SEQ ID NO: 2129177 - protein, 23 aa, Cryptosporidium hominis
IEDCLKLNFKGSLIFQSIESNKV

SEQ ID NO: 2129178 - protein, 17 aa, Cryptosporidium hominis
IEDFEHWFISNKCPYFI

SEQ ID NO: 2129179 - protein, 21 aa, Cryptosporidium hominis
IEDFSKLLLCFEINVEDLFYN

SEQ ID NO: 2129180 - protein, 20 aa, Cryptosporidium hominis
IEEFEIFKSSFLGLGKKFLN

SEQ ID NO: 2129181 - protein, 20 aa, Cryptosporidium hominis
IEFVIKINLLYGLRNNVFGS

SEQ ID NO: 2129182 - protein, 23 aa, Cryptosporidium hominis
IEFWARDRPDLISAPSLGLDPDS

SEQ ID NO: 2129183 - protein, 21 aa, Cryptosporidium hominis
IEIKVRNAGLIIDDNNSNSNN

SEQ ID NO: 2129184 - protein, 17 aa, Cryptosporidium hominis
IEILVFFAFKKNYHSIF

SEQ ID NO: 2129185 - protein, 19 aa, Cryptosporidium hominis
IEKRICLLDIALIQKHLLA

SEQ ID NO: 2129186 - protein, 19 aa, Cryptosporidium hominis
IENALRLSQAWDFVNSFRD

SEQ ID NO: 2129187 - protein, 18 aa, Cryptosporidium hominis
IEPFKGSLGWGFYLLLLA

SEQ ID NO: 2129188 - protein, 18 aa, Cryptosporidium hominis
IFCELFSFIFLKFHSFWM

SEQ ID NO: 2129189 - protein, 17 aa, Cryptosporidium hominis
IFDYPLTCELLRGLPHS

SEQ ID NO: 2129190 - protein, 22 aa, Cryptosporidium hominis
IFEAICVLSVLIISMYTSLGVF

SEQ ID NO: 2129191 - protein, 17 aa, Cryptosporidium hominis
IFFAMAITLPCFLIIWC

SEQ ID NO: 2129192 - protein, 18 aa, Cryptosporidium hominis
IFFLNSMICFYRCSGSFL

SEQ ID NO: 2129193 - protein, 19 aa, Cryptosporidium hominis
IFLFSCSLCSIVFTQTVSN

SEQ ID NO: 2129194 - protein, 21 aa, Cryptosporidium hominis
IFPSKCLFKLFPIIMQSVGQL

SEQ ID NO: 2129195 - protein, 21 aa, Cryptosporidium hominis
IFVSRLSKIYIILTLTISSLS

SEQ ID NO: 2129196 - protein, 24 aa, Cryptosporidium hominis
IFYLLFKDCRGIVLSSFDHYKINK

SEQ ID NO: 2129197 - protein, 23 aa, Cryptosporidium hominis
IGLNRLGGFIGFMSLIVLVIIVI

SEQ ID NO: 2129198 - protein, 17 aa, Cryptosporidium hominis
IGMMQGIPQHMGGAGQG

SEQ ID NO: 2129199 - protein, 24 aa, Cryptosporidium hominis
IGNAKLWWRYAIGCIIRDRRADIS

SEQ ID NO: 2129200 - protein, 17 aa, Cryptosporidium hominis
IGRWDLLDIFNKNLLII

SEQ ID NO: 2129201 - protein, 23 aa, Cryptosporidium hominis
IGYRCFIEAGMLRSFVFSILPSN

SEQ ID NO: 2129202 - protein, 25 aa, Cryptosporidium hominis
IHCIQARIAILSGIIWGLGIVFAGK

SEQ ID NO: 2129203 - protein, 18 aa, Cryptosporidium hominis
IHSNWGYFRSIFITSDGI

SEQ ID NO: 2129204 - protein, 19 aa, Cryptosporidium hominis
IHVVYCLLCEAPLVEIFQQ

SEQ ID NO: 2129205 - protein, 17 aa, Cryptosporidium hominis
IHYLKRRINMLSTTKRY

SEQ ID NO: 2129206 - protein, 17 aa, Cryptosporidium hominis
IICCMIGFFLINSLGNF

SEQ ID NO: 2129207 - protein, 19 aa, Cryptosporidium hominis
IIDMPWMHRMACFRDDIIF

SEQ ID NO: 2129208 - protein, 24 aa, Cryptosporidium hominis
IIDYEIIDRGPFDLKHGLRRFYKK

SEQ ID NO: 2129209 - protein, 18 aa, Cryptosporidium hominis
IIFCLVYFFIYGRFVYSF

SEQ ID NO: 2129210 - protein, 17 aa, Cryptosporidium hominis
IIFYLGLRFIKNEKVRA

SEQ ID NO: 2129211 - protein, 19 aa, Cryptosporidium hominis
IIGGFCFCGATGANRNHGN

SEQ ID NO: 2129212 - protein, 18 aa, Cryptosporidium hominis
IIIMCLRHIITLYTLSRF

SEQ ID NO: 2129213 - protein, 22 aa, Cryptosporidium hominis
IIISELCYLNFPGFSQNSKLTI

SEQ ID NO: 2129214 - protein, 22 aa, Cryptosporidium hominis
IIKDVYIKWIWNDSDSANNNCS

SEQ ID NO: 2129215 - protein, 19 aa, Cryptosporidium hominis
IILRLSCAISPSWLQVLYH

SEQ ID NO: 2129216 - protein, 21 aa, Cryptosporidium hominis
IITCLFSYFSIQIVYSLYLVQ

SEQ ID NO: 2129217 - protein, 17 aa, Cryptosporidium hominis
IIVWLKLIVRFQNIYMK

SEQ ID NO: 2129218 - protein, 20 aa, Cryptosporidium hominis
IKELPFMLAIEPPNTNCVPI

SEQ ID NO: 2129219 - protein, 17 aa, Cryptosporidium hominis
IKGFKMVKYRGKYGPGH

SEQ ID NO: 2129220 - protein, 26 aa, Cryptosporidium hominis
IKKGNFLLEWLREMKTFIPSNHFVFD

SEQ ID NO: 2129221 - protein, 20 aa, Cryptosporidium hominis
IKNNPGEFIINNYKLGKNRN

SEQ ID NO: 2129222 - protein, 21 aa, Cryptosporidium hominis
IKPLLIRWIIFVIRLHKFSGL

SEQ ID NO: 2129223 - protein, 17 aa, Cryptosporidium hominis
ILFCYYCEQPLCQTYFE

SEQ ID NO: 2129224 - protein, 17 aa, Cryptosporidium hominis
ILFKLNIGFLFLSIILF

SEQ ID NO: 2129225 - protein, 18 aa, Cryptosporidium hominis
ILHICVFTGPIISSLTAL

SEQ ID NO: 2129226 - protein, 17 aa, Cryptosporidium hominis
ILIDLGYFYYLYMLCLT

SEQ ID NO: 2129227 - protein, 18 aa, Cryptosporidium hominis
ILIGFIFIIGILGAFFYL

SEQ ID NO: 2129228 - protein, 18 aa, Cryptosporidium hominis
ILIYKIHSNWGYFRSIFI

SEQ ID NO: 2129229 - protein, 20 aa, Cryptosporidium hominis
ILKKDSFMLLSFVPIPTTAI

SEQ ID NO: 2129230 - protein, 21 aa, Cryptosporidium hominis
ILKSLRPSLDFGENTSHHIPI

SEQ ID NO: 2129231 - protein, 22 aa, Cryptosporidium hominis
ILLEAFTSWSLVLFSIIICAFL

SEQ ID NO: 2129232 - protein, 17 aa, Cryptosporidium hominis
ILLPCRIFVASLLMYRN

SEQ ID NO: 2129233 - protein, 18 aa, Cryptosporidium hominis
ILNMLRFIAIINPELSSS

SEQ ID NO: 2129234 - protein, 22 aa, Cryptosporidium hominis
ILRYRPDFRIHLAEFFRVPINF

SEQ ID NO: 2129235 - protein, 18 aa, Cryptosporidium hominis
ILSCFCLHYLWKYFEKEF

SEQ ID NO: 2129236 - protein, 18 aa, Cryptosporidium hominis
ILSLGWRGPFYIFGLIGV

SEQ ID NO: 2129237 - protein, 22 aa, Cryptosporidium hominis
IMGLCIFVRLFAVVRYEAIIHE

SEQ ID NO: 2129238 - protein, 19 aa, Cryptosporidium hominis
IMPFSWRIEFVIICLTTMF

SEQ ID NO: 2129239 - protein, 18 aa, Cryptosporidium hominis
IMRGFSILIHHILVRSYN

SEQ ID NO: 2129240 - protein, 25 aa, Cryptosporidium hominis
INEIFIQWNILRAGLKYILHQIKNN

SEQ ID NO: 2129241 - protein, 19 aa, Cryptosporidium hominis
INFLPFIFRNIASYIVMNS

SEQ ID NO: 2129242 - protein, 19 aa, Cryptosporidium hominis
INFWERFCNFLRKSINKKF

SEQ ID NO: 2129243 - protein, 17 aa, Cryptosporidium hominis
INIIGIFNVWNFKKNSP

SEQ ID NO: 2129244 - protein, 22 aa, Cryptosporidium hominis
INIKAWFFWIVYSFLVFIIYFS

SEQ ID NO: 2129245 - protein, 23 aa, Cryptosporidium hominis
INLKKYFRFTAIELTDFSRFLVL

SEQ ID NO: 2129246 - protein, 24 aa, Cryptosporidium hominis
INRFGIVAVPSFRFFRNGKMYTYT

SEQ ID NO: 2129247 - protein, 20 aa, Cryptosporidium hominis
IPAYCLRPLCQHILPSFHDA

SEQ ID NO: 2129248 - protein, 20 aa, Cryptosporidium hominis
IPCLEWTSTMSYTFTPYFFD

SEQ ID NO: 2129249 - protein, 22 aa, Cryptosporidium hominis
IPELRTGPLFTYIAPLLLVLSI

SEQ ID NO: 2129250 - protein, 17 aa, Cryptosporidium hominis
IPFRMILVITMLTRTMG

SEQ ID NO: 2129251 - protein, 24 aa, Cryptosporidium hominis
IPGLKRINPVFVDRFILYSFISIE

SEQ ID NO: 2129252 - protein, 21 aa, Cryptosporidium hominis
IPLRWISFFLFKWRLELDESF

SEQ ID NO: 2129253 - protein, 27 aa, Cryptosporidium hominis
IPNPLLFLRCLCGWLLIQSIIKEFEQN

SEQ ID NO: 2129254 - protein, 22 aa, Cryptosporidium hominis
IPPICLFAWFWLFQYYRHASRE

SEQ ID NO: 2129255 - protein, 21 aa, Cryptosporidium hominis
IPRSRFDMVMISLFWAIITFG

SEQ ID NO: 2129256 - protein, 18 aa, Cryptosporidium hominis
IQILESFLGYSLDYIISK

SEQ ID NO: 2129257 - protein, 18 aa, Cryptosporidium hominis
IRIMPNFNKRYIISSTLL

SEQ ID NO: 2129258 - protein, 17 aa, Cryptosporidium hominis
IRISPRWIINNDVRQSR

SEQ ID NO: 2129259 - protein, 18 aa, Cryptosporidium hominis
IRIYELWKGTPMDIRQIL

SEQ ID NO: 2129260 - protein, 17 aa, Cryptosporidium hominis
IRKGRIESIGYFKPLKV

SEQ ID NO: 2129261 - protein, 17 aa, Cryptosporidium hominis
IRLVGSVWLHFSVQLLD

SEQ ID NO: 2129262 - protein, 18 aa, Cryptosporidium hominis
IRNFCLFSAASIIFTYLY

SEQ ID NO: 2129263 - protein, 17 aa, Cryptosporidium hominis
IRSWEFLVDFEMEDEVL

SEQ ID NO: 2129264 - protein, 22 aa, Cryptosporidium hominis
IRYMFCKGLQYPTSGWLRLNHL

SEQ ID NO: 2129265 - protein, 22 aa, Cryptosporidium hominis
ISAHIGSLLAWLFQNMAQHVEQ

SEQ ID NO: 2129266 - protein, 19 aa, Cryptosporidium hominis
ISCESCLRSLRQDKCPLCR

SEQ ID NO: 2129267 - protein, 20 aa, Cryptosporidium hominis
ISEIYLRYLYACRIILYSKN

SEQ ID NO: 2129268 - protein, 17 aa, Cryptosporidium hominis
ISGLTCMGFLFANFRLR

SEQ ID NO: 2129269 - protein, 21 aa, Cryptosporidium hominis
ISLWPDYFFKVLFSEWLQVDD

SEQ ID NO: 2129270 - protein, 17 aa, Cryptosporidium hominis
ISMGFEFSVLVLYLLEG

SEQ ID NO: 2129271 - protein, 17 aa, Cryptosporidium hominis
ISNEVVHRFLPWDSLNE

SEQ ID NO: 2129272 - protein, 17 aa, Cryptosporidium hominis
ISNVFSRIFLSYYNLCK

SEQ ID NO: 2129273 - protein, 18 aa, Cryptosporidium hominis
ITCSLLSLRSMEFLISIL

SEQ ID NO: 2129274 - protein, 19 aa, Cryptosporidium hominis
ITMIKLRFKYIFDPINRKI

SEQ ID NO: 2129275 - protein, 18 aa, Cryptosporidium hominis
ITVLMQFLSCIAPIGYGM

SEQ ID NO: 2129276 - protein, 18 aa, Cryptosporidium hominis
IVIQCYFRRYLCKKYLYF

SEQ ID NO: 2129277 - protein, 27 aa, Cryptosporidium hominis
IVKNIKENIPFKHILLPFTTTTTTVTT

SEQ ID NO: 2129278 - protein, 19 aa, Cryptosporidium hominis
IVSDLFSPIGMNWISTVSP

SEQ ID NO: 2129279 - protein, 18 aa, Cryptosporidium hominis
IVYLLPLWFDLMRLPDKI

SEQ ID NO: 2129280 - protein, 17 aa, Cryptosporidium hominis
IWILYCISICLFKADLN

SEQ ID NO: 2129281 - protein, 24 aa, Cryptosporidium hominis
IYIIFCFICALAVLIVINNEEAKY

SEQ ID NO: 2129282 - protein, 17 aa, Cryptosporidium hominis
IYKFKWVLIYLILFIFS

SEQ ID NO: 2129283 - protein, 18 aa, Cryptosporidium hominis
IYTLFIHILGLRCMVPVS

SEQ ID NO: 2129284 - protein, 17 aa, Cryptosporidium hominis
KCIYKNPFFYSFFPINS

SEQ ID NO: 2129285 - protein, 18 aa, Cryptosporidium hominis
KCKIKNGCCCTSDSEENE

SEQ ID NO: 2129286 - protein, 20 aa, Cryptosporidium hominis
KCLPFSCLFILQILVALATI

SEQ ID NO: 2129287 - protein, 30 aa, Cryptosporidium hominis
KCNLPNGKLKGIIFDLSIIKNILIDYPTYN

SEQ ID NO: 2129288 - protein, 23 aa, Cryptosporidium hominis
KDFLLKFVNICFTNVIGSLLFRR

SEQ ID NO: 2129289 - protein, 21 aa, Cryptosporidium hominis
KDGGLPCIVWLLLAIVHCSVN

SEQ ID NO: 2129290 - protein, 17 aa, Cryptosporidium hominis
KDYPNGLALELSLTKLP

SEQ ID NO: 2129291 - protein, 18 aa, Cryptosporidium hominis
KEALERCLLLIENGNDYI

SEQ ID NO: 2129292 - protein, 21 aa, Cryptosporidium hominis
KEARSAILLGLRVNKSSLILW

SEQ ID NO: 2129293 - protein, 20 aa, Cryptosporidium hominis
KELNCGLVLDSLEVRSIPNL

SEQ ID NO: 2129294 - protein, 17 aa, Cryptosporidium hominis
KELRWNFYWCIMTLLCL

SEQ ID NO: 2129295 - protein, 20 aa, Cryptosporidium hominis
KEMLRISGIITVGVVRTIGN

SEQ ID NO: 2129296 - protein, 19 aa, Cryptosporidium hominis
KFANCFISSFSGPFMLFYS

SEQ ID NO: 2129297 - protein, 19 aa, Cryptosporidium hominis
KFLISSKCMEMFILNLQFQ

SEQ ID NO: 2129298 - protein, 19 aa, Cryptosporidium hominis
KFPIKFPLAMYKINIENFG

SEQ ID NO: 2129299 - protein, 18 aa, Cryptosporidium hominis
KFRIRAMFANRQLKRIFH

SEQ ID NO: 2129300 - protein, 23 aa, Cryptosporidium hominis
KFRPQIMPIILKWSKGESFASIL

SEQ ID NO: 2129301 - protein, 17 aa, Cryptosporidium hominis
KFSIGFYAAIFVALLPI

SEQ ID NO: 2129302 - protein, 35 aa, Cryptosporidium hominis
KGIKLASRCPIWFEYFCLILWRLLPIFEQSIPVSE

SEQ ID NO: 2129303 - protein, 22 aa, Cryptosporidium hominis
KGKEIFSSYGFLIVERYKYFSR

SEQ ID NO: 2129304 - protein, 18 aa, Cryptosporidium hominis
KGVIPIHLACKIQDFDIL

SEQ ID NO: 2129305 - protein, 33 aa, Cryptosporidium hominis
KHGLRRFYKKHFRKSNSLPIFSNYHILQSLLII

SEQ ID NO: 2129306 - protein, 20 aa, Cryptosporidium hominis
KHNVCITCSLLSLRSMEFLI

SEQ ID NO: 2129307 - protein, 17 aa, Cryptosporidium hominis
KIFILSRRFPFFSIKDD

SEQ ID NO: 2129308 - protein, 19 aa, Cryptosporidium hominis
KIKVVKLMPIWSIRNKSNF

SEQ ID NO: 2129309 - protein, 19 aa, Cryptosporidium hominis
KILFKREKFSLLYSFTSGI

SEQ ID NO: 2129310 - protein, 19 aa, Cryptosporidium hominis
KINTIWAILRVQFLVLLLF

SEQ ID NO: 2129311 - protein, 21 aa, Cryptosporidium hominis
KKFNFCKSFPLFFYPLSIIMQ

SEQ ID NO: 2129312 - protein, 17 aa, Cryptosporidium hominis
KKIEDFAPFAFFTTSKG

SEQ ID NO: 2129313 - protein, 18 aa, Cryptosporidium hominis
KKNKCEIIYSFKVKNSIN

SEQ ID NO: 2129314 - protein, 18 aa, Cryptosporidium hominis
KKREEIYIIHPLLKSISL

SEQ ID NO: 2129315 - protein, 20 aa, Cryptosporidium hominis
KLELCGGCIEHFILAFQMIS

SEQ ID NO: 2129316 - protein, 18 aa, Cryptosporidium hominis
KLFLPDWSPLGGFLLVIV

SEQ ID NO: 2129317 - protein, 20 aa, Cryptosporidium hominis
KLGLNIQLFWFLRLNSLKFD

SEQ ID NO: 2129318 - protein, 19 aa, Cryptosporidium hominis
KLKKGDCVLIHVASGGVGL

SEQ ID NO: 2129319 - protein, 17 aa, Cryptosporidium hominis
KLLEISLIFAGIVTGIL

SEQ ID NO: 2129320 - protein, 24 aa, Cryptosporidium hominis
KLRSTMKWMACIEISLAVCSCCFA

SEQ ID NO: 2129321 - protein, 24 aa, Cryptosporidium hominis
KLSLPELLRLLIIMIESWDELVII

SEQ ID NO: 2129322 - protein, 24 aa, Cryptosporidium hominis
KLWITFILLCFFSVWISILESGIL

SEQ ID NO: 2129323 - protein, 17 aa, Cryptosporidium hominis
KLYKILRKMLIKFYIEE

SEQ ID NO: 2129324 - protein, 20 aa, Cryptosporidium hominis
KMVKYRGKYGPGHFVSMDDI

SEQ ID NO: 2129325 - protein, 17 aa, Cryptosporidium hominis
KNGMIGIDIDKEYIDDK

SEQ ID NO: 2129326 - protein, 25 aa, Cryptosporidium hominis
KNSMLYKWGIEYDKPYLIALPHIFK

SEQ ID NO: 2129327 - protein, 20 aa, Cryptosporidium hominis
KPDFFYAFNSMPGWIQNRFI

SEQ ID NO: 2129328 - protein, 23 aa, Cryptosporidium hominis
KPFLKRVNSIYSMSALILLAPTP

SEQ ID NO: 2129329 - protein, 18 aa, Cryptosporidium hominis
KPITRWILPSGFEPQYFQ

SEQ ID NO: 2129330 - protein, 17 aa, Cryptosporidium hominis
KRFLGFCVNGIKEIHGS

SEQ ID NO: 2129331 - protein, 23 aa, Cryptosporidium hominis
KRGFLNTILFKWLSPIINSAEKG

SEQ ID NO: 2129332 - protein, 18 aa, Cryptosporidium hominis
KRGWKLILHRFVWEYKLS

SEQ ID NO: 2129333 - protein, 22 aa, Cryptosporidium hominis
KRGYCILFMRLLEIPGESVPIS

SEQ ID NO: 2129334 - protein, 33 aa, Cryptosporidium hominis
KRLTSEFPWFTSAWLRRACLALERNDYQLAAQY

SEQ ID NO: 2129335 - protein, 19 aa, Cryptosporidium hominis
KRRVIDLIMEFPRSKSSIL

SEQ ID NO: 2129336 - protein, 18 aa, Cryptosporidium hominis
KRRVIFHANIVWSPKQIY

SEQ ID NO: 2129337 - protein, 25 aa, Cryptosporidium hominis
KRTVNIKRLWEFGRLYNELNKNSES

SEQ ID NO: 2129338 - protein, 22 aa, Cryptosporidium hominis
KSAAEVFLAFDIVKILRTTISE

SEQ ID NO: 2129339 - protein, 22 aa, Cryptosporidium hominis
KSGFIFFQWYFWYCLESRRYPS

SEQ ID NO: 2129340 - protein, 18 aa, Cryptosporidium hominis
KSKECPFCKNTIETLFFT

SEQ ID NO: 2129341 - protein, 17 aa, Cryptosporidium hominis
KSSKCGLNARFSSDEYD

SEQ ID NO: 2129342 - protein, 24 aa, Cryptosporidium hominis
KSTFSWKIMSIFSFLKLKKPKYAP

SEQ ID NO: 2129343 - protein, 19 aa, Cryptosporidium hominis
KTIKCIFIYMIFALLLRKL

SEQ ID NO: 2129344 - protein, 23 aa, Cryptosporidium hominis
KVLYCLYSLLGIAFILFKLGTMG

SEQ ID NO: 2129345 - protein, 20 aa, Cryptosporidium hominis
KVNLLVALLICFLLCDTVLT

SEQ ID NO: 2129346 - protein, 19 aa, Cryptosporidium hominis
KWYLPQMFLEFSIYNENVD

SEQ ID NO: 2129347 - protein, 26 aa, Cryptosporidium hominis
KYDVPDWYKHICIIYASLKEKNRILF

SEQ ID NO: 2129348 - protein, 22 aa, Cryptosporidium hominis
KYLNEIVHAFVLIQKGFYRSAK

SEQ ID NO: 2129349 - protein, 17 aa, Cryptosporidium hominis
KYLTFLLNELLKLFQLF

SEQ ID NO: 2129350 - protein, 18 aa, Cryptosporidium hominis
KYRGCYVKGILQPSRAIG

SEQ ID NO: 2129351 - protein, 17 aa, Cryptosporidium hominis
LAAYLLLCFVIGNGLGP

SEQ ID NO: 2129352 - protein, 21 aa, Cryptosporidium hominis
LAFSKSRFNGFSKWLQEDLAS

SEQ ID NO: 2129353 - protein, 23 aa, Cryptosporidium hominis
LAICLSRATGLWSHLDTVERLAS

SEQ ID NO: 2129354 - protein, 24 aa, Cryptosporidium hominis
LASIKPILARKGSKIVHMSQKSIS

SEQ ID NO: 2129355 - protein, 17 aa, Cryptosporidium hominis
LASILLPLIKKYRVDFI

SEQ ID NO: 2129356 - protein, 20 aa, Cryptosporidium hominis
LCIFSLNNLRAFKEINNNDT

SEQ ID NO: 2129357 - protein, 18 aa, Cryptosporidium hominis
LCKVWLLSPFNALDVLLT

SEQ ID NO: 2129358 - protein, 19 aa, Cryptosporidium hominis
LCTLPFPGNDNWLLRRAFL

SEQ ID NO: 2129359 - protein, 21 aa, Cryptosporidium hominis
LDAWFKMRIKILLTIPITLIN

SEQ ID NO: 2129360 - protein, 23 aa, Cryptosporidium hominis
LDCLRLPVCYSFTTLNTRQQLFF

SEQ ID NO: 2129361 - protein, 19 aa, Cryptosporidium hominis
LDMEGRFVLISAITNFLGY

SEQ ID NO: 2129362 - protein, 18 aa, Cryptosporidium hominis
LDYGIKPWFLFSVSSVNS

SEQ ID NO: 2129363 - protein, 22 aa, Cryptosporidium hominis
LEAYSNFKWVFAIFVLKPSILF

SEQ ID NO: 2129364 - protein, 17 aa, Cryptosporidium hominis
LEFLSGIAYVPIKVDFP

SEQ ID NO: 2129365 - protein, 19 aa, Cryptosporidium hominis
LEFSNWLLTNWVFRTISNL

SEQ ID NO: 2129366 - protein, 17 aa, Cryptosporidium hominis
LEILDLLDLFGLVDKKK

SEQ ID NO: 2129367 - protein, 21 aa, Cryptosporidium hominis
LEIRTPFYLFILHTLRQHGVE

SEQ ID NO: 2129368 - protein, 22 aa, Cryptosporidium hominis
LEKLEPRASISLAKTKTKATGW

SEQ ID NO: 2129369 - protein, 17 aa, Cryptosporidium hominis
LEPRIQLILSEQRQISQ

SEQ ID NO: 2129370 - protein, 17 aa, Cryptosporidium hominis
LERCLQMLISRSVGKGS

SEQ ID NO: 2129371 - protein, 17 aa, Cryptosporidium hominis
LFIERFWLLNPFHFSIN

SEQ ID NO: 2129372 - protein, 17 aa, Cryptosporidium hominis
LFKEMKSPIVGVGDICF

SEQ ID NO: 2129373 - protein, 18 aa, Cryptosporidium hominis
LFSLWLFVQKRLTTIQIA

SEQ ID NO: 2129374 - protein, 19 aa, Cryptosporidium hominis
LFSVCAIRFHAEWLDIVKF

SEQ ID NO: 2129375 - protein, 23 aa, Cryptosporidium hominis
LHEIRGSSFITVWNMKISKENAN

SEQ ID NO: 2129376 - protein, 17 aa, Cryptosporidium hominis
LIEPGGLICKPLVEDYY

SEQ ID NO: 2129377 - protein, 23 aa, Cryptosporidium hominis
LIFEILKGLIILLFFVKQRKRLC

SEQ ID NO: 2129378 - protein, 17 aa, Cryptosporidium hominis
LIFPFFLSWTVVGTVWL

SEQ ID NO: 2129379 - protein, 19 aa, Cryptosporidium hominis
LILKSFYILHIWKVKDPSL

SEQ ID NO: 2129380 - protein, 18 aa, Cryptosporidium hominis
LILQELLCLFKRSTSPYI

SEQ ID NO: 2129381 - protein, 20 aa, Cryptosporidium hominis
LISKAVMFSSLFVRKLNESS

SEQ ID NO: 2129382 - protein, 18 aa, Cryptosporidium hominis
LKCKPFRWFLDNVAPETY

SEQ ID NO: 2129383 - protein, 17 aa, Cryptosporidium hominis
LKELSAMFWNNKYIGDF

SEQ ID NO: 2129384 - protein, 26 aa, Cryptosporidium hominis
LKLKKCFKVFLSVCGTSLSAIFGFFK

SEQ ID NO: 2129385 - protein, 21 aa, Cryptosporidium hominis
LKQYRFFSIYALKCLKNQVNL

SEQ ID NO: 2129386 - protein, 17 aa, Cryptosporidium hominis
LKSAFLMKEESLNCDKT

SEQ ID NO: 2129387 - protein, 20 aa, Cryptosporidium hominis
LKSSHFWKGGGYWLAGSGGL

SEQ ID NO: 2129388 - protein, 22 aa, Cryptosporidium hominis
LKVASLCPACFCRPLSGIQKLV

SEQ ID NO: 2129389 - protein, 20 aa, Cryptosporidium hominis
LKVRLLKPFYSWRATAAHGV

SEQ ID NO: 2129390 - protein, 18 aa, Cryptosporidium hominis
LKWKTEFPSVISRQHLIS

SEQ ID NO: 2129391 - protein, 19 aa, Cryptosporidium hominis
LKWSWTIALLILCYSKTMF

SEQ ID NO: 2129392 - protein, 19 aa, Cryptosporidium hominis
LKYVIGMLLGVFFGIWILS

SEQ ID NO: 2129393 - protein, 17 aa, Cryptosporidium hominis
LLAIISIRFLVKCCQGK

SEQ ID NO: 2129394 - protein, 17 aa, Cryptosporidium hominis
LLCLFKRSTSPYISTEQ

SEQ ID NO: 2129395 - protein, 22 aa, Cryptosporidium hominis
LLEIRIGFRAARYFHNSLLLGY

SEQ ID NO: 2129396 - protein, 26 aa, Cryptosporidium hominis
LLILLILMFCCVFFLRRRSDDTESAQ

SEQ ID NO: 2129397 - protein, 18 aa, Cryptosporidium hominis
LLKICIVVAFITIPVMLY

SEQ ID NO: 2129398 - protein, 18 aa, Cryptosporidium hominis
LLLSFGLVAIQVYYIKSY

SEQ ID NO: 2129399 - protein, 18 aa, Cryptosporidium hominis
LLMNCIMYLLSHYYRKVS

SEQ ID NO: 2129400 - protein, 25 aa, Cryptosporidium hominis
LLSLIAFEWIKRNTLVFSEIKLVDK

SEQ ID NO: 2129401 - protein, 23 aa, Cryptosporidium hominis
LLTFKILFCIGTKQIFPIGCPLN

SEQ ID NO: 2129402 - protein, 28 aa, Cryptosporidium hominis
LMGIFRFKLCYVWKFSILNSYCLPLIND

SEQ ID NO: 2129403 - protein, 17 aa, Cryptosporidium hominis
LMGLRISCYKCDNQAVK

SEQ ID NO: 2129404 - protein, 21 aa, Cryptosporidium hominis
LNDRLKVILIYKHANKNYFSF

SEQ ID NO: 2129405 - protein, 17 aa, Cryptosporidium hominis
LNFTMMWLQYCGLSPLL

SEQ ID NO: 2129406 - protein, 20 aa, Cryptosporidium hominis
LNGTFCTRGFFIGSIINVHV

SEQ ID NO: 2129407 - protein, 22 aa, Cryptosporidium hominis
LNHIMLWFGLIIFWAITQIYGK

SEQ ID NO: 2129408 - protein, 17 aa, Cryptosporidium hominis
LNILNSYFLWEAGKRSK

SEQ ID NO: 2129409 - protein, 23 aa, Cryptosporidium hominis
LNNFWKVIIGFIMSVLSGISIPL

SEQ ID NO: 2129410 - protein, 24 aa, Cryptosporidium hominis
LNPEECKHENGLDIIDYEIIDRGP

SEQ ID NO: 2129411 - protein, 17 aa, Cryptosporidium hominis
LPAWDWKSPSILVSILR

SEQ ID NO: 2129412 - protein, 17 aa, Cryptosporidium hominis
LPESWRAYCLFIGENMM

SEQ ID NO: 2129413 - protein, 17 aa, Cryptosporidium hominis
LPEYAVRGVDNYADGFS

SEQ ID NO: 2129414 - protein, 17 aa, Cryptosporidium hominis
LPFYFACWFHFQYGKLI

SEQ ID NO: 2129415 - protein, 23 aa, Cryptosporidium hominis
LPGDDCIGGWLPPPVAIPCPSHA

SEQ ID NO: 2129416 - protein, 17 aa, Cryptosporidium hominis
LPILRIVILAVWDPGKL

SEQ ID NO: 2129417 - protein, 18 aa, Cryptosporidium hominis
LPLFLDRIIPSWVAVICS

SEQ ID NO: 2129418 - protein, 20 aa, Cryptosporidium hominis
LPMSICFVGLVAFGNICLKY

SEQ ID NO: 2129419 - protein, 17 aa, Cryptosporidium hominis
LPPLSLGCFEELSSPET

SEQ ID NO: 2129420 - protein, 20 aa, Cryptosporidium hominis
LPSFNCAFSILKKLSKIIRP

SEQ ID NO: 2129421 - protein, 19 aa, Cryptosporidium hominis
LPSSGRISDILSVDNLETT

SEQ ID NO: 2129422 - protein, 17 aa, Cryptosporidium hominis
LPSSMPWTPNSSSFHVP

SEQ ID NO: 2129423 - protein, 23 aa, Cryptosporidium hominis
LQDKSRFPLLRILRGKDYGPATK

SEQ ID NO: 2129424 - protein, 18 aa, Cryptosporidium hominis
LQVPHWFNFMAIESESQQ

SEQ ID NO: 2129425 - protein, 17 aa, Cryptosporidium hominis
LRFSLFGEISIPVFRDI

SEQ ID NO: 2129426 - protein, 22 aa, Cryptosporidium hominis
LRGFLLIKFIRWVITKDPFNNV

SEQ ID NO: 2129427 - protein, 19 aa, Cryptosporidium hominis
LRKEPRLVYRECWRGDYFR

SEQ ID NO: 2129428 - protein, 19 aa, Cryptosporidium hominis
LRLDQELRDTIDLIFQLLF

SEQ ID NO: 2129429 - protein, 19 aa, Cryptosporidium hominis
LRLPIKVKYGCIETINISI

SEQ ID NO: 2129430 - protein, 18 aa, Cryptosporidium hominis
LRNFCKNGSLQLLVNSLS

SEQ ID NO: 2129431 - protein, 25 aa, Cryptosporidium hominis
LRPIWLKIRIVYIIFAILLFFIIGA

SEQ ID NO: 2129432 - protein, 25 aa, Cryptosporidium hominis
LRQGEMIRMFWAMWMHTGFIHIGFN

SEQ ID NO: 2129433 - protein, 31 aa, Cryptosporidium hominis
LRQQMWLRRPRWFVYEIIPLIILFTKIFSSV

SEQ ID NO: 2129434 - protein, 30 aa, Cryptosporidium hominis
LRSIEAFALFFDWRFCIDLTGYLIKLLRLF

SEQ ID NO: 2129435 - protein, 21 aa, Cryptosporidium hominis
LRWNFYWCIMTLLCLIHFSSY

SEQ ID NO: 2129436 - protein, 17 aa, Cryptosporidium hominis
LRYIFLNSLKISTIAQF

SEQ ID NO: 2129437 - protein, 20 aa, Cryptosporidium hominis
LRYVDSIAFIIAWNASDAFV

SEQ ID NO: 2129438 - protein, 23 aa, Cryptosporidium hominis
LSIKYRIWISLALTIIILTLIAL

SEQ ID NO: 2129439 - protein, 24 aa, Cryptosporidium hominis
LSKVIAVICLIVWVINFRNFQDPA

SEQ ID NO: 2129440 - protein, 23 aa, Cryptosporidium hominis
LSLTRWFACFLLIFGVIMIPKKS

SEQ ID NO: 2129441 - protein, 19 aa, Cryptosporidium hominis
LSMRIGLHYGGCIGGIVGS

SEQ ID NO: 2129442 - protein, 17 aa, Cryptosporidium hominis
LSQAWDFVNSFRDGLET

SEQ ID NO: 2129443 - protein, 23 aa, Cryptosporidium hominis
LSSLFLKEGILIWILSKEIFAPV

SEQ ID NO: 2129444 - protein, 21 aa, Cryptosporidium hominis
LSSMFFICFSLVYGTKTESDV

SEQ ID NO: 2129445 - protein, 17 aa, Cryptosporidium hominis
LSSTFKIMLHIFDIQSD

SEQ ID NO: 2129446 - protein, 20 aa, Cryptosporidium hominis
LTLICSIGFIPGIPKWVDSA

SEQ ID NO: 2129447 - protein, 18 aa, Cryptosporidium hominis
LTLWEIMKQFYLINNLFF

SEQ ID NO: 2129448 - protein, 17 aa, Cryptosporidium hominis
LTMSFSYIFTSLAITCS

SEQ ID NO: 2129449 - protein, 17 aa, Cryptosporidium hominis
LVFIYSFLLIIYQFLDI

SEQ ID NO: 2129450 - protein, 24 aa, Cryptosporidium hominis
LVGFLLKYRFLRLINCNWTKLRPH

SEQ ID NO: 2129451 - protein, 21 aa, Cryptosporidium hominis
LVIASNFCWDCIKSSKGKVSD

SEQ ID NO: 2129452 - protein, 17 aa, Cryptosporidium hominis
LVIFYFVCYDLQKLDTV

SEQ ID NO: 2129453 - protein, 17 aa, Cryptosporidium hominis
LVIIFIFILVVCMFAGG

SEQ ID NO: 2129454 - protein, 24 aa, Cryptosporidium hominis
LVLRDCIYIVFSLIYYSKSRELDD

SEQ ID NO: 2129455 - protein, 19 aa, Cryptosporidium hominis
LYFYKCVFFPLSSSFTAAL

SEQ ID NO: 2129456 - protein, 18 aa, Cryptosporidium hominis
LYGPFWLNITLAMLIGTY

SEQ ID NO: 2129457 - protein, 17 aa, Cryptosporidium hominis
LYISNEVVHRFLPWDSL

SEQ ID NO: 2129458 - protein, 20 aa, Cryptosporidium hominis
LYLKLCFELLLSFEKHSWAV

SEQ ID NO: 2129459 - protein, 26 aa, Cryptosporidium hominis
LYLSIIKFCFKFGIFYILKSQLNKKQ

SEQ ID NO: 2129460 - protein, 17 aa, Cryptosporidium hominis
MAEYLGSIESCFEDEMF

SEQ ID NO: 2129461 - protein, 19 aa, Cryptosporidium hominis
MAHNNWLIFYPIRCLSSTF

SEQ ID NO: 2129462 - protein, 25 aa, Cryptosporidium hominis
MALKEHISNILGIHIQDIVIDEIYA

SEQ ID NO: 2129463 - protein, 23 aa, Cryptosporidium hominis
MFAWLRLRLDFLLPVALTSINVL

SEQ ID NO: 2129464 - protein, 20 aa, Cryptosporidium hominis
MFRICNFVSIFLEILIRGGF

SEQ ID NO: 2129465 - protein, 25 aa, Cryptosporidium hominis
MGCMFCATGSMGLRGSLLSGEILQQ

SEQ ID NO: 2129466 - protein, 18 aa, Cryptosporidium hominis
MIIIRLGVYSSIFYYKMV

SEQ ID NO: 2129467 - protein, 18 aa, Cryptosporidium hominis
MIKDRHFLGAYTIFGSLL

SEQ ID NO: 2129468 - protein, 17 aa, Cryptosporidium hominis
MKDPLIIGGEIRTISSR

SEQ ID NO: 2129469 - protein, 18 aa, Cryptosporidium hominis
MKPACFVSSIFSLIKISF

SEQ ID NO: 2129470 - protein, 19 aa, Cryptosporidium hominis
MKSPIVGVGDICFGNNCNY

SEQ ID NO: 2129471 - protein, 20 aa, Cryptosporidium hominis
MLIERWKWVLAIFAIHNIIG

SEQ ID NO: 2129472 - protein, 19 aa, Cryptosporidium hominis
MLMVCHWLLFDSIQCIITL

SEQ ID NO: 2129473 - protein, 17 aa, Cryptosporidium hominis
MLRMLLHLYSGMRTRTQ

SEQ ID NO: 2129474 - protein, 17 aa, Cryptosporidium hominis
MLTECRVLYSSNLEDLN

SEQ ID NO: 2129475 - protein, 17 aa, Cryptosporidium hominis
MNVRMRQVWGLYLEEEN

SEQ ID NO: 2129476 - protein, 19 aa, Cryptosporidium hominis
MSIIYLYIYWHIQFRAKNE

SEQ ID NO: 2129477 - protein, 20 aa, Cryptosporidium hominis
MSWLMLFCQLLSYGNSSNFN

SEQ ID NO: 2129478 - protein, 24 aa, Cryptosporidium hominis
MTICGNILRLGRIVAYISYCIGNY

SEQ ID NO: 2129479 - protein, 17 aa, Cryptosporidium hominis
MTNECKTIISCTNDITL

SEQ ID NO: 2129480 - protein, 20 aa, Cryptosporidium hominis
MVYSRFVFRHSIAVIIAVTL

SEQ ID NO: 2129481 - protein, 23 aa, Cryptosporidium hominis
MYFLSILVLFSWISIVIGGEGNL

SEQ ID NO: 2129482 - protein, 20 aa, Cryptosporidium hominis
NALVCAWTLFSLLIICTLKG

SEQ ID NO: 2129483 - protein, 19 aa, Cryptosporidium hominis
NASDAFVFSGIACWSHVNN

SEQ ID NO: 2129484 - protein, 20 aa, Cryptosporidium hominis
NCYRLLFFLIHVIRRLYEEV

SEQ ID NO: 2129485 - protein, 20 aa, Cryptosporidium hominis
NCYRRWKWKKRVKRRKMKKI

SEQ ID NO: 2129486 - protein, 21 aa, Cryptosporidium hominis
NDGGVCLPTLFSDLYIPLMGF

SEQ ID NO: 2129487 - protein, 24 aa, Cryptosporidium hominis
NDIWRIKLIISRLFKIDSTTHPNL

SEQ ID NO: 2129488 - protein, 18 aa, Cryptosporidium hominis
NDYLNSCLSFQCHRVREH

SEQ ID NO: 2129489 - protein, 24 aa, Cryptosporidium hominis
NEHNPFCQASLKTTNNIKFMCINN

SEQ ID NO: 2129490 - protein, 19 aa, Cryptosporidium hominis
NEILHPFFIFQVCAVCIWF

SEQ ID NO: 2129491 - protein, 17 aa, Cryptosporidium hominis
NEKEWFLYWSSIFGKLC

SEQ ID NO: 2129492 - protein, 18 aa, Cryptosporidium hominis
NEVVHRFLPWDSLNELMD

SEQ ID NO: 2129493 - protein, 19 aa, Cryptosporidium hominis
NFNDHWRKGAGILPLNMLY

SEQ ID NO: 2129494 - protein, 24 aa, Cryptosporidium hominis
NFNSRFSWIVGMSIFTSSIFGLSY

SEQ ID NO: 2129495 - protein, 18 aa, Cryptosporidium hominis
NFRIPRSRFDMVMISLFW

SEQ ID NO: 2129496 - protein, 20 aa, Cryptosporidium hominis
NIKLSFPIARSFERKLEASI

SEQ ID NO: 2129497 - protein, 23 aa, Cryptosporidium hominis
NIKTRFNWDLSLFQTEFGYVKNI

SEQ ID NO: 2129498 - protein, 21 aa, Cryptosporidium hominis
NINELWPFFYLNYNYTQKKLI

SEQ ID NO: 2129499 - protein, 18 aa, Cryptosporidium hominis
NIWITWKLLSKQVGLIAA

SEQ ID NO: 2129500 - protein, 25 aa, Cryptosporidium hominis
NKEMPRIPLLILIRANIGVIEDESI

SEQ ID NO: 2129501 - protein, 18 aa, Cryptosporidium hominis
NKLLPRREYKLFLFDLAR

SEQ ID NO: 2129502 - protein, 17 aa, Cryptosporidium hominis
NKWKVSSIWVIFTLENN

SEQ ID NO: 2129503 - protein, 19 aa, Cryptosporidium hominis
NLLEASFCRLPIRMLIHSA

SEQ ID NO: 2129504 - protein, 22 aa, Cryptosporidium hominis
NLRFTALSAFNWYLISMGFEFS

SEQ ID NO: 2129505 - protein, 23 aa, Cryptosporidium hominis
NLSFCFPEIDLSIAILTNDYVKG

SEQ ID NO: 2129506 - protein, 18 aa, Cryptosporidium hominis
NMFSLCIVCKLYTEISIC

SEQ ID NO: 2129507 - protein, 23 aa, Cryptosporidium hominis
NNGKSNWKSIVSTSTTTISTRED

SEQ ID NO: 2129508 - protein, 22 aa, Cryptosporidium hominis
NNVGVFKLCFKRRIINEEDSND

SEQ ID NO: 2129509 - protein, 19 aa, Cryptosporidium hominis
NPQCVPLTILENGCPMKQV

SEQ ID NO: 2129510 - protein, 22 aa, Cryptosporidium hominis
NQHGRLGYFKSIFRITKELKLF

SEQ ID NO: 2129511 - protein, 17 aa, Cryptosporidium hominis
NRFSLKMILQVALLGIM

SEQ ID NO: 2129512 - protein, 17 aa, Cryptosporidium hominis
NSIVYKLYWKLMLTCGV

SEQ ID NO: 2129513 - protein, 18 aa, Cryptosporidium hominis
NSLFLTMFCCIGGDSSVT

SEQ ID NO: 2129514 - protein, 22 aa, Cryptosporidium hominis
NSLWKRFICLFIICWSVIASTR

SEQ ID NO: 2129515 - protein, 22 aa, Cryptosporidium hominis
NSPEFFRLWTLLILCGLLSMLL

SEQ ID NO: 2129516 - protein, 17 aa, Cryptosporidium hominis
NSSRQTLMWLFISIIIM

SEQ ID NO: 2129517 - protein, 19 aa, Cryptosporidium hominis
NVLFLKLIFLFSCSLCSIV

SEQ ID NO: 2129518 - protein, 21 aa, Cryptosporidium hominis
PCMIFHYSVLFSYLVFILKTT

SEQ ID NO: 2129519 - protein, 21 aa, Cryptosporidium hominis
PDIQALFLLKICKTSYEINNR

SEQ ID NO: 2129520 - protein, 20 aa, Cryptosporidium hominis
PELYKRFLVSTGVYALFGTI

SEQ ID NO: 2129521 - protein, 23 aa, Cryptosporidium hominis
PFFSLKIFGIWSMNAVFHAAVSL

SEQ ID NO: 2129522 - protein, 24 aa, Cryptosporidium hominis
PFGELRLGLKIPYDNKVVSIFFDD

SEQ ID NO: 2129523 - protein, 20 aa, Cryptosporidium hominis
PGFRILWTVRIIYISSVFLS

SEQ ID NO: 2129524 - protein, 18 aa, Cryptosporidium hominis
PGLLRKASIYNILSKLYV

SEQ ID NO: 2129525 - protein, 22 aa, Cryptosporidium hominis
PGVLRLLVRLNMMYYYECRINT

SEQ ID NO: 2129526 - protein, 21 aa, Cryptosporidium hominis
PICQHNWRPIFITSLILSDKL

SEQ ID NO: 2129527 - protein, 18 aa, Cryptosporidium hominis
PIICIFGIILPSYVYALF

SEQ ID NO: 2129528 - protein, 18 aa, Cryptosporidium hominis
PIIDLWRILALHPQSSDI

SEQ ID NO: 2129529 - protein, 24 aa, Cryptosporidium hominis
PIIRWRCDRLYKRIHLDRLNELSD

SEQ ID NO: 2129530 - protein, 22 aa, Cryptosporidium hominis
PIKARELLLLFFINLGRTSAEE

SEQ ID NO: 2129531 - protein, 20 aa, Cryptosporidium hominis
PIRLTLKMIYELSVFANHSS

SEQ ID NO: 2129532 - protein, 21 aa, Cryptosporidium hominis
PKKIAEMIFEFHYLLEISLKY

SEQ ID NO: 2129533 - protein, 18 aa, Cryptosporidium hominis
PLAIKAFLGRLVFPELLE

SEQ ID NO: 2129534 - protein, 19 aa, Cryptosporidium hominis
PLLILRTYIWLHFPVFPGF

SEQ ID NO: 2129535 - protein, 19 aa, Cryptosporidium hominis
PLLSSWFGLEWTKNQLWSK

SEQ ID NO: 2129536 - protein, 20 aa, Cryptosporidium hominis
PLPCLGFLTSVFEGEVFPEY

SEQ ID NO: 2129537 - protein, 18 aa, Cryptosporidium hominis
PLVHCISLSYIPTCIVGL

SEQ ID NO: 2129538 - protein, 17 aa, Cryptosporidium hominis
PLVLRFDNNLTYEQPFC

SEQ ID NO: 2129539 - protein, 18 aa, Cryptosporidium hominis
PPETFLRNTTKYWVHPNN

SEQ ID NO: 2129540 - protein, 17 aa, Cryptosporidium hominis
PPPLRQIPMPSISVESL

SEQ ID NO: 2129541 - protein, 17 aa, Cryptosporidium hominis
PQMFLEFSIYNENVDSI

SEQ ID NO: 2129542 - protein, 21 aa, Cryptosporidium hominis
PRFLEFYNLIGVNIFAVSYRG

SEQ ID NO: 2129543 - protein, 23 aa, Cryptosporidium hominis
PRWIPKFFFLLNFRIPRSRFDMV

SEQ ID NO: 2129544 - protein, 22 aa, Cryptosporidium hominis
PSDLTFKIGLTYCLERLVYSEM

SEQ ID NO: 2129545 - protein, 24 aa, Cryptosporidium hominis
PSLKINSLRRLRGLSEDNSQDVEE

SEQ ID NO: 2129546 - protein, 17 aa, Cryptosporidium hominis
PSPPLPMSNSIKDFQKF

SEQ ID NO: 2129547 - protein, 20 aa, Cryptosporidium hominis
PTFQPRSGFVVGMGSGAGTG

SEQ ID NO: 2129548 - protein, 19 aa, Cryptosporidium hominis
PTNGNIVFKNVVFRYNPDE

SEQ ID NO: 2129549 - protein, 18 aa, Cryptosporidium hominis
PTYHIRRLLDIFTVLQLK

SEQ ID NO: 2129550 - protein, 18 aa, Cryptosporidium hominis
PVCELKCIIRDLQNRVQW

SEQ ID NO: 2129551 - protein, 23 aa, Cryptosporidium hominis
PVFICIPCLIWVWCSDHCLQILK

SEQ ID NO: 2129552 - protein, 17 aa, Cryptosporidium hominis
PVLQFIYRKCVELRFTV

SEQ ID NO: 2129553 - protein, 19 aa, Cryptosporidium hominis
PVYECIKLIITKFLLLILV

SEQ ID NO: 2129554 - protein, 17 aa, Cryptosporidium hominis
PWSILSLDISFKEKKKN

SEQ ID NO: 2129555 - protein, 23 aa, Cryptosporidium hominis
QAICSRYGLYIGGFFSPFIRLIQ

SEQ ID NO: 2129556 - protein, 22 aa, Cryptosporidium hominis
QCARFILLFVCNDFFTLFSKLY

SEQ ID NO: 2129557 - protein, 18 aa, Cryptosporidium hominis
QDLEAITAMLDRLCVNNI

SEQ ID NO: 2129558 - protein, 17 aa, Cryptosporidium hominis
QEFKSLVSFSIFYIWSL

SEQ ID NO: 2129559 - protein, 20 aa, Cryptosporidium hominis
QEGFWKKHFIYIGMNPPQIV

SEQ ID NO: 2129560 - protein, 17 aa, Cryptosporidium hominis
QELKIEYIVAILSSLLY

SEQ ID NO: 2129561 - protein, 19 aa, Cryptosporidium hominis
QELYRYGGLRTFWTGLLPT

SEQ ID NO: 2129562 - protein, 25 aa, Cryptosporidium hominis
QFFFSMCFWGLFSAVLGPLSQKIAS

SEQ ID NO: 2129563 - protein, 19 aa, Cryptosporidium hominis
QGGPRTHLMMLIFFGGNIL

SEQ ID NO: 2129564 - protein, 18 aa, Cryptosporidium hominis
QGIFLRFYIWAILWAIMI

SEQ ID NO: 2129565 - protein, 21 aa, Cryptosporidium hominis
QGVVYMCGFKSYTVEKDLIEL

SEQ ID NO: 2129566 - protein, 18 aa, Cryptosporidium hominis
QIFFAISILLSFPLMIFP

SEQ ID NO: 2129567 - protein, 22 aa, Cryptosporidium hominis
QLLTCLLGCFIFGNIVTDKLLL

SEQ ID NO: 2129568 - protein, 21 aa, Cryptosporidium hominis
QLRVVIWRVRHIPLEPNTTIS

SEQ ID NO: 2129569 - protein, 17 aa, Cryptosporidium hominis
QLSEIWKIITLDSGKCP

SEQ ID NO: 2129570 - protein, 23 aa, Cryptosporidium hominis
QPGEFKWEYGILSLCLINGDWLL

SEQ ID NO: 2129571 - protein, 23 aa, Cryptosporidium hominis
QPSLRPLVPLALDRSIREILQVV

SEQ ID NO: 2129572 - protein, 23 aa, Cryptosporidium hominis
QQELPRLIKIIIEVILFGMKPNN

SEQ ID NO: 2129573 - protein, 17 aa, Cryptosporidium hominis
QRARICLARALYSLPDY

SEQ ID NO: 2129574 - protein, 17 aa, Cryptosporidium hominis
QRFPPVILVFDIVEQGR

SEQ ID NO: 2129575 - protein, 22 aa, Cryptosporidium hominis
QRGFRSGYYWNICNSELRRVNQ

SEQ ID NO: 2129576 - protein, 18 aa, Cryptosporidium hominis
QSIFKFYLLESIGHQMAP

SEQ ID NO: 2129577 - protein, 18 aa, Cryptosporidium hominis
QSNPLLLNWKAFFPNIIF

SEQ ID NO: 2129578 - protein, 21 aa, Cryptosporidium hominis
QWFILICVVGFFLSMFGTFLI

SEQ ID NO: 2129579 - protein, 28 aa, Cryptosporidium hominis
QWHPKKRICVFHLLRLCLEHGLQDQTSI

SEQ ID NO: 2129580 - protein, 24 aa, Cryptosporidium hominis
QWSRKEFILEFAVRVCKKHFSWKD

SEQ ID NO: 2129581 - protein, 25 aa, Cryptosporidium hominis
QYALIWMTWCLWLLGSFLFSFGRVM

SEQ ID NO: 2129582 - protein, 19 aa, Cryptosporidium hominis
QYCSFRFKFSASLKKISST

SEQ ID NO: 2129583 - protein, 19 aa, Cryptosporidium hominis
QYLPSCIMISVGCPSKHYI

SEQ ID NO: 2129584 - protein, 18 aa, Cryptosporidium hominis
RATLILTILLPFILEIYY

SEQ ID NO: 2129585 - protein, 21 aa, Cryptosporidium hominis
RAVFFLHWWLITWPKIPFYAN

SEQ ID NO: 2129586 - protein, 18 aa, Cryptosporidium hominis
RCKFWWLSLVQFPECIWI

SEQ ID NO: 2129587 - protein, 19 aa, Cryptosporidium hominis
RDWCWYFIFSWVIYYFNIW

SEQ ID NO: 2129588 - protein, 17 aa, Cryptosporidium hominis
RFREFTLEYALREINKL

SEQ ID NO: 2129589 - protein, 18 aa, Cryptosporidium hominis
RFTCIFIHAMCFCMQPFF

SEQ ID NO: 2129590 - protein, 17 aa, Cryptosporidium hominis
RGIEILVFFAFKKNYHS

SEQ ID NO: 2129591 - protein, 17 aa, Cryptosporidium hominis
RGLICLSFFKLMRFKEV

SEQ ID NO: 2129592 - protein, 19 aa, Cryptosporidium hominis
RGTWKAVSSRAFIRDPYAL

SEQ ID NO: 2129593 - protein, 22 aa, Cryptosporidium hominis
RGYKEILCRIMVGWSNNIDKSL

SEQ ID NO: 2129594 - protein, 29 aa, Cryptosporidium hominis
RHFPELISTILLRCCSTLGYINMGALESS

SEQ ID NO: 2129595 - protein, 20 aa, Cryptosporidium hominis
RHMIPLALCFIGMVSLSNIC

SEQ ID NO: 2129596 - protein, 19 aa, Cryptosporidium hominis
RILPPYWYMNWVEQTSTRS

SEQ ID NO: 2129597 - protein, 21 aa, Cryptosporidium hominis
RIRLKHIFLIFIFTVLYVSCF

SEQ ID NO: 2129598 - protein, 23 aa, Cryptosporidium hominis
RIYRRKYDVFPFLKFKLNNKRSK

SEQ ID NO: 2129599 - protein, 21 aa, Cryptosporidium hominis
RKESISFIDWINRLISSKFSL

SEQ ID NO: 2129600 - protein, 17 aa, Cryptosporidium hominis
RKGEIVFKNVFFSYSDN

SEQ ID NO: 2129601 - protein, 23 aa, Cryptosporidium hominis
RKLSGEFPKFFVINSHFNENLQE

SEQ ID NO: 2129602 - protein, 18 aa, Cryptosporidium hominis
RKNMSLDYFIEIYKDLYS

SEQ ID NO: 2129603 - protein, 19 aa, Cryptosporidium hominis
RKWIILLIIIEFVIKINLL

SEQ ID NO: 2129604 - protein, 24 aa, Cryptosporidium hominis
RKYMYWIWRRWRYLLSAKERMPIL

SEQ ID NO: 2129605 - protein, 23 aa, Cryptosporidium hominis
RLCYRRTSILVLYNLYKCFTLNI

SEQ ID NO: 2129606 - protein, 20 aa, Cryptosporidium hominis
RLCYTVHLLALISHISAHIG

SEQ ID NO: 2129607 - protein, 21 aa, Cryptosporidium hominis
RLGVYSSIFYYKMVLFKSKID

SEQ ID NO: 2129608 - protein, 19 aa, Cryptosporidium hominis
RLNSQLSLHCRIRRVNYIP

SEQ ID NO: 2129609 - protein, 20 aa, Cryptosporidium hominis
RLYDPLIWRYISVANWKVRL

SEQ ID NO: 2129610 - protein, 17 aa, Cryptosporidium hominis
RMKEALERCLLLIENGN

SEQ ID NO: 2129611 - protein, 17 aa, Cryptosporidium hominis
RMLEFLSGIAYVPIKVD

SEQ ID NO: 2129612 - protein, 18 aa, Cryptosporidium hominis
RMLIKKSPIWILDEPTSA

SEQ ID NO: 2129613 - protein, 20 aa, Cryptosporidium hominis
RNTYCLGFDSDKSFLVLGAS

SEQ ID NO: 2129614 - protein, 20 aa, Cryptosporidium hominis
RRLSQMLYHYVRVTLKEPRV

SEQ ID NO: 2129615 - protein, 20 aa, Cryptosporidium hominis
RRSAWLLGCIFEFSSPNMAL

SEQ ID NO: 2129616 - protein, 19 aa, Cryptosporidium hominis
RRTFRCWTNIISKLVSYDS

SEQ ID NO: 2129617 - protein, 18 aa, Cryptosporidium hominis
RSRWMIAMHPFRVTVSYN

SEQ ID NO: 2129618 - protein, 23 aa, Cryptosporidium hominis
RTHHCRVCRTCVLKMDHHCPWIS

SEQ ID NO: 2129619 - protein, 17 aa, Cryptosporidium hominis
RTHLMMLIFFGGNILRG

SEQ ID NO: 2129620 - protein, 22 aa, Cryptosporidium hominis
RVMSTKTFFCWVWKSLYQGTVI

SEQ ID NO: 2129621 - protein, 21 aa, Cryptosporidium hominis
RVSEHAIFCFGNNIEVIVEYL

SEQ ID NO: 2129622 - protein, 25 aa, Cryptosporidium hominis
RYHISILMKAIFVFMFFDVSREFYI

SEQ ID NO: 2129623 - protein, 19 aa, Cryptosporidium hominis
RYKLVPIKWSWSVQEISEI

SEQ ID NO: 2129624 - protein, 20 aa, Cryptosporidium hominis
RYLKCVIMFKSIKEYSGNNN

SEQ ID NO: 2129625 - protein, 19 aa, Cryptosporidium hominis
SAFGFRYIVPSVFAIFAAL

SEQ ID NO: 2129626 - protein, 19 aa, Cryptosporidium hominis
SAPLRASVLFGHLQTIMPG

SEQ ID NO: 2129627 - protein, 18 aa, Cryptosporidium hominis
SCAVVLTRRYVITIFLIF

SEQ ID NO: 2129628 - protein, 21 aa, Cryptosporidium hominis
SCAYLLCIILICFFLYPSWSL

SEQ ID NO: 2129629 - protein, 20 aa, Cryptosporidium hominis
SCFLLGIIVYYSFKDVEILN

SEQ ID NO: 2129630 - protein, 20 aa, Cryptosporidium hominis
SCLIVRLSAYIAFKKKFRSM

SEQ ID NO: 2129631 - protein, 21 aa, Cryptosporidium hominis
SDCEGFLKKGALFGGMSICTP

SEQ ID NO: 2129632 - protein, 21 aa, Cryptosporidium hominis
SDFCRIWLLTALVRLIHIPSG

SEQ ID NO: 2129633 - protein, 17 aa, Cryptosporidium hominis
SEIPSWFVGILTLPTLK

SEQ ID NO: 2129634 - protein, 17 aa, Cryptosporidium hominis
SELFSVCAIRFHAEWLD

SEQ ID NO: 2129635 - protein, 18 aa, Cryptosporidium hominis
SESCFKSSIKLNVELPKY

SEQ ID NO: 2129636 - protein, 21 aa, Cryptosporidium hominis
SFELSYKWCFQVFSYDNRYCD

SEQ ID NO: 2129637 - protein, 18 aa, Cryptosporidium hominis
SFLKSVCWFAIGADAFSN

SEQ ID NO: 2129638 - protein, 25 aa, Cryptosporidium hominis
SFNTGGICSFLWIMAKFPDYVYCDK

SEQ ID NO: 2129639 - protein, 19 aa, Cryptosporidium hominis
SFRLFGIVVASSIVFIFMM

SEQ ID NO: 2129640 - protein, 19 aa, Cryptosporidium hominis
SFWSFKLPLIIKNIIFFIY

SEQ ID NO: 2129641 - protein, 23 aa, Cryptosporidium hominis
SGFLTRLPIEWDISTKLENDLLS

SEQ ID NO: 2129642 - protein, 25 aa, Cryptosporidium hominis
SGNNEFRGSLFLICIRFLCNMFHNS

SEQ ID NO: 2129643 - protein, 17 aa, Cryptosporidium hominis
SHARIVLVIALFIIIFM

SEQ ID NO: 2129644 - protein, 17 aa, Cryptosporidium hominis
SHGRIGMMQGIPQHMGG

SEQ ID NO: 2129645 - protein, 25 aa, Cryptosporidium hominis
SICLKLGWRSVFYIPSIFVFLFGII

SEQ ID NO: 2129646 - protein, 19 aa, Cryptosporidium hominis
SIFCIFIYLFGKVEASLTD

SEQ ID NO: 2129647 - protein, 26 aa, Cryptosporidium hominis
SIFLLLIIIVIFSFNMDNLLLEAAYN

SEQ ID NO: 2129648 - protein, 27 aa, Cryptosporidium hominis
SIKSLFLKTVFLFRILRYWNNDITSSS

SEQ ID NO: 2129649 - protein, 18 aa, Cryptosporidium hominis
SILAILGIHFSKKRKLSF

SEQ ID NO: 2129650 - protein, 25 aa, Cryptosporidium hominis
SIRFKSNIITFIWKPLYYLLTFFTF

SEQ ID NO: 2129651 - protein, 19 aa, Cryptosporidium hominis
SISISFAFLAKYYFQNIRK

SEQ ID NO: 2129652 - protein, 18 aa, Cryptosporidium hominis
SKIKYKFFRNFQLSPFLP

SEQ ID NO: 2129653 - protein, 26 aa, Cryptosporidium hominis
SKRRARKIMTKKGLSLLIKEFNTSKT

SEQ ID NO: 2129654 - protein, 20 aa, Cryptosporidium hominis
SKVMFPWSMGNRVPINSVSC

SEQ ID NO: 2129655 - protein, 17 aa, Cryptosporidium hominis
SLECIRKIISLAISCSS

SEQ ID NO: 2129656 - protein, 17 aa, Cryptosporidium hominis
SLITLRGSSEFILLSIS

SEQ ID NO: 2129657 - protein, 21 aa, Cryptosporidium hominis
SLKCFHAICWCCTLRLRYLLK

SEQ ID NO: 2129658 - protein, 22 aa, Cryptosporidium hominis
SLKGLCCNFGHLVFPSNGLIQF

SEQ ID NO: 2129659 - protein, 25 aa, Cryptosporidium hominis
SLLYWSLRVTRYFFPLTIALVLLSF

SEQ ID NO: 2129660 - protein, 20 aa, Cryptosporidium hominis
SLMILFKWIHIFYIEIKYLF

SEQ ID NO: 2129661 - protein, 19 aa, Cryptosporidium hominis
SLNYHNGWRYSLLAPCLLL

SEQ ID NO: 2129662 - protein, 21 aa, Cryptosporidium hominis
SLPFNFLLLFTLLVFSIGVVS

SEQ ID NO: 2129663 - protein, 21 aa, Cryptosporidium hominis
SLPWFKLQIFKLLKLKQENLK

SEQ ID NO: 2129664 - protein, 21 aa, Cryptosporidium hominis
SLVLLCIICYIITEFKNDNDH

SEQ ID NO: 2129665 - protein, 22 aa, Cryptosporidium hominis
SMKCAFDFLFRGIRRVQRLVEL

SEQ ID NO: 2129666 - protein, 18 aa, Cryptosporidium hominis
SMLFWLPYYLIRELNYGP

SEQ ID NO: 2129667 - protein, 20 aa, Cryptosporidium hominis
SMPICLNEPLSFIQRLSEDL

SEQ ID NO: 2129668 - protein, 22 aa, Cryptosporidium hominis
SMPTCTCKKCKQAGSPSSGTEE

SEQ ID NO: 2129669 - protein, 20 aa, Cryptosporidium hominis
SNACMFEFIIPLVLEPIMIR

SEQ ID NO: 2129670 - protein, 18 aa, Cryptosporidium hominis
SNIKFCWFDFHSECSKMR

SEQ ID NO: 2129671 - protein, 24 aa, Cryptosporidium hominis
SNSPFGCLMFRLARTTLEQGLDYS

SEQ ID NO: 2129672 - protein, 18 aa, Cryptosporidium hominis
SPESILFSPFCNISDANE

SEQ ID NO: 2129673 - protein, 17 aa, Cryptosporidium hominis
SPFRIACQFSLIKCTLA

SEQ ID NO: 2129674 - protein, 17 aa, Cryptosporidium hominis
SPIGLTFLNGFAVSLAC

SEQ ID NO: 2129675 - protein, 17 aa, Cryptosporidium hominis
SPIPGPIRFCREVKYLT

SEQ ID NO: 2129676 - protein, 22 aa, Cryptosporidium hominis
SQFMLSKSFLFKILLLVLNLIP

SEQ ID NO: 2129677 - protein, 18 aa, Cryptosporidium hominis
SQILRYVDSIAFIIAWNA

SEQ ID NO: 2129678 - protein, 19 aa, Cryptosporidium hominis
SQLSHFGWFKLILNSGEKT

SEQ ID NO: 2129679 - protein, 18 aa, Cryptosporidium hominis
SRCFWDFDMPIPFTATSV

SEQ ID NO: 2129680 - protein, 20 aa, Cryptosporidium hominis
SRFSLYEGYTWDNLEVTSKI

SEQ ID NO: 2129681 - protein, 17 aa, Cryptosporidium hominis
SRILFKIIMSIYNNENI

SEQ ID NO: 2129682 - protein, 19 aa, Cryptosporidium hominis
SRQTLMWLFISIIIMLLII

SEQ ID NO: 2129683 - protein, 22 aa, Cryptosporidium hominis
SSCKASACNGCLTISKYNVFTG

SEQ ID NO: 2129684 - protein, 19 aa, Cryptosporidium hominis
SSFFLDKRLLCIFEDKKMI

SEQ ID NO: 2129685 - protein, 24 aa, Cryptosporidium hominis
SSIRFPTIRSFFSWFGSFNSLYVK

SEQ ID NO: 2129686 - protein, 22 aa, Cryptosporidium hominis
SSSENWLALQFIKQYNVSIYID

SEQ ID NO: 2129687 - protein, 18 aa, Cryptosporidium hominis
SSTCMFILMSIFDHMVLF

SEQ ID NO: 2129688 - protein, 24 aa, Cryptosporidium hominis
STFKIPEVWGVYKFVINHKRIGYN

SEQ ID NO: 2129689 - protein, 26 aa, Cryptosporidium hominis
STFVFSWSCSLVWFGNHLLKLFCNID

SEQ ID NO: 2129690 - protein, 19 aa, Cryptosporidium hominis
STVFCFFNYIFTDLSRAHD

SEQ ID NO: 2129691 - protein, 25 aa, Cryptosporidium hominis
STYQSICYIWLWDLFVEYFGGSEQI

SEQ ID NO: 2129692 - protein, 23 aa, Cryptosporidium hominis
SVLPARLKYIWNCIKEFEPIDLS

SEQ ID NO: 2129693 - protein, 19 aa, Cryptosporidium hominis
SWFIFRYFFDFIRYFIEEN

SEQ ID NO: 2129694 - protein, 19 aa, Cryptosporidium hominis
SYYFICFNFYFSMTTLPAI

SEQ ID NO: 2129695 - protein, 24 aa, Cryptosporidium hominis
TCDSCLYVRLIAFECIKECMKRCI

SEQ ID NO: 2129696 - protein, 18 aa, Cryptosporidium hominis
TCIPICFGSLILEVSNSI

SEQ ID NO: 2129697 - protein, 17 aa, Cryptosporidium hominis
TCLMLRMLLHLYSGMRT

SEQ ID NO: 2129698 - protein, 22 aa, Cryptosporidium hominis
TEGRSSIPFGIIPDLNFHLRRY

SEQ ID NO: 2129699 - protein, 20 aa, Cryptosporidium hominis
TELFPSIVIVVSFWQKISPS

SEQ ID NO: 2129700 - protein, 21 aa, Cryptosporidium hominis
TFQLKSCHGVSCASDCIVTEW

SEQ ID NO: 2129701 - protein, 18 aa, Cryptosporidium hominis
TFSSLVLELGIRDNILSQ

SEQ ID NO: 2129702 - protein, 20 aa, Cryptosporidium hominis
TFSSRFGWRRVEEIIKSNIS

SEQ ID NO: 2129703 - protein, 20 aa, Cryptosporidium hominis
TGIFNWRFVFDIKIPTQYPI

SEQ ID NO: 2129704 - protein, 18 aa, Cryptosporidium hominis
THHCSVCKRCIFKMDHHC

SEQ ID NO: 2129705 - protein, 23 aa, Cryptosporidium hominis
TILVCIFKKKWLVAFLAFIAGLI

SEQ ID NO: 2129706 - protein, 20 aa, Cryptosporidium hominis
TLLILCGLLSMLLNYFTFLV

SEQ ID NO: 2129707 - protein, 17 aa, Cryptosporidium hominis
TLQGMQCCVPQKSAKGW

SEQ ID NO: 2129708 - protein, 51 aa, Cryptosporidium hominis
TNDITLPIIPRCSTSPYSIGCPCNLNPYSKLCGCYINPFNPGCHCTYNPNS

SEQ ID NO: 2129709 - protein, 17 aa, Cryptosporidium hominis
TNFTGVVEDSILKNNLT

SEQ ID NO: 2129710 - protein, 24 aa, Cryptosporidium hominis
TNNPESLLLLSRLTTKAPPKFLIS

SEQ ID NO: 2129711 - protein, 21 aa, Cryptosporidium hominis
TPECSYCKSFPVIVDEKYNII

SEQ ID NO: 2129712 - protein, 23 aa, Cryptosporidium hominis
TQDFGIRCPYFLTSILRSGRVGH

SEQ ID NO: 2129713 - protein, 23 aa, Cryptosporidium hominis
TQQFPFNGSLLLNGKVANITTFD

SEQ ID NO: 2129714 - protein, 24 aa, Cryptosporidium hominis
TRQECLSCTSMAYCPQCPGLEDLS

SEQ ID NO: 2129715 - protein, 21 aa, Cryptosporidium hominis
TTKAPPKFLISSIKASSNSTL

SEQ ID NO: 2129716 - protein, 20 aa, Cryptosporidium hominis
TTKYEEWWIFAVTKGSNPQI

SEQ ID NO: 2129717 - protein, 17 aa, Cryptosporidium hominis
TYFYFPLITDMRIMSSI

SEQ ID NO: 2129718 - protein, 20 aa, Cryptosporidium hominis
VAYYPFKLVVAFLLVIGNVS

SEQ ID NO: 2129719 - protein, 18 aa, Cryptosporidium hominis
VCDIMLKFSPLLKKINML

SEQ ID NO: 2129720 - protein, 17 aa, Cryptosporidium hominis
VCGLIKLIRIIFSIFTY

SEQ ID NO: 2129721 - protein, 18 aa, Cryptosporidium hominis
VCIYILNMLRFIAIINPE

SEQ ID NO: 2129722 - protein, 17 aa, Cryptosporidium hominis
VCSCCFALVQAVVLPFI

SEQ ID NO: 2129723 - protein, 19 aa, Cryptosporidium hominis
VFIGIKWRNHRLILVFKRL

SEQ ID NO: 2129724 - protein, 17 aa, Cryptosporidium hominis
VFIPFLIVILIKRLNNH

SEQ ID NO: 2129725 - protein, 23 aa, Cryptosporidium hominis
VFSRSDWVLAFFYRYMQWGFHVA

SEQ ID NO: 2129726 - protein, 23 aa, Cryptosporidium hominis
VGFFEVWLLLSLWKRYPARIYRH

SEQ ID NO: 2129727 - protein, 17 aa, Cryptosporidium hominis
VGIFVWWYVWGIDPSDG

SEQ ID NO: 2129728 - protein, 25 aa, Cryptosporidium hominis
VGLKICFSSKVFKDLILFFGSKVPT

SEQ ID NO: 2129729 - protein, 21 aa, Cryptosporidium hominis
VGPALFWFITWGLILLCAAGA

SEQ ID NO: 2129730 - protein, 18 aa, Cryptosporidium hominis
VGRHGCKAQHYWYFREKT

SEQ ID NO: 2129731 - protein, 23 aa, Cryptosporidium hominis
VGTIRPKISFGIFDTISLCLDSC

SEQ ID NO: 2129732 - protein, 21 aa, Cryptosporidium hominis
VHYLMCCLSLITLRGSSEFIL

SEQ ID NO: 2129733 - protein, 20 aa, Cryptosporidium hominis
VIFRYALEIQYIFYNKKKNS

SEQ ID NO: 2129734 - protein, 23 aa, Cryptosporidium hominis
VIIAHKWVEGIAVSAGIKKHTEI

SEQ ID NO: 2129735 - protein, 18 aa, Cryptosporidium hominis
VIKAFIWNKDYKKLTPQP

SEQ ID NO: 2129736 - protein, 17 aa, Cryptosporidium hominis
VILLEFWQFSAFVISTQ

SEQ ID NO: 2129737 - protein, 19 aa, Cryptosporidium hominis
VKFFWKLAYLVLFILCWVI

SEQ ID NO: 2129738 - protein, 19 aa, Cryptosporidium hominis
VKFTCIFVLLLGSFINTLQ

SEQ ID NO: 2129739 - protein, 17 aa, Cryptosporidium hominis
VKHIGFMLNTDWKNEEP

SEQ ID NO: 2129740 - protein, 22 aa, Cryptosporidium hominis
VLIETRGPFIIVNEEGEENKTN

SEQ ID NO: 2129741 - protein, 18 aa, Cryptosporidium hominis
VLIPHSWLSSQMIYNESR

SEQ ID NO: 2129742 - protein, 22 aa, Cryptosporidium hominis
VLLACWSVCIILSILDLYYLNN

SEQ ID NO: 2129743 - protein, 22 aa, Cryptosporidium hominis
VLRFTLCFFDIFGLAHGKNRVN

SEQ ID NO: 2129744 - protein, 17 aa, Cryptosporidium hominis
VMIPMWLSMKIPRYKKR

SEQ ID NO: 2129745 - protein, 17 aa, Cryptosporidium hominis
VNLPIFFAMAITLPCFL

SEQ ID NO: 2129746 - protein, 18 aa, Cryptosporidium hominis
VQLFCFFCACGSVIYKEF

SEQ ID NO: 2129747 - protein, 24 aa, Cryptosporidium hominis
VQVFRRMISIFSWFFTGIVILLMV

SEQ ID NO: 2129748 - protein, 19 aa, Cryptosporidium hominis
VRLSFKILACFPFCSSSKR

SEQ ID NO: 2129749 - protein, 25 aa, Cryptosporidium hominis
VRLYRLGKIFKVWRLIKKNNKSIKI

SEQ ID NO: 2129750 - protein, 19 aa, Cryptosporidium hominis
VRRFACAKPAIGLTAESAA

SEQ ID NO: 2129751 - protein, 20 aa, Cryptosporidium hominis
VRYYCIHAGFGILYLFIFHW

SEQ ID NO: 2129752 - protein, 20 aa, Cryptosporidium hominis
VSILCLVFWYNLMKVTNVEF

SEQ ID NO: 2129753 - protein, 18 aa, Cryptosporidium hominis
VSMCLIELTNIYDILELE

SEQ ID NO: 2129754 - protein, 17 aa, Cryptosporidium hominis
VSSDTYIYWGYQNKTRT

SEQ ID NO: 2129755 - protein, 26 aa, Cryptosporidium hominis
VSTCLLGSALLEWILSVVFVRQPPTT

SEQ ID NO: 2129756 - protein, 17 aa, Cryptosporidium hominis
VSWMPLMLENCSPALSD

SEQ ID NO: 2129757 - protein, 19 aa, Cryptosporidium hominis
VTISLDWILKIYKRSLYPE

SEQ ID NO: 2129758 - protein, 18 aa, Cryptosporidium hominis
VTKGRFLASVSHELRTPL

SEQ ID NO: 2129759 - protein, 18 aa, Cryptosporidium hominis
VVCTLQGMQCCVPQKSAK

SEQ ID NO: 2129760 - protein, 19 aa, Cryptosporidium hominis
VVIITFVFIIWIRRTNQQV

SEQ ID NO: 2129761 - protein, 19 aa, Cryptosporidium hominis
VVNFLRLYLIKVLPKNILG

SEQ ID NO: 2129762 - protein, 18 aa, Cryptosporidium hominis
VVRTCSYISFFWGMIIIL

SEQ ID NO: 2129763 - protein, 23 aa, Cryptosporidium hominis
VVTICLSIGCSEMCRRKANIRKL

SEQ ID NO: 2129764 - protein, 17 aa, Cryptosporidium hominis
VYVWPRNASGLFKSLFD

SEQ ID NO: 2129765 - protein, 17 aa, Cryptosporidium hominis
WAGQISLLWKLQLTLNK

SEQ ID NO: 2129766 - protein, 22 aa, Cryptosporidium hominis
WGRLRLLADYGIHFIRHGLTPV

SEQ ID NO: 2129767 - protein, 17 aa, Cryptosporidium hominis
WIALVLFPSFIYIRNTM

SEQ ID NO: 2129768 - protein, 18 aa, Cryptosporidium hominis
WIHGGRLIWYKTGKNSSN

SEQ ID NO: 2129769 - protein, 17 aa, Cryptosporidium hominis
WILPSGFEPQYFQMYAE

SEQ ID NO: 2129770 - protein, 23 aa, Cryptosporidium hominis
WKLAYLVLFILCWVIFPILLEYE

SEQ ID NO: 2129771 - protein, 19 aa, Cryptosporidium hominis
WKSLISMILYDPVRRSSLK

SEQ ID NO: 2129772 - protein, 19 aa, Cryptosporidium hominis
WKSQCYVDILPLDFCDVNH

SEQ ID NO: 2129773 - protein, 20 aa, Cryptosporidium hominis
WKVSSIWVIFTLENNSRVYP

SEQ ID NO: 2129774 - protein, 17 aa, Cryptosporidium hominis
WLGVCIGEYNRCKFWWL

SEQ ID NO: 2129775 - protein, 22 aa, Cryptosporidium hominis
WLQNRICYVFKFGCVVGWDLTR

SEQ ID NO: 2129776 - protein, 20 aa, Cryptosporidium hominis
WMHRMACFRDDIIFIIYIYQ

SEQ ID NO: 2129777 - protein, 19 aa, Cryptosporidium hominis
WNYKVLFLFLRILGLTLFV

SEQ ID NO: 2129778 - protein, 20 aa, Cryptosporidium hominis
WPHQLPIRSWRVWGPSDENI

SEQ ID NO: 2129779 - protein, 24 aa, Cryptosporidium hominis
WRCYCLIQRWLGIHIDILGACVIS

SEQ ID NO: 2129780 - protein, 18 aa, Cryptosporidium hominis
WRNHRLILVFKRLIRQLI

SEQ ID NO: 2129781 - protein, 17 aa, Cryptosporidium hominis
WRSDTPLQYRAVPSWFI

SEQ ID NO: 2129782 - protein, 17 aa, Cryptosporidium hominis
WSFCWSALILYTNLFSF

SEQ ID NO: 2129783 - protein, 19 aa, Cryptosporidium hominis
WSIAEAFVLGGISVFGIAI

SEQ ID NO: 2129784 - protein, 19 aa, Cryptosporidium hominis
WSIYRLVFIYSFLLIIYQF

SEQ ID NO: 2129785 - protein, 18 aa, Cryptosporidium hominis
WVAGQLYFLFGITGHYPT

SEQ ID NO: 2129786 - protein, 20 aa, Cryptosporidium hominis
WVICCHIFLLYLCISSPNAL

SEQ ID NO: 2129787 - protein, 23 aa, Cryptosporidium hominis
WWACKLHYPKLIFRLLEFYIQAK

SEQ ID NO: 2129788 - protein, 18 aa, Cryptosporidium hominis
WYHCYRFFVQEAIRYENT

SEQ ID NO: 2129789 - protein, 17 aa, Cryptosporidium hominis
WYIAWTWFVDLILSIST

SEQ ID NO: 2129790 - protein, 18 aa, Cryptosporidium hominis
YAKRFGFKSRRDEVPIEQ

SEQ ID NO: 2129791 - protein, 18 aa, Cryptosporidium hominis
YCKCSGCVSNIENIRRKH

SEQ ID NO: 2129792 - protein, 18 aa, Cryptosporidium hominis
YCLWAGQISLLWKLQLTL

SEQ ID NO: 2129793 - protein, 17 aa, Cryptosporidium hominis
YCRTRPTLMPSLNTATY

SEQ ID NO: 2129794 - protein, 19 aa, Cryptosporidium hominis
YDFVLRYIFLNSLKISTIA

SEQ ID NO: 2129795 - protein, 22 aa, Cryptosporidium hominis
YEPRSKFGYRFFLVCNRVQNIG

SEQ ID NO: 2129796 - protein, 17 aa, Cryptosporidium hominis
YEVPLIFACETKKLICH

SEQ ID NO: 2129797 - protein, 24 aa, Cryptosporidium hominis
YFEFPIQILFWFGYEDTRLIAYKI

SEQ ID NO: 2129798 - protein, 23 aa, Cryptosporidium hominis
YFFFRWITYYVEMEIAANYERII

SEQ ID NO: 2129799 - protein, 17 aa, Cryptosporidium hominis
YFFPEQIIDLSLVKIQD

SEQ ID NO: 2129800 - protein, 17 aa, Cryptosporidium hominis
YFIPFAIFGYYKTRADV

SEQ ID NO: 2129801 - protein, 20 aa, Cryptosporidium hominis
YFRINFAYRFSFIVCCQLNQ

SEQ ID NO: 2129802 - protein, 17 aa, Cryptosporidium hominis
YFSKLKWSWTIALLILC

SEQ ID NO: 2129803 - protein, 23 aa, Cryptosporidium hominis
YFWDLRFGQSIVCDNAPKICNIL

SEQ ID NO: 2129804 - protein, 19 aa, Cryptosporidium hominis
YGGPRKWSLGFQILECKKI

SEQ ID NO: 2129805 - protein, 19 aa, Cryptosporidium hominis
YGLCLGLLFLGKREACETT

SEQ ID NO: 2129806 - protein, 17 aa, Cryptosporidium hominis
YGLPGFLLLILALILTL

SEQ ID NO: 2129807 - protein, 24 aa, Cryptosporidium hominis
YILSCWKLLWCLSINELIGESLRN

SEQ ID NO: 2129808 - protein, 19 aa, Cryptosporidium hominis
YIRSLECSNQFKGHNCNNI

SEQ ID NO: 2129809 - protein, 19 aa, Cryptosporidium hominis
YKKSMWLFFGIGIVQMTLS

SEQ ID NO: 2129810 - protein, 18 aa, Cryptosporidium hominis
YKKYRNTYCLGFDSDKSF

SEQ ID NO: 2129811 - protein, 20 aa, Cryptosporidium hominis
YKPPTLYTHQTFDMVDRQIA

SEQ ID NO: 2129812 - protein, 20 aa, Cryptosporidium hominis
YKSLSIEEFEIFKSSFLGLG

SEQ ID NO: 2129813 - protein, 20 aa, Cryptosporidium hominis
YKYGFKLYWIRKVSKTLKFL

SEQ ID NO: 2129814 - protein, 18 aa, Cryptosporidium hominis
YLELIFCEELDWKITFKL

SEQ ID NO: 2129815 - protein, 19 aa, Cryptosporidium hominis
YLLNFSMLLCFDTILYDLT

SEQ ID NO: 2129816 - protein, 22 aa, Cryptosporidium hominis
YLQYRGSIPIVWRQPPNLKKTP

SEQ ID NO: 2129817 - protein, 24 aa, Cryptosporidium hominis
YNRMAALPLFRLFMKQDKEWINRQ

SEQ ID NO: 2129818 - protein, 24 aa, Cryptosporidium hominis
YPYYYRPFFGYGFPLLGTEPYFQS

SEQ ID NO: 2129819 - protein, 17 aa, Cryptosporidium hominis
YRMGWYYSMLSIVSGLI

SEQ ID NO: 2129820 - protein, 20 aa, Cryptosporidium hominis
YRVKLGFGLHYGWAIEGAIG

SEQ ID NO: 2129821 - protein, 23 aa, Cryptosporidium hominis
YRWLFVRLEIMGCIAVFTAGTLG

SEQ ID NO: 2129822 - protein, 23 aa, Cryptosporidium hominis
YSIIWKLCLIFLLGATDSQLSFM

SEQ ID NO: 2129823 - protein, 23 aa, Cryptosporidium hominis
YSNTRFGDILTFPTKDYPNGLAL

SEQ ID NO: 2129824 - protein, 23 aa, Cryptosporidium hominis
YSPIFRVVLGVLRWLRWESRVNP

SEQ ID NO: 2129825 - protein, 18 aa, Cryptosporidium hominis
YSSPIVCDIMLKFSPLLK

SEQ ID NO: 2129826 - protein, 19 aa, Cryptosporidium hominis
YTVRTWDWFTKPLFNNPWL

SEQ ID NO: 2129827 - protein, 24 aa, Cryptosporidium hominis
YVWITCSFLSFLLVNYYITKWIWG

SEQ ID NO: 2129828 - protein, 22 aa, Cryptosporidium hominis
YVYVCTYWGLFYFKIPKKYGIY

SEQ ID NO: 2129829 - protein, 24 aa, Cryptosporidium hominis
YYEERRWKIYAARRLSQMVQNYWR

SEQ ID NO: 2129830 - protein, 18 aa, Cryptosporidium hominis
YYFKHPWFLKSWKFVNIE

SEQ ID NO: 2129831 - protein, 26 aa, Cryptosporidium hominis
YYNEYSFPDYMYIIVLGNLKNSVKIK

SEQ ID NO: 2129832 - protein, 17 aa, Cryptosporidium hominis
AAFFKRFNKTRNQITIA

SEQ ID NO: 2129833 - protein, 29 aa, Cryptosporidium hominis
AAFHIMGWIFCFFLDKTWFYFPYIGICLW

SEQ ID NO: 2129834 - protein, 23 aa, Cryptosporidium hominis
AAFHLFFALFLISFYQCTNTEPG

SEQ ID NO: 2129835 - protein, 25 aa, Cryptosporidium hominis
AAFYAKRLLPLRTNGNFLLVTLLFG

SEQ ID NO: 2129836 - protein, 25 aa, Cryptosporidium hominis
AAGVGIYFGWKLFKKGKVCSMIKEI

SEQ ID NO: 2129837 - protein, 35 aa, Cryptosporidium hominis
AAIRLQLYTLPLIIFILFIPVESNWRYLALLYSLL

SEQ ID NO: 2129838 - protein, 25 aa, Cryptosporidium hominis
AAIYYLVILVVNIKVLLMADHIHYL

SEQ ID NO: 2129839 - protein, 27 aa, Cryptosporidium hominis
AALPGIITFLFFFISSFGFQVLGTIYK

SEQ ID NO: 2129840 - protein, 17 aa, Cryptosporidium hominis
AALSWPITIMQYAATLD

SEQ ID NO: 2129841 - protein, 25 aa, Cryptosporidium hominis
AAMLLLFEILFVTILLNMFTTIIMN

SEQ ID NO: 2129842 - protein, 28 aa, Cryptosporidium hominis
AATLYEIFYFRVFVLLTRFQNVKTILVS

SEQ ID NO: 2129843 - protein, 21 aa, Cryptosporidium hominis
AAVSLFIPYFILGGNNPISND

SEQ ID NO: 2129844 - protein, 22 aa, Cryptosporidium hominis
ACALWMDFQILPDGDQTLIGEK

SEQ ID NO: 2129845 - protein, 36 aa, Cryptosporidium hominis
ACIVIVSTIFIIIIGIWLAWIFRYKRQTEIYDMDHL

SEQ ID NO: 2129846 - protein, 30 aa, Cryptosporidium hominis
ACKIEIEAFYKWIQVLYYKVLNNNITSNNE

SEQ ID NO: 2129847 - protein, 23 aa, Cryptosporidium hominis
ACQFKLLSYFLTPSEFVFEILDE

SEQ ID NO: 2129848 - protein, 39 aa, Cryptosporidium hominis
AEECIRYIYRYGLYIYNGLILDFKILYKVYQKSFMDSGF

SEQ ID NO: 2129849 - protein, 24 aa, Cryptosporidium hominis
AEFLMVLGILLHKVGSEVALITLA

SEQ ID NO: 2129850 - protein, 17 aa, Cryptosporidium hominis
AEGIYLPIIYPSDFWCI

SEQ ID NO: 2129851 - protein, 23 aa, Cryptosporidium hominis
AEKKKCSFYSIWQEFTNQVNNMC

SEQ ID NO: 2129852 - protein, 25 aa, Cryptosporidium hominis
AEKRNLILVFAILVNIILISMANII

SEQ ID NO: 2129853 - protein, 20 aa, Cryptosporidium hominis
AELIKNLIFSWKIFSEHMDI

SEQ ID NO: 2129854 - protein, 31 aa, Cryptosporidium hominis
AEMIFEFHYLLEISLKYLLGNRYDSLELKRL

SEQ ID NO: 2129855 - protein, 32 aa, Cryptosporidium hominis
AEWLPIKRIIMLFLAGTFILSIYIILAFNCGG

SEQ ID NO: 2129856 - protein, 25 aa, Cryptosporidium hominis
AFAAFGMIWIVLLPLWSVCALPSDI

SEQ ID NO: 2129857 - protein, 38 aa, Cryptosporidium hominis
AFALFFDWRFCIDLTGYLIKLLRLFPQRKTYIIKGICS

SEQ ID NO: 2129858 - protein, 25 aa, Cryptosporidium hominis
AFDELVPKPLYRRIVERRRIRAKLL

SEQ ID NO: 2129859 - protein, 18 aa, Cryptosporidium hominis
AFGNFPSYIKPMVFSWPS

SEQ ID NO: 2129860 - protein, 18 aa, Cryptosporidium hominis
AFGTYYQHLVLYSIIRNT

SEQ ID NO: 2129861 - protein, 17 aa, Cryptosporidium hominis
AFIIRRMTRGGGAGNSG

SEQ ID NO: 2129862 - protein, 31 aa, Cryptosporidium hominis
AFKEDYCRYVILTFLLIALDAFVKYKGILFI

SEQ ID NO: 2129863 - protein, 18 aa, Cryptosporidium hominis
AFLNFGQNFIFTGGLLSA

SEQ ID NO: 2129864 - protein, 20 aa, Cryptosporidium hominis
AFSFAAFLICSLTLCLYAFL

SEQ ID NO: 2129865 - protein, 32 aa, Cryptosporidium hominis
AGFLSLLISFTRFFCYFLQTSSLRSPKAWNRT

SEQ ID NO: 2129866 - protein, 24 aa, Cryptosporidium hominis
AGLLLFIGYIFNVLFIGVASVLIP

SEQ ID NO: 2129867 - protein, 25 aa, Cryptosporidium hominis
AGMTLFACLIGFILPNLFTPKYTHY

SEQ ID NO: 2129868 - protein, 21 aa, Cryptosporidium hominis
AGMYSLLGLLLREISSHEFSD

SEQ ID NO: 2129869 - protein, 25 aa, Cryptosporidium hominis
AGNYKLFILFISTLFLLELAMLLGS

SEQ ID NO: 2129870 - protein, 23 aa, Cryptosporidium hominis
AGRISPVLLFLSVVLIMGLCIFV

SEQ ID NO: 2129871 - protein, 21 aa, Cryptosporidium hominis
AHIGGFVVGILYTFATMKACK

SEQ ID NO: 2129872 - protein, 28 aa, Cryptosporidium hominis
AICSLFLIISFFVNFLNKHLEVIFTSTT

SEQ ID NO: 2129873 - protein, 22 aa, Cryptosporidium hominis
AIDNPLFFMKNVEMIFGNAKDS

SEQ ID NO: 2129874 - protein, 24 aa, Cryptosporidium hominis
AIEKGLLILPIITARTMFELLETV

SEQ ID NO: 2129875 - protein, 17 aa, Cryptosporidium hominis
AIGKLLCYLFIHNPDIT

SEQ ID NO: 2129876 - protein, 19 aa, Cryptosporidium hominis
AIGYDYMKNYILTNILILI

SEQ ID NO: 2129877 - protein, 21 aa, Cryptosporidium hominis
AIICVVMFLIFGVYTMLFSFY

SEQ ID NO: 2129878 - protein, 25 aa, Cryptosporidium hominis
AIKHGFDLIPIYIAGAKDGTYLTLN

SEQ ID NO: 2129879 - protein, 23 aa, Cryptosporidium hominis
AIKSNSWLLPLLRVHINRTELSF

SEQ ID NO: 2129880 - protein, 21 aa, Cryptosporidium hominis
AILAFFVLKRKVTVREVIAFS

SEQ ID NO: 2129881 - protein, 18 aa, Cryptosporidium hominis
AILGLGYSYIGTCREDIL

SEQ ID NO: 2129882 - protein, 20 aa, Cryptosporidium hominis
AILTFTMILIGVISNFFASF

SEQ ID NO: 2129883 - protein, 18 aa, Cryptosporidium hominis
AIPKNRPTALPKSVCKYF

SEQ ID NO: 2129884 - protein, 21 aa, Cryptosporidium hominis
AIQFQSILKILLFNQNLTTCS

SEQ ID NO: 2129885 - protein, 19 aa, Cryptosporidium hominis
AIRFDTLLNLLTTFNLNKA

SEQ ID NO: 2129886 - protein, 27 aa, Cryptosporidium hominis
AIRIIFCLVYFFIYGRFVYSFSFDGLR

SEQ ID NO: 2129887 - protein, 25 aa, Cryptosporidium hominis
AIRIPIMCILFLVIPKESSSFYYFM

SEQ ID NO: 2129888 - protein, 31 aa, Cryptosporidium hominis
AIRKSIYMLAFNIILKIKYSSYFLALNQILR

SEQ ID NO: 2129889 - protein, 27 aa, Cryptosporidium hominis
AISYSIRIFIFPIKIASTFAIAIKTFD

SEQ ID NO: 2129890 - protein, 25 aa, Cryptosporidium hominis
AIVLIKIYVLISKLYLLMRNINAKD

SEQ ID NO: 2129891 - protein, 24 aa, Cryptosporidium hominis
AIWAYLGSVLILSLAIFECFFDTH

SEQ ID NO: 2129892 - protein, 17 aa, Cryptosporidium hominis
AIYCFYSHLICIQAISS

SEQ ID NO: 2129893 - protein, 18 aa, Cryptosporidium hominis
AIYSLKYYKYKGWYSFII

SEQ ID NO: 2129894 - protein, 24 aa, Cryptosporidium hominis
AKCIQNFWRNIYLKNINIEREILT

SEQ ID NO: 2129895 - protein, 27 aa, Cryptosporidium hominis
AKDGGLPCIVWLLLAIVHCSVNGNKSS

SEQ ID NO: 2129896 - protein, 17 aa, Cryptosporidium hominis
AKFIVFIDEIDLARSNR

SEQ ID NO: 2129897 - protein, 25 aa, Cryptosporidium hominis
AKGMKIEWFAVRDGILWVGSFGKEF

SEQ ID NO: 2129898 - protein, 25 aa, Cryptosporidium hominis
AKLLIGFFTLLFYLGVFEVILGIFQ

SEQ ID NO: 2129899 - protein, 25 aa, Cryptosporidium hominis
AKSILFHMLLFIIGKTDEIWILLNE

SEQ ID NO: 2129900 - protein, 32 aa, Cryptosporidium hominis
AKTFPNFPGFLHSIVLLYNGSVVYTLVIARKY

SEQ ID NO: 2129901 - protein, 36 aa, Cryptosporidium hominis
AKTNLNLAVLPPPPLRQIPMPSISVESLVITPQLMV

SEQ ID NO: 2129902 - protein, 30 aa, Cryptosporidium hominis
ALAVIFPIISFIIFRLGFIPGVYVTIIGFL

SEQ ID NO: 2129903 - protein, 20 aa, Cryptosporidium hominis
ALDELIFMNSSLANKLIDLE

SEQ ID NO: 2129904 - protein, 18 aa, Cryptosporidium hominis
ALFAFEIIEYLRFKADMK

SEQ ID NO: 2129905 - protein, 17 aa, Cryptosporidium hominis
ALFFSIIAFNINFEYDL

SEQ ID NO: 2129906 - protein, 19 aa, Cryptosporidium hominis
ALFLNVCSQIKFIDAKELY

SEQ ID NO: 2129907 - protein, 18 aa, Cryptosporidium hominis
ALFSLYLAYKFLPVYWVN

SEQ ID NO: 2129908 - protein, 17 aa, Cryptosporidium hominis
ALILSKIVLNLSSLIGP

SEQ ID NO: 2129909 - protein, 32 aa, Cryptosporidium hominis
ALINVSIMICLYLNFIPSIYKIPGVPNVSASR

SEQ ID NO: 2129910 - protein, 18 aa, Cryptosporidium hominis
ALIPTRIILAGKLRIMCF

SEQ ID NO: 2129911 - protein, 23 aa, Cryptosporidium hominis
ALITFLQLIIYIPLVSARKIQSL

SEQ ID NO: 2129912 - protein, 26 aa, Cryptosporidium hominis
ALLFSNNLLQVPHWFNFMAIESESQQ

SEQ ID NO: 2129913 - protein, 20 aa, Cryptosporidium hominis
ALLMNPFRRNIKRNSFNINT

SEQ ID NO: 2129914 - protein, 18 aa, Cryptosporidium hominis
ALLTMHMVKIKEIKPPMK

SEQ ID NO: 2129915 - protein, 31 aa, Cryptosporidium hominis
ALMQMIVNFHLIDWMLIPIKEIPFGDPDVVF

SEQ ID NO: 2129916 - protein, 33 aa, Cryptosporidium hominis
ALRPSSTCMFILMSIFDHMVLFGEILNKSKFGK

SEQ ID NO: 2129917 - protein, 20 aa, Cryptosporidium hominis
ALSFTLLFTRLSVGLIVLNN

SEQ ID NO: 2129918 - protein, 27 aa, Cryptosporidium hominis
ALTYILLFFLLIPLKDYSIIWKLCLIF

SEQ ID NO: 2129919 - protein, 40 aa, Cryptosporidium hominis
ALVLLSFTIFSLTWILYLGFYWYWIPPKSISFPINFDFQN

SEQ ID NO: 2129920 - protein, 18 aa, Cryptosporidium hominis
AMCFCMQPFFLFQEVQGI

SEQ ID NO: 2129921 - protein, 18 aa, Cryptosporidium hominis
AMLYLTVLQSFLGPYYVR

SEQ ID NO: 2129922 - protein, 18 aa, Cryptosporidium hominis
AMRGITSNGMLLCASSAP

SEQ ID NO: 2129923 - protein, 29 aa, Cryptosporidium hominis
AMYSMHFLCMFFIPTFFYGLQYLTSNLSD

SEQ ID NO: 2129924 - protein, 32 aa, Cryptosporidium hominis
ANALVFLTVFPWCISLLLYSLLHFTYGNDKRS

SEQ ID NO: 2129925 - protein, 45 aa, Cryptosporidium hominis
ANEVCGLIKLIRIIFSIFTYSVFILFILLTILSLNTLFENKYSKL

SEQ ID NO: 2129926 - protein, 20 aa, Cryptosporidium hominis
ANIDKFQWSDDPFIKAGALI

SEQ ID NO: 2129927 - protein, 23 aa, Cryptosporidium hominis
ANIEHFRFYTIRNITGNITDVIS

SEQ ID NO: 2129928 - protein, 17 aa, Cryptosporidium hominis
ANKLLLNPISLVSIITT

SEQ ID NO: 2129929 - protein, 17 aa, Cryptosporidium hominis
ANLNILERILIGQALEL

SEQ ID NO: 2129930 - protein, 21 aa, Cryptosporidium hominis
ANSFIYYIFSYKMIIFIIAAH

SEQ ID NO: 2129931 - protein, 18 aa, Cryptosporidium hominis
ANSILELVKYRYLAPLTV

SEQ ID NO: 2129932 - protein, 31 aa, Cryptosporidium hominis
ANSMLIMTVIPWILTIALFGLLRLTYKQDQN

SEQ ID NO: 2129933 - protein, 28 aa, Cryptosporidium hominis
ANSRSLYLFMIMYGFTIVICKNILLYSA

SEQ ID NO: 2129934 - protein, 28 aa, Cryptosporidium hominis
ANTIERILGLRAPFYRLAMNTTTFPEDS

SEQ ID NO: 2129935 - protein, 25 aa, Cryptosporidium hominis
ANTYRGLIWFILPSCLVICNDIFAY

SEQ ID NO: 2129936 - protein, 25 aa, Cryptosporidium hominis
ANYGLPGFLLLILALILTLYFLHVI

SEQ ID NO: 2129937 - protein, 24 aa, Cryptosporidium hominis
APISHLILHLWVNNIPCSYRGILW

SEQ ID NO: 2129938 - protein, 22 aa, Cryptosporidium hominis
APNGRYILITLGQEYVAKALSM

SEQ ID NO: 2129939 - protein, 35 aa, Cryptosporidium hominis
APTKKIHLSLIPDLSLLSILLYKKTDLKSFWISID

SEQ ID NO: 2129940 - protein, 43 aa, Cryptosporidium hominis
AQCIFGKIILLIASIILLLGLLVWIFQEKLLFFPNINGKRDLA

SEQ ID NO: 2129941 - protein, 18 aa, Cryptosporidium hominis
AQTCPYYYKYGVCNKFIE

SEQ ID NO: 2129942 - protein, 26 aa, Cryptosporidium hominis
ARDSKKLLEKLFLLLSGESYNNRILQ

SEQ ID NO: 2129943 - protein, 18 aa, Cryptosporidium hominis
ARIKIGYINPLGDSLPIA

SEQ ID NO: 2129944 - protein, 24 aa, Cryptosporidium hominis
ARILIDLGYFYYLYMLCLTVFCTN

SEQ ID NO: 2129945 - protein, 22 aa, Cryptosporidium hominis
ARIQTFLFSRIYDYPILKDREF

SEQ ID NO: 2129946 - protein, 22 aa, Cryptosporidium hominis
ARLASILLPLIKKYRVDFIISG

SEQ ID NO: 2129947 - protein, 20 aa, Cryptosporidium hominis
ARLYSILEEQVWALLPGFFD

SEQ ID NO: 2129948 - protein, 22 aa, Cryptosporidium hominis
ARNIVGLIFFVSTSISFFSIKG

SEQ ID NO: 2129949 - protein, 23 aa, Cryptosporidium hominis
ARRIFSKILSCESFLALTSKETY

SEQ ID NO: 2129950 - protein, 25 aa, Cryptosporidium hominis
ARRSDLLIKILKQVLEIINIENLGQ

SEQ ID NO: 2129951 - protein, 26 aa, Cryptosporidium hominis
ARSLLTVIFCIVFLKLLKAKYGSFEQ

SEQ ID NO: 2129952 - protein, 22 aa, Cryptosporidium hominis
ARTGVKIIYVPAILVSSSESLN

SEQ ID NO: 2129953 - protein, 18 aa, Cryptosporidium hominis
ARTYIVGVNWIRNQLPFP

SEQ ID NO: 2129954 - protein, 24 aa, Cryptosporidium hominis
ASAVLRYIEIFLFSGMNGSSPLIT

SEQ ID NO: 2129955 - protein, 39 aa, Cryptosporidium hominis
ASEYPIIQTILFSILFYIIYKYIFRYFIHSCRLLHNTYI

SEQ ID NO: 2129956 - protein, 24 aa, Cryptosporidium hominis
ASFLVILILALIYRSYRAKSAAKK

SEQ ID NO: 2129957 - protein, 18 aa, Cryptosporidium hominis
ASFQLALSPVLWAYVPEA

SEQ ID NO: 2129958 - protein, 21 aa, Cryptosporidium hominis
ASFYYPYFFSQKCGFAREFDY

SEQ ID NO: 2129959 - protein, 30 aa, Cryptosporidium hominis
ASIIFTYLYVFLFMFPILCLDAKREASRRV

SEQ ID NO: 2129960 - protein, 28 aa, Cryptosporidium hominis
ASIKAFAIFGILFVFEEPYLLVSTSRDI

SEQ ID NO: 2129961 - protein, 21 aa, Cryptosporidium hominis
ASNITFFQLYTNYIREYQRRL

SEQ ID NO: 2129962 - protein, 21 aa, Cryptosporidium hominis
ASSWFCAYLALFLKLKREKNV

SEQ ID NO: 2129963 - protein, 27 aa, Cryptosporidium hominis
ASTSLSHFLIFYLLSSIPRINKVENGI

SEQ ID NO: 2129964 - protein, 36 aa, Cryptosporidium hominis
ATFGFYFLSVVICTLSTIVFFLWKSDGEVNTKKDIF

SEQ ID NO: 2129965 - protein, 20 aa, Cryptosporidium hominis
ATFPLMGYLIGKFVTSGVLP

SEQ ID NO: 2129966 - protein, 28 aa, Cryptosporidium hominis
ATGIDEIFYPFIPQLFLMMGREQVISSL

SEQ ID NO: 2129967 - protein, 26 aa, Cryptosporidium hominis
ATIFFRKYFVVFFIIPSYLKGDIDFG

SEQ ID NO: 2129968 - protein, 18 aa, Cryptosporidium hominis
ATIVGFCGFFADCFGMNL

SEQ ID NO: 2129969 - protein, 26 aa, Cryptosporidium hominis
ATLSTILPFLFIIIHTYDTAGCNRRE

SEQ ID NO: 2129970 - protein, 38 aa, Cryptosporidium hominis
ATNDYFLFKEGLLKFQEKKILRYYLYDVGNKVYSDTIA

SEQ ID NO: 2129971 - protein, 32 aa, Cryptosporidium hominis
ATQIFSLILLIIIFTPLILFSIHIIISSKFKT

SEQ ID NO: 2129972 - protein, 28 aa, Cryptosporidium hominis
ATQLIVFIIFYLFIGTSLNLPAALASIH

SEQ ID NO: 2129973 - protein, 25 aa, Cryptosporidium hominis
ATRSTLIFTFLTEQTNKFFDCFLNT

SEQ ID NO: 2129974 - protein, 27 aa, Cryptosporidium hominis
ATSKILSFVFWLFSYRELAPEHGKNVP

SEQ ID NO: 2129975 - protein, 24 aa, Cryptosporidium hominis
ATVLVFLIVIYFQGFRVDLAVKYQ

SEQ ID NO: 2129976 - protein, 27 aa, Cryptosporidium hominis
AVAGGLAVVGALLYYLFRSDSSENKDE

SEQ ID NO: 2129977 - protein, 19 aa, Cryptosporidium hominis
AVIALFHLLFTKPDKISAL

SEQ ID NO: 2129978 - protein, 20 aa, Cryptosporidium hominis
AVIILLFEFDSKLLSSAFLF

SEQ ID NO: 2129979 - protein, 23 aa, Cryptosporidium hominis
AVIRFLFENIDIKSANRLSTMFI

SEQ ID NO: 2129980 - protein, 21 aa, Cryptosporidium hominis
AVIYRHFYPINLFNTISHHNI

SEQ ID NO: 2129981 - protein, 27 aa, Cryptosporidium hominis
AVKSMSGFLSRFPLNDILQTSISLYNS

SEQ ID NO: 2129982 - protein, 17 aa, Cryptosporidium hominis
AVLKPKRTWTQGQNQCK

SEQ ID NO: 2129983 - protein, 18 aa, Cryptosporidium hominis
AVLLYYYLWALSKGQIDQ

SEQ ID NO: 2129984 - protein, 23 aa, Cryptosporidium hominis
AVSVLVLPILGWIVDRVGERCKL

SEQ ID NO: 2129985 - protein, 32 aa, Cryptosporidium hominis
AVVGSLAGLGLLGGLGYGFKRKKTRGGDLTGD

SEQ ID NO: 2129986 - protein, 25 aa, Cryptosporidium hominis
AYAVPVYFILLRSFTQDLVTHAVFS

SEQ ID NO: 2129987 - protein, 18 aa, Cryptosporidium hominis
AYIFAMTTLIIAYAILRQ

SEQ ID NO: 2129988 - protein, 18 aa, Cryptosporidium hominis
AYLDTPFTSIFAASLRFF

SEQ ID NO: 2129989 - protein, 23 aa, Cryptosporidium hominis
AYNNALGFLFLSAGHFSFSNKDK

SEQ ID NO: 2129990 - protein, 25 aa, Cryptosporidium hominis
AYRPPILQMYIFISALGTLFCTIYF

SEQ ID NO: 2129991 - protein, 25 aa, Cryptosporidium hominis
AYRRICKLALYMFYKNLTVGIPVFI

SEQ ID NO: 2129992 - protein, 18 aa, Cryptosporidium hominis
CACALIHVILWNGIKESF

SEQ ID NO: 2129993 - protein, 29 aa, Cryptosporidium hominis
CAFFHYMCAYLFILTVISFLCWDGFTEIL

SEQ ID NO: 2129994 - protein, 29 aa, Cryptosporidium hominis
CALGGPLLGFLFGWGVHLFLKVAQATNDV

SEQ ID NO: 2129995 - protein, 31 aa, Cryptosporidium hominis
CATFVRCLIICLFVFSWPISKFLDYFIGENG

SEQ ID NO: 2129996 - protein, 19 aa, Cryptosporidium hominis
CDCDRFPEGVACPMVLSGE

SEQ ID NO: 2129997 - protein, 36 aa, Cryptosporidium hominis
CDSNIYFPEQLLDCFYFIFIVFIFETISDTGFILKI

SEQ ID NO: 2129998 - protein, 26 aa, Cryptosporidium hominis
CDVLILFDCLFIVPCLLIFLSDFLIP

SEQ ID NO: 2129999 - protein, 25 aa, Cryptosporidium hominis
CEDCNLMIFVIPSQFIRSVASQIRK

SEQ ID NO: 2130000 - protein, 38 aa, Cryptosporidium hominis
CEMLRAYTVRTWDWFTKPLFNNPWLHFACSLSASSTLI

SEQ ID NO: 2130001 - protein, 33 aa, Cryptosporidium hominis
CEQHSGLYLSWRNIFDYPLTCELLRGLPHSVLL

SEQ ID NO: 2130002 - protein, 25 aa, Cryptosporidium hominis
CFDTHFIYILTMFIDQIKEISRSIG

SEQ ID NO: 2130003 - protein, 17 aa, Cryptosporidium hominis
CFFLGLYDDMVPADLLI

SEQ ID NO: 2130004 - protein, 24 aa, Cryptosporidium hominis
CFFLIVCGWVINVFWPFVEGIGIR

SEQ ID NO: 2130005 - protein, 26 aa, Cryptosporidium hominis
CFHIPQIKLVLSWISRIYGSNLTLLY

SEQ ID NO: 2130006 - protein, 18 aa, Cryptosporidium hominis
CFKRHILISPQYSAFLVN

SEQ ID NO: 2130007 - protein, 23 aa, Cryptosporidium hominis
CFLGCIIFILTYVASRALRANLK

SEQ ID NO: 2130008 - protein, 26 aa, Cryptosporidium hominis
CFRDDIIFIIYIYQRWIYRSKKGYQS

SEQ ID NO: 2130009 - protein, 24 aa, Cryptosporidium hominis
CFSKCCCWPVWSGSIISFAAYMVM

SEQ ID NO: 2130010 - protein, 18 aa, Cryptosporidium hominis
CFVIGLLAVLVSGGSLGS

SEQ ID NO: 2130011 - protein, 23 aa, Cryptosporidium hominis
CGDYTIVYAPIKDQTDPAPRYIS

SEQ ID NO: 2130012 - protein, 39 aa, Cryptosporidium hominis
CGPVILFTDFQVYSFLLFLAMLLSSINIIGGFYVTTRML

SEQ ID NO: 2130013 - protein, 30 aa, Cryptosporidium hominis
CGRQCEDFLWLSLEAVNFRMLPRAESQKEC

SEQ ID NO: 2130014 - protein, 28 aa, Cryptosporidium hominis
CGTSLSAIFGFFKTLFCVPNLNNRAQDN

SEQ ID NO: 2130015 - protein, 23 aa, Cryptosporidium hominis
CHGWTQFGFVTWMPIYFTDVCKV

SEQ ID NO: 2130016 - protein, 24 aa, Cryptosporidium hominis
CHLQPLVLIHGRLCYRRTSILVLY

SEQ ID NO: 2130017 - protein, 24 aa, Cryptosporidium hominis
CICIHVVYCLLCEAPLVEIFQQSQ

SEQ ID NO: 2130018 - protein, 24 aa, Cryptosporidium hominis
CIEKRKTMLLPEHYLYGVKDLSRH

SEQ ID NO: 2130019 - protein, 22 aa, Cryptosporidium hominis
CIISILIYFASFFLLESHFDLQ

SEQ ID NO: 2130020 - protein, 42 aa, Cryptosporidium hominis
CIKLIITKFLLLILVSIVGGSFFPLWAPIRYIPAFMAERHRK

SEQ ID NO: 2130021 - protein, 18 aa, Cryptosporidium hominis
CIKPLPKDIARLALYIVC

SEQ ID NO: 2130022 - protein, 18 aa, Cryptosporidium hominis
CILSWYLGDYSITLNFFA

SEQ ID NO: 2130023 - protein, 34 aa, Cryptosporidium hominis
CIPIQVIPKVWDSLFLFGEPYAFQVALGVLKYHE

SEQ ID NO: 2130024 - protein, 29 aa, Cryptosporidium hominis
CIPVWNIFLFLFALIVPVTNFLKRIFLGK

SEQ ID NO: 2130025 - protein, 18 aa, Cryptosporidium hominis
CISGFRFMQKTNHIGKVV

SEQ ID NO: 2130026 - protein, 17 aa, Cryptosporidium hominis
CISLCVIIPLFTVSICN

SEQ ID NO: 2130027 - protein, 32 aa, Cryptosporidium hominis
CISLFVSKILVLTFFLVIFTSDFEIQNRLGHF

SEQ ID NO: 2130028 - protein, 26 aa, Cryptosporidium hominis
CISLRMKFFIKALYKKLGKFKKFDMN

SEQ ID NO: 2130029 - protein, 27 aa, Cryptosporidium hominis
CIYKNPFFYSFFPINSICREFTGLPIT

SEQ ID NO: 2130030 - protein, 48 aa, Cryptosporidium hominis
CKMNKYQIYRILITILGVFFMLLAFFGVSFLLLLPKIAEIQIRNSKMD

SEQ ID NO: 2130031 - protein, 28 aa, Cryptosporidium hominis
CKQDKKIRQVYWLRILLPEIRTNQKDKL

SEQ ID NO: 2130032 - protein, 25 aa, Cryptosporidium hominis
CLDFISLLNVLIQGIQFLQTLITMI

SEQ ID NO: 2130033 - protein, 17 aa, Cryptosporidium hominis
CLFSAASIIFTYLYVFL

SEQ ID NO: 2130034 - protein, 23 aa, Cryptosporidium hominis
CLGVFTCILTCIIISYIQDNHTR

SEQ ID NO: 2130035 - protein, 20 aa, Cryptosporidium hominis
CLIAEVGLFMIYDIKRDMRE

SEQ ID NO: 2130036 - protein, 17 aa, Cryptosporidium hominis
CLLAIIISRLRVLALPY

SEQ ID NO: 2130037 - protein, 24 aa, Cryptosporidium hominis
CLTYLLVAAFTTIALILIFVIFDK

SEQ ID NO: 2130038 - protein, 18 aa, Cryptosporidium hominis
CLYIVILCIYIPGSIFMY

SEQ ID NO: 2130039 - protein, 24 aa, Cryptosporidium hominis
CMEALPLFLDRIIPSWVAVICSVT

SEQ ID NO: 2130040 - protein, 18 aa, Cryptosporidium hominis
CMIFTSFLSYLGIAGFII

SEQ ID NO: 2130041 - protein, 18 aa, Cryptosporidium hominis
CMNTNILEIAWIILTEFN

SEQ ID NO: 2130042 - protein, 17 aa, Cryptosporidium hominis
CMTIIRIINLFVDQCQL

SEQ ID NO: 2130043 - protein, 17 aa, Cryptosporidium hominis
CMYPCMDLDLIIEKNII

SEQ ID NO: 2130044 - protein, 25 aa, Cryptosporidium hominis
CNIIKKIIYLTKLQKNIVFLALNSI

SEQ ID NO: 2130045 - protein, 18 aa, Cryptosporidium hominis
CNIKEFMKIFSASNKKKL

SEQ ID NO: 2130046 - protein, 24 aa, Cryptosporidium hominis
CNRSNFMFLSKDKLVKILNLIIVL

SEQ ID NO: 2130047 - protein, 28 aa, Cryptosporidium hominis
CNVPNDIWRIKLIISRLFKIDSTTHPNL

SEQ ID NO: 2130048 - protein, 17 aa, Cryptosporidium hominis
CPAIFFDCTHDNETPCE

SEQ ID NO: 2130049 - protein, 17 aa, Cryptosporidium hominis
CPGVEFLSKGFIEKLIV

SEQ ID NO: 2130050 - protein, 27 aa, Cryptosporidium hominis
CRRVRGWNLPFLRTIPQMNAITQIRHE

SEQ ID NO: 2130051 - protein, 26 aa, Cryptosporidium hominis
CSIDKFLLLFEMLGIILSIPDSSLSN

SEQ ID NO: 2130052 - protein, 24 aa, Cryptosporidium hominis
CSKLYPALCFDLYGSPGFHNIYVG

SEQ ID NO: 2130053 - protein, 24 aa, Cryptosporidium hominis
CSSIQLMSFWKLYNDVFDLVESEF

SEQ ID NO: 2130054 - protein, 20 aa, Cryptosporidium hominis
CSWMLLLLSYFFGAGYLFSG

SEQ ID NO: 2130055 - protein, 24 aa, Cryptosporidium hominis
CTAPPIVQIFGSILAILGIHFSKK

SEQ ID NO: 2130056 - protein, 31 aa, Cryptosporidium hominis
CTLPFPGNDNWLLRRAFLPEVVIQRVAFCKE

SEQ ID NO: 2130057 - protein, 27 aa, Cryptosporidium hominis
CTSQYFLWWFILFPLALRVYLTNNIAQ

SEQ ID NO: 2130058 - protein, 25 aa, Cryptosporidium hominis
CTVMIFSFLRHIWSFDKSSIKIIFS

SEQ ID NO: 2130059 - protein, 24 aa, Cryptosporidium hominis
CVAGIYFFFIFYGIVQERIHTLGD

SEQ ID NO: 2130060 - protein, 18 aa, Cryptosporidium hominis
CVGGGLLGYINRAKKLLK

SEQ ID NO: 2130061 - protein, 19 aa, Cryptosporidium hominis
CVGVYFLGVGVVGSVLYIP

SEQ ID NO: 2130062 - protein, 20 aa, Cryptosporidium hominis
CVIKVLLLLGQVLAFDAEGH

SEQ ID NO: 2130063 - protein, 26 aa, Cryptosporidium hominis
CVIRGIMVFILSPLLTRIGYGLTIKE

SEQ ID NO: 2130064 - protein, 25 aa, Cryptosporidium hominis
CVTSYSILIWLLLENINALGFVSGF

SEQ ID NO: 2130065 - protein, 27 aa, Cryptosporidium hominis
CWPNDIIYFVRILLLLRGICAELNESI

SEQ ID NO: 2130066 - protein, 22 aa, Cryptosporidium hominis
CYRLLFFLIHVIRRLYEEVFIS

SEQ ID NO: 2130067 - protein, 18 aa, Cryptosporidium hominis
CYVWKFSILNSYCLPLIN

SEQ ID NO: 2130068 - protein, 17 aa, Cryptosporidium hominis
CYWSKYTVFGNCQRSVY

SEQ ID NO: 2130069 - protein, 19 aa, Cryptosporidium hominis
DAFLRERAKAHWLICLVDG

SEQ ID NO: 2130070 - protein, 25 aa, Cryptosporidium hominis
DAFMAFQILQLLIKLAKTGRTIICT

SEQ ID NO: 2130071 - protein, 39 aa, Cryptosporidium hominis
DAGTKGMLVKWGLVVLIFQLFFSLLINAGDLDLPSRNSE

SEQ ID NO: 2130072 - protein, 27 aa, Cryptosporidium hominis
DAISWEFPFISFISFLVLALSSIFLRN

SEQ ID NO: 2130073 - protein, 24 aa, Cryptosporidium hominis
DAITTKFYILHNWVFFGNNVVNTS

SEQ ID NO: 2130074 - protein, 33 aa, Cryptosporidium hominis
DASISLISFPSPLLPQHIPLVLSSCLTILVTVS

SEQ ID NO: 2130075 - protein, 27 aa, Cryptosporidium hominis
DASPLAIFISVYLQAMSIVQSNLMQIQ

SEQ ID NO: 2130076 - protein, 22 aa, Cryptosporidium hominis
DASSVFKFWKNMISLVTCISEI

SEQ ID NO: 2130077 - protein, 18 aa, Cryptosporidium hominis
DAYRLYNVTPRLISFLDT

SEQ ID NO: 2130078 - protein, 27 aa, Cryptosporidium hominis
DCGWRRPRITIPPPVDSIDASPLAIFI

SEQ ID NO: 2130079 - protein, 24 aa, Cryptosporidium hominis
DDESAIFSLEYFKQIGSKKDYENH

SEQ ID NO: 2130080 - protein, 21 aa, Cryptosporidium hominis
DDIKQCCIFISQIILNSPISL

SEQ ID NO: 2130081 - protein, 17 aa, Cryptosporidium hominis
DDILISNKLLYGHKMII

SEQ ID NO: 2130082 - protein, 36 aa, Cryptosporidium hominis
DDKKKSHWGVFWYILPIILILFSSGAGFAYYYYLNN

SEQ ID NO: 2130083 - protein, 23 aa, Cryptosporidium hominis
DDMNGFYIMPVKEYYRFLDMESI

SEQ ID NO: 2130084 - protein, 18 aa, Cryptosporidium hominis
DDMVPADLLIPKLKKMMP

SEQ ID NO: 2130085 - protein, 24 aa, Cryptosporidium hominis
DDPKDKIVTYGFGGGPVAPPASTT

SEQ ID NO: 2130086 - protein, 27 aa, Cryptosporidium hominis
DDPVAYMNPAPPILFKEMKSPIVGVGD

SEQ ID NO: 2130087 - protein, 19 aa, Cryptosporidium hominis
DDYIIWMFSVVVAPLIIMV

SEQ ID NO: 2130088 - protein, 26 aa, Cryptosporidium hominis
DEEKKLAIMLFENGICTYLMIILLNQ

SEQ ID NO: 2130089 - protein, 32 aa, Cryptosporidium hominis
DEFFQSELFERKPGFFFFLEEKQTGIVFENVS

SEQ ID NO: 2130090 - protein, 23 aa, Cryptosporidium hominis
DEGNLFWVIRSYSLSTGSDVNVD

SEQ ID NO: 2130091 - protein, 32 aa, Cryptosporidium hominis
DEKCDVWSIGVILFILLAGYPPFGGQTDQEIL

SEQ ID NO: 2130092 - protein, 24 aa, Cryptosporidium hominis
DEKFQPFIFNLFSLLCENSNKNHT

SEQ ID NO: 2130093 - protein, 18 aa, Cryptosporidium hominis
DENITPYFKILKNGAKID

SEQ ID NO: 2130094 - protein, 29 aa, Cryptosporidium hominis
DENTLFNGFFINLGILVIAILICVEKGYI

SEQ ID NO: 2130095 - protein, 25 aa, Cryptosporidium hominis
DENYRICNLSKVKLPKLLRRVSGRR

SEQ ID NO: 2130096 - protein, 18 aa, Cryptosporidium hominis
DERHLPYYFLNEFPICKE

SEQ ID NO: 2130097 - protein, 26 aa, Cryptosporidium hominis
DEYNKFFLAYLSYLVLYSTRKPFSVV

SEQ ID NO: 2130098 - protein, 30 aa, Cryptosporidium hominis
DFAIIGSLVVILLIYGWTVGYGSNIYTSRA

SEQ ID NO: 2130099 - protein, 24 aa, Cryptosporidium hominis
DFDEYEDLYYYGFENDYGSNHSKN

SEQ ID NO: 2130100 - protein, 25 aa, Cryptosporidium hominis
DFFEKIGSIFYLLLLKRYETTFCDI

SEQ ID NO: 2130101 - protein, 20 aa, Cryptosporidium hominis
DFFIYYQLRNFYQNNKSFIF

SEQ ID NO: 2130102 - protein, 27 aa, Cryptosporidium hominis
DFITHFPVIVMYLLDEWDPILRLDKFI

SEQ ID NO: 2130103 - protein, 19 aa, Cryptosporidium hominis
DFLHLFPFSEIFSRSRKLE

SEQ ID NO: 2130104 - protein, 30 aa, Cryptosporidium hominis
DFSLKCFHAICWCCTLRLRYLLKSKECPFC

SEQ ID NO: 2130105 - protein, 18 aa, Cryptosporidium hominis
DFTFRLYALYAQHSYIFF

SEQ ID NO: 2130106 - protein, 29 aa, Cryptosporidium hominis
DFTTYSMYIVTVLTIVGAFYVISSIRKRE

SEQ ID NO: 2130107 - protein, 24 aa, Cryptosporidium hominis
DFVTLFISLFSWYNFYTLCRTYAQ

SEQ ID NO: 2130108 - protein, 33 aa, Cryptosporidium hominis
DGDFFILVPATAKPVLIPPIGLSGGTGGAEGKG

SEQ ID NO: 2130109 - protein, 18 aa, Cryptosporidium hominis
DGEGFLKAVSKLVNIRKR

SEQ ID NO: 2130110 - protein, 23 aa, Cryptosporidium hominis
DGGTVFKGEFPAGGPFSSPSDSS

SEQ ID NO: 2130111 - protein, 37 aa, Cryptosporidium hominis
DGKAIYGDNLLYFKKKIIPKMTILNLIEKSRNVRSKT

SEQ ID NO: 2130112 - protein, 17 aa, Cryptosporidium hominis
DGLFLLYFQKRANKLKN

SEQ ID NO: 2130113 - protein, 24 aa, Cryptosporidium hominis
DGSLDFPCDDLTGMYAFCVGSINN

SEQ ID NO: 2130114 - protein, 24 aa, Cryptosporidium hominis
DHHKLSFLYLPHNETQLYFSMDGT

SEQ ID NO: 2130115 - protein, 37 aa, Cryptosporidium hominis
DHHSRKLFYQVYRPSILIFGIFLYLCVSNSNQANDYI

SEQ ID NO: 2130116 - protein, 25 aa, Cryptosporidium hominis
DHLKPDFFYAFNSMPGWIQNRFIFA

SEQ ID NO: 2130117 - protein, 22 aa, Cryptosporidium hominis
DIALRYFLSRFFLPGESQMVYR

SEQ ID NO: 2130118 - protein, 20 aa, Cryptosporidium hominis
DICSYFISLLGIHLSKRKAT

SEQ ID NO: 2130119 - protein, 30 aa, Cryptosporidium hominis
DIEKSCLKPLIYFLKSIPSGFAPLPLPSLE

SEQ ID NO: 2130120 - protein, 27 aa, Cryptosporidium hominis
DIFIKEEILFLINYFKNNGFLEIEKIK

SEQ ID NO: 2130121 - protein, 23 aa, Cryptosporidium hominis
DIGLFGFMYYWNVKLNMVSMINL

SEQ ID NO: 2130122 - protein, 19 aa, Cryptosporidium hominis
DIIGKIVSILLIIREKLLP

SEQ ID NO: 2130123 - protein, 18 aa, Cryptosporidium hominis
DIIPFYKHIILKVVDQND

SEQ ID NO: 2130124 - protein, 18 aa, Cryptosporidium hominis
DIIPLYPLGSIFESKNEQ

SEQ ID NO: 2130125 - protein, 25 aa, Cryptosporidium hominis
DIISALLKGPLLYWRDKRLAKLHEV

SEQ ID NO: 2130126 - protein, 23 aa, Cryptosporidium hominis
DIKELLSLLRKYIRTNGSCLESF

SEQ ID NO: 2130127 - protein, 31 aa, Cryptosporidium hominis
DIKESTRFLFWIIRHFDLNYLSPAIAFSITK

SEQ ID NO: 2130128 - protein, 18 aa, Cryptosporidium hominis
DILALDDILLKYLAKSND

SEQ ID NO: 2130129 - protein, 22 aa, Cryptosporidium hominis
DILLIDFTRLLISKAVMFSSLF

SEQ ID NO: 2130130 - protein, 23 aa, Cryptosporidium hominis
DILTLKFVRIVSTSLFFTGVKPI

SEQ ID NO: 2130131 - protein, 29 aa, Cryptosporidium hominis
DIMALYDPRFLVFEFAYSILLRKDQVELI

SEQ ID NO: 2130132 - protein, 19 aa, Cryptosporidium hominis
DINPIIMREYLLKVLINDS

SEQ ID NO: 2130133 - protein, 31 aa, Cryptosporidium hominis
DINSKQCYIIVFLLQKITTCLLFRGRRTIRR

SEQ ID NO: 2130134 - protein, 27 aa, Cryptosporidium hominis
DIPEFHLYQWIFVIDFFNTKDTTETDD

SEQ ID NO: 2130135 - protein, 30 aa, Cryptosporidium hominis
DIQQKSMLILLVRLIQFTFKNIYLPTSLLV

SEQ ID NO: 2130136 - protein, 20 aa, Cryptosporidium hominis
DIQYKFFLQLIAACICNRKL

SEQ ID NO: 2130137 - protein, 25 aa, Cryptosporidium hominis
DIRNDDFFLFLKSIVDFCVIEEDLK

SEQ ID NO: 2130138 - protein, 24 aa, Cryptosporidium hominis
DISPWKPVFIDSSDLRFWTIFFED

SEQ ID NO: 2130139 - protein, 21 aa, Cryptosporidium hominis
DISTILWFKTFEAKISIILEG

SEQ ID NO: 2130140 - protein, 28 aa, Cryptosporidium hominis
DIYSAALILLELLCPRFTTAMERIHVLD

SEQ ID NO: 2130141 - protein, 19 aa, Cryptosporidium hominis
DKCFIREDPKFPWPNCSQV

SEQ ID NO: 2130142 - protein, 21 aa, Cryptosporidium hominis
DKFFRKMVVPILKSVNFMASP

SEQ ID NO: 2130143 - protein, 32 aa, Cryptosporidium hominis
DKFPVLLYEAEGLVFWLFRVHNLVTLRVATES

SEQ ID NO: 2130144 - protein, 38 aa, Cryptosporidium hominis
DKGIKLASRCPIWFEYFCLILWRLLPIFEQSIPVSESS

SEQ ID NO: 2130145 - protein, 25 aa, Cryptosporidium hominis
DKIKIIIIYFVIFLVGLFTNIVSEI

SEQ ID NO: 2130146 - protein, 24 aa, Cryptosporidium hominis
DKNDGFLVLIRFISQIRGHPIIGK

SEQ ID NO: 2130147 - protein, 23 aa, Cryptosporidium hominis
DKNLFRFKIFVVTLLYISRSIIE

SEQ ID NO: 2130148 - protein, 28 aa, Cryptosporidium hominis
DKNPFTYPFFILLLDVFTYIIIMCLRHI

SEQ ID NO: 2130149 - protein, 27 aa, Cryptosporidium hominis
DKQNNTFYIFLIDLSYKTGIFEKIMSL

SEQ ID NO: 2130150 - protein, 32 aa, Cryptosporidium hominis
DKSIFEGKKFALIYIILALIQLAVSSMVFIGE

SEQ ID NO: 2130151 - protein, 26 aa, Cryptosporidium hominis
DKSPIPYISKILFYNVIIQQINNSNT

SEQ ID NO: 2130152 - protein, 19 aa, Cryptosporidium hominis
DKYSKFRNWILNSLSSVRE

SEQ ID NO: 2130153 - protein, 23 aa, Cryptosporidium hominis
DLASPWVLYINVLGNREYPRGTW

SEQ ID NO: 2130154 - protein, 19 aa, Cryptosporidium hominis
DLDMWRLNELTKGNCLSVA

SEQ ID NO: 2130155 - protein, 24 aa, Cryptosporidium hominis
DLDSKVAILMAPINETLSILQETT

SEQ ID NO: 2130156 - protein, 25 aa, Cryptosporidium hominis
DLDSQPLFPWGPLYSYQHPVVTVSQ

SEQ ID NO: 2130157 - protein, 26 aa, Cryptosporidium hominis
DLESAKKFLKLLYIQKLWGSNVSKDK

SEQ ID NO: 2130158 - protein, 18 aa, Cryptosporidium hominis
DLFFVIDYRFNSFGKKKI

SEQ ID NO: 2130159 - protein, 25 aa, Cryptosporidium hominis
DLKRHLLIYFFIEAFISLIEVLSSI

SEQ ID NO: 2130160 - protein, 23 aa, Cryptosporidium hominis
DLLLGLYRYIGYDEFQFLSMDTP

SEQ ID NO: 2130161 - protein, 24 aa, Cryptosporidium hominis
DLLTVYIILFMLNGSPSIYYGSEF

SEQ ID NO: 2130162 - protein, 28 aa, Cryptosporidium hominis
DLMAIPVTLLVRLIILSNGIEGGIREIN

SEQ ID NO: 2130163 - protein, 25 aa, Cryptosporidium hominis
DLNHAVEQIFLKSSLYSNDLKKLVL

SEQ ID NO: 2130164 - protein, 29 aa, Cryptosporidium hominis
DLNSFRLYTYYTTHYLFQITSIFSMGISL

SEQ ID NO: 2130165 - protein, 24 aa, Cryptosporidium hominis
DLQYKDTLYPVLFQRLPSSSSRTL

SEQ ID NO: 2130166 - protein, 23 aa, Cryptosporidium hominis
DLSPLFYSVISKNLRMTHFLLKC

SEQ ID NO: 2130167 - protein, 25 aa, Cryptosporidium hominis
DLSSNLFIGVLYLFSDVYQNNSGSD

SEQ ID NO: 2130168 - protein, 19 aa, Cryptosporidium hominis
DLSSYLFELLRKGGNPTVY

SEQ ID NO: 2130169 - protein, 32 aa, Cryptosporidium hominis
DLSTMINHSWIYQGLIHDVYNLKLNRITIDDP

SEQ ID NO: 2130170 - protein, 24 aa, Cryptosporidium hominis
DLTKYGYIWAAMSGTPIFKDQAKI

SEQ ID NO: 2130171 - protein, 26 aa, Cryptosporidium hominis
DLVLEKYIFGIITFLSEKILNSDEFS

SEQ ID NO: 2130172 - protein, 19 aa, Cryptosporidium hominis
DLVSRFLGWFNPVNWQVLK

SEQ ID NO: 2130173 - protein, 20 aa, Cryptosporidium hominis
DLYLLIFRMNEEISILCISV

SEQ ID NO: 2130174 - protein, 25 aa, Cryptosporidium hominis
DLYNYAMFLIGCAEIYFTINSKRRV

SEQ ID NO: 2130175 - protein, 20 aa, Cryptosporidium hominis
DLYRKLPFNFKPIKLKSGSK

SEQ ID NO: 2130176 - protein, 35 aa, Cryptosporidium hominis
DNKPILYKIKQPIGWMLYDPLLPIKFFGSEDETNY

SEQ ID NO: 2130177 - protein, 28 aa, Cryptosporidium hominis
DNLIKDELKWAYLDHLITTPIGASAVLR

SEQ ID NO: 2130178 - protein, 28 aa, Cryptosporidium hominis
DNLISAWVFVRFLIVGLYVGIATVGIFV

SEQ ID NO: 2130179 - protein, 17 aa, Cryptosporidium hominis
DNLLFFIQGLENALHEL

SEQ ID NO: 2130180 - protein, 22 aa, Cryptosporidium hominis
DNLNFYWMNLSSTVLLRGFEHS

SEQ ID NO: 2130181 - protein, 26 aa, Cryptosporidium hominis
DNQNLINPFYFWDLRFGQSIVCDNAP

SEQ ID NO: 2130182 - protein, 25 aa, Cryptosporidium hominis
DNSSGVLLFIPMFLSINKGGNYKVS

SEQ ID NO: 2130183 - protein, 23 aa, Cryptosporidium hominis
DNVKLYCWFIIHKKFDRYSHEQS

SEQ ID NO: 2130184 - protein, 18 aa, Cryptosporidium hominis
DNYKLLFFSFIQTFVTLF

SEQ ID NO: 2130185 - protein, 26 aa, Cryptosporidium hominis
DPLCTILFSFFVLATTIKILKDSANV

SEQ ID NO: 2130186 - protein, 25 aa, Cryptosporidium hominis
DPNLKFEIDFIKKYLSKFSNKNCLL

SEQ ID NO: 2130187 - protein, 21 aa, Cryptosporidium hominis
DPRYTLECLKLLILNKSLFCN

SEQ ID NO: 2130188 - protein, 18 aa, Cryptosporidium hominis
DQCLNLIRYLDSNDFRVK

SEQ ID NO: 2130189 - protein, 23 aa, Cryptosporidium hominis
DQEILGSPFWMAPEIILGTGTGI

SEQ ID NO: 2130190 - protein, 21 aa, Cryptosporidium hominis
DQIRKHWFFNAHPGLLELCDT

SEQ ID NO: 2130191 - protein, 22 aa, Cryptosporidium hominis
DQNIILKWFSETVVYISNDSLS

SEQ ID NO: 2130192 - protein, 28 aa, Cryptosporidium hominis
DRHLLRTLTFIFLFICTTVTYFVSDLGL

SEQ ID NO: 2130193 - protein, 27 aa, Cryptosporidium hominis
DRLERNLRYFLLNYIVIILGMTMLSLI

SEQ ID NO: 2130194 - protein, 19 aa, Cryptosporidium hominis
DRNGLTPFYFLLKDGMSTN

SEQ ID NO: 2130195 - protein, 18 aa, Cryptosporidium hominis
DRYLYIMMEFVIGGEFFT

SEQ ID NO: 2130196 - protein, 23 aa, Cryptosporidium hominis
DSAIPWWAVILGIVPERFSSSIA

SEQ ID NO: 2130197 - protein, 17 aa, Cryptosporidium hominis
DSIRLMVDPRIFSLSSG

SEQ ID NO: 2130198 - protein, 22 aa, Cryptosporidium hominis
DSKLTLTRYIGMNPQKVKITLV

SEQ ID NO: 2130199 - protein, 23 aa, Cryptosporidium hominis
DSLDLLELILKYIDDLSLMYEVD

SEQ ID NO: 2130200 - protein, 20 aa, Cryptosporidium hominis
DSLLERLSYSYALSQSVKLS

SEQ ID NO: 2130201 - protein, 21 aa, Cryptosporidium hominis
DSLYLTYITLLGYGKEMELGL

SEQ ID NO: 2130202 - protein, 23 aa, Cryptosporidium hominis
DSNYDHLILPLIDKLISLKEKDQ

SEQ ID NO: 2130203 - protein, 18 aa, Cryptosporidium hominis
DSRSWYPLGRIIGQTLFP

SEQ ID NO: 2130204 - protein, 25 aa, Cryptosporidium hominis
DSTRPWLLIITLSHQLWKFIIDSSI

SEQ ID NO: 2130205 - protein, 25 aa, Cryptosporidium hominis
DSVLLALSLIFTSPWYIYKDNSLKE

SEQ ID NO: 2130206 - protein, 25 aa, Cryptosporidium hominis
DSYKELIFIQRILQNIYKNIDSYNK

SEQ ID NO: 2130207 - protein, 33 aa, Cryptosporidium hominis
DTCASLLYWSLRVTRYFFPLTIALVLLSFTIFS

SEQ ID NO: 2130208 - protein, 20 aa, Cryptosporidium hominis
DTILNPRYIALPTPIKPPPD

SEQ ID NO: 2130209 - protein, 26 aa, Cryptosporidium hominis
DTIVKIMLGIPFFKYFEEKESMISSC

SEQ ID NO: 2130210 - protein, 30 aa, Cryptosporidium hominis
DTKTKKLFIERFWLLNPFHFSINISNDKKD

SEQ ID NO: 2130211 - protein, 24 aa, Cryptosporidium hominis
DTLGNILVFSLSVIVGYYCIWNVT

SEQ ID NO: 2130212 - protein, 21 aa, Cryptosporidium hominis
DTLIDILVNQTIWLTPEEQSK

SEQ ID NO: 2130213 - protein, 37 aa, Cryptosporidium hominis
DTLSLPVVLIIWDNFLLLGLPLLFQAGLSLLKLCEPQ

SEQ ID NO: 2130214 - protein, 25 aa, Cryptosporidium hominis
DTPFTSIFAASLRFFASIFGYGHSY

SEQ ID NO: 2130215 - protein, 27 aa, Cryptosporidium hominis
DTYGLPSLILFIRALNELNPQKNAELV

SEQ ID NO: 2130216 - protein, 29 aa, Cryptosporidium hominis
DVATIADYLRWIALVLFPSFIYIRNTMNS

SEQ ID NO: 2130217 - protein, 17 aa, Cryptosporidium hominis
DVFLIPIGNFLIKKISD

SEQ ID NO: 2130218 - protein, 23 aa, Cryptosporidium hominis
DVGHGFIVFLIGLVLVLNYGKLK

SEQ ID NO: 2130219 - protein, 26 aa, Cryptosporidium hominis
DVKQKDYFIIWGCNYLSQISTYLSIP

SEQ ID NO: 2130220 - protein, 23 aa, Cryptosporidium hominis
DVLLLTGMSLKYPTWSGEQLTNI

SEQ ID NO: 2130221 - protein, 32 aa, Cryptosporidium hominis
DVNMLFIFCELFSFIFLKFHSFWMERKPKNIL

SEQ ID NO: 2130222 - protein, 19 aa, Cryptosporidium hominis
DVPKYLLDLPYLYNSSRSG

SEQ ID NO: 2130223 - protein, 25 aa, Cryptosporidium hominis
DVPLTLEAFRYAGIKIWLLTGDKLE

SEQ ID NO: 2130224 - protein, 19 aa, Cryptosporidium hominis
DVSKDFWPFEALLAGNAML

SEQ ID NO: 2130225 - protein, 21 aa, Cryptosporidium hominis
DVVPGHYLILILNGTKNFVNI

SEQ ID NO: 2130226 - protein, 18 aa, Cryptosporidium hominis
DWCVSRNRFWGTPIPIWV

SEQ ID NO: 2130227 - protein, 21 aa, Cryptosporidium hominis
DWIILVTHYSIYSSGLHGPHA

SEQ ID NO: 2130228 - protein, 34 aa, Cryptosporidium hominis
DWKSPSILVSILRLLILNPRLALSSRMPRFSEEV

SEQ ID NO: 2130229 - protein, 35 aa, Cryptosporidium hominis
DWSKQGFYMKIFSGLKLLFWNLDKIGDIFGKIIND

SEQ ID NO: 2130230 - protein, 17 aa, Cryptosporidium hominis
DWSSIPNNFVNFNRILK

SEQ ID NO: 2130231 - protein, 25 aa, Cryptosporidium hominis
DYAMNPFWEFFAYQIPECISPNLLT

SEQ ID NO: 2130232 - protein, 23 aa, Cryptosporidium hominis
DYANRTYLMYGNSLLSMLLGIHL

SEQ ID NO: 2130233 - protein, 25 aa, Cryptosporidium hominis
DYIEKLFVIVRSIRFLIYANELLLR

SEQ ID NO: 2130234 - protein, 24 aa, Cryptosporidium hominis
DYIVWFDLDIVITNKFFSIERILD

SEQ ID NO: 2130235 - protein, 26 aa, Cryptosporidium hominis
DYKFSKINTLQLLEKSLKGLKFEDTS

SEQ ID NO: 2130236 - protein, 25 aa, Cryptosporidium hominis
DYPNGLALELSLTKLPEKLSSSLDS

SEQ ID NO: 2130237 - protein, 20 aa, Cryptosporidium hominis
DYQWIYLKEYIIRLKEARKN

SEQ ID NO: 2130238 - protein, 24 aa, Cryptosporidium hominis
DYQYTFSCLIFQKKKSELLLLEEK

SEQ ID NO: 2130239 - protein, 18 aa, Cryptosporidium hominis
DYRTFSMRFLLGVSESFS

SEQ ID NO: 2130240 - protein, 36 aa, Cryptosporidium hominis
EAERDLNIFYIVWKLLLYITLGVSIMLCIIQNPLTG

SEQ ID NO: 2130241 - protein, 25 aa, Cryptosporidium hominis
EAFFSSIFPCKYRPYSYVILTIGAE

SEQ ID NO: 2130242 - protein, 17 aa, Cryptosporidium hominis
EAFGEDIVIPLLIMTSD

SEQ ID NO: 2130243 - protein, 24 aa, Cryptosporidium hominis
EAIFLIAEYLLLISSIILGIYIAY

SEQ ID NO: 2130244 - protein, 18 aa, Cryptosporidium hominis
EAISFPVIIRINPEYITG

SEQ ID NO: 2130245 - protein, 17 aa, Cryptosporidium hominis
EAKFFSLNNFWKVIIGF

SEQ ID NO: 2130246 - protein, 18 aa, Cryptosporidium hominis
EAMLQSFWCIHALQHALI

SEQ ID NO: 2130247 - protein, 20 aa, Cryptosporidium hominis
EANVIRFWNKILAKELKNVA

SEQ ID NO: 2130248 - protein, 24 aa, Cryptosporidium hominis
EATYFSYYYSVISSLLMIFNYNSV

SEQ ID NO: 2130249 - protein, 29 aa, Cryptosporidium hominis
EAVIWSHLMRKWIFLPRRVSFDEYDEEKD

SEQ ID NO: 2130250 - protein, 20 aa, Cryptosporidium hominis
ECIMYFMKQISNKRAKFIVF

SEQ ID NO: 2130251 - protein, 26 aa, Cryptosporidium hominis
ECMNILRRYYFFVAIVYEIISTSNCV

SEQ ID NO: 2130252 - protein, 27 aa, Cryptosporidium hominis
ECPNQYLLLVAFIGMIMLVLLISYGIA

SEQ ID NO: 2130253 - protein, 25 aa, Cryptosporidium hominis
ECVFILYCSFALPSLLFSSFSLMIL

SEQ ID NO: 2130254 - protein, 24 aa, Cryptosporidium hominis
EDCVENIKYLPLKLAQVGASSVIE

SEQ ID NO: 2130255 - protein, 36 aa, Cryptosporidium hominis
EDDFQDLLWHLIIYSIAPFIVYIYNRRMKFVYDPSN

SEQ ID NO: 2130256 - protein, 31 aa, Cryptosporidium hominis
EDFIMALIQFILLPCRIFVASLLMYRNIGES

SEQ ID NO: 2130257 - protein, 27 aa, Cryptosporidium hominis
EDFLDIPEIFWHNYKFHSVWRNLQEYL

SEQ ID NO: 2130258 - protein, 27 aa, Cryptosporidium hominis
EDFSGIPLFMIFVQSNSLILSSRSYLI

SEQ ID NO: 2130259 - protein, 28 aa, Cryptosporidium hominis
EDGIPGFRILWTVRIIYISSVFLSWLVL

SEQ ID NO: 2130260 - protein, 19 aa, Cryptosporidium hominis
EDILILYKLSNFNILIIVI

SEQ ID NO: 2130261 - protein, 36 aa, Cryptosporidium hominis
EDMSNFDYLKIFKIPLILFILSLISVLFVDLFGKDY

SEQ ID NO: 2130262 - protein, 25 aa, Cryptosporidium hominis
EDNLIYGYKNPQCVPLTILENGCPM

SEQ ID NO: 2130263 - protein, 30 aa, Cryptosporidium hominis
EDPRNIWLKLFLPDWSPLGGFLLVIVSVGA

SEQ ID NO: 2130264 - protein, 24 aa, Cryptosporidium hominis
EDRNKLIGILPQVPLILKGWTVRN

SEQ ID NO: 2130265 - protein, 26 aa, Cryptosporidium hominis
EDSEKFYVRVLLNKKRFPKLVYDKIV

SEQ ID NO: 2130266 - protein, 28 aa, Cryptosporidium hominis
EDTIDYVPIHQLLRQYFPHCTVFVVAHH

SEQ ID NO: 2130267 - protein, 30 aa, Cryptosporidium hominis
EEAKHLGRIIFYLGLRFIKNEKVRAELTLG

SEQ ID NO: 2130268 - protein, 26 aa, Cryptosporidium hominis
EECGTSFVMWFEKGTPVATLKCGDYT

SEQ ID NO: 2130269 - protein, 24 aa, Cryptosporidium hominis
EEFLNEDLDPKYRARYPLVENGPF

SEQ ID NO: 2130270 - protein, 35 aa, Cryptosporidium hominis
EEHFPHITLSFNPPICILYAKLYWKENKSPVSTIV

SEQ ID NO: 2130271 - protein, 23 aa, Cryptosporidium hominis
EEKESIDFIFNSALATLAEEDRN

SEQ ID NO: 2130272 - protein, 35 aa, Cryptosporidium hominis
EEKIYPLLILEFSSSLFLTLWLMLIALSGYSVKNQ

SEQ ID NO: 2130273 - protein, 40 aa, Cryptosporidium hominis
EEKRPYNYFRNNPIMRLFFFIFILAMFSPANISNGLQKAQ

SEQ ID NO: 2130274 - protein, 20 aa, Cryptosporidium hominis
EENMWTKWGLLKVEPETQEI

SEQ ID NO: 2130275 - protein, 31 aa, Cryptosporidium hominis
EEQSKTIDLLLLLSVYSPYELLLFLEEQKEW

SEQ ID NO: 2130276 - protein, 21 aa, Cryptosporidium hominis
EESSWFSSWFGGTTEPAKVND

SEQ ID NO: 2130277 - protein, 23 aa, Cryptosporidium hominis
EESYQLSFLMLVKMGIIEPVYNI

SEQ ID NO: 2130278 - protein, 24 aa, Cryptosporidium hominis
EETISFPRLVIIRPKGLNNLKDIN

SEQ ID NO: 2130279 - protein, 24 aa, Cryptosporidium hominis
EEVFKIAFMLLRKGCRMQLDAFLR

SEQ ID NO: 2130280 - protein, 26 aa, Cryptosporidium hominis
EFCRTNIIPLLLKRHSISKKLAIIKS

SEQ ID NO: 2130281 - protein, 26 aa, Cryptosporidium hominis
EFEESIIEILLFPIIRNFCCDEQEGV

SEQ ID NO: 2130282 - protein, 29 aa, Cryptosporidium hominis
EFFNIYAQLLYYSYIYRIIFILQCKFTNK

SEQ ID NO: 2130283 - protein, 25 aa, Cryptosporidium hominis
EFILKVLALFYWISMPLFRMPHESR

SEQ ID NO: 2130284 - protein, 18 aa, Cryptosporidium hominis
EFLKLLLELYKLTSELKS

SEQ ID NO: 2130285 - protein, 28 aa, Cryptosporidium hominis
EFLRQIEIFFLIFYPFAFHVSVVAVMFY

SEQ ID NO: 2130286 - protein, 32 aa, Cryptosporidium hominis
EFNNILAIVILSFAWYCLFVLYFTGCVKFLEK

SEQ ID NO: 2130287 - protein, 18 aa, Cryptosporidium hominis
EFSLRIFSYFRSIGVYNT

SEQ ID NO: 2130288 - protein, 28 aa, Cryptosporidium hominis
EFSLYHIMDLILFFLPNKVNKHNSSFYM

SEQ ID NO: 2130289 - protein, 18 aa, Cryptosporidium hominis
EFSNYFEIIFSNGGFKDK

SEQ ID NO: 2130290 - protein, 26 aa, Cryptosporidium hominis
EFVDEIVDLLWLGPSSPVISSLLAEF

SEQ ID NO: 2130291 - protein, 28 aa, Cryptosporidium hominis
EFVHSKIINLPYLSALFNVPNSITHENK

SEQ ID NO: 2130292 - protein, 18 aa, Cryptosporidium hominis
EFVKFSYSLRFLGEVIKK

SEQ ID NO: 2130293 - protein, 17 aa, Cryptosporidium hominis
EFYNLIGVNIFAVSYRG

SEQ ID NO: 2130294 - protein, 18 aa, Cryptosporidium hominis
EFYSRIRIILRLSCAISP

SEQ ID NO: 2130295 - protein, 22 aa, Cryptosporidium hominis
EGDSFYIEFIELLFLSQGESYD

SEQ ID NO: 2130296 - protein, 25 aa, Cryptosporidium hominis
EGFTFQTIFRHFPLRRSFVFELMDH

SEQ ID NO: 2130297 - protein, 20 aa, Cryptosporidium hominis
EGGSFFALGLINAGYMDQKS

SEQ ID NO: 2130298 - protein, 31 aa, Cryptosporidium hominis
EGISAFIEPIVILFILILNAFVGVWQESNAE

SEQ ID NO: 2130299 - protein, 21 aa, Cryptosporidium hominis
EGKRLLQFIKISTAVIDLRRR

SEQ ID NO: 2130300 - protein, 25 aa, Cryptosporidium hominis
EGKYEKPFFMLKKIFEMFIELQIIN

SEQ ID NO: 2130301 - protein, 17 aa, Cryptosporidium hominis
EGLEMYCKTVWKCIVDC

SEQ ID NO: 2130302 - protein, 18 aa, Cryptosporidium hominis
EGLYIVSIIPFISLLVSM

SEQ ID NO: 2130303 - protein, 22 aa, Cryptosporidium hominis
EGQFCMGMVYTLFPFLDSLECI

SEQ ID NO: 2130304 - protein, 24 aa, Cryptosporidium hominis
EGRNLLWWMTHLGDEELIRILVSF

SEQ ID NO: 2130305 - protein, 40 aa, Cryptosporidium hominis
EGSLGNIISFRDPLYGFPDKQFILLYLQEVLINIKNNNIM

SEQ ID NO: 2130306 - protein, 20 aa, Cryptosporidium hominis
EGYVIYLILGPYSTNIRDEL

SEQ ID NO: 2130307 - protein, 27 aa, Cryptosporidium hominis
EHDLYLKLCFELLLSFEKHSWAVSIAL

SEQ ID NO: 2130308 - protein, 17 aa, Cryptosporidium hominis
EHFSYMITQIISLLLCC

SEQ ID NO: 2130309 - protein, 41 aa, Cryptosporidium hominis
EHGMLETFYVSRYLYLVVSLLDLPYFVDSFSLFWCKEQERK

SEQ ID NO: 2130310 - protein, 22 aa, Cryptosporidium hominis
EHISNILGIHIQDIVIDEIYAE

SEQ ID NO: 2130311 - protein, 26 aa, Cryptosporidium hominis
EHKKYSWWVYFVVCIATQIIIGAIVK

SEQ ID NO: 2130312 - protein, 24 aa, Cryptosporidium hominis
EHSLHYILLSCIIIPLMSSAEWLL

SEQ ID NO: 2130313 - protein, 25 aa, Cryptosporidium hominis
EHYCSIGYIPLDIPAPRGPLFVLGN

SEQ ID NO: 2130314 - protein, 24 aa, Cryptosporidium hominis
EHYTKFVCIIWSIISSMDPESIYK

SEQ ID NO: 2130315 - protein, 22 aa, Cryptosporidium hominis
EICPYVWGLFIFIHCIAFYIRY

SEQ ID NO: 2130316 - protein, 22 aa, Cryptosporidium hominis
EIDDLLGLLKLLTTIRNSLELG

SEQ ID NO: 2130317 - protein, 25 aa, Cryptosporidium hominis
EIDFKTWWNNIFLNRLGISDSKEHL

SEQ ID NO: 2130318 - protein, 20 aa, Cryptosporidium hominis
EIDLLIISNSRRKAFSLIHE

SEQ ID NO: 2130319 - protein, 24 aa, Cryptosporidium hominis
EIEIQWIIPAFYSSLSSSNSKPLK

SEQ ID NO: 2130320 - protein, 23 aa, Cryptosporidium hominis
EIELVILNLIPEMTILISIRELN

SEQ ID NO: 2130321 - protein, 27 aa, Cryptosporidium hominis
EIIDFEELILFNEIKILYNQKINFKLD

SEQ ID NO: 2130322 - protein, 31 aa, Cryptosporidium hominis
EIIDQGRMFLLDTIFFLLFSSPTIDNIEVGA

SEQ ID NO: 2130323 - protein, 17 aa, Cryptosporidium hominis
EIISTLLNLFLQNVKQP

SEQ ID NO: 2130324 - protein, 17 aa, Cryptosporidium hominis
EIKFEAKFFSLNNFWKV

SEQ ID NO: 2130325 - protein, 32 aa, Cryptosporidium hominis
EILGALLSILLIWFMTIMLVYEAIQRMLYPVN

SEQ ID NO: 2130326 - protein, 20 aa, Cryptosporidium hominis
EILHPFFIFQVCAVCIWFRN

SEQ ID NO: 2130327 - protein, 17 aa, Cryptosporidium hominis
EILLFTIKSLSYLWNFE

SEQ ID NO: 2130328 - protein, 30 aa, Cryptosporidium hominis
EILSTRFRAFLSYFLPMVYGISLFSVAWLK

SEQ ID NO: 2130329 - protein, 28 aa, Cryptosporidium hominis
EINEIFIQWNILRAGLKYILHQIKNNRK

SEQ ID NO: 2130330 - protein, 25 aa, Cryptosporidium hominis
EISLIFAGIVTGILIFVPTSLIFPK

SEQ ID NO: 2130331 - protein, 26 aa, Cryptosporidium hominis
EISLLFAQIIVLVLLTLLTSRLVTTV

SEQ ID NO: 2130332 - protein, 28 aa, Cryptosporidium hominis
EITSASKLLLFNYLKLNSTKTTLIHNYG

SEQ ID NO: 2130333 - protein, 25 aa, Cryptosporidium hominis
EITTFYKYCFNWVSQILIYSKEEII

SEQ ID NO: 2130334 - protein, 60 aa, Cryptosporidium hominis
EITTPDLYLFPRFLSFYKLAPIKLRQQMWLRRPRWFVYEIIPLIILFTKIFSSVDYYSIF

SEQ ID NO: 2130335 - protein, 33 aa, Cryptosporidium hominis
EIVTYYKVNLLVALLICFLLCDTVLTSNSTLHF

SEQ ID NO: 2130336 - protein, 21 aa, Cryptosporidium hominis
EIYPFVHFFFQNLDISNLKWK

SEQ ID NO: 2130337 - protein, 32 aa, Cryptosporidium hominis
EIYWMELIAFWVLLIMVIVLLRGIRSNYEVAI

SEQ ID NO: 2130338 - protein, 21 aa, Cryptosporidium hominis
EKDMRNLLFASTAIVAIIILL

SEQ ID NO: 2130339 - protein, 25 aa, Cryptosporidium hominis
EKDQKILVLIIFSKLIQYKTDKVSV

SEQ ID NO: 2130340 - protein, 35 aa, Cryptosporidium hominis
EKEFKMFKLGLNIQLFWFLRLNSLKFDFVSDNNSW

SEQ ID NO: 2130341 - protein, 22 aa, Cryptosporidium hominis
EKFSTVALIGFLVSQYKHFNDS

SEQ ID NO: 2130342 - protein, 26 aa, Cryptosporidium hominis
EKGFIYFITCLVCQICLVLSDLLSKT

SEQ ID NO: 2130343 - protein, 23 aa, Cryptosporidium hominis
EKGLYYIVGYIKYTLCIIQQPDS

SEQ ID NO: 2130344 - protein, 17 aa, Cryptosporidium hominis
EKGVYYAIDMGGTNLRC

SEQ ID NO: 2130345 - protein, 29 aa, Cryptosporidium hominis
EKKKFNFCKSFPLFFYPLSIIMQNKMFSD

SEQ ID NO: 2130346 - protein, 17 aa, Cryptosporidium hominis
EKLIQFINVSHIQILQD

SEQ ID NO: 2130347 - protein, 19 aa, Cryptosporidium hominis
EKLLLYLVGISMGGLMTLC

SEQ ID NO: 2130348 - protein, 21 aa, Cryptosporidium hominis
EKLRMKISILFASVLLDHISL

SEQ ID NO: 2130349 - protein, 22 aa, Cryptosporidium hominis
EKLTIWIGSWNLGGQPLNIDLD

SEQ ID NO: 2130350 - protein, 25 aa, Cryptosporidium hominis
EKLVNFTLALILYLRERQYDINHID

SEQ ID NO: 2130351 - protein, 29 aa, Cryptosporidium hominis
EKMINLPLFLIFLCVFRVLSNFFLTVILL

SEQ ID NO: 2130352 - protein, 23 aa, Cryptosporidium hominis
EKNPLKNFLEKIKKKRNLGLTNE

SEQ ID NO: 2130353 - protein, 26 aa, Cryptosporidium hominis
EKNVDIFWFMAYTMITLCVFAGIVVI

SEQ ID NO: 2130354 - protein, 26 aa, Cryptosporidium hominis
EKNYRHFFLLLFFVTMLLIMIIIATI

SEQ ID NO: 2130355 - protein, 25 aa, Cryptosporidium hominis
EKQYLRYAFAAPPEYLYPVTITIYS

SEQ ID NO: 2130356 - protein, 19 aa, Cryptosporidium hominis
EKVFVRIIGIKPKHVKMVI

SEQ ID NO: 2130357 - protein, 20 aa, Cryptosporidium hominis
EKVLFHIYTSMKMLLERNQS

SEQ ID NO: 2130358 - protein, 17 aa, Cryptosporidium hominis
EKVLKILHIKRLKFPIY

SEQ ID NO: 2130359 - protein, 24 aa, Cryptosporidium hominis
EKVRREMFLPIKFSESETPRGILF

SEQ ID NO: 2130360 - protein, 23 aa, Cryptosporidium hominis
EKYTILKSSLFNLLLNPINNQEQ

SEQ ID NO: 2130361 - protein, 19 aa, Cryptosporidium hominis
ELALITKELIYWTCTNRDK

SEQ ID NO: 2130362 - protein, 23 aa, Cryptosporidium hominis
ELDHYFGWLDIFKPRPVLVYNMS

SEQ ID NO: 2130363 - protein, 25 aa, Cryptosporidium hominis
ELDLMRLTKKLLIFSLTVIKGKKSF

SEQ ID NO: 2130364 - protein, 23 aa, Cryptosporidium hominis
ELERTEFIVNLYSKAFLSDSSMS

SEQ ID NO: 2130365 - protein, 32 aa, Cryptosporidium hominis
ELKETIINLSILLLILCILISTIILRAGEEFY

SEQ ID NO: 2130366 - protein, 28 aa, Cryptosporidium hominis
ELKKFVSIVFPHPKKFKPIFKGSLLIPN

SEQ ID NO: 2130367 - protein, 30 aa, Cryptosporidium hominis
ELKLGFLLQLAFFRLWSVNLAALIVSLEGL

SEQ ID NO: 2130368 - protein, 30 aa, Cryptosporidium hominis
ELKRMFGDYYLLLGKNIYFRKLSYTATQNS

SEQ ID NO: 2130369 - protein, 20 aa, Cryptosporidium hominis
ELLFETLRNLVSKLKSYLVK

SEQ ID NO: 2130370 - protein, 18 aa, Cryptosporidium hominis
ELLFPRLSKISIPINGPL

SEQ ID NO: 2130371 - protein, 24 aa, Cryptosporidium hominis
ELLGKYYIILRYLKNNLISISLGK

SEQ ID NO: 2130372 - protein, 26 aa, Cryptosporidium hominis
ELLIPILDFLVFSISLLNLAQILHVL

SEQ ID NO: 2130373 - protein, 37 aa, Cryptosporidium hominis
ELLRQYYNEYSFPDYMYIIVLGNLKNSVKIKNNPGEF

SEQ ID NO: 2130374 - protein, 18 aa, Cryptosporidium hominis
ELLTLENLVYFAENYRNI

SEQ ID NO: 2130375 - protein, 29 aa, Cryptosporidium hominis
ELNLVFVPLFILFEYFFPGLWNLDIPLFG

SEQ ID NO: 2130376 - protein, 24 aa, Cryptosporidium hominis
ELNPGYIYINHLLPYILTSEINKN

SEQ ID NO: 2130377 - protein, 25 aa, Cryptosporidium hominis
ELPFSYVEFYEKLGVFVIDVRSSIK

SEQ ID NO: 2130378 - protein, 23 aa, Cryptosporidium hominis
ELSNLLLPEILEKAFKFLTGCDL

SEQ ID NO: 2130379 - protein, 30 aa, Cryptosporidium hominis
ELTESILLMIITNIQLWWKEVLTNYYLDMA

SEQ ID NO: 2130380 - protein, 22 aa, Cryptosporidium hominis
ELTSGWLAFTVSTILIMIFGEI

SEQ ID NO: 2130381 - protein, 18 aa, Cryptosporidium hominis
ELVHYVLGIMFKSNIVAE

SEQ ID NO: 2130382 - protein, 19 aa, Cryptosporidium hominis
ELYVALGFGFYSHALLNLL

SEQ ID NO: 2130383 - protein, 32 aa, Cryptosporidium hominis
EMGVTYPYYYRPFFGYGFPLLGTEPYFQSGYG

SEQ ID NO: 2130384 - protein, 18 aa, Cryptosporidium hominis
EMLSKKFHFIRAPVINVG

SEQ ID NO: 2130385 - protein, 18 aa, Cryptosporidium hominis
EMPPYYHIYNSRSKLEES

SEQ ID NO: 2130386 - protein, 20 aa, Cryptosporidium hominis
EMRKVLLLVLHANVSRIEDL

SEQ ID NO: 2130387 - protein, 17 aa, Cryptosporidium hominis
EMRNKIFRQIKIVYPDA

SEQ ID NO: 2130388 - protein, 25 aa, Cryptosporidium hominis
EMSYRLWSIVYFIMTGIRISEYKYK

SEQ ID NO: 2130389 - protein, 24 aa, Cryptosporidium hominis
ENDKFIRFRAIYSQIQPVLQFIYR

SEQ ID NO: 2130390 - protein, 22 aa, Cryptosporidium hominis
ENFEYIQTVQFPITYPSSLEKY

SEQ ID NO: 2130391 - protein, 26 aa, Cryptosporidium hominis
ENGICTYLMIILLNQELRNCNAEIDN

SEQ ID NO: 2130392 - protein, 34 aa, Cryptosporidium hominis
ENIGINFQWFALEWFLCFFVTSLPLKSIMEILDL

SEQ ID NO: 2130393 - protein, 29 aa, Cryptosporidium hominis
ENIINSMVLPYFQLLPIPSSEFKPIKSNE

SEQ ID NO: 2130394 - protein, 26 aa, Cryptosporidium hominis
ENIMIWQILFPKLIYEFFFCFSFSIY

SEQ ID NO: 2130395 - protein, 24 aa, Cryptosporidium hominis
ENIPKIRWIPKSKGLRPLINLSKV

SEQ ID NO: 2130396 - protein, 26 aa, Cryptosporidium hominis
ENIRKLNILPPIRIYELWKGTPMDIR

SEQ ID NO: 2130397 - protein, 23 aa, Cryptosporidium hominis
ENKKKIKFISTLKGRLINYSELM

SEQ ID NO: 2130398 - protein, 27 aa, Cryptosporidium hominis
ENLVFYIFKLVPLFKYTRQAIEKNKMS

SEQ ID NO: 2130399 - protein, 21 aa, Cryptosporidium hominis
ENMLYKWIIAQTVTTSAGIIC

SEQ ID NO: 2130400 - protein, 21 aa, Cryptosporidium hominis
ENNPLLLMYYDDYCLMCFLIR

SEQ ID NO: 2130401 - protein, 22 aa, Cryptosporidium hominis
ENQNLFIMIFLHPITIRIVSFL

SEQ ID NO: 2130402 - protein, 23 aa, Cryptosporidium hominis
ENSPIMPIKLSPIALKDSEPVVL

SEQ ID NO: 2130403 - protein, 17 aa, Cryptosporidium hominis
ENTEIDLLIISNSRRKA

SEQ ID NO: 2130404 - protein, 22 aa, Cryptosporidium hominis
ENTFSFLLYHYHPQYYHDRMSG

SEQ ID NO: 2130405 - protein, 20 aa, Cryptosporidium hominis
ENWADTVQVLLQGPGIINTR

SEQ ID NO: 2130406 - protein, 21 aa, Cryptosporidium hominis
ENYRNIFKVILKESQRFSSGE

SEQ ID NO: 2130407 - protein, 21 aa, Cryptosporidium hominis
EPILDGLLIFLRDGSETFRIQ

SEQ ID NO: 2130408 - protein, 33 aa, Cryptosporidium hominis
EPRVAQLNLLFTNLTNFPELFKLCKTIFKMDIS

SEQ ID NO: 2130409 - protein, 25 aa, Cryptosporidium hominis
EPSVVFLFPMIGLGIYYAVARYFSR

SEQ ID NO: 2130410 - protein, 25 aa, Cryptosporidium hominis
EPVEILLKYFLFPDYTRDSSAKSNL

SEQ ID NO: 2130411 - protein, 19 aa, Cryptosporidium hominis
EQCLKLFKSRSFPIKDFRG

SEQ ID NO: 2130412 - protein, 24 aa, Cryptosporidium hominis
EQESSFWGWFGYSTTPENPKAKIK

SEQ ID NO: 2130413 - protein, 34 aa, Cryptosporidium hominis
EQGDLRVMYILLMMFVLEVFSIVWTFWNPEWDED

SEQ ID NO: 2130414 - protein, 17 aa, Cryptosporidium hominis
EQLYSKKFIKYVIEPNK

SEQ ID NO: 2130415 - protein, 18 aa, Cryptosporidium hominis
EQQLYFNYVFSSFSLEGQ

SEQ ID NO: 2130416 - protein, 27 aa, Cryptosporidium hominis
EQSPSSFLIIILSLLRLHAIDGILNSR

SEQ ID NO: 2130417 - protein, 23 aa, Cryptosporidium hominis
EQYAYWMLTLFTLAGVSELMMLF

SEQ ID NO: 2130418 - protein, 35 aa, Cryptosporidium hominis
EQYGSPLLHFLKTVAYYPFKLVVAFLLVIGNVSPV

SEQ ID NO: 2130419 - protein, 18 aa, Cryptosporidium hominis
ERAPLFQTWTKRSKYAKD

SEQ ID NO: 2130420 - protein, 20 aa, Cryptosporidium hominis
ERFISFLPNSVATVLAICSF

SEQ ID NO: 2130421 - protein, 24 aa, Cryptosporidium hominis
ERGTYYAIKFLRLGIGANDDITRI

SEQ ID NO: 2130422 - protein, 32 aa, Cryptosporidium hominis
ERHISSKCSALIQSFWLGIADNVDPELIPNDL

SEQ ID NO: 2130423 - protein, 19 aa, Cryptosporidium hominis
ERKCYEIYKFFGGLDKFSK

SEQ ID NO: 2130424 - protein, 28 aa, Cryptosporidium hominis
ERPNCIIHNIIFGSTWLEWLGDVNVTSK

SEQ ID NO: 2130425 - protein, 19 aa, Cryptosporidium hominis
ERQLRVCTTIAIAIISEIC

SEQ ID NO: 2130426 - protein, 18 aa, Cryptosporidium hominis
ERSYLPIIVFSFSKKDCE

SEQ ID NO: 2130427 - protein, 27 aa, Cryptosporidium hominis
ERWARSYAYFPFPYKPKLMDLDLVVEK

SEQ ID NO: 2130428 - protein, 25 aa, Cryptosporidium hominis
ESDKYYLLIKIVPPNTFWIKDEYKN

SEQ ID NO: 2130429 - protein, 35 aa, Cryptosporidium hominis
ESERERNILRYFYLKLFLFVYKLSIGLANKVVVNS

SEQ ID NO: 2130430 - protein, 40 aa, Cryptosporidium hominis
ESFFDKYGIPEYVFWIIVYTVPVLFVLLLCLTSYCCCCRR

SEQ ID NO: 2130431 - protein, 25 aa, Cryptosporidium hominis
ESFPPSLAPLYMWVLKPYHIRKRLG

SEQ ID NO: 2130432 - protein, 18 aa, Cryptosporidium hominis
ESFYKQLWSRLQGIKKEM

SEQ ID NO: 2130433 - protein, 26 aa, Cryptosporidium hominis
ESIKGFIYAIYFWSDAINAKVYSPIN

SEQ ID NO: 2130434 - protein, 27 aa, Cryptosporidium hominis
ESILISLLERLFKCILSRKIKKYSKSS

SEQ ID NO: 2130435 - protein, 24 aa, Cryptosporidium hominis
ESILYPIVLFLADAIYFSFVYEVN

SEQ ID NO: 2130436 - protein, 19 aa, Cryptosporidium hominis
ESIVYFPKTIHLLGRIGDD

SEQ ID NO: 2130437 - protein, 28 aa, Cryptosporidium hominis
ESKHLVFLMWIVLSLIFTLYSKWLMNNY

SEQ ID NO: 2130438 - protein, 25 aa, Cryptosporidium hominis
ESKIYKEPLLLDKYQPDFTGESFPE

SEQ ID NO: 2130439 - protein, 36 aa, Cryptosporidium hominis
ESLKMLLEHYPRWIPKFFFLLNFRIPRSRFDMVMIS

SEQ ID NO: 2130440 - protein, 28 aa, Cryptosporidium hominis
ESLSYYQLYILLVFLIESSDWFIHHGYF

SEQ ID NO: 2130441 - protein, 30 aa, Cryptosporidium hominis
ESMITIENSFPWFIPVKTSVQFFDLNSTRS

SEQ ID NO: 2130442 - protein, 18 aa, Cryptosporidium hominis
ESNWRYLALLYSLLISDT

SEQ ID NO: 2130443 - protein, 22 aa, Cryptosporidium hominis
ESQKWSFILGNRMLYNFKSKKC

SEQ ID NO: 2130444 - protein, 23 aa, Cryptosporidium hominis
ESRHIWIPLYTLEHLTCDFKEVR

SEQ ID NO: 2130445 - protein, 19 aa, Cryptosporidium hominis
ESRILPFYRRIAEKLMHEI

SEQ ID NO: 2130446 - protein, 33 aa, Cryptosporidium hominis
ESSLEMILYLVLLLLHQFILLFGEKVLLGNLSL

SEQ ID NO: 2130447 - protein, 27 aa, Cryptosporidium hominis
ESSSFYYFMVLSFLMGFFAIAGAAASR

SEQ ID NO: 2130448 - protein, 18 aa, Cryptosporidium hominis
ESSWFTYITSVALFLIIG

SEQ ID NO: 2130449 - protein, 21 aa, Cryptosporidium hominis
ESSYPRRILFASKLDTLFFDK

SEQ ID NO: 2130450 - protein, 23 aa, Cryptosporidium hominis
ESTTSIFQIYYSEVFDLFFTEWN

SEQ ID NO: 2130451 - protein, 36 aa, Cryptosporidium hominis
ESVHFKEPIGEPLLWNYIIQIVLALVHIHSSQLAAR

SEQ ID NO: 2130452 - protein, 30 aa, Cryptosporidium hominis
ESVQKRLIYAIFFCLVFTLIEVVVGILSNS

SEQ ID NO: 2130453 - protein, 25 aa, Cryptosporidium hominis
ETIAVSLHYSILSGFKLFLDRCHCI

SEQ ID NO: 2130454 - protein, 22 aa, Cryptosporidium hominis
ETKRLLERLAINLELPPIDDKM

SEQ ID NO: 2130455 - protein, 20 aa, Cryptosporidium hominis
ETLFIGAPKCRCPNGFQGDG

SEQ ID NO: 2130456 - protein, 32 aa, Cryptosporidium hominis
ETPKYSSAFYWIRRGFYLPRSYNLLKISINNG

SEQ ID NO: 2130457 - protein, 46 aa, Cryptosporidium hominis
ETPSIAYIYPYYWKYVLEPIRYIIYIIFYFIWGIELTPKKEFDNKD

SEQ ID NO: 2130458 - protein, 46 aa, Cryptosporidium hominis
ETSLICEAKLFIQKWVIILIGIIVIFLPLYFRIRTRRRKAELIRKI

SEQ ID NO: 2130459 - protein, 33 aa, Cryptosporidium hominis
ETSSKLNWLNILPGLFLIILQLFSIILTTHCEY

SEQ ID NO: 2130460 - protein, 36 aa, Cryptosporidium hominis
ETWIYTVFRFFFPDSAPLSWLFFLACSSIAAYVNYL

SEQ ID NO: 2130461 - protein, 26 aa, Cryptosporidium hominis
ETYFKNYHVLGYLPISYTKGLSERLS

SEQ ID NO: 2130462 - protein, 25 aa, Cryptosporidium hominis
EVAIILLMIAYIVVFFLECKKFTKI

SEQ ID NO: 2130463 - protein, 27 aa, Cryptosporidium hominis
EVDQLRRSAWLLGCIFEFSSPNMALAI

SEQ ID NO: 2130464 - protein, 26 aa, Cryptosporidium hominis
EVLYKYVIFISFLLQWIASATRSCYL

SEQ ID NO: 2130465 - protein, 24 aa, Cryptosporidium hominis
EVNERLVLTLLLKIKNGAPILRRK

SEQ ID NO: 2130466 - protein, 23 aa, Cryptosporidium hominis
EVSKILYFGFGGFLTTSIISLAV

SEQ ID NO: 2130467 - protein, 27 aa, Cryptosporidium hominis
EVTKVPNFILLCALIPQIPGCPCDPLL

SEQ ID NO: 2130468 - protein, 26 aa, Cryptosporidium hominis
EVVGRYFYMTLVEKLSFNTGGICSFL

SEQ ID NO: 2130469 - protein, 23 aa, Cryptosporidium hominis
EWNSLDFYYLKFSHNNSLLKVKP

SEQ ID NO: 2130470 - protein, 18 aa, Cryptosporidium hominis
EWSSWSPCSVTCGCGTTT

SEQ ID NO: 2130471 - protein, 29 aa, Cryptosporidium hominis
EYARYHGYSYFLFDGSFYDSIPKPVITDW

SEQ ID NO: 2130472 - protein, 18 aa, Cryptosporidium hominis
EYEWDFTHEYWNYKDSQD

SEQ ID NO: 2130473 - protein, 20 aa, Cryptosporidium hominis
EYFSNILFKNSKLIMIGIST

SEQ ID NO: 2130474 - protein, 27 aa, Cryptosporidium hominis
EYHDGVCLTLLLLLQNLTNLSVTNDNC

SEQ ID NO: 2130475 - protein, 19 aa, Cryptosporidium hominis
EYIYLIKIIVNNVFKYIDS

SEQ ID NO: 2130476 - protein, 29 aa, Cryptosporidium hominis
EYKRLTSEFPWFTSAWLRRACLALERNDY

SEQ ID NO: 2130477 - protein, 25 aa, Cryptosporidium hominis
EYLVSAFLLYLLICSFRELAFGSFS

SEQ ID NO: 2130478 - protein, 24 aa, Cryptosporidium hominis
EYNIFLLDYALFLADNRVGLMGIQ

SEQ ID NO: 2130479 - protein, 22 aa, Cryptosporidium hominis
EYPGYTIQILHSLTSAFDCQLQ

SEQ ID NO: 2130480 - protein, 32 aa, Cryptosporidium hominis
FAAERVMLYWVRKTIYISTFVILLISKTKKNT

SEQ ID NO: 2130481 - protein, 26 aa, Cryptosporidium hominis
FAAFVTPPMILSLGWRGPFYIFGLIG

SEQ ID NO: 2130482 - protein, 20 aa, Cryptosporidium hominis
FACFTILFSLSLLIFHLYIG

SEQ ID NO: 2130483 - protein, 20 aa, Cryptosporidium hominis
FAEFGLPFVIKLFPNMLPST

SEQ ID NO: 2130484 - protein, 17 aa, Cryptosporidium hominis
FAELPFDGLVGLGFPDK

SEQ ID NO: 2130485 - protein, 19 aa, Cryptosporidium hominis
FAFFTFIHALLISIYVFIY

SEQ ID NO: 2130486 - protein, 26 aa, Cryptosporidium hominis
FAFSGMIDIFFFKFLSSVNKYRQKNN

SEQ ID NO: 2130487 - protein, 24 aa, Cryptosporidium hominis
FAIEICMIPSIWYLEIIHCMHMGM

SEQ ID NO: 2130488 - protein, 19 aa, Cryptosporidium hominis
FAILLLFSILENKFGIAHD

SEQ ID NO: 2130489 - protein, 17 aa, Cryptosporidium hominis
FAITIATPVLSILACII

SEQ ID NO: 2130490 - protein, 18 aa, Cryptosporidium hominis
FAITVIQYYFYFGASLDR

SEQ ID NO: 2130491 - protein, 19 aa, Cryptosporidium hominis
FAKLAFITVRMKSNLILVS

SEQ ID NO: 2130492 - protein, 31 aa, Cryptosporidium hominis
FALIAALDYFIWFFLEFFYPKESIEHCIDFP

SEQ ID NO: 2130493 - protein, 25 aa, Cryptosporidium hominis
FALNKLYFIIIYYSVYLSTNFIVEL

SEQ ID NO: 2130494 - protein, 29 aa, Cryptosporidium hominis
FALTSFSTALLWALLFEPSINEFSPAFGE

SEQ ID NO: 2130495 - protein, 26 aa, Cryptosporidium hominis
FAQICLDAWFKMRIKILLTIPITLIN

SEQ ID NO: 2130496 - protein, 34 aa, Cryptosporidium hominis
FASSAISSTFLRLSKPFNPLLGETFELTHRGFKF

SEQ ID NO: 2130497 - protein, 24 aa, Cryptosporidium hominis
FAVGTFIQLLPLWAPSCIQFSLNK

SEQ ID NO: 2130498 - protein, 34 aa, Cryptosporidium hominis
FAYGYLKFIILYFLSLVLWGLYRHYLHLKVEAEI

SEQ ID NO: 2130499 - protein, 18 aa, Cryptosporidium hominis
FCILITIVLSVLTILQSA

SEQ ID NO: 2130500 - protein, 30 aa, Cryptosporidium hominis
FCVPISIILPALFHLTLFKQQISLPAFILD

SEQ ID NO: 2130501 - protein, 17 aa, Cryptosporidium hominis
FDCFLNTIKNQSYLENS

SEQ ID NO: 2130502 - protein, 20 aa, Cryptosporidium hominis
FDFTKIGVFGYNPPGTSEEQ

SEQ ID NO: 2130503 - protein, 18 aa, Cryptosporidium hominis
FDILAYADTWDTSEDIIL

SEQ ID NO: 2130504 - protein, 18 aa, Cryptosporidium hominis
FDLFSNIPPLPKITNISL

SEQ ID NO: 2130505 - protein, 20 aa, Cryptosporidium hominis
FDLIQSYLDLFYNNILNSLK

SEQ ID NO: 2130506 - protein, 27 aa, Cryptosporidium hominis
FDPTFLQYIYMILGISYHLLDNTKEAC

SEQ ID NO: 2130507 - protein, 30 aa, Cryptosporidium hominis
FDQFSNFFNFFYLIVALLQLIPELRTGPLF

SEQ ID NO: 2130508 - protein, 23 aa, Cryptosporidium hominis
FDQPAFKNIIVNGLVLASDGKKM

SEQ ID NO: 2130509 - protein, 42 aa, Cryptosporidium hominis
FDSKRYLNIYQLWSGLWITILRDVPFTAVYWTLTEKLRSRIA

SEQ ID NO: 2130510 - protein, 26 aa, Cryptosporidium hominis
FDSLEELLEYILRSPPPQKTVREEIK

SEQ ID NO: 2130511 - protein, 19 aa, Cryptosporidium hominis
FDVSFVLLNPILAVSILCL

SEQ ID NO: 2130512 - protein, 21 aa, Cryptosporidium hominis
FEAFAFICLALFIADIPNSSD

SEQ ID NO: 2130513 - protein, 24 aa, Cryptosporidium hominis
FEDIITFLSLYSFGGFVGKYSKNC

SEQ ID NO: 2130514 - protein, 26 aa, Cryptosporidium hominis
FEFNEYFIFNGFLLYILLCSFNELED

SEQ ID NO: 2130515 - protein, 25 aa, Cryptosporidium hominis
FEGFTFIMTIIFSFGIIITTSFVIV

SEQ ID NO: 2130516 - protein, 21 aa, Cryptosporidium hominis
FEIIEYLRFKADMKDPLIIGG

SEQ ID NO: 2130517 - protein, 20 aa, Cryptosporidium hominis
FEIIKIMQGCVWEIAIELSI

SEQ ID NO: 2130518 - protein, 18 aa, Cryptosporidium hominis
FEILDEKLVYFPSYFRNN

SEQ ID NO: 2130519 - protein, 20 aa, Cryptosporidium hominis
FEILTFLFNVFKRKNKEQLF

SEQ ID NO: 2130520 - protein, 22 aa, Cryptosporidium hominis
FEIQNMLLLISSYYLNINWGYI

SEQ ID NO: 2130521 - protein, 23 aa, Cryptosporidium hominis
FEKIPNIFFISSLELFNQIIVNT

SEQ ID NO: 2130522 - protein, 36 aa, Cryptosporidium hominis
FEKKIYVSYPLFYLIALLLSSIISLVLFFIYTCILN

SEQ ID NO: 2130523 - protein, 21 aa, Cryptosporidium hominis
FEKQSILPPPGVGSPHVVCTL

SEQ ID NO: 2130524 - protein, 31 aa, Cryptosporidium hominis
FEKTILMIELILFSFPFNIPNFPLPKNLEIF

SEQ ID NO: 2130525 - protein, 17 aa, Cryptosporidium hominis
FEMLISTLWISASKNDI

SEQ ID NO: 2130526 - protein, 18 aa, Cryptosporidium hominis
FENEEILEFNWLNPNLKK

SEQ ID NO: 2130527 - protein, 19 aa, Cryptosporidium hominis
FEQFFYYPCDLKDADFVSI

SEQ ID NO: 2130528 - protein, 23 aa, Cryptosporidium hominis
FETDLLFDLKKISPGQALLIADL

SEQ ID NO: 2130529 - protein, 20 aa, Cryptosporidium hominis
FFAMAITLPCFLIIWCSCIE

SEQ ID NO: 2130530 - protein, 27 aa, Cryptosporidium hominis
FFANERTLLQWMNMSVLLATISVSLLS

SEQ ID NO: 2130531 - protein, 17 aa, Cryptosporidium hominis
FFDPFVFNFSIDVHQCI

SEQ ID NO: 2130532 - protein, 19 aa, Cryptosporidium hominis
FFETFFYLRETLDKCAYVK

SEQ ID NO: 2130533 - protein, 33 aa, Cryptosporidium hominis
FFFDSSIPIFFPSRQLIWPTSLHFLLAQFFSNY

SEQ ID NO: 2130534 - protein, 17 aa, Cryptosporidium hominis
FFHYYDTANTQYSYLNI

SEQ ID NO: 2130535 - protein, 19 aa, Cryptosporidium hominis
FFIATLVLSIAGFFSAIYS

SEQ ID NO: 2130536 - protein, 18 aa, Cryptosporidium hominis
FFIFQVCAVCIWFRNSYV

SEQ ID NO: 2130537 - protein, 20 aa, Cryptosporidium hominis
FFIHLIFSTTFITTFVLLIL

SEQ ID NO: 2130538 - protein, 26 aa, Cryptosporidium hominis
FFIVSTIIYIIPFWSTSSMSLYFNNA

SEQ ID NO: 2130539 - protein, 21 aa, Cryptosporidium hominis
FFKCLKIIIDLLFNSNLFSKE

SEQ ID NO: 2130540 - protein, 19 aa, Cryptosporidium hominis
FFLQLIAACICNRKLVYSD

SEQ ID NO: 2130541 - protein, 47 aa, Cryptosporidium hominis
FFNKSWKTLRGYNFEFFKTISLDIFLPLSPLFDPRLTIRIFEGLVDE

SEQ ID NO: 2130542 - protein, 25 aa, Cryptosporidium hominis
FFNTFFLFLVYYFTGFTMAFTDFLL

SEQ ID NO: 2130543 - protein, 19 aa, Cryptosporidium hominis
FFNTYYYFLNAMGFSPGIA

SEQ ID NO: 2130544 - protein, 18 aa, Cryptosporidium hominis
FFRAIEYLDKFTNTFQSI

SEQ ID NO: 2130545 - protein, 17 aa, Cryptosporidium hominis
FFRQLLMTPIMFILYLT

SEQ ID NO: 2130546 - protein, 19 aa, Cryptosporidium hominis
FFSIIAFNINFEYDLSLNL

SEQ ID NO: 2130547 - protein, 26 aa, Cryptosporidium hominis
FFSIPRLFDFLVFLDCLFCIPLFLIV

SEQ ID NO: 2130548 - protein, 29 aa, Cryptosporidium hominis
FFSKITIDKGWIYCYKLWKETMVYHFLYT

SEQ ID NO: 2130549 - protein, 27 aa, Cryptosporidium hominis
FFSTYFGLLFVIIGGLIFWKVYVTIIP

SEQ ID NO: 2130550 - protein, 21 aa, Cryptosporidium hominis
FFVIIVHFISFSIGEQQPSPN

SEQ ID NO: 2130551 - protein, 37 aa, Cryptosporidium hominis
FGAFKANSFFFFSWIFMVILPLLISLTYRFGSQIASR

SEQ ID NO: 2130552 - protein, 25 aa, Cryptosporidium hominis
FGESKYLWFLPLRNIIRPNFNEELY

SEQ ID NO: 2130553 - protein, 25 aa, Cryptosporidium hominis
FGGTRWPHQLPIRSWRVWGPSDENI

SEQ ID NO: 2130554 - protein, 18 aa, Cryptosporidium hominis
FGIKNYYLNWLREYEKAL

SEQ ID NO: 2130555 - protein, 25 aa, Cryptosporidium hominis
FGILRVFFVLLMFLLCASYVVHSVW

SEQ ID NO: 2130556 - protein, 26 aa, Cryptosporidium hominis
FGIQHLCLPFIIYPILLCTSVGQMAD

SEQ ID NO: 2130557 - protein, 21 aa, Cryptosporidium hominis
FGKSRNFLLFAWSTSSILSSS

SEQ ID NO: 2130558 - protein, 17 aa, Cryptosporidium hominis
FGKTYHKYLLGYLFGIH

SEQ ID NO: 2130559 - protein, 21 aa, Cryptosporidium hominis
FGLIMSIIFSLNYLNLFHSVF

SEQ ID NO: 2130560 - protein, 25 aa, Cryptosporidium hominis
FGLIYSFPMILFIPAITSLFIVSKY

SEQ ID NO: 2130561 - protein, 20 aa, Cryptosporidium hominis
FGLNFCLILLELHILNENRL

SEQ ID NO: 2130562 - protein, 40 aa, Cryptosporidium hominis
FGQGKYQFYKYILKFKPFLTLISTLPLDLEYRFFAFTSGK

SEQ ID NO: 2130563 - protein, 24 aa, Cryptosporidium hominis
FGSDRIPFLFSPLENIQKFVHKGT

SEQ ID NO: 2130564 - protein, 22 aa, Cryptosporidium hominis
FGSLLLIFRKYIPHPSEFFPFS

SEQ ID NO: 2130565 - protein, 26 aa, Cryptosporidium hominis
FGYNVLSFWFSFYNTALIISMVSICF

SEQ ID NO: 2130566 - protein, 29 aa, Cryptosporidium hominis
FHEKLLSRLRYTKLSFFESTPIGRILNRF

SEQ ID NO: 2130567 - protein, 23 aa, Cryptosporidium hominis
FHGAVVLPILLSLVGRMPSHSSN

SEQ ID NO: 2130568 - protein, 29 aa, Cryptosporidium hominis
FHHFSKALLIVIMLSTFFVSYKINLHVNK

SEQ ID NO: 2130569 - protein, 27 aa, Cryptosporidium hominis
FHKDDSVYEIFKWIDSLALDENNLISD

SEQ ID NO: 2130570 - protein, 22 aa, Cryptosporidium hominis
FHKLVKYTIKLLIIASLNVNLF

SEQ ID NO: 2130571 - protein, 28 aa, Cryptosporidium hominis
FHTEKSSFLFIRPLRNLTSKEVMLYWKF

SEQ ID NO: 2130572 - protein, 30 aa, Cryptosporidium hominis
FHVYSCLFGLFLSFPSIFRKSRGLFPVYSI

SEQ ID NO: 2130573 - protein, 24 aa, Cryptosporidium hominis
FIAIVYALIIYFNPNRAQIIIIKN

SEQ ID NO: 2130574 - protein, 23 aa, Cryptosporidium hominis
FIAPKILIPIFMYSRELTIKVPE

SEQ ID NO: 2130575 - protein, 37 aa, Cryptosporidium hominis
FIDIILFWMPFYYLFKLCFLFWLFLPQTTGAVTLYSN

SEQ ID NO: 2130576 - protein, 25 aa, Cryptosporidium hominis
FIDQVFIWQSPFISLPIIITAMVKL

SEQ ID NO: 2130577 - protein, 18 aa, Cryptosporidium hominis
FIFAPKTLEILKMEKAIM

SEQ ID NO: 2130578 - protein, 21 aa, Cryptosporidium hominis
FIFFGVFTVLCSWFPFTSLLA

SEQ ID NO: 2130579 - protein, 18 aa, Cryptosporidium hominis
FIFLMFRTRRRLGLITSL

SEQ ID NO: 2130580 - protein, 28 aa, Cryptosporidium hominis
FIGPLTISVIVIILIISCIIGGFCFCGA

SEQ ID NO: 2130581 - protein, 21 aa, Cryptosporidium hominis
FIIALIISYLFCDIYAAEAPE

SEQ ID NO: 2130582 - protein, 27 aa, Cryptosporidium hominis
FIINSRIIHRFLNPGRLVYIRLPYLEQ

SEQ ID NO: 2130583 - protein, 23 aa, Cryptosporidium hominis
FIINSYLSIISFLLVIVAILVCF

SEQ ID NO: 2130584 - protein, 17 aa, Cryptosporidium hominis
FIIVSQHNNLKVGDQST

SEQ ID NO: 2130585 - protein, 23 aa, Cryptosporidium hominis
FIIYHLYGLGCNLLLFSKYHEIE

SEQ ID NO: 2130586 - protein, 24 aa, Cryptosporidium hominis
FIKKTKKIVTFYFLYRGEYKRDYD

SEQ ID NO: 2130587 - protein, 24 aa, Cryptosporidium hominis
FILENDWFLGMTPIIRVPIYTILG

SEQ ID NO: 2130588 - protein, 27 aa, Cryptosporidium hominis
FINSRNIPLSFLILNSLTFVPNTSNLN

SEQ ID NO: 2130589 - protein, 18 aa, Cryptosporidium hominis
FINTCRTLRLLFLNSQTA

SEQ ID NO: 2130590 - protein, 17 aa, Cryptosporidium hominis
FIPLRLNLEIPKFEGEE

SEQ ID NO: 2130591 - protein, 20 aa, Cryptosporidium hominis
FIPLSMKFLKRNGTFIELGK

SEQ ID NO: 2130592 - protein, 23 aa, Cryptosporidium hominis
FIPSGMRHFPIKKLIALIQSHSD

SEQ ID NO: 2130593 - protein, 25 aa, Cryptosporidium hominis
FIRDPYALVLLSGGLLMPRIYTLFI

SEQ ID NO: 2130594 - protein, 23 aa, Cryptosporidium hominis
FISFQIFTMDKLISAPSVFPSLD

SEQ ID NO: 2130595 - protein, 24 aa, Cryptosporidium hominis
FISIILFYIDIFQSFSYVNLTENQ

SEQ ID NO: 2130596 - protein, 17 aa, Cryptosporidium hominis
FISTLFKKPFIAHREKR

SEQ ID NO: 2130597 - protein, 31 aa, Cryptosporidium hominis
FISTVVFVIICRFLFFPVSTLRRIKMQINVF

SEQ ID NO: 2130598 - protein, 24 aa, Cryptosporidium hominis
FITAELIKICRCLSIPIVVDADGL

SEQ ID NO: 2130599 - protein, 28 aa, Cryptosporidium hominis
FITLCNMFIMYRLLLDVIPYPIGVTFSQ

SEQ ID NO: 2130600 - protein, 22 aa, Cryptosporidium hominis
FIWNRNISLPVLISGVDPRWIT

SEQ ID NO: 2130601 - protein, 19 aa, Cryptosporidium hominis
FIYKKLQLYTTPKFHRMFF

SEQ ID NO: 2130602 - protein, 26 aa, Cryptosporidium hominis
FIYNSWSFYLLVYTIGVIYSIFLYNK

SEQ ID NO: 2130603 - protein, 17 aa, Cryptosporidium hominis
FKCHGFEWLWFLALLIV

SEQ ID NO: 2130604 - protein, 19 aa, Cryptosporidium hominis
FKCIQSLCYYAKIEEIYLS

SEQ ID NO: 2130605 - protein, 18 aa, Cryptosporidium hominis
FKELILLKILAFVEINKR

SEQ ID NO: 2130606 - protein, 37 aa, Cryptosporidium hominis
FKEPRKLPGPLLPYGFSILILLSLFKIIPIWNKLSKI

SEQ ID NO: 2130607 - protein, 24 aa, Cryptosporidium hominis
FKHLNWYHLYPRTSEMVKYVRPVP

SEQ ID NO: 2130608 - protein, 19 aa, Cryptosporidium hominis
FKIANVLCKVSFSPIPLKF

SEQ ID NO: 2130609 - protein, 33 aa, Cryptosporidium hominis
FKKISVIFLFIIVILLFLNLELLYASDTKENEG

SEQ ID NO: 2130610 - protein, 18 aa, Cryptosporidium hominis
FKNFNVKALIPTRIILAG

SEQ ID NO: 2130611 - protein, 17 aa, Cryptosporidium hominis
FKNLLFFISISTTYGIF

SEQ ID NO: 2130612 - protein, 17 aa, Cryptosporidium hominis
FKQKFIFAPKTLEILKM

SEQ ID NO: 2130613 - protein, 29 aa, Cryptosporidium hominis
FKSLVSFSIFYIWSLSCVYLLFGLTTSKC

SEQ ID NO: 2130614 - protein, 30 aa, Cryptosporidium hominis
FKSMIPSWGLLLFWLFSALESSFFYIYVSL

SEQ ID NO: 2130615 - protein, 25 aa, Cryptosporidium hominis
FKTSLFIVIFILNYVNINTSKSGKM

SEQ ID NO: 2130616 - protein, 17 aa, Cryptosporidium hominis
FKVILKESQRFSSGEKI

SEQ ID NO: 2130617 - protein, 18 aa, Cryptosporidium hominis
FKVIYILLYFIYCQGVNI

SEQ ID NO: 2130618 - protein, 19 aa, Cryptosporidium hominis
FKVLAFLSFIFGPFFFRFF

SEQ ID NO: 2130619 - protein, 33 aa, Cryptosporidium hominis
FKVNQINPGILSFSFKPMRFSDNSPFRIACQFS

SEQ ID NO: 2130620 - protein, 18 aa, Cryptosporidium hominis
FLDILISLIDNCRRLQSE

SEQ ID NO: 2130621 - protein, 17 aa, Cryptosporidium hominis
FLDQRIMILKNTLAILN

SEQ ID NO: 2130622 - protein, 36 aa, Cryptosporidium hominis
FLESFMYLLTSYNELIFYLKTLLPVVIAKFSNLVSN

SEQ ID NO: 2130623 - protein, 19 aa, Cryptosporidium hominis
FLETPIGLLFWSYLYIYEK

SEQ ID NO: 2130624 - protein, 19 aa, Cryptosporidium hominis
FLFFTQIVSIAVFYEYSVK

SEQ ID NO: 2130625 - protein, 33 aa, Cryptosporidium hominis
FLFRESTIDWIFFSIILFLTIVRGIEILVFFAF

SEQ ID NO: 2130626 - protein, 25 aa, Cryptosporidium hominis
FLGHFLIAFVFFAISFLYTSGTFFI

SEQ ID NO: 2130627 - protein, 46 aa, Cryptosporidium hominis
FLGYFMVMIPWFFSILSPQPMLLVHFPRLLIYFLIAMHRVIFLHII

SEQ ID NO: 2130628 - protein, 23 aa, Cryptosporidium hominis
FLIGCLLTGLFLPVLKSKVLLIG

SEQ ID NO: 2130629 - protein, 18 aa, Cryptosporidium hominis
FLIITYLSIIFIYSSLLV

SEQ ID NO: 2130630 - protein, 18 aa, Cryptosporidium hominis
FLLRLTCEFYMKAMREIQ

SEQ ID NO: 2130631 - protein, 17 aa, Cryptosporidium hominis
FLMIIFLIGDISGHWLY

SEQ ID NO: 2130632 - protein, 17 aa, Cryptosporidium hominis
FLNAKLDLLKKLISEDE

SEQ ID NO: 2130633 - protein, 23 aa, Cryptosporidium hominis
FLQYPCKILPLNFADIKSKIKNS

SEQ ID NO: 2130634 - protein, 19 aa, Cryptosporidium hominis
FLRNNLEWLGKATHWSRFS

SEQ ID NO: 2130635 - protein, 23 aa, Cryptosporidium hominis
FLSDILIPIIPVRKKGFDGKMKT

SEQ ID NO: 2130636 - protein, 17 aa, Cryptosporidium hominis
FLSKLIQIEWLYIIIMC

SEQ ID NO: 2130637 - protein, 17 aa, Cryptosporidium hominis
FLSWLVLFSTYTNYQIQ

SEQ ID NO: 2130638 - protein, 21 aa, Cryptosporidium hominis
FLTCFIYILPVYLMVISVKSL

SEQ ID NO: 2130639 - protein, 20 aa, Cryptosporidium hominis
FLTPEDLFRMFFGGMPAEVS

SEQ ID NO: 2130640 - protein, 18 aa, Cryptosporidium hominis
FLVRLSFLVIQVRSFLAA

SEQ ID NO: 2130641 - protein, 21 aa, Cryptosporidium hominis
FLWIVLLKLAQNGMLATDVVN

SEQ ID NO: 2130642 - protein, 21 aa, Cryptosporidium hominis
FMDFKQLISMLVLFCVYLTGR

SEQ ID NO: 2130643 - protein, 30 aa, Cryptosporidium hominis
FMKMKRILYFILIHILIFNILEINSLPPSF

SEQ ID NO: 2130644 - protein, 18 aa, Cryptosporidium hominis
FMNILKKSMILNGEEINS

SEQ ID NO: 2130645 - protein, 18 aa, Cryptosporidium hominis
FMSLVSFFTSLWNRSSLT

SEQ ID NO: 2130646 - protein, 18 aa, Cryptosporidium hominis
FMTMYLQYCDLSNFQAAL

SEQ ID NO: 2130647 - protein, 42 aa, Cryptosporidium hominis
FMTSDPWFALIMFNSIMNIPWMIFVLYLFIRHVKSIMSNVTF

SEQ ID NO: 2130648 - protein, 22 aa, Cryptosporidium hominis
FNKYLISNYIHLFPIGISKSKA

SEQ ID NO: 2130649 - protein, 22 aa, Cryptosporidium hominis
FNLVVYLCWMFIPDEYLNQINI

SEQ ID NO: 2130650 - protein, 17 aa, Cryptosporidium hominis
FNNLYFKNYVDFFMEFI

SEQ ID NO: 2130651 - protein, 25 aa, Cryptosporidium hominis
FNNSPFLCIWLLIHGSLQMLQGIFR

SEQ ID NO: 2130652 - protein, 26 aa, Cryptosporidium hominis
FNNVYELRYYLLFPHLETFENSCNDI

SEQ ID NO: 2130653 - protein, 24 aa, Cryptosporidium hominis
FNSSSFFFLAALTLGLHQYNVQRE

SEQ ID NO: 2130654 - protein, 26 aa, Cryptosporidium hominis
FNTGGICSFLWIMAKFPDYVYCDKGE

SEQ ID NO: 2130655 - protein, 43 aa, Cryptosporidium hominis
FNTNSPEFFRLWTLLILCGLLSMLLNYFTFLVVGYTSPVTFNV

SEQ ID NO: 2130656 - protein, 28 aa, Cryptosporidium hominis
FNVLYILMGLLHLLFSYFWVHYGSSLFT

SEQ ID NO: 2130657 - protein, 34 aa, Cryptosporidium hominis
FNVQKVLYCLYSLLGIAFILFKLGTMGLIPVNRG

SEQ ID NO: 2130658 - protein, 18 aa, Cryptosporidium hominis
FNYAIYCFYSHLICIQAI

SEQ ID NO: 2130659 - protein, 30 aa, Cryptosporidium hominis
FNYKFYSQLIIRMIYLCTWMIVDNNYESYK

SEQ ID NO: 2130660 - protein, 19 aa, Cryptosporidium hominis
FNYSLFLVFCFCLVNTVVS

SEQ ID NO: 2130661 - protein, 17 aa, Cryptosporidium hominis
FNYVFSSFSLEGQEKCY

SEQ ID NO: 2130662 - protein, 23 aa, Cryptosporidium hominis
FPCSEYLLKLKLILKRNSRNKII

SEQ ID NO: 2130663 - protein, 18 aa, Cryptosporidium hominis
FPFAILEVKLQSEQPIWV

SEQ ID NO: 2130664 - protein, 17 aa, Cryptosporidium hominis
FPFALIPARVLPTTKHI

SEQ ID NO: 2130665 - protein, 23 aa, Cryptosporidium hominis
FPGAMMFGAIRLDGETGLPLEAE

SEQ ID NO: 2130666 - protein, 30 aa, Cryptosporidium hominis
FPIRYQLGYFSILGLLRLHALLGSYYIAIE

SEQ ID NO: 2130667 - protein, 24 aa, Cryptosporidium hominis
FPISKFWMMGFFDAFSSILTLLAS

SEQ ID NO: 2130668 - protein, 20 aa, Cryptosporidium hominis
FPKRKALFLNVCSQIKFIDA

SEQ ID NO: 2130669 - protein, 30 aa, Cryptosporidium hominis
FPNNRSLMHILKYYFDLMTLPPHSVMLQFV

SEQ ID NO: 2130670 - protein, 29 aa, Cryptosporidium hominis
FPSNGLIQFFYRLISKIFTKNFFFLPYLN

SEQ ID NO: 2130671 - protein, 31 aa, Cryptosporidium hominis
FPVKIVSLYLYIFLSFPITVLMQFLSCIAPI

SEQ ID NO: 2130672 - protein, 17 aa, Cryptosporidium hominis
FQDYWALAYPDYPEINR

SEQ ID NO: 2130673 - protein, 17 aa, Cryptosporidium hominis
FQIYCTISMFMNSNDFR

SEQ ID NO: 2130674 - protein, 40 aa, Cryptosporidium hominis
FQNMDEFFIHYLKIIKLLSPNLWLPLGIFPSKCLFKLFPI

SEQ ID NO: 2130675 - protein, 17 aa, Cryptosporidium hominis
FQQLVGLAIFQILKIYK

SEQ ID NO: 2130676 - protein, 32 aa, Cryptosporidium hominis
FQRNVLGITLLILVIWILITSFVIIFSSRSRL

SEQ ID NO: 2130677 - protein, 18 aa, Cryptosporidium hominis
FQTWTKRSKYAKDAILSL

SEQ ID NO: 2130678 - protein, 23 aa, Cryptosporidium hominis
FQVFPLEHNQLYRYLIREMNKTS

SEQ ID NO: 2130679 - protein, 22 aa, Cryptosporidium hominis
FRLLSLLVILSLVFLLELTEIE

SEQ ID NO: 2130680 - protein, 26 aa, Cryptosporidium hominis
FRNPFFKNPFILVPVTINALVYGTLI

SEQ ID NO: 2130681 - protein, 28 aa, Cryptosporidium hominis
FRRMISIFSWFFTGIVILLMVGINVNTL

SEQ ID NO: 2130682 - protein, 23 aa, Cryptosporidium hominis
FSDPKFIIQPKFKWVPLKVNNAK

SEQ ID NO: 2130683 - protein, 27 aa, Cryptosporidium hominis
FSERLFVNMLLFGYIWRKSAGYLNSEW

SEQ ID NO: 2130684 - protein, 34 aa, Cryptosporidium hominis
FSFAHSYIQFTWVTKWIYLGSRRPLPAKDLPDLP

SEQ ID NO: 2130685 - protein, 18 aa, Cryptosporidium hominis
FSFFYYLTNWGCTSTLIF

SEQ ID NO: 2130686 - protein, 19 aa, Cryptosporidium hominis
FSFLPKILEFQVKDGIFQA

SEQ ID NO: 2130687 - protein, 21 aa, Cryptosporidium hominis
FSFNPLPFIISVNLALSYLMG

SEQ ID NO: 2130688 - protein, 19 aa, Cryptosporidium hominis
FSGALLFTSLAVSLILVCI

SEQ ID NO: 2130689 - protein, 19 aa, Cryptosporidium hominis
FSGPFMLFYSVLRTIDGMA

SEQ ID NO: 2130690 - protein, 19 aa, Cryptosporidium hominis
FSIAAGINSLIFSLSNTIY

SEQ ID NO: 2130691 - protein, 31 aa, Cryptosporidium hominis
FSIIYLLIQMSFWPWNFLITITLQLIFMGMC

SEQ ID NO: 2130692 - protein, 45 aa, Cryptosporidium hominis
FSINFWERFCNFLRKSINKKFTLFYFFFRWITYYVEMEIAANYER

SEQ ID NO: 2130693 - protein, 28 aa, Cryptosporidium hominis
FSIYIIFYLIFFYIQVVYSLHSNLSKGA

SEQ ID NO: 2130694 - protein, 24 aa, Cryptosporidium hominis
FSKEIYLRTIPYARYTPLFIEVRS

SEQ ID NO: 2130695 - protein, 20 aa, Cryptosporidium hominis
FSKIFVVQFLLEVLVVVSVN

SEQ ID NO: 2130696 - protein, 21 aa, Cryptosporidium hominis
FSKYIVILIVLFSLNNQLSNT

SEQ ID NO: 2130697 - protein, 19 aa, Cryptosporidium hominis
FSLIINHVLLDLRYFNSKI

SEQ ID NO: 2130698 - protein, 20 aa, Cryptosporidium hominis
FSLIYLYSYLFVGQNTGYLI

SEQ ID NO: 2130699 - protein, 17 aa, Cryptosporidium hominis
FSLSIMHLLGDLKVFDS

SEQ ID NO: 2130700 - protein, 20 aa, Cryptosporidium hominis
FSQKYLYWLKNLHFQFCIGF

SEQ ID NO: 2130701 - protein, 30 aa, Cryptosporidium hominis
FSRCYVFILTIFFGFFFLYLERIKTEKVLY

SEQ ID NO: 2130702 - protein, 27 aa, Cryptosporidium hominis
FSRSDWVLAFFYRYMQWGFHVAGISPI

SEQ ID NO: 2130703 - protein, 23 aa, Cryptosporidium hominis
FSSERLFIIPLCNRKTFLERVIE

SEQ ID NO: 2130704 - protein, 25 aa, Cryptosporidium hominis
FSSFSLMILFKWIHIFYIEIKYLFW

SEQ ID NO: 2130705 - protein, 18 aa, Cryptosporidium hominis
FSSLAFLKLVGSPIVHAY

SEQ ID NO: 2130706 - protein, 21 aa, Cryptosporidium hominis
FSSVMIRLMLVFGPAACCLSA

SEQ ID NO: 2130707 - protein, 18 aa, Cryptosporidium hominis
FSTLFLYFKFQNGIITTI

SEQ ID NO: 2130708 - protein, 35 aa, Cryptosporidium hominis
FSTSMLVAILFKLCSILLITLLFSIKKYDSDFTFR

SEQ ID NO: 2130709 - protein, 19 aa, Cryptosporidium hominis
FSVLILKRKLSLTRWFACF

SEQ ID NO: 2130710 - protein, 23 aa, Cryptosporidium hominis
FSVMIPMWLSMKIPRYKKRCVQQ

SEQ ID NO: 2130711 - protein, 23 aa, Cryptosporidium hominis
FSYIPICLLLFFSNNLIPMSQPF

SEQ ID NO: 2130712 - protein, 20 aa, Cryptosporidium hominis
FSYLLSFPKIDCNIIKKIIY

SEQ ID NO: 2130713 - protein, 26 aa, Cryptosporidium hominis
FTCFDALLIFYILYILVKNENSEEID

SEQ ID NO: 2130714 - protein, 26 aa, Cryptosporidium hominis
FTDFQQTLIIFYLKIIRNCCLASEKA

SEQ ID NO: 2130715 - protein, 18 aa, Cryptosporidium hominis
FTFMALFIYNFWRCSILV

SEQ ID NO: 2130716 - protein, 18 aa, Cryptosporidium hominis
FTGAEKLPRKWKLSKGHA

SEQ ID NO: 2130717 - protein, 33 aa, Cryptosporidium hominis
FTGSKLFFELLFQLYNFLYTSIPPIIFATFDSD

SEQ ID NO: 2130718 - protein, 18 aa, Cryptosporidium hominis
FTHCLQKYFPLWFSDEDL

SEQ ID NO: 2130719 - protein, 18 aa, Cryptosporidium hominis
FTICYIIINFFKKIVKFF

SEQ ID NO: 2130720 - protein, 20 aa, Cryptosporidium hominis
FTIWVIFGIQHLCLPFIIYP

SEQ ID NO: 2130721 - protein, 25 aa, Cryptosporidium hominis
FTKHFFIVLAPVWFIFLLNSCIQRS

SEQ ID NO: 2130722 - protein, 26 aa, Cryptosporidium hominis
FTKLNILFLFVPFGVLSYYLEWGALA

SEQ ID NO: 2130723 - protein, 17 aa, Cryptosporidium hominis
FTLLTVFASYSITLIVI

SEQ ID NO: 2130724 - protein, 39 aa, Cryptosporidium hominis
FTMAEWKFYKLASVLRFISFLYCIVIFISIGRVRHLLFT

SEQ ID NO: 2130725 - protein, 36 aa, Cryptosporidium hominis
FTPGLQQIFGTHTIYWWLYILAIGAGFLNMAFDELV

SEQ ID NO: 2130726 - protein, 41 aa, Cryptosporidium hominis
FTRVTIYIGYFIYLDYRFIIVFIPISYFFNKFRIRAMFANR

SEQ ID NO: 2130727 - protein, 39 aa, Cryptosporidium hominis
FTSIAIIYYNHWLFDKVAPFPVFATWVQQIVGVFCFGIL

SEQ ID NO: 2130728 - protein, 26 aa, Cryptosporidium hominis
FTSKKYFHHALFDPTFLQYIYMILGI

SEQ ID NO: 2130729 - protein, 26 aa, Cryptosporidium hominis
FTTIALILIFVIFDKNGRNPIQVYFQ

SEQ ID NO: 2130730 - protein, 30 aa, Cryptosporidium hominis
FTVNKVVKLVLWLLGWLSVTFIIPLCGIIL

SEQ ID NO: 2130731 - protein, 21 aa, Cryptosporidium hominis
FTYKHFVVYIVFYVIGTILNL

SEQ ID NO: 2130732 - protein, 20 aa, Cryptosporidium hominis
FVCLPLFQELCYVDVEGDVR

SEQ ID NO: 2130733 - protein, 35 aa, Cryptosporidium hominis
FVCRNKLLYLVLAIILLWALSFTIVHQLVISSTGN

SEQ ID NO: 2130734 - protein, 24 aa, Cryptosporidium hominis
FVDAAMLIAIFPRQIRFLIAEASF

SEQ ID NO: 2130735 - protein, 18 aa, Cryptosporidium hominis
FVEFFFDSSIPIFFPSRQ

SEQ ID NO: 2130736 - protein, 18 aa, Cryptosporidium hominis
FVIPIINSRFKLAYSVLR

SEQ ID NO: 2130737 - protein, 20 aa, Cryptosporidium hominis
FVLAFHVIPTLVVNKYLLFE

SEQ ID NO: 2130738 - protein, 17 aa, Cryptosporidium hominis
FVMSYALLINDFFNMFT

SEQ ID NO: 2130739 - protein, 18 aa, Cryptosporidium hominis
FVNICFTNVIGSLLFRRE

SEQ ID NO: 2130740 - protein, 24 aa, Cryptosporidium hominis
FVNKYYFERYLKFSHLIISNETIN

SEQ ID NO: 2130741 - protein, 18 aa, Cryptosporidium hominis
FVNSFPIIFEKLIPEYCI

SEQ ID NO: 2130742 - protein, 27 aa, Cryptosporidium hominis
FVPHSIQLFWGVDYFAAKELLIEEKKV

SEQ ID NO: 2130743 - protein, 22 aa, Cryptosporidium hominis
FVPHVNLLVYYLKSLNSIVNHP

SEQ ID NO: 2130744 - protein, 28 aa, Cryptosporidium hominis
FVQISLFLINIIWALLWALDSNYLTRES

SEQ ID NO: 2130745 - protein, 29 aa, Cryptosporidium hominis
FVSRLICIILIIFTIIYVPNQISKLVQLA

SEQ ID NO: 2130746 - protein, 23 aa, Cryptosporidium hominis
FVTPLLLALFPFSRLHIGFIVRN

SEQ ID NO: 2130747 - protein, 19 aa, Cryptosporidium hominis
FYFYHIIMHITITKASTMI

SEQ ID NO: 2130748 - protein, 26 aa, Cryptosporidium hominis
FYGYSLLSLSAIILFSGKESHHLRKS

SEQ ID NO: 2130749 - protein, 17 aa, Cryptosporidium hominis
FYIFNWIYRFYAQHYVN

SEQ ID NO: 2130750 - protein, 27 aa, Cryptosporidium hominis
FYKLIYCLLMVLLYDSLLDFLNNMEPK

SEQ ID NO: 2130751 - protein, 25 aa, Cryptosporidium hominis
FYLINNLFFILKVLKTLISSNKTHR

SEQ ID NO: 2130752 - protein, 38 aa, Cryptosporidium hominis
FYLSINILRGNFGKIWLWLVKLLNKKSPHRLFVFVVLA

SEQ ID NO: 2130753 - protein, 17 aa, Cryptosporidium hominis
FYMITVLVIIQLTLSIF

SEQ ID NO: 2130754 - protein, 25 aa, Cryptosporidium hominis
FYNRKFFIQLLIYAQLSLLFLFVQG

SEQ ID NO: 2130755 - protein, 36 aa, Cryptosporidium hominis
FYSKLRPIIAVYYFKHPWFLKSWKFVNIEPVELKLL

SEQ ID NO: 2130756 - protein, 27 aa, Cryptosporidium hominis
FYSQNQLIVPIWDIRKLCNSNRATKFY

SEQ ID NO: 2130757 - protein, 18 aa, Cryptosporidium hominis
FYVFCKLSINVISEHPRI

SEQ ID NO: 2130758 - protein, 25 aa, Cryptosporidium hominis
FYVKSIIFLLMLDFPNNRMDKTLIS

SEQ ID NO: 2130759 - protein, 21 aa, Cryptosporidium hominis
FYYYYFTMLSSSILALLTSIF

SEQ ID NO: 2130760 - protein, 46 aa, Cryptosporidium hominis
GAAIALIAVMAPSANLLLWIMGAAIPLEAWFVMRSQKALVLSGGIA

SEQ ID NO: 2130761 - protein, 31 aa, Cryptosporidium hominis
GAETLLLFEEAFLWIADISFLYKILGEISLL

SEQ ID NO: 2130762 - protein, 27 aa, Cryptosporidium hominis
GALATFWFNFIALIPLANLLGIFTEEL

SEQ ID NO: 2130763 - protein, 32 aa, Cryptosporidium hominis
GAVVFKFPKDQWFILICVVGFFLSMFGTFLID

SEQ ID NO: 2130764 - protein, 21 aa, Cryptosporidium hominis
GAYLWSLFHLKGVESSPISIN

SEQ ID NO: 2130765 - protein, 21 aa, Cryptosporidium hominis
GCGTSFHAALFAQLLMEHISG

SEQ ID NO: 2130766 - protein, 28 aa, Cryptosporidium hominis
GCNDALIHLLNFLWPNVFENSPHLVQAV

SEQ ID NO: 2130767 - protein, 21 aa, Cryptosporidium hominis
GCPFFMIIYKALFPSMLTITF

SEQ ID NO: 2130768 - protein, 35 aa, Cryptosporidium hominis
GDATLAIAIGLPVGILGLCIIAGSLFLIGGRSGDQ

SEQ ID NO: 2130769 - protein, 20 aa, Cryptosporidium hominis
GDFSLWIMNPRHGYFEPIIE

SEQ ID NO: 2130770 - protein, 29 aa, Cryptosporidium hominis
GDKSNLFWFLVIPYWIIYFIQSGNNFHKW

SEQ ID NO: 2130771 - protein, 21 aa, Cryptosporidium hominis
GDLSSLKVLFGWFSTSNQTNL

SEQ ID NO: 2130772 - protein, 26 aa, Cryptosporidium hominis
GDSKTPYIFIPLLKDINLKKDKSSKF

SEQ ID NO: 2130773 - protein, 20 aa, Cryptosporidium hominis
GEEYPPIPGYLQDKSRFPLL

SEQ ID NO: 2130774 - protein, 17 aa, Cryptosporidium hominis
GEFKWEYGILSLCLING

SEQ ID NO: 2130775 - protein, 25 aa, Cryptosporidium hominis
GEFVISLVSFLPWIPDVDSAHEWIS

SEQ ID NO: 2130776 - protein, 28 aa, Cryptosporidium hominis
GEGTHFMLPWIERPVIFDIRARPRVVVS

SEQ ID NO: 2130777 - protein, 20 aa, Cryptosporidium hominis
GELFINRFYINLQTDILDTP

SEQ ID NO: 2130778 - protein, 30 aa, Cryptosporidium hominis
GENRKQKFILFLLGILLVSIINIIQHKLGG

SEQ ID NO: 2130779 - protein, 29 aa, Cryptosporidium hominis
GESSHVWGVLLARSLPAWDWKSPSILVSI

SEQ ID NO: 2130780 - protein, 35 aa, Cryptosporidium hominis
GETCDQFEFPWWFYSVIIVLVVLAIGIFYKSQISN

SEQ ID NO: 2130781 - protein, 24 aa, Cryptosporidium hominis
GETVATVDLFAFTLDGGRRIEVAV

SEQ ID NO: 2130782 - protein, 26 aa, Cryptosporidium hominis
GEWVAYFLHRSVIWASLKLLDDCLDN

SEQ ID NO: 2130783 - protein, 20 aa, Cryptosporidium hominis
GFCGLKNFEYLSYRSVLISV

SEQ ID NO: 2130784 - protein, 21 aa, Cryptosporidium hominis
GFDMYLSILKAFKEDYCRYVI

SEQ ID NO: 2130785 - protein, 31 aa, Cryptosporidium hominis
GFGYTLFATVYWPCISLSVPPTLLGTALGVV

SEQ ID NO: 2130786 - protein, 20 aa, Cryptosporidium hominis
GFHINVSVMPLLISGCFHAT

SEQ ID NO: 2130787 - protein, 26 aa, Cryptosporidium hominis
GFHNIYVGLLVIISGIWLVNRLSKIV

SEQ ID NO: 2130788 - protein, 25 aa, Cryptosporidium hominis
GFIDTFIIILYPLYIYTNIWMHRMP

SEQ ID NO: 2130789 - protein, 21 aa, Cryptosporidium hominis
GFIFSFFLYYNSRKRIFINNL

SEQ ID NO: 2130790 - protein, 25 aa, Cryptosporidium hominis
GFLSTFLLLFLINLVLDPTALVIVP

SEQ ID NO: 2130791 - protein, 23 aa, Cryptosporidium hominis
GFNPWIMKNILFIPLQIVRLNQC

SEQ ID NO: 2130792 - protein, 34 aa, Cryptosporidium hominis
GFQSLAYLPNIYPKFLNFSLLKSSLFDYNFHRFE

SEQ ID NO: 2130793 - protein, 26 aa, Cryptosporidium hominis
GFTIPPSLLWILTTSRLAFIPLYAAI

SEQ ID NO: 2130794 - protein, 24 aa, Cryptosporidium hominis
GFVASIFIFILKATFLLSDTHLKY

SEQ ID NO: 2130795 - protein, 24 aa, Cryptosporidium hominis
GFVEKLIILLKIPNILNIAISYYF

SEQ ID NO: 2130796 - protein, 38 aa, Cryptosporidium hominis
GFVRNQIFMIVRYLLYSLIFTIITFITLFKNNSKLVLG

SEQ ID NO: 2130797 - protein, 27 aa, Cryptosporidium hominis
GFWILSSMFFICFSLVYGTKTESDVKN

SEQ ID NO: 2130798 - protein, 23 aa, Cryptosporidium hominis
GGGLGVLYRLPKTAYFDGILQVL

SEQ ID NO: 2130799 - protein, 25 aa, Cryptosporidium hominis
GGILASILRKFYSKPKLHISAVEID

SEQ ID NO: 2130800 - protein, 25 aa, Cryptosporidium hominis
GGIYLILKIINFLPPKIRQLLTFYI

SEQ ID NO: 2130801 - protein, 25 aa, Cryptosporidium hominis
GGKGVLFFGVMFWSLCMIFTSFLSY

SEQ ID NO: 2130802 - protein, 26 aa, Cryptosporidium hominis
GGKHPYFGILYIISGILFILLSIYYI

SEQ ID NO: 2130803 - protein, 17 aa, Cryptosporidium hominis
GGPILFLNAVLAGGASM

SEQ ID NO: 2130804 - protein, 27 aa, Cryptosporidium hominis
GGPRTHLMMLIFFGGNILRGLFTNSNA

SEQ ID NO: 2130805 - protein, 25 aa, Cryptosporidium hominis
GGQPLNIDLDYWIKKDLPKNTSIVC

SEQ ID NO: 2130806 - protein, 28 aa, Cryptosporidium hominis
GGSGSWIQWLFKFHRISSVPLNSADDVF

SEQ ID NO: 2130807 - protein, 23 aa, Cryptosporidium hominis
GGSSLIFGIIYYWSKKFPTSLVS

SEQ ID NO: 2130808 - protein, 31 aa, Cryptosporidium hominis
GGTPVYLSDWIFIYELLTGYFPLEVIPGESS

SEQ ID NO: 2130809 - protein, 28 aa, Cryptosporidium hominis
GHFSKTLLLFFLPQILNFIISIPQLFGI

SEQ ID NO: 2130810 - protein, 23 aa, Cryptosporidium hominis
GIFLINLIKYLLYLYVDLRQKKC

SEQ ID NO: 2130811 - protein, 23 aa, Cryptosporidium hominis
GIFSLIGTIWEGGYFRIYDTFTW

SEQ ID NO: 2130812 - protein, 23 aa, Cryptosporidium hominis
GIFTLIVFLVISFTCQIIASTYK

SEQ ID NO: 2130813 - protein, 21 aa, Cryptosporidium hominis
GIFTYSFDTRLLLGKTAVTIS

SEQ ID NO: 2130814 - protein, 22 aa, Cryptosporidium hominis
GIFVRLKISLWAPLFEDVTDQK

SEQ ID NO: 2130815 - protein, 31 aa, Cryptosporidium hominis
GIIKKGLHPIITLIYKLLLFNRGLNVDAISI

SEQ ID NO: 2130816 - protein, 21 aa, Cryptosporidium hominis
GIINIIPAYNLIPGDIVLLRT

SEQ ID NO: 2130817 - protein, 36 aa, Cryptosporidium hominis
GILFKLNIGFLFLSIILFELFIFLDKMHKHYRLFFG

SEQ ID NO: 2130818 - protein, 36 aa, Cryptosporidium hominis
GILIFVPTSLIFPKIGQFFYGKRLYSLLSGNELDSS

SEQ ID NO: 2130819 - protein, 25 aa, Cryptosporidium hominis
GINITVILIMYITGLIFDIVAFMVL

SEQ ID NO: 2130820 - protein, 23 aa, Cryptosporidium hominis
GINKGAIFGRKLPLCNFPLLDNN

SEQ ID NO: 2130821 - protein, 18 aa, Cryptosporidium hominis
GINLGVVLFFLSNKSWFV

SEQ ID NO: 2130822 - protein, 34 aa, Cryptosporidium hominis
GINNQKHFLLFLAYVFLFCAYSLILICIRFYKCI

SEQ ID NO: 2130823 - protein, 25 aa, Cryptosporidium hominis
GINPLAYIIILSFGSPLGAMIGAIV

SEQ ID NO: 2130824 - protein, 17 aa, Cryptosporidium hominis
GINTFKNFLLRISLRNQ

SEQ ID NO: 2130825 - protein, 28 aa, Cryptosporidium hominis
GINTIFDEWILLLRITIFNGVGGSERNN

SEQ ID NO: 2130826 - protein, 36 aa, Cryptosporidium hominis
GIPVFIYGFFTLWSGTRLYFDYWYQVYNVILSSVPI

SEQ ID NO: 2130827 - protein, 31 aa, Cryptosporidium hominis
GIRSFYRSLPITLFMNIPQTGLFVLLNENLK

SEQ ID NO: 2130828 - protein, 22 aa, Cryptosporidium hominis
GISEFGLFIRYFEIPDKRRAIE

SEQ ID NO: 2130829 - protein, 23 aa, Cryptosporidium hominis
GISIAILIGFLQVLFVILTTQVG

SEQ ID NO: 2130830 - protein, 22 aa, Cryptosporidium hominis
GISLFSVAWLKVSSPIFIAVCL

SEQ ID NO: 2130831 - protein, 29 aa, Cryptosporidium hominis
GISSLPFFARAWIAALPLTFISFFTHYSA

SEQ ID NO: 2130832 - protein, 25 aa, Cryptosporidium hominis
GISTGVVFLALLYNSISVVPRQIDA

SEQ ID NO: 2130833 - protein, 18 aa, Cryptosporidium hominis
GITWIPRTLNIVHPINGF

SEQ ID NO: 2130834 - protein, 22 aa, Cryptosporidium hominis
GIYQKILAGKIFFPKYFDKNCK

SEQ ID NO: 2130835 - protein, 40 aa, Cryptosporidium hominis
GKCLPFSCLFILQILVALATITWVIVNVLFFVNTNNNVSK

SEQ ID NO: 2130836 - protein, 24 aa, Cryptosporidium hominis
GKDFNIFFFPIIVVLVYAINIFDL

SEQ ID NO: 2130837 - protein, 19 aa, Cryptosporidium hominis
GKEPILRFDFLVSQLMSSS

SEQ ID NO: 2130838 - protein, 26 aa, Cryptosporidium hominis
GKEPYLFISRFPSTPYYILALSLTGT

SEQ ID NO: 2130839 - protein, 19 aa, Cryptosporidium hominis
GKFAMLRRSLVSVISAWGE

SEQ ID NO: 2130840 - protein, 23 aa, Cryptosporidium hominis
GKFQLCLLQFYQDPNISGGEGAR

SEQ ID NO: 2130841 - protein, 52 aa, Cryptosporidium hominis
GKNRVFCRTFLITILIFLIFFFKRRLVIDLLLIVELILIDILFSKFLKKKKA

SEQ ID NO: 2130842 - protein, 37 aa, Cryptosporidium hominis
GKNSSRQTLMWLFISIIIMLLIIFVGEYNNSVIEFIE

SEQ ID NO: 2130843 - protein, 33 aa, Cryptosporidium hominis
GKTPKVSIQELFGFVLSVLHLGGFNVSSFVLSV

SEQ ID NO: 2130844 - protein, 32 aa, Cryptosporidium hominis
GKTVKFQLLAFGLSILIFMGGTFYMLINSSRN

SEQ ID NO: 2130845 - protein, 35 aa, Cryptosporidium hominis
GLANVLYQKMAFSRALRLFSTLLLILGTEKCPNTV

SEQ ID NO: 2130846 - protein, 24 aa, Cryptosporidium hominis
GLCSSFLFEFDLNSPVLGMIRSSS

SEQ ID NO: 2130847 - protein, 25 aa, Cryptosporidium hominis
GLEKSIRYFISPLLLNCLQQMVLFD

SEQ ID NO: 2130848 - protein, 40 aa, Cryptosporidium hominis
GLFETIICLVFPAVVYLKLFKYIFICDKYLSRPVFILLTF

SEQ ID NO: 2130849 - protein, 18 aa, Cryptosporidium hominis
GLFGWMLLLLYCGVLIDI

SEQ ID NO: 2130850 - protein, 17 aa, Cryptosporidium hominis
GLFSKEFYSRIRIILRL

SEQ ID NO: 2130851 - protein, 23 aa, Cryptosporidium hominis
GLGSPILLYLTGAGIGVIGVVDH

SEQ ID NO: 2130852 - protein, 24 aa, Cryptosporidium hominis
GLGSSLYEYSFNSAAFKLDKLISS

SEQ ID NO: 2130853 - protein, 27 aa, Cryptosporidium hominis
GLHADFACLIYKALKFKLPAPRVQQII

SEQ ID NO: 2130854 - protein, 19 aa, Cryptosporidium hominis
GLKSQLLKMFKRRNKGGKN

SEQ ID NO: 2130855 - protein, 26 aa, Cryptosporidium hominis
GLLDGFFEFCDFFRQLLMTPIMFILY

SEQ ID NO: 2130856 - protein, 20 aa, Cryptosporidium hominis
GLLTLYFLGKVILNMFVGRL

SEQ ID NO: 2130857 - protein, 26 aa, Cryptosporidium hominis
GLSGFFKGYLTYYFRIAPHAMITLLC

SEQ ID NO: 2130858 - protein, 29 aa, Cryptosporidium hominis
GLSVEQIFYFETLILQAASILFIIVANTY

SEQ ID NO: 2130859 - protein, 20 aa, Cryptosporidium hominis
GLTIILLFSKILTDSTRPWL

SEQ ID NO: 2130860 - protein, 20 aa, Cryptosporidium hominis
GLVLTRNFFEILSAKYSIDT

SEQ ID NO: 2130861 - protein, 20 aa, Cryptosporidium hominis
GLYRLFYIFNWIYRFYAQHY

SEQ ID NO: 2130862 - protein, 18 aa, Cryptosporidium hominis
GMIFGVPISPLTPLFIHM

SEQ ID NO: 2130863 - protein, 25 aa, Cryptosporidium hominis
GMLNPWYILFDWEYIFRKAQIWRFL

SEQ ID NO: 2130864 - protein, 17 aa, Cryptosporidium hominis
GMLTMLELNLALGCFET

SEQ ID NO: 2130865 - protein, 17 aa, Cryptosporidium hominis
GMNILYFMLLTFLLFED

SEQ ID NO: 2130866 - protein, 25 aa, Cryptosporidium hominis
GMYHGRIILPHSYPFSPPSLMMLTG

SEQ ID NO: 2130867 - protein, 30 aa, Cryptosporidium hominis
GNAILCMTIFPWIISILLFYFITREGQKIV

SEQ ID NO: 2130868 - protein, 32 aa, Cryptosporidium hominis
GNELTDLFLFRNKIPINLLINGNLTIDTFSEM

SEQ ID NO: 2130869 - protein, 38 aa, Cryptosporidium hominis
GNGNNFEIPNPLLFLRCLCGWLLIQSIIKEFEQNQLLC

SEQ ID NO: 2130870 - protein, 33 aa, Cryptosporidium hominis
GNGSSHPWFLIFWLVLCYIWIVAYTAFISISIF

SEQ ID NO: 2130871 - protein, 21 aa, Cryptosporidium hominis
GNINRPLLFHFLRQLISENRN

SEQ ID NO: 2130872 - protein, 19 aa, Cryptosporidium hominis
GNIYISNYLGTRFALSLLN

SEQ ID NO: 2130873 - protein, 20 aa, Cryptosporidium hominis
GNKYYITFFVDGSDLHVYFH

SEQ ID NO: 2130874 - protein, 26 aa, Cryptosporidium hominis
GNLACMLLDIIYIPSKLFFHYYDTAN

SEQ ID NO: 2130875 - protein, 18 aa, Cryptosporidium hominis
GNLGCDGGFYSNGWSYLL

SEQ ID NO: 2130876 - protein, 29 aa, Cryptosporidium hominis
GNLQYFSINLLLDHLLPLVTINFANESSE

SEQ ID NO: 2130877 - protein, 29 aa, Cryptosporidium hominis
GNMSSIHCILILTLFINFKVSGDLIFTHI

SEQ ID NO: 2130878 - protein, 22 aa, Cryptosporidium hominis
GNNYILGLFSYEDFMDWHSKKG

SEQ ID NO: 2130879 - protein, 24 aa, Cryptosporidium hominis
GNQKRMLLLLRLALNSQKYRLLLL

SEQ ID NO: 2130880 - protein, 25 aa, Cryptosporidium hominis
GNSLLSMLLGIHLVASIGGADMPVA

SEQ ID NO: 2130881 - protein, 27 aa, Cryptosporidium hominis
GNSQNYTFFSQSFLNLSLKNNVSKGKS

SEQ ID NO: 2130882 - protein, 22 aa, Cryptosporidium hominis
GNTALHLAYMYGMIGLAEFLIN

SEQ ID NO: 2130883 - protein, 28 aa, Cryptosporidium hominis
GNTLWSKLFFTWLSPWMSKFLGPGVNTD

SEQ ID NO: 2130884 - protein, 20 aa, Cryptosporidium hominis
GPDSETILRLLRVEFPKYKK

SEQ ID NO: 2130885 - protein, 34 aa, Cryptosporidium hominis
GPGAILTMVLLAFAIKFITSMNFVLCFLVSSVLS

SEQ ID NO: 2130886 - protein, 21 aa, Cryptosporidium hominis
GPILLIACLGFFLLLAGKIHF

SEQ ID NO: 2130887 - protein, 18 aa, Cryptosporidium hominis
GPLLDDFFEKIGSIFYLL

SEQ ID NO: 2130888 - protein, 17 aa, Cryptosporidium hominis
GQFFILSNKILLNKTFS

SEQ ID NO: 2130889 - protein, 30 aa, Cryptosporidium hominis
GQIFFAISILLSFPLMIFPVKEIFTKYIDN

SEQ ID NO: 2130890 - protein, 29 aa, Cryptosporidium hominis
GQKQTWQSILACIVVCAGFLIGSLDRSTL

SEQ ID NO: 2130891 - protein, 25 aa, Cryptosporidium hominis
GQLARLFWSFWLHTGFIHLFINLSC

SEQ ID NO: 2130892 - protein, 18 aa, Cryptosporidium hominis
GQMILPNNQMIKMKKREI

SEQ ID NO: 2130893 - protein, 20 aa, Cryptosporidium hominis
GQNIWQFIVSRSKLLYNIDS

SEQ ID NO: 2130894 - protein, 23 aa, Cryptosporidium hominis
GQVPQWIILLFPSFIVNLIGCMI

SEQ ID NO: 2130895 - protein, 33 aa, Cryptosporidium hominis
GRKKVFLELNKKLFPTFLRLSLSPVNFDISESP

SEQ ID NO: 2130896 - protein, 17 aa, Cryptosporidium hominis
GRLCIIIVSIIWGIQIA

SEQ ID NO: 2130897 - protein, 27 aa, Cryptosporidium hominis
GRLGKVLFPAGIYPSIKMILGRSGRRR

SEQ ID NO: 2130898 - protein, 25 aa, Cryptosporidium hominis
GRQSSLWNALNFLSSFSNKEEKSRS

SEQ ID NO: 2130899 - protein, 21 aa, Cryptosporidium hominis
GRVFGISCLLIILVGLTQYVA

SEQ ID NO: 2130900 - protein, 17 aa, Cryptosporidium hominis
GSAFSVSSSIYNFVFIF

SEQ ID NO: 2130901 - protein, 36 aa, Cryptosporidium hominis
GSDVYTIWIPLYNNILFWITLISGLSISLWPDYFFK

SEQ ID NO: 2130902 - protein, 25 aa, Cryptosporidium hominis
GSFLLQRFLLILFSKQLISFCYFVF

SEQ ID NO: 2130903 - protein, 24 aa, Cryptosporidium hominis
GSFLTTALLFKLPRGRYLLESGVE

SEQ ID NO: 2130904 - protein, 23 aa, Cryptosporidium hominis
GSIIYPNFVLNKNKSWKILLKKP

SEQ ID NO: 2130905 - protein, 23 aa, Cryptosporidium hominis
GSKGKLLLWFVSGEINMISDDPL

SEQ ID NO: 2130906 - protein, 29 aa, Cryptosporidium hominis
GSLGKFTTKWLYFNGLKNIILLSRNSNNY

SEQ ID NO: 2130907 - protein, 17 aa, Cryptosporidium hominis
GSNIYNFSYVQFCLRNP

SEQ ID NO: 2130908 - protein, 20 aa, Cryptosporidium hominis
GSPIVHAYFNLAKRAIIVLT

SEQ ID NO: 2130909 - protein, 24 aa, Cryptosporidium hominis
GSQDSLVPFFPPIPQIKNRDFDIN

SEQ ID NO: 2130910 - protein, 23 aa, Cryptosporidium hominis
GSRRIYFAFLFGGLIQRCLIHQI

SEQ ID NO: 2130911 - protein, 31 aa, Cryptosporidium hominis
GSSNFTPLPSGIPPHLLAPGNLPSATSVEEY

SEQ ID NO: 2130912 - protein, 31 aa, Cryptosporidium hominis
GSSSDPIHLPGIRYFALFIFSKQVNVCMSKV

SEQ ID NO: 2130913 - protein, 27 aa, Cryptosporidium hominis
GSSSYIFTVFFKMMVMVVGFGIFHGAV

SEQ ID NO: 2130914 - protein, 42 aa, Cryptosporidium hominis
GSSVIMTMFILSIILLFFAAIFLLTFWFCYRTRRVRQSIFML

SEQ ID NO: 2130915 - protein, 34 aa, Cryptosporidium hominis
GSTAILLTSIIYILLWAIISYLKVFYIKNMINDW

SEQ ID NO: 2130916 - protein, 34 aa, Cryptosporidium hominis
GSVTTLFMLGFLRYFRVLNPIPILTIILSWSSEV

SEQ ID NO: 2130917 - protein, 17 aa, Cryptosporidium hominis
GSVWLHFSVQLLDGYDA

SEQ ID NO: 2130918 - protein, 17 aa, Cryptosporidium hominis
GSYYYPPNPWTNNILYA

SEQ ID NO: 2130919 - protein, 22 aa, Cryptosporidium hominis
GTCFSFYYIVMTRLLNSPWMIP

SEQ ID NO: 2130920 - protein, 19 aa, Cryptosporidium hominis
GTFLILFSIIIDTANIRAS

SEQ ID NO: 2130921 - protein, 28 aa, Cryptosporidium hominis
GTGIFNWRFVFDIKIPTQYPILKLQLWS

SEQ ID NO: 2130922 - protein, 27 aa, Cryptosporidium hominis
GTKYSFPIITGLLLYIGIYLPNGNESN

SEQ ID NO: 2130923 - protein, 20 aa, Cryptosporidium hominis
GTLLNFFSSSLIALPILCLC

SEQ ID NO: 2130924 - protein, 30 aa, Cryptosporidium hominis
GTNVVFVIWILLVSSFFTWVIYRIYKFGCY

SEQ ID NO: 2130925 - protein, 23 aa, Cryptosporidium hominis
GTPLILCLIALFSCFTIAATTQY

SEQ ID NO: 2130926 - protein, 18 aa, Cryptosporidium hominis
GVDKFFNILKNYYEIVIW

SEQ ID NO: 2130927 - protein, 32 aa, Cryptosporidium hominis
GVFIVYDFQPFLLQKIYKRVPISHLITSFCAI

SEQ ID NO: 2130928 - protein, 22 aa, Cryptosporidium hominis
GVFLAGLFLNTLLGSASVSASS

SEQ ID NO: 2130929 - protein, 25 aa, Cryptosporidium hominis
GVFSLPTFHFWILDNNSYILVDKLE

SEQ ID NO: 2130930 - protein, 35 aa, Cryptosporidium hominis
GVFSLSTWLRVIPILMIFLIYYRKVRVRRQSILIF

SEQ ID NO: 2130931 - protein, 24 aa, Cryptosporidium hominis
GVILSYLLQGLFHPAKKVRSVYWR

SEQ ID NO: 2130932 - protein, 32 aa, Cryptosporidium hominis
GVITILTRKFNNSLLLLSYTPFYMIEMHKNKD

SEQ ID NO: 2130933 - protein, 26 aa, Cryptosporidium hominis
GVIYESFACRWVFERILEYRCWFPNC

SEQ ID NO: 2130934 - protein, 19 aa, Cryptosporidium hominis
GVIYVKFLYTLEKKSKLQS

SEQ ID NO: 2130935 - protein, 20 aa, Cryptosporidium hominis
GVLALLAFLTSVAVAGVAII

SEQ ID NO: 2130936 - protein, 20 aa, Cryptosporidium hominis
GVLKLFLSLALSSSKKKFIK

SEQ ID NO: 2130937 - protein, 24 aa, Cryptosporidium hominis
GVMLATLFFTVLGLTMTTIQIQNI

SEQ ID NO: 2130938 - protein, 24 aa, Cryptosporidium hominis
GVSDIKLHKWFYNYDFNSLISRKV

SEQ ID NO: 2130939 - protein, 29 aa, Cryptosporidium hominis
GVSFVPTVLVTPFLIMGAAVNYLFVIVNA

SEQ ID NO: 2130940 - protein, 17 aa, Cryptosporidium hominis
GVTTWKILALNIPTNKL

SEQ ID NO: 2130941 - protein, 37 aa, Cryptosporidium hominis
GVVALTLLIIYLLNKILFWFILISIFAFCISVATRSL

SEQ ID NO: 2130942 - protein, 24 aa, Cryptosporidium hominis
GVVFGFLISVWLRAAQALGGVQVI

SEQ ID NO: 2130943 - protein, 23 aa, Cryptosporidium hominis
GWQPPPCYWSLMKHPAVVNSIQK

SEQ ID NO: 2130944 - protein, 33 aa, Cryptosporidium hominis
GYASIFTYFTIYLATFILFWILAMNNIINAAKL

SEQ ID NO: 2130945 - protein, 33 aa, Cryptosporidium hominis
GYEKLLNNILPMKSIIIVFLNYHIFNQHSHFFN

SEQ ID NO: 2130946 - protein, 20 aa, Cryptosporidium hominis
GYFCYGIISIYVWYNHFDTY

SEQ ID NO: 2130947 - protein, 38 aa, Cryptosporidium hominis
GYIGIGYVFGFWPSLLFKQHYNNILRSKKHKLFIMGDS

SEQ ID NO: 2130948 - protein, 29 aa, Cryptosporidium hominis
GYLEGMSIIYLYIYWHIQFRAKNERKTPE

SEQ ID NO: 2130949 - protein, 33 aa, Cryptosporidium hominis
GYMIEPDWGILRFFLLFFLSGVGGNLAVAVISP

SEQ ID NO: 2130950 - protein, 30 aa, Cryptosporidium hominis
GYPNSYTYYFSSLILWLFSKSNDSIVQEQI

SEQ ID NO: 2130951 - protein, 17 aa, Cryptosporidium hominis
GYPRNLPTLVLGLRGLI

SEQ ID NO: 2130952 - protein, 26 aa, Cryptosporidium hominis
GYVMFSFLQLLIFYMGGDQVILSVLE

SEQ ID NO: 2130953 - protein, 24 aa, Cryptosporidium hominis
GYYKFMLNLFLSSLLFDLIFGVLY

SEQ ID NO: 2130954 - protein, 19 aa, Cryptosporidium hominis
HAALFAQLLMEHISGFNTV

SEQ ID NO: 2130955 - protein, 27 aa, Cryptosporidium hominis
HACRLKIWLYCLRHFSASLLLKSRNKI

SEQ ID NO: 2130956 - protein, 26 aa, Cryptosporidium hominis
HAGALNIPFWMTFTHKLDSINNRIPC

SEQ ID NO: 2130957 - protein, 22 aa, Cryptosporidium hominis
HAIFLILIINSAFFTINEVHPS

SEQ ID NO: 2130958 - protein, 32 aa, Cryptosporidium hominis
HAIMDGLSRQYFWTELLGLCALSNEFPDIAIP

SEQ ID NO: 2130959 - protein, 18 aa, Cryptosporidium hominis
HAKEQKAIILCHPTSIKS

SEQ ID NO: 2130960 - protein, 20 aa, Cryptosporidium hominis
HAPKLLSVYLQILNSLLSKK

SEQ ID NO: 2130961 - protein, 30 aa, Cryptosporidium hominis
HCKYAKFLFQFLIFFIDNVCNLVLCGKRSQ

SEQ ID NO: 2130962 - protein, 32 aa, Cryptosporidium hominis
HDAIGKFIDRMSWLMLFCQLLSYGNSSNFNRM

SEQ ID NO: 2130963 - protein, 25 aa, Cryptosporidium hominis
HDEDLYLLDIFVYPCSDPAQRYGLI

SEQ ID NO: 2130964 - protein, 21 aa, Cryptosporidium hominis
HDIVIIMMIIIRLGVYSSIFY

SEQ ID NO: 2130965 - protein, 21 aa, Cryptosporidium hominis
HDWDIYRYLTGPYKPHSYSNA

SEQ ID NO: 2130966 - protein, 31 aa, Cryptosporidium hominis
HDYLHYIGHSLPFPVVIYLLSNQFSSEKKKF

SEQ ID NO: 2130967 - protein, 18 aa, Cryptosporidium hominis
HEFADLRPLFLWHGRHAY

SEQ ID NO: 2130968 - protein, 21 aa, Cryptosporidium hominis
HEFWTITSSLDPGLKPLAFLP

SEQ ID NO: 2130969 - protein, 19 aa, Cryptosporidium hominis
HELWLFIIVSQHNNLKVGD

SEQ ID NO: 2130970 - protein, 18 aa, Cryptosporidium hominis
HENKMLWRPFTEQNQEKH

SEQ ID NO: 2130971 - protein, 18 aa, Cryptosporidium hominis
HENMIKGFKMVKYRGKYG

SEQ ID NO: 2130972 - protein, 19 aa, Cryptosporidium hominis
HEYLVVVPLDIGWTGWVVL

SEQ ID NO: 2130973 - protein, 28 aa, Cryptosporidium hominis
HFKAIHKYWGFLYLYKSVITNEIDLSQR

SEQ ID NO: 2130974 - protein, 18 aa, Cryptosporidium hominis
HFLIRIFGYLDRNSCHVF

SEQ ID NO: 2130975 - protein, 31 aa, Cryptosporidium hominis
HFMEMDHFIYFLHILIGWNKFVLKKFMVYTV

SEQ ID NO: 2130976 - protein, 41 aa, Cryptosporidium hominis
HFNCSWIIPQWFLIYLRLSVFLYLLIMLGLDVSNYYKLGYA

SEQ ID NO: 2130977 - protein, 21 aa, Cryptosporidium hominis
HFRAIILHQKVLLIASGYSRS

SEQ ID NO: 2130978 - protein, 28 aa, Cryptosporidium hominis
HFSKFHLNICNLPRPAFSRPVLRRNQQD

SEQ ID NO: 2130979 - protein, 22 aa, Cryptosporidium hominis
HGFEWLWFLALLIVISVVMFPF

SEQ ID NO: 2130980 - protein, 26 aa, Cryptosporidium hominis
HGLLNIILLFLTISVLFSIPIGLLGS

SEQ ID NO: 2130981 - protein, 18 aa, Cryptosporidium hominis
HGTYMAHIPLMFSRKYIQ

SEQ ID NO: 2130982 - protein, 35 aa, Cryptosporidium hominis
HHELKIIQLQWVLYLAVAGLIPLWKKIENDQFGVF

SEQ ID NO: 2130983 - protein, 23 aa, Cryptosporidium hominis
HHFKIVRLYLDNTIDSKSLLGNW

SEQ ID NO: 2130984 - protein, 18 aa, Cryptosporidium hominis
HHHHHHGYKPHKTTTTTT

SEQ ID NO: 2130985 - protein, 23 aa, Cryptosporidium hominis
HHLKLCWVFIFCLSLFGMLDIIT

SEQ ID NO: 2130986 - protein, 38 aa, Cryptosporidium hominis
HHLSDLFVYFGISRFTLYYIKHNIALIFAILVGLTCAI

SEQ ID NO: 2130987 - protein, 23 aa, Cryptosporidium hominis
HHRPPLQEYILTSSSLSLKPTQI

SEQ ID NO: 2130988 - protein, 27 aa, Cryptosporidium hominis
HIEFIIPIFIYVLFYLVSILFKNDTNL

SEQ ID NO: 2130989 - protein, 24 aa, Cryptosporidium hominis
HIELLPYVRILYNKELLFQSCIVK

SEQ ID NO: 2130990 - protein, 20 aa, Cryptosporidium hominis
HIFTIWENFIYLTSFFSKSQ

SEQ ID NO: 2130991 - protein, 18 aa, Cryptosporidium hominis
HIGLFLYEYLGEEYPEVL

SEQ ID NO: 2130992 - protein, 25 aa, Cryptosporidium hominis
HINTMLINFLFDAIINMLNPWISLF

SEQ ID NO: 2130993 - protein, 19 aa, Cryptosporidium hominis
HIPIEYRPLYRDCTSNVNY

SEQ ID NO: 2130994 - protein, 24 aa, Cryptosporidium hominis
HITETGLIPSLLTILSCEYSIHSQ

SEQ ID NO: 2130995 - protein, 23 aa, Cryptosporidium hominis
HKHLLLLILYSAISCSFITITLG

SEQ ID NO: 2130996 - protein, 28 aa, Cryptosporidium hominis
HKHYRLFFGLIFLFMGCGYIGSIRVNLL

SEQ ID NO: 2130997 - protein, 32 aa, Cryptosporidium hominis
HKLEKLIFSILKIHIIYILELSILLSEISEIK

SEQ ID NO: 2130998 - protein, 17 aa, Cryptosporidium hominis
HKLNLYSYIRWLKTSMQ

SEQ ID NO: 2130999 - protein, 21 aa, Cryptosporidium hominis
HKVPVILILELFQFIKEETST

SEQ ID NO: 2131000 - protein, 21 aa, Cryptosporidium hominis
HKWIEILIVYMTLVSKGINPL

SEQ ID NO: 2131001 - protein, 18 aa, Cryptosporidium hominis
HLDAYYDPFKSITKREVP

SEQ ID NO: 2131002 - protein, 35 aa, Cryptosporidium hominis
HLDNELGWYWYHLGIYNLILIKIIYLNLSVQNEES

SEQ ID NO: 2131003 - protein, 26 aa, Cryptosporidium hominis
HLGILNYLLFDEFGFTLLTVFASYSI

SEQ ID NO: 2131004 - protein, 19 aa, Cryptosporidium hominis
HLIIELFMSSFPYGIVEFL

SEQ ID NO: 2131005 - protein, 24 aa, Cryptosporidium hominis
HLIKIWLVYFFTVVFYELILSFIL

SEQ ID NO: 2131006 - protein, 33 aa, Cryptosporidium hominis
HLLKQIDSLFSLKHSFLWPHNNATLISAISMYN

SEQ ID NO: 2131007 - protein, 18 aa, Cryptosporidium hominis
HLLPLLMQSTLEEQERHI

SEQ ID NO: 2131008 - protein, 25 aa, Cryptosporidium hominis
HLYNYIHILIVKFVGFFTLRLLGVL

SEQ ID NO: 2131009 - protein, 18 aa, Cryptosporidium hominis
HMGMAPFFTGMLMSYSLQ

SEQ ID NO: 2131010 - protein, 18 aa, Cryptosporidium hominis
HMPSWAGLTHLLEGLLGL

SEQ ID NO: 2131011 - protein, 18 aa, Cryptosporidium hominis
HMRIKLQQKIRDLVYTKG

SEQ ID NO: 2131012 - protein, 36 aa, Cryptosporidium hominis
HNAGLLFKYIVLFDLLIMFLILTIFSVGINVNLEGI

SEQ ID NO: 2131013 - protein, 24 aa, Cryptosporidium hominis
HNHIQTITLALLESSFCEERKDNY

SEQ ID NO: 2131014 - protein, 18 aa, Cryptosporidium hominis
HNSNIFLGNRYGSGVGSS

SEQ ID NO: 2131015 - protein, 18 aa, Cryptosporidium hominis
HQGDGFLTPEDLFRMFFG

SEQ ID NO: 2131016 - protein, 37 aa, Cryptosporidium hominis
HQGVFRDVARAWTLILLVLCGFFSNLLFFSSCPNLGD

SEQ ID NO: 2131017 - protein, 19 aa, Cryptosporidium hominis
HQSLPCWMTLRSNTRESSS

SEQ ID NO: 2131018 - protein, 27 aa, Cryptosporidium hominis
HRLILVFKRLIRQLILYWKSIINYFMP

SEQ ID NO: 2131019 - protein, 31 aa, Cryptosporidium hominis
HRPHPWGLLITFIELIKNPKYAFWSCSFVHL

SEQ ID NO: 2131020 - protein, 28 aa, Cryptosporidium hominis
HRVREHKSWYRFWEKKPKYVHKNIYGSE

SEQ ID NO: 2131021 - protein, 29 aa, Cryptosporidium hominis
HRYCTTLKMLFLKYLVDNIIKLLFDCLTE

SEQ ID NO: 2131022 - protein, 17 aa, Cryptosporidium hominis
HSFWMERKPKNILEFPI

SEQ ID NO: 2131023 - protein, 27 aa, Cryptosporidium hominis
HSISLVGLFCVIFVRRSFHHFVKSVES

SEQ ID NO: 2131024 - protein, 18 aa, Cryptosporidium hominis
HSLNFTMMWLQYCGLSPL

SEQ ID NO: 2131025 - protein, 25 aa, Cryptosporidium hominis
HSMGTRLFIQSFPKLLSENLLERCE

SEQ ID NO: 2131026 - protein, 22 aa, Cryptosporidium hominis
HSMKLLIFSLSTLFAGAIISLF

SEQ ID NO: 2131027 - protein, 29 aa, Cryptosporidium hominis
HSSIQFWLILYLILIIFQIKDIINKGSKY

SEQ ID NO: 2131028 - protein, 20 aa, Cryptosporidium hominis
HTILLGKYLKALSTLKNRIE

SEQ ID NO: 2131029 - protein, 20 aa, Cryptosporidium hominis
HTIYSFLMKVLENILVIDLH

SEQ ID NO: 2131030 - protein, 37 aa, Cryptosporidium hominis
HTLNIFQFMYIFTPAICIFFVLLKLSLRNFNYPSFSN

SEQ ID NO: 2131031 - protein, 17 aa, Cryptosporidium hominis
HTNKRCFKLLSVKIQDL

SEQ ID NO: 2131032 - protein, 33 aa, Cryptosporidium hominis
HTWKKLYLRSPSDAMWYLFKQIIPIRGDLTVFG

SEQ ID NO: 2131033 - protein, 24 aa, Cryptosporidium hominis
HTYTLKWFDNILPSLKIPKVPWDL

SEQ ID NO: 2131034 - protein, 35 aa, Cryptosporidium hominis
HVKGWQPYQALLLQIFIFISPFLRSVQLSSNIKTI

SEQ ID NO: 2131035 - protein, 26 aa, Cryptosporidium hominis
HVVTFFFMLFLIFILIGLLSSFVAEN

SEQ ID NO: 2131036 - protein, 25 aa, Cryptosporidium hominis
HYASCALFFIFGLKSLYEGLFLIES

SEQ ID NO: 2131037 - protein, 29 aa, Cryptosporidium hominis
HYENPFIVYLHVLYLKFSLGNFSGPISCT

SEQ ID NO: 2131038 - protein, 32 aa, Cryptosporidium hominis
HYFDFTWALLTFSFLSFLFSIFLYKSCIEHAF

SEQ ID NO: 2131039 - protein, 24 aa, Cryptosporidium hominis
HYRIWMHGAWLPSFKMVWGQISHG

SEQ ID NO: 2131040 - protein, 17 aa, Cryptosporidium hominis
HYYEAEGRLLMFKVKQL

SEQ ID NO: 2131041 - protein, 30 aa, Cryptosporidium hominis
HYYLVFLLHIVLYIFLKEEILKWTKNYPIC

SEQ ID NO: 2131042 - protein, 22 aa, Cryptosporidium hominis
IAAHGLFYKGYNLIILCVEIGM

SEQ ID NO: 2131043 - protein, 32 aa, Cryptosporidium hominis
IAAQLPIPIAALQILFLNLMSDGGPAVALSVD

SEQ ID NO: 2131044 - protein, 25 aa, Cryptosporidium hominis
IAAVVHFFSIILGVPILYGQYVSKV

SEQ ID NO: 2131045 - protein, 24 aa, Cryptosporidium hominis
IAENMILSIFRRGGFYFSTNPNVD

SEQ ID NO: 2131046 - protein, 29 aa, Cryptosporidium hominis
IAFMQCVFSALFYFIPVALFQGWLAVGYA

SEQ ID NO: 2131047 - protein, 32 aa, Cryptosporidium hominis
IAGNALFIAFLSLLLVIYHLFLAYNNLTTWEN

SEQ ID NO: 2131048 - protein, 28 aa, Cryptosporidium hominis
IAIGERILPPYWYMNWVEQTSTRSKERF

SEQ ID NO: 2131049 - protein, 31 aa, Cryptosporidium hominis
IAIHEKVQWLLWICVLITTICFYATRLPYFD

SEQ ID NO: 2131050 - protein, 24 aa, Cryptosporidium hominis
IAKKRLMFFSPFISAVPSIMGNIL

SEQ ID NO: 2131051 - protein, 32 aa, Cryptosporidium hominis
IAKLGFLSLFSFIIFLLSVLYRYFISPFDGVM

SEQ ID NO: 2131052 - protein, 23 aa, Cryptosporidium hominis
IAKYILFFSIIYKSYTQFSNSIS

SEQ ID NO: 2131053 - protein, 25 aa, Cryptosporidium hominis
IALDLIKRHHLLLVTLLLANSICME

SEQ ID NO: 2131054 - protein, 23 aa, Cryptosporidium hominis
IALKNLLHRPLKYALKNAIEIAK

SEQ ID NO: 2131055 - protein, 27 aa, Cryptosporidium hominis
IALNWNSWYFFPEQIIDLSLVKIQDFL

SEQ ID NO: 2131056 - protein, 22 aa, Cryptosporidium hominis
IAPILIMELPTLSSLGLQILKV

SEQ ID NO: 2131057 - protein, 22 aa, Cryptosporidium hominis
IAPNFVKKLRKLGFRVLVESGA

SEQ ID NO: 2131058 - protein, 19 aa, Cryptosporidium hominis
IARVLIGHLILFPQKMVVN

SEQ ID NO: 2131059 - protein, 32 aa, Cryptosporidium hominis
IASKFRKWVNPIHGRIFVVLTTSFALVGVFFQ

SEQ ID NO: 2131060 - protein, 26 aa, Cryptosporidium hominis
IASVCIFLYLVRYFLEIVLNVSRRYK

SEQ ID NO: 2131061 - protein, 22 aa, Cryptosporidium hominis
IASVLPFICKILENIKGSYYYP

SEQ ID NO: 2131062 - protein, 28 aa, Cryptosporidium hominis
IATKNFISEWFLLVTFYSFFSFIHIYFL

SEQ ID NO: 2131063 - protein, 26 aa, Cryptosporidium hominis
IAVDVYLPRIRFGYKTLPTVVDITRY

SEQ ID NO: 2131064 - protein, 18 aa, Cryptosporidium hominis
IAVQNLRWKKSDISILIG

SEQ ID NO: 2131065 - protein, 18 aa, Cryptosporidium hominis
IAYGLKRTLYNPSLNASN

SEQ ID NO: 2131066 - protein, 20 aa, Cryptosporidium hominis
ICCAAFGSLLLIFRKYIPHP

SEQ ID NO: 2131067 - protein, 18 aa, Cryptosporidium hominis
ICDKYRFTCIFIHAMCFC

SEQ ID NO: 2131068 - protein, 24 aa, Cryptosporidium hominis
ICFLWLTILIELFWFNKECRKNVD

SEQ ID NO: 2131069 - protein, 27 aa, Cryptosporidium hominis
ICIFPILYYTFYFYYFWVFDSTKNSNR

SEQ ID NO: 2131070 - protein, 29 aa, Cryptosporidium hominis
ICKKSLFCGIWLLFHSWSISLLKGVQQQG

SEQ ID NO: 2131071 - protein, 20 aa, Cryptosporidium hominis
ICKWIIIIAHFFCLNRNGAS

SEQ ID NO: 2131072 - protein, 35 aa, Cryptosporidium hominis
ICLKLGWRSVFYIPSIFVFLFGIIVLKYLKKPRNL

SEQ ID NO: 2131073 - protein, 24 aa, Cryptosporidium hominis
ICLTLAGSVWYGFAKSLNCNSGGK

SEQ ID NO: 2131074 - protein, 34 aa, Cryptosporidium hominis
ICMKSVKKIFLSWTGFIFVLREIIEKAIFSIKNN

SEQ ID NO: 2131075 - protein, 22 aa, Cryptosporidium hominis
ICNYAIIAMFYASDNLFRKMIV

SEQ ID NO: 2131076 - protein, 37 aa, Cryptosporidium hominis
ICRQLKFLLIIEFMTLIILFVLVPTGGTVWVLLQVFS

SEQ ID NO: 2131077 - protein, 24 aa, Cryptosporidium hominis
ICSAEGQCIWTLAKRLKELSAMFW

SEQ ID NO: 2131078 - protein, 29 aa, Cryptosporidium hominis
ICSLITYLLFIILFLVLNPSRIPLYIMGD

SEQ ID NO: 2131079 - protein, 18 aa, Cryptosporidium hominis
ICVDWEGGWWSKEFLSRR

SEQ ID NO: 2131080 - protein, 25 aa, Cryptosporidium hominis
ICVLSSLGTIPIIRCSNKQFSPSQM

SEQ ID NO: 2131081 - protein, 31 aa, Cryptosporidium hominis
ICWTRKNYWLALMLNFWYYHNKLFGRISLLR

SEQ ID NO: 2131082 - protein, 24 aa, Cryptosporidium hominis
IDIEDRFFHPIYQKLILNSESLQP

SEQ ID NO: 2131083 - protein, 27 aa, Cryptosporidium hominis
IDISYQFLFLIYRKILVSKTKCLVISH

SEQ ID NO: 2131084 - protein, 28 aa, Cryptosporidium hominis
IDLLLYVTFCFGFMMAILFFNSSGSVKH

SEQ ID NO: 2131085 - protein, 22 aa, Cryptosporidium hominis
IDLRMWLTNLILKQYYSDLTYY

SEQ ID NO: 2131086 - protein, 24 aa, Cryptosporidium hominis
IDPKSPFIQFIVQSIFAYFNSLIK

SEQ ID NO: 2131087 - protein, 62 aa, Cryptosporidium hominis
IDRKTMFRICNFVSIFLEILIRGGFIIFVFPWLLLMIPPICLFAWFWLFQYYRHASRELFRS

SEQ ID NO: 2131088 - protein, 20 aa, Cryptosporidium hominis
IDSKSFQLSDLSLPNMEAES

SEQ ID NO: 2131089 - protein, 23 aa, Cryptosporidium hominis
IEDRNIILCLILGAAFHVYSCLF

SEQ ID NO: 2131090 - protein, 17 aa, Cryptosporidium hominis
IEEFVKFSYSLRFLGEV

SEQ ID NO: 2131091 - protein, 24 aa, Cryptosporidium hominis
IEEKYFHISFSIPNSLFLYESKID

SEQ ID NO: 2131092 - protein, 25 aa, Cryptosporidium hominis
IEFKVYIYSAYYDWRIDRIRINSLI

SEQ ID NO: 2131093 - protein, 18 aa, Cryptosporidium hominis
IEFNKYKVLIVIFSALLA

SEQ ID NO: 2131094 - protein, 27 aa, Cryptosporidium hominis
IEFVADRLLFALDIPKIYNVSNPFDWM

SEQ ID NO: 2131095 - protein, 33 aa, Cryptosporidium hominis
IEKFIDLKVIYYQYLIILWHYEQNPKEISICFL

SEQ ID NO: 2131096 - protein, 22 aa, Cryptosporidium hominis
IEKLIFNCLSFIDGFYNIGASR

SEQ ID NO: 2131097 - protein, 25 aa, Cryptosporidium hominis
IELITLMLIPELMSGLFVIILMACI

SEQ ID NO: 2131098 - protein, 26 aa, Cryptosporidium hominis
IELPPAPLNSMLLLKAASGMPYSTSS

SEQ ID NO: 2131099 - protein, 30 aa, Cryptosporidium hominis
IEMDSYMHIYVYLLLRLIQSICIPNGIVSG

SEQ ID NO: 2131100 - protein, 24 aa, Cryptosporidium hominis
IENGEFNFPMKVNFFSALEVFQVS

SEQ ID NO: 2131101 - protein, 18 aa, Cryptosporidium hominis
IENIILLYLLSLNNFFNL

SEQ ID NO: 2131102 - protein, 26 aa, Cryptosporidium hominis
IENKPLPPIWIPLKQTRDGWIDMIDN

SEQ ID NO: 2131103 - protein, 22 aa, Cryptosporidium hominis
IENPFLFSLMKRVLNKQLLSLE

SEQ ID NO: 2131104 - protein, 23 aa, Cryptosporidium hominis
IENYYLYFDILLVNIVMDFIFTL

SEQ ID NO: 2131105 - protein, 29 aa, Cryptosporidium hominis
IEQEYIKHKIKLFELYNTTCTILDHLEND

SEQ ID NO: 2131106 - protein, 23 aa, Cryptosporidium hominis
IEQLSDIPPPPSYPAPVLKINIS

SEQ ID NO: 2131107 - protein, 29 aa, Cryptosporidium hominis
IESIKKLCKVWLLSPFNALDVLLTDSKQR

SEQ ID NO: 2131108 - protein, 25 aa, Cryptosporidium hominis
IESSTPFEYLVLETILVESCNIINR

SEQ ID NO: 2131109 - protein, 27 aa, Cryptosporidium hominis
IESWDELVIIYYYYNTIELLRIKRSRG

SEQ ID NO: 2131110 - protein, 22 aa, Cryptosporidium hominis
IETILREYGVIDRAPRQDMSSN

SEQ ID NO: 2131111 - protein, 22 aa, Cryptosporidium hominis
IETVNWISIFYCIANLICNNSC

SEQ ID NO: 2131112 - protein, 25 aa, Cryptosporidium hominis
IEVDKLMIRMIYGNLPSFGCESLQI

SEQ ID NO: 2131113 - protein, 19 aa, Cryptosporidium hominis
IEYIVHITHLFLLTKRNSG

SEQ ID NO: 2131114 - protein, 20 aa, Cryptosporidium hominis
IFCMLICILFIIPVLVRLWH

SEQ ID NO: 2131115 - protein, 22 aa, Cryptosporidium hominis
IFDRYYIFCKGSFDVLTKFSPN

SEQ ID NO: 2131116 - protein, 26 aa, Cryptosporidium hominis
IFEDAKIFVILFKILSKHSINILIPV

SEQ ID NO: 2131117 - protein, 34 aa, Cryptosporidium hominis
IFEKIMSLFHFSMSTYWMVLGKIIGKHNTENVNK

SEQ ID NO: 2131118 - protein, 18 aa, Cryptosporidium hominis
IFESLRVLDPYSNQTCLA

SEQ ID NO: 2131119 - protein, 29 aa, Cryptosporidium hominis
IFESRDLLNYFFLVALISPFVVVSDSTTS

SEQ ID NO: 2131120 - protein, 19 aa, Cryptosporidium hominis
IFFLEFFVQRLVFDKLQLV

SEQ ID NO: 2131121 - protein, 21 aa, Cryptosporidium hominis
IFFLVFAISALNVNSQELILT

SEQ ID NO: 2131122 - protein, 39 aa, Cryptosporidium hominis
IFGVYTMLFSFYTACKKYKFIQPWHFMLLSAMSCVGGLI

SEQ ID NO: 2131123 - protein, 24 aa, Cryptosporidium hominis
IFGYTLMFLLHFSSYAYYFAGICF

SEQ ID NO: 2131124 - protein, 17 aa, Cryptosporidium hominis
IFHVLKALYSKLSSFRR

SEQ ID NO: 2131125 - protein, 23 aa, Cryptosporidium hominis
IFLFFNILNLLNGEEIDSKSFQL

SEQ ID NO: 2131126 - protein, 27 aa, Cryptosporidium hominis
IFLFLFVLRFYFWVRGRFSFNVGSNEK

SEQ ID NO: 2131127 - protein, 19 aa, Cryptosporidium hominis
IFLICVYTLNLNVAEGFYS

SEQ ID NO: 2131128 - protein, 20 aa, Cryptosporidium hominis
IFLLIVFLANYKENGIFLNN

SEQ ID NO: 2131129 - protein, 23 aa, Cryptosporidium hominis
IFLSIIILFISCSTQLELDIMKE

SEQ ID NO: 2131130 - protein, 20 aa, Cryptosporidium hominis
IFLSIPPLHFAYLGVVLCIV

SEQ ID NO: 2131131 - protein, 21 aa, Cryptosporidium hominis
IFNLKFLIREFVCKIEAVQLK

SEQ ID NO: 2131132 - protein, 17 aa, Cryptosporidium hominis
IFNLPLHYLILAGIQAL

SEQ ID NO: 2131133 - protein, 30 aa, Cryptosporidium hominis
IFSATPIGYLLITLIRLIAFMTDKLLLLSR

SEQ ID NO: 2131134 - protein, 27 aa, Cryptosporidium hominis
IFSLNYLNLFHSVFPYYRGEVPKLTVS

SEQ ID NO: 2131135 - protein, 27 aa, Cryptosporidium hominis
IFSNEYLSKFYLFLAKELEVLEPKTPE

SEQ ID NO: 2131136 - protein, 33 aa, Cryptosporidium hominis
IFSRYFVPSIILLSLLAFVVWFLLAYYDKVDPA

SEQ ID NO: 2131137 - protein, 18 aa, Cryptosporidium hominis
IFTFKLSLKFLSGTMIFQ

SEQ ID NO: 2131138 - protein, 26 aa, Cryptosporidium hominis
IFTLYSKWLMNNYFPYPITMSLIHMI

SEQ ID NO: 2131139 - protein, 29 aa, Cryptosporidium hominis
IFTRKIFHLFLIALFFPQILSFNIMPTKE

SEQ ID NO: 2131140 - protein, 27 aa, Cryptosporidium hominis
IFVCCGLLIWLLLTNIFEVLWIAKYLL

SEQ ID NO: 2131141 - protein, 31 aa, Cryptosporidium hominis
IFVCILRLYAYYPVWLLLNNTSNDWYINNAP

SEQ ID NO: 2131142 - protein, 22 aa, Cryptosporidium hominis
IFVFIIPAWIYYSTYFKHRNKI

SEQ ID NO: 2131143 - protein, 40 aa, Cryptosporidium hominis
IFVLSGVVSMRIFRPYWSDGRMWFNLVLVYIAMNIVRGIM

SEQ ID NO: 2131144 - protein, 25 aa, Cryptosporidium hominis
IFVTYLHYLFILITTPIGFSILRVV

SEQ ID NO: 2131145 - protein, 31 aa, Cryptosporidium hominis
IGDYSIIRLIHFIFKRALRKFPSDEKLWLQN

SEQ ID NO: 2131146 - protein, 27 aa, Cryptosporidium hominis
IGFAISIVIGIIWLISLRYESRIADSI

SEQ ID NO: 2131147 - protein, 28 aa, Cryptosporidium hominis
IGHSNFTPLLLLFEILNSPIVQNSPQHI

SEQ ID NO: 2131148 - protein, 29 aa, Cryptosporidium hominis
IGIEPIVIILRSFDLFTIVAPPALPATIA

SEQ ID NO: 2131149 - protein, 37 aa, Cryptosporidium hominis
IGILSPFIDILIELAWIPSTFRNLFWSIISEISNFGV

SEQ ID NO: 2131150 - protein, 24 aa, Cryptosporidium hominis
IGISFVTLILLTTLMILVHCVLEK

SEQ ID NO: 2131151 - protein, 28 aa, Cryptosporidium hominis
IGISVWIRNLIINLIIILICLAVLAYIS

SEQ ID NO: 2131152 - protein, 18 aa, Cryptosporidium hominis
IGKVLLGFALYNKAKYQS

SEQ ID NO: 2131153 - protein, 29 aa, Cryptosporidium hominis
IGLGSFIGFIILIALIRIIYFAAKKRNSR

SEQ ID NO: 2131154 - protein, 18 aa, Cryptosporidium hominis
IGLKVYYLPYKSIYDNVV

SEQ ID NO: 2131155 - protein, 22 aa, Cryptosporidium hominis
IGLTILAYRYNGLRRNDIYHLL

SEQ ID NO: 2131156 - protein, 26 aa, Cryptosporidium hominis
IGNISKFNIFFRELNIRYLNNKYHNE

SEQ ID NO: 2131157 - protein, 25 aa, Cryptosporidium hominis
IGPQSFISFILFYSEIESLDTQIIE

SEQ ID NO: 2131158 - protein, 25 aa, Cryptosporidium hominis
IGRGYKRCLLLQTGELLRLVHSYNK

SEQ ID NO: 2131159 - protein, 20 aa, Cryptosporidium hominis
IGSCLLLLNCRFGIAPVSMN

SEQ ID NO: 2131160 - protein, 26 aa, Cryptosporidium hominis
IGSFGLMLFIIIMGTFLTYVLEAVAC

SEQ ID NO: 2131161 - protein, 17 aa, Cryptosporidium hominis
IGSLVIFFQMGEPNLYS

SEQ ID NO: 2131162 - protein, 24 aa, Cryptosporidium hominis
IGSSIYYFFIRYFINGCRTLRSCY

SEQ ID NO: 2131163 - protein, 24 aa, Cryptosporidium hominis
IGTLKIFYLYARWTLYFNTQVIAG

SEQ ID NO: 2131164 - protein, 17 aa, Cryptosporidium hominis
IGTWVWLELFRITGTQL

SEQ ID NO: 2131165 - protein, 27 aa, Cryptosporidium hominis
IGVDILYFTYFVCIVLAILSVVASGIL

SEQ ID NO: 2131166 - protein, 23 aa, Cryptosporidium hominis
IGVFIMLPPLFYISRVSFEMIMP

SEQ ID NO: 2131167 - protein, 19 aa, Cryptosporidium hominis
IGVMIAGLLILYNPAWTIA

SEQ ID NO: 2131168 - protein, 31 aa, Cryptosporidium hominis
IGWRNVEFFEYLASILRFLEVFLTIQHRPIE

SEQ ID NO: 2131169 - protein, 19 aa, Cryptosporidium hominis
IGYINPLGDSLPIALNSMV

SEQ ID NO: 2131170 - protein, 27 aa, Cryptosporidium hominis
IGYQEILFIILITTILVYFGIISVLYD

SEQ ID NO: 2131171 - protein, 32 aa, Cryptosporidium hominis
IHDEIDLYLQYFIFKRPYLSAFSLVFSKSQMD

SEQ ID NO: 2131172 - protein, 22 aa, Cryptosporidium hominis
IHGMGACIMTAIWLVQDLKSNL

SEQ ID NO: 2131173 - protein, 17 aa, Cryptosporidium hominis
IHIYMIGVLLYFCLTGE

SEQ ID NO: 2131174 - protein, 24 aa, Cryptosporidium hominis
IHKIFPNYDKIPLIRLDRLPLKNK

SEQ ID NO: 2131175 - protein, 49 aa, Cryptosporidium hominis
IHKTKPFRLSLFTNKLFVIQIFFIIISTIAIILVPTSLLSKFLNIVPLP

SEQ ID NO: 2131176 - protein, 17 aa, Cryptosporidium hominis
IHKYLNPRQLLIDSYSR

SEQ ID NO: 2131177 - protein, 23 aa, Cryptosporidium hominis
IHLFLFFVLFSEFKYDEINYYQI

SEQ ID NO: 2131178 - protein, 18 aa, Cryptosporidium hominis
IHPLIFTICYIIINFFKK

SEQ ID NO: 2131179 - protein, 23 aa, Cryptosporidium hominis
IHQIRMIWLFIKFLCLIKDKNKN

SEQ ID NO: 2131180 - protein, 21 aa, Cryptosporidium hominis
IHSLVLLCIICYIITEFKNDN

SEQ ID NO: 2131181 - protein, 18 aa, Cryptosporidium hominis
IHSRISLLYLSKKPVMNL

SEQ ID NO: 2131182 - protein, 17 aa, Cryptosporidium hominis
IHSYIIDIFIYTLRFIL

SEQ ID NO: 2131183 - protein, 25 aa, Cryptosporidium hominis
IHTTLLDELIWLVFCSIEQEKEYVR

SEQ ID NO: 2131184 - protein, 18 aa, Cryptosporidium hominis
IIAEWLIKYKKIRNIILL

SEQ ID NO: 2131185 - protein, 23 aa, Cryptosporidium hominis
IIAFFVNLPIFFAMAITLPCFLI

SEQ ID NO: 2131186 - protein, 18 aa, Cryptosporidium hominis
IIAIVVVAIIIIAGIIHC

SEQ ID NO: 2131187 - protein, 20 aa, Cryptosporidium hominis
IICDQPFDYHLWNLVINICQ

SEQ ID NO: 2131188 - protein, 33 aa, Cryptosporidium hominis
IICVNRAVFFLHWWLITWPKIPFYANDFVLAEL

SEQ ID NO: 2131189 - protein, 18 aa, Cryptosporidium hominis
IIDYFNSILSPKVAPPHG

SEQ ID NO: 2131190 - protein, 23 aa, Cryptosporidium hominis
IIEELFWRSFVYKELIISLGVRN

SEQ ID NO: 2131191 - protein, 25 aa, Cryptosporidium hominis
IIFGISIFTFIAVSLGFVLCRVMND

SEQ ID NO: 2131192 - protein, 27 aa, Cryptosporidium hominis
IIFNIDRFFLTLNLYNKFKLPNHILYA

SEQ ID NO: 2131193 - protein, 44 aa, Cryptosporidium hominis
IIFSLSKKDYVWITCSFLSFLLVNYYITKWIWGSNLTSSQNEGS

SEQ ID NO: 2131194 - protein, 19 aa, Cryptosporidium hominis
IIGFAVLGVVLIISIIYIL

SEQ ID NO: 2131195 - protein, 18 aa, Cryptosporidium hominis
IIGGLLFVLFADERQISL

SEQ ID NO: 2131196 - protein, 30 aa, Cryptosporidium hominis
IIIINCFFSILWMIGFYFIIPKHPFVTPTV

SEQ ID NO: 2131197 - protein, 19 aa, Cryptosporidium hominis
IIIPLQIPYLQSIFLTFTI

SEQ ID NO: 2131198 - protein, 36 aa, Cryptosporidium hominis
IIIVSIIWGIQIAIVFLYFILRIITSFTRLFSKKNS

SEQ ID NO: 2131199 - protein, 19 aa, Cryptosporidium hominis
IIKQFPLKQSFFDKVFIKN

SEQ ID NO: 2131200 - protein, 28 aa, Cryptosporidium hominis
IIKYTLLTIFIIMFITTFINYSIDIGVN

SEQ ID NO: 2131201 - protein, 24 aa, Cryptosporidium hominis
IILETRWVIWRYAILYLLGGISGN

SEQ ID NO: 2131202 - protein, 21 aa, Cryptosporidium hominis
IILQTALVSNLYFFSQLLYRR

SEQ ID NO: 2131203 - protein, 17 aa, Cryptosporidium hominis
IILYPIHILISALVAHS

SEQ ID NO: 2131204 - protein, 17 aa, Cryptosporidium hominis
IIMSCILSWYLGDYSIT

SEQ ID NO: 2131205 - protein, 25 aa, Cryptosporidium hominis
IINTFLDQISFKSALFIFGFIIALI

SEQ ID NO: 2131206 - protein, 22 aa, Cryptosporidium hominis
IIPIQVLRYLSISPLIFVVLSR

SEQ ID NO: 2131207 - protein, 20 aa, Cryptosporidium hominis
IIPKLQIIPFCSSIIRGDTQ

SEQ ID NO: 2131208 - protein, 27 aa, Cryptosporidium hominis
IIPTILFITPAIYILLSFRAAPQLYGS

SEQ ID NO: 2131209 - protein, 19 aa, Cryptosporidium hominis
IIRYQPIVMLLTNSDPRDY

SEQ ID NO: 2131210 - protein, 19 aa, Cryptosporidium hominis
IIRYVPYLIFGISNSELET

SEQ ID NO: 2131211 - protein, 25 aa, Cryptosporidium hominis
IISGFFGFLRFFTHKDVIVSPIMTI

SEQ ID NO: 2131212 - protein, 19 aa, Cryptosporidium hominis
IISNRLSFIYGIKGPSVTI

SEQ ID NO: 2131213 - protein, 17 aa, Cryptosporidium hominis
IITLYTLSRFGEGRFFA

SEQ ID NO: 2131214 - protein, 17 aa, Cryptosporidium hominis
IITVINIIGLITLGVII

SEQ ID NO: 2131215 - protein, 20 aa, Cryptosporidium hominis
IIVCHGNVIRYMFCKGLQYP

SEQ ID NO: 2131216 - protein, 37 aa, Cryptosporidium hominis
IKASYFFFIWSVWLFTISFLFIFMLSCSCNTLKIILR

SEQ ID NO: 2131217 - protein, 17 aa, Cryptosporidium hominis
IKDKFGKILFKTSYSLV

SEQ ID NO: 2131218 - protein, 31 aa, Cryptosporidium hominis
IKDTIKIIPFSFFIIVPFAEFGLPFVIKLFP

SEQ ID NO: 2131219 - protein, 23 aa, Cryptosporidium hominis
IKEGFLEQLRLPIKVKYGCIETI

SEQ ID NO: 2131220 - protein, 18 aa, Cryptosporidium hominis
IKFGINTLKYFNYQKSIS

SEQ ID NO: 2131221 - protein, 22 aa, Cryptosporidium hominis
IKFPRILERLLYKACKLVNLME

SEQ ID NO: 2131222 - protein, 31 aa, Cryptosporidium hominis
IKGGYYFQYDFVLRYIFLNSLKISTIAQFDS

SEQ ID NO: 2131223 - protein, 24 aa, Cryptosporidium hominis
IKILGLESLFYWKINKSRINELKS

SEQ ID NO: 2131224 - protein, 18 aa, Cryptosporidium hominis
IKKNKFSYYYPTNYFYMF

SEQ ID NO: 2131225 - protein, 30 aa, Cryptosporidium hominis
IKKSITLPFLCFPLSIFIMNNVIKIKSDEK

SEQ ID NO: 2131226 - protein, 24 aa, Cryptosporidium hominis
IKLLFLLLLEVCAYKFTNGVPIAS

SEQ ID NO: 2131227 - protein, 21 aa, Cryptosporidium hominis
IKLNLCTYIIFGYSLVTDCIY

SEQ ID NO: 2131228 - protein, 20 aa, Cryptosporidium hominis
IKLNPLIALRMRLILHGFHS

SEQ ID NO: 2131229 - protein, 18 aa, Cryptosporidium hominis
IKNGGFIGFSSYTGPEVP

SEQ ID NO: 2131230 - protein, 22 aa, Cryptosporidium hominis
IKNIILFGRPLNQLKYDVILDC

SEQ ID NO: 2131231 - protein, 19 aa, Cryptosporidium hominis
IKPFLKRVNSIYSMSALIL

SEQ ID NO: 2131232 - protein, 26 aa, Cryptosporidium hominis
IKPSKYFIYPFLFQYNTRSNIDMGIS

SEQ ID NO: 2131233 - protein, 28 aa, Cryptosporidium hominis
IKQGILTIPIYFLLLGDQERATKILVNT

SEQ ID NO: 2131234 - protein, 20 aa, Cryptosporidium hominis
IKQKPFLIWKTQNLTIGHYI

SEQ ID NO: 2131235 - protein, 26 aa, Cryptosporidium hominis
IKREKSLLWRLVLIHDLNKCIQVVGD

SEQ ID NO: 2131236 - protein, 17 aa, Cryptosporidium hominis
IKRLFENAFFYNTVSNI

SEQ ID NO: 2131237 - protein, 19 aa, Cryptosporidium hominis
IKTRFNWDLSLFQTEFGYV

SEQ ID NO: 2131238 - protein, 19 aa, Cryptosporidium hominis
IKVATFISLAISLFIILCY

SEQ ID NO: 2131239 - protein, 20 aa, Cryptosporidium hominis
ILAIPLSFIFLMFRTRRRLG

SEQ ID NO: 2131240 - protein, 19 aa, Cryptosporidium hominis
ILATIHILTAILNIKLSET

SEQ ID NO: 2131241 - protein, 21 aa, Cryptosporidium hominis
ILDLYITMNYFPSSNILRDVW

SEQ ID NO: 2131242 - protein, 18 aa, Cryptosporidium hominis
ILDNTWPLFIDIIANMIK

SEQ ID NO: 2131243 - protein, 22 aa, Cryptosporidium hominis
ILDSFILFMAIISIIQIIYCLL

SEQ ID NO: 2131244 - protein, 23 aa, Cryptosporidium hominis
ILEEKINLVLSRFLAHSIMDHSH

SEQ ID NO: 2131245 - protein, 19 aa, Cryptosporidium hominis
ILENYLARQKVALDTIGYL

SEQ ID NO: 2131246 - protein, 23 aa, Cryptosporidium hominis
ILESIIHVIPFKYGENRSFGVNI

SEQ ID NO: 2131247 - protein, 30 aa, Cryptosporidium hominis
ILGGIIYERPWYFILGSVLLTLICSIGFIP

SEQ ID NO: 2131248 - protein, 25 aa, Cryptosporidium hominis
ILGKYKFSGLYLPGLPLLNTHLEKL

SEQ ID NO: 2131249 - protein, 33 aa, Cryptosporidium hominis
ILGLRFAIVLVLSALLYPLLSSSVWIQINSSAF

SEQ ID NO: 2131250 - protein, 24 aa, Cryptosporidium hominis
ILGYSILISVFLFIVFIIMKLLLL

SEQ ID NO: 2131251 - protein, 22 aa, Cryptosporidium hominis
ILHYIYFVEIINHIFVEALVND

SEQ ID NO: 2131252 - protein, 18 aa, Cryptosporidium hominis
ILIEKYISALIFSIYSSK

SEQ ID NO: 2131253 - protein, 23 aa, Cryptosporidium hominis
ILIGLFTYLYIRAFIFTNPKSVS

SEQ ID NO: 2131254 - protein, 22 aa, Cryptosporidium hominis
ILIIGPCILYFISTSKWLFMQH

SEQ ID NO: 2131255 - protein, 17 aa, Cryptosporidium hominis
ILIIIIIPFNANGDDMQ

SEQ ID NO: 2131256 - protein, 26 aa, Cryptosporidium hominis
ILIYCKACIKTLNDPNFLLLEKQKEE

SEQ ID NO: 2131257 - protein, 17 aa, Cryptosporidium hominis
ILKILLFNQNLTTCSVN

SEQ ID NO: 2131258 - protein, 18 aa, Cryptosporidium hominis
ILKPHPFVLNRSTKYGIL

SEQ ID NO: 2131259 - protein, 44 aa, Cryptosporidium hominis
ILKSRLMVLIFAIRRLILAFIMFFFMLDFIGSMSKLLVGFLLKY

SEQ ID NO: 2131260 - protein, 21 aa, Cryptosporidium hominis
ILLFYSLEILFQRFPTRNKTF

SEQ ID NO: 2131261 - protein, 20 aa, Cryptosporidium hominis
ILLGDYLFSKSCLNISLIEN

SEQ ID NO: 2131262 - protein, 48 aa, Cryptosporidium hominis
ILLKKLKLHLMLEKKVLLVLYMEFISYILLAMPFQFESEILLVLFCLG

SEQ ID NO: 2131263 - protein, 17 aa, Cryptosporidium hominis
ILLLDFLSFIENSEFTE

SEQ ID NO: 2131264 - protein, 18 aa, Cryptosporidium hominis
ILLPCRHCISCESCLRSL

SEQ ID NO: 2131265 - protein, 17 aa, Cryptosporidium hominis
ILLSIYYIIRNKFNTNI

SEQ ID NO: 2131266 - protein, 21 aa, Cryptosporidium hominis
ILMLNSGLTIILLFSKILTDS

SEQ ID NO: 2131267 - protein, 18 aa, Cryptosporidium hominis
ILMQIKYFRAQLLESAQL

SEQ ID NO: 2131268 - protein, 20 aa, Cryptosporidium hominis
ILNCLYGLFPPQLEYVEVFE

SEQ ID NO: 2131269 - protein, 17 aa, Cryptosporidium hominis
ILNFIFMNRFANNVNSY

SEQ ID NO: 2131270 - protein, 40 aa, Cryptosporidium hominis
ILNIAISYYFIKLIRYSMLFWLPYYLIRELNYGPSVAGYS

SEQ ID NO: 2131271 - protein, 17 aa, Cryptosporidium hominis
ILNKAISSIVPLTGPMD

SEQ ID NO: 2131272 - protein, 19 aa, Cryptosporidium hominis
ILNMLGIFELLFRSFGRNI

SEQ ID NO: 2131273 - protein, 28 aa, Cryptosporidium hominis
ILNNQCSLKFRIYVRKVLISLIKRFGAE

SEQ ID NO: 2131274 - protein, 36 aa, Cryptosporidium hominis
ILNTWSLTFNILKAPGLMIFILTQRIQVLRYFLLAY

SEQ ID NO: 2131275 - protein, 19 aa, Cryptosporidium hominis
ILPSFWMMISCIFITFLGY

SEQ ID NO: 2131276 - protein, 29 aa, Cryptosporidium hominis
ILQALELIQICFFLLNGLNVLSVFEEQRL

SEQ ID NO: 2131277 - protein, 24 aa, Cryptosporidium hominis
ILQQLYYIKNILKEPVRNVVFMGM

SEQ ID NO: 2131278 - protein, 27 aa, Cryptosporidium hominis
ILQSPIFNEIPNFKGFLKSGSSLQDHD

SEQ ID NO: 2131279 - protein, 18 aa, Cryptosporidium hominis
ILRLLRVEFPKYKKILNE

SEQ ID NO: 2131280 - protein, 32 aa, Cryptosporidium hominis
ILSAFLVVVLFSFFFFHLWLVFNSMTTIEFCE

SEQ ID NO: 2131281 - protein, 17 aa, Cryptosporidium hominis
ILSFLMSTSKLLKDFNP

SEQ ID NO: 2131282 - protein, 19 aa, Cryptosporidium hominis
ILSILNSRHRSGILNFIFM

SEQ ID NO: 2131283 - protein, 20 aa, Cryptosporidium hominis
ILSNKILLNKTFSLKIKDVY

SEQ ID NO: 2131284 - protein, 33 aa, Cryptosporidium hominis
ILTLLLVSYGFMLMVCHWLLFDSIQCIITLLIG

SEQ ID NO: 2131285 - protein, 17 aa, Cryptosporidium hominis
ILVFCHKVDPRLGGAIY

SEQ ID NO: 2131286 - protein, 17 aa, Cryptosporidium hominis
ILVFDLNPYFDKIEITW

SEQ ID NO: 2131287 - protein, 25 aa, Cryptosporidium hominis
ILVFIIPIILFIIFIMDSSAFRKFL

SEQ ID NO: 2131288 - protein, 17 aa, Cryptosporidium hominis
ILVLTISVIGSLYSIIQ

SEQ ID NO: 2131289 - protein, 22 aa, Cryptosporidium hominis
ILVSFILFFLLKMNSCTGRKCG

SEQ ID NO: 2131290 - protein, 18 aa, Cryptosporidium hominis
ILVSYIYKFANCFISSFS

SEQ ID NO: 2131291 - protein, 25 aa, Cryptosporidium hominis
ILYEKLFILLFASKNLEEYSITLFW

SEQ ID NO: 2131292 - protein, 23 aa, Cryptosporidium hominis
ILYLTIILLALFATPIFVPKYNK

SEQ ID NO: 2131293 - protein, 22 aa, Cryptosporidium hominis
ILYTNLFSFFKDIFRNRKLLKE

SEQ ID NO: 2131294 - protein, 26 aa, Cryptosporidium hominis
IMAVILLIFSILVYPLCFSAIIYTHF

SEQ ID NO: 2131295 - protein, 17 aa, Cryptosporidium hominis
IMAVTLIRIPITTLTFI

SEQ ID NO: 2131296 - protein, 30 aa, Cryptosporidium hominis
IMDINAWKMKAYYLLTYTLEYESALFCMEE

SEQ ID NO: 2131297 - protein, 26 aa, Cryptosporidium hominis
IMKLGDVTLFLLRLIRFRSEEFSLYH

SEQ ID NO: 2131298 - protein, 18 aa, Cryptosporidium hominis
IMNIYWLYKVVKNVFNPN

SEQ ID NO: 2131299 - protein, 23 aa, Cryptosporidium hominis
IMSCIFLCILLFNTVDKYTNFGK

SEQ ID NO: 2131300 - protein, 30 aa, Cryptosporidium hominis
INAIECFIFPFRLIIAYFVLKDSLGSSTTI

SEQ ID NO: 2131301 - protein, 26 aa, Cryptosporidium hominis
INCLYFLLVSLYLFRFVISESSYLND

SEQ ID NO: 2131302 - protein, 28 aa, Cryptosporidium hominis
INEKYIVYLIFWVVVKFFESIKIVESDR

SEQ ID NO: 2131303 - protein, 25 aa, Cryptosporidium hominis
INEVMYILDFFLQLPKHRADTKSKQ

SEQ ID NO: 2131304 - protein, 25 aa, Cryptosporidium hominis
INEYLPHVFQLVHRVSYGLLDESTS

SEQ ID NO: 2131305 - protein, 18 aa, Cryptosporidium hominis
INFESVVTPWFRHIFMDT

SEQ ID NO: 2131306 - protein, 29 aa, Cryptosporidium hominis
INFNKYFLLVVTIIVYFNNLMFNNDGKLN

SEQ ID NO: 2131307 - protein, 22 aa, Cryptosporidium hominis
INGAIYYLKIAVALAVAAIPEG

SEQ ID NO: 2131308 - protein, 23 aa, Cryptosporidium hominis
INGIITLKYLITSATFIPLLEML

SEQ ID NO: 2131309 - protein, 33 aa, Cryptosporidium hominis
INGVTMQVLVRWLTSIDYLNWISSAKTIKELQK

SEQ ID NO: 2131310 - protein, 17 aa, Cryptosporidium hominis
INHVLLDLRYFNSKIGN

SEQ ID NO: 2131311 - protein, 42 aa, Cryptosporidium hominis
INILRLGSLWQGIFLRFYIWAILWAIMIIFTTFKTLKVIISN

SEQ ID NO: 2131312 - protein, 25 aa, Cryptosporidium hominis
INKLVKFLEKLLKKILDARTISGLN

SEQ ID NO: 2131313 - protein, 25 aa, Cryptosporidium hominis
INKYKFPVINISKFYPRPGTPAAKM

SEQ ID NO: 2131314 - protein, 18 aa, Cryptosporidium hominis
INLLRFALQIHKIGSSFF

SEQ ID NO: 2131315 - protein, 26 aa, Cryptosporidium hominis
INNGMQIYFHLINQIKLNYFQHKHHF

SEQ ID NO: 2131316 - protein, 36 aa, Cryptosporidium hominis
INNIEKWIPFYTPNYLILIYIFVGITFITIGIFFQI

SEQ ID NO: 2131317 - protein, 24 aa, Cryptosporidium hominis
INNKRVIEVILLLTFYKRIEKYNN

SEQ ID NO: 2131318 - protein, 22 aa, Cryptosporidium hominis
INNRLLHNLKNYMKQNQLKHAL

SEQ ID NO: 2131319 - protein, 24 aa, Cryptosporidium hominis
INPHYKLLFENLLFHFQNIFSLER

SEQ ID NO: 2131320 - protein, 17 aa, Cryptosporidium hominis
INQVKFSHNGYLLASSS

SEQ ID NO: 2131321 - protein, 20 aa, Cryptosporidium hominis
INRELALNDALFKVSFEYID

SEQ ID NO: 2131322 - protein, 17 aa, Cryptosporidium hominis
INRFGIVAVPSFRFFRN

SEQ ID NO: 2131323 - protein, 30 aa, Cryptosporidium hominis
INRMQAFRIWLSSVLPRMPFHCSDPLLARD

SEQ ID NO: 2131324 - protein, 27 aa, Cryptosporidium hominis
INSNDCYLLFQRWFLYFVNACKNHDRD

SEQ ID NO: 2131325 - protein, 24 aa, Cryptosporidium hominis
INTEIFNYGIFNIYFKMMDIIEDF

SEQ ID NO: 2131326 - protein, 18 aa, Cryptosporidium hominis
INYQTLKIYIIEKLFVLY

SEQ ID NO: 2131327 - protein, 23 aa, Cryptosporidium hominis
IPAIFFTLVIFFTTSSILYLTII

SEQ ID NO: 2131328 - protein, 36 aa, Cryptosporidium hominis
IPAMAWLFIDIFCTLLPLLLFSFSRPKEYKIENLNT

SEQ ID NO: 2131329 - protein, 21 aa, Cryptosporidium hominis
IPANLLLLIGIYYLPMEEICN

SEQ ID NO: 2131330 - protein, 19 aa, Cryptosporidium hominis
IPAPRGPLFVLGNNFIRKY

SEQ ID NO: 2131331 - protein, 28 aa, Cryptosporidium hominis
IPEGLAPVQLLWVNLVTDGLPATALGFN

SEQ ID NO: 2131332 - protein, 21 aa, Cryptosporidium hominis
IPERGFSSLKFLPGSFDQIIV

SEQ ID NO: 2131333 - protein, 26 aa, Cryptosporidium hominis
IPGLYHFMIQILFSEKFLEIEYNWNP

SEQ ID NO: 2131334 - protein, 20 aa, Cryptosporidium hominis
IPIKNKIKIYFKNRIKSLRE

SEQ ID NO: 2131335 - protein, 34 aa, Cryptosporidium hominis
IPILEQILSILTLFDNLLPFNIPSVNLSINGIPS

SEQ ID NO: 2131336 - protein, 23 aa, Cryptosporidium hominis
IPILVILMLYYYKLGEFSMLIFI

SEQ ID NO: 2131337 - protein, 29 aa, Cryptosporidium hominis
IPISFVPVVRFCTWIVLLANIIPIALVVS

SEQ ID NO: 2131338 - protein, 26 aa, Cryptosporidium hominis
IPLFTMALGILFFKHKYRLSQIPPVI

SEQ ID NO: 2131339 - protein, 31 aa, Cryptosporidium hominis
IPLLILRTYIWLHFPVFPGFNPWIMKNILFI

SEQ ID NO: 2131340 - protein, 19 aa, Cryptosporidium hominis
IPLNHKVLDLAVFCLSLMG

SEQ ID NO: 2131341 - protein, 26 aa, Cryptosporidium hominis
IPLPNYLIGMQFLQIVSYIFENHSMI

SEQ ID NO: 2131342 - protein, 26 aa, Cryptosporidium hominis
IPLRWISFFLFKWRLELDESFIGGPL

SEQ ID NO: 2131343 - protein, 17 aa, Cryptosporidium hominis
IPLYIMGDIFHVLKALY

SEQ ID NO: 2131344 - protein, 24 aa, Cryptosporidium hominis
IPPGIEEGFPLLRKLEHISGIESS

SEQ ID NO: 2131345 - protein, 21 aa, Cryptosporidium hominis
IPQDPIIFSGTIRFNLDPLQQ

SEQ ID NO: 2131346 - protein, 32 aa, Cryptosporidium hominis
IPRLHNTVFSTFLPLIDRYLELSISSQKSNFT

SEQ ID NO: 2131347 - protein, 26 aa, Cryptosporidium hominis
IPSYQFVILCNIISLRLYHIHVINGE

SEQ ID NO: 2131348 - protein, 29 aa, Cryptosporidium hominis
IPSYRRPLIFIYLLNVILFILRLTVFNSK

SEQ ID NO: 2131349 - protein, 30 aa, Cryptosporidium hominis
IQACKFFHNNLLYKILINSSIPTLMKISAG

SEQ ID NO: 2131350 - protein, 22 aa, Cryptosporidium hominis
IQALYIIPCILFLIAHSRFESQ

SEQ ID NO: 2131351 - protein, 31 aa, Cryptosporidium hominis
IQCKQILHEKFLMGLYTIPKYRGCYVKGILQ

SEQ ID NO: 2131352 - protein, 17 aa, Cryptosporidium hominis
IQCLILICLQTFKIFLD

SEQ ID NO: 2131353 - protein, 27 aa, Cryptosporidium hominis
IQDHYNIPYLMYKPIILKQAISNSHGI

SEQ ID NO: 2131354 - protein, 24 aa, Cryptosporidium hominis
IQDRDFFINTFKKLILLSSNKISF

SEQ ID NO: 2131355 - protein, 25 aa, Cryptosporidium hominis
IQDSIYSIIRFLLNSLIDGYTQDAY

SEQ ID NO: 2131356 - protein, 21 aa, Cryptosporidium hominis
IQFIYGFIWIEIAGVSLSNAC

SEQ ID NO: 2131357 - protein, 23 aa, Cryptosporidium hominis
IQGFLIIFSLFVFVSVIIIPSFN

SEQ ID NO: 2131358 - protein, 18 aa, Cryptosporidium hominis
IQHYLSYKDLKKAIKLIT

SEQ ID NO: 2131359 - protein, 24 aa, Cryptosporidium hominis
IQIQNIFSFIISTMLGYYCVWDVD

SEQ ID NO: 2131360 - protein, 26 aa, Cryptosporidium hominis
IQITSLFSWITIFVVVLFAISIINEA

SEQ ID NO: 2131361 - protein, 31 aa, Cryptosporidium hominis
IQLSYINIAIIWIFILRLFGQFSSISSNFRF

SEQ ID NO: 2131362 - protein, 17 aa, Cryptosporidium hominis
IQNLIIYLRNFQFHLEL

SEQ ID NO: 2131363 - protein, 25 aa, Cryptosporidium hominis
IQRLLLFTHYFLKRNEISILLIDEP

SEQ ID NO: 2131364 - protein, 28 aa, Cryptosporidium hominis
IQRVLFLTIFCPVLLFIRGIISGVQCIY

SEQ ID NO: 2131365 - protein, 19 aa, Cryptosporidium hominis
IQVIILNIILPIFLELFII

SEQ ID NO: 2131366 - protein, 37 aa, Cryptosporidium hominis
IRCTLKEYYLLFDFVIFLFYIINAYKSAVEKLDKFIS

SEQ ID NO: 2131367 - protein, 22 aa, Cryptosporidium hominis
IREIALYPPIFSKQLIPPVSNN

SEQ ID NO: 2131368 - protein, 18 aa, Cryptosporidium hominis
IRENILFGAPFDPEWYAQ

SEQ ID NO: 2131369 - protein, 44 aa, Cryptosporidium hominis
IRFKSNIITFIWKPLYYLLTFFTFNFILKALIPASIIFYMRSVA

SEQ ID NO: 2131370 - protein, 31 aa, Cryptosporidium hominis
IRGNLLLVHAKVVKPLLPALIFSYASIVVQT

SEQ ID NO: 2131371 - protein, 22 aa, Cryptosporidium hominis
IRHPGIINVSFLWPAVDCEPST

SEQ ID NO: 2131372 - protein, 22 aa, Cryptosporidium hominis
IRLIKYWYHYYSIYLNNYYLDF

SEQ ID NO: 2131373 - protein, 20 aa, Cryptosporidium hominis
IRLMVDPRIFSLSSGHILVS

SEQ ID NO: 2131374 - protein, 29 aa, Cryptosporidium hominis
IRPREYYVSNILLYYYLKKLSIDLENQKE

SEQ ID NO: 2131375 - protein, 22 aa, Cryptosporidium hominis
IRQFERSLYECGKLNELNKTAN

SEQ ID NO: 2131376 - protein, 34 aa, Cryptosporidium hominis
IRQLTSIFSLPLLSSWFGLEWTKNQLWSKNILPM

SEQ ID NO: 2131377 - protein, 24 aa, Cryptosporidium hominis
IRRIILCFIVWTLSCGILLRFDRN

SEQ ID NO: 2131378 - protein, 19 aa, Cryptosporidium hominis
IRSNGTRALFRGFPAVVFG

SEQ ID NO: 2131379 - protein, 19 aa, Cryptosporidium hominis
IRVIFFQIVMNYFMGGHKN

SEQ ID NO: 2131380 - protein, 18 aa, Cryptosporidium hominis
IRYDLTTSILPKDYTRRI

SEQ ID NO: 2131381 - protein, 25 aa, Cryptosporidium hominis
IRYLDLLIHYDDCPIIWKSMPFHIY

SEQ ID NO: 2131382 - protein, 19 aa, Cryptosporidium hominis
ISAFPDSVWSYAYSCVYIL

SEQ ID NO: 2131383 - protein, 19 aa, Cryptosporidium hominis
ISAKLGWTAFIGLLVSAVL

SEQ ID NO: 2131384 - protein, 24 aa, Cryptosporidium hominis
ISAPTWLLVLYFRGSKKKIRPIVL

SEQ ID NO: 2131385 - protein, 27 aa, Cryptosporidium hominis
ISDLMRSLDIFIFKTIINKCYKNLLDD

SEQ ID NO: 2131386 - protein, 24 aa, Cryptosporidium hominis
ISDPFEIFLVVNAPIDYFTLIMND

SEQ ID NO: 2131387 - protein, 25 aa, Cryptosporidium hominis
ISEFQHWRLFWDAFSFMPPCSAQQV

SEQ ID NO: 2131388 - protein, 22 aa, Cryptosporidium hominis
ISELIIGLYLFDSNETSWILLI

SEQ ID NO: 2131389 - protein, 27 aa, Cryptosporidium hominis
ISESDYKLFFRFLKARQFNVEKSTEML

SEQ ID NO: 2131390 - protein, 35 aa, Cryptosporidium hominis
ISEYYGWSALFLCLLLFSTFSFLILIPASYTKEQK

SEQ ID NO: 2131391 - protein, 17 aa, Cryptosporidium hominis
ISFFTFSLIFTSFYFNY

SEQ ID NO: 2131392 - protein, 18 aa, Cryptosporidium hominis
ISFLDTLCNWYVRLNRDR

SEQ ID NO: 2131393 - protein, 18 aa, Cryptosporidium hominis
ISFLILVGLLHRSYLKVK

SEQ ID NO: 2131394 - protein, 26 aa, Cryptosporidium hominis
ISGNNFISYLPRFIRNYFFGQSQSFI

SEQ ID NO: 2131395 - protein, 17 aa, Cryptosporidium hominis
ISGPKYCNYKKISKNKL

SEQ ID NO: 2131396 - protein, 22 aa, Cryptosporidium hominis
ISGRLNIVTLLLLTGIDANIKL

SEQ ID NO: 2131397 - protein, 26 aa, Cryptosporidium hominis
ISGSLYWLVLYILAIPLSFIFLMFRT

SEQ ID NO: 2131398 - protein, 27 aa, Cryptosporidium hominis
ISGVDPRWITPLIQGYFCNQAIIISPE

SEQ ID NO: 2131399 - protein, 22 aa, Cryptosporidium hominis
ISIFPARLFKKITRGLFNNVSK

SEQ ID NO: 2131400 - protein, 24 aa, Cryptosporidium hominis
ISIIQIIYCLLIRTTYPIDSLIGG

SEQ ID NO: 2131401 - protein, 22 aa, Cryptosporidium hominis
ISIPYSNILRPGSSSPLVVEID

SEQ ID NO: 2131402 - protein, 25 aa, Cryptosporidium hominis
ISKHLTLIIIYLISTLNLIKKKKVE

SEQ ID NO: 2131403 - protein, 18 aa, Cryptosporidium hominis
ISKIFPELVCRKGHDIIV

SEQ ID NO: 2131404 - protein, 22 aa, Cryptosporidium hominis
ISLFIILCYWHTLNIFQFMYIF

SEQ ID NO: 2131405 - protein, 21 aa, Cryptosporidium hominis
ISLIIPYFFVKLIFTILSITH

SEQ ID NO: 2131406 - protein, 25 aa, Cryptosporidium hominis
ISLLILYFLIFLGNVKSSSTVTKKD

SEQ ID NO: 2131407 - protein, 19 aa, Cryptosporidium hominis
ISLLVFIFHEFQNAVNSRM

SEQ ID NO: 2131408 - protein, 30 aa, Cryptosporidium hominis
ISMFRDWCWYFIFSWVIYYFNIWSDNSMVK

SEQ ID NO: 2131409 - protein, 20 aa, Cryptosporidium hominis
ISMIAFLQKAIIPNAKILIL

SEQ ID NO: 2131410 - protein, 21 aa, Cryptosporidium hominis
ISMPIFLGLMRVPFSQAVTFS

SEQ ID NO: 2131411 - protein, 24 aa, Cryptosporidium hominis
ISNEDLILYFILKNFNGYCDNLIQ

SEQ ID NO: 2131412 - protein, 23 aa, Cryptosporidium hominis
ISNKQILNLFFNIGYFAQLSIQN

SEQ ID NO: 2131413 - protein, 22 aa, Cryptosporidium hominis
ISNRIIGILSISGSIFIGIFIW

SEQ ID NO: 2131414 - protein, 28 aa, Cryptosporidium hominis
ISNSRCVYFFFIQLNFQLIANVYALIAS

SEQ ID NO: 2131415 - protein, 28 aa, Cryptosporidium hominis
ISNVSQFLFGFIVGFYRGWKMALVMSAS

SEQ ID NO: 2131416 - protein, 24 aa, Cryptosporidium hominis
ISPDLLNLFFFTVYLNSCKSLIFE

SEQ ID NO: 2131417 - protein, 25 aa, Cryptosporidium hominis
ISPLTPLFIHMLLGVVVSYMIISVR

SEQ ID NO: 2131418 - protein, 26 aa, Cryptosporidium hominis
ISPWTIRTILRHYGAWNSRGCLLSSS

SEQ ID NO: 2131419 - protein, 24 aa, Cryptosporidium hominis
ISPYFFQVSVIFLGLLQDELFLKV

SEQ ID NO: 2131420 - protein, 36 aa, Cryptosporidium hominis
ISQFNIGSIFFILGTLLQLLPIWAPAFVQSCINSSV

SEQ ID NO: 2131421 - protein, 33 aa, Cryptosporidium hominis
ISQKGFFFGFNTLVWFVIILQAIGGIIVAAVLK

SEQ ID NO: 2131422 - protein, 24 aa, Cryptosporidium hominis
ISQLFLSTFTFTVLILSINYVGDL

SEQ ID NO: 2131423 - protein, 27 aa, Cryptosporidium hominis
ISSATLFINLMIKYEFLWKSWKNNNCV

SEQ ID NO: 2131424 - protein, 23 aa, Cryptosporidium hominis
ISSGFAILYFNSAIPWYDENSRK

SEQ ID NO: 2131425 - protein, 24 aa, Cryptosporidium hominis
ISSHPLYIVFLIVEIIIQSETKLF

SEQ ID NO: 2131426 - protein, 23 aa, Cryptosporidium hominis
ISSLLLVSAIFFAIIRLGFSVFS

SEQ ID NO: 2131427 - protein, 19 aa, Cryptosporidium hominis
ISTELFQHLYTSEVFMLMA

SEQ ID NO: 2131428 - protein, 30 aa, Cryptosporidium hominis
ISTFIELSFIPMIITTLIFGLIVYIKRINS

SEQ ID NO: 2131429 - protein, 24 aa, Cryptosporidium hominis
ISTGTLSYFLYLKDYWSFKAYNFV

SEQ ID NO: 2131430 - protein, 26 aa, Cryptosporidium hominis
ISTIPGIIILLIISVATLRIGVILSS

SEQ ID NO: 2131431 - protein, 38 aa, Cryptosporidium hominis
ISTWIAGFIVTFLSLFLQPLVLALSYSIILLLSKKTSS

SEQ ID NO: 2131432 - protein, 19 aa, Cryptosporidium hominis
ISVFVLKLNAKRLKEFILL

SEQ ID NO: 2131433 - protein, 18 aa, Cryptosporidium hominis
ISVILEYMEPLILLHEQN

SEQ ID NO: 2131434 - protein, 17 aa, Cryptosporidium hominis
ISVWYISVVFLSAMLIV

SEQ ID NO: 2131435 - protein, 22 aa, Cryptosporidium hominis
ISWQLFKELMLCSPLITGTTGA

SEQ ID NO: 2131436 - protein, 23 aa, Cryptosporidium hominis
ISYFPQVLIYLSFIRIICFPITE

SEQ ID NO: 2131437 - protein, 26 aa, Cryptosporidium hominis
ISYKNLLIIFLSFIALLSATPIKGML

SEQ ID NO: 2131438 - protein, 23 aa, Cryptosporidium hominis
ITAIKRGFDKKVIFSLLLPEIKA

SEQ ID NO: 2131439 - protein, 26 aa, Cryptosporidium hominis
ITATYQLLYFLPISALVVVLSKGRVH

SEQ ID NO: 2131440 - protein, 18 aa, Cryptosporidium hominis
ITCLTILLGVLCIDARLE

SEQ ID NO: 2131441 - protein, 26 aa, Cryptosporidium hominis
ITCTRKYFVLGYLKSSLFLSNIVKHK

SEQ ID NO: 2131442 - protein, 29 aa, Cryptosporidium hominis
ITFMLSCITLLYLLLERYLEKCISRKNSH

SEQ ID NO: 2131443 - protein, 24 aa, Cryptosporidium hominis
ITFPRYVLWELIFTSRWIWLSLHF

SEQ ID NO: 2131444 - protein, 22 aa, Cryptosporidium hominis
ITIPVMLYLDYLFYKKFTIPMI

SEQ ID NO: 2131445 - protein, 26 aa, Cryptosporidium hominis
ITISLWAYITLVLQFLTITGVYRRQA

SEQ ID NO: 2131446 - protein, 28 aa, Cryptosporidium hominis
ITLPKYPKYISMLYGFLAGLIGAQCVLE

SEQ ID NO: 2131447 - protein, 17 aa, Cryptosporidium hominis
ITLYLYSTPANINKGGY

SEQ ID NO: 2131448 - protein, 22 aa, Cryptosporidium hominis
ITPIWFLYYPLNIVYTIICAVI

SEQ ID NO: 2131449 - protein, 36 aa, Cryptosporidium hominis
ITRFNYVYCFIHYLLHILSRIGMSHFFISFKHHNLL

SEQ ID NO: 2131450 - protein, 18 aa, Cryptosporidium hominis
ITRILPKIKQLLRDNIIV

SEQ ID NO: 2131451 - protein, 23 aa, Cryptosporidium hominis
ITSFNWNIFNLILNMLRILDINI

SEQ ID NO: 2131452 - protein, 18 aa, Cryptosporidium hominis
ITSLQLLRQIILYGKDQV

SEQ ID NO: 2131453 - protein, 45 aa, Cryptosporidium hominis
ITVYIIECIFTYWISNLIFEILKGLIILLFFVKQRKRLCIVLVQH

SEQ ID NO: 2131454 - protein, 35 aa, Cryptosporidium hominis
ITYYPDRMWGITVPIYMLFLPFMTIITYNCISILN

SEQ ID NO: 2131455 - protein, 31 aa, Cryptosporidium hominis
IVAGVQLLLSPLYYIVFSKANMLSPRGECRA

SEQ ID NO: 2131456 - protein, 21 aa, Cryptosporidium hominis
IVAKYIRVHFPQAGNFSNMTM

SEQ ID NO: 2131457 - protein, 39 aa, Cryptosporidium hominis
IVALIIISSLLLLGLYWAFIFFFIFLKTGQLTNISTTIA

SEQ ID NO: 2131458 - protein, 23 aa, Cryptosporidium hominis
IVEPLVRIKDSKFLPYYIEIINK

SEQ ID NO: 2131459 - protein, 19 aa, Cryptosporidium hominis
IVFLNYKIFSGIIEFPIFV

SEQ ID NO: 2131460 - protein, 36 aa, Cryptosporidium hominis
IVFMMTNFIAIVSCYFLFIGLFEYNTRSVTFLLKSS

SEQ ID NO: 2131461 - protein, 19 aa, Cryptosporidium hominis
IVGIVGVVWLFVFGKSRNF

SEQ ID NO: 2131462 - protein, 39 aa, Cryptosporidium hominis
IVIQCYFRRYLCKKYLYFRKYGPIKLLNTSAMQIQACWR

SEQ ID NO: 2131463 - protein, 48 aa, Cryptosporidium hominis
IVITICSILHFMLPISFMSILIYSITSISFYIILVPSMLMPIPNETQY

SEQ ID NO: 2131464 - protein, 22 aa, Cryptosporidium hominis
IVLERFPVIIFGLIEDIFKEGI

SEQ ID NO: 2131465 - protein, 17 aa, Cryptosporidium hominis
IVLITLISWLFLGDTKM

SEQ ID NO: 2131466 - protein, 28 aa, Cryptosporidium hominis
IVLLITEIILFQLVAYIFAARVLSTLDL

SEQ ID NO: 2131467 - protein, 19 aa, Cryptosporidium hominis
IVLRIRKYSSFGGAEFFIS

SEQ ID NO: 2131468 - protein, 17 aa, Cryptosporidium hominis
IVLYAMYILIISIEWCA

SEQ ID NO: 2131469 - protein, 17 aa, Cryptosporidium hominis
IVMLVFVTPLLLALFPF

SEQ ID NO: 2131470 - protein, 25 aa, Cryptosporidium hominis
IVNKWLPFDKSLYPAFGVLTYDDIQ

SEQ ID NO: 2131471 - protein, 29 aa, Cryptosporidium hominis
IVNSTQFIFLNWFYLVYHGSNDLYFSKKM

SEQ ID NO: 2131472 - protein, 19 aa, Cryptosporidium hominis
IVRIVSFFIFFSYASCIYS

SEQ ID NO: 2131473 - protein, 23 aa, Cryptosporidium hominis
IVSCFLLGIIVYYSFKDVEILNS

SEQ ID NO: 2131474 - protein, 20 aa, Cryptosporidium hominis
IVSQYQKYFIWKLKKKKNMR

SEQ ID NO: 2131475 - protein, 27 aa, Cryptosporidium hominis
IVYKQLMGIFRFKLCYVWKFSILNSYC

SEQ ID NO: 2131476 - protein, 24 aa, Cryptosporidium hominis
IWEPNLPFIFGEIRKIFLMEFIRR

SEQ ID NO: 2131477 - protein, 17 aa, Cryptosporidium hominis
IWLHLKPSDTKNPQEDT

SEQ ID NO: 2131478 - protein, 22 aa, Cryptosporidium hominis
IWPLLVVGDYLRLPFQAIMFLI

SEQ ID NO: 2131479 - protein, 32 aa, Cryptosporidium hominis
IWSACLIHIVYLFFSALISFTFTGSLMYQHCD

SEQ ID NO: 2131480 - protein, 30 aa, Cryptosporidium hominis
IYDNVVYPSLFTLFPLFRQILIREKIDIVH

SEQ ID NO: 2131481 - protein, 18 aa, Cryptosporidium hominis
IYHRKNILMLIATVFGIF

SEQ ID NO: 2131482 - protein, 19 aa, Cryptosporidium hominis
IYIHLFMTLGQIMIVLPTC

SEQ ID NO: 2131483 - protein, 32 aa, Cryptosporidium hominis
IYIPSAVRYIILLLLWTIFTKNVYSESSEETL

SEQ ID NO: 2131484 - protein, 35 aa, Cryptosporidium hominis
IYIYVYFFFFFFACALQRFVILLALLEIYSRHMGS

SEQ ID NO: 2131485 - protein, 30 aa, Cryptosporidium hominis
IYKFKWVLIYLILFIFSVYIQLNCVGCYEI

SEQ ID NO: 2131486 - protein, 23 aa, Cryptosporidium hominis
IYKHCIIICLLNYYKYIKKTTLI

SEQ ID NO: 2131487 - protein, 22 aa, Cryptosporidium hominis
IYLIIYGIVSTLFWATTLYFTI

SEQ ID NO: 2131488 - protein, 19 aa, Cryptosporidium hominis
IYLSENLVFYIFKLVPLFK

SEQ ID NO: 2131489 - protein, 18 aa, Cryptosporidium hominis
IYNFSYVQFCLRNPSLSY

SEQ ID NO: 2131490 - protein, 19 aa, Cryptosporidium hominis
IYRQKIFPFQLSPNISLVA

SEQ ID NO: 2131491 - protein, 19 aa, Cryptosporidium hominis
IYSDLIFFNTYVIRRAFQE

SEQ ID NO: 2131492 - protein, 18 aa, Cryptosporidium hominis
IYSFIYLIEAGSGTLGEA

SEQ ID NO: 2131493 - protein, 24 aa, Cryptosporidium hominis
IYSILYLIYLIQPRILVSRLVKNN

SEQ ID NO: 2131494 - protein, 17 aa, Cryptosporidium hominis
IYVFLSSVLFEPAFVSM

SEQ ID NO: 2131495 - protein, 27 aa, Cryptosporidium hominis
IYVTRKRPLIVYFRRAMNLLTVSEAHN

SEQ ID NO: 2131496 - protein, 18 aa, Cryptosporidium hominis
IYYVFFEYYIFDDYVIGS

SEQ ID NO: 2131497 - protein, 31 aa, Cryptosporidium hominis
KAAIWSILELLLSFGLVAIQVYYIKSYFQVK

SEQ ID NO: 2131498 - protein, 39 aa, Cryptosporidium hominis
KADVIMRLMCNFTFRLFACLFFIVVVILGILFGKNVNTE

SEQ ID NO: 2131499 - protein, 24 aa, Cryptosporidium hominis
KAESILTRFRAFVAISVILEYMEP

SEQ ID NO: 2131500 - protein, 22 aa, Cryptosporidium hominis
KAIMAPNYFDNKFILAAKRYQC

SEQ ID NO: 2131501 - protein, 24 aa, Cryptosporidium hominis
KAIWFLSCNLLIGMISFISLGLIS

SEQ ID NO: 2131502 - protein, 21 aa, Cryptosporidium hominis
KAKFALFSSWTEGCNKSFLQT

SEQ ID NO: 2131503 - protein, 23 aa, Cryptosporidium hominis
KAKFSNFLYTRLYSNGLVEVNLP

SEQ ID NO: 2131504 - protein, 19 aa, Cryptosporidium hominis
KALNYVELVILLGTTLILD

SEQ ID NO: 2131505 - protein, 19 aa, Cryptosporidium hominis
KALSSNIPEKPLLGKEWIQ

SEQ ID NO: 2131506 - protein, 37 aa, Cryptosporidium hominis
KANGNFFLILKLGHLLLFLLILKLLVYIYTKWTKTRE

SEQ ID NO: 2131507 - protein, 21 aa, Cryptosporidium hominis
KASIDFMAAFFSSTISLFLSG

SEQ ID NO: 2131508 - protein, 24 aa, Cryptosporidium hominis
KASNLSIAFWTLKKKLLGQSEIEK

SEQ ID NO: 2131509 - protein, 22 aa, Cryptosporidium hominis
KAVLPLMKIRWKTLNLINTSKM

SEQ ID NO: 2131510 - protein, 22 aa, Cryptosporidium hominis
KAYFELFCVRYWYSENLKRFTC

SEQ ID NO: 2131511 - protein, 44 aa, Cryptosporidium hominis
KAYLPYAEIFPDTLCYLLLSCKVGLHPWIRVNRVIRDIPNQSII

SEQ ID NO: 2131512 - protein, 24 aa, Cryptosporidium hominis
KCHNLVLALLYYRYLQLGVILENG

SEQ ID NO: 2131513 - protein, 17 aa, Cryptosporidium hominis
KCIKPFLRNVSLILGDI

SEQ ID NO: 2131514 - protein, 25 aa, Cryptosporidium hominis
KCLHGYFRIHWLEIPKLAFKLTNLL

SEQ ID NO: 2131515 - protein, 17 aa, Cryptosporidium hominis
KCSTILGWLATKYPNNY

SEQ ID NO: 2131516 - protein, 30 aa, Cryptosporidium hominis
KDFICSQIPSYLWYLPSDKIFPFPITSNKY

SEQ ID NO: 2131517 - protein, 21 aa, Cryptosporidium hominis
KDFLLKFVNICFTNVIGSLLF

SEQ ID NO: 2131518 - protein, 24 aa, Cryptosporidium hominis
KDGSSWIWDAILPVYDSITNKKIL

SEQ ID NO: 2131519 - protein, 19 aa, Cryptosporidium hominis
KDIISVYELGLIKRVIFSN

SEQ ID NO: 2131520 - protein, 22 aa, Cryptosporidium hominis
KDINYVFIATILTIIITTVTTG

SEQ ID NO: 2131521 - protein, 26 aa, Cryptosporidium hominis
KDIVNLGIIVWLKLIVRFQNIYMKEK

SEQ ID NO: 2131522 - protein, 42 aa, Cryptosporidium hominis
KDIWTWFSVYLVILKTFKRFYGIYFLLFSINLAISYFVKFQA

SEQ ID NO: 2131523 - protein, 33 aa, Cryptosporidium hominis
KDKFEYICSHGTFFWILKRYILPWDTYSDYNIK

SEQ ID NO: 2131524 - protein, 24 aa, Cryptosporidium hominis
KDKPYYLLYPSCRIFEPLDNLKDE

SEQ ID NO: 2131525 - protein, 17 aa, Cryptosporidium hominis
KDLRPIYIYFNSFKDRI

SEQ ID NO: 2131526 - protein, 17 aa, Cryptosporidium hominis
KDLVLLLKEYHLKYLKL

SEQ ID NO: 2131527 - protein, 21 aa, Cryptosporidium hominis
KDMVRLGKRFVYYNSFKQFPK

SEQ ID NO: 2131528 - protein, 20 aa, Cryptosporidium hominis
KDNLKVILYLYTLSIIRVEK

SEQ ID NO: 2131529 - protein, 38 aa, Cryptosporidium hominis
KDPYEFSFHLFINRFMKSLIPIPIEKFVKFTGIRQYPR

SEQ ID NO: 2131530 - protein, 29 aa, Cryptosporidium hominis
KDQAIQQPLIRLLLYGIILPILEQCNAYC

SEQ ID NO: 2131531 - protein, 24 aa, Cryptosporidium hominis
KDQILILWGREIIGPVFELLKSEL

SEQ ID NO: 2131532 - protein, 23 aa, Cryptosporidium hominis
KDRIDFFLLNESYLDQLLDIYDN

SEQ ID NO: 2131533 - protein, 24 aa, Cryptosporidium hominis
KDRPLFWYILNLPIKIFTNLNIDQ

SEQ ID NO: 2131534 - protein, 26 aa, Cryptosporidium hominis
KDSEDFLVVLVIYSKLWLNGSITIYN

SEQ ID NO: 2131535 - protein, 27 aa, Cryptosporidium hominis
KDVIKDVLLPWYHCYRFFVQEAIRYEN

SEQ ID NO: 2131536 - protein, 18 aa, Cryptosporidium hominis
KDVLMSKNFKIFKSLKIE

SEQ ID NO: 2131537 - protein, 31 aa, Cryptosporidium hominis
KDWYIHPNYLSYLVLLIVIVSVIFSLNLIKM

SEQ ID NO: 2131538 - protein, 24 aa, Cryptosporidium hominis
KDYKDLMILARHGSPLLVGVQSGH

SEQ ID NO: 2131539 - protein, 30 aa, Cryptosporidium hominis
KDYNLPIEYLYEFLIPTISLVIMSIEDPAM

SEQ ID NO: 2131540 - protein, 25 aa, Cryptosporidium hominis
KEARFLTHLTGKSLCLLFLSCLTST

SEQ ID NO: 2131541 - protein, 18 aa, Cryptosporidium hominis
KEDGVIIHLVPYARNQRN

SEQ ID NO: 2131542 - protein, 17 aa, Cryptosporidium hominis
KEFFFKISVDRINSVLK

SEQ ID NO: 2131543 - protein, 23 aa, Cryptosporidium hominis
KEIEYPFIVLSLNSVIGELFPYI

SEQ ID NO: 2131544 - protein, 17 aa, Cryptosporidium hominis
KEIGIKLIIIDFLLIIS

SEQ ID NO: 2131545 - protein, 29 aa, Cryptosporidium hominis
KEIVDVLKKMYLQLIKTLALLHKEKEKMA

SEQ ID NO: 2131546 - protein, 29 aa, Cryptosporidium hominis
KEKVSFYFILIISLLLCIIIRDLHMIKEY

SEQ ID NO: 2131547 - protein, 20 aa, Cryptosporidium hominis
KEKYLCKFLFFQNDIFNHNQ

SEQ ID NO: 2131548 - protein, 22 aa, Cryptosporidium hominis
KELHFEMIGFIESKFDEIVQLN

SEQ ID NO: 2131549 - protein, 24 aa, Cryptosporidium hominis
KEMIPFLDCYLTYLDIISTKNIEP

SEQ ID NO: 2131550 - protein, 23 aa, Cryptosporidium hominis
KENLHHYLPIFNFSEEFVAPNRT

SEQ ID NO: 2131551 - protein, 29 aa, Cryptosporidium hominis
KENLVIINKFSLLFSKIFSRFISRLLESF

SEQ ID NO: 2131552 - protein, 33 aa, Cryptosporidium hominis
KEPISYNDKFGPTLLVMCLIISLTSVLLLNIIV

SEQ ID NO: 2131553 - protein, 26 aa, Cryptosporidium hominis
KERDLSLLWVFQNLSPHIPMFTIHPK

SEQ ID NO: 2131554 - protein, 34 aa, Cryptosporidium hominis
KERRIRGKFLLILMVQLFCFFCACGSVIYKEFRE

SEQ ID NO: 2131555 - protein, 25 aa, Cryptosporidium hominis
KERRRIIGVLPQIPLLLKGWTIRDF

SEQ ID NO: 2131556 - protein, 20 aa, Cryptosporidium hominis
KESFKYVYSPKVQGLWNIHQ

SEQ ID NO: 2131557 - protein, 26 aa, Cryptosporidium hominis
KESNMVWLYCYLMSANTPSKLMLIGV

SEQ ID NO: 2131558 - protein, 17 aa, Cryptosporidium hominis
KETPLLLATFALMIIFM

SEQ ID NO: 2131559 - protein, 21 aa, Cryptosporidium hominis
KEWDRICFDLLDSLKANKKSI

SEQ ID NO: 2131560 - protein, 29 aa, Cryptosporidium hominis
KEYEERSIFPLAEGLKLIKKLDILNKADC

SEQ ID NO: 2131561 - protein, 24 aa, Cryptosporidium hominis
KEYYLYNYYYYKKSVENRKNIRNI

SEQ ID NO: 2131562 - protein, 21 aa, Cryptosporidium hominis
KFAVLILPPFCNIAHWTYNSK

SEQ ID NO: 2131563 - protein, 29 aa, Cryptosporidium hominis
KFCFLYILYFFTFYFSMVVTISLRNSSNS

SEQ ID NO: 2131564 - protein, 18 aa, Cryptosporidium hominis
KFCNSLCTLPFPGNDNWL

SEQ ID NO: 2131565 - protein, 24 aa, Cryptosporidium hominis
KFDCTILLEIGPQPILTKLSIQCI

SEQ ID NO: 2131566 - protein, 17 aa, Cryptosporidium hominis
KFFCWKKVRSKSSHLLN

SEQ ID NO: 2131567 - protein, 17 aa, Cryptosporidium hominis
KFFFNPESFIKMMIDSA

SEQ ID NO: 2131568 - protein, 24 aa, Cryptosporidium hominis
KFGNIEYFFFAVETMFSIGYGSPR

SEQ ID NO: 2131569 - protein, 20 aa, Cryptosporidium hominis
KFIFQFLNENTLNHLFLQIS

SEQ ID NO: 2131570 - protein, 21 aa, Cryptosporidium hominis
KFLIWTIFLVILLNFCFYKKK

SEQ ID NO: 2131571 - protein, 43 aa, Cryptosporidium hominis
KFLNTKICLIYLLNSAWHIFVVFTIPYILFRVNSTNLFGSNQS

SEQ ID NO: 2131572 - protein, 19 aa, Cryptosporidium hominis
KFNGILTDLFSKNLNRSQN

SEQ ID NO: 2131573 - protein, 27 aa, Cryptosporidium hominis
KFNYNIIYNIILIVINIIVKDLQIFDK

SEQ ID NO: 2131574 - protein, 36 aa, Cryptosporidium hominis
KFPSLARVLFQCYSKQIFIIFALVIFSNICNLTQIF

SEQ ID NO: 2131575 - protein, 31 aa, Cryptosporidium hominis
KFQQIPSWWVVFWPCWFWCGVIFSFSTVFCV

SEQ ID NO: 2131576 - protein, 37 aa, Cryptosporidium hominis
KFRKRTEIGIFWIGLLTLFLIILDILLEVYNQKVNEV

SEQ ID NO: 2131577 - protein, 29 aa, Cryptosporidium hominis
KFSAIFARILLLWWYSIPDIREIQHRCIA

SEQ ID NO: 2131578 - protein, 26 aa, Cryptosporidium hominis
KFSCYFYYWSFCQCSKPWKLKFLNYF

SEQ ID NO: 2131579 - protein, 28 aa, Cryptosporidium hominis
KFSIGFYAAIFVALLPIGISLTYWYEGV

SEQ ID NO: 2131580 - protein, 18 aa, Cryptosporidium hominis
KFSVIIAFFQMTLGVILK

SEQ ID NO: 2131581 - protein, 20 aa, Cryptosporidium hominis
KFVLKKFMVYTVNSLRNLLA

SEQ ID NO: 2131582 - protein, 25 aa, Cryptosporidium hominis
KGAGILPLNMLYNAPLKSLENVDAI

SEQ ID NO: 2131583 - protein, 17 aa, Cryptosporidium hominis
KGDFFIYYQLRNFYQNN

SEQ ID NO: 2131584 - protein, 19 aa, Cryptosporidium hominis
KGEELPLLWGQRATILHEN

SEQ ID NO: 2131585 - protein, 26 aa, Cryptosporidium hominis
KGGNKDIWILPSPSSAEMLTYFLRLL

SEQ ID NO: 2131586 - protein, 23 aa, Cryptosporidium hominis
KGIIKLFLDFLMTQNAPGGGKTV

SEQ ID NO: 2131587 - protein, 21 aa, Cryptosporidium hominis
KGIILMLKYSIEMKMFSVAKI

SEQ ID NO: 2131588 - protein, 38 aa, Cryptosporidium hominis
KGKSLRIYKPLIKVFWLQCLMVLLLKVFFDVLQTLATL

SEQ ID NO: 2131589 - protein, 45 aa, Cryptosporidium hominis
KGLSGPALYAILFAPLILGMLILAILFWFRRYKWKKNFEDDQNTE

SEQ ID NO: 2131590 - protein, 31 aa, Cryptosporidium hominis
KGLTVRGSMILPFSNLIVIGKLIVGKNVYTA

SEQ ID NO: 2131591 - protein, 18 aa, Cryptosporidium hominis
KGMNRDFISVLLGGFDQE

SEQ ID NO: 2131592 - protein, 27 aa, Cryptosporidium hominis
KGSLGWGFYLLLLANSLLIVHILALVD

SEQ ID NO: 2131593 - protein, 23 aa, Cryptosporidium hominis
KGTLYLLSGILAMSIFRINFLEL

SEQ ID NO: 2131594 - protein, 22 aa, Cryptosporidium hominis
KGTWVSWMHCIALVLGRTCDSC

SEQ ID NO: 2131595 - protein, 21 aa, Cryptosporidium hominis
KGWFRYFYLVGVFTTSICVYL

SEQ ID NO: 2131596 - protein, 19 aa, Cryptosporidium hominis
KGWYSFIISTLAGTVYTFG

SEQ ID NO: 2131597 - protein, 27 aa, Cryptosporidium hominis
KHFRSLTFPSVFFYLSQHLADMIALLV

SEQ ID NO: 2131598 - protein, 24 aa, Cryptosporidium hominis
KHGFYAFWNWFDSRSWYPLGRIIG

SEQ ID NO: 2131599 - protein, 27 aa, Cryptosporidium hominis
KHKMVLKLLLISLLGLLNIIVWANGEE

SEQ ID NO: 2131600 - protein, 24 aa, Cryptosporidium hominis
KHLSFLLRKEPRLVYRECWRGDYF

SEQ ID NO: 2131601 - protein, 26 aa, Cryptosporidium hominis
KHPRAVRFVFAWMLIAQVLRNYDTGA

SEQ ID NO: 2131602 - protein, 25 aa, Cryptosporidium hominis
KHTEGILVPWPWELSKYRVLDVISY

SEQ ID NO: 2131603 - protein, 31 aa, Cryptosporidium hominis
KHVSKLFNRFLLFSFLFFSTGLGYYYYTKIY

SEQ ID NO: 2131604 - protein, 18 aa, Cryptosporidium hominis
KHWDILRKILLGETKDIN

SEQ ID NO: 2131605 - protein, 19 aa, Cryptosporidium hominis
KIDLYQRAYHGIDRLGRPI

SEQ ID NO: 2131606 - protein, 36 aa, Cryptosporidium hominis
KIFIFKRKIPGWSALILLISFIFSVLCIYFGYKMKV

SEQ ID NO: 2131607 - protein, 18 aa, Cryptosporidium hominis
KIFPFQLSPNISLVAPEE

SEQ ID NO: 2131608 - protein, 30 aa, Cryptosporidium hominis
KIFSGIIEFPIFVSWFQQLVGLAIFQILKI

SEQ ID NO: 2131609 - protein, 17 aa, Cryptosporidium hominis
KIIFGEITALKSMTNIQ

SEQ ID NO: 2131610 - protein, 27 aa, Cryptosporidium hominis
KIIIGIILHIVLFIIALVFTRNRKYHK

SEQ ID NO: 2131611 - protein, 19 aa, Cryptosporidium hominis
KIIKAFKKIPIISPTISFL

SEQ ID NO: 2131612 - protein, 20 aa, Cryptosporidium hominis
KIIQELYRYGGLRTFWTGLL

SEQ ID NO: 2131613 - protein, 26 aa, Cryptosporidium hominis
KIISVLSRLLNLLKLLAVVEVSEYIR

SEQ ID NO: 2131614 - protein, 17 aa, Cryptosporidium hominis
KIIYKLCYNISYLSPYS

SEQ ID NO: 2131615 - protein, 25 aa, Cryptosporidium hominis
KIKDLRLFDAKWNMWQWKVTANLAQ

SEQ ID NO: 2131616 - protein, 33 aa, Cryptosporidium hominis
KIKIPICQHNWRPIFITSLILSDKLWDDSCAKS

SEQ ID NO: 2131617 - protein, 18 aa, Cryptosporidium hominis
KIKIYFKNRIKSLREKKL

SEQ ID NO: 2131618 - protein, 17 aa, Cryptosporidium hominis
KILLKKPSGDKFQVKTE

SEQ ID NO: 2131619 - protein, 35 aa, Cryptosporidium hominis
KILSITLIYNLQNALRIFLRRALYKDGVAIRDNKT

SEQ ID NO: 2131620 - protein, 19 aa, Cryptosporidium hominis
KILVECFILYRPDIGYVEG

SEQ ID NO: 2131621 - protein, 19 aa, Cryptosporidium hominis
KINLINAFIGTGFDTILQM

SEQ ID NO: 2131622 - protein, 17 aa, Cryptosporidium hominis
KINSILLLHSGSKIRIG

SEQ ID NO: 2131623 - protein, 33 aa, Cryptosporidium hominis
KINTIWAILRVQFLVLLLFLNNLACENEILDES

SEQ ID NO: 2131624 - protein, 28 aa, Cryptosporidium hominis
KIPRIYVIFIIFIIFFSNVECLLKKANQ

SEQ ID NO: 2131625 - protein, 26 aa, Cryptosporidium hominis
KIPTQYPILKLQLWSYGLIQSDNIGE

SEQ ID NO: 2131626 - protein, 22 aa, Cryptosporidium hominis
KIQSLIPCSILFLKALESCIDD

SEQ ID NO: 2131627 - protein, 18 aa, Cryptosporidium hominis
KISLLRFLIYKRYDINEI

SEQ ID NO: 2131628 - protein, 20 aa, Cryptosporidium hominis
KISSDFLRKISVLKLCVYVT

SEQ ID NO: 2131629 - protein, 28 aa, Cryptosporidium hominis
KISVFNWFIFIIFVIYIRLIGYRHIDLF

SEQ ID NO: 2131630 - protein, 37 aa, Cryptosporidium hominis
KITIGLYNILLLLLILLVFLLILFSGGITIGQMAPPP

SEQ ID NO: 2131631 - protein, 21 aa, Cryptosporidium hominis
KIVFDEFVNFFLINLTKHEPY

SEQ ID NO: 2131632 - protein, 42 aa, Cryptosporidium hominis
KIWDEEILFLYISLLREFIGLSKFLSYFQWRDFIFGQEHILG

SEQ ID NO: 2131633 - protein, 18 aa, Cryptosporidium hominis
KIWNTILISFPDIPIDKY

SEQ ID NO: 2131634 - protein, 20 aa, Cryptosporidium hominis
KIYDFILQEQLSLLDSVKFM

SEQ ID NO: 2131635 - protein, 17 aa, Cryptosporidium hominis
KKELDLCLRILHIFKYE

SEQ ID NO: 2131636 - protein, 36 aa, Cryptosporidium hominis
KKFHSELLYGCLLTYGIYLAYLINPSKSLNLFIWKF

SEQ ID NO: 2131637 - protein, 19 aa, Cryptosporidium hominis
KKGNFLLEWLREMKTFIPS

SEQ ID NO: 2131638 - protein, 24 aa, Cryptosporidium hominis
KKGVFEIFIIPIEKNRYLVVYSKF

SEQ ID NO: 2131639 - protein, 24 aa, Cryptosporidium hominis
KKIFFGCFNHIKYFIYKFTGNFTL

SEQ ID NO: 2131640 - protein, 19 aa, Cryptosporidium hominis
KKLGFVGGKIKMISSHLSN

SEQ ID NO: 2131641 - protein, 26 aa, Cryptosporidium hominis
KKLKCKPFRWFLDNVAPETYITQLDH

SEQ ID NO: 2131642 - protein, 31 aa, Cryptosporidium hominis
KKLTILIHVFIIYFLVIYNNEWNSLDFYYLK

SEQ ID NO: 2131643 - protein, 22 aa, Cryptosporidium hominis
KKNILLFIFACYTPIILMFGFI

SEQ ID NO: 2131644 - protein, 29 aa, Cryptosporidium hominis
KKNNALLILFLMIFLIIEIGIGIYIKLEM

SEQ ID NO: 2131645 - protein, 27 aa, Cryptosporidium hominis
KKNNSNYWKIINSLWSIFICALDDIIR

SEQ ID NO: 2131646 - protein, 31 aa, Cryptosporidium hominis
KKNYHSIFFFDLVAYIFLILSAVLFDSSEHS

SEQ ID NO: 2131647 - protein, 29 aa, Cryptosporidium hominis
KKPYNSVFLLITLFLLIVTRNSECVRYKE

SEQ ID NO: 2131648 - protein, 43 aa, Cryptosporidium hominis
KKQFKKFFELPPKLEYIPYHLFFLIVLFSIVSILWIINIANYQ

SEQ ID NO: 2131649 - protein, 25 aa, Cryptosporidium hominis
KKSPRTSILPIKISKELLKKLMSKC

SEQ ID NO: 2131650 - protein, 27 aa, Cryptosporidium hominis
KKTDQGWWLLALILNVVDLISIDYLNY

SEQ ID NO: 2131651 - protein, 18 aa, Cryptosporidium hominis
KKTTLIRRFSLKFPQPYL

SEQ ID NO: 2131652 - protein, 29 aa, Cryptosporidium hominis
KKVGFFEVWLLLSLWKRYPARIYRHMMKT

SEQ ID NO: 2131653 - protein, 26 aa, Cryptosporidium hominis
KKVHFPPIIECPNQYSLFPGGNCSKR

SEQ ID NO: 2131654 - protein, 21 aa, Cryptosporidium hominis
KKWILLYFTSVILLEFWQFSA

SEQ ID NO: 2131655 - protein, 18 aa, Cryptosporidium hominis
KKYVIKMDPLRQVILKNE

SEQ ID NO: 2131656 - protein, 24 aa, Cryptosporidium hominis
KLAQHPCIVSYRQSFASLDFSQGS

SEQ ID NO: 2131657 - protein, 23 aa, Cryptosporidium hominis
KLCLIYINFILKCDHPGSSENLL

SEQ ID NO: 2131658 - protein, 34 aa, Cryptosporidium hominis
KLELSALLQILHYFLIPMFPLDLVSFNSIFVRNL

SEQ ID NO: 2131659 - protein, 20 aa, Cryptosporidium hominis
KLEYILKILSTHQANLEIPS

SEQ ID NO: 2131660 - protein, 46 aa, Cryptosporidium hominis
KLFSGYEKCNLPNGKLKGIIFDLSIIKNILIDYPTYNDIERITLIE

SEQ ID NO: 2131661 - protein, 21 aa, Cryptosporidium hominis
KLGEILFYKYSFNILVFLFIQ

SEQ ID NO: 2131662 - protein, 24 aa, Cryptosporidium hominis
KLHEIFPSGALKLPGRHFLNALMV

SEQ ID NO: 2131663 - protein, 25 aa, Cryptosporidium hominis
KLHNHAIEIVNWFKHLFNINSKVSR

SEQ ID NO: 2131664 - protein, 17 aa, Cryptosporidium hominis
KLIEFWPINRELLCETK

SEQ ID NO: 2131665 - protein, 18 aa, Cryptosporidium hominis
KLIIIDFLLIISGIFTSI

SEQ ID NO: 2131666 - protein, 22 aa, Cryptosporidium hominis
KLIKITFLLSILISTILCLDHG

SEQ ID NO: 2131667 - protein, 26 aa, Cryptosporidium hominis
KLIVGFQGWRFAFLLVGVLSAILGGI

SEQ ID NO: 2131668 - protein, 23 aa, Cryptosporidium hominis
KLKKCFKVFLSVCGTSLSAIFGF

SEQ ID NO: 2131669 - protein, 29 aa, Cryptosporidium hominis
KLKKWVKKCYSLLPLFYSLIEKIMKTIKN

SEQ ID NO: 2131670 - protein, 31 aa, Cryptosporidium hominis
KLKLENFWTKFWLWPNQLFLTYTKAHFISLR

SEQ ID NO: 2131671 - protein, 19 aa, Cryptosporidium hominis
KLKPLLNFTLESLALLSCI

SEQ ID NO: 2131672 - protein, 17 aa, Cryptosporidium hominis
KLLEEVAVLKLLDHPNI

SEQ ID NO: 2131673 - protein, 18 aa, Cryptosporidium hominis
KLLLNPISLVSIITTLHL

SEQ ID NO: 2131674 - protein, 21 aa, Cryptosporidium hominis
KLLNSFFQTILKLSSTCIGFY

SEQ ID NO: 2131675 - protein, 18 aa, Cryptosporidium hominis
KLMTRRLIFYCHFPDQLL

SEQ ID NO: 2131676 - protein, 18 aa, Cryptosporidium hominis
KLNKILSLFLDPFNKLSR

SEQ ID NO: 2131677 - protein, 28 aa, Cryptosporidium hominis
KLNKSAFYFVRFNLLLHLAAIVIQCYFR

SEQ ID NO: 2131678 - protein, 26 aa, Cryptosporidium hominis
KLNKTIKYLFLRLYSNVVQLGEGKIQ

SEQ ID NO: 2131679 - protein, 19 aa, Cryptosporidium hominis
KLNLYRIITKNLLGIGITM

SEQ ID NO: 2131680 - protein, 23 aa, Cryptosporidium hominis
KLPQLYQHLLYTIGINFESVVTP

SEQ ID NO: 2131681 - protein, 26 aa, Cryptosporidium hominis
KLRRNEPFLLIKDPSLRYGPNVKRKT

SEQ ID NO: 2131682 - protein, 24 aa, Cryptosporidium hominis
KLSIPFFPLEFINLVKNVNLLPNS

SEQ ID NO: 2131683 - protein, 34 aa, Cryptosporidium hominis
KLVGFEHLWKKRVVYLLKIQSVNAVLFLEGRKTE

SEQ ID NO: 2131684 - protein, 18 aa, Cryptosporidium hominis
KLVWMKTSVLFKSKIHRF

SEQ ID NO: 2131685 - protein, 26 aa, Cryptosporidium hominis
KLYKILRKMLIKFYIEEFGIILTYHM

SEQ ID NO: 2131686 - protein, 34 aa, Cryptosporidium hominis
KMASCKYLTFLLNELLKLFQLFGNSVKNLIKDFE

SEQ ID NO: 2131687 - protein, 19 aa, Cryptosporidium hominis
KMCVAHENKMLWRPFTEQN

SEQ ID NO: 2131688 - protein, 27 aa, Cryptosporidium hominis
KMKTFGYLRGYILLALPGVLDEINSKK

SEQ ID NO: 2131689 - protein, 23 aa, Cryptosporidium hominis
KMLEHFFNTIYLKNKGKPRKLIL

SEQ ID NO: 2131690 - protein, 25 aa, Cryptosporidium hominis
KMVPYYIPYLEICPYVWGLFIFIHC

SEQ ID NO: 2131691 - protein, 20 aa, Cryptosporidium hominis
KMWTPFNALRSRKVGFLVVF

SEQ ID NO: 2131692 - protein, 37 aa, Cryptosporidium hominis
KNALAIFYSFIPYIIGLVLFVWLLIGDSFVPAYALIM

SEQ ID NO: 2131693 - protein, 37 aa, Cryptosporidium hominis
KNALFPILTVNAVINFLIFYLINGTLIYIFTRKMNSF

SEQ ID NO: 2131694 - protein, 27 aa, Cryptosporidium hominis
KNANKLLIFGILLLRQGTEYLGESKDD

SEQ ID NO: 2131695 - protein, 20 aa, Cryptosporidium hominis
KNCLVVLLLIWHFMHAIIFG

SEQ ID NO: 2131696 - protein, 23 aa, Cryptosporidium hominis
KNDGVEFLFLTKAVEGCLISQEI

SEQ ID NO: 2131697 - protein, 24 aa, Cryptosporidium hominis
KNELTLLGLIGFLDPPRPGVEKAI

SEQ ID NO: 2131698 - protein, 38 aa, Cryptosporidium hominis
KNGFVLDSVLFPCKYSFDGPIYILLTTTPKRIDNLGKY

SEQ ID NO: 2131699 - protein, 30 aa, Cryptosporidium hominis
KNIKENIPFKHILLPFTTTTTTVTTTTTTT

SEQ ID NO: 2131700 - protein, 20 aa, Cryptosporidium hominis
KNILQGVRALLPINKTLKVT

SEQ ID NO: 2131701 - protein, 27 aa, Cryptosporidium hominis
KNKEKFNIWRFLLSTAILLVSIFLSHV

SEQ ID NO: 2131702 - protein, 27 aa, Cryptosporidium hominis
KNKGYGWTLTIIASLILIFTSFYESLI

SEQ ID NO: 2131703 - protein, 22 aa, Cryptosporidium hominis
KNLVPIAYWRLSQGMTPSITVS

SEQ ID NO: 2131704 - protein, 32 aa, Cryptosporidium hominis
KNLYKKSSLFIILLMLIMAIFQVCNYSGFKIF

SEQ ID NO: 2131705 - protein, 30 aa, Cryptosporidium hominis
KNNELKHLFKIPMNYLPYIPKDTGENDEKS

SEQ ID NO: 2131706 - protein, 21 aa, Cryptosporidium hominis
KNNRYLRLLKINNGNHLLSNS

SEQ ID NO: 2131707 - protein, 20 aa, Cryptosporidium hominis
KNPEYCHWFAFYLVKNRASK

SEQ ID NO: 2131708 - protein, 24 aa, Cryptosporidium hominis
KNPKIYFPIIALTATLTAGHIQNP

SEQ ID NO: 2131709 - protein, 27 aa, Cryptosporidium hominis
KNRFLLTLGLIGVVIGGVWYITKNNKK

SEQ ID NO: 2131710 - protein, 20 aa, Cryptosporidium hominis
KNRGHYITSILFFMEANLLE

SEQ ID NO: 2131711 - protein, 22 aa, Cryptosporidium hominis
KNRYCLYLFKEIYWKRSKVTIH

SEQ ID NO: 2131712 - protein, 24 aa, Cryptosporidium hominis
KNSSVMPLIPILNHGLRRIKLEYK

SEQ ID NO: 2131713 - protein, 35 aa, Cryptosporidium hominis
KNSWAFFIYLIFFTSIFLICKIIFYLTIIKINKNK

SEQ ID NO: 2131714 - protein, 23 aa, Cryptosporidium hominis
KNSYLSFFAKTIQIFKKIIIFLK

SEQ ID NO: 2131715 - protein, 56 aa, Cryptosporidium hominis
KNTNLQSIIKYLFFFIQIISLIYLFTILFLISEYDYIWFLIGVIITAALCSSVRIY

SEQ ID NO: 2131716 - protein, 42 aa, Cryptosporidium hominis
KNWSIYDHQLLESKAWWICGIPLSVYSLLAEISLLIATSFSY

SEQ ID NO: 2131717 - protein, 21 aa, Cryptosporidium hominis
KNYILTNILILIISEEFFTEI

SEQ ID NO: 2131718 - protein, 26 aa, Cryptosporidium hominis
KNYKKSMWLFFGIGIVQMTLSLFLDT

SEQ ID NO: 2131719 - protein, 24 aa, Cryptosporidium hominis
KPCRENFFLIVCMMSLLISSVFNS

SEQ ID NO: 2131720 - protein, 28 aa, Cryptosporidium hominis
KPKEYLNLFYHMAIPILIISIYVPFSNK

SEQ ID NO: 2131721 - protein, 25 aa, Cryptosporidium hominis
KPLKYWNLFLALFSFIGTLRLMPYV

SEQ ID NO: 2131722 - protein, 19 aa, Cryptosporidium hominis
KPMFIFRSRITLTDIHNGR

SEQ ID NO: 2131723 - protein, 28 aa, Cryptosporidium hominis
KPNFTTLFDYFYFTIITISTVGYGDYTP

SEQ ID NO: 2131724 - protein, 25 aa, Cryptosporidium hominis
KPRQDLLTGILFQPLLRNYDKVYIE

SEQ ID NO: 2131725 - protein, 26 aa, Cryptosporidium hominis
KPSDLYFCEIFTDFFLGIGDVLCKSI

SEQ ID NO: 2131726 - protein, 22 aa, Cryptosporidium hominis
KPVFSNLILLALCYIVEIEPYI

SEQ ID NO: 2131727 - protein, 20 aa, Cryptosporidium hominis
KQLVIFFSFALLSDSSSSLK

SEQ ID NO: 2131728 - protein, 28 aa, Cryptosporidium hominis
KQNPKSYWAPLSLLLVAITLGFGKLSSL

SEQ ID NO: 2131729 - protein, 24 aa, Cryptosporidium hominis
KQQISLPAFILDIFLIISGIITSI

SEQ ID NO: 2131730 - protein, 19 aa, Cryptosporidium hominis
KQRKRLCIVLVQHIPTQFK

SEQ ID NO: 2131731 - protein, 20 aa, Cryptosporidium hominis
KQRWTGIHNVGFYTNPKANF

SEQ ID NO: 2131732 - protein, 36 aa, Cryptosporidium hominis
KQSFKLFMTFLRTPIRNISFPPYLSSLGLSPIPVNN

SEQ ID NO: 2131733 - protein, 19 aa, Cryptosporidium hominis
KQVHILERLAWELTGFQVE

SEQ ID NO: 2131734 - protein, 30 aa, Cryptosporidium hominis
KQYTIYVSLFNPFLIPIILDCFSVIIKGEV

SEQ ID NO: 2131735 - protein, 28 aa, Cryptosporidium hominis
KRERLYARFVFITFGIASLFMWNTYLSC

SEQ ID NO: 2131736 - protein, 23 aa, Cryptosporidium hominis
KRGYCILFMRLLEIPGESVPISA

SEQ ID NO: 2131737 - protein, 19 aa, Cryptosporidium hominis
KRIKNKLEFLWLKMNNHKQ

SEQ ID NO: 2131738 - protein, 17 aa, Cryptosporidium hominis
KRKISLVDFDRLVERFY

SEQ ID NO: 2131739 - protein, 24 aa, Cryptosporidium hominis
KRKVMVLIIVYRYLVIIQNDIASN

SEQ ID NO: 2131740 - protein, 29 aa, Cryptosporidium hominis
KRLDNRAEIIWILVHSFFSTLTSLYIHSD

SEQ ID NO: 2131741 - protein, 28 aa, Cryptosporidium hominis
KRNKSLIFVYLLLSTVPFLSFKIIEYKI

SEQ ID NO: 2131742 - protein, 42 aa, Cryptosporidium hominis
KRSTRKMLLFLIIVIACSIAILYSPIYTLLKNLIGYLVSKFT

SEQ ID NO: 2131743 - protein, 24 aa, Cryptosporidium hominis
KRYRSINIQKLFDQLILTVVFHRD

SEQ ID NO: 2131744 - protein, 33 aa, Cryptosporidium hominis
KSCGRKWNKFIIFINFISFFSIITKINGNLLHN

SEQ ID NO: 2131745 - protein, 24 aa, Cryptosporidium hominis
KSCKYLIMLLNPWDLPIDCISEEF

SEQ ID NO: 2131746 - protein, 25 aa, Cryptosporidium hominis
KSDISILIGVNLLISPQAYIVFSKS

SEQ ID NO: 2131747 - protein, 31 aa, Cryptosporidium hominis
KSEEFKINLYVRYLLLIKLIEHFKVKRILSP

SEQ ID NO: 2131748 - protein, 25 aa, Cryptosporidium hominis
KSEILRIYSTLPSELYYLSKNVYYS

SEQ ID NO: 2131749 - protein, 26 aa, Cryptosporidium hominis
KSFIMGNLIIILFEDSTIKVLKILKS

SEQ ID NO: 2131750 - protein, 17 aa, Cryptosporidium hominis
KSFLVLGASFFINKDVI

SEQ ID NO: 2131751 - protein, 33 aa, Cryptosporidium hominis
KSFSGFSIHPFLLQLLFDFIKLYNIEEIIKGKS

SEQ ID NO: 2131752 - protein, 34 aa, Cryptosporidium hominis
KSIKRNWNFTPEPLWILCFMYGTFIALTDSYTLS

SEQ ID NO: 2131753 - protein, 38 aa, Cryptosporidium hominis
KSINSKMIIILVALFIFFALYNHYYYFFHEPNFCNSNI

SEQ ID NO: 2131754 - protein, 17 aa, Cryptosporidium hominis
KSIYYNYNHNLLSLLFG

SEQ ID NO: 2131755 - protein, 23 aa, Cryptosporidium hominis
KSKILPILTAFGAGAFIALALVH

SEQ ID NO: 2131756 - protein, 24 aa, Cryptosporidium hominis
KSKIPIFYHILEEINIIKIRLPIL

SEQ ID NO: 2131757 - protein, 33 aa, Cryptosporidium hominis
KSKITILLILIFYLFLLLIIYKNILNRWNILIM

SEQ ID NO: 2131758 - protein, 24 aa, Cryptosporidium hominis
KSKLSLIIWMFISSIFTISQPLVD

SEQ ID NO: 2131759 - protein, 24 aa, Cryptosporidium hominis
KSKSFEFFVTLYKKNLLTNEELQI

SEQ ID NO: 2131760 - protein, 24 aa, Cryptosporidium hominis
KSKSPGLFLLTFLVCLLTSSVAVL

SEQ ID NO: 2131761 - protein, 42 aa, Cryptosporidium hominis
KSKWSIYRLVFIYSFLLIIYQFLDILLKFSIIYLLIQMSFWP

SEQ ID NO: 2131762 - protein, 19 aa, Cryptosporidium hominis
KSLNAFIFRNLFLKNNKFD

SEQ ID NO: 2131763 - protein, 51 aa, Cryptosporidium hominis
KSLREKKLLWTFRILSGILLLFYFIIGWLGTFYPPLYWPNPIGVISFSDGA

SEQ ID NO: 2131764 - protein, 22 aa, Cryptosporidium hominis
KSNDMEFIHNLILKTVYGITYS

SEQ ID NO: 2131765 - protein, 25 aa, Cryptosporidium hominis
KSNIPEVPALYFIKPTEENIDKLCD

SEQ ID NO: 2131766 - protein, 22 aa, Cryptosporidium hominis
KSNLRALWGILQCNLLKNDAYN

SEQ ID NO: 2131767 - protein, 24 aa, Cryptosporidium hominis
KSNSLPWFKLQIFKLLKLKQENLK

SEQ ID NO: 2131768 - protein, 23 aa, Cryptosporidium hominis
KSNSLQYSLFKFAYCIILDIKSI

SEQ ID NO: 2131769 - protein, 23 aa, Cryptosporidium hominis
KSNYMWSVLGIKLIRYFDFRIKN

SEQ ID NO: 2131770 - protein, 25 aa, Cryptosporidium hominis
KSPHRLFVFVVLAVTQIVPHFFFSQ

SEQ ID NO: 2131771 - protein, 23 aa, Cryptosporidium hominis
KSRERLFSLIKKTKPKGLFFLSG

SEQ ID NO: 2131772 - protein, 27 aa, Cryptosporidium hominis
KSRFLIENFVIHFYLDRKIIIDFLDPF

SEQ ID NO: 2131773 - protein, 24 aa, Cryptosporidium hominis
KSRKIVFMALINGKQHIFDFTKPH

SEQ ID NO: 2131774 - protein, 20 aa, Cryptosporidium hominis
KSSLFSAILRLFDPSFGAIL

SEQ ID NO: 2131775 - protein, 22 aa, Cryptosporidium hominis
KSSLLHFNGNISTPLYAMERIT

SEQ ID NO: 2131776 - protein, 24 aa, Cryptosporidium hominis
KSSLNNLFKYYWNKNDILEELFDF

SEQ ID NO: 2131777 - protein, 17 aa, Cryptosporidium hominis
KSSLYSNDLKKLVLILL

SEQ ID NO: 2131778 - protein, 36 aa, Cryptosporidium hominis
KSSRFTKRMLLISIPLLIQLLEAIFKFLTSENTTML

SEQ ID NO: 2131779 - protein, 30 aa, Cryptosporidium hominis
KSSRLHIFIFVGIGIIILLISSIILINSWN

SEQ ID NO: 2131780 - protein, 23 aa, Cryptosporidium hominis
KSTYLMSILIIKYIQIKVDNDSD

SEQ ID NO: 2131781 - protein, 25 aa, Cryptosporidium hominis
KSVIFTLLWKLFLRMTKKTSLFLFQ

SEQ ID NO: 2131782 - protein, 20 aa, Cryptosporidium hominis
KSVILTFDLSSEDLFSKISL

SEQ ID NO: 2131783 - protein, 26 aa, Cryptosporidium hominis
KSVLIFLIVTIFYGYQIKLLECATTN

SEQ ID NO: 2131784 - protein, 17 aa, Cryptosporidium hominis
KSVLPILRIVILAVWDP

SEQ ID NO: 2131785 - protein, 18 aa, Cryptosporidium hominis
KSYLALKLPEKFTQPSNS

SEQ ID NO: 2131786 - protein, 17 aa, Cryptosporidium hominis
KSYLLKKKKLEDLSPIY

SEQ ID NO: 2131787 - protein, 23 aa, Cryptosporidium hominis
KSYNWCDRLVFHNCIGFELESME

SEQ ID NO: 2131788 - protein, 26 aa, Cryptosporidium hominis
KTAIISLFSLLFFPICIPSGCFNWVG

SEQ ID NO: 2131789 - protein, 24 aa, Cryptosporidium hominis
KTFTNLLHNSFFLDMFMLNHRNVK

SEQ ID NO: 2131790 - protein, 19 aa, Cryptosporidium hominis
KTILNFCTTFQRVAIVYKE

SEQ ID NO: 2131791 - protein, 20 aa, Cryptosporidium hominis
KTIPYYVAQSQANTLQLHSG

SEQ ID NO: 2131792 - protein, 46 aa, Cryptosporidium hominis
KTIQIFKKIIIFLKDLIINIFIEKIVGSIFYLLFKDCRGIVLSSFD

SEQ ID NO: 2131793 - protein, 22 aa, Cryptosporidium hominis
KTKPKGLFFLSGDVHWGQIFES

SEQ ID NO: 2131794 - protein, 17 aa, Cryptosporidium hominis
KTKYPWYDYLAVIVITI

SEQ ID NO: 2131795 - protein, 24 aa, Cryptosporidium hominis
KTLPLHQQYVIMGIILAIIDEQIQ

SEQ ID NO: 2131796 - protein, 25 aa, Cryptosporidium hominis
KTNINYFDKLPKFDYKWTISKNISE

SEQ ID NO: 2131797 - protein, 35 aa, Cryptosporidium hominis
KTNSIQMFTRKMIVLFLFAGFLGLFPGSFFHNQTP

SEQ ID NO: 2131798 - protein, 20 aa, Cryptosporidium hominis
KTRNALILGLGGGILASILR

SEQ ID NO: 2131799 - protein, 41 aa, Cryptosporidium hominis
KTSFPGIIFAFLQLEKNWIIDFLLLKRLLYHRMNPFNIIYR

SEQ ID NO: 2131800 - protein, 40 aa, Cryptosporidium hominis
KTSYWALILAQFDDLLVRILLGAALMSFFFALIGDNAYEE

SEQ ID NO: 2131801 - protein, 27 aa, Cryptosporidium hominis
KTTNNIKFMCINNPIYCIHNNEYKCYT

SEQ ID NO: 2131802 - protein, 18 aa, Cryptosporidium hominis
KTVYVWPRNASGLFKSLF

SEQ ID NO: 2131803 - protein, 28 aa, Cryptosporidium hominis
KTYHKYLLGYLFGIHRWYKYLTGDLSIH

SEQ ID NO: 2131804 - protein, 24 aa, Cryptosporidium hominis
KVELSTIKPFKLIKKPKIESLQID

SEQ ID NO: 2131805 - protein, 26 aa, Cryptosporidium hominis
KVESSPSPYLHWTLKEIYDQPHALAR

SEQ ID NO: 2131806 - protein, 17 aa, Cryptosporidium hominis
KVFFDVLQTLATLSLRS

SEQ ID NO: 2131807 - protein, 32 aa, Cryptosporidium hominis
KVFKRMVSIVLWFFSSLFILIIIGINVNTLVI

SEQ ID NO: 2131808 - protein, 25 aa, Cryptosporidium hominis
KVGRVKCWIPNQSIELPLRRALQIR

SEQ ID NO: 2131809 - protein, 25 aa, Cryptosporidium hominis
KVIDRYLDFVSLSPTKFSLGMDKVY

SEQ ID NO: 2131810 - protein, 30 aa, Cryptosporidium hominis
KVIFKHRMLFVSFLVLGLALVTYILIGSYR

SEQ ID NO: 2131811 - protein, 29 aa, Cryptosporidium hominis
KVIFKTFYLRIINILLFKLIYDIIQMCRP

SEQ ID NO: 2131812 - protein, 19 aa, Cryptosporidium hominis
KVIPKILLKFFPDLENINL

SEQ ID NO: 2131813 - protein, 21 aa, Cryptosporidium hominis
KVKLPKLLRRVSGRRQIQYNN

SEQ ID NO: 2131814 - protein, 25 aa, Cryptosporidium hominis
KVLIYSIFLVLISSLLFSIYIGKFN

SEQ ID NO: 2131815 - protein, 24 aa, Cryptosporidium hominis
KVLNIPLDKVALYDLYPLAVIRKY

SEQ ID NO: 2131816 - protein, 30 aa, Cryptosporidium hominis
KVLSFIYYTWFMFGFYWILSVRPNVEAFSG

SEQ ID NO: 2131817 - protein, 32 aa, Cryptosporidium hominis
KVLTNPIFFEVYFKELFYVPYSILSFGTCINQ

SEQ ID NO: 2131818 - protein, 33 aa, Cryptosporidium hominis
KVLVSTWFLAQLGLLFLIFSEPSLITCFFKINC

SEQ ID NO: 2131819 - protein, 25 aa, Cryptosporidium hominis
KVLVVAKLLSILGFGTNYGLVNADK

SEQ ID NO: 2131820 - protein, 23 aa, Cryptosporidium hominis
KVNCAVLLIMDIFTKVTSLDLPN

SEQ ID NO: 2131821 - protein, 24 aa, Cryptosporidium hominis
KVNIDKFWITRDASILPLITETIK

SEQ ID NO: 2131822 - protein, 27 aa, Cryptosporidium hominis
KVNSILSYFLRLLKVLLTRESKNYFNE

SEQ ID NO: 2131823 - protein, 23 aa, Cryptosporidium hominis
KVPLPVIVFISIISIWIINQVIN

SEQ ID NO: 2131824 - protein, 27 aa, Cryptosporidium hominis
KVRAIIVFLFLVFSIFLATNLQDLLLL

SEQ ID NO: 2131825 - protein, 18 aa, Cryptosporidium hominis
KVRLPLSVVLFGYGIMMD

SEQ ID NO: 2131826 - protein, 22 aa, Cryptosporidium hominis
KVRSVYWRIYNNLYIGSQDSLV

SEQ ID NO: 2131827 - protein, 24 aa, Cryptosporidium hominis
KVTFAICLLVWSCILFIACGTVAD

SEQ ID NO: 2131828 - protein, 31 aa, Cryptosporidium hominis
KVTFPILFGALLVLFFFSSYGIIGLILLGDY

SEQ ID NO: 2131829 - protein, 25 aa, Cryptosporidium hominis
KVYGNWIPRTFFGYGTTLFSYIRII

SEQ ID NO: 2131830 - protein, 27 aa, Cryptosporidium hominis
KWGAKLMTWLITAVVIITILSLLIKLF

SEQ ID NO: 2131831 - protein, 33 aa, Cryptosporidium hominis
KYFIKLLKMRSIDSIFWMIAFIGTVTAGITYGI

SEQ ID NO: 2131832 - protein, 26 aa, Cryptosporidium hominis
KYFIPGFFILYFIQPFSYYISSEYPI

SEQ ID NO: 2131833 - protein, 31 aa, Cryptosporidium hominis
KYFLLLHIDTFPFRIFPDYPSGIRKPVIEAL

SEQ ID NO: 2131834 - protein, 21 aa, Cryptosporidium hominis
KYGLLALAYILTIVKCQRKIP

SEQ ID NO: 2131835 - protein, 34 aa, Cryptosporidium hominis
KYITLALLISVPWMFFPKPLYLIYKSRKQKKASE

SEQ ID NO: 2131836 - protein, 25 aa, Cryptosporidium hominis
KYLILLCYALNIFLSLVFCQELTSI

SEQ ID NO: 2131837 - protein, 20 aa, Cryptosporidium hominis
KYLLLFFGSRMGLAAEVLLA

SEQ ID NO: 2131838 - protein, 30 aa, Cryptosporidium hominis
KYNQCISTILLIPCIFLARELELIMGSAAF

SEQ ID NO: 2131839 - protein, 22 aa, Cryptosporidium hominis
KYSFNILVFLFIQIIQRNSRNI

SEQ ID NO: 2131840 - protein, 19 aa, Cryptosporidium hominis
KYTIFHYLKHFFTIIWNHS

SEQ ID NO: 2131841 - protein, 27 aa, Cryptosporidium hominis
KYVQMWSILFFFIPMFGTGEVIPAFTT

SEQ ID NO: 2131842 - protein, 23 aa, Cryptosporidium hominis
KYYLDLLFLLPIIYNFLSIPNRT

SEQ ID NO: 2131843 - protein, 22 aa, Cryptosporidium hominis
LAAIYMYRFICQSNLVCGYILG

SEQ ID NO: 2131844 - protein, 23 aa, Cryptosporidium hominis
LAAYLLLCFVIGNGLGPLILFSN

SEQ ID NO: 2131845 - protein, 30 aa, Cryptosporidium hominis
LAFQEWVEGIGILFIVLINASLATYMENNA

SEQ ID NO: 2131846 - protein, 17 aa, Cryptosporidium hominis
LAFTNYLLERDSENSPI

SEQ ID NO: 2131847 - protein, 19 aa, Cryptosporidium hominis
LAIFFAFSALIFPFGLNLR

SEQ ID NO: 2131848 - protein, 22 aa, Cryptosporidium hominis
LAILILNSLLILATFFTIFFLN

SEQ ID NO: 2131849 - protein, 21 aa, Cryptosporidium hominis
LAIVISLYIISISSVVLIIEV

SEQ ID NO: 2131850 - protein, 23 aa, Cryptosporidium hominis
LAKRHFPELISTILLRCCSTLGY

SEQ ID NO: 2131851 - protein, 17 aa, Cryptosporidium hominis
LALFLVFKLILNPFSDH

SEQ ID NO: 2131852 - protein, 17 aa, Cryptosporidium hominis
LALISHISAHIGSLLAW

SEQ ID NO: 2131853 - protein, 21 aa, Cryptosporidium hominis
LALVLFNTGLLPYFLESLNKE

SEQ ID NO: 2131854 - protein, 27 aa, Cryptosporidium hominis
LASLWFGSYIHITNLKRLPTDGWMLLG

SEQ ID NO: 2131855 - protein, 20 aa, Cryptosporidium hominis
LASSKLYRFAKISTSSIILS

SEQ ID NO: 2131856 - protein, 17 aa, Cryptosporidium hominis
LAYILTIVKCQRKIPEY

SEQ ID NO: 2131857 - protein, 27 aa, Cryptosporidium hominis
LCDDLRNLYYESYYVNFISPCTDKLLE

SEQ ID NO: 2131858 - protein, 20 aa, Cryptosporidium hominis
LCDSKMVPPQPLFPELKRVQ

SEQ ID NO: 2131859 - protein, 53 aa, Cryptosporidium hominis
LCFDTILYDLTFLPINSMIALLKLFLLIFLNITNIFMFLITGKSTYFQNDSII

SEQ ID NO: 2131860 - protein, 18 aa, Cryptosporidium hominis
LCHLTFQFLFLSSNTYKK

SEQ ID NO: 2131861 - protein, 19 aa, Cryptosporidium hominis
LCLPLISIYEFGSSDFYFK

SEQ ID NO: 2131862 - protein, 20 aa, Cryptosporidium hominis
LCVKQWHAIIRQFMDLKFHQ

SEQ ID NO: 2131863 - protein, 24 aa, Cryptosporidium hominis
LCVQSLENIWRKKSFRRMVNEHIQ

SEQ ID NO: 2131864 - protein, 25 aa, Cryptosporidium hominis
LDAVARIWDLFFLEGVDLIFKISIA

SEQ ID NO: 2131865 - protein, 20 aa, Cryptosporidium hominis
LDCLFCIPLFLIVLSDLIPA

SEQ ID NO: 2131866 - protein, 23 aa, Cryptosporidium hominis
LDDYRYKLSLPELLRLLIIMIES

SEQ ID NO: 2131867 - protein, 25 aa, Cryptosporidium hominis
LDEIKYQILIDKLNPMYITEKKYYE

SEQ ID NO: 2131868 - protein, 24 aa, Cryptosporidium hominis
LDEKLVYFPSYFRNNIISQRLEFF

SEQ ID NO: 2131869 - protein, 25 aa, Cryptosporidium hominis
LDESMLIERWKWVLAIFAIHNIIGG

SEQ ID NO: 2131870 - protein, 19 aa, Cryptosporidium hominis
LDFYGDLHILLTPPPHVFA

SEQ ID NO: 2131871 - protein, 18 aa, Cryptosporidium hominis
LDHPNIMKLYDFFEDKRN

SEQ ID NO: 2131872 - protein, 21 aa, Cryptosporidium hominis
LDIFIAKFFIAVSMVFSFPIQ

SEQ ID NO: 2131873 - protein, 20 aa, Cryptosporidium hominis
LDLCLRILHIFKYESVVIVD

SEQ ID NO: 2131874 - protein, 18 aa, Cryptosporidium hominis
LDLPYLYNSSRSGYYSHW

SEQ ID NO: 2131875 - protein, 27 aa, Cryptosporidium hominis
LDMAHNNWLIFYPIRCLSSTFKIMLHI

SEQ ID NO: 2131876 - protein, 22 aa, Cryptosporidium hominis
LDMITWYSQTCLKNLIFKENLQ

SEQ ID NO: 2131877 - protein, 18 aa, Cryptosporidium hominis
LDPFLKEWKNPDIQALFL

SEQ ID NO: 2131878 - protein, 32 aa, Cryptosporidium hominis
LDPGLKPLAFLPDHALIPIRHVGPYGAHSNST

SEQ ID NO: 2131879 - protein, 17 aa, Cryptosporidium hominis
LDRDYKFSKINTLQLLE

SEQ ID NO: 2131880 - protein, 33 aa, Cryptosporidium hominis
LDRTNALQWYIAWTWFVDLILSISTCSFENSNL

SEQ ID NO: 2131881 - protein, 20 aa, Cryptosporidium hominis
LDSINNRIPCMAFDIIMHTV

SEQ ID NO: 2131882 - protein, 23 aa, Cryptosporidium hominis
LDSLPIWVSPILHRQIKRVNSQL

SEQ ID NO: 2131883 - protein, 47 aa, Cryptosporidium hominis
LDTYMKYIFSYKKLTLFKLLIFVSLLVAIYVLITFFIGIWLENANEE

SEQ ID NO: 2131884 - protein, 25 aa, Cryptosporidium hominis
LDVIKHVIQLILIVAPTLDPGNEDY

SEQ ID NO: 2131885 - protein, 18 aa, Cryptosporidium hominis
LDYFIEIYKDLYSEPLNV

SEQ ID NO: 2131886 - protein, 20 aa, Cryptosporidium hominis
LDYMPFFVRQCISVTTAFVR

SEQ ID NO: 2131887 - protein, 25 aa, Cryptosporidium hominis
LDYSIAFILCKIICELSQHGFLHIG

SEQ ID NO: 2131888 - protein, 22 aa, Cryptosporidium hominis
LEENNEILLHLSNGLAKCAQSL

SEQ ID NO: 2131889 - protein, 21 aa, Cryptosporidium hominis
LEEVAVLKLLDHPNIMKLYDF

SEQ ID NO: 2131890 - protein, 25 aa, Cryptosporidium hominis
LEEYSITLFWILKLDKQISEPFDDF

SEQ ID NO: 2131891 - protein, 21 aa, Cryptosporidium hominis
LEFYLKIERIWKRSFIEDEKI

SEQ ID NO: 2131892 - protein, 23 aa, Cryptosporidium hominis
LEIFEVMQFIYKIPIMVFEMNQD

SEQ ID NO: 2131893 - protein, 26 aa, Cryptosporidium hominis
LEIIPYALPIIPFKQVWDFAQTTMIQ

SEQ ID NO: 2131894 - protein, 26 aa, Cryptosporidium hominis
LEIRTPFYLFILHTLRQHGVEYFLPE

SEQ ID NO: 2131895 - protein, 19 aa, Cryptosporidium hominis
LEISFYWNRPEAWEYPKNT

SEQ ID NO: 2131896 - protein, 28 aa, Cryptosporidium hominis
LEITQYIYKPWMGFLYLEADNNNSSEII

SEQ ID NO: 2131897 - protein, 26 aa, Cryptosporidium hominis
LEKAFKFLTGCDLNLLYLINTRISTI

SEQ ID NO: 2131898 - protein, 25 aa, Cryptosporidium hominis
LEKVEYRWNFLINILDFVDKNEGNK

SEQ ID NO: 2131899 - protein, 31 aa, Cryptosporidium hominis
LELDFVDPWKSLISMILYDPVRRSSLKFDET

SEQ ID NO: 2131900 - protein, 35 aa, Cryptosporidium hominis
LELFSSFRDRIFPYLLTIIVFSASIELPPAPLNSM

SEQ ID NO: 2131901 - protein, 17 aa, Cryptosporidium hominis
LELGTLSSTLLSSAMMI

SEQ ID NO: 2131902 - protein, 23 aa, Cryptosporidium hominis
LELPIYINILFITITSLLLTQIF

SEQ ID NO: 2131903 - protein, 18 aa, Cryptosporidium hominis
LELPLLYECDWNLVMRAR

SEQ ID NO: 2131904 - protein, 28 aa, Cryptosporidium hominis
LELTTVILGFFIFLIPTGYAQSKVIKGS

SEQ ID NO: 2131905 - protein, 26 aa, Cryptosporidium hominis
LEMFHASLTFRIIYYYGGGAADFLQS

SEQ ID NO: 2131906 - protein, 25 aa, Cryptosporidium hominis
LENDKLRVVLSLLLHERHGQNLNQQ

SEQ ID NO: 2131907 - protein, 23 aa, Cryptosporidium hominis
LEPDGWAFLKPPFKKKYVHNIPN

SEQ ID NO: 2131908 - protein, 32 aa, Cryptosporidium hominis
LEQKKLDFFVKYLLEYILINQALNIKKKGFLA

SEQ ID NO: 2131909 - protein, 18 aa, Cryptosporidium hominis
LERVIYKFKNQHGRLGYF

SEQ ID NO: 2131910 - protein, 27 aa, Cryptosporidium hominis
LESERNLLFLRSLSVFGLLLNSMDSAT

SEQ ID NO: 2131911 - protein, 23 aa, Cryptosporidium hominis
LESGIAGLFLLSLPINDPFQRKR

SEQ ID NO: 2131912 - protein, 36 aa, Cryptosporidium hominis
LESNKIIFDLLCDLYYILDWNLNKGVLFPTLIQFLM

SEQ ID NO: 2131913 - protein, 25 aa, Cryptosporidium hominis
LESSFFYIYVSLFSPLLRPLIFEGQ

SEQ ID NO: 2131914 - protein, 26 aa, Cryptosporidium hominis
LEVIFSIISFLFLRSFEDIKYYYNKL

SEQ ID NO: 2131915 - protein, 33 aa, Cryptosporidium hominis
LEVRIPRVVIITFVFIIWIRRTNQQVINACTIG

SEQ ID NO: 2131916 - protein, 20 aa, Cryptosporidium hominis
LEVTPMRLLTRYLGNNSNSI

SEQ ID NO: 2131917 - protein, 19 aa, Cryptosporidium hominis
LEWLGKATHWSRFSTAASL

SEQ ID NO: 2131918 - protein, 28 aa, Cryptosporidium hominis
LEYIVSLISILIFLIKIKLNIRRISIPK

SEQ ID NO: 2131919 - protein, 27 aa, Cryptosporidium hominis
LEYKKEAHIIFMFRQYYKLYNTLLKDG

SEQ ID NO: 2131920 - protein, 33 aa, Cryptosporidium hominis
LEYLKDEYFLSALYFLLVLPFATKSKVSELDFL

SEQ ID NO: 2131921 - protein, 25 aa, Cryptosporidium hominis
LEYLLNFSMLLCFDTILYDLTFLPI

SEQ ID NO: 2131922 - protein, 19 aa, Cryptosporidium hominis
LFAALIPLKNTFFGDLPIC

SEQ ID NO: 2131923 - protein, 25 aa, Cryptosporidium hominis
LFCSNTVCYFLPAVLHLKLFSDSPW

SEQ ID NO: 2131924 - protein, 19 aa, Cryptosporidium hominis
LFCTIYFAVSLSIAGSPLS

SEQ ID NO: 2131925 - protein, 20 aa, Cryptosporidium hominis
LFCVPLNILLPALFHFIIFR

SEQ ID NO: 2131926 - protein, 22 aa, Cryptosporidium hominis
LFDGVILGIYLCMVVGIGLPLM

SEQ ID NO: 2131927 - protein, 19 aa, Cryptosporidium hominis
LFELIFRATAQDVILESEE

SEQ ID NO: 2131928 - protein, 18 aa, Cryptosporidium hominis
LFFIYLSNEKYQTGGFSF

SEQ ID NO: 2131929 - protein, 17 aa, Cryptosporidium hominis
LFFSFIQTFVTLFIFHL

SEQ ID NO: 2131930 - protein, 20 aa, Cryptosporidium hominis
LFGILLMILDVPGSPRWSAR

SEQ ID NO: 2131931 - protein, 19 aa, Cryptosporidium hominis
LFGSIFRNLIRVLPIAVIS

SEQ ID NO: 2131932 - protein, 19 aa, Cryptosporidium hominis
LFHGDSPLIWIYRLRESFS

SEQ ID NO: 2131933 - protein, 24 aa, Cryptosporidium hominis
LFKSKIHRFFSHQLMMFCFENWGY

SEQ ID NO: 2131934 - protein, 17 aa, Cryptosporidium hominis
LFLLYFQKRANKLKNNV

SEQ ID NO: 2131935 - protein, 18 aa, Cryptosporidium hominis
LFLVQISYIKVGYGLNVE

SEQ ID NO: 2131936 - protein, 17 aa, Cryptosporidium hominis
LFLYFKFQNGIITTISV

SEQ ID NO: 2131937 - protein, 29 aa, Cryptosporidium hominis
LFPNNVLVSSFFFVKACFLFVSAIGRVHS

SEQ ID NO: 2131938 - protein, 18 aa, Cryptosporidium hominis
LFQETLYYELYNNPESNY

SEQ ID NO: 2131939 - protein, 20 aa, Cryptosporidium hominis
LFQVLFKVLAFLSFIFGPFF

SEQ ID NO: 2131940 - protein, 25 aa, Cryptosporidium hominis
LFQYIYVTILLGISLIFVCAEEVQN

SEQ ID NO: 2131941 - protein, 19 aa, Cryptosporidium hominis
LFRMFFGGMPAEVSFNRQR

SEQ ID NO: 2131942 - protein, 17 aa, Cryptosporidium hominis
LFSAVLIINIVEYMLCF

SEQ ID NO: 2131943 - protein, 29 aa, Cryptosporidium hominis
LFSCILNVRLLFFIFIVVNAANNSDQCIN

SEQ ID NO: 2131944 - protein, 29 aa, Cryptosporidium hominis
LFSGSFCAIFWLKKRGLMPGLTFSNELIS

SEQ ID NO: 2131945 - protein, 25 aa, Cryptosporidium hominis
LFSPKIAIILFLIGGVFHAVFAAFF

SEQ ID NO: 2131946 - protein, 24 aa, Cryptosporidium hominis
LFTIEKIITLIPILQDIAELDDVY

SEQ ID NO: 2131947 - protein, 46 aa, Cryptosporidium hominis
LFTLKAPLYFQLLPARLLITYILFWYSIPFLVFANNYNLGKSQNNQ

SEQ ID NO: 2131948 - protein, 19 aa, Cryptosporidium hominis
LFTNWTYFDHSFSFLSNYF

SEQ ID NO: 2131949 - protein, 17 aa, Cryptosporidium hominis
LFTPKYTHYASCALFFI

SEQ ID NO: 2131950 - protein, 19 aa, Cryptosporidium hominis
LFVASMLILIFGEALAIYG

SEQ ID NO: 2131951 - protein, 17 aa, Cryptosporidium hominis
LFVLFADERQISLNQQS

SEQ ID NO: 2131952 - protein, 19 aa, Cryptosporidium hominis
LFVLGILYRIFACITFALF

SEQ ID NO: 2131953 - protein, 20 aa, Cryptosporidium hominis
LFVVPFSVIVGWLLGKPMTL

SEQ ID NO: 2131954 - protein, 17 aa, Cryptosporidium hominis
LFYRSISLFYTSAVIYR

SEQ ID NO: 2131955 - protein, 21 aa, Cryptosporidium hominis
LGCDFFTYDMMNRVCLFKAAK

SEQ ID NO: 2131956 - protein, 26 aa, Cryptosporidium hominis
LGEISRLLIINFLKNKTPEIFFQKNS

SEQ ID NO: 2131957 - protein, 37 aa, Cryptosporidium hominis
LGFNSIISKVFILKEGLSIPYFPSNFYYIEQVHVSRL

SEQ ID NO: 2131958 - protein, 20 aa, Cryptosporidium hominis
LGFTIYSVIIKLSEKFESEI

SEQ ID NO: 2131959 - protein, 21 aa, Cryptosporidium hominis
LGGIFLLLVAFIAYAQRYRKL

SEQ ID NO: 2131960 - protein, 20 aa, Cryptosporidium hominis
LGIFLFMIHNFVPDSCLYQF

SEQ ID NO: 2131961 - protein, 22 aa, Cryptosporidium hominis
LGIKLIRYFDFRIKNGLLYDCK

SEQ ID NO: 2131962 - protein, 26 aa, Cryptosporidium hominis
LGIQYFDPIFLSKLKCKLNLHSNFHK

SEQ ID NO: 2131963 - protein, 22 aa, Cryptosporidium hominis
LGKERIPLYGPVLFVGNHMNQF

SEQ ID NO: 2131964 - protein, 24 aa, Cryptosporidium hominis
LGLQIFLKLIIYLIKWVKHNKFLL

SEQ ID NO: 2131965 - protein, 41 aa, Cryptosporidium hominis
LGLYHIFRISINIILFIWSSLLLRLSLWIRSFHTARDELYY

SEQ ID NO: 2131966 - protein, 21 aa, Cryptosporidium hominis
LGNFITWILFVSIVMKCIDNI

SEQ ID NO: 2131967 - protein, 28 aa, Cryptosporidium hominis
LGNVIILNPIIVKSSFPIRVDMVRDATQ

SEQ ID NO: 2131968 - protein, 26 aa, Cryptosporidium hominis
LGQRKPRFLPNLMMTIVFSTCTDLLA

SEQ ID NO: 2131969 - protein, 28 aa, Cryptosporidium hominis
LGRQRLRMILTLQQGILLLCFNEEKMFV

SEQ ID NO: 2131970 - protein, 31 aa, Cryptosporidium hominis
LGRSLTIVDLVIYISLYSYFESLKDQNQEYI

SEQ ID NO: 2131971 - protein, 33 aa, Cryptosporidium hominis
LGSELLSRALYILFLLKLVMLIGFGSYYFNKRK

SEQ ID NO: 2131972 - protein, 23 aa, Cryptosporidium hominis
LGSYPLSLWKLIFSEFTSVLNII

SEQ ID NO: 2131973 - protein, 24 aa, Cryptosporidium hominis
LGTILSFAVALPGWLRYSIFTVGE

SEQ ID NO: 2131974 - protein, 19 aa, Cryptosporidium hominis
LGVGVVGSVLYIPISLMRA

SEQ ID NO: 2131975 - protein, 36 aa, Cryptosporidium hominis
LGWRGPFYIFGLIGVIWSIVWLFLDVKTLSWTNKPR

SEQ ID NO: 2131976 - protein, 25 aa, Cryptosporidium hominis
LGYFKSIFRITKELKLFYIALQETF

SEQ ID NO: 2131977 - protein, 23 aa, Cryptosporidium hominis
LHDRVFYILCALLALYVALESIC

SEQ ID NO: 2131978 - protein, 18 aa, Cryptosporidium hominis
LHFPLFMAAITFIWAVSD

SEQ ID NO: 2131979 - protein, 17 aa, Cryptosporidium hominis
LHIVWIVFYLSPENSRQ

SEQ ID NO: 2131980 - protein, 17 aa, Cryptosporidium hominis
LHPINILRLGSLWQGIF

SEQ ID NO: 2131981 - protein, 20 aa, Cryptosporidium hominis
LHTHYPHFIPNISERKLYTE

SEQ ID NO: 2131982 - protein, 31 aa, Cryptosporidium hominis
LHYSTKRFGFILLIYCPILINHYFAELIKLK

SEQ ID NO: 2131983 - protein, 19 aa, Cryptosporidium hominis
LICIRFLCNMFHNSTNREA

SEQ ID NO: 2131984 - protein, 25 aa, Cryptosporidium hominis
LICLQTFKIFLDSHFNFLIAKMSLN

SEQ ID NO: 2131985 - protein, 18 aa, Cryptosporidium hominis
LICRVPIQCKLTINQTFN

SEQ ID NO: 2131986 - protein, 17 aa, Cryptosporidium hominis
LIEFLTEFYLGIGSTFE

SEQ ID NO: 2131987 - protein, 19 aa, Cryptosporidium hominis
LIELIAFSRIYNFKVMVYK

SEQ ID NO: 2131988 - protein, 20 aa, Cryptosporidium hominis
LIFGMLNYTLYILISFGDPG

SEQ ID NO: 2131989 - protein, 17 aa, Cryptosporidium hominis
LIFIPLALPIITFSLAG

SEQ ID NO: 2131990 - protein, 26 aa, Cryptosporidium hominis
LIFVYLFVILQIYIKFEFAGANSVGK

SEQ ID NO: 2131991 - protein, 32 aa, Cryptosporidium hominis
LIGIQCFIFLIFLILVIYNFYRKRLLRKRLMN

SEQ ID NO: 2131992 - protein, 19 aa, Cryptosporidium hominis
LIGRLTWAITLIPITIIDD

SEQ ID NO: 2131993 - protein, 26 aa, Cryptosporidium hominis
LIGTILFTIFVLILPTITAFYINFLF

SEQ ID NO: 2131994 - protein, 18 aa, Cryptosporidium hominis
LIIHHLGFISSKMSVIPL

SEQ ID NO: 2131995 - protein, 19 aa, Cryptosporidium hominis
LIIIGLIGSSIYYFFIRYF

SEQ ID NO: 2131996 - protein, 26 aa, Cryptosporidium hominis
LIINCIFGILFILFKQGIIVRWINIF

SEQ ID NO: 2131997 - protein, 19 aa, Cryptosporidium hominis
LIIPFRMILVITMLTRTMG

SEQ ID NO: 2131998 - protein, 17 aa, Cryptosporidium hominis
LIISQLLVIYFLTSHLL

SEQ ID NO: 2131999 - protein, 19 aa, Cryptosporidium hominis
LIIVFNNFSPMDYIFNRIS

SEQ ID NO: 2132000 - protein, 25 aa, Cryptosporidium hominis
LIKDKNFIELLKFDQFLLEKKSDNE

SEQ ID NO: 2132001 - protein, 18 aa, Cryptosporidium hominis
LIKIVDFGLSAVFENQKK

SEQ ID NO: 2132002 - protein, 17 aa, Cryptosporidium hominis
LIKKYRVDFIISGHDHH

SEQ ID NO: 2132003 - protein, 18 aa, Cryptosporidium hominis
LIKMMRYYNWVPLKSLKL

SEQ ID NO: 2132004 - protein, 22 aa, Cryptosporidium hominis
LIKNIKFKNWEKIIFVIDNFNV

SEQ ID NO: 2132005 - protein, 18 aa, Cryptosporidium hominis
LIKPLDSFLDPKAFARFA

SEQ ID NO: 2132006 - protein, 27 aa, Cryptosporidium hominis
LILATFFTIFFLNIGYYRWGFSNGSNV

SEQ ID NO: 2132007 - protein, 19 aa, Cryptosporidium hominis
LILEDPFMPKALKEGFLGL

SEQ ID NO: 2132008 - protein, 26 aa, Cryptosporidium hominis
LILIGYSLALEYFCEAIYACILRVEG

SEQ ID NO: 2132009 - protein, 17 aa, Cryptosporidium hominis
LILISLIVKFYSTFVFS

SEQ ID NO: 2132010 - protein, 22 aa, Cryptosporidium hominis
LILLIFNINYSQGLGLRRNYNS

SEQ ID NO: 2132011 - protein, 17 aa, Cryptosporidium hominis
LIMLIKNPISHIVIQDV

SEQ ID NO: 2132012 - protein, 26 aa, Cryptosporidium hominis
LINVNKLLIRLLGINICFDTHFIYIL

SEQ ID NO: 2132013 - protein, 18 aa, Cryptosporidium hominis
LIQDSWGDYIFLDARKLN

SEQ ID NO: 2132014 - protein, 18 aa, Cryptosporidium hominis
LIQENIFSFSTIPVYITS

SEQ ID NO: 2132015 - protein, 25 aa, Cryptosporidium hominis
LIQIFNLICYFLDLKEEIILDKNLD

SEQ ID NO: 2132016 - protein, 23 aa, Cryptosporidium hominis
LIRGKPMILCPYRWTKLQNIIQK

SEQ ID NO: 2132017 - protein, 18 aa, Cryptosporidium hominis
LIRIPITTLTFILGLNVL

SEQ ID NO: 2132018 - protein, 24 aa, Cryptosporidium hominis
LISEPYLIPIFRSLSASIFSIIVL

SEQ ID NO: 2132019 - protein, 22 aa, Cryptosporidium hominis
LISILTFFIWIVISQIYEEIVC

SEQ ID NO: 2132020 - protein, 23 aa, Cryptosporidium hominis
LISIYVFIYRRPVISRLSRILKM

SEQ ID NO: 2132021 - protein, 17 aa, Cryptosporidium hominis
LISKSKLLLFILHTLRQ

SEQ ID NO: 2132022 - protein, 17 aa, Cryptosporidium hominis
LISNRSPLKSSLKDLLI

SEQ ID NO: 2132023 - protein, 17 aa, Cryptosporidium hominis
LISSIILINSWNKKRKN

SEQ ID NO: 2132024 - protein, 17 aa, Cryptosporidium hominis
LISSLLFFFLYNYSNLL

SEQ ID NO: 2132025 - protein, 29 aa, Cryptosporidium hominis
LISYLFLESYLLYLFGYSILYAIGNGLLF

SEQ ID NO: 2132026 - protein, 22 aa, Cryptosporidium hominis
LITFIQLILYIPMSCFGRIQSL

SEQ ID NO: 2132027 - protein, 27 aa, Cryptosporidium hominis
LITILEICLAFFKWTYLVRRDERMNLM

SEQ ID NO: 2132028 - protein, 30 aa, Cryptosporidium hominis
LITQILLWIFLFPYLLYNEKFKIIIMGQVF

SEQ ID NO: 2132029 - protein, 24 aa, Cryptosporidium hominis
LIVGVLLLLLDIPGQPRWSAKFRS

SEQ ID NO: 2132030 - protein, 20 aa, Cryptosporidium hominis
LIVRISHIVKLRKSIRADKS

SEQ ID NO: 2132031 - protein, 37 aa, Cryptosporidium hominis
LIVYNIIPLIYITLQFLISFVSFFYSKLRPIIAVYYF

SEQ ID NO: 2132032 - protein, 17 aa, Cryptosporidium hominis
LIYYRRILKYYFGDNFD

SEQ ID NO: 2132033 - protein, 24 aa, Cryptosporidium hominis
LKAIKTFFYIFRGLKSNIFSNIDH

SEQ ID NO: 2132034 - protein, 22 aa, Cryptosporidium hominis
LKHILKCKPFEWYIGKFRPAFE

SEQ ID NO: 2132035 - protein, 17 aa, Cryptosporidium hominis
LKHLNYLKYLSDPILQS

SEQ ID NO: 2132036 - protein, 25 aa, Cryptosporidium hominis
LKINKNFCQILKLIYNNVINKKWFE

SEQ ID NO: 2132037 - protein, 24 aa, Cryptosporidium hominis
LKINSFILILVISIFFSSLDATKK

SEQ ID NO: 2132038 - protein, 23 aa, Cryptosporidium hominis
LKIVKMLWGFLDPELFRFHEPTT

SEQ ID NO: 2132039 - protein, 22 aa, Cryptosporidium hominis
LKLALEMFLKEGLTHIPIVFEE

SEQ ID NO: 2132040 - protein, 31 aa, Cryptosporidium hominis
LKLRQRIIFSSLNILPRWISTRKIPGLIFNT

SEQ ID NO: 2132041 - protein, 26 aa, Cryptosporidium hominis
LKLSTLEYFFLKPDILDPLIYNSKKL

SEQ ID NO: 2132042 - protein, 31 aa, Cryptosporidium hominis
LKMSGIKMYFLSILVLFSWISIVIGGEGNLD

SEQ ID NO: 2132043 - protein, 25 aa, Cryptosporidium hominis
LKNDFDIELIRIVYSSLFTSPSIYG

SEQ ID NO: 2132044 - protein, 22 aa, Cryptosporidium hominis
LKPSNFIIFITSKAFFNNNNEY

SEQ ID NO: 2132045 - protein, 19 aa, Cryptosporidium hominis
LKQYRFFSIYALKCLKNQV

SEQ ID NO: 2132046 - protein, 27 aa, Cryptosporidium hominis
LKRIRLKHIFLIFIFTVLYVSCFLMEH

SEQ ID NO: 2132047 - protein, 26 aa, Cryptosporidium hominis
LKSSLKDLLILKNEYLKYISNFDICV

SEQ ID NO: 2132048 - protein, 18 aa, Cryptosporidium hominis
LKSYYKTASLFSFGGIAC

SEQ ID NO: 2132049 - protein, 18 aa, Cryptosporidium hominis
LKTKIIIGIILHIVLFII

SEQ ID NO: 2132050 - protein, 17 aa, Cryptosporidium hominis
LKVIFAKYDVGKTGFLN

SEQ ID NO: 2132051 - protein, 18 aa, Cryptosporidium hominis
LKYIFRSLQLIQEDHFFP

SEQ ID NO: 2132052 - protein, 29 aa, Cryptosporidium hominis
LKYVIGMLLGVFFGIWILSICFKGETKKQ

SEQ ID NO: 2132053 - protein, 17 aa, Cryptosporidium hominis
LLAIPAALSLSIMHIRS

SEQ ID NO: 2132054 - protein, 29 aa, Cryptosporidium hominis
LLARVFMLFYWILYPLFKLSIVPGRRLHI

SEQ ID NO: 2132055 - protein, 28 aa, Cryptosporidium hominis
LLCFNHNYWYNLMVCLIYLITDEAASIE

SEQ ID NO: 2132056 - protein, 25 aa, Cryptosporidium hominis
LLCKVSGIFMFLTIIFPDCKTIGSL

SEQ ID NO: 2132057 - protein, 18 aa, Cryptosporidium hominis
LLCYLFIHNPDITTSMIS

SEQ ID NO: 2132058 - protein, 17 aa, Cryptosporidium hominis
LLDTLIDILVNQTIWLT

SEQ ID NO: 2132059 - protein, 41 aa, Cryptosporidium hominis
LLEAFTSWSLVLFSIIICAFLFFLSILCFPHIFHIPELELA

SEQ ID NO: 2132060 - protein, 29 aa, Cryptosporidium hominis
LLEALLEVIPYEFLVIWINSHTISKEQYD

SEQ ID NO: 2132061 - protein, 21 aa, Cryptosporidium hominis
LLEILFRYICMKSVKKIFLSW

SEQ ID NO: 2132062 - protein, 17 aa, Cryptosporidium hominis
LLEWLREMKTFIPSNHF

SEQ ID NO: 2132063 - protein, 22 aa, Cryptosporidium hominis
LLFPLFLIIICISFPFTECERI

SEQ ID NO: 2132064 - protein, 31 aa, Cryptosporidium hominis
LLFTNLMFGFLCKLSRFLPFSSLVFQKIADN

SEQ ID NO: 2132065 - protein, 17 aa, Cryptosporidium hominis
LLFVPTFLVHCSNIIPK

SEQ ID NO: 2132066 - protein, 23 aa, Cryptosporidium hominis
LLGTEFWFDLHKMASYKDIINAI

SEQ ID NO: 2132067 - protein, 17 aa, Cryptosporidium hominis
LLHMRIKLQQKIRDLVY

SEQ ID NO: 2132068 - protein, 21 aa, Cryptosporidium hominis
LLIEKFHLSLFPIITYTTIED

SEQ ID NO: 2132069 - protein, 19 aa, Cryptosporidium hominis
LLIGIYYLPMEEICNLIEI

SEQ ID NO: 2132070 - protein, 17 aa, Cryptosporidium hominis
LLIGLLSPLILALSLTF

SEQ ID NO: 2132071 - protein, 17 aa, Cryptosporidium hominis
LLILYNPAWTIADPLCT

SEQ ID NO: 2132072 - protein, 25 aa, Cryptosporidium hominis
LLISIQIFISLTKPYPKLFSQVIQR

SEQ ID NO: 2132073 - protein, 20 aa, Cryptosporidium hominis
LLKAIWISCFLVSSSAFLVL

SEQ ID NO: 2132074 - protein, 25 aa, Cryptosporidium hominis
LLKECLIPLKDLLLKSFIALQDQAF

SEQ ID NO: 2132075 - protein, 25 aa, Cryptosporidium hominis
LLKNNSLIYYLIYSSNIISLFKNGS

SEQ ID NO: 2132076 - protein, 17 aa, Cryptosporidium hominis
LLLELGTLSSTLLSSAM

SEQ ID NO: 2132077 - protein, 26 aa, Cryptosporidium hominis
LLLELKQTFIKYYSLKGLVLSFKKKP

SEQ ID NO: 2132078 - protein, 25 aa, Cryptosporidium hominis
LLLGIKYYIREQILLELLEIEISLE

SEQ ID NO: 2132079 - protein, 17 aa, Cryptosporidium hominis
LLLLGLFTIFKNYISSV

SEQ ID NO: 2132080 - protein, 18 aa, Cryptosporidium hominis
LLLNTLLVLIYFVLGALS

SEQ ID NO: 2132081 - protein, 18 aa, Cryptosporidium hominis
LLLVLHANVSRIEDLLFI

SEQ ID NO: 2132082 - protein, 21 aa, Cryptosporidium hominis
LLNAILILGGLIRYLYLPNEI

SEQ ID NO: 2132083 - protein, 20 aa, Cryptosporidium hominis
LLNFVITIFLEIYIGLKSAN

SEQ ID NO: 2132084 - protein, 28 aa, Cryptosporidium hominis
LLNGLAFIYRYHGIKLRWDVTSGVSIGT

SEQ ID NO: 2132085 - protein, 20 aa, Cryptosporidium hominis
LLNLVYISSIFIAFLSLINS

SEQ ID NO: 2132086 - protein, 27 aa, Cryptosporidium hominis
LLPCLNALFWLFFISNGWLAMYSMHFL

SEQ ID NO: 2132087 - protein, 23 aa, Cryptosporidium hominis
LLPGFVYWLLIFVIKNFDKFELS

SEQ ID NO: 2132088 - protein, 27 aa, Cryptosporidium hominis
LLPRVIFIFVIPCLSLIIVANSLPWIP

SEQ ID NO: 2132089 - protein, 18 aa, Cryptosporidium hominis
LLQYVISVFLPKLSYSNK

SEQ ID NO: 2132090 - protein, 33 aa, Cryptosporidium hominis
LLRKASIYNILSKLYVKLPYSDLSNIILFCMKN

SEQ ID NO: 2132091 - protein, 27 aa, Cryptosporidium hominis
LLSFTYVLFLFFQLYTHINLFRDESVA

SEQ ID NO: 2132092 - protein, 36 aa, Cryptosporidium hominis
LLSNQKIIDIVYLLPLWFDLMRLPDKILRSKLLKHI

SEQ ID NO: 2132093 - protein, 20 aa, Cryptosporidium hominis
LLSSILIIISVVTYMCIFIP

SEQ ID NO: 2132094 - protein, 18 aa, Cryptosporidium hominis
LLSTMRFDWDTHYYLVDE

SEQ ID NO: 2132095 - protein, 18 aa, Cryptosporidium hominis
LLSVIVSAVFSAPAVPLR

SEQ ID NO: 2132096 - protein, 20 aa, Cryptosporidium hominis
LLTIFGFLCSLIAMLLTMMT

SEQ ID NO: 2132097 - protein, 25 aa, Cryptosporidium hominis
LLTSQFFYLFYFTLLTPMPRPKYSK

SEQ ID NO: 2132098 - protein, 18 aa, Cryptosporidium hominis
LLVLFISYYQVNSQDAYH

SEQ ID NO: 2132099 - protein, 20 aa, Cryptosporidium hominis
LLVLIILYNVFGNKGLFTFD

SEQ ID NO: 2132100 - protein, 23 aa, Cryptosporidium hominis
LLYACYFVILLQPLFEIYYIGAS

SEQ ID NO: 2132101 - protein, 22 aa, Cryptosporidium hominis
LLYGHKMIIIEYTMLKDVNDSE

SEQ ID NO: 2132102 - protein, 24 aa, Cryptosporidium hominis
LMGIYLFLVLFVASSLLILVLFAN

SEQ ID NO: 2132103 - protein, 24 aa, Cryptosporidium hominis
LMGTLNCIFGLISINLLAIVISLY

SEQ ID NO: 2132104 - protein, 25 aa, Cryptosporidium hominis
LMIEKRICLLDIALIQKHLLASSSN

SEQ ID NO: 2132105 - protein, 20 aa, Cryptosporidium hominis
LMLEFINSYLFLGANKFYLY

SEQ ID NO: 2132106 - protein, 17 aa, Cryptosporidium hominis
LMNWVRLSSMKQLPLSL

SEQ ID NO: 2132107 - protein, 21 aa, Cryptosporidium hominis
LMSLRIFGILLNNINVDRELS

SEQ ID NO: 2132108 - protein, 39 aa, Cryptosporidium hominis
LMSMNALIGLILTFIGGFYAPLYMGLEDINSRIFIGIAC

SEQ ID NO: 2132109 - protein, 24 aa, Cryptosporidium hominis
LMSSAEWLLLFSNKSKQLLCIYSP

SEQ ID NO: 2132110 - protein, 19 aa, Cryptosporidium hominis
LMYDKYFLRGLTAFFSKDF

SEQ ID NO: 2132111 - protein, 33 aa, Cryptosporidium hominis
LMYQVKFVSIYLMFLMRNFWDQVLLNTDKSFAN

SEQ ID NO: 2132112 - protein, 28 aa, Cryptosporidium hominis
LMYYDDYCLMCFLIRPLINSLAARLRNT

SEQ ID NO: 2132113 - protein, 18 aa, Cryptosporidium hominis
LNDAYYNTYWLNESLKMT

SEQ ID NO: 2132114 - protein, 22 aa, Cryptosporidium hominis
LNDYRKYLENWADTVQVLLQGP

SEQ ID NO: 2132115 - protein, 17 aa, Cryptosporidium hominis
LNEKLRMKISILFASVL

SEQ ID NO: 2132116 - protein, 37 aa, Cryptosporidium hominis
LNGIKSFYIGSFLRALWLTIGGIIYFGCYQLCNSALE

SEQ ID NO: 2132117 - protein, 24 aa, Cryptosporidium hominis
LNGILRSLILTKFELLEKLSRFKI

SEQ ID NO: 2132118 - protein, 28 aa, Cryptosporidium hominis
LNHIMLWFGLIIFWAITQIYGKSPVEHG

SEQ ID NO: 2132119 - protein, 27 aa, Cryptosporidium hominis
LNHPSIFHLLKLIIGILFCQDQDHELF

SEQ ID NO: 2132120 - protein, 21 aa, Cryptosporidium hominis
LNIAFCYMPIVGSIKYHHLKV

SEQ ID NO: 2132121 - protein, 17 aa, Cryptosporidium hominis
LNIGIIDPERYYSLLLS

SEQ ID NO: 2132122 - protein, 26 aa, Cryptosporidium hominis
LNIILPIFLELFIIKNIYANNIEPNK

SEQ ID NO: 2132123 - protein, 18 aa, Cryptosporidium hominis
LNILERILIGQALELPVT

SEQ ID NO: 2132124 - protein, 19 aa, Cryptosporidium hominis
LNILVPCIFFVQGWLKALE

SEQ ID NO: 2132125 - protein, 18 aa, Cryptosporidium hominis
LNIRDLGRLYFYSGRLGV

SEQ ID NO: 2132126 - protein, 26 aa, Cryptosporidium hominis
LNKFNMTILDLFKLLDKNQTGSISSI

SEQ ID NO: 2132127 - protein, 25 aa, Cryptosporidium hominis
LNKGVLFPTLIQFLMNQKQFVKTLK

SEQ ID NO: 2132128 - protein, 22 aa, Cryptosporidium hominis
LNKKLIIFFEGRRVKGNKINLE

SEQ ID NO: 2132129 - protein, 25 aa, Cryptosporidium hominis
LNLISLLSLCSFLVITGLQGTIENN

SEQ ID NO: 2132130 - protein, 17 aa, Cryptosporidium hominis
LNLLKDPENLKKYVIKM

SEQ ID NO: 2132131 - protein, 27 aa, Cryptosporidium hominis
LNLNGKWNYIYSVDLFKLNSISWSKDG

SEQ ID NO: 2132132 - protein, 17 aa, Cryptosporidium hominis
LNNLIYMVLFLLQENFS

SEQ ID NO: 2132133 - protein, 33 aa, Cryptosporidium hominis
LNNQSMFCIFECFFEPLLYYKNKHNLPPNLPKL

SEQ ID NO: 2132134 - protein, 17 aa, Cryptosporidium hominis
LNNYLLPILNPVETNSY

SEQ ID NO: 2132135 - protein, 26 aa, Cryptosporidium hominis
LNPSTSIPVIPYFPDTIRLNYKNLSD

SEQ ID NO: 2132136 - protein, 23 aa, Cryptosporidium hominis
LNQQDLYLYSGLASGLMLVINTV

SEQ ID NO: 2132137 - protein, 30 aa, Cryptosporidium hominis
LNSKDYFEFPIQILFWFGYEDTRLIAYKIK

SEQ ID NO: 2132138 - protein, 24 aa, Cryptosporidium hominis
LNSLIDCILLPVNIWITWKLLSKQ

SEQ ID NO: 2132139 - protein, 23 aa, Cryptosporidium hominis
LNSRHRSGILNFIFMNRFANNVN

SEQ ID NO: 2132140 - protein, 21 aa, Cryptosporidium hominis
LNTKYIFFDYFTLVDLEKDEM

SEQ ID NO: 2132141 - protein, 24 aa, Cryptosporidium hominis
LNVLGWFLIYDYYQNLILFNNVKH

SEQ ID NO: 2132142 - protein, 23 aa, Cryptosporidium hominis
LNVYGFILSAFIALPVLVWGMFV

SEQ ID NO: 2132143 - protein, 19 aa, Cryptosporidium hominis
LNYKLIPNQVLIYSLFGIS

SEQ ID NO: 2132144 - protein, 25 aa, Cryptosporidium hominis
LNYQDSITPLLIWITNEIMNRIKHR

SEQ ID NO: 2132145 - protein, 18 aa, Cryptosporidium hominis
LPALIFSYASIVVQTPNR

SEQ ID NO: 2132146 - protein, 20 aa, Cryptosporidium hominis
LPFCCIYLYFCAFSALRSFI

SEQ ID NO: 2132147 - protein, 29 aa, Cryptosporidium hominis
LPGDDCIGGWLPPPVAIPCPSHAPTSSHA

SEQ ID NO: 2132148 - protein, 18 aa, Cryptosporidium hominis
LPIFHKLVTNNIKFNDQL

SEQ ID NO: 2132149 - protein, 18 aa, Cryptosporidium hominis
LPIIYPSDFWCIERNFKM

SEQ ID NO: 2132150 - protein, 21 aa, Cryptosporidium hominis
LPILRIVILAVWDPGKLHSSG

SEQ ID NO: 2132151 - protein, 25 aa, Cryptosporidium hominis
LPILTVFYGIFFSLAFMHGQNLNSK

SEQ ID NO: 2132152 - protein, 30 aa, Cryptosporidium hominis
LPKKSGYKFEYLWYPPISQGKLIDSVRYTI

SEQ ID NO: 2132153 - protein, 29 aa, Cryptosporidium hominis
LPKNLEIFSWWYRFILSTPSRVFNTGKTI

SEQ ID NO: 2132154 - protein, 18 aa, Cryptosporidium hominis
LPKNLLLHILYSLLSFDE

SEQ ID NO: 2132155 - protein, 20 aa, Cryptosporidium hominis
LPLHPYFILTSLIGKAFVPI

SEQ ID NO: 2132156 - protein, 23 aa, Cryptosporidium hominis
LPPLDTSMMFCPLTKIGMSQSLL

SEQ ID NO: 2132157 - protein, 20 aa, Cryptosporidium hominis
LPSELLISQGFLRNQKNSNG

SEQ ID NO: 2132158 - protein, 19 aa, Cryptosporidium hominis
LPTILLIPAIVRKDITIGG

SEQ ID NO: 2132159 - protein, 19 aa, Cryptosporidium hominis
LPVIFVVVIIMCLYLIYTF

SEQ ID NO: 2132160 - protein, 21 aa, Cryptosporidium hominis
LPVLVWGMFVTLISKYSDFNL

SEQ ID NO: 2132161 - protein, 31 aa, Cryptosporidium hominis
LQDPNNYLIPKLFWMLNHLITYINGLDDFKS

SEQ ID NO: 2132162 - protein, 18 aa, Cryptosporidium hominis
LQELCYLIYYISEGNNAL

SEQ ID NO: 2132163 - protein, 17 aa, Cryptosporidium hominis
LQFFITEDQLGLSIHNP

SEQ ID NO: 2132164 - protein, 21 aa, Cryptosporidium hominis
LQFFSLKFQLSLLTALLTMHM

SEQ ID NO: 2132165 - protein, 28 aa, Cryptosporidium hominis
LQFFTDPIFSTFFKFGSPLFRVKNIPLR

SEQ ID NO: 2132166 - protein, 23 aa, Cryptosporidium hominis
LQFLDWWLFYQASNKYPYIFSMD

SEQ ID NO: 2132167 - protein, 24 aa, Cryptosporidium hominis
LQHFVYLLIRNVVSFKFQAAISEI

SEQ ID NO: 2132168 - protein, 25 aa, Cryptosporidium hominis
LQHGYKLEWIVIYLICAEIVIEVVW

SEQ ID NO: 2132169 - protein, 18 aa, Cryptosporidium hominis
LQILKVFIYERYFKAQSA

SEQ ID NO: 2132170 - protein, 19 aa, Cryptosporidium hominis
LQKRLWYEEFPLATFTIWV

SEQ ID NO: 2132171 - protein, 23 aa, Cryptosporidium hominis
LQLLKTFEYILNKLKQIQNPESR

SEQ ID NO: 2132172 - protein, 21 aa, Cryptosporidium hominis
LQLQFTGFLFLKTICNTIEEP

SEQ ID NO: 2132173 - protein, 20 aa, Cryptosporidium hominis
LQMLQGIFRFYYKIILERER

SEQ ID NO: 2132174 - protein, 25 aa, Cryptosporidium hominis
LQNQILKYSLIKIKLHSKCKIKNGC

SEQ ID NO: 2132175 - protein, 25 aa, Cryptosporidium hominis
LQSDHILFYLCRVLYSIGKSASQRE

SEQ ID NO: 2132176 - protein, 23 aa, Cryptosporidium hominis
LRALLILLSLILGFLSILAFAWI

SEQ ID NO: 2132177 - protein, 28 aa, Cryptosporidium hominis
LRDTIDLIFQLLFGFSKHSFGASGVEDA

SEQ ID NO: 2132178 - protein, 21 aa, Cryptosporidium hominis
LREFGTNHPKFKFLSSLWLSQ

SEQ ID NO: 2132179 - protein, 19 aa, Cryptosporidium hominis
LRERKIFDFVKYLVSDKTI

SEQ ID NO: 2132180 - protein, 19 aa, Cryptosporidium hominis
LRGKIIRSILYPSKYSFGL

SEQ ID NO: 2132181 - protein, 25 aa, Cryptosporidium hominis
LRIVEFIYKLFFRSIEDWHYPITKK

SEQ ID NO: 2132182 - protein, 25 aa, Cryptosporidium hominis
LRMGLLFELMCYLGLTMISYNYTNQ

SEQ ID NO: 2132183 - protein, 27 aa, Cryptosporidium hominis
LRQMLLPFIQLILIRFTFIFDYEIQQI

SEQ ID NO: 2132184 - protein, 18 aa, Cryptosporidium hominis
LRSFLLRMTGKNHLGASL

SEQ ID NO: 2132185 - protein, 28 aa, Cryptosporidium hominis
LRSISILVLYQLILFNILNSSSQTSNKV

SEQ ID NO: 2132186 - protein, 27 aa, Cryptosporidium hominis
LRSRTILFGNYHYLLLSIVPAITPRHV

SEQ ID NO: 2132187 - protein, 29 aa, Cryptosporidium hominis
LRTLLINGVFLSLFFIYILYQEEHSDAKS

SEQ ID NO: 2132188 - protein, 17 aa, Cryptosporidium hominis
LRYILENFGLYLNNYVP

SEQ ID NO: 2132189 - protein, 18 aa, Cryptosporidium hominis
LSALALVVPIDYSENIYQ

SEQ ID NO: 2132190 - protein, 26 aa, Cryptosporidium hominis
LSALIIITLLLSFGSALFSGLTLGMM

SEQ ID NO: 2132191 - protein, 51 aa, Cryptosporidium hominis
LSCFCLHYLWKYFEKEFGIITSLLSISILIITFYGAYIYFKKSLYIEIDFG

SEQ ID NO: 2132192 - protein, 36 aa, Cryptosporidium hominis
LSDIQSLILPPTYLDLLYNLASCIPAYCLRPLCQHI

SEQ ID NO: 2132193 - protein, 20 aa, Cryptosporidium hominis
LSDMLIFIDLNALVSLILTS

SEQ ID NO: 2132194 - protein, 28 aa, Cryptosporidium hominis
LSDRRKFLLTKLLKLPNPLDLSSYLFEL

SEQ ID NO: 2132195 - protein, 47 aa, Cryptosporidium hominis
LSEDNSLLQVPPWANPLLLVAILISVFVHLVILYVPPISVIFNVVPL

SEQ ID NO: 2132196 - protein, 24 aa, Cryptosporidium hominis
LSELYYTFIESSKTIFDLLTVSQL

SEQ ID NO: 2132197 - protein, 32 aa, Cryptosporidium hominis
LSEYFLCSPSLFVLMFIYIKRIIDNNPSYIFD

SEQ ID NO: 2132198 - protein, 20 aa, Cryptosporidium hominis
LSFLIYVNGIRNFPTLDVKE

SEQ ID NO: 2132199 - protein, 26 aa, Cryptosporidium hominis
LSFNKSIYRYLLVQYLIRKNRSRSEI

SEQ ID NO: 2132200 - protein, 19 aa, Cryptosporidium hominis
LSFSFVWFFKTLSFHHVCH

SEQ ID NO: 2132201 - protein, 22 aa, Cryptosporidium hominis
LSGFYLYIFTPLAILTFFKFTT

SEQ ID NO: 2132202 - protein, 28 aa, Cryptosporidium hominis
LSGGLLMPRIYTLFIHILGLRCMVPVSH

SEQ ID NO: 2132203 - protein, 19 aa, Cryptosporidium hominis
LSIAIAAQLPIPIAALQIL

SEQ ID NO: 2132204 - protein, 18 aa, Cryptosporidium hominis
LSIFEAIFQSIVPKHVFA

SEQ ID NO: 2132205 - protein, 25 aa, Cryptosporidium hominis
LSIIYIFFSFIFEKIFVLSTHISKN

SEQ ID NO: 2132206 - protein, 19 aa, Cryptosporidium hominis
LSILQEIYLLLNYNNEYFK

SEQ ID NO: 2132207 - protein, 24 aa, Cryptosporidium hominis
LSINSFLLQIQLVLCIIKADPSCF

SEQ ID NO: 2132208 - protein, 18 aa, Cryptosporidium hominis
LSIYIILAFNCGGLFLNN

SEQ ID NO: 2132209 - protein, 20 aa, Cryptosporidium hominis
LSKFLNIVPLPGSSNYILII

SEQ ID NO: 2132210 - protein, 23 aa, Cryptosporidium hominis
LSKHVVRYYTWWCEEPEALQNYV

SEQ ID NO: 2132211 - protein, 24 aa, Cryptosporidium hominis
LSKKLLPTFSSRFGWRRVEEIIKS

SEQ ID NO: 2132212 - protein, 27 aa, Cryptosporidium hominis
LSKLNYPIIYFASFIYKIKVKSSGTSD

SEQ ID NO: 2132213 - protein, 23 aa, Cryptosporidium hominis
LSKNAPLFIFRAITEGKKLPNYL

SEQ ID NO: 2132214 - protein, 19 aa, Cryptosporidium hominis
LSLNLLWKINHFTNGFIIS

SEQ ID NO: 2132215 - protein, 24 aa, Cryptosporidium hominis
LSLTRWFACFLLIFGVIMIPKKSK

SEQ ID NO: 2132216 - protein, 24 aa, Cryptosporidium hominis
LSLVFRSIFLYFLIARVPTAVSYF

SEQ ID NO: 2132217 - protein, 38 aa, Cryptosporidium hominis
LSMGWGSLILFIFLIYILLAIILAIIHFIITFGDAANC

SEQ ID NO: 2132218 - protein, 32 aa, Cryptosporidium hominis
LSMKLPKVSSFKLLLLLKKDIHFLILGIISAS

SEQ ID NO: 2132219 - protein, 25 aa, Cryptosporidium hominis
LSNELGLSLFINFGIRFFGKLESDK

SEQ ID NO: 2132220 - protein, 36 aa, Cryptosporidium hominis
LSNFNILIIVIMLIAFFVLFFSSIAYYILIISTKIS

SEQ ID NO: 2132221 - protein, 24 aa, Cryptosporidium hominis
LSNIEKPEWLLETYFSLFKSHSEY

SEQ ID NO: 2132222 - protein, 23 aa, Cryptosporidium hominis
LSPNHLIFIQYLGEKPHEGNCYY

SEQ ID NO: 2132223 - protein, 20 aa, Cryptosporidium hominis
LSQKFWVGAKLNKLLDTEGN

SEQ ID NO: 2132224 - protein, 17 aa, Cryptosporidium hominis
LSRHLLSIPFIGKDTPS

SEQ ID NO: 2132225 - protein, 19 aa, Cryptosporidium hominis
LSRIADWMIGTFILEKHIP

SEQ ID NO: 2132226 - protein, 22 aa, Cryptosporidium hominis
LSRIKHPFLVRMFGTFKDDRYL

SEQ ID NO: 2132227 - protein, 27 aa, Cryptosporidium hominis
LSRLDILLLFILPFNNITLFNSGFMIN

SEQ ID NO: 2132228 - protein, 25 aa, Cryptosporidium hominis
LSRNKILNPFLYPLLVIGETNSLEE

SEQ ID NO: 2132229 - protein, 26 aa, Cryptosporidium hominis
LSRRDGTVLFVFIDTFILSSSFPDHK

SEQ ID NO: 2132230 - protein, 22 aa, Cryptosporidium hominis
LSRYITLILVLKLLHLISHIRI

SEQ ID NO: 2132231 - protein, 41 aa, Cryptosporidium hominis
LSSFDRNVLVIRALWKCLYGQFIMLIILKVSWEACLYLNNS

SEQ ID NO: 2132232 - protein, 17 aa, Cryptosporidium hominis
LSSFIHDLILLSPKTKE

SEQ ID NO: 2132233 - protein, 18 aa, Cryptosporidium hominis
LSSIGVSNPPFTSATKPN

SEQ ID NO: 2132234 - protein, 20 aa, Cryptosporidium hominis
LSSLLFCRFLQDFIENNKRV

SEQ ID NO: 2132235 - protein, 24 aa, Cryptosporidium hominis
LSSSLFKLLDLVFATLHNYSIEDK

SEQ ID NO: 2132236 - protein, 23 aa, Cryptosporidium hominis
LSTKLISTIIYLTILGLTDHCIL

SEQ ID NO: 2132237 - protein, 25 aa, Cryptosporidium hominis
LSTTRWFACFLLFVGVLLVQKTNIR

SEQ ID NO: 2132238 - protein, 25 aa, Cryptosporidium hominis
LSVIYFSVLWMMMFLDCGPNYFSFF

SEQ ID NO: 2132239 - protein, 20 aa, Cryptosporidium hominis
LSVYLQILNSLLSKKSKYFP

SEQ ID NO: 2132240 - protein, 19 aa, Cryptosporidium hominis
LSYIMCKGMNRDFISVLLG

SEQ ID NO: 2132241 - protein, 24 aa, Cryptosporidium hominis
LTDFSRFLVLLLSIYIFSRLDISF

SEQ ID NO: 2132242 - protein, 19 aa, Cryptosporidium hominis
LTEDASPFWNSPWSFKCNV

SEQ ID NO: 2132243 - protein, 24 aa, Cryptosporidium hominis
LTEDFLLVFMNFSLVRILSSNSYG

SEQ ID NO: 2132244 - protein, 17 aa, Cryptosporidium hominis
LTFHLFIGVFAEDSSSE

SEQ ID NO: 2132245 - protein, 24 aa, Cryptosporidium hominis
LTGDLSIHYLLLNMLFHESYASRT

SEQ ID NO: 2132246 - protein, 21 aa, Cryptosporidium hominis
LTHILLFSIIICLLSLRSDQG

SEQ ID NO: 2132247 - protein, 27 aa, Cryptosporidium hominis
LTIIFNIIIFLYLLSSFNIIRCNGEKM

SEQ ID NO: 2132248 - protein, 19 aa, Cryptosporidium hominis
LTILLTSWASYGLVYFICG

SEQ ID NO: 2132249 - protein, 22 aa, Cryptosporidium hominis
LTISNIQFIKPLIFPNELGRNP

SEQ ID NO: 2132250 - protein, 39 aa, Cryptosporidium hominis
LTISVLLPLLIAIYYIIMPVHTIIILRSLWLSKKESTDI

SEQ ID NO: 2132251 - protein, 22 aa, Cryptosporidium hominis
LTITLVIIAHKWVEGIAVSAGI

SEQ ID NO: 2132252 - protein, 22 aa, Cryptosporidium hominis
LTKLDLLNINKISLFSAIEIFS

SEQ ID NO: 2132253 - protein, 25 aa, Cryptosporidium hominis
LTLFFNIIFSIFILKQQISTICIFG

SEQ ID NO: 2132254 - protein, 25 aa, Cryptosporidium hominis
LTMIDWLAVLICSLPVILIDEVLKA

SEQ ID NO: 2132255 - protein, 20 aa, Cryptosporidium hominis
LTMYCIMGTLFSFLIKIKSF

SEQ ID NO: 2132256 - protein, 31 aa, Cryptosporidium hominis
LTRRYVITIFLIFFTIIVFTTLRTLLKIYGL

SEQ ID NO: 2132257 - protein, 19 aa, Cryptosporidium hominis
LTSGWIFIRCALGGPLLGF

SEQ ID NO: 2132258 - protein, 25 aa, Cryptosporidium hominis
LTSKEVMLYWKFNISKMLNSSIGAE

SEQ ID NO: 2132259 - protein, 35 aa, Cryptosporidium hominis
LTSSVIYLIKFLYRPKFEILGKLPGTLIFKSLDKF

SEQ ID NO: 2132260 - protein, 19 aa, Cryptosporidium hominis
LTWVVHSKYWFNSVGSELN

SEQ ID NO: 2132261 - protein, 23 aa, Cryptosporidium hominis
LVCLRYLVCLISKISIGFSLQFI

SEQ ID NO: 2132262 - protein, 27 aa, Cryptosporidium hominis
LVETQMFCFLPLFILSHNIIKQYYQSS

SEQ ID NO: 2132263 - protein, 31 aa, Cryptosporidium hominis
LVFCGLLMIIFAIILLLIKMMRYYNWVPLKS

SEQ ID NO: 2132264 - protein, 18 aa, Cryptosporidium hominis
LVFEPYQRLMSFAIEICM

SEQ ID NO: 2132265 - protein, 17 aa, Cryptosporidium hominis
LVGWIAYCILNISKITL

SEQ ID NO: 2132266 - protein, 17 aa, Cryptosporidium hominis
LVIAILMGLRISCYKCD

SEQ ID NO: 2132267 - protein, 18 aa, Cryptosporidium hominis
LVIARKYVSFFSSLYSGE

SEQ ID NO: 2132268 - protein, 24 aa, Cryptosporidium hominis
LVIFSSYSLGFWYGGVLVADSMDS

SEQ ID NO: 2132269 - protein, 22 aa, Cryptosporidium hominis
LVIFYFVCYDLQKLDTVDCIKL

SEQ ID NO: 2132270 - protein, 20 aa, Cryptosporidium hominis
LVIGFFFCNFGLLISYLFLE

SEQ ID NO: 2132271 - protein, 27 aa, Cryptosporidium hominis
LVISLNMLNILHLIPLSLSILNQLFEN

SEQ ID NO: 2132272 - protein, 19 aa, Cryptosporidium hominis
LVKLFNTILTIIITNGQET

SEQ ID NO: 2132273 - protein, 22 aa, Cryptosporidium hominis
LVKTWHLFLGISIKVDEKFQPF

SEQ ID NO: 2132274 - protein, 18 aa, Cryptosporidium hominis
LVLKFIQLIQQQSKYFHI

SEQ ID NO: 2132275 - protein, 17 aa, Cryptosporidium hominis
LVNVFIFYWRQALTEYY

SEQ ID NO: 2132276 - protein, 17 aa, Cryptosporidium hominis
LVNYLLKQNTELKIEES

SEQ ID NO: 2132277 - protein, 26 aa, Cryptosporidium hominis
LVQDEKMWFTFYYLNKKSSICDVQGS

SEQ ID NO: 2132278 - protein, 28 aa, Cryptosporidium hominis
LVSHYYFLKRLLKGIFIEILIISTLIKL

SEQ ID NO: 2132279 - protein, 40 aa, Cryptosporidium hominis
LVSKKYQLFILCFLSLIILFVIPLAFIIYYRRQKKYASNG

SEQ ID NO: 2132280 - protein, 34 aa, Cryptosporidium hominis
LVSTTNWNLIALSHNYFFGALYGRMKTAKQCQER

SEQ ID NO: 2132281 - protein, 31 aa, Cryptosporidium hominis
LVSVVALFMFPAWPLAIKISVWYISVVFLSA

SEQ ID NO: 2132282 - protein, 22 aa, Cryptosporidium hominis
LVVLVILFCLCMTGSLLTYKYI

SEQ ID NO: 2132283 - protein, 18 aa, Cryptosporidium hominis
LVVTIIVYINNLNFNNNE

SEQ ID NO: 2132284 - protein, 17 aa, Cryptosporidium hominis
LVYFGIISVLYDAEILQ

SEQ ID NO: 2132285 - protein, 18 aa, Cryptosporidium hominis
LWKETMVYHFLYTVLVTS

SEQ ID NO: 2132286 - protein, 19 aa, Cryptosporidium hominis
LWMLITCSWMLLLLSYFFG

SEQ ID NO: 2132287 - protein, 44 aa, Cryptosporidium hominis
LYALYAQHSYIFFLSIPLFISYVVLYNLIFKIIIHHILPDPATC

SEQ ID NO: 2132288 - protein, 31 aa, Cryptosporidium hominis
LYCQNMMFAWLRLRLDFLLPVALTSINVLFS

SEQ ID NO: 2132289 - protein, 38 aa, Cryptosporidium hominis
LYDDTAFFFFFGTIVICILIFWTYNVLSKVLCPTRKFN

SEQ ID NO: 2132290 - protein, 18 aa, Cryptosporidium hominis
LYDLYPLAVIRKYIEFRG

SEQ ID NO: 2132291 - protein, 18 aa, Cryptosporidium hominis
LYDTFKKNYFDLWTSNIQ

SEQ ID NO: 2132292 - protein, 26 aa, Cryptosporidium hominis
LYFGIGFIIFVFLFNKNNIGHNFHLG

SEQ ID NO: 2132293 - protein, 19 aa, Cryptosporidium hominis
LYHFDWNIFVRKKALLSII

SEQ ID NO: 2132294 - protein, 26 aa, Cryptosporidium hominis
LYHPYTCIISCILQLPFLSMNNINGE

SEQ ID NO: 2132295 - protein, 30 aa, Cryptosporidium hominis
LYIILKFFVLFIFFVYLKTRHDLVKYDHTL

SEQ ID NO: 2132296 - protein, 18 aa, Cryptosporidium hominis
LYIMGDIFHVLKALYSKL

SEQ ID NO: 2132297 - protein, 26 aa, Cryptosporidium hominis
LYISNEVVHRFLPWDSLNELMDILER

SEQ ID NO: 2132298 - protein, 19 aa, Cryptosporidium hominis
LYKDFLQFTLMRNLERRDS

SEQ ID NO: 2132299 - protein, 28 aa, Cryptosporidium hominis
LYLAYKFLPVYWVNLLLTSYLFIIGAVA

SEQ ID NO: 2132300 - protein, 17 aa, Cryptosporidium hominis
LYLQKCGFFIISTVLLF

SEQ ID NO: 2132301 - protein, 17 aa, Cryptosporidium hominis
LYLWSFINESNAISWII

SEQ ID NO: 2132302 - protein, 24 aa, Cryptosporidium hominis
LYNHNFFCYPFSWIDIEGIKEIPN

SEQ ID NO: 2132303 - protein, 22 aa, Cryptosporidium hominis
LYNKFTLIIFGVFTITSIIINE

SEQ ID NO: 2132304 - protein, 31 aa, Cryptosporidium hominis
LYNQVTIASFIFLLFICLSFGIIVACIDYFG

SEQ ID NO: 2132305 - protein, 25 aa, Cryptosporidium hominis
LYNRKYFILFLAWSFLSCLLISIFS

SEQ ID NO: 2132306 - protein, 27 aa, Cryptosporidium hominis
LYQQFYTKIYSRTLTWSYFLGTCIMDY

SEQ ID NO: 2132307 - protein, 19 aa, Cryptosporidium hominis
LYSIKYYRGTNSFHYLFDL

SEQ ID NO: 2132308 - protein, 23 aa, Cryptosporidium hominis
LYSLYHFFVLIRFSSIHCSILST

SEQ ID NO: 2132309 - protein, 25 aa, Cryptosporidium hominis
LYTTPKFHRMFFKKVMKSINEEYRL

SEQ ID NO: 2132310 - protein, 24 aa, Cryptosporidium hominis
LYTTSFIFTTIAYLGLVSFFNIFT

SEQ ID NO: 2132311 - protein, 27 aa, Cryptosporidium hominis
MASQTIKFIFIIFKPNNLSINTPLSKI

SEQ ID NO: 2132312 - protein, 18 aa, Cryptosporidium hominis
MAVYLSICFEMVSLFILT

SEQ ID NO: 2132313 - protein, 21 aa, Cryptosporidium hominis
MCINFVSYNLLWFGMTKYFEV

SEQ ID NO: 2132314 - protein, 21 aa, Cryptosporidium hominis
MCRPWQIHGVLYWIGDPNGSK

SEQ ID NO: 2132315 - protein, 23 aa, Cryptosporidium hominis
MDEIPHLHLHRFRSIRSDPNSES

SEQ ID NO: 2132316 - protein, 20 aa, Cryptosporidium hominis
MDILERDCGWRRPRITIPPP

SEQ ID NO: 2132317 - protein, 18 aa, Cryptosporidium hominis
MDQNLLQLSIIPEVLYSS

SEQ ID NO: 2132318 - protein, 41 aa, Cryptosporidium hominis
MDRDILSFHSCLIFGLVRLLWNIVFILYGATSLVNIPNMER

SEQ ID NO: 2132319 - protein, 17 aa, Cryptosporidium hominis
MDRKYFSVLKNFSFYKL

SEQ ID NO: 2132320 - protein, 27 aa, Cryptosporidium hominis
MDVATYLFMMIVRLIIFRLILPWLCPE

SEQ ID NO: 2132321 - protein, 25 aa, Cryptosporidium hominis
MEDEVLSNLLYKFLLVSPQCNIKEF

SEQ ID NO: 2132322 - protein, 17 aa, Cryptosporidium hominis
MEEAPPALDLEEIPRLD

SEQ ID NO: 2132323 - protein, 23 aa, Cryptosporidium hominis
MEENYFFVLITNFPVLSLTIGIV

SEQ ID NO: 2132324 - protein, 22 aa, Cryptosporidium hominis
MEFYLMLLQFIYNAIDYNKLEL

SEQ ID NO: 2132325 - protein, 17 aa, Cryptosporidium hominis
MFAGGSLIFFKKFGKKK

SEQ ID NO: 2132326 - protein, 24 aa, Cryptosporidium hominis
MFCFENWGYFLLGNNFQLLDHIIE

SEQ ID NO: 2132327 - protein, 23 aa, Cryptosporidium hominis
MFEPPFTLEIFQNIILITSFHSN

SEQ ID NO: 2132328 - protein, 17 aa, Cryptosporidium hominis
MFLNIFIAIWSISSILY

SEQ ID NO: 2132329 - protein, 19 aa, Cryptosporidium hominis
MFLSSQGVFYSFYKNVLFA

SEQ ID NO: 2132330 - protein, 26 aa, Cryptosporidium hominis
MFPTIIEFGILLIITVINIIGLITLG

SEQ ID NO: 2132331 - protein, 28 aa, Cryptosporidium hominis
MFSTKFNLFMFITYDKYIDLLLESGQEL

SEQ ID NO: 2132332 - protein, 30 aa, Cryptosporidium hominis
MFTSYLLHFFNYYILLTPLPQIGVSILLSI

SEQ ID NO: 2132333 - protein, 18 aa, Cryptosporidium hominis
MGFNLYTHIRSLNARRPY

SEQ ID NO: 2132334 - protein, 18 aa, Cryptosporidium hominis
MGLCIFVRLFAVVRYEAI

SEQ ID NO: 2132335 - protein, 25 aa, Cryptosporidium hominis
MGNMQLYKKLLLSEKQWLYVENSME

SEQ ID NO: 2132336 - protein, 19 aa, Cryptosporidium hominis
MGQTLVLDDLQYLYTHLKI

SEQ ID NO: 2132337 - protein, 23 aa, Cryptosporidium hominis
MGTIGCITWFLETVDTYWFFHSI

SEQ ID NO: 2132338 - protein, 23 aa, Cryptosporidium hominis
MHGHRWFPPLLDQIRHFLVKGYM

SEQ ID NO: 2132339 - protein, 19 aa, Cryptosporidium hominis
MHLSPSFFQTLLDSNERFI

SEQ ID NO: 2132340 - protein, 44 aa, Cryptosporidium hominis
MHSILFQCVLYSYPELQPVLRLLKYWLHIRRLPVAKDGGLPCIV

SEQ ID NO: 2132341 - protein, 30 aa, Cryptosporidium hominis
MIDYSILLFTMFLFRPFKSLKLFSNVLAKH

SEQ ID NO: 2132342 - protein, 32 aa, Cryptosporidium hominis
MIEYRIQNFIFFNFLLYLASIGPQSFISFILF

SEQ ID NO: 2132343 - protein, 34 aa, Cryptosporidium hominis
MIGILVCHIISGFIFSRNMFWLANWTGRKKHLNS

SEQ ID NO: 2132344 - protein, 22 aa, Cryptosporidium hominis
MIIMSIFGLIRMAISKSSESGN

SEQ ID NO: 2132345 - protein, 26 aa, Cryptosporidium hominis
MIITKTGLNLPILFGIAFMGFCVSGP

SEQ ID NO: 2132346 - protein, 27 aa, Cryptosporidium hominis
MIKLRFKYIFDPINRKILEFEPIISCI

SEQ ID NO: 2132347 - protein, 19 aa, Cryptosporidium hominis
MILHPLKSELHWPIGEKIP

SEQ ID NO: 2132348 - protein, 24 aa, Cryptosporidium hominis
MILQVALLGIMWSLTYYMLSKYSE

SEQ ID NO: 2132349 - protein, 36 aa, Cryptosporidium hominis
MIQDNFWRVRYCSIILLILSLYKLLSSYYEEDEIWN

SEQ ID NO: 2132350 - protein, 22 aa, Cryptosporidium hominis
MISMIVFMIILDIISALLKGPL

SEQ ID NO: 2132351 - protein, 30 aa, Cryptosporidium hominis
MIVINAPSIFGIIWNFLKPLIDERTAKKIS

SEQ ID NO: 2132352 - protein, 19 aa, Cryptosporidium hominis
MIWYAVRKFLDLKEYEFLY

SEQ ID NO: 2132353 - protein, 19 aa, Cryptosporidium hominis
MKIPVLFETIKLISNQDSK

SEQ ID NO: 2132354 - protein, 43 aa, Cryptosporidium hominis
MKNFQLFNLIHFFFFLKVIWVAGQLYFLFGITGHYPTGKLPIE

SEQ ID NO: 2132355 - protein, 33 aa, Cryptosporidium hominis
MKNYIKFILVYFICQFLLIYVYVCTYWGLFYFK

SEQ ID NO: 2132356 - protein, 23 aa, Cryptosporidium hominis
MKYYVVYTILRLILESITSFGMS

SEQ ID NO: 2132357 - protein, 19 aa, Cryptosporidium hominis
MLCVYFIGVLFLAGFQEFI

SEQ ID NO: 2132358 - protein, 26 aa, Cryptosporidium hominis
MLFDLYEEYFFLSNLKLLELVDDFHK

SEQ ID NO: 2132359 - protein, 27 aa, Cryptosporidium hominis
MLFTGFGSFFILFFAAALIVTCTWAFQ

SEQ ID NO: 2132360 - protein, 20 aa, Cryptosporidium hominis
MLGIYTLSWPMYNGIVQYSP

SEQ ID NO: 2132361 - protein, 21 aa, Cryptosporidium hominis
MLGRKVVQILDLLWRQVAESQ

SEQ ID NO: 2132362 - protein, 22 aa, Cryptosporidium hominis
MLGYYCVWDVDPKLHTPLMSVT

SEQ ID NO: 2132363 - protein, 26 aa, Cryptosporidium hominis
MLILTIFFFINIVSKAFINILIFGFS

SEQ ID NO: 2132364 - protein, 35 aa, Cryptosporidium hominis
MLIVFFGRLIVFAFLWFFGFDFWILPNLFDEDTGV

SEQ ID NO: 2132365 - protein, 17 aa, Cryptosporidium hominis
MLLLLYCGVLIDIESSR

SEQ ID NO: 2132366 - protein, 23 aa, Cryptosporidium hominis
MLNPWISLFYQASFIINSYLSII

SEQ ID NO: 2132367 - protein, 29 aa, Cryptosporidium hominis
MLPDIIYLEVAMLLRRLAKRIDLFRSAEE

SEQ ID NO: 2132368 - protein, 17 aa, Cryptosporidium hominis
MLTIPQYATSYLSYQGT

SEQ ID NO: 2132369 - protein, 17 aa, Cryptosporidium hominis
MMEFVIGGEFFTYLRRC

SEQ ID NO: 2132370 - protein, 46 aa, Cryptosporidium hominis
MMKDRQILILSTSTLFLVNSGYFDIVFWLDIILDISNLFKVHGLVA

SEQ ID NO: 2132371 - protein, 29 aa, Cryptosporidium hominis
MNAIHIIQRYWRIYIYRNQIMRELLIKNV

SEQ ID NO: 2132372 - protein, 31 aa, Cryptosporidium hominis
MNFPCEQVHYWFLAYWAFRIGSGQILWDMAS

SEQ ID NO: 2132373 - protein, 42 aa, Cryptosporidium hominis
MNICLLIALAPWTLPIFLIMMGLILFKIFLPMISASRNLQRI

SEQ ID NO: 2132374 - protein, 19 aa, Cryptosporidium hominis
MNIWSWQITQTFIPNFYAV

SEQ ID NO: 2132375 - protein, 23 aa, Cryptosporidium hominis
MNKNLLIITILFPILYNIINFSN

SEQ ID NO: 2132376 - protein, 25 aa, Cryptosporidium hominis
MNKVDIYEIYLMKLLYTECGYTFIS

SEQ ID NO: 2132377 - protein, 19 aa, Cryptosporidium hominis
MNLDLICRVPIQCKLTINQ

SEQ ID NO: 2132378 - protein, 23 aa, Cryptosporidium hominis
MNNWTIFITFTPTLGLDCIITTS

SEQ ID NO: 2132379 - protein, 33 aa, Cryptosporidium hominis
MNYMYGLIIIFIFGILTHLLVQVTQIYASLRAA

SEQ ID NO: 2132380 - protein, 33 aa, Cryptosporidium hominis
MPIKLFKPEILGQLQIPLFPDKSAMIKKTIREE

SEQ ID NO: 2132381 - protein, 17 aa, Cryptosporidium hominis
MPKALKEGFLGLRELTF

SEQ ID NO: 2132382 - protein, 32 aa, Cryptosporidium hominis
MPVLLACWSVCIILSILDLYYLNNMDKNWSIY

SEQ ID NO: 2132383 - protein, 25 aa, Cryptosporidium hominis
MQNLPVYYLIILVNFLLFTSLPPHP

SEQ ID NO: 2132384 - protein, 18 aa, Cryptosporidium hominis
MQRIRFLQHTSLIWCNTR

SEQ ID NO: 2132385 - protein, 17 aa, Cryptosporidium hominis
MRPIYIQSSLEAWLKIR

SEQ ID NO: 2132386 - protein, 25 aa, Cryptosporidium hominis
MRRDSYRYFVKNPLSFPYVKSEPML

SEQ ID NO: 2132387 - protein, 18 aa, Cryptosporidium hominis
MRTILVYVTMLRSFMWSS

SEQ ID NO: 2132388 - protein, 17 aa, Cryptosporidium hominis
MSFGPNSLSILPQGTVH

SEQ ID NO: 2132389 - protein, 19 aa, Cryptosporidium hominis
MSKLAFIIRRMTRGGGAGN

SEQ ID NO: 2132390 - protein, 27 aa, Cryptosporidium hominis
MSKLLVGFLLKYRFLRLINCNWTKLRP

SEQ ID NO: 2132391 - protein, 19 aa, Cryptosporidium hominis
MSLLDTFVAWLFKNNINRY

SEQ ID NO: 2132392 - protein, 17 aa, Cryptosporidium hominis
MSTVCILPLLFAFSYPY

SEQ ID NO: 2132393 - protein, 22 aa, Cryptosporidium hominis
MTKIRLLLIESIPSDFDLVLEK

SEQ ID NO: 2132394 - protein, 37 aa, Cryptosporidium hominis
MTNECKTIISCTNDITLPIIPRCSTSPYSIGCPCNLN

SEQ ID NO: 2132395 - protein, 18 aa, Cryptosporidium hominis
MTPIVSWIHDFEIFHFGT

SEQ ID NO: 2132396 - protein, 19 aa, Cryptosporidium hominis
MTRIYDYLVSLKGGYIRIP

SEQ ID NO: 2132397 - protein, 30 aa, Cryptosporidium hominis
MTVRRLLLAIITFYFRLDFIMSINPQVSQF

SEQ ID NO: 2132398 - protein, 22 aa, Cryptosporidium hominis
MVGYNFFYRDISLELQLNGNIA

SEQ ID NO: 2132399 - protein, 17 aa, Cryptosporidium hominis
MVKSLYKLALFSCDLNA

SEQ ID NO: 2132400 - protein, 24 aa, Cryptosporidium hominis
MVLEKYLYLLDRLIEIYNVKIMDQ

SEQ ID NO: 2132401 - protein, 23 aa, Cryptosporidium hominis
MVLLMMSIFLSSWLYNAAGKGFY

SEQ ID NO: 2132402 - protein, 18 aa, Cryptosporidium hominis
MVNPAVFITLLNDVEWYS

SEQ ID NO: 2132403 - protein, 20 aa, Cryptosporidium hominis
MVPPQPLFPELKRVQMIVTT

SEQ ID NO: 2132404 - protein, 17 aa, Cryptosporidium hominis
MVQIRGKLRTTFYGYLI

SEQ ID NO: 2132405 - protein, 33 aa, Cryptosporidium hominis
MVSKKTYYWYFSKLKWSWTIALLILCYSKTMFD

SEQ ID NO: 2132406 - protein, 25 aa, Cryptosporidium hominis
MVTEKPITRWILPSGFEPQYFQMYA

SEQ ID NO: 2132407 - protein, 17 aa, Cryptosporidium hominis
MVVVAVIQTLFGGFLAP

SEQ ID NO: 2132408 - protein, 17 aa, Cryptosporidium hominis
MWVLKPYHIRKRLGHQY

SEQ ID NO: 2132409 - protein, 24 aa, Cryptosporidium hominis
MYASQWFMTIFAYSFNLDAVARIW

SEQ ID NO: 2132410 - protein, 19 aa, Cryptosporidium hominis
MYISYFALFFDFFIKRYIT

SEQ ID NO: 2132411 - protein, 30 aa, Cryptosporidium hominis
MYNIQPYLAFIFFSTSTWLQMHFLNLGLAM

SEQ ID NO: 2132412 - protein, 29 aa, Cryptosporidium hominis
MYQDSFKGVYPLLPYFGLKADFSKKYPNF

SEQ ID NO: 2132413 - protein, 19 aa, Cryptosporidium hominis
MYYCNFFTFTIITLIMMHI

SEQ ID NO: 2132414 - protein, 21 aa, Cryptosporidium hominis
MYYYFIFSRWMYNTLFGMTAF

SEQ ID NO: 2132415 - protein, 31 aa, Cryptosporidium hominis
NAASMDLLIPLYIGFWFINSILDAIVYILQQ

SEQ ID NO: 2132416 - protein, 21 aa, Cryptosporidium hominis
NAENPTYGYFSKPGVYLPASS

SEQ ID NO: 2132417 - protein, 26 aa, Cryptosporidium hominis
NAHAEVHPFFFNPLLNNCKDIIFPNN

SEQ ID NO: 2132418 - protein, 23 aa, Cryptosporidium hominis
NAILIIIQLFFAGVVVILLDELM

SEQ ID NO: 2132419 - protein, 23 aa, Cryptosporidium hominis
NAKLICNLVSLLSKHKLIPEDIF

SEQ ID NO: 2132420 - protein, 21 aa, Cryptosporidium hominis
NANPLIYFNSLKCIRIFLLRL

SEQ ID NO: 2132421 - protein, 20 aa, Cryptosporidium hominis
NASIKLIRAWNSHMILRSKR

SEQ ID NO: 2132422 - protein, 22 aa, Cryptosporidium hominis
NAYFYAQALLHYMIVWRGDYSG

SEQ ID NO: 2132423 - protein, 26 aa, Cryptosporidium hominis
NCSKRVHHLPQMKCPLGTNLMNSYCI

SEQ ID NO: 2132424 - protein, 25 aa, Cryptosporidium hominis
NCVCHLILLGFLFSIIFESIADEYF

SEQ ID NO: 2132425 - protein, 25 aa, Cryptosporidium hominis
NCVPIKAFFLLLDKLSNTNWHATIF

SEQ ID NO: 2132426 - protein, 22 aa, Cryptosporidium hominis
NDCAIKIWQLFLKSGSENCILK

SEQ ID NO: 2132427 - protein, 24 aa, Cryptosporidium hominis
NDELNLLRFLNILPSQYKFSDLKG

SEQ ID NO: 2132428 - protein, 39 aa, Cryptosporidium hominis
NDEVESLFFLLVSPYSICPTLCSLFLLLKSKVIRSRFKY

SEQ ID NO: 2132429 - protein, 25 aa, Cryptosporidium hominis
NDFMRYIYYLIGVTLNSFFSGWLSI

SEQ ID NO: 2132430 - protein, 31 aa, Cryptosporidium hominis
NDINKLIKLAPLVTIIILLIGFFTGIGVTNI

SEQ ID NO: 2132431 - protein, 25 aa, Cryptosporidium hominis
NDLNRMIYLWGLITTSALLAIGVNQ

SEQ ID NO: 2132432 - protein, 29 aa, Cryptosporidium hominis
NDLTFSILGPLWTHILNYIRRLINNKDSS

SEQ ID NO: 2132433 - protein, 36 aa, Cryptosporidium hominis
NDPIIEIFRSSSIILPPLMALVPRAFRYRQGQDILA

SEQ ID NO: 2132434 - protein, 37 aa, Cryptosporidium hominis
NDPRRVALLQVIVSLVFLIPDKLIEILLIVAEESRTN

SEQ ID NO: 2132435 - protein, 23 aa, Cryptosporidium hominis
NDQFFSIKIYHLSNTLLLLDEIN

SEQ ID NO: 2132436 - protein, 22 aa, Cryptosporidium hominis
NDSILLVLRAPQFSLSTLTIIY

SEQ ID NO: 2132437 - protein, 20 aa, Cryptosporidium hominis
NDSMKCAFDFLFRGIRRVQR

SEQ ID NO: 2132438 - protein, 23 aa, Cryptosporidium hominis
NDSVPIPIKCGVLKLFLSLALSS

SEQ ID NO: 2132439 - protein, 23 aa, Cryptosporidium hominis
NDVSSFLNVLRHLGYWLGQITIG

SEQ ID NO: 2132440 - protein, 18 aa, Cryptosporidium hominis
NDWYINNAPFLIVYSLIF

SEQ ID NO: 2132441 - protein, 24 aa, Cryptosporidium hominis
NEAMSFFQELIYGNGFHLYKKLDL

SEQ ID NO: 2132442 - protein, 31 aa, Cryptosporidium hominis
NEAWIAQGHELLFFYLTYYSPSVAEAIQSFL

SEQ ID NO: 2132443 - protein, 26 aa, Cryptosporidium hominis
NEECENPEYLFPWGNDYLNSCLSFQC

SEQ ID NO: 2132444 - protein, 25 aa, Cryptosporidium hominis
NEENWRTYFNIYLAACIVLPIVCTL

SEQ ID NO: 2132445 - protein, 25 aa, Cryptosporidium hominis
NEETMRLFYPLVKKDNPKSFEEFPI

SEQ ID NO: 2132446 - protein, 24 aa, Cryptosporidium hominis
NEFFKFMVHFIFSSIIFQIVNNIN

SEQ ID NO: 2132447 - protein, 21 aa, Cryptosporidium hominis
NEFLQYFSIAAGINSLIFSLS

SEQ ID NO: 2132448 - protein, 26 aa, Cryptosporidium hominis
NEHCKLLTSKLLYYMAITPKEIIENF

SEQ ID NO: 2132449 - protein, 31 aa, Cryptosporidium hominis
NEIGWIFYAFPRLYQAFVLIDLYICFGNKNS

SEQ ID NO: 2132450 - protein, 31 aa, Cryptosporidium hominis
NEMDYVIAAVYYYFIRWQGIPQVYGQFVIEK

SEQ ID NO: 2132451 - protein, 22 aa, Cryptosporidium hominis
NERTDICPIKYICLMLSNSFYG

SEQ ID NO: 2132452 - protein, 24 aa, Cryptosporidium hominis
NERYIIMVLFIFIEYLIILKEDEK

SEQ ID NO: 2132453 - protein, 31 aa, Cryptosporidium hominis
NEVIKIIGLLRPTILQRLIWFVASQVAAGAY

SEQ ID NO: 2132454 - protein, 35 aa, Cryptosporidium hominis
NEVSYLYRIISFSALSYLFFKLAISGSVVAIMVYY

SEQ ID NO: 2132455 - protein, 24 aa, Cryptosporidium hominis
NEWKKIVLLILFLSQVFTAVHGYK

SEQ ID NO: 2132456 - protein, 22 aa, Cryptosporidium hominis
NEYQWCRRIIFLETVAGVPGMV

SEQ ID NO: 2132457 - protein, 23 aa, Cryptosporidium hominis
NEYYKLKINNFLRDIIKENENLN

SEQ ID NO: 2132458 - protein, 19 aa, Cryptosporidium hominis
NFDHFYHLDFPILDNKIVK

SEQ ID NO: 2132459 - protein, 24 aa, Cryptosporidium hominis
NFGFFNIQLLLKSKITILLILIFY

SEQ ID NO: 2132460 - protein, 29 aa, Cryptosporidium hominis
NFIIYIWTFIFFILVVLYLFLTLKSFFQN

SEQ ID NO: 2132461 - protein, 38 aa, Cryptosporidium hominis
NFKDPMTCIPIGFLFLLFIYWNYLSYFINTCRTLRLLF

SEQ ID NO: 2132462 - protein, 24 aa, Cryptosporidium hominis
NFKIYPMVIHLTFNLNLLKSSINS

SEQ ID NO: 2132463 - protein, 23 aa, Cryptosporidium hominis
NFKKLKLLLPDPPTINYFELKFE

SEQ ID NO: 2132464 - protein, 19 aa, Cryptosporidium hominis
NFNSHILWIIADSSQYWLA

SEQ ID NO: 2132465 - protein, 24 aa, Cryptosporidium hominis
NFPLYPLGFILIGLPQGPIFNSVV

SEQ ID NO: 2132466 - protein, 22 aa, Cryptosporidium hominis
NFPNYYHLFLFNFSYRYLQNPK

SEQ ID NO: 2132467 - protein, 40 aa, Cryptosporidium hominis
NFRFLTFSYRRSFLPLFLVFIFLALQFIGLSIMIFINFSS

SEQ ID NO: 2132468 - protein, 27 aa, Cryptosporidium hominis
NFSDWNFPPVLLDKLYFFTRFSKNNKK

SEQ ID NO: 2132469 - protein, 18 aa, Cryptosporidium hominis
NFSIFFKGLITASYSNIP

SEQ ID NO: 2132470 - protein, 18 aa, Cryptosporidium hominis
NFSKLCQNYWKKGVKSLI

SEQ ID NO: 2132471 - protein, 36 aa, Cryptosporidium hominis
NFSKLVYYMMIYDLEWTWKYILSTKNGVFLLNLIGL

SEQ ID NO: 2132472 - protein, 35 aa, Cryptosporidium hominis
NFSKVFTFFNFVWKIILFFIIWKSRNDFIKFQQYD

SEQ ID NO: 2132473 - protein, 24 aa, Cryptosporidium hominis
NFSNMTMVKLLNKESKREFAAKMI

SEQ ID NO: 2132474 - protein, 33 aa, Cryptosporidium hominis
NFSRSIFVFMLISLIFWALTRFFSFAIFDTTRN

SEQ ID NO: 2132475 - protein, 17 aa, Cryptosporidium hominis
NFTMMWLQYCGLSPLLA

SEQ ID NO: 2132476 - protein, 20 aa, Cryptosporidium hominis
NFVIKDWFASQSIFKFYLLE

SEQ ID NO: 2132477 - protein, 25 aa, Cryptosporidium hominis
NGDNSHNFFLTYMALELNEISDDYN

SEQ ID NO: 2132478 - protein, 26 aa, Cryptosporidium hominis
NGGIGCTLGFLWKLIEHAFPQQISPD

SEQ ID NO: 2132479 - protein, 25 aa, Cryptosporidium hominis
NGIKKWFRDLKQKIFRFLDFGKQTY

SEQ ID NO: 2132480 - protein, 25 aa, Cryptosporidium hominis
NGILQPIIYLFIGSSLYISIGVNSV

SEQ ID NO: 2132481 - protein, 29 aa, Cryptosporidium hominis
NGINSNCLLFESPYLFYQVEHRNIKDQLG

SEQ ID NO: 2132482 - protein, 21 aa, Cryptosporidium hominis
NGLIVELVIARSLYAESGVIY

SEQ ID NO: 2132483 - protein, 30 aa, Cryptosporidium hominis
NGLSPCVYFFLFSLYYFLSYSNHIYGFIQF

SEQ ID NO: 2132484 - protein, 29 aa, Cryptosporidium hominis
NGLVMLLQVFYYLSFIFSLINPVLPNQEP

SEQ ID NO: 2132485 - protein, 23 aa, Cryptosporidium hominis
NGNKYLYMVFVNETIMNINKLNS

SEQ ID NO: 2132486 - protein, 34 aa, Cryptosporidium hominis
NGPAILLRWFQASYFLQLILISIVIHLSYLQKRL

SEQ ID NO: 2132487 - protein, 17 aa, Cryptosporidium hominis
NGSLLLNGKVANITTFD

SEQ ID NO: 2132488 - protein, 25 aa, Cryptosporidium hominis
NGTISHRFGLWLAAQRLSEQKTELL

SEQ ID NO: 2132489 - protein, 25 aa, Cryptosporidium hominis
NHHFFSILLLLPFTASSLSLFHFNR

SEQ ID NO: 2132490 - protein, 20 aa, Cryptosporidium hominis
NHIAFLPLEIYFPKNGNIRD

SEQ ID NO: 2132491 - protein, 24 aa, Cryptosporidium hominis
NHIYYLIILLLQLTSSIIPILTKQ

SEQ ID NO: 2132492 - protein, 17 aa, Cryptosporidium hominis
NHNFMVKMLSFLHEYSL

SEQ ID NO: 2132493 - protein, 31 aa, Cryptosporidium hominis
NHPKFKFLSSLWLSQTLQKLASVLFFHLVNK

SEQ ID NO: 2132494 - protein, 24 aa, Cryptosporidium hominis
NIAKPIILLIVVNRLIKIGNKTIF

SEQ ID NO: 2132495 - protein, 26 aa, Cryptosporidium hominis
NICLDIFFYIFNWKSIPKIGMAIEMI

SEQ ID NO: 2132496 - protein, 23 aa, Cryptosporidium hominis
NICNLTQIFLLRKLLECIQSSEF

SEQ ID NO: 2132497 - protein, 22 aa, Cryptosporidium hominis
NIDHLIWDLIVSDYILSLRKKG

SEQ ID NO: 2132498 - protein, 34 aa, Cryptosporidium hominis
NIEEPLMQQIIGPKFYLFEDVFPNSILSIPFIQN

SEQ ID NO: 2132499 - protein, 34 aa, Cryptosporidium hominis
NIEEYLFFYVVKFTCIFVLLLGSFINTLQYIFTS

SEQ ID NO: 2132500 - protein, 17 aa, Cryptosporidium hominis
NIEFYKAYLLLDSFYAI

SEQ ID NO: 2132501 - protein, 23 aa, Cryptosporidium hominis
NIELIFDFKTYLSTFSSLIFKSI

SEQ ID NO: 2132502 - protein, 19 aa, Cryptosporidium hominis
NIERAWYRQILNTAFHKIM

SEQ ID NO: 2132503 - protein, 25 aa, Cryptosporidium hominis
NIETPLFIIAIMDYIRARLVYMTYA

SEQ ID NO: 2132504 - protein, 31 aa, Cryptosporidium hominis
NIFFNKIFFLNSMICFYRCSGSFLTTALLFK

SEQ ID NO: 2132505 - protein, 33 aa, Cryptosporidium hominis
NIFKEPFPISWVNLYWTQPPYGGAAELFSSSNT

SEQ ID NO: 2132506 - protein, 17 aa, Cryptosporidium hominis
NIFLPLSEYYVISSNTT

SEQ ID NO: 2132507 - protein, 24 aa, Cryptosporidium hominis
NIGPQILKCIKPFKLVGDQCVHQV

SEQ ID NO: 2132508 - protein, 20 aa, Cryptosporidium hominis
NIIEFLFHHFSKALLIVIML

SEQ ID NO: 2132509 - protein, 20 aa, Cryptosporidium hominis
NIIFCSFIISLACCAVGNFA

SEQ ID NO: 2132510 - protein, 20 aa, Cryptosporidium hominis
NIIIPIVYSIKNALFPILTV

SEQ ID NO: 2132511 - protein, 47 aa, Cryptosporidium hominis
NIIKFKPYSFEFLLNQLFVTQSLKINFLPFIFRNIASYIVMNSINCM

SEQ ID NO: 2132512 - protein, 20 aa, Cryptosporidium hominis
NIIPLIHVINYVAGILRTVP

SEQ ID NO: 2132513 - protein, 33 aa, Cryptosporidium hominis
NIIPTYYPRNPYVPPYGNPYYFAPNILVPYVYI

SEQ ID NO: 2132514 - protein, 24 aa, Cryptosporidium hominis
NIKGFFSIFQLLLNFWDNKKAEFS

SEQ ID NO: 2132515 - protein, 42 aa, Cryptosporidium hominis
NIKTSRWFCRFFQHYLQIMINPYLQFNIWKTTLENLLEPHIR

SEQ ID NO: 2132516 - protein, 18 aa, Cryptosporidium hominis
NILANLGIMLVAGGSILA

SEQ ID NO: 2132517 - protein, 17 aa, Cryptosporidium hominis
NINILPSTLGRLALMFK

SEQ ID NO: 2132518 - protein, 24 aa, Cryptosporidium hominis
NIPRSFICIDHVVIFVTLKKKSFN

SEQ ID NO: 2132519 - protein, 23 aa, Cryptosporidium hominis
NIQSLLFSFFQQDKNIPKDCFLI

SEQ ID NO: 2132520 - protein, 19 aa, Cryptosporidium hominis
NIQYLPSCIMISVGCPSKH

SEQ ID NO: 2132521 - protein, 31 aa, Cryptosporidium hominis
NIRKGRYFVLSLFHMPHISESYMTVLLESII

SEQ ID NO: 2132522 - protein, 20 aa, Cryptosporidium hominis
NISFVFKIYAGLSAFSVLWF

SEQ ID NO: 2132523 - protein, 25 aa, Cryptosporidium hominis
NISLPFFHSAPIFEKLLHLHKSLDI

SEQ ID NO: 2132524 - protein, 19 aa, Cryptosporidium hominis
NITRRRNLPVPKTSAKFSL

SEQ ID NO: 2132525 - protein, 27 aa, Cryptosporidium hominis
NIVHLKALLTALLTVFRTSSGIIFSYE

SEQ ID NO: 2132526 - protein, 20 aa, Cryptosporidium hominis
NIVLMNIFVLLFMVDPYSNR

SEQ ID NO: 2132527 - protein, 21 aa, Cryptosporidium hominis
NIVTRLKSYLALKLPEKFTQP

SEQ ID NO: 2132528 - protein, 39 aa, Cryptosporidium hominis
NKAYQKFLQIVWNLIIVILLMLSIIFYLAVTTKNLTEAQ

SEQ ID NO: 2132529 - protein, 22 aa, Cryptosporidium hominis
NKEKNHYWLPNKIKNTATNTRN

SEQ ID NO: 2132530 - protein, 25 aa, Cryptosporidium hominis
NKEMPRIPLLILIRANIGVIEDESI

SEQ ID NO: 2132531 - protein, 37 aa, Cryptosporidium hominis
NKEYIKKVIIFFEKLQPFIFILYNDVSWRIRSNVSRP

SEQ ID NO: 2132532 - protein, 22 aa, Cryptosporidium hominis
NKFALYFLIISFLRCLTSYLVN

SEQ ID NO: 2132533 - protein, 18 aa, Cryptosporidium hominis
NKFFDCFLNTIKNQSYLE

SEQ ID NO: 2132534 - protein, 22 aa, Cryptosporidium hominis
NKFSYYYPTNYFYMFISGSKRF

SEQ ID NO: 2132535 - protein, 28 aa, Cryptosporidium hominis
NKIQISFIMIYLIFEFNEYFIFNGFLLY

SEQ ID NO: 2132536 - protein, 17 aa, Cryptosporidium hominis
NKKLFQETLYYELYNNP

SEQ ID NO: 2132537 - protein, 18 aa, Cryptosporidium hominis
NKKNFFFLSLNKYVWVHD

SEQ ID NO: 2132538 - protein, 22 aa, Cryptosporidium hominis
NKLFLLLNRPEKKLTSFGSWAI

SEQ ID NO: 2132539 - protein, 21 aa, Cryptosporidium hominis
NKLNVFFLISSYGIARISSSG

SEQ ID NO: 2132540 - protein, 26 aa, Cryptosporidium hominis
NKLRMEMIIYSYYMGLNFGLAFQLMD

SEQ ID NO: 2132541 - protein, 35 aa, Cryptosporidium hominis
NKLTEQLVINWPPESYLYLNKILEGNIKVYCLGIA

SEQ ID NO: 2132542 - protein, 28 aa, Cryptosporidium hominis
NKMPNSIILFYLKLLSQPITIAWGISKC

SEQ ID NO: 2132543 - protein, 26 aa, Cryptosporidium hominis
NKNEKEWFLYWSSIFGKLCGKEPILR

SEQ ID NO: 2132544 - protein, 22 aa, Cryptosporidium hominis
NKNNVWILEGPHIWKVLIYDKM

SEQ ID NO: 2132545 - protein, 23 aa, Cryptosporidium hominis
NKNSRWFVFGKPMGIDIPEGKQQ

SEQ ID NO: 2132546 - protein, 25 aa, Cryptosporidium hominis
NKNYHFDIIKLIYKLNNHPVEIQSN

SEQ ID NO: 2132547 - protein, 24 aa, Cryptosporidium hominis
NKPSPTLLIRSFALRWSSTFELAY

SEQ ID NO: 2132548 - protein, 26 aa, Cryptosporidium hominis
NKQLSKIRWLSLLLLTIGAVLVQTGK

SEQ ID NO: 2132549 - protein, 23 aa, Cryptosporidium hominis
NKRRAFNITNIIKNLGIFSGNSH

SEQ ID NO: 2132550 - protein, 29 aa, Cryptosporidium hominis
NKSIDLIRPWLGKMDVIIIGCGLGREKDI

SEQ ID NO: 2132551 - protein, 24 aa, Cryptosporidium hominis
NKSNMDFWMDLISDFALGIVTFKN

SEQ ID NO: 2132552 - protein, 28 aa, Cryptosporidium hominis
NKSSFSIFSFFNSLLFKPSLSYSERSIH

SEQ ID NO: 2132553 - protein, 17 aa, Cryptosporidium hominis
NKSWKILLKKPSGDKFQ

SEQ ID NO: 2132554 - protein, 27 aa, Cryptosporidium hominis
NKTKKIELLNRKLLSLGILKVQLDDHF

SEQ ID NO: 2132555 - protein, 25 aa, Cryptosporidium hominis
NKTYGDFFFIILISTFLKEVSRIHL

SEQ ID NO: 2132556 - protein, 20 aa, Cryptosporidium hominis
NKYIKKFIINSRIIHRFLNP

SEQ ID NO: 2132557 - protein, 18 aa, Cryptosporidium hominis
NLCIVIGLLSYFMAYSGH

SEQ ID NO: 2132558 - protein, 24 aa, Cryptosporidium hominis
NLDKPQPRSLPLRGFPSSLATDSD

SEQ ID NO: 2132559 - protein, 20 aa, Cryptosporidium hominis
NLDLKIRIYLPYSSELHVEY

SEQ ID NO: 2132560 - protein, 26 aa, Cryptosporidium hominis
NLDSFIERFNFYKIPYFGTEKKYNGY

SEQ ID NO: 2132561 - protein, 25 aa, Cryptosporidium hominis
NLELKFSLRKWSPLLEKFNGEVSSF

SEQ ID NO: 2132562 - protein, 17 aa, Cryptosporidium hominis
NLELLFDDFSKSSLLNS

SEQ ID NO: 2132563 - protein, 18 aa, Cryptosporidium hominis
NLFIDRLPKVLILIGNSG

SEQ ID NO: 2132564 - protein, 19 aa, Cryptosporidium hominis
NLGLLIWISSAFLLLPLFF

SEQ ID NO: 2132565 - protein, 25 aa, Cryptosporidium hominis
NLGNNDMLILYLKQQLHDIDDIADN

SEQ ID NO: 2132566 - protein, 38 aa, Cryptosporidium hominis
NLHAWNTLLSKIGPIEILFLFVCCIIFRILGDHSEILI

SEQ ID NO: 2132567 - protein, 19 aa, Cryptosporidium hominis
NLHKTNISWILHRNLDLKD

SEQ ID NO: 2132568 - protein, 17 aa, Cryptosporidium hominis
NLILLLVIGIRGDEINA

SEQ ID NO: 2132569 - protein, 17 aa, Cryptosporidium hominis
NLIYMVLFLLQENFSSK

SEQ ID NO: 2132570 - protein, 25 aa, Cryptosporidium hominis
NLKKLVFLLRWCCDRNFASISKQAL

SEQ ID NO: 2132571 - protein, 20 aa, Cryptosporidium hominis
NLKYFFTQWGWWFCIERATS

SEQ ID NO: 2132572 - protein, 17 aa, Cryptosporidium hominis
NLLFFISISTTYGIFVK

SEQ ID NO: 2132573 - protein, 18 aa, Cryptosporidium hominis
NLLNEAWIAQGHELLFFY

SEQ ID NO: 2132574 - protein, 39 aa, Cryptosporidium hominis
NLLNNIKYLIFNNFNSRFSWIVGMSIFTSSIFGLSYLRS

SEQ ID NO: 2132575 - protein, 25 aa, Cryptosporidium hominis
NLLPEDFLVQIITKLLIRISNKEFS

SEQ ID NO: 2132576 - protein, 18 aa, Cryptosporidium hominis
NLLYLINTRISTIEYLLI

SEQ ID NO: 2132577 - protein, 28 aa, Cryptosporidium hominis
NLMECQKWFTEYLSKLWPPFNMEGFKAD

SEQ ID NO: 2132578 - protein, 22 aa, Cryptosporidium hominis
NLNNRFLILSIPKLKSLKKVKA

SEQ ID NO: 2132579 - protein, 19 aa, Cryptosporidium hominis
NLNVNKLFLTKKSSIDGLF

SEQ ID NO: 2132580 - protein, 24 aa, Cryptosporidium hominis
NLNYGGPICTKKLFNNGEISCPKG

SEQ ID NO: 2132581 - protein, 19 aa, Cryptosporidium hominis
NLPAYFPCSDSNLLFELWN

SEQ ID NO: 2132582 - protein, 27 aa, Cryptosporidium hominis
NLPLLIRLMWVFHAIALPASFIVSIVY

SEQ ID NO: 2132583 - protein, 18 aa, Cryptosporidium hominis
NLRYEIFSLIINHVLLDL

SEQ ID NO: 2132584 - protein, 26 aa, Cryptosporidium hominis
NLSSQVFLNLIFRKYLSLSFGDIQTV

SEQ ID NO: 2132585 - protein, 25 aa, Cryptosporidium hominis
NLSVLTYILLYLISLTLQVVGSLYK

SEQ ID NO: 2132586 - protein, 17 aa, Cryptosporidium hominis
NLTLKWAKPSLDVSKDF

SEQ ID NO: 2132587 - protein, 23 aa, Cryptosporidium hominis
NLTNYFTLFIFRKKQSNSSQLKN

SEQ ID NO: 2132588 - protein, 24 aa, Cryptosporidium hominis
NLTSIIFFHLINSPISLVHDRNNL

SEQ ID NO: 2132589 - protein, 26 aa, Cryptosporidium hominis
NLTTNMILMILERILQLLKTFEYILN

SEQ ID NO: 2132590 - protein, 24 aa, Cryptosporidium hominis
NLVCQLVFLLLLFSRVMSITIEHY

SEQ ID NO: 2132591 - protein, 42 aa, Cryptosporidium hominis
NLVGNIMLIRFFSIIIILISLVFTAIIFIPLILIESEKGKEI

SEQ ID NO: 2132592 - protein, 18 aa, Cryptosporidium hominis
NLVLSGICNYAIIAMFYA

SEQ ID NO: 2132593 - protein, 22 aa, Cryptosporidium hominis
NLYLNWLLVINEYQIWRLATCF

SEQ ID NO: 2132594 - protein, 22 aa, Cryptosporidium hominis
NLYRPKILILSNKPSPTLLIRS

SEQ ID NO: 2132595 - protein, 22 aa, Cryptosporidium hominis
NMFTINLHIPFHFIIVAEGKTT

SEQ ID NO: 2132596 - protein, 20 aa, Cryptosporidium hominis
NMILLGCGTSFHAALFAQLL

SEQ ID NO: 2132597 - protein, 36 aa, Cryptosporidium hominis
NMISFIVTLFLLSLLFFIVFLSGIYFLWKKYPANNY

SEQ ID NO: 2132598 - protein, 37 aa, Cryptosporidium hominis
NMKLLSFFKLFSIISILSLIYEHALGSHINLIKELNP

SEQ ID NO: 2132599 - protein, 26 aa, Cryptosporidium hominis
NMLDETWMKYIKLFGVLTQLDPFSQD

SEQ ID NO: 2132600 - protein, 17 aa, Cryptosporidium hominis
NMLKGDLMFYRGDGGNC

SEQ ID NO: 2132601 - protein, 17 aa, Cryptosporidium hominis
NMMYYYECRINTLILFC

SEQ ID NO: 2132602 - protein, 17 aa, Cryptosporidium hominis
NMPLIPPPGTPNAPQNP

SEQ ID NO: 2132603 - protein, 23 aa, Cryptosporidium hominis
NMVRMQFLYPLYEPGEGPESPNQ

SEQ ID NO: 2132604 - protein, 19 aa, Cryptosporidium hominis
NMYTSLMHSILFQCVLYSY

SEQ ID NO: 2132605 - protein, 34 aa, Cryptosporidium hominis
NNFKRLCLNLLKILYLFTLLLFILSDSEFISNYS

SEQ ID NO: 2132606 - protein, 31 aa, Cryptosporidium hominis
NNHSIFYIYYENEIIFWNWSKDDPIYSVQTE

SEQ ID NO: 2132607 - protein, 21 aa, Cryptosporidium hominis
NNIMDKWIYSEAQSLLKFVKT

SEQ ID NO: 2132608 - protein, 17 aa, Cryptosporidium hominis
NNKYLLITLLAQIIPAF

SEQ ID NO: 2132609 - protein, 24 aa, Cryptosporidium hominis
NNLDLRFLYSRFYYDFQRKLNRDK

SEQ ID NO: 2132610 - protein, 20 aa, Cryptosporidium hominis
NNLDVFILANMLAARMIPQI

SEQ ID NO: 2132611 - protein, 40 aa, Cryptosporidium hominis
NNLLIQINIKAWFFWIVYSFLVFIIYFSADYLYIFKNSIL

SEQ ID NO: 2132612 - protein, 23 aa, Cryptosporidium hominis
NNMPYLITFGLIKFNPVDYENFF

SEQ ID NO: 2132613 - protein, 23 aa, Cryptosporidium hominis
NNNFNAILFITNFNLVINSRIIC

SEQ ID NO: 2132614 - protein, 25 aa, Cryptosporidium hominis
NNNINELWPFFYLNYNYTQKKLIIS

SEQ ID NO: 2132615 - protein, 24 aa, Cryptosporidium hominis
NNNKFLFPLFSPRSSSSSSFFAQE

SEQ ID NO: 2132616 - protein, 24 aa, Cryptosporidium hominis
NNNKLMRLDLFPNPYIYGNELFLY

SEQ ID NO: 2132617 - protein, 22 aa, Cryptosporidium hominis
NNNLFNWIELDKQFLYGARACE

SEQ ID NO: 2132618 - protein, 25 aa, Cryptosporidium hominis
NNNSPSFFTAYYLILAHLYRKHSEL

SEQ ID NO: 2132619 - protein, 24 aa, Cryptosporidium hominis
NNPGEFIINNYKLGKNRNFSNSTV

SEQ ID NO: 2132620 - protein, 32 aa, Cryptosporidium hominis
NNPNFIWIYTFIVLFQGFLCALLFIGEAIGGV

SEQ ID NO: 2132621 - protein, 26 aa, Cryptosporidium hominis
NNPTGFWLLFIPTFGSLTLASNSLLP

SEQ ID NO: 2132622 - protein, 23 aa, Cryptosporidium hominis
NNQSSSWFSSWFGNTSSANEIQE

SEQ ID NO: 2132623 - protein, 30 aa, Cryptosporidium hominis
NNQTIFDHDLLNRLLPKLLRRTKVYLSKNN

SEQ ID NO: 2132624 - protein, 28 aa, Cryptosporidium hominis
NNRMILCKNYLISNYLFSSSIPESAEYV

SEQ ID NO: 2132625 - protein, 24 aa, Cryptosporidium hominis
NNSKYYIQSIFNYVNHFFSHEDKA

SEQ ID NO: 2132626 - protein, 25 aa, Cryptosporidium hominis
NNTNLLIFNPFIYSVNIVYYQITAI

SEQ ID NO: 2132627 - protein, 25 aa, Cryptosporidium hominis
NNVSKILRQILKKMLDHLLNLTLKE

SEQ ID NO: 2132628 - protein, 39 aa, Cryptosporidium hominis
NNYFSIVKFFWKLAYLVLFILCWVIFPILLEYELSGDFD

SEQ ID NO: 2132629 - protein, 30 aa, Cryptosporidium hominis
NPDSLPSLLKILLLIWESIGLSLSQFGGNL

SEQ ID NO: 2132630 - protein, 23 aa, Cryptosporidium hominis
NPIKARELLLLFFINLGRTSAEE

SEQ ID NO: 2132631 - protein, 18 aa, Cryptosporidium hominis
NPIYCIHNNEYKCYTNPM

SEQ ID NO: 2132632 - protein, 24 aa, Cryptosporidium hominis
NPKAKIISLIIYSSAIMFSIPLQL

SEQ ID NO: 2132633 - protein, 20 aa, Cryptosporidium hominis
NPKMTLINLYNNTGGAGGAG

SEQ ID NO: 2132634 - protein, 19 aa, Cryptosporidium hominis
NPLLILLDKHNKTLKFVGL

SEQ ID NO: 2132635 - protein, 23 aa, Cryptosporidium hominis
NPNDKLVIIFSRRLKHVYLCHRV

SEQ ID NO: 2132636 - protein, 23 aa, Cryptosporidium hominis
NPNTIRRFFYDLNVIISDIFYKS

SEQ ID NO: 2132637 - protein, 23 aa, Cryptosporidium hominis
NPQLTLMQLFNNSGGFSGSGAAN

SEQ ID NO: 2132638 - protein, 41 aa, Cryptosporidium hominis
NPSEWNYKVLFLFLRILGLTLFVEHLLIHTIKIEKTSEPKI

SEQ ID NO: 2132639 - protein, 26 aa, Cryptosporidium hominis
NPSKSLNLFIWKFTNTEYLKSNEETK

SEQ ID NO: 2132640 - protein, 26 aa, Cryptosporidium hominis
NPSNFFYFHLFYVISSFIMYVTPINL

SEQ ID NO: 2132641 - protein, 23 aa, Cryptosporidium hominis
NPSQILAIWRRPSNSRIKSEVDW

SEQ ID NO: 2132642 - protein, 28 aa, Cryptosporidium hominis
NPTFINYLLIFFFILFDSVTLFESKSGF

SEQ ID NO: 2132643 - protein, 19 aa, Cryptosporidium hominis
NPTFLECLFLRVKIESDPL

SEQ ID NO: 2132644 - protein, 17 aa, Cryptosporidium hominis
NPVYLSIMLDPEKLQKD

SEQ ID NO: 2132645 - protein, 55 aa, Cryptosporidium hominis
NPWERYHISILMKAIFVFMFFDVSREFYIVLISLYFLYIRGLFDGLQDLFERISS

SEQ ID NO: 2132646 - protein, 19 aa, Cryptosporidium hominis
NPYRNLFLQRLSRQGLLRM

SEQ ID NO: 2132647 - protein, 25 aa, Cryptosporidium hominis
NPYSKLCGCYINPFNPGCHCTYNPN

SEQ ID NO: 2132648 - protein, 25 aa, Cryptosporidium hominis
NQDSKLFFIGLQIILNYMYKRRNNE

SEQ ID NO: 2132649 - protein, 27 aa, Cryptosporidium hominis
NQECNSFVDLLLLKRIYRFSQISLDEN

SEQ ID NO: 2132650 - protein, 20 aa, Cryptosporidium hominis
NQFFLVLRSQGILGYKKAPV

SEQ ID NO: 2132651 - protein, 18 aa, Cryptosporidium hominis
NQISDFIPFISTNNKKNK

SEQ ID NO: 2132652 - protein, 35 aa, Cryptosporidium hominis
NQREKRFFTWIYLLAIFVVFIFALTFTYLCAFAYG

SEQ ID NO: 2132653 - protein, 32 aa, Cryptosporidium hominis
NQRKNANFLLKHPFILLKAKRPNSLGTFIQTI

SEQ ID NO: 2132654 - protein, 32 aa, Cryptosporidium hominis
NQSIFSHPLVIIFIFILVVCMFAGGSLIFFKK

SEQ ID NO: 2132655 - protein, 22 aa, Cryptosporidium hominis
NQSMLLEDYLTSAALDVSRLIE

SEQ ID NO: 2132656 - protein, 25 aa, Cryptosporidium hominis
NQSVKLLRLLYSSITGLFVSMDLKD

SEQ ID NO: 2132657 - protein, 19 aa, Cryptosporidium hominis
NQWMALDTLFAIISIGRTH

SEQ ID NO: 2132658 - protein, 29 aa, Cryptosporidium hominis
NRIAHFIFFATSIIFLFFSISKFPFSEIQ

SEQ ID NO: 2132659 - protein, 17 aa, Cryptosporidium hominis
NRIQILRSILICIETKD

SEQ ID NO: 2132660 - protein, 24 aa, Cryptosporidium hominis
NRISKLIDILLNSYLNLTNFDLDG

SEQ ID NO: 2132661 - protein, 31 aa, Cryptosporidium hominis
NRSLKLIFQPITLQIHYPHVLDLYDVLLSMQ

SEQ ID NO: 2132662 - protein, 26 aa, Cryptosporidium hominis
NRVEYWFKLLSAKVIPKILLKFFPDL

SEQ ID NO: 2132663 - protein, 21 aa, Cryptosporidium hominis
NSAFFGFLLNKVTFAICLLVW

SEQ ID NO: 2132664 - protein, 21 aa, Cryptosporidium hominis
NSCIWDLSWDDHGISFISGSS

SEQ ID NO: 2132665 - protein, 25 aa, Cryptosporidium hominis
NSCKYFSFYPRSFTLNYKKDLKLLE

SEQ ID NO: 2132666 - protein, 30 aa, Cryptosporidium hominis
NSDILLVGLTFTLLFFYVGVANFSFDLYKM

SEQ ID NO: 2132667 - protein, 26 aa, Cryptosporidium hominis
NSDLISRIPILLRRMVLYSEIGDIVL

SEQ ID NO: 2132668 - protein, 42 aa, Cryptosporidium hominis
NSFILKYMSMIEYIFTILRTQPLYIINLMLECSFGEEFISIL

SEQ ID NO: 2132669 - protein, 21 aa, Cryptosporidium hominis
NSFILLFNLINIEIMEYVYNA

SEQ ID NO: 2132670 - protein, 24 aa, Cryptosporidium hominis
NSFILSIVVSFLYFLFNYKKNENN

SEQ ID NO: 2132671 - protein, 25 aa, Cryptosporidium hominis
NSFSWGLFTFFFALGSMNSTFPLYL

SEQ ID NO: 2132672 - protein, 19 aa, Cryptosporidium hominis
NSIFNMRPSILYNTYIVCP

SEQ ID NO: 2132673 - protein, 24 aa, Cryptosporidium hominis
NSILFSLSILYHRNHLAMTTGIIL

SEQ ID NO: 2132674 - protein, 23 aa, Cryptosporidium hominis
NSISILSLLLLLNKNYTSKVVLQ

SEQ ID NO: 2132675 - protein, 17 aa, Cryptosporidium hominis
NSISSLTISKVDNIPFI

SEQ ID NO: 2132676 - protein, 27 aa, Cryptosporidium hominis
NSKFCKDIFLWSFQQKGLIKIGEISHR

SEQ ID NO: 2132677 - protein, 21 aa, Cryptosporidium hominis
NSKFNIFDCLPYIIISTLELI

SEQ ID NO: 2132678 - protein, 30 aa, Cryptosporidium hominis
NSKHLYLSNLRFFIFGFISKLLASALTYPL

SEQ ID NO: 2132679 - protein, 25 aa, Cryptosporidium hominis
NSKLVLGVVFLSFIASVLLFSSIEL

SEQ ID NO: 2132680 - protein, 23 aa, Cryptosporidium hominis
NSKLYMMLLILISSWANSCITMI

SEQ ID NO: 2132681 - protein, 26 aa, Cryptosporidium hominis
NSLIRQILFSPFWLSDSTPTSYLMNR

SEQ ID NO: 2132682 - protein, 32 aa, Cryptosporidium hominis
NSLQIIGLILLLIKPICLYYDKLNIIAFTQYG

SEQ ID NO: 2132683 - protein, 18 aa, Cryptosporidium hominis
NSLRLLFLSSITTVIVDY

SEQ ID NO: 2132684 - protein, 26 aa, Cryptosporidium hominis
NSLSRSYLWKFLDSEWKTLPQFYKMN

SEQ ID NO: 2132685 - protein, 22 aa, Cryptosporidium hominis
NSLYQLILGLKNRGIRHIHIMT

SEQ ID NO: 2132686 - protein, 24 aa, Cryptosporidium hominis
NSMYLIIPAFLMALVFHPSLNSWM

SEQ ID NO: 2132687 - protein, 17 aa, Cryptosporidium hominis
NSNLLLAFSARIATYYS

SEQ ID NO: 2132688 - protein, 24 aa, Cryptosporidium hominis
NSNNRPVLILLDRDIDLSTMINHS

SEQ ID NO: 2132689 - protein, 32 aa, Cryptosporidium hominis
NSPDLNITALLYFYKCVFFPLSSSFTAALLNI

SEQ ID NO: 2132690 - protein, 21 aa, Cryptosporidium hominis
NSPFRIACQFSLIKCTLANIK

SEQ ID NO: 2132691 - protein, 28 aa, Cryptosporidium hominis
NSPLLSIFIFLITSIQMIIYFVQLKFGP

SEQ ID NO: 2132692 - protein, 22 aa, Cryptosporidium hominis
NSQKLAQAALLYMASKLTSQEE

SEQ ID NO: 2132693 - protein, 24 aa, Cryptosporidium hominis
NSQKYRLLLLDELPNYRLTTEDGG

SEQ ID NO: 2132694 - protein, 24 aa, Cryptosporidium hominis
NSQLSHFGWFKLILNSGEKTQLEE

SEQ ID NO: 2132695 - protein, 30 aa, Cryptosporidium hominis
NSSGIIKYILPFYSFQMFLKDIYLHLNGFN

SEQ ID NO: 2132696 - protein, 26 aa, Cryptosporidium hominis
NSSNNYYIFYEKKLHNWVLTDKFDLD

SEQ ID NO: 2132697 - protein, 25 aa, Cryptosporidium hominis
NSSVALAHFWLHPALIHTSSHSNLW

SEQ ID NO: 2132698 - protein, 18 aa, Cryptosporidium hominis
NSTPEYLLQAFPAILTFT

SEQ ID NO: 2132699 - protein, 19 aa, Cryptosporidium hominis
NSYKFIGSDIWGLVRSARY

SEQ ID NO: 2132700 - protein, 17 aa, Cryptosporidium hominis
NSYKWDWSSIPNNFVNF

SEQ ID NO: 2132701 - protein, 24 aa, Cryptosporidium hominis
NSYSTLFFYILKAANRFKYPKNWS

SEQ ID NO: 2132702 - protein, 25 aa, Cryptosporidium hominis
NSYSYIFMALAIISGFFGFLRFFTH

SEQ ID NO: 2132703 - protein, 27 aa, Cryptosporidium hominis
NSYVEYAIFIILITIVSLINSIYETRC

SEQ ID NO: 2132704 - protein, 23 aa, Cryptosporidium hominis
NTELFIGPLSFFQTNTKGCETLY

SEQ ID NO: 2132705 - protein, 17 aa, Cryptosporidium hominis
NTFKNFLLRISLRNQNT

SEQ ID NO: 2132706 - protein, 36 aa, Cryptosporidium hominis
NTHEFIRLIFNIIIVFITLYIIFGIIFVIKNDIESK

SEQ ID NO: 2132707 - protein, 18 aa, Cryptosporidium hominis
NTILPFSILCITFIFLKI

SEQ ID NO: 2132708 - protein, 25 aa, Cryptosporidium hominis
NTLAMYMEWIWLNDHIQSVIEQGYD

SEQ ID NO: 2132709 - protein, 28 aa, Cryptosporidium hominis
NTNKLRYFYGRHLWLFSSKVNLINLCSI

SEQ ID NO: 2132710 - protein, 24 aa, Cryptosporidium hominis
NTNMETGIFTIWKPIPPSNQFVSL

SEQ ID NO: 2132711 - protein, 19 aa, Cryptosporidium hominis
NTPLILFGSLFLKSYGIVI

SEQ ID NO: 2132712 - protein, 19 aa, Cryptosporidium hominis
NTSIGGFPGAMMFGAIRLD

SEQ ID NO: 2132713 - protein, 25 aa, Cryptosporidium hominis
NTTIPTLFIIFDGTHEFWTITSSLD

SEQ ID NO: 2132714 - protein, 27 aa, Cryptosporidium hominis
NVDVTLEFAWLEIFRSRILIAGARLSI

SEQ ID NO: 2132715 - protein, 24 aa, Cryptosporidium hominis
NVETVFELLMVPLVLRFDNNLTYE

SEQ ID NO: 2132716 - protein, 31 aa, Cryptosporidium hominis
NVFIPFSPIRFLSSQLTFFKVLGLVKIYHES

SEQ ID NO: 2132717 - protein, 26 aa, Cryptosporidium hominis
NVFPFSWKFELVGWIAASFLICIFIY

SEQ ID NO: 2132718 - protein, 21 aa, Cryptosporidium hominis
NVFSIFFVITNASIALGQSTP

SEQ ID NO: 2132719 - protein, 23 aa, Cryptosporidium hominis
NVHPIIQFLSYYSVSVSTLTSIN

SEQ ID NO: 2132720 - protein, 28 aa, Cryptosporidium hominis
NVIKTARYSLLFFLPKNLYDQFNNVANI

SEQ ID NO: 2132721 - protein, 25 aa, Cryptosporidium hominis
NVIRYMFCKGLQYPTSGWLRLNHLN

SEQ ID NO: 2132722 - protein, 27 aa, Cryptosporidium hominis
NVLTQYCAIFHRLYAPAILPGHTAYTD

SEQ ID NO: 2132723 - protein, 17 aa, Cryptosporidium hominis
NVMIFGTIMFTINKYFS

SEQ ID NO: 2132724 - protein, 29 aa, Cryptosporidium hominis
NVQEFIQIVSYWRSAIQHILYKNTKLWTS

SEQ ID NO: 2132725 - protein, 19 aa, Cryptosporidium hominis
NVQFSFFYILCQLGEMAKY

SEQ ID NO: 2132726 - protein, 28 aa, Cryptosporidium hominis
NVSADSCDMFWYPGIIRQLSSESLPDKC

SEQ ID NO: 2132727 - protein, 17 aa, Cryptosporidium hominis
NVTPRLISFLDTLCNWY

SEQ ID NO: 2132728 - protein, 23 aa, Cryptosporidium hominis
NVYTIKTIGIPLALDALLQKGSG

SEQ ID NO: 2132729 - protein, 29 aa, Cryptosporidium hominis
NWGKIGKIILFIYISFLSMLHDITGIVIP

SEQ ID NO: 2132730 - protein, 23 aa, Cryptosporidium hominis
NYALFPIFCVVASIILIFSLTGY

SEQ ID NO: 2132731 - protein, 24 aa, Cryptosporidium hominis
NYDDKWIVVQKYYNGKLLNNLSLS

SEQ ID NO: 2132732 - protein, 20 aa, Cryptosporidium hominis
NYELYIIPTINYHYDNQLQV

SEQ ID NO: 2132733 - protein, 19 aa, Cryptosporidium hominis
NYFEIIFSNGGFKDKIVRA

SEQ ID NO: 2132734 - protein, 21 aa, Cryptosporidium hominis
NYFEKYLLKSYYKTASLFSFG

SEQ ID NO: 2132735 - protein, 23 aa, Cryptosporidium hominis
NYFMLSRSFLDRYDIPLLFNLLY

SEQ ID NO: 2132736 - protein, 19 aa, Cryptosporidium hominis
NYKWWWFSFLNGLSPCVYF

SEQ ID NO: 2132737 - protein, 21 aa, Cryptosporidium hominis
NYLSVFLMYMDPPSAFKCILN

SEQ ID NO: 2132738 - protein, 32 aa, Cryptosporidium hominis
NYREILDRNVLFSRLFWLDIAYSEIAVHYLNN

SEQ ID NO: 2132739 - protein, 26 aa, Cryptosporidium hominis
NYSEILLFPSILILKLLSIQNYEKSI

SEQ ID NO: 2132740 - protein, 31 aa, Cryptosporidium hominis
NYSNGIIFTILILSLLISAPILGLLAVAIKS

SEQ ID NO: 2132741 - protein, 18 aa, Cryptosporidium hominis
NYTLYILISFGDPGYLKS

SEQ ID NO: 2132742 - protein, 22 aa, Cryptosporidium hominis
NYTVLLSFIPDLLEEILKAINN

SEQ ID NO: 2132743 - protein, 29 aa, Cryptosporidium hominis
NYVKSNRGLIIKLFLLLIAFIIFYVIFLT

SEQ ID NO: 2132744 - protein, 21 aa, Cryptosporidium hominis
NYYEEFLILIGYSLALEYFCE

SEQ ID NO: 2132745 - protein, 18 aa, Cryptosporidium hominis
PADFLWMLITCSWMLLLL

SEQ ID NO: 2132746 - protein, 17 aa, Cryptosporidium hominis
PADLLIPKLKKMMPKTR

SEQ ID NO: 2132747 - protein, 29 aa, Cryptosporidium hominis
PAEWSTQILVWISSLLRISDFNGVLKILI

SEQ ID NO: 2132748 - protein, 25 aa, Cryptosporidium hominis
PAFDIIPFWVLICLLFCNYGKITLS

SEQ ID NO: 2132749 - protein, 17 aa, Cryptosporidium hominis
PALLLMDTFPLISLSFI

SEQ ID NO: 2132750 - protein, 20 aa, Cryptosporidium hominis
PAPWQYIKYGSATAKASMVL

SEQ ID NO: 2132751 - protein, 22 aa, Cryptosporidium hominis
PAPYVINTLTYQSFRTDMWLSP

SEQ ID NO: 2132752 - protein, 25 aa, Cryptosporidium hominis
PAVLTLLFNYFPLSSAFLGRKHLRL

SEQ ID NO: 2132753 - protein, 33 aa, Cryptosporidium hominis
PCMIFHYSVLFSYLVFILKTTPWWLNISDLVNL

SEQ ID NO: 2132754 - protein, 25 aa, Cryptosporidium hominis
PCSDSNLLFELWNGESKPTLIGKFK

SEQ ID NO: 2132755 - protein, 24 aa, Cryptosporidium hominis
PCTDKLLEYFAKKALETGNANRIT

SEQ ID NO: 2132756 - protein, 20 aa, Cryptosporidium hominis
PDQWLNLDWIHPMEPSCSNT

SEQ ID NO: 2132757 - protein, 23 aa, Cryptosporidium hominis
PDRIIIMIHHFPTFLNVFINSRM

SEQ ID NO: 2132758 - protein, 31 aa, Cryptosporidium hominis
PDRLVYTLQNYYFRSFIYEGMNLRGVGSSLP

SEQ ID NO: 2132759 - protein, 20 aa, Cryptosporidium hominis
PDSFNFWFFGSHWLNQNTSM

SEQ ID NO: 2132760 - protein, 18 aa, Cryptosporidium hominis
PDSVWSYAYSCVYILDEN

SEQ ID NO: 2132761 - protein, 17 aa, Cryptosporidium hominis
PEDSFLKRKLFYCEPES

SEQ ID NO: 2132762 - protein, 26 aa, Cryptosporidium hominis
PEGINYLDLPFFKKKLVKKEKKNTGE

SEQ ID NO: 2132763 - protein, 26 aa, Cryptosporidium hominis
PEKALEFPLVLYSSVTTPLILENITS

SEQ ID NO: 2132764 - protein, 26 aa, Cryptosporidium hominis
PEKKPTLPSSMPWTPNSSSFHVPQNS

SEQ ID NO: 2132765 - protein, 29 aa, Cryptosporidium hominis
PELRTGPLFTYIAPLLLVLSITIGKEAID

SEQ ID NO: 2132766 - protein, 31 aa, Cryptosporidium hominis
PENIPGLSRYLLYTLLFGSLKKKFTKQFAML

SEQ ID NO: 2132767 - protein, 25 aa, Cryptosporidium hominis
PERHFIKYVLAFFAASDGIVMENLA

SEQ ID NO: 2132768 - protein, 26 aa, Cryptosporidium hominis
PFCKNTIETLFFTSNPRYFEYLIDDS

SEQ ID NO: 2132769 - protein, 22 aa, Cryptosporidium hominis
PFEPIKIFRLVTQAGLKNASVD

SEQ ID NO: 2132770 - protein, 30 aa, Cryptosporidium hominis
PFGSIASFRFALAFLAPITTYIIGYFTMFN

SEQ ID NO: 2132771 - protein, 21 aa, Cryptosporidium hominis
PFIFLGLFQSIFLCCSGEEIL

SEQ ID NO: 2132772 - protein, 20 aa, Cryptosporidium hominis
PFIISFRLFNISQEPFFSPD

SEQ ID NO: 2132773 - protein, 26 aa, Cryptosporidium hominis
PFKVVAYNYMMLFYESDLSILTECFS

SEQ ID NO: 2132774 - protein, 26 aa, Cryptosporidium hominis
PFREILLWTTLFSIPIYILPLVLVTG

SEQ ID NO: 2132775 - protein, 22 aa, Cryptosporidium hominis
PFSILCITFIFLKISKLLIKKP

SEQ ID NO: 2132776 - protein, 18 aa, Cryptosporidium hominis
PFSKIEEWYENKAYLPYA

SEQ ID NO: 2132777 - protein, 26 aa, Cryptosporidium hominis
PFSWRIEFVIICLTTMFLTVSLFSLI

SEQ ID NO: 2132778 - protein, 25 aa, Cryptosporidium hominis
PGEVPGAALLRKRVYRRLNNIEDIV

SEQ ID NO: 2132779 - protein, 24 aa, Cryptosporidium hominis
PGFLSFFLLAYLTMLFFSPFVAIS

SEQ ID NO: 2132780 - protein, 23 aa, Cryptosporidium hominis
PGFNFAYDIWRKQKNKRTMEVIQ

SEQ ID NO: 2132781 - protein, 26 aa, Cryptosporidium hominis
PGGGYYYYYNFYPPPPPMQPEPFPYY

SEQ ID NO: 2132782 - protein, 23 aa, Cryptosporidium hominis
PGKSKFLYYLSSVVLRGPDLRSL

SEQ ID NO: 2132783 - protein, 25 aa, Cryptosporidium hominis
PGQALLIADLYYNPLLVSSKLTLYS

SEQ ID NO: 2132784 - protein, 18 aa, Cryptosporidium hominis
PGRRWCWKFVKHAQVSYF

SEQ ID NO: 2132785 - protein, 27 aa, Cryptosporidium hominis
PGRVKYWMMLCEAVGNFYHWLSIIKET

SEQ ID NO: 2132786 - protein, 25 aa, Cryptosporidium hominis
PGSSNYILIISFTLNIFISIFTMNY

SEQ ID NO: 2132787 - protein, 21 aa, Cryptosporidium hominis
PGTNIFFLTMAAHGQLVLSGT

SEQ ID NO: 2132788 - protein, 17 aa, Cryptosporidium hominis
PGWIQNRFIFASAFMEE

SEQ ID NO: 2132789 - protein, 24 aa, Cryptosporidium hominis
PHDFKLLICHIIDKILLNYNILAG

SEQ ID NO: 2132790 - protein, 22 aa, Cryptosporidium hominis
PHTNTRVFIFKMADIFPNKLSS

SEQ ID NO: 2132791 - protein, 24 aa, Cryptosporidium hominis
PIAIPIMFLIIISMFRMIRHSSMK

SEQ ID NO: 2132792 - protein, 27 aa, Cryptosporidium hominis
PIKELMANTLFIMSNYLIWKEYIKDEN

SEQ ID NO: 2132793 - protein, 26 aa, Cryptosporidium hominis
PILAVSILCLVFWYNLMKVTNVEFSD

SEQ ID NO: 2132794 - protein, 19 aa, Cryptosporidium hominis
PILCQSYCNLWYDACYEDY

SEQ ID NO: 2132795 - protein, 36 aa, Cryptosporidium hominis
PILIQVISLILLLFRWVILLMYIVAQLFLPIKAVRQ

SEQ ID NO: 2132796 - protein, 33 aa, Cryptosporidium hominis
PILKLICFQIVIYLPFIFLRDIENLGFLSVLAN

SEQ ID NO: 2132797 - protein, 17 aa, Cryptosporidium hominis
PINLELLFDDFSKSSLL

SEQ ID NO: 2132798 - protein, 17 aa, Cryptosporidium hominis
PIPGYLQDKSRFPLLRI

SEQ ID NO: 2132799 - protein, 31 aa, Cryptosporidium hominis
PIRPVLKFFCIKLIIFMSFWQSIILSVLSHF

SEQ ID NO: 2132800 - protein, 22 aa, Cryptosporidium hominis
PIRTLEIPFRLKKDFISPLSSP

SEQ ID NO: 2132801 - protein, 20 aa, Cryptosporidium hominis
PISLIIILISTFSSAFVASR

SEQ ID NO: 2132802 - protein, 23 aa, Cryptosporidium hominis
PISRSFIHFIPASNLYTLYSISD

SEQ ID NO: 2132803 - protein, 25 aa, Cryptosporidium hominis
PISTLEPFWIKLKGGARLNNHVGDI

SEQ ID NO: 2132804 - protein, 19 aa, Cryptosporidium hominis
PIVQRIFYGLCLLDDSNVA

SEQ ID NO: 2132805 - protein, 28 aa, Cryptosporidium hominis
PIYGQNSWMFLLLSLNQSHYTRKFWTEV

SEQ ID NO: 2132806 - protein, 18 aa, Cryptosporidium hominis
PIYKLVLGPWTHSGRASC

SEQ ID NO: 2132807 - protein, 26 aa, Cryptosporidium hominis
PKEIFQLMIFIAQTCPYYYKYGVCNK

SEQ ID NO: 2132808 - protein, 21 aa, Cryptosporidium hominis
PKKHLGKYLARIKRAIPTKKP

SEQ ID NO: 2132809 - protein, 29 aa, Cryptosporidium hominis
PKKSPIMTRDWWIFGNIPHAIFEAICVLS

SEQ ID NO: 2132810 - protein, 24 aa, Cryptosporidium hominis
PKKYLDYTFRLRWYGENEGSPDQW

SEQ ID NO: 2132811 - protein, 21 aa, Cryptosporidium hominis
PKLIFRLLEFYIQAKNLPEGH

SEQ ID NO: 2132812 - protein, 40 aa, Cryptosporidium hominis
PKSIGAWNIHYIITSLLDYIPLLIMFSSISALIGNSGQTN

SEQ ID NO: 2132813 - protein, 37 aa, Cryptosporidium hominis
PKSLKYLELIFCEELDWKITFKLDTIKSFISKIVDSK

SEQ ID NO: 2132814 - protein, 20 aa, Cryptosporidium hominis
PKSSLYIFTTSCLILAFSLM

SEQ ID NO: 2132815 - protein, 31 aa, Cryptosporidium hominis
PKSTFSWKIMSIFSFLKLKKPKYAPPSHNLH

SEQ ID NO: 2132816 - protein, 35 aa, Cryptosporidium hominis
PKSVCKYFPSSLKVRLLKPFYSWRATAAHGVCLYR

SEQ ID NO: 2132817 - protein, 21 aa, Cryptosporidium hominis
PKYISFCFFLGIMGSLHLMSF

SEQ ID NO: 2132818 - protein, 18 aa, Cryptosporidium hominis
PLALCFIGMVSLSNICLK

SEQ ID NO: 2132819 - protein, 19 aa, Cryptosporidium hominis
PLEMCMFEFSGWVLCDDYN

SEQ ID NO: 2132820 - protein, 18 aa, Cryptosporidium hominis
PLEVGFTFSFPIVQSKIA

SEQ ID NO: 2132821 - protein, 23 aa, Cryptosporidium hominis
PLGEFLYSVFSLSFPWTRMTSQV

SEQ ID NO: 2132822 - protein, 19 aa, Cryptosporidium hominis
PLHFAYLGVVLCIVLSTFG

SEQ ID NO: 2132823 - protein, 19 aa, Cryptosporidium hominis
PLHWAVRLELPKVVHRLVK

SEQ ID NO: 2132824 - protein, 26 aa, Cryptosporidium hominis
PLIAYGFYVLLLQWSEKSTSLSMPVN

SEQ ID NO: 2132825 - protein, 22 aa, Cryptosporidium hominis
PLIDIQIVLFIAPLLTLGSLCG

SEQ ID NO: 2132826 - protein, 29 aa, Cryptosporidium hominis
PLKPIFLSFFLFIVGLFFFYIGMALFLSK

SEQ ID NO: 2132827 - protein, 27 aa, Cryptosporidium hominis
PLKQSFFDKVFIKNFKIYPMVIHLTFN

SEQ ID NO: 2132828 - protein, 21 aa, Cryptosporidium hominis
PLKRLSCPAIFFDCTHDNETP

SEQ ID NO: 2132829 - protein, 32 aa, Cryptosporidium hominis
PLKTATFMFFSFALFGLIPMLSFVSFKYIFSL

SEQ ID NO: 2132830 - protein, 20 aa, Cryptosporidium hominis
PLLLVPFSLPLILLSSIFPL

SEQ ID NO: 2132831 - protein, 24 aa, Cryptosporidium hominis
PLNLSLFISLLLFLYQTFDAADGK

SEQ ID NO: 2132832 - protein, 23 aa, Cryptosporidium hominis
PLRENFALPFIWINNMILISIIK

SEQ ID NO: 2132833 - protein, 21 aa, Cryptosporidium hominis
PLRRVIYGFMTKIRLLLIESI

SEQ ID NO: 2132834 - protein, 17 aa, Cryptosporidium hominis
PLSLPKIRRNPFVEIIT

SEQ ID NO: 2132835 - protein, 34 aa, Cryptosporidium hominis
PLTALNAVIPLQLIAYYLAIKRGINPDKPRGLAK

SEQ ID NO: 2132836 - protein, 25 aa, Cryptosporidium hominis
PMAKLLFSFIYLISTYTQSLYCIDN

SEQ ID NO: 2132837 - protein, 28 aa, Cryptosporidium hominis
PMDYSSITNFLWPRIVFAISSSSSSALS

SEQ ID NO: 2132838 - protein, 22 aa, Cryptosporidium hominis
PNARKCLTPLRVLPIGVAQSVP

SEQ ID NO: 2132839 - protein, 22 aa, Cryptosporidium hominis
PNCDKLKWLRDKYPSIYRQTMR

SEQ ID NO: 2132840 - protein, 24 aa, Cryptosporidium hominis
PNDISILKGILLDTNKLLSQNIEA

SEQ ID NO: 2132841 - protein, 17 aa, Cryptosporidium hominis
PNFLSTFFFVAGGLSFI

SEQ ID NO: 2132842 - protein, 30 aa, Cryptosporidium hominis
PNHPINALLQKSLLKWLLGVGLVSSSFEVQ

SEQ ID NO: 2132843 - protein, 34 aa, Cryptosporidium hominis
PNKKLKNIIIATLIAIFIVLVVTVSLYITNNTSD

SEQ ID NO: 2132844 - protein, 30 aa, Cryptosporidium hominis
PNLEACFILIRYFWLAKLIKINKRKYRPLK

SEQ ID NO: 2132845 - protein, 27 aa, Cryptosporidium hominis
PNNYVLMSVRNIIYQLALPHSMLQENA

SEQ ID NO: 2132846 - protein, 26 aa, Cryptosporidium hominis
PNSHSKLPWFPTLSSALYLTEDASPF

SEQ ID NO: 2132847 - protein, 23 aa, Cryptosporidium hominis
PNSNPVFGIILVAVGFAVSSIPE

SEQ ID NO: 2132848 - protein, 24 aa, Cryptosporidium hominis
PNVFSLIPIIYLNSKLWNVQKLLY

SEQ ID NO: 2132849 - protein, 26 aa, Cryptosporidium hominis
PPAEESSWFSGWFGASETTPAPPPTP

SEQ ID NO: 2132850 - protein, 25 aa, Cryptosporidium hominis
PPAEKSSWFSGWFGASETTPAPPPT

SEQ ID NO: 2132851 - protein, 23 aa, Cryptosporidium hominis
PPEYLYPVTITIYSSASFLASIK

SEQ ID NO: 2132852 - protein, 35 aa, Cryptosporidium hominis
PPPPPPTPTLIPKDKPKWSPPPPLEPIDNSTNTQT

SEQ ID NO: 2132853 - protein, 25 aa, Cryptosporidium hominis
PPRRLPQLLVLSIIGGLTVLGFGAL

SEQ ID NO: 2132854 - protein, 27 aa, Cryptosporidium hominis
PPWVLQAFFVIFFGFLADKLVSSSVKP

SEQ ID NO: 2132855 - protein, 33 aa, Cryptosporidium hominis
PQEQFLELIPNSRYSPVLPLQKSGFIILNDSTP

SEQ ID NO: 2132856 - protein, 20 aa, Cryptosporidium hominis
PQIPLLLKGWTIRDFLDPYE

SEQ ID NO: 2132857 - protein, 25 aa, Cryptosporidium hominis
PQRRKIPIALISLGLNSPFLSFKNK

SEQ ID NO: 2132858 - protein, 21 aa, Cryptosporidium hominis
PRKDQLIPLSGRFSNLFDKII

SEQ ID NO: 2132859 - protein, 19 aa, Cryptosporidium hominis
PRQKSLLLMIPLIEMMNQL

SEQ ID NO: 2132860 - protein, 25 aa, Cryptosporidium hominis
PSDHKKFFFFLVEKNFDADKALELV

SEQ ID NO: 2132861 - protein, 22 aa, Cryptosporidium hominis
PSIFHQRCCILLLNSVRSIIDT

SEQ ID NO: 2132862 - protein, 33 aa, Cryptosporidium hominis
PSLLIFIFTLFYPLLLLFLWFLFREKNLLVDPL

SEQ ID NO: 2132863 - protein, 28 aa, Cryptosporidium hominis
PSPKSIIQFRFIFPLDKITDNFSEFSTD

SEQ ID NO: 2132864 - protein, 28 aa, Cryptosporidium hominis
PSQIRFVHYFSFLLKHTFPESVIKRGSN

SEQ ID NO: 2132865 - protein, 24 aa, Cryptosporidium hominis
PSQPLFFENFLVNNLKLGFGSMLL

SEQ ID NO: 2132866 - protein, 17 aa, Cryptosporidium hominis
PSRFPLISGDKRGKHKK

SEQ ID NO: 2132867 - protein, 26 aa, Cryptosporidium hominis
PSSAEMLTYFLRLLAVPEQKAKNEHL

SEQ ID NO: 2132868 - protein, 28 aa, Cryptosporidium hominis
PSSLESLYFRINFAYRFSFIVCCQLNQV

SEQ ID NO: 2132869 - protein, 19 aa, Cryptosporidium hominis
PSTPYYILALSLTGTCGQF

SEQ ID NO: 2132870 - protein, 26 aa, Cryptosporidium hominis
PSTRSKLFLILRIRYRILKLKNEDKD

SEQ ID NO: 2132871 - protein, 34 aa, Cryptosporidium hominis
PSVIITFPLLEDPNIQFLAWTTTPWTLPSNVAIA

SEQ ID NO: 2132872 - protein, 21 aa, Cryptosporidium hominis
PSWFVGILTLPTLKEGISLIP

SEQ ID NO: 2132873 - protein, 19 aa, Cryptosporidium hominis
PSYIKPMVFSWPSGNSFLE

SEQ ID NO: 2132874 - protein, 24 aa, Cryptosporidium hominis
PTCIGIKAIFYLKFSRLISTDGNV

SEQ ID NO: 2132875 - protein, 18 aa, Cryptosporidium hominis
PTHLGVYYNFINSEGPTT

SEQ ID NO: 2132876 - protein, 27 aa, Cryptosporidium hominis
PTILFTIIYSLMWFVRLYFTVNMKSIL

SEQ ID NO: 2132877 - protein, 22 aa, Cryptosporidium hominis
PTKHYLYPVHTSKSFIFINSVV

SEQ ID NO: 2132878 - protein, 19 aa, Cryptosporidium hominis
PTPAPIEESSWFSSWFGGT

SEQ ID NO: 2132879 - protein, 23 aa, Cryptosporidium hominis
PTRKIYNSFLSPLPTSKPSPILL

SEQ ID NO: 2132880 - protein, 17 aa, Cryptosporidium hominis
PTSLHFLLAQFFSNYSE

SEQ ID NO: 2132881 - protein, 26 aa, Cryptosporidium hominis
PTVEESSWFSGWFGASETTPAPPPTP

SEQ ID NO: 2132882 - protein, 29 aa, Cryptosporidium hominis
PVEYKEEISLLWRLLTLLVGNSSKNNYTT

SEQ ID NO: 2132883 - protein, 31 aa, Cryptosporidium hominis
PVFLQKPYNIPPFLHFIFGKEPILIPDSQFH

SEQ ID NO: 2132884 - protein, 28 aa, Cryptosporidium hominis
PVGTEMYIPSRFLLGLIPQIFLETHEFW

SEQ ID NO: 2132885 - protein, 47 aa, Cryptosporidium hominis
PVHKTGDLKMILISLSGIARICLTSVLLFFSIPTNSQYVRVPVETCP

SEQ ID NO: 2132886 - protein, 20 aa, Cryptosporidium hominis
PVIYPPSLWDLRCNAQLILS

SEQ ID NO: 2132887 - protein, 25 aa, Cryptosporidium hominis
PVKAYKYVFPRNINTLKTALAKYGP

SEQ ID NO: 2132888 - protein, 28 aa, Cryptosporidium hominis
PVLLLLHYQLLLMLTLVLSLAISYIHLE

SEQ ID NO: 2132889 - protein, 19 aa, Cryptosporidium hominis
PVLSTYFGYSIVPITEKNT

SEQ ID NO: 2132890 - protein, 18 aa, Cryptosporidium hominis
PVPFEMFFEKVFIYSNDM

SEQ ID NO: 2132891 - protein, 17 aa, Cryptosporidium hominis
PVPVPVPVPVPMPVPQP

SEQ ID NO: 2132892 - protein, 19 aa, Cryptosporidium hominis
PVRVPLVFELAYLPLMMRV

SEQ ID NO: 2132893 - protein, 19 aa, Cryptosporidium hominis
PVTSSWQLLLISLSDNCYG

SEQ ID NO: 2132894 - protein, 21 aa, Cryptosporidium hominis
PWIEREFVIKIFGYESPQRHL

SEQ ID NO: 2132895 - protein, 21 aa, Cryptosporidium hominis
PWIHGGRLIWYKTGKNSSNNY

SEQ ID NO: 2132896 - protein, 20 aa, Cryptosporidium hominis
PWKLKFLNYFIPPLYDCYPS

SEQ ID NO: 2132897 - protein, 31 aa, Cryptosporidium hominis
PWYLQSTFIFSFVGIIFLLIVGAIAIFYIAA

SEQ ID NO: 2132898 - protein, 29 aa, Cryptosporidium hominis
PYDFNYYNIINTVFLILTITAISIYFSKR

SEQ ID NO: 2132899 - protein, 26 aa, Cryptosporidium hominis
PYFDGGLFNELLLDFSRQFSEYYILR

SEQ ID NO: 2132900 - protein, 18 aa, Cryptosporidium hominis
PYIMSTVCILPLLFAFSY

SEQ ID NO: 2132901 - protein, 22 aa, Cryptosporidium hominis
PYLSSLRIFVALRIFHFNNKLN

SEQ ID NO: 2132902 - protein, 26 aa, Cryptosporidium hominis
PYNSLTNLKFIHPINRLFACIKNKKI

SEQ ID NO: 2132903 - protein, 19 aa, Cryptosporidium hominis
PYPFGFDPVWKGAVNEMSF

SEQ ID NO: 2132904 - protein, 21 aa, Cryptosporidium hominis
PYSKIFYTYIFEPLFDNDQPN

SEQ ID NO: 2132905 - protein, 27 aa, Cryptosporidium hominis
PYVKSEPMLHLFFYNSLNNNLSSTDNT

SEQ ID NO: 2132906 - protein, 22 aa, Cryptosporidium hominis
QAILNMIVFLFKNKTIGICSKV

SEQ ID NO: 2132907 - protein, 30 aa, Cryptosporidium hominis
QAMFFLNIIRIIFIIHFFTLIHGTEFKFDH

SEQ ID NO: 2132908 - protein, 38 aa, Cryptosporidium hominis
QANLPVMIYVFIDVFLVFPSIWLMILCKPKKYINSYRP

SEQ ID NO: 2132909 - protein, 34 aa, Cryptosporidium hominis
QAVIMYLWMYQDTFLFLMFLIGDIPLLMNFLLRR

SEQ ID NO: 2132910 - protein, 24 aa, Cryptosporidium hominis
QAVVLPFISPIPFGSRIQPMNGQP

SEQ ID NO: 2132911 - protein, 22 aa, Cryptosporidium hominis
QCGFKLFSRRLARVIFPSLHIK

SEQ ID NO: 2132912 - protein, 28 aa, Cryptosporidium hominis
QCNAYCTYFYFPLITDMRIMSSIQLLAH

SEQ ID NO: 2132913 - protein, 27 aa, Cryptosporidium hominis
QCVRFHPWNPEFLLSAGIDSIIKLSII

SEQ ID NO: 2132914 - protein, 40 aa, Cryptosporidium hominis
QDCEQILKYYVTFSSNSFLYILMEYAEGGSLYGLYSKYGS

SEQ ID NO: 2132915 - protein, 18 aa, Cryptosporidium hominis
QDFDILRLLLRCEDLDVN

SEQ ID NO: 2132916 - protein, 25 aa, Cryptosporidium hominis
QDFGIRCPYFLTSILRSGRVGHSLK

SEQ ID NO: 2132917 - protein, 22 aa, Cryptosporidium hominis
QDKLVDVFVEKLSFEIPSTVPF

SEQ ID NO: 2132918 - protein, 23 aa, Cryptosporidium hominis
QDKSRFPLLRILRGKDYGPATKF

SEQ ID NO: 2132919 - protein, 25 aa, Cryptosporidium hominis
QDLELFLYDEFLYNNIIILDIDNSD

SEQ ID NO: 2132920 - protein, 25 aa, Cryptosporidium hominis
QDLKKLYLEILRRYYLKIFEEKKSL

SEQ ID NO: 2132921 - protein, 25 aa, Cryptosporidium hominis
QDSSQYIWVLPKNTSPLSLSNADLL

SEQ ID NO: 2132922 - protein, 23 aa, Cryptosporidium hominis
QEKTLFPPRIKIKNLPKIINDVK

SEQ ID NO: 2132923 - protein, 26 aa, Cryptosporidium hominis
QELNKFKYPWLHIPNLKNFKENIQSL

SEQ ID NO: 2132924 - protein, 20 aa, Cryptosporidium hominis
QELPRLIKIIIEVILFGMKP

SEQ ID NO: 2132925 - protein, 17 aa, Cryptosporidium hominis
QENFMRAFYTHKNYYNN

SEQ ID NO: 2132926 - protein, 32 aa, Cryptosporidium hominis
QESILINKCPFLALLLLYISSHKRHLKERVDE

SEQ ID NO: 2132927 - protein, 26 aa, Cryptosporidium hominis
QETCLMLRMLLHLYSGMRTRTQFLNI

SEQ ID NO: 2132928 - protein, 23 aa, Cryptosporidium hominis
QETFPPVLSCPSGFQKNSQNLNY

SEQ ID NO: 2132929 - protein, 22 aa, Cryptosporidium hominis
QEYFPVFFPECAVPVDMFPFTK

SEQ ID NO: 2132930 - protein, 23 aa, Cryptosporidium hominis
QFFFSMCFWGLFSAVLGPLSQKI

SEQ ID NO: 2132931 - protein, 20 aa, Cryptosporidium hominis
QFFKAFLSNSFPLPALAIAY

SEQ ID NO: 2132932 - protein, 25 aa, Cryptosporidium hominis
QFFWGYSLAILAFLTSILLPLFGCY

SEQ ID NO: 2132933 - protein, 24 aa, Cryptosporidium hominis
QFGFIFIISIIYPIIIVPIFNKLT

SEQ ID NO: 2132934 - protein, 19 aa, Cryptosporidium hominis
QFGKLYRYFEHSLTTSFTS

SEQ ID NO: 2132935 - protein, 24 aa, Cryptosporidium hominis
QFKKALSLILYGLVSVTLVFFNKR

SEQ ID NO: 2132936 - protein, 20 aa, Cryptosporidium hominis
QFRLQFIQQWSDIIAKIINK

SEQ ID NO: 2132937 - protein, 24 aa, Cryptosporidium hominis
QFSIEILISLLYLTYMTGTLDEFD

SEQ ID NO: 2132938 - protein, 20 aa, Cryptosporidium hominis
QGFLWINSLISFSSSITIKI

SEQ ID NO: 2132939 - protein, 24 aa, Cryptosporidium hominis
QGFSWLTILVIFLNAYGGFIVVGV

SEQ ID NO: 2132940 - protein, 21 aa, Cryptosporidium hominis
QGHLIELMILLRFSDNRTSKN

SEQ ID NO: 2132941 - protein, 24 aa, Cryptosporidium hominis
QGILLTIFCAFLSSLSLYLLSSIA

SEQ ID NO: 2132942 - protein, 28 aa, Cryptosporidium hominis
QGIMDLRMLLLQLYFKDGQFIDSAISRL

SEQ ID NO: 2132943 - protein, 21 aa, Cryptosporidium hominis
QGPGIINTRAEYRPPNFHLDS

SEQ ID NO: 2132944 - protein, 27 aa, Cryptosporidium hominis
QGPVVAFLEAYYWKEGWILPKTTLDLQ

SEQ ID NO: 2132945 - protein, 25 aa, Cryptosporidium hominis
QGSLVILLGLILIVVTLYSNVGYYE

SEQ ID NO: 2132946 - protein, 28 aa, Cryptosporidium hominis
QGSVRSQWDFLLQEMTWMSKDYYEERRW

SEQ ID NO: 2132947 - protein, 19 aa, Cryptosporidium hominis
QGYFKPLIALIAPKNLQEH

SEQ ID NO: 2132948 - protein, 20 aa, Cryptosporidium hominis
QHFYLYSPLPLIFEANHNNI

SEQ ID NO: 2132949 - protein, 17 aa, Cryptosporidium hominis
QHRGFGKTLLRAAEYLA

SEQ ID NO: 2132950 - protein, 25 aa, Cryptosporidium hominis
QIDRFWEFQIFGFNILKITGGKFQG

SEQ ID NO: 2132951 - protein, 27 aa, Cryptosporidium hominis
QIERINSFQLLLKLINDLKPNIVEELN

SEQ ID NO: 2132952 - protein, 28 aa, Cryptosporidium hominis
QIHSIIQMIIILPYIFEKLLLIIELDQE

SEQ ID NO: 2132953 - protein, 19 aa, Cryptosporidium hominis
QIIFVKLLISDKAANRILS

SEQ ID NO: 2132954 - protein, 17 aa, Cryptosporidium hominis
QIIIWNYVENAWIQELH

SEQ ID NO: 2132955 - protein, 18 aa, Cryptosporidium hominis
QIIPFCSSIIRGDTQLDK

SEQ ID NO: 2132956 - protein, 33 aa, Cryptosporidium hominis
QIISSLFERFPNLIINKYKEISLYGFVFCTSNF

SEQ ID NO: 2132957 - protein, 17 aa, Cryptosporidium hominis
QIKIGDFGLARLMFDGD

SEQ ID NO: 2132958 - protein, 24 aa, Cryptosporidium hominis
QILEFIVTLLNFCPASFWGLGWDR

SEQ ID NO: 2132959 - protein, 38 aa, Cryptosporidium hominis
QIMLLNCFIDFIQFRKLGPFSHLWFHRTTFANPKRNIC

SEQ ID NO: 2132960 - protein, 22 aa, Cryptosporidium hominis
QINKTDIIAGLFYSLKKTYYIL

SEQ ID NO: 2132961 - protein, 36 aa, Cryptosporidium hominis
QIQAWQERFARLDIPRLCYTVHLLALISHISAHIGS

SEQ ID NO: 2132962 - protein, 23 aa, Cryptosporidium hominis
QIRNLILSAFPRNMKLPDPFLPT

SEQ ID NO: 2132963 - protein, 28 aa, Cryptosporidium hominis
QIRTLTMPIIILLDRLASLWFGSYIHIT

SEQ ID NO: 2132964 - protein, 30 aa, Cryptosporidium hominis
QISQVILVILVIVLLICVILSLICCRYSVP

SEQ ID NO: 2132965 - protein, 24 aa, Cryptosporidium hominis
QISWRLVFFIEYLGPIIIFPIFYF

SEQ ID NO: 2132966 - protein, 34 aa, Cryptosporidium hominis
QISYYSSKFWLKLRKEAIGWFIYTIEDPKYSVDI

SEQ ID NO: 2132967 - protein, 19 aa, Cryptosporidium hominis
QITFLWGFGLVAIPLKIKN

SEQ ID NO: 2132968 - protein, 17 aa, Cryptosporidium hominis
QITQTFIPNFYAVVVVD

SEQ ID NO: 2132969 - protein, 26 aa, Cryptosporidium hominis
QITQYLYIELEFLIAYSSIASLLGNI

SEQ ID NO: 2132970 - protein, 21 aa, Cryptosporidium hominis
QITRLLVLAFTNYLLERDSEN

SEQ ID NO: 2132971 - protein, 26 aa, Cryptosporidium hominis
QITRYNPYFLGWILSELIALLTNQST

SEQ ID NO: 2132972 - protein, 17 aa, Cryptosporidium hominis
QIVGVFCFGILSLSRRT

SEQ ID NO: 2132973 - protein, 39 aa, Cryptosporidium hominis
QIVPHFFFSQFKNQFMKIIDYILRFKLPQIYTLIEGNPF

SEQ ID NO: 2132974 - protein, 18 aa, Cryptosporidium hominis
QIWLFTLLIVVIVCEIRC

SEQ ID NO: 2132975 - protein, 23 aa, Cryptosporidium hominis
QIWRFLTSFFFVGPFSIGWIMSQ

SEQ ID NO: 2132976 - protein, 21 aa, Cryptosporidium hominis
QIYHMRIFCTHIPVIHMKSIH

SEQ ID NO: 2132977 - protein, 25 aa, Cryptosporidium hominis
QIYNLLLVTYMLFCGLEAFFSSIFP

SEQ ID NO: 2132978 - protein, 41 aa, Cryptosporidium hominis
QKAIILCHPTSIKSLFLKTVFLFRILRYWNNDITSSSGLKM

SEQ ID NO: 2132979 - protein, 24 aa, Cryptosporidium hominis
QKDHLKLYKKKLFVLRKILPELVI

SEQ ID NO: 2132980 - protein, 33 aa, Cryptosporidium hominis
QKEKHEPIWRIFLSQFTSLVVSLLLVAGIVSLA

SEQ ID NO: 2132981 - protein, 32 aa, Cryptosporidium hominis
QKIFELYNIPVWLYPYRILPMMFKDINNSVIY

SEQ ID NO: 2132982 - protein, 22 aa, Cryptosporidium hominis
QKIYILFLFYLACSSSLTIVSS

SEQ ID NO: 2132983 - protein, 30 aa, Cryptosporidium hominis
QKLNIKIVILLYLPLLFGKTRFNLIEETIQ

SEQ ID NO: 2132984 - protein, 28 aa, Cryptosporidium hominis
QKQDLVALGYIILALCCGSLTIINDLNH

SEQ ID NO: 2132985 - protein, 21 aa, Cryptosporidium hominis
QKREKLYYPRGYNPEWDNGLT

SEQ ID NO: 2132986 - protein, 18 aa, Cryptosporidium hominis
QKRSWPIDPLDNIINYIS

SEQ ID NO: 2132987 - protein, 26 aa, Cryptosporidium hominis
QKRVLLMIILLLISYYIYIGGFTYSK

SEQ ID NO: 2132988 - protein, 31 aa, Cryptosporidium hominis
QKTAFLLRGFLLIKFIRWVITKDPFNNVQLE

SEQ ID NO: 2132989 - protein, 19 aa, Cryptosporidium hominis
QKYAPILALSAIVLIIIIW

SEQ ID NO: 2132990 - protein, 31 aa, Cryptosporidium hominis
QKYSQKWIIVTSLFFLSFGLALLISSTTSTL

SEQ ID NO: 2132991 - protein, 18 aa, Cryptosporidium hominis
QLEFTMLDPYIRTYLKQS

SEQ ID NO: 2132992 - protein, 25 aa, Cryptosporidium hominis
QLENIVDILIYLGSFGKNLLGKDSS

SEQ ID NO: 2132993 - protein, 32 aa, Cryptosporidium hominis
QLEQLYQLLRFQPLAIKAFLGRLVFPELLEYS

SEQ ID NO: 2132994 - protein, 24 aa, Cryptosporidium hominis
QLFTIYLIIILISSIFNLIGIYLL

SEQ ID NO: 2132995 - protein, 36 aa, Cryptosporidium hominis
QLILSEELTALVPDLLWPLLIDAVNHLKLGSAMPTV

SEQ ID NO: 2132996 - protein, 24 aa, Cryptosporidium hominis
QLIQAYKQFIIYYGTKPLSPNQVT

SEQ ID NO: 2132997 - protein, 27 aa, Cryptosporidium hominis
QLITAILFTMIMFKVKNPSKFKSFEVV

SEQ ID NO: 2132998 - protein, 18 aa, Cryptosporidium hominis
QLKLIDYSLDRYRQSTMG

SEQ ID NO: 2132999 - protein, 26 aa, Cryptosporidium hominis
QLKSSFFILLLPYFTLTVFRSDSIKA

SEQ ID NO: 2133000 - protein, 18 aa, Cryptosporidium hominis
QLLLKHLSLNWLESMRRL

SEQ ID NO: 2133001 - protein, 17 aa, Cryptosporidium hominis
QLLLKSSTDNLLTVDSA

SEQ ID NO: 2133002 - protein, 32 aa, Cryptosporidium hominis
QLLNKKRFRNLLEASFCRLPIRMLIHSANIST

SEQ ID NO: 2133003 - protein, 29 aa, Cryptosporidium hominis
QLRSSIKKLLIPLLVRLEGPTLELSRSVW

SEQ ID NO: 2133004 - protein, 35 aa, Cryptosporidium hominis
QLSGFYGHLYFIFALLLIGISFYFALDRLNKSIKG

SEQ ID NO: 2133005 - protein, 25 aa, Cryptosporidium hominis
QLTDRFFQMISLSFAEYLFEENYIN

SEQ ID NO: 2133006 - protein, 26 aa, Cryptosporidium hominis
QLTYSTARLGIFRLLCDYYKNQMVYQ

SEQ ID NO: 2133007 - protein, 19 aa, Cryptosporidium hominis
QLVLLLSTMRFDWDTHYYL

SEQ ID NO: 2133008 - protein, 18 aa, Cryptosporidium hominis
QLWLIISYITIIAFRVIH

SEQ ID NO: 2133009 - protein, 23 aa, Cryptosporidium hominis
QMIHLNRYLFLSNELGLSLFINF

SEQ ID NO: 2133010 - protein, 20 aa, Cryptosporidium hominis
QMNLYYIYFNETSAYEHEKC

SEQ ID NO: 2133011 - protein, 26 aa, Cryptosporidium hominis
QMRMLLFVNFFLKREKLRILLVDEPP

SEQ ID NO: 2133012 - protein, 22 aa, Cryptosporidium hominis
QNDFLSNFLIKSVLPILRIVIL

SEQ ID NO: 2133013 - protein, 20 aa, Cryptosporidium hominis
QNFLDWFKQIYNNSNLFMLA

SEQ ID NO: 2133014 - protein, 18 aa, Cryptosporidium hominis
QNFTVIWSCLIDLGNEIK

SEQ ID NO: 2133015 - protein, 23 aa, Cryptosporidium hominis
QNKKLQPLFPVFGIILGIAKNDQ

SEQ ID NO: 2133016 - protein, 17 aa, Cryptosporidium hominis
QNLYPTDKIIFLKHLNY

SEQ ID NO: 2133017 - protein, 25 aa, Cryptosporidium hominis
QNMYIKSILLSNILHLVLPQLFEVT

SEQ ID NO: 2133018 - protein, 23 aa, Cryptosporidium hominis
QNQSFTFNLLLSSLNFNDEQNPS

SEQ ID NO: 2133019 - protein, 17 aa, Cryptosporidium hominis
QNRFIFASAFMEEFLVK

SEQ ID NO: 2133020 - protein, 25 aa, Cryptosporidium hominis
QNRLMKDILIPLSKKLLLSNYYEYY

SEQ ID NO: 2133021 - protein, 19 aa, Cryptosporidium hominis
QNWPILWCICQLLALVFVS

SEQ ID NO: 2133022 - protein, 30 aa, Cryptosporidium hominis
QPDIPFNHGYIWGPLPITCFIDVINPNGGN

SEQ ID NO: 2133023 - protein, 24 aa, Cryptosporidium hominis
QPFTPLISLIILFIFTYKSNKEHH

SEQ ID NO: 2133024 - protein, 22 aa, Cryptosporidium hominis
QPISGKFFLLTGSQNKSLFLWK

SEQ ID NO: 2133025 - protein, 19 aa, Cryptosporidium hominis
QPPPLIFKHSFISISLTKI

SEQ ID NO: 2133026 - protein, 27 aa, Cryptosporidium hominis
QPPVEESSWFSGWFGASETTPAPPPTP

SEQ ID NO: 2133027 - protein, 32 aa, Cryptosporidium hominis
QPSDSTMPLFYILSCWKLLWCLSINELIGESL

SEQ ID NO: 2133028 - protein, 21 aa, Cryptosporidium hominis
QPVLQFIYRKCVELRFTVNNE

SEQ ID NO: 2133029 - protein, 28 aa, Cryptosporidium hominis
QQAAYSYFRLWSIWLTSSFCILITIVLS

SEQ ID NO: 2133030 - protein, 23 aa, Cryptosporidium hominis
QQGSFPIKLFYTSNIPIILQTAL

SEQ ID NO: 2133031 - protein, 25 aa, Cryptosporidium hominis
QQPRLLTGMILILVFGEALAIYGVI

SEQ ID NO: 2133032 - protein, 26 aa, Cryptosporidium hominis
QQRLAFARIFIFKPSICFLDEATSAL

SEQ ID NO: 2133033 - protein, 26 aa, Cryptosporidium hominis
QRIQVLRYFLLAYPDINQNIFNSLKR

SEQ ID NO: 2133034 - protein, 23 aa, Cryptosporidium hominis
QRKAFFEVFVVGIYIFFAVLTRR

SEQ ID NO: 2133035 - protein, 24 aa, Cryptosporidium hominis
QRLGFARMLIKKSPIWILDEPTSA

SEQ ID NO: 2133036 - protein, 29 aa, Cryptosporidium hominis
QRLLELLQHLIFYEIPRYSPIGLLSSLGA

SEQ ID NO: 2133037 - protein, 48 aa, Cryptosporidium hominis
QSDQRFPWYVEPIIRPVYRRIYPEPSLYIFFLNFPIERWCIGDTWPIN

SEQ ID NO: 2133038 - protein, 34 aa, Cryptosporidium hominis
QSFIKSMFNKKFRGLLYVLYLNSDIDVFLIPIGN

SEQ ID NO: 2133039 - protein, 22 aa, Cryptosporidium hominis
QSGVIVITILTSPGAFSCKHDC

SEQ ID NO: 2133040 - protein, 24 aa, Cryptosporidium hominis
QSIIEAVLDLLLTIGLTSASMEDG

SEQ ID NO: 2133041 - protein, 25 aa, Cryptosporidium hominis
QSIKTAVFSLIKKFIFELISLIEYQ

SEQ ID NO: 2133042 - protein, 39 aa, Cryptosporidium hominis
QSKLFSFQFPWSHQSHDIPMYWLVPLLVSCLGSKTLVDP

SEQ ID NO: 2133043 - protein, 19 aa, Cryptosporidium hominis
QSLKKRWIQSYFGNFLNLV

SEQ ID NO: 2133044 - protein, 23 aa, Cryptosporidium hominis
QSNPLLLNWKAFFPNIIFDENKS

SEQ ID NO: 2133045 - protein, 23 aa, Cryptosporidium hominis
QSPTTMLLVTKLLSKMPLKRWFG

SEQ ID NO: 2133046 - protein, 28 aa, Cryptosporidium hominis
QSQLEILFWIAFCLLLMVGYKYLSDGSF

SEQ ID NO: 2133047 - protein, 17 aa, Cryptosporidium hominis
QSQLLLCFVFKSNPTFI

SEQ ID NO: 2133048 - protein, 24 aa, Cryptosporidium hominis
QSSLLFLDGKWLFNKDMRKNKNDY

SEQ ID NO: 2133049 - protein, 24 aa, Cryptosporidium hominis
QSSLLYYLWSGILAWYTILTLLTI

SEQ ID NO: 2133050 - protein, 26 aa, Cryptosporidium hominis
QSVIVPFFWIIVYPKEKWRSITWEVQ

SEQ ID NO: 2133051 - protein, 22 aa, Cryptosporidium hominis
QSVWLIPTFYHPLNDIIFFVYY

SEQ ID NO: 2133052 - protein, 44 aa, Cryptosporidium hominis
QTAILLRIIFMIILLRYIPWGSHYFFYYLVVSILIGFMAGWPGV

SEQ ID NO: 2133053 - protein, 24 aa, Cryptosporidium hominis
QTGLMKTYLVPLPCLGFLTSVFEG

SEQ ID NO: 2133054 - protein, 29 aa, Cryptosporidium hominis
QTHSDFLYSFYRIGIIVPEGFWVAEQRGT

SEQ ID NO: 2133055 - protein, 26 aa, Cryptosporidium hominis
QTIRNPMHILWCKLISLATNIFVSLE

SEQ ID NO: 2133056 - protein, 24 aa, Cryptosporidium hominis
QTKNNLIFPLISYNNEYFNIELNY

SEQ ID NO: 2133057 - protein, 24 aa, Cryptosporidium hominis
QTQSPFILVLIVNVLHIFGIAWWF

SEQ ID NO: 2133058 - protein, 25 aa, Cryptosporidium hominis
QTRGWFYTLMVLSTALFDQPAFKNI

SEQ ID NO: 2133059 - protein, 39 aa, Cryptosporidium hominis
QTTHANRLTWIVIILLAIDCFFSFFRHILLNHPHNVSEL

SEQ ID NO: 2133060 - protein, 30 aa, Cryptosporidium hominis
QTVLFVAIIIVLGLLLISFGIFCGVLGYIG

SEQ ID NO: 2133061 - protein, 23 aa, Cryptosporidium hominis
QVCGMIFYLIAYATLNLFGIHNL

SEQ ID NO: 2133062 - protein, 39 aa, Cryptosporidium hominis
QVGRICGLIMAPVAIFFIAYSYYIYLKRNRALETKEPIS

SEQ ID NO: 2133063 - protein, 26 aa, Cryptosporidium hominis
QVIFSRLFLRGYKEILCRIMVGWSNN

SEQ ID NO: 2133064 - protein, 18 aa, Cryptosporidium hominis
QVIVISMLILFGISTALI

SEQ ID NO: 2133065 - protein, 40 aa, Cryptosporidium hominis
QVKPIFLDLIDQYFLPLGPGLLPCLSGLIVGLLPGLEDSK

SEQ ID NO: 2133066 - protein, 19 aa, Cryptosporidium hominis
QVLLQGPGIINTRAEYRPP

SEQ ID NO: 2133067 - protein, 18 aa, Cryptosporidium hominis
QVRPIRDSVLFILDSFPG

SEQ ID NO: 2133068 - protein, 28 aa, Cryptosporidium hominis
QVSDPSMIYLYIFRMMNVRMRQVWGLYL

SEQ ID NO: 2133069 - protein, 25 aa, Cryptosporidium hominis
QVSPYYRYVLSEKSTYWFKCIQSLC

SEQ ID NO: 2133070 - protein, 17 aa, Cryptosporidium hominis
QVSSLILCILEQLNKQG

SEQ ID NO: 2133071 - protein, 25 aa, Cryptosporidium hominis
QWHPKKRICVFHLLRLCLEHGLQDQ

SEQ ID NO: 2133072 - protein, 31 aa, Cryptosporidium hominis
QWISVRMQLLLLPFTAGITLAPILLKYLNLS

SEQ ID NO: 2133073 - protein, 26 aa, Cryptosporidium hominis
QWLNHHLILIFLLKNELIIPYSISSI

SEQ ID NO: 2133074 - protein, 33 aa, Cryptosporidium hominis
QWVVDEDLLLQLDPLVFVKTAIPPTASSTDIID

SEQ ID NO: 2133075 - protein, 20 aa, Cryptosporidium hominis
QYIVLEYIWEYFINGNTMIL

SEQ ID NO: 2133076 - protein, 18 aa, Cryptosporidium hominis
QYLCYQLTILLTSWASYG

SEQ ID NO: 2133077 - protein, 18 aa, Cryptosporidium hominis
QYLSIYKHDLSLSYSALI

SEQ ID NO: 2133078 - protein, 29 aa, Cryptosporidium hominis
QYMSKFRPQIMPIILKWSKGESFASILEN

SEQ ID NO: 2133079 - protein, 17 aa, Cryptosporidium hominis
QYNITYPMTNECKTIIS

SEQ ID NO: 2133080 - protein, 18 aa, Cryptosporidium hominis
QYQFLYDTFKKNYFDLWT

SEQ ID NO: 2133081 - protein, 22 aa, Cryptosporidium hominis
QYSSIFIRRAVPISLAALSIGN

SEQ ID NO: 2133082 - protein, 24 aa, Cryptosporidium hominis
RADYYSFLGGRYNLMNALWSDKIE

SEQ ID NO: 2133083 - protein, 18 aa, Cryptosporidium hominis
RAIITPMFVITIVISITV

SEQ ID NO: 2133084 - protein, 29 aa, Cryptosporidium hominis
RALRLCISLLFYNFYYLSGFLDLLFQVDT

SEQ ID NO: 2133085 - protein, 22 aa, Cryptosporidium hominis
RAQEFNIILDDVSLTHLSFSQD

SEQ ID NO: 2133086 - protein, 31 aa, Cryptosporidium hominis
RAQLPLIKFVLRIFIILSLTILPLINEIHSV

SEQ ID NO: 2133087 - protein, 26 aa, Cryptosporidium hominis
RATLILTILLPFILEIYYLIPNFVSF

SEQ ID NO: 2133088 - protein, 20 aa, Cryptosporidium hominis
RAYFFLRRPIDFEDIPLSLQ

SEQ ID NO: 2133089 - protein, 21 aa, Cryptosporidium hominis
RCFWDFDMPIPFTATSVLINN

SEQ ID NO: 2133090 - protein, 31 aa, Cryptosporidium hominis
RCIDNLFDFFVYSILLYNVNFKLFISAIIYS

SEQ ID NO: 2133091 - protein, 27 aa, Cryptosporidium hominis
RCPFHSSLFPGLYLTGSRTSDVLAIDL

SEQ ID NO: 2133092 - protein, 17 aa, Cryptosporidium hominis
RDEVMSMVYIMLNFIEE

SEQ ID NO: 2133093 - protein, 17 aa, Cryptosporidium hominis
RDKINLINAFIGTGFDT

SEQ ID NO: 2133094 - protein, 23 aa, Cryptosporidium hominis
RDRSPFVTGYWGGGVFGGDIQYK

SEQ ID NO: 2133095 - protein, 24 aa, Cryptosporidium hominis
RDVLRSRFSCIVKKRILKFQFNRN

SEQ ID NO: 2133096 - protein, 23 aa, Cryptosporidium hominis
REEIYIIHPLLKSISLLVLFLTI

SEQ ID NO: 2133097 - protein, 30 aa, Cryptosporidium hominis
REIDTFFLHPSLLDGCFQLFALFIENHENK

SEQ ID NO: 2133098 - protein, 18 aa, Cryptosporidium hominis
REILLNRSNKHWDILRKI

SEQ ID NO: 2133099 - protein, 20 aa, Cryptosporidium hominis
REISAKSFIIEIVALLWGSS

SEQ ID NO: 2133100 - protein, 32 aa, Cryptosporidium hominis
REKQIRIMPNFNKRYIISSTLLKHLKEFSKSL

SEQ ID NO: 2133101 - protein, 18 aa, Cryptosporidium hominis
RELSWRIIAPNYPTLGRQ

SEQ ID NO: 2133102 - protein, 34 aa, Cryptosporidium hominis
RENRYRLIYNWMQQYFIYKLRKIPKFNYEEVRTL

SEQ ID NO: 2133103 - protein, 24 aa, Cryptosporidium hominis
REYRKRIIFSLLSLGVAKLATIQV

SEQ ID NO: 2133104 - protein, 19 aa, Cryptosporidium hominis
RFCLSLLELSLISSLSFSI

SEQ ID NO: 2133105 - protein, 26 aa, Cryptosporidium hominis
RFDVIYRNELITQITWYDANLKSGNN

SEQ ID NO: 2133106 - protein, 19 aa, Cryptosporidium hominis
RFFKLNYGIIILSVFSMLV

SEQ ID NO: 2133107 - protein, 20 aa, Cryptosporidium hominis
RFIIPYFPILLITTSLGIYK

SEQ ID NO: 2133108 - protein, 40 aa, Cryptosporidium hominis
RFKKRYAGVLGFAILICFLIGFYLILFSAKHPTSKISKNN

SEQ ID NO: 2133109 - protein, 20 aa, Cryptosporidium hominis
RFPEGVACPMVLSGEANVEC

SEQ ID NO: 2133110 - protein, 17 aa, Cryptosporidium hominis
RFVAIRPIGNIIAIGYS

SEQ ID NO: 2133111 - protein, 17 aa, Cryptosporidium hominis
RFWNKILAKELKNVANI

SEQ ID NO: 2133112 - protein, 27 aa, Cryptosporidium hominis
RGDDWFMLSIRVFCAIFLAGAIYQLSK

SEQ ID NO: 2133113 - protein, 24 aa, Cryptosporidium hominis
RGFSILIHHILVRSYNFHKGENVD

SEQ ID NO: 2133114 - protein, 30 aa, Cryptosporidium hominis
RGGLPCLSVLRLLPPNLLGARTLLRFIIQT

SEQ ID NO: 2133115 - protein, 19 aa, Cryptosporidium hominis
RGKLRTTFYGYLISNNETP

SEQ ID NO: 2133116 - protein, 32 aa, Cryptosporidium hominis
RGKNNLLLFPRLNKFRYIISILLCSSIIAYTI

SEQ ID NO: 2133117 - protein, 24 aa, Cryptosporidium hominis
RGLMRGDLLLWRKSFEKSSSDNSY

SEQ ID NO: 2133118 - protein, 21 aa, Cryptosporidium hominis
RGLVRMIIDIILGKDTTKQYK

SEQ ID NO: 2133119 - protein, 23 aa, Cryptosporidium hominis
RGNLNLRGFRLKEKNYQELNESR

SEQ ID NO: 2133120 - protein, 23 aa, Cryptosporidium hominis
RGSIQILLCTISLYLTQSTYFSL

SEQ ID NO: 2133121 - protein, 19 aa, Cryptosporidium hominis
RGTNSFHYLFDLRQSRAFV

SEQ ID NO: 2133122 - protein, 34 aa, Cryptosporidium hominis
RHCFSSFKYKYGFKLYWIRKVSKTLKFLKLTNQS

SEQ ID NO: 2133123 - protein, 19 aa, Cryptosporidium hominis
RHEQILNSLLLNLTTKRSF

SEQ ID NO: 2133124 - protein, 27 aa, Cryptosporidium hominis
RHLKKGEMFLKPPILPHISCPICKVWC

SEQ ID NO: 2133125 - protein, 23 aa, Cryptosporidium hominis
RHQSLCRYVNYSNPTLECPPGSF

SEQ ID NO: 2133126 - protein, 21 aa, Cryptosporidium hominis
RHSIKIKVVKLMPIWSIRNKS

SEQ ID NO: 2133127 - protein, 20 aa, Cryptosporidium hominis
RIDRSYKLIKPLDSFLDPKA

SEQ ID NO: 2133128 - protein, 29 aa, Cryptosporidium hominis
RIDSQFYIGYNMLLNLLRLEGADPEYMIN

SEQ ID NO: 2133129 - protein, 17 aa, Cryptosporidium hominis
RIFPLEAQMFTHLSFLY

SEQ ID NO: 2133130 - protein, 17 aa, Cryptosporidium hominis
RIGALTEVFFALSKTQK

SEQ ID NO: 2133131 - protein, 20 aa, Cryptosporidium hominis
RIIDNFIPLRLNLEIPKFEG

SEQ ID NO: 2133132 - protein, 21 aa, Cryptosporidium hominis
RIIIRLFVTPIIKTLSTVLII

SEQ ID NO: 2133133 - protein, 25 aa, Cryptosporidium hominis
RIIKLNNPYYLYKLITRAQGISDPY

SEQ ID NO: 2133134 - protein, 20 aa, Cryptosporidium hominis
RIISNRLDFSILGLDYTRLF

SEQ ID NO: 2133135 - protein, 28 aa, Cryptosporidium hominis
RIKHIEIFVRTWFKFLELSVGRGSIQIL

SEQ ID NO: 2133136 - protein, 25 aa, Cryptosporidium hominis
RILDYILEILINQITLFLKNYCDWG

SEQ ID NO: 2133137 - protein, 20 aa, Cryptosporidium hominis
RILIHANIFLLWNSTLKDFF

SEQ ID NO: 2133138 - protein, 17 aa, Cryptosporidium hominis
RILLERLIVHRPHPWGL

SEQ ID NO: 2133139 - protein, 18 aa, Cryptosporidium hominis
RIPCMAFDIIMHTVSPQN

SEQ ID NO: 2133140 - protein, 24 aa, Cryptosporidium hominis
RIQVSFLVILAITNLLVYTIAFCT

SEQ ID NO: 2133141 - protein, 33 aa, Cryptosporidium hominis
RIRQYALIWMTWCLWLLGSFLFSFGRVMLGLYH

SEQ ID NO: 2133142 - protein, 18 aa, Cryptosporidium hominis
RITCGTWLVYLYELKRCH

SEQ ID NO: 2133143 - protein, 33 aa, Cryptosporidium hominis
RITLIENEFNNKYGKIILWKRNIDNINNEHNPF

SEQ ID NO: 2133144 - protein, 40 aa, Cryptosporidium hominis
RIVLDYIGLILYYFINNVKLIFHYILNPRLNTLKELYPHH

SEQ ID NO: 2133145 - protein, 18 aa, Cryptosporidium hominis
RIYKANVIVILLNAILIL

SEQ ID NO: 2133146 - protein, 27 aa, Cryptosporidium hominis
RIYRRKYDVFPFLKFKLNNKRSKYLFI

SEQ ID NO: 2133147 - protein, 25 aa, Cryptosporidium hominis
RKAALPTVVCPEPFVFDTSLKMCIQ

SEQ ID NO: 2133148 - protein, 24 aa, Cryptosporidium hominis
RKAFLNTLPYSLFRLRDFAEIFPV

SEQ ID NO: 2133149 - protein, 28 aa, Cryptosporidium hominis
RKDEYLSIIKIILLLLLSTISKVHSKNE

SEQ ID NO: 2133150 - protein, 24 aa, Cryptosporidium hominis
RKEIDNGRLFRLLTKINTIADRTQ

SEQ ID NO: 2133151 - protein, 26 aa, Cryptosporidium hominis
RKGGWWLFHSFFQVVSKDWLLGWNFI

SEQ ID NO: 2133152 - protein, 25 aa, Cryptosporidium hominis
RKIALKYIYLITKFQIQGIGVGIID

SEQ ID NO: 2133153 - protein, 31 aa, Cryptosporidium hominis
RKIFSLPFIAFFIYMLFFALSRIHYQLFFRS

SEQ ID NO: 2133154 - protein, 22 aa, Cryptosporidium hominis
RKIPGLIFNTLIIYSVLKSTEN

SEQ ID NO: 2133155 - protein, 23 aa, Cryptosporidium hominis
RKKALICEQKEYEKWRLKININE

SEQ ID NO: 2133156 - protein, 22 aa, Cryptosporidium hominis
RKKIEDFAPFAFFTTSKGSGGI

SEQ ID NO: 2133157 - protein, 25 aa, Cryptosporidium hominis
RKLNRDKYFILLNNNFRNFHNLNQS

SEQ ID NO: 2133158 - protein, 24 aa, Cryptosporidium hominis
RKLTVGLLVPLGEEQDWLYSTRKG

SEQ ID NO: 2133159 - protein, 29 aa, Cryptosporidium hominis
RKNINLLVIPSPFLKKLGLQLILEVSDNK

SEQ ID NO: 2133160 - protein, 49 aa, Cryptosporidium hominis
RKNYSIALFLFWFQFVQIFVPILLPIILCVLILYILHRNGIRTEKKNVP

SEQ ID NO: 2133161 - protein, 26 aa, Cryptosporidium hominis
RKVSRLYEIWRLPSNGLERAIIHRNM

SEQ ID NO: 2133162 - protein, 30 aa, Cryptosporidium hominis
RKWIILLIIIEFVIKINLLYGLRNNVFGSL

SEQ ID NO: 2133163 - protein, 31 aa, Cryptosporidium hominis
RKYKRKYMYWIWRRWRYLLSAKERMPILVED

SEQ ID NO: 2133164 - protein, 28 aa, Cryptosporidium hominis
RLDNFKINWIAKGLPFYCRTRPTLMPSL

SEQ ID NO: 2133165 - protein, 18 aa, Cryptosporidium hominis
RLEKLFLVSIYLHLPNSS

SEQ ID NO: 2133166 - protein, 17 aa, Cryptosporidium hominis
RLEVDALLLIDFRLKVT

SEQ ID NO: 2133167 - protein, 29 aa, Cryptosporidium hominis
RLGGFIGFMSLIVLVIIVIVALLTNYKDP

SEQ ID NO: 2133168 - protein, 24 aa, Cryptosporidium hominis
RLIIFRLILPWLCPEGRIFAALSG

SEQ ID NO: 2133169 - protein, 23 aa, Cryptosporidium hominis
RLKEFILLIKRLIHRNGESFLSK

SEQ ID NO: 2133170 - protein, 17 aa, Cryptosporidium hominis
RLKIDKYYSNYKPFKML

SEQ ID NO: 2133171 - protein, 26 aa, Cryptosporidium hominis
RLLNCLHYLFFILDRMDDINSKQCYI

SEQ ID NO: 2133172 - protein, 17 aa, Cryptosporidium hominis
RLMSFAIEICMIPSIWY

SEQ ID NO: 2133173 - protein, 17 aa, Cryptosporidium hominis
RLNFHLLSALNLNISPW

SEQ ID NO: 2133174 - protein, 22 aa, Cryptosporidium hominis
RLNSIVRFYLSINILRGNFGKI

SEQ ID NO: 2133175 - protein, 24 aa, Cryptosporidium hominis
RLTELQIFLFFGSRFSSSSLVLLA

SEQ ID NO: 2133176 - protein, 23 aa, Cryptosporidium hominis
RLYILGLILVIFSYIPICLLLFF

SEQ ID NO: 2133177 - protein, 27 aa, Cryptosporidium hominis
RMAALLNILLIIDISLVFKYYGLLSKD

SEQ ID NO: 2133178 - protein, 36 aa, Cryptosporidium hominis
RMLWSRYIFCCLLFFIWYICTWFVGAHLLRIETKEG

SEQ ID NO: 2133179 - protein, 21 aa, Cryptosporidium hominis
RMMLAIIFYISFFAVGFIDQL

SEQ ID NO: 2133180 - protein, 17 aa, Cryptosporidium hominis
RMRIAGIYLVLGSPISS

SEQ ID NO: 2133181 - protein, 32 aa, Cryptosporidium hominis
RNEFGIYFDPLWFIDLPFMYNNAWWDSYSSIH

SEQ ID NO: 2133182 - protein, 19 aa, Cryptosporidium hominis
RNGFCTVPIFINLTFEAIE

SEQ ID NO: 2133183 - protein, 36 aa, Cryptosporidium hominis
RNGLEEVGPALFWFITWGLILLCAAGAIVVLTTFRK

SEQ ID NO: 2133184 - protein, 36 aa, Cryptosporidium hominis
RNHLAMTTGIILFIVNVILLFVLLSKRKHTSSANNQ

SEQ ID NO: 2133185 - protein, 17 aa, Cryptosporidium hominis
RNIIDSIRICPPGFVFE

SEQ ID NO: 2133186 - protein, 18 aa, Cryptosporidium hominis
RNILIFYSIVVCGALAMV

SEQ ID NO: 2133187 - protein, 26 aa, Cryptosporidium hominis
RNKLNSLQLASIKPILARKGSKIVHM

SEQ ID NO: 2133188 - protein, 30 aa, Cryptosporidium hominis
RNLHFKELIPIKTINYLPIKDHYSWITTYR

SEQ ID NO: 2133189 - protein, 24 aa, Cryptosporidium hominis
RNMKLPDPFLPTLKIENLPEMKLI

SEQ ID NO: 2133190 - protein, 24 aa, Cryptosporidium hominis
RNNDDIFIPWKIAFNGIEWMESYT

SEQ ID NO: 2133191 - protein, 23 aa, Cryptosporidium hominis
RNPKIWMMGIILSKYLFTVLGII

SEQ ID NO: 2133192 - protein, 17 aa, Cryptosporidium hominis
RNQLPFPNVIPKTKNKL

SEQ ID NO: 2133193 - protein, 23 aa, Cryptosporidium hominis
RNRKSEFLLAFLQDLHNFSKTNP

SEQ ID NO: 2133194 - protein, 26 aa, Cryptosporidium hominis
RNRSGIWRLLLIRLSETNKEIMVIVQ

SEQ ID NO: 2133195 - protein, 17 aa, Cryptosporidium hominis
RNSFVNSGFFILSRSRA

SEQ ID NO: 2133196 - protein, 34 aa, Cryptosporidium hominis
RNTLEIYWWYFSLVGRTWCIVLLISCILKSVFDR

SEQ ID NO: 2133197 - protein, 32 aa, Cryptosporidium hominis
RNVKMRLDFFDMLFKELMPSLAYHFDLLSITS

SEQ ID NO: 2133198 - protein, 20 aa, Cryptosporidium hominis
RNYCTVYFNFFSIDELKEFL

SEQ ID NO: 2133199 - protein, 17 aa, Cryptosporidium hominis
RPAFSRPVLRRNQQDWM

SEQ ID NO: 2133200 - protein, 30 aa, Cryptosporidium hominis
RPNVPVIGNAKLWWRYAIGCIIRDRRADIS

SEQ ID NO: 2133201 - protein, 37 aa, Cryptosporidium hominis
RPQSAAGFSLFFQFWFWFPLVHCISLSYIPTCIVGLD

SEQ ID NO: 2133202 - protein, 24 aa, Cryptosporidium hominis
RPSGILWMYKDTKDFGKPIPAPYV

SEQ ID NO: 2133203 - protein, 25 aa, Cryptosporidium hominis
RPSTNNMLFYPSKILRSFLLRMTGK

SEQ ID NO: 2133204 - protein, 19 aa, Cryptosporidium hominis
RPYYRIFYSLLQEYESIGF

SEQ ID NO: 2133205 - protein, 18 aa, Cryptosporidium hominis
RQAAYIGLGLLLMQQNES

SEQ ID NO: 2133206 - protein, 22 aa, Cryptosporidium hominis
RQFSEYYILRVPFSRFVSLHTS

SEQ ID NO: 2133207 - protein, 27 aa, Cryptosporidium hominis
RQGEMIRMFWAMWMHTGFIHIGFNVIS

SEQ ID NO: 2133208 - protein, 21 aa, Cryptosporidium hominis
RQIDALKQITRLLVLAFTNYL

SEQ ID NO: 2133209 - protein, 23 aa, Cryptosporidium hominis
RQLEFIGMILYILKNITLNFKKE

SEQ ID NO: 2133210 - protein, 27 aa, Cryptosporidium hominis
RQLLMTPIMFILYLTVPSPSLRRSVQI

SEQ ID NO: 2133211 - protein, 24 aa, Cryptosporidium hominis
RQLVYYLLVIQIISSIFGFFVRYS

SEQ ID NO: 2133212 - protein, 28 aa, Cryptosporidium hominis
RQNISKPLLYSYLFNMLGSFGPNQWMAL

SEQ ID NO: 2133213 - protein, 20 aa, Cryptosporidium hominis
RQRENYLFIELISHGTFTSS

SEQ ID NO: 2133214 - protein, 25 aa, Cryptosporidium hominis
RQSPPSVLIFVILPSGTPDPQSCVT

SEQ ID NO: 2133215 - protein, 18 aa, Cryptosporidium hominis
RRCISGCATAFLAGGLSA

SEQ ID NO: 2133216 - protein, 42 aa, Cryptosporidium hominis
RRELAPYWNNRALVFISLWLECFFLCFFYRSTKSSFEQFFYY

SEQ ID NO: 2133217 - protein, 26 aa, Cryptosporidium hominis
RRMDVHWPFTLFSLWGEPKSVSMNIW

SEQ ID NO: 2133218 - protein, 25 aa, Cryptosporidium hominis
RRNQTFIWHSKPLLSLAFEPDITVP

SEQ ID NO: 2133219 - protein, 44 aa, Cryptosporidium hominis
RRPIFTSNRLFYVVFTILIGFIFIIGILGAFFYLGKSQGWNETL

SEQ ID NO: 2133220 - protein, 21 aa, Cryptosporidium hominis
RRSLIKLFLFLAAISACSVLL

SEQ ID NO: 2133221 - protein, 24 aa, Cryptosporidium hominis
RSATVLLLILDKIVYFPPIYNYDT

SEQ ID NO: 2133222 - protein, 22 aa, Cryptosporidium hominis
RSCLNDLFIWNKSTLFKKLSRI

SEQ ID NO: 2133223 - protein, 21 aa, Cryptosporidium hominis
RSDTPLQYRAVPSWFINVESL

SEQ ID NO: 2133224 - protein, 21 aa, Cryptosporidium hominis
RSEIFYPIRNLYHPPIDFINK

SEQ ID NO: 2133225 - protein, 24 aa, Cryptosporidium hominis
RSFESLYITMEYLNPISLFKQHLS

SEQ ID NO: 2133226 - protein, 23 aa, Cryptosporidium hominis
RSFLSFITECCAIIGGIFAFSGM

SEQ ID NO: 2133227 - protein, 40 aa, Cryptosporidium hominis
RSGIWPLYLIIMLICTFRIIFMVSFFYFIFPTVVSSEYSD

SEQ ID NO: 2133228 - protein, 27 aa, Cryptosporidium hominis
RSINFNYIMLPSYYLWGNIYSILGQWD

SEQ ID NO: 2133229 - protein, 24 aa, Cryptosporidium hominis
RSKFGYRFFLVCNRVQNIGFGFEY

SEQ ID NO: 2133230 - protein, 24 aa, Cryptosporidium hominis
RSKIKYKFFRNFQLSPFLPENSKK

SEQ ID NO: 2133231 - protein, 31 aa, Cryptosporidium hominis
RSKYFGLATIFIVSILRYSLCELTVFSIGDW

SEQ ID NO: 2133232 - protein, 18 aa, Cryptosporidium hominis
RSMAIIIDVYRQHVWNDA

SEQ ID NO: 2133233 - protein, 17 aa, Cryptosporidium hominis
RSMGYFCYGIISIYVWY

SEQ ID NO: 2133234 - protein, 33 aa, Cryptosporidium hominis
RSQLKKVISYIIQLFLNLVIDSIVALSPNFAKY

SEQ ID NO: 2133235 - protein, 30 aa, Cryptosporidium hominis
RSRFDMVMISLFWAIITFGAFKANSFFFFS

SEQ ID NO: 2133236 - protein, 30 aa, Cryptosporidium hominis
RSRKVGFLVVFLLNIIFFDVNIGLFKNEGI

SEQ ID NO: 2133237 - protein, 22 aa, Cryptosporidium hominis
RSTVFCFFNYIFTDLSRAHDIV

SEQ ID NO: 2133238 - protein, 23 aa, Cryptosporidium hominis
RSVFGIICKKASWFIVIYQEETV

SEQ ID NO: 2133239 - protein, 28 aa, Cryptosporidium hominis
RSYETLFIMYMLLISLGWRVLRDSLLSM

SEQ ID NO: 2133240 - protein, 25 aa, Cryptosporidium hominis
RTAILLFVVIFIIGPASYPTSLAEL

SEQ ID NO: 2133241 - protein, 30 aa, Cryptosporidium hominis
RTDPNVIFYILLPIFLYESSATLNFHVFSR

SEQ ID NO: 2133242 - protein, 21 aa, Cryptosporidium hominis
RTEFHRPLMSILALVSLYKDN

SEQ ID NO: 2133243 - protein, 33 aa, Cryptosporidium hominis
RTEIGSIIIYLRPLILQELLCLFKRSTSPYIST

SEQ ID NO: 2133244 - protein, 23 aa, Cryptosporidium hominis
RTFLHNVLNWLTLDIKYRYTKLA

SEQ ID NO: 2133245 - protein, 17 aa, Cryptosporidium hominis
RTLLHMRIKLQQKIRDL

SEQ ID NO: 2133246 - protein, 17 aa, Cryptosporidium hominis
RTMLDALHAFFPTPGEG

SEQ ID NO: 2133247 - protein, 23 aa, Cryptosporidium hominis
RTSRENGILFALPTGNNGKQELD

SEQ ID NO: 2133248 - protein, 42 aa, Cryptosporidium hominis
RTVNKKLIIGVVIGILLILLILMFCCVFFLRRRSDDTESAQN

SEQ ID NO: 2133249 - protein, 33 aa, Cryptosporidium hominis
RTYMKTRIYIRVPFHYLPLLNPKYVRVSGNEVF

SEQ ID NO: 2133250 - protein, 17 aa, Cryptosporidium hominis
RVEASSFLWESLIKSRV

SEQ ID NO: 2133251 - protein, 18 aa, Cryptosporidium hominis
RVEFLRKAFSKPFVCSEK

SEQ ID NO: 2133252 - protein, 17 aa, Cryptosporidium hominis
RVHFPQAGNFSNMTMVK

SEQ ID NO: 2133253 - protein, 27 aa, Cryptosporidium hominis
RVIATFVFLLFCIFFALSAKNAAQYVE

SEQ ID NO: 2133254 - protein, 26 aa, Cryptosporidium hominis
RVIPLSLYGWYLSKVGIVFFISVCLL

SEQ ID NO: 2133255 - protein, 36 aa, Cryptosporidium hominis
RVISLLLLLSLLTIGFLFLLYKPLYTKFNLVLGHLS

SEQ ID NO: 2133256 - protein, 32 aa, Cryptosporidium hominis
RVLLLKVHYQSLMPLWPIVLAELIKIFRLKNH

SEQ ID NO: 2133257 - protein, 30 aa, Cryptosporidium hominis
RVNKLLLRLYDPLIWRYISVANWKVRLNTT

SEQ ID NO: 2133258 - protein, 34 aa, Cryptosporidium hominis
RVPFKERVLWTLISLFVFLVCCQIPLYGVLSSKS

SEQ ID NO: 2133259 - protein, 17 aa, Cryptosporidium hominis
RVQCVRFHPWNPEFLLS

SEQ ID NO: 2133260 - protein, 22 aa, Cryptosporidium hominis
RVSMLIFLLIVSILCIYNIIML

SEQ ID NO: 2133261 - protein, 25 aa, Cryptosporidium hominis
RVSSWKNYIALFNHLLFRGHSSTES

SEQ ID NO: 2133262 - protein, 22 aa, Cryptosporidium hominis
RWFLLLLYFLISFSVCGLVGSF

SEQ ID NO: 2133263 - protein, 18 aa, Cryptosporidium hominis
RYFNSFLGKFFTKGLEKL

SEQ ID NO: 2133264 - protein, 21 aa, Cryptosporidium hominis
RYFRHPVWIKIVRQADKWYLE

SEQ ID NO: 2133265 - protein, 39 aa, Cryptosporidium hominis
RYGLYIGGFFSPFIRLIQIILFPLLKPISVILDKAVGKT

SEQ ID NO: 2133266 - protein, 31 aa, Cryptosporidium hominis
RYHAGTAYRWLFVRLEIMGCIAVFTAGTLGV

SEQ ID NO: 2133267 - protein, 26 aa, Cryptosporidium hominis
RYHLDTAYIWLYLRLEVIGCMTLVVT

SEQ ID NO: 2133268 - protein, 19 aa, Cryptosporidium hominis
RYHYWFLMAPTMCFQFWYP

SEQ ID NO: 2133269 - protein, 17 aa, Cryptosporidium hominis
RYISVANWKVRLNTTAL

SEQ ID NO: 2133270 - protein, 17 aa, Cryptosporidium hominis
RYLINDAAVYYKKPVVS

SEQ ID NO: 2133271 - protein, 25 aa, Cryptosporidium hominis
RYNRMAALPLFRLFMKQDKEWINRQ

SEQ ID NO: 2133272 - protein, 24 aa, Cryptosporidium hominis
RYSYRMGWYYSMLSIVSGLIILVS

SEQ ID NO: 2133273 - protein, 18 aa, Cryptosporidium hominis
RYYKYVFPSYLLKDEEKI

SEQ ID NO: 2133274 - protein, 23 aa, Cryptosporidium hominis
SAFLLLPLFFLNLVSYHAFSIFQ

SEQ ID NO: 2133275 - protein, 26 aa, Cryptosporidium hominis
SAFNSFKFITMILSYILVISMNNTLN

SEQ ID NO: 2133276 - protein, 21 aa, Cryptosporidium hominis
SAIPIVLPGLYYKPYSYTTNL

SEQ ID NO: 2133277 - protein, 17 aa, Cryptosporidium hominis
SAKRNFSMPPKSNPVFS

SEQ ID NO: 2133278 - protein, 28 aa, Cryptosporidium hominis
SALFIFGFIIALIIGNYFVLSSAFCFNR

SEQ ID NO: 2133279 - protein, 25 aa, Cryptosporidium hominis
SALIRKSFWLDSWSQFDIFATGRKN

SEQ ID NO: 2133280 - protein, 23 aa, Cryptosporidium hominis
SAMQIQACWRSFLTRFGASLCEG

SEQ ID NO: 2133281 - protein, 19 aa, Cryptosporidium hominis
SAMYLGEFYFNLLYELFPS

SEQ ID NO: 2133282 - protein, 22 aa, Cryptosporidium hominis
SANRCFILKGRVYLIPPEIMDN

SEQ ID NO: 2133283 - protein, 29 aa, Cryptosporidium hominis
SAQLIISFVFILLCRFNYKVEISLLFAQI

SEQ ID NO: 2133284 - protein, 22 aa, Cryptosporidium hominis
SARFQILISLIILIDSTKTLKE

SEQ ID NO: 2133285 - protein, 23 aa, Cryptosporidium hominis
SASFTFLLVFSLALTISAYTTFG

SEQ ID NO: 2133286 - protein, 33 aa, Cryptosporidium hominis
SASTFVSYWFVSSYYWFLIIFGCILGIADGIAF

SEQ ID NO: 2133287 - protein, 25 aa, Cryptosporidium hominis
SCDLTAAVYLLLFALKQLSSLSEVE

SEQ ID NO: 2133288 - protein, 24 aa, Cryptosporidium hominis
SCFEFKLFKKFNIDSLIISFGKEQ

SEQ ID NO: 2133289 - protein, 22 aa, Cryptosporidium hominis
SCGLLICHDLLRAIINIYNRIN

SEQ ID NO: 2133290 - protein, 30 aa, Cryptosporidium hominis
SCGRCFGSLFIILFAFICTSCCYAYPIYNS

SEQ ID NO: 2133291 - protein, 22 aa, Cryptosporidium hominis
SCKLVRLLVERELPPGFYQGVF

SEQ ID NO: 2133292 - protein, 26 aa, Cryptosporidium hominis
SCLIVRLSAYIAFKKKFRSMLASDLI

SEQ ID NO: 2133293 - protein, 17 aa, Cryptosporidium hominis
SCLLPCLIYNKEGIKFI

SEQ ID NO: 2133294 - protein, 27 aa, Cryptosporidium hominis
SCLMGIFILLLSMLLSKINLFRTNGRL

SEQ ID NO: 2133295 - protein, 18 aa, Cryptosporidium hominis
SCLYQFFSAKIRINSISG

SEQ ID NO: 2133296 - protein, 36 aa, Cryptosporidium hominis
SCPFPDHQVPTLGSLFIICFLVLNYLVSDRKNVVAI

SEQ ID NO: 2133297 - protein, 27 aa, Cryptosporidium hominis
SDDFHNDIPLLWLLALSVASVVITVQC

SEQ ID NO: 2133298 - protein, 27 aa, Cryptosporidium hominis
SDDGSWVYWGTVWSTMSFGPNSLSILP

SEQ ID NO: 2133299 - protein, 18 aa, Cryptosporidium hominis
SDEDFSTLILKKVKDDSA

SEQ ID NO: 2133300 - protein, 17 aa, Cryptosporidium hominis
SDFYFKLSLIELKAVGG

SEQ ID NO: 2133301 - protein, 24 aa, Cryptosporidium hominis
SDHKLHLKLIMIAQSLLFVINNAI

SEQ ID NO: 2133302 - protein, 18 aa, Cryptosporidium hominis
SDIRGEVWCYLLGSDRML

SEQ ID NO: 2133303 - protein, 33 aa, Cryptosporidium hominis
SDIWSLGITVLELAFGRIPWPNFDSLEELLEYI

SEQ ID NO: 2133304 - protein, 19 aa, Cryptosporidium hominis
SDIYLGRILISLKTELLRN

SEQ ID NO: 2133305 - protein, 28 aa, Cryptosporidium hominis
SDKVDLYLPIFLLFLETFSFEDLNGDLF

SEQ ID NO: 2133306 - protein, 19 aa, Cryptosporidium hominis
SDLKPKWYKAAFGVSIALI

SEQ ID NO: 2133307 - protein, 21 aa, Cryptosporidium hominis
SDLTFKIGLTYCLERLVYSEM

SEQ ID NO: 2133308 - protein, 27 aa, Cryptosporidium hominis
SDPIHTFFYISFVLISCALFSKTWIEV

SEQ ID NO: 2133309 - protein, 27 aa, Cryptosporidium hominis
SDPYYLIYIIFCFICALAVLIVINNEE

SEQ ID NO: 2133310 - protein, 28 aa, Cryptosporidium hominis
SDQMNKLLSFLLFLFDKGLKNHEICSRL

SEQ ID NO: 2133311 - protein, 26 aa, Cryptosporidium hominis
SDSIEDILVPITKPIFSDYASIGRNS

SEQ ID NO: 2133312 - protein, 35 aa, Cryptosporidium hominis
SDSIKMLLDILILKSFYILHIWKVKDPSLLGRPCE

SEQ ID NO: 2133313 - protein, 18 aa, Cryptosporidium hominis
SDSKFFCWKKVRSKSSHL

SEQ ID NO: 2133314 - protein, 23 aa, Cryptosporidium hominis
SDSKYFRYIPMIPKVTVCDFEDL

SEQ ID NO: 2133315 - protein, 32 aa, Cryptosporidium hominis
SDSNSSCKIIYKIILWLLKYSKNIDEPLSVIQ

SEQ ID NO: 2133316 - protein, 24 aa, Cryptosporidium hominis
SDVHPSFPISYVPKILNFIDRGGN

SEQ ID NO: 2133317 - protein, 20 aa, Cryptosporidium hominis
SDVRTYCRYILKKTMDEINE

SEQ ID NO: 2133318 - protein, 28 aa, Cryptosporidium hominis
SDYDDAYIWQYLFDTPWFKIDCVPDVIC

SEQ ID NO: 2133319 - protein, 17 aa, Cryptosporidium hominis
SDYILFQRYRCSIHSNH

SEQ ID NO: 2133320 - protein, 24 aa, Cryptosporidium hominis
SECGILDWYCILNRIYIAGQTLGY

SEQ ID NO: 2133321 - protein, 28 aa, Cryptosporidium hominis
SECVFPYKEYIWKLLNWESQLHSLFALS

SEQ ID NO: 2133322 - protein, 19 aa, Cryptosporidium hominis
SECYLAEPLLKECPTGFQM

SEQ ID NO: 2133323 - protein, 23 aa, Cryptosporidium hominis
SEDLFSKISLISDSKLTLTRYIG

SEQ ID NO: 2133324 - protein, 28 aa, Cryptosporidium hominis
SEEKKILPRFYRYLGLYYSLICISRMKR

SEQ ID NO: 2133325 - protein, 32 aa, Cryptosporidium hominis
SEFDPFFLQIFRYLLFYSLTLLSFSSSVIWSC

SEQ ID NO: 2133326 - protein, 25 aa, Cryptosporidium hominis
SEFVLVSLIFICRLIYNCINGQFPV

SEQ ID NO: 2133327 - protein, 17 aa, Cryptosporidium hominis
SEFYLNNYKLEGFIVGN

SEQ ID NO: 2133328 - protein, 26 aa, Cryptosporidium hominis
SEIEKLYLFISDNLNFYWMNLSSTVL

SEQ ID NO: 2133329 - protein, 34 aa, Cryptosporidium hominis
SEILLKVVCIYILNMLRFIAIINPELSSSLFKLL

SEQ ID NO: 2133330 - protein, 20 aa, Cryptosporidium hominis
SEIWIQMLIGFVTVVKATVG

SEQ ID NO: 2133331 - protein, 23 aa, Cryptosporidium hominis
SEKLPVFALVDIFHVPPESRQKC

SEQ ID NO: 2133332 - protein, 18 aa, Cryptosporidium hominis
SELCKYIEMVIGNKNVKE

SEQ ID NO: 2133333 - protein, 21 aa, Cryptosporidium hominis
SELILTAILAFFVLKRKVTVR

SEQ ID NO: 2133334 - protein, 25 aa, Cryptosporidium hominis
SELLTAYAYFLHFSGYKVICKNENL

SEQ ID NO: 2133335 - protein, 25 aa, Cryptosporidium hominis
SELSVVLIIVLEYLYRKTAMTVSQA

SEQ ID NO: 2133336 - protein, 26 aa, Cryptosporidium hominis
SENDYLFYVNVLIKTLLKSLERKTKR

SEQ ID NO: 2133337 - protein, 25 aa, Cryptosporidium hominis
SEQDKTLLFPIPPSKVYKFREKGYE

SEQ ID NO: 2133338 - protein, 22 aa, Cryptosporidium hominis
SEQYYHIPVPNLFLRQPISQIV

SEQ ID NO: 2133339 - protein, 30 aa, Cryptosporidium hominis
SERGLFYTMLFCMVSAIFATLFGALALIID

SEQ ID NO: 2133340 - protein, 33 aa, Cryptosporidium hominis
SFAERNIACLNARRWLLNKILNIRKGRYFVLSL

SEQ ID NO: 2133341 - protein, 23 aa, Cryptosporidium hominis
SFARSLYCKLIQSSVYRIGSSEN

SEQ ID NO: 2133342 - protein, 19 aa, Cryptosporidium hominis
SFDYYYYLNKSNSLPWFKL

SEQ ID NO: 2133343 - protein, 17 aa, Cryptosporidium hominis
SFFALVSYKLAVVFLKS

SEQ ID NO: 2133344 - protein, 36 aa, Cryptosporidium hominis
SFGLYDQLPIAWLFLSIIVALIIFKQGNSFSWGLFT

SEQ ID NO: 2133345 - protein, 24 aa, Cryptosporidium hominis
SFGMSIIFYIYFKSTMYDENLPVW

SEQ ID NO: 2133346 - protein, 18 aa, Cryptosporidium hominis
SFIIEIVALLWGSSHNHS

SEQ ID NO: 2133347 - protein, 28 aa, Cryptosporidium hominis
SFIKSFTRFNPLIGRLQWNSSSPRTYRW

SEQ ID NO: 2133348 - protein, 20 aa, Cryptosporidium hominis
SFILILSIFILLYTKRWNSH

SEQ ID NO: 2133349 - protein, 20 aa, Cryptosporidium hominis
SFILTFFLTSILLSLDFWTV

SEQ ID NO: 2133350 - protein, 32 aa, Cryptosporidium hominis
SFLDDPLSILYGLCLGLLFLGKREACETTLEA

SEQ ID NO: 2133351 - protein, 33 aa, Cryptosporidium hominis
SFLGYSLDYIISKEITFFWTTLLLLGETDTRDS

SEQ ID NO: 2133352 - protein, 23 aa, Cryptosporidium hominis
SFLSTLFCWIFIGGNYAIFKEIH

SEQ ID NO: 2133353 - protein, 19 aa, Cryptosporidium hominis
SFLTIVQLLLASVTGILIC

SEQ ID NO: 2133354 - protein, 21 aa, Cryptosporidium hominis
SFMLANLGEFGFVLASKGISL

SEQ ID NO: 2133355 - protein, 30 aa, Cryptosporidium hominis
SFNFPSIRMPLFLKWLRYSAFAVLYPIGIF

SEQ ID NO: 2133356 - protein, 31 aa, Cryptosporidium hominis
SFNYVYSKSQHWIYRNWVPLILGDKPSEIMG

SEQ ID NO: 2133357 - protein, 18 aa, Cryptosporidium hominis
SFPVIIRINPEYITGNKP

SEQ ID NO: 2133358 - protein, 20 aa, Cryptosporidium hominis
SFPYHKYLLLPALFLGFITS

SEQ ID NO: 2133359 - protein, 34 aa, Cryptosporidium hominis
SFRFNYTIFSISISFAFLAKYYFQNIRKQLNMKA

SEQ ID NO: 2133360 - protein, 26 aa, Cryptosporidium hominis
SFSNWRFNVPWLLWADSAFIGIQNAF

SEQ ID NO: 2133361 - protein, 19 aa, Cryptosporidium hominis
SFSSDWINKIFLKSIFGLL

SEQ ID NO: 2133362 - protein, 30 aa, Cryptosporidium hominis
SFVGFYNYHYFWDPALLLNAFYSQAEILSI

SEQ ID NO: 2133363 - protein, 25 aa, Cryptosporidium hominis
SFVLLFCLFFYQLDKLHAEVIYAVN

SEQ ID NO: 2133364 - protein, 24 aa, Cryptosporidium hominis
SFVLSVINMAKFVEKIKIPICQHN

SEQ ID NO: 2133365 - protein, 18 aa, Cryptosporidium hominis
SFWCIHALQHALITATIL

SEQ ID NO: 2133366 - protein, 25 aa, Cryptosporidium hominis
SFYKVAPWIPVYLETKNKFLIEVSG

SEQ ID NO: 2133367 - protein, 33 aa, Cryptosporidium hominis
SGDEFDYYLYYNNSYLTFLFKHKDGKYYEVGSL

SEQ ID NO: 2133368 - protein, 26 aa, Cryptosporidium hominis
SGDLARTIGFISPKSLKYLELIFCEE

SEQ ID NO: 2133369 - protein, 24 aa, Cryptosporidium hominis
SGFLFKLSIILITAPVPWARWYVE

SEQ ID NO: 2133370 - protein, 27 aa, Cryptosporidium hominis
SGGLQWFWYSLILTLKMVFLVWHKSFD

SEQ ID NO: 2133371 - protein, 24 aa, Cryptosporidium hominis
SGIAQLVLFLLAVYKGIQYSREHN

SEQ ID NO: 2133372 - protein, 18 aa, Cryptosporidium hominis
SGILFILLSIYYIIRNKF

SEQ ID NO: 2133373 - protein, 21 aa, Cryptosporidium hominis
SGLFVIILMACIDIGLFGFMY

SEQ ID NO: 2133374 - protein, 22 aa, Cryptosporidium hominis
SGLLPILIGISGWLRNNDDIFI

SEQ ID NO: 2133375 - protein, 27 aa, Cryptosporidium hominis
SGLPNGISLFVHLLDLMKFQTRIIEEF

SEQ ID NO: 2133376 - protein, 25 aa, Cryptosporidium hominis
SGLSNYYVGVILVSSLILDTKNQDK

SEQ ID NO: 2133377 - protein, 25 aa, Cryptosporidium hominis
SGNIWKMFQPILNIKYHSSLMIGDG

SEQ ID NO: 2133378 - protein, 28 aa, Cryptosporidium hominis
SGQQNSYFWILTILAVALGVIAISLLSC

SEQ ID NO: 2133379 - protein, 33 aa, Cryptosporidium hominis
SGRMISIFLVIFGFIQFLKFKGPKAATKPLLDE

SEQ ID NO: 2133380 - protein, 24 aa, Cryptosporidium hominis
SGSGKTSLLFLIAKSLKYKGKISH

SEQ ID NO: 2133381 - protein, 27 aa, Cryptosporidium hominis
SGSIFIGIFIWILIKSKFHRDKVELNQ

SEQ ID NO: 2133382 - protein, 24 aa, Cryptosporidium hominis
SGSYLYFILILMTGINIIGTAFDY

SEQ ID NO: 2133383 - protein, 27 aa, Cryptosporidium hominis
SGTIHTWIFHPNKAKFALFSSWTEGCN

SEQ ID NO: 2133384 - protein, 30 aa, Cryptosporidium hominis
SGYVLSIVLILIYWLLNVICTILMFKCADE

SEQ ID NO: 2133385 - protein, 26 aa, Cryptosporidium hominis
SHAILNPPFFLFQRPTLDGFDVDSIS

SEQ ID NO: 2133386 - protein, 30 aa, Cryptosporidium hominis
SHESIDYYHWWFLCIDIVFSGISISQNSEL

SEQ ID NO: 2133387 - protein, 34 aa, Cryptosporidium hominis
SHFDLQFIFTFIFWGKICVLTSISWGPILLYKLI

SEQ ID NO: 2133388 - protein, 28 aa, Cryptosporidium hominis
SHISAHIGSLLAWLFQNMAQHVEQDGLI

SEQ ID NO: 2133389 - protein, 18 aa, Cryptosporidium hominis
SHIVKLRKSIRADKSDLL

SEQ ID NO: 2133390 - protein, 22 aa, Cryptosporidium hominis
SHNSHIFLVPWVDHLPTNYQFR

SEQ ID NO: 2133391 - protein, 24 aa, Cryptosporidium hominis
SHSNLWTFFLEWDTSSKTWLIRDC

SEQ ID NO: 2133392 - protein, 26 aa, Cryptosporidium hominis
SIATSPSSFKIFFSPSPEPITIFEDT

SEQ ID NO: 2133393 - protein, 23 aa, Cryptosporidium hominis
SICQKFIDLLTKPTSSSSTTTTS

SEQ ID NO: 2133394 - protein, 17 aa, Cryptosporidium hominis
SICQMILKSKSIVAQNP

SEQ ID NO: 2133395 - protein, 23 aa, Cryptosporidium hominis
SIDALPSDWFLAALQQLSQMNAE

SEQ ID NO: 2133396 - protein, 18 aa, Cryptosporidium hominis
SIEFHNISFLFLAGYFKN

SEQ ID NO: 2133397 - protein, 25 aa, Cryptosporidium hominis
SIEKYALFELIITKLLPLCSSMLDD

SEQ ID NO: 2133398 - protein, 22 aa, Cryptosporidium hominis
SIFCIFIYLFGKVEASLTDIPW

SEQ ID NO: 2133399 - protein, 19 aa, Cryptosporidium hominis
SIFLHSQFSPLLRNSNDIS

SEQ ID NO: 2133400 - protein, 18 aa, Cryptosporidium hominis
SIFPGEVPGAALLRKRVY

SEQ ID NO: 2133401 - protein, 29 aa, Cryptosporidium hominis
SIFPLVLTFIIVLFTFFEIHIMYLKQYIL

SEQ ID NO: 2133402 - protein, 28 aa, Cryptosporidium hominis
SIFRLDVFPFITIYIVLISILLGEIFSL

SEQ ID NO: 2133403 - protein, 26 aa, Cryptosporidium hominis
SIFSIIVLILPCAIFWFVFYSEMVPQ

SEQ ID NO: 2133404 - protein, 19 aa, Cryptosporidium hominis
SIFTMNYIIKAVYLKELHS

SEQ ID NO: 2133405 - protein, 24 aa, Cryptosporidium hominis
SIGQFIYSLIFLSSTLFACFKTFG

SEQ ID NO: 2133406 - protein, 35 aa, Cryptosporidium hominis
SIGRVRHLLFTLFFLFLGLFLKLNQFLLLKENDIV

SEQ ID NO: 2133407 - protein, 17 aa, Cryptosporidium hominis
SIGYFKPLKVPFLSWSE

SEQ ID NO: 2133408 - protein, 23 aa, Cryptosporidium hominis
SIIFIQFLIWALLVYEFANYLDS

SEQ ID NO: 2133409 - protein, 18 aa, Cryptosporidium hominis
SIILASAIQIYYLKTILT

SEQ ID NO: 2133410 - protein, 25 aa, Cryptosporidium hominis
SIINNFPCMATSMIFNLIPILRDEN

SEQ ID NO: 2133411 - protein, 26 aa, Cryptosporidium hominis
SIIQHTILVALIKLITLGVTNITFKK

SEQ ID NO: 2133412 - protein, 25 aa, Cryptosporidium hominis
SIKEMYSYIVVYLKDFRQFKSEVMV

SEQ ID NO: 2133413 - protein, 19 aa, Cryptosporidium hominis
SIKFKRFKKRYAGVLGFAI

SEQ ID NO: 2133414 - protein, 35 aa, Cryptosporidium hominis
SIKLIYKTIKCIFIYMIFALLLRKLEDNNHKVSFD

SEQ ID NO: 2133415 - protein, 26 aa, Cryptosporidium hominis
SIKNFNIPFPFVAKLARLFPESMRTK

SEQ ID NO: 2133416 - protein, 19 aa, Cryptosporidium hominis
SILALFTYNILLVFIVLVF

SEQ ID NO: 2133417 - protein, 17 aa, Cryptosporidium hominis
SILFIIVANTYKFYEER

SEQ ID NO: 2133418 - protein, 20 aa, Cryptosporidium hominis
SILHLCILGNIPNIALYIFN

SEQ ID NO: 2133419 - protein, 22 aa, Cryptosporidium hominis
SILKLILRLYDPDKGKILLDGL

SEQ ID NO: 2133420 - protein, 28 aa, Cryptosporidium hominis
SILKNNLTQQFPFNGSLLLNGKVANITT

SEQ ID NO: 2133421 - protein, 20 aa, Cryptosporidium hominis
SILLIIREKLLPDSITNISK

SEQ ID NO: 2133422 - protein, 24 aa, Cryptosporidium hominis
SILNWLVSLIYIPLSYIISDLSVY

SEQ ID NO: 2133423 - protein, 21 aa, Cryptosporidium hominis
SILQYYPIKPKKPSDLYFCEI

SEQ ID NO: 2133424 - protein, 19 aa, Cryptosporidium hominis
SILSASLTMYCIMGTLFSF

SEQ ID NO: 2133425 - protein, 20 aa, Cryptosporidium hominis
SILTITFFSTLLITFGMLNP

SEQ ID NO: 2133426 - protein, 17 aa, Cryptosporidium hominis
SILVCLLAIISIRFLVK

SEQ ID NO: 2133427 - protein, 17 aa, Cryptosporidium hominis
SILVIWYSILNWSTENP

SEQ ID NO: 2133428 - protein, 29 aa, Cryptosporidium hominis
SIMKNHDAWIPLLRSMTYQDPEFRPSAEN

SEQ ID NO: 2133429 - protein, 21 aa, Cryptosporidium hominis
SINTLIFFCIGKIMLVAIYNK

SEQ ID NO: 2133430 - protein, 28 aa, Cryptosporidium hominis
SIPCSIGIFFLLFLTSNIIWFFVGFSRN

SEQ ID NO: 2133431 - protein, 24 aa, Cryptosporidium hominis
SIPNDIIHGLLLRVVLPSIKDPSI

SEQ ID NO: 2133432 - protein, 38 aa, Cryptosporidium hominis
SIPYTFENWNNLPAPMFMFIFSLFSLIIGMILSFTGVT

SEQ ID NO: 2133433 - protein, 17 aa, Cryptosporidium hominis
SIQLPQPPLLPPLSTSI

SEQ ID NO: 2133434 - protein, 47 aa, Cryptosporidium hominis
SIQQDFLLSLTNTKLFPLLIKLLYQELDFVLLAPIFSFLKTFDFSET

SEQ ID NO: 2133435 - protein, 29 aa, Cryptosporidium hominis
SIRFRFFTLLFTFILFTLAHFFIMVLNLG

SEQ ID NO: 2133436 - protein, 23 aa, Cryptosporidium hominis
SIRLILNLLKKEESLLFMISSIL

SEQ ID NO: 2133437 - protein, 19 aa, Cryptosporidium hominis
SISIFNFLTYNLIGEQYPD

SEQ ID NO: 2133438 - protein, 18 aa, Cryptosporidium hominis
SISLFFTEKYRCIIFFCV

SEQ ID NO: 2133439 - protein, 24 aa, Cryptosporidium hominis
SISLLNNFLLSHCDTLILGIMQEK

SEQ ID NO: 2133440 - protein, 18 aa, Cryptosporidium hominis
SISPLIFVVLSRVPQIVK

SEQ ID NO: 2133441 - protein, 25 aa, Cryptosporidium hominis
SISWGPILLYKLIKKTIHPPRYYKL

SEQ ID NO: 2133442 - protein, 28 aa, Cryptosporidium hominis
SISYGVFPYLWEGLLEMFLLINQSVSRS

SEQ ID NO: 2133443 - protein, 18 aa, Cryptosporidium hominis
SITKYFIPGFFILYFIQP

SEQ ID NO: 2133444 - protein, 17 aa, Cryptosporidium hominis
SITLTCLTSCAALFLGT

SEQ ID NO: 2133445 - protein, 17 aa, Cryptosporidium hominis
SITRIKLFHASNSCLNK

SEQ ID NO: 2133446 - protein, 31 aa, Cryptosporidium hominis
SITSDTYLISWLTSLFSTCIPIQVIPKVWDS

SEQ ID NO: 2133447 - protein, 18 aa, Cryptosporidium hominis
SITTFPLILEPKEIYKIL

SEQ ID NO: 2133448 - protein, 19 aa, Cryptosporidium hominis
SIVLFQIQPSLRPLVPLAL

SEQ ID NO: 2133449 - protein, 26 aa, Cryptosporidium hominis
SIVLVTSLLFQLAIPLNFIGMIYRES

SEQ ID NO: 2133450 - protein, 28 aa, Cryptosporidium hominis
SIVSIALIIIIVVFGLVVWKKVKDIEKK

SEQ ID NO: 2133451 - protein, 27 aa, Cryptosporidium hominis
SIVSTCILSLILSLIWIAHPPSSIILD

SEQ ID NO: 2133452 - protein, 25 aa, Cryptosporidium hominis
SIVYKLYWKLMLTCGVATICTLAAV

SEQ ID NO: 2133453 - protein, 31 aa, Cryptosporidium hominis
SIWEPDVFIYILLIIFYILSHITSTLLVRNG

SEQ ID NO: 2133454 - protein, 31 aa, Cryptosporidium hominis
SIYIFSRLDISFFYHYIRGQGLSKLYVILNM

SEQ ID NO: 2133455 - protein, 24 aa, Cryptosporidium hominis
SIYPLFVYSIIWGRKKSFFTNFFV

SEQ ID NO: 2133456 - protein, 23 aa, Cryptosporidium hominis
SKAFLYNLILIISLTISIYGIML

SEQ ID NO: 2133457 - protein, 25 aa, Cryptosporidium hominis
SKDELDLYGFIRLRVRFKDEEVVAQ

SEQ ID NO: 2133458 - protein, 17 aa, Cryptosporidium hominis
SKDGLFLLYFQKRANKL

SEQ ID NO: 2133459 - protein, 30 aa, Cryptosporidium hominis
SKESRIHLLLWLSSVIILLLFPNISLPKRS

SEQ ID NO: 2133460 - protein, 28 aa, Cryptosporidium hominis
SKFSEAHFLQLLILAQNQLKLFLESRFI

SEQ ID NO: 2133461 - protein, 20 aa, Cryptosporidium hominis
SKFTFSWFTPIIDSAYDHIL

SEQ ID NO: 2133462 - protein, 26 aa, Cryptosporidium hominis
SKFTYFLVRISSLFYILGLGLHLYDI

SEQ ID NO: 2133463 - protein, 21 aa, Cryptosporidium hominis
SKIELEMFSFLPKILEFQVKD

SEQ ID NO: 2133464 - protein, 30 aa, Cryptosporidium hominis
SKILVGYVPQLIWILSGLPLSDLILCGGEY

SEQ ID NO: 2133465 - protein, 24 aa, Cryptosporidium hominis
SKKQLIFHRIYFDLGTYPDRKLTQ

SEQ ID NO: 2133466 - protein, 38 aa, Cryptosporidium hominis
SKKSILSLLFKIMYLIRILNSLRCLVLLLYSRSNETNE

SEQ ID NO: 2133467 - protein, 20 aa, Cryptosporidium hominis
SKKYFIIFIIFALFIFGKYY

SEQ ID NO: 2133468 - protein, 22 aa, Cryptosporidium hominis
SKLLLFILHTLRQLGIQYTLPV

SEQ ID NO: 2133469 - protein, 24 aa, Cryptosporidium hominis
SKLRKILNILKYYGSRDLEDLGIY

SEQ ID NO: 2133470 - protein, 20 aa, Cryptosporidium hominis
SKMLIICGALIGSSGAILSH

SEQ ID NO: 2133471 - protein, 24 aa, Cryptosporidium hominis
SKNEFFEVFFWIIDSELNSKQLAL

SEQ ID NO: 2133472 - protein, 24 aa, Cryptosporidium hominis
SKNRNHFWLPLLQVYGRSIVNVLF

SEQ ID NO: 2133473 - protein, 51 aa, Cryptosporidium hominis
SKNYLVAPRSNFLEMEDISLILSLFVLAVDHLPAFLNRYMASSPSNVVYRS

SEQ ID NO: 2133474 - protein, 25 aa, Cryptosporidium hominis
SKQFGLWMFPFLLSSLSGIVLFTLL

SEQ ID NO: 2133475 - protein, 18 aa, Cryptosporidium hominis
SKRVKNCLTYLLVAAFTT

SEQ ID NO: 2133476 - protein, 29 aa, Cryptosporidium hominis
SKSFCFTFLVLFYLRIYLYLYEEKIVSRT

SEQ ID NO: 2133477 - protein, 37 aa, Cryptosporidium hominis
SKSFIFINSVVSGLYLMLWRFLEQQFESVLSVLDIAT

SEQ ID NO: 2133478 - protein, 30 aa, Cryptosporidium hominis
SKSIYPSWYYFLVAFYNLIGRLTWAITLIP

SEQ ID NO: 2133479 - protein, 25 aa, Cryptosporidium hominis
SKSSKLIFGLFLRSNSHFSEVEDKL

SEQ ID NO: 2133480 - protein, 31 aa, Cryptosporidium hominis
SKTNHMKAYFNLTIWAFTIICLSQKLNKCPD

SEQ ID NO: 2133481 - protein, 28 aa, Cryptosporidium hominis
SKVIAVICLIVWVINFRNFQDPAHGSTI

SEQ ID NO: 2133482 - protein, 30 aa, Cryptosporidium hominis
SKVNLLRKALKLFLIREWSLTRRLIQWIMN

SEQ ID NO: 2133483 - protein, 68 aa, Cryptosporidium hominis
SKVSWTRVLQKIRILNIPDLYIQATAKKILKFNIYIYRIYTDKYKRKIIKRVQGILRNLKIVNKSQMI

SEQ ID NO: 2133484 - protein, 24 aa, Cryptosporidium hominis
SKVTRYICILLSENTFTREKEADL

SEQ ID NO: 2133485 - protein, 33 aa, Cryptosporidium hominis
SKVVPKFLICIPVLAYLFFQVSKKYAPMLRQSE

SEQ ID NO: 2133486 - protein, 19 aa, Cryptosporidium hominis
SLAEFYMMNLPFSDTMDSL

SEQ ID NO: 2133487 - protein, 35 aa, Cryptosporidium hominis
SLAIFNNIFKLFLLIIPNLLFQFYCEWSGTLLQLL

SEQ ID NO: 2133488 - protein, 24 aa, Cryptosporidium hominis
SLAILSISLFYFLYKKKEVISREN

SEQ ID NO: 2133489 - protein, 25 aa, Cryptosporidium hominis
SLANKSLLFPFSIFSILSSEHINVR

SEQ ID NO: 2133490 - protein, 22 aa, Cryptosporidium hominis
SLASLLGIFSISQLFLSPGSYL

SEQ ID NO: 2133491 - protein, 29 aa, Cryptosporidium hominis
SLCILGIIKPWIFMAWLTTAVTEFEKNLR

SEQ ID NO: 2133492 - protein, 31 aa, Cryptosporidium hominis
SLCLYFTHGFWTILFYFGLTANILASTLFIL

SEQ ID NO: 2133493 - protein, 27 aa, Cryptosporidium hominis
SLDEIAIICFDFFNLLEFYTDQYNYGN

SEQ ID NO: 2133494 - protein, 30 aa, Cryptosporidium hominis
SLDSTFPSLLIWIRFFHQTILKNQETKEAK

SEQ ID NO: 2133495 - protein, 29 aa, Cryptosporidium hominis
SLEICRVGGILIFFYLISNYWKNQYDYLT

SEQ ID NO: 2133496 - protein, 26 aa, Cryptosporidium hominis
SLESFFMDLFIILIKIMVEFKAEEKE

SEQ ID NO: 2133497 - protein, 25 aa, Cryptosporidium hominis
SLEYYNYLLKWLSIIITFFSLNCND

SEQ ID NO: 2133498 - protein, 25 aa, Cryptosporidium hominis
SLFLKEGILIWILSKEIFAPVSNRE

SEQ ID NO: 2133499 - protein, 26 aa, Cryptosporidium hominis
SLHPNHFSLIFKSRYPNYVKDEVAKT

SEQ ID NO: 2133500 - protein, 17 aa, Cryptosporidium hominis
SLIAAWFAQNRDSVISQ

SEQ ID NO: 2133501 - protein, 31 aa, Cryptosporidium hominis
SLIAISTCIFIFFILYIVLNALSRNREIQTN

SEQ ID NO: 2133502 - protein, 24 aa, Cryptosporidium hominis
SLIALPILCLCIPAKILEVIYIEN

SEQ ID NO: 2133503 - protein, 31 aa, Cryptosporidium hominis
SLIKDKISFIIIIWCPLIIVNYSNLDCILKI

SEQ ID NO: 2133504 - protein, 26 aa, Cryptosporidium hominis
SLILLNSTFFALLPFSFEPLIFLTAV

SEQ ID NO: 2133505 - protein, 17 aa, Cryptosporidium hominis
SLILTSGWIFIRCALGG

SEQ ID NO: 2133506 - protein, 23 aa, Cryptosporidium hominis
SLINQAVFLIFLSGLINSINSSD

SEQ ID NO: 2133507 - protein, 22 aa, Cryptosporidium hominis
SLISILFGPKWVRPENIQLFSA

SEQ ID NO: 2133508 - protein, 29 aa, Cryptosporidium hominis
SLISYLEFVVLLFGTIFQFLIIRQDYSPS

SEQ ID NO: 2133509 - protein, 20 aa, Cryptosporidium hominis
SLKDIINLLRFALQIHKIGS

SEQ ID NO: 2133510 - protein, 17 aa, Cryptosporidium hominis
SLKMILQVALLGIMWSL

SEQ ID NO: 2133511 - protein, 19 aa, Cryptosporidium hominis
SLKNFTNFCIKLFISESTD

SEQ ID NO: 2133512 - protein, 26 aa, Cryptosporidium hominis
SLKYIYSVLILLSQIFLCIVVWNVVC

SEQ ID NO: 2133513 - protein, 18 aa, Cryptosporidium hominis
SLLFFRLDCLDGIISEIL

SEQ ID NO: 2133514 - protein, 19 aa, Cryptosporidium hominis
SLLLIILREESIQLSWNSI

SEQ ID NO: 2133515 - protein, 17 aa, Cryptosporidium hominis
SLLNSQLSHFGWFKLIL

SEQ ID NO: 2133516 - protein, 31 aa, Cryptosporidium hominis
SLLRNPYAVYYWFISILNLLVVFIMVSTLKS

SEQ ID NO: 2133517 - protein, 18 aa, Cryptosporidium hominis
SLLTLIIIGLIGSSIYYF

SEQ ID NO: 2133518 - protein, 29 aa, Cryptosporidium hominis
SLLYSDVISMILIALILGLPNIENRRELI

SEQ ID NO: 2133519 - protein, 21 aa, Cryptosporidium hominis
SLMGTDWPLFIKEACRTLKDN

SEQ ID NO: 2133520 - protein, 25 aa, Cryptosporidium hominis
SLMKYFSGIHFLHAALLCRKTREWR

SEQ ID NO: 2133521 - protein, 42 aa, Cryptosporidium hominis
SLNFEDPLLPFLTLSILVILTTILNLGLYLFNLIIGNQKTAF

SEQ ID NO: 2133522 - protein, 26 aa, Cryptosporidium hominis
SLNSNLLYIYLLLSTYNEHIKTSNIA

SEQ ID NO: 2133523 - protein, 33 aa, Cryptosporidium hominis
SLNYHNGWRYSLLAPCLLLLIMSICLVFTKSEY

SEQ ID NO: 2133524 - protein, 24 aa, Cryptosporidium hominis
SLPELLRLLIIMIESWDELVIIYY

SEQ ID NO: 2133525 - protein, 28 aa, Cryptosporidium hominis
SLPFNFLLLFTLLVFSIGVVSVKSNDNS

SEQ ID NO: 2133526 - protein, 20 aa, Cryptosporidium hominis
SLPPFNLKSVPIMLGISLIP

SEQ ID NO: 2133527 - protein, 19 aa, Cryptosporidium hominis
SLRLFLSLNGMPLASHFNF

SEQ ID NO: 2133528 - protein, 21 aa, Cryptosporidium hominis
SLRSLFSISIFNFLTYNLIGE

SEQ ID NO: 2133529 - protein, 25 aa, Cryptosporidium hominis
SLSFSIFNLIFFFGSRLKSAAEVFL

SEQ ID NO: 2133530 - protein, 18 aa, Cryptosporidium hominis
SLSLSLSLSLSLSLSLSH

SEQ ID NO: 2133531 - protein, 18 aa, Cryptosporidium hominis
SLSNNLYDLLPLISNSRN

SEQ ID NO: 2133532 - protein, 25 aa, Cryptosporidium hominis
SLSSIFSMDSFINPIGNLLKGKKPS

SEQ ID NO: 2133533 - protein, 25 aa, Cryptosporidium hominis
SLSSTFPMDIPLAGKLKVLCLDKTG

SEQ ID NO: 2133534 - protein, 25 aa, Cryptosporidium hominis
SLSVPIIDLWRILALHPQSSDIHKK

SEQ ID NO: 2133535 - protein, 24 aa, Cryptosporidium hominis
SLSYFTCIGSWLRHSRTLIYNTPN

SEQ ID NO: 2133536 - protein, 19 aa, Cryptosporidium hominis
SLTISKVDNIPFISIESNE

SEQ ID NO: 2133537 - protein, 19 aa, Cryptosporidium hominis
SLTIWLRAWLIKRQLQPRN

SEQ ID NO: 2133538 - protein, 17 aa, Cryptosporidium hominis
SLTVFYLVETGPFLQEQ

SEQ ID NO: 2133539 - protein, 23 aa, Cryptosporidium hominis
SLVILVYICKLLRAKYGVSGKLK

SEQ ID NO: 2133540 - protein, 23 aa, Cryptosporidium hominis
SLVPSLSALLKYYNQEYIQSLLG

SEQ ID NO: 2133541 - protein, 26 aa, Cryptosporidium hominis
SMCLILYFLEPFFETFFYLRETLDKC

SEQ ID NO: 2133542 - protein, 24 aa, Cryptosporidium hominis
SMDDSLRFYSLINLNLMGNKISEF

SEQ ID NO: 2133543 - protein, 19 aa, Cryptosporidium hominis
SMFGTFLIDAKSPFSGFTN

SEQ ID NO: 2133544 - protein, 19 aa, Cryptosporidium hominis
SMFSTFLASINTFGGFYVT

SEQ ID NO: 2133545 - protein, 23 aa, Cryptosporidium hominis
SMGLYPICYFSPLTILSDLVQNL

SEQ ID NO: 2133546 - protein, 28 aa, Cryptosporidium hominis
SMGVLLVAMFLLEYIRFLPEAVLGAIIS

SEQ ID NO: 2133547 - protein, 37 aa, Cryptosporidium hominis
SMIDFIILRSIFGNGLLIFLLFEIHYLKRRINMLSTT

SEQ ID NO: 2133548 - protein, 26 aa, Cryptosporidium hominis
SMILTTFFMYYFVGGIFDWTCSLLIS

SEQ ID NO: 2133549 - protein, 24 aa, Cryptosporidium hominis
SMKQLPLSLMLWIQATRLISDNID

SEQ ID NO: 2133550 - protein, 18 aa, Cryptosporidium hominis
SMLILFAELVSSIPDLII

SEQ ID NO: 2133551 - protein, 21 aa, Cryptosporidium hominis
SMLMLTILWQFTMVDNSISLW

SEQ ID NO: 2133552 - protein, 21 aa, Cryptosporidium hominis
SMTFESYLILLTSLGICISHI

SEQ ID NO: 2133553 - protein, 25 aa, Cryptosporidium hominis
SMVLQNLLLLFSLYQFIGISAFIGY

SEQ ID NO: 2133554 - protein, 34 aa, Cryptosporidium hominis
SNDGISHIYLLLVIILLVNLGIGLFFCGRNLNKQ

SEQ ID NO: 2133555 - protein, 25 aa, Cryptosporidium hominis
SNDLKKLVLILLSKPALNKNNLDVF

SEQ ID NO: 2133556 - protein, 22 aa, Cryptosporidium hominis
SNEKLFKILNDFNIPILQENEK

SEQ ID NO: 2133557 - protein, 28 aa, Cryptosporidium hominis
SNEPPMTRYLLWIDIYEISCRPAFDGEV

SEQ ID NO: 2133558 - protein, 19 aa, Cryptosporidium hominis
SNEYPYINPFIPIRSQETE

SEQ ID NO: 2133559 - protein, 21 aa, Cryptosporidium hominis
SNFNLIKSFQYSILKFEKLDS

SEQ ID NO: 2133560 - protein, 47 aa, Cryptosporidium hominis
SNGIDHQIFRPLLWKVQTAYVSYLYYLGFSYMMLQRYIDAIRIFQQS

SEQ ID NO: 2133561 - protein, 23 aa, Cryptosporidium hominis
SNGNPNWYTLKPIFDISAGYTFN

SEQ ID NO: 2133562 - protein, 40 aa, Cryptosporidium hominis
SNIKTIYGALLRILLVLLHDFPEFLCDYSCSFCDVLPVNC

SEQ ID NO: 2133563 - protein, 28 aa, Cryptosporidium hominis
SNKQESLLLRWVDDFLFLTSDLESAKKF

SEQ ID NO: 2133564 - protein, 22 aa, Cryptosporidium hominis
SNLEIRQKFKNKFVFGCNIIEN

SEQ ID NO: 2133565 - protein, 27 aa, Cryptosporidium hominis
SNLLICYGNILFILWLEYNNQSNEERM

SEQ ID NO: 2133566 - protein, 19 aa, Cryptosporidium hominis
SNLNILIPLAIYGLNKPSK

SEQ ID NO: 2133567 - protein, 22 aa, Cryptosporidium hominis
SNLPLLITLSFLLEDKKKSLLV

SEQ ID NO: 2133568 - protein, 18 aa, Cryptosporidium hominis
SNLPLNSTILDQIKETRS

SEQ ID NO: 2133569 - protein, 27 aa, Cryptosporidium hominis
SNNAKYLVWLLVLVPVFICIPCLIWVW

SEQ ID NO: 2133570 - protein, 25 aa, Cryptosporidium hominis
SNNDLILQWMSYGGYLTNPVLSHYN

SEQ ID NO: 2133571 - protein, 19 aa, Cryptosporidium hominis
SNNKLLTPQKDELLRQYYN

SEQ ID NO: 2133572 - protein, 32 aa, Cryptosporidium hominis
SNNNNIFLTLYTIVGYFFTSIAIIYYNHWLFD

SEQ ID NO: 2133573 - protein, 21 aa, Cryptosporidium hominis
SNQRWVVITIKYLLGTEFTSR

SEQ ID NO: 2133574 - protein, 21 aa, Cryptosporidium hominis
SNRYPYIYNFTLSFAGSCGDS

SEQ ID NO: 2133575 - protein, 30 aa, Cryptosporidium hominis
SNSGILEYMKPKALYLPCSLFDENPQVKLE

SEQ ID NO: 2133576 - protein, 25 aa, Cryptosporidium hominis
SNSGIWVFSFVLIGIQCFIFLIFLI

SEQ ID NO: 2133577 - protein, 26 aa, Cryptosporidium hominis
SNSITKLLPSFLWPHDPNNIILKESN

SEQ ID NO: 2133578 - protein, 23 aa, Cryptosporidium hominis
SNSKQFLHIFKYFKNSKFNLNKK

SEQ ID NO: 2133579 - protein, 30 aa, Cryptosporidium hominis
SNSLPIFSNYHILQSLLIIFLNMMILYTSA

SEQ ID NO: 2133580 - protein, 24 aa, Cryptosporidium hominis
SNSWLFKSDLYYIFLLASNTKLNY

SEQ ID NO: 2133581 - protein, 42 aa, Cryptosporidium hominis
SNTSFLLMTFIFAFVPFMYFTAIFLVLLFAFSIIMHAMYGAI

SEQ ID NO: 2133582 - protein, 26 aa, Cryptosporidium hominis
SNVFSRIFLSYYNLCKSFILNNKTSI

SEQ ID NO: 2133583 - protein, 25 aa, Cryptosporidium hominis
SNVSFGFFVFISVLVSIGLGYIIDH

SEQ ID NO: 2133584 - protein, 24 aa, Cryptosporidium hominis
SNVTYIAHTFGYRLYIHELRENNE

SEQ ID NO: 2133585 - protein, 23 aa, Cryptosporidium hominis
SNYHPELWQPAWGIRTMLDALHA

SEQ ID NO: 2133586 - protein, 20 aa, Cryptosporidium hominis
SNYKALFFLGDIRRGIHFGM

SEQ ID NO: 2133587 - protein, 26 aa, Cryptosporidium hominis
SNYYENIWICTLYILNDIRLIDKATY

SEQ ID NO: 2133588 - protein, 27 aa, Cryptosporidium hominis
SPCAFFLFITISFVRGILLSLIAFEWI

SEQ ID NO: 2133589 - protein, 19 aa, Cryptosporidium hominis
SPCQISHSLLFTRAANNLG

SEQ ID NO: 2133590 - protein, 25 aa, Cryptosporidium hominis
SPIFRVVLGVLRWLRWESRVNPYKQ

SEQ ID NO: 2133591 - protein, 27 aa, Cryptosporidium hominis
SPKYPITDDLWYLMAHFRNPDSKMEDK

SEQ ID NO: 2133592 - protein, 20 aa, Cryptosporidium hominis
SPLYPSGIIYPQSPINLPGM

SEQ ID NO: 2133593 - protein, 23 aa, Cryptosporidium hominis
SPSYYFLFIPVVALVYYNVNSYY

SEQ ID NO: 2133594 - protein, 19 aa, Cryptosporidium hominis
SQAMLIFNVKMPNFKHITE

SEQ ID NO: 2133595 - protein, 26 aa, Cryptosporidium hominis
SQCLNAFNYFYVHPNLITCTPSPSKE

SEQ ID NO: 2133596 - protein, 29 aa, Cryptosporidium hominis
SQDNYYLLHQLFSQFFWALHDDPELEHLR

SEQ ID NO: 2133597 - protein, 24 aa, Cryptosporidium hominis
SQIDQICLLWPLDVINLQDHEQLE

SEQ ID NO: 2133598 - protein, 30 aa, Cryptosporidium hominis
SQKCHNLVLALLYYRYLQLGVILENGKKLD

SEQ ID NO: 2133599 - protein, 33 aa, Cryptosporidium hominis
SQLFASKEDKLLLKLPILITTTTSTMTTTTRKS

SEQ ID NO: 2133600 - protein, 18 aa, Cryptosporidium hominis
SQLQLWFPQTIASLRSHF

SEQ ID NO: 2133601 - protein, 18 aa, Cryptosporidium hominis
SQMCCLFQFIKVIGLFLA

SEQ ID NO: 2133602 - protein, 43 aa, Cryptosporidium hominis
SQMIKDRHFLGAYTIFGSLLTALLLLSIATFHERQYAEKSEDI

SEQ ID NO: 2133603 - protein, 24 aa, Cryptosporidium hominis
SQNKSLFLWKIPEAKLIKTIKNSH

SEQ ID NO: 2133604 - protein, 22 aa, Cryptosporidium hominis
SQNLISLRQILGSTKYKLKINH

SEQ ID NO: 2133605 - protein, 25 aa, Cryptosporidium hominis
SQNSSKIFFPPYNNTYISSLLYSSP

SEQ ID NO: 2133606 - protein, 28 aa, Cryptosporidium hominis
SQNTTLLRLYLMHIPSILPSIYTKSLQI

SEQ ID NO: 2133607 - protein, 23 aa, Cryptosporidium hominis
SQQSIAWSFLLIKKPSNILEGVA

SEQ ID NO: 2133608 - protein, 25 aa, Cryptosporidium hominis
SQVGLGLSAFLFPSLFTPTDQQGQP

SEQ ID NO: 2133609 - protein, 22 aa, Cryptosporidium hominis
SQYIFDLHITAIFFPLGIFVCA

SEQ ID NO: 2133610 - protein, 23 aa, Cryptosporidium hominis
SRELQRMCLVLYSPLCGVFSEAM

SEQ ID NO: 2133611 - protein, 31 aa, Cryptosporidium hominis
SREQYNLQFFSLKFQLSLLTALLTMHMVKIK

SEQ ID NO: 2133612 - protein, 26 aa, Cryptosporidium hominis
SRFFIGFFQAFSIVYLPLWVERFSPQ

SEQ ID NO: 2133613 - protein, 22 aa, Cryptosporidium hominis
SRFPTITLGFPGLKVEWEPAQY

SEQ ID NO: 2133614 - protein, 25 aa, Cryptosporidium hominis
SRHLVCDYIYIHEKFPEAALGRRGQ

SEQ ID NO: 2133615 - protein, 48 aa, Cryptosporidium hominis
SRILEYYLLVIVLAKLFFIFSRKILSMILLLNHILIYILDNFEDYTFM

SEQ ID NO: 2133616 - protein, 26 aa, Cryptosporidium hominis
SRISLPEIYFVLTVDGTLWSIGENGK

SEQ ID NO: 2133617 - protein, 23 aa, Cryptosporidium hominis
SRISMPICLNEPLSFIQRLSEDL

SEQ ID NO: 2133618 - protein, 22 aa, Cryptosporidium hominis
SRKQIFFDSILKKLNLSLNLLW

SEQ ID NO: 2133619 - protein, 32 aa, Cryptosporidium hominis
SRKYLSFIFNYYKPILLWIFRIKYNKNKAINP

SEQ ID NO: 2133620 - protein, 23 aa, Cryptosporidium hominis
SRLPNLLRGCRKLFRSTGQKPTT

SEQ ID NO: 2133621 - protein, 24 aa, Cryptosporidium hominis
SRNQFVWCLLWTTTEYTRTFARFR

SEQ ID NO: 2133622 - protein, 19 aa, Cryptosporidium hominis
SRNTPQELFLVVLDNLHSK

SEQ ID NO: 2133623 - protein, 19 aa, Cryptosporidium hominis
SRQYSTIPELLLFSRSSHT

SEQ ID NO: 2133624 - protein, 19 aa, Cryptosporidium hominis
SRSILECLRFSLFGEISIP

SEQ ID NO: 2133625 - protein, 25 aa, Cryptosporidium hominis
SRWQFLYVLLVIIASLIGISLSFMS

SEQ ID NO: 2133626 - protein, 23 aa, Cryptosporidium hominis
SRYKLVPIKWSWSVQEISEIFIL

SEQ ID NO: 2133627 - protein, 27 aa, Cryptosporidium hominis
SSAKFLYERLIQALKLPSPVIPSSIMC

SEQ ID NO: 2133628 - protein, 22 aa, Cryptosporidium hominis
SSDEVELQLLLKSSTDNLLTVD

SEQ ID NO: 2133629 - protein, 21 aa, Cryptosporidium hominis
SSEFGFYNQSFFDLSYDRLSI

SEQ ID NO: 2133630 - protein, 20 aa, Cryptosporidium hominis
SSEFLGQLSEYILPKLSSVH

SEQ ID NO: 2133631 - protein, 29 aa, Cryptosporidium hominis
SSEVMRICIVIIWTIACVVLGFSGAMMII

SEQ ID NO: 2133632 - protein, 19 aa, Cryptosporidium hominis
SSFIVIILSYFNNYFRDKD

SEQ ID NO: 2133633 - protein, 31 aa, Cryptosporidium hominis
SSFVAFFAHTLLLIGLLFNSPCRRLAAARPF

SEQ ID NO: 2133634 - protein, 18 aa, Cryptosporidium hominis
SSFWGYKPSPYKKDLRKS

SEQ ID NO: 2133635 - protein, 26 aa, Cryptosporidium hominis
SSGDIVHLGYFFTDGHLLICIGDTCF

SEQ ID NO: 2133636 - protein, 25 aa, Cryptosporidium hominis
SSGDKQMLIYLFSTYITLSFQHLKN

SEQ ID NO: 2133637 - protein, 23 aa, Cryptosporidium hominis
SSGIFYVTAYRKLPGDDCIGGWL

SEQ ID NO: 2133638 - protein, 28 aa, Cryptosporidium hominis
SSGSYILHMMFILIGSLDYYNLDFWKNQ

SEQ ID NO: 2133639 - protein, 23 aa, Cryptosporidium hominis
SSHSLFDLVFDRIKIFARSNPEH

SEQ ID NO: 2133640 - protein, 24 aa, Cryptosporidium hominis
SSHTIIAWISSDSKFFCWKKVRSK

SEQ ID NO: 2133641 - protein, 36 aa, Cryptosporidium hominis
SSIESYLMIFLLILPPIMVKLGESLLLIILREESIQ

SEQ ID NO: 2133642 - protein, 31 aa, Cryptosporidium hominis
SSIFSLIKISFWYEWIMIKIHLQLGNDHQDE

SEQ ID NO: 2133643 - protein, 19 aa, Cryptosporidium hominis
SSIFYYKMVLFKSKIDTDE

SEQ ID NO: 2133644 - protein, 17 aa, Cryptosporidium hominis
SSIILINSWNKKRKNRI

SEQ ID NO: 2133645 - protein, 35 aa, Cryptosporidium hominis
SSILSLYLSIIKFCFKFGIFYILKSQLNKKQEIIT

SEQ ID NO: 2133646 - protein, 33 aa, Cryptosporidium hominis
SSIRKFPILAQEFLLMLNWYIYNAMGSDPIIRD

SEQ ID NO: 2133647 - protein, 23 aa, Cryptosporidium hominis
SSISGICIFIFATGLILSISIVN

SEQ ID NO: 2133648 - protein, 23 aa, Cryptosporidium hominis
SSISYILCCLYYNFLDLNPEIQN

SEQ ID NO: 2133649 - protein, 22 aa, Cryptosporidium hominis
SSKCMEMFILNLQFQDNKMKEF

SEQ ID NO: 2133650 - protein, 37 aa, Cryptosporidium hominis
SSKPPIFVISEIYLRYLYACRIILYSKNYNLILIDEP

SEQ ID NO: 2133651 - protein, 28 aa, Cryptosporidium hominis
SSKRRARKIMTKKGLSLLIKEFNTSKTK

SEQ ID NO: 2133652 - protein, 26 aa, Cryptosporidium hominis
SSLAKLFYNLFFSISLFFTEKYRCII

SEQ ID NO: 2133653 - protein, 29 aa, Cryptosporidium hominis
SSLFFERPELLLIHKKKVLRDMLNGNNYL

SEQ ID NO: 2133654 - protein, 41 aa, Cryptosporidium hominis
SSLRCPWVILRFLFIDIWIGLLLFQIFLRISSESKYYREIS

SEQ ID NO: 2133655 - protein, 30 aa, Cryptosporidium hominis
SSLSPFEKFPIPSWLYKLFSRLIEVDFTEY

SEQ ID NO: 2133656 - protein, 23 aa, Cryptosporidium hominis
SSMKLFVALLIRPKSVEWFNGLF

SEQ ID NO: 2133657 - protein, 25 aa, Cryptosporidium hominis
SSNLQRFLFWNFREFYRFHESYYFT

SEQ ID NO: 2133658 - protein, 25 aa, Cryptosporidium hominis
SSPCPVDCVLSFWSPWTDCSKFLCE

SEQ ID NO: 2133659 - protein, 25 aa, Cryptosporidium hominis
SSPSPPPPPPPPPPPPSSSSPSPPP

SEQ ID NO: 2133660 - protein, 21 aa, Cryptosporidium hominis
SSQAAFKIIFGEITALKSMTN

SEQ ID NO: 2133661 - protein, 27 aa, Cryptosporidium hominis
SSRNLFFTFFVFFVIIILSFENKFQGN

SEQ ID NO: 2133662 - protein, 29 aa, Cryptosporidium hominis
SSSAVPAQETSWFTGWFGIGAESSPPPPP

SEQ ID NO: 2133663 - protein, 23 aa, Cryptosporidium hominis
SSSVKPFRPILVINQSGYDIQLI

SEQ ID NO: 2133664 - protein, 26 aa, Cryptosporidium hominis
SSSYITLILCRYLLYFSYGALEPSVQ

SEQ ID NO: 2133665 - protein, 31 aa, Cryptosporidium hominis
SSTDGYFWVKLDSLMKLFQGLNSEEFSLYPK

SEQ ID NO: 2133666 - protein, 22 aa, Cryptosporidium hominis
SSVCMFILPWIITYFSHNISVK

SEQ ID NO: 2133667 - protein, 24 aa, Cryptosporidium hominis
SSVPICPITFLPINVFAMYKHLSC

SEQ ID NO: 2133668 - protein, 18 aa, Cryptosporidium hominis
SSWILLCSGLTIGLSNLF

SEQ ID NO: 2133669 - protein, 23 aa, Cryptosporidium hominis
SSYPFDPLIFQNISNMYISLFGH

SEQ ID NO: 2133670 - protein, 26 aa, Cryptosporidium hominis
SSYSHYIWTFIRLAIGGPAVGVVFGF

SEQ ID NO: 2133671 - protein, 25 aa, Cryptosporidium hominis
STAFFASFTIIKMTAGLWGLALVFV

SEQ ID NO: 2133672 - protein, 18 aa, Cryptosporidium hominis
STALLYPELYRHLKAGRV

SEQ ID NO: 2133673 - protein, 28 aa, Cryptosporidium hominis
STCLSLPPFLFARLMAWLPLDCPEYSIN

SEQ ID NO: 2133674 - protein, 26 aa, Cryptosporidium hominis
STEMKKLLKILPMSICFVGLVAFGNI

SEQ ID NO: 2133675 - protein, 22 aa, Cryptosporidium hominis
STFKIMLHIFDIQSDSFNSFVA

SEQ ID NO: 2133676 - protein, 21 aa, Cryptosporidium hominis
STFLSTFLPKSIGAWNIHYII

SEQ ID NO: 2133677 - protein, 33 aa, Cryptosporidium hominis
STGGIKTYLFWALFIYFSISSSLLVYMMLKVIS

SEQ ID NO: 2133678 - protein, 33 aa, Cryptosporidium hominis
STGRQPQNIPWWIYLLIIILGFDEITYVLTSPV

SEQ ID NO: 2133679 - protein, 21 aa, Cryptosporidium hominis
STHYPMLHFPLTNGIKMNDYF

SEQ ID NO: 2133680 - protein, 30 aa, Cryptosporidium hominis
STIQSFQFFVLYIFIQFTSVLYLYSKGTNF

SEQ ID NO: 2133681 - protein, 32 aa, Cryptosporidium hominis
STKSEKRRWIIDFFVYLIGGGLYGAVLAYMSK

SEQ ID NO: 2133682 - protein, 18 aa, Cryptosporidium hominis
STKSLKFLSRNLLSISSV

SEQ ID NO: 2133683 - protein, 18 aa, Cryptosporidium hominis
STLTCFFTYLFEGRVHFD

SEQ ID NO: 2133684 - protein, 24 aa, Cryptosporidium hominis
STLTIIYLEVLIKIINILKSKSKR

SEQ ID NO: 2133685 - protein, 28 aa, Cryptosporidium hominis
STNTVFQIFPLFSLVFALLTGYFVTFDQ

SEQ ID NO: 2133686 - protein, 25 aa, Cryptosporidium hominis
STRRPIFMLQTFPIFVFSFTCHHNF

SEQ ID NO: 2133687 - protein, 30 aa, Cryptosporidium hominis
STRVVNFLRLYLIKVLPKNILGTFKNFKTF

SEQ ID NO: 2133688 - protein, 26 aa, Cryptosporidium hominis
STSDELLITELLFNNVFFQELKIEYI

SEQ ID NO: 2133689 - protein, 23 aa, Cryptosporidium hominis
STSIKIIRYIYNSQIQTKNSSGV

SEQ ID NO: 2133690 - protein, 20 aa, Cryptosporidium hominis
STSILAFRRSLIHALDGGPN

SEQ ID NO: 2133691 - protein, 32 aa, Cryptosporidium hominis
STSRSIISLLVYIIVFFLTLNEIFKYFKGEMI

SEQ ID NO: 2133692 - protein, 23 aa, Cryptosporidium hominis
STSSSWYLARLARESFMNINLDL

SEQ ID NO: 2133693 - protein, 25 aa, Cryptosporidium hominis
STTGDWFVLFYLPNCQQSQMSLAEL

SEQ ID NO: 2133694 - protein, 21 aa, Cryptosporidium hominis
STTIYLFVFCSVCILAKRVNV

SEQ ID NO: 2133695 - protein, 22 aa, Cryptosporidium hominis
STVLATYRIVLPKTQNSPVSVD

SEQ ID NO: 2133696 - protein, 21 aa, Cryptosporidium hominis
STYFFIVFLIGSVNSIFFSKL

SEQ ID NO: 2133697 - protein, 25 aa, Cryptosporidium hominis
STYQSICYIWLWDLFVEYFGGSEQI

SEQ ID NO: 2133698 - protein, 20 aa, Cryptosporidium hominis
SVACLFLLNENLISSYIGSK

SEQ ID NO: 2133699 - protein, 23 aa, Cryptosporidium hominis
SVACSFILEMIAKLKLGNKNLEK

SEQ ID NO: 2133700 - protein, 33 aa, Cryptosporidium hominis
SVAFRVYPIFKYFGFFFKFIQRLKFDSVSKISR

SEQ ID NO: 2133701 - protein, 20 aa, Cryptosporidium hominis
SVALPNFQSGALGCPVSASI

SEQ ID NO: 2133702 - protein, 18 aa, Cryptosporidium hominis
SVAPYMSALFWITAVLST

SEQ ID NO: 2133703 - protein, 25 aa, Cryptosporidium hominis
SVCFIVFVNICYILYKNSSIERYRN

SEQ ID NO: 2133704 - protein, 20 aa, Cryptosporidium hominis
SVDKHCLIPKLRFEIAPNQN

SEQ ID NO: 2133705 - protein, 25 aa, Cryptosporidium hominis
SVEEYLSRLPGIDIQLKLIDYSLDR

SEQ ID NO: 2133706 - protein, 30 aa, Cryptosporidium hominis
SVFIATVVGILWLFFALTLPAYHYARVVFP

SEQ ID NO: 2133707 - protein, 33 aa, Cryptosporidium hominis
SVGVITPQFLFFIPPIFYAFYCVAKKYPPILRQ

SEQ ID NO: 2133708 - protein, 17 aa, Cryptosporidium hominis
SVKVFPAIFIITNGYQY

SEQ ID NO: 2133709 - protein, 29 aa, Cryptosporidium hominis
SVLASFISRIIFAIWITTTLSLNFNSYRK

SEQ ID NO: 2133710 - protein, 26 aa, Cryptosporidium hominis
SVLELYMNRLFVTPLNKMSLTVPIND

SEQ ID NO: 2133711 - protein, 22 aa, Cryptosporidium hominis
SVLLTLICSIGFIPGIPKWVDS

SEQ ID NO: 2133712 - protein, 27 aa, Cryptosporidium hominis
SVLSFAYGIVLLKLKMKYSKKLALINE

SEQ ID NO: 2133713 - protein, 25 aa, Cryptosporidium hominis
SVNKITLLLIFIGVLITVFGGILSQ

SEQ ID NO: 2133714 - protein, 24 aa, Cryptosporidium hominis
SVNKRIVIYSIIQLTLVSIISYFS

SEQ ID NO: 2133715 - protein, 24 aa, Cryptosporidium hominis
SVSFPLIRINLIKDWDWKNKQLTG

SEQ ID NO: 2133716 - protein, 18 aa, Cryptosporidium hominis
SVSFTQLVLWMIRNISET

SEQ ID NO: 2133717 - protein, 19 aa, Cryptosporidium hominis
SVSISRYFSRKRSTITIQN

SEQ ID NO: 2133718 - protein, 23 aa, Cryptosporidium hominis
SVSKLLNIMIFQIIPTTAEFLMV

SEQ ID NO: 2133719 - protein, 27 aa, Cryptosporidium hominis
SVTDWSYYIWWLFSRRPEISKISPKLP

SEQ ID NO: 2133720 - protein, 32 aa, Cryptosporidium hominis
SVTFLLKSSVIGLALILTWIPGVLSTYTESFR

SEQ ID NO: 2133721 - protein, 28 aa, Cryptosporidium hominis
SVVSNYFWYIFLLIPIYIIYKIGKLIIN

SEQ ID NO: 2133722 - protein, 20 aa, Cryptosporidium hominis
SVVWFFHGFVSLISLSTSYF

SEQ ID NO: 2133723 - protein, 21 aa, Cryptosporidium hominis
SVWGFFPVNLLPRFNPYNSGM

SEQ ID NO: 2133724 - protein, 20 aa, Cryptosporidium hominis
SVYELGLIKRVIFSNFTLSD

SEQ ID NO: 2133725 - protein, 34 aa, Cryptosporidium hominis
SVYQKLIEYGYLSSLLHPIAHKMWGCVKYGHYYD

SEQ ID NO: 2133726 - protein, 20 aa, Cryptosporidium hominis
SWLQNILHRTPPGAGIYIVI

SEQ ID NO: 2133727 - protein, 19 aa, Cryptosporidium hominis
SWNQFILNSPFKLVVNHLS

SEQ ID NO: 2133728 - protein, 18 aa, Cryptosporidium hominis
SWVSWIKYISFQRYSYSA

SEQ ID NO: 2133729 - protein, 26 aa, Cryptosporidium hominis
SWVYTLNVFFLGLILPIGGYINKRIG

SEQ ID NO: 2133730 - protein, 18 aa, Cryptosporidium hominis
SYAFVMVYSFYIYYDTQK

SEQ ID NO: 2133731 - protein, 20 aa, Cryptosporidium hominis
SYECILYSINDKRGLRPLFD

SEQ ID NO: 2133732 - protein, 22 aa, Cryptosporidium hominis
SYGYINFLAFSASGASLLLHAT

SEQ ID NO: 2133733 - protein, 28 aa, Cryptosporidium hominis
SYISFFWGMIIILFFLTSTLPMSIIVIM

SEQ ID NO: 2133734 - protein, 27 aa, Cryptosporidium hominis
SYLIRDSTLYFLYNKSPITVYIIECIF

SEQ ID NO: 2133735 - protein, 17 aa, Cryptosporidium hominis
SYLNWTCWYAWMIQSFL

SEQ ID NO: 2133736 - protein, 18 aa, Cryptosporidium hominis
SYNLLWFGMTKYFEVFCG

SEQ ID NO: 2133737 - protein, 29 aa, Cryptosporidium hominis
SYSILSIRILFIIPIIFSLILSLIWILKL

SEQ ID NO: 2133738 - protein, 32 aa, Cryptosporidium hominis
SYSNIYGLLSLYLLYLRFPKHIKKLDLKRILS

SEQ ID NO: 2133739 - protein, 23 aa, Cryptosporidium hominis
SYSSLFREFGITNFNFIQGYEIV

SEQ ID NO: 2133740 - protein, 18 aa, Cryptosporidium hominis
SYWCAFPINMDEPYEWHF

SEQ ID NO: 2133741 - protein, 28 aa, Cryptosporidium hominis
SYYIPEHLLLNYKFQAYYRIKSHIITFS

SEQ ID NO: 2133742 - protein, 28 aa, Cryptosporidium hominis
SYYNTIRGGYLLILQKILFATRSNLHSI

SEQ ID NO: 2133743 - protein, 31 aa, Cryptosporidium hominis
TAAFSMIVAGIWWILALFSRSYHYLIISFPI

SEQ ID NO: 2133744 - protein, 31 aa, Cryptosporidium hominis
TADPELIYCLWAGQISLLWKLQLTLNKEENG

SEQ ID NO: 2133745 - protein, 29 aa, Cryptosporidium hominis
TAEVISILHLFLVWICEFVFDYKSKIPIF

SEQ ID NO: 2133746 - protein, 21 aa, Cryptosporidium hominis
TAFTDFVICCIVFFIGCASVL

SEQ ID NO: 2133747 - protein, 39 aa, Cryptosporidium hominis
TAIFNWRFVFNIPVPCHFPILRLQVWNRGLLVFGDAISE

SEQ ID NO: 2133748 - protein, 22 aa, Cryptosporidium hominis
TAITGFLLDNSLLIISGALIGS

SEQ ID NO: 2133749 - protein, 22 aa, Cryptosporidium hominis
TALRMVFAYVHLFDGVILGIYL

SEQ ID NO: 2133750 - protein, 22 aa, Cryptosporidium hominis
TAMLLHSQTLRNDPDFGRISFQ

SEQ ID NO: 2133751 - protein, 24 aa, Cryptosporidium hominis
TASDWNVFFSDKNTLIIKKLHKET

SEQ ID NO: 2133752 - protein, 23 aa, Cryptosporidium hominis
TAVASMEWRLLPKVRPDILNLFI

SEQ ID NO: 2133753 - protein, 21 aa, Cryptosporidium hominis
TAVFIYIDSWTLTQDPFKKTS

SEQ ID NO: 2133754 - protein, 17 aa, Cryptosporidium hominis
TCFIFFQIMNFLTSQYF

SEQ ID NO: 2133755 - protein, 34 aa, Cryptosporidium hominis
TCLFCLLGIIVVLYYFKEYRFYPRMADYITYKIE

SEQ ID NO: 2133756 - protein, 18 aa, Cryptosporidium hominis
TCLTSCAALFLGTVVDFP

SEQ ID NO: 2133757 - protein, 26 aa, Cryptosporidium hominis
TCREDILELLIPILMDPFSSLECSAI

SEQ ID NO: 2133758 - protein, 26 aa, Cryptosporidium hominis
TCRKPQLPEFLLQRSVINSGANSGMA

SEQ ID NO: 2133759 - protein, 30 aa, Cryptosporidium hominis
TDGNSKLTISPLYLLGMNLKGKNITELSQK

SEQ ID NO: 2133760 - protein, 22 aa, Cryptosporidium hominis
TDGWMLLGMKRYLMRQMAKKLC

SEQ ID NO: 2133761 - protein, 26 aa, Cryptosporidium hominis
TDHIKLLIQLIIFKDIKHYLDSIDHS

SEQ ID NO: 2133762 - protein, 25 aa, Cryptosporidium hominis
TDIWNEWFILIKKWETTKGIILMLK

SEQ ID NO: 2133763 - protein, 19 aa, Cryptosporidium hominis
TDKIIFLKHLNYLKYLSDP

SEQ ID NO: 2133764 - protein, 23 aa, Cryptosporidium hominis
TDLVPILRRYIPYVPGDVEGKRL

SEQ ID NO: 2133765 - protein, 24 aa, Cryptosporidium hominis
TDMIIPIIYRNVKINPLLATSDSM

SEQ ID NO: 2133766 - protein, 29 aa, Cryptosporidium hominis
TDQNGLTILWWACKLHYPKLIFRLLEFYI

SEQ ID NO: 2133767 - protein, 23 aa, Cryptosporidium hominis
TDSIFYIRRISCLPIFWCSHDPW

SEQ ID NO: 2133768 - protein, 27 aa, Cryptosporidium hominis
TDSVTFNLLFLIFTDIFGLVLTRNFFE

SEQ ID NO: 2133769 - protein, 21 aa, Cryptosporidium hominis
TEFFCNFFLITKKKCFIHSTS

SEQ ID NO: 2133770 - protein, 20 aa, Cryptosporidium hominis
TEHFTAIFDILLQDKAPKLS

SEQ ID NO: 2133771 - protein, 23 aa, Cryptosporidium hominis
TEIESIVFVLVHPYGIMGGSSSN

SEQ ID NO: 2133772 - protein, 31 aa, Cryptosporidium hominis
TEKPQFWFGGWTHILAIRDIFDKELLLWKER

SEQ ID NO: 2133773 - protein, 29 aa, Cryptosporidium hominis
TELLLLYSALILNFFFIKKFLDSGERILF

SEQ ID NO: 2133774 - protein, 20 aa, Cryptosporidium hominis
TELRFNKLFTDPFSKITHST

SEQ ID NO: 2133775 - protein, 23 aa, Cryptosporidium hominis
TELSFFIENLLPIALKLNKYCSK

SEQ ID NO: 2133776 - protein, 17 aa, Cryptosporidium hominis
TENLFFRAIEYLDKFTN

SEQ ID NO: 2133777 - protein, 35 aa, Cryptosporidium hominis
TESFRLFGIVVASSIVFIFMMYSRNYQITGKVKDL

SEQ ID NO: 2133778 - protein, 32 aa, Cryptosporidium hominis
TETGKYSLYFLFLAILIFLTTFAQNSFLQISG

SEQ ID NO: 2133779 - protein, 30 aa, Cryptosporidium hominis
TFAKDIGLIIFLGLKYSWNQFILNSPFKLV

SEQ ID NO: 2133780 - protein, 20 aa, Cryptosporidium hominis
TFEMLALRSLGADKYIKLHS

SEQ ID NO: 2133781 - protein, 35 aa, Cryptosporidium hominis
TFFGFEILKVLFPWKWISWLPTISQLLLMDKNKPL

SEQ ID NO: 2133782 - protein, 35 aa, Cryptosporidium hominis
TFILQYLMLSTTFFLRFFTWSFCWSALILYTNLFS

SEQ ID NO: 2133783 - protein, 25 aa, Cryptosporidium hominis
TFITTFVLLILINARIRQYALIWMT

SEQ ID NO: 2133784 - protein, 21 aa, Cryptosporidium hominis
TFLVIFGIFYTITLCSTIQYI

SEQ ID NO: 2133785 - protein, 29 aa, Cryptosporidium hominis
TFSIGIIFRLLYIIVYLAINLLPKFIENG

SEQ ID NO: 2133786 - protein, 21 aa, Cryptosporidium hominis
TFSLHFFWNAYVLLYYCASLE

SEQ ID NO: 2133787 - protein, 25 aa, Cryptosporidium hominis
TFYHPLNDIIFFVYYIIEGKISMER

SEQ ID NO: 2133788 - protein, 23 aa, Cryptosporidium hominis
TGCHTFIILMLLLWSRRSRIRIF

SEQ ID NO: 2133789 - protein, 24 aa, Cryptosporidium hominis
TGDRYICKLFREYLFQQTDSQGRP

SEQ ID NO: 2133790 - protein, 26 aa, Cryptosporidium hominis
TGEPVFNWRLVYPHLVTPISGCLLQI

SEQ ID NO: 2133791 - protein, 21 aa, Cryptosporidium hominis
TGGVPILVGFVSTCLLGSALL

SEQ ID NO: 2133792 - protein, 19 aa, Cryptosporidium hominis
TGIIFLPGTFRVSGIISGN

SEQ ID NO: 2133793 - protein, 32 aa, Cryptosporidium hominis
TGIYTGIFFVPIICIFGIILPSYVYALFCHIY

SEQ ID NO: 2133794 - protein, 27 aa, Cryptosporidium hominis
TGKLNIIFISSIIFTFKLSLKFLSGTM

SEQ ID NO: 2133795 - protein, 38 aa, Cryptosporidium hominis
TGPIWQKIAGIIQILPVLLMLFLAIMGNFMPTLFPEDK

SEQ ID NO: 2133796 - protein, 24 aa, Cryptosporidium hominis
TGRTGVLPIGRPGLAVATIPISNF

SEQ ID NO: 2133797 - protein, 26 aa, Cryptosporidium hominis
TGVLQLLLPFVGWIWAIVWGIAIICR

SEQ ID NO: 2133798 - protein, 34 aa, Cryptosporidium hominis
TGVVYSFRLSILYTAITFLLFILRTTISDSENST

SEQ ID NO: 2133799 - protein, 24 aa, Cryptosporidium hominis
TIAWTTAMIYLIISSTLVPLAGIV

SEQ ID NO: 2133800 - protein, 29 aa, Cryptosporidium hominis
TIDLITLLPIIFFLIQSIHFHITQVSKTN

SEQ ID NO: 2133801 - protein, 28 aa, Cryptosporidium hominis
TIEKLLAFFLLIMAVLILILCLSAIFIG

SEQ ID NO: 2133802 - protein, 17 aa, Cryptosporidium hominis
TIFLIPWISYIIKNIES

SEQ ID NO: 2133803 - protein, 30 aa, Cryptosporidium hominis
TIFLTMGIVMFIFSSYVIRLLYQINRTSVR

SEQ ID NO: 2133804 - protein, 23 aa, Cryptosporidium hominis
TIGLINYLFPIYSISRTNTVDKI

SEQ ID NO: 2133805 - protein, 26 aa, Cryptosporidium hominis
TIHYLTLIHFLNLLLFFGISNNLHYT

SEQ ID NO: 2133806 - protein, 23 aa, Cryptosporidium hominis
TIIGKCNYVFSMPLQSSELFSGN

SEQ ID NO: 2133807 - protein, 22 aa, Cryptosporidium hominis
TIIIDYPTISELCKYIEMVIGN

SEQ ID NO: 2133808 - protein, 19 aa, Cryptosporidium hominis
TILDYGIKPWFLFSVSSVN

SEQ ID NO: 2133809 - protein, 24 aa, Cryptosporidium hominis
TILIIMMLLLIFMQVLRSEFSRYF

SEQ ID NO: 2133810 - protein, 20 aa, Cryptosporidium hominis
TILIWYNLYIGFLSFEFLAL

SEQ ID NO: 2133811 - protein, 18 aa, Cryptosporidium hominis
TILSIDLTTLLYFINNQP

SEQ ID NO: 2133812 - protein, 26 aa, Cryptosporidium hominis
TILSIIAMIILFYSELKYYLNITRKD

SEQ ID NO: 2133813 - protein, 25 aa, Cryptosporidium hominis
TIMLEKNLFIKLISKKKAIIPLTCL

SEQ ID NO: 2133814 - protein, 17 aa, Cryptosporidium hominis
TIPKYRGCYVKGILQPS

SEQ ID NO: 2133815 - protein, 25 aa, Cryptosporidium hominis
TIPNHCSILILSYLIISNSLERDSE

SEQ ID NO: 2133816 - protein, 21 aa, Cryptosporidium hominis
TISFLSFILGFSFKFFSRIPR

SEQ ID NO: 2133817 - protein, 20 aa, Cryptosporidium hominis
TISIIILDLTWPIVSEYRLL

SEQ ID NO: 2133818 - protein, 22 aa, Cryptosporidium hominis
TISISFYSLFLFAFGSPFSETE

SEQ ID NO: 2133819 - protein, 23 aa, Cryptosporidium hominis
TISLILFIFFCGISIILGTVPSF

SEQ ID NO: 2133820 - protein, 25 aa, Cryptosporidium hominis
TISSFLFIWVLYCFSIIKYLKGDQH

SEQ ID NO: 2133821 - protein, 33 aa, Cryptosporidium hominis
TITAFYINFLFIWSCVYISLVLLFFTISTINTF

SEQ ID NO: 2133822 - protein, 22 aa, Cryptosporidium hominis
TITCPNLENIFLPLSEYYVISS

SEQ ID NO: 2133823 - protein, 26 aa, Cryptosporidium hominis
TITMTSIMLYFFSLSSMRNFNGQPKD

SEQ ID NO: 2133824 - protein, 23 aa, Cryptosporidium hominis
TIVWIIIFTLFITDYRLGISLFS

SEQ ID NO: 2133825 - protein, 22 aa, Cryptosporidium hominis
TIYILIGLLMKIEISYSKFEFL

SEQ ID NO: 2133826 - protein, 31 aa, Cryptosporidium hominis
TIYVIYSLFAWLVYILMAIKRYLSTKVSEEE

SEQ ID NO: 2133827 - protein, 26 aa, Cryptosporidium hominis
TKAFSTQVLVLSLIAAWFAQNRDSVI

SEQ ID NO: 2133828 - protein, 39 aa, Cryptosporidium hominis
TKESFWSFKLPLIIKNIIFFIYWKIIKQISIYFSTHSID

SEQ ID NO: 2133829 - protein, 17 aa, Cryptosporidium hominis
TKIQPIVFCLFSDLKNQ

SEQ ID NO: 2133830 - protein, 24 aa, Cryptosporidium hominis
TKKLKYALAFILVLQLIVLLMRVV

SEQ ID NO: 2133831 - protein, 27 aa, Cryptosporidium hominis
TKLFWILIPIIICIISLSINIFDINSI

SEQ ID NO: 2133832 - protein, 26 aa, Cryptosporidium hominis
TKLHAIAVLLLFIRLLEISLFSSNTS

SEQ ID NO: 2133833 - protein, 20 aa, Cryptosporidium hominis
TKMFHYYVKLIPTQYFSGNG

SEQ ID NO: 2133834 - protein, 22 aa, Cryptosporidium hominis
TKWTNMLKYWPSRFSKQLYHDN

SEQ ID NO: 2133835 - protein, 17 aa, Cryptosporidium hominis
TKYLTVSDPFKIFIWLC

SEQ ID NO: 2133836 - protein, 26 aa, Cryptosporidium hominis
TLAIFPLFRLVLMGIFVLWGSGISIC

SEQ ID NO: 2133837 - protein, 24 aa, Cryptosporidium hominis
TLAPILLKYLNLSTAFFASFTIIK

SEQ ID NO: 2133838 - protein, 27 aa, Cryptosporidium hominis
TLEFSNWLLTNWVFRTISNLPILFSDY

SEQ ID NO: 2133839 - protein, 24 aa, Cryptosporidium hominis
TLEPITWTFFKDHKLAISITGADT

SEQ ID NO: 2133840 - protein, 33 aa, Cryptosporidium hominis
TLEQKVLIRFHLFIVLSIWNLYLKELQGKLINT

SEQ ID NO: 2133841 - protein, 20 aa, Cryptosporidium hominis
TLFIFVLKFVAIAANQDKNL

SEQ ID NO: 2133842 - protein, 26 aa, Cryptosporidium hominis
TLFSDLYIPLMGFITYILADGVINGV

SEQ ID NO: 2133843 - protein, 28 aa, Cryptosporidium hominis
TLGIISIICHWFPNFYRWMNFKASTISE

SEQ ID NO: 2133844 - protein, 29 aa, Cryptosporidium hominis
TLIKDIYSCRIWILILLAVFESTGEYGIY

SEQ ID NO: 2133845 - protein, 21 aa, Cryptosporidium hominis
TLIRRFSLKFPQPYLSLIENI

SEQ ID NO: 2133846 - protein, 18 aa, Cryptosporidium hominis
TLISLPILQGAKPLKRLS

SEQ ID NO: 2133847 - protein, 19 aa, Cryptosporidium hominis
TLLAQIIPAFFFTTIFQRG

SEQ ID NO: 2133848 - protein, 23 aa, Cryptosporidium hominis
TLLESVFILSNQIYLAKSFCQMA

SEQ ID NO: 2133849 - protein, 25 aa, Cryptosporidium hominis
TLLHTTQLILIFDVTFEQIPLNTEC

SEQ ID NO: 2133850 - protein, 20 aa, Cryptosporidium hominis
TLLNLYLSCLLGAIKTSCGL

SEQ ID NO: 2133851 - protein, 24 aa, Cryptosporidium hominis
TLLRAAEYLALIHGFSRIVVISGV

SEQ ID NO: 2133852 - protein, 28 aa, Cryptosporidium hominis
TLMWSLCLQFLILGIKVKLTSLISCAII

SEQ ID NO: 2133853 - protein, 22 aa, Cryptosporidium hominis
TLNFIQQYRFPFLNAPSRMEFI

SEQ ID NO: 2133854 - protein, 35 aa, Cryptosporidium hominis
TLNTVIWGFLTFTVIFSFLVFALFAFEIIEYLRFK

SEQ ID NO: 2133855 - protein, 26 aa, Cryptosporidium hominis
TLNYFERFFMVYSRFVFRHSIAVIIA

SEQ ID NO: 2133856 - protein, 25 aa, Cryptosporidium hominis
TLPTMGYFYYSIFVNFPSVWGIKRS

SEQ ID NO: 2133857 - protein, 34 aa, Cryptosporidium hominis
TLQKLNVRPILFLWIFFLISMVYTFSIFLDEYIV

SEQ ID NO: 2133858 - protein, 18 aa, Cryptosporidium hominis
TLSAWIQQIFFLSTFWQS

SEQ ID NO: 2133859 - protein, 25 aa, Cryptosporidium hominis
TLTAFSLLAALAYGATLLVRSAGAL

SEQ ID NO: 2133860 - protein, 25 aa, Cryptosporidium hominis
TLVPTIWCYVSASPLIPQLCDPVPT

SEQ ID NO: 2133861 - protein, 35 aa, Cryptosporidium hominis
TMDLNFMQTVWWVFKQLFDQNLVYRAYRVMPYSTA

SEQ ID NO: 2133862 - protein, 19 aa, Cryptosporidium hominis
TMMNFFRRTAQMNNWTIFI

SEQ ID NO: 2133863 - protein, 21 aa, Cryptosporidium hominis
TMTLTIIAFLLFILLILQWVL

SEQ ID NO: 2133864 - protein, 24 aa, Cryptosporidium hominis
TNFQDFLINIFPIKLEFSTMNTLS

SEQ ID NO: 2133865 - protein, 26 aa, Cryptosporidium hominis
TNIIIIFNLYFLLYFSSSQEIASKQD

SEQ ID NO: 2133866 - protein, 20 aa, Cryptosporidium hominis
TNKEYWLVRNSWGEAWGEKG

SEQ ID NO: 2133867 - protein, 26 aa, Cryptosporidium hominis
TNKYYLIFSLAFFILHSSFQMLAFKN

SEQ ID NO: 2133868 - protein, 23 aa, Cryptosporidium hominis
TNLFAMILCGILSLFLEGKEPYL

SEQ ID NO: 2133869 - protein, 17 aa, Cryptosporidium hominis
TNLLVYTIAFCTGKKLT

SEQ ID NO: 2133870 - protein, 25 aa, Cryptosporidium hominis
TNPMGIDCFCYNDQSIYNHIQNNQY

SEQ ID NO: 2133871 - protein, 24 aa, Cryptosporidium hominis
TNRTRLPRVFYSKSQVLAPFSKEH

SEQ ID NO: 2133872 - protein, 22 aa, Cryptosporidium hominis
TNSIIRHPFVDQFTWIKPNCEN

SEQ ID NO: 2133873 - protein, 23 aa, Cryptosporidium hominis
TNSTLNVYFLVSALSVHAIFEGM

SEQ ID NO: 2133874 - protein, 28 aa, Cryptosporidium hominis
TNSYFDSNFWLFLKRVCTRILECLSIQN

SEQ ID NO: 2133875 - protein, 31 aa, Cryptosporidium hominis
TNSYQQFLNCIIPFIIYSEILRDGSLKLKPE

SEQ ID NO: 2133876 - protein, 24 aa, Cryptosporidium hominis
TNTLLFPTIIWINVIRSFILPKDY

SEQ ID NO: 2133877 - protein, 23 aa, Cryptosporidium hominis
TNYLNIIYFVLLASASVSIFGVA

SEQ ID NO: 2133878 - protein, 31 aa, Cryptosporidium hominis
TNYSATLKPIPLIVILFSCLKYLIVNCNSLP

SEQ ID NO: 2133879 - protein, 22 aa, Cryptosporidium hominis
TPALYILCFDWQKYPINTNNSN

SEQ ID NO: 2133880 - protein, 23 aa, Cryptosporidium hominis
TPDCRYYSYGAFLKGPGSIIGTC

SEQ ID NO: 2133881 - protein, 30 aa, Cryptosporidium hominis
TPENQTSVWLFLTASLLTSLLLYRNVQKEQ

SEQ ID NO: 2133882 - protein, 24 aa, Cryptosporidium hominis
TPGIIFQPLRYLFISAMNYGRRVV

SEQ ID NO: 2133883 - protein, 23 aa, Cryptosporidium hominis
TPICNYALVFSYFITKVLEKPQN

SEQ ID NO: 2133884 - protein, 29 aa, Cryptosporidium hominis
TPIVKIIVIIIWLGFLGVSIYGFTKMESG

SEQ ID NO: 2133885 - protein, 21 aa, Cryptosporidium hominis
TPLLLATFALMIIFMAVCISG

SEQ ID NO: 2133886 - protein, 18 aa, Cryptosporidium hominis
TPLLPLLSFSRPLLLVPF

SEQ ID NO: 2133887 - protein, 23 aa, Cryptosporidium hominis
TPYEYFNVVIICKILSCIVAMSS

SEQ ID NO: 2133888 - protein, 30 aa, Cryptosporidium hominis
TQESLVLHKYEVPLIFACETKKLICHNTST

SEQ ID NO: 2133889 - protein, 31 aa, Cryptosporidium hominis
TQLTSALYIPLFGLVLLIFYFRGELSRDNLE

SEQ ID NO: 2133890 - protein, 23 aa, Cryptosporidium hominis
TQSIRRLIFDSFTSIWFHNSSKV

SEQ ID NO: 2133891 - protein, 31 aa, Cryptosporidium hominis
TQSSDFCRIWLLTALVRLIHIPSGGLAIGVS

SEQ ID NO: 2133892 - protein, 17 aa, Cryptosporidium hominis
TQSTYFSLMSLFVGLTG

SEQ ID NO: 2133893 - protein, 20 aa, Cryptosporidium hominis
TRALFRGFPAVVFGNVPAHA

SEQ ID NO: 2133894 - protein, 23 aa, Cryptosporidium hominis
TREYFESIIYLFKCSNYKDYFQK

SEQ ID NO: 2133895 - protein, 26 aa, Cryptosporidium hominis
TRISTIEYLLIQILKFNNNKSDYNSV

SEQ ID NO: 2133896 - protein, 25 aa, Cryptosporidium hominis
TRKFMDSIIKDVYIKWIWNDSDSAN

SEQ ID NO: 2133897 - protein, 22 aa, Cryptosporidium hominis
TRMEKFYMIPEFPKPSFLDSII

SEQ ID NO: 2133898 - protein, 30 aa, Cryptosporidium hominis
TRSNACMFEFIIPLVLEPIMIRLITVLASN

SEQ ID NO: 2133899 - protein, 23 aa, Cryptosporidium hominis
TSAALWKAYFYRPEEMDDFTTYS

SEQ ID NO: 2133900 - protein, 24 aa, Cryptosporidium hominis
TSAKFSLLSMMRQVFGKDLSRISM

SEQ ID NO: 2133901 - protein, 24 aa, Cryptosporidium hominis
TSCFLIFTIILYRNISFTFKKQEY

SEQ ID NO: 2133902 - protein, 22 aa, Cryptosporidium hominis
TSESFKVFLWITTIVLCVSATA

SEQ ID NO: 2133903 - protein, 35 aa, Cryptosporidium hominis
TSEVVIGLFFLSQLNPLCLLLFALEITKLSGSRDI

SEQ ID NO: 2133904 - protein, 22 aa, Cryptosporidium hominis
TSFIILFYIIITWYFRGIQKHS

SEQ ID NO: 2133905 - protein, 18 aa, Cryptosporidium hominis
TSFLAYLPLYLSSAYIGL

SEQ ID NO: 2133906 - protein, 26 aa, Cryptosporidium hominis
TSFVIIRWFMLISRMVMQLWSFNTFF

SEQ ID NO: 2133907 - protein, 18 aa, Cryptosporidium hominis
TSGIISLALFLVFKLILN

SEQ ID NO: 2133908 - protein, 30 aa, Cryptosporidium hominis
TSGSASLIFTLWEFFWFLSVKISRKHATSI

SEQ ID NO: 2133909 - protein, 17 aa, Cryptosporidium hominis
TSIFIPAGLLIIVSISL

SEQ ID NO: 2133910 - protein, 20 aa, Cryptosporidium hominis
TSILPKDYTRRIPLEGLEMY

SEQ ID NO: 2133911 - protein, 37 aa, Cryptosporidium hominis
TSISRLLSHGFFLPLVFLLFSILSRIFSVIINIKVTI

SEQ ID NO: 2133912 - protein, 17 aa, Cryptosporidium hominis
TSIWRDRNSFQGKMIFL

SEQ ID NO: 2133913 - protein, 19 aa, Cryptosporidium hominis
TSKARNIILPLKFDTKTIE

SEQ ID NO: 2133914 - protein, 26 aa, Cryptosporidium hominis
TSKTKKKTTFLKKLFSRISNDDVNLI

SEQ ID NO: 2133915 - protein, 25 aa, Cryptosporidium hominis
TSLLAHIILYWTGLSVDFFGFITAL

SEQ ID NO: 2133916 - protein, 21 aa, Cryptosporidium hominis
TSMFIPFDLITNLNVNKLFLT

SEQ ID NO: 2133917 - protein, 33 aa, Cryptosporidium hominis
TSNIILRNGFHTNILRLYIPFETYDLESLASNG

SEQ ID NO: 2133918 - protein, 24 aa, Cryptosporidium hominis
TSNSILRWFPLSFILNRLTNDQLH

SEQ ID NO: 2133919 - protein, 21 aa, Cryptosporidium hominis
TSPILLVMKYSIGSGSVTTLF

SEQ ID NO: 2133920 - protein, 22 aa, Cryptosporidium hominis
TSPYSIGCPCNLNPYSKLCGCY

SEQ ID NO: 2133921 - protein, 25 aa, Cryptosporidium hominis
TSQKIFWLTIYILNFFLGSIIFFLR

SEQ ID NO: 2133922 - protein, 25 aa, Cryptosporidium hominis
TSSFDQLAILYSAPKKLPSRNFLEQ

SEQ ID NO: 2133923 - protein, 36 aa, Cryptosporidium hominis
TSSHARIVLVIALFIIIFMLKQGMFGDWTRFGELGY

SEQ ID NO: 2133924 - protein, 27 aa, Cryptosporidium hominis
TSVNHQLSLLRLLSLIISSYAISGDAV

SEQ ID NO: 2133925 - protein, 17 aa, Cryptosporidium hominis
TSWILLIEIFIGIAISA

SEQ ID NO: 2133926 - protein, 30 aa, Cryptosporidium hominis
TSYFLSCRILPYLWSFYESYPTYKDIYTRL

SEQ ID NO: 2133927 - protein, 23 aa, Cryptosporidium hominis
TSYFNQIILLLKKTTRQIMIQYT

SEQ ID NO: 2133928 - protein, 20 aa, Cryptosporidium hominis
TTAPIAPAIPALAAYPIIQN

SEQ ID NO: 2133929 - protein, 24 aa, Cryptosporidium hominis
TTFERLFDIFFSRKKYLTLKQKKE

SEQ ID NO: 2133930 - protein, 24 aa, Cryptosporidium hominis
TTIIFNLILSYKILKQKSSIFTVI

SEQ ID NO: 2133931 - protein, 24 aa, Cryptosporidium hominis
TTIPVRWYNFYGNSALNIELGNKY

SEQ ID NO: 2133932 - protein, 20 aa, Cryptosporidium hominis
TTISFFLCGLIPTLILPCLH

SEQ ID NO: 2133933 - protein, 26 aa, Cryptosporidium hominis
TTLAKLIYRIFEPNSGKIRIFGKEIE

SEQ ID NO: 2133934 - protein, 22 aa, Cryptosporidium hominis
TTLCIVSWMPLMLENCSPALSD

SEQ ID NO: 2133935 - protein, 32 aa, Cryptosporidium hominis
TTLFSYIRIIYTSLIMFFFVIMTSFSLEKTSR

SEQ ID NO: 2133936 - protein, 33 aa, Cryptosporidium hominis
TTLNTYILNNRLFSLWLFVQKRLTTIQIAIKIM

SEQ ID NO: 2133937 - protein, 26 aa, Cryptosporidium hominis
TTLSYFPEHIFIQILNVINQRIAETE

SEQ ID NO: 2133938 - protein, 26 aa, Cryptosporidium hominis
TTRAKTYIIFYMSGLSMCLILYFLEP

SEQ ID NO: 2133939 - protein, 20 aa, Cryptosporidium hominis
TTRFLILVLVILSNIGELLS

SEQ ID NO: 2133940 - protein, 23 aa, Cryptosporidium hominis
TTRHISWLSLIAGFLFAITVIQY

SEQ ID NO: 2133941 - protein, 23 aa, Cryptosporidium hominis
TTSFGFLCIFSLIQFTQDLFQEK

SEQ ID NO: 2133942 - protein, 24 aa, Cryptosporidium hominis
TTSFWLLMTQFQTGVVYSFRLSIL

SEQ ID NO: 2133943 - protein, 26 aa, Cryptosporidium hominis
TTSGYLIFRISVIVGLLIVAIILYIY

SEQ ID NO: 2133944 - protein, 38 aa, Cryptosporidium hominis
TTTNNPESLLLLSRLTTKAPPKFLISSIKASSNSTLEI

SEQ ID NO: 2133945 - protein, 24 aa, Cryptosporidium hominis
TTTTEAPSLKINSLRRLRGLSEDN

SEQ ID NO: 2133946 - protein, 27 aa, Cryptosporidium hominis
TTVNQLLISFILMSPLGIIIGQLFSYI

SEQ ID NO: 2133947 - protein, 42 aa, Cryptosporidium hominis
TTVTSMSPFIARLLWFVCYITGTIYMFIWDIYMDWGLMKERS

SEQ ID NO: 2133948 - protein, 22 aa, Cryptosporidium hominis
TVENMLIWNFLTNLIYQNTRGV

SEQ ID NO: 2133949 - protein, 22 aa, Cryptosporidium hominis
TVGFVLISIYLNAFNGAIRNEK

SEQ ID NO: 2133950 - protein, 24 aa, Cryptosporidium hominis
TVLLFHLMLAIFYQIRTKHVNKGK

SEQ ID NO: 2133951 - protein, 33 aa, Cryptosporidium hominis
TVQERIPTNLFIISFLALITGAFFLQYISSEVI

SEQ ID NO: 2133952 - protein, 34 aa, Cryptosporidium hominis
TVRMKSNLILVSILTFLIFFNFVNSSSIDHAQVK

SEQ ID NO: 2133953 - protein, 24 aa, Cryptosporidium hominis
TVTISLDWILKIYKRSLYPEISHL

SEQ ID NO: 2133954 - protein, 27 aa, Cryptosporidium hominis
TWDTSEDIILVYFVSQYSSTPSCGVLS

SEQ ID NO: 2133955 - protein, 17 aa, Cryptosporidium hominis
TWHRLTGSHYWEIKIKD

SEQ ID NO: 2133956 - protein, 20 aa, Cryptosporidium hominis
TWIVPFLMDHLIHYSILVKN

SEQ ID NO: 2133957 - protein, 21 aa, Cryptosporidium hominis
TYIHTPKDFAIIGSLVVILLI

SEQ ID NO: 2133958 - protein, 39 aa, Cryptosporidium hominis
TYITSVALFLIIGWISCPILPLIWTLIQDSVHTCPRCLN

SEQ ID NO: 2133959 - protein, 21 aa, Cryptosporidium hominis
TYIYWNSRLYFWSPITFYTIG

SEQ ID NO: 2133960 - protein, 31 aa, Cryptosporidium hominis
TYLARNMYFLIVYLVFPILRRHFYATEIEGS

SEQ ID NO: 2133961 - protein, 21 aa, Cryptosporidium hominis
TYLTVLLLGTVLFFFGFNGEK

SEQ ID NO: 2133962 - protein, 26 aa, Cryptosporidium hominis
TYMVIPGIIYFFLSILLNFIGIPKHV

SEQ ID NO: 2133963 - protein, 18 aa, Cryptosporidium hominis
TYNIFFHLVMMEMIECIL

SEQ ID NO: 2133964 - protein, 36 aa, Cryptosporidium hominis
TYSEIKHIFYFLSFFFFVLSIFLFERSWNGVTKVKV

SEQ ID NO: 2133965 - protein, 30 aa, Cryptosporidium hominis
TYSKTMLESLYWFFNFYSFTETYQQYEIVQ

SEQ ID NO: 2133966 - protein, 22 aa, Cryptosporidium hominis
TYTGLILSVFIPGERFSKVTTD

SEQ ID NO: 2133967 - protein, 34 aa, Cryptosporidium hominis
TYTSFFDKLALDTLFFIFYFQQGTFQQFLSIQEL

SEQ ID NO: 2133968 - protein, 20 aa, Cryptosporidium hominis
TYYQHLVLYSIIRNTVSTFS

SEQ ID NO: 2133969 - protein, 17 aa, Cryptosporidium hominis
VAFLMLYSRSFKVEDNK

SEQ ID NO: 2133970 - protein, 19 aa, Cryptosporidium hominis
VALNAIFALGLISAGTNNS

SEQ ID NO: 2133971 - protein, 23 aa, Cryptosporidium hominis
VALNFLCFILVFYTSYQPDISKI

SEQ ID NO: 2133972 - protein, 19 aa, Cryptosporidium hominis
VARISKHLSFLLRKEPRLV

SEQ ID NO: 2133973 - protein, 30 aa, Cryptosporidium hominis
VASGVSWFIFRYFFDFIRYFIEENKCFVFS

SEQ ID NO: 2133974 - protein, 17 aa, Cryptosporidium hominis
VASIFLTAALGIPEGLA

SEQ ID NO: 2133975 - protein, 33 aa, Cryptosporidium hominis
VASSPIVHWIIIFLCILHMAIFLAIFMNKTQNS

SEQ ID NO: 2133976 - protein, 28 aa, Cryptosporidium hominis
VASYTFQGYVLFAVKWVPMMIISIIANI

SEQ ID NO: 2133977 - protein, 24 aa, Cryptosporidium hominis
VATIPISNFSIPITIRATSSTGIP

SEQ ID NO: 2133978 - protein, 26 aa, Cryptosporidium hominis
VAVEAFFLLICIMALIVCYIVSRVDI

SEQ ID NO: 2133979 - protein, 20 aa, Cryptosporidium hominis
VAYCRLKITDIPHYIENKPL

SEQ ID NO: 2133980 - protein, 27 aa, Cryptosporidium hominis
VCDIMLKFSPLLKKINMLEKVLFHIYT

SEQ ID NO: 2133981 - protein, 31 aa, Cryptosporidium hominis
VCICNYVPNIFLPLSVMMLRVPYFTLKGKQK

SEQ ID NO: 2133982 - protein, 27 aa, Cryptosporidium hominis
VCIFKKKWLVAFLAFIAGLISSIFHAA

SEQ ID NO: 2133983 - protein, 17 aa, Cryptosporidium hominis
VCKCLAAILLSTSSSLL

SEQ ID NO: 2133984 - protein, 24 aa, Cryptosporidium hominis
VCKNTFLVFLVVYINYFSGSELEL

SEQ ID NO: 2133985 - protein, 18 aa, Cryptosporidium hominis
VCLLIMTSIILDSGQDFL

SEQ ID NO: 2133986 - protein, 17 aa, Cryptosporidium hominis
VCTNYYVILLNIIKNTN

SEQ ID NO: 2133987 - protein, 18 aa, Cryptosporidium hominis
VCTTIAIAIISEICMPYT

SEQ ID NO: 2133988 - protein, 24 aa, Cryptosporidium hominis
VCVYIVLSLELVGKLYLISAGNIL

SEQ ID NO: 2133989 - protein, 27 aa, Cryptosporidium hominis
VDEILHYQLLILTNNYYYLIKLESYSH

SEQ ID NO: 2133990 - protein, 32 aa, Cryptosporidium hominis
VDEYFEVFKKFISYILLFLNASRTASNIVFVI

SEQ ID NO: 2133991 - protein, 24 aa, Cryptosporidium hominis
VDHLPWRFLVYKALNTFIDDIFSF

SEQ ID NO: 2133992 - protein, 20 aa, Cryptosporidium hominis
VDSLLSYAFVMVYSFYIYYD

SEQ ID NO: 2133993 - protein, 26 aa, Cryptosporidium hominis
VDSRNLIILYVCKFFPLTRCGEFAEY

SEQ ID NO: 2133994 - protein, 26 aa, Cryptosporidium hominis
VEADGIIRVYLFLSNLIDIFFKDIKE

SEQ ID NO: 2133995 - protein, 41 aa, Cryptosporidium hominis
VEAENITLVLFLDAFLHNIYYFSYLIDNIQSFVYYLEEDNV

SEQ ID NO: 2133996 - protein, 19 aa, Cryptosporidium hominis
VEAETIKKLGFVGGKIKMI

SEQ ID NO: 2133997 - protein, 28 aa, Cryptosporidium hominis
VEGMSHIAMILLLFNINLMEAFKTFTNL

SEQ ID NO: 2133998 - protein, 25 aa, Cryptosporidium hominis
VEKEISFFPTYKYIRGEYIYDLTRT

SEQ ID NO: 2133999 - protein, 25 aa, Cryptosporidium hominis
VEKFHNFYVILPKKIAEMIFEFHYL

SEQ ID NO: 2134000 - protein, 24 aa, Cryptosporidium hominis
VEKSALLCKLPYNQHFNAAKTFGQ

SEQ ID NO: 2134001 - protein, 20 aa, Cryptosporidium hominis
VELVILLGTTLILDYNRKLG

SEQ ID NO: 2134002 - protein, 29 aa, Cryptosporidium hominis
VESNSTWMYTITGVAVIVVIIGVSIALYF

SEQ ID NO: 2134003 - protein, 23 aa, Cryptosporidium hominis
VESRWMRILFILEAAMSILTHAE

SEQ ID NO: 2134004 - protein, 31 aa, Cryptosporidium hominis
VESSIRFPTIRSFFSWFGSFNSLYVKYQHTF

SEQ ID NO: 2134005 - protein, 19 aa, Cryptosporidium hominis
VFELAYLPLMMRVDECLGQ

SEQ ID NO: 2134006 - protein, 24 aa, Cryptosporidium hominis
VFELFKAIINFPNSGFVLIVASNT

SEQ ID NO: 2134007 - protein, 19 aa, Cryptosporidium hominis
VFENVSFVQFFKKKKSNST

SEQ ID NO: 2134008 - protein, 18 aa, Cryptosporidium hominis
VFETKFLLSKISILNLVG

SEQ ID NO: 2134009 - protein, 24 aa, Cryptosporidium hominis
VFGNLSKFSIFLKGINLLKTPEMK

SEQ ID NO: 2134010 - protein, 24 aa, Cryptosporidium hominis
VFITYFLVIYTVSATELDSTKTVV

SEQ ID NO: 2134011 - protein, 18 aa, Cryptosporidium hominis
VFLITSIFGPMNPYISAP

SEQ ID NO: 2134012 - protein, 29 aa, Cryptosporidium hominis
VFMAGIIFPFIFYYLEFIESFNLPHIMNG

SEQ ID NO: 2134013 - protein, 27 aa, Cryptosporidium hominis
VGAIVLIGLIIFFITKSRSNNSQGQDP

SEQ ID NO: 2134014 - protein, 28 aa, Cryptosporidium hominis
VGEKNFMCTLWLVILRTTQVRYPALEVI

SEQ ID NO: 2134015 - protein, 31 aa, Cryptosporidium hominis
VGESIWFTVLLCFILILLITSSIFEFRKQIY

SEQ ID NO: 2134016 - protein, 23 aa, Cryptosporidium hominis
VGIKKDPIHTLLFDRLSNTNSNA

SEQ ID NO: 2134017 - protein, 25 aa, Cryptosporidium hominis
VGILALICLLYFSLAHPFESKLIHR

SEQ ID NO: 2134018 - protein, 19 aa, Cryptosporidium hominis
VGILIILISASLIYMNLRL

SEQ ID NO: 2134019 - protein, 35 aa, Cryptosporidium hominis
VGKTGFLNFEQFAKFFWHLLNSIREKYYPEKSILV

SEQ ID NO: 2134020 - protein, 24 aa, Cryptosporidium hominis
VGLAIFQILKIYKNHLRFGLTEFT

SEQ ID NO: 2134021 - protein, 19 aa, Cryptosporidium hominis
VGLFMIYDIKRDMREAPKV

SEQ ID NO: 2134022 - protein, 17 aa, Cryptosporidium hominis
VGLLIVAIILYIYKDKI

SEQ ID NO: 2134023 - protein, 17 aa, Cryptosporidium hominis
VGLTGILNIIFGILAAS

SEQ ID NO: 2134024 - protein, 26 aa, Cryptosporidium hominis
VGLWNGLLLVLFYIVHVYISTQFNFW

SEQ ID NO: 2134025 - protein, 35 aa, Cryptosporidium hominis
VGSVFDIFPVLYPILTFFIFSLTVFYLVETGPFLQ

SEQ ID NO: 2134026 - protein, 27 aa, Cryptosporidium hominis
VGVKIMLYISLPTFFFYSLATFCSYFN

SEQ ID NO: 2134027 - protein, 20 aa, Cryptosporidium hominis
VGVVWLFVFGKSRNFLLFAW

SEQ ID NO: 2134028 - protein, 20 aa, Cryptosporidium hominis
VGYWVIIMQIVQLALMGDFV

SEQ ID NO: 2134029 - protein, 17 aa, Cryptosporidium hominis
VHFDLAILLLVISVICT

SEQ ID NO: 2134030 - protein, 18 aa, Cryptosporidium hominis
VHISEYLLDLIRSDAANK

SEQ ID NO: 2134031 - protein, 21 aa, Cryptosporidium hominis
VHKGAFIYELGDFGGLIVMAN

SEQ ID NO: 2134032 - protein, 23 aa, Cryptosporidium hominis
VHKYGYYFIKVNVGFPISQQQTL

SEQ ID NO: 2134033 - protein, 18 aa, Cryptosporidium hominis
VHRIWGLAFILYFIVCMS

SEQ ID NO: 2134034 - protein, 18 aa, Cryptosporidium hominis
VIATFLLMSKIRSLPDID

SEQ ID NO: 2134035 - protein, 18 aa, Cryptosporidium hominis
VIAYLKFLWTIDSKETFP

SEQ ID NO: 2134036 - protein, 18 aa, Cryptosporidium hominis
VIDLRRRPIKELPDRSME

SEQ ID NO: 2134037 - protein, 20 aa, Cryptosporidium hominis
VIFFCVVAVSLFGVSNSQPI

SEQ ID NO: 2134038 - protein, 24 aa, Cryptosporidium hominis
VIFLSYYLIVNLKVNAFLRNDLAD

SEQ ID NO: 2134039 - protein, 22 aa, Cryptosporidium hominis
VIFSCFLLVIFLANISQILAED

SEQ ID NO: 2134040 - protein, 30 aa, Cryptosporidium hominis
VIGTQFAFLIFYTIFYIISPKYSHRFVGYL

SEQ ID NO: 2134041 - protein, 18 aa, Cryptosporidium hominis
VIIHDWISFIRFLKIEFE

SEQ ID NO: 2134042 - protein, 17 aa, Cryptosporidium hominis
VIISTKILHYISGAIHS

SEQ ID NO: 2134043 - protein, 38 aa, Cryptosporidium hominis
VIKTSIITFFTWIIVLANLIPIGMFFYLVISKVSQAII

SEQ ID NO: 2134044 - protein, 17 aa, Cryptosporidium hominis
VILYERQLQYLLGNVER

SEQ ID NO: 2134045 - protein, 19 aa, Cryptosporidium hominis
VIQLPHLLQNPNPPSPTHV

SEQ ID NO: 2134046 - protein, 19 aa, Cryptosporidium hominis
VIQRFPPVILVFDIVEQGR

SEQ ID NO: 2134047 - protein, 26 aa, Cryptosporidium hominis
VISLLSTPIILRIFSIILKRRNSNIP

SEQ ID NO: 2134048 - protein, 18 aa, Cryptosporidium hominis
VISYFQPKTLILFTDKLL

SEQ ID NO: 2134049 - protein, 20 aa, Cryptosporidium hominis
VIVGYYCIWNVTPSLHTPLM

SEQ ID NO: 2134050 - protein, 21 aa, Cryptosporidium hominis
VIVPCIIFPIIGWNPNNLFQE

SEQ ID NO: 2134051 - protein, 25 aa, Cryptosporidium hominis
VIVSYILMIQFLPINIFVSILNVIH

SEQ ID NO: 2134052 - protein, 21 aa, Cryptosporidium hominis
VIVVIIGVSIALYFQNKNKES

SEQ ID NO: 2134053 - protein, 18 aa, Cryptosporidium hominis
VIVWLHGLCSSAVEWERF

SEQ ID NO: 2134054 - protein, 25 aa, Cryptosporidium hominis
VIYITLSIVIIVNFFAFSDSFLKSV

SEQ ID NO: 2134055 - protein, 26 aa, Cryptosporidium hominis
VKEIVELLFGESFIKVLFSTETFSMG

SEQ ID NO: 2134056 - protein, 29 aa, Cryptosporidium hominis
VKFRNYKLWITFILLCFFSVWISILESGI

SEQ ID NO: 2134057 - protein, 23 aa, Cryptosporidium hominis
VKFSSLIFPWSAFLAVIISYVLS

SEQ ID NO: 2134058 - protein, 19 aa, Cryptosporidium hominis
VKIDKLFSHFLAHEKGRLA

SEQ ID NO: 2134059 - protein, 21 aa, Cryptosporidium hominis
VKIPMIRWLGVFNSSFLTILI

SEQ ID NO: 2134060 - protein, 24 aa, Cryptosporidium hominis
VKIRGLICLSFFKLMRFKEVSEEI

SEQ ID NO: 2134061 - protein, 18 aa, Cryptosporidium hominis
VKNSLPYLELYKGNKQGL

SEQ ID NO: 2134062 - protein, 32 aa, Cryptosporidium hominis
VKQSEQLFKLVQLLFHILYSRKIQAFESTTDA

SEQ ID NO: 2134063 - protein, 21 aa, Cryptosporidium hominis
VKSSSVVFPFTFYVKSSDNNS

SEQ ID NO: 2134064 - protein, 30 aa, Cryptosporidium hominis
VKVVQLFNLFFMFFAFTSFIMILMDSLECF

SEQ ID NO: 2134065 - protein, 17 aa, Cryptosporidium hominis
VLAIFAIHNIIGGLLFV

SEQ ID NO: 2134066 - protein, 25 aa, Cryptosporidium hominis
VLASYRILVIIALLPILTVFYGIFF

SEQ ID NO: 2134067 - protein, 21 aa, Cryptosporidium hominis
VLCIYFGYKMKVSWYAPTFYP

SEQ ID NO: 2134068 - protein, 23 aa, Cryptosporidium hominis
  misc_feature (21)..(22): Xaa can be any naturally occurring amino acid
VLFGEFTIWYLNGFLRACLFXXL

SEQ ID NO: 2134069 - protein, 24 aa, Cryptosporidium hominis
VLFREWLIRIWDISPAIGRDPLFV

SEQ ID NO: 2134070 - protein, 40 aa, Cryptosporidium hominis
VLGFCCKILPIIIRILNLFFILLLVIPFIYITTSGACYRR

SEQ ID NO: 2134071 - protein, 28 aa, Cryptosporidium hominis
VLGKHDFVFKLFYKKGYYYLDSSFTSLT

SEQ ID NO: 2134072 - protein, 20 aa, Cryptosporidium hominis
VLKILHIKRLKFPIYSIITQ

SEQ ID NO: 2134073 - protein, 26 aa, Cryptosporidium hominis
VLKNKLRTLYLWMDEFGDLAWRVMGR

SEQ ID NO: 2134074 - protein, 20 aa, Cryptosporidium hominis
VLLHIYIVQKYVICSKLTHY

SEQ ID NO: 2134075 - protein, 20 aa, Cryptosporidium hominis
VLLLCFSLTIWLRAWLIKRQ

SEQ ID NO: 2134076 - protein, 28 aa, Cryptosporidium hominis
VLLTILYYFMHYLLMLIAMTFNWGLFFS

SEQ ID NO: 2134077 - protein, 20 aa, Cryptosporidium hominis
VLMFFLNILTSIIPLALPII

SEQ ID NO: 2134078 - protein, 38 aa, Cryptosporidium hominis
VLNIIRIMTLLDALFYSFIVWPLCWSIITFYTISWSII

SEQ ID NO: 2134079 - protein, 31 aa, Cryptosporidium hominis
VLNYLSICNISIGFILVLKKLAQLSSEYIEN

SEQ ID NO: 2134080 - protein, 17 aa, Cryptosporidium hominis
VLRFTLCFFDIFGLAHG

SEQ ID NO: 2134081 - protein, 25 aa, Cryptosporidium hominis
VLRGTLFRILFGKILCEILGMFIAD

SEQ ID NO: 2134082 - protein, 31 aa, Cryptosporidium hominis
VLSGISIPLFLLYFGLALQKIPLTPNYTEDQ

SEQ ID NO: 2134083 - protein, 17 aa, Cryptosporidium hominis
VLSLVWIYVHFCSRFEN

SEQ ID NO: 2134084 - protein, 27 aa, Cryptosporidium hominis
VLSRPAMFCIIFISLLITILEICLAFF

SEQ ID NO: 2134085 - protein, 25 aa, Cryptosporidium hominis
VLSSFSWYYLFYNDDYRLVLAPFVT

SEQ ID NO: 2134086 - protein, 35 aa, Cryptosporidium hominis
VLVFCKGFDTLWYVSFARFMLLLSSIIPISLRVNL

SEQ ID NO: 2134087 - protein, 25 aa, Cryptosporidium hominis
VLWVICCHIFLLYLCISSPNALTCL

SEQ ID NO: 2134088 - protein, 17 aa, Cryptosporidium hominis
VLYLICTVLLLVYILKI

SEQ ID NO: 2134089 - protein, 24 aa, Cryptosporidium hominis
VMKVKVLLAKIVPLVSIGLLNVED

SEQ ID NO: 2134090 - protein, 18 aa, Cryptosporidium hominis
VMRLGVLEMILYGSIFFN

SEQ ID NO: 2134091 - protein, 25 aa, Cryptosporidium hominis
VMSILQVMISLFGMGFNLYTHIRSL

SEQ ID NO: 2134092 - protein, 26 aa, Cryptosporidium hominis
VMSTKTFFCWVWKSLYQGTVIMLGAF

SEQ ID NO: 2134093 - protein, 24 aa, Cryptosporidium hominis
VMYAIPVAFFFSFNISFNNICLTH

SEQ ID NO: 2134094 - protein, 26 aa, Cryptosporidium hominis
VNELKYTFVIFSLFLSNSNLTEISKA

SEQ ID NO: 2134095 - protein, 30 aa, Cryptosporidium hominis
VNITSQKMYLLLDILILIKQNWEKMKPSLE

SEQ ID NO: 2134096 - protein, 25 aa, Cryptosporidium hominis
VNIWITWKLLSKQVGLIAALPGIIT

SEQ ID NO: 2134097 - protein, 25 aa, Cryptosporidium hominis
VNLLVIFGFLWLVSPILITLTASFS

SEQ ID NO: 2134098 - protein, 17 aa, Cryptosporidium hominis
VNLYRKKIQVYTKIIKA

SEQ ID NO: 2134099 - protein, 27 aa, Cryptosporidium hominis
VNNDAKFFIRFYSFQKNTFSLSFKRED

SEQ ID NO: 2134100 - protein, 24 aa, Cryptosporidium hominis
VNPINMMYYSLLQILEVIGDFITH

SEQ ID NO: 2134101 - protein, 23 aa, Cryptosporidium hominis
VNRITLFIDFDSDKYQFMFADLE

SEQ ID NO: 2134102 - protein, 27 aa, Cryptosporidium hominis
VNSIYSMSALILLAPTPLGIYYKDFMK

SEQ ID NO: 2134103 - protein, 28 aa, Cryptosporidium hominis
VNTLSKILFLLLIITSFVLVFCKGFDTL

SEQ ID NO: 2134104 - protein, 25 aa, Cryptosporidium hominis
VNVINIVGIFLYFELVIFNEMTFSK

SEQ ID NO: 2134105 - protein, 30 aa, Cryptosporidium hominis
VNVLHIFGIAWWFYGINLIYSNPPELTCRK

SEQ ID NO: 2134106 - protein, 18 aa, Cryptosporidium hominis
VPCLLIFLSDFLIPINIL

SEQ ID NO: 2134107 - protein, 19 aa, Cryptosporidium hominis
VPDWYKHICIIYASLKEKN

SEQ ID NO: 2134108 - protein, 19 aa, Cryptosporidium hominis
VPFSLPLLLVPFSLPLILL

SEQ ID NO: 2134109 - protein, 17 aa, Cryptosporidium hominis
VPHFRAIILHQKVLLIA

SEQ ID NO: 2134110 - protein, 20 aa, Cryptosporidium hominis
VPILYFSIIGLEKKTYEWIV

SEQ ID NO: 2134111 - protein, 25 aa, Cryptosporidium hominis
VPIVEDIIILKLWDNSTKPPAIITQ

SEQ ID NO: 2134112 - protein, 17 aa, Cryptosporidium hominis
VPKLLKLTFIFSAILQI

SEQ ID NO: 2134113 - protein, 29 aa, Cryptosporidium hominis
VPKMAYNGMPFQPGFPPAIPGPFNGQFQY

SEQ ID NO: 2134114 - protein, 26 aa, Cryptosporidium hominis
VPLAFVYPPLFYFSLNREKISKAGQL

SEQ ID NO: 2134115 - protein, 21 aa, Cryptosporidium hominis
VPQLIQHRFIGRRAALRFQES

SEQ ID NO: 2134116 - protein, 25 aa, Cryptosporidium hominis
VPVFICIPCLIWVWCSDHCLQILKY

SEQ ID NO: 2134117 - protein, 25 aa, Cryptosporidium hominis
VQDNSLILLSIHKLALHYLSIHGQR

SEQ ID NO: 2134118 - protein, 25 aa, Cryptosporidium hominis
VQLGIQHTDYWVLKLINRGCYMRQI

SEQ ID NO: 2134119 - protein, 21 aa, Cryptosporidium hominis
VQLPIRLTLKMIYELSVFANH

SEQ ID NO: 2134120 - protein, 25 aa, Cryptosporidium hominis
VQMEDLSAFILYKSHTPYKCTKEQY

SEQ ID NO: 2134121 - protein, 24 aa, Cryptosporidium hominis
VQNQIQTFGGLGYGQRGPQKASDS

SEQ ID NO: 2134122 - protein, 24 aa, Cryptosporidium hominis
VRDLVTLNLLWERVIPIRDYLKSN

SEQ ID NO: 2134123 - protein, 27 aa, Cryptosporidium hominis
VRENSIAFALLYPLMKLFSKTSFSGAQ

SEQ ID NO: 2134124 - protein, 24 aa, Cryptosporidium hominis
VRGIEILVFFAFKKNYHSIFFFDL

SEQ ID NO: 2134125 - protein, 28 aa, Cryptosporidium hominis
VRLNTTALLAILFPLIDPSLSAGNYNSE

SEQ ID NO: 2134126 - protein, 23 aa, Cryptosporidium hominis
VRMTLIGLISRLNERHRRISYQY

SEQ ID NO: 2134127 - protein, 24 aa, Cryptosporidium hominis
VRVANKHFLLKTFGLIMSIIFSLN

SEQ ID NO: 2134128 - protein, 27 aa, Cryptosporidium hominis
VRVYERLFRQLLCTLITLLGVSSVWFN

SEQ ID NO: 2134129 - protein, 17 aa, Cryptosporidium hominis
VRYSVALLVLKISRIQG

SEQ ID NO: 2134130 - protein, 26 aa, Cryptosporidium hominis
VSCIHFFGLLLFFTLYFINFSNEAGL

SEQ ID NO: 2134131 - protein, 29 aa, Cryptosporidium hominis
VSDPFKIFIWLCMYAHDPHIYNGVLAYWS

SEQ ID NO: 2134132 - protein, 19 aa, Cryptosporidium hominis
VSFFTMLIIFIVGLTIDTD

SEQ ID NO: 2134133 - protein, 25 aa, Cryptosporidium hominis
VSFQQFNFIMYIATAWRTYLELQIN

SEQ ID NO: 2134134 - protein, 25 aa, Cryptosporidium hominis
VSGKPYYWLQYFVNNVSVIPIKLNE

SEQ ID NO: 2134135 - protein, 27 aa, Cryptosporidium hominis
VSGLSILKQIFFQLAKFSSNIDLEELK

SEQ ID NO: 2134136 - protein, 26 aa, Cryptosporidium hominis
VSGQFFRGFPLCHIYPAPSIGMNRSG

SEQ ID NO: 2134137 - protein, 17 aa, Cryptosporidium hominis
VSIFGVAFLMLYSRSFK

SEQ ID NO: 2134138 - protein, 25 aa, Cryptosporidium hominis
VSIFVLNALLLYVLKVSISKFNKIR

SEQ ID NO: 2134139 - protein, 23 aa, Cryptosporidium hominis
VSLAISLLLIYWGNTKLKYQYKF

SEQ ID NO: 2134140 - protein, 19 aa, Cryptosporidium hominis
VSLEGLLFSWPFPEVFVET

SEQ ID NO: 2134141 - protein, 18 aa, Cryptosporidium hominis
VSMINLLLSMGFAVDYST

SEQ ID NO: 2134142 - protein, 18 aa, Cryptosporidium hominis
VSMLMFSIFLCYADRIIM

SEQ ID NO: 2134143 - protein, 31 aa, Cryptosporidium hominis
VSNKNIFNNLRRFPWININPHPLVKLETDRK

SEQ ID NO: 2134144 - protein, 24 aa, Cryptosporidium hominis
VSNLYFFSQLLYRRFKSNMLVNIL

SEQ ID NO: 2134145 - protein, 24 aa, Cryptosporidium hominis
VSNWINFLQYKLHSSYPLYTFPII

SEQ ID NO: 2134146 - protein, 17 aa, Cryptosporidium hominis
VSQSLLLGSPRFEDYFG

SEQ ID NO: 2134147 - protein, 24 aa, Cryptosporidium hominis
VSQVYLYSYFSIFLNYSGSNDSEN

SEQ ID NO: 2134148 - protein, 20 aa, Cryptosporidium hominis
VSSFLAVLKPKRTWTQGQNQ

SEQ ID NO: 2134149 - protein, 23 aa, Cryptosporidium hominis
VSTLEYLHPFTLKFRSEILEKKF

SEQ ID NO: 2134150 - protein, 18 aa, Cryptosporidium hominis
VSTNLYISVIFVLLSTLI

SEQ ID NO: 2134151 - protein, 24 aa, Cryptosporidium hominis
VSTTILFFFVKYFSPQDSCFSFVR

SEQ ID NO: 2134152 - protein, 36 aa, Cryptosporidium hominis
VSVALIWDILNIYSFLLFFIYTIMAKLYNLNLKAIK

SEQ ID NO: 2134153 - protein, 24 aa, Cryptosporidium hominis
VSYLFLVAFFFTRNIILPYAFHTQ

SEQ ID NO: 2134154 - protein, 37 aa, Cryptosporidium hominis
VTAIGQYLIIITFLLLLPIVQLLFTYSQTLTGNLACM

SEQ ID NO: 2134155 - protein, 24 aa, Cryptosporidium hominis
VTAYFIICGVVAICSLFLIISFFV

SEQ ID NO: 2134156 - protein, 24 aa, Cryptosporidium hominis
VTDKLLLGILLTSLGALWYSLDKQ

SEQ ID NO: 2134157 - protein, 29 aa, Cryptosporidium hominis
VTFDQIPVWIRWLGWISTVRYTYTGLILS

SEQ ID NO: 2134158 - protein, 17 aa, Cryptosporidium hominis
VTFIVNVEWFATIPKII

SEQ ID NO: 2134159 - protein, 19 aa, Cryptosporidium hominis
VTFMLVFRSGGCMALLISN

SEQ ID NO: 2134160 - protein, 27 aa, Cryptosporidium hominis
VTIVGVWGLLFFGSFLVPPITGISVGV

SEQ ID NO: 2134161 - protein, 22 aa, Cryptosporidium hominis
VTKLLLSFFVILFICFGVIDMI

SEQ ID NO: 2134162 - protein, 18 aa, Cryptosporidium hominis
VTLKGLKYIFRSLQLIQE

SEQ ID NO: 2134163 - protein, 29 aa, Cryptosporidium hominis
VTVIAFLIVAGLTVFCCLIFFGDLADSYL

SEQ ID NO: 2134164 - protein, 18 aa, Cryptosporidium hominis
VVAIIIIAGIIHCLCICK

SEQ ID NO: 2134165 - protein, 25 aa, Cryptosporidium hominis
VVCLRWLQNRICYVFKFGCVVGWDL

SEQ ID NO: 2134166 - protein, 25 aa, Cryptosporidium hominis
VVEKLRWPGGFYFYISGSGPYYPCH

SEQ ID NO: 2134167 - protein, 17 aa, Cryptosporidium hominis
VVGDLVYSLFFYNNSFG

SEQ ID NO: 2134168 - protein, 21 aa, Cryptosporidium hominis
VVGMLPLLRRGIGIHHGGLLP

SEQ ID NO: 2134169 - protein, 26 aa, Cryptosporidium hominis
VVGSVLYIPISLMRAIEYYHLDGDGR

SEQ ID NO: 2134170 - protein, 20 aa, Cryptosporidium hominis
VVIFRRIIRLFPSTNLSITS

SEQ ID NO: 2134171 - protein, 32 aa, Cryptosporidium hominis
VVIVFIALFPFNTNALYFILNPGYTECIHFHA

SEQ ID NO: 2134172 - protein, 25 aa, Cryptosporidium hominis
VVKLHKQFVIFLNKIDPKKNTVYLE

SEQ ID NO: 2134173 - protein, 23 aa, Cryptosporidium hominis
VVKQIFGIVKLFSSFIDNYGIEF

SEQ ID NO: 2134174 - protein, 17 aa, Cryptosporidium hominis
VVLLYKYSAYSPAFDII

SEQ ID NO: 2134175 - protein, 26 aa, Cryptosporidium hominis
VVQDLFKLFIYLPLLLDLSKHITRTW

SEQ ID NO: 2134176 - protein, 18 aa, Cryptosporidium hominis
VVSILFSILALLGVSFCS

SEQ ID NO: 2134177 - protein, 20 aa, Cryptosporidium hominis
VVSMILIGMIYILCKVNKIN

SEQ ID NO: 2134178 - protein, 23 aa, Cryptosporidium hominis
VVTPWFRHIFMDTLSLPVVLIIW

SEQ ID NO: 2134179 - protein, 23 aa, Cryptosporidium hominis
VVTYMCIFIPINWLWTEDSSLEY

SEQ ID NO: 2134180 - protein, 18 aa, Cryptosporidium hominis
VVVSKRSLAYGYACIENE

SEQ ID NO: 2134181 - protein, 23 aa, Cryptosporidium hominis
VVWEESIILLPDTVRLVFLSATI

SEQ ID NO: 2134182 - protein, 41 aa, Cryptosporidium hominis
VWDSSNLYFTWLLATRIILSLTTYFPRILREIWLRNSNNKT

SEQ ID NO: 2134183 - protein, 18 aa, Cryptosporidium hominis
VWHHGIFIQWENHWSLDS

SEQ ID NO: 2134184 - protein, 18 aa, Cryptosporidium hominis
VWIGIGVGAIVLIGLIIF

SEQ ID NO: 2134185 - protein, 20 aa, Cryptosporidium hominis
VWKSSPIWLHLKPSDTKNPQ

SEQ ID NO: 2134186 - protein, 27 aa, Cryptosporidium hominis
VWSAGVVMYFLLAGTLPFTGRSIKEVR

SEQ ID NO: 2134187 - protein, 54 aa, Cryptosporidium hominis
VWSGSIISFAAYMVMAFLAIYWQSALFSLGLKSSHFWKGGGYWLAGSGGLGIFV

SEQ ID NO: 2134188 - protein, 17 aa, Cryptosporidium hominis
VYFPEKLEWWKRAVQDR

SEQ ID NO: 2134189 - protein, 18 aa, Cryptosporidium hominis
VYLEILLPSLLIEDQMFN

SEQ ID NO: 2134190 - protein, 26 aa, Cryptosporidium hominis
VYPNPVRVRLYILSALALVVPIDYSE

SEQ ID NO: 2134191 - protein, 21 aa, Cryptosporidium hominis
VYRYNLFLSNGIHQVVFKVYY

SEQ ID NO: 2134192 - protein, 20 aa, Cryptosporidium hominis
VYSHMRLLFSYFSNYSKDGV

SEQ ID NO: 2134193 - protein, 17 aa, Cryptosporidium hominis
VYSLFFYNNSFGIDPKV

SEQ ID NO: 2134194 - protein, 27 aa, Cryptosporidium hominis
VYTDYRPVPLQHFIFPAGGNGVYLVMD

SEQ ID NO: 2134195 - protein, 18 aa, Cryptosporidium hominis
VYYDNFGNFPLLFKNNEY

SEQ ID NO: 2134196 - protein, 19 aa, Cryptosporidium hominis
WAHIGGFVAGLLWSFASME

SEQ ID NO: 2134197 - protein, 18 aa, Cryptosporidium hominis
WCIVWLSRFLLTSVIRSM

SEQ ID NO: 2134198 - protein, 18 aa, Cryptosporidium hominis
WCKLFGNYYIHILEKFPV

SEQ ID NO: 2134199 - protein, 26 aa, Cryptosporidium hominis
WCNTRIQFFILPISIINSIFPYITPF

SEQ ID NO: 2134200 - protein, 23 aa, Cryptosporidium hominis
WCRIVNYRSLPCIGSLQQKPIIG

SEQ ID NO: 2134201 - protein, 20 aa, Cryptosporidium hominis
WDHKKYFSLNLENFGPYYYA

SEQ ID NO: 2134202 - protein, 30 aa, Cryptosporidium hominis
WELPRIDFKRKKFPWIKPGHPYIGPKISGS

SEQ ID NO: 2134203 - protein, 19 aa, Cryptosporidium hominis
WEPAQYLYKKYRNTYCLGF

SEQ ID NO: 2134204 - protein, 51 aa, Cryptosporidium hominis
WESQLHSLFALSIIWYLSFNPKYIFSFVFSLGLIILFISFDKRNLALNLES

SEQ ID NO: 2134205 - protein, 20 aa, Cryptosporidium hominis
WFIHHGYFQHINLLKILRQV

SEQ ID NO: 2134206 - protein, 29 aa, Cryptosporidium hominis
WFLETVDTYWFFHSIWHIMAFLASTFIIH

SEQ ID NO: 2134207 - protein, 17 aa, Cryptosporidium hominis
WFLMAPTMCFQFWYPRT

SEQ ID NO: 2134208 - protein, 18 aa, Cryptosporidium hominis
WFNGLFFDHSMKKTTLFY

SEQ ID NO: 2134209 - protein, 21 aa, Cryptosporidium hominis
WFYFPYIGICLWGISTQLLTL

SEQ ID NO: 2134210 - protein, 26 aa, Cryptosporidium hominis
WGIQEKVYPYLACKILGLLNQEKKED

SEQ ID NO: 2134211 - protein, 25 aa, Cryptosporidium hominis
WHHLQSILYLIYGAGALVFVRLIAN

SEQ ID NO: 2134212 - protein, 17 aa, Cryptosporidium hominis
WHIFKETFAKDIGLIIF

SEQ ID NO: 2134213 - protein, 20 aa, Cryptosporidium hominis
WIAKYLLSLSWLFLGIGRVC

SEQ ID NO: 2134214 - protein, 17 aa, Cryptosporidium hominis
WIDRLLDIPNINSSPMN

SEQ ID NO: 2134215 - protein, 29 aa, Cryptosporidium hominis
WIHIFYIEIKYLFWIWKSNYLQNAPSSEI

SEQ ID NO: 2134216 - protein, 19 aa, Cryptosporidium hominis
WILLIEIFIGIAISAWKLW

SEQ ID NO: 2134217 - protein, 29 aa, Cryptosporidium hominis
WINKIFLKSIFGLLHTYPRVYNRFDNPNM

SEQ ID NO: 2134218 - protein, 30 aa, Cryptosporidium hominis
WIQIISSNRFFPYLLRHVKGWQPYQALLLQ

SEQ ID NO: 2134219 - protein, 17 aa, Cryptosporidium hominis
WIQNRFIFASAFMEEFL

SEQ ID NO: 2134220 - protein, 19 aa, Cryptosporidium hominis
WIQQIFFLSTFWQSKKVWS

SEQ ID NO: 2134221 - protein, 23 aa, Cryptosporidium hominis
WIQSYFGNFLNLVLSGICNYAII

SEQ ID NO: 2134222 - protein, 27 aa, Cryptosporidium hominis
WIQVLPPEIAIIRPIYPLNPPTVETCQ

SEQ ID NO: 2134223 - protein, 19 aa, Cryptosporidium hominis
WISTRKIPGLIFNTLIIYS

SEQ ID NO: 2134224 - protein, 18 aa, Cryptosporidium hominis
WKIMMGMNILYFMLLTFL

SEQ ID NO: 2134225 - protein, 19 aa, Cryptosporidium hominis
WKRLENPIFIFKNGVIVAW

SEQ ID NO: 2134226 - protein, 21 aa, Cryptosporidium hominis
WKSFLWEFQFSRLYFKLARGD

SEQ ID NO: 2134227 - protein, 23 aa, Cryptosporidium hominis
WKTKIFILSRRFPFFSIKDDSDA

SEQ ID NO: 2134228 - protein, 18 aa, Cryptosporidium hominis
WKVKLSIYILSTLLCGLC

SEQ ID NO: 2134229 - protein, 19 aa, Cryptosporidium hominis
WKVLIYDKMGQTILSPLMK

SEQ ID NO: 2134230 - protein, 20 aa, Cryptosporidium hominis
WLFSQFYLTFASNAKTTRLF

SEQ ID NO: 2134231 - protein, 25 aa, Cryptosporidium hominis
WLIKYKKIRNIILLSRSGLPSKRCK

SEQ ID NO: 2134232 - protein, 20 aa, Cryptosporidium hominis
WLKIRLQVGIIIPLTFFNVF

SEQ ID NO: 2134233 - protein, 26 aa, Cryptosporidium hominis
WLTLDIKYRYTKLAKLKLIPKLFGKD

SEQ ID NO: 2134234 - protein, 27 aa, Cryptosporidium hominis
WNELMVLNFFLTSFKGFAMLFRESLTG

SEQ ID NO: 2134235 - protein, 22 aa, Cryptosporidium hominis
WNFYWCIMTLLCLIHFSSYSAS

SEQ ID NO: 2134236 - protein, 29 aa, Cryptosporidium hominis
WNMPSSYWMRYLPILLGINTFCGFLGYRS

SEQ ID NO: 2134237 - protein, 29 aa, Cryptosporidium hominis
WNRIFNKNFYLNGLLDYVLLRTSEILVEI

SEQ ID NO: 2134238 - protein, 20 aa, Cryptosporidium hominis
WNTNQIFTFIYVSYKNKHQN

SEQ ID NO: 2134239 - protein, 17 aa, Cryptosporidium hominis
WQFHKKCFAWFYKRSDS

SEQ ID NO: 2134240 - protein, 20 aa, Cryptosporidium hominis
WRCYCLIQRWLGIHIDILGA

SEQ ID NO: 2134241 - protein, 37 aa, Cryptosporidium hominis
WRSEYVNSYFLLNILQYLIVLLQVYPSISDPGLLRKA

SEQ ID NO: 2134242 - protein, 35 aa, Cryptosporidium hominis
WSGTLLQLLDIVSLYIIFWTVLLPVFYGIYGIDVP

SEQ ID NO: 2134243 - protein, 25 aa, Cryptosporidium hominis
WSIICIIFNILIYQITFKNPIGLPF

SEQ ID NO: 2134244 - protein, 24 aa, Cryptosporidium hominis
WSNHIVCPVLFYDAINHALNKFDC

SEQ ID NO: 2134245 - protein, 22 aa, Cryptosporidium hominis
WSNLKFLIKRLVDIGMDDLGIT

SEQ ID NO: 2134246 - protein, 24 aa, Cryptosporidium hominis
WSNRLRMLMLTGKLNIIFISSIIF

SEQ ID NO: 2134247 - protein, 17 aa, Cryptosporidium hominis
WSTAITGFLLDNSLLII

SEQ ID NO: 2134248 - protein, 21 aa, Cryptosporidium hominis
WSYKFFIFLSIVQFKMFSFIW

SEQ ID NO: 2134249 - protein, 23 aa, Cryptosporidium hominis
WTKMFCFGVFAMEMFIDRFISFP

SEQ ID NO: 2134250 - protein, 25 aa, Cryptosporidium hominis
WTLGILIYEMVVGFPPFYDDEPMGI

SEQ ID NO: 2134251 - protein, 20 aa, Cryptosporidium hominis
WTLTLVLLIIQVVLGQNEKF

SEQ ID NO: 2134252 - protein, 40 aa, Cryptosporidium hominis
WTNNGFKFILYSIFISLIIDIFWMNIFFPAWSVSSEEGDL

SEQ ID NO: 2134253 - protein, 24 aa, Cryptosporidium hominis
WTYNSKRRLPWSTFFSIKQNGLPT

SEQ ID NO: 2134254 - protein, 17 aa, Cryptosporidium hominis
WWFSFLNGLSPCVYFFL

SEQ ID NO: 2134255 - protein, 20 aa, Cryptosporidium hominis
WWGSNKMLFSAALYAIANIC

SEQ ID NO: 2134256 - protein, 17 aa, Cryptosporidium hominis
WYQVFQKYLVFVQVIFS

SEQ ID NO: 2134257 - protein, 20 aa, Cryptosporidium hominis
WYTPIPCIVNFPFNAKISRI

SEQ ID NO: 2134258 - protein, 17 aa, Cryptosporidium hominis
  misc_feature (1)..(2): Xaa can be any naturally occurring amino acid
XXFVFCLFVFVLVVLVF

SEQ ID NO: 2134259 - protein, 31 aa, Cryptosporidium hominis
YAALSIFSEFYYYWSKFKYNIRKFSYENPIK

SEQ ID NO: 2134260 - protein, 31 aa, Cryptosporidium hominis
YANNTRWYLPGYWWYEKVTFTSEVSLPSLFE

SEQ ID NO: 2134261 - protein, 22 aa, Cryptosporidium hominis
YANTILIISPILKEILFSKSVG

SEQ ID NO: 2134262 - protein, 25 aa, Cryptosporidium hominis
YCDNLIQVMKIIRFNFLSDSAKNVY

SEQ ID NO: 2134263 - protein, 25 aa, Cryptosporidium hominis
YCFNLLVLLIMIPFGYYLVEHKLKL

SEQ ID NO: 2134264 - protein, 17 aa, Cryptosporidium hominis
YCIWNVTPSLHTPLMSV

SEQ ID NO: 2134265 - protein, 17 aa, Cryptosporidium hominis
YCNTFSNIIFPFKYFKN

SEQ ID NO: 2134266 - protein, 17 aa, Cryptosporidium hominis
YCRYILKKTMDEINEDY

SEQ ID NO: 2134267 - protein, 26 aa, Cryptosporidium hominis
YDEALRYLLSSYRLFDPLENSSFSES

SEQ ID NO: 2134268 - protein, 23 aa, Cryptosporidium hominis
YDIFQELLTFRKSWRKLSTSLEE

SEQ ID NO: 2134269 - protein, 27 aa, Cryptosporidium hominis
YDSNNDIFPRFSFPNYFYHYVSHYTDT

SEQ ID NO: 2134270 - protein, 26 aa, Cryptosporidium hominis
YDYHEPLYLLGITKPFFSLKIFGIWS

SEQ ID NO: 2134271 - protein, 31 aa, Cryptosporidium hominis
YEKLNKYLQKISLIFYLFNKTRELENEGLNN

SEQ ID NO: 2134272 - protein, 22 aa, Cryptosporidium hominis
YELDAILPLNALLTITVFHKNK

SEQ ID NO: 2134273 - protein, 20 aa, Cryptosporidium hominis
YELIIKKSRFLIENFVIHFY

SEQ ID NO: 2134274 - protein, 23 aa, Cryptosporidium hominis
YENNLLTQSWRFPMSFSSSFNMV

SEQ ID NO: 2134275 - protein, 24 aa, Cryptosporidium hominis
YEVIMMIQMELCIGVTLRSWLGDA

SEQ ID NO: 2134276 - protein, 17 aa, Cryptosporidium hominis
YFDFRIKNGLLYDCKIN

SEQ ID NO: 2134277 - protein, 20 aa, Cryptosporidium hominis
YFHLGEYLGFPFFRQKRNKK

SEQ ID NO: 2134278 - protein, 22 aa, Cryptosporidium hominis
YFIGIMILLLISNSDVNCWKFK

SEQ ID NO: 2134279 - protein, 18 aa, Cryptosporidium hominis
YFILSGILVIITILSTYI

SEQ ID NO: 2134280 - protein, 48 aa, Cryptosporidium hominis
YFKNYVDFFMEFIPQFIFMVGFIGYLNFLIFFKWLTPIEGYNKPSILN

SEQ ID NO: 2134281 - protein, 22 aa, Cryptosporidium hominis
YFKPLKVPFLSWSEAAYHSLLS

SEQ ID NO: 2134282 - protein, 18 aa, Cryptosporidium hominis
YFLDYNLETDLFKTLKYI

SEQ ID NO: 2134283 - protein, 25 aa, Cryptosporidium hominis
YFLFIDLMLFLLHSGDFFASCESPN

SEQ ID NO: 2134284 - protein, 22 aa, Cryptosporidium hominis
YFLIINIFFYFSYSANLYILYT

SEQ ID NO: 2134285 - protein, 17 aa, Cryptosporidium hominis
YFLYTRNPDLEGGFATE

SEQ ID NO: 2134286 - protein, 28 aa, Cryptosporidium hominis
YFNIEYYPLWVYPALLMTIEFSLLFIPS

SEQ ID NO: 2134287 - protein, 28 aa, Cryptosporidium hominis
YFNSLKCIRIFLLRLNADLMWNYTQNII

SEQ ID NO: 2134288 - protein, 45 aa, Cryptosporidium hominis
YFPGILLIILFNHTILNWIFLTISSLFNMMFLYNSLFINGSRTHT

SEQ ID NO: 2134289 - protein, 18 aa, Cryptosporidium hominis
YFPHFHPLRMPKSKLEWK

SEQ ID NO: 2134290 - protein, 18 aa, Cryptosporidium hominis
YFPTQAFGFAFKDMIRDM

SEQ ID NO: 2134291 - protein, 24 aa, Cryptosporidium hominis
YFQKYYHQLLSQRIVYYFTNNRIG

SEQ ID NO: 2134292 - protein, 28 aa, Cryptosporidium hominis
YFSEISIHLYFSLTKLGASKFKVINEIF

SEQ ID NO: 2134293 - protein, 25 aa, Cryptosporidium hominis
YFSNLIPYELLFTSLMSHCDVNPIN

SEQ ID NO: 2134294 - protein, 18 aa, Cryptosporidium hominis
YFSVLKNFSFYKLIYCLL

SEQ ID NO: 2134295 - protein, 19 aa, Cryptosporidium hominis
YFSWIIFKKILWTIFYSSY

SEQ ID NO: 2134296 - protein, 17 aa, Cryptosporidium hominis
YFTIWKDENYNLKWLER

SEQ ID NO: 2134297 - protein, 26 aa, Cryptosporidium hominis
YFVRLNYLPRVLANNFTWLIPMRDHY

SEQ ID NO: 2134298 - protein, 17 aa, Cryptosporidium hominis
YGACVFLLLFGFGSSVF

SEQ ID NO: 2134299 - protein, 20 aa, Cryptosporidium hominis
YGFSFRRRFMDLMFKGTSFM

SEQ ID NO: 2134300 - protein, 26 aa, Cryptosporidium hominis
YGIAPLIIIFFVIVSGFYVTVNKLPS

SEQ ID NO: 2134301 - protein, 18 aa, Cryptosporidium hominis
YGIPMFPMAPNPGQLQNG

SEQ ID NO: 2134302 - protein, 28 aa, Cryptosporidium hominis
YGKANLFQKIFRFPKLLLSKDEVHNIES

SEQ ID NO: 2134303 - protein, 52 aa, Cryptosporidium hominis
YGKRSQFMLSKSFLFKILLLVLNLIPVTLLTLGFYLIIAEIWTIISSKILEN

SEQ ID NO: 2134304 - protein, 23 aa, Cryptosporidium hominis
YGNELFLYLYRLKVICTEKLGYY

SEQ ID NO: 2134305 - protein, 39 aa, Cryptosporidium hominis
YGNQRAFFFFLKFLTISFFLYYYLFQQYCSFRFKFSASL

SEQ ID NO: 2134306 - protein, 30 aa, Cryptosporidium hominis
YGRSIVNVLFLKLIFLFSCSLCSIVFTQTV

SEQ ID NO: 2134307 - protein, 25 aa, Cryptosporidium hominis
YGSNLTLLYDYIYNLASRVIGSGQE

SEQ ID NO: 2134308 - protein, 26 aa, Cryptosporidium hominis
YGWALLWVVIIVFQFLSLKFQWISLS

SEQ ID NO: 2134309 - protein, 18 aa, Cryptosporidium hominis
YHEESPWIHGGRLIWYKT

SEQ ID NO: 2134310 - protein, 23 aa, Cryptosporidium hominis
YHIPEIMCYGRIKCYIPCFFQNN

SEQ ID NO: 2134311 - protein, 17 aa, Cryptosporidium hominis
YHTNMSRRGIFNIGPRI

SEQ ID NO: 2134312 - protein, 20 aa, Cryptosporidium hominis
YIAHQLGLLVSILHICVFTG

SEQ ID NO: 2134313 - protein, 19 aa, Cryptosporidium hominis
YIMIRIALTYPVNINRISK

SEQ ID NO: 2134314 - protein, 20 aa, Cryptosporidium hominis
YIPESFSVQATLHVIPKYSA

SEQ ID NO: 2134315 - protein, 27 aa, Cryptosporidium hominis
YIPHPSEFFPFSWFFLKFGVHKHENFN

SEQ ID NO: 2134316 - protein, 19 aa, Cryptosporidium hominis
YIPSKLFFHYYDTANTQYS

SEQ ID NO: 2134317 - protein, 18 aa, Cryptosporidium hominis
YIQDIKLDLIPFLTSEDN

SEQ ID NO: 2134318 - protein, 25 aa, Cryptosporidium hominis
YIRNLKALWIIMLSSAFAAILYQNH

SEQ ID NO: 2134319 - protein, 19 aa, Cryptosporidium hominis
YITYLLLFIIENWLPKIVT

SEQ ID NO: 2134320 - protein, 20 aa, Cryptosporidium hominis
YIVSIIPFISLLVSMFYVIS

SEQ ID NO: 2134321 - protein, 17 aa, Cryptosporidium hominis
YIYALTPLLEVALTDRD

SEQ ID NO: 2134322 - protein, 45 aa, Cryptosporidium hominis
YKEGSAAYFIDKIQKILRLISLMFSLFILGFIITSRINKGRKDVS

SEQ ID NO: 2134323 - protein, 17 aa, Cryptosporidium hominis
YKELDGYFLKKFNEASN

SEQ ID NO: 2134324 - protein, 23 aa, Cryptosporidium hominis
YKELYIYFVNTLRQLYIDSLSHN

SEQ ID NO: 2134325 - protein, 17 aa, Cryptosporidium hominis
YKFCLRLSCSRMLESQL

SEQ ID NO: 2134326 - protein, 19 aa, Cryptosporidium hominis
YKFFFLALLYGCASLTYMM

SEQ ID NO: 2134327 - protein, 40 aa, Cryptosporidium hominis
YKFMRGLMCFLTVSLSMLYLIFSCSFAIKYRPLVFDNILT

SEQ ID NO: 2134328 - protein, 23 aa, Cryptosporidium hominis
YKLFFLIFVSRLSKIYIILTLTI

SEQ ID NO: 2134329 - protein, 23 aa, Cryptosporidium hominis
YKLTQIPKVWKSSPIWLHLKPSD

SEQ ID NO: 2134330 - protein, 35 aa, Cryptosporidium hominis
YKTGSIEFYLCILFSIALIFFGGILSGLTTGLMSL

SEQ ID NO: 2134331 - protein, 34 aa, Cryptosporidium hominis
YLAIKNFCILTFVGLLFGYITCLTILLGVLCIDA

SEQ ID NO: 2134332 - protein, 25 aa, Cryptosporidium hominis
YLATATFLVVVLWISSLFSANWQNY

SEQ ID NO: 2134333 - protein, 26 aa, Cryptosporidium hominis
YLCSTYPMLIFMRHLLQNRKRFKGPK

SEQ ID NO: 2134334 - protein, 31 aa, Cryptosporidium hominis
YLDGIYLGYFYTWIILFAAAQLFWVLSNIGN

SEQ ID NO: 2134335 - protein, 17 aa, Cryptosporidium hominis
YLDYLFYKKFTIPMINF

SEQ ID NO: 2134336 - protein, 21 aa, Cryptosporidium hominis
YLESYNIFPTYNFLLENKEKV

SEQ ID NO: 2134337 - protein, 17 aa, Cryptosporidium hominis
YLGFSWDQQYLSLNKTN

SEQ ID NO: 2134338 - protein, 25 aa, Cryptosporidium hominis
YLGFTLILSIWILKSQDWYNLDDLS

SEQ ID NO: 2134339 - protein, 27 aa, Cryptosporidium hominis
YLGPIIIFPIFYFFPTLIYGEPAPPKS

SEQ ID NO: 2134340 - protein, 25 aa, Cryptosporidium hominis
YLITFTFIIPFVLSQSTLLNLGAGG

SEQ ID NO: 2134341 - protein, 21 aa, Cryptosporidium hominis
YLIVIFFIILCENIDDKLLSS

SEQ ID NO: 2134342 - protein, 34 aa, Cryptosporidium hominis
YLKNAELLKPFFGSKFHIILNRTSISLLNNFLLS

SEQ ID NO: 2134343 - protein, 18 aa, Cryptosporidium hominis
YLLQAFPAILTFTMILIG

SEQ ID NO: 2134344 - protein, 26 aa, Cryptosporidium hominis
YLLSALIMFYYWVLNVLSTFLLMQCA

SEQ ID NO: 2134345 - protein, 20 aa, Cryptosporidium hominis
YLNCSFLYHTLKRYNDLDLI

SEQ ID NO: 2134346 - protein, 23 aa, Cryptosporidium hominis
YLNINWGYIYKLIPGISNFNCSN

SEQ ID NO: 2134347 - protein, 23 aa, Cryptosporidium hominis
YLNQFLYIFSLVTSIGIIFAEAT

SEQ ID NO: 2134348 - protein, 19 aa, Cryptosporidium hominis
YLPYKSIYDNVVYPSLFTL

SEQ ID NO: 2134349 - protein, 24 aa, Cryptosporidium hominis
YLQYRGSIPIVWRQPPNLKKTPPV

SEQ ID NO: 2134350 - protein, 23 aa, Cryptosporidium hominis
YLSICFEMVSLFILTQFIFQNQS

SEQ ID NO: 2134351 - protein, 23 aa, Cryptosporidium hominis
YLSSHFSILKYLESLTKSIFNLH

SEQ ID NO: 2134352 - protein, 21 aa, Cryptosporidium hominis
YLTFEKYFLYTRNPDLEGGFA

SEQ ID NO: 2134353 - protein, 19 aa, Cryptosporidium hominis
YLTILLSTFSTCISLYCKI

SEQ ID NO: 2134354 - protein, 17 aa, Cryptosporidium hominis
YLTVSDPFKIFIWLCMY

SEQ ID NO: 2134355 - protein, 22 aa, Cryptosporidium hominis
YLYILVIFKVNYVISIRNNKSS

SEQ ID NO: 2134356 - protein, 25 aa, Cryptosporidium hominis
YMIGVLLYFCLTGEYYSFESKNDTI

SEQ ID NO: 2134357 - protein, 17 aa, Cryptosporidium hominis
YMITQIISLLLCCSSQI

SEQ ID NO: 2134358 - protein, 17 aa, Cryptosporidium hominis
YMRDRISYINFSTINYL

SEQ ID NO: 2134359 - protein, 24 aa, Cryptosporidium hominis
YNDNIWILFSHIFQSFVYSKLPQL

SEQ ID NO: 2134360 - protein, 21 aa, Cryptosporidium hominis
YNEVTWWIGVISYAFGAIVHI

SEQ ID NO: 2134361 - protein, 43 aa, Cryptosporidium hominis
YNGTQVLTLMFFISVIIFGLFILAIALIPRYAKRFGFKSRRDE

SEQ ID NO: 2134362 - protein, 35 aa, Cryptosporidium hominis
YNIHLSSFLVLRDCIYIVFSLIYYSKSRELDDFII

SEQ ID NO: 2134363 - protein, 25 aa, Cryptosporidium hominis
YNIPVNENLLLQWKPLNYRNSEATQ

SEQ ID NO: 2134364 - protein, 17 aa, Cryptosporidium hominis
YNKLTIIFVTIGANLLC

SEQ ID NO: 2134365 - protein, 17 aa, Cryptosporidium hominis
YNMNFPCEQVHYWFLAY

SEQ ID NO: 2134366 - protein, 28 aa, Cryptosporidium hominis
YNRCKFWWLSLVQFPECIWILYCISICL

SEQ ID NO: 2134367 - protein, 23 aa, Cryptosporidium hominis
YNYLNCMVSPWKNLEFICVMDTV

SEQ ID NO: 2134368 - protein, 35 aa, Cryptosporidium hominis
YPISTLLPVITLLLFSWLLFPGAISSVLMFPYNVY

SEQ ID NO: 2134369 - protein, 31 aa, Cryptosporidium hominis
YPKYHSFFKRGFLNTILFKWLSPIINSAEKG

SEQ ID NO: 2134370 - protein, 38 aa, Cryptosporidium hominis
YPVYITPICRRLYLEKVYLIFQIFTLGIISIICHWFPN

SEQ ID NO: 2134371 - protein, 22 aa, Cryptosporidium hominis
YQPFFLLHGLYLYAYIIGILLA

SEQ ID NO: 2134372 - protein, 23 aa, Cryptosporidium hominis
YQTNFLLQILGITISFFGNIFNS

SEQ ID NO: 2134373 - protein, 21 aa, Cryptosporidium hominis
YRDLFELLSKIFISKLKNKKI

SEQ ID NO: 2134374 - protein, 24 aa, Cryptosporidium hominis
YRDVLFIFVTRGILLTLCFTWASL

SEQ ID NO: 2134375 - protein, 18 aa, Cryptosporidium hominis
YRGYLVSLIIEILDYIET

SEQ ID NO: 2134376 - protein, 20 aa, Cryptosporidium hominis
YRIEAIIMKFLKHKQKSSLL

SEQ ID NO: 2134377 - protein, 27 aa, Cryptosporidium hominis
YRMKNTLALFYLIFGNDPEYLVSAFLL

SEQ ID NO: 2134378 - protein, 28 aa, Cryptosporidium hominis
YRRLYVFLFGIVLFFILLFGICNSSILF

SEQ ID NO: 2134379 - protein, 18 aa, Cryptosporidium hominis
YSAPKKLPSRNFLEQLFA

SEQ ID NO: 2134380 - protein, 26 aa, Cryptosporidium hominis
YSASTWFYCFLLIILNVQYSKLHLKV

SEQ ID NO: 2134381 - protein, 32 aa, Cryptosporidium hominis
YSCAYLLCIILICFFLYPSWSLYVHIKINGIP

SEQ ID NO: 2134382 - protein, 32 aa, Cryptosporidium hominis
YSELTKLLYIEQYYRHIFAKFPNHVKWIDRVS

SEQ ID NO: 2134383 - protein, 26 aa, Cryptosporidium hominis
YSFLYCLIYLIFTIVYFILKLPNPQS

SEQ ID NO: 2134384 - protein, 29 aa, Cryptosporidium hominis
YSIQQINLLYKQKLIWLRIHLTVGIIDSE

SEQ ID NO: 2134385 - protein, 22 aa, Cryptosporidium hominis
YSITLIVIVWLACTSNQISEFQ

SEQ ID NO: 2134386 - protein, 22 aa, Cryptosporidium hominis
YSKELCIHLLGASLSIIYKNVN

SEQ ID NO: 2134387 - protein, 17 aa, Cryptosporidium hominis
YSKFIFQFLNENTLNHL

SEQ ID NO: 2134388 - protein, 32 aa, Cryptosporidium hominis
YSKKSGFIFFQWYFWYCLESRRYPSKDFLLKF

SEQ ID NO: 2134389 - protein, 19 aa, Cryptosporidium hominis
YSKPFPWPMELLNPSHNLI

SEQ ID NO: 2134390 - protein, 30 aa, Cryptosporidium hominis
YSLFIQVFGSKFSWRWFLPTMTRPPFTTSN

SEQ ID NO: 2134391 - protein, 25 aa, Cryptosporidium hominis
YSNFKWVFAIFVLKPSILFLCRVFT

SEQ ID NO: 2134392 - protein, 33 aa, Cryptosporidium hominis
YSNSQPTIIHWLIILLTALFSCYLFNGVDQKDA

SEQ ID NO: 2134393 - protein, 23 aa, Cryptosporidium hominis
YSNTRFGDILTFPTKDYPNGLAL

SEQ ID NO: 2134394 - protein, 21 aa, Cryptosporidium hominis
YSPELIVHPLFPSYGELSKEE

SEQ ID NO: 2134395 - protein, 27 aa, Cryptosporidium hominis
YSRFINEALLTMLPPKFSRNSWINHLS

SEQ ID NO: 2134396 - protein, 42 aa, Cryptosporidium hominis
YSSKFPIKYDLNGLLFWNVSSDTYIYWGYQNKTRTIYILGNN

SEQ ID NO: 2134397 - protein, 23 aa, Cryptosporidium hominis
YSSKWNRRLLARKHNLPLGNSDS

SEQ ID NO: 2134398 - protein, 35 aa, Cryptosporidium hominis
YSSTLDSIGMRWLIPWYLIEALLTKPNQINLLSNG

SEQ ID NO: 2134399 - protein, 27 aa, Cryptosporidium hominis
YSSTSLLLSWFFNGLFHAGVYPMLVKY

SEQ ID NO: 2134400 - protein, 22 aa, Cryptosporidium hominis
YSTIFMFLYSCFTVFNYATCEL

SEQ ID NO: 2134401 - protein, 17 aa, Cryptosporidium hominis
YSVIIKLSEKFESEIDP

SEQ ID NO: 2134402 - protein, 22 aa, Cryptosporidium hominis
YTLRLRGKIPDSINIFASKFNG

SEQ ID NO: 2134403 - protein, 17 aa, Cryptosporidium hominis
YTLVISPVVGWLTSTKR

SEQ ID NO: 2134404 - protein, 24 aa, Cryptosporidium hominis
YTNIQAEYRSMLIRDLINIARNDS

SEQ ID NO: 2134405 - protein, 19 aa, Cryptosporidium hominis
YTRELYYTSLLSKQNFPLI

SEQ ID NO: 2134406 - protein, 22 aa, Cryptosporidium hominis
YTRRIPLEGLEMYCKTVWKCIV

SEQ ID NO: 2134407 - protein, 24 aa, Cryptosporidium hominis
YVAHIMRQIMAALAYFHSRNIVHK

SEQ ID NO: 2134408 - protein, 26 aa, Cryptosporidium hominis
YVELHYLFISFWNYTPFYFYNNQHHN

SEQ ID NO: 2134409 - protein, 28 aa, Cryptosporidium hominis
YVGIATVGIFVWWYVWGIDPSDGNTLVS

SEQ ID NO: 2134410 - protein, 25 aa, Cryptosporidium hominis
YVIKKILLIICPYITFFTQNKRKSF

SEQ ID NO: 2134411 - protein, 21 aa, Cryptosporidium hominis
YVLLSFGLLLGLFVHLLSVYD

SEQ ID NO: 2134412 - protein, 31 aa, Cryptosporidium hominis
YVLTSPVLVTLLLLLASFIYSYLTGNFSSFC

SEQ ID NO: 2134413 - protein, 18 aa, Cryptosporidium hominis
YVPKILNFIDRGGNLMIF

SEQ ID NO: 2134414 - protein, 22 aa, Cryptosporidium hominis
YVQNNFIRIFQKELSQYMSSLV

SEQ ID NO: 2134415 - protein, 23 aa, Cryptosporidium hominis
YVSQIILTSWTISKSFFPGRHYT

SEQ ID NO: 2134416 - protein, 26 aa, Cryptosporidium hominis
YVTIYRVEDLLFKKGLRDPFITVEFS

SEQ ID NO: 2134417 - protein, 27 aa, Cryptosporidium hominis
YVYVCTYWGLFYFKIPKKYGIYLNKHT

SEQ ID NO: 2134418 - protein, 26 aa, Cryptosporidium hominis
YWCTIPVTILVFCGVILRTILQTSSQ

SEQ ID NO: 2134419 - protein, 35 aa, Cryptosporidium hominis
YYCIHAGFGILYLFIFHWLIFLPSFVLDEKRIYRR

SEQ ID NO: 2134420 - protein, 41 aa, Cryptosporidium hominis
YYEERRWKIYAARRLSQMVQNYWRKKMLNLERHISSKCSAL

SEQ ID NO: 2134421 - protein, 32 aa, Cryptosporidium hominis
YYEKEIKPLLIRWIIFVIRLHKFSGLSDELCE

SEQ ID NO: 2134422 - protein, 26 aa, Cryptosporidium hominis
YYMGSVFIILTLLKILVETQYSYWCG

SEQ ID NO: 2134423 - protein, 18 aa, Cryptosporidium hominis
YYPRGYNPEWDNGLTKTI

SEQ ID NO: 2134424 - protein, 19 aa, Cryptosporidium hominis
YYREFLAFVYYRCIYGAEG

SEQ ID NO: 2134425 - protein, 26 aa, Cryptosporidium hominis
YYTCDLLHYNLLLIIKALSFLESYEI

SEQ ID NO: 2134426 - protein, 17 aa, Cryptosporidium hominis
YYYFFHEPNFCNSNILS

SEQ ID NO: 2134427 - protein, 17 aa, Cryptosporidium hominis
AAIFLLTFWFCYRTRRV

SEQ ID NO: 2134428 - protein, 24 aa, Cryptosporidium hominis
AALDYFIWFFLEFFYPKESIEHCI

SEQ ID NO: 2134429 - protein, 18 aa, Cryptosporidium hominis
AEIIWILVHSFFSTLTSL

SEQ ID NO: 2134430 - protein, 18 aa, Cryptosporidium hominis
AFYWIRRGFYLPRSYNLL

SEQ ID NO: 2134431 - protein, 26 aa, Cryptosporidium hominis
AGFGILYLFIFHWLIFLPSFVLDEKR

SEQ ID NO: 2134432 - protein, 29 aa, Cryptosporidium hominis
AGFSLFFQFWFWFPLVHCISLSYIPTCIV

SEQ ID NO: 2134433 - protein, 23 aa, Cryptosporidium hominis
AGTAYRWLFVRLEIMGCIAVFTA

SEQ ID NO: 2134434 - protein, 22 aa, Cryptosporidium hominis
AHIGSLLAWLFQNMAQHVEQDG

SEQ ID NO: 2134435 - protein, 19 aa, Cryptosporidium hominis
AHTLLLIGLLFNSPCRRLA

SEQ ID NO: 2134436 - protein, 23 aa, Cryptosporidium hominis
AIFARILLLWWYSIPDIREIQHR

SEQ ID NO: 2134437 - protein, 22 aa, Cryptosporidium hominis
AILRVQFLVLLLFLNNLACENE

SEQ ID NO: 2134438 - protein, 20 aa, Cryptosporidium hominis
AIRIIFCLVYFFIYGRFVYS

SEQ ID NO: 2134439 - protein, 21 aa, Cryptosporidium hominis
AKLIYRIFEPNSGKIRIFGKE

SEQ ID NO: 2134440 - protein, 24 aa, Cryptosporidium hominis
ALELIQICFFLLNGLNVLSVFEEQ

SEQ ID NO: 2134441 - protein, 18 aa, Cryptosporidium hominis
ALIHLLNFLWPNVFENSP

SEQ ID NO: 2134442 - protein, 25 aa, Cryptosporidium hominis
ALLISVPWMFFPKPLYLIYKSRKQK

SEQ ID NO: 2134443 - protein, 22 aa, Cryptosporidium hominis
ALLKLFLLIFLNITNIFMFLIT

SEQ ID NO: 2134444 - protein, 26 aa, Cryptosporidium hominis
ALLQILHYFLIPMFPLDLVSFNSIFV

SEQ ID NO: 2134445 - protein, 22 aa, Cryptosporidium hominis
ALLSILLIWFMTIMLVYEAIQR

SEQ ID NO: 2134446 - protein, 29 aa, Cryptosporidium hominis
ALVFISLWLECFFLCFFYRSTKSSFEQFF

SEQ ID NO: 2134447 - protein, 20 aa, Cryptosporidium hominis
AMFFLNIIRIIFIIHFFTLI

SEQ ID NO: 2134448 - protein, 24 aa, Cryptosporidium hominis
ANFLLKHPFILLKAKRPNSLGTFI

SEQ ID NO: 2134449 - protein, 26 aa, Cryptosporidium hominis
AQFDDLLVRILLGAALMSFFFALIGD

SEQ ID NO: 2134450 - protein, 20 aa, Cryptosporidium hominis
ASKLLLFNYLKLNSTKTTLI

SEQ ID NO: 2134451 - protein, 28 aa, Cryptosporidium hominis
AYMVMAFLAIYWQSALFSLGLKSSHFWK

SEQ ID NO: 2134452 - protein, 27 aa, Cryptosporidium hominis
CDQFEFPWWFYSVIIVLVVLAIGIFYK

SEQ ID NO: 2134453 - protein, 18 aa, Cryptosporidium hominis
CFGSLFIILFAFICTSCC

SEQ ID NO: 2134454 - protein, 20 aa, Cryptosporidium hominis
CIFECFFEPLLYYKNKHNLP

SEQ ID NO: 2134455 - protein, 18 aa, Cryptosporidium hominis
CLDIFFYIFNWKSIPKIG

SEQ ID NO: 2134456 - protein, 25 aa, Cryptosporidium hominis
CPIWFEYFCLILWRLLPIFEQSIPV

SEQ ID NO: 2134457 - protein, 22 aa, Cryptosporidium hominis
CPWVILRFLFIDIWIGLLLFQI

SEQ ID NO: 2134458 - protein, 25 aa, Cryptosporidium hominis
CSFLSFLLVNYYITKWIWGSNLTSS

SEQ ID NO: 2134459 - protein, 18 aa, Cryptosporidium hominis
CSIGIFFLLFLTSNIIWF

SEQ ID NO: 2134460 - protein, 23 aa, Cryptosporidium hominis
CSQIPSYLWYLPSDKIFPFPITS

SEQ ID NO: 2134461 - protein, 29 aa, Cryptosporidium hominis
CVNRAVFFLHWWLITWPKIPFYANDFVLA

SEQ ID NO: 2134462 - protein, 36 aa, Cryptosporidium hominis
DALRPIWLKIRIVYIIFAILLFFIIGAVYPALFYQS

SEQ ID NO: 2134463 - protein, 17 aa, Cryptosporidium hominis
DFFFIILISTFLKEVSR

SEQ ID NO: 2134464 - protein, 24 aa, Cryptosporidium hominis
DFQDLLWHLIIYSIAPFIVYIYNR

SEQ ID NO: 2134465 - protein, 18 aa, Cryptosporidium hominis
DIILFWMPFYYLFKLCFL

SEQ ID NO: 2134466 - protein, 21 aa, Cryptosporidium hominis
DIIYFVRILLLLRGICAELNE

SEQ ID NO: 2134467 - protein, 17 aa, Cryptosporidium hominis
DIVFWLDIILDISNLFK

SEQ ID NO: 2134468 - protein, 21 aa, Cryptosporidium hominis
DIVHLGYFFTDGHLLICIGDT

SEQ ID NO: 2134469 - protein, 18 aa, Cryptosporidium hominis
DLLNYFFLVALISPFVVV

SEQ ID NO: 2134470 - protein, 17 aa, Cryptosporidium hominis
DNYYLLHQLFSQFFWAL

SEQ ID NO: 2134471 - protein, 18 aa, Cryptosporidium hominis
DQGWWLLALILNVVDLIS

SEQ ID NO: 2134472 - protein, 25 aa, Cryptosporidium hominis
DRIFPYLLTIIVFSASIELPPAPLN

SEQ ID NO: 2134473 - protein, 23 aa, Cryptosporidium hominis
DSKTPYIFIPLLKDINLKKDKSS

SEQ ID NO: 2134474 - protein, 26 aa, Cryptosporidium hominis
DSTFPSLLIWIRFFHQTILKNQETKE

SEQ ID NO: 2134475 - protein, 19 aa, Cryptosporidium hominis
DSVYEIFKWIDSLALDENN

SEQ ID NO: 2134476 - protein, 21 aa, Cryptosporidium hominis
DTLFFIFYFQQGTFQQFLSIQ

SEQ ID NO: 2134477 - protein, 19 aa, Cryptosporidium hominis
DVLKKMYLQLIKTLALLHK

SEQ ID NO: 2134478 - protein, 23 aa, Cryptosporidium hominis
DVWSIGVILFILLAGYPPFGGQT

SEQ ID NO: 2134479 - protein, 20 aa, Cryptosporidium hominis
DWVLAFFYRYMQWGFHVAGI

SEQ ID NO: 2134480 - protein, 25 aa, Cryptosporidium hominis
DYSIIRLIHFIFKRALRKFPSDEKL

SEQ ID NO: 2134481 - protein, 21 aa, Cryptosporidium hominis
DYVWITCSFLSFLLVNYYITK

SEQ ID NO: 2134482 - protein, 23 aa, Cryptosporidium hominis
DYYHWWFLCIDIVFSGISISQNS

SEQ ID NO: 2134483 - protein, 22 aa, Cryptosporidium hominis
ECENPEYLFPWGNDYLNSCLSF

SEQ ID NO: 2134484 - protein, 23 aa, Cryptosporidium hominis
ECNSFVDLLLLKRIYRFSQISLD

SEQ ID NO: 2134485 - protein, 23 aa, Cryptosporidium hominis
EDLLLQLDPLVFVKTAIPPTASS

SEQ ID NO: 2134486 - protein, 23 aa, Cryptosporidium hominis
EDNSLLQVPPWANPLLLVAILIS

SEQ ID NO: 2134487 - protein, 28 aa, Cryptosporidium hominis
EEVGPALFWFITWGLILLCAAGAIVVLT

SEQ ID NO: 2134488 - protein, 25 aa, Cryptosporidium hominis
EFNNKYGKIILWKRNIDNINNEHNP

SEQ ID NO: 2134489 - protein, 19 aa, Cryptosporidium hominis
EGKKFALIYIILALIQLAV

SEQ ID NO: 2134490 - protein, 25 aa, Cryptosporidium hominis
EGMSIIYLYIYWHIQFRAKNERKTP

SEQ ID NO: 2134491 - protein, 22 aa, Cryptosporidium hominis
EHKSWYRFWEKKPKYVHKNIYG

SEQ ID NO: 2134492 - protein, 23 aa, Cryptosporidium hominis
EIDLYLQYFIFKRPYLSAFSLVF

SEQ ID NO: 2134493 - protein, 17 aa, Cryptosporidium hominis
EIFYPFIPQLFLMMGRE

SEQ ID NO: 2134494 - protein, 25 aa, Cryptosporidium hominis
EIKPLLIRWIIFVIRLHKFSGLSDE

SEQ ID NO: 2134495 - protein, 22 aa, Cryptosporidium hominis
EILDRNVLFSRLFWLDIAYSEI

SEQ ID NO: 2134496 - protein, 23 aa, Cryptosporidium hominis
EKLLAFFLLIMAVLILILCLSAI

SEQ ID NO: 2134497 - protein, 23 aa, Cryptosporidium hominis
EKYIVYLIFWVVVKFFESIKIVE

SEQ ID NO: 2134498 - protein, 24 aa, Cryptosporidium hominis
ELNKKLFPTFLRLSLSPVNFDISE

SEQ ID NO: 2134499 - protein, 19 aa, Cryptosporidium hominis
ELQPVLRLLKYWLHIRRLP

SEQ ID NO: 2134500 - protein, 23 aa, Cryptosporidium hominis
EMDHFIYFLHILIGWNKFVLKKF

SEQ ID NO: 2134501 - protein, 21 aa, Cryptosporidium hominis
EMIRMFWAMWMHTGFIHIGFN

SEQ ID NO: 2134502 - protein, 26 aa, Cryptosporidium hominis
EPDVFIYILLIIFYILSHITSTLLVR

SEQ ID NO: 2134503 - protein, 20 aa, Cryptosporidium hominis
EPIWRIFLSQFTSLVVSLLL

SEQ ID NO: 2134504 - protein, 18 aa, Cryptosporidium hominis
EQDKTLLFPIPPSKVYKF

SEQ ID NO: 2134505 - protein, 19 aa, Cryptosporidium hominis
EQFAKFFWHLLNSIREKYY

SEQ ID NO: 2134506 - protein, 23 aa, Cryptosporidium hominis
EQILKYYVTFSSNSFLYILMEYA

SEQ ID NO: 2134507 - protein, 30 aa, Cryptosporidium hominis
ERDLNIFYIVWKLLLYITLGVSIMLCIIQN

SEQ ID NO: 2134508 - protein, 28 aa, Cryptosporidium hominis
ERERNILRYFYLKLFLFVYKLSIGLANK

SEQ ID NO: 2134509 - protein, 21 aa, Cryptosporidium hominis
ERNLRYFLLNYIVIILGMTML

SEQ ID NO: 2134510 - protein, 18 aa, Cryptosporidium hominis
ESAKKFLKLLYIQKLWGS

SEQ ID NO: 2134511 - protein, 24 aa, Cryptosporidium hominis
ESTRFLFWIIRHFDLNYLSPAIAF

SEQ ID NO: 2134512 - protein, 17 aa, Cryptosporidium hominis
ETQMFCFLPLFILSHNI

SEQ ID NO: 2134513 - protein, 17 aa, Cryptosporidium hominis
EVWLLLSLWKRYPARIY

SEQ ID NO: 2134514 - protein, 25 aa, Cryptosporidium hominis
EWNYKVLFLFLRILGLTLFVEHLLI

SEQ ID NO: 2134515 - protein, 19 aa, Cryptosporidium hominis
FATVYWPCISLSVPPTLLG

SEQ ID NO: 2134516 - protein, 18 aa, Cryptosporidium hominis
FAWLVYILMAIKRYLSTK

SEQ ID NO: 2134517 - protein, 18 aa, Cryptosporidium hominis
FCFTFLVLFYLRIYLYLY

SEQ ID NO: 2134518 - protein, 19 aa, Cryptosporidium hominis
FDFFVYSILLYNVNFKLFI

SEQ ID NO: 2134519 - protein, 19 aa, Cryptosporidium hominis
FDSNFWLFLKRVCTRILEC

SEQ ID NO: 2134520 - protein, 24 aa, Cryptosporidium hominis
FEKLQPFIFILYNDVSWRIRSNVS

SEQ ID NO: 2134521 - protein, 19 aa, Cryptosporidium hominis
FFHYMCAYLFILTVISFLC

SEQ ID NO: 2134522 - protein, 18 aa, Cryptosporidium hominis
FFVKYLLEYILINQALNI

SEQ ID NO: 2134523 - protein, 19 aa, Cryptosporidium hominis
FFWGMIIILFFLTSTLPMS

SEQ ID NO: 2134524 - protein, 26 aa, Cryptosporidium hominis
FGFEILKVLFPWKWISWLPTISQLLL

SEQ ID NO: 2134525 - protein, 25 aa, Cryptosporidium hominis
FHIMGWIFCFFLDKTWFYFPYIGIC

SEQ ID NO: 2134526 - protein, 18 aa, Cryptosporidium hominis
FHSSLFPGLYLTGSRTSD

SEQ ID NO: 2134527 - protein, 24 aa, Cryptosporidium hominis
FIEPIVILFILILNAFVGVWQESN

SEQ ID NO: 2134528 - protein, 19 aa, Cryptosporidium hominis
FIFLIFLILVIYNFYRKRL

SEQ ID NO: 2134529 - protein, 18 aa, Cryptosporidium hominis
FIIALIISYLFCDIYAAE

SEQ ID NO: 2134530 - protein, 17 aa, Cryptosporidium hominis
FILICVVGFFLSMFGTF

SEQ ID NO: 2134531 - protein, 18 aa, Cryptosporidium hominis
FILLSYQLTHFLLFFIFI

SEQ ID NO: 2134532 - protein, 17 aa, Cryptosporidium hominis
FIMALIQFILLPCRIFV

SEQ ID NO: 2134533 - protein, 25 aa, Cryptosporidium hominis
FINNVKLIFHYILNPRLNTLKELYP

SEQ ID NO: 2134534 - protein, 19 aa, Cryptosporidium hominis
FINYLLIFFFILFDSVTLF

SEQ ID NO: 2134535 - protein, 18 aa, Cryptosporidium hominis
FISIILFYIDIFQSFSYV

SEQ ID NO: 2134536 - protein, 19 aa, Cryptosporidium hominis
FISRIIFAIWITTTLSLNF

SEQ ID NO: 2134537 - protein, 18 aa, Cryptosporidium hominis
FIWSVWLFTISFLFIFML

SEQ ID NO: 2134538 - protein, 26 aa, Cryptosporidium hominis
FKEPIGEPLLWNYIIQIVLALVHIHS

SEQ ID NO: 2134539 - protein, 23 aa, Cryptosporidium hominis
FKIFIWLCMYAHDPHIYNGVLAY

SEQ ID NO: 2134540 - protein, 31 aa, Cryptosporidium hominis
FKKISVIFLFIIVILLFLNLELLYASDTKEN

SEQ ID NO: 2134541 - protein, 31 aa, Cryptosporidium hominis
FLGAYTIFGSLLTALLLLSIATFHERQYAEK

SEQ ID NO: 2134542 - protein, 29 aa, Cryptosporidium hominis
FLILKLGHLLLFLLILKLLVYIYTKWTKT

SEQ ID NO: 2134543 - protein, 24 aa, Cryptosporidium hominis
FLISFLVFIPFLIVILIKRLNNHS

SEQ ID NO: 2134544 - protein, 17 aa, Cryptosporidium hominis
FLKLLYIQKLWGSNVSK

SEQ ID NO: 2134545 - protein, 20 aa, Cryptosporidium hominis
FLLVGSGLYIHYFFRRNKRL

SEQ ID NO: 2134546 - protein, 17 aa, Cryptosporidium hominis
FLQYPCKILPLNFADIK

SEQ ID NO: 2134547 - protein, 24 aa, Cryptosporidium hominis
FLSQLNPLCLLLFALEITKLSGSR

SEQ ID NO: 2134548 - protein, 20 aa, Cryptosporidium hominis
FLVIFGFIQFLKFKGPKAAT

SEQ ID NO: 2134549 - protein, 18 aa, Cryptosporidium hominis
FLWIVLLKLAQNGMLATD

SEQ ID NO: 2134550 - protein, 25 aa, Cryptosporidium hominis
FMIVRYLLYSLIFTIITFITLFKNN

SEQ ID NO: 2134551 - protein, 44 aa, Cryptosporidium hominis
FMLSKSFLFKILLLVLNLIPVTLLTLGFYLIIAEIWTIISSKIL

SEQ ID NO: 2134552 - protein, 25 aa, Cryptosporidium hominis
FPVLYPILTFFIFSLTVFYLVETGP

SEQ ID NO: 2134553 - protein, 20 aa, Cryptosporidium hominis
FQFFVLYIFIQFTSVLYLYS

SEQ ID NO: 2134554 - protein, 30 aa, Cryptosporidium hominis
FQLFNLIHFFFFLKVIWVAGQLYFLFGITG

SEQ ID NO: 2134555 - protein, 20 aa, Cryptosporidium hominis
FRPQIMPIILKWSKGESFAS

SEQ ID NO: 2134556 - protein, 18 aa, Cryptosporidium hominis
FSFFFFHLWLVFNSMTTI

SEQ ID NO: 2134557 - protein, 23 aa, Cryptosporidium hominis
FSGIPLFMIFVQSNSLILSSRSY

SEQ ID NO: 2134558 - protein, 27 aa, Cryptosporidium hominis
FSIFTYSVFILFILLTILSLNTLFENK

SEQ ID NO: 2134559 - protein, 25 aa, Cryptosporidium hominis
FSIYIIFYLIFFYIQVVYSLHSNLS

SEQ ID NO: 2134560 - protein, 20 aa, Cryptosporidium hominis
FSNFFNFFYLIVALLQLIPE

SEQ ID NO: 2134561 - protein, 25 aa, Cryptosporidium hominis
FTDFQVYSFLLFLAMLLSSINIIGG

SEQ ID NO: 2134562 - protein, 23 aa, Cryptosporidium hominis
FTDPIFSTFFKFGSPLFRVKNIP

SEQ ID NO: 2134563 - protein, 17 aa, Cryptosporidium hominis
FTIIYSLMWFVRLYFTV

SEQ ID NO: 2134564 - protein, 36 aa, Cryptosporidium hominis
FTSNRLFYVVFTILIGFIFIIGILGAFFYLGKSQGW

SEQ ID NO: 2134565 - protein, 17 aa, Cryptosporidium hominis
FVILQIYIKFEFAGANS

SEQ ID NO: 2134566 - protein, 24 aa, Cryptosporidium hominis
FVSIYLMFLMRNFWDQVLLNTDKS

SEQ ID NO: 2134567 - protein, 17 aa, Cryptosporidium hominis
FVVSVLFILLVVIIIYI

SEQ ID NO: 2134568 - protein, 17 aa, Cryptosporidium hominis
FWHLLNSIREKYYPEKS

SEQ ID NO: 2134569 - protein, 27 aa, Cryptosporidium hominis
FYGHLYFIFALLLIGISFYFALDRLNK

SEQ ID NO: 2134570 - protein, 17 aa, Cryptosporidium hominis
FYGYSLLSLSAIILFSG

SEQ ID NO: 2134571 - protein, 17 aa, Cryptosporidium hominis
FYIFNWKSIPKIGMAIE

SEQ ID NO: 2134572 - protein, 26 aa, Cryptosporidium hominis
FYVSRYLYLVVSLLDLPYFVDSFSLF

SEQ ID NO: 2134573 - protein, 17 aa, Cryptosporidium hominis
GFDTLWYVSFARFMLLL

SEQ ID NO: 2134574 - protein, 20 aa, Cryptosporidium hominis
GFWILSSMFFICFSLVYGTK

SEQ ID NO: 2134575 - protein, 22 aa, Cryptosporidium hominis
GGYYYYYNFYPPPPPMQPEPFP

SEQ ID NO: 2134576 - protein, 25 aa, Cryptosporidium hominis
GIIFTILILSLLISAPILGLLAVAI

SEQ ID NO: 2134577 - protein, 21 aa, Cryptosporidium hominis
GIKSFYIGSFLRALWLTIGGI

SEQ ID NO: 2134578 - protein, 24 aa, Cryptosporidium hominis
GISIPLFLLYFGLALQKIPLTPNY

SEQ ID NO: 2134579 - protein, 24 aa, Cryptosporidium hominis
GIYFDPLWFIDLPFMYNNAWWDSY

SEQ ID NO: 2134580 - protein, 20 aa, Cryptosporidium hominis
GLAVVGALLYYLFRSDSSEN

SEQ ID NO: 2134581 - protein, 20 aa, Cryptosporidium hominis
GLPCIVWLLLAIVHCSVNGN

SEQ ID NO: 2134582 - protein, 25 aa, Cryptosporidium hominis
GPFDLKHGLRRFYKKHFRKSNSLPI

SEQ ID NO: 2134583 - protein, 24 aa, Cryptosporidium hominis
GSKLFFELLFQLYNFLYTSIPPII

SEQ ID NO: 2134584 - protein, 25 aa, Cryptosporidium hominis
GSVRSQWDFLLQEMTWMSKDYYEER

SEQ ID NO: 2134585 - protein, 20 aa, Cryptosporidium hominis
GSYILHMMFILIGSLDYYNL

SEQ ID NO: 2134586 - protein, 21 aa, Cryptosporidium hominis
HAIFLILIINSAFFTINEVHP

SEQ ID NO: 2134587 - protein, 29 aa, Cryptosporidium hominis
HARIVLVIALFIIIFMLKQGMFGDWTRFG

SEQ ID NO: 2134588 - protein, 17 aa, Cryptosporidium hominis
HCILILTLFINFKVSGD

SEQ ID NO: 2134589 - protein, 18 aa, Cryptosporidium hominis
HFFLQVVILLSINGSSLG

SEQ ID NO: 2134590 - protein, 20 aa, Cryptosporidium hominis
HLFKIPMNYLPYIPKDTGEN

SEQ ID NO: 2134591 - protein, 22 aa, Cryptosporidium hominis
HNWRPIFITSLILSDKLWDDSC

SEQ ID NO: 2134592 - protein, 28 aa, Cryptosporidium hominis
HSCLIFGLVRLLWNIVFILYGATSLVNI

SEQ ID NO: 2134593 - protein, 23 aa, Cryptosporidium hominis
HSRKLFYQVYRPSILIFGIFLYL

SEQ ID NO: 2134594 - protein, 19 aa, Cryptosporidium hominis
ICAFLFFLSILCFPHIFHI

SEQ ID NO: 2134595 - protein, 22 aa, Cryptosporidium hominis
ICFLWLTILIELFWFNKECRKN

SEQ ID NO: 2134596 - protein, 17 aa, Cryptosporidium hominis
IDILIELAWIPSTFRNL

SEQ ID NO: 2134597 - protein, 21 aa, Cryptosporidium hominis
IDKFLLLFEMLGIILSIPDSS

SEQ ID NO: 2134598 - protein, 21 aa, Cryptosporidium hominis
IDLIFQLLFGFSKHSFGASGV

SEQ ID NO: 2134599 - protein, 20 aa, Cryptosporidium hominis
IEAFYKWIQVLYYKVLNNNI

SEQ ID NO: 2134600 - protein, 18 aa, Cryptosporidium hominis
IERFWLLNPFHFSINISN

SEQ ID NO: 2134601 - protein, 17 aa, Cryptosporidium hominis
IESYLMIFLLILPPIMV

SEQ ID NO: 2134602 - protein, 19 aa, Cryptosporidium hominis
IFCIFIYLFGKVEASLTDI

SEQ ID NO: 2134603 - protein, 17 aa, Cryptosporidium hominis
IFDLSIIKNILIDYPTY

SEQ ID NO: 2134604 - protein, 20 aa, Cryptosporidium hominis
IFFLVFAISALNVNSQELIL

SEQ ID NO: 2134605 - protein, 18 aa, Cryptosporidium hominis
IFGLTFILILVFILSYYS

SEQ ID NO: 2134606 - protein, 19 aa, Cryptosporidium hominis
IFIFVIPCLSLIIVANSLP

SEQ ID NO: 2134607 - protein, 20 aa, Cryptosporidium hominis
IFIGIFIWILIKSKFHRDKV

SEQ ID NO: 2134608 - protein, 20 aa, Cryptosporidium hominis
IFINSVVSGLYLMLWRFLEQ

SEQ ID NO: 2134609 - protein, 21 aa, Cryptosporidium hominis
IFLFFNILNLLNGEEIDSKSF

SEQ ID NO: 2134610 - protein, 24 aa, Cryptosporidium hominis
IFLFLFVLRFYFWVRGRFSFNVGS

SEQ ID NO: 2134611 - protein, 17 aa, Cryptosporidium hominis
IFLICVYTLNLNVAEGF

SEQ ID NO: 2134612 - protein, 17 aa, Cryptosporidium hominis
IFLLIVFLANYKENGIF

SEQ ID NO: 2134613 - protein, 18 aa, Cryptosporidium hominis
IFLSIIILFISCSTQLEL

SEQ ID NO: 2134614 - protein, 19 aa, Cryptosporidium hominis
IFSWWYRFILSTPSRVFNT

SEQ ID NO: 2134615 - protein, 18 aa, Cryptosporidium hominis
IGGWLPPPVAIPCPSHAP

SEQ ID NO: 2134616 - protein, 20 aa, Cryptosporidium hominis
IGILLITIFILFVRLFSTFI

SEQ ID NO: 2134617 - protein, 23 aa, Cryptosporidium hominis
IGYLNFLIFFKWLTPIEGYNKPS

SEQ ID NO: 2134618 - protein, 17 aa, Cryptosporidium hominis
IHYIITSLLDYIPLLIM

SEQ ID NO: 2134619 - protein, 20 aa, Cryptosporidium hominis
IIAVYYFKHPWFLKSWKFVN

SEQ ID NO: 2134620 - protein, 24 aa, Cryptosporidium hominis
IIFTYLYVFLFMFPILCLDAKREA

SEQ ID NO: 2134621 - protein, 18 aa, Cryptosporidium hominis
IIIVFITLYIIFGIIFVI

SEQ ID NO: 2134622 - protein, 22 aa, Cryptosporidium hominis
IIKYILPFYSFQMFLKDIYLHL

SEQ ID NO: 2134623 - protein, 18 aa, Cryptosporidium hominis
IILFVIPLAFIIYYRRQK

SEQ ID NO: 2134624 - protein, 22 aa, Cryptosporidium hominis
IISLIYLFTILFLISEYDYIWF

SEQ ID NO: 2134625 - protein, 31 aa, Cryptosporidium hominis
IISSLLLLGLYWAFIFFFIFLKTGQLTNIST

SEQ ID NO: 2134626 - protein, 31 aa, Cryptosporidium hominis
IITFIWKPLYYLLTFFTFNFILKALIPASII

SEQ ID NO: 2134627 - protein, 17 aa, Cryptosporidium hominis
IIVIFLPLYFRIRTRRR

SEQ ID NO: 2134628 - protein, 20 aa, Cryptosporidium hominis
IIVILLMLSIIFYLAVTTKN

SEQ ID NO: 2134629 - protein, 18 aa, Cryptosporidium hominis
IIVTSLFFLSFGLALLIS

SEQ ID NO: 2134630 - protein, 26 aa, Cryptosporidium hominis
IKTYLFWALFIYFSISSSLLVYMMLK

SEQ ID NO: 2134631 - protein, 20 aa, Cryptosporidium hominis
ILFLFVCCIIFRILGDHSEI

SEQ ID NO: 2134632 - protein, 22 aa, Cryptosporidium hominis
ILFSFLIIFHKFFRKLNFSEKN

SEQ ID NO: 2134633 - protein, 19 aa, Cryptosporidium hominis
ILIRYFWLAKLIKINKRKY

SEQ ID NO: 2134634 - protein, 28 aa, Cryptosporidium hominis
ILLLLLILLVFLLILFSGGITIGQMAPP

SEQ ID NO: 2134635 - protein, 25 aa, Cryptosporidium hominis
ILLTSIIYILLWAIISYLKVFYIKN

SEQ ID NO: 2134636 - protein, 17 aa, Cryptosporidium hominis
ILNPPFFLFQRPTLDGF

SEQ ID NO: 2134637 - protein, 17 aa, Cryptosporidium hominis
ILPPIRIYELWKGTPMD

SEQ ID NO: 2134638 - protein, 18 aa, Cryptosporidium hominis
ILPPLMALVPRAFRYRQG

SEQ ID NO: 2134639 - protein, 18 aa, Cryptosporidium hominis
ILTIPIYFLLLGDQERAT

SEQ ID NO: 2134640 - protein, 25 aa, Cryptosporidium hominis
IPIGFLFLLFIYWNYLSYFINTCRT

SEQ ID NO: 2134641 - protein, 17 aa, Cryptosporidium hominis
IPLQLIAYYLAIKRGIN

SEQ ID NO: 2134642 - protein, 17 aa, Cryptosporidium hominis
IPNPLLFLRCLCGWLLI

SEQ ID NO: 2134643 - protein, 24 aa, Cryptosporidium hominis
IQILPVLLMLFLAIMGNFMPTLFP

SEQ ID NO: 2134644 - protein, 25 aa, Cryptosporidium hominis
IRILNLFFILLLVIPFIYITTSGAC

SEQ ID NO: 2134645 - protein, 18 aa, Cryptosporidium hominis
IRKLNILPPIRIYELWKG

SEQ ID NO: 2134646 - protein, 21 aa, Cryptosporidium hominis
IRLIFNIIIVFITLYIIFGII

SEQ ID NO: 2134647 - protein, 17 aa, Cryptosporidium hominis
ISFILFYSEIESLDTQI

SEQ ID NO: 2134648 - protein, 17 aa, Cryptosporidium hominis
ISFRDPLYGFPDKQFIL

SEQ ID NO: 2134649 - protein, 22 aa, Cryptosporidium hominis
ISLLILYFLIFLGNVKSSSTVT

SEQ ID NO: 2134650 - protein, 23 aa, Cryptosporidium hominis
ISTCIFIFFILYIVLNALSRNRE

SEQ ID NO: 2134651 - protein, 21 aa, Cryptosporidium hominis
ITLLPIIFFLIQSIHFHITQV

SEQ ID NO: 2134652 - protein, 22 aa, Cryptosporidium hominis
ITPQFLFFIPPIFYAFYCVAKK

SEQ ID NO: 2134653 - protein, 20 aa, Cryptosporidium hominis
IVHWIIIFLCILHMAIFLAI

SEQ ID NO: 2134654 - protein, 18 aa, Cryptosporidium hominis
IVILLYLPLLFGKTRFNL

SEQ ID NO: 2134655 - protein, 19 aa, Cryptosporidium hominis
IVLIGLIIFFITKSRSNNS

SEQ ID NO: 2134656 - protein, 21 aa, Cryptosporidium hominis
IVSLYIIFWTVLLPVFYGIYG

SEQ ID NO: 2134657 - protein, 18 aa, Cryptosporidium hominis
IYERPWYFILGSVLLTLI

SEQ ID NO: 2134658 - protein, 28 aa, Cryptosporidium hominis
IYIPSAVRYIILLLLWTIFTKNVYSESS

SEQ ID NO: 2134659 - protein, 23 aa, Cryptosporidium hominis
IYIYVYFFFFFFACALQRFVILL

SEQ ID NO: 2134660 - protein, 28 aa, Cryptosporidium hominis
IYKFKWVLIYLILFIFSVYIQLNCVGCY

SEQ ID NO: 2134661 - protein, 18 aa, Cryptosporidium hominis
IYNFVFIFSIIISTIYLL

SEQ ID NO: 2134662 - protein, 18 aa, Cryptosporidium hominis
IYPKFLNFSLLKSSLFDY

SEQ ID NO: 2134663 - protein, 17 aa, Cryptosporidium hominis
IYQLPLALIFYSFAIYL

SEQ ID NO: 2134664 - protein, 17 aa, Cryptosporidium hominis
IYSLMWFVRLYFTVNMK

SEQ ID NO: 2134665 - protein, 21 aa, Cryptosporidium hominis
IYYTWFMFGFYWILSVRPNVE

SEQ ID NO: 2134666 - protein, 28 aa, Cryptosporidium hominis
KANSFFFFSWIFMVILPLLISLTYRFGS

SEQ ID NO: 2134667 - protein, 23 aa, Cryptosporidium hominis
KCHNLVLALLYYRYLQLGVILEN

SEQ ID NO: 2134668 - protein, 24 aa, Cryptosporidium hominis
KENIPFKHILLPFTTTTTTVTTTT

SEQ ID NO: 2134669 - protein, 28 aa, Cryptosporidium hominis
KEYYLLFDFVIFLFYIINAYKSAVEKLD

SEQ ID NO: 2134670 - protein, 26 aa, Cryptosporidium hominis
KFCFLYILYFFTFYFSMVVTISLRNS

SEQ ID NO: 2134671 - protein, 21 aa, Cryptosporidium hominis
KFHLNICNLPRPAFSRPVLRR

SEQ ID NO: 2134672 - protein, 18 aa, Cryptosporidium hominis
KFILFLLGILLVSIINII

SEQ ID NO: 2134673 - protein, 22 aa, Cryptosporidium hominis
KHFLLFLAYVFLFCAYSLILIC

SEQ ID NO: 2134674 - protein, 21 aa, Cryptosporidium hominis
KHIFYFLSFFFFVLSIFLFER

SEQ ID NO: 2134675 - protein, 22 aa, Cryptosporidium hominis
KHLVFLMWIVLSLIFTLYSKWL

SEQ ID NO: 2134676 - protein, 18 aa, Cryptosporidium hominis
KHRMLFVSFLVLGLALVT

SEQ ID NO: 2134677 - protein, 18 aa, Cryptosporidium hominis
KIGQFFYGKRLYSLLSGN

SEQ ID NO: 2134678 - protein, 21 aa, Cryptosporidium hominis
KIIVIIIWLGFLGVSIYGFTK

SEQ ID NO: 2134679 - protein, 21 aa, Cryptosporidium hominis
KILPRFYRYLGLYYSLICISR

SEQ ID NO: 2134680 - protein, 19 aa, Cryptosporidium hominis
KISFIIIIWCPLIIVNYSN

SEQ ID NO: 2134681 - protein, 19 aa, Cryptosporidium hominis
KKHFRKSNSLPIFSNYHIL

SEQ ID NO: 2134682 - protein, 25 aa, Cryptosporidium hominis
KKILKFNIYIYRIYTDKYKRKIIKR

SEQ ID NO: 2134683 - protein, 32 aa, Cryptosporidium hominis
KKKSHWGVFWYILPIILILFSSGAGFAYYYYL

SEQ ID NO: 2134684 - protein, 26 aa, Cryptosporidium hominis
KKLTILIHVFIIYFLVIYNNEWNSLD

SEQ ID NO: 2134685 - protein, 26 aa, Cryptosporidium hominis
KKPYNSVFLLITLFLLIVTRNSECVR

SEQ ID NO: 2134686 - protein, 25 aa, Cryptosporidium hominis
KKSSLFIILLMLIMAIFQVCNYSGF

SEQ ID NO: 2134687 - protein, 19 aa, Cryptosporidium hominis
KLCKVWLLSPFNALDVLLT

SEQ ID NO: 2134688 - protein, 27 aa, Cryptosporidium hominis
KLGLNIQLFWFLRLNSLKFDFVSDNNS

SEQ ID NO: 2134689 - protein, 33 aa, Cryptosporidium hominis
KLIIGVVIGILLILLILMFCCVFFLRRRSDDTE

SEQ ID NO: 2134690 - protein, 19 aa, Cryptosporidium hominis
KLIRIIFSIFTYSVFILFI

SEQ ID NO: 2134691 - protein, 19 aa, Cryptosporidium hominis
KLKGIIFDLSIIKNILIDY

SEQ ID NO: 2134692 - protein, 22 aa, Cryptosporidium hominis
KLTLFKLLIFVSLLVAIYVLIT

SEQ ID NO: 2134693 - protein, 19 aa, Cryptosporidium hominis
KMYFLSILVLFSWISIVIG

SEQ ID NO: 2134694 - protein, 23 aa, Cryptosporidium hominis
KNEKEWFLYWSSIFGKLCGKEPI

SEQ ID NO: 2134695 - protein, 17 aa, Cryptosporidium hominis
KNFYLNGLLDYVLLRTS

SEQ ID NO: 2134696 - protein, 31 aa, Cryptosporidium hominis
KPKSFLEKVLFWSIIIFCIVFTVVLLLIWFA

SEQ ID NO: 2134697 - protein, 27 aa, Cryptosporidium hominis
KQGFYMKIFSGLKLLFWNLDKIGDIFG

SEQ ID NO: 2134698 - protein, 22 aa, Cryptosporidium hominis
KRILYFILIHILIFNILEINSL

SEQ ID NO: 2134699 - protein, 25 aa, Cryptosporidium hominis
KSGFIFFQWYFWYCLESRRYPSKDF

SEQ ID NO: 2134700 - protein, 22 aa, Cryptosporidium hominis
KSGYKFEYLWYPPISQGKLIDS

SEQ ID NO: 2134701 - protein, 17 aa, Cryptosporidium hominis
KSILGYSILISVFLFIV

SEQ ID NO: 2134702 - protein, 21 aa, Cryptosporidium hominis
KSMLILLVRLIQFTFKNIYLP

SEQ ID NO: 2134703 - protein, 20 aa, Cryptosporidium hominis
KTFFCWVWKSLYQGTVIMLG

SEQ ID NO: 2134704 - protein, 20 aa, Cryptosporidium hominis
KTLLFPIPPSKVYKFREKGY

SEQ ID NO: 2134705 - protein, 30 aa, Cryptosporidium hominis
KTQKKMLWIILCIFILILVVLLPMIIGFTI

SEQ ID NO: 2134706 - protein, 27 aa, Cryptosporidium hominis
KVFTFFNFVWKIILFFIIWKSRNDFIK

SEQ ID NO: 2134707 - protein, 24 aa, Cryptosporidium hominis
KVLIRFHLFIVLSIWNLYLKELQG

SEQ ID NO: 2134708 - protein, 25 aa, Cryptosporidium hominis
KVSIQELFGFVLSVLHLGGFNVSSF

SEQ ID NO: 2134709 - protein, 19 aa, Cryptosporidium hominis
KVYPYLACKILGLLNQEKK

SEQ ID NO: 2134710 - protein, 24 aa, Cryptosporidium hominis
KWKIMVLIIHLFYILNKDLGILIM

SEQ ID NO: 2134711 - protein, 21 aa, Cryptosporidium hominis
KYMYWIWRRWRYLLSAKERMP

SEQ ID NO: 2134712 - protein, 18 aa, Cryptosporidium hominis
KYTFVIFSLFLSNSNLTE

SEQ ID NO: 2134713 - protein, 31 aa, Cryptosporidium hominis
KYVLEPIRYIIYIIFYFIWGIELTPKKEFDN

SEQ ID NO: 2134714 - protein, 18 aa, Cryptosporidium hominis
LAPWTLPIFLIMMGLILF

SEQ ID NO: 2134715 - protein, 20 aa, Cryptosporidium hominis
LCFLSLIILFVIPLAFIIYY

SEQ ID NO: 2134716 - protein, 22 aa, Cryptosporidium hominis
LCKKYLYFRKYGPIKLLNTSAM

SEQ ID NO: 2134717 - protein, 21 aa, Cryptosporidium hominis
LDCFYFIFIVFIFETISDTGF

SEQ ID NO: 2134718 - protein, 24 aa, Cryptosporidium hominis
LDYIGLILYYFINNVKLIFHYILN

SEQ ID NO: 2134719 - protein, 18 aa, Cryptosporidium hominis
LEKNWIIDFLLLKRLLYH

SEQ ID NO: 2134720 - protein, 24 aa, Cryptosporidium hominis
LEMILYLVLLLLHQFILLFGEKVL

SEQ ID NO: 2134721 - protein, 21 aa, Cryptosporidium hominis
LFCGIWLLFHSWSISLLKGVQ

SEQ ID NO: 2134722 - protein, 18 aa, Cryptosporidium hominis
LFIQKWVIILIGIIVIFL

SEQ ID NO: 2134723 - protein, 18 aa, Cryptosporidium hominis
LFQYIYVTILLGISLIFV

SEQ ID NO: 2134724 - protein, 25 aa, Cryptosporidium hominis
LGKHDFVFKLFYKKGYYYLDSSFTS

SEQ ID NO: 2134725 - protein, 18 aa, Cryptosporidium hominis
LGTLLQLLPIWAPAFVQS

SEQ ID NO: 2134726 - protein, 19 aa, Cryptosporidium hominis
LGYFYTWIILFAAAQLFWV

SEQ ID NO: 2134727 - protein, 22 aa, Cryptosporidium hominis
LHIFIFVGIGIIILLISSIILI

SEQ ID NO: 2134728 - protein, 17 aa, Cryptosporidium hominis
LHKYEVPLIFACETKKL

SEQ ID NO: 2134729 - protein, 24 aa, Cryptosporidium hominis
LHSLFALSIIWYLSFNPKYIFSFV

SEQ ID NO: 2134730 - protein, 20 aa, Cryptosporidium hominis
LIFVYLFVILQIYIKFEFAG

SEQ ID NO: 2134731 - protein, 17 aa, Cryptosporidium hominis
LIFYLINGTLIYIFTRK

SEQ ID NO: 2134732 - protein, 24 aa, Cryptosporidium hominis
LIIITFLLLLPIVQLLFTYSQTLT

SEQ ID NO: 2134733 - protein, 24 aa, Cryptosporidium hominis
LIIKNIIFFIYWKIIKQISIYFST

SEQ ID NO: 2134734 - protein, 23 aa, Cryptosporidium hominis
LIKFVLRIFIILSLTILPLINEI

SEQ ID NO: 2134735 - protein, 25 aa, Cryptosporidium hominis
LINKCPFLALLLLYISSHKRHLKER

SEQ ID NO: 2134736 - protein, 20 aa, Cryptosporidium hominis
LIQFILLPCRIFVASLLMYR

SEQ ID NO: 2134737 - protein, 18 aa, Cryptosporidium hominis
LIVELILIDILFSKFLKK

SEQ ID NO: 2134738 - protein, 22 aa, Cryptosporidium hominis
LIVFIIFYLFIGTSLNLPAALA

SEQ ID NO: 2134739 - protein, 28 aa, Cryptosporidium hominis
LKEWFIYLFNALYDFIIYQLPLALIFYS

SEQ ID NO: 2134740 - protein, 21 aa, Cryptosporidium hominis
LKINFLPFIFRNIASYIVMNS

SEQ ID NO: 2134741 - protein, 24 aa, Cryptosporidium hominis
LKNNLTQQFPFNGSLLLNGKVANI

SEQ ID NO: 2134742 - protein, 21 aa, Cryptosporidium hominis
LKPIPLIVILFSCLKYLIVNC

SEQ ID NO: 2134743 - protein, 20 aa, Cryptosporidium hominis
LKTVFLFRILRYWNNDITSS

SEQ ID NO: 2134744 - protein, 18 aa, Cryptosporidium hominis
LKYVIGMLLGVFFGIWIL

SEQ ID NO: 2134745 - protein, 25 aa, Cryptosporidium hominis
LLCIILICFFLYPSWSLYVHIKING

SEQ ID NO: 2134746 - protein, 24 aa, Cryptosporidium hominis
LLESKAWWICGIPLSVYSLLAEIS

SEQ ID NO: 2134747 - protein, 18 aa, Cryptosporidium hominis
LLFLRCLCGWLLIQSIIK

SEQ ID NO: 2134748 - protein, 19 aa, Cryptosporidium hominis
LLILFLMIFLIIEIGIGIY

SEQ ID NO: 2134749 - protein, 30 aa, Cryptosporidium hominis
LLPARLLITYILFWYSIPFLVFANNYNLGK

SEQ ID NO: 2134750 - protein, 20 aa, Cryptosporidium hominis
LLPRVIFIFVIPCLSLIIVA

SEQ ID NO: 2134751 - protein, 17 aa, Cryptosporidium hominis
LLRFQPLAIKAFLGRLV

SEQ ID NO: 2134752 - protein, 17 aa, Cryptosporidium hominis
LLRPTILQRLIWFVASQ

SEQ ID NO: 2134753 - protein, 17 aa, Cryptosporidium hominis
LLSLWKRYPARIYRHMM

SEQ ID NO: 2134754 - protein, 24 aa, Cryptosporidium hominis
LLSRALYILFLLKLVMLIGFGSYY

SEQ ID NO: 2134755 - protein, 17 aa, Cryptosporidium hominis
LMIIFAIILLLIKMMRY

SEQ ID NO: 2134756 - protein, 18 aa, Cryptosporidium hominis
LMLWRFLEQQFESVLSVL

SEQ ID NO: 2134757 - protein, 25 aa, Cryptosporidium hominis
LNHIMLWFGLIIFWAITQIYGKSPV

SEQ ID NO: 2134758 - protein, 21 aa, Cryptosporidium hominis
LNKILFWFILISIFAFCISVA

SEQ ID NO: 2134759 - protein, 26 aa, Cryptosporidium hominis
LNNYYWKLLLFIIIRRHSLLFFIIIK

SEQ ID NO: 2134760 - protein, 17 aa, Cryptosporidium hominis
LNYLNLFHSVFPYYRGE

SEQ ID NO: 2134761 - protein, 18 aa, Cryptosporidium hominis
LPFLCFPLSIFIMNNVIK

SEQ ID NO: 2134762 - protein, 19 aa, Cryptosporidium hominis
LPIFLIMMGLILFKIFLPM

SEQ ID NO: 2134763 - protein, 29 aa, Cryptosporidium hominis
LPVVLIIWDNFLLLGLPLLFQAGLSLLKL

SEQ ID NO: 2134764 - protein, 21 aa, Cryptosporidium hominis
LQIVWNLIIVILLMLSIIFYL

SEQ ID NO: 2134765 - protein, 17 aa, Cryptosporidium hominis
LQKISLIFYLFNKTREL

SEQ ID NO: 2134766 - protein, 28 aa, Cryptosporidium hominis
LQSIIKYLFFFIQIISLIYLFTILFLIS

SEQ ID NO: 2134767 - protein, 39 aa, Cryptosporidium hominis
LREKKLLWTFRILSGILLLFYFIIGWLGTFYPPLYWPNP

SEQ ID NO: 2134768 - protein, 19 aa, Cryptosporidium hominis
LRLISLMFSLFILGFIITS

SEQ ID NO: 2134769 - protein, 17 aa, Cryptosporidium hominis
LRLYLMHIPSILPSIYT

SEQ ID NO: 2134770 - protein, 28 aa, Cryptosporidium hominis
LSHGFFLPLVFLLFSILSRIFSVIINIK

SEQ ID NO: 2134771 - protein, 23 aa, Cryptosporidium hominis
LSIIYIFFSFIFEKIFVLSTHIS

SEQ ID NO: 2134772 - protein, 17 aa, Cryptosporidium hominis
LSLLFKIMYLIRILNSL

SEQ ID NO: 2134773 - protein, 23 aa, Cryptosporidium hominis
LSTTFFLRFFTWSFCWSALILYT

SEQ ID NO: 2134774 - protein, 19 aa, Cryptosporidium hominis
LTMPIIILLDRLASLWFGS

SEQ ID NO: 2134775 - protein, 18 aa, Cryptosporidium hominis
LVFLLHIVLYIFLKEEIL

SEQ ID NO: 2134776 - protein, 18 aa, Cryptosporidium hominis
LVIFYFVCYDLQKLDTVD

SEQ ID NO: 2134777 - protein, 17 aa, Cryptosporidium hominis
LVLFYLRIYLYLYEEKI

SEQ ID NO: 2134778 - protein, 22 aa, Cryptosporidium hominis
LVSFSIFYIWSLSCVYLLFGLT

SEQ ID NO: 2134779 - protein, 19 aa, Cryptosporidium hominis
LYEAEGLVFWLFRVHNLVT

SEQ ID NO: 2134780 - protein, 21 aa, Cryptosporidium hominis
LYFKKKIIPKMTILNLIEKSR

SEQ ID NO: 2134781 - protein, 27 aa, Cryptosporidium hominis
LYIILKFFVLFIFFVYLKTRHDLVKYD

SEQ ID NO: 2134782 - protein, 17 aa, Cryptosporidium hominis
LYLLGITKPFFSLKIFG

SEQ ID NO: 2134783 - protein, 24 aa, Cryptosporidium hominis
MAGIIFPFIFYYLEFIESFNLPHI

SEQ ID NO: 2134784 - protein, 24 aa, Cryptosporidium hominis
MEDISLILSLFVLAVDHLPAFLNR

SEQ ID NO: 2134785 - protein, 18 aa, Cryptosporidium hominis
MFCFLPLFILSHNIIKQY

SEQ ID NO: 2134786 - protein, 17 aa, Cryptosporidium hominis
MIIILFFLTSTLPMSII

SEQ ID NO: 2134787 - protein, 25 aa, Cryptosporidium hominis
MLCGILSICLLIIIVLLVVLSIRKN

SEQ ID NO: 2134788 - protein, 19 aa, Cryptosporidium hominis
MLESLYWFFNFYSFTETYQ

SEQ ID NO: 2134789 - protein, 24 aa, Cryptosporidium hominis
MLLISIPLLIQLLEAIFKFLTSEN

SEQ ID NO: 2134790 - protein, 28 aa, Cryptosporidium hominis
MLVKWGLVVLIFQLFFSLLINAGDLDLP

SEQ ID NO: 2134791 - protein, 20 aa, Cryptosporidium hominis
MMFAWLRLRLDFLLPVALTS

SEQ ID NO: 2134792 - protein, 18 aa, Cryptosporidium hominis
MNIPWMIFVLYLFIRHVK

SEQ ID NO: 2134793 - protein, 22 aa, Cryptosporidium hominis
MNKLLSFLLFLFDKGLKNHEIC

SEQ ID NO: 2134794 - protein, 17 aa, Cryptosporidium hominis
MPIILKWSKGESFASIL

SEQ ID NO: 2134795 - protein, 20 aa, Cryptosporidium hominis
MRLDFFDMLFKELMPSLAYH

SEQ ID NO: 2134796 - protein, 20 aa, Cryptosporidium hominis
MSHIAMILLLFNINLMEAFK

SEQ ID NO: 2134797 - protein, 21 aa, Cryptosporidium hominis
MSNFDYLKIFKIPLILFILSL

SEQ ID NO: 2134798 - protein, 18 aa, Cryptosporidium hominis
MSTKTFFCWVWKSLYQGT

SEQ ID NO: 2134799 - protein, 18 aa, Cryptosporidium hominis
MVLPYFQLLPIPSSEFKP

SEQ ID NO: 2134800 - protein, 20 aa, Cryptosporidium hominis
MYFLIVYLVFPILRRHFYAT

SEQ ID NO: 2134801 - protein, 23 aa, Cryptosporidium hominis
MYQDTFLFLMFLIGDIPLLMNFL

SEQ ID NO: 2134802 - protein, 17 aa, Cryptosporidium hominis
NDYLFYVNVLIKTLLKS

SEQ ID NO: 2134803 - protein, 17 aa, Cryptosporidium hominis
NFCKSFPLFFYPLSIIM

SEQ ID NO: 2134804 - protein, 24 aa, Cryptosporidium hominis
NFGKIWLWLVKLLNKKSPHRLFVF

SEQ ID NO: 2134805 - protein, 23 aa, Cryptosporidium hominis
NFNKYFLLVVTIIVYFNNLMFNN

SEQ ID NO: 2134806 - protein, 18 aa, Cryptosporidium hominis
NFNYIMLPSYYLWGNIYS

SEQ ID NO: 2134807 - protein, 20 aa, Cryptosporidium hominis
NGMQIYFHLINQIKLNYFQH

SEQ ID NO: 2134808 - protein, 24 aa, Cryptosporidium hominis
NHMKAYFNLTIWAFTIICLSQKLN

SEQ ID NO: 2134809 - protein, 23 aa, Cryptosporidium hominis
NIAIIWIFILRLFGQFSSISSNF

SEQ ID NO: 2134810 - protein, 23 aa, Cryptosporidium hominis
NIGFLFLSIILFELFIFLDKMHK

SEQ ID NO: 2134811 - protein, 30 aa, Cryptosporidium hominis
NIKAWFFWIVYSFLVFIIYFSADYLYIFKN

SEQ ID NO: 2134812 - protein, 19 aa, Cryptosporidium hominis
NIPVWLYPYRILPMMFKDI

SEQ ID NO: 2134813 - protein, 17 aa, Cryptosporidium hominis
NIQPYLAFIFFSTSTWL

SEQ ID NO: 2134814 - protein, 26 aa, Cryptosporidium hominis
NKKFTLFYFFFRWITYYVEMEIAANY

SEQ ID NO: 2134815 - protein, 23 aa, Cryptosporidium hominis
NKSAFYFVRFNLLLHLAAIVIQC

SEQ ID NO: 2134816 - protein, 23 aa, Cryptosporidium hominis
NKSLIFVYLLLSTVPFLSFKIIE

SEQ ID NO: 2134817 - protein, 17 aa, Cryptosporidium hominis
NKWLPFDKSLYPAFGVL

SEQ ID NO: 2134818 - protein, 18 aa, Cryptosporidium hominis
NLFHSVFPYYRGEVPKLT

SEQ ID NO: 2134819 - protein, 20 aa, Cryptosporidium hominis
NLFQKIFRFPKLLLSKDEVH

SEQ ID NO: 2134820 - protein, 18 aa, Cryptosporidium hominis
NLLLWIMGAAIPLEAWFV

SEQ ID NO: 2134821 - protein, 23 aa, Cryptosporidium hominis
NLPAPMFMFIFSLFSLIIGMILS

SEQ ID NO: 2134822 - protein, 28 aa, Cryptosporidium hominis
NLVLKTLLLLLLEYLIINFPGVSSIDEK

SEQ ID NO: 2134823 - protein, 23 aa, Cryptosporidium hominis
NMKLLSFFKLFSIISILSLIYEH

SEQ ID NO: 2134824 - protein, 24 aa, Cryptosporidium hominis
NNIFKLFLLIIPNLLFQFYCEWSG

SEQ ID NO: 2134825 - protein, 23 aa, Cryptosporidium hominis
NQTSVWLFLTASLLTSLLLYRNV

SEQ ID NO: 2134826 - protein, 18 aa, Cryptosporidium hominis
NRLTWIVIILLAIDCFFS

SEQ ID NO: 2134827 - protein, 31 aa, Cryptosporidium hominis
NRSLLFAYVLHLWLNLTIIWVWNLVYFFKKF

SEQ ID NO: 2134828 - protein, 23 aa, Cryptosporidium hominis
NSIFMWVILGFIVLLLTLICICG

SEQ ID NO: 2134829 - protein, 28 aa, Cryptosporidium hominis
NSQPTIIHWLIILLTALFSCYLFNGVDQ

SEQ ID NO: 2134830 - protein, 30 aa, Cryptosporidium hominis
NSSRQTLMWLFISIIIMLLIIFVGEYNNSV

SEQ ID NO: 2134831 - protein, 17 aa, Cryptosporidium hominis
NTIRGGYLLILQKILFA

SEQ ID NO: 2134832 - protein, 24 aa, Cryptosporidium hominis
NTRWYLPGYWWYEKVTFTSEVSLP

SEQ ID NO: 2134833 - protein, 19 aa, Cryptosporidium hominis
NVLFLKLIFLFSCSLCSIV

SEQ ID NO: 2134834 - protein, 20 aa, Cryptosporidium hominis
NVRLLFFIFIVVNAANNSDQ

SEQ ID NO: 2134835 - protein, 26 aa, Cryptosporidium hominis
NVRPILFLWIFFLISMVYTFSIFLDE

SEQ ID NO: 2134836 - protein, 23 aa, Cryptosporidium hominis
NVSIMICLYLNFIPSIYKIPGVP

SEQ ID NO: 2134837 - protein, 20 aa, Cryptosporidium hominis
NWNLIALSHNYFFGALYGRM

SEQ ID NO: 2134838 - protein, 19 aa, Cryptosporidium hominis
PAQETSWFTGWFGIGAESS

SEQ ID NO: 2134839 - protein, 24 aa, Cryptosporidium hominis
PCEQVHYWFLAYWAFRIGSGQILW

SEQ ID NO: 2134840 - protein, 21 aa, Cryptosporidium hominis
PFEKFPIPSWLYKLFSRLIEV

SEQ ID NO: 2134841 - protein, 17 aa, Cryptosporidium hominis
PFIFLGLFQSIFLCCSG

SEQ ID NO: 2134842 - protein, 24 aa, Cryptosporidium hominis
PFIRLIQIILFPLLKPISVILDKA

SEQ ID NO: 2134843 - protein, 22 aa, Cryptosporidium hominis
PFTYPFFILLLDVFTYIIIMCL

SEQ ID NO: 2134844 - protein, 20 aa, Cryptosporidium hominis
PIYMLFLPFMTIITYNCISI

SEQ ID NO: 2134845 - protein, 27 aa, Cryptosporidium hominis
PLILGMLILAILFWFRRYKWKKNFEDD

SEQ ID NO: 2134846 - protein, 24 aa, Cryptosporidium hominis
PRWIPKFFFLLNFRIPRSRFDMVM

SEQ ID NO: 2134847 - protein, 19 aa, Cryptosporidium hominis
PSLILFIRALNELNPQKNA

SEQ ID NO: 2134848 - protein, 19 aa, Cryptosporidium hominis
PYAVYYWFISILNLLVVFI

SEQ ID NO: 2134849 - protein, 18 aa, Cryptosporidium hominis
PYGFSILILLSLFKIIPI

SEQ ID NO: 2134850 - protein, 26 aa, Cryptosporidium hominis
PYQALLLQIFIFISPFLRSVQLSSNI

SEQ ID NO: 2134851 - protein, 25 aa, Cryptosporidium hominis
QAIQQPLIRLLLYGIILPILEQCNA

SEQ ID NO: 2134852 - protein, 22 aa, Cryptosporidium hominis
QDEKMWFTFYYLNKKSSICDVQ

SEQ ID NO: 2134853 - protein, 26 aa, Cryptosporidium hominis
QERIPTNLFIISFLALITGAFFLQYI

SEQ ID NO: 2134854 - protein, 27 aa, Cryptosporidium hominis
QGKYQFYKYILKFKPFLTLISTLPLDL

SEQ ID NO: 2134855 - protein, 28 aa, Cryptosporidium hominis
QIFGTHTIYWWLYILAIGAGFLNMAFDE

SEQ ID NO: 2134856 - protein, 20 aa, Cryptosporidium hominis
QIFRPLLWKVQTAYVSYLYY

SEQ ID NO: 2134857 - protein, 25 aa, Cryptosporidium hominis
QIFSLILLIIIFTPLILFSIHIIIS

SEQ ID NO: 2134858 - protein, 24 aa, Cryptosporidium hominis
QILLWIFLFPYLLYNEKFKIIIMG

SEQ ID NO: 2134859 - protein, 17 aa, Cryptosporidium hominis
QISLFLINIIWALLWAL

SEQ ID NO: 2134860 - protein, 30 aa, Cryptosporidium hominis
QKIIDIVYLLPLWFDLMRLPDKILRSKLLK

SEQ ID NO: 2134861 - protein, 19 aa, Cryptosporidium hominis
QKMYLLLDILILIKQNWEK

SEQ ID NO: 2134862 - protein, 19 aa, Cryptosporidium hominis
QKWFTEYLSKLWPPFNMEG

SEQ ID NO: 2134863 - protein, 25 aa, Cryptosporidium hominis
QLLLSPLYYIVFSKANMLSPRGECR

SEQ ID NO: 2134864 - protein, 26 aa, Cryptosporidium hominis
QMFTRKMIVLFLFAGFLGLFPGSFFH

SEQ ID NO: 2134865 - protein, 25 aa, Cryptosporidium hominis
QQIPSWWVVFWPCWFWCGVIFSFST

SEQ ID NO: 2134866 - protein, 26 aa, Cryptosporidium hominis
QTILFSILFYIIYKYIFRYFIHSCRL

SEQ ID NO: 2134867 - protein, 31 aa, Cryptosporidium hominis
QVLTLMFFISVIIFGLFILAIALIPRYAKRF

SEQ ID NO: 2134868 - protein, 24 aa, Cryptosporidium hominis
QWFALEWFLCFFVTSLPLKSIMEI

SEQ ID NO: 2134869 - protein, 17 aa, Cryptosporidium hominis
QYPILKLQLWSYGLIQS

SEQ ID NO: 2134870 - protein, 29 aa, Cryptosporidium hominis
QYYNEYSFPDYMYIIVLGNLKNSVKIKNN

SEQ ID NO: 2134871 - protein, 38 aa, Cryptosporidium hominis
RGGFIIFVFPWLLLMIPPICLFAWFWLFQYYRHASREL

SEQ ID NO: 2134872 - protein, 28 aa, Cryptosporidium hominis
RHLLFTLFFLFLGLFLKLNQFLLLKEND

SEQ ID NO: 2134873 - protein, 19 aa, Cryptosporidium hominis
RIIMLFLAGTFILSIYIIL

SEQ ID NO: 2134874 - protein, 32 aa, Cryptosporidium hominis
RILITILGVFFMLLAFFGVSFLLLLPKIAEIQ

SEQ ID NO: 2134875 - protein, 22 aa, Cryptosporidium hominis
RIRGKFLLILMVQLFCFFCACG

SEQ ID NO: 2134876 - protein, 24 aa, Cryptosporidium hominis
RISINIILFIWSSLLLRLSLWIRS

SEQ ID NO: 2134877 - protein, 23 aa, Cryptosporidium hominis
RIYKPLIKVFWLQCLMVLLLKVF

SEQ ID NO: 2134878 - protein, 21 aa, Cryptosporidium hominis
RKWIILLIIIEFVIKINLLYG

SEQ ID NO: 2134879 - protein, 23 aa, Cryptosporidium hominis
RKWNKFIIFINFISFFSIITKIN

SEQ ID NO: 2134880 - protein, 25 aa, Cryptosporidium hominis
RLCLNLLKILYLFTLLLFILSDSEF

SEQ ID NO: 2134881 - protein, 20 aa, Cryptosporidium hominis
RLDIPRLCYTVHLLALISHI

SEQ ID NO: 2134882 - protein, 18 aa, Cryptosporidium hominis
RMLLFVNFFLKREKLRIL

SEQ ID NO: 2134883 - protein, 26 aa, Cryptosporidium hominis
RNKLLYLVLAIILLWALSFTIVHQLV

SEQ ID NO: 2134884 - protein, 21 aa, Cryptosporidium hominis
RPRWFVYEIIPLIILFTKIFS

SEQ ID NO: 2134885 - protein, 22 aa, Cryptosporidium hominis
RPSILIFGIFLYLCVSNSNQAN

SEQ ID NO: 2134886 - protein, 17 aa, Cryptosporidium hominis
RPTILQRLIWFVASQVA

SEQ ID NO: 2134887 - protein, 23 aa, Cryptosporidium hominis
RQIEIFFLIFYPFAFHVSVVAVM

SEQ ID NO: 2134888 - protein, 27 aa, Cryptosporidium hominis
RQPQNIPWWIYLLIIILGFDEITYVLT

SEQ ID NO: 2134889 - protein, 17 aa, Cryptosporidium hominis
RRNEPFLLIKDPSLRYG

SEQ ID NO: 2134890 - protein, 25 aa, Cryptosporidium hominis
RSFLPLFLVFIFLALQFIGLSIMIF

SEQ ID NO: 2134891 - protein, 17 aa, Cryptosporidium hominis
RSKYFGLATIFIVSILR

SEQ ID NO: 2134892 - protein, 26 aa, Cryptosporidium hominis
RTEIGIFWIGLLTLFLIILDILLEVY

SEQ ID NO: 2134893 - protein, 19 aa, Cryptosporidium hominis
RTHLMMLIFFGGNILRGLF

SEQ ID NO: 2134894 - protein, 23 aa, Cryptosporidium hominis
RVIPILMIFLIYYRKVRVRRQSI

SEQ ID NO: 2134895 - protein, 23 aa, Cryptosporidium hominis
SATLFINLMIKYEFLWKSWKNNN

SEQ ID NO: 2134896 - protein, 19 aa, Cryptosporidium hominis
SCLFILQILVALATITWVI

SEQ ID NO: 2134897 - protein, 18 aa, Cryptosporidium hominis
SDLFVYFGISRFTLYYIK

SEQ ID NO: 2134898 - protein, 17 aa, Cryptosporidium hominis
SEILLFPSILILKLLSI

SEQ ID NO: 2134899 - protein, 23 aa, Cryptosporidium hominis
SEKRRWIIDFFVYLIGGGLYGAV

SEQ ID NO: 2134900 - protein, 17 aa, Cryptosporidium hominis
SFIFLLFICLSFGIIVA

SEQ ID NO: 2134901 - protein, 23 aa, Cryptosporidium hominis
SFIGFIILIALIRIIYFAAKKRN

SEQ ID NO: 2134902 - protein, 19 aa, Cryptosporidium hominis
SFLFIRPLRNLTSKEVMLY

SEQ ID NO: 2134903 - protein, 18 aa, Cryptosporidium hominis
SFLYILMEYAEGGSLYGL

SEQ ID NO: 2134904 - protein, 18 aa, Cryptosporidium hominis
SFTRFFCYFLQTSSLRSP

SEQ ID NO: 2134905 - protein, 23 aa, Cryptosporidium hominis
SFVLLFCLFFYQLDKLHAEVIYA

SEQ ID NO: 2134906 - protein, 26 aa, Cryptosporidium hominis
SGFSIHPFLLQLLFDFIKLYNIEEII

SEQ ID NO: 2134907 - protein, 24 aa, Cryptosporidium hominis
SHIYLLLVIILLVNLGIGLFFCGR

SEQ ID NO: 2134908 - protein, 22 aa, Cryptosporidium hominis
SHPLVIIFIFILVVCMFAGGSL

SEQ ID NO: 2134909 - protein, 22 aa, Cryptosporidium hominis
SHSKLPWFPTLSSALYLTEDAS

SEQ ID NO: 2134910 - protein, 18 aa, Cryptosporidium hominis
SICPTLCSLFLLLKSKVI

SEQ ID NO: 2134911 - protein, 21 aa, Cryptosporidium hominis
SIFFFDLVAYIFLILSAVLFD

SEQ ID NO: 2134912 - protein, 27 aa, Cryptosporidium hominis
SIFLLLIIIVIFSFNMDNLLLEAAYNS

SEQ ID NO: 2134913 - protein, 22 aa, Cryptosporidium hominis
SIFVFMLISLIFWALTRFFSFA

SEQ ID NO: 2134914 - protein, 25 aa, Cryptosporidium hominis
SIGMRWLIPWYLIEALLTKPNQINL

SEQ ID NO: 2134915 - protein, 18 aa, Cryptosporidium hominis
SIIIYLRPLILQELLCLF

SEQ ID NO: 2134916 - protein, 17 aa, Cryptosporidium hominis
SILCLVFWYNLMKVTNV

SEQ ID NO: 2134917 - protein, 19 aa, Cryptosporidium hominis
SILYGLCLGLLFLGKREAC

SEQ ID NO: 2134918 - protein, 22 aa, Cryptosporidium hominis
SIVKFFWKLAYLVLFILCWVIF

SEQ ID NO: 2134919 - protein, 20 aa, Cryptosporidium hominis
SIWFTVLLCFILILLITSSI

SEQ ID NO: 2134920 - protein, 19 aa, Cryptosporidium hominis
SKCSALIQSFWLGIADNVD

SEQ ID NO: 2134921 - protein, 25 aa, Cryptosporidium hominis
SKEDKLLLKLPILITTTTSTMTTTT

SEQ ID NO: 2134922 - protein, 22 aa, Cryptosporidium hominis
SKLFNRFLLFSFLFFSTGLGYY

SEQ ID NO: 2134923 - protein, 24 aa, Cryptosporidium hominis
SKQCYIIVFLLQKITTCLLFRGRR

SEQ ID NO: 2134924 - protein, 17 aa, Cryptosporidium hominis
SLFAWLVYILMAIKRYL

SEQ ID NO: 2134925 - protein, 17 aa, Cryptosporidium hominis
SLFLKTVFLFRILRYWN

SEQ ID NO: 2134926 - protein, 23 aa, Cryptosporidium hominis
SLIFTLWEFFWFLSVKISRKHAT

SEQ ID NO: 2134927 - protein, 18 aa, Cryptosporidium hominis
SLKHSFLWPHNNATLISA

SEQ ID NO: 2134928 - protein, 25 aa, Cryptosporidium hominis
SLLILVLSLYFLILSLDLSFINGDN

SEQ ID NO: 2134929 - protein, 20 aa, Cryptosporidium hominis
SLMHILKYYFDLMTLPPHSV

SEQ ID NO: 2134930 - protein, 26 aa, Cryptosporidium hominis
SLPFNFLLLFTLLVFSIGVVSVKSND

SEQ ID NO: 2134931 - protein, 28 aa, Cryptosporidium hominis
SLWQGIFLRFYIWAILWAIMIIFTTFKT

SEQ ID NO: 2134932 - protein, 23 aa, Cryptosporidium hominis
SRPAMFCIIFISLLITILEICLA

SEQ ID NO: 2134933 - protein, 21 aa, Cryptosporidium hominis
SSAFGFRYIVPSVFAIFAALF

SEQ ID NO: 2134934 - protein, 21 aa, Cryptosporidium hominis
SSCKIIYKIILWLLKYSKNID

SEQ ID NO: 2134935 - protein, 23 aa, Cryptosporidium hominis
SSDPIHLPGIRYFALFIFSKQVN

SEQ ID NO: 2134936 - protein, 25 aa, Cryptosporidium hominis
SSHPWFLIFWLVLCYIWIVAYTAFI

SEQ ID NO: 2134937 - protein, 17 aa, Cryptosporidium hominis
SSRKFILLSYQLTHFLL

SEQ ID NO: 2134938 - protein, 17 aa, Cryptosporidium hominis
SSVIGLALILTWIPGVL

SEQ ID NO: 2134939 - protein, 23 aa, Cryptosporidium hominis
STIDWIFFSIILFLTIVRGIEIL

SEQ ID NO: 2134940 - protein, 22 aa, Cryptosporidium hominis
SVALFLIIGWISCPILPLIWTL

SEQ ID NO: 2134941 - protein, 20 aa, Cryptosporidium hominis
SVFGIAIIAFIFKFARFYSI

SEQ ID NO: 2134942 - protein, 24 aa, Cryptosporidium hominis
SVLFSYLVFILKTTPWWLNISDLV

SEQ ID NO: 2134943 - protein, 23 aa, Cryptosporidium hominis
SVVALFMFPAWPLAIKISVWYIS

SEQ ID NO: 2134944 - protein, 19 aa, Cryptosporidium hominis
SWIQWLFKFHRISSVPLNS

SEQ ID NO: 2134945 - protein, 19 aa, Cryptosporidium hominis
SYFFFIWSVWLFTISFLFI

SEQ ID NO: 2134946 - protein, 17 aa, Cryptosporidium hominis
SYIIQLFLNLVIDSIVA

SEQ ID NO: 2134947 - protein, 19 aa, Cryptosporidium hominis
TALLYFYKCVFFPLSSSFT

SEQ ID NO: 2134948 - protein, 24 aa, Cryptosporidium hominis
TATYQLLYFLPISALVVVLSKGRV

SEQ ID NO: 2134949 - protein, 23 aa, Cryptosporidium hominis
TCTRKYFVLGYLKSSLFLSNIVK

SEQ ID NO: 2134950 - protein, 23 aa, Cryptosporidium hominis
TDWSYYIWWLFSRRPEISKISPK

SEQ ID NO: 2134951 - protein, 18 aa, Cryptosporidium hominis
TFCFGFMMAILFFNSSGS

SEQ ID NO: 2134952 - protein, 27 aa, Cryptosporidium hominis
TFLITILIFLIFFFKRRLVIDLLLIVE

SEQ ID NO: 2134953 - protein, 17 aa, Cryptosporidium hominis
TFNFILKALIPASIIFY

SEQ ID NO: 2134954 - protein, 23 aa, Cryptosporidium hominis
TFVRCLIICLFVFSWPISKFLDY

SEQ ID NO: 2134955 - protein, 27 aa, Cryptosporidium hominis
TGKYSLYFLFLAILIFLTTFAQNSFLQ

SEQ ID NO: 2134956 - protein, 26 aa, Cryptosporidium hominis
TGSIEFYLCILFSIALIFFGGILSGL

SEQ ID NO: 2134957 - protein, 25 aa, Cryptosporidium hominis
TIENSFPWFIPVKTSVQFFDLNSTR

SEQ ID NO: 2134958 - protein, 23 aa, Cryptosporidium hominis
TIFDHDLLNRLLPKLLRRTKVYL

SEQ ID NO: 2134959 - protein, 32 aa, Cryptosporidium hominis
TIFSLTWILYLGFYWYWIPPKSISFPINFDFQ

SEQ ID NO: 2134960 - protein, 20 aa, Cryptosporidium hominis
TIGMYIFTLMPWWNPDPTYL

SEQ ID NO: 2134961 - protein, 24 aa, Cryptosporidium hominis
TIIFNIIIFLYLLSSFNIIRCNGE

SEQ ID NO: 2134962 - protein, 25 aa, Cryptosporidium hominis
TIKCIFIYMIFALLLRKLEDNNHKV

SEQ ID NO: 2134963 - protein, 23 aa, Cryptosporidium hominis
TILMIELILFSFPFNIPNFPLPK

SEQ ID NO: 2134964 - protein, 23 aa, Cryptosporidium hominis
TKFNLFMFITYDKYIDLLLESGQ

SEQ ID NO: 2134965 - protein, 22 aa, Cryptosporidium hominis
TKLFWILIPIIICIISLSINIF

SEQ ID NO: 2134966 - protein, 26 aa, Cryptosporidium hominis
TLFLLSLLFFIVFLSGIYFLWKKYPA

SEQ ID NO: 2134967 - protein, 25 aa, Cryptosporidium hominis
TLFMLGFLRYFRVLNPIPILTIILS

SEQ ID NO: 2134968 - protein, 18 aa, Cryptosporidium hominis
TLIFTFLTEQTNKFFDCF

SEQ ID NO: 2134969 - protein, 23 aa, Cryptosporidium hominis
TLSKILFLLLIITSFVLVFCKGF

SEQ ID NO: 2134970 - protein, 23 aa, Cryptosporidium hominis
TLWSKLFFTWLSPWMSKFLGPGV

SEQ ID NO: 2134971 - protein, 17 aa, Cryptosporidium hominis
TMPLFYILSCWKLLWCL

SEQ ID NO: 2134972 - protein, 28 aa, Cryptosporidium hominis
TNALQWYIAWTWFVDLILSISTCSFENS

SEQ ID NO: 2134973 - protein, 27 aa, Cryptosporidium hominis
TNNPESLLLLSRLTTKAPPKFLISSIK

SEQ ID NO: 2134974 - protein, 27 aa, Cryptosporidium hominis
TNSPEFFRLWTLLILCGLLSMLLNYFT

SEQ ID NO: 2134975 - protein, 26 aa, Cryptosporidium hominis
TPDLYLFPRFLSFYKLAPIKLRQQMW

SEQ ID NO: 2134976 - protein, 18 aa, Cryptosporidium hominis
TPLLLLFEILNSPIVQNS

SEQ ID NO: 2134977 - protein, 22 aa, Cryptosporidium hominis
TPNYLILIYIFVGITFITIGIF

SEQ ID NO: 2134978 - protein, 24 aa, Cryptosporidium hominis
TRVLQKIRILNIPDLYIQATAKKI

SEQ ID NO: 2134979 - protein, 22 aa, Cryptosporidium hominis
TRYNPYFLGWILSELIALLTNQ

SEQ ID NO: 2134980 - protein, 19 aa, Cryptosporidium hominis
TSEFPWFTSAWLRRACLAL

SEQ ID NO: 2134981 - protein, 25 aa, Cryptosporidium hominis
TSQYFLWWFILFPLALRVYLTNNIA

SEQ ID NO: 2134982 - protein, 22 aa, Cryptosporidium hominis
TVNQLLISFILMSPLGIIIGQL

SEQ ID NO: 2134983 - protein, 22 aa, Cryptosporidium hominis
VDLYLPIFLLFLETFSFEDLNG

SEQ ID NO: 2134984 - protein, 20 aa, Cryptosporidium hominis
VFITYFLVIYTVSATELDST

SEQ ID NO: 2134985 - protein, 24 aa, Cryptosporidium hominis
VFKKFISYILLFLNASRTASNIVF

SEQ ID NO: 2134986 - protein, 19 aa, Cryptosporidium hominis
VFLIATFIIMLLSPILCFI

SEQ ID NO: 2134987 - protein, 17 aa, Cryptosporidium hominis
VFPWCISLLLYSLLHFT

SEQ ID NO: 2134988 - protein, 22 aa, Cryptosporidium hominis
VFVIICRFLFFPVSTLRRIKMQ

SEQ ID NO: 2134989 - protein, 18 aa, Cryptosporidium hominis
VFVRFLIVGLYVGIATVG

SEQ ID NO: 2134990 - protein, 17 aa, Cryptosporidium hominis
VGILWLFFALTLPAYHY

SEQ ID NO: 2134991 - protein, 22 aa, Cryptosporidium hominis
VGRYFYMTLVEKLSFNTGGICS

SEQ ID NO: 2134992 - protein, 19 aa, Cryptosporidium hominis
VIDLLLIVELILIDILFSK

SEQ ID NO: 2134993 - protein, 29 aa, Cryptosporidium hominis
VIERLMLYFIIFVLLLANIYVFFRRIFGR

SEQ ID NO: 2134994 - protein, 17 aa, Cryptosporidium hominis
VIFLSYYLIVNLKVNAF

SEQ ID NO: 2134995 - protein, 18 aa, Cryptosporidium hominis
VIGLFFLSQLNPLCLLLF

SEQ ID NO: 2134996 - protein, 20 aa, Cryptosporidium hominis
VIILIGIIVIFLPLYFRIRT

SEQ ID NO: 2134997 - protein, 27 aa, Cryptosporidium hominis
VLGFAILICFLIGFYLILFSAKHPTSK

SEQ ID NO: 2134998 - protein, 18 aa, Cryptosporidium hominis
VLLHIYIVQKYVICSKLT

SEQ ID NO: 2134999 - protein, 17 aa, Cryptosporidium hominis
VMYFLLAGTLPFTGRSI

SEQ ID NO: 2135000 - protein, 28 aa, Cryptosporidium hominis
VPKFLICIPVLAYLFFQVSKKYAPMLRQ

SEQ ID NO: 2135001 - protein, 21 aa, Cryptosporidium hominis
VQKSFISTFIRLLLLLKSKSN

SEQ ID NO: 2135002 - protein, 26 aa, Cryptosporidium hominis
VQLFNLFFMFFAFTSFIMILMDSLEC

SEQ ID NO: 2135003 - protein, 30 aa, Cryptosporidium hominis
VSREFYIVLISLYFLYIRGLFDGLQDLFER

SEQ ID NO: 2135004 - protein, 18 aa, Cryptosporidium hominis
VSSSIYNFVFIFSIIIST

SEQ ID NO: 2135005 - protein, 21 aa, Cryptosporidium hominis
VSWFIFRYFFDFIRYFIEENK

SEQ ID NO: 2135006 - protein, 18 aa, Cryptosporidium hominis
VTIYIGYFIYLDYRFIIV

SEQ ID NO: 2135007 - protein, 17 aa, Cryptosporidium hominis
VTLLLLLASFIYSYLTG

SEQ ID NO: 2135008 - protein, 24 aa, Cryptosporidium hominis
VTYPYYYRPFFGYGFPLLGTEPYF

SEQ ID NO: 2135009 - protein, 20 aa, Cryptosporidium hominis
VVCIYILNMLRFIAIINPEL

SEQ ID NO: 2135010 - protein, 17 aa, Cryptosporidium hominis
VVFLLNIIFFDVNIGLF

SEQ ID NO: 2135011 - protein, 20 aa, Cryptosporidium hominis
VVNFLRLYLIKVLPKNILGT

SEQ ID NO: 2135012 - protein, 22 aa, Cryptosporidium hominis
VVYPSLFTLFPLFRQILIREKI

SEQ ID NO: 2135013 - protein, 21 aa, Cryptosporidium hominis
VYERLFRQLLCTLITLLGVSS

SEQ ID NO: 2135014 - protein, 19 aa, Cryptosporidium hominis
VYGCILLTSLIFITIYLFI

SEQ ID NO: 2135015 - protein, 18 aa, Cryptosporidium hominis
WFLVIPYWIIYFIQSGNN

SEQ ID NO: 2135016 - protein, 20 aa, Cryptosporidium hominis
WGILRFFLLFFLSGVGGNLA

SEQ ID NO: 2135017 - protein, 20 aa, Cryptosporidium hominis
WGLLLFWLFSALESSFFYIY

SEQ ID NO: 2135018 - protein, 26 aa, Cryptosporidium hominis
WGSLILFIFLIYILLAIILAIIHFII

SEQ ID NO: 2135019 - protein, 17 aa, Cryptosporidium hominis
WIAQGHELLFFYLTYYS

SEQ ID NO: 2135020 - protein, 24 aa, Cryptosporidium hominis
WIIPQWFLIYLRLSVFLYLLIMLG

SEQ ID NO: 2135021 - protein, 27 aa, Cryptosporidium hominis
WIPLYNNILFWITLISGLSISLWPDYF

SEQ ID NO: 2135022 - protein, 18 aa, Cryptosporidium hominis
WLILYLILIIFQIKDIIN

SEQ ID NO: 2135023 - protein, 17 aa, Cryptosporidium hominis
WLLLSLWKRYPARIYRH

SEQ ID NO: 2135024 - protein, 17 aa, Cryptosporidium hominis
WLRRPRWFVYEIIPLII

SEQ ID NO: 2135025 - protein, 27 aa, Cryptosporidium hominis
WMELIAFWVLLIMVIVLLRGIRSNYEV

SEQ ID NO: 2135026 - protein, 17 aa, Cryptosporidium hominis
WTLTLVLLIIQVVLGQN

SEQ ID NO: 2135027 - protein, 18 aa, Cryptosporidium hominis
WVNLYWTQPPYGGAAELF

SEQ ID NO: 2135028 - protein, 17 aa, Cryptosporidium hominis
WWLFHSFFQVVSKDWLL

SEQ ID NO: 2135029 - protein, 19 aa, Cryptosporidium hominis
WYFSKLKWSWTIALLILCY

SEQ ID NO: 2135030 - protein, 17 aa, Cryptosporidium hominis
WYVSFARFMLLLSSIIP

SEQ ID NO: 2135031 - protein, 17 aa, Cryptosporidium hominis
YAIYFWSDAINAKVYSP

SEQ ID NO: 2135032 - protein, 25 aa, Cryptosporidium hominis
YALIWMTWCLWLLGSFLFSFGRVML

SEQ ID NO: 2135033 - protein, 24 aa, Cryptosporidium hominis
YDDAYIWQYLFDTPWFKIDCVPDV

SEQ ID NO: 2135034 - protein, 17 aa, Cryptosporidium hominis
YEEYFFLSNLKLLELVD

SEQ ID NO: 2135035 - protein, 23 aa, Cryptosporidium hominis
YETLFIMYMLLISLGWRVLRDSL

SEQ ID NO: 2135036 - protein, 18 aa, Cryptosporidium hominis
YFEFPIQILFWFGYEDTR

SEQ ID NO: 2135037 - protein, 17 aa, Cryptosporidium hominis
YFFLFSLYYFLSYSNHI

SEQ ID NO: 2135038 - protein, 17 aa, Cryptosporidium hominis
YFIRWQGIPQVYGQFVI

SEQ ID NO: 2135039 - protein, 20 aa, Cryptosporidium hominis
YFLFIDLMLFLLHSGDFFAS

SEQ ID NO: 2135040 - protein, 20 aa, Cryptosporidium hominis
YFQYDFVLRYIFLNSLKIST

SEQ ID NO: 2135041 - protein, 31 aa, Cryptosporidium hominis
YFRNNPIMRLFFFIFILAMFSPANISNGLQK

SEQ ID NO: 2135042 - protein, 17 aa, Cryptosporidium hominis
YGDFFFIILISTFLKEV

SEQ ID NO: 2135043 - protein, 19 aa, Cryptosporidium hominis
YGLLSLYLLYLRFPKHIKK

SEQ ID NO: 2135044 - protein, 18 aa, Cryptosporidium hominis
YGLYIYNGLILDFKILYK

SEQ ID NO: 2135045 - protein, 25 aa, Cryptosporidium hominis
YGYLKFIILYFLSLVLWGLYRHYLH

SEQ ID NO: 2135046 - protein, 28 aa, Cryptosporidium hominis
YIFCCLLFFIWYICTWFVGAHLLRIETK

SEQ ID NO: 2135047 - protein, 31 aa, Cryptosporidium hominis
YIGYFIYLDYRFIIVFIPISYFFNKFRIRAM

SEQ ID NO: 2135048 - protein, 25 aa, Cryptosporidium hominis
YILNNRLFSLWLFVQKRLTTIQIAI

SEQ ID NO: 2135049 - protein, 24 aa, Cryptosporidium hominis
YIPYHLFFLIVLFSIVSILWIINI

SEQ ID NO: 2135050 - protein, 18 aa, Cryptosporidium hominis
YIYNGLILDFKILYKVYQ

SEQ ID NO: 2135051 - protein, 17 aa, Cryptosporidium hominis
YKLYWKLMLTCGVATIC

SEQ ID NO: 2135052 - protein, 20 aa, Cryptosporidium hominis
YKYGFKLYWIRKVSKTLKFL

SEQ ID NO: 2135053 - protein, 18 aa, Cryptosporidium hominis
YLILITKFFLIFKFLLGV

SEQ ID NO: 2135054 - protein, 19 aa, Cryptosporidium hominis
YLIVIFFIILCENIDDKLL

SEQ ID NO: 2135055 - protein, 19 aa, Cryptosporidium hominis
YLLHQLFSQFFWALHDDPE

SEQ ID NO: 2135056 - protein, 19 aa, Cryptosporidium hominis
YLLVIVLAKLFFIFSRKIL

SEQ ID NO: 2135057 - protein, 20 aa, Cryptosporidium hominis
YLRYLYACRIILYSKNYNLI

SEQ ID NO: 2135058 - protein, 24 aa, Cryptosporidium hominis
YLSDWIFIYELLTGYFPLEVIPGE

SEQ ID NO: 2135059 - protein, 19 aa, Cryptosporidium hominis
YLVLFILCWVIFPILLEYE

SEQ ID NO: 2135060 - protein, 20 aa, Cryptosporidium hominis
YLYILVIFKVNYVISIRNNK

SEQ ID NO: 2135061 - protein, 21 aa, Cryptosporidium hominis
YQFLFLIYRKILVSKTKCLVI

SEQ ID NO: 2135062 - protein, 19 aa, Cryptosporidium hominis
YQLFILCFLSLIILFVIPL

SEQ ID NO: 2135063 - protein, 17 aa, Cryptosporidium hominis
YSILYLIYLIQPRILVS

SEQ ID NO: 2135064 - protein, 21 aa, Cryptosporidium hominis
YTYYFSSLILWLFSKSNDSIV

SEQ ID NO: 2135065 - protein, 23 aa, Cryptosporidium hominis
YVNSYFLLNILQYLIVLLQVYPS

SEQ ID NO: 2135066 - protein, 21 aa, Cryptosporidium hominis
YVSLFNPFLIPIILDCFSVII

SEQ ID NO: 2135067 - protein, 17 aa, Cryptosporidium hominis
YWGFLYLYKSVITNEID

SEQ ID NO: 2135068 - protein, 17 aa, Cryptosporidium hominis
YYLLTYTLEYESALFCM

SEQ ID NO: 2135069 - protein, 20 aa, Cryptosporidium hominis
YYQLYILLVFLIESSDWFIH

SEQ ID NO: 2135070 - protein, 8 aa, Cryptosporidium hominis
GPPGTGKT

SEQ ID NO: 2135071 - protein, 7 aa, Cryptosporidium hominis
EPSDTIE

SEQ ID NO: 2135072 - protein, 12 aa, Cryptosporidium hominis
KIQDKEGIPPDQ

SEQ ID NO: 2135073 - protein, 7 aa, Cryptosporidium hominis
LEDGRTL

SEQ ID NO: 2135074 - protein, 4 aa, Cryptosporidium hominis
DSEK

SEQ ID NO: 2135075 - protein, 4 aa, Cryptosporidium hominis
ENEE

SEQ ID NO: 2135076 - protein, 4 aa, Cryptosporidium hominis
GNPL

SEQ ID NO: 2135077 - protein, 4 aa, Cryptosporidium hominis
IDPS

SEQ ID NO: 2135078 - protein, 6 aa, Cryptosporidium hominis
IPPKKD

SEQ ID NO: 2135079 - protein, 4 aa, Cryptosporidium hominis
KEEE

SEQ ID NO: 2135080 - protein, 8 aa, Cryptosporidium hominis
LKIPPKKD

SEQ ID NO: 2135081 - protein, 16 aa, Cryptosporidium hominis
LSIPPIKKEADTSIQT

SEQ ID NO: 2135082 - protein, 5 aa, Cryptosporidium hominis
PPGCG

SEQ ID NO: 2135083 - protein, 13 aa, Cryptosporidium hominis
TIPENGSGSDHAP

SEQ ID NO: 2135084 - protein, 6 aa, Cryptosporidium hominis
AAGKTT

SEQ ID NO: 2135085 - protein, 4 aa, Cryptosporidium hominis
AGET

SEQ ID NO: 2135086 - protein, 4 aa, Cryptosporidium hominis
AGGL

SEQ ID NO: 2135087 - protein, 4 aa, Cryptosporidium hominis
ANER

SEQ ID NO: 2135088 - protein, 4 aa, Cryptosporidium hominis
APNL

SEQ ID NO: 2135089 - protein, 7 aa, Cryptosporidium hominis
ASDDRGI

SEQ ID NO: 2135090 - protein, 6 aa, Cryptosporidium hominis
ATSAKI

SEQ ID NO: 2135091 - protein, 5 aa, Cryptosporidium hominis
CNNSE

SEQ ID NO: 2135092 - protein, 4 aa, Cryptosporidium hominis
DDQY

SEQ ID NO: 2135093 - protein, 5 aa, Cryptosporidium hominis
DDSQI

SEQ ID NO: 2135094 - protein, 4 aa, Cryptosporidium hominis
DGVT

SEQ ID NO: 2135095 - protein, 4 aa, Cryptosporidium hominis
DKIK

SEQ ID NO: 2135096 - protein, 4 aa, Cryptosporidium hominis
DKRS

SEQ ID NO: 2135097 - protein, 4 aa, Cryptosporidium hominis
DKSN

SEQ ID NO: 2135098 - protein, 13 aa, Cryptosporidium hominis
DLENAQTDNYSGF

SEQ ID NO: 2135099 - protein, 8 aa, Cryptosporidium hominis
DPSTAKSQ

SEQ ID NO: 2135100 - protein, 4 aa, Cryptosporidium hominis
DSED

SEQ ID NO: 2135101 - protein, 4 aa, Cryptosporidium hominis
DSSN

SEQ ID NO: 2135102 - protein, 4 aa, Cryptosporidium hominis
DVNE

SEQ ID NO: 2135103 - protein, 4 aa, Cryptosporidium hominis
EDES

SEQ ID NO: 2135104 - protein, 5 aa, Cryptosporidium hominis
EDPKE

SEQ ID NO: 2135105 - protein, 4 aa, Cryptosporidium hominis
EEAI

SEQ ID NO: 2135106 - protein, 4 aa, Cryptosporidium hominis
EEDD

SEQ ID NO: 2135107 - protein, 4 aa, Cryptosporidium hominis
EEDI

SEQ ID NO: 2135108 - protein, 4 aa, Cryptosporidium hominis
EEES

SEQ ID NO: 2135109 - protein, 4 aa, Cryptosporidium hominis
EESD

SEQ ID NO: 2135110 - protein, 4 aa, Cryptosporidium hominis
ELKE

SEQ ID NO: 2135111 - protein, 4 aa, Cryptosporidium hominis
ENDI

SEQ ID NO: 2135112 - protein, 4 aa, Cryptosporidium hominis
ENET

SEQ ID NO: 2135113 - protein, 5 aa, Cryptosporidium hominis
EPEIK

SEQ ID NO: 2135114 - protein, 8 aa, Cryptosporidium hominis
EQSRRDDL

SEQ ID NO: 2135115 - protein, 4 aa, Cryptosporidium hominis
ESED

SEQ ID NO: 2135116 - protein, 4 aa, Cryptosporidium hominis
ESFE

SEQ ID NO: 2135117 - protein, 7 aa, Cryptosporidium hominis
ETGSGKT

SEQ ID NO: 2135118 - protein, 10 aa, Cryptosporidium hominis
ETNANNETEI

SEQ ID NO: 2135119 - protein, 4 aa, Cryptosporidium hominis
ETVN

SEQ ID NO: 2135120 - protein, 4 aa, Cryptosporidium hominis
GDPI

SEQ ID NO: 2135121 - protein, 4 aa, Cryptosporidium hominis
GDPS

SEQ ID NO: 2135122 - protein, 4 aa, Cryptosporidium hominis
GDSR

SEQ ID NO: 2135123 - protein, 4 aa, Cryptosporidium hominis
GENS

SEQ ID NO: 2135124 - protein, 9 aa, Cryptosporidium hominis
GETSRDPDI

SEQ ID NO: 2135125 - protein, 4 aa, Cryptosporidium hominis
GGAV

SEQ ID NO: 2135126 - protein, 4 aa, Cryptosporidium hominis
GGVS

SEQ ID NO: 2135127 - protein, 4 aa, Cryptosporidium hominis
GIPN

SEQ ID NO: 2135128 - protein, 5 aa, Cryptosporidium hominis
GKEEM

SEQ ID NO: 2135129 - protein, 6 aa, Cryptosporidium hominis
GKETEE

SEQ ID NO: 2135130 - protein, 5 aa, Cryptosporidium hominis
GQDKI

SEQ ID NO: 2135131 - protein, 4 aa, Cryptosporidium hominis
GQIN

SEQ ID NO: 2135132 - protein, 10 aa, Cryptosporidium hominis
GQTNYSAANS

SEQ ID NO: 2135133 - protein, 5 aa, Cryptosporidium hominis
GRSRG

SEQ ID NO: 2135134 - protein, 4 aa, Cryptosporidium hominis
GSEI

SEQ ID NO: 2135135 - protein, 6 aa, Cryptosporidium hominis
GSGELD

SEQ ID NO: 2135136 - protein, 5 aa, Cryptosporidium hominis
GTFRP

SEQ ID NO: 2135137 - protein, 10 aa, Cryptosporidium hominis
GYNSKPEMNL

SEQ ID NO: 2135138 - protein, 5 aa, Cryptosporidium hominis
GYNTE

SEQ ID NO: 2135139 - protein, 4 aa, Cryptosporidium hominis
HISP

SEQ ID NO: 2135140 - protein, 4 aa, Cryptosporidium hominis
HNSE

SEQ ID NO: 2135141 - protein, 4 aa, Cryptosporidium hominis
IEGS

SEQ ID NO: 2135142 - protein, 4 aa, Cryptosporidium hominis
IGSK

SEQ ID NO: 2135143 - protein, 5 aa, Cryptosporidium hominis
IKPPK

SEQ ID NO: 2135144 - protein, 22 aa, Cryptosporidium hominis
IKSDALKKSTELGKSQVDSKSM

SEQ ID NO: 2135145 - protein, 12 aa, Cryptosporidium hominis
IPENGSGSDHAP

SEQ ID NO: 2135146 - protein, 13 aa, Cryptosporidium hominis
IPETGSGSDHAPV

SEQ ID NO: 2135147 - protein, 4 aa, Cryptosporidium hominis
IPNE

SEQ ID NO: 2135148 - protein, 9 aa, Cryptosporidium hominis
ISPQVAPGV

SEQ ID NO: 2135149 - protein, 4 aa, Cryptosporidium hominis
ISTL

SEQ ID NO: 2135150 - protein, 4 aa, Cryptosporidium hominis
KDPI

SEQ ID NO: 2135151 - protein, 4 aa, Cryptosporidium hominis
KEIE

SEQ ID NO: 2135152 - protein, 4 aa, Cryptosporidium hominis
KENL

SEQ ID NO: 2135153 - protein, 4 aa, Cryptosporidium hominis
KEVE

SEQ ID NO: 2135154 - protein, 4 aa, Cryptosporidium hominis
KGEI

SEQ ID NO: 2135155 - protein, 4 aa, Cryptosporidium hominis
KLAG

SEQ ID NO: 2135156 - protein, 4 aa, Cryptosporidium hominis
KNET

SEQ ID NO: 2135157 - protein, 5 aa, Cryptosporidium hominis
KNKER

SEQ ID NO: 2135158 - protein, 11 aa, Cryptosporidium hominis
KNSKNDKCSPF

SEQ ID NO: 2135159 - protein, 4 aa, Cryptosporidium hominis
KPQG

SEQ ID NO: 2135160 - protein, 21 aa, Cryptosporidium hominis
KQTETTNQDENNNGYQPDTEQ

SEQ ID NO: 2135161 - protein, 5 aa, Cryptosporidium hominis
KRTNS

SEQ ID NO: 2135162 - protein, 4 aa, Cryptosporidium hominis
KSDS

SEQ ID NO: 2135163 - protein, 20 aa, Cryptosporidium hominis
KSETYNSNKSIRSSPYESLQ

SEQ ID NO: 2135164 - protein, 4 aa, Cryptosporidium hominis
KSKD

SEQ ID NO: 2135165 - protein, 4 aa, Cryptosporidium hominis
KTQR

SEQ ID NO: 2135166 - protein, 7 aa, Cryptosporidium hominis
LAPKSDL

SEQ ID NO: 2135167 - protein, 4 aa, Cryptosporidium hominis
LEEQ

SEQ ID NO: 2135168 - protein, 4 aa, Cryptosporidium hominis
LESN

SEQ ID NO: 2135169 - protein, 16 aa, Cryptosporidium hominis
LKQNSREKLSKLDNEK

SEQ ID NO: 2135170 - protein, 4 aa, Cryptosporidium hominis
LPPG

SEQ ID NO: 2135171 - protein, 4 aa, Cryptosporidium hominis
LPSE

SEQ ID NO: 2135172 - protein, 5 aa, Cryptosporidium hominis
LSENE

SEQ ID NO: 2135173 - protein, 4 aa, Cryptosporidium hominis
LSNE

SEQ ID NO: 2135174 - protein, 4 aa, Cryptosporidium hominis
LSSE

SEQ ID NO: 2135175 - protein, 5 aa, Cryptosporidium hominis
LSSSS

SEQ ID NO: 2135176 - protein, 9 aa, Cryptosporidium hominis
NAGPNTNGS

SEQ ID NO: 2135177 - protein, 4 aa, Cryptosporidium hominis
NDEN

SEQ ID NO: 2135178 - protein, 4 aa, Cryptosporidium hominis
NEEN

SEQ ID NO: 2135179 - protein, 4 aa, Cryptosporidium hominis
NEPL

SEQ ID NO: 2135180 - protein, 5 aa, Cryptosporidium hominis
NIKSE

SEQ ID NO: 2135181 - protein, 4 aa, Cryptosporidium hominis
NKIT

SEQ ID NO: 2135182 - protein, 4 aa, Cryptosporidium hominis
NKKN

SEQ ID NO: 2135183 - protein, 4 aa, Cryptosporidium hominis
NNNF

SEQ ID NO: 2135184 - protein, 4 aa, Cryptosporidium hominis
NNNT

SEQ ID NO: 2135185 - protein, 5 aa, Cryptosporidium hominis
NNSNL

SEQ ID NO: 2135186 - protein, 6 aa, Cryptosporidium hominis
NPNNLK

SEQ ID NO: 2135187 - protein, 4 aa, Cryptosporidium hominis
NPNQ

SEQ ID NO: 2135188 - protein, 5 aa, Cryptosporidium hominis
NSPIT

SEQ ID NO: 2135189 - protein, 4 aa, Cryptosporidium hominis
NSRY

SEQ ID NO: 2135190 - protein, 4 aa, Cryptosporidium hominis
NSSQ

SEQ ID NO: 2135191 - protein, 4 aa, Cryptosporidium hominis
NTNE

SEQ ID NO: 2135192 - protein, 5 aa, Cryptosporidium hominis
NTNIN

SEQ ID NO: 2135193 - protein, 21 aa, Cryptosporidium hominis
NTTTGQFEKNEDHPNPDEINP

SEQ ID NO: 2135194 - protein, 4 aa, Cryptosporidium hominis
PDEN

SEQ ID NO: 2135195 - protein, 5 aa, Cryptosporidium hominis
PDLEP

SEQ ID NO: 2135196 - protein, 4 aa, Cryptosporidium hominis
PESE

SEQ ID NO: 2135197 - protein, 4 aa, Cryptosporidium hominis
PNNV

SEQ ID NO: 2135198 - protein, 5 aa, Cryptosporidium hominis
PPLPD

SEQ ID NO: 2135199 - protein, 4 aa, Cryptosporidium hominis
PPSL

SEQ ID NO: 2135200 - protein, 4 aa, Cryptosporidium hominis
PTIS

SEQ ID NO: 2135201 - protein, 4 aa, Cryptosporidium hominis
QEPT

SEQ ID NO: 2135202 - protein, 4 aa, Cryptosporidium hominis
QESI

SEQ ID NO: 2135203 - protein, 4 aa, Cryptosporidium hominis
RDPR

SEQ ID NO: 2135204 - protein, 4 aa, Cryptosporidium hominis
REES

SEQ ID NO: 2135205 - protein, 4 aa, Cryptosporidium hominis
RIGQ

SEQ ID NO: 2135206 - protein, 8 aa, Cryptosporidium hominis
RKSSQMSH

SEQ ID NO: 2135207 - protein, 4 aa, Cryptosporidium hominis
RNGT

SEQ ID NO: 2135208 - protein, 4 aa, Cryptosporidium hominis
SAGN

SEQ ID NO: 2135209 - protein, 4 aa, Cryptosporidium hominis
SDNN

SEQ ID NO: 2135210 - protein, 4 aa, Cryptosporidium hominis
SDSG

SEQ ID NO: 2135211 - protein, 4 aa, Cryptosporidium hominis
SEIE

SEQ ID NO: 2135212 - protein, 4 aa, Cryptosporidium hominis
SESI

SEQ ID NO: 2135213 - protein, 14 aa, Cryptosporidium hominis
SGEFPNDSNLKNAT

SEQ ID NO: 2135214 - protein, 4 aa, Cryptosporidium hominis
SGVG

SEQ ID NO: 2135215 - protein, 14 aa, Cryptosporidium hominis
SIARPISKDLSRES

SEQ ID NO: 2135216 - protein, 5 aa, Cryptosporidium hominis
SITNN

SEQ ID NO: 2135217 - protein, 4 aa, Cryptosporidium hominis
SKNN

SEQ ID NO: 2135218 - protein, 7 aa, Cryptosporidium hominis
SLGPKGM

SEQ ID NO: 2135219 - protein, 5 aa, Cryptosporidium hominis
SNDID

SEQ ID NO: 2135220 - protein, 4 aa, Cryptosporidium hominis
SNPQ

SEQ ID NO: 2135221 - protein, 4 aa, Cryptosporidium hominis
SNPS

SEQ ID NO: 2135222 - protein, 4 aa, Cryptosporidium hominis
SNSN

SEQ ID NO: 2135223 - protein, 4 aa, Cryptosporidium hominis
SNSQ

SEQ ID NO: 2135224 - protein, 4 aa, Cryptosporidium hominis
SNSV

SEQ ID NO: 2135225 - protein, 7 aa, Cryptosporidium hominis
SQITPGV

SEQ ID NO: 2135226 - protein, 5 aa, Cryptosporidium hominis
SQNID

SEQ ID NO: 2135227 - protein, 5 aa, Cryptosporidium hominis
SRNNI

SEQ ID NO: 2135228 - protein, 4 aa, Cryptosporidium hominis
SSED

SEQ ID NO: 2135229 - protein, 4 aa, Cryptosporidium hominis
SSEE

SEQ ID NO: 2135230 - protein, 4 aa, Cryptosporidium hominis
SSER

SEQ ID NO: 2135231 - protein, 4 aa, Cryptosporidium hominis
SSGI

SEQ ID NO: 2135232 - protein, 4 aa, Cryptosporidium hominis
SSKE

SEQ ID NO: 2135233 - protein, 4 aa, Cryptosporidium hominis
SSNE

SEQ ID NO: 2135234 - protein, 4 aa, Cryptosporidium hominis
SSPI

SEQ ID NO: 2135235 - protein, 4 aa, Cryptosporidium hominis
SSPK

SEQ ID NO: 2135236 - protein, 4 aa, Cryptosporidium hominis
SSQI

SEQ ID NO: 2135237 - protein, 4 aa, Cryptosporidium hominis
SSSI

SEQ ID NO: 2135238 - protein, 5 aa, Cryptosporidium hominis
STRIP

SEQ ID NO: 2135239 - protein, 4 aa, Cryptosporidium hominis
SYPG

SEQ ID NO: 2135240 - protein, 22 aa, Cryptosporidium hominis
TEKDKSNEKQNDNDERDVTSPQ

SEQ ID NO: 2135241 - protein, 4 aa, Cryptosporidium hominis
TELE

SEQ ID NO: 2135242 - protein, 4 aa, Cryptosporidium hominis
TESK

SEQ ID NO: 2135243 - protein, 34 aa, Cryptosporidium hominis
TGGKAPRKQLASKGARKSAPVTGGVKKPRRYRPG

SEQ ID NO: 2135244 - protein, 4 aa, Cryptosporidium hominis
TGTE

SEQ ID NO: 2135245 - protein, 14 aa, Cryptosporidium hominis
TIPETGSGSDHAPV

SEQ ID NO: 2135246 - protein, 6 aa, Cryptosporidium hominis
TNETKE

SEQ ID NO: 2135247 - protein, 4 aa, Cryptosporidium hominis
TNSI

SEQ ID NO: 2135248 - protein, 4 aa, Cryptosporidium hominis
TPEE

SEQ ID NO: 2135249 - protein, 5 aa, Cryptosporidium hominis
TPLQN

SEQ ID NO: 2135250 - protein, 4 aa, Cryptosporidium hominis
TPNG

SEQ ID NO: 2135251 - protein, 13 aa, Cryptosporidium hominis
VGGSPSGGSPIGD

SEQ ID NO: 2135252 - protein, 8 aa, Cryptosporidium hominis
AAAAAAAA

SEQ ID NO: 2135253 - protein, 18 aa, Cryptosporidium hominis
AAAAAAAANNAASSTIQN

SEQ ID NO: 2135254 - protein, 11 aa, Cryptosporidium hominis
AAAAAAAANPY

SEQ ID NO: 2135255 - protein, 22 aa, Cryptosporidium hominis
AAAAAAVGSSNTHIGSGSSNSH

SEQ ID NO: 2135256 - protein, 35 aa, Cryptosporidium hominis
AAAAAIASTPTKSQAPTKDHTSSQPTATPQPQVRG

SEQ ID NO: 2135257 - protein, 33 aa, Cryptosporidium hominis
AAAAASATNATANFSTSNPPSPSLGSKKRTIDA

SEQ ID NO: 2135258 - protein, 26 aa, Cryptosporidium hominis
AAAAATAATSTGSGGQAQVPAQPQNM

SEQ ID NO: 2135259 - protein, 24 aa, Cryptosporidium hominis
AAAAGGRAKRKKWSKGKQKDKANH

SEQ ID NO: 2135260 - protein, 9 aa, Cryptosporidium hominis
AAAKQSVDN

SEQ ID NO: 2135261 - protein, 15 aa, Cryptosporidium hominis
AAANQRSGRAGRVRP

SEQ ID NO: 2135262 - protein, 8 aa, Cryptosporidium hominis
AAASPSMQ

SEQ ID NO: 2135263 - protein, 8 aa, Cryptosporidium hominis
AACGTDKG

SEQ ID NO: 2135264 - protein, 25 aa, Cryptosporidium hominis
AADTESKHLSQTDKDKLNKAKKGFF

SEQ ID NO: 2135265 - protein, 5 aa, Cryptosporidium hominis
AADTY

SEQ ID NO: 2135266 - protein, 47 aa, Cryptosporidium hominis
AAEAANPEVENAPELKTLEKEKSGSGKSSKSSSIESKKSGKKTSKVA

SEQ ID NO: 2135267 - protein, 6 aa, Cryptosporidium hominis
AAEKRK

SEQ ID NO: 2135268 - protein, 6 aa, Cryptosporidium hominis
AAEKSI

SEQ ID NO: 2135269 - protein, 15 aa, Cryptosporidium hominis
AAERKESREKQARSG

SEQ ID NO: 2135270 - protein, 7 aa, Cryptosporidium hominis
AAESNQR

SEQ ID NO: 2135271 - protein, 9 aa, Cryptosporidium hominis
AAGENFDNI

SEQ ID NO: 2135272 - protein, 10 aa, Cryptosporidium hominis
AAGETSGNAI

SEQ ID NO: 2135273 - protein, 6 aa, Cryptosporidium hominis
AAGGRY

SEQ ID NO: 2135274 - protein, 8 aa, Cryptosporidium hominis
AAGGSVEP

SEQ ID NO: 2135275 - protein, 7 aa, Cryptosporidium hominis
AAGNGKH

SEQ ID NO: 2135276 - protein, 5 aa, Cryptosporidium hominis
AAGVS

SEQ ID NO: 2135277 - protein, 19 aa, Cryptosporidium hominis
AAHHNGSQYNEFSTEDARH

SEQ ID NO: 2135278 - protein, 10 aa, Cryptosporidium hominis
AAHSDDGKPV

SEQ ID NO: 2135279 - protein, 6 aa, Cryptosporidium hominis
AAIKAA

SEQ ID NO: 2135280 - protein, 5 aa, Cryptosporidium hominis
AAISN

SEQ ID NO: 2135281 - protein, 6 aa, Cryptosporidium hominis
AAITNS

SEQ ID NO: 2135282 - protein, 8 aa, Cryptosporidium hominis
AAKDLSPN

SEQ ID NO: 2135283 - protein, 14 aa, Cryptosporidium hominis
AAKNQVARNPENTV

SEQ ID NO: 2135284 - protein, 10 aa, Cryptosporidium hominis
AAKPNRKIKT

SEQ ID NO: 2135285 - protein, 5 aa, Cryptosporidium hominis
AAKRM

SEQ ID NO: 2135286 - protein, 4 aa, Cryptosporidium hominis
AAKT

SEQ ID NO: 2135287 - protein, 5 aa, Cryptosporidium hominis
AAKTG

SEQ ID NO: 2135288 - protein, 14 aa, Cryptosporidium hominis
AALEQRKKRENKNS

SEQ ID NO: 2135289 - protein, 4 aa, Cryptosporidium hominis
AALG

SEQ ID NO: 2135290 - protein, 68 aa, Cryptosporidium hominis
AALNNEEKMNQLDNKDDNNTNKSNNSNEKDNFNDSSNKAHNNIENDDNSHLNESNNTNENDNKIDRIS

SEQ ID NO: 2135291 - protein, 33 aa, Cryptosporidium hominis
AALSESERRSLEEREGQLYEKESRLKDKEGKFI

SEQ ID NO: 2135292 - protein, 4 aa, Cryptosporidium hominis
AANA

SEQ ID NO: 2135293 - protein, 5 aa, Cryptosporidium hominis
AANAD

SEQ ID NO: 2135294 - protein, 11 aa, Cryptosporidium hominis
AANDKKTDPKI

SEQ ID NO: 2135295 - protein, 35 aa, Cryptosporidium hominis
AANGYGAKRRSPPPFSSGPYNTGGRARGRYPSPSR

SEQ ID NO: 2135296 - protein, 11 aa, Cryptosporidium hominis
AANKDEIAYSD

SEQ ID NO: 2135297 - protein, 4 aa, Cryptosporidium hominis
AANN

SEQ ID NO: 2135298 - protein, 9 aa, Cryptosporidium hominis
AANNDNTSN

SEQ ID NO: 2135299 - protein, 12 aa, Cryptosporidium hominis
AANSKSNQKNLG

SEQ ID NO: 2135300 - protein, 19 aa, Cryptosporidium hominis
AAPAEQRGIPAKRPAPDYF

SEQ ID NO: 2135301 - protein, 9 aa, Cryptosporidium hominis
AAPGGKTTY

SEQ ID NO: 2135302 - protein, 15 aa, Cryptosporidium hominis
AAPHPGSSTQFHQGQ

SEQ ID NO: 2135303 - protein, 10 aa, Cryptosporidium hominis
AAPLDEHTQR

SEQ ID NO: 2135304 - protein, 8 aa, Cryptosporidium hominis
AAPPDNSD

SEQ ID NO: 2135305 - protein, 14 aa, Cryptosporidium hominis
AAPPSATKKSDAES

SEQ ID NO: 2135306 - protein, 9 aa, Cryptosporidium hominis
AAQKSLKDP

SEQ ID NO: 2135307 - protein, 4 aa, Cryptosporidium hominis
AAQL

SEQ ID NO: 2135308 - protein, 7 aa, Cryptosporidium hominis
AAQQQPS

SEQ ID NO: 2135309 - protein, 9 aa, Cryptosporidium hominis
AAQSKTRDE

SEQ ID NO: 2135310 - protein, 10 aa, Cryptosporidium hominis
AARAKDVRRN

SEQ ID NO: 2135311 - protein, 9 aa, Cryptosporidium hominis
AARDSNNVP

SEQ ID NO: 2135312 - protein, 13 aa, Cryptosporidium hominis
AAREEVPGRRGYP

SEQ ID NO: 2135313 - protein, 12 aa, Cryptosporidium hominis
AARGALSTRARV

SEQ ID NO: 2135314 - protein, 8 aa, Cryptosporidium hominis
AARGNGTS

SEQ ID NO: 2135315 - protein, 5 aa, Cryptosporidium hominis
AARGQ

SEQ ID NO: 2135316 - protein, 6 aa, Cryptosporidium hominis
AARRAQ

SEQ ID NO: 2135317 - protein, 7 aa, Cryptosporidium hominis
AASAQTA

SEQ ID NO: 2135318 - protein, 25 aa, Cryptosporidium hominis
AASEYSCSSGSFRDLNSSAEQTTFE

SEQ ID NO: 2135319 - protein, 4 aa, Cryptosporidium hominis
AASG

SEQ ID NO: 2135320 - protein, 5 aa, Cryptosporidium hominis
AASIR

SEQ ID NO: 2135321 - protein, 65 aa, Cryptosporidium hominis
AASNSEESKSISSDSVSIKGTAGGASSSAISSSAASVSGSSQRLKPSKSNLNANSPGASGDPSLK

SEQ ID NO: 2135322 - protein, 24 aa, Cryptosporidium hominis
AASPPKPASGAAAGGAASAQPKED

SEQ ID NO: 2135323 - protein, 4 aa, Cryptosporidium hominis
AASS

SEQ ID NO: 2135324 - protein, 72 aa, Cryptosporidium hominis
AASTGSSSSSSSSPLTVSGSTPGSSIVTSTSNSNSVSNIGPSTSTGTGTSSISTSNSNSNSNSSSNSNSSTI

SEQ ID NO: 2135325 - protein, 11 aa, Cryptosporidium hominis
AASTNSSEISG

SEQ ID NO: 2135326 - protein, 6 aa, Cryptosporidium hominis
AATEGV

SEQ ID NO: 2135327 - protein, 9 aa, Cryptosporidium hominis
AATGRGRGR

SEQ ID NO: 2135328 - protein, 16 aa, Cryptosporidium hominis
AATITTVGAGTGIGTA

SEQ ID NO: 2135329 - protein, 4 aa, Cryptosporidium hominis
AATS

SEQ ID NO: 2135330 - protein, 20 aa, Cryptosporidium hominis
AAVASSRQSNHRQKQKQKPK

SEQ ID NO: 2135331 - protein, 6 aa, Cryptosporidium hominis
AAVNPE

SEQ ID NO: 2135332 - protein, 14 aa, Cryptosporidium hominis
AAVSSSNSSNINNV

SEQ ID NO: 2135333 - protein, 6 aa, Cryptosporidium hominis
AAWGKE

SEQ ID NO: 2135334 - protein, 6 aa, Cryptosporidium hominis
AAYRAT

SEQ ID NO: 2135335 - protein, 31 aa, Cryptosporidium hominis
ACGPSTEAEKRLARSKRLGAASEDDKRKLRQ

SEQ ID NO: 2135336 - protein, 7 aa, Cryptosporidium hominis
ACKNGDN

SEQ ID NO: 2135337 - protein, 14 aa, Cryptosporidium hominis
ACQESNKYVTSEEK

SEQ ID NO: 2135338 - protein, 8 aa, Cryptosporidium hominis
ACTGSGKT

SEQ ID NO: 2135339 - protein, 13 aa, Cryptosporidium hominis
ACTSTGKKGAHVG

SEQ ID NO: 2135340 - protein, 4 aa, Cryptosporidium hominis
ADAL

SEQ ID NO: 2135341 - protein, 30 aa, Cryptosporidium hominis
ADASKKMESDQNQNKDLEIKPKDEKKTKLS

SEQ ID NO: 2135342 - protein, 37 aa, Cryptosporidium hominis
ADDDTSKLAELEDTSPKKKSKTRLKNSKSSKFSTKTI

SEQ ID NO: 2135343 - protein, 12 aa, Cryptosporidium hominis
ADDMNTTVSSYS

SEQ ID NO: 2135344 - protein, 8 aa, Cryptosporidium hominis
ADDSRFDP

SEQ ID NO: 2135345 - protein, 4 aa, Cryptosporidium hominis
ADED

SEQ ID NO: 2135346 - protein, 35 aa, Cryptosporidium hominis
ADEDLDANTSSVLKGTPNKTPPKSPENNDDNKNSL

SEQ ID NO: 2135347 - protein, 12 aa, Cryptosporidium hominis
ADEEDMSGGNKK

SEQ ID NO: 2135348 - protein, 5 aa, Cryptosporidium hominis
ADEEE

SEQ ID NO: 2135349 - protein, 6 aa, Cryptosporidium hominis
ADEEVD

SEQ ID NO: 2135350 - protein, 14 aa, Cryptosporidium hominis
ADENQDNYGDEQIS

SEQ ID NO: 2135351 - protein, 9 aa, Cryptosporidium hominis
ADESTGTIK

SEQ ID NO: 2135352 - protein, 6 aa, Cryptosporidium hominis
ADETVA

SEQ ID NO: 2135353 - protein, 9 aa, Cryptosporidium hominis
ADGASYEGE

SEQ ID NO: 2135354 - protein, 13 aa, Cryptosporidium hominis
ADGEDEEVHYEGD

SEQ ID NO: 2135355 - protein, 9 aa, Cryptosporidium hominis
ADGEETIEY

SEQ ID NO: 2135356 - protein, 5 aa, Cryptosporidium hominis
ADGLK

SEQ ID NO: 2135357 - protein, 7 aa, Cryptosporidium hominis
ADGLPNI

SEQ ID NO: 2135358 - protein, 31 aa, Cryptosporidium hominis
ADGNATTCETTPCKSKNLKSDNFGVETTGRR

SEQ ID NO: 2135359 - protein, 7 aa, Cryptosporidium hominis
ADGQGWH

SEQ ID NO: 2135360 - protein, 7 aa, Cryptosporidium hominis
ADGQSNS

SEQ ID NO: 2135361 - protein, 27 aa, Cryptosporidium hominis
ADGVEEKGTKVVSESNQATNLLTAEMK

SEQ ID NO: 2135362 - protein, 7 aa, Cryptosporidium hominis
ADHNSKS

SEQ ID NO: 2135363 - protein, 6 aa, Cryptosporidium hominis
ADITEK

SEQ ID NO: 2135364 - protein, 5 aa, Cryptosporidium hominis
ADITN

SEQ ID NO: 2135365 - protein, 9 aa, Cryptosporidium hominis
ADKKSISNK

SEQ ID NO: 2135366 - protein, 23 aa, Cryptosporidium hominis
ADKNENGKTLNQNQEEKNHDSFK

SEQ ID NO: 2135367 - protein, 12 aa, Cryptosporidium hominis
ADKNSSISNIEN

SEQ ID NO: 2135368 - protein, 16 aa, Cryptosporidium hominis
ADKPQPGSLSSGGYGP

SEQ ID NO: 2135369 - protein, 35 aa, Cryptosporidium hominis
ADLEYDSDDNAKRFPTIENAEERRQIENRNRFRKR

SEQ ID NO: 2135370 - protein, 9 aa, Cryptosporidium hominis
ADLGGPPLS

SEQ ID NO: 2135371 - protein, 21 aa, Cryptosporidium hominis
ADLNAKASSFDNANEGLSKSQ

SEQ ID NO: 2135372 - protein, 13 aa, Cryptosporidium hominis
ADLTSKWQGESEK

SEQ ID NO: 2135373 - protein, 8 aa, Cryptosporidium hominis
ADMSTSDA

SEQ ID NO: 2135374 - protein, 4 aa, Cryptosporidium hominis
ADNA

SEQ ID NO: 2135375 - protein, 5 aa, Cryptosporidium hominis
ADNDR

SEQ ID NO: 2135376 - protein, 6 aa, Cryptosporidium hominis
ADNGDA

SEQ ID NO: 2135377 - protein, 14 aa, Cryptosporidium hominis
ADNNNKENNQTVDE

SEQ ID NO: 2135378 - protein, 8 aa, Cryptosporidium hominis
ADNPNKKN

SEQ ID NO: 2135379 - protein, 6 aa, Cryptosporidium hominis
ADNQSG

SEQ ID NO: 2135380 - protein, 4 aa, Cryptosporidium hominis
ADNV

SEQ ID NO: 2135381 - protein, 21 aa, Cryptosporidium hominis
ADPDSGSNLIPNGKDLPFTNA

SEQ ID NO: 2135382 - protein, 5 aa, Cryptosporidium hominis
ADPER

SEQ ID NO: 2135383 - protein, 7 aa, Cryptosporidium hominis
ADPEVNV

SEQ ID NO: 2135384 - protein, 8 aa, Cryptosporidium hominis
ADPKTVGA

SEQ ID NO: 2135385 - protein, 5 aa, Cryptosporidium hominis
ADPMS

SEQ ID NO: 2135386 - protein, 8 aa, Cryptosporidium hominis
ADPNTRTD

SEQ ID NO: 2135387 - protein, 11 aa, Cryptosporidium hominis
ADPSKAEKELG

SEQ ID NO: 2135388 - protein, 7 aa, Cryptosporidium hominis
ADPSQNE

SEQ ID NO: 2135389 - protein, 9 aa, Cryptosporidium hominis
ADPTNAEEN

SEQ ID NO: 2135390 - protein, 5 aa, Cryptosporidium hominis
ADQEA

SEQ ID NO: 2135391 - protein, 58 aa, Cryptosporidium hominis
ADQENDENDSFDNYEDEDEDDIDTDHEDENEDDDDEDDDDEVDDNGNEDDDDEDYNSK

SEQ ID NO: 2135392 - protein, 9 aa, Cryptosporidium hominis
ADQGSRGKK

SEQ ID NO: 2135393 - protein, 16 aa, Cryptosporidium hominis
ADQSTLSQSDKREIPS

SEQ ID NO: 2135394 - protein, 6 aa, Cryptosporidium hominis
ADRDKI

SEQ ID NO: 2135395 - protein, 6 aa, Cryptosporidium hominis
ADRIAE

SEQ ID NO: 2135396 - protein, 9 aa, Cryptosporidium hominis
ADRISNTEE

SEQ ID NO: 2135397 - protein, 6 aa, Cryptosporidium hominis
ADRPTV

SEQ ID NO: 2135398 - protein, 8 aa, Cryptosporidium hominis
ADSDGSSS

SEQ ID NO: 2135399 - protein, 13 aa, Cryptosporidium hominis
ADSDSESAKNAHK

SEQ ID NO: 2135400 - protein, 7 aa, Cryptosporidium hominis
ADSGEMS

SEQ ID NO: 2135401 - protein, 6 aa, Cryptosporidium hominis
ADSGES

SEQ ID NO: 2135402 - protein, 4 aa, Cryptosporidium hominis
ADSI

SEQ ID NO: 2135403 - protein, 5 aa, Cryptosporidium hominis
ADSIR

SEQ ID NO: 2135404 - protein, 9 aa, Cryptosporidium hominis
ADSNGDGEI

SEQ ID NO: 2135405 - protein, 8 aa, Cryptosporidium hominis
ADSNGRQV

SEQ ID NO: 2135406 - protein, 9 aa, Cryptosporidium hominis
ADSSDSSVQ

SEQ ID NO: 2135407 - protein, 6 aa, Cryptosporidium hominis
ADSSIQ

SEQ ID NO: 2135408 - protein, 12 aa, Cryptosporidium hominis
ADSSNSPKGHNH

SEQ ID NO: 2135409 - protein, 9 aa, Cryptosporidium hominis
ADTFEGNSI

SEQ ID NO: 2135410 - protein, 5 aa, Cryptosporidium hominis
ADTIS

SEQ ID NO: 2135411 - protein, 5 aa, Cryptosporidium hominis
ADTVE

SEQ ID NO: 2135412 - protein, 13 aa, Cryptosporidium hominis
ADVNAKDKYGRTP

SEQ ID NO: 2135413 - protein, 11 aa, Cryptosporidium hominis
ADVVPPNETVY

SEQ ID NO: 2135414 - protein, 21 aa, Cryptosporidium hominis
ADYNSSSGNGQTTNNNNAQNF

SEQ ID NO: 2135415 - protein, 7 aa, Cryptosporidium hominis
AEAEVEA

SEQ ID NO: 2135416 - protein, 8 aa, Cryptosporidium hominis
AEAGDFGN

SEQ ID NO: 2135417 - protein, 10 aa, Cryptosporidium hominis
AECQKQGKEL

SEQ ID NO: 2135418 - protein, 4 aa, Cryptosporidium hominis
AEDC

SEQ ID NO: 2135419 - protein, 20 aa, Cryptosporidium hominis
AEDDDDDVIDGKKPKKPKRM

SEQ ID NO: 2135420 - protein, 10 aa, Cryptosporidium hominis
AEDEGIPSTA

SEQ ID NO: 2135421 - protein, 10 aa, Cryptosporidium hominis
AEDENSSKFY

SEQ ID NO: 2135422 - protein, 10 aa, Cryptosporidium hominis
AEDEYRQKGD

SEQ ID NO: 2135423 - protein, 12 aa, Cryptosporidium hominis
AEDGGFNSPQKS

SEQ ID NO: 2135424 - protein, 16 aa, Cryptosporidium hominis
AEDKTGQVKLTGNPNF

SEQ ID NO: 2135425 - protein, 5 aa, Cryptosporidium hominis
AEDNG

SEQ ID NO: 2135426 - protein, 5 aa, Cryptosporidium hominis
AEDPE

SEQ ID NO: 2135427 - protein, 6 aa, Cryptosporidium hominis
AEDPFQ

SEQ ID NO: 2135428 - protein, 4 aa, Cryptosporidium hominis
AEEA

SEQ ID NO: 2135429 - protein, 5 aa, Cryptosporidium hominis
AEEAA

SEQ ID NO: 2135430 - protein, 11 aa, Cryptosporidium hominis
AEEAQTGQCGK

SEQ ID NO: 2135431 - protein, 7 aa, Cryptosporidium hominis
AEEAVES

SEQ ID NO: 2135432 - protein, 5 aa, Cryptosporidium hominis
AEEDA

SEQ ID NO: 2135433 - protein, 11 aa, Cryptosporidium hominis
AEEEASEDNSK

SEQ ID NO: 2135434 - protein, 12 aa, Cryptosporidium hominis
AEEEYSELDIKD

SEQ ID NO: 2135435 - protein, 14 aa, Cryptosporidium hominis
AEEFGSGNKRRLSG

SEQ ID NO: 2135436 - protein, 8 aa, Cryptosporidium hominis
AEEGAYSG

SEQ ID NO: 2135437 - protein, 7 aa, Cryptosporidium hominis
AEEKEEQ

SEQ ID NO: 2135438 - protein, 6 aa, Cryptosporidium hominis
AEEKEI

SEQ ID NO: 2135439 - protein, 9 aa, Cryptosporidium hominis
AEEKHYSSC

SEQ ID NO: 2135440 - protein, 23 aa, Cryptosporidium hominis
AEEKRMETEEKGMESKKKGSIDS

SEQ ID NO: 2135441 - protein, 7 aa, Cryptosporidium hominis
AEESEHR

SEQ ID NO: 2135442 - protein, 18 aa, Cryptosporidium hominis
AEESKETKTDIQKDEEMA

SEQ ID NO: 2135443 - protein, 6 aa, Cryptosporidium hominis
AEETIS

SEQ ID NO: 2135444 - protein, 8 aa, Cryptosporidium hominis
AEETNMNS

SEQ ID NO: 2135445 - protein, 12 aa, Cryptosporidium hominis
AEEYNNQKKTRA

SEQ ID NO: 2135446 - protein, 5 aa, Cryptosporidium hominis
AEEYT

SEQ ID NO: 2135447 - protein, 9 aa, Cryptosporidium hominis
AEGARNTLK

SEQ ID NO: 2135448 - protein, 6 aa, Cryptosporidium hominis
AEGFDA

SEQ ID NO: 2135449 - protein, 118 aa, Cryptosporidium hominis
AEGGGKETEKRGEGEGKGGREGEGGPGGDGGERRGETTGKGGKKGGGGGGGGKAARRSRDPTRRRERGGRGGGRQRGEERGREGERGKGRRHHKEREPAADQEEKTQPQNRPPPQKKK

SEQ ID NO: 2135450 - protein, 60 aa, Cryptosporidium hominis
AEGGMPGGMPGGMPGGMPGGMPGGMPGGMPGGMPGGMPGGMPGGMPGGMPGSNGPTVEEV

SEQ ID NO: 2135451 - protein, 13 aa, Cryptosporidium hominis
AEGGSSDAQLSAE

SEQ ID NO: 2135452 - protein, 7 aa, Cryptosporidium hominis
AEGTGLK

SEQ ID NO: 2135453 - protein, 5 aa, Cryptosporidium hominis
AEGVS

SEQ ID NO: 2135454 - protein, 8 aa, Cryptosporidium hominis
AEHQSGVP

SEQ ID NO: 2135455 - protein, 10 aa, Cryptosporidium hominis
AEIDDDDEKI

SEQ ID NO: 2135456 - protein, 14 aa, Cryptosporidium hominis
AEIDENNPSGFDET

SEQ ID NO: 2135457 - protein, 14 aa, Cryptosporidium hominis
AEIEDQSADTGGEI

SEQ ID NO: 2135458 - protein, 10 aa, Cryptosporidium hominis
AEIENGTQEF

SEQ ID NO: 2135459 - protein, 6 aa, Cryptosporidium hominis
AEISRP

SEQ ID NO: 2135460 - protein, 8 aa, Cryptosporidium hominis
AEITELTP

SEQ ID NO: 2135461 - protein, 10 aa, Cryptosporidium hominis
AEKCKPKEQL

SEQ ID NO: 2135462 - protein, 9 aa, Cryptosporidium hominis
AEKDNAEVR

SEQ ID NO: 2135463 - protein, 8 aa, Cryptosporidium hominis
AEKEAYIN

SEQ ID NO: 2135464 - protein, 29 aa, Cryptosporidium hominis
AEKEQQKKSEEKPKVNKKSAGSKQASSKR

SEQ ID NO: 2135465 - protein, 24 aa, Cryptosporidium hominis
AEKKEREKQRRSGNKKLSETKDKG

SEQ ID NO: 2135466 - protein, 9 aa, Cryptosporidium hominis
AEKNSESYR

SEQ ID NO: 2135467 - protein, 7 aa, Cryptosporidium hominis
AEKQSTI

SEQ ID NO: 2135468 - protein, 13 aa, Cryptosporidium hominis
AEKYKGEDEQNRL

SEQ ID NO: 2135469 - protein, 6 aa, Cryptosporidium hominis
AELKES

SEQ ID NO: 2135470 - protein, 14 aa, Cryptosporidium hominis
AELNSQKDELDKQG

SEQ ID NO: 2135471 - protein, 50 aa, Cryptosporidium hominis
AELRTRDGKLRHPTLSTGNSEVANQNQGQSQSQSQTQSQSQYQSATQLPT

SEQ ID NO: 2135472 - protein, 13 aa, Cryptosporidium hominis
AELSGSSKLEDEN

SEQ ID NO: 2135473 - protein, 22 aa, Cryptosporidium hominis
AEMYSEDEEPKDRGAYESSVTP

SEQ ID NO: 2135474 - protein, 12 aa, Cryptosporidium hominis
AENAGLDQQETT

SEQ ID NO: 2135475 - protein, 13 aa, Cryptosporidium hominis
AENAKKIASPGKG

SEQ ID NO: 2135476 - protein, 6 aa, Cryptosporidium hominis
AENDSG

SEQ ID NO: 2135477 - protein, 8 aa, Cryptosporidium hominis
AENESDKG

SEQ ID NO: 2135478 - protein, 19 aa, Cryptosporidium hominis
AENGNVYDTSMKKRRKECS

SEQ ID NO: 2135479 - protein, 25 aa, Cryptosporidium hominis
AENISGTENSISRSSLESKTITTDA

SEQ ID NO: 2135480 - protein, 6 aa, Cryptosporidium hominis
AENITK

SEQ ID NO: 2135481 - protein, 14 aa, Cryptosporidium hominis
AENKKMEGNLDYEK

SEQ ID NO: 2135482 - protein, 7 aa, Cryptosporidium hominis
AENKNKD

SEQ ID NO: 2135483 - protein, 8 aa, Cryptosporidium hominis
AENNSSVS

SEQ ID NO: 2135484 - protein, 8 aa, Cryptosporidium hominis
AENNTLRD

SEQ ID NO: 2135485 - protein, 4 aa, Cryptosporidium hominis
AENQ

SEQ ID NO: 2135486 - protein, 26 aa, Cryptosporidium hominis
AENQTQTDDDKGHWSEESAESNSRTM

SEQ ID NO: 2135487 - protein, 5 aa, Cryptosporidium hominis
AENRN

SEQ ID NO: 2135488 - protein, 8 aa, Cryptosporidium hominis
AENSETEI

SEQ ID NO: 2135489 - protein, 8 aa, Cryptosporidium hominis
AENSHTTR

SEQ ID NO: 2135490 - protein, 13 aa, Cryptosporidium hominis
AENSSTKGKKKNE

SEQ ID NO: 2135491 - protein, 15 aa, Cryptosporidium hominis
AENSTQKSDSDSLNS

SEQ ID NO: 2135492 - protein, 5 aa, Cryptosporidium hominis
AENYE

SEQ ID NO: 2135493 - protein, 16 aa, Cryptosporidium hominis
AENYNEDKKDGKIAAK

SEQ ID NO: 2135494 - protein, 6 aa, Cryptosporidium hominis
AEPNFY

SEQ ID NO: 2135495 - protein, 8 aa, Cryptosporidium hominis
AEQDDSIK

SEQ ID NO: 2135496 - protein, 9 aa, Cryptosporidium hominis
AEQEEEEEV

SEQ ID NO: 2135497 - protein, 8 aa, Cryptosporidium hominis
AEQGGYSS

SEQ ID NO: 2135498 - protein, 11 aa, Cryptosporidium hominis
AEQKKSFENSL

SEQ ID NO: 2135499 - protein, 6 aa, Cryptosporidium hominis
AEQPDC

SEQ ID NO: 2135500 - protein, 6 aa, Cryptosporidium hominis
AEQQIT

SEQ ID NO: 2135501 - protein, 26 aa, Cryptosporidium hominis
AEQQQKPSVALKNSSSQTSSTQETIT

SEQ ID NO: 2135502 - protein, 6 aa, Cryptosporidium hominis
AEQSEW

SEQ ID NO: 2135503 - protein, 34 aa, Cryptosporidium hominis
AEQSSVSRPEPGEKALQDTIDSQGEDTEQRTQKL

SEQ ID NO: 2135504 - protein, 6 aa, Cryptosporidium hominis
AEQSVY

SEQ ID NO: 2135505 - protein, 7 aa, Cryptosporidium hominis
AERENAD

SEQ ID NO: 2135506 - protein, 7 aa, Cryptosporidium hominis
AERETAA

SEQ ID NO: 2135507 - protein, 7 aa, Cryptosporidium hominis
AERGTRM

SEQ ID NO: 2135508 - protein, 6 aa, Cryptosporidium hominis
AERING

SEQ ID NO: 2135509 - protein, 6 aa, Cryptosporidium hominis
AERREL

SEQ ID NO: 2135510 - protein, 5 aa, Cryptosporidium hominis
AERSL

SEQ ID NO: 2135511 - protein, 6 aa, Cryptosporidium hominis
AERSSF

SEQ ID NO: 2135512 - protein, 8 aa, Cryptosporidium hominis
AESCSDSN

SEQ ID NO: 2135513 - protein, 5 aa, Cryptosporidium hominis
AESEM

SEQ ID NO: 2135514 - protein, 7 aa, Cryptosporidium hominis
AESESPI

SEQ ID NO: 2135515 - protein, 35 aa, Cryptosporidium hominis
AESFEKRKSAESEKKNANGSYKSCKESEKNDEIDQ

SEQ ID NO: 2135516 - protein, 4 aa, Cryptosporidium hominis
AESH

SEQ ID NO: 2135517 - protein, 5 aa, Cryptosporidium hominis
AESII

SEQ ID NO: 2135518 - protein, 6 aa, Cryptosporidium hominis
AESIKD

SEQ ID NO: 2135519 - protein, 6 aa, Cryptosporidium hominis
AESKNL

SEQ ID NO: 2135520 - protein, 7 aa, Cryptosporidium hominis
AESKRQF

SEQ ID NO: 2135521 - protein, 8 aa, Cryptosporidium hominis
AESMETVG

SEQ ID NO: 2135522 - protein, 6 aa, Cryptosporidium hominis
AESNCD

SEQ ID NO: 2135523 - protein, 7 aa, Cryptosporidium hominis
AESNSKQ

SEQ ID NO: 2135524 - protein, 5 aa, Cryptosporidium hominis
AESPN

SEQ ID NO: 2135525 - protein, 7 aa, Cryptosporidium hominis
AESQHRI

SEQ ID NO: 2135526 - protein, 60 aa, Cryptosporidium hominis
AESSEGSSPNRNRGRINSNAQSNRTSRSSRSRRTRTDRRTRSGVSRRDHSRSERSATGTS

SEQ ID NO: 2135527 - protein, 5 aa, Cryptosporidium hominis
AESSI

SEQ ID NO: 2135528 - protein, 5 aa, Cryptosporidium hominis
AESSS

SEQ ID NO: 2135529 - protein, 8 aa, Cryptosporidium hominis
AESSSKFK

SEQ ID NO: 2135530 - protein, 15 aa, Cryptosporidium hominis
AESTAREWNRLYAKG

SEQ ID NO: 2135531 - protein, 7 aa, Cryptosporidium hominis
AESTMSR

SEQ ID NO: 2135532 - protein, 11 aa, Cryptosporidium hominis
AETEVKYSDET

SEQ ID NO: 2135533 - protein, 19 aa, Cryptosporidium hominis
AETKVNDGEESATESGSNN

SEQ ID NO: 2135534 - protein, 33 aa, Cryptosporidium hominis
AETNHGTAKHRIDGDQNSGSGVVGQNENISGFS

SEQ ID NO: 2135535 - protein, 7 aa, Cryptosporidium hominis
AETNIEP

SEQ ID NO: 2135536 - protein, 6 aa, Cryptosporidium hominis
AETPQE

SEQ ID NO: 2135537 - protein, 16 aa, Cryptosporidium hominis
AETSRWSEETTVQSSV

SEQ ID NO: 2135538 - protein, 4 aa, Cryptosporidium hominis
AETV

SEQ ID NO: 2135539 - protein, 7 aa, Cryptosporidium hominis
AETVPGL

SEQ ID NO: 2135540 - protein, 6 aa, Cryptosporidium hominis
AEVDGN

SEQ ID NO: 2135541 - protein, 5 aa, Cryptosporidium hominis
AEVER

SEQ ID NO: 2135542 - protein, 7 aa, Cryptosporidium hominis
AEVERRD

SEQ ID NO: 2135543 - protein, 10 aa, Cryptosporidium hominis
AEVNEEDQSN

SEQ ID NO: 2135544 - protein, 14 aa, Cryptosporidium hominis
AEVSGNLNQGDQQA

SEQ ID NO: 2135545 - protein, 6 aa, Cryptosporidium hominis
AEYEKQ

SEQ ID NO: 2135546 - protein, 4 aa, Cryptosporidium hominis
AEYN

SEQ ID NO: 2135547 - protein, 14 aa, Cryptosporidium hominis
AEYSPSSPLDETKN

SEQ ID NO: 2135548 - protein, 15 aa, Cryptosporidium hominis
AFEGSGNLEKDASLD

SEQ ID NO: 2135549 - protein, 10 aa, Cryptosporidium hominis
AFESNKNSYS

SEQ ID NO: 2135550 - protein, 20 aa, Cryptosporidium hominis
AFGEEGLKSEGFGGGGDGGF

SEQ ID NO: 2135551 - protein, 5 aa, Cryptosporidium hominis
AFGGG

SEQ ID NO: 2135552 - protein, 9 aa, Cryptosporidium hominis
AFKPGEKVS

SEQ ID NO: 2135553 - protein, 13 aa, Cryptosporidium hominis
AFNGGDPTQVQAP

SEQ ID NO: 2135554 - protein, 14 aa, Cryptosporidium hominis
AFNKPTKTITDSFN

SEQ ID NO: 2135555 - protein, 6 aa, Cryptosporidium hominis
AFPANK

SEQ ID NO: 2135556 - protein, 5 aa, Cryptosporidium hominis
AFPNS

SEQ ID NO: 2135557 - protein, 12 aa, Cryptosporidium hominis
AFQGNKKSTINF

SEQ ID NO: 2135558 - protein, 12 aa, Cryptosporidium hominis
AFSESDPESAVN

SEQ ID NO: 2135559 - protein, 19 aa, Cryptosporidium hominis
AFSSPSSSSASEDEDDISL

SEQ ID NO: 2135560 - protein, 7 aa, Cryptosporidium hominis
AFSSSNN

SEQ ID NO: 2135561 - protein, 5 aa, Cryptosporidium hominis
AFTDE

SEQ ID NO: 2135562 - protein, 4 aa, Cryptosporidium hominis
AFYS

SEQ ID NO: 2135563 - protein, 9 aa, Cryptosporidium hominis
AGAAAARGV

SEQ ID NO: 2135564 - protein, 9 aa, Cryptosporidium hominis
AGAAGETSG

SEQ ID NO: 2135565 - protein, 8 aa, Cryptosporidium hominis
AGAGTAAD

SEQ ID NO: 2135566 - protein, 10 aa, Cryptosporidium hominis
AGAKNAERIS

SEQ ID NO: 2135567 - protein, 10 aa, Cryptosporidium hominis
AGANPNAVSA

SEQ ID NO: 2135568 - protein, 8 aa, Cryptosporidium hominis
AGAPITLG

SEQ ID NO: 2135569 - protein, 20 aa, Cryptosporidium hominis
AGASKGPKQLVGQDQRPYPL

SEQ ID NO: 2135570 - protein, 12 aa, Cryptosporidium hominis
AGATGLDPSQTS

SEQ ID NO: 2135571 - protein, 9 aa, Cryptosporidium hominis
AGATQKEDF

SEQ ID NO: 2135572 - protein, 6 aa, Cryptosporidium hominis
AGDANG

SEQ ID NO: 2135573 - protein, 8 aa, Cryptosporidium hominis
AGDLETET

SEQ ID NO: 2135574 - protein, 6 aa, Cryptosporidium hominis
AGDSAN

SEQ ID NO: 2135575 - protein, 7 aa, Cryptosporidium hominis
AGDSRAV

SEQ ID NO: 2135576 - protein, 7 aa, Cryptosporidium hominis
AGDTIDD

SEQ ID NO: 2135577 - protein, 8 aa, Cryptosporidium hominis
AGEAEGNL

SEQ ID NO: 2135578 - protein, 4 aa, Cryptosporidium hominis
AGED

SEQ ID NO: 2135579 - protein, 7 aa, Cryptosporidium hominis
AGEDTIS

SEQ ID NO: 2135580 - protein, 6 aa, Cryptosporidium hominis
AGEEAP

SEQ ID NO: 2135581 - protein, 8 aa, Cryptosporidium hominis
AGEGGRRI

SEQ ID NO: 2135582 - protein, 6 aa, Cryptosporidium hominis
AGEGGS

SEQ ID NO: 2135583 - protein, 13 aa, Cryptosporidium hominis
AGESAEASPSSTK

SEQ ID NO: 2135584 - protein, 9 aa, Cryptosporidium hominis
AGESSKSKV

SEQ ID NO: 2135585 - protein, 5 aa, Cryptosporidium hominis
AGETV

SEQ ID NO: 2135586 - protein, 8 aa, Cryptosporidium hominis
AGFTRPEA

SEQ ID NO: 2135587 - protein, 4 aa, Cryptosporidium hominis
AGGD

SEQ ID NO: 2135588 - protein, 12 aa, Cryptosporidium hominis
AGGDLTQLDKPE

SEQ ID NO: 2135589 - protein, 6 aa, Cryptosporidium hominis
AGGEGL

SEQ ID NO: 2135590 - protein, 4 aa, Cryptosporidium hominis
AGGI

SEQ ID NO: 2135591 - protein, 7 aa, Cryptosporidium hominis
AGGIARD

SEQ ID NO: 2135592 - protein, 5 aa, Cryptosporidium hominis
AGGIE

SEQ ID NO: 2135593 - protein, 8 aa, Cryptosporidium hominis
AGGPPPHI

SEQ ID NO: 2135594 - protein, 6 aa, Cryptosporidium hominis
AGGSDQ

SEQ ID NO: 2135595 - protein, 13 aa, Cryptosporidium hominis
AGGSLGGAQSVNE

SEQ ID NO: 2135596 - protein, 9 aa, Cryptosporidium hominis
AGGTGSGMG

SEQ ID NO: 2135597 - protein, 16 aa, Cryptosporidium hominis
AGGTNKIKKDQGANSI

SEQ ID NO: 2135598 - protein, 18 aa, Cryptosporidium hominis
AGGTSKNSLNSSSNERSR

SEQ ID NO: 2135599 - protein, 27 aa, Cryptosporidium hominis
AGGVGGTGIGEAGSVSGAGGATENPIS

SEQ ID NO: 2135600 - protein, 6 aa, Cryptosporidium hominis
AGIGPG

SEQ ID NO: 2135601 - protein, 6 aa, Cryptosporidium hominis
AGISDH

SEQ ID NO: 2135602 - protein, 6 aa, Cryptosporidium hominis
AGISEE

SEQ ID NO: 2135603 - protein, 10 aa, Cryptosporidium hominis
AGKLPSSYNN

SEQ ID NO: 2135604 - protein, 19 aa, Cryptosporidium hominis
AGKQDHTEAIKNGENTDQS

SEQ ID NO: 2135605 - protein, 11 aa, Cryptosporidium hominis
AGKSFRKSAPA

SEQ ID NO: 2135606 - protein, 8 aa, Cryptosporidium hominis
AGKSTSAV

SEQ ID NO: 2135607 - protein, 12 aa, Cryptosporidium hominis
AGLESSDGSLRS

SEQ ID NO: 2135608 - protein, 6 aa, Cryptosporidium hominis
AGLSGN

SEQ ID NO: 2135609 - protein, 14 aa, Cryptosporidium hominis
AGLTPGVSTDSGRI

SEQ ID NO: 2135610 - protein, 12 aa, Cryptosporidium hominis
AGNDEESGNSEL

SEQ ID NO: 2135611 - protein, 6 aa, Cryptosporidium hominis
AGNDTN

SEQ ID NO: 2135612 - protein, 19 aa, Cryptosporidium hominis
AGNEIDEKTLKESNDGNNK

SEQ ID NO: 2135613 - protein, 7 aa, Cryptosporidium hominis
AGNGYTN

SEQ ID NO: 2135614 - protein, 18 aa, Cryptosporidium hominis
AGNKSSVAGRDKKENVSS

SEQ ID NO: 2135615 - protein, 6 aa, Cryptosporidium hominis
AGNNYH

SEQ ID NO: 2135616 - protein, 8 aa, Cryptosporidium hominis
AGNSENLD

SEQ ID NO: 2135617 - protein, 8 aa, Cryptosporidium hominis
AGNSESSS

SEQ ID NO: 2135618 - protein, 8 aa, Cryptosporidium hominis
AGNTGITT

SEQ ID NO: 2135619 - protein, 5 aa, Cryptosporidium hominis
AGPGI

SEQ ID NO: 2135620 - protein, 9 aa, Cryptosporidium hominis
AGPNITSYT

SEQ ID NO: 2135621 - protein, 10 aa, Cryptosporidium hominis
AGPPGTGKTA

SEQ ID NO: 2135622 - protein, 4 aa, Cryptosporidium hominis
AGPY

SEQ ID NO: 2135623 - protein, 17 aa, Cryptosporidium hominis
AGQDDGIEGETRLEKKK

SEQ ID NO: 2135624 - protein, 8 aa, Cryptosporidium hominis
AGQEKFGG

SEQ ID NO: 2135625 - protein, 6 aa, Cryptosporidium hominis
AGQERF

SEQ ID NO: 2135626 - protein, 6 aa, Cryptosporidium hominis
AGQERY

SEQ ID NO: 2135627 - protein, 7 aa, Cryptosporidium hominis
AGQERYR

SEQ ID NO: 2135628 - protein, 9 aa, Cryptosporidium hominis
AGQGDDNIE

SEQ ID NO: 2135629 - protein, 10 aa, Cryptosporidium hominis
AGQIDNADEH

SEQ ID NO: 2135630 - protein, 6 aa, Cryptosporidium hominis
AGQRTR

SEQ ID NO: 2135631 - protein, 7 aa, Cryptosporidium hominis
AGRFGTK

SEQ ID NO: 2135632 - protein, 11 aa, Cryptosporidium hominis
AGRGRGKSAAL

SEQ ID NO: 2135633 - protein, 29 aa, Cryptosporidium hominis
AGRGSSRGKGGVPSNGRPSFSGPPSSITE

SEQ ID NO: 2135634 - protein, 7 aa, Cryptosporidium hominis
AGRKDKR

SEQ ID NO: 2135635 - protein, 7 aa, Cryptosporidium hominis
AGRKNLE

SEQ ID NO: 2135636 - protein, 7 aa, Cryptosporidium hominis
AGRPQFE

SEQ ID NO: 2135637 - protein, 8 aa, Cryptosporidium hominis
AGRTQIAA

SEQ ID NO: 2135638 - protein, 6 aa, Cryptosporidium hominis
AGRTTG

SEQ ID NO: 2135639 - protein, 6 aa, Cryptosporidium hominis
AGSCPK

SEQ ID NO: 2135640 - protein, 8 aa, Cryptosporidium hominis
AGSEYTQN

SEQ ID NO: 2135641 - protein, 4 aa, Cryptosporidium hominis
AGSI

SEQ ID NO: 2135642 - protein, 9 aa, Cryptosporidium hominis
AGSNVGSSI

SEQ ID NO: 2135643 - protein, 7 aa, Cryptosporidium hominis
AGSRDNT

SEQ ID NO: 2135644 - protein, 6 aa, Cryptosporidium hominis
AGSRGV

SEQ ID NO: 2135645 - protein, 5 aa, Cryptosporidium hominis
AGSSD

SEQ ID NO: 2135646 - protein, 5 aa, Cryptosporidium hominis
AGSSG

SEQ ID NO: 2135647 - protein, 8 aa, Cryptosporidium hominis
AGSTAEKL

SEQ ID NO: 2135648 - protein, 8 aa, Cryptosporidium hominis
AGSTEPNA

SEQ ID NO: 2135649 - protein, 4 aa, Cryptosporidium hominis
AGSY

SEQ ID NO: 2135650 - protein, 7 aa, Cryptosporidium hominis
AGTDGHY

SEQ ID NO: 2135651 - protein, 6 aa, Cryptosporidium hominis
AGTEEA

SEQ ID NO: 2135652 - protein, 8 aa, Cryptosporidium hominis
AGTGNTSI

SEQ ID NO: 2135653 - protein, 4 aa, Cryptosporidium hominis
AGTL

SEQ ID NO: 2135654 - protein, 6 aa, Cryptosporidium hominis
AGTPDY

SEQ ID NO: 2135655 - protein, 6 aa, Cryptosporidium hominis
AGTRMY

SEQ ID NO: 2135656 - protein, 27 aa, Cryptosporidium hominis
AGTSLQPYSGAYKRTKGKRWSTEQTNK

SEQ ID NO: 2135657 - protein, 7 aa, Cryptosporidium hominis
AGTSSEL

SEQ ID NO: 2135658 - protein, 36 aa, Cryptosporidium hominis
AGTVASSSITINTNTNTNSASVSSPNYLEQPSTTVV

SEQ ID NO: 2135659 - protein, 4 aa, Cryptosporidium hominis
AGTY

SEQ ID NO: 2135660 - protein, 15 aa, Cryptosporidium hominis
AGVGAGVGTQTEIER

SEQ ID NO: 2135661 - protein, 42 aa, Cryptosporidium hominis
AGVNQGEGSYFSDSKEKKSRGLSRKSLTSNSNLSYTNSGLFS

SEQ ID NO: 2135662 - protein, 6 aa, Cryptosporidium hominis
AGVSKP

SEQ ID NO: 2135663 - protein, 5 aa, Cryptosporidium hominis
AGVTL

SEQ ID NO: 2135664 - protein, 63 aa, Cryptosporidium hominis
AGVTNNSLTKTPTKTRTRKVRESSDDFGNSSSGPSVHSKSGYSSNSSGESCSFGSSSNISEDL

SEQ ID NO: 2135665 - protein, 6 aa, Cryptosporidium hominis
AGVTTE

SEQ ID NO: 2135666 - protein, 7 aa, Cryptosporidium hominis
AGYAADA

SEQ ID NO: 2135667 - protein, 4 aa, Cryptosporidium hominis
AGYG

SEQ ID NO: 2135668 - protein, 6 aa, Cryptosporidium hominis
AGYNRH

SEQ ID NO: 2135669 - protein, 4 aa, Cryptosporidium hominis
AGYV

SEQ ID NO: 2135670 - protein, 16 aa, Cryptosporidium hominis
AHDGSKAQAKVSKLRE

SEQ ID NO: 2135671 - protein, 9 aa, Cryptosporidium hominis
AHEENRKNL

SEQ ID NO: 2135672 - protein, 4 aa, Cryptosporidium hominis
AHEG

SEQ ID NO: 2135673 - protein, 4 aa, Cryptosporidium hominis
AHEL

SEQ ID NO: 2135674 - protein, 7 aa, Cryptosporidium hominis
AHEQTKS

SEQ ID NO: 2135675 - protein, 5 aa, Cryptosporidium hominis
AHESE

SEQ ID NO: 2135676 - protein, 7 aa, Cryptosporidium hominis
AHGDSST

SEQ ID NO: 2135677 - protein, 61 aa, Cryptosporidium hominis
AHGQGHVQGHSHGHGQRHGHGHGHTQTQNQNHSHQARTTGDQSLQQESNNASKVATTIGSN

SEQ ID NO: 2135678 - protein, 7 aa, Cryptosporidium hominis
AHNGPAA

SEQ ID NO: 2135679 - protein, 7 aa, Cryptosporidium hominis
AHNNNAI

SEQ ID NO: 2135680 - protein, 8 aa, Cryptosporidium hominis
AHNSNTTI

SEQ ID NO: 2135681 - protein, 6 aa, Cryptosporidium hominis
AHNTQL

SEQ ID NO: 2135682 - protein, 4 aa, Cryptosporidium hominis
AHPE

SEQ ID NO: 2135683 - protein, 5 aa, Cryptosporidium hominis
AHPGA

SEQ ID NO: 2135684 - protein, 5 aa, Cryptosporidium hominis
AHPND

SEQ ID NO: 2135685 - protein, 14 aa, Cryptosporidium hominis
AHRADAQCSSCGGT

SEQ ID NO: 2135686 - protein, 7 aa, Cryptosporidium hominis
AHRIGQK

SEQ ID NO: 2135687 - protein, 8 aa, Cryptosporidium hominis
AHRPPKHQ

SEQ ID NO: 2135688 - protein, 7 aa, Cryptosporidium hominis
AHSKGQL

SEQ ID NO: 2135689 - protein, 4 aa, Cryptosporidium hominis
AHSL

SEQ ID NO: 2135690 - protein, 6 aa, Cryptosporidium hominis
AHTFTP

SEQ ID NO: 2135691 - protein, 5 aa, Cryptosporidium hominis
AHTKE

SEQ ID NO: 2135692 - protein, 5 aa, Cryptosporidium hominis
AIDNK

SEQ ID NO: 2135693 - protein, 24 aa, Cryptosporidium hominis
AIDPKKGQEEESSNFGSSDKIEED

SEQ ID NO: 2135694 - protein, 7 aa, Cryptosporidium hominis
AIDSGAS

SEQ ID NO: 2135695 - protein, 19 aa, Cryptosporidium hominis
AIEASQKAIEASKKAIEAS

SEQ ID NO: 2135696 - protein, 8 aa, Cryptosporidium hominis
AIEDSGES

SEQ ID NO: 2135697 - protein, 11 aa, Cryptosporidium hominis
AIEEEYKKNQE

SEQ ID NO: 2135698 - protein, 7 aa, Cryptosporidium hominis
AIENPLS

SEQ ID NO: 2135699 - protein, 13 aa, Cryptosporidium hominis
AIEPSIAPPIPPI

SEQ ID NO: 2135700 - protein, 5 aa, Cryptosporidium hominis
AIERE

SEQ ID NO: 2135701 - protein, 10 aa, Cryptosporidium hominis
AIGGGGSYSL

SEQ ID NO: 2135702 - protein, 9 aa, Cryptosporidium hominis
AIGKDMQNA

SEQ ID NO: 2135703 - protein, 7 aa, Cryptosporidium hominis
AIGPVNK

SEQ ID NO: 2135704 - protein, 11 aa, Cryptosporidium hominis
AIGQNNQTATS

SEQ ID NO: 2135705 - protein, 10 aa, Cryptosporidium hominis
AIGTAQEGAE

SEQ ID NO: 2135706 - protein, 20 aa, Cryptosporidium hominis
AIGTGPLNTGSSNNYFGGQS

SEQ ID NO: 2135707 - protein, 16 aa, Cryptosporidium hominis
AIKDNEKFKEKHKNLK

SEQ ID NO: 2135708 - protein, 4 aa, Cryptosporidium hominis
AIKG

SEQ ID NO: 2135709 - protein, 7 aa, Cryptosporidium hominis
AIKPDKN

SEQ ID NO: 2135710 - protein, 5 aa, Cryptosporidium hominis
AIKQG

SEQ ID NO: 2135711 - protein, 6 aa, Cryptosporidium hominis
AINGNN

SEQ ID NO: 2135712 - protein, 16 aa, Cryptosporidium hominis
AINGPKSVTISGSRSS

SEQ ID NO: 2135713 - protein, 11 aa, Cryptosporidium hominis
AINKEKKETKV

SEQ ID NO: 2135714 - protein, 14 aa, Cryptosporidium hominis
AINNQKRQVVHSPF

SEQ ID NO: 2135715 - protein, 5 aa, Cryptosporidium hominis
AINSA

SEQ ID NO: 2135716 - protein, 9 aa, Cryptosporidium hominis
AINSKEETE

SEQ ID NO: 2135717 - protein, 5 aa, Cryptosporidium hominis
AIPEE

SEQ ID NO: 2135718 - protein, 15 aa, Cryptosporidium hominis
AIPGQVDTSTPQANP

SEQ ID NO: 2135719 - protein, 12 aa, Cryptosporidium hominis
AIPNGSSSNTNC

SEQ ID NO: 2135720 - protein, 5 aa, Cryptosporidium hominis
AIPNM

SEQ ID NO: 2135721 - protein, 11 aa, Cryptosporidium hominis
AIPPGPPGVHG

SEQ ID NO: 2135722 - protein, 12 aa, Cryptosporidium hominis
AIPSSNINSKSV

SEQ ID NO: 2135723 - protein, 7 aa, Cryptosporidium hominis
AIQPDDR

SEQ ID NO: 2135724 - protein, 10 aa, Cryptosporidium hominis
AIQYDTRSNE

SEQ ID NO: 2135725 - protein, 5 aa, Cryptosporidium hominis
AISEK

SEQ ID NO: 2135726 - protein, 10 aa, Cryptosporidium hominis
AISGSASGSN

SEQ ID NO: 2135727 - protein, 8 aa, Cryptosporidium hominis
AISGSGSG

SEQ ID NO: 2135728 - protein, 5 aa, Cryptosporidium hominis
AISKE

SEQ ID NO: 2135729 - protein, 8 aa, Cryptosporidium hominis
AISNGEDK

SEQ ID NO: 2135730 - protein, 15 aa, Cryptosporidium hominis
AISNQKALNQVNSDS

SEQ ID NO: 2135731 - protein, 5 aa, Cryptosporidium hominis
AISRK

SEQ ID NO: 2135732 - protein, 11 aa, Cryptosporidium hominis
AISSGTSNGKY

SEQ ID NO: 2135733 - protein, 6 aa, Cryptosporidium hominis
AISSMP

SEQ ID NO: 2135734 - protein, 6 aa, Cryptosporidium hominis
AISSNS

SEQ ID NO: 2135735 - protein, 18 aa, Cryptosporidium hominis
AISSSYGNDELTIGTSEE

SEQ ID NO: 2135736 - protein, 9 aa, Cryptosporidium hominis
AISTANSKR

SEQ ID NO: 2135737 - protein, 8 aa, Cryptosporidium hominis
AISTDEEN

SEQ ID NO: 2135738 - protein, 4 aa, Cryptosporidium hominis
AITD

SEQ ID NO: 2135739 - protein, 9 aa, Cryptosporidium hominis
AITGPPESL

SEQ ID NO: 2135740 - protein, 13 aa, Cryptosporidium hominis
AKAAAPSYSGLPA

SEQ ID NO: 2135741 - protein, 19 aa, Cryptosporidium hominis
AKAEAEVETETETESETIA

SEQ ID NO: 2135742 - protein, 10 aa, Cryptosporidium hominis
AKAESDYDEA

SEQ ID NO: 2135743 - protein, 7 aa, Cryptosporidium hominis
AKAFSGT

SEQ ID NO: 2135744 - protein, 4 aa, Cryptosporidium hominis
AKAK

SEQ ID NO: 2135745 - protein, 12 aa, Cryptosporidium hominis
AKAKAKSKSNSV

SEQ ID NO: 2135746 - protein, 10 aa, Cryptosporidium hominis
AKAKESRTTH

SEQ ID NO: 2135747 - protein, 4 aa, Cryptosporidium hominis
AKAM

SEQ ID NO: 2135748 - protein, 7 aa, Cryptosporidium hominis
AKANENI

SEQ ID NO: 2135749 - protein, 7 aa, Cryptosporidium hominis
AKANKSW

SEQ ID NO: 2135750 - protein, 9 aa, Cryptosporidium hominis
AKANSEAQL

SEQ ID NO: 2135751 - protein, 7 aa, Cryptosporidium hominis
AKAPEVN

SEQ ID NO: 2135752 - protein, 20 aa, Cryptosporidium hominis
AKAQDNKDDKKSGTSDKATV

SEQ ID NO: 2135753 - protein, 9 aa, Cryptosporidium hominis
AKASTSVPI

SEQ ID NO: 2135754 - protein, 13 aa, Cryptosporidium hominis
AKATPIKETLTNA

SEQ ID NO: 2135755 - protein, 6 aa, Cryptosporidium hominis
AKDASQ

SEQ ID NO: 2135756 - protein, 9 aa, Cryptosporidium hominis
AKDEKSIAE

SEQ ID NO: 2135757 - protein, 26 aa, Cryptosporidium hominis
AKDGDSIAEYSTSKGNNSMIDGGTST

SEQ ID NO: 2135758 - protein, 7 aa, Cryptosporidium hominis
AKDHPNL

SEQ ID NO: 2135759 - protein, 8 aa, Cryptosporidium hominis
AKDIGSLP

SEQ ID NO: 2135760 - protein, 13 aa, Cryptosporidium hominis
AKDISGPNSKLPS

SEQ ID NO: 2135761 - protein, 25 aa, Cryptosporidium hominis
AKDKGTGKSEKITITNDKGRLSQED

SEQ ID NO: 2135762 - protein, 9 aa, Cryptosporidium hominis
AKDKSPKVR

SEQ ID NO: 2135763 - protein, 8 aa, Cryptosporidium hominis
AKDNSHLA

SEQ ID NO: 2135764 - protein, 7 aa, Cryptosporidium hominis
AKDQDTL

SEQ ID NO: 2135765 - protein, 7 aa, Cryptosporidium hominis
AKDSQGR

SEQ ID NO: 2135766 - protein, 6 aa, Cryptosporidium hominis
AKDVPA

SEQ ID NO: 2135767 - protein, 17 aa, Cryptosporidium hominis
AKEAETWSKDSSMGKSC

SEQ ID NO: 2135768 - protein, 6 aa, Cryptosporidium hominis
AKEDKV

SEQ ID NO: 2135769 - protein, 6 aa, Cryptosporidium hominis
AKEEKI

SEQ ID NO: 2135770 - protein, 64 aa, Cryptosporidium hominis
AKEKEKSSQKQSTGNDSSVSSSTSKDKDNSNTNSHAGSATSSGGSSCAGGLGGSSGSLSGAAAS

SEQ ID NO: 2135771 - protein, 11 aa, Cryptosporidium hominis
AKEKSMETSTR

SEQ ID NO: 2135772 - protein, 4 aa, Cryptosporidium hominis
AKEM

SEQ ID NO: 2135773 - protein, 48 aa, Cryptosporidium hominis
AKENNGNSNGETSNNSNATSINNNSSSSTNKHDESNKSISQSGQDEYN

SEQ ID NO: 2135774 - protein, 32 aa, Cryptosporidium hominis
AKERRRLKRKNQRKNKQKLGSQATESSNAEED

SEQ ID NO: 2135775 - protein, 13 aa, Cryptosporidium hominis
AKESENLKKSQQT

SEQ ID NO: 2135776 - protein, 6 aa, Cryptosporidium hominis
AKESGA

SEQ ID NO: 2135777 - protein, 6 aa, Cryptosporidium hominis
AKESGL

SEQ ID NO: 2135778 - protein, 8 aa, Cryptosporidium hominis
AKESSLRR

SEQ ID NO: 2135779 - protein, 7 aa, Cryptosporidium hominis
AKETLND

SEQ ID NO: 2135780 - protein, 15 aa, Cryptosporidium hominis
AKETYSDYKQGNGFS

SEQ ID NO: 2135781 - protein, 13 aa, Cryptosporidium hominis
AKEYEDEAQAKRK

SEQ ID NO: 2135782 - protein, 12 aa, Cryptosporidium hominis
AKFAPISQESDD

SEQ ID NO: 2135783 - protein, 14 aa, Cryptosporidium hominis
AKFKSNSCTCSKGG

SEQ ID NO: 2135784 - protein, 5 aa, Cryptosporidium hominis
AKGGD

SEQ ID NO: 2135785 - protein, 15 aa, Cryptosporidium hominis
AKGGGGSQGHSSTPQ

SEQ ID NO: 2135786 - protein, 13 aa, Cryptosporidium hominis
AKGIPTATTNDAR

SEQ ID NO: 2135787 - protein, 8 aa, Cryptosporidium hominis
AKGKSSIK

SEQ ID NO: 2135788 - protein, 12 aa, Cryptosporidium hominis
AKGQPQYDRAED

SEQ ID NO: 2135789 - protein, 8 aa, Cryptosporidium hominis
AKGTSKRV

SEQ ID NO: 2135790 - protein, 16 aa, Cryptosporidium hominis
AKHPKKTFQECFPGIE

SEQ ID NO: 2135791 - protein, 8 aa, Cryptosporidium hominis
AKINSEKK

SEQ ID NO: 2135792 - protein, 17 aa, Cryptosporidium hominis
AKINSNGLTSTTSGVEE

SEQ ID NO: 2135793 - protein, 14 aa, Cryptosporidium hominis
AKIQAKRNSSKKNY

SEQ ID NO: 2135794 - protein, 14 aa, Cryptosporidium hominis
AKITKKNTGSSTIR

SEQ ID NO: 2135795 - protein, 9 aa, Cryptosporidium hominis
AKKDGNEKA

SEQ ID NO: 2135796 - protein, 4 aa, Cryptosporidium hominis
AKKE

SEQ ID NO: 2135797 - protein, 76 aa, Cryptosporidium hominis
AKKERQKKANLTQSRVRNGRGGKGRDLKKRSERRPNSVNSNGRRNFKGSPGKISRSRGGNRGRGFDQGKRMSKDQV

SEQ ID NO: 2135798 - protein, 6 aa, Cryptosporidium hominis
AKKIQN

SEQ ID NO: 2135799 - protein, 18 aa, Cryptosporidium hominis
AKKKKSRQRWAEISKNQK

SEQ ID NO: 2135800 - protein, 10 aa, Cryptosporidium hominis
AKKKQKNVMD

SEQ ID NO: 2135801 - protein, 9 aa, Cryptosporidium hominis
AKKKYAGEN

SEQ ID NO: 2135802 - protein, 10 aa, Cryptosporidium hominis
AKKLNPNPSK

SEQ ID NO: 2135803 - protein, 6 aa, Cryptosporidium hominis
AKKLST

SEQ ID NO: 2135804 - protein, 9 aa, Cryptosporidium hominis
AKKLTDSSS

SEQ ID NO: 2135805 - protein, 8 aa, Cryptosporidium hominis
AKKMANDD

SEQ ID NO: 2135806 - protein, 4 aa, Cryptosporidium hominis
AKKN

SEQ ID NO: 2135807 - protein, 7 aa, Cryptosporidium hominis
AKKPEIP

SEQ ID NO: 2135808 - protein, 15 aa, Cryptosporidium hominis
AKKQNPGAILFILEE

SEQ ID NO: 2135809 - protein, 47 aa, Cryptosporidium hominis
AKKQQIEESEKDLDESTEDSSQTYCSKPEINPDPADNDLTNSSQTPV

SEQ ID NO: 2135810 - protein, 7 aa, Cryptosporidium hominis
AKKRDHR

SEQ ID NO: 2135811 - protein, 7 aa, Cryptosporidium hominis
AKKYRSE

SEQ ID NO: 2135812 - protein, 7 aa, Cryptosporidium hominis
AKLDESK

SEQ ID NO: 2135813 - protein, 7 aa, Cryptosporidium hominis
AKLPPTL

SEQ ID NO: 2135814 - protein, 8 aa, Cryptosporidium hominis
AKLPQKKI

SEQ ID NO: 2135815 - protein, 6 aa, Cryptosporidium hominis
AKLQEK

SEQ ID NO: 2135816 - protein, 6 aa, Cryptosporidium hominis
AKLQSR

SEQ ID NO: 2135817 - protein, 6 aa, Cryptosporidium hominis
AKMAKN

SEQ ID NO: 2135818 - protein, 7 aa, Cryptosporidium hominis
AKNEFEA

SEQ ID NO: 2135819 - protein, 18 aa, Cryptosporidium hominis
AKNKDSCVDNDEEQASTF

SEQ ID NO: 2135820 - protein, 65 aa, Cryptosporidium hominis
AKNKGDNGDGDDDDNDDDDDDNNNNNNNNNNNSNSDVDNNDRANEESREDREGKEGEDGREGGES

SEQ ID NO: 2135821 - protein, 19 aa, Cryptosporidium hominis
AKNQGDEPSSLLKGSADSS

SEQ ID NO: 2135822 - protein, 5 aa, Cryptosporidium hominis
AKNSL

SEQ ID NO: 2135823 - protein, 10 aa, Cryptosporidium hominis
AKNSSKNSHE

SEQ ID NO: 2135824 - protein, 12 aa, Cryptosporidium hominis
AKNSSRSSINYS

SEQ ID NO: 2135825 - protein, 8 aa, Cryptosporidium hominis
AKPCTQPT

SEQ ID NO: 2135826 - protein, 7 aa, Cryptosporidium hominis
AKPEEPC

SEQ ID NO: 2135827 - protein, 9 aa, Cryptosporidium hominis
AKPESIETN

SEQ ID NO: 2135828 - protein, 10 aa, Cryptosporidium hominis
AKPESSEWGN

SEQ ID NO: 2135829 - protein, 7 aa, Cryptosporidium hominis
AKPKNNS

SEQ ID NO: 2135830 - protein, 8 aa, Cryptosporidium hominis
AKPNEGHR

SEQ ID NO: 2135831 - protein, 10 aa, Cryptosporidium hominis
AKPPNGGNLD

SEQ ID NO: 2135832 - protein, 8 aa, Cryptosporidium hominis
AKPQGASF

SEQ ID NO: 2135833 - protein, 9 aa, Cryptosporidium hominis
AKPTSKEER

SEQ ID NO: 2135834 - protein, 6 aa, Cryptosporidium hominis
AKQGDA

SEQ ID NO: 2135835 - protein, 9 aa, Cryptosporidium hominis
AKQKSQNVS

SEQ ID NO: 2135836 - protein, 5 aa, Cryptosporidium hominis
AKQSL

SEQ ID NO: 2135837 - protein, 8 aa, Cryptosporidium hominis
AKQSPKYE

SEQ ID NO: 2135838 - protein, 7 aa, Cryptosporidium hominis
AKREGAN

SEQ ID NO: 2135839 - protein, 5 aa, Cryptosporidium hominis
AKREL

SEQ ID NO: 2135840 - protein, 6 aa, Cryptosporidium hominis
AKRGNY

SEQ ID NO: 2135841 - protein, 7 aa, Cryptosporidium hominis
AKRKNSS

SEQ ID NO: 2135842 - protein, 22 aa, Cryptosporidium hominis
AKRPRAETSFSDKLDSDTLEPT

SEQ ID NO: 2135843 - protein, 6 aa, Cryptosporidium hominis
AKRRTV

SEQ ID NO: 2135844 - protein, 8 aa, Cryptosporidium hominis
AKRSEASG

SEQ ID NO: 2135845 - protein, 9 aa, Cryptosporidium hominis
AKRSNKGNN

SEQ ID NO: 2135846 - protein, 11 aa, Cryptosporidium hominis
AKRTESTNLED

SEQ ID NO: 2135847 - protein, 4 aa, Cryptosporidium hominis
AKSD

SEQ ID NO: 2135848 - protein, 10 aa, Cryptosporidium hominis
AKSDMDSGKI

SEQ ID NO: 2135849 - protein, 6 aa, Cryptosporidium hominis
AKSEHN

SEQ ID NO: 2135850 - protein, 7 aa, Cryptosporidium hominis
AKSGTDF

SEQ ID NO: 2135851 - protein, 8 aa, Cryptosporidium hominis
AKSGTGKT

SEQ ID NO: 2135852 - protein, 6 aa, Cryptosporidium hominis
AKSIGT

SEQ ID NO: 2135853 - protein, 10 aa, Cryptosporidium hominis
AKSISKVSQC

SEQ ID NO: 2135854 - protein, 8 aa, Cryptosporidium hominis
AKSKGRRH

SEQ ID NO: 2135855 - protein, 11 aa, Cryptosporidium hominis
AKSKQIEEDER

SEQ ID NO: 2135856 - protein, 5 aa, Cryptosporidium hominis
AKSKV

SEQ ID NO: 2135857 - protein, 25 aa, Cryptosporidium hominis
AKSMNNNLESNSDADTVLNQALTKQ

SEQ ID NO: 2135858 - protein, 13 aa, Cryptosporidium hominis
AKSNDPGSIETKA

SEQ ID NO: 2135859 - protein, 14 aa, Cryptosporidium hominis
AKSNISNKEPAKHR

SEQ ID NO: 2135860 - protein, 10 aa, Cryptosporidium hominis
AKSPDGTSGR

SEQ ID NO: 2135861 - protein, 11 aa, Cryptosporidium hominis
AKSPPANDPFK

SEQ ID NO: 2135862 - protein, 10 aa, Cryptosporidium hominis
AKSQLKESQK

SEQ ID NO: 2135863 - protein, 7 aa, Cryptosporidium hominis
AKSRMEQ

SEQ ID NO: 2135864 - protein, 7 aa, Cryptosporidium hominis
AKSRSKS

SEQ ID NO: 2135865 - protein, 5 aa, Cryptosporidium hominis
AKSRY

SEQ ID NO: 2135866 - protein, 12 aa, Cryptosporidium hominis
AKSSSRTSTETD

SEQ ID NO: 2135867 - protein, 19 aa, Cryptosporidium hominis
AKSSSSLFQNNPNKKNTKL

SEQ ID NO: 2135868 - protein, 6 aa, Cryptosporidium hominis
AKSTDS

SEQ ID NO: 2135869 - protein, 8 aa, Cryptosporidium hominis
AKSTDYQR

SEQ ID NO: 2135870 - protein, 8 aa, Cryptosporidium hominis
AKTHNTNL

SEQ ID NO: 2135871 - protein, 6 aa, Cryptosporidium hominis
AKTINK

SEQ ID NO: 2135872 - protein, 12 aa, Cryptosporidium hominis
AKTLRNNNSSRF

SEQ ID NO: 2135873 - protein, 8 aa, Cryptosporidium hominis
AKTNDETK

SEQ ID NO: 2135874 - protein, 5 aa, Cryptosporidium hominis
AKTPS

SEQ ID NO: 2135875 - protein, 6 aa, Cryptosporidium hominis
AKTQQM

SEQ ID NO: 2135876 - protein, 6 aa, Cryptosporidium hominis
AKTSEF

SEQ ID NO: 2135877 - protein, 8 aa, Cryptosporidium hominis
AKTSEHSS

SEQ ID NO: 2135878 - protein, 5 aa, Cryptosporidium hominis
AKTSL

SEQ ID NO: 2135879 - protein, 34 aa, Cryptosporidium hominis
AKTSSKIKVKGSRANISSIKSKNSHSEKETPTIS

SEQ ID NO: 2135880 - protein, 15 aa, Cryptosporidium hominis
AKVSESKQKGPKMSL

SEQ ID NO: 2135881 - protein, 18 aa, Cryptosporidium hominis
AKWRPGRGNSSKSQATKR

SEQ ID NO: 2135882 - protein, 4 aa, Cryptosporidium hominis
AKYG

SEQ ID NO: 2135883 - protein, 9 aa, Cryptosporidium hominis
AKYGKEAAS

SEQ ID NO: 2135884 - protein, 9 aa, Cryptosporidium hominis
AKYKQETQP

SEQ ID NO: 2135885 - protein, 8 aa, Cryptosporidium hominis
AKYNNSPV

SEQ ID NO: 2135886 - protein, 4 aa, Cryptosporidium hominis
AKYQ

SEQ ID NO: 2135887 - protein, 10 aa, Cryptosporidium hominis
AKYTEQEKAK

SEQ ID NO: 2135888 - protein, 23 aa, Cryptosporidium hominis
ALASGSASGPSSVSLSGPASGSA

SEQ ID NO: 2135889 - protein, 7 aa, Cryptosporidium hominis
ALDPRGS

SEQ ID NO: 2135890 - protein, 7 aa, Cryptosporidium hominis
ALDPRNV

SEQ ID NO: 2135891 - protein, 4 aa, Cryptosporidium hominis
ALED

SEQ ID NO: 2135892 - protein, 13 aa, Cryptosporidium hominis
ALEEGNDKLEPDE

SEQ ID NO: 2135893 - protein, 14 aa, Cryptosporidium hominis
ALEENKNSDSSPSF

SEQ ID NO: 2135894 - protein, 8 aa, Cryptosporidium hominis
ALEKENES

SEQ ID NO: 2135895 - protein, 13 aa, Cryptosporidium hominis
ALERNKDKLDNED

SEQ ID NO: 2135896 - protein, 5 aa, Cryptosporidium hominis
ALEST

SEQ ID NO: 2135897 - protein, 9 aa, Cryptosporidium hominis
ALGKSEGEF

SEQ ID NO: 2135898 - protein, 9 aa, Cryptosporidium hominis
ALGNTGNRR

SEQ ID NO: 2135899 - protein, 9 aa, Cryptosporidium hominis
ALKSGGGGK

SEQ ID NO: 2135900 - protein, 26 aa, Cryptosporidium hominis
ALKSHYPPLSSGANSISANSSAPGDI

SEQ ID NO: 2135901 - protein, 17 aa, Cryptosporidium hominis
ALKSNNNDVVEAILSLS

SEQ ID NO: 2135902 - protein, 7 aa, Cryptosporidium hominis
ALLPTDS

SEQ ID NO: 2135903 - protein, 5 aa, Cryptosporidium hominis
ALNDD

SEQ ID NO: 2135904 - protein, 5 aa, Cryptosporidium hominis
ALNGS

SEQ ID NO: 2135905 - protein, 11 aa, Cryptosporidium hominis
ALNNEQEKQKA

SEQ ID NO: 2135906 - protein, 8 aa, Cryptosporidium hominis
ALNSSTEF

SEQ ID NO: 2135907 - protein, 6 aa, Cryptosporidium hominis
ALPNTN

SEQ ID NO: 2135908 - protein, 8 aa, Cryptosporidium hominis
ALPPSSFG

SEQ ID NO: 2135909 - protein, 23 aa, Cryptosporidium hominis
ALQDQLDARKARAANLKQKRKVL

SEQ ID NO: 2135910 - protein, 10 aa, Cryptosporidium hominis
ALQEKEGGGK

SEQ ID NO: 2135911 - protein, 8 aa, Cryptosporidium hominis
ALQGDKNS

SEQ ID NO: 2135912 - protein, 6 aa, Cryptosporidium hominis
ALQKNT

SEQ ID NO: 2135913 - protein, 7 aa, Cryptosporidium hominis
ALQSKTD

SEQ ID NO: 2135914 - protein, 7 aa, Cryptosporidium hominis
ALRNEEE

SEQ ID NO: 2135915 - protein, 20 aa, Cryptosporidium hominis
ALSANNSKQNTINSGKPGVV

SEQ ID NO: 2135916 - protein, 7 aa, Cryptosporidium hominis
ALSDSEG

SEQ ID NO: 2135917 - protein, 156 aa, Cryptosporidium hominis
ALSEPTKSKETSSTSSDEEETPPPLPPPLSPPSPPSPPLPEELPPPPPSEELPPPPPSPSEELPLPPAPSSEELPLPPPPPPSLEEPLSTPSDEPLPPPPPEASSSSNESLSKEKAPTASIPPAPALAPTPTPTTAPPPPAPPLPPPSFSPSTVSS

SEQ ID NO: 2135918 - protein, 7 aa, Cryptosporidium hominis
ALSGKSV

SEQ ID NO: 2135919 - protein, 12 aa, Cryptosporidium hominis
ALSKSKKEDPYY

SEQ ID NO: 2135920 - protein, 8 aa, Cryptosporidium hominis
ALSNADQK

SEQ ID NO: 2135921 - protein, 14 aa, Cryptosporidium hominis
ALSNNKKIESKNCS

SEQ ID NO: 2135922 - protein, 21 aa, Cryptosporidium hominis
ALSPSLDKKSSSKKQSSKVGA

SEQ ID NO: 2135923 - protein, 13 aa, Cryptosporidium hominis
ALSQTTQQAPTSQ

SEQ ID NO: 2135924 - protein, 4 aa, Cryptosporidium hominis
ALSR

SEQ ID NO: 2135925 - protein, 8 aa, Cryptosporidium hominis
ALSSEEYQ

SEQ ID NO: 2135926 - protein, 7 aa, Cryptosporidium hominis
ALSSQKY

SEQ ID NO: 2135927 - protein, 12 aa, Cryptosporidium hominis
ALSTGENSGGVG

SEQ ID NO: 2135928 - protein, 14 aa, Cryptosporidium hominis
ALTGKNIRHVSDKI

SEQ ID NO: 2135929 - protein, 8 aa, Cryptosporidium hominis
ALTPSSNS

SEQ ID NO: 2135930 - protein, 8 aa, Cryptosporidium hominis
AMDNDENK

SEQ ID NO: 2135931 - protein, 16 aa, Cryptosporidium hominis
AMGRNDKTKARSIREN

SEQ ID NO: 2135932 - protein, 14 aa, Cryptosporidium hominis
AMGSVSGQSVIDPS

SEQ ID NO: 2135933 - protein, 5 aa, Cryptosporidium hominis
AMNKD

SEQ ID NO: 2135934 - protein, 4 aa, Cryptosporidium hominis
AMNS

SEQ ID NO: 2135935 - protein, 10 aa, Cryptosporidium hominis
AMPQNQNRPL

SEQ ID NO: 2135936 - protein, 4 aa, Cryptosporidium hominis
AMQG

SEQ ID NO: 2135937 - protein, 13 aa, Cryptosporidium hominis
AMRERIKENKKRK

SEQ ID NO: 2135938 - protein, 8 aa, Cryptosporidium hominis
AMSEKTSY

SEQ ID NO: 2135939 - protein, 7 aa, Cryptosporidium hominis
ANACNPE

SEQ ID NO: 2135940 - protein, 11 aa, Cryptosporidium hominis
ANAEGDANDRT

SEQ ID NO: 2135941 - protein, 13 aa, Cryptosporidium hominis
ANAGANGPIPTNG

SEQ ID NO: 2135942 - protein, 32 aa, Cryptosporidium hominis
ANASASENTERTLSETGSTPPPEESSDEESDV

SEQ ID NO: 2135943 - protein, 6 aa, Cryptosporidium hominis
ANASEE

SEQ ID NO: 2135944 - protein, 8 aa, Cryptosporidium hominis
ANATELSR

SEQ ID NO: 2135945 - protein, 10 aa, Cryptosporidium hominis
ANCNPATSQL

SEQ ID NO: 2135946 - protein, 8 aa, Cryptosporidium hominis
ANDAARHE

SEQ ID NO: 2135947 - protein, 28 aa, Cryptosporidium hominis
ANDFGLADDKDESTDKKKSSSHKNLADR

SEQ ID NO: 2135948 - protein, 8 aa, Cryptosporidium hominis
ANDGSVTH

SEQ ID NO: 2135949 - protein, 5 aa, Cryptosporidium hominis
ANDLA

SEQ ID NO: 2135950 - protein, 16 aa, Cryptosporidium hominis
ANDPDHITAESSEIPS

SEQ ID NO: 2135951 - protein, 18 aa, Cryptosporidium hominis
ANDPIYQKNRESSEKSIR

SEQ ID NO: 2135952 - protein, 17 aa, Cryptosporidium hominis
ANDPSPGINAEPDEDNY

SEQ ID NO: 2135953 - protein, 21 aa, Cryptosporidium hominis
ANDSNQQREEKGDKPDARRKV

SEQ ID NO: 2135954 - protein, 21 aa, Cryptosporidium hominis
ANEEKDAVEKDPENVQKGAVP

SEQ ID NO: 2135955 - protein, 45 aa, Cryptosporidium hominis
ANEGRGQPSSTSQIYSQNKKKPKPYFSDTTKDKRTFGTKAGSGWD

SEQ ID NO: 2135956 - protein, 4 aa, Cryptosporidium hominis
ANEI

SEQ ID NO: 2135957 - protein, 21 aa, Cryptosporidium hominis
ANEITSDTEPACKKKRTECAE

SEQ ID NO: 2135958 - protein, 9 aa, Cryptosporidium hominis
ANEKTNKQR

SEQ ID NO: 2135959 - protein, 13 aa, Cryptosporidium hominis
ANENATEQVHDQE

SEQ ID NO: 2135960 - protein, 8 aa, Cryptosporidium hominis
ANENGSGD

SEQ ID NO: 2135961 - protein, 14 aa, Cryptosporidium hominis
ANENNSKKLSSRTC

SEQ ID NO: 2135962 - protein, 33 aa, Cryptosporidium hominis
ANENSKSHSINSQFQNNEHKRASKNNKAVGDSA

SEQ ID NO: 2135963 - protein, 12 aa, Cryptosporidium hominis
ANEQESNIKNKS

SEQ ID NO: 2135964 - protein, 7 aa, Cryptosporidium hominis
ANEQNSN

SEQ ID NO: 2135965 - protein, 17 aa, Cryptosporidium hominis
ANERSLAPMERKAREKQ

SEQ ID NO: 2135966 - protein, 8 aa, Cryptosporidium hominis
ANESNWPG

SEQ ID NO: 2135967 - protein, 4 aa, Cryptosporidium hominis
ANET

SEQ ID NO: 2135968 - protein, 5 aa, Cryptosporidium hominis
ANEVD

SEQ ID NO: 2135969 - protein, 7 aa, Cryptosporidium hominis
ANEYETC

SEQ ID NO: 2135970 - protein, 5 aa, Cryptosporidium hominis
ANFQD

SEQ ID NO: 2135971 - protein, 11 aa, Cryptosporidium hominis
ANFTKKTAEQL

SEQ ID NO: 2135972 - protein, 19 aa, Cryptosporidium hominis
ANGANRSVNSNAPNPAPQM

SEQ ID NO: 2135973 - protein, 9 aa, Cryptosporidium hominis
ANGDFNKST

SEQ ID NO: 2135974 - protein, 40 aa, Cryptosporidium hominis
ANGFSSTDLDSVTTSINSSTENLTLSKKGSTLEGLDENKE

SEQ ID NO: 2135975 - protein, 8 aa, Cryptosporidium hominis
ANGGKSEL

SEQ ID NO: 2135976 - protein, 11 aa, Cryptosporidium hominis
ANGPAAGSKAR

SEQ ID NO: 2135977 - protein, 32 aa, Cryptosporidium hominis
ANGQNNLDSKNGQDSFEGNETNLGNSNDTISE

SEQ ID NO: 2135978 - protein, 4 aa, Cryptosporidium hominis
ANGR

SEQ ID NO: 2135979 - protein, 9 aa, Cryptosporidium hominis
ANGRKDGKG

SEQ ID NO: 2135980 - protein, 5 aa, Cryptosporidium hominis
ANGTG

SEQ ID NO: 2135981 - protein, 7 aa, Cryptosporidium hominis
ANGTTVS

SEQ ID NO: 2135982 - protein, 6 aa, Cryptosporidium hominis
ANGTVI

SEQ ID NO: 2135983 - protein, 11 aa, Cryptosporidium hominis
ANHENENLENT

SEQ ID NO: 2135984 - protein, 26 aa, Cryptosporidium hominis
ANHSDDEESEISSLEGDESEKQGEDI

SEQ ID NO: 2135985 - protein, 5 aa, Cryptosporidium hominis
ANHTT

SEQ ID NO: 2135986 - protein, 7 aa, Cryptosporidium hominis
ANIDESS

SEQ ID NO: 2135987 - protein, 5 aa, Cryptosporidium hominis
ANIDN

SEQ ID NO: 2135988 - protein, 7 aa, Cryptosporidium hominis
ANIEEKE

SEQ ID NO: 2135989 - protein, 9 aa, Cryptosporidium hominis
ANIGPNTSN

SEQ ID NO: 2135990 - protein, 5 aa, Cryptosporidium hominis
ANINS

SEQ ID NO: 2135991 - protein, 26 aa, Cryptosporidium hominis
ANIPKGNYTVDKNSVPKLSRPTKSDI

SEQ ID NO: 2135992 - protein, 23 aa, Cryptosporidium hominis
ANISSYPQDISKTQNVGRVQSTC

SEQ ID NO: 2135993 - protein, 9 aa, Cryptosporidium hominis
ANITNGGNP

SEQ ID NO: 2135994 - protein, 16 aa, Cryptosporidium hominis
ANKADRYGNKSNSKNW

SEQ ID NO: 2135995 - protein, 12 aa, Cryptosporidium hominis
ANKAEEKGIKEY

SEQ ID NO: 2135996 - protein, 9 aa, Cryptosporidium hominis
ANKEGMKIE

SEQ ID NO: 2135997 - protein, 9 aa, Cryptosporidium hominis
ANKEHSKSL

SEQ ID NO: 2135998 - protein, 7 aa, Cryptosporidium hominis
ANKETYY

SEQ ID NO: 2135999 - protein, 10 aa, Cryptosporidium hominis
ANKKKNTRQR

SEQ ID NO: 2136000 - protein, 8 aa, Cryptosporidium hominis
ANKKNGSF

SEQ ID NO: 2136001 - protein, 10 aa, Cryptosporidium hominis
ANKKSGVHGR

SEQ ID NO: 2136002 - protein, 24 aa, Cryptosporidium hominis
ANKLTENSRAQRPKKKKRRQQGSI

SEQ ID NO: 2136003 - protein, 5 aa, Cryptosporidium hominis
ANKND

SEQ ID NO: 2136004 - protein, 11 aa, Cryptosporidium hominis
ANKNINGTGGI

SEQ ID NO: 2136005 - protein, 11 aa, Cryptosporidium hominis
ANKNSEHPESI

SEQ ID NO: 2136006 - protein, 6 aa, Cryptosporidium hominis
ANKQTP

SEQ ID NO: 2136007 - protein, 16 aa, Cryptosporidium hominis
ANKQVEEEDGLDSDNE

SEQ ID NO: 2136008 - protein, 7 aa, Cryptosporidium hominis
ANKTSEG

SEQ ID NO: 2136009 - protein, 10 aa, Cryptosporidium hominis
ANLQSPPCNI

SEQ ID NO: 2136010 - protein, 9 aa, Cryptosporidium hominis
ANLSHRSDT

SEQ ID NO: 2136011 - protein, 16 aa, Cryptosporidium hominis
ANLSSNGLYNGDDDEE

SEQ ID NO: 2136012 - protein, 6 aa, Cryptosporidium hominis
ANLTPT

SEQ ID NO: 2136013 - protein, 8 aa, Cryptosporidium hominis
ANNAISNP

SEQ ID NO: 2136014 - protein, 6 aa, Cryptosporidium hominis
ANNDSL

SEQ ID NO: 2136015 - protein, 11 aa, Cryptosporidium hominis
ANNDSSSGRSS

SEQ ID NO: 2136016 - protein, 5 aa, Cryptosporidium hominis
ANNEQ

SEQ ID NO: 2136017 - protein, 9 aa, Cryptosporidium hominis
ANNGGGKRG

SEQ ID NO: 2136018 - protein, 5 aa, Cryptosporidium hominis
ANNGS

SEQ ID NO: 2136019 - protein, 9 aa, Cryptosporidium hominis
ANNKEEKYK

SEQ ID NO: 2136020 - protein, 6 aa, Cryptosporidium hominis
ANNKEY

SEQ ID NO: 2136021 - protein, 40 aa, Cryptosporidium hominis
ANNNNNSDNINGEVKAESGIDNNNNNNNNNNNGTKQVPTN

SEQ ID NO: 2136022 - protein, 13 aa, Cryptosporidium hominis
ANNNNSDNQQQYF

SEQ ID NO: 2136023 - protein, 6 aa, Cryptosporidium hominis
ANNNPH

SEQ ID NO: 2136024 - protein, 8 aa, Cryptosporidium hominis
ANNPEDSV

SEQ ID NO: 2136025 - protein, 15 aa, Cryptosporidium hominis
ANNPENSSNAINQNS

SEQ ID NO: 2136026 - protein, 6 aa, Cryptosporidium hominis
ANNPLK

SEQ ID NO: 2136027 - protein, 7 aa, Cryptosporidium hominis
ANNPNPA

SEQ ID NO: 2136028 - protein, 5 aa, Cryptosporidium hominis
ANNPQ

SEQ ID NO: 2136029 - protein, 5 aa, Cryptosporidium hominis
ANNQS

SEQ ID NO: 2136030 - protein, 19 aa, Cryptosporidium hominis
ANNSNNNNTNNNVNNNSNN

SEQ ID NO: 2136031 - protein, 35 aa, Cryptosporidium hominis
ANNTTNTTSTTNNTTNSTNAALGQNSQFKDTKYTS

SEQ ID NO: 2136032 - protein, 15 aa, Cryptosporidium hominis
ANNVPSGSRARVTPF

SEQ ID NO: 2136033 - protein, 6 aa, Cryptosporidium hominis
ANNVSP

SEQ ID NO: 2136034 - protein, 8 aa, Cryptosporidium hominis
ANNVSSRS

SEQ ID NO: 2136035 - protein, 8 aa, Cryptosporidium hominis
ANNYTSKV

SEQ ID NO: 2136036 - protein, 14 aa, Cryptosporidium hominis
ANPISSRYDPKKSV

SEQ ID NO: 2136037 - protein, 6 aa, Cryptosporidium hominis
ANPKTI

SEQ ID NO: 2136038 - protein, 12 aa, Cryptosporidium hominis
ANPNRVEGKSLE

SEQ ID NO: 2136039 - protein, 7 aa, Cryptosporidium hominis
ANPPIER

SEQ ID NO: 2136040 - protein, 5 aa, Cryptosporidium hominis
ANPRV

SEQ ID NO: 2136041 - protein, 39 aa, Cryptosporidium hominis
ANPTNSNNVSPVSVGNNTNQNMRASASSPTATTSTSNTH

SEQ ID NO: 2136042 - protein, 16 aa, Cryptosporidium hominis
ANPVSGRYDPRKSPVA

SEQ ID NO: 2136043 - protein, 9 aa, Cryptosporidium hominis
ANQDPEKLG

SEQ ID NO: 2136044 - protein, 4 aa, Cryptosporidium hominis
ANQG

SEQ ID NO: 2136045 - protein, 9 aa, Cryptosporidium hominis
ANQGIQRDD

SEQ ID NO: 2136046 - protein, 12 aa, Cryptosporidium hominis
ANQHPPPHPSQL

SEQ ID NO: 2136047 - protein, 16 aa, Cryptosporidium hominis
ANQQLKSSKQLGSQKL

SEQ ID NO: 2136048 - protein, 12 aa, Cryptosporidium hominis
ANQRAPNTYRSG

SEQ ID NO: 2136049 - protein, 6 aa, Cryptosporidium hominis
ANRAKN

SEQ ID NO: 2136050 - protein, 9 aa, Cryptosporidium hominis
ANREKRKEE

SEQ ID NO: 2136051 - protein, 37 aa, Cryptosporidium hominis
ANRFEAEKDIKNRKKNKIEKRNMSTSLSGKGFSEKSG

SEQ ID NO: 2136052 - protein, 13 aa, Cryptosporidium hominis
ANRMKEKGGQCYK

SEQ ID NO: 2136053 - protein, 24 aa, Cryptosporidium hominis
ANRPQSHTGGASNSRTTTTSQHSG

SEQ ID NO: 2136054 - protein, 9 aa, Cryptosporidium hominis
ANRRNGKSE

SEQ ID NO: 2136055 - protein, 12 aa, Cryptosporidium hominis
ANRRTEAEKLSK

SEQ ID NO: 2136056 - protein, 11 aa, Cryptosporidium hominis
ANRSNGTIDNK

SEQ ID NO: 2136057 - protein, 7 aa, Cryptosporidium hominis
ANRSVQN

SEQ ID NO: 2136058 - protein, 4 aa, Cryptosporidium hominis
ANSD

SEQ ID NO: 2136059 - protein, 8 aa, Cryptosporidium hominis
ANSEEEEA

SEQ ID NO: 2136060 - protein, 5 aa, Cryptosporidium hominis
ANSGC

SEQ ID NO: 2136061 - protein, 7 aa, Cryptosporidium hominis
ANSKNGE

SEQ ID NO: 2136062 - protein, 20 aa, Cryptosporidium hominis
ANSKSQGEIMEKRDELFEIS

SEQ ID NO: 2136063 - protein, 27 aa, Cryptosporidium hominis
ANSKSSGGSSNNNSSNNNSGGFNDRGD

SEQ ID NO: 2136064 - protein, 8 aa, Cryptosporidium hominis
ANSKTGGY

SEQ ID NO: 2136065 - protein, 10 aa, Cryptosporidium hominis
ANSNINNSSI

SEQ ID NO: 2136066 - protein, 8 aa, Cryptosporidium hominis
ANSNNKTK

SEQ ID NO: 2136067 - protein, 8 aa, Cryptosporidium hominis
ANSNPNTI

SEQ ID NO: 2136068 - protein, 7 aa, Cryptosporidium hominis
ANSPHSS

SEQ ID NO: 2136069 - protein, 5 aa, Cryptosporidium hominis
ANSQI

SEQ ID NO: 2136070 - protein, 10 aa, Cryptosporidium hominis
ANSQSINKQF

SEQ ID NO: 2136071 - protein, 18 aa, Cryptosporidium hominis
ANSRHNKYHDNSPKNIPF

SEQ ID NO: 2136072 - protein, 20 aa, Cryptosporidium hominis
ANSRISSVSSSSAKAATSSV

SEQ ID NO: 2136073 - protein, 21 aa, Cryptosporidium hominis
ANSRNSNTKNMLPSKNTEIEK

SEQ ID NO: 2136074 - protein, 8 aa, Cryptosporidium hominis
ANSSDDEI

SEQ ID NO: 2136075 - protein, 7 aa, Cryptosporidium hominis
ANSSEFK

SEQ ID NO: 2136076 - protein, 10 aa, Cryptosporidium hominis
ANSSNNVSSV

SEQ ID NO: 2136077 - protein, 14 aa, Cryptosporidium hominis
ANSVGSEVDSLDGY

SEQ ID NO: 2136078 - protein, 14 aa, Cryptosporidium hominis
ANSVQDENKKYSSP

SEQ ID NO: 2136079 - protein, 6 aa, Cryptosporidium hominis
ANTENS

SEQ ID NO: 2136080 - protein, 7 aa, Cryptosporidium hominis
ANTGIEN

SEQ ID NO: 2136081 - protein, 12 aa, Cryptosporidium hominis
ANTGSAQRSEEC

SEQ ID NO: 2136082 - protein, 49 aa, Cryptosporidium hominis
ANTPSDDFGHKEEVTQDSGPASLNSSPMQEHKSEVEDVKGENTQTEKFN

SEQ ID NO: 2136083 - protein, 7 aa, Cryptosporidium hominis
ANTSEKT

SEQ ID NO: 2136084 - protein, 6 aa, Cryptosporidium hominis
ANTSKE

SEQ ID NO: 2136085 - protein, 7 aa, Cryptosporidium hominis
ANTSNEK

SEQ ID NO: 2136086 - protein, 8 aa, Cryptosporidium hominis
ANTSSTGQ

SEQ ID NO: 2136087 - protein, 8 aa, Cryptosporidium hominis
ANVEDSIR

SEQ ID NO: 2136088 - protein, 4 aa, Cryptosporidium hominis
ANVQ

SEQ ID NO: 2136089 - protein, 7 aa, Cryptosporidium hominis
ANYDGTI

SEQ ID NO: 2136090 - protein, 5 aa, Cryptosporidium hominis
ANYEN

SEQ ID NO: 2136091 - protein, 9 aa, Cryptosporidium hominis
ANYTNQQNM

SEQ ID NO: 2136092 - protein, 5 aa, Cryptosporidium hominis
APAKD

SEQ ID NO: 2136093 - protein, 12 aa, Cryptosporidium hominis
APAPRFTNSPSY

SEQ ID NO: 2136094 - protein, 11 aa, Cryptosporidium hominis
APDGKKMSKSL

SEQ ID NO: 2136095 - protein, 13 aa, Cryptosporidium hominis
APDYEGKESGVGD

SEQ ID NO: 2136096 - protein, 5 aa, Cryptosporidium hominis
APEFS

SEQ ID NO: 2136097 - protein, 6 aa, Cryptosporidium hominis
APEGLE

SEQ ID NO: 2136098 - protein, 4 aa, Cryptosporidium hominis
APEL

SEQ ID NO: 2136099 - protein, 4 aa, Cryptosporidium hominis
APEN

SEQ ID NO: 2136100 - protein, 10 aa, Cryptosporidium hominis
APERQVTEPL

SEQ ID NO: 2136101 - protein, 7 aa, Cryptosporidium hominis
APESDDE

SEQ ID NO: 2136102 - protein, 6 aa, Cryptosporidium hominis
APESVT

SEQ ID NO: 2136103 - protein, 6 aa, Cryptosporidium hominis
APFPQS

SEQ ID NO: 2136104 - protein, 9 aa, Cryptosporidium hominis
APGAPNTWP

SEQ ID NO: 2136105 - protein, 12 aa, Cryptosporidium hominis
APGGANNKINTS

SEQ ID NO: 2136106 - protein, 5 aa, Cryptosporidium hominis
APGKI

SEQ ID NO: 2136107 - protein, 7 aa, Cryptosporidium hominis
APGNYDS

SEQ ID NO: 2136108 - protein, 10 aa, Cryptosporidium hominis
APGSGKGTQC

SEQ ID NO: 2136109 - protein, 8 aa, Cryptosporidium hominis
APGSKSTQ

SEQ ID NO: 2136110 - protein, 8 aa, Cryptosporidium hominis
APGSKTSQ

SEQ ID NO: 2136111 - protein, 5 aa, Cryptosporidium hominis
APGSP

SEQ ID NO: 2136112 - protein, 5 aa, Cryptosporidium hominis
APGSW

SEQ ID NO: 2136113 - protein, 6 aa, Cryptosporidium hominis
APHPQW

SEQ ID NO: 2136114 - protein, 14 aa, Cryptosporidium hominis
APIDGNEANTPPGY

SEQ ID NO: 2136115 - protein, 12 aa, Cryptosporidium hominis
APIEKKNPHDND

SEQ ID NO: 2136116 - protein, 11 aa, Cryptosporidium hominis
APIQPNEGFSG

SEQ ID NO: 2136117 - protein, 30 aa, Cryptosporidium hominis
APKLGKKSKSSPDLTTKSSIGSSKLTPETL

SEQ ID NO: 2136118 - protein, 17 aa, Cryptosporidium hominis
APKSNQFSSGAGVQSNP

SEQ ID NO: 2136119 - protein, 5 aa, Cryptosporidium hominis
APKSS

SEQ ID NO: 2136120 - protein, 6 aa, Cryptosporidium hominis
APKTIG

SEQ ID NO: 2136121 - protein, 9 aa, Cryptosporidium hominis
APKVSGFGS

SEQ ID NO: 2136122 - protein, 9 aa, Cryptosporidium hominis
APLEPTPTH

SEQ ID NO: 2136123 - protein, 4 aa, Cryptosporidium hominis
APLP

SEQ ID NO: 2136124 - protein, 5 aa, Cryptosporidium hominis
APNCC

SEQ ID NO: 2136125 - protein, 5 aa, Cryptosporidium hominis
APNDE

SEQ ID NO: 2136126 - protein, 16 aa, Cryptosporidium hominis
APNEEIHEKKDEGQVG

SEQ ID NO: 2136127 - protein, 6 aa, Cryptosporidium hominis
APNKGF

SEQ ID NO: 2136128 - protein, 15 aa, Cryptosporidium hominis
APNKRDPNNSEIDQS

SEQ ID NO: 2136129 - protein, 5 aa, Cryptosporidium hominis
APNLP

SEQ ID NO: 2136130 - protein, 12 aa, Cryptosporidium hominis
APNQSNLSGNLP

SEQ ID NO: 2136131 - protein, 15 aa, Cryptosporidium hominis
APNQYSNSKQIPLNP

SEQ ID NO: 2136132 - protein, 4 aa, Cryptosporidium hominis
APNR

SEQ ID NO: 2136133 - protein, 8 aa, Cryptosporidium hominis
APNSEEIT

SEQ ID NO: 2136134 - protein, 8 aa, Cryptosporidium hominis
APNSHTNN

SEQ ID NO: 2136135 - protein, 6 aa, Cryptosporidium hominis
APNTNI

SEQ ID NO: 2136136 - protein, 13 aa, Cryptosporidium hominis
APNYNAGSLESDR

SEQ ID NO: 2136137 - protein, 10 aa, Cryptosporidium hominis
APPAGETSEF

SEQ ID NO: 2136138 - protein, 7 aa, Cryptosporidium hominis
APPAPIK

SEQ ID NO: 2136139 - protein, 20 aa, Cryptosporidium hominis
APPEMKKDELTKRDERREKA

SEQ ID NO: 2136140 - protein, 6 aa, Cryptosporidium hominis
APPERK

SEQ ID NO: 2136141 - protein, 5 aa, Cryptosporidium hominis
APPGC

SEQ ID NO: 2136142 - protein, 6 aa, Cryptosporidium hominis
APPKMM

SEQ ID NO: 2136143 - protein, 15 aa, Cryptosporidium hominis
APPKNQSTKPVEPTF

SEQ ID NO: 2136144 - protein, 5 aa, Cryptosporidium hominis
APPPL

SEQ ID NO: 2136145 - protein, 6 aa, Cryptosporidium hominis
APPPQV

SEQ ID NO: 2136146 - protein, 25 aa, Cryptosporidium hominis
APPPSSIVTPSREKINRKESAARGH

SEQ ID NO: 2136147 - protein, 6 aa, Cryptosporidium hominis
APPRCV

SEQ ID NO: 2136148 - protein, 9 aa, Cryptosporidium hominis
APPSPKKNV

SEQ ID NO: 2136149 - protein, 7 aa, Cryptosporidium hominis
APQCPPD

SEQ ID NO: 2136150 - protein, 6 aa, Cryptosporidium hominis
APQDPS

SEQ ID NO: 2136151 - protein, 6 aa, Cryptosporidium hominis
APQNGI

SEQ ID NO: 2136152 - protein, 21 aa, Cryptosporidium hominis
APQSTDNGADPALSVNSTPQI

SEQ ID NO: 2136153 - protein, 15 aa, Cryptosporidium hominis
APRAKMNQQRSRRYK

SEQ ID NO: 2136154 - protein, 7 aa, Cryptosporidium hominis
APRDQER

SEQ ID NO: 2136155 - protein, 6 aa, Cryptosporidium hominis
APRGTA

SEQ ID NO: 2136156 - protein, 20 aa, Cryptosporidium hominis
APRKPNKTIPGGKKRGRKRS

SEQ ID NO: 2136157 - protein, 7 aa, Cryptosporidium hominis
APRRGEF

SEQ ID NO: 2136158 - protein, 5 aa, Cryptosporidium hominis
APRRP

SEQ ID NO: 2136159 - protein, 8 aa, Cryptosporidium hominis
APSEAEAQ

SEQ ID NO: 2136160 - protein, 41 aa, Cryptosporidium hominis
APSESESNKDNLTDNFQEQNKSKSNNQNSTTNGQISGNNDH

SEQ ID NO: 2136161 - protein, 4 aa, Cryptosporidium hominis
APSH

SEQ ID NO: 2136162 - protein, 9 aa, Cryptosporidium hominis
APSISENSD

SEQ ID NO: 2136163 - protein, 19 aa, Cryptosporidium hominis
APSKSDLEKLNEETGGKVT

SEQ ID NO: 2136164 - protein, 13 aa, Cryptosporidium hominis
APSLKRKSLIQDI

SEQ ID NO: 2136165 - protein, 5 aa, Cryptosporidium hominis
APSLS

SEQ ID NO: 2136166 - protein, 12 aa, Cryptosporidium hominis
APSTLTDTVSRQ

SEQ ID NO: 2136167 - protein, 7 aa, Cryptosporidium hominis
APTEPNI

SEQ ID NO: 2136168 - protein, 5 aa, Cryptosporidium hominis
APTGH

SEQ ID NO: 2136169 - protein, 6 aa, Cryptosporidium hominis
APTGQI

SEQ ID NO: 2136170 - protein, 8 aa, Cryptosporidium hominis
APTGSGKT

SEQ ID NO: 2136171 - protein, 9 aa, Cryptosporidium hominis
APTGSGKTN

SEQ ID NO: 2136172 - protein, 8 aa, Cryptosporidium hominis
APTGTGKT

SEQ ID NO: 2136173 - protein, 8 aa, Cryptosporidium hominis
APTINSNM

SEQ ID NO: 2136174 - protein, 7 aa, Cryptosporidium hominis
APTKQFP

SEQ ID NO: 2136175 - protein, 10 aa, Cryptosporidium hominis
APTMQDKDGN

SEQ ID NO: 2136176 - protein, 5 aa, Cryptosporidium hominis
APTNL

SEQ ID NO: 2136177 - protein, 14 aa, Cryptosporidium hominis
APTPTKFDNSDDSN

SEQ ID NO: 2136178 - protein, 11 aa, Cryptosporidium hominis
APTTERDHNNV

SEQ ID NO: 2136179 - protein, 12 aa, Cryptosporidium hominis
APVSAGASTSFK

SEQ ID NO: 2136180 - protein, 22 aa, Cryptosporidium hominis
APVTPRMTSRHTSRHISRKTTE

SEQ ID NO: 2136181 - protein, 4 aa, Cryptosporidium hominis
APWK

SEQ ID NO: 2136182 - protein, 16 aa, Cryptosporidium hominis
APYSYDSAPFSSSNDL

SEQ ID NO: 2136183 - protein, 16 aa, Cryptosporidium hominis
AQANDADSQQGQDETL

SEQ ID NO: 2136184 - protein, 8 aa, Cryptosporidium hominis
AQAQEQYK

SEQ ID NO: 2136185 - protein, 11 aa, Cryptosporidium hominis
AQDDEVGDGTT

SEQ ID NO: 2136186 - protein, 10 aa, Cryptosporidium hominis
AQDDSDDLEC

SEQ ID NO: 2136187 - protein, 9 aa, Cryptosporidium hominis
AQDKDVENL

SEQ ID NO: 2136188 - protein, 8 aa, Cryptosporidium hominis
AQDLSGEG

SEQ ID NO: 2136189 - protein, 6 aa, Cryptosporidium hominis
AQDLTG

SEQ ID NO: 2136190 - protein, 8 aa, Cryptosporidium hominis
AQDSKDIE

SEQ ID NO: 2136191 - protein, 6 aa, Cryptosporidium hominis
AQDTGK

SEQ ID NO: 2136192 - protein, 12 aa, Cryptosporidium hominis
AQDVEVGDGTSS

SEQ ID NO: 2136193 - protein, 13 aa, Cryptosporidium hominis
AQDVTTTGTQEGK

SEQ ID NO: 2136194 - protein, 7 aa, Cryptosporidium hominis
AQENFEE

SEQ ID NO: 2136195 - protein, 18 aa, Cryptosporidium hominis
AQEPPQKPMKKPLPIPKD

SEQ ID NO: 2136196 - protein, 11 aa, Cryptosporidium hominis
AQESANFSGAE

SEQ ID NO: 2136197 - protein, 8 aa, Cryptosporidium hominis
AQESESNF

SEQ ID NO: 2136198 - protein, 4 aa, Cryptosporidium hominis
AQEY

SEQ ID NO: 2136199 - protein, 9 aa, Cryptosporidium hominis
AQFENSETN

SEQ ID NO: 2136200 - protein, 10 aa, Cryptosporidium hominis
AQGAAGGGQG

SEQ ID NO: 2136201 - protein, 10 aa, Cryptosporidium hominis
AQGHGPGAGL

SEQ ID NO: 2136202 - protein, 13 aa, Cryptosporidium hominis
AQGKEEDSKIVEN

SEQ ID NO: 2136203 - protein, 10 aa, Cryptosporidium hominis
AQGREWKENR

SEQ ID NO: 2136204 - protein, 7 aa, Cryptosporidium hominis
AQGSHVQ

SEQ ID NO: 2136205 - protein, 12 aa, Cryptosporidium hominis
AQIQHQKHQPGI

SEQ ID NO: 2136206 - protein, 9 aa, Cryptosporidium hominis
AQKCTNNKY

SEQ ID NO: 2136207 - protein, 8 aa, Cryptosporidium hominis
AQKDSPEA

SEQ ID NO: 2136208 - protein, 9 aa, Cryptosporidium hominis
AQKELSSEN

SEQ ID NO: 2136209 - protein, 12 aa, Cryptosporidium hominis
AQKGKLDCQPGK

SEQ ID NO: 2136210 - protein, 9 aa, Cryptosporidium hominis
AQKISSKKR

SEQ ID NO: 2136211 - protein, 8 aa, Cryptosporidium hominis
AQKKNERQ

SEQ ID NO: 2136212 - protein, 24 aa, Cryptosporidium hominis
AQKKSNNKKENQSKRQNGNLKDER

SEQ ID NO: 2136213 - protein, 5 aa, Cryptosporidium hominis
AQKQL

SEQ ID NO: 2136214 - protein, 8 aa, Cryptosporidium hominis
AQKSQAIR

SEQ ID NO: 2136215 - protein, 12 aa, Cryptosporidium hominis
AQLDSNTNKENH

SEQ ID NO: 2136216 - protein, 7 aa, Cryptosporidium hominis
AQNATNI

SEQ ID NO: 2136217 - protein, 10 aa, Cryptosporidium hominis
AQNENTYKTV

SEQ ID NO: 2136218 - protein, 4 aa, Cryptosporidium hominis
AQNG

SEQ ID NO: 2136219 - protein, 17 aa, Cryptosporidium hominis
AQNPPNTQKSKSNPYSE

SEQ ID NO: 2136220 - protein, 9 aa, Cryptosporidium hominis
AQNQAMEGE

SEQ ID NO: 2136221 - protein, 13 aa, Cryptosporidium hominis
AQNQNSPPKSPNR

SEQ ID NO: 2136222 - protein, 7 aa, Cryptosporidium hominis
AQNQSMN

SEQ ID NO: 2136223 - protein, 11 aa, Cryptosporidium hominis
AQNRNNESYRI

SEQ ID NO: 2136224 - protein, 6 aa, Cryptosporidium hominis
AQPDQA

SEQ ID NO: 2136225 - protein, 6 aa, Cryptosporidium hominis
AQPGDM

SEQ ID NO: 2136226 - protein, 7 aa, Cryptosporidium hominis
AQPMSTH

SEQ ID NO: 2136227 - protein, 7 aa, Cryptosporidium hominis
AQPPTAG

SEQ ID NO: 2136228 - protein, 9 aa, Cryptosporidium hominis
AQQQNSLSN

SEQ ID NO: 2136229 - protein, 12 aa, Cryptosporidium hominis
AQQQQKYTHRGG

SEQ ID NO: 2136230 - protein, 8 aa, Cryptosporidium hominis
AQQREDER

SEQ ID NO: 2136231 - protein, 5 aa, Cryptosporidium hominis
AQQRK

SEQ ID NO: 2136232 - protein, 5 aa, Cryptosporidium hominis
AQQSV

SEQ ID NO: 2136233 - protein, 4 aa, Cryptosporidium hominis
AQQY

SEQ ID NO: 2136234 - protein, 4 aa, Cryptosporidium hominis
AQRK

SEQ ID NO: 2136235 - protein, 5 aa, Cryptosporidium hominis
AQRQF

SEQ ID NO: 2136236 - protein, 14 aa, Cryptosporidium hominis
AQSANIGSSSESQF

SEQ ID NO: 2136237 - protein, 20 aa, Cryptosporidium hominis
AQSKREKKSKNAARLQKEYS

SEQ ID NO: 2136238 - protein, 19 aa, Cryptosporidium hominis
AQSRSSPNPLSIINISSST

SEQ ID NO: 2136239 - protein, 20 aa, Cryptosporidium hominis
AQSSNGPSNTRTTSDTTGPT

SEQ ID NO: 2136240 - protein, 6 aa, Cryptosporidium hominis
AQSSPH

SEQ ID NO: 2136241 - protein, 13 aa, Cryptosporidium hominis
AQTFSNKADYKNK

SEQ ID NO: 2136242 - protein, 5 aa, Cryptosporidium hominis
AQTHT

SEQ ID NO: 2136243 - protein, 5 aa, Cryptosporidium hominis
AQTIP

SEQ ID NO: 2136244 - protein, 4 aa, Cryptosporidium hominis
AQTK

SEQ ID NO: 2136245 - protein, 8 aa, Cryptosporidium hominis
AQTLSETS

SEQ ID NO: 2136246 - protein, 15 aa, Cryptosporidium hominis
AQTNAGKDVKTTENE

SEQ ID NO: 2136247 - protein, 24 aa, Cryptosporidium hominis
AQTPQQANTHNSNSEEEGANRAQQ

SEQ ID NO: 2136248 - protein, 7 aa, Cryptosporidium hominis
AQTSGLP

SEQ ID NO: 2136249 - protein, 11 aa, Cryptosporidium hominis
AQTTTTSNVNV

SEQ ID NO: 2136250 - protein, 15 aa, Cryptosporidium hominis
AQTVGTNEGIPSGSQ

SEQ ID NO: 2136251 - protein, 7 aa, Cryptosporidium hominis
AQVNEKN

SEQ ID NO: 2136252 - protein, 4 aa, Cryptosporidium hominis
AQVT

SEQ ID NO: 2136253 - protein, 6 aa, Cryptosporidium hominis
AQYEPY

SEQ ID NO: 2136254 - protein, 8 aa, Cryptosporidium hominis
ARAEYDKT

SEQ ID NO: 2136255 - protein, 9 aa, Cryptosporidium hominis
ARAGTGGNG

SEQ ID NO: 2136256 - protein, 5 aa, Cryptosporidium hominis
ARDFQ

SEQ ID NO: 2136257 - protein, 5 aa, Cryptosporidium hominis
ARDGL

SEQ ID NO: 2136258 - protein, 4 aa, Cryptosporidium hominis
ARDL

SEQ ID NO: 2136259 - protein, 8 aa, Cryptosporidium hominis
ARDMGRER

SEQ ID NO: 2136260 - protein, 8 aa, Cryptosporidium hominis
ARDPQGKT

SEQ ID NO: 2136261 - protein, 50 aa, Cryptosporidium hominis
ARDSSKFSNKSKVSIDDNSPATSEKRWNKEEQLESEESPSQYSSNAADTY

SEQ ID NO: 2136262 - protein, 11 aa, Cryptosporidium hominis
AREETEKEGSI

SEQ ID NO: 2136263 - protein, 7 aa, Cryptosporidium hominis
AREPKIV

SEQ ID NO: 2136264 - protein, 4 aa, Cryptosporidium hominis
ARER

SEQ ID NO: 2136265 - protein, 5 aa, Cryptosporidium hominis
ARESA

SEQ ID NO: 2136266 - protein, 8 aa, Cryptosporidium hominis
ARESDKMD

SEQ ID NO: 2136267 - protein, 34 aa, Cryptosporidium hominis
ARESVSEDSVPEDSKESEMNDREHQSGELSNNGL

SEQ ID NO: 2136268 - protein, 10 aa, Cryptosporidium hominis
ARETSKKDIS

SEQ ID NO: 2136269 - protein, 12 aa, Cryptosporidium hominis
ARFDSNNADESY

SEQ ID NO: 2136270 - protein, 13 aa, Cryptosporidium hominis
ARGGNMGASSNGM

SEQ ID NO: 2136271 - protein, 7 aa, Cryptosporidium hominis
ARGPPLI

SEQ ID NO: 2136272 - protein, 5 aa, Cryptosporidium hominis
ARGRI

SEQ ID NO: 2136273 - protein, 8 aa, Cryptosporidium hominis
ARHEGEDF

SEQ ID NO: 2136274 - protein, 7 aa, Cryptosporidium hominis
ARIDPDS

SEQ ID NO: 2136275 - protein, 7 aa, Cryptosporidium hominis
ARIKGGT

SEQ ID NO: 2136276 - protein, 7 aa, Cryptosporidium hominis
ARKETLK

SEQ ID NO: 2136277 - protein, 18 aa, Cryptosporidium hominis
ARKKERRLARKSQLTENI

SEQ ID NO: 2136278 - protein, 15 aa, Cryptosporidium hominis
ARKKTSGTKKTGIVK

SEQ ID NO: 2136279 - protein, 5 aa, Cryptosporidium hominis
ARKNE

SEQ ID NO: 2136280 - protein, 61 aa, Cryptosporidium hominis
ARKNNNKDAGSTLEKSQTTNNNNKDHKNSSNDTITKEKLSQDHSASTRQHQEQENTQETSS

SEQ ID NO: 2136281 - protein, 12 aa, Cryptosporidium hominis
ARKNQRNGNSYS

SEQ ID NO: 2136282 - protein, 13 aa, Cryptosporidium hominis
ARKNTREGEDFGS

SEQ ID NO: 2136283 - protein, 7 aa, Cryptosporidium hominis
ARKSPCL

SEQ ID NO: 2136284 - protein, 17 aa, Cryptosporidium hominis
ARKSSSSSQFGEEGGLN

SEQ ID NO: 2136285 - protein, 5 aa, Cryptosporidium hominis
ARKSV

SEQ ID NO: 2136286 - protein, 7 aa, Cryptosporidium hominis
ARLTPND

SEQ ID NO: 2136287 - protein, 6 aa, Cryptosporidium hominis
ARNDEL

SEQ ID NO: 2136288 - protein, 6 aa, Cryptosporidium hominis
ARNDSG

SEQ ID NO: 2136289 - protein, 6 aa, Cryptosporidium hominis
ARNGNC

SEQ ID NO: 2136290 - protein, 4 aa, Cryptosporidium hominis
ARNN

SEQ ID NO: 2136291 - protein, 14 aa, Cryptosporidium hominis
ARNNKHANKELDED

SEQ ID NO: 2136292 - protein, 4 aa, Cryptosporidium hominis
ARNP

SEQ ID NO: 2136293 - protein, 16 aa, Cryptosporidium hominis
ARNSEINNNLEENDHN

SEQ ID NO: 2136294 - protein, 17 aa, Cryptosporidium hominis
ARPGPYAQGRYAPSGAL

SEQ ID NO: 2136295 - protein, 7 aa, Cryptosporidium hominis
ARPKSQQ

SEQ ID NO: 2136296 - protein, 10 aa, Cryptosporidium hominis
ARPQNLEPSE

SEQ ID NO: 2136297 - protein, 8 aa, Cryptosporidium hominis
ARPSTVNN

SEQ ID NO: 2136298 - protein, 32 aa, Cryptosporidium hominis
ARQKRAKKVEESLSNNKNNPEDKNEELDEKDE

SEQ ID NO: 2136299 - protein, 6 aa, Cryptosporidium hominis
ARQNQD

SEQ ID NO: 2136300 - protein, 5 aa, Cryptosporidium hominis
ARQNS

SEQ ID NO: 2136301 - protein, 6 aa, Cryptosporidium hominis
ARQPNS

SEQ ID NO: 2136302 - protein, 5 aa, Cryptosporidium hominis
ARQRK

SEQ ID NO: 2136303 - protein, 5 aa, Cryptosporidium hominis
ARQRR

SEQ ID NO: 2136304 - protein, 15 aa, Cryptosporidium hominis
ARQTLNGEITPPQNI

SEQ ID NO: 2136305 - protein, 7 aa, Cryptosporidium hominis
ARRPKSD

SEQ ID NO: 2136306 - protein, 8 aa, Cryptosporidium hominis
ARRRPYSS

SEQ ID NO: 2136307 - protein, 4 aa, Cryptosporidium hominis
ARRS

SEQ ID NO: 2136308 - protein, 4 aa, Cryptosporidium hominis
ARSE

SEQ ID NO: 2136309 - protein, 23 aa, Cryptosporidium hominis
ARSERYQTKNEGVIQNSSIKENK

SEQ ID NO: 2136310 - protein, 6 aa, Cryptosporidium hominis
ARSNIN

SEQ ID NO: 2136311 - protein, 7 aa, Cryptosporidium hominis
ARSNPNK

SEQ ID NO: 2136312 - protein, 8 aa, Cryptosporidium hominis
ARSQASNM

SEQ ID NO: 2136313 - protein, 8 aa, Cryptosporidium hominis
ARSQKLEK

SEQ ID NO: 2136314 - protein, 12 aa, Cryptosporidium hominis
ARSSEGNGATER

SEQ ID NO: 2136315 - protein, 13 aa, Cryptosporidium hominis
ARTGRSKQYGNSS

SEQ ID NO: 2136316 - protein, 6 aa, Cryptosporidium hominis
ARTPQK

SEQ ID NO: 2136317 - protein, 10 aa, Cryptosporidium hominis
ARTQKNKATN

SEQ ID NO: 2136318 - protein, 12 aa, Cryptosporidium hominis
ARTQKNKKTEYH

SEQ ID NO: 2136319 - protein, 14 aa, Cryptosporidium hominis
ARYPGADISDEKAR

SEQ ID NO: 2136320 - protein, 8 aa, Cryptosporidium hominis
ARYRPEPG

SEQ ID NO: 2136321 - protein, 4 aa, Cryptosporidium hominis
ASAA

SEQ ID NO: 2136322 - protein, 7 aa, Cryptosporidium hominis
ASADDGR

SEQ ID NO: 2136323 - protein, 8 aa, Cryptosporidium hominis
ASADQGDA

SEQ ID NO: 2136324 - protein, 4 aa, Cryptosporidium hominis
ASAF

SEQ ID NO: 2136325 - protein, 11 aa, Cryptosporidium hominis
ASAGVPYSSGM

SEQ ID NO: 2136326 - protein, 7 aa, Cryptosporidium hominis
ASAIETQ

SEQ ID NO: 2136327 - protein, 16 aa, Cryptosporidium hominis
ASAKRNLGGTPVNSDD

SEQ ID NO: 2136328 - protein, 10 aa, Cryptosporidium hominis
ASANGYVRGE

SEQ ID NO: 2136329 - protein, 29 aa, Cryptosporidium hominis
ASAQQGQLNNYATKPTSSELTVKPQDQDK

SEQ ID NO: 2136330 - protein, 14 aa, Cryptosporidium hominis
ASARRLAEDSNSFI

SEQ ID NO: 2136331 - protein, 16 aa, Cryptosporidium hominis
ASASELNTESNQNKNY

SEQ ID NO: 2136332 - protein, 23 aa, Cryptosporidium hominis
ASASLEKNKPSQPPVATQSTTSF

SEQ ID NO: 2136333 - protein, 15 aa, Cryptosporidium hominis
ASASQRSGRAGRVGP

SEQ ID NO: 2136334 - protein, 13 aa, Cryptosporidium hominis
ASASSDSTVSVSL

SEQ ID NO: 2136335 - protein, 4 aa, Cryptosporidium hominis
ASAT

SEQ ID NO: 2136336 - protein, 14 aa, Cryptosporidium hominis
ASATIPSSSNSNNI

SEQ ID NO: 2136337 - protein, 4 aa, Cryptosporidium hominis
ASCG

SEQ ID NO: 2136338 - protein, 20 aa, Cryptosporidium hominis
ASCPYSKPRKSKPIDSSHDS

SEQ ID NO: 2136339 - protein, 4 aa, Cryptosporidium hominis
ASDA

SEQ ID NO: 2136340 - protein, 8 aa, Cryptosporidium hominis
ASDDRTKE

SEQ ID NO: 2136341 - protein, 8 aa, Cryptosporidium hominis
ASDEKARF

SEQ ID NO: 2136342 - protein, 6 aa, Cryptosporidium hominis
ASDKPM

SEQ ID NO: 2136343 - protein, 6 aa, Cryptosporidium hominis
ASDLAQ

SEQ ID NO: 2136344 - protein, 18 aa, Cryptosporidium hominis
ASDQGIAKVSSPQSSTSY

SEQ ID NO: 2136345 - protein, 8 aa, Cryptosporidium hominis
ASDSHSFQ

SEQ ID NO: 2136346 - protein, 6 aa, Cryptosporidium hominis
ASDTGL

SEQ ID NO: 2136347 - protein, 11 aa, Cryptosporidium hominis
ASDTSSLEFGP

SEQ ID NO: 2136348 - protein, 5 aa, Cryptosporidium hominis
ASDVS

SEQ ID NO: 2136349 - protein, 9 aa, Cryptosporidium hominis
ASDVYEESP

SEQ ID NO: 2136350 - protein, 4 aa, Cryptosporidium hominis
ASEC

SEQ ID NO: 2136351 - protein, 5 aa, Cryptosporidium hominis
ASEDG

SEQ ID NO: 2136352 - protein, 10 aa, Cryptosporidium hominis
ASEDGLEDDT

SEQ ID NO: 2136353 - protein, 7 aa, Cryptosporidium hominis
ASEDKTN

SEQ ID NO: 2136354 - protein, 6 aa, Cryptosporidium hominis
ASEDNT

SEQ ID NO: 2136355 - protein, 14 aa, Cryptosporidium hominis
ASEERTTKTVENEQ

SEQ ID NO: 2136356 - protein, 10 aa, Cryptosporidium hominis
ASEGKNNKSF

SEQ ID NO: 2136357 - protein, 6 aa, Cryptosporidium hominis
ASEIEE

SEQ ID NO: 2136358 - protein, 10 aa, Cryptosporidium hominis
ASEKQKLNRP

SEQ ID NO: 2136359 - protein, 11 aa, Cryptosporidium hominis
ASEKRNGNEAV

SEQ ID NO: 2136360 - protein, 4 aa, Cryptosporidium hominis
ASEM

SEQ ID NO: 2136361 - protein, 8 aa, Cryptosporidium hominis
ASENPELP

SEQ ID NO: 2136362 - protein, 15 aa, Cryptosporidium hominis
ASENPKEEVNSESLE

SEQ ID NO: 2136363 - protein, 26 aa, Cryptosporidium hominis
ASEQETQESACPESKASNGSKSESTI

SEQ ID NO: 2136364 - protein, 16 aa, Cryptosporidium hominis
ASERSDLDYKLVADQY

SEQ ID NO: 2136365 - protein, 46 aa, Cryptosporidium hominis
ASESGVDINNRTESNSTEVIPTSEASKSTTASASPLNQSQSCKDEL

SEQ ID NO: 2136366 - protein, 8 aa, Cryptosporidium hominis
ASESNSSD

SEQ ID NO: 2136367 - protein, 12 aa, Cryptosporidium hominis
ASESSKSEREAK

SEQ ID NO: 2136368 - protein, 4 aa, Cryptosporidium hominis
ASET

SEQ ID NO: 2136369 - protein, 15 aa, Cryptosporidium hominis
ASETSRPDPDLSDDD

SEQ ID NO: 2136370 - protein, 7 aa, Cryptosporidium hominis
ASETTTE

SEQ ID NO: 2136371 - protein, 8 aa, Cryptosporidium hominis
ASFESKSD

SEQ ID NO: 2136372 - protein, 4 aa, Cryptosporidium hominis
ASGD

SEQ ID NO: 2136373 - protein, 7 aa, Cryptosporidium hominis
ASGDRKG

SEQ ID NO: 2136374 - protein, 6 aa, Cryptosporidium hominis
ASGDSR

SEQ ID NO: 2136375 - protein, 9 aa, Cryptosporidium hominis
ASGEAQAAE

SEQ ID NO: 2136376 - protein, 22 aa, Cryptosporidium hominis
ASGEDTNRNSSYSKSSASKSIG

SEQ ID NO: 2136377 - protein, 29 aa, Cryptosporidium hominis
ASGGDGTGTTGGEDEENNEEANEEPEIES

SEQ ID NO: 2136378 - protein, 9 aa, Cryptosporidium hominis
ASGGGTADR

SEQ ID NO: 2136379 - protein, 9 aa, Cryptosporidium hominis
ASGISPNTI

SEQ ID NO: 2136380 - protein, 15 aa, Cryptosporidium hominis
ASGKKVSIDEESLNR

SEQ ID NO: 2136381 - protein, 7 aa, Cryptosporidium hominis
ASGNNPK

SEQ ID NO: 2136382 - protein, 11 aa, Cryptosporidium hominis
ASGNSKKNSSK

SEQ ID NO: 2136383 - protein, 6 aa, Cryptosporidium hominis
ASGPYA

SEQ ID NO: 2136384 - protein, 12 aa, Cryptosporidium hominis
ASGRAGRRGYDV

SEQ ID NO: 2136385 - protein, 7 aa, Cryptosporidium hominis
ASGYSSN

SEQ ID NO: 2136386 - protein, 8 aa, Cryptosporidium hominis
ASHKGNVS

SEQ ID NO: 2136387 - protein, 4 aa, Cryptosporidium hominis
ASHN

SEQ ID NO: 2136388 - protein, 20 aa, Cryptosporidium hominis
ASINDENDSSSIETQSNSRD

SEQ ID NO: 2136389 - protein, 13 aa, Cryptosporidium hominis
ASINKQNNNGNSP

SEQ ID NO: 2136390 - protein, 10 aa, Cryptosporidium hominis
ASIPDERGDI

SEQ ID NO: 2136391 - protein, 4 aa, Cryptosporidium hominis
ASIR

SEQ ID NO: 2136392 - protein, 6 aa, Cryptosporidium hominis
ASIREK

SEQ ID NO: 2136393 - protein, 13 aa, Cryptosporidium hominis
ASIRGDRVSHESQ

SEQ ID NO: 2136394 - protein, 16 aa, Cryptosporidium hominis
ASISTNNTLSSPRSSE

SEQ ID NO: 2136395 - protein, 6 aa, Cryptosporidium hominis
ASITPR

SEQ ID NO: 2136396 - protein, 5 aa, Cryptosporidium hominis
ASIVP

SEQ ID NO: 2136397 - protein, 8 aa, Cryptosporidium hominis
ASKALEKN

SEQ ID NO: 2136398 - protein, 19 aa, Cryptosporidium hominis
ASKEKGRYKQSGNESSQFR

SEQ ID NO: 2136399 - protein, 8 aa, Cryptosporidium hominis
ASKEKKDK

SEQ ID NO: 2136400 - protein, 15 aa, Cryptosporidium hominis
ASKGQDSDDSQIEKN

SEQ ID NO: 2136401 - protein, 8 aa, Cryptosporidium hominis
ASKGSFGA

SEQ ID NO: 2136402 - protein, 10 aa, Cryptosporidium hominis
ASKGTFVRES

SEQ ID NO: 2136403 - protein, 5 aa, Cryptosporidium hominis
ASKGV

SEQ ID NO: 2136404 - protein, 4 aa, Cryptosporidium hominis
ASKK

SEQ ID NO: 2136405 - protein, 9 aa, Cryptosporidium hominis
ASKNIDPES

SEQ ID NO: 2136406 - protein, 6 aa, Cryptosporidium hominis
ASKNWD

SEQ ID NO: 2136407 - protein, 16 aa, Cryptosporidium hominis
ASKPSDQVCNESSKSC

SEQ ID NO: 2136408 - protein, 5 aa, Cryptosporidium hominis
ASKQI

SEQ ID NO: 2136409 - protein, 6 aa, Cryptosporidium hominis
ASKTEM

SEQ ID NO: 2136410 - protein, 21 aa, Cryptosporidium hominis
ASKTNTMEEQTTSRSSNMASN

SEQ ID NO: 2136411 - protein, 42 aa, Cryptosporidium hominis
ASLANSSGKPNDSSSQNVNSGSLSYGKVGSNSKFTNKAASNN

SEQ ID NO: 2136412 - protein, 7 aa, Cryptosporidium hominis
ASLETGV

SEQ ID NO: 2136413 - protein, 7 aa, Cryptosporidium hominis
ASLGPTI

SEQ ID NO: 2136414 - protein, 13 aa, Cryptosporidium hominis
ASLKENPKNVKAA

SEQ ID NO: 2136415 - protein, 7 aa, Cryptosporidium hominis
ASLMPDK

SEQ ID NO: 2136416 - protein, 11 aa, Cryptosporidium hominis
ASLNSGSPESR

SEQ ID NO: 2136417 - protein, 34 aa, Cryptosporidium hominis
ASMGNQKHSSKLTDANSKNSNAAKLGSKAIPGLS

SEQ ID NO: 2136418 - protein, 6 aa, Cryptosporidium hominis
ASNAKV

SEQ ID NO: 2136419 - protein, 8 aa, Cryptosporidium hominis
ASNDENDV

SEQ ID NO: 2136420 - protein, 9 aa, Cryptosporidium hominis
ASNDRKPLD

SEQ ID NO: 2136421 - protein, 7 aa, Cryptosporidium hominis
ASNDSEK

SEQ ID NO: 2136422 - protein, 5 aa, Cryptosporidium hominis
ASNEP

SEQ ID NO: 2136423 - protein, 9 aa, Cryptosporidium hominis
ASNGIPKRS

SEQ ID NO: 2136424 - protein, 6 aa, Cryptosporidium hominis
ASNINE

SEQ ID NO: 2136425 - protein, 6 aa, Cryptosporidium hominis
ASNIQI

SEQ ID NO: 2136426 - protein, 9 aa, Cryptosporidium hominis
ASNKSLPLP

SEQ ID NO: 2136427 - protein, 16 aa, Cryptosporidium hominis
ASNLQKQEDEEREEEL

SEQ ID NO: 2136428 - protein, 4 aa, Cryptosporidium hominis
ASNN

SEQ ID NO: 2136429 - protein, 8 aa, Cryptosporidium hominis
ASNNIEKN

SEQ ID NO: 2136430 - protein, 5 aa, Cryptosporidium hominis
ASNNS

SEQ ID NO: 2136431 - protein, 40 aa, Cryptosporidium hominis
ASNPPKSQAPRKSLSSRGNSKYKRQTRRKQAQGQQDSSTT

SEQ ID NO: 2136432 - protein, 7 aa, Cryptosporidium hominis
ASNQNDH

SEQ ID NO: 2136433 - protein, 45 aa, Cryptosporidium hominis
ASNRPEQKSDNKDDSSEVNKNPLIENEDEQNHSNDKTLVGESRTE

SEQ ID NO: 2136434 - protein, 9 aa, Cryptosporidium hominis
ASNRPTKQS

SEQ ID NO: 2136435 - protein, 15 aa, Cryptosporidium hominis
ASNSEGNSPENKKDI

SEQ ID NO: 2136436 - protein, 5 aa, Cryptosporidium hominis
ASNSI

SEQ ID NO: 2136437 - protein, 6 aa, Cryptosporidium hominis
ASNSLG

SEQ ID NO: 2136438 - protein, 4 aa, Cryptosporidium hominis
ASNT

SEQ ID NO: 2136439 - protein, 8 aa, Cryptosporidium hominis
ASNTREFQ

SEQ ID NO: 2136440 - protein, 39 aa, Cryptosporidium hominis
ASNTRSNNSNKNTRKNKTDFATKSPECNAKNKNKSYVDG

SEQ ID NO: 2136441 - protein, 13 aa, Cryptosporidium hominis
ASNTSSFQSSDAS

SEQ ID NO: 2136442 - protein, 28 aa, Cryptosporidium hominis
ASNVNNNDSRQNGGISPSINDSPKSSAA

SEQ ID NO: 2136443 - protein, 6 aa, Cryptosporidium hominis
ASPAIE

SEQ ID NO: 2136444 - protein, 8 aa, Cryptosporidium hominis
ASPDETAY

SEQ ID NO: 2136445 - protein, 5 aa, Cryptosporidium hominis
ASPES

SEQ ID NO: 2136446 - protein, 7 aa, Cryptosporidium hominis
ASPGAAP

SEQ ID NO: 2136447 - protein, 12 aa, Cryptosporidium hominis
ASPGIDGAESFE

SEQ ID NO: 2136448 - protein, 7 aa, Cryptosporidium hominis
ASPGKNI

SEQ ID NO: 2136449 - protein, 5 aa, Cryptosporidium hominis
ASPIS

SEQ ID NO: 2136450 - protein, 17 aa, Cryptosporidium hominis
ASPLQQNSANSVASATS

SEQ ID NO: 2136451 - protein, 7 aa, Cryptosporidium hominis
ASPLSTT

SEQ ID NO: 2136452 - protein, 34 aa, Cryptosporidium hominis
ASPNVSNVQTRQQNYVSSNSSSFYNKSQSNYKSN

SEQ ID NO: 2136453 - protein, 7 aa, Cryptosporidium hominis
ASPPEEI

SEQ ID NO: 2136454 - protein, 15 aa, Cryptosporidium hominis
ASPQGAASNSTSEAL

SEQ ID NO: 2136455 - protein, 4 aa, Cryptosporidium hominis
ASPR

SEQ ID NO: 2136456 - protein, 6 aa, Cryptosporidium hominis
ASPSIS

SEQ ID NO: 2136457 - protein, 16 aa, Cryptosporidium hominis
ASPSRTPSASPTSPLS

SEQ ID NO: 2136458 - protein, 33 aa, Cryptosporidium hominis
ASPTYRKNVPQTRSNNNTTLPNSNLNNLTFSYK

SEQ ID NO: 2136459 - protein, 16 aa, Cryptosporidium hominis
ASPVKSDTSTATPSSM

SEQ ID NO: 2136460 - protein, 5 aa, Cryptosporidium hominis
ASPYN

SEQ ID NO: 2136461 - protein, 8 aa, Cryptosporidium hominis
ASQAQSRM

SEQ ID NO: 2136462 - protein, 14 aa, Cryptosporidium hominis
ASQDDRKKRQNNPL

SEQ ID NO: 2136463 - protein, 10 aa, Cryptosporidium hominis
ASQDSKVTKD

SEQ ID NO: 2136464 - protein, 4 aa, Cryptosporidium hominis
ASQF

SEQ ID NO: 2136465 - protein, 6 aa, Cryptosporidium hominis
ASQGVE

SEQ ID NO: 2136466 - protein, 14 aa, Cryptosporidium hominis
ASQLKKKEKIPEKQ

SEQ ID NO: 2136467 - protein, 8 aa, Cryptosporidium hominis
ASQNLTKY

SEQ ID NO: 2136468 - protein, 30 aa, Cryptosporidium hominis
ASQNSETGNLNKRTLSTYNSQLKSNNIGGV

SEQ ID NO: 2136469 - protein, 23 aa, Cryptosporidium hominis
ASQQPPSSSYSLPPQFSNEPDVR

SEQ ID NO: 2136470 - protein, 28 aa, Cryptosporidium hominis
ASQQSPPENVSGKKPCDSNCMPESPSEH

SEQ ID NO: 2136471 - protein, 5 aa, Cryptosporidium hominis
ASQRG

SEQ ID NO: 2136472 - protein, 7 aa, Cryptosporidium hominis
ASQRSNC

SEQ ID NO: 2136473 - protein, 7 aa, Cryptosporidium hominis
ASQSPDV

SEQ ID NO: 2136474 - protein, 9 aa, Cryptosporidium hominis
ASQSSDQTV

SEQ ID NO: 2136475 - protein, 6 aa, Cryptosporidium hominis
ASQTIS

SEQ ID NO: 2136476 - protein, 6 aa, Cryptosporidium hominis
ASQTNC

SEQ ID NO: 2136477 - protein, 6 aa, Cryptosporidium hominis
ASRAQI

SEQ ID NO: 2136478 - protein, 5 aa, Cryptosporidium hominis
ASRDE

SEQ ID NO: 2136479 - protein, 5 aa, Cryptosporidium hominis
ASRDK

SEQ ID NO: 2136480 - protein, 6 aa, Cryptosporidium hominis
ASRDNT

SEQ ID NO: 2136481 - protein, 6 aa, Cryptosporidium hominis
ASREIQ

SEQ ID NO: 2136482 - protein, 9 aa, Cryptosporidium hominis
ASREKISQL

SEQ ID NO: 2136483 - protein, 4 aa, Cryptosporidium hominis
ASRG

SEQ ID NO: 2136484 - protein, 5 aa, Cryptosporidium hominis
ASRGM

SEQ ID NO: 2136485 - protein, 12 aa, Cryptosporidium hominis
ASRGVRSRKYRN

SEQ ID NO: 2136486 - protein, 7 aa, Cryptosporidium hominis
ASRHGQK

SEQ ID NO: 2136487 - protein, 39 aa, Cryptosporidium hominis
ASRRSDIDMNPNSYDASHGLEAEESTGAPEESPVSPDIS

SEQ ID NO: 2136488 - protein, 7 aa, Cryptosporidium hominis
ASRRSGV

SEQ ID NO: 2136489 - protein, 5 aa, Cryptosporidium hominis
ASRTC

SEQ ID NO: 2136490 - protein, 5 aa, Cryptosporidium hominis
ASRYD

SEQ ID NO: 2136491 - protein, 9 aa, Cryptosporidium hominis
ASSCGNDPI

SEQ ID NO: 2136492 - protein, 6 aa, Cryptosporidium hominis
ASSDET

SEQ ID NO: 2136493 - protein, 6 aa, Cryptosporidium hominis
ASSDYI

SEQ ID NO: 2136494 - protein, 12 aa, Cryptosporidium hominis
ASSEHTSTAEKR

SEQ ID NO: 2136495 - protein, 6 aa, Cryptosporidium hominis
ASSGED

SEQ ID NO: 2136496 - protein, 5 aa, Cryptosporidium hominis
ASSGF

SEQ ID NO: 2136497 - protein, 51 aa, Cryptosporidium hominis
ASSGFGTGAGGGAGATAGAGATAGAGENNNTANRGSTNTIRQSRGSTAANN

SEQ ID NO: 2136498 - protein, 9 aa, Cryptosporidium hominis
ASSGGGGKG

SEQ ID NO: 2136499 - protein, 15 aa, Cryptosporidium hominis
ASSGNHIGAGAGGAA

SEQ ID NO: 2136500 - protein, 10 aa, Cryptosporidium hominis
ASSGNTPLNN

SEQ ID NO: 2136501 - protein, 6 aa, Cryptosporidium hominis
ASSGNY

SEQ ID NO: 2136502 - protein, 10 aa, Cryptosporidium hominis
ASSKGKENVI

SEQ ID NO: 2136503 - protein, 14 aa, Cryptosporidium hominis
ASSKKISSQNNSQE

SEQ ID NO: 2136504 - protein, 20 aa, Cryptosporidium hominis
ASSKTDSTFDTSYSTYSDEN

SEQ ID NO: 2136505 - protein, 6 aa, Cryptosporidium hominis
ASSKTM

SEQ ID NO: 2136506 - protein, 14 aa, Cryptosporidium hominis
ASSMGKFSTDRTIE

SEQ ID NO: 2136507 - protein, 9 aa, Cryptosporidium hominis
ASSNEAEVR

SEQ ID NO: 2136508 - protein, 6 aa, Cryptosporidium hominis
ASSNIE

SEQ ID NO: 2136509 - protein, 17 aa, Cryptosporidium hominis
ASSNSKNRNISNRTKSS

SEQ ID NO: 2136510 - protein, 232 aa, Cryptosporidium hominis
ASSPTYNTEVSERARKKYKVNNTLSSYSPSSPLNSDNKISNISPDLSPTSPHYSPTSPHYSPTSPHYSPTSPHYSPTSPHYSPTSPHYSPTSPHYSPTSPHYSPTSPHYSPTSPHYSPTSPHYSPTSPHYSPTSPHYSPTSPHYSPTSPHYSPTSPHYSPSSPHYSPTSPQYSPTSPNYNPASPNYSPTSHYSPTSPNYNPTSPNYSPSSPNYISNNSGSPGYSPSSPQYDP

SEQ ID NO: 2136511 - protein, 13 aa, Cryptosporidium hominis
ASSRDHSKLDRSK

SEQ ID NO: 2136512 - protein, 16 aa, Cryptosporidium hominis
ASSSSNENSNISNSYY

SEQ ID NO: 2136513 - protein, 5 aa, Cryptosporidium hominis
ASSST

SEQ ID NO: 2136514 - protein, 5 aa, Cryptosporidium hominis
ASSTI

SEQ ID NO: 2136515 - protein, 6 aa, Cryptosporidium hominis
ASSTIK

SEQ ID NO: 2136516 - protein, 18 aa, Cryptosporidium hominis
ASSTLSSLDSAEFGSVTF

SEQ ID NO: 2136517 - protein, 16 aa, Cryptosporidium hominis
ASSTSNMNSNGGHSEY

SEQ ID NO: 2136518 - protein, 16 aa, Cryptosporidium hominis
ASTGFKNDARKTVNRD

SEQ ID NO: 2136519 - protein, 6 aa, Cryptosporidium hominis
ASTGPR

SEQ ID NO: 2136520 - protein, 7 aa, Cryptosporidium hominis
ASTGTTI

SEQ ID NO: 2136521 - protein, 11 aa, Cryptosporidium hominis
ASTISTTPTRS

SEQ ID NO: 2136522 - protein, 5 aa, Cryptosporidium hominis
ASTNI

SEQ ID NO: 2136523 - protein, 31 aa, Cryptosporidium hominis
ASTNPDNNDSNNNNNNNNNNNNNNMAENNHY

SEQ ID NO: 2136524 - protein, 17 aa, Cryptosporidium hominis
ASTNRMSRSKMGAYSTE

SEQ ID NO: 2136525 - protein, 13 aa, Cryptosporidium hominis
ASTNSSQEISPSS

SEQ ID NO: 2136526 - protein, 5 aa, Cryptosporidium hominis
ASTPS

SEQ ID NO: 2136527 - protein, 9 aa, Cryptosporidium hominis
ASTPTEKDK

SEQ ID NO: 2136528 - protein, 4 aa, Cryptosporidium hominis
ASTQ

SEQ ID NO: 2136529 - protein, 4 aa, Cryptosporidium hominis
ASTR

SEQ ID NO: 2136530 - protein, 7 aa, Cryptosporidium hominis
ASTRTNY

SEQ ID NO: 2136531 - protein, 8 aa, Cryptosporidium hominis
ASTSGFGQ

SEQ ID NO: 2136532 - protein, 17 aa, Cryptosporidium hominis
ASTSPVSPSSNSTDSEY

SEQ ID NO: 2136533 - protein, 15 aa, Cryptosporidium hominis
ASTTAREVESSEPEE

SEQ ID NO: 2136534 - protein, 10 aa, Cryptosporidium hominis
ASTTVSPNTN

SEQ ID NO: 2136535 - protein, 7 aa, Cryptosporidium hominis
ASTVPKD

SEQ ID NO: 2136536 - protein, 4 aa, Cryptosporidium hominis
ASVA

SEQ ID NO: 2136537 - protein, 7 aa, Cryptosporidium hominis
ASVSKEL

SEQ ID NO: 2136538 - protein, 7 aa, Cryptosporidium hominis
ASYEKTM

SEQ ID NO: 2136539 - protein, 6 aa, Cryptosporidium hominis
ASYGST

SEQ ID NO: 2136540 - protein, 4 aa, Cryptosporidium hominis
ASYQ

SEQ ID NO: 2136541 - protein, 9 aa, Cryptosporidium hominis
ASYSTDGKY

SEQ ID NO: 2136542 - protein, 16 aa, Cryptosporidium hominis
ASYSTSSIAKRAIYPI

SEQ ID NO: 2136543 - protein, 33 aa, Cryptosporidium hominis
ASYTAPSSRSTSSSSNSVISSSSLVSNSSIYSR

SEQ ID NO: 2136544 - protein, 6 aa, Cryptosporidium hominis
ATADSR

SEQ ID NO: 2136545 - protein, 15 aa, Cryptosporidium hominis
ATAEKKDDIKETKEI

SEQ ID NO: 2136546 - protein, 18 aa, Cryptosporidium hominis
ATAETSINKSTETKPEKL

SEQ ID NO: 2136547 - protein, 7 aa, Cryptosporidium hominis
ATAGDGL

SEQ ID NO: 2136548 - protein, 13 aa, Cryptosporidium hominis
ATAGDTHLGGEDF

SEQ ID NO: 2136549 - protein, 13 aa, Cryptosporidium hominis
ATAQDDISGDGTT

SEQ ID NO: 2136550 - protein, 12 aa, Cryptosporidium hominis
ATARKRTRDADY

SEQ ID NO: 2136551 - protein, 10 aa, Cryptosporidium hominis
ATASPKVQKD

SEQ ID NO: 2136552 - protein, 7 aa, Cryptosporidium hominis
ATASSDH

SEQ ID NO: 2136553 - protein, 5 aa, Cryptosporidium hominis
ATDIT

SEQ ID NO: 2136554 - protein, 6 aa, Cryptosporidium hominis
ATDKDG

SEQ ID NO: 2136555 - protein, 9 aa, Cryptosporidium hominis
ATDNESKNL

SEQ ID NO: 2136556 - protein, 11 aa, Cryptosporidium hominis
ATDSENRIQES

SEQ ID NO: 2136557 - protein, 17 aa, Cryptosporidium hominis
ATDTTTITTTQMPTSSK

SEQ ID NO: 2136558 - protein, 5 aa, Cryptosporidium hominis
ATEEE

SEQ ID NO: 2136559 - protein, 8 aa, Cryptosporidium hominis
ATEGDANT

SEQ ID NO: 2136560 - protein, 4 aa, Cryptosporidium hominis
ATEN

SEQ ID NO: 2136561 - protein, 6 aa, Cryptosporidium hominis
ATESGS

SEQ ID NO: 2136562 - protein, 5 aa, Cryptosporidium hominis
ATESN

SEQ ID NO: 2136563 - protein, 37 aa, Cryptosporidium hominis
ATFATKKESRHTFGKSSKTRQKHTRARTNSSNENLNN

SEQ ID NO: 2136564 - protein, 9 aa, Cryptosporidium hominis
ATGDSKKRD

SEQ ID NO: 2136565 - protein, 8 aa, Cryptosporidium hominis
ATGGCTDG

SEQ ID NO: 2136566 - protein, 7 aa, Cryptosporidium hominis
ATGGNDN

SEQ ID NO: 2136567 - protein, 7 aa, Cryptosporidium hominis
ATGGSDA

SEQ ID NO: 2136568 - protein, 10 aa, Cryptosporidium hominis
ATGKELPRGV

SEQ ID NO: 2136569 - protein, 11 aa, Cryptosporidium hominis
ATGKGSSGVGL

SEQ ID NO: 2136570 - protein, 17 aa, Cryptosporidium hominis
ATGNDKGDVLLYRINDY

SEQ ID NO: 2136571 - protein, 11 aa, Cryptosporidium hominis
ATGQKIPKELD

SEQ ID NO: 2136572 - protein, 6 aa, Cryptosporidium hominis
ATGRSK

SEQ ID NO: 2136573 - protein, 8 aa, Cryptosporidium hominis
ATGSADKT

SEQ ID NO: 2136574 - protein, 5 aa, Cryptosporidium hominis
ATGSD

SEQ ID NO: 2136575 - protein, 32 aa, Cryptosporidium hominis
ATGSSLAKEIPKSNVSKVEKSASKKPEDKSIS

SEQ ID NO: 2136576 - protein, 7 aa, Cryptosporidium hominis
ATGTGKT

SEQ ID NO: 2136577 - protein, 7 aa, Cryptosporidium hominis
ATGTKSG

SEQ ID NO: 2136578 - protein, 6 aa, Cryptosporidium hominis
ATHSRA

SEQ ID NO: 2136579 - protein, 28 aa, Cryptosporidium hominis
ATHTKKTMDRPGRSEGNQGRGYGRNRQQ

SEQ ID NO: 2136580 - protein, 24 aa, Cryptosporidium hominis
ATIPENDHEFTENLSNSSVNNTSE

SEQ ID NO: 2136581 - protein, 11 aa, Cryptosporidium hominis
ATIQTPNPFPY

SEQ ID NO: 2136582 - protein, 16 aa, Cryptosporidium hominis
ATKEVPGLSSGPGNGN

SEQ ID NO: 2136583 - protein, 14 aa, Cryptosporidium hominis
ATKTAKKAKRVKRR

SEQ ID NO: 2136584 - protein, 5 aa, Cryptosporidium hominis
ATLED

SEQ ID NO: 2136585 - protein, 8 aa, Cryptosporidium hominis
ATLGEKDQ

SEQ ID NO: 2136586 - protein, 4 aa, Cryptosporidium hominis
ATLS

SEQ ID NO: 2136587 - protein, 11 aa, Cryptosporidium hominis
ATLSKKAEELV

SEQ ID NO: 2136588 - protein, 13 aa, Cryptosporidium hominis
ATNCTESDMGQTL

SEQ ID NO: 2136589 - protein, 11 aa, Cryptosporidium hominis
ATNDESEQRRV

SEQ ID NO: 2136590 - protein, 19 aa, Cryptosporidium hominis
ATNGNGVAGGSCSAVGKSS

SEQ ID NO: 2136591 - protein, 8 aa, Cryptosporidium hominis
ATNGNTEL

SEQ ID NO: 2136592 - protein, 13 aa, Cryptosporidium hominis
ATNGNTSLGGEDF

SEQ ID NO: 2136593 - protein, 28 aa, Cryptosporidium hominis
ATNGSENYKRMSSKSKNSPRSHNKYTGN

SEQ ID NO: 2136594 - protein, 21 aa, Cryptosporidium hominis
ATNHNGRSASLTAPNGPSQTE

SEQ ID NO: 2136595 - protein, 7 aa, Cryptosporidium hominis
ATNSDGY

SEQ ID NO: 2136596 - protein, 8 aa, Cryptosporidium hominis
ATPEQAQE

SEQ ID NO: 2136597 - protein, 20 aa, Cryptosporidium hominis
ATPESNPNNITSNKSNEPIY

SEQ ID NO: 2136598 - protein, 7 aa, Cryptosporidium hominis
ATPLSAE

SEQ ID NO: 2136599 - protein, 15 aa, Cryptosporidium hominis
ATPNNNKLSSSNSNI

SEQ ID NO: 2136600 - protein, 12 aa, Cryptosporidium hominis
ATPQPPAQQYGT

SEQ ID NO: 2136601 - protein, 7 aa, Cryptosporidium hominis
ATPSLST

SEQ ID NO: 2136602 - protein, 6 aa, Cryptosporidium hominis
ATPSNL

SEQ ID NO: 2136603 - protein, 13 aa, Cryptosporidium hominis
ATPSSTISYNNNN

SEQ ID NO: 2136604 - protein, 6 aa, Cryptosporidium hominis
ATQRGS

SEQ ID NO: 2136605 - protein, 7 aa, Cryptosporidium hominis
ATQTTKV

SEQ ID NO: 2136606 - protein, 13 aa, Cryptosporidium hominis
ATQVNNGQFFSID

SEQ ID NO: 2136607 - protein, 5 aa, Cryptosporidium hominis
ATREY

SEQ ID NO: 2136608 - protein, 4 aa, Cryptosporidium hominis
ATRL

SEQ ID NO: 2136609 - protein, 12 aa, Cryptosporidium hominis
ATRSSSKSEDKV

SEQ ID NO: 2136610 - protein, 5 aa, Cryptosporidium hominis
ATSAQ

SEQ ID NO: 2136611 - protein, 8 aa, Cryptosporidium hominis
ATSDKTPL

SEQ ID NO: 2136612 - protein, 5 aa, Cryptosporidium hominis
ATSEF

SEQ ID NO: 2136613 - protein, 7 aa, Cryptosporidium hominis
ATSGKAF

SEQ ID NO: 2136614 - protein, 20 aa, Cryptosporidium hominis
ATSGNNGDADPDLEKQIGGL

SEQ ID NO: 2136615 - protein, 8 aa, Cryptosporidium hominis
ATSKESKN

SEQ ID NO: 2136616 - protein, 4 aa, Cryptosporidium hominis
ATSN

SEQ ID NO: 2136617 - protein, 10 aa, Cryptosporidium hominis
ATSNSSNSSC

SEQ ID NO: 2136618 - protein, 5 aa, Cryptosporidium hominis
ATSPA

SEQ ID NO: 2136619 - protein, 19 aa, Cryptosporidium hominis
ATSRTTNSNSNQPTNVYSG

SEQ ID NO: 2136620 - protein, 9 aa, Cryptosporidium hominis
ATSSSEPME

SEQ ID NO: 2136621 - protein, 12 aa, Cryptosporidium hominis
ATSTAGAHVTGG

SEQ ID NO: 2136622 - protein, 6 aa, Cryptosporidium hominis
ATSTKF

SEQ ID NO: 2136623 - protein, 21 aa, Cryptosporidium hominis
ATSYYSNSINNSNPIKKGGGF

SEQ ID NO: 2136624 - protein, 18 aa, Cryptosporidium hominis
ATTASGGHPSVSNSQNIS

SEQ ID NO: 2136625 - protein, 9 aa, Cryptosporidium hominis
ATTASSGII

SEQ ID NO: 2136626 - protein, 5 aa, Cryptosporidium hominis
ATTGF

SEQ ID NO: 2136627 - protein, 6 aa, Cryptosporidium hominis
ATTGIN

SEQ ID NO: 2136628 - protein, 14 aa, Cryptosporidium hominis
ATTGRGYVTEGPDC

SEQ ID NO: 2136629 - protein, 20 aa, Cryptosporidium hominis
ATTNATANATATTSATNAAT

SEQ ID NO: 2136630 - protein, 12 aa, Cryptosporidium hominis
ATTNKPRGSNLA

SEQ ID NO: 2136631 - protein, 7 aa, Cryptosporidium hominis
ATTPVDP

SEQ ID NO: 2136632 - protein, 5 aa, Cryptosporidium hominis
ATTQI

SEQ ID NO: 2136633 - protein, 4 aa, Cryptosporidium hominis
ATTS

SEQ ID NO: 2136634 - protein, 7 aa, Cryptosporidium hominis
ATTTSTA

SEQ ID NO: 2136635 - protein, 14 aa, Cryptosporidium hominis
ATTTTTTTSPPWQD

SEQ ID NO: 2136636 - protein, 4 aa, Cryptosporidium hominis
ATYE

SEQ ID NO: 2136637 - protein, 31 aa, Cryptosporidium hominis
ATYNSNTGSIGGRKSSIGGNRGSCRSNPNVF

SEQ ID NO: 2136638 - protein, 8 aa, Cryptosporidium hominis
ATYTRNNS

SEQ ID NO: 2136639 - protein, 7 aa, Cryptosporidium hominis
AVAEPSN

SEQ ID NO: 2136640 - protein, 19 aa, Cryptosporidium hominis
AVANAEKQKNGFGSNSGLN

SEQ ID NO: 2136641 - protein, 15 aa, Cryptosporidium hominis
AVDEDDELEEDDEGD

SEQ ID NO: 2136642 - protein, 8 aa, Cryptosporidium hominis
AVDGAAAL

SEQ ID NO: 2136643 - protein, 29 aa, Cryptosporidium hominis
AVDSAAAANEWGGVSGNWGGSAADEWRNA

SEQ ID NO: 2136644 - protein, 15 aa, Cryptosporidium hominis
AVEEKTTTSEIEKQI

SEQ ID NO: 2136645 - protein, 10 aa, Cryptosporidium hominis
AVENYNDSSE

SEQ ID NO: 2136646 - protein, 17 aa, Cryptosporidium hominis
AVGGREGYSSSYVPAPK

SEQ ID NO: 2136647 - protein, 20 aa, Cryptosporidium hominis
AVGGTTSEDLKKKKNKKRFN

SEQ ID NO: 2136648 - protein, 9 aa, Cryptosporidium hominis
AVGQNSKTV

SEQ ID NO: 2136649 - protein, 6 aa, Cryptosporidium hominis
AVGSPQ

SEQ ID NO: 2136650 - protein, 7 aa, Cryptosporidium hominis
AVGSRRS

SEQ ID NO: 2136651 - protein, 11 aa, Cryptosporidium hominis
AVKNESHSSEI

SEQ ID NO: 2136652 - protein, 5 aa, Cryptosporidium hominis
AVNGN

SEQ ID NO: 2136653 - protein, 13 aa, Cryptosporidium hominis
AVNGSEVSVSAAA

SEQ ID NO: 2136654 - protein, 11 aa, Cryptosporidium hominis
AVNPESETIET

SEQ ID NO: 2136655 - protein, 8 aa, Cryptosporidium hominis
AVNSEHNK

SEQ ID NO: 2136656 - protein, 9 aa, Cryptosporidium hominis
AVNSSKRRI

SEQ ID NO: 2136657 - protein, 9 aa, Cryptosporidium hominis
AVPSPSYNF

SEQ ID NO: 2136658 - protein, 16 aa, Cryptosporidium hominis
AVSEGTKAVTKFTGGQ

SEQ ID NO: 2136659 - protein, 5 aa, Cryptosporidium hominis
AVSGT

SEQ ID NO: 2136660 - protein, 9 aa, Cryptosporidium hominis
AVSNDTGLK

SEQ ID NO: 2136661 - protein, 15 aa, Cryptosporidium hominis
AVSPTSSRSLENPDF

SEQ ID NO: 2136662 - protein, 18 aa, Cryptosporidium hominis
AVSSPASISPEKNYIPAS

SEQ ID NO: 2136663 - protein, 23 aa, Cryptosporidium hominis
AVTGGNNDRFGNLNEKPQERGYN

SEQ ID NO: 2136664 - protein, 6 aa, Cryptosporidium hominis
AVTPSG

SEQ ID NO: 2136665 - protein, 7 aa, Cryptosporidium hominis
AVTSSDS

SEQ ID NO: 2136666 - protein, 14 aa, Cryptosporidium hominis
AVTSSGNRVASGYP

SEQ ID NO: 2136667 - protein, 5 aa, Cryptosporidium hominis
AWSRK

SEQ ID NO: 2136668 - protein, 6 aa, Cryptosporidium hominis
AYDPNG

SEQ ID NO: 2136669 - protein, 4 aa, Cryptosporidium hominis
AYEP

SEQ ID NO: 2136670 - protein, 6 aa, Cryptosporidium hominis
AYKEGG

SEQ ID NO: 2136671 - protein, 29 aa, Cryptosporidium hominis
AYKPGNSDNQSSENYANHEDNSYESQDSD

SEQ ID NO: 2136672 - protein, 7 aa, Cryptosporidium hominis
AYKTAQA

SEQ ID NO: 2136673 - protein, 6 aa, Cryptosporidium hominis
AYKTIG

SEQ ID NO: 2136674 - protein, 4 aa, Cryptosporidium hominis
AYMP

SEQ ID NO: 2136675 - protein, 10 aa, Cryptosporidium hominis
AYNGNKPSLS

SEQ ID NO: 2136676 - protein, 11 aa, Cryptosporidium hominis
AYNSSKEGFLG

SEQ ID NO: 2136677 - protein, 20 aa, Cryptosporidium hominis
AYNSYKRKISNREKLDEANS

SEQ ID NO: 2136678 - protein, 6 aa, Cryptosporidium hominis
AYPAPN

SEQ ID NO: 2136679 - protein, 11 aa, Cryptosporidium hominis
AYPNTDANPSL

SEQ ID NO: 2136680 - protein, 5 aa, Cryptosporidium hominis
AYQPR

SEQ ID NO: 2136681 - protein, 11 aa, Cryptosporidium hominis
AYRDSNKYNIN

SEQ ID NO: 2136682 - protein, 4 aa, Cryptosporidium hominis
AYRQ

SEQ ID NO: 2136683 - protein, 5 aa, Cryptosporidium hominis
AYSES

SEQ ID NO: 2136684 - protein, 5 aa, Cryptosporidium hominis
AYSPA

SEQ ID NO: 2136685 - protein, 15 aa, Cryptosporidium hominis
AYSSHQSHNGQTQTF

SEQ ID NO: 2136686 - protein, 10 aa, Cryptosporidium hominis
AYTGEPLANA

SEQ ID NO: 2136687 - protein, 9 aa, Cryptosporidium hominis
AYWNSGNNA

SEQ ID NO: 2136688 - protein, 4 aa, Cryptosporidium hominis
CADE

SEQ ID NO: 2136689 - protein, 6 aa, Cryptosporidium hominis
CAGDDK

SEQ ID NO: 2136690 - protein, 8 aa, Cryptosporidium hominis
CAGRPRLD

SEQ ID NO: 2136691 - protein, 5 aa, Cryptosporidium hominis
CAKGQ

SEQ ID NO: 2136692 - protein, 7 aa, Cryptosporidium hominis
CASGGKD

SEQ ID NO: 2136693 - protein, 11 aa, Cryptosporidium hominis
CASSPTLPSPD

SEQ ID NO: 2136694 - protein, 8 aa, Cryptosporidium hominis
CATSGDGL

SEQ ID NO: 2136695 - protein, 21 aa, Cryptosporidium hominis
CATTANNLKRRRSSVNKGEDS

SEQ ID NO: 2136696 - protein, 4 aa, Cryptosporidium hominis
CDAL

SEQ ID NO: 2136697 - protein, 7 aa, Cryptosporidium hominis
CDASNQI

SEQ ID NO: 2136698 - protein, 6 aa, Cryptosporidium hominis
CDDDDG

SEQ ID NO: 2136699 - protein, 9 aa, Cryptosporidium hominis
CDDPNQANI

SEQ ID NO: 2136700 - protein, 4 aa, Cryptosporidium hominis
CDEK

SEQ ID NO: 2136701 - protein, 17 aa, Cryptosporidium hominis
CDENADNHNSNGQIQNN

SEQ ID NO: 2136702 - protein, 19 aa, Cryptosporidium hominis
CDGKSRKESISAGNGGPSR

SEQ ID NO: 2136703 - protein, 8 aa, Cryptosporidium hominis
CDGRKPEV

SEQ ID NO: 2136704 - protein, 9 aa, Cryptosporidium hominis
CDKEYSYEN

SEQ ID NO: 2136705 - protein, 10 aa, Cryptosporidium hominis
CDKHGTEEQT

SEQ ID NO: 2136706 - protein, 10 aa, Cryptosporidium hominis
CDNISSNPID

SEQ ID NO: 2136707 - protein, 10 aa, Cryptosporidium hominis
CDNPKGCNSQ

SEQ ID NO: 2136708 - protein, 4 aa, Cryptosporidium hominis
CDNS

SEQ ID NO: 2136709 - protein, 10 aa, Cryptosporidium hominis
CDNSSEATLS

SEQ ID NO: 2136710 - protein, 6 aa, Cryptosporidium hominis
CDNSSI

SEQ ID NO: 2136711 - protein, 12 aa, Cryptosporidium hominis
CDNTENVNLESS

SEQ ID NO: 2136712 - protein, 6 aa, Cryptosporidium hominis
CDPRHG

SEQ ID NO: 2136713 - protein, 4 aa, Cryptosporidium hominis
CDSK

SEQ ID NO: 2136714 - protein, 8 aa, Cryptosporidium hominis
CDSNGNQN

SEQ ID NO: 2136715 - protein, 12 aa, Cryptosporidium hominis
CDSNKNSNIAQG

SEQ ID NO: 2136716 - protein, 38 aa, Cryptosporidium hominis
CDTKTLGSKLGYSPNVNSVSASSNSSLGLSSSVTGDYR

SEQ ID NO: 2136717 - protein, 19 aa, Cryptosporidium hominis
CEAETRNEDTIDNRRKRGS

SEQ ID NO: 2136718 - protein, 15 aa, Cryptosporidium hominis
CEDKNEEKNQEIEDE

SEQ ID NO: 2136719 - protein, 27 aa, Cryptosporidium hominis
CEDSDLNSSPKESLKTAKDLPSDSYQE

SEQ ID NO: 2136720 - protein, 5 aa, Cryptosporidium hominis
CEDSS

SEQ ID NO: 2136721 - protein, 10 aa, Cryptosporidium hominis
CEEEQMESVN

SEQ ID NO: 2136722 - protein, 9 aa, Cryptosporidium hominis
CEEPTGISN

SEQ ID NO: 2136723 - protein, 20 aa, Cryptosporidium hominis
CEEYGGWDGSYTSPKKGQIQ

SEQ ID NO: 2136724 - protein, 5 aa, Cryptosporidium hominis
CEGAG

SEQ ID NO: 2136725 - protein, 5 aa, Cryptosporidium hominis
CEGLN

SEQ ID NO: 2136726 - protein, 10 aa, Cryptosporidium hominis
CEKESIQEHE

SEQ ID NO: 2136727 - protein, 4 aa, Cryptosporidium hominis
CENG

SEQ ID NO: 2136728 - protein, 19 aa, Cryptosporidium hominis
CENNERKENENQDKTAGFN

SEQ ID NO: 2136729 - protein, 7 aa, Cryptosporidium hominis
CEPADSG

SEQ ID NO: 2136730 - protein, 7 aa, Cryptosporidium hominis
CEQNPNS

SEQ ID NO: 2136731 - protein, 4 aa, Cryptosporidium hominis
CEQR

SEQ ID NO: 2136732 - protein, 12 aa, Cryptosporidium hominis
CERGGSKQPLQV

SEQ ID NO: 2136733 - protein, 6 aa, Cryptosporidium hominis
CESGKT

SEQ ID NO: 2136734 - protein, 9 aa, Cryptosporidium hominis
CESGTGNGN

SEQ ID NO: 2136735 - protein, 7 aa, Cryptosporidium hominis
CESKTEV

SEQ ID NO: 2136736 - protein, 13 aa, Cryptosporidium hominis
CESSKNSSSDSEI

SEQ ID NO: 2136737 - protein, 9 aa, Cryptosporidium hominis
CESTSEGSF

SEQ ID NO: 2136738 - protein, 5 aa, Cryptosporidium hominis
CETNK

SEQ ID NO: 2136739 - protein, 7 aa, Cryptosporidium hominis
CETQQDK

SEQ ID NO: 2136740 - protein, 4 aa, Cryptosporidium hominis
CETR

SEQ ID NO: 2136741 - protein, 6 aa, Cryptosporidium hominis
CETRDS

SEQ ID NO: 2136742 - protein, 12 aa, Cryptosporidium hominis
CEVESNSPLSES

SEQ ID NO: 2136743 - protein, 6 aa, Cryptosporidium hominis
CGAGFT

SEQ ID NO: 2136744 - protein, 10 aa, Cryptosporidium hominis
CGAKSGIGEK

SEQ ID NO: 2136745 - protein, 11 aa, Cryptosporidium hominis
CGDASSREVSK

SEQ ID NO: 2136746 - protein, 7 aa, Cryptosporidium hominis
CGDENKN

SEQ ID NO: 2136747 - protein, 5 aa, Cryptosporidium hominis
CGDRS

SEQ ID NO: 2136748 - protein, 5 aa, Cryptosporidium hominis
CGGAS

SEQ ID NO: 2136749 - protein, 7 aa, Cryptosporidium hominis
CGGDENF

SEQ ID NO: 2136750 - protein, 9 aa, Cryptosporidium hominis
CGGSSSGVQ

SEQ ID NO: 2136751 - protein, 15 aa, Cryptosporidium hominis
CGKPALGGGAGNSPV

SEQ ID NO: 2136752 - protein, 5 aa, Cryptosporidium hominis
CGKSS

SEQ ID NO: 2136753 - protein, 5 aa, Cryptosporidium hominis
CGNKR

SEQ ID NO: 2136754 - protein, 4 aa, Cryptosporidium hominis
CGNN

SEQ ID NO: 2136755 - protein, 9 aa, Cryptosporidium hominis
CGNNGESDV

SEQ ID NO: 2136756 - protein, 9 aa, Cryptosporidium hominis
CGNPSAQSW

SEQ ID NO: 2136757 - protein, 4 aa, Cryptosporidium hominis
CGNV

SEQ ID NO: 2136758 - protein, 7 aa, Cryptosporidium hominis
CGPNGTV

SEQ ID NO: 2136759 - protein, 15 aa, Cryptosporidium hominis
CGRVSSDNSSVSHTS

SEQ ID NO: 2136760 - protein, 7 aa, Cryptosporidium hominis
CGSANKV

SEQ ID NO: 2136761 - protein, 15 aa, Cryptosporidium hominis
CGSEGDSGKNGLTST

SEQ ID NO: 2136762 - protein, 11 aa, Cryptosporidium hominis
CGSGPTAITET

SEQ ID NO: 2136763 - protein, 10 aa, Cryptosporidium hominis
CGSGSEVTST

SEQ ID NO: 2136764 - protein, 12 aa, Cryptosporidium hominis
CGSKTKSKLSCP

SEQ ID NO: 2136765 - protein, 51 aa, Cryptosporidium hominis
CGSPPNYGDISNSGSSNSSTTNTGKEANSKDLATNSSSQTGSNNKPTGSIA

SEQ ID NO: 2136766 - protein, 16 aa, Cryptosporidium hominis
CGTSSSSSSASSFAAS

SEQ ID NO: 2136767 - protein, 10 aa, Cryptosporidium hominis
CKARSSATWY

SEQ ID NO: 2136768 - protein, 20 aa, Cryptosporidium hominis
CKDENQTKESKEHPESPPSS

SEQ ID NO: 2136769 - protein, 9 aa, Cryptosporidium hominis
CKDPQNESL

SEQ ID NO: 2136770 - protein, 12 aa, Cryptosporidium hominis
CKEDDSPTSESK

SEQ ID NO: 2136771 - protein, 9 aa, Cryptosporidium hominis
CKEDETGKF

SEQ ID NO: 2136772 - protein, 12 aa, Cryptosporidium hominis
CKEESQTSSIRS

SEQ ID NO: 2136773 - protein, 9 aa, Cryptosporidium hominis
CKEGNDCGE

SEQ ID NO: 2136774 - protein, 11 aa, Cryptosporidium hominis
CKELNKDEMEA

SEQ ID NO: 2136775 - protein, 11 aa, Cryptosporidium hominis
CKENGNIPRHS

SEQ ID NO: 2136776 - protein, 9 aa, Cryptosporidium hominis
CKGGNSENL

SEQ ID NO: 2136777 - protein, 16 aa, Cryptosporidium hominis
CKGSEYLDGNNKSADF

SEQ ID NO: 2136778 - protein, 6 aa, Cryptosporidium hominis
CKGSMS

SEQ ID NO: 2136779 - protein, 10 aa, Cryptosporidium hominis
CKKDSQEGYR

SEQ ID NO: 2136780 - protein, 9 aa, Cryptosporidium hominis
CKKPRNDNS

SEQ ID NO: 2136781 - protein, 8 aa, Cryptosporidium hominis
CKKSMSSN

SEQ ID NO: 2136782 - protein, 34 aa, Cryptosporidium hominis
CKNANDNESEKESNSVDNSETSSRGKRHKKDTSD

SEQ ID NO: 2136783 - protein, 7 aa, Cryptosporidium hominis
CKNDNKL

SEQ ID NO: 2136784 - protein, 7 aa, Cryptosporidium hominis
CKNGSSC

SEQ ID NO: 2136785 - protein, 7 aa, Cryptosporidium hominis
CKNKNDY

SEQ ID NO: 2136786 - protein, 8 aa, Cryptosporidium hominis
CKNNPKIS

SEQ ID NO: 2136787 - protein, 7 aa, Cryptosporidium hominis
CKNSGNL

SEQ ID NO: 2136788 - protein, 7 aa, Cryptosporidium hominis
CKNSNLR

SEQ ID NO: 2136789 - protein, 8 aa, Cryptosporidium hominis
CKNSYNNN

SEQ ID NO: 2136790 - protein, 7 aa, Cryptosporidium hominis
CKPTTQY

SEQ ID NO: 2136791 - protein, 10 aa, Cryptosporidium hominis
CKRERAEKKI

SEQ ID NO: 2136792 - protein, 15 aa, Cryptosporidium hominis
CKRNLSQMYAGWMPQ

SEQ ID NO: 2136793 - protein, 25 aa, Cryptosporidium hominis
CKRRPKMANPNYGTPLSGGQCPFPD

SEQ ID NO: 2136794 - protein, 4 aa, Cryptosporidium hominis
CKSG

SEQ ID NO: 2136795 - protein, 14 aa, Cryptosporidium hominis
CKSITDSNGQTRTA

SEQ ID NO: 2136796 - protein, 5 aa, Cryptosporidium hominis
CKSKN

SEQ ID NO: 2136797 - protein, 8 aa, Cryptosporidium hominis
CKSQAHYT

SEQ ID NO: 2136798 - protein, 9 aa, Cryptosporidium hominis
CKTKKAPNM

SEQ ID NO: 2136799 - protein, 9 aa, Cryptosporidium hominis
CLNSGGSKT

SEQ ID NO: 2136800 - protein, 9 aa, Cryptosporidium hominis
CLPSPSTTQ

SEQ ID NO: 2136801 - protein, 8 aa, Cryptosporidium hominis
CNAQSTMS

SEQ ID NO: 2136802 - protein, 11 aa, Cryptosporidium hominis
CNDEPTSQDIT

SEQ ID NO: 2136803 - protein, 4 aa, Cryptosporidium hominis
CNDK

SEQ ID NO: 2136804 - protein, 6 aa, Cryptosporidium hominis
CNDKEV

SEQ ID NO: 2136805 - protein, 8 aa, Cryptosporidium hominis
CNDNTNLS

SEQ ID NO: 2136806 - protein, 32 aa, Cryptosporidium hominis
CNDRDNQIKPSRDSRASLEKENLDDNIGKSEC

SEQ ID NO: 2136807 - protein, 5 aa, Cryptosporidium hominis
CNDSS

SEQ ID NO: 2136808 - protein, 15 aa, Cryptosporidium hominis
CNEESQFNDLDEDKL

SEQ ID NO: 2136809 - protein, 5 aa, Cryptosporidium hominis
CNEGY

SEQ ID NO: 2136810 - protein, 17 aa, Cryptosporidium hominis
CNEQRRAKRRSFSRSLS

SEQ ID NO: 2136811 - protein, 7 aa, Cryptosporidium hominis
CNESSSS

SEQ ID NO: 2136812 - protein, 5 aa, Cryptosporidium hominis
CNGGA

SEQ ID NO: 2136813 - protein, 6 aa, Cryptosporidium hominis
CNGNKE

SEQ ID NO: 2136814 - protein, 8 aa, Cryptosporidium hominis
CNGNNNNA

SEQ ID NO: 2136815 - protein, 8 aa, Cryptosporidium hominis
CNGTKESL

SEQ ID NO: 2136816 - protein, 21 aa, Cryptosporidium hominis
CNNDDEPNNNKNSSNNFGNNT

SEQ ID NO: 2136817 - protein, 14 aa, Cryptosporidium hominis
CNNDNNNGTSFEGN

SEQ ID NO: 2136818 - protein, 7 aa, Cryptosporidium hominis
CNNGANG

SEQ ID NO: 2136819 - protein, 28 aa, Cryptosporidium hominis
CNNKKSLEELNKKEKENKEGSTDKIEDD

SEQ ID NO: 2136820 - protein, 11 aa, Cryptosporidium hominis
CNNNNGNTFHD

SEQ ID NO: 2136821 - protein, 9 aa, Cryptosporidium hominis
CNNPTDLSR

SEQ ID NO: 2136822 - protein, 7 aa, Cryptosporidium hominis
CNNTTKD

SEQ ID NO: 2136823 - protein, 9 aa, Cryptosporidium hominis
CNPKLSTDA

SEQ ID NO: 2136824 - protein, 7 aa, Cryptosporidium hominis
CNPNSQA

SEQ ID NO: 2136825 - protein, 4 aa, Cryptosporidium hominis
CNQQ

SEQ ID NO: 2136826 - protein, 11 aa, Cryptosporidium hominis
CNQSVGRNSKI

SEQ ID NO: 2136827 - protein, 19 aa, Cryptosporidium hominis
CNRKSDLSLSSSSIGKKLN

SEQ ID NO: 2136828 - protein, 16 aa, Cryptosporidium hominis
CNRQGTEEDDQASRGH

SEQ ID NO: 2136829 - protein, 11 aa, Cryptosporidium hominis
CNRRGRSPSLS

SEQ ID NO: 2136830 - protein, 8 aa, Cryptosporidium hominis
CNSDGSLK

SEQ ID NO: 2136831 - protein, 5 aa, Cryptosporidium hominis
CNSDK

SEQ ID NO: 2136832 - protein, 19 aa, Cryptosporidium hominis
CNSGIQSNNNNDSKKKRSR

SEQ ID NO: 2136833 - protein, 9 aa, Cryptosporidium hominis
CNSNTEDPR

SEQ ID NO: 2136834 - protein, 8 aa, Cryptosporidium hominis
CNSQNKSK

SEQ ID NO: 2136835 - protein, 13 aa, Cryptosporidium hominis
CNSSNNNSISEKL

SEQ ID NO: 2136836 - protein, 15 aa, Cryptosporidium hominis
CNTEFSEETAIIQYF

SEQ ID NO: 2136837 - protein, 10 aa, Cryptosporidium hominis
CNTGTSGSII

SEQ ID NO: 2136838 - protein, 6 aa, Cryptosporidium hominis
CNYPKK

SEQ ID NO: 2136839 - protein, 6 aa, Cryptosporidium hominis
CPADKD

SEQ ID NO: 2136840 - protein, 4 aa, Cryptosporidium hominis
CPDE

SEQ ID NO: 2136841 - protein, 7 aa, Cryptosporidium hominis
CPEGYTA

SEQ ID NO: 2136842 - protein, 5 aa, Cryptosporidium hominis
CPEPY

SEQ ID NO: 2136843 - protein, 13 aa, Cryptosporidium hominis
CPGTDDNPSSSTT

SEQ ID NO: 2136844 - protein, 6 aa, Cryptosporidium hominis
CPIESN

SEQ ID NO: 2136845 - protein, 4 aa, Cryptosporidium hominis
CPLE

SEQ ID NO: 2136846 - protein, 7 aa, Cryptosporidium hominis
CPNKNGL

SEQ ID NO: 2136847 - protein, 7 aa, Cryptosporidium hominis
CPNQDKS

SEQ ID NO: 2136848 - protein, 4 aa, Cryptosporidium hominis
CPPN

SEQ ID NO: 2136849 - protein, 5 aa, Cryptosporidium hominis
CPPQN

SEQ ID NO: 2136850 - protein, 6 aa, Cryptosporidium hominis
CPRSQS

SEQ ID NO: 2136851 - protein, 8 aa, Cryptosporidium hominis
CPRSQSAD

SEQ ID NO: 2136852 - protein, 10 aa, Cryptosporidium hominis
CQAGGDNNHL

SEQ ID NO: 2136853 - protein, 4 aa, Cryptosporidium hominis
CQDS

SEQ ID NO: 2136854 - protein, 11 aa, Cryptosporidium hominis
CQDYGQNTGVV

SEQ ID NO: 2136855 - protein, 13 aa, Cryptosporidium hominis
CQGGKNKKPASSD

SEQ ID NO: 2136856 - protein, 12 aa, Cryptosporidium hominis
CQGNSTYKSSKI

SEQ ID NO: 2136857 - protein, 6 aa, Cryptosporidium hominis
CQGSNK

SEQ ID NO: 2136858 - protein, 9 aa, Cryptosporidium hominis
CQKDENNNW

SEQ ID NO: 2136859 - protein, 12 aa, Cryptosporidium hominis
CQNASANATIES

SEQ ID NO: 2136860 - protein, 5 aa, Cryptosporidium hominis
CQNEA

SEQ ID NO: 2136861 - protein, 9 aa, Cryptosporidium hominis
CQNGGRSSR

SEQ ID NO: 2136862 - protein, 15 aa, Cryptosporidium hominis
CQPPNLDNSTIRGSE

SEQ ID NO: 2136863 - protein, 8 aa, Cryptosporidium hominis
CQPSPNNG

SEQ ID NO: 2136864 - protein, 7 aa, Cryptosporidium hominis
CQPTGGR

SEQ ID NO: 2136865 - protein, 7 aa, Cryptosporidium hominis
CQQKPRN

SEQ ID NO: 2136866 - protein, 11 aa, Cryptosporidium hominis
CQQNKEKMKEK

SEQ ID NO: 2136867 - protein, 5 aa, Cryptosporidium hominis
CQSSN

SEQ ID NO: 2136868 - protein, 9 aa, Cryptosporidium hominis
CQTEENELE

SEQ ID NO: 2136869 - protein, 8 aa, Cryptosporidium hominis
CQTGKAQD

SEQ ID NO: 2136870 - protein, 33 aa, Cryptosporidium hominis
CQTKNLDKSTNIEKGNSEDDESEKQENSIYDVI

SEQ ID NO: 2136871 - protein, 9 aa, Cryptosporidium hominis
CRDEEMDNT

SEQ ID NO: 2136872 - protein, 6 aa, Cryptosporidium hominis
CRDENG

SEQ ID NO: 2136873 - protein, 13 aa, Cryptosporidium hominis
CRKENGGNVNNNL

SEQ ID NO: 2136874 - protein, 7 aa, Cryptosporidium hominis
CRKESEK

SEQ ID NO: 2136875 - protein, 9 aa, Cryptosporidium hominis
CRNQSGLTQ

SEQ ID NO: 2136876 - protein, 11 aa, Cryptosporidium hominis
CRPGFSSGQDL

SEQ ID NO: 2136877 - protein, 26 aa, Cryptosporidium hominis
CRPKSSFSLTSTNSTDEDKDDININN

SEQ ID NO: 2136878 - protein, 6 aa, Cryptosporidium hominis
CRTGTI

SEQ ID NO: 2136879 - protein, 12 aa, Cryptosporidium hominis
CSANSDSRTINK

SEQ ID NO: 2136880 - protein, 38 aa, Cryptosporidium hominis
CSASKDSQAKPQSGSADASEEKPKKKDNPLDNLPPTSM

SEQ ID NO: 2136881 - protein, 8 aa, Cryptosporidium hominis
CSDKPEEP

SEQ ID NO: 2136882 - protein, 6 aa, Cryptosporidium hominis
CSDNKG

SEQ ID NO: 2136883 - protein, 6 aa, Cryptosporidium hominis
CSDNPR

SEQ ID NO: 2136884 - protein, 50 aa, Cryptosporidium hominis
CSEDSSLEDQCTQNTFNRKAQGENKSKQKSREEKKSVRNNKKNNTKTENG

SEQ ID NO: 2136885 - protein, 6 aa, Cryptosporidium hominis
CSETPI

SEQ ID NO: 2136886 - protein, 20 aa, Cryptosporidium hominis
CSGASGTYPGNSRRHSTERQ

SEQ ID NO: 2136887 - protein, 8 aa, Cryptosporidium hominis
CSGGGSVG

SEQ ID NO: 2136888 - protein, 8 aa, Cryptosporidium hominis
CSGSDGPH

SEQ ID NO: 2136889 - protein, 6 aa, Cryptosporidium hominis
CSGTPR

SEQ ID NO: 2136890 - protein, 11 aa, Cryptosporidium hominis
CSIGTSSSTNY

SEQ ID NO: 2136891 - protein, 5 aa, Cryptosporidium hominis
CSKNA

SEQ ID NO: 2136892 - protein, 5 aa, Cryptosporidium hominis
CSKPR

SEQ ID NO: 2136893 - protein, 10 aa, Cryptosporidium hominis
CSKQKQSNLD

SEQ ID NO: 2136894 - protein, 8 aa, Cryptosporidium hominis
CSKSDCQY

SEQ ID NO: 2136895 - protein, 13 aa, Cryptosporidium hominis
CSNEESSFSTEMD

SEQ ID NO: 2136896 - protein, 8 aa, Cryptosporidium hominis
CSNETNKM

SEQ ID NO: 2136897 - protein, 4 aa, Cryptosporidium hominis
CSNG

SEQ ID NO: 2136898 - protein, 7 aa, Cryptosporidium hominis
CSNGIDP

SEQ ID NO: 2136899 - protein, 5 aa, Cryptosporidium hominis
CSNGS

SEQ ID NO: 2136900 - protein, 12 aa, Cryptosporidium hominis
CSNNNSESSSLA

SEQ ID NO: 2136901 - protein, 8 aa, Cryptosporidium hominis
CSNRHEEK

SEQ ID NO: 2136902 - protein, 6 aa, Cryptosporidium hominis
CSNSQQ

SEQ ID NO: 2136903 - protein, 14 aa, Cryptosporidium hominis
CSNTNGSSSTAYNK

SEQ ID NO: 2136904 - protein, 17 aa, Cryptosporidium hominis
CSNTNKVEKNEKNQNGD

SEQ ID NO: 2136905 - protein, 5 aa, Cryptosporidium hominis
CSPPC

SEQ ID NO: 2136906 - protein, 11 aa, Cryptosporidium hominis
CSPTPEQPKKR

SEQ ID NO: 2136907 - protein, 15 aa, Cryptosporidium hominis
CSQAYDNDRTVPRGA

SEQ ID NO: 2136908 - protein, 32 aa, Cryptosporidium hominis
CSQDEKSLERKQNQRLSLSSSSSSSSSTSSSV

SEQ ID NO: 2136909 - protein, 27 aa, Cryptosporidium hominis
CSQSSKSTVSTNNVSNSNNNLGNGNNS

SEQ ID NO: 2136910 - protein, 10 aa, Cryptosporidium hominis
CSRAARRQQK

SEQ ID NO: 2136911 - protein, 8 aa, Cryptosporidium hominis
CSRPTGAE

SEQ ID NO: 2136912 - protein, 7 aa, Cryptosporidium hominis
CSRSRGK

SEQ ID NO: 2136913 - protein, 6 aa, Cryptosporidium hominis
CSSDFS

SEQ ID NO: 2136914 - protein, 20 aa, Cryptosporidium hominis
CSSENSEIKNERNEINNDQS

SEQ ID NO: 2136915 - protein, 13 aa, Cryptosporidium hominis
CSSIGSGNSSVQN

SEQ ID NO: 2136916 - protein, 13 aa, Cryptosporidium hominis
CSSKDGKKSTVQD

SEQ ID NO: 2136917 - protein, 4 aa, Cryptosporidium hominis
CSSP

SEQ ID NO: 2136918 - protein, 6 aa, Cryptosporidium hominis
CSSRRE

SEQ ID NO: 2136919 - protein, 14 aa, Cryptosporidium hominis
CSSSISSYGTSIPR

SEQ ID NO: 2136920 - protein, 14 aa, Cryptosporidium hominis
CSSSSSMPKMTNSL

SEQ ID NO: 2136921 - protein, 9 aa, Cryptosporidium hominis
CSTDSNGAK

SEQ ID NO: 2136922 - protein, 8 aa, Cryptosporidium hominis
CSTDTEKI

SEQ ID NO: 2136923 - protein, 77 aa, Cryptosporidium hominis
CSTNSSKQYPSNEREEIECSPSEEAHIGDNSSITKNTANTCSSYANDDNQNQISKKLPNESSTLPIDEPQDKQQTFN

SEQ ID NO: 2136924 - protein, 8 aa, Cryptosporidium hominis
CSTPAGSA

SEQ ID NO: 2136925 - protein, 10 aa, Cryptosporidium hominis
CSTPPRSSVS

SEQ ID NO: 2136926 - protein, 19 aa, Cryptosporidium hominis
CSTYNKSKSQISNSSYNTS

SEQ ID NO: 2136927 - protein, 11 aa, Cryptosporidium hominis
CTAPSSWSSIK

SEQ ID NO: 2136928 - protein, 4 aa, Cryptosporidium hominis
CTDG

SEQ ID NO: 2136929 - protein, 5 aa, Cryptosporidium hominis
CTDKG

SEQ ID NO: 2136930 - protein, 5 aa, Cryptosporidium hominis
CTDPQ

SEQ ID NO: 2136931 - protein, 6 aa, Cryptosporidium hominis
CTDYQS

SEQ ID NO: 2136932 - protein, 5 aa, Cryptosporidium hominis
CTENR

SEQ ID NO: 2136933 - protein, 10 aa, Cryptosporidium hominis
CTGESNNIYK

SEQ ID NO: 2136934 - protein, 8 aa, Cryptosporidium hominis
CTHEDKDR

SEQ ID NO: 2136935 - protein, 7 aa, Cryptosporidium hominis
CTHPASG

SEQ ID NO: 2136936 - protein, 12 aa, Cryptosporidium hominis
CTKDTTSTTTST

SEQ ID NO: 2136937 - protein, 6 aa, Cryptosporidium hominis
CTKKEY

SEQ ID NO: 2136938 - protein, 20 aa, Cryptosporidium hominis
CTNSTTTNTSNDNNKNSGFE

SEQ ID NO: 2136939 - protein, 44 aa, Cryptosporidium hominis
CTPSESSPSSPIPSESSLPTSPPPIPPESPLPIPPSLSRTRSAS

SEQ ID NO: 2136940 - protein, 6 aa, Cryptosporidium hominis
CTQSNE

SEQ ID NO: 2136941 - protein, 6 aa, Cryptosporidium hominis
CTSEET

SEQ ID NO: 2136942 - protein, 6 aa, Cryptosporidium hominis
CTSPQG

SEQ ID NO: 2136943 - protein, 8 aa, Cryptosporidium hominis
CTSPQQPI

SEQ ID NO: 2136944 - protein, 10 aa, Cryptosporidium hominis
CTTESRKKQM

SEQ ID NO: 2136945 - protein, 4 aa, Cryptosporidium hominis
CTTL

SEQ ID NO: 2136946 - protein, 4 aa, Cryptosporidium hominis
CVNG

SEQ ID NO: 2136947 - protein, 4 aa, Cryptosporidium hominis
CYAQ

SEQ ID NO: 2136948 - protein, 5 aa, Cryptosporidium hominis
DAACR

SEQ ID NO: 2136949 - protein, 13 aa, Cryptosporidium hominis
DAAHKKTIPQPGL

SEQ ID NO: 2136950 - protein, 7 aa, Cryptosporidium hominis
DADCSKQ

SEQ ID NO: 2136951 - protein, 12 aa, Cryptosporidium hominis
DADGFTDTNEPL

SEQ ID NO: 2136952 - protein, 8 aa, Cryptosporidium hominis
DADGNGTI

SEQ ID NO: 2136953 - protein, 8 aa, Cryptosporidium hominis
DADMKPPE

SEQ ID NO: 2136954 - protein, 5 aa, Cryptosporidium hominis
DADSL

SEQ ID NO: 2136955 - protein, 5 aa, Cryptosporidium hominis
DAEAG

SEQ ID NO: 2136956 - protein, 4 aa, Cryptosporidium hominis
DAED

SEQ ID NO: 2136957 - protein, 12 aa, Cryptosporidium hominis
DAEKYRKSIDDN

SEQ ID NO: 2136958 - protein, 4 aa, Cryptosporidium hominis
DAEL

SEQ ID NO: 2136959 - protein, 12 aa, Cryptosporidium hominis
DAELQASKMEEV

SEQ ID NO: 2136960 - protein, 5 aa, Cryptosporidium hominis
DAEND

SEQ ID NO: 2136961 - protein, 7 aa, Cryptosporidium hominis
DAERRAR

SEQ ID NO: 2136962 - protein, 26 aa, Cryptosporidium hominis
DAERRRERVRKNKEKLKPRRKLTKEE

SEQ ID NO: 2136963 - protein, 4 aa, Cryptosporidium hominis
DAEY

SEQ ID NO: 2136964 - protein, 7 aa, Cryptosporidium hominis
DAEYKQE

SEQ ID NO: 2136965 - protein, 6 aa, Cryptosporidium hominis
DAFKRG

SEQ ID NO: 2136966 - protein, 6 aa, Cryptosporidium hominis
DAFSSS

SEQ ID NO: 2136967 - protein, 8 aa, Cryptosporidium hominis
DAFTQHDA

SEQ ID NO: 2136968 - protein, 4 aa, Cryptosporidium hominis
DAGA

SEQ ID NO: 2136969 - protein, 9 aa, Cryptosporidium hominis
DAGIKKSEV

SEQ ID NO: 2136970 - protein, 8 aa, Cryptosporidium hominis
DAGMDKRS

SEQ ID NO: 2136971 - protein, 6 aa, Cryptosporidium hominis
DAGNQG

SEQ ID NO: 2136972 - protein, 4 aa, Cryptosporidium hominis
DAGQ

SEQ ID NO: 2136973 - protein, 17 aa, Cryptosporidium hominis
DAGQGERLVHAKKNIIS

SEQ ID NO: 2136974 - protein, 9 aa, Cryptosporidium hominis
DAGSDSPTE

SEQ ID NO: 2136975 - protein, 11 aa, Cryptosporidium hominis
DAGTAANTSIE

SEQ ID NO: 2136976 - protein, 7 aa, Cryptosporidium hominis
DAGTGTL

SEQ ID NO: 2136977 - protein, 6 aa, Cryptosporidium hominis
DAIDEE

SEQ ID NO: 2136978 - protein, 13 aa, Cryptosporidium hominis
DAIENGKATARKL

SEQ ID NO: 2136979 - protein, 7 aa, Cryptosporidium hominis
DAKAREY

SEQ ID NO: 2136980 - protein, 4 aa, Cryptosporidium hominis
DAKE

SEQ ID NO: 2136981 - protein, 11 aa, Cryptosporidium hominis
DAKEEKTNFDS

SEQ ID NO: 2136982 - protein, 10 aa, Cryptosporidium hominis
DAKKKQKERL

SEQ ID NO: 2136983 - protein, 5 aa, Cryptosporidium hominis
DAKKV

SEQ ID NO: 2136984 - protein, 6 aa, Cryptosporidium hominis
DAKNAL

SEQ ID NO: 2136985 - protein, 30 aa, Cryptosporidium hominis
DAKQENLDEVKEDNTTEGNPIQDETNDSNI

SEQ ID NO: 2136986 - protein, 40 aa, Cryptosporidium hominis
DAKRKQSCKEKNDICDTNQDQIQTETHSETESVVDTDGKS

SEQ ID NO: 2136987 - protein, 10 aa, Cryptosporidium hominis
DAKSESSNNY

SEQ ID NO: 2136988 - protein, 6 aa, Cryptosporidium hominis
DALENE

SEQ ID NO: 2136989 - protein, 11 aa, Cryptosporidium hominis
DALPKTPQPTI

SEQ ID NO: 2136990 - protein, 6 aa, Cryptosporidium hominis
DANGFT

SEQ ID NO: 2136991 - protein, 22 aa, Cryptosporidium hominis
DANKDQHSIGSAKTRLTGHNQA

SEQ ID NO: 2136992 - protein, 5 aa, Cryptosporidium hominis
DANLS

SEQ ID NO: 2136993 - protein, 9 aa, Cryptosporidium hominis
DANNGSSKE

SEQ ID NO: 2136994 - protein, 9 aa, Cryptosporidium hominis
DANNTTFSK

SEQ ID NO: 2136995 - protein, 8 aa, Cryptosporidium hominis
DANSKETA

SEQ ID NO: 2136996 - protein, 4 aa, Cryptosporidium hominis
DANT

SEQ ID NO: 2136997 - protein, 20 aa, Cryptosporidium hominis
DANTNKALDAISSKLKGMSV

SEQ ID NO: 2136998 - protein, 9 aa, Cryptosporidium hominis
DANTRDPRA

SEQ ID NO: 2136999 - protein, 6 aa, Cryptosporidium hominis
DAPGVN

SEQ ID NO: 2137000 - protein, 13 aa, Cryptosporidium hominis
DAPIPPPNPVSKN

SEQ ID NO: 2137001 - protein, 5 aa, Cryptosporidium hominis
DAPPV

SEQ ID NO: 2137002 - protein, 13 aa, Cryptosporidium hominis
DAPVPKVPNSMKG

SEQ ID NO: 2137003 - protein, 5 aa, Cryptosporidium hominis
DAQSA

SEQ ID NO: 2137004 - protein, 12 aa, Cryptosporidium hominis
DARAASKSKELY

SEQ ID NO: 2137005 - protein, 9 aa, Cryptosporidium hominis
DARDSNVST

SEQ ID NO: 2137006 - protein, 7 aa, Cryptosporidium hominis
DARGPKH

SEQ ID NO: 2137007 - protein, 12 aa, Cryptosporidium hominis
DARKGEVQKEIE

SEQ ID NO: 2137008 - protein, 4 aa, Cryptosporidium hominis
DARN

SEQ ID NO: 2137009 - protein, 27 aa, Cryptosporidium hominis
DARSIADENDDNTNKKPSYKKNNSIDN

SEQ ID NO: 2137010 - protein, 12 aa, Cryptosporidium hominis
DARSRDLRPRGQ

SEQ ID NO: 2137011 - protein, 9 aa, Cryptosporidium hominis
DARSSDTSE

SEQ ID NO: 2137012 - protein, 10 aa, Cryptosporidium hominis
DARYSSDGMV

SEQ ID NO: 2137013 - protein, 4 aa, Cryptosporidium hominis
DASD

SEQ ID NO: 2137014 - protein, 9 aa, Cryptosporidium hominis
DASKDEKVN

SEQ ID NO: 2137015 - protein, 13 aa, Cryptosporidium hominis
DASLGKTLSDQGY

SEQ ID NO: 2137016 - protein, 18 aa, Cryptosporidium hominis
DASNGSISDPRSKYLGNR

SEQ ID NO: 2137017 - protein, 10 aa, Cryptosporidium hominis
DASSSSDEST

SEQ ID NO: 2137018 - protein, 10 aa, Cryptosporidium hominis
DASTSEIRKS

SEQ ID NO: 2137019 - protein, 9 aa, Cryptosporidium hominis
DASVIDGSN

SEQ ID NO: 2137020 - protein, 7 aa, Cryptosporidium hominis
DASVTDT

SEQ ID NO: 2137021 - protein, 5 aa, Cryptosporidium hominis
DATPH

SEQ ID NO: 2137022 - protein, 6 aa, Cryptosporidium hominis
DATQIV

SEQ ID NO: 2137023 - protein, 5 aa, Cryptosporidium hominis
DATTC

SEQ ID NO: 2137024 - protein, 4 aa, Cryptosporidium hominis
DAVA

SEQ ID NO: 2137025 - protein, 7 aa, Cryptosporidium hominis
DAVEARK

SEQ ID NO: 2137026 - protein, 8 aa, Cryptosporidium hominis
DAVQKQAK

SEQ ID NO: 2137027 - protein, 8 aa, Cryptosporidium hominis
DAYKPTNN

SEQ ID NO: 2137028 - protein, 11 aa, Cryptosporidium hominis
DAYKTKKCNTF

SEQ ID NO: 2137029 - protein, 7 aa, Cryptosporidium hominis
DAYPKFS

SEQ ID NO: 2137030 - protein, 4 aa, Cryptosporidium hominis
DCDE

SEQ ID NO: 2137031 - protein, 9 aa, Cryptosporidium hominis
DCDESANIQ

SEQ ID NO: 2137032 - protein, 17 aa, Cryptosporidium hominis
DCDQDNGNKILESSSDE

SEQ ID NO: 2137033 - protein, 9 aa, Cryptosporidium hominis
DCDTDSSNR

SEQ ID NO: 2137034 - protein, 13 aa, Cryptosporidium hominis
DCEKLSGGKQCET

SEQ ID NO: 2137035 - protein, 6 aa, Cryptosporidium hominis
DCEPNG

SEQ ID NO: 2137036 - protein, 6 aa, Cryptosporidium hominis
DCERAQ

SEQ ID NO: 2137037 - protein, 5 aa, Cryptosporidium hominis
DCHSE

SEQ ID NO: 2137038 - protein, 8 aa, Cryptosporidium hominis
DCKKPLAG

SEQ ID NO: 2137039 - protein, 5 aa, Cryptosporidium hominis
DCNGE

SEQ ID NO: 2137040 - protein, 10 aa, Cryptosporidium hominis
DCNGGYTSAN

SEQ ID NO: 2137041 - protein, 7 aa, Cryptosporidium hominis
DCNNQRS

SEQ ID NO: 2137042 - protein, 10 aa, Cryptosporidium hominis
DCNNRIGEGI

SEQ ID NO: 2137043 - protein, 8 aa, Cryptosporidium hominis
DCPKSDNE

SEQ ID NO: 2137044 - protein, 9 aa, Cryptosporidium hominis
DCPSNNHLK

SEQ ID NO: 2137045 - protein, 34 aa, Cryptosporidium hominis
DCSSKSKNYISESESESESKHEFKPESEPENSKV

SEQ ID NO: 2137046 - protein, 10 aa, Cryptosporidium hominis
DCTDDNSLSC

SEQ ID NO: 2137047 - protein, 11 aa, Cryptosporidium hominis
DCTNKESGKIT

SEQ ID NO: 2137048 - protein, 18 aa, Cryptosporidium hominis
DCVTPSGTSSETTNVGND

SEQ ID NO: 2137049 - protein, 9 aa, Cryptosporidium hominis
DDAGEVKRQ

SEQ ID NO: 2137050 - protein, 7 aa, Cryptosporidium hominis
DDAGTGQ

SEQ ID NO: 2137051 - protein, 6 aa, Cryptosporidium hominis
DDAKIE

SEQ ID NO: 2137052 - protein, 10 aa, Cryptosporidium hominis
DDAKTHTSIN

SEQ ID NO: 2137053 - protein, 24 aa, Cryptosporidium hominis
DDASNLDDTPNNSKNKKSQGNLNS

SEQ ID NO: 2137054 - protein, 4 aa, Cryptosporidium hominis
DDAY

SEQ ID NO: 2137055 - protein, 23 aa, Cryptosporidium hominis
DDCSGKAKTKEKAISHKDDDQYS

SEQ ID NO: 2137056 - protein, 6 aa, Cryptosporidium hominis
DDDAEL

SEQ ID NO: 2137057 - protein, 11 aa, Cryptosporidium hominis
DDDDDDDDDNI

SEQ ID NO: 2137058 - protein, 21 aa, Cryptosporidium hominis
DDDDDDNDRRESIGKNTYSRK

SEQ ID NO: 2137059 - protein, 14 aa, Cryptosporidium hominis
DDDDDKGDKKEKFN

SEQ ID NO: 2137060 - protein, 16 aa, Cryptosporidium hominis
DDDDFSVDEDDDMKLD

SEQ ID NO: 2137061 - protein, 8 aa, Cryptosporidium hominis
DDDDLQAD

SEQ ID NO: 2137062 - protein, 5 aa, Cryptosporidium hominis
DDDEE

SEQ ID NO: 2137063 - protein, 13 aa, Cryptosporidium hominis
DDDEEEDQENEYK

SEQ ID NO: 2137064 - protein, 10 aa, Cryptosporidium hominis
DDDENPENPV

SEQ ID NO: 2137065 - protein, 10 aa, Cryptosporidium hominis
DDDFKTAQAN

SEQ ID NO: 2137066 - protein, 4 aa, Cryptosporidium hominis
DDDI

SEQ ID NO: 2137067 - protein, 6 aa, Cryptosporidium hominis
DDDIHE

SEQ ID NO: 2137068 - protein, 14 aa, Cryptosporidium hominis
DDDKPKGKRGRPRL

SEQ ID NO: 2137069 - protein, 4 aa, Cryptosporidium hominis
DDDL

SEQ ID NO: 2137070 - protein, 7 aa, Cryptosporidium hominis
DDDNNDA

SEQ ID NO: 2137071 - protein, 9 aa, Cryptosporidium hominis
DDDNQNQER

SEQ ID NO: 2137072 - protein, 10 aa, Cryptosporidium hominis
DDDTQLTPGS

SEQ ID NO: 2137073 - protein, 32 aa, Cryptosporidium hominis
DDDYSGYSDADINENYGEFDGENEDNGEIADE

SEQ ID NO: 2137074 - protein, 23 aa, Cryptosporidium hominis
DDEEEAKYNDNSKQQPKSSNDEI

SEQ ID NO: 2137075 - protein, 69 aa, Cryptosporidium hominis
DDEEPEEQKPVVKKEKTSQVKKEKPTKKELDESEDEFDDDETEEDSEDDRHSKSKKDSKEIKKEKKSKD

SEQ ID NO: 2137076 - protein, 7 aa, Cryptosporidium hominis
DDEEPPI

SEQ ID NO: 2137077 - protein, 26 aa, Cryptosporidium hominis
DDEESLNSEENNKQSKYNKDSKNDKL

SEQ ID NO: 2137078 - protein, 9 aa, Cryptosporidium hominis
DDEGEYYEE

SEQ ID NO: 2137079 - protein, 24 aa, Cryptosporidium hominis
DDEHNSAINSSHETDTDSIKGSYD

SEQ ID NO: 2137080 - protein, 5 aa, Cryptosporidium hominis
DDEIQ

SEQ ID NO: 2137081 - protein, 38 aa, Cryptosporidium hominis
DDEKGQPATKTNEKMSDEEESDTEAPPLGNGGSTDKYT

SEQ ID NO: 2137082 - protein, 6 aa, Cryptosporidium hominis
DDEKSL

SEQ ID NO: 2137083 - protein, 4 aa, Cryptosporidium hominis
DDEL

SEQ ID NO: 2137084 - protein, 5 aa, Cryptosporidium hominis
DDEMS

SEQ ID NO: 2137085 - protein, 21 aa, Cryptosporidium hominis
DDENSGNYDSRNITTGSTPIV

SEQ ID NO: 2137086 - protein, 5 aa, Cryptosporidium hominis
DDESE

SEQ ID NO: 2137087 - protein, 6 aa, Cryptosporidium hominis
DDESLS

SEQ ID NO: 2137088 - protein, 9 aa, Cryptosporidium hominis
DDESQISKY

SEQ ID NO: 2137089 - protein, 20 aa, Cryptosporidium hominis
DDESSDDSDQSSSNEEDLGM

SEQ ID NO: 2137090 - protein, 7 aa, Cryptosporidium hominis
DDETGKI

SEQ ID NO: 2137091 - protein, 7 aa, Cryptosporidium hominis
DDETLQS

SEQ ID NO: 2137092 - protein, 15 aa, Cryptosporidium hominis
DDEYISSESMNNPNK

SEQ ID NO: 2137093 - protein, 14 aa, Cryptosporidium hominis
DDFASQTDKTTTFQ

SEQ ID NO: 2137094 - protein, 102 aa, Cryptosporidium hominis
DDFDGGSRSDRKKEPKSEDDSGNNTKKEEIDDADNDMNNEMDGDDKDKNDDDDNSSVESSSSTSEEENGKDDSDEETEMNNGKFTEEANENDESGSEEDGDL

SEQ ID NO: 2137095 - protein, 7 aa, Cryptosporidium hominis
DDFEGHK

SEQ ID NO: 2137096 - protein, 57 aa, Cryptosporidium hominis
DDFSDDDGGGNKGKRTQKTLANKSKTDNQGKTKLNNLKKAKNTSLVKSSSKDKKRGL

SEQ ID NO: 2137097 - protein, 17 aa, Cryptosporidium hominis
DDFSDESPKNVEEHSDS

SEQ ID NO: 2137098 - protein, 5 aa, Cryptosporidium hominis
DDGGS

SEQ ID NO: 2137099 - protein, 9 aa, Cryptosporidium hominis
DDGNGEGYS

SEQ ID NO: 2137100 - protein, 15 aa, Cryptosporidium hominis
DDGNTSSNENSSSSS

SEQ ID NO: 2137101 - protein, 7 aa, Cryptosporidium hominis
DDGPGKY

SEQ ID NO: 2137102 - protein, 5 aa, Cryptosporidium hominis
DDHEK

SEQ ID NO: 2137103 - protein, 9 aa, Cryptosporidium hominis
DDHNGLNSS

SEQ ID NO: 2137104 - protein, 5 aa, Cryptosporidium hominis
DDHSE

SEQ ID NO: 2137105 - protein, 13 aa, Cryptosporidium hominis
DDHSQSRKNPYSY

SEQ ID NO: 2137106 - protein, 13 aa, Cryptosporidium hominis
DDHSTSSKYNLTS

SEQ ID NO: 2137107 - protein, 4 aa, Cryptosporidium hominis
DDIA

SEQ ID NO: 2137108 - protein, 7 aa, Cryptosporidium hominis
DDIPPNT

SEQ ID NO: 2137109 - protein, 14 aa, Cryptosporidium hominis
DDIQKRGSKSLNDG

SEQ ID NO: 2137110 - protein, 4 aa, Cryptosporidium hominis
DDIS

SEQ ID NO: 2137111 - protein, 5 aa, Cryptosporidium hominis
DDISE

SEQ ID NO: 2137112 - protein, 7 aa, Cryptosporidium hominis
DDKATLQ

SEQ ID NO: 2137113 - protein, 9 aa, Cryptosporidium hominis
DDKDENSQV

SEQ ID NO: 2137114 - protein, 9 aa, Cryptosporidium hominis
DDKDENSSF

SEQ ID NO: 2137115 - protein, 10 aa, Cryptosporidium hominis
DDKETNNGLK

SEQ ID NO: 2137116 - protein, 6 aa, Cryptosporidium hominis
DDKIST

SEQ ID NO: 2137117 - protein, 23 aa, Cryptosporidium hominis
DDKKGEFISAGDDGEIALWRFDF

SEQ ID NO: 2137118 - protein, 8 aa, Cryptosporidium hominis
DDKKTIKS

SEQ ID NO: 2137119 - protein, 5 aa, Cryptosporidium hominis
DDKNI

SEQ ID NO: 2137120 - protein, 8 aa, Cryptosporidium hominis
DDKNKRNW

SEQ ID NO: 2137121 - protein, 15 aa, Cryptosporidium hominis
DDKQSADMHPEKRQK

SEQ ID NO: 2137122 - protein, 4 aa, Cryptosporidium hominis
DDKS

SEQ ID NO: 2137123 - protein, 10 aa, Cryptosporidium hominis
DDKSNSSPLY

SEQ ID NO: 2137124 - protein, 6 aa, Cryptosporidium hominis
DDKTGN

SEQ ID NO: 2137125 - protein, 19 aa, Cryptosporidium hominis
DDKTTAPSTPDDKSTPLPH

SEQ ID NO: 2137126 - protein, 8 aa, Cryptosporidium hominis
DDKYSNLP

SEQ ID NO: 2137127 - protein, 13 aa, Cryptosporidium hominis
DDLDTDEDNDYPS

SEQ ID NO: 2137128 - protein, 7 aa, Cryptosporidium hominis
DDLGESS

SEQ ID NO: 2137129 - protein, 9 aa, Cryptosporidium hominis
DDLKSKTKV

SEQ ID NO: 2137130 - protein, 7 aa, Cryptosporidium hominis
DDLPSYS

SEQ ID NO: 2137131 - protein, 8 aa, Cryptosporidium hominis
DDLRGSPM

SEQ ID NO: 2137132 - protein, 5 aa, Cryptosporidium hominis
DDLTM

SEQ ID NO: 2137133 - protein, 39 aa, Cryptosporidium hominis
DDMEDIGKDSKNNNLESDGPPAIESPPLPGQGLDSSDFK

SEQ ID NO: 2137134 - protein, 6 aa, Cryptosporidium hominis
DDMNID

SEQ ID NO: 2137135 - protein, 7 aa, Cryptosporidium hominis
DDNAEAV

SEQ ID NO: 2137136 - protein, 23 aa, Cryptosporidium hominis
DDNCSSTTGASGYRDASVSPQRF

SEQ ID NO: 2137137 - protein, 14 aa, Cryptosporidium hominis
DDNEGDTRLTGKDR

SEQ ID NO: 2137138 - protein, 178 aa, Cryptosporidium hominis
DDNEHFNTGGGQGSGSGGGGQSSRRFSGQRRDYRERGGDRTERGGELERDRERGDRGERGERGERGDRGDRGDRGERGERGERVDRGDRDRDRDRDRDRDRDRDRDRGERGERGERGERDRNRDRNREKNDRDRVDKGDIKAERSEKERHREKDWERDRSGDQEKGSTNKGSGGPSMV

SEQ ID NO: 2137139 - protein, 8 aa, Cryptosporidium hominis
DDNGGSVR

SEQ ID NO: 2137140 - protein, 9 aa, Cryptosporidium hominis
DDNGSLTDL

SEQ ID NO: 2137141 - protein, 4 aa, Cryptosporidium hominis
DDNH

SEQ ID NO: 2137142 - protein, 17 aa, Cryptosporidium hominis
DDNKSSVKSVYKSENTF

SEQ ID NO: 2137143 - protein, 12 aa, Cryptosporidium hominis
DDNKYRKKRRVR

SEQ ID NO: 2137144 - protein, 83 aa, Cryptosporidium hominis
DDNLSDDDSDSNSYSDSSDSDSDSDSDSSSSSSSGSDSRSVSGSGSDGNGSSSDESSSDSDSSSSSSSSEWSSYEDEYEDRHA

SEQ ID NO: 2137145 - protein, 4 aa, Cryptosporidium hominis
DDNN

SEQ ID NO: 2137146 - protein, 8 aa, Cryptosporidium hominis
DDNNKLPD

SEQ ID NO: 2137147 - protein, 10 aa, Cryptosporidium hominis
DDNNSSVDTT

SEQ ID NO: 2137148 - protein, 7 aa, Cryptosporidium hominis
DDNNVEM

SEQ ID NO: 2137149 - protein, 34 aa, Cryptosporidium hominis
DDNPNGSAGSSGGINESNSAKTMSNVNTSPSDEV

SEQ ID NO: 2137150 - protein, 10 aa, Cryptosporidium hominis
DDNSKESEYE

SEQ ID NO: 2137151 - protein, 8 aa, Cryptosporidium hominis
DDNTGKIS

SEQ ID NO: 2137152 - protein, 6 aa, Cryptosporidium hominis
DDNTGQ

SEQ ID NO: 2137153 - protein, 13 aa, Cryptosporidium hominis
DDNTKDLQRKEDL

SEQ ID NO: 2137154 - protein, 4 aa, Cryptosporidium hominis
DDNY

SEQ ID NO: 2137155 - protein, 6 aa, Cryptosporidium hominis
DDPEHG

SEQ ID NO: 2137156 - protein, 7 aa, Cryptosporidium hominis
DDPGSLE

SEQ ID NO: 2137157 - protein, 6 aa, Cryptosporidium hominis
DDPITE

SEQ ID NO: 2137158 - protein, 10 aa, Cryptosporidium hominis
DDPNKKSNSL

SEQ ID NO: 2137159 - protein, 19 aa, Cryptosporidium hominis
DDPNPTSMENSKKRNAEEV

SEQ ID NO: 2137160 - protein, 23 aa, Cryptosporidium hominis
DDPNWSEISPEQEENDLESDIDD

SEQ ID NO: 2137161 - protein, 8 aa, Cryptosporidium hominis
DDPPEDSF

SEQ ID NO: 2137162 - protein, 5 aa, Cryptosporidium hominis
DDPPN

SEQ ID NO: 2137163 - protein, 8 aa, Cryptosporidium hominis
DDPSGNSF

SEQ ID NO: 2137164 - protein, 6 aa, Cryptosporidium hominis
DDPSLE

SEQ ID NO: 2137165 - protein, 6 aa, Cryptosporidium hominis
DDPSVP

SEQ ID NO: 2137166 - protein, 4 aa, Cryptosporidium hominis
DDPY

SEQ ID NO: 2137167 - protein, 14 aa, Cryptosporidium hominis
DDQDYELGKNSQDL

SEQ ID NO: 2137168 - protein, 4 aa, Cryptosporidium hominis
DDQE

SEQ ID NO: 2137169 - protein, 9 aa, Cryptosporidium hominis
DDQKKKDQF

SEQ ID NO: 2137170 - protein, 9 aa, Cryptosporidium hominis
DDQKPINNE

SEQ ID NO: 2137171 - protein, 7 aa, Cryptosporidium hominis
DDQKRGA

SEQ ID NO: 2137172 - protein, 9 aa, Cryptosporidium hominis
DDQLPPSIR

SEQ ID NO: 2137173 - protein, 7 aa, Cryptosporidium hominis
DDQNSSV

SEQ ID NO: 2137174 - protein, 20 aa, Cryptosporidium hominis
DDQQLKTEKYQRTDYQNETL

SEQ ID NO: 2137175 - protein, 28 aa, Cryptosporidium hominis
DDRDPPGSRPSGGYVSSGVPSGGRPNVA

SEQ ID NO: 2137176 - protein, 11 aa, Cryptosporidium hominis
DDRIHQNSNNY

SEQ ID NO: 2137177 - protein, 8 aa, Cryptosporidium hominis
DDRNSASE

SEQ ID NO: 2137178 - protein, 6 aa, Cryptosporidium hominis
DDRPDY

SEQ ID NO: 2137179 - protein, 8 aa, Cryptosporidium hominis
DDRYPGRA

SEQ ID NO: 2137180 - protein, 20 aa, Cryptosporidium hominis
DDSCQKSQKKVGLTNNPITK

SEQ ID NO: 2137181 - protein, 4 aa, Cryptosporidium hominis
DDSD

SEQ ID NO: 2137182 - protein, 5 aa, Cryptosporidium hominis
DDSEN

SEQ ID NO: 2137183 - protein, 17 aa, Cryptosporidium hominis
DDSERKFPTINICDLGR

SEQ ID NO: 2137184 - protein, 5 aa, Cryptosporidium hominis
DDSET

SEQ ID NO: 2137185 - protein, 7 aa, Cryptosporidium hominis
DDSFGTK

SEQ ID NO: 2137186 - protein, 11 aa, Cryptosporidium hominis
DDSFQNEDEEI

SEQ ID NO: 2137187 - protein, 11 aa, Cryptosporidium hominis
DDSGDSDNYQL

SEQ ID NO: 2137188 - protein, 23 aa, Cryptosporidium hominis
DDSIEDSDQDELNKDLNTTPKNV

SEQ ID NO: 2137189 - protein, 9 aa, Cryptosporidium hominis
DDSKTARVE

SEQ ID NO: 2137190 - protein, 21 aa, Cryptosporidium hominis
DDSKYTYEPGDLETKVTENGL

SEQ ID NO: 2137191 - protein, 14 aa, Cryptosporidium hominis
DDSNHSQDDDRLGD

SEQ ID NO: 2137192 - protein, 11 aa, Cryptosporidium hominis
DDSNNNNQNSD

SEQ ID NO: 2137193 - protein, 5 aa, Cryptosporidium hominis
DDSSD

SEQ ID NO: 2137194 - protein, 7 aa, Cryptosporidium hominis
DDSSYAG

SEQ ID NO: 2137195 - protein, 8 aa, Cryptosporidium hominis
DDSTPYRK

SEQ ID NO: 2137196 - protein, 6 aa, Cryptosporidium hominis
DDSTRN

SEQ ID NO: 2137197 - protein, 14 aa, Cryptosporidium hominis
DDTEGGDEEETSVH

SEQ ID NO: 2137198 - protein, 8 aa, Cryptosporidium hominis
DDTGSSYS

SEQ ID NO: 2137199 - protein, 34 aa, Cryptosporidium hominis
DDTGVGTSGVGGSQYRSKPYSQQSNKYTHQQQMN

SEQ ID NO: 2137200 - protein, 6 aa, Cryptosporidium hominis
DDTINT

SEQ ID NO: 2137201 - protein, 6 aa, Cryptosporidium hominis
DDTKKA

SEQ ID NO: 2137202 - protein, 7 aa, Cryptosporidium hominis
DDTNKQS

SEQ ID NO: 2137203 - protein, 9 aa, Cryptosporidium hominis
DDTVSSGGA

SEQ ID NO: 2137204 - protein, 8 aa, Cryptosporidium hominis
DDVDSNSD

SEQ ID NO: 2137205 - protein, 29 aa, Cryptosporidium hominis
DDYDDDESSVRDDESEEFEDLSSENEEDY

SEQ ID NO: 2137206 - protein, 8 aa, Cryptosporidium hominis
DDYDENSA

SEQ ID NO: 2137207 - protein, 58 aa, Cryptosporidium hominis
DDYDSSDDSEGEDQYEEEGEEDDSDEDEDESNTKDWGNKKQDFYDGGSSSTDSEGENW

SEQ ID NO: 2137208 - protein, 25 aa, Cryptosporidium hominis
DDYRDDEAEDESEDGENESQIDSET

SEQ ID NO: 2137209 - protein, 8 aa, Cryptosporidium hominis
DEAARGGA

SEQ ID NO: 2137210 - protein, 40 aa, Cryptosporidium hominis
DEAEDFEEEEEEEDDEEDEEDEIQASSSKKQRIEQDDDED

SEQ ID NO: 2137211 - protein, 10 aa, Cryptosporidium hominis
DEAEQEYEKR

SEQ ID NO: 2137212 - protein, 19 aa, Cryptosporidium hominis
DEAESQVKENLAKASEIND

SEQ ID NO: 2137213 - protein, 4 aa, Cryptosporidium hominis
DEAK

SEQ ID NO: 2137214 - protein, 4 aa, Cryptosporidium hominis
DEAQ

SEQ ID NO: 2137215 - protein, 23 aa, Cryptosporidium hominis
DEAQKTPSNKDVRNSPSEDGTER

SEQ ID NO: 2137216 - protein, 6 aa, Cryptosporidium hominis
DEASQF

SEQ ID NO: 2137217 - protein, 10 aa, Cryptosporidium hominis
DEATKEFETQ

SEQ ID NO: 2137218 - protein, 8 aa, Cryptosporidium hominis
DEATKQEI

SEQ ID NO: 2137219 - protein, 16 aa, Cryptosporidium hominis
DEDDEQKDNEEKPTIS

SEQ ID NO: 2137220 - protein, 5 aa, Cryptosporidium hominis
DEDDP

SEQ ID NO: 2137221 - protein, 39 aa, Cryptosporidium hominis
DEDDSDSESESSSDSNSDTDSDSEDDRSNKISNRSNKKN

SEQ ID NO: 2137222 - protein, 8 aa, Cryptosporidium hominis
DEDEDMSA

SEQ ID NO: 2137223 - protein, 14 aa, Cryptosporidium hominis
DEDEELERIKDIQV

SEQ ID NO: 2137224 - protein, 5 aa, Cryptosporidium hominis
DEDEN

SEQ ID NO: 2137225 - protein, 4 aa, Cryptosporidium hominis
DEDF

SEQ ID NO: 2137226 - protein, 7 aa, Cryptosporidium hominis
DEDFNKK

SEQ ID NO: 2137227 - protein, 7 aa, Cryptosporidium hominis
DEDGKLS

SEQ ID NO: 2137228 - protein, 7 aa, Cryptosporidium hominis
DEDGPSL

SEQ ID NO: 2137229 - protein, 21 aa, Cryptosporidium hominis
DEDHSSSTQRVEQENSSHPAF

SEQ ID NO: 2137230 - protein, 14 aa, Cryptosporidium hominis
DEDISGELLLTSCS

SEQ ID NO: 2137231 - protein, 12 aa, Cryptosporidium hominis
DEDNDNSDIEEN

SEQ ID NO: 2137232 - protein, 5 aa, Cryptosporidium hominis
DEDNQ

SEQ ID NO: 2137233 - protein, 17 aa, Cryptosporidium hominis
DEDPNCCGSKRKEEFPN

SEQ ID NO: 2137234 - protein, 8 aa, Cryptosporidium hominis
DEDQMENS

SEQ ID NO: 2137235 - protein, 6 aa, Cryptosporidium hominis
DEDRNL

SEQ ID NO: 2137236 - protein, 7 aa, Cryptosporidium hominis
DEDSEDK

SEQ ID NO: 2137237 - protein, 9 aa, Cryptosporidium hominis
DEDTSSKRE

SEQ ID NO: 2137238 - protein, 26 aa, Cryptosporidium hominis
DEEEDDDDDLSDNTNEIRKSNKKEMT

SEQ ID NO: 2137239 - protein, 47 aa, Cryptosporidium hominis
DEEEEEEEEVEEEEVEEEEVEGEEVEGEEVEGEEDKDEEKNDQNNDL

SEQ ID NO: 2137240 - protein, 6 aa, Cryptosporidium hominis
DEEEEY

SEQ ID NO: 2137241 - protein, 8 aa, Cryptosporidium hominis
DEEFTDGD

SEQ ID NO: 2137242 - protein, 5 aa, Cryptosporidium hominis
DEEGA

SEQ ID NO: 2137243 - protein, 5 aa, Cryptosporidium hominis
DEEGI

SEQ ID NO: 2137244 - protein, 6 aa, Cryptosporidium hominis
DEEGIK

SEQ ID NO: 2137245 - protein, 6 aa, Cryptosporidium hominis
DEEGNN

SEQ ID NO: 2137246 - protein, 9 aa, Cryptosporidium hominis
DEEGNPSKV

SEQ ID NO: 2137247 - protein, 8 aa, Cryptosporidium hominis
DEEGRPSI

SEQ ID NO: 2137248 - protein, 6 aa, Cryptosporidium hominis
DEEIKT

SEQ ID NO: 2137249 - protein, 11 aa, Cryptosporidium hominis
DEEISDNLSNN

SEQ ID NO: 2137250 - protein, 6 aa, Cryptosporidium hominis
DEEKEF

SEQ ID NO: 2137251 - protein, 10 aa, Cryptosporidium hominis
DEENENKNSI

SEQ ID NO: 2137252 - protein, 7 aa, Cryptosporidium hominis
DEEQYSK

SEQ ID NO: 2137253 - protein, 7 aa, Cryptosporidium hominis
DEEREKS

SEQ ID NO: 2137254 - protein, 4 aa, Cryptosporidium hominis
DEET

SEQ ID NO: 2137255 - protein, 7 aa, Cryptosporidium hominis
DEETAIK

SEQ ID NO: 2137256 - protein, 10 aa, Cryptosporidium hominis
DEEVGDGTTS

SEQ ID NO: 2137257 - protein, 5 aa, Cryptosporidium hominis
DEEVK

SEQ ID NO: 2137258 - protein, 12 aa, Cryptosporidium hominis
DEFDESTNIDSD

SEQ ID NO: 2137259 - protein, 5 aa, Cryptosporidium hominis
DEFGT

SEQ ID NO: 2137260 - protein, 6 aa, Cryptosporidium hominis
DEFSPV

SEQ ID NO: 2137261 - protein, 10 aa, Cryptosporidium hominis
DEFSTRRPES

SEQ ID NO: 2137262 - protein, 8 aa, Cryptosporidium hominis
DEGARQRA

SEQ ID NO: 2137263 - protein, 8 aa, Cryptosporidium hominis
DEGDSREK

SEQ ID NO: 2137264 - protein, 4 aa, Cryptosporidium hominis
DEGE

SEQ ID NO: 2137265 - protein, 6 aa, Cryptosporidium hominis
DEGELT

SEQ ID NO: 2137266 - protein, 4 aa, Cryptosporidium hominis
DEGF

SEQ ID NO: 2137267 - protein, 9 aa, Cryptosporidium hominis
DEGGRNGRD

SEQ ID NO: 2137268 - protein, 9 aa, Cryptosporidium hominis
DEGINETSK

SEQ ID NO: 2137269 - protein, 14 aa, Cryptosporidium hominis
DEGINKNKNADKVE

SEQ ID NO: 2137270 - protein, 15 aa, Cryptosporidium hominis
DEGKNKDISAKEKDY

SEQ ID NO: 2137271 - protein, 6 aa, Cryptosporidium hominis
DEGKSK

SEQ ID NO: 2137272 - protein, 6 aa, Cryptosporidium hominis
DEGKTI

SEQ ID NO: 2137273 - protein, 4 aa, Cryptosporidium hominis
DEGL

SEQ ID NO: 2137274 - protein, 6 aa, Cryptosporidium hominis
DEGNSK

SEQ ID NO: 2137275 - protein, 14 aa, Cryptosporidium hominis
DEGPGTINEDNKCE

SEQ ID NO: 2137276 - protein, 7 aa, Cryptosporidium hominis
DEGPPQP

SEQ ID NO: 2137277 - protein, 5 aa, Cryptosporidium hominis
DEGRN

SEQ ID NO: 2137278 - protein, 11 aa, Cryptosporidium hominis
DEGRQIPTEYK

SEQ ID NO: 2137279 - protein, 5 aa, Cryptosporidium hominis
DEGRR

SEQ ID NO: 2137280 - protein, 9 aa, Cryptosporidium hominis
DEGSISESQ

SEQ ID NO: 2137281 - protein, 7 aa, Cryptosporidium hominis
DEGYNAR

SEQ ID NO: 2137282 - protein, 9 aa, Cryptosporidium hominis
DEGYSGTHS

SEQ ID NO: 2137283 - protein, 20 aa, Cryptosporidium hominis
DEHEQTKSELKKAKEQSSEF

SEQ ID NO: 2137284 - protein, 11 aa, Cryptosporidium hominis
DEHNNTSPSTS

SEQ ID NO: 2137285 - protein, 16 aa, Cryptosporidium hominis
DEHNQEDKLPKQDSLQ

SEQ ID NO: 2137286 - protein, 13 aa, Cryptosporidium hominis
DEHSIQSTGTDYC

SEQ ID NO: 2137287 - protein, 4 aa, Cryptosporidium hominis
DEID

SEQ ID NO: 2137288 - protein, 7 aa, Cryptosporidium hominis
DEIDQYE

SEQ ID NO: 2137289 - protein, 5 aa, Cryptosporidium hominis
DEIEE

SEQ ID NO: 2137290 - protein, 11 aa, Cryptosporidium hominis
DEIEGKSNNLK

SEQ ID NO: 2137291 - protein, 6 aa, Cryptosporidium hominis
DEIEQE

SEQ ID NO: 2137292 - protein, 8 aa, Cryptosporidium hominis
DEIESEEE

SEQ ID NO: 2137293 - protein, 4 aa, Cryptosporidium hominis
DEIG

SEQ ID NO: 2137294 - protein, 4 aa, Cryptosporidium hominis
DEIK

SEQ ID NO: 2137295 - protein, 6 aa, Cryptosporidium hominis
DEIPPI

SEQ ID NO: 2137296 - protein, 4 aa, Cryptosporidium hominis
DEIQ

SEQ ID NO: 2137297 - protein, 4 aa, Cryptosporidium hominis
DEIS

SEQ ID NO: 2137298 - protein, 12 aa, Cryptosporidium hominis
DEISPNVKHDEP

SEQ ID NO: 2137299 - protein, 10 aa, Cryptosporidium hominis
DEITNNNNAE

SEQ ID NO: 2137300 - protein, 5 aa, Cryptosporidium hominis
DEITS

SEQ ID NO: 2137301 - protein, 11 aa, Cryptosporidium hominis
DEKAPEKQQEV

SEQ ID NO: 2137302 - protein, 9 aa, Cryptosporidium hominis
DEKEESDNI

SEQ ID NO: 2137303 - protein, 8 aa, Cryptosporidium hominis
DEKELRRQ

SEQ ID NO: 2137304 - protein, 10 aa, Cryptosporidium hominis
DEKENDIEDI

SEQ ID NO: 2137305 - protein, 14 aa, Cryptosporidium hominis
DEKEPVSDKPRSVQ

SEQ ID NO: 2137306 - protein, 7 aa, Cryptosporidium hominis
DEKERNI

SEQ ID NO: 2137307 - protein, 5 aa, Cryptosporidium hominis
DEKEY

SEQ ID NO: 2137308 - protein, 8 aa, Cryptosporidium hominis
DEKFGEKN

SEQ ID NO: 2137309 - protein, 5 aa, Cryptosporidium hominis
DEKGF

SEQ ID NO: 2137310 - protein, 5 aa, Cryptosporidium hominis
DEKIQ

SEQ ID NO: 2137311 - protein, 6 aa, Cryptosporidium hominis
DEKLKH

SEQ ID NO: 2137312 - protein, 53 aa, Cryptosporidium hominis
DEKNEQEEKDGKDHFQEANKKEETEENIQTKEVQDVKSEVGSPKNSRESLEEL

SEQ ID NO: 2137313 - protein, 5 aa, Cryptosporidium hominis
DEKNK

SEQ ID NO: 2137314 - protein, 7 aa, Cryptosporidium hominis
DEKNKEN

SEQ ID NO: 2137315 - protein, 5 aa, Cryptosporidium hominis
DEKNN

SEQ ID NO: 2137316 - protein, 5 aa, Cryptosporidium hominis
DEKPI

SEQ ID NO: 2137317 - protein, 8 aa, Cryptosporidium hominis
DEKRQAIQ

SEQ ID NO: 2137318 - protein, 18 aa, Cryptosporidium hominis
DEKSGTKVEIDEKKSVEV

SEQ ID NO: 2137319 - protein, 8 aa, Cryptosporidium hominis
DEKSNTLS

SEQ ID NO: 2137320 - protein, 6 aa, Cryptosporidium hominis
DEKSQK

SEQ ID NO: 2137321 - protein, 6 aa, Cryptosporidium hominis
DEKSQN

SEQ ID NO: 2137322 - protein, 26 aa, Cryptosporidium hominis
DEKTESDKEGNIKEREANESSEEETN

SEQ ID NO: 2137323 - protein, 7 aa, Cryptosporidium hominis
DEKYQNN

SEQ ID NO: 2137324 - protein, 4 aa, Cryptosporidium hominis
DELD

SEQ ID NO: 2137325 - protein, 4 aa, Cryptosporidium hominis
DELE

SEQ ID NO: 2137326 - protein, 12 aa, Cryptosporidium hominis
DELEAKKTEFEV

SEQ ID NO: 2137327 - protein, 5 aa, Cryptosporidium hominis
DELEE

SEQ ID NO: 2137328 - protein, 14 aa, Cryptosporidium hominis
DELENLQNKSNFRP

SEQ ID NO: 2137329 - protein, 9 aa, Cryptosporidium hominis
DELGPSESN

SEQ ID NO: 2137330 - protein, 5 aa, Cryptosporidium hominis
DELKD

SEQ ID NO: 2137331 - protein, 6 aa, Cryptosporidium hominis
DELKET

SEQ ID NO: 2137332 - protein, 4 aa, Cryptosporidium hominis
DELN

SEQ ID NO: 2137333 - protein, 6 aa, Cryptosporidium hominis
DELPNN

SEQ ID NO: 2137334 - protein, 8 aa, Cryptosporidium hominis
DELPNTGL

SEQ ID NO: 2137335 - protein, 15 aa, Cryptosporidium hominis
DELQNNEKKETLNSL

SEQ ID NO: 2137336 - protein, 5 aa, Cryptosporidium hominis
DELQR

SEQ ID NO: 2137337 - protein, 5 aa, Cryptosporidium hominis
DEMEE

SEQ ID NO: 2137338 - protein, 21 aa, Cryptosporidium hominis
DEMKSDIEESSNSNSNNNNGI

SEQ ID NO: 2137339 - protein, 9 aa, Cryptosporidium hominis
DENAGLNRE

SEQ ID NO: 2137340 - protein, 4 aa, Cryptosporidium hominis
DEND

SEQ ID NO: 2137341 - protein, 17 aa, Cryptosporidium hominis
DENDFKSNDLKKEMNDQ

SEQ ID NO: 2137342 - protein, 8 aa, Cryptosporidium hominis
DENDPDSA

SEQ ID NO: 2137343 - protein, 7 aa, Cryptosporidium hominis
DENENDE

SEQ ID NO: 2137344 - protein, 6 aa, Cryptosporidium hominis
DENENK

SEQ ID NO: 2137345 - protein, 11 aa, Cryptosporidium hominis
DENGQFGTGGL

SEQ ID NO: 2137346 - protein, 10 aa, Cryptosporidium hominis
DENGVTRSSR

SEQ ID NO: 2137347 - protein, 7 aa, Cryptosporidium hominis
DENIENE

SEQ ID NO: 2137348 - protein, 9 aa, Cryptosporidium hominis
DENKAKKFA

SEQ ID NO: 2137349 - protein, 14 aa, Cryptosporidium hominis
DENKNENESNDDNN

SEQ ID NO: 2137350 - protein, 8 aa, Cryptosporidium hominis
DENLGNSN

SEQ ID NO: 2137351 - protein, 7 aa, Cryptosporidium hominis
DENNEFD

SEQ ID NO: 2137352 - protein, 6 aa, Cryptosporidium hominis
DENNPR

SEQ ID NO: 2137353 - protein, 21 aa, Cryptosporidium hominis
DENNSIESFQNKDDQDPEQYR

SEQ ID NO: 2137354 - protein, 9 aa, Cryptosporidium hominis
DENNSNLSE

SEQ ID NO: 2137355 - protein, 9 aa, Cryptosporidium hominis
DENQKKRKE

SEQ ID NO: 2137356 - protein, 8 aa, Cryptosporidium hominis
DENQYRQR

SEQ ID NO: 2137357 - protein, 5 aa, Cryptosporidium hominis
DENSH

SEQ ID NO: 2137358 - protein, 33 aa, Cryptosporidium hominis
DENSTGSRTKASSSSSSSTSSPTLPSKQNSGAK

SEQ ID NO: 2137359 - protein, 7 aa, Cryptosporidium hominis
DENTGSF

SEQ ID NO: 2137360 - protein, 7 aa, Cryptosporidium hominis
DENTNRE

SEQ ID NO: 2137361 - protein, 4 aa, Cryptosporidium hominis
DENY

SEQ ID NO: 2137362 - protein, 8 aa, Cryptosporidium hominis
DENYENNY

SEQ ID NO: 2137363 - protein, 9 aa, Cryptosporidium hominis
DEPDGHNDQ

SEQ ID NO: 2137364 - protein, 22 aa, Cryptosporidium hominis
DEPLGNNNIGDKVNNYKGNNLS

SEQ ID NO: 2137365 - protein, 6 aa, Cryptosporidium hominis
DEPSED

SEQ ID NO: 2137366 - protein, 17 aa, Cryptosporidium hominis
DEPSSSDETQESNTNSI

SEQ ID NO: 2137367 - protein, 8 aa, Cryptosporidium hominis
DEQAGELP

SEQ ID NO: 2137368 - protein, 18 aa, Cryptosporidium hominis
DEQDNSEMFQDDDEIQEI

SEQ ID NO: 2137369 - protein, 5 aa, Cryptosporidium hominis
DEQIQ

SEQ ID NO: 2137370 - protein, 28 aa, Cryptosporidium hominis
DEQPGGPPPSLPPSLPGPCTSVSSPPSL

SEQ ID NO: 2137371 - protein, 5 aa, Cryptosporidium hominis
DERAL

SEQ ID NO: 2137372 - protein, 5 aa, Cryptosporidium hominis
DERDM

SEQ ID NO: 2137373 - protein, 13 aa, Cryptosporidium hominis
DEREASKKQVNTT

SEQ ID NO: 2137374 - protein, 19 aa, Cryptosporidium hominis
DERELEEDDDDDEEEEESN

SEQ ID NO: 2137375 - protein, 5 aa, Cryptosporidium hominis
DERGE

SEQ ID NO: 2137376 - protein, 6 aa, Cryptosporidium hominis
DERGLK

SEQ ID NO: 2137377 - protein, 7 aa, Cryptosporidium hominis
DERGPSV

SEQ ID NO: 2137378 - protein, 7 aa, Cryptosporidium hominis
DERKGNL

SEQ ID NO: 2137379 - protein, 10 aa, Cryptosporidium hominis
DERNSESDSC

SEQ ID NO: 2137380 - protein, 45 aa, Cryptosporidium hominis
DERQNTSNESSSSNVQNKGNTLGSSITTVSGSISVSGSGSGSSSR

SEQ ID NO: 2137381 - protein, 25 aa, Cryptosporidium hominis
DERSKKTPYQLSEGDSVYDTQSYGS

SEQ ID NO: 2137382 - protein, 12 aa, Cryptosporidium hominis
DERSVGENGEIQ

SEQ ID NO: 2137383 - protein, 6 aa, Cryptosporidium hominis
DERTHR

SEQ ID NO: 2137384 - protein, 15 aa, Cryptosporidium hominis
DERTSNVISKGKKTA

SEQ ID NO: 2137385 - protein, 11 aa, Cryptosporidium hominis
DESDPTSSKPW

SEQ ID NO: 2137386 - protein, 4 aa, Cryptosporidium hominis
DESE

SEQ ID NO: 2137387 - protein, 10 aa, Cryptosporidium hominis
DESEDANLDG

SEQ ID NO: 2137388 - protein, 16 aa, Cryptosporidium hominis
DESEDESEISSDEKRV

SEQ ID NO: 2137389 - protein, 6 aa, Cryptosporidium hominis
DESEIG

SEQ ID NO: 2137390 - protein, 8 aa, Cryptosporidium hominis
DESEPNLP

SEQ ID NO: 2137391 - protein, 7 aa, Cryptosporidium hominis
DESERNN

SEQ ID NO: 2137392 - protein, 7 aa, Cryptosporidium hominis
DESFKSQ

SEQ ID NO: 2137393 - protein, 19 aa, Cryptosporidium hominis
DESFQERDISQEDDDSIPY

SEQ ID NO: 2137394 - protein, 16 aa, Cryptosporidium hominis
DESFSSDTQKEHNQGI

SEQ ID NO: 2137395 - protein, 5 aa, Cryptosporidium hominis
DESGP

SEQ ID NO: 2137396 - protein, 12 aa, Cryptosporidium hominis
DESGRERTNPNN

SEQ ID NO: 2137397 - protein, 6 aa, Cryptosporidium hominis
DESINN

SEQ ID NO: 2137398 - protein, 5 aa, Cryptosporidium hominis
DESKN

SEQ ID NO: 2137399 - protein, 14 aa, Cryptosporidium hominis
DESPNNTRYGVQGS

SEQ ID NO: 2137400 - protein, 9 aa, Cryptosporidium hominis
DESQKTQKR

SEQ ID NO: 2137401 - protein, 7 aa, Cryptosporidium hominis
DESRPIY

SEQ ID NO: 2137402 - protein, 16 aa, Cryptosporidium hominis
DESSFNGIDETREVQK

SEQ ID NO: 2137403 - protein, 7 aa, Cryptosporidium hominis
DESSISH

SEQ ID NO: 2137404 - protein, 6 aa, Cryptosporidium hominis
DESSKQ

SEQ ID NO: 2137405 - protein, 21 aa, Cryptosporidium hominis
DESSTDSESEESTMKKRVTRR

SEQ ID NO: 2137406 - protein, 7 aa, Cryptosporidium hominis
DESVDSK

SEQ ID NO: 2137407 - protein, 9 aa, Cryptosporidium hominis
DESVENEDT

SEQ ID NO: 2137408 - protein, 15 aa, Cryptosporidium hominis
DESYPKQGETSSAES

SEQ ID NO: 2137409 - protein, 6 aa, Cryptosporidium hominis
DETDIP

SEQ ID NO: 2137410 - protein, 6 aa, Cryptosporidium hominis
DETDKK

SEQ ID NO: 2137411 - protein, 9 aa, Cryptosporidium hominis
DETESNKSK

SEQ ID NO: 2137412 - protein, 7 aa, Cryptosporidium hominis
DETGDTP

SEQ ID NO: 2137413 - protein, 15 aa, Cryptosporidium hominis
DETKISGKAINDKSF

SEQ ID NO: 2137414 - protein, 11 aa, Cryptosporidium hominis
DETKSKSNPRY

SEQ ID NO: 2137415 - protein, 7 aa, Cryptosporidium hominis
DETKSSK

SEQ ID NO: 2137416 - protein, 6 aa, Cryptosporidium hominis
DETNQI

SEQ ID NO: 2137417 - protein, 7 aa, Cryptosporidium hominis
DETPESL

SEQ ID NO: 2137418 - protein, 4 aa, Cryptosporidium hominis
DETQ

SEQ ID NO: 2137419 - protein, 11 aa, Cryptosporidium hominis
DETSNNSSDGH

SEQ ID NO: 2137420 - protein, 7 aa, Cryptosporidium hominis
DETSRQP

SEQ ID NO: 2137421 - protein, 5 aa, Cryptosporidium hominis
DETTR

SEQ ID NO: 2137422 - protein, 11 aa, Cryptosporidium hominis
DEVAGKNKGIV

SEQ ID NO: 2137423 - protein, 29 aa, Cryptosporidium hominis
DEVDENGNYNENLESKDEVHNYNQKGMQS

SEQ ID NO: 2137424 - protein, 9 aa, Cryptosporidium hominis
DEVKQENSQ

SEQ ID NO: 2137425 - protein, 12 aa, Cryptosporidium hominis
DEVNKNKRAVSK

SEQ ID NO: 2137426 - protein, 10 aa, Cryptosporidium hominis
DEVNQKTKLS

SEQ ID NO: 2137427 - protein, 9 aa, Cryptosporidium hominis
DEVPKTSKD

SEQ ID NO: 2137428 - protein, 6 aa, Cryptosporidium hominis
DEVQEQ

SEQ ID NO: 2137429 - protein, 13 aa, Cryptosporidium hominis
DEVRKKQKQLPKI

SEQ ID NO: 2137430 - protein, 23 aa, Cryptosporidium hominis
DEVTDDEDDESSEEGSEEDEEVE

SEQ ID NO: 2137431 - protein, 4 aa, Cryptosporidium hominis
DEVY

SEQ ID NO: 2137432 - protein, 21 aa, Cryptosporidium hominis
DEYEGRSNSIREENEDSQIEE

SEQ ID NO: 2137433 - protein, 5 aa, Cryptosporidium hominis
DEYEK

SEQ ID NO: 2137434 - protein, 18 aa, Cryptosporidium hominis
DEYGEEGLEGGGGGADPV

SEQ ID NO: 2137435 - protein, 17 aa, Cryptosporidium hominis
DEYKAPPSITNKISEGH

SEQ ID NO: 2137436 - protein, 14 aa, Cryptosporidium hominis
DEYSETQQESNHTT

SEQ ID NO: 2137437 - protein, 19 aa, Cryptosporidium hominis
DEYSNHSISKTEKAALGNN

SEQ ID NO: 2137438 - protein, 5 aa, Cryptosporidium hominis
DEYTR

SEQ ID NO: 2137439 - protein, 8 aa, Cryptosporidium hominis
DEYTSLQR

SEQ ID NO: 2137440 - protein, 12 aa, Cryptosporidium hominis
DFDDEDDELDDF

SEQ ID NO: 2137441 - protein, 5 aa, Cryptosporidium hominis
DFDES

SEQ ID NO: 2137442 - protein, 5 aa, Cryptosporidium hominis
DFDGE

SEQ ID NO: 2137443 - protein, 5 aa, Cryptosporidium hominis
DFEEG

SEQ ID NO: 2137444 - protein, 20 aa, Cryptosporidium hominis
DFEGESSNHKKINRENEQEI

SEQ ID NO: 2137445 - protein, 11 aa, Cryptosporidium hominis
DFEKSNIKKKY

SEQ ID NO: 2137446 - protein, 7 aa, Cryptosporidium hominis
DFEQGEK

SEQ ID NO: 2137447 - protein, 5 aa, Cryptosporidium hominis
DFGSP

SEQ ID NO: 2137448 - protein, 6 aa, Cryptosporidium hominis
DFKNEL

SEQ ID NO: 2137449 - protein, 5 aa, Cryptosporidium hominis
DFKQN

SEQ ID NO: 2137450 - protein, 23 aa, Cryptosporidium hominis
DFLQESNDDLKKAATSQSKVENV

SEQ ID NO: 2137451 - protein, 15 aa, Cryptosporidium hominis
DFNKGSNSNHKSNEN

SEQ ID NO: 2137452 - protein, 8 aa, Cryptosporidium hominis
DFNPANGR

SEQ ID NO: 2137453 - protein, 36 aa, Cryptosporidium hominis
DFNSGSNKTPTEESFVEDSDSEFYPQPSSLESTNKD

SEQ ID NO: 2137454 - protein, 17 aa, Cryptosporidium hominis
DFNTQKVETREFEPEQR

SEQ ID NO: 2137455 - protein, 10 aa, Cryptosporidium hominis
DFPDSNEFSN

SEQ ID NO: 2137456 - protein, 7 aa, Cryptosporidium hominis
DFPEPSR

SEQ ID NO: 2137457 - protein, 7 aa, Cryptosporidium hominis
DFPPGMS

SEQ ID NO: 2137458 - protein, 13 aa, Cryptosporidium hominis
DFQNFSSKQREAN

SEQ ID NO: 2137459 - protein, 4 aa, Cryptosporidium hominis
DFRG

SEQ ID NO: 2137460 - protein, 16 aa, Cryptosporidium hominis
DFSEENDTEKQEEKLP

SEQ ID NO: 2137461 - protein, 11 aa, Cryptosporidium hominis
DFSKNNKDSID

SEQ ID NO: 2137462 - protein, 5 aa, Cryptosporidium hominis
DFSNE

SEQ ID NO: 2137463 - protein, 8 aa, Cryptosporidium hominis
DFSPSESE

SEQ ID NO: 2137464 - protein, 5 aa, Cryptosporidium hominis
DFSSN

SEQ ID NO: 2137465 - protein, 21 aa, Cryptosporidium hominis
DFSSNEEEDNDLKNQNNIKDQ

SEQ ID NO: 2137466 - protein, 7 aa, Cryptosporidium hominis
DFSSNKN

SEQ ID NO: 2137467 - protein, 5 aa, Cryptosporidium hominis
DFTGA

SEQ ID NO: 2137468 - protein, 14 aa, Cryptosporidium hominis
DFTRGDGTGGESIY

SEQ ID NO: 2137469 - protein, 7 aa, Cryptosporidium hominis
DGAFGGV

SEQ ID NO: 2137470 - protein, 9 aa, Cryptosporidium hominis
DGAKSQVRK

SEQ ID NO: 2137471 - protein, 4 aa, Cryptosporidium hominis
DGAL

SEQ ID NO: 2137472 - protein, 5 aa, Cryptosporidium hominis
DGATL

SEQ ID NO: 2137473 - protein, 4 aa, Cryptosporidium hominis
DGDA

SEQ ID NO: 2137474 - protein, 10 aa, Cryptosporidium hominis
DGDEKDANIN

SEQ ID NO: 2137475 - protein, 9 aa, Cryptosporidium hominis
DGDENSGYN

SEQ ID NO: 2137476 - protein, 30 aa, Cryptosporidium hominis
DGDGKMSDDEGYIEKNEMDEKFEEEHNPNL

SEQ ID NO: 2137477 - protein, 6 aa, Cryptosporidium hominis
DGDNKT

SEQ ID NO: 2137478 - protein, 9 aa, Cryptosporidium hominis
DGDSLTRAT

SEQ ID NO: 2137479 - protein, 17 aa, Cryptosporidium hominis
DGDSYSNFPTSHKDQTT

SEQ ID NO: 2137480 - protein, 6 aa, Cryptosporidium hominis
DGDTDL

SEQ ID NO: 2137481 - protein, 5 aa, Cryptosporidium hominis
DGEAV

SEQ ID NO: 2137482 - protein, 10 aa, Cryptosporidium hominis
DGEDGGASYI

SEQ ID NO: 2137483 - protein, 16 aa, Cryptosporidium hominis
DGEDNISSGDRKQKEI

SEQ ID NO: 2137484 - protein, 22 aa, Cryptosporidium hominis
DGEEDEEDEEVEVNGGFSSNNR

SEQ ID NO: 2137485 - protein, 7 aa, Cryptosporidium hominis
DGEEPDN

SEQ ID NO: 2137486 - protein, 21 aa, Cryptosporidium hominis
DGEKNNSSSSTDNQQTKNVAP

SEQ ID NO: 2137487 - protein, 11 aa, Cryptosporidium hominis
DGELNSPKKKL

SEQ ID NO: 2137488 - protein, 4 aa, Cryptosporidium hominis
DGEN

SEQ ID NO: 2137489 - protein, 12 aa, Cryptosporidium hominis
DGEQLSQIPSNS

SEQ ID NO: 2137490 - protein, 7 aa, Cryptosporidium hominis
DGERDID

SEQ ID NO: 2137491 - protein, 6 aa, Cryptosporidium hominis
DGESEV

SEQ ID NO: 2137492 - protein, 5 aa, Cryptosporidium hominis
DGESL

SEQ ID NO: 2137493 - protein, 6 aa, Cryptosporidium hominis
DGETTK

SEQ ID NO: 2137494 - protein, 6 aa, Cryptosporidium hominis
DGETYS

SEQ ID NO: 2137495 - protein, 15 aa, Cryptosporidium hominis
DGEVRNKAKDSDERL

SEQ ID NO: 2137496 - protein, 5 aa, Cryptosporidium hominis
DGFDS

SEQ ID NO: 2137497 - protein, 7 aa, Cryptosporidium hominis
DGFQGQE

SEQ ID NO: 2137498 - protein, 14 aa, Cryptosporidium hominis
DGGATSHTGSNSNV

SEQ ID NO: 2137499 - protein, 5 aa, Cryptosporidium hominis
DGGDA

SEQ ID NO: 2137500 - protein, 7 aa, Cryptosporidium hominis
DGGHFGP

SEQ ID NO: 2137501 - protein, 14 aa, Cryptosporidium hominis
DGGKEEEDQSRPLD

SEQ ID NO: 2137502 - protein, 16 aa, Cryptosporidium hominis
DGGLSGGGNNKIEQEE

SEQ ID NO: 2137503 - protein, 5 aa, Cryptosporidium hominis
DGGNM

SEQ ID NO: 2137504 - protein, 6 aa, Cryptosporidium hominis
DGGNVE

SEQ ID NO: 2137505 - protein, 6 aa, Cryptosporidium hominis
DGGSGI

SEQ ID NO: 2137506 - protein, 6 aa, Cryptosporidium hominis
DGGSQE

SEQ ID NO: 2137507 - protein, 7 aa, Cryptosporidium hominis
DGGVGKT

SEQ ID NO: 2137508 - protein, 13 aa, Cryptosporidium hominis
DGGVTEGTIGEEI

SEQ ID NO: 2137509 - protein, 9 aa, Cryptosporidium hominis
DGHEGASLS

SEQ ID NO: 2137510 - protein, 10 aa, Cryptosporidium hominis
DGHGSSGSHA

SEQ ID NO: 2137511 - protein, 10 aa, Cryptosporidium hominis
DGIDKSGLKE

SEQ ID NO: 2137512 - protein, 24 aa, Cryptosporidium hominis
DGINKENKEDSDSISNRKSIPKPF

SEQ ID NO: 2137513 - protein, 13 aa, Cryptosporidium hominis
DGIPSSENKKKEI

SEQ ID NO: 2137514 - protein, 7 aa, Cryptosporidium hominis
DGKAQGE

SEQ ID NO: 2137515 - protein, 8 aa, Cryptosporidium hominis
DGKCDEGE

SEQ ID NO: 2137516 - protein, 15 aa, Cryptosporidium hominis
DGKDDDSSGPSRTEK

SEQ ID NO: 2137517 - protein, 13 aa, Cryptosporidium hominis
DGKEETRLKSPEE

SEQ ID NO: 2137518 - protein, 4 aa, Cryptosporidium hominis
DGKI

SEQ ID NO: 2137519 - protein, 8 aa, Cryptosporidium hominis
DGKKIKKP

SEQ ID NO: 2137520 - protein, 8 aa, Cryptosporidium hominis
DGKNGLNF

SEQ ID NO: 2137521 - protein, 6 aa, Cryptosporidium hominis
DGKNRC

SEQ ID NO: 2137522 - protein, 9 aa, Cryptosporidium hominis
DGKPASDES

SEQ ID NO: 2137523 - protein, 23 aa, Cryptosporidium hominis
DGKSKASSTISSKVDAQKLAKGK

SEQ ID NO: 2137524 - protein, 5 aa, Cryptosporidium hominis
DGKTE

SEQ ID NO: 2137525 - protein, 12 aa, Cryptosporidium hominis
DGKTNVAMSEFS

SEQ ID NO: 2137526 - protein, 8 aa, Cryptosporidium hominis
DGLAEDDG

SEQ ID NO: 2137527 - protein, 7 aa, Cryptosporidium hominis
DGLGSLS

SEQ ID NO: 2137528 - protein, 16 aa, Cryptosporidium hominis
DGLKPGKSGYSENQNC

SEQ ID NO: 2137529 - protein, 21 aa, Cryptosporidium hominis
DGLQNSPKESIKETENLSDKS

SEQ ID NO: 2137530 - protein, 5 aa, Cryptosporidium hominis
DGLSN

SEQ ID NO: 2137531 - protein, 6 aa, Cryptosporidium hominis
DGLTES

SEQ ID NO: 2137532 - protein, 13 aa, Cryptosporidium hominis
DGLTGGPIRSSDK

SEQ ID NO: 2137533 - protein, 5 aa, Cryptosporidium hominis
DGMPK

SEQ ID NO: 2137534 - protein, 10 aa, Cryptosporidium hominis
DGMQNTSTFG

SEQ ID NO: 2137535 - protein, 11 aa, Cryptosporidium hominis
DGNARDGRSIK

SEQ ID NO: 2137536 - protein, 4 aa, Cryptosporidium hominis
DGNG

SEQ ID NO: 2137537 - protein, 7 aa, Cryptosporidium hominis
DGNIGPG

SEQ ID NO: 2137538 - protein, 17 aa, Cryptosporidium hominis
DGNKVGGGYRGGGSDPL

SEQ ID NO: 2137539 - protein, 4 aa, Cryptosporidium hominis
DGNL

SEQ ID NO: 2137540 - protein, 74 aa, Cryptosporidium hominis
  misc_feature (26)..(26): Xaa can be any naturally occurring amino acid
  misc_feature (31)..(31): Xaa can be any naturally occurring amino acid
  misc_feature (40)..(40): Xaa can be any naturally occurring amino acid
  misc_feature (51)..(51): Xaa can be any naturally occurring amino acid
DGNNNNNNNNKGIGDSNNDIQFYDVXEESIXNYQNFNKNXQISVVQNLIDXDRSKKNNNQRNSSSSYSSKNSTT

SEQ ID NO: 2137541 - protein, 10 aa, Cryptosporidium hominis
DGNNRGSSNQ

SEQ ID NO: 2137542 - protein, 4 aa, Cryptosporidium hominis
DGNR

SEQ ID NO: 2137543 - protein, 4 aa, Cryptosporidium hominis
DGNS

SEQ ID NO: 2137544 - protein, 6 aa, Cryptosporidium hominis
DGNYIN

SEQ ID NO: 2137545 - protein, 8 aa, Cryptosporidium hominis
DGPLKEYQ

SEQ ID NO: 2137546 - protein, 11 aa, Cryptosporidium hominis
DGPPPTPQQSS

SEQ ID NO: 2137547 - protein, 6 aa, Cryptosporidium hominis
DGPSMG

SEQ ID NO: 2137548 - protein, 10 aa, Cryptosporidium hominis
DGQCDGRGGT

SEQ ID NO: 2137549 - protein, 10 aa, Cryptosporidium hominis
DGQENDSDNF

SEQ ID NO: 2137550 - protein, 5 aa, Cryptosporidium hominis
DGQKK

SEQ ID NO: 2137551 - protein, 7 aa, Cryptosporidium hominis
DGQKPVD

SEQ ID NO: 2137552 - protein, 17 aa, Cryptosporidium hominis
DGQNKAPMTPSTLSPAS

SEQ ID NO: 2137553 - protein, 6 aa, Cryptosporidium hominis
DGRGDQ

SEQ ID NO: 2137554 - protein, 5 aa, Cryptosporidium hominis
DGRMG

SEQ ID NO: 2137555 - protein, 5 aa, Cryptosporidium hominis
DGRSF

SEQ ID NO: 2137556 - protein, 8 aa, Cryptosporidium hominis
DGRTSTGP

SEQ ID NO: 2137557 - protein, 6 aa, Cryptosporidium hominis
DGSAPF

SEQ ID NO: 2137558 - protein, 12 aa, Cryptosporidium hominis
DGSDRDDEDLNR

SEQ ID NO: 2137559 - protein, 4 aa, Cryptosporidium hominis
DGSE

SEQ ID NO: 2137560 - protein, 5 aa, Cryptosporidium hominis
DGSED

SEQ ID NO: 2137561 - protein, 5 aa, Cryptosporidium hominis
DGSEI

SEQ ID NO: 2137562 - protein, 7 aa, Cryptosporidium hominis
DGSFHSK

SEQ ID NO: 2137563 - protein, 5 aa, Cryptosporidium hominis
DGSGI

SEQ ID NO: 2137564 - protein, 15 aa, Cryptosporidium hominis
DGSGKKKKSVYPNNI

SEQ ID NO: 2137565 - protein, 4 aa, Cryptosporidium hominis
DGSI

SEQ ID NO: 2137566 - protein, 5 aa, Cryptosporidium hominis
DGSKE

SEQ ID NO: 2137567 - protein, 9 aa, Cryptosporidium hominis
DGSNLENIS

SEQ ID NO: 2137568 - protein, 6 aa, Cryptosporidium hominis
DGSQYN

SEQ ID NO: 2137569 - protein, 7 aa, Cryptosporidium hominis
DGSSDFD

SEQ ID NO: 2137570 - protein, 5 aa, Cryptosporidium hominis
DGSSV

SEQ ID NO: 2137571 - protein, 7 aa, Cryptosporidium hominis
DGSTEAV

SEQ ID NO: 2137572 - protein, 8 aa, Cryptosporidium hominis
DGSTPLST

SEQ ID NO: 2137573 - protein, 7 aa, Cryptosporidium hominis
DGSTSSN

SEQ ID NO: 2137574 - protein, 7 aa, Cryptosporidium hominis
DGSTTDC

SEQ ID NO: 2137575 - protein, 7 aa, Cryptosporidium hominis
DGSVREG

SEQ ID NO: 2137576 - protein, 6 aa, Cryptosporidium hominis
DGSYLE

SEQ ID NO: 2137577 - protein, 9 aa, Cryptosporidium hominis
DGTDPYNEP

SEQ ID NO: 2137578 - protein, 6 aa, Cryptosporidium hominis
DGTDSQ

SEQ ID NO: 2137579 - protein, 48 aa, Cryptosporidium hominis
DGTINSSKQQNNLNQNRDSGTKLKNTNTINTSSISEKKDTSIKPNYPF

SEQ ID NO: 2137580 - protein, 6 aa, Cryptosporidium hominis
DGTITR

SEQ ID NO: 2137581 - protein, 6 aa, Cryptosporidium hominis
DGTLHS

SEQ ID NO: 2137582 - protein, 6 aa, Cryptosporidium hominis
DGTLPN

SEQ ID NO: 2137583 - protein, 6 aa, Cryptosporidium hominis
DGTLTP

SEQ ID NO: 2137584 - protein, 6 aa, Cryptosporidium hominis
DGTPDI

SEQ ID NO: 2137585 - protein, 19 aa, Cryptosporidium hominis
DGTQGVENKLKEDESSADL

SEQ ID NO: 2137586 - protein, 8 aa, Cryptosporidium hominis
DGTRNEQM

SEQ ID NO: 2137587 - protein, 5 aa, Cryptosporidium hominis
DGTSL

SEQ ID NO: 2137588 - protein, 6 aa, Cryptosporidium hominis
DGTSNI

SEQ ID NO: 2137589 - protein, 7 aa, Cryptosporidium hominis
DGTTVDG

SEQ ID NO: 2137590 - protein, 4 aa, Cryptosporidium hominis
DGVQ

SEQ ID NO: 2137591 - protein, 20 aa, Cryptosporidium hominis
DGVSKDWKPEKKEVDYNKNE

SEQ ID NO: 2137592 - protein, 47 aa, Cryptosporidium hominis
DGVTSSIENTPVRQTSSRKVDQNSSCNRKCQSTESYRTRTKLESSER

SEQ ID NO: 2137593 - protein, 4 aa, Cryptosporidium hominis
DGYI

SEQ ID NO: 2137594 - protein, 11 aa, Cryptosporidium hominis
DGYKRNNSVLS

SEQ ID NO: 2137595 - protein, 5 aa, Cryptosporidium hominis
DGYPN

SEQ ID NO: 2137596 - protein, 7 aa, Cryptosporidium hominis
DHAENAS

SEQ ID NO: 2137597 - protein, 6 aa, Cryptosporidium hominis
DHAKEK

SEQ ID NO: 2137598 - protein, 67 aa, Cryptosporidium hominis
DHAPEVEEKKGEEKEEEGEEEEEEEDEEEEEEEEEEEEEEEENDEKDIKGADDIDQVNGNHYNEREN

SEQ ID NO: 2137599 - protein, 5 aa, Cryptosporidium hominis
DHDNS

SEQ ID NO: 2137600 - protein, 19 aa, Cryptosporidium hominis
DHDSIQDENKDEKTGIRKD

SEQ ID NO: 2137601 - protein, 6 aa, Cryptosporidium hominis
DHEENV

SEQ ID NO: 2137602 - protein, 19 aa, Cryptosporidium hominis
DHEEYEGSQTREENRVNSV

SEQ ID NO: 2137603 - protein, 9 aa, Cryptosporidium hominis
DHESDQNMK

SEQ ID NO: 2137604 - protein, 7 aa, Cryptosporidium hominis
DHETEVK

SEQ ID NO: 2137605 - protein, 15 aa, Cryptosporidium hominis
DHGPASTVVSSPTPC

SEQ ID NO: 2137606 - protein, 5 aa, Cryptosporidium hominis
DHGRI

SEQ ID NO: 2137607 - protein, 7 aa, Cryptosporidium hominis
DHKIKQD

SEQ ID NO: 2137608 - protein, 14 aa, Cryptosporidium hominis
DHKQTDQHVEERQQ

SEQ ID NO: 2137609 - protein, 27 aa, Cryptosporidium hominis
DHLDQESVNNIKSDSLSNLETFNKVKT

SEQ ID NO: 2137610 - protein, 7 aa, Cryptosporidium hominis
DHLTSQA

SEQ ID NO: 2137611 - protein, 7 aa, Cryptosporidium hominis
DHNNHGF

SEQ ID NO: 2137612 - protein, 8 aa, Cryptosporidium hominis
DHNNSELA

SEQ ID NO: 2137613 - protein, 14 aa, Cryptosporidium hominis
DHNQSSKKCLPKCY

SEQ ID NO: 2137614 - protein, 20 aa, Cryptosporidium hominis
DHNYNENNDCDDNNNDNNNY

SEQ ID NO: 2137615 - protein, 5 aa, Cryptosporidium hominis
DHPGL

SEQ ID NO: 2137616 - protein, 10 aa, Cryptosporidium hominis
DHPHGGGNHQ

SEQ ID NO: 2137617 - protein, 20 aa, Cryptosporidium hominis
DHPPITPVRSATQNDLDGDS

SEQ ID NO: 2137618 - protein, 6 aa, Cryptosporidium hominis
DHRSAP

SEQ ID NO: 2137619 - protein, 5 aa, Cryptosporidium hominis
DHSGE

SEQ ID NO: 2137620 - protein, 6 aa, Cryptosporidium hominis
DHSNSI

SEQ ID NO: 2137621 - protein, 5 aa, Cryptosporidium hominis
DHSNT

SEQ ID NO: 2137622 - protein, 9 aa, Cryptosporidium hominis
DHSQNNSQN

SEQ ID NO: 2137623 - protein, 5 aa, Cryptosporidium hominis
DHSQV

SEQ ID NO: 2137624 - protein, 5 aa, Cryptosporidium hominis
DHSSD

SEQ ID NO: 2137625 - protein, 13 aa, Cryptosporidium hominis
DHTEGAGSSKTSF

SEQ ID NO: 2137626 - protein, 9 aa, Cryptosporidium hominis
DHTERIQNS

SEQ ID NO: 2137627 - protein, 6 aa, Cryptosporidium hominis
DHTQGL

SEQ ID NO: 2137628 - protein, 6 aa, Cryptosporidium hominis
DHTSGI

SEQ ID NO: 2137629 - protein, 7 aa, Cryptosporidium hominis
DHVGSKQ

SEQ ID NO: 2137630 - protein, 11 aa, Cryptosporidium hominis
DHYEESGAEDI

SEQ ID NO: 2137631 - protein, 14 aa, Cryptosporidium hominis
DHYKQQNPSSETRY

SEQ ID NO: 2137632 - protein, 8 aa, Cryptosporidium hominis
DHYNKESS

SEQ ID NO: 2137633 - protein, 5 aa, Cryptosporidium hominis
DIDNA

SEQ ID NO: 2137634 - protein, 7 aa, Cryptosporidium hominis
DIDNDEG

SEQ ID NO: 2137635 - protein, 10 aa, Cryptosporidium hominis
DIDNDPDPKV

SEQ ID NO: 2137636 - protein, 5 aa, Cryptosporidium hominis
DIDQI

SEQ ID NO: 2137637 - protein, 26 aa, Cryptosporidium hominis
DIDSNDQKNETKKDLCENGKSMHEED

SEQ ID NO: 2137638 - protein, 5 aa, Cryptosporidium hominis
DIEDV

SEQ ID NO: 2137639 - protein, 6 aa, Cryptosporidium hominis
DIEKEE

SEQ ID NO: 2137640 - protein, 11 aa, Cryptosporidium hominis
DIENNEEMDSK

SEQ ID NO: 2137641 - protein, 12 aa, Cryptosporidium hominis
DIEPTRSSRKLS

SEQ ID NO: 2137642 - protein, 35 aa, Cryptosporidium hominis
DIEREREGKHQKEREEESKSEKERERKEKKEIKAK

SEQ ID NO: 2137643 - protein, 9 aa, Cryptosporidium hominis
DIERETQKT

SEQ ID NO: 2137644 - protein, 13 aa, Cryptosporidium hominis
DIESINGKSSENI

SEQ ID NO: 2137645 - protein, 15 aa, Cryptosporidium hominis
DIESNGSSSNELIGE

SEQ ID NO: 2137646 - protein, 8 aa, Cryptosporidium hominis
DIESRPRK

SEQ ID NO: 2137647 - protein, 9 aa, Cryptosporidium hominis
DIESTSDKQ

SEQ ID NO: 2137648 - protein, 81 aa, Cryptosporidium hominis
DIGGANNGEMKDSTLSHNANHHTNSALGDHPNKGLKKSHDSSSGPNLSSNYNNSNNNNNQSMEESYQYSNSGRGSKSVKYE

SEQ ID NO: 2137649 - protein, 17 aa, Cryptosporidium hominis
DIGPESLEDNLRGPGSA

SEQ ID NO: 2137650 - protein, 6 aa, Cryptosporidium hominis
DIGTNV

SEQ ID NO: 2137651 - protein, 6 aa, Cryptosporidium hominis
DIKSNS

SEQ ID NO: 2137652 - protein, 9 aa, Cryptosporidium hominis
DILNQNKSE

SEQ ID NO: 2137653 - protein, 9 aa, Cryptosporidium hominis
DINDDKDSH

SEQ ID NO: 2137654 - protein, 6 aa, Cryptosporidium hominis
DINDEL

SEQ ID NO: 2137655 - protein, 4 aa, Cryptosporidium hominis
DINE

SEQ ID NO: 2137656 - protein, 5 aa, Cryptosporidium hominis
DINED

SEQ ID NO: 2137657 - protein, 9 aa, Cryptosporidium hominis
DINEDNSFR

SEQ ID NO: 2137658 - protein, 10 aa, Cryptosporidium hominis
DINNSDGSYL

SEQ ID NO: 2137659 - protein, 12 aa, Cryptosporidium hominis
DINYSDKQISRE

SEQ ID NO: 2137660 - protein, 23 aa, Cryptosporidium hominis
DIPDSNSLEKLDNDALDKREIQP

SEQ ID NO: 2137661 - protein, 5 aa, Cryptosporidium hominis
DIPEM

SEQ ID NO: 2137662 - protein, 7 aa, Cryptosporidium hominis
DIPNDKK

SEQ ID NO: 2137663 - protein, 9 aa, Cryptosporidium hominis
DIPNKEREY

SEQ ID NO: 2137664 - protein, 22 aa, Cryptosporidium hominis
DIPNQTNNSSSIQSATQQPNIP

SEQ ID NO: 2137665 - protein, 10 aa, Cryptosporidium hominis
DIPPSTQKGV

SEQ ID NO: 2137666 - protein, 9 aa, Cryptosporidium hominis
DIPRKKNAD

SEQ ID NO: 2137667 - protein, 10 aa, Cryptosporidium hominis
DIPSENNSAL

SEQ ID NO: 2137668 - protein, 8 aa, Cryptosporidium hominis
DIPSPEKI

SEQ ID NO: 2137669 - protein, 7 aa, Cryptosporidium hominis
DIPSSIN

SEQ ID NO: 2137670 - protein, 7 aa, Cryptosporidium hominis
DIPTENN

SEQ ID NO: 2137671 - protein, 19 aa, Cryptosporidium hominis
DIPTKDQGVKSFDWISSLL

SEQ ID NO: 2137672 - protein, 7 aa, Cryptosporidium hominis
DIQDQAR

SEQ ID NO: 2137673 - protein, 9 aa, Cryptosporidium hominis
DIQGNEIPE

SEQ ID NO: 2137674 - protein, 8 aa, Cryptosporidium hominis
DIQGSNGV

SEQ ID NO: 2137675 - protein, 8 aa, Cryptosporidium hominis
DIQKGGSA

SEQ ID NO: 2137676 - protein, 5 aa, Cryptosporidium hominis
DIQNN

SEQ ID NO: 2137677 - protein, 8 aa, Cryptosporidium hominis
DIQPDSSN

SEQ ID NO: 2137678 - protein, 7 aa, Cryptosporidium hominis
DIRPKTD

SEQ ID NO: 2137679 - protein, 4 aa, Cryptosporidium hominis
DISD

SEQ ID NO: 2137680 - protein, 96 aa, Cryptosporidium hominis
DISDEDDDDLNDESFEPVKPTKSRERKGTGRGGRANSSKTSSNNATEGNNSSGEQDGNHNSAETSVDGTNTLSNGARQSKKRKSTNSNNSNTGDDI

SEQ ID NO: 2137681 - protein, 13 aa, Cryptosporidium hominis
DISDKSNKRFNGR

SEQ ID NO: 2137682 - protein, 5 aa, Cryptosporidium hominis
DISDS

SEQ ID NO: 2137683 - protein, 9 aa, Cryptosporidium hominis
DISDSQHDS

SEQ ID NO: 2137684 - protein, 6 aa, Cryptosporidium hominis
DISEGI

SEQ ID NO: 2137685 - protein, 22 aa, Cryptosporidium hominis
DISEKKKSKAIEKPDQEEQKME

SEQ ID NO: 2137686 - protein, 9 aa, Cryptosporidium hominis
DISENTEDV

SEQ ID NO: 2137687 - protein, 6 aa, Cryptosporidium hominis
DISGAD

SEQ ID NO: 2137688 - protein, 8 aa, Cryptosporidium hominis
DISKATSL

SEQ ID NO: 2137689 - protein, 7 aa, Cryptosporidium hominis
DISKSDQ

SEQ ID NO: 2137690 - protein, 9 aa, Cryptosporidium hominis
DISKTGAVS

SEQ ID NO: 2137691 - protein, 6 aa, Cryptosporidium hominis
DISNDT

SEQ ID NO: 2137692 - protein, 10 aa, Cryptosporidium hominis
DISQATESYL

SEQ ID NO: 2137693 - protein, 5 aa, Cryptosporidium hominis
DISSD

SEQ ID NO: 2137694 - protein, 24 aa, Cryptosporidium hominis
DISSPDTHIPSTNSLTADSPISED

SEQ ID NO: 2137695 - protein, 6 aa, Cryptosporidium hominis
DISSVQ

SEQ ID NO: 2137696 - protein, 5 aa, Cryptosporidium hominis
DITDN

SEQ ID NO: 2137697 - protein, 11 aa, Cryptosporidium hominis
DITHDEESRLS

SEQ ID NO: 2137698 - protein, 7 aa, Cryptosporidium hominis
DITNGSN

SEQ ID NO: 2137699 - protein, 10 aa, Cryptosporidium hominis
DITSDNKGDE

SEQ ID NO: 2137700 - protein, 17 aa, Cryptosporidium hominis
DITSGMSSRSKLKCNKF

SEQ ID NO: 2137701 - protein, 5 aa, Cryptosporidium hominis
DITSI

SEQ ID NO: 2137702 - protein, 5 aa, Cryptosporidium hominis
DITYD

SEQ ID NO: 2137703 - protein, 6 aa, Cryptosporidium hominis
DIYSKG

SEQ ID NO: 2137704 - protein, 20 aa, Cryptosporidium hominis
DKAEKTSQVTPSDADIETRV

SEQ ID NO: 2137705 - protein, 4 aa, Cryptosporidium hominis
DKAL

SEQ ID NO: 2137706 - protein, 24 aa, Cryptosporidium hominis
DKAPGKSNLRKKEGRNARISQRED

SEQ ID NO: 2137707 - protein, 10 aa, Cryptosporidium hominis
DKAQESNTKR

SEQ ID NO: 2137708 - protein, 4 aa, Cryptosporidium hominis
DKCD

SEQ ID NO: 2137709 - protein, 13 aa, Cryptosporidium hominis
DKCEEGNKGFKQR

SEQ ID NO: 2137710 - protein, 6 aa, Cryptosporidium hominis
DKCEVA

SEQ ID NO: 2137711 - protein, 8 aa, Cryptosporidium hominis
DKDDTKPK

SEQ ID NO: 2137712 - protein, 8 aa, Cryptosporidium hominis
DKDDYDDD

SEQ ID NO: 2137713 - protein, 10 aa, Cryptosporidium hominis
DKDGGLTSTT

SEQ ID NO: 2137714 - protein, 11 aa, Cryptosporidium hominis
DKDGNGLGKAG

SEQ ID NO: 2137715 - protein, 9 aa, Cryptosporidium hominis
DKDGSISGS

SEQ ID NO: 2137716 - protein, 6 aa, Cryptosporidium hominis
DKDIER

SEQ ID NO: 2137717 - protein, 24 aa, Cryptosporidium hominis
DKDKLAQKLEEEDKEKIKEALKDA

SEQ ID NO: 2137718 - protein, 8 aa, Cryptosporidium hominis
DKDNPDHK

SEQ ID NO: 2137719 - protein, 8 aa, Cryptosporidium hominis
DKDNQGKC

SEQ ID NO: 2137720 - protein, 19 aa, Cryptosporidium hominis
DKDNSKEGEDTDMGENGKG

SEQ ID NO: 2137721 - protein, 20 aa, Cryptosporidium hominis
DKDNYNRNTKESSKINENGY

SEQ ID NO: 2137722 - protein, 4 aa, Cryptosporidium hominis
DKDP

SEQ ID NO: 2137723 - protein, 9 aa, Cryptosporidium hominis
DKDSDGKVS

SEQ ID NO: 2137724 - protein, 7 aa, Cryptosporidium hominis
DKDTKRK

SEQ ID NO: 2137725 - protein, 15 aa, Cryptosporidium hominis
DKEENDENLEYNGQD

SEQ ID NO: 2137726 - protein, 4 aa, Cryptosporidium hominis
DKEF

SEQ ID NO: 2137727 - protein, 5 aa, Cryptosporidium hominis
DKEFS

SEQ ID NO: 2137728 - protein, 9 aa, Cryptosporidium hominis
DKEGKIPQG

SEQ ID NO: 2137729 - protein, 5 aa, Cryptosporidium hominis
DKEGN

SEQ ID NO: 2137730 - protein, 5 aa, Cryptosporidium hominis
DKEGR

SEQ ID NO: 2137731 - protein, 13 aa, Cryptosporidium hominis
DKEINSLKSENQE

SEQ ID NO: 2137732 - protein, 6 aa, Cryptosporidium hominis
DKEKDL

SEQ ID NO: 2137733 - protein, 7 aa, Cryptosporidium hominis
DKEKNPD

SEQ ID NO: 2137734 - protein, 8 aa, Cryptosporidium hominis
DKEKRNIY

SEQ ID NO: 2137735 - protein, 5 aa, Cryptosporidium hominis
DKENK

SEQ ID NO: 2137736 - protein, 13 aa, Cryptosporidium hominis
DKENSRKSNQGLF

SEQ ID NO: 2137737 - protein, 7 aa, Cryptosporidium hominis
DKEPWES

SEQ ID NO: 2137738 - protein, 6 aa, Cryptosporidium hominis
DKERKK

SEQ ID NO: 2137739 - protein, 6 aa, Cryptosporidium hominis
DKERYR

SEQ ID NO: 2137740 - protein, 7 aa, Cryptosporidium hominis
DKESEEI

SEQ ID NO: 2137741 - protein, 7 aa, Cryptosporidium hominis
DKESRID

SEQ ID NO: 2137742 - protein, 7 aa, Cryptosporidium hominis
DKESRKN

SEQ ID NO: 2137743 - protein, 15 aa, Cryptosporidium hominis
DKESSKYLSSNSKDN

SEQ ID NO: 2137744 - protein, 14 aa, Cryptosporidium hominis
DKETDNLEKNSDFT

SEQ ID NO: 2137745 - protein, 9 aa, Cryptosporidium hominis
DKETERNAT

SEQ ID NO: 2137746 - protein, 12 aa, Cryptosporidium hominis
DKETGTSKGEEM

SEQ ID NO: 2137747 - protein, 9 aa, Cryptosporidium hominis
DKETIEDTG

SEQ ID NO: 2137748 - protein, 8 aa, Cryptosporidium hominis
DKETKTSG

SEQ ID NO: 2137749 - protein, 7 aa, Cryptosporidium hominis
DKETNKY

SEQ ID NO: 2137750 - protein, 12 aa, Cryptosporidium hominis
DKFEDNEETRKK

SEQ ID NO: 2137751 - protein, 6 aa, Cryptosporidium hominis
DKFEGY

SEQ ID NO: 2137752 - protein, 18 aa, Cryptosporidium hominis
DKFNEEVSTKNKEFSEDR

SEQ ID NO: 2137753 - protein, 4 aa, Cryptosporidium hominis
DKFR

SEQ ID NO: 2137754 - protein, 5 aa, Cryptosporidium hominis
DKGDG

SEQ ID NO: 2137755 - protein, 8 aa, Cryptosporidium hominis
DKGDNYTF

SEQ ID NO: 2137756 - protein, 4 aa, Cryptosporidium hominis
DKGE

SEQ ID NO: 2137757 - protein, 7 aa, Cryptosporidium hominis
DKGNRIR

SEQ ID NO: 2137758 - protein, 6 aa, Cryptosporidium hominis
DKGPLQ

SEQ ID NO: 2137759 - protein, 10 aa, Cryptosporidium hominis
DKGPTKSGNY

SEQ ID NO: 2137760 - protein, 8 aa, Cryptosporidium hominis
DKGQLGMS

SEQ ID NO: 2137761 - protein, 5 aa, Cryptosporidium hominis
DKGRF

SEQ ID NO: 2137762 - protein, 7 aa, Cryptosporidium hominis
DKGTELA

SEQ ID NO: 2137763 - protein, 9 aa, Cryptosporidium hominis
DKGTGKSAL

SEQ ID NO: 2137764 - protein, 4 aa, Cryptosporidium hominis
DKHG

SEQ ID NO: 2137765 - protein, 13 aa, Cryptosporidium hominis
DKHGKPNEQTPES

SEQ ID NO: 2137766 - protein, 8 aa, Cryptosporidium hominis
DKHGSKTE

SEQ ID NO: 2137767 - protein, 4 aa, Cryptosporidium hominis
DKHI

SEQ ID NO: 2137768 - protein, 5 aa, Cryptosporidium hominis
DKIED

SEQ ID NO: 2137769 - protein, 13 aa, Cryptosporidium hominis
DKIFSKSKEHRAG

SEQ ID NO: 2137770 - protein, 14 aa, Cryptosporidium hominis
DKIKDSRNNSNLSF

SEQ ID NO: 2137771 - protein, 22 aa, Cryptosporidium hominis
DKIKERTDEELTAGSSTESKQI

SEQ ID NO: 2137772 - protein, 10 aa, Cryptosporidium hominis
DKIKNRRERF

SEQ ID NO: 2137773 - protein, 4 aa, Cryptosporidium hominis
DKIL

SEQ ID NO: 2137774 - protein, 6 aa, Cryptosporidium hominis
DKINKK

SEQ ID NO: 2137775 - protein, 6 aa, Cryptosporidium hominis
DKIPRE

SEQ ID NO: 2137776 - protein, 4 aa, Cryptosporidium hominis
DKIR

SEQ ID NO: 2137777 - protein, 7 aa, Cryptosporidium hominis
DKIRDYK

SEQ ID NO: 2137778 - protein, 7 aa, Cryptosporidium hominis
DKISDQS

SEQ ID NO: 2137779 - protein, 14 aa, Cryptosporidium hominis
DKISEPSNIPSSQQ

SEQ ID NO: 2137780 - protein, 6 aa, Cryptosporidium hominis
DKISQS

SEQ ID NO: 2137781 - protein, 21 aa, Cryptosporidium hominis
DKISSTGGDNEVDNSINPASD

SEQ ID NO: 2137782 - protein, 6 aa, Cryptosporidium hominis
DKITDQ

SEQ ID NO: 2137783 - protein, 4 aa, Cryptosporidium hominis
DKKA

SEQ ID NO: 2137784 - protein, 9 aa, Cryptosporidium hominis
DKKAKSGLS

SEQ ID NO: 2137785 - protein, 7 aa, Cryptosporidium hominis
DKKDLEV

SEQ ID NO: 2137786 - protein, 13 aa, Cryptosporidium hominis
DKKEGSDEDNDEF

SEQ ID NO: 2137787 - protein, 11 aa, Cryptosporidium hominis
DKKGGEPNKYS

SEQ ID NO: 2137788 - protein, 6 aa, Cryptosporidium hominis
DKKGKK

SEQ ID NO: 2137789 - protein, 6 aa, Cryptosporidium hominis
DKKGMT

SEQ ID NO: 2137790 - protein, 20 aa, Cryptosporidium hominis
DKKGSSPSPSNKQQRRMRRK

SEQ ID NO: 2137791 - protein, 8 aa, Cryptosporidium hominis
DKKGTGER

SEQ ID NO: 2137792 - protein, 7 aa, Cryptosporidium hominis
DKKINQY

SEQ ID NO: 2137793 - protein, 8 aa, Cryptosporidium hominis
DKKKEDSI

SEQ ID NO: 2137794 - protein, 6 aa, Cryptosporidium hominis
DKKKKK

SEQ ID NO: 2137795 - protein, 14 aa, Cryptosporidium hominis
DKKKTNSDTNPPKT

SEQ ID NO: 2137796 - protein, 14 aa, Cryptosporidium hominis
DKKNDKIIKQESEI

SEQ ID NO: 2137797 - protein, 10 aa, Cryptosporidium hominis
DKKNKKSKLN

SEQ ID NO: 2137798 - protein, 11 aa, Cryptosporidium hominis
DKKQEANEEET

SEQ ID NO: 2137799 - protein, 8 aa, Cryptosporidium hominis
DKKQEERT

SEQ ID NO: 2137800 - protein, 26 aa, Cryptosporidium hominis
DKKRELEEAKAREKLKQEEFEKEEKL

SEQ ID NO: 2137801 - protein, 4 aa, Cryptosporidium hominis
DKKS

SEQ ID NO: 2137802 - protein, 10 aa, Cryptosporidium hominis
DKKSLSSEEL

SEQ ID NO: 2137803 - protein, 7 aa, Cryptosporidium hominis
DKKSNDL

SEQ ID NO: 2137804 - protein, 6 aa, Cryptosporidium hominis
DKKSPL

SEQ ID NO: 2137805 - protein, 47 aa, Cryptosporidium hominis
DKKTARSLNEGDTKSQSNQENRAHSNSSITSNSKTNTRRPSSRIPHR

SEQ ID NO: 2137806 - protein, 11 aa, Cryptosporidium hominis
DKKTSTNKTRP

SEQ ID NO: 2137807 - protein, 4 aa, Cryptosporidium hominis
DKKY

SEQ ID NO: 2137808 - protein, 6 aa, Cryptosporidium hominis
DKKYSS

SEQ ID NO: 2137809 - protein, 6 aa, Cryptosporidium hominis
DKLARE

SEQ ID NO: 2137810 - protein, 13 aa, Cryptosporidium hominis
DKLDSNQLSRLKE

SEQ ID NO: 2137811 - protein, 6 aa, Cryptosporidium hominis
DKLESV

SEQ ID NO: 2137812 - protein, 18 aa, Cryptosporidium hominis
DKLGAANSVSDEDLDGNG

SEQ ID NO: 2137813 - protein, 35 aa, Cryptosporidium hominis
DKLGDTNKVSSLNKKKKTKIQDKKSDSTDGQHNLG

SEQ ID NO: 2137814 - protein, 5 aa, Cryptosporidium hominis
DKLGT

SEQ ID NO: 2137815 - protein, 7 aa, Cryptosporidium hominis
DKLRDTA

SEQ ID NO: 2137816 - protein, 7 aa, Cryptosporidium hominis
DKLSDRN

SEQ ID NO: 2137817 - protein, 7 aa, Cryptosporidium hominis
DKLSEET

SEQ ID NO: 2137818 - protein, 7 aa, Cryptosporidium hominis
DKLTSGH

SEQ ID NO: 2137819 - protein, 7 aa, Cryptosporidium hominis
DKMPETR

SEQ ID NO: 2137820 - protein, 9 aa, Cryptosporidium hominis
DKMPQDPPS

SEQ ID NO: 2137821 - protein, 8 aa, Cryptosporidium hominis
DKMRNSNK

SEQ ID NO: 2137822 - protein, 16 aa, Cryptosporidium hominis
DKNAVQKDKSGVKFTF

SEQ ID NO: 2137823 - protein, 4 aa, Cryptosporidium hominis
DKNF

SEQ ID NO: 2137824 - protein, 11 aa, Cryptosporidium hominis
DKNGDRITPNR

SEQ ID NO: 2137825 - protein, 7 aa, Cryptosporidium hominis
DKNGKEL

SEQ ID NO: 2137826 - protein, 6 aa, Cryptosporidium hominis
DKNGPI

SEQ ID NO: 2137827 - protein, 11 aa, Cryptosporidium hominis
DKNKEKDMDKG

SEQ ID NO: 2137828 - protein, 12 aa, Cryptosporidium hominis
DKNKKASKSERT

SEQ ID NO: 2137829 - protein, 8 aa, Cryptosporidium hominis
DKNKPTTN

SEQ ID NO: 2137830 - protein, 14 aa, Cryptosporidium hominis
DKNKQKDEQNKIEG

SEQ ID NO: 2137831 - protein, 12 aa, Cryptosporidium hominis
DKNKSQREQNNS

SEQ ID NO: 2137832 - protein, 13 aa, Cryptosporidium hominis
DKNKTLPKKYSKE

SEQ ID NO: 2137833 - protein, 9 aa, Cryptosporidium hominis
DKNMGNDRQ

SEQ ID NO: 2137834 - protein, 9 aa, Cryptosporidium hominis
DKNNGRPRG

SEQ ID NO: 2137835 - protein, 6 aa, Cryptosporidium hominis
DKNNNI

SEQ ID NO: 2137836 - protein, 7 aa, Cryptosporidium hominis
DKNNPDL

SEQ ID NO: 2137837 - protein, 17 aa, Cryptosporidium hominis
DKNPISSEASTSAPHYS

SEQ ID NO: 2137838 - protein, 10 aa, Cryptosporidium hominis
DKNQEDNQES

SEQ ID NO: 2137839 - protein, 6 aa, Cryptosporidium hominis
DKNQFE

SEQ ID NO: 2137840 - protein, 7 aa, Cryptosporidium hominis
DKNQSSQ

SEQ ID NO: 2137841 - protein, 8 aa, Cryptosporidium hominis
DKNQTSVV

SEQ ID NO: 2137842 - protein, 11 aa, Cryptosporidium hominis
DKNSPLKSSQF

SEQ ID NO: 2137843 - protein, 5 aa, Cryptosporidium hominis
DKNST

SEQ ID NO: 2137844 - protein, 8 aa, Cryptosporidium hominis
DKNSTIAG

SEQ ID NO: 2137845 - protein, 4 aa, Cryptosporidium hominis
DKNT

SEQ ID NO: 2137846 - protein, 7 aa, Cryptosporidium hominis
DKNTGNE

SEQ ID NO: 2137847 - protein, 7 aa, Cryptosporidium hominis
DKNTKNM

SEQ ID NO: 2137848 - protein, 9 aa, Cryptosporidium hominis
DKNTNKSNM

SEQ ID NO: 2137849 - protein, 8 aa, Cryptosporidium hominis
DKPDSSNA

SEQ ID NO: 2137850 - protein, 18 aa, Cryptosporidium hominis
DKPDVTYNDIGGAKEQLE

SEQ ID NO: 2137851 - protein, 5 aa, Cryptosporidium hominis
DKPKI

SEQ ID NO: 2137852 - protein, 9 aa, Cryptosporidium hominis
DKPLENNTD

SEQ ID NO: 2137853 - protein, 6 aa, Cryptosporidium hominis
DKPQKI

SEQ ID NO: 2137854 - protein, 7 aa, Cryptosporidium hominis
DKPSLKH

SEQ ID NO: 2137855 - protein, 21 aa, Cryptosporidium hominis
DKPTRGRYKQRYNNKRSRNGI

SEQ ID NO: 2137856 - protein, 7 aa, Cryptosporidium hominis
DKPVDTS

SEQ ID NO: 2137857 - protein, 6 aa, Cryptosporidium hominis
DKPYEE

SEQ ID NO: 2137858 - protein, 17 aa, Cryptosporidium hominis
DKPYQTPNSTLSNFGKE

SEQ ID NO: 2137859 - protein, 8 aa, Cryptosporidium hominis
DKQAENQD

SEQ ID NO: 2137860 - protein, 16 aa, Cryptosporidium hominis
DKQGSGNELDESTATQ

SEQ ID NO: 2137861 - protein, 7 aa, Cryptosporidium hominis
DKQNQES

SEQ ID NO: 2137862 - protein, 7 aa, Cryptosporidium hominis
DKQNSAL

SEQ ID NO: 2137863 - protein, 8 aa, Cryptosporidium hominis
DKQSGAQR

SEQ ID NO: 2137864 - protein, 7 aa, Cryptosporidium hominis
DKRDREE

SEQ ID NO: 2137865 - protein, 30 aa, Cryptosporidium hominis
DKRGKVASKTKCIPDKDSGWTKADQDPNTK

SEQ ID NO: 2137866 - protein, 8 aa, Cryptosporidium hominis
DKRGNSTV

SEQ ID NO: 2137867 - protein, 4 aa, Cryptosporidium hominis
DKRN

SEQ ID NO: 2137868 - protein, 10 aa, Cryptosporidium hominis
DKRNNQYSND

SEQ ID NO: 2137869 - protein, 5 aa, Cryptosporidium hominis
DKRQR

SEQ ID NO: 2137870 - protein, 5 aa, Cryptosporidium hominis
DKRYE

SEQ ID NO: 2137871 - protein, 10 aa, Cryptosporidium hominis
DKRYPDGIRR

SEQ ID NO: 2137872 - protein, 4 aa, Cryptosporidium hominis
DKSA

SEQ ID NO: 2137873 - protein, 7 aa, Cryptosporidium hominis
DKSAETE

SEQ ID NO: 2137874 - protein, 7 aa, Cryptosporidium hominis
DKSAFEK

SEQ ID NO: 2137875 - protein, 8 aa, Cryptosporidium hominis
DKSAGKVG

SEQ ID NO: 2137876 - protein, 27 aa, Cryptosporidium hominis
DKSDQLDEAPGSSNTMNQTTNLNNERY

SEQ ID NO: 2137877 - protein, 7 aa, Cryptosporidium hominis
DKSDSEE

SEQ ID NO: 2137878 - protein, 8 aa, Cryptosporidium hominis
DKSGGFGG

SEQ ID NO: 2137879 - protein, 9 aa, Cryptosporidium hominis
DKSGSGQVE

SEQ ID NO: 2137880 - protein, 5 aa, Cryptosporidium hominis
DKSHL

SEQ ID NO: 2137881 - protein, 8 aa, Cryptosporidium hominis
DKSHNFGD

SEQ ID NO: 2137882 - protein, 5 aa, Cryptosporidium hominis
DKSIH

SEQ ID NO: 2137883 - protein, 12 aa, Cryptosporidium hominis
DKSISPEKSDWD

SEQ ID NO: 2137884 - protein, 8 aa, Cryptosporidium hominis
DKSKDELT

SEQ ID NO: 2137885 - protein, 21 aa, Cryptosporidium hominis
DKSKQDKDLAAENKDALEEER

SEQ ID NO: 2137886 - protein, 7 aa, Cryptosporidium hominis
DKSKQGY

SEQ ID NO: 2137887 - protein, 18 aa, Cryptosporidium hominis
DKSLNNPDSLSNNISRNA

SEQ ID NO: 2137888 - protein, 9 aa, Cryptosporidium hominis
DKSLSSSTS

SEQ ID NO: 2137889 - protein, 9 aa, Cryptosporidium hominis
DKSNKSKKK

SEQ ID NO: 2137890 - protein, 18 aa, Cryptosporidium hominis
DKSNSKVSGEELNENRTT

SEQ ID NO: 2137891 - protein, 4 aa, Cryptosporidium hominis
DKSP

SEQ ID NO: 2137892 - protein, 5 aa, Cryptosporidium hominis
DKSPK

SEQ ID NO: 2137893 - protein, 7 aa, Cryptosporidium hominis
DKSPYSS

SEQ ID NO: 2137894 - protein, 8 aa, Cryptosporidium hominis
DKSRQSKS

SEQ ID NO: 2137895 - protein, 5 aa, Cryptosporidium hominis
DKSRV

SEQ ID NO: 2137896 - protein, 14 aa, Cryptosporidium hominis
DKSSGPNSEALPNP

SEQ ID NO: 2137897 - protein, 7 aa, Cryptosporidium hominis
DKSSKDF

SEQ ID NO: 2137898 - protein, 14 aa, Cryptosporidium hominis
DKSSNESYQSSKIN

SEQ ID NO: 2137899 - protein, 4 aa, Cryptosporidium hominis
DKST

SEQ ID NO: 2137900 - protein, 26 aa, Cryptosporidium hominis
DKSTENSLRKRAEKGSSNLPPLPRTE

SEQ ID NO: 2137901 - protein, 9 aa, Cryptosporidium hominis
DKSTGKKHE

SEQ ID NO: 2137902 - protein, 5 aa, Cryptosporidium hominis
DKSTI

SEQ ID NO: 2137903 - protein, 18 aa, Cryptosporidium hominis
DKSTSDSLDDSDDNKFDL

SEQ ID NO: 2137904 - protein, 6 aa, Cryptosporidium hominis
DKTAET

SEQ ID NO: 2137905 - protein, 7 aa, Cryptosporidium hominis
DKTGSIT

SEQ ID NO: 2137906 - protein, 9 aa, Cryptosporidium hominis
DKTKYNSPK

SEQ ID NO: 2137907 - protein, 9 aa, Cryptosporidium hominis
DKTLEGGRK

SEQ ID NO: 2137908 - protein, 9 aa, Cryptosporidium hominis
DKTNDSDGY

SEQ ID NO: 2137909 - protein, 8 aa, Cryptosporidium hominis
DKTNENTR

SEQ ID NO: 2137910 - protein, 30 aa, Cryptosporidium hominis
DKTPENKESNKEANQKSKTSKSKSEKKKEQ

SEQ ID NO: 2137911 - protein, 15 aa, Cryptosporidium hominis
DKTPGPKYPGGPTGR

SEQ ID NO: 2137912 - protein, 4 aa, Cryptosporidium hominis
DKTQ

SEQ ID NO: 2137913 - protein, 21 aa, Cryptosporidium hominis
DKTQSQSSGNNISKNNERYNR

SEQ ID NO: 2137914 - protein, 9 aa, Cryptosporidium hominis
DKTSHEKAR

SEQ ID NO: 2137915 - protein, 23 aa, Cryptosporidium hominis
DKTSNSSESTSKKRQNKTLSSNN

SEQ ID NO: 2137916 - protein, 6 aa, Cryptosporidium hominis
DKTSNV

SEQ ID NO: 2137917 - protein, 25 aa, Cryptosporidium hominis
DKTTRGEGGFGSTDKLDSVKGLPQK

SEQ ID NO: 2137918 - protein, 7 aa, Cryptosporidium hominis
DKTYEYN

SEQ ID NO: 2137919 - protein, 6 aa, Cryptosporidium hominis
DKVISS

SEQ ID NO: 2137920 - protein, 5 aa, Cryptosporidium hominis
DKVQS

SEQ ID NO: 2137921 - protein, 5 aa, Cryptosporidium hominis
DKVSQ

SEQ ID NO: 2137922 - protein, 19 aa, Cryptosporidium hominis
DKVSRIKAKDADLSGGRSD

SEQ ID NO: 2137923 - protein, 7 aa, Cryptosporidium hominis
DKVSSEK

SEQ ID NO: 2137924 - protein, 6 aa, Cryptosporidium hominis
DKYKKK

SEQ ID NO: 2137925 - protein, 5 aa, Cryptosporidium hominis
DKYLK

SEQ ID NO: 2137926 - protein, 8 aa, Cryptosporidium hominis
DKYNENDD

SEQ ID NO: 2137927 - protein, 5 aa, Cryptosporidium hominis
DKYNS

SEQ ID NO: 2137928 - protein, 7 aa, Cryptosporidium hominis
DKYNSKN

SEQ ID NO: 2137929 - protein, 11 aa, Cryptosporidium hominis
DLDAEKRRNNL

SEQ ID NO: 2137930 - protein, 33 aa, Cryptosporidium hominis
DLDGESDFAGEEGEEDDSEDEEDEEDEEDDEDD

SEQ ID NO: 2137931 - protein, 9 aa, Cryptosporidium hominis
DLDKPQSQN

SEQ ID NO: 2137932 - protein, 8 aa, Cryptosporidium hominis
DLDNEDSR

SEQ ID NO: 2137933 - protein, 6 aa, Cryptosporidium hominis
DLDNTN

SEQ ID NO: 2137934 - protein, 15 aa, Cryptosporidium hominis
DLEDDDDEDEFEPGD

SEQ ID NO: 2137935 - protein, 46 aa, Cryptosporidium hominis
DLEDGKERDNVQIQPQQKQAESTEHSSQLENKQPDAITGSESELKS

SEQ ID NO: 2137936 - protein, 6 aa, Cryptosporidium hominis
DLEEDN

SEQ ID NO: 2137937 - protein, 6 aa, Cryptosporidium hominis
DLEEGK

SEQ ID NO: 2137938 - protein, 38 aa, Cryptosporidium hominis
DLEENTKDLKGYSGDSEQVGINNTTNREEDENNLRNEP

SEQ ID NO: 2137939 - protein, 7 aa, Cryptosporidium hominis
DLEESEC

SEQ ID NO: 2137940 - protein, 12 aa, Cryptosporidium hominis
DLEESPKSGRNI

SEQ ID NO: 2137941 - protein, 5 aa, Cryptosporidium hominis
DLENY

SEQ ID NO: 2137942 - protein, 83 aa, Cryptosporidium hominis
DLEPEKEQEQEHQSEQEPEQELEHEPEQEPEQELEHEPDQYQDQEQKPEQEPEHQPEPNQDQERQPELEHQPELEQEPEPDLE

SEQ ID NO: 2137943 - protein, 19 aa, Cryptosporidium hominis
DLESSRTVDSETARNYAKE

SEQ ID NO: 2137944 - protein, 7 aa, Cryptosporidium hominis
DLETSNI

SEQ ID NO: 2137945 - protein, 7 aa, Cryptosporidium hominis
DLGDGNA

SEQ ID NO: 2137946 - protein, 9 aa, Cryptosporidium hominis
DLGKEKNIE

SEQ ID NO: 2137947 - protein, 10 aa, Cryptosporidium hominis
DLGRTSPSLG

SEQ ID NO: 2137948 - protein, 12 aa, Cryptosporidium hominis
DLGSETDESNGR

SEQ ID NO: 2137949 - protein, 13 aa, Cryptosporidium hominis
DLKEQSNPGNHHQ

SEQ ID NO: 2137950 - protein, 9 aa, Cryptosporidium hominis
DLKGQERSV

SEQ ID NO: 2137951 - protein, 17 aa, Cryptosporidium hominis
DLKNEIEKASNSNTDRR

SEQ ID NO: 2137952 - protein, 8 aa, Cryptosporidium hominis
DLKNGKHN

SEQ ID NO: 2137953 - protein, 6 aa, Cryptosporidium hominis
DLKSNT

SEQ ID NO: 2137954 - protein, 42 aa, Cryptosporidium hominis
DLNDDKDVEMSDQNRANSSSEIKPHSETQNRESDIVNDGSKS

SEQ ID NO: 2137955 - protein, 7 aa, Cryptosporidium hominis
DLNDNSE

SEQ ID NO: 2137956 - protein, 18 aa, Cryptosporidium hominis
DLNEPKKLGGEPSFPSLE

SEQ ID NO: 2137957 - protein, 10 aa, Cryptosporidium hominis
DLNHSNDEIN

SEQ ID NO: 2137958 - protein, 7 aa, Cryptosporidium hominis
DLNNDEP

SEQ ID NO: 2137959 - protein, 8 aa, Cryptosporidium hominis
DLNNNAKS

SEQ ID NO: 2137960 - protein, 15 aa, Cryptosporidium hominis
DLNNSKGGRGCGGHS

SEQ ID NO: 2137961 - protein, 8 aa, Cryptosporidium hominis
DLNNTKDL

SEQ ID NO: 2137962 - protein, 6 aa, Cryptosporidium hominis
DLNSKL

SEQ ID NO: 2137963 - protein, 11 aa, Cryptosporidium hominis
DLNSKSQQVGE

SEQ ID NO: 2137964 - protein, 7 aa, Cryptosporidium hominis
DLNSLNE

SEQ ID NO: 2137965 - protein, 7 aa, Cryptosporidium hominis
DLNSNKK

SEQ ID NO: 2137966 - protein, 5 aa, Cryptosporidium hominis
DLPAS

SEQ ID NO: 2137967 - protein, 4 aa, Cryptosporidium hominis
DLPE

SEQ ID NO: 2137968 - protein, 6 aa, Cryptosporidium hominis
DLPEAD

SEQ ID NO: 2137969 - protein, 5 aa, Cryptosporidium hominis
DLPED

SEQ ID NO: 2137970 - protein, 5 aa, Cryptosporidium hominis
DLPEG

SEQ ID NO: 2137971 - protein, 6 aa, Cryptosporidium hominis
DLPEKK

SEQ ID NO: 2137972 - protein, 12 aa, Cryptosporidium hominis
DLPGSADDEEMK

SEQ ID NO: 2137973 - protein, 7 aa, Cryptosporidium hominis
DLPKNEE

SEQ ID NO: 2137974 - protein, 6 aa, Cryptosporidium hominis
DLPKST

SEQ ID NO: 2137975 - protein, 7 aa, Cryptosporidium hominis
DLPPGQR

SEQ ID NO: 2137976 - protein, 5 aa, Cryptosporidium hominis
DLPPH

SEQ ID NO: 2137977 - protein, 11 aa, Cryptosporidium hominis
DLPRPNNNMDN

SEQ ID NO: 2137978 - protein, 46 aa, Cryptosporidium hominis
DLPSDDEDDEDFENDEDSYSSSGGSSDGDEEGGSEDDDEADDDDDD

SEQ ID NO: 2137979 - protein, 6 aa, Cryptosporidium hominis
DLPSEI

SEQ ID NO: 2137980 - protein, 16 aa, Cryptosporidium hominis
DLPTPPIKKEADTSIQ

SEQ ID NO: 2137981 - protein, 4 aa, Cryptosporidium hominis
DLPY

SEQ ID NO: 2137982 - protein, 11 aa, Cryptosporidium hominis
DLQDVKEEGKS

SEQ ID NO: 2137983 - protein, 13 aa, Cryptosporidium hominis
DLQEGLNEEERRK

SEQ ID NO: 2137984 - protein, 11 aa, Cryptosporidium hominis
DLQETEQPGLY

SEQ ID NO: 2137985 - protein, 5 aa, Cryptosporidium hominis
DLRNC

SEQ ID NO: 2137986 - protein, 4 aa, Cryptosporidium hominis
DLRQ

SEQ ID NO: 2137987 - protein, 17 aa, Cryptosporidium hominis
DLSDEKQKDFYNESGKD

SEQ ID NO: 2137988 - protein, 6 aa, Cryptosporidium hominis
DLSESS

SEQ ID NO: 2137989 - protein, 6 aa, Cryptosporidium hominis
DLSETH

SEQ ID NO: 2137990 - protein, 5 aa, Cryptosporidium hominis
DLSFD

SEQ ID NO: 2137991 - protein, 5 aa, Cryptosporidium hominis
DLSKD

SEQ ID NO: 2137992 - protein, 12 aa, Cryptosporidium hominis
DLSKNTGNLTEE

SEQ ID NO: 2137993 - protein, 14 aa, Cryptosporidium hominis
DLSNPNNKSIESKR

SEQ ID NO: 2137994 - protein, 29 aa, Cryptosporidium hominis
DLSPQKVDQGFSSPASNKLSSSDLSNQST

SEQ ID NO: 2137995 - protein, 12 aa, Cryptosporidium hominis
DLSRNNTFSKET

SEQ ID NO: 2137996 - protein, 20 aa, Cryptosporidium hominis
DLSRSEENCEDDKAGEKTTV

SEQ ID NO: 2137997 - protein, 7 aa, Cryptosporidium hominis
DLSSDRI

SEQ ID NO: 2137998 - protein, 8 aa, Cryptosporidium hominis
DLSSGLNT

SEQ ID NO: 2137999 - protein, 12 aa, Cryptosporidium hominis
DLSSNNKPKDYQ

SEQ ID NO: 2138000 - protein, 8 aa, Cryptosporidium hominis
DLSTTENN

SEQ ID NO: 2138001 - protein, 29 aa, Cryptosporidium hominis
DLSVKGKYSNESRNETSSSIQEIQNNEEF

SEQ ID NO: 2138002 - protein, 10 aa, Cryptosporidium hominis
DLTESRQKVG

SEQ ID NO: 2138003 - protein, 54 aa, Cryptosporidium hominis
DLTGTQSKDLPDLDGKAKSSISKASEIKKSPPAKKMNDIPNTEDLDQNKELTKT

SEQ ID NO: 2138004 - protein, 13 aa, Cryptosporidium hominis
DLTLSSSAEYNNF

SEQ ID NO: 2138005 - protein, 11 aa, Cryptosporidium hominis
DLTSGTESEEC

SEQ ID NO: 2138006 - protein, 16 aa, Cryptosporidium hominis
DLTTPTAKTSKEAVSG

SEQ ID NO: 2138007 - protein, 10 aa, Cryptosporidium hominis
DLYDGDDEEF

SEQ ID NO: 2138008 - protein, 4 aa, Cryptosporidium hominis
DLYE

SEQ ID NO: 2138009 - protein, 13 aa, Cryptosporidium hominis
DMDNSNKNNISEP

SEQ ID NO: 2138010 - protein, 11 aa, Cryptosporidium hominis
DMEEKDQGQRE

SEQ ID NO: 2138011 - protein, 5 aa, Cryptosporidium hominis
DMESK

SEQ ID NO: 2138012 - protein, 18 aa, Cryptosporidium hominis
DMESPEDFDEDDNSHFEQ

SEQ ID NO: 2138013 - protein, 11 aa, Cryptosporidium hominis
DMGGAGMKDPM

SEQ ID NO: 2138014 - protein, 7 aa, Cryptosporidium hominis
DMGKSQT

SEQ ID NO: 2138015 - protein, 4 aa, Cryptosporidium hominis
DMGP

SEQ ID NO: 2138016 - protein, 17 aa, Cryptosporidium hominis
DMKAEEANSDIGNDSEI

SEQ ID NO: 2138017 - protein, 6 aa, Cryptosporidium hominis
DMKRES

SEQ ID NO: 2138018 - protein, 11 aa, Cryptosporidium hominis
DMNDSQNIKRG

SEQ ID NO: 2138019 - protein, 4 aa, Cryptosporidium hominis
DMNG

SEQ ID NO: 2138020 - protein, 8 aa, Cryptosporidium hominis
DMNGDGTL

SEQ ID NO: 2138021 - protein, 5 aa, Cryptosporidium hominis
DMRQR

SEQ ID NO: 2138022 - protein, 9 aa, Cryptosporidium hominis
DMTDKSEEI

SEQ ID NO: 2138023 - protein, 5 aa, Cryptosporidium hominis
DMTNP

SEQ ID NO: 2138024 - protein, 13 aa, Cryptosporidium hominis
DMVTDSKKNSLSK

SEQ ID NO: 2138025 - protein, 8 aa, Cryptosporidium hominis
DNAAKIGN

SEQ ID NO: 2138026 - protein, 269 aa, Cryptosporidium hominis
DNANIKNNEQLDGQKDWEKDLKKDQEKKADEKQKDQKEGEKEVEKNAKKNQKKESENKDQDNDNKKREKEEADKAKTKEDVKKEVKKKDQKEGQKKEANIKDQEKDSKKETKIKDQEKDPKKDQKKDPKKETKIKDQEKDQKKDQEKDPKKDQKKDPKKETKIKDQEKDPKKDQKKDLKKETKRDQKEDPKKDEKKDLKNKSDQAKTKDKKDTKKDSGKEVQKKDSSSQNKAKYKENIEEDNITDSESDHKEKKNSKTKKNSSSSSKSI

SEQ ID NO: 2138027 - protein, 12 aa, Cryptosporidium hominis
DNANSKSSFNQD

SEQ ID NO: 2138028 - protein, 15 aa, Cryptosporidium hominis
DNANSRNNKANVDEI

SEQ ID NO: 2138029 - protein, 9 aa, Cryptosporidium hominis
DNDDKSSVV

SEQ ID NO: 2138030 - protein, 26 aa, Cryptosporidium hominis
DNDKLNNSSDNTNNTNNNSKIEDNEE

SEQ ID NO: 2138031 - protein, 8 aa, Cryptosporidium hominis
DNDLPNVG

SEQ ID NO: 2138032 - protein, 8 aa, Cryptosporidium hominis
DNDSCTDN

SEQ ID NO: 2138033 - protein, 16 aa, Cryptosporidium hominis
DNDSGSGKHKNKQIGD

SEQ ID NO: 2138034 - protein, 6 aa, Cryptosporidium hominis
DNDYAS

SEQ ID NO: 2138035 - protein, 8 aa, Cryptosporidium hominis
DNEDINSN

SEQ ID NO: 2138036 - protein, 7 aa, Cryptosporidium hominis
DNEDLSN

SEQ ID NO: 2138037 - protein, 6 aa, Cryptosporidium hominis
DNEEAC

SEQ ID NO: 2138038 - protein, 7 aa, Cryptosporidium hominis
DNEEDVR

SEQ ID NO: 2138039 - protein, 23 aa, Cryptosporidium hominis
DNEEHHSKRQNSQGRDFDEEDMN

SEQ ID NO: 2138040 - protein, 7 aa, Cryptosporidium hominis
DNEETFD

SEQ ID NO: 2138041 - protein, 6 aa, Cryptosporidium hominis
DNEFQR

SEQ ID NO: 2138042 - protein, 5 aa, Cryptosporidium hominis
DNEGN

SEQ ID NO: 2138043 - protein, 8 aa, Cryptosporidium hominis
DNEGNLNE

SEQ ID NO: 2138044 - protein, 8 aa, Cryptosporidium hominis
DNEISHDD

SEQ ID NO: 2138045 - protein, 7 aa, Cryptosporidium hominis
DNEITDE

SEQ ID NO: 2138046 - protein, 4 aa, Cryptosporidium hominis
DNEL

SEQ ID NO: 2138047 - protein, 23 aa, Cryptosporidium hominis
DNENIDNQNEYEDIDNSEEISQG

SEQ ID NO: 2138048 - protein, 14 aa, Cryptosporidium hominis
DNENSYLSNNDDLK

SEQ ID NO: 2138049 - protein, 8 aa, Cryptosporidium hominis
DNERQSES

SEQ ID NO: 2138050 - protein, 14 aa, Cryptosporidium hominis
DNESDRTCSADEVE

SEQ ID NO: 2138051 - protein, 8 aa, Cryptosporidium hominis
DNESEKTL

SEQ ID NO: 2138052 - protein, 21 aa, Cryptosporidium hominis
DNESSTQCKNNPKRRSSEHEY

SEQ ID NO: 2138053 - protein, 6 aa, Cryptosporidium hominis
DNESTY

SEQ ID NO: 2138054 - protein, 6 aa, Cryptosporidium hominis
DNETFS

SEQ ID NO: 2138055 - protein, 4 aa, Cryptosporidium hominis
DNFA

SEQ ID NO: 2138056 - protein, 5 aa, Cryptosporidium hominis
DNFED

SEQ ID NO: 2138057 - protein, 14 aa, Cryptosporidium hominis
DNFEENQPKTLEER

SEQ ID NO: 2138058 - protein, 4 aa, Cryptosporidium hominis
DNFG

SEQ ID NO: 2138059 - protein, 10 aa, Cryptosporidium hominis
DNGENNKQIS

SEQ ID NO: 2138060 - protein, 7 aa, Cryptosporidium hominis
DNGEPTC

SEQ ID NO: 2138061 - protein, 9 aa, Cryptosporidium hominis
DNGGSTNNK

SEQ ID NO: 2138062 - protein, 8 aa, Cryptosporidium hominis
DNGHNGNV

SEQ ID NO: 2138063 - protein, 6 aa, Cryptosporidium hominis
DNGKEF

SEQ ID NO: 2138064 - protein, 28 aa, Cryptosporidium hominis
DNGLGKNNSSPNDTHKSSTQSNQNKDSL

SEQ ID NO: 2138065 - protein, 4 aa, Cryptosporidium hominis
DNGQ

SEQ ID NO: 2138066 - protein, 7 aa, Cryptosporidium hominis
DNGSGTI

SEQ ID NO: 2138067 - protein, 10 aa, Cryptosporidium hominis
DNGSKQDEKL

SEQ ID NO: 2138068 - protein, 17 aa, Cryptosporidium hominis
DNGTGFKRSTRSRTMDD

SEQ ID NO: 2138069 - protein, 5 aa, Cryptosporidium hominis
DNGYK

SEQ ID NO: 2138070 - protein, 12 aa, Cryptosporidium hominis
DNIADENSSLEW

SEQ ID NO: 2138071 - protein, 17 aa, Cryptosporidium hominis
DNIEDTINKKNDLDQDV

SEQ ID NO: 2138072 - protein, 9 aa, Cryptosporidium hominis
DNIEQNTDF

SEQ ID NO: 2138073 - protein, 6 aa, Cryptosporidium hominis
DNIGNR

SEQ ID NO: 2138074 - protein, 8 aa, Cryptosporidium hominis
DNIGSRLR

SEQ ID NO: 2138075 - protein, 6 aa, Cryptosporidium hominis
DNINNS

SEQ ID NO: 2138076 - protein, 7 aa, Cryptosporidium hominis
DNINPEN

SEQ ID NO: 2138077 - protein, 11 aa, Cryptosporidium hominis
DNINSEKEEIK

SEQ ID NO: 2138078 - protein, 6 aa, Cryptosporidium hominis
DNIPKI

SEQ ID NO: 2138079 - protein, 8 aa, Cryptosporidium hominis
DNIPSENE

SEQ ID NO: 2138080 - protein, 36 aa, Cryptosporidium hominis
DNIQDPNNFEQDLGETQEDERNEFQVPDENKVLENS

SEQ ID NO: 2138081 - protein, 13 aa, Cryptosporidium hominis
DNIRRVGNNDTIN

SEQ ID NO: 2138082 - protein, 6 aa, Cryptosporidium hominis
DNISDT

SEQ ID NO: 2138083 - protein, 13 aa, Cryptosporidium hominis
DNISSYKSGDAGL

SEQ ID NO: 2138084 - protein, 4 aa, Cryptosporidium hominis
DNIT

SEQ ID NO: 2138085 - protein, 10 aa, Cryptosporidium hominis
DNKAYPNKGN

SEQ ID NO: 2138086 - protein, 5 aa, Cryptosporidium hominis
DNKDS

SEQ ID NO: 2138087 - protein, 11 aa, Cryptosporidium hominis
DNKESKTPRKI

SEQ ID NO: 2138088 - protein, 9 aa, Cryptosporidium hominis
DNKEYSGDI

SEQ ID NO: 2138089 - protein, 8 aa, Cryptosporidium hominis
DNKGSYDG

SEQ ID NO: 2138090 - protein, 6 aa, Cryptosporidium hominis
DNKIPK

SEQ ID NO: 2138091 - protein, 13 aa, Cryptosporidium hominis
DNKISNKDLEDLD

SEQ ID NO: 2138092 - protein, 10 aa, Cryptosporidium hominis
DNKKDQLSRI

SEQ ID NO: 2138093 - protein, 75 aa, Cryptosporidium hominis
DNKNEKDGDGDGDGDGDGDGDGEEETTTSTTTTTTTTTTTTTTTTTTTTTTTTTTTTTTTTTTTTTSSTTTTTEM

SEQ ID NO: 2138094 - protein, 11 aa, Cryptosporidium hominis
DNKNGNTEANS

SEQ ID NO: 2138095 - protein, 16 aa, Cryptosporidium hominis
DNKNYPPNGNGFNSRN

SEQ ID NO: 2138096 - protein, 8 aa, Cryptosporidium hominis
DNKRQENT

SEQ ID NO: 2138097 - protein, 19 aa, Cryptosporidium hominis
DNKRTHNSSLDSQASTMDS

SEQ ID NO: 2138098 - protein, 14 aa, Cryptosporidium hominis
DNKRTLKGASKKIY

SEQ ID NO: 2138099 - protein, 16 aa, Cryptosporidium hominis
DNKSLNDESNKNVGES

SEQ ID NO: 2138100 - protein, 6 aa, Cryptosporidium hominis
DNKSRL

SEQ ID NO: 2138101 - protein, 7 aa, Cryptosporidium hominis
DNKSSGF

SEQ ID NO: 2138102 - protein, 8 aa, Cryptosporidium hominis
DNLHSSDE

SEQ ID NO: 2138103 - protein, 8 aa, Cryptosporidium hominis
DNLKTGTA

SEQ ID NO: 2138104 - protein, 11 aa, Cryptosporidium hominis
DNLNNSSNSNH

SEQ ID NO: 2138105 - protein, 8 aa, Cryptosporidium hominis
DNLNQVPE

SEQ ID NO: 2138106 - protein, 23 aa, Cryptosporidium hominis
DNLPTSNRLNGEKTPRKLPPGAE

SEQ ID NO: 2138107 - protein, 25 aa, Cryptosporidium hominis
DNLSREKKLDGDKELRQSCNQKRKH

SEQ ID NO: 2138108 - protein, 6 aa, Cryptosporidium hominis
DNLSTT

SEQ ID NO: 2138109 - protein, 24 aa, Cryptosporidium hominis
DNMKKETNSINNKKHKDIGELDGG

SEQ ID NO: 2138110 - protein, 4 aa, Cryptosporidium hominis
DNMR

SEQ ID NO: 2138111 - protein, 8 aa, Cryptosporidium hominis
DNNDDNLV

SEQ ID NO: 2138112 - protein, 27 aa, Cryptosporidium hominis
DNNEESKSKDKSKAEESPGKRKTIDSK

SEQ ID NO: 2138113 - protein, 10 aa, Cryptosporidium hominis
DNNEKYNESS

SEQ ID NO: 2138114 - protein, 32 aa, Cryptosporidium hominis
DNNHSDNFGNKKQEKVELDEEKGKKGKGFSSK

SEQ ID NO: 2138115 - protein, 4 aa, Cryptosporidium hominis
DNNI

SEQ ID NO: 2138116 - protein, 13 aa, Cryptosporidium hominis
DNNINSNNLNPNM

SEQ ID NO: 2138117 - protein, 10 aa, Cryptosporidium hominis
DNNKELESDK

SEQ ID NO: 2138118 - protein, 8 aa, Cryptosporidium hominis
DNNKSNHN

SEQ ID NO: 2138119 - protein, 14 aa, Cryptosporidium hominis
DNNKSRSSRRPYTT

SEQ ID NO: 2138120 - protein, 5 aa, Cryptosporidium hominis
DNNLS

SEQ ID NO: 2138121 - protein, 56 aa, Cryptosporidium hominis
DNNNDGISNASSSHKNQIHSTDSKSGSSPSGFKSDYNNRRRSISGGGKQTTENNDL

SEQ ID NO: 2138122 - protein, 21 aa, Cryptosporidium hominis
DNNNNGNESNQVNIENSTDNN

SEQ ID NO: 2138123 - protein, 13 aa, Cryptosporidium hominis
DNNNNNNNNNDHH

SEQ ID NO: 2138124 - protein, 11 aa, Cryptosporidium hominis
DNNNNNNNNNI

SEQ ID NO: 2138125 - protein, 4 aa, Cryptosporidium hominis
DNNP

SEQ ID NO: 2138126 - protein, 6 aa, Cryptosporidium hominis
DNNQQN

SEQ ID NO: 2138127 - protein, 30 aa, Cryptosporidium hominis
DNNSDHQLETSDYEQEPNDFNDSNNIDDHN

SEQ ID NO: 2138128 - protein, 16 aa, Cryptosporidium hominis
DNNSLEKQFQQNSTIS

SEQ ID NO: 2138129 - protein, 8 aa, Cryptosporidium hominis
DNNSSIDA

SEQ ID NO: 2138130 - protein, 8 aa, Cryptosporidium hominis
DNNSSTET

SEQ ID NO: 2138131 - protein, 9 aa, Cryptosporidium hominis
DNNTGKPRP

SEQ ID NO: 2138132 - protein, 13 aa, Cryptosporidium hominis
DNNTPEKHEKRDS

SEQ ID NO: 2138133 - protein, 9 aa, Cryptosporidium hominis
DNNTPSTKV

SEQ ID NO: 2138134 - protein, 7 aa, Cryptosporidium hominis
DNNTSSS

SEQ ID NO: 2138135 - protein, 14 aa, Cryptosporidium hominis
DNNTTDLPENNGSH

SEQ ID NO: 2138136 - protein, 104 aa, Cryptosporidium hominis
DNPDNNSNEGNHLNQNTKKTSKSTHNTNKKANTKSTNSKNSRKKKKYEDEFEDDYNAEEESIDEYSEYDESDDSRDLNTKRRKNAKNQKKKQNDDDDDDDDDEY

SEQ ID NO: 2138137 - protein, 4 aa, Cryptosporidium hominis
DNPE

SEQ ID NO: 2138138 - protein, 7 aa, Cryptosporidium hominis
DNPEENQ

SEQ ID NO: 2138139 - protein, 7 aa, Cryptosporidium hominis
DNPESNK

SEQ ID NO: 2138140 - protein, 8 aa, Cryptosporidium hominis
DNPETIQD

SEQ ID NO: 2138141 - protein, 5 aa, Cryptosporidium hominis
DNPIK

SEQ ID NO: 2138142 - protein, 5 aa, Cryptosporidium hominis
DNPKL

SEQ ID NO: 2138143 - protein, 6 aa, Cryptosporidium hominis
DNPQNY

SEQ ID NO: 2138144 - protein, 21 aa, Cryptosporidium hominis
DNPWNTKTGNNINSNLRREDH

SEQ ID NO: 2138145 - protein, 4 aa, Cryptosporidium hominis
DNQA

SEQ ID NO: 2138146 - protein, 8 aa, Cryptosporidium hominis
DNQDNDQI

SEQ ID NO: 2138147 - protein, 7 aa, Cryptosporidium hominis
DNQEHTQ

SEQ ID NO: 2138148 - protein, 7 aa, Cryptosporidium hominis
DNQENSM

SEQ ID NO: 2138149 - protein, 6 aa, Cryptosporidium hominis
DNQESA

SEQ ID NO: 2138150 - protein, 12 aa, Cryptosporidium hominis
DNQKIASEWRTF

SEQ ID NO: 2138151 - protein, 7 aa, Cryptosporidium hominis
DNQNSDI

SEQ ID NO: 2138152 - protein, 10 aa, Cryptosporidium hominis
DNQPNANSNF

SEQ ID NO: 2138153 - protein, 5 aa, Cryptosporidium hominis
DNQQI

SEQ ID NO: 2138154 - protein, 8 aa, Cryptosporidium hominis
DNQQNNIE

SEQ ID NO: 2138155 - protein, 15 aa, Cryptosporidium hominis
DNQRKKFGKSPPKVV

SEQ ID NO: 2138156 - protein, 10 aa, Cryptosporidium hominis
DNQRRSKTFS

SEQ ID NO: 2138157 - protein, 14 aa, Cryptosporidium hominis
DNQSASEYEFPKPQ

SEQ ID NO: 2138158 - protein, 6 aa, Cryptosporidium hominis
DNQSEI

SEQ ID NO: 2138159 - protein, 25 aa, Cryptosporidium hominis
DNQSGNLEPGKYNPKDLNEKQGIQE

SEQ ID NO: 2138160 - protein, 9 aa, Cryptosporidium hominis
DNRKKGKPD

SEQ ID NO: 2138161 - protein, 23 aa, Cryptosporidium hominis
DNRVSGGGARCRTGRKRRSSRVD

SEQ ID NO: 2138162 - protein, 29 aa, Cryptosporidium hominis
DNSATNFEDSQVGYSDQFSENENINRNSE

SEQ ID NO: 2138163 - protein, 5 aa, Cryptosporidium hominis
DNSDE

SEQ ID NO: 2138164 - protein, 9 aa, Cryptosporidium hominis
DNSDEIQSS

SEQ ID NO: 2138165 - protein, 6 aa, Cryptosporidium hominis
DNSDTL

SEQ ID NO: 2138166 - protein, 7 aa, Cryptosporidium hominis
DNSECNS

SEQ ID NO: 2138167 - protein, 5 aa, Cryptosporidium hominis
DNSEI

SEQ ID NO: 2138168 - protein, 8 aa, Cryptosporidium hominis
DNSEKSLS

SEQ ID NO: 2138169 - protein, 17 aa, Cryptosporidium hominis
DNSFNNTNKSYVSSPNV

SEQ ID NO: 2138170 - protein, 7 aa, Cryptosporidium hominis
DNSGGKN

SEQ ID NO: 2138171 - protein, 6 aa, Cryptosporidium hominis
DNSGLE

SEQ ID NO: 2138172 - protein, 7 aa, Cryptosporidium hominis
DNSHENA

SEQ ID NO: 2138173 - protein, 11 aa, Cryptosporidium hominis
DNSHEYKRQES

SEQ ID NO: 2138174 - protein, 9 aa, Cryptosporidium hominis
DNSHNVASE

SEQ ID NO: 2138175 - protein, 5 aa, Cryptosporidium hominis
DNSIS

SEQ ID NO: 2138176 - protein, 9 aa, Cryptosporidium hominis
DNSKSNTID

SEQ ID NO: 2138177 - protein, 7 aa, Cryptosporidium hominis
DNSLSHS

SEQ ID NO: 2138178 - protein, 12 aa, Cryptosporidium hominis
DNSNNDDNNNNK

SEQ ID NO: 2138179 - protein, 9 aa, Cryptosporidium hominis
DNSNNTEIN

SEQ ID NO: 2138180 - protein, 6 aa, Cryptosporidium hominis
DNSNQI

SEQ ID NO: 2138181 - protein, 6 aa, Cryptosporidium hominis
DNSPYI

SEQ ID NO: 2138182 - protein, 7 aa, Cryptosporidium hominis
DNSQISD

SEQ ID NO: 2138183 - protein, 7 aa, Cryptosporidium hominis
DNSQSCD

SEQ ID NO: 2138184 - protein, 19 aa, Cryptosporidium hominis
DNSQSYGQNYNQNQNHDDI

SEQ ID NO: 2138185 - protein, 10 aa, Cryptosporidium hominis
DNSREKNPSW

SEQ ID NO: 2138186 - protein, 9 aa, Cryptosporidium hominis
DNSRRSELE

SEQ ID NO: 2138187 - protein, 7 aa, Cryptosporidium hominis
DNSSHES

SEQ ID NO: 2138188 - protein, 9 aa, Cryptosporidium hominis
DNSSLRSAI

SEQ ID NO: 2138189 - protein, 8 aa, Cryptosporidium hominis
DNSTENRE

SEQ ID NO: 2138190 - protein, 7 aa, Cryptosporidium hominis
DNSTGIK

SEQ ID NO: 2138191 - protein, 5 aa, Cryptosporidium hominis
DNSVN

SEQ ID NO: 2138192 - protein, 5 aa, Cryptosporidium hominis
DNSYK

SEQ ID NO: 2138193 - protein, 5 aa, Cryptosporidium hominis
DNTDA

SEQ ID NO: 2138194 - protein, 10 aa, Cryptosporidium hominis
DNTDFKENNN

SEQ ID NO: 2138195 - protein, 8 aa, Cryptosporidium hominis
DNTGEYYS

SEQ ID NO: 2138196 - protein, 12 aa, Cryptosporidium hominis
DNTIPNNSTPGN

SEQ ID NO: 2138197 - protein, 7 aa, Cryptosporidium hominis
DNTKSYN

SEQ ID NO: 2138198 - protein, 4 aa, Cryptosporidium hominis
DNTL

SEQ ID NO: 2138199 - protein, 6 aa, Cryptosporidium hominis
DNTNNL

SEQ ID NO: 2138200 - protein, 6 aa, Cryptosporidium hominis
DNTNSM

SEQ ID NO: 2138201 - protein, 12 aa, Cryptosporidium hominis
DNTPKGSQYDSF

SEQ ID NO: 2138202 - protein, 12 aa, Cryptosporidium hominis
DNTPSTHFTESQ

SEQ ID NO: 2138203 - protein, 28 aa, Cryptosporidium hominis
DNTQTYSAREVRTEDNEIRHSSQYNSAN

SEQ ID NO: 2138204 - protein, 15 aa, Cryptosporidium hominis
DNTRFSSASDFNREE

SEQ ID NO: 2138205 - protein, 14 aa, Cryptosporidium hominis
DNTSASIRKQLQSG

SEQ ID NO: 2138206 - protein, 16 aa, Cryptosporidium hominis
DNTSKQKSKNKSNRDL

SEQ ID NO: 2138207 - protein, 8 aa, Cryptosporidium hominis
DNTSSKNH

SEQ ID NO: 2138208 - protein, 14 aa, Cryptosporidium hominis
DNTTSTQTTSSNSA

SEQ ID NO: 2138209 - protein, 5 aa, Cryptosporidium hominis
DNTVT

SEQ ID NO: 2138210 - protein, 7 aa, Cryptosporidium hominis
DNVRRDE

SEQ ID NO: 2138211 - protein, 4 aa, Cryptosporidium hominis
DNVS

SEQ ID NO: 2138212 - protein, 15 aa, Cryptosporidium hominis
DNYDGWNTENSKGVS

SEQ ID NO: 2138213 - protein, 4 aa, Cryptosporidium hominis
DNYG

SEQ ID NO: 2138214 - protein, 51 aa, Cryptosporidium hominis
DNYGNHSSRRENNQTRYEELGNNYKSTGQSDYNSFGPRNKRINTRSNPYSA

SEQ ID NO: 2138215 - protein, 4 aa, Cryptosporidium hominis
DNYN

SEQ ID NO: 2138216 - protein, 8 aa, Cryptosporidium hominis
DNYNPSKD

SEQ ID NO: 2138217 - protein, 8 aa, Cryptosporidium hominis
DNYSEQEK

SEQ ID NO: 2138218 - protein, 13 aa, Cryptosporidium hominis
DNYTGIQQAKKKS

SEQ ID NO: 2138219 - protein, 5 aa, Cryptosporidium hominis
DNYYN

SEQ ID NO: 2138220 - protein, 13 aa, Cryptosporidium hominis
DPAAENERPEEEI

SEQ ID NO: 2138221 - protein, 5 aa, Cryptosporidium hominis
DPAGG

SEQ ID NO: 2138222 - protein, 5 aa, Cryptosporidium hominis
DPAGN

SEQ ID NO: 2138223 - protein, 12 aa, Cryptosporidium hominis
DPARPNSNANEK

SEQ ID NO: 2138224 - protein, 11 aa, Cryptosporidium hominis
DPATGNKNPLK

SEQ ID NO: 2138225 - protein, 7 aa, Cryptosporidium hominis
DPDEDLE

SEQ ID NO: 2138226 - protein, 11 aa, Cryptosporidium hominis
DPDHPNKETNN

SEQ ID NO: 2138227 - protein, 10 aa, Cryptosporidium hominis
DPDNNYKSGL

SEQ ID NO: 2138228 - protein, 7 aa, Cryptosporidium hominis
DPDNPAL

SEQ ID NO: 2138229 - protein, 11 aa, Cryptosporidium hominis
DPDNSLRDRDD

SEQ ID NO: 2138230 - protein, 13 aa, Cryptosporidium hominis
DPDPDNRSKSYVN

SEQ ID NO: 2138231 - protein, 14 aa, Cryptosporidium hominis
DPDTGKEIDGPGSG

SEQ ID NO: 2138232 - protein, 7 aa, Cryptosporidium hominis
DPDTQNV

SEQ ID NO: 2138233 - protein, 7 aa, Cryptosporidium hominis
DPDYPPA

SEQ ID NO: 2138234 - protein, 15 aa, Cryptosporidium hominis
DPEASNDYSSNFEKS

SEQ ID NO: 2138235 - protein, 5 aa, Cryptosporidium hominis
DPEDS

SEQ ID NO: 2138236 - protein, 4 aa, Cryptosporidium hominis
DPEF

SEQ ID NO: 2138237 - protein, 14 aa, Cryptosporidium hominis
DPEGKTGPSKPLPD

SEQ ID NO: 2138238 - protein, 11 aa, Cryptosporidium hominis
DPEIPQKTSRT

SEQ ID NO: 2138239 - protein, 4 aa, Cryptosporidium hominis
DPEK

SEQ ID NO: 2138240 - protein, 15 aa, Cryptosporidium hominis
DPEKDVRGWGENDRG

SEQ ID NO: 2138241 - protein, 14 aa, Cryptosporidium hominis
DPEKHSQEFAQKIS

SEQ ID NO: 2138242 - protein, 8 aa, Cryptosporidium hominis
DPENDSRQ

SEQ ID NO: 2138243 - protein, 35 aa, Cryptosporidium hominis
DPENRIENSNNRKRSSIDHYPGSIQNSKPQDPNQY

SEQ ID NO: 2138244 - protein, 24 aa, Cryptosporidium hominis
DPENRNEQESQNDENSLSNDNSSI

SEQ ID NO: 2138245 - protein, 8 aa, Cryptosporidium hominis
DPENSTNL

SEQ ID NO: 2138246 - protein, 17 aa, Cryptosporidium hominis
DPENYHSTNLEKPCSEK

SEQ ID NO: 2138247 - protein, 8 aa, Cryptosporidium hominis
DPEQNWSK

SEQ ID NO: 2138248 - protein, 5 aa, Cryptosporidium hominis
DPERG

SEQ ID NO: 2138249 - protein, 8 aa, Cryptosporidium hominis
DPERRKEY

SEQ ID NO: 2138250 - protein, 11 aa, Cryptosporidium hominis
DPERRKRYDEY

SEQ ID NO: 2138251 - protein, 8 aa, Cryptosporidium hominis
DPESRCTA

SEQ ID NO: 2138252 - protein, 6 aa, Cryptosporidium hominis
DPETQV

SEQ ID NO: 2138253 - protein, 6 aa, Cryptosporidium hominis
DPETRK

SEQ ID NO: 2138254 - protein, 12 aa, Cryptosporidium hominis
DPFGKKSIKKDE

SEQ ID NO: 2138255 - protein, 7 aa, Cryptosporidium hominis
DPFPESS

SEQ ID NO: 2138256 - protein, 11 aa, Cryptosporidium hominis
DPFSKTPFANQ

SEQ ID NO: 2138257 - protein, 16 aa, Cryptosporidium hominis
DPFSQNKDNNKRKTRY

SEQ ID NO: 2138258 - protein, 6 aa, Cryptosporidium hominis
DPGIDS

SEQ ID NO: 2138259 - protein, 13 aa, Cryptosporidium hominis
DPGSVSYSQVGGL

SEQ ID NO: 2138260 - protein, 10 aa, Cryptosporidium hominis
DPGTKTISIN

SEQ ID NO: 2138261 - protein, 5 aa, Cryptosporidium hominis
DPGYS

SEQ ID NO: 2138262 - protein, 6 aa, Cryptosporidium hominis
DPHGNV

SEQ ID NO: 2138263 - protein, 4 aa, Cryptosporidium hominis
DPID

SEQ ID NO: 2138264 - protein, 7 aa, Cryptosporidium hominis
DPIEGVS

SEQ ID NO: 2138265 - protein, 13 aa, Cryptosporidium hominis
DPIKREDEEKMDD

SEQ ID NO: 2138266 - protein, 6 aa, Cryptosporidium hominis
DPISKV

SEQ ID NO: 2138267 - protein, 6 aa, Cryptosporidium hominis
DPISNH

SEQ ID NO: 2138268 - protein, 7 aa, Cryptosporidium hominis
DPISSNI

SEQ ID NO: 2138269 - protein, 7 aa, Cryptosporidium hominis
DPKDRGY

SEQ ID NO: 2138270 - protein, 5 aa, Cryptosporidium hominis
DPKEL

SEQ ID NO: 2138271 - protein, 9 aa, Cryptosporidium hominis
DPKGKPKGF

SEQ ID NO: 2138272 - protein, 6 aa, Cryptosporidium hominis
DPKGNT

SEQ ID NO: 2138273 - protein, 7 aa, Cryptosporidium hominis
DPKKEEL

SEQ ID NO: 2138274 - protein, 8 aa, Cryptosporidium hominis
DPKPFPPP

SEQ ID NO: 2138275 - protein, 8 aa, Cryptosporidium hominis
DPKPNPEN

SEQ ID NO: 2138276 - protein, 11 aa, Cryptosporidium hominis
DPKRRERENDY

SEQ ID NO: 2138277 - protein, 5 aa, Cryptosporidium hominis
DPKSG

SEQ ID NO: 2138278 - protein, 22 aa, Cryptosporidium hominis
DPKSYEEKSRDQKTKNTQSEDD

SEQ ID NO: 2138279 - protein, 8 aa, Cryptosporidium hominis
DPKTPIPI

SEQ ID NO: 2138280 - protein, 15 aa, Cryptosporidium hominis
DPKVDSTNNDSCTNV

SEQ ID NO: 2138281 - protein, 11 aa, Cryptosporidium hominis
DPLEKGSKTEE

SEQ ID NO: 2138282 - protein, 12 aa, Cryptosporidium hominis
DPLGASNPYGQT

SEQ ID NO: 2138283 - protein, 14 aa, Cryptosporidium hominis
DPLNPGQAPDPERW

SEQ ID NO: 2138284 - protein, 7 aa, Cryptosporidium hominis
DPNADPE

SEQ ID NO: 2138285 - protein, 8 aa, Cryptosporidium hominis
DPNDSHNE

SEQ ID NO: 2138286 - protein, 9 aa, Cryptosporidium hominis
DPNEPLPNP

SEQ ID NO: 2138287 - protein, 5 aa, Cryptosporidium hominis
DPNGE

SEQ ID NO: 2138288 - protein, 20 aa, Cryptosporidium hominis
DPNGVYEGDVNEKGLKHGNG

SEQ ID NO: 2138289 - protein, 9 aa, Cryptosporidium hominis
DPNIDDSTF

SEQ ID NO: 2138290 - protein, 9 aa, Cryptosporidium hominis
DPNLRPTPE

SEQ ID NO: 2138291 - protein, 4 aa, Cryptosporidium hominis
DPNN

SEQ ID NO: 2138292 - protein, 6 aa, Cryptosporidium hominis
DPNNPH

SEQ ID NO: 2138293 - protein, 8 aa, Cryptosporidium hominis
DPNPNTRW

SEQ ID NO: 2138294 - protein, 20 aa, Cryptosporidium hominis
DPNSKSAVKVPTGVDPTEVP

SEQ ID NO: 2138295 - protein, 7 aa, Cryptosporidium hominis
DPNSQNF

SEQ ID NO: 2138296 - protein, 8 aa, Cryptosporidium hominis
DPNSRLDQ

SEQ ID NO: 2138297 - protein, 6 aa, Cryptosporidium hominis
DPNTTL

SEQ ID NO: 2138298 - protein, 8 aa, Cryptosporidium hominis
DPPDDPRE

SEQ ID NO: 2138299 - protein, 7 aa, Cryptosporidium hominis
DPPGCKD

SEQ ID NO: 2138300 - protein, 4 aa, Cryptosporidium hominis
DPPK

SEQ ID NO: 2138301 - protein, 21 aa, Cryptosporidium hominis
DPPNSCENRLNPEQNQPSQSL

SEQ ID NO: 2138302 - protein, 6 aa, Cryptosporidium hominis
DPPPTT

SEQ ID NO: 2138303 - protein, 6 aa, Cryptosporidium hominis
DPPQSI

SEQ ID NO: 2138304 - protein, 6 aa, Cryptosporidium hominis
DPPRPS

SEQ ID NO: 2138305 - protein, 5 aa, Cryptosporidium hominis
DPPSL

SEQ ID NO: 2138306 - protein, 14 aa, Cryptosporidium hominis
DPPSQGKHSSIQQQ

SEQ ID NO: 2138307 - protein, 6 aa, Cryptosporidium hominis
DPPSSQ

SEQ ID NO: 2138308 - protein, 8 aa, Cryptosporidium hominis
DPPTAKDL

SEQ ID NO: 2138309 - protein, 5 aa, Cryptosporidium hominis
DPPTL

SEQ ID NO: 2138310 - protein, 4 aa, Cryptosporidium hominis
DPQC

SEQ ID NO: 2138311 - protein, 10 aa, Cryptosporidium hominis
DPQFKSGYKG

SEQ ID NO: 2138312 - protein, 5 aa, Cryptosporidium hominis
DPQND

SEQ ID NO: 2138313 - protein, 5 aa, Cryptosporidium hominis
DPQPS

SEQ ID NO: 2138314 - protein, 7 aa, Cryptosporidium hominis
DPQQGEA

SEQ ID NO: 2138315 - protein, 15 aa, Cryptosporidium hominis
DPQQKEGRSPSPRGV

SEQ ID NO: 2138316 - protein, 6 aa, Cryptosporidium hominis
DPQSKG

SEQ ID NO: 2138317 - protein, 8 aa, Cryptosporidium hominis
DPQTSNNK

SEQ ID NO: 2138318 - protein, 21 aa, Cryptosporidium hominis
DPQVETEDKQTAKKSIQEETS

SEQ ID NO: 2138319 - protein, 11 aa, Cryptosporidium hominis
DPRGNTIKRGT

SEQ ID NO: 2138320 - protein, 6 aa, Cryptosporidium hominis
DPRHGR

SEQ ID NO: 2138321 - protein, 9 aa, Cryptosporidium hominis
DPRKDPESR

SEQ ID NO: 2138322 - protein, 8 aa, Cryptosporidium hominis
DPRLQAPE

SEQ ID NO: 2138323 - protein, 7 aa, Cryptosporidium hominis
DPRLRPS

SEQ ID NO: 2138324 - protein, 5 aa, Cryptosporidium hominis
DPRMP

SEQ ID NO: 2138325 - protein, 5 aa, Cryptosporidium hominis
DPRNA

SEQ ID NO: 2138326 - protein, 6 aa, Cryptosporidium hominis
DPRTGR

SEQ ID NO: 2138327 - protein, 9 aa, Cryptosporidium hominis
DPSGTYTQY

SEQ ID NO: 2138328 - protein, 7 aa, Cryptosporidium hominis
DPSIELS

SEQ ID NO: 2138329 - protein, 8 aa, Cryptosporidium hominis
DPSKQIYG

SEQ ID NO: 2138330 - protein, 6 aa, Cryptosporidium hominis
DPSKSI

SEQ ID NO: 2138331 - protein, 5 aa, Cryptosporidium hominis
DPSLG

SEQ ID NO: 2138332 - protein, 8 aa, Cryptosporidium hominis
DPSNADAH

SEQ ID NO: 2138333 - protein, 9 aa, Cryptosporidium hominis
DPSNERQNE

SEQ ID NO: 2138334 - protein, 4 aa, Cryptosporidium hominis
DPSP

SEQ ID NO: 2138335 - protein, 26 aa, Cryptosporidium hominis
DPSPIRKKNQKEIKQRDELDESYSNK

SEQ ID NO: 2138336 - protein, 10 aa, Cryptosporidium hominis
DPSSNDGEPL

SEQ ID NO: 2138337 - protein, 4 aa, Cryptosporidium hominis
DPST

SEQ ID NO: 2138338 - protein, 7 aa, Cryptosporidium hominis
DPSTAKS

SEQ ID NO: 2138339 - protein, 6 aa, Cryptosporidium hominis
DPSTQH

SEQ ID NO: 2138340 - protein, 5 aa, Cryptosporidium hominis
DPSVK

SEQ ID NO: 2138341 - protein, 4 aa, Cryptosporidium hominis
DPSY

SEQ ID NO: 2138342 - protein, 8 aa, Cryptosporidium hominis
DPTADKRR

SEQ ID NO: 2138343 - protein, 8 aa, Cryptosporidium hominis
DPTARGSV

SEQ ID NO: 2138344 - protein, 8 aa, Cryptosporidium hominis
DPTDNDSL

SEQ ID NO: 2138345 - protein, 6 aa, Cryptosporidium hominis
DPTEAN

SEQ ID NO: 2138346 - protein, 8 aa, Cryptosporidium hominis
DPTEEEIN

SEQ ID NO: 2138347 - protein, 4 aa, Cryptosporidium hominis
DPTI

SEQ ID NO: 2138348 - protein, 6 aa, Cryptosporidium hominis
DPTNEN

SEQ ID NO: 2138349 - protein, 5 aa, Cryptosporidium hominis
DPTSN

SEQ ID NO: 2138350 - protein, 4 aa, Cryptosporidium hominis
DPTT

SEQ ID NO: 2138351 - protein, 4 aa, Cryptosporidium hominis
DPTV

SEQ ID NO: 2138352 - protein, 14 aa, Cryptosporidium hominis
DPVFNSESEDENVS

SEQ ID NO: 2138353 - protein, 44 aa, Cryptosporidium hominis
DPVGISTTTTTTTTTTTTTTTSTSTPGLDNTSSSTTTLPPDLSG

SEQ ID NO: 2138354 - protein, 8 aa, Cryptosporidium hominis
DPVKGGGL

SEQ ID NO: 2138355 - protein, 5 aa, Cryptosporidium hominis
DPVSS

SEQ ID NO: 2138356 - protein, 6 aa, Cryptosporidium hominis
DPWSPV

SEQ ID NO: 2138357 - protein, 7 aa, Cryptosporidium hominis
DPYASFT

SEQ ID NO: 2138358 - protein, 5 aa, Cryptosporidium hominis
DPYPE

SEQ ID NO: 2138359 - protein, 15 aa, Cryptosporidium hominis
DPYSDKRVSVDSTSL

SEQ ID NO: 2138360 - protein, 9 aa, Cryptosporidium hominis
DPYSKDDNA

SEQ ID NO: 2138361 - protein, 13 aa, Cryptosporidium hominis
DPYSQSIASNNDN

SEQ ID NO: 2138362 - protein, 8 aa, Cryptosporidium hominis
DQADSAKI

SEQ ID NO: 2138363 - protein, 18 aa, Cryptosporidium hominis
DQAEYKRMKTTGGTMDTS

SEQ ID NO: 2138364 - protein, 6 aa, Cryptosporidium hominis
DQAKLS

SEQ ID NO: 2138365 - protein, 37 aa, Cryptosporidium hominis
DQALNNDKDSTKESESSDNTNLSNSDLPENGDYDPSL

SEQ ID NO: 2138366 - protein, 5 aa, Cryptosporidium hominis
DQAQD

SEQ ID NO: 2138367 - protein, 6 aa, Cryptosporidium hominis
DQAVQS

SEQ ID NO: 2138368 - protein, 7 aa, Cryptosporidium hominis
DQDETKI

SEQ ID NO: 2138369 - protein, 5 aa, Cryptosporidium hominis
DQDGE

SEQ ID NO: 2138370 - protein, 9 aa, Cryptosporidium hominis
DQDGKAKYF

SEQ ID NO: 2138371 - protein, 5 aa, Cryptosporidium hominis
DQDGL

SEQ ID NO: 2138372 - protein, 7 aa, Cryptosporidium hominis
DQDMDEE

SEQ ID NO: 2138373 - protein, 10 aa, Cryptosporidium hominis
DQDNEGSATT

SEQ ID NO: 2138374 - protein, 12 aa, Cryptosporidium hominis
DQDPKKTEKKIS

SEQ ID NO: 2138375 - protein, 5 aa, Cryptosporidium hominis
DQDRG

SEQ ID NO: 2138376 - protein, 7 aa, Cryptosporidium hominis
DQDSTNV

SEQ ID NO: 2138377 - protein, 9 aa, Cryptosporidium hominis
DQDTATPYN

SEQ ID NO: 2138378 - protein, 17 aa, Cryptosporidium hominis
DQDTHNTLSQNNEQIEH

SEQ ID NO: 2138379 - protein, 6 aa, Cryptosporidium hominis
DQDTLE

SEQ ID NO: 2138380 - protein, 6 aa, Cryptosporidium hominis
DQDTVT

SEQ ID NO: 2138381 - protein, 7 aa, Cryptosporidium hominis
DQDYGSK

SEQ ID NO: 2138382 - protein, 5 aa, Cryptosporidium hominis
DQEAR

SEQ ID NO: 2138383 - protein, 10 aa, Cryptosporidium hominis
DQEDENDLNT

SEQ ID NO: 2138384 - protein, 55 aa, Cryptosporidium hominis
DQEEEEREEEEEEEEEDDDDDDDDDEDEQGHHNSRKKRSINTRKNNRKCSKRKRF

SEQ ID NO: 2138385 - protein, 8 aa, Cryptosporidium hominis
DQEETVNY

SEQ ID NO: 2138386 - protein, 11 aa, Cryptosporidium hominis
DQEEWTPVGDQ

SEQ ID NO: 2138387 - protein, 19 aa, Cryptosporidium hominis
DQEGNVKKKKLEKIRGTAR

SEQ ID NO: 2138388 - protein, 6 aa, Cryptosporidium hominis
DQEIDT

SEQ ID NO: 2138389 - protein, 8 aa, Cryptosporidium hominis
DQEKNSNS

SEQ ID NO: 2138390 - protein, 5 aa, Cryptosporidium hominis
DQENF

SEQ ID NO: 2138391 - protein, 9 aa, Cryptosporidium hominis
DQENGSNVK

SEQ ID NO: 2138392 - protein, 43 aa, Cryptosporidium hominis
DQEQEQEQKQEQEQKQEQEQEQEQEQEQEQEQEQEQEQEQEQV

SEQ ID NO: 2138393 - protein, 9 aa, Cryptosporidium hominis
DQEQKNDEV

SEQ ID NO: 2138394 - protein, 18 aa, Cryptosporidium hominis
DQEQSEEGINNDGGSYNK

SEQ ID NO: 2138395 - protein, 4 aa, Cryptosporidium hominis
DQER

SEQ ID NO: 2138396 - protein, 12 aa, Cryptosporidium hominis
DQEREERRRGRL

SEQ ID NO: 2138397 - protein, 6 aa, Cryptosporidium hominis
DQFKKE

SEQ ID NO: 2138398 - protein, 4 aa, Cryptosporidium hominis
DQGG

SEQ ID NO: 2138399 - protein, 7 aa, Cryptosporidium hominis
DQGGEQL

SEQ ID NO: 2138400 - protein, 5 aa, Cryptosporidium hominis
DQGQL

SEQ ID NO: 2138401 - protein, 7 aa, Cryptosporidium hominis
DQGSEKY

SEQ ID NO: 2138402 - protein, 7 aa, Cryptosporidium hominis
DQGSKKC

SEQ ID NO: 2138403 - protein, 4 aa, Cryptosporidium hominis
DQGY

SEQ ID NO: 2138404 - protein, 10 aa, Cryptosporidium hominis
DQIPSSVKSY

SEQ ID NO: 2138405 - protein, 15 aa, Cryptosporidium hominis
DQKDDEKEGFGEDEM

SEQ ID NO: 2138406 - protein, 7 aa, Cryptosporidium hominis
DQKENTN

SEQ ID NO: 2138407 - protein, 10 aa, Cryptosporidium hominis
DQKKDSNTNL

SEQ ID NO: 2138408 - protein, 13 aa, Cryptosporidium hominis
DQKKQSKSNKRYI

SEQ ID NO: 2138409 - protein, 10 aa, Cryptosporidium hominis
DQKKRQALEN

SEQ ID NO: 2138410 - protein, 9 aa, Cryptosporidium hominis
DQKKSTFSA

SEQ ID NO: 2138411 - protein, 5 aa, Cryptosporidium hominis
DQKND

SEQ ID NO: 2138412 - protein, 9 aa, Cryptosporidium hominis
DQKNLDSEY

SEQ ID NO: 2138413 - protein, 5 aa, Cryptosporidium hominis
DQKPK

SEQ ID NO: 2138414 - protein, 15 aa, Cryptosporidium hominis
DQKSESSKNPNIEEK

SEQ ID NO: 2138415 - protein, 27 aa, Cryptosporidium hominis
DQKSNDGSQSNSSNSDQFSNKNNGTLN

SEQ ID NO: 2138416 - protein, 17 aa, Cryptosporidium hominis
DQKSTNQSEDFGSRSNL

SEQ ID NO: 2138417 - protein, 22 aa, Cryptosporidium hominis
DQKSYNSYDGSLDHDQDLDPGM

SEQ ID NO: 2138418 - protein, 11 aa, Cryptosporidium hominis
DQLGKRKGQTG

SEQ ID NO: 2138419 - protein, 9 aa, Cryptosporidium hominis
DQLQDDGED

SEQ ID NO: 2138420 - protein, 14 aa, Cryptosporidium hominis
DQLSKRKKKEKIQP

SEQ ID NO: 2138421 - protein, 10 aa, Cryptosporidium hominis
DQLTSKSEIG

SEQ ID NO: 2138422 - protein, 4 aa, Cryptosporidium hominis
DQMK

SEQ ID NO: 2138423 - protein, 6 aa, Cryptosporidium hominis
DQMNSN

SEQ ID NO: 2138424 - protein, 4 aa, Cryptosporidium hominis
DQMR

SEQ ID NO: 2138425 - protein, 6 aa, Cryptosporidium hominis
DQNDHT

SEQ ID NO: 2138426 - protein, 8 aa, Cryptosporidium hominis
DQNIQEAQ

SEQ ID NO: 2138427 - protein, 8 aa, Cryptosporidium hominis
DQNKQNSL

SEQ ID NO: 2138428 - protein, 10 aa, Cryptosporidium hominis
DQNKSNEEEL

SEQ ID NO: 2138429 - protein, 7 aa, Cryptosporidium hominis
DQNLQNK

SEQ ID NO: 2138430 - protein, 10 aa, Cryptosporidium hominis
DQNPQNDTTG

SEQ ID NO: 2138431 - protein, 14 aa, Cryptosporidium hominis
DQNQSSQQQGSCDQ

SEQ ID NO: 2138432 - protein, 5 aa, Cryptosporidium hominis
DQNSF

SEQ ID NO: 2138433 - protein, 25 aa, Cryptosporidium hominis
DQNSGNSTKSDSKKHSQASNEQGKI

SEQ ID NO: 2138434 - protein, 10 aa, Cryptosporidium hominis
DQNSPNFQSP

SEQ ID NO: 2138435 - protein, 12 aa, Cryptosporidium hominis
DQNTCSSQSMSQ

SEQ ID NO: 2138436 - protein, 13 aa, Cryptosporidium hominis
DQNTTKDHNKNVS

SEQ ID NO: 2138437 - protein, 6 aa, Cryptosporidium hominis
DQPKNI

SEQ ID NO: 2138438 - protein, 8 aa, Cryptosporidium hominis
DQPSEPNK

SEQ ID NO: 2138439 - protein, 6 aa, Cryptosporidium hominis
DQPSEV

SEQ ID NO: 2138440 - protein, 5 aa, Cryptosporidium hominis
DQQEI

SEQ ID NO: 2138441 - protein, 10 aa, Cryptosporidium hominis
DQQGSNPSTE

SEQ ID NO: 2138442 - protein, 9 aa, Cryptosporidium hominis
DQQNSLEDF

SEQ ID NO: 2138443 - protein, 6 aa, Cryptosporidium hominis
DQQSSH

SEQ ID NO: 2138444 - protein, 5 aa, Cryptosporidium hominis
DQQYG

SEQ ID NO: 2138445 - protein, 4 aa, Cryptosporidium hominis
DQRI

SEQ ID NO: 2138446 - protein, 12 aa, Cryptosporidium hominis
DQRIPDEYKDPE

SEQ ID NO: 2138447 - protein, 4 aa, Cryptosporidium hominis
DQRN

SEQ ID NO: 2138448 - protein, 5 aa, Cryptosporidium hominis
DQRRR

SEQ ID NO: 2138449 - protein, 10 aa, Cryptosporidium hominis
DQRSLSTPTE

SEQ ID NO: 2138450 - protein, 6 aa, Cryptosporidium hominis
DQSCSS

SEQ ID NO: 2138451 - protein, 17 aa, Cryptosporidium hominis
DQSESNTNNLFHLEIEN

SEQ ID NO: 2138452 - protein, 5 aa, Cryptosporidium hominis
DQSKF

SEQ ID NO: 2138453 - protein, 9 aa, Cryptosporidium hominis
DQSKGFEED

SEQ ID NO: 2138454 - protein, 9 aa, Cryptosporidium hominis
DQSNDETGY

SEQ ID NO: 2138455 - protein, 5 aa, Cryptosporidium hominis
DQSNK

SEQ ID NO: 2138456 - protein, 5 aa, Cryptosporidium hominis
DQSNV

SEQ ID NO: 2138457 - protein, 11 aa, Cryptosporidium hominis
DQSPVSESKSS

SEQ ID NO: 2138458 - protein, 53 aa, Cryptosporidium hominis
DQSSSSSSSSSDNNNDNNSLSLSDNNSSLSSNNNYSSPNNLQSKLSNSPQINN

SEQ ID NO: 2138459 - protein, 11 aa, Cryptosporidium hominis
DQSSSTASTNP

SEQ ID NO: 2138460 - protein, 11 aa, Cryptosporidium hominis
DQSTEYNASEV

SEQ ID NO: 2138461 - protein, 7 aa, Cryptosporidium hominis
DQSVEPV

SEQ ID NO: 2138462 - protein, 10 aa, Cryptosporidium hominis
DQTKNPVPGN

SEQ ID NO: 2138463 - protein, 7 aa, Cryptosporidium hominis
DQTPSDC

SEQ ID NO: 2138464 - protein, 5 aa, Cryptosporidium hominis
DQTRG

SEQ ID NO: 2138465 - protein, 7 aa, Cryptosporidium hominis
DQTTVSN

SEQ ID NO: 2138466 - protein, 4 aa, Cryptosporidium hominis
DQVA

SEQ ID NO: 2138467 - protein, 4 aa, Cryptosporidium hominis
DQVS

SEQ ID NO: 2138468 - protein, 21 aa, Cryptosporidium hominis
DQVSEESVSGIRQKSKEKDET

SEQ ID NO: 2138469 - protein, 5 aa, Cryptosporidium hominis
DQWNQ

SEQ ID NO: 2138470 - protein, 7 aa, Cryptosporidium hominis
DQWTQGG

SEQ ID NO: 2138471 - protein, 12 aa, Cryptosporidium hominis
DQYEDDTSSNYS

SEQ ID NO: 2138472 - protein, 14 aa, Cryptosporidium hominis
DQYNQNENNSKGRT

SEQ ID NO: 2138473 - protein, 9 aa, Cryptosporidium hominis
DQYRKSPLP

SEQ ID NO: 2138474 - protein, 13 aa, Cryptosporidium hominis
DRAEKNKTYDKSL

SEQ ID NO: 2138475 - protein, 8 aa, Cryptosporidium hominis
DRDGSEIE

SEQ ID NO: 2138476 - protein, 30 aa, Cryptosporidium hominis
DRDPGSESQIRSSSRRKGNIKNTPVSKSRR

SEQ ID NO: 2138477 - protein, 18 aa, Cryptosporidium hominis
DRDSESGLTDRQSNKVES

SEQ ID NO: 2138478 - protein, 6 aa, Cryptosporidium hominis
DRDSFD

SEQ ID NO: 2138479 - protein, 20 aa, Cryptosporidium hominis
DRDSKINNDDHQKSNSVSTL

SEQ ID NO: 2138480 - protein, 6 aa, Cryptosporidium hominis
DRDVNS

SEQ ID NO: 2138481 - protein, 16 aa, Cryptosporidium hominis
DREDEISESSSTREGD

SEQ ID NO: 2138482 - protein, 22 aa, Cryptosporidium hominis
DREDESSRYGRRSNKWNNRGYG

SEQ ID NO: 2138483 - protein, 5 aa, Cryptosporidium hominis
DREER

SEQ ID NO: 2138484 - protein, 9 aa, Cryptosporidium hominis
DREGNPRKV

SEQ ID NO: 2138485 - protein, 7 aa, Cryptosporidium hominis
DREGSSA

SEQ ID NO: 2138486 - protein, 6 aa, Cryptosporidium hominis
DREKRQ

SEQ ID NO: 2138487 - protein, 10 aa, Cryptosporidium hominis
DREKTEEDIK

SEQ ID NO: 2138488 - protein, 17 aa, Cryptosporidium hominis
DRENKNEGTEIQTEKSK

SEQ ID NO: 2138489 - protein, 5 aa, Cryptosporidium hominis
DREQL

SEQ ID NO: 2138490 - protein, 13 aa, Cryptosporidium hominis
DRERELDEKERQL

SEQ ID NO: 2138491 - protein, 4 aa, Cryptosporidium hominis
DRES

SEQ ID NO: 2138492 - protein, 17 aa, Cryptosporidium hominis
DRESINQTKSETPIENN

SEQ ID NO: 2138493 - protein, 12 aa, Cryptosporidium hominis
DRESKGDNKYRG

SEQ ID NO: 2138494 - protein, 8 aa, Cryptosporidium hominis
DRETEVDN

SEQ ID NO: 2138495 - protein, 14 aa, Cryptosporidium hominis
DRFEGEYKDGVKEG

SEQ ID NO: 2138496 - protein, 4 aa, Cryptosporidium hominis
DRFK

SEQ ID NO: 2138497 - protein, 11 aa, Cryptosporidium hominis
DRGEEARKKLD

SEQ ID NO: 2138498 - protein, 4 aa, Cryptosporidium hominis
DRGG

SEQ ID NO: 2138499 - protein, 7 aa, Cryptosporidium hominis
DRGKQSL

SEQ ID NO: 2138500 - protein, 5 aa, Cryptosporidium hominis
DRGPY

SEQ ID NO: 2138501 - protein, 6 aa, Cryptosporidium hominis
DRGSHS

SEQ ID NO: 2138502 - protein, 10 aa, Cryptosporidium hominis
DRHSSRSKEK

SEQ ID NO: 2138503 - protein, 11 aa, Cryptosporidium hominis
DRIPPPREDYY

SEQ ID NO: 2138504 - protein, 7 aa, Cryptosporidium hominis
DRIQDKQ

SEQ ID NO: 2138505 - protein, 13 aa, Cryptosporidium hominis
DRITHKKNKVQKE

SEQ ID NO: 2138506 - protein, 7 aa, Cryptosporidium hominis
DRKASDF

SEQ ID NO: 2138507 - protein, 8 aa, Cryptosporidium hominis
DRKSDPNW

SEQ ID NO: 2138508 - protein, 8 aa, Cryptosporidium hominis
DRKSHDPY

SEQ ID NO: 2138509 - protein, 6 aa, Cryptosporidium hominis
DRKTSF

SEQ ID NO: 2138510 - protein, 5 aa, Cryptosporidium hominis
DRKYN

SEQ ID NO: 2138511 - protein, 4 aa, Cryptosporidium hominis
DRLA

SEQ ID NO: 2138512 - protein, 17 aa, Cryptosporidium hominis
DRLEEADASREKFSIPE

SEQ ID NO: 2138513 - protein, 20 aa, Cryptosporidium hominis
DRLQTGMRGAYGKPTGTAAR

SEQ ID NO: 2138514 - protein, 7 aa, Cryptosporidium hominis
DRLSEDK

SEQ ID NO: 2138515 - protein, 12 aa, Cryptosporidium hominis
DRLSSSANSNDL

SEQ ID NO: 2138516 - protein, 6 aa, Cryptosporidium hominis
DRNGDG

SEQ ID NO: 2138517 - protein, 4 aa, Cryptosporidium hominis
DRNI

SEQ ID NO: 2138518 - protein, 6 aa, Cryptosporidium hominis
DRNKST

SEQ ID NO: 2138519 - protein, 5 aa, Cryptosporidium hominis
DRNNT

SEQ ID NO: 2138520 - protein, 16 aa, Cryptosporidium hominis
DRNSENKNAKNDSSHI

SEQ ID NO: 2138521 - protein, 4 aa, Cryptosporidium hominis
DRPD

SEQ ID NO: 2138522 - protein, 41 aa, Cryptosporidium hominis
DRPQETRPNSKQEYSGGKEGSSVKLPADLEKKRQLRDNQRK

SEQ ID NO: 2138523 - protein, 10 aa, Cryptosporidium hominis
DRQIKQDQRL

SEQ ID NO: 2138524 - protein, 5 aa, Cryptosporidium hominis
DRQNV

SEQ ID NO: 2138525 - protein, 4 aa, Cryptosporidium hominis
DRRA

SEQ ID NO: 2138526 - protein, 15 aa, Cryptosporidium hominis
DRRGGGNCFSNGCSS

SEQ ID NO: 2138527 - protein, 6 aa, Cryptosporidium hominis
DRRGIT

SEQ ID NO: 2138528 - protein, 5 aa, Cryptosporidium hominis
DRRHG

SEQ ID NO: 2138529 - protein, 8 aa, Cryptosporidium hominis
DRRRDSKM

SEQ ID NO: 2138530 - protein, 11 aa, Cryptosporidium hominis
DRRSANQADQI

SEQ ID NO: 2138531 - protein, 8 aa, Cryptosporidium hominis
DRRSPSEA

SEQ ID NO: 2138532 - protein, 11 aa, Cryptosporidium hominis
DRRSPSRSGIG

SEQ ID NO: 2138533 - protein, 6 aa, Cryptosporidium hominis
DRRTGE

SEQ ID NO: 2138534 - protein, 6 aa, Cryptosporidium hominis
DRSDED

SEQ ID NO: 2138535 - protein, 5 aa, Cryptosporidium hominis
DRSDR

SEQ ID NO: 2138536 - protein, 7 aa, Cryptosporidium hominis
DRSDSTN

SEQ ID NO: 2138537 - protein, 24 aa, Cryptosporidium hominis
DRSFENSSEKLADVEGELEQGEEH

SEQ ID NO: 2138538 - protein, 6 aa, Cryptosporidium hominis
DRSGQL

SEQ ID NO: 2138539 - protein, 9 aa, Cryptosporidium hominis
DRSNTTGVK

SEQ ID NO: 2138540 - protein, 30 aa, Cryptosporidium hominis
DRSNTVKRIEAEDKEEKKDEPKKASLGKSK

SEQ ID NO: 2138541 - protein, 11 aa, Cryptosporidium hominis
DRSRFGETREE

SEQ ID NO: 2138542 - protein, 6 aa, Cryptosporidium hominis
DRSRRK

SEQ ID NO: 2138543 - protein, 18 aa, Cryptosporidium hominis
DRSRSQSRRRSSLEENGV

SEQ ID NO: 2138544 - protein, 7 aa, Cryptosporidium hominis
DRSTKHY

SEQ ID NO: 2138545 - protein, 8 aa, Cryptosporidium hominis
DRTESTKT

SEQ ID NO: 2138546 - protein, 7 aa, Cryptosporidium hominis
DRTHGSL

SEQ ID NO: 2138547 - protein, 6 aa, Cryptosporidium hominis
DRVEGK

SEQ ID NO: 2138548 - protein, 5 aa, Cryptosporidium hominis
DRVPM

SEQ ID NO: 2138549 - protein, 5 aa, Cryptosporidium hominis
DRYGN

SEQ ID NO: 2138550 - protein, 5 aa, Cryptosporidium hominis
DRYPD

SEQ ID NO: 2138551 - protein, 10 aa, Cryptosporidium hominis
DRYSDKNSNY

SEQ ID NO: 2138552 - protein, 16 aa, Cryptosporidium hominis
DRYSQSNGFNSGGGNM

SEQ ID NO: 2138553 - protein, 9 aa, Cryptosporidium hominis
DSADLDDNS

SEQ ID NO: 2138554 - protein, 8 aa, Cryptosporidium hominis
DSAKEAIS

SEQ ID NO: 2138555 - protein, 8 aa, Cryptosporidium hominis
DSAKNNNE

SEQ ID NO: 2138556 - protein, 6 aa, Cryptosporidium hominis
DSAKTY

SEQ ID NO: 2138557 - protein, 8 aa, Cryptosporidium hominis
DSANGGGL

SEQ ID NO: 2138558 - protein, 13 aa, Cryptosporidium hominis
DSANLESEGGLAM

SEQ ID NO: 2138559 - protein, 8 aa, Cryptosporidium hominis
DSAPLSEQ

SEQ ID NO: 2138560 - protein, 6 aa, Cryptosporidium hominis
DSASAT

SEQ ID NO: 2138561 - protein, 12 aa, Cryptosporidium hominis
DSASDGSSLTNP

SEQ ID NO: 2138562 - protein, 7 aa, Cryptosporidium hominis
DSASNDT

SEQ ID NO: 2138563 - protein, 6 aa, Cryptosporidium hominis
DSCEKE

SEQ ID NO: 2138564 - protein, 22 aa, Cryptosporidium hominis
DSDDEREDSEAFDAAAEDDFDE

SEQ ID NO: 2138565 - protein, 9 aa, Cryptosporidium hominis
DSDDSVIGK

SEQ ID NO: 2138566 - protein, 6 aa, Cryptosporidium hominis
DSDEAD

SEQ ID NO: 2138567 - protein, 11 aa, Cryptosporidium hominis
DSDEDEVQNEK

SEQ ID NO: 2138568 - protein, 7 aa, Cryptosporidium hominis
DSDEDRY

SEQ ID NO: 2138569 - protein, 14 aa, Cryptosporidium hominis
DSDEERAKIRGKQL

SEQ ID NO: 2138570 - protein, 22 aa, Cryptosporidium hominis
DSDENVPDSNLPKNSQSAPNTG

SEQ ID NO: 2138571 - protein, 10 aa, Cryptosporidium hominis
DSDESTGNRK

SEQ ID NO: 2138572 - protein, 8 aa, Cryptosporidium hominis
DSDGNGEI

SEQ ID NO: 2138573 - protein, 7 aa, Cryptosporidium hominis
DSDGRIE

SEQ ID NO: 2138574 - protein, 9 aa, Cryptosporidium hominis
DSDGSGSID

SEQ ID NO: 2138575 - protein, 7 aa, Cryptosporidium hominis
DSDIRRS

SEQ ID NO: 2138576 - protein, 14 aa, Cryptosporidium hominis
DSDKNEDKEEAKQE

SEQ ID NO: 2138577 - protein, 7 aa, Cryptosporidium hominis
DSDKPCT

SEQ ID NO: 2138578 - protein, 10 aa, Cryptosporidium hominis
DSDKPNEERV

SEQ ID NO: 2138579 - protein, 16 aa, Cryptosporidium hominis
DSDLVKDPDFEKDEKL

SEQ ID NO: 2138580 - protein, 5 aa, Cryptosporidium hominis
DSDNM

SEQ ID NO: 2138581 - protein, 10 aa, Cryptosporidium hominis
DSDNSSPIEF

SEQ ID NO: 2138582 - protein, 9 aa, Cryptosporidium hominis
DSDRFTDTS

SEQ ID NO: 2138583 - protein, 14 aa, Cryptosporidium hominis
DSDSDSSEDDRRVV

SEQ ID NO: 2138584 - protein, 9 aa, Cryptosporidium hominis
DSDSEFESR

SEQ ID NO: 2138585 - protein, 8 aa, Cryptosporidium hominis
DSDSLDGM

SEQ ID NO: 2138586 - protein, 9 aa, Cryptosporidium hominis
DSDSLDPSN

SEQ ID NO: 2138587 - protein, 30 aa, Cryptosporidium hominis
DSDSNSDKDIEDNNNNNNNNNKECSPTKNQ

SEQ ID NO: 2138588 - protein, 7 aa, Cryptosporidium hominis
DSDSSIK

SEQ ID NO: 2138589 - protein, 10 aa, Cryptosporidium hominis
DSDSSTSSLN

SEQ ID NO: 2138590 - protein, 12 aa, Cryptosporidium hominis
DSDSTGNPTGLT

SEQ ID NO: 2138591 - protein, 14 aa, Cryptosporidium hominis
DSDSVSDYYKEPDP

SEQ ID NO: 2138592 - protein, 4 aa, Cryptosporidium hominis
DSDT

SEQ ID NO: 2138593 - protein, 9 aa, Cryptosporidium hominis
DSDTPQEKE

SEQ ID NO: 2138594 - protein, 9 aa, Cryptosporidium hominis
DSDTQCGVG

SEQ ID NO: 2138595 - protein, 17 aa, Cryptosporidium hominis
DSEASTDIEEKETLDSD

SEQ ID NO: 2138596 - protein, 15 aa, Cryptosporidium hominis
DSEAVSSKIKEDNAI

SEQ ID NO: 2138597 - protein, 7 aa, Cryptosporidium hominis
DSEDSIS

SEQ ID NO: 2138598 - protein, 7 aa, Cryptosporidium hominis
DSEEQEV

SEQ ID NO: 2138599 - protein, 13 aa, Cryptosporidium hominis
DSEERSRIPDKDI

SEQ ID NO: 2138600 - protein, 4 aa, Cryptosporidium hominis
DSEG

SEQ ID NO: 2138601 - protein, 7 aa, Cryptosporidium hominis
DSEGIPD

SEQ ID NO: 2138602 - protein, 6 aa, Cryptosporidium hominis
DSEGYT

SEQ ID NO: 2138603 - protein, 11 aa, Cryptosporidium hominis
DSEHSGDREVQ

SEQ ID NO: 2138604 - protein, 15 aa, Cryptosporidium hominis
DSEKGLESNKQAASD

SEQ ID NO: 2138605 - protein, 9 aa, Cryptosporidium hominis
DSEKNQAIS

SEQ ID NO: 2138606 - protein, 5 aa, Cryptosporidium hominis
DSEKS

SEQ ID NO: 2138607 - protein, 60 aa, Cryptosporidium hominis
DSENAKKSPTMRKSNYTKTNKIDTIATEKTQNQVSSNDIPKKECKKKLKATKLKNSTELN

SEQ ID NO: 2138608 - protein, 5 aa, Cryptosporidium hominis
DSENF

SEQ ID NO: 2138609 - protein, 10 aa, Cryptosporidium hominis
DSENPEKKAN

SEQ ID NO: 2138610 - protein, 6 aa, Cryptosporidium hominis
DSENTK

SEQ ID NO: 2138611 - protein, 24 aa, Cryptosporidium hominis
DSERSLTSEEENFSEGSWEDEEDA

SEQ ID NO: 2138612 - protein, 18 aa, Cryptosporidium hominis
DSESNTKSKRQQTLGSSF

SEQ ID NO: 2138613 - protein, 6 aa, Cryptosporidium hominis
DSESPP

SEQ ID NO: 2138614 - protein, 4 aa, Cryptosporidium hominis
DSET

SEQ ID NO: 2138615 - protein, 9 aa, Cryptosporidium hominis
DSETEKNQF

SEQ ID NO: 2138616 - protein, 28 aa, Cryptosporidium hominis
DSEYEKSQESKSKLETKNLNRKQKVQRQ

SEQ ID NO: 2138617 - protein, 15 aa, Cryptosporidium hominis
DSEYVTKQDRPEKKR

SEQ ID NO: 2138618 - protein, 53 aa, Cryptosporidium hominis
DSFDSSDDSTSIGSQDTKSIGEDSTTSSTSSIKSAGKRAAKKLKEKSKSLKRR

SEQ ID NO: 2138619 - protein, 16 aa, Cryptosporidium hominis
DSFEEGLGSQKGEVSE

SEQ ID NO: 2138620 - protein, 12 aa, Cryptosporidium hominis
DSFGPKKSGVTT

SEQ ID NO: 2138621 - protein, 4 aa, Cryptosporidium hominis
DSFK

SEQ ID NO: 2138622 - protein, 6 aa, Cryptosporidium hominis
DSFSSS

SEQ ID NO: 2138623 - protein, 17 aa, Cryptosporidium hominis
DSFTNSESINSNFQGST

SEQ ID NO: 2138624 - protein, 8 aa, Cryptosporidium hominis
DSGAQTTI

SEQ ID NO: 2138625 - protein, 7 aa, Cryptosporidium hominis
DSGDQDT

SEQ ID NO: 2138626 - protein, 12 aa, Cryptosporidium hominis
DSGEDSINNGTY

SEQ ID NO: 2138627 - protein, 4 aa, Cryptosporidium hominis
DSGG

SEQ ID NO: 2138628 - protein, 8 aa, Cryptosporidium hominis
DSGGVQIS

SEQ ID NO: 2138629 - protein, 4 aa, Cryptosporidium hominis
DSGI

SEQ ID NO: 2138630 - protein, 11 aa, Cryptosporidium hominis
DSGKDPNYHTL

SEQ ID NO: 2138631 - protein, 6 aa, Cryptosporidium hominis
DSGKFD

SEQ ID NO: 2138632 - protein, 9 aa, Cryptosporidium hominis
DSGKSTTTG

SEQ ID NO: 2138633 - protein, 11 aa, Cryptosporidium hominis
DSGLKNGQSSN

SEQ ID NO: 2138634 - protein, 4 aa, Cryptosporidium hominis
DSGN

SEQ ID NO: 2138635 - protein, 6 aa, Cryptosporidium hominis
DSGNDA

SEQ ID NO: 2138636 - protein, 9 aa, Cryptosporidium hominis
DSGNEIESE

SEQ ID NO: 2138637 - protein, 15 aa, Cryptosporidium hominis
DSGNHSSQKNKVQPK

SEQ ID NO: 2138638 - protein, 6 aa, Cryptosporidium hominis
DSGNTL

SEQ ID NO: 2138639 - protein, 4 aa, Cryptosporidium hominis
DSGQ

SEQ ID NO: 2138640 - protein, 6 aa, Cryptosporidium hominis
DSGRSM

SEQ ID NO: 2138641 - protein, 9 aa, Cryptosporidium hominis
DSGSAKEEA

SEQ ID NO: 2138642 - protein, 12 aa, Cryptosporidium hominis
DSGSRRASTKEM

SEQ ID NO: 2138643 - protein, 5 aa, Cryptosporidium hominis
DSGVF

SEQ ID NO: 2138644 - protein, 25 aa, Cryptosporidium hominis
DSHGLPDDDDDDDFDDDDDEDAGQV

SEQ ID NO: 2138645 - protein, 10 aa, Cryptosporidium hominis
DSHLNTNKRY

SEQ ID NO: 2138646 - protein, 6 aa, Cryptosporidium hominis
DSHSDY

SEQ ID NO: 2138647 - protein, 9 aa, Cryptosporidium hominis
DSIDGNGTI

SEQ ID NO: 2138648 - protein, 10 aa, Cryptosporidium hominis
DSIDSDKISS

SEQ ID NO: 2138649 - protein, 4 aa, Cryptosporidium hominis
DSIE

SEQ ID NO: 2138650 - protein, 38 aa, Cryptosporidium hominis
DSIESSPNSSYNSDEQRSQEGSKETCEDTEDEKNSPKI

SEQ ID NO: 2138651 - protein, 4 aa, Cryptosporidium hominis
DSIG

SEQ ID NO: 2138652 - protein, 5 aa, Cryptosporidium hominis
DSIGS

SEQ ID NO: 2138653 - protein, 21 aa, Cryptosporidium hominis
DSIIQKNENDLEIESNYNFKA

SEQ ID NO: 2138654 - protein, 5 aa, Cryptosporidium hominis
DSIKS

SEQ ID NO: 2138655 - protein, 7 aa, Cryptosporidium hominis
DSINEED

SEQ ID NO: 2138656 - protein, 19 aa, Cryptosporidium hominis
DSIQEVSKSESSSPKKFSK

SEQ ID NO: 2138657 - protein, 14 aa, Cryptosporidium hominis
DSIRNQNSNLVSDG

SEQ ID NO: 2138658 - protein, 31 aa, Cryptosporidium hominis
DSISGNSVSNQSSVSHPQSSDSVGPSKDSEC

SEQ ID NO: 2138659 - protein, 6 aa, Cryptosporidium hominis
DSISPI

SEQ ID NO: 2138660 - protein, 7 aa, Cryptosporidium hominis
DSISRKV

SEQ ID NO: 2138661 - protein, 6 aa, Cryptosporidium hominis
DSITNI

SEQ ID NO: 2138662 - protein, 7 aa, Cryptosporidium hominis
DSIVDSK

SEQ ID NO: 2138663 - protein, 12 aa, Cryptosporidium hominis
DSIVNSSNEHIS

SEQ ID NO: 2138664 - protein, 6 aa, Cryptosporidium hominis
DSKARK

SEQ ID NO: 2138665 - protein, 13 aa, Cryptosporidium hominis
DSKDYREKHSNQY

SEQ ID NO: 2138666 - protein, 4 aa, Cryptosporidium hominis
DSKE

SEQ ID NO: 2138667 - protein, 8 aa, Cryptosporidium hominis
DSKEEALA

SEQ ID NO: 2138668 - protein, 9 aa, Cryptosporidium hominis
DSKEIDKSN

SEQ ID NO: 2138669 - protein, 6 aa, Cryptosporidium hominis
DSKFAD

SEQ ID NO: 2138670 - protein, 15 aa, Cryptosporidium hominis
DSKGKHHSYSSKRSI

SEQ ID NO: 2138671 - protein, 12 aa, Cryptosporidium hominis
DSKGLKRKPMDE

SEQ ID NO: 2138672 - protein, 18 aa, Cryptosporidium hominis
DSKGNAHDLRPKENKPCY

SEQ ID NO: 2138673 - protein, 10 aa, Cryptosporidium hominis
DSKGPGKATI

SEQ ID NO: 2138674 - protein, 9 aa, Cryptosporidium hominis
DSKGQFNSG

SEQ ID NO: 2138675 - protein, 8 aa, Cryptosporidium hominis
DSKGSTIK

SEQ ID NO: 2138676 - protein, 9 aa, Cryptosporidium hominis
DSKGYSSIE

SEQ ID NO: 2138677 - protein, 18 aa, Cryptosporidium hominis
DSKIQDENQGSKNNEDHK

SEQ ID NO: 2138678 - protein, 7 aa, Cryptosporidium hominis
DSKKEIQ

SEQ ID NO: 2138679 - protein, 5 aa, Cryptosporidium hominis
DSKKL

SEQ ID NO: 2138680 - protein, 35 aa, Cryptosporidium hominis
DSKKSTGNGKAGPNNSESNIETTGFSPKNSNRIDG

SEQ ID NO: 2138681 - protein, 7 aa, Cryptosporidium hominis
DSKLDKV

SEQ ID NO: 2138682 - protein, 8 aa, Cryptosporidium hominis
DSKQYSKE

SEQ ID NO: 2138683 - protein, 8 aa, Cryptosporidium hominis
DSKRENDK

SEQ ID NO: 2138684 - protein, 5 aa, Cryptosporidium hominis
DSKSK

SEQ ID NO: 2138685 - protein, 19 aa, Cryptosporidium hominis
DSKSRGKRKLSKFEGKKGF

SEQ ID NO: 2138686 - protein, 6 aa, Cryptosporidium hominis
DSKTFH

SEQ ID NO: 2138687 - protein, 4 aa, Cryptosporidium hominis
DSKV

SEQ ID NO: 2138688 - protein, 15 aa, Cryptosporidium hominis
DSKVPNKLSEVPTEG

SEQ ID NO: 2138689 - protein, 12 aa, Cryptosporidium hominis
DSLDSQNTSESV

SEQ ID NO: 2138690 - protein, 6 aa, Cryptosporidium hominis
DSLEEQ

SEQ ID NO: 2138691 - protein, 13 aa, Cryptosporidium hominis
DSLESQKKENNEL

SEQ ID NO: 2138692 - protein, 6 aa, Cryptosporidium hominis
DSLGKK

SEQ ID NO: 2138693 - protein, 6 aa, Cryptosporidium hominis
DSLGRR

SEQ ID NO: 2138694 - protein, 18 aa, Cryptosporidium hominis
DSLNAKNNANINRSNPHK

SEQ ID NO: 2138695 - protein, 10 aa, Cryptosporidium hominis
DSLNENGNIV

SEQ ID NO: 2138696 - protein, 14 aa, Cryptosporidium hominis
DSLNNADDRKTNAG

SEQ ID NO: 2138697 - protein, 7 aa, Cryptosporidium hominis
DSLSEDQ

SEQ ID NO: 2138698 - protein, 7 aa, Cryptosporidium hominis
DSLSGDR

SEQ ID NO: 2138699 - protein, 16 aa, Cryptosporidium hominis
DSLSGENKSTESLEKH

SEQ ID NO: 2138700 - protein, 20 aa, Cryptosporidium hominis
DSLSGGGGDGASSSSGYGEK

SEQ ID NO: 2138701 - protein, 7 aa, Cryptosporidium hominis
DSLSKSV

SEQ ID NO: 2138702 - protein, 6 aa, Cryptosporidium hominis
DSLSNN

SEQ ID NO: 2138703 - protein, 6 aa, Cryptosporidium hominis
DSMGNK

SEQ ID NO: 2138704 - protein, 11 aa, Cryptosporidium hominis
DSMMDENKDHG

SEQ ID NO: 2138705 - protein, 8 aa, Cryptosporidium hominis
DSMPGFPS

SEQ ID NO: 2138706 - protein, 6 aa, Cryptosporidium hominis
DSNADD

SEQ ID NO: 2138707 - protein, 9 aa, Cryptosporidium hominis
DSNAEDIEG

SEQ ID NO: 2138708 - protein, 15 aa, Cryptosporidium hominis
DSNCEVDPHTGAQKS

SEQ ID NO: 2138709 - protein, 9 aa, Cryptosporidium hominis
DSNDKPSAL

SEQ ID NO: 2138710 - protein, 7 aa, Cryptosporidium hominis
DSNEARI

SEQ ID NO: 2138711 - protein, 7 aa, Cryptosporidium hominis
DSNEKSQ

SEQ ID NO: 2138712 - protein, 4 aa, Cryptosporidium hominis
DSNF

SEQ ID NO: 2138713 - protein, 8 aa, Cryptosporidium hominis
DSNFPKNC

SEQ ID NO: 2138714 - protein, 20 aa, Cryptosporidium hominis
DSNFSNSESEESEEATKLGS

SEQ ID NO: 2138715 - protein, 6 aa, Cryptosporidium hominis
DSNGKD

SEQ ID NO: 2138716 - protein, 6 aa, Cryptosporidium hominis
DSNGLN

SEQ ID NO: 2138717 - protein, 6 aa, Cryptosporidium hominis
DSNGRI

SEQ ID NO: 2138718 - protein, 7 aa, Cryptosporidium hominis
DSNGYFG

SEQ ID NO: 2138719 - protein, 4 aa, Cryptosporidium hominis
DSNI

SEQ ID NO: 2138720 - protein, 6 aa, Cryptosporidium hominis
DSNIGG

SEQ ID NO: 2138721 - protein, 7 aa, Cryptosporidium hominis
DSNIKQK

SEQ ID NO: 2138722 - protein, 25 aa, Cryptosporidium hominis
DSNKEESEISYSKKRKQAEKNNSGV

SEQ ID NO: 2138723 - protein, 9 aa, Cryptosporidium hominis
DSNKRNQVR

SEQ ID NO: 2138724 - protein, 14 aa, Cryptosporidium hominis
DSNLEGSKNKEGNN

SEQ ID NO: 2138725 - protein, 12 aa, Cryptosporidium hominis
DSNLSDTKTSDI

SEQ ID NO: 2138726 - protein, 9 aa, Cryptosporidium hominis
DSNMENSQV

SEQ ID NO: 2138727 - protein, 4 aa, Cryptosporidium hominis
DSNN

SEQ ID NO: 2138728 - protein, 8 aa, Cryptosporidium hominis
DSNNEVEL

SEQ ID NO: 2138729 - protein, 6 aa, Cryptosporidium hominis
DSNNFS

SEQ ID NO: 2138730 - protein, 7 aa, Cryptosporidium hominis
DSNNGIG

SEQ ID NO: 2138731 - protein, 8 aa, Cryptosporidium hominis
DSNNIENL

SEQ ID NO: 2138732 - protein, 16 aa, Cryptosporidium hominis
DSNNIYSASSPSIGNN

SEQ ID NO: 2138733 - protein, 9 aa, Cryptosporidium hominis
DSNNNSNIE

SEQ ID NO: 2138734 - protein, 9 aa, Cryptosporidium hominis
DSNNSPQTL

SEQ ID NO: 2138735 - protein, 12 aa, Cryptosporidium hominis
DSNNYNSKQNHS

SEQ ID NO: 2138736 - protein, 16 aa, Cryptosporidium hominis
DSNRKATADATYVPVN

SEQ ID NO: 2138737 - protein, 6 aa, Cryptosporidium hominis
DSNRKM

SEQ ID NO: 2138738 - protein, 4 aa, Cryptosporidium hominis
DSNS

SEQ ID NO: 2138739 - protein, 7 aa, Cryptosporidium hominis
DSNSDSI

SEQ ID NO: 2138740 - protein, 8 aa, Cryptosporidium hominis
DSNSIGGG

SEQ ID NO: 2138741 - protein, 8 aa, Cryptosporidium hominis
DSNSISQI

SEQ ID NO: 2138742 - protein, 6 aa, Cryptosporidium hominis
DSNSKH

SEQ ID NO: 2138743 - protein, 16 aa, Cryptosporidium hominis
DSNSLIQNEGSTIEDQ

SEQ ID NO: 2138744 - protein, 9 aa, Cryptosporidium hominis
DSNSNPTVK

SEQ ID NO: 2138745 - protein, 13 aa, Cryptosporidium hominis
DSNSQKSSSDSIS

SEQ ID NO: 2138746 - protein, 7 aa, Cryptosporidium hominis
DSNSYQS

SEQ ID NO: 2138747 - protein, 4 aa, Cryptosporidium hominis
DSNT

SEQ ID NO: 2138748 - protein, 16 aa, Cryptosporidium hominis
DSNTPRRSSKTGICGN

SEQ ID NO: 2138749 - protein, 8 aa, Cryptosporidium hominis
DSNTTDSI

SEQ ID NO: 2138750 - protein, 30 aa, Cryptosporidium hominis
DSNTVQQKSRQDSYSNRSLTVNTSKTDGLL

SEQ ID NO: 2138751 - protein, 6 aa, Cryptosporidium hominis
DSNVND

SEQ ID NO: 2138752 - protein, 6 aa, Cryptosporidium hominis
DSNYTP

SEQ ID NO: 2138753 - protein, 7 aa, Cryptosporidium hominis
DSPAGRK

SEQ ID NO: 2138754 - protein, 7 aa, Cryptosporidium hominis
DSPDGKY

SEQ ID NO: 2138755 - protein, 5 aa, Cryptosporidium hominis
DSPDI

SEQ ID NO: 2138756 - protein, 20 aa, Cryptosporidium hominis
DSPDSNKNCTHESSSPIKSR

SEQ ID NO: 2138757 - protein, 7 aa, Cryptosporidium hominis
DSPELNE

SEQ ID NO: 2138758 - protein, 8 aa, Cryptosporidium hominis
DSPKREPW

SEQ ID NO: 2138759 - protein, 4 aa, Cryptosporidium hominis
DSPL

SEQ ID NO: 2138760 - protein, 15 aa, Cryptosporidium hominis
DSPNWKFGNVDLEII

SEQ ID NO: 2138761 - protein, 4 aa, Cryptosporidium hominis
DSPW

SEQ ID NO: 2138762 - protein, 16 aa, Cryptosporidium hominis
DSQDCSDEDNSSRSSD

SEQ ID NO: 2138763 - protein, 10 aa, Cryptosporidium hominis
DSQDDDNIQI

SEQ ID NO: 2138764 - protein, 8 aa, Cryptosporidium hominis
DSQEDENK

SEQ ID NO: 2138765 - protein, 23 aa, Cryptosporidium hominis
DSQEKVTNQTKDTPSLNNNTEEY

SEQ ID NO: 2138766 - protein, 7 aa, Cryptosporidium hominis
DSQGKLD

SEQ ID NO: 2138767 - protein, 5 aa, Cryptosporidium hominis
DSQGN

SEQ ID NO: 2138768 - protein, 10 aa, Cryptosporidium hominis
DSQGRKMSKS

SEQ ID NO: 2138769 - protein, 5 aa, Cryptosporidium hominis
DSQNK

SEQ ID NO: 2138770 - protein, 11 aa, Cryptosporidium hominis
DSQNSIDNRND

SEQ ID NO: 2138771 - protein, 6 aa, Cryptosporidium hominis
DSQPPI

SEQ ID NO: 2138772 - protein, 4 aa, Cryptosporidium hominis
DSQR

SEQ ID NO: 2138773 - protein, 13 aa, Cryptosporidium hominis
DSQRQATKDAGAI

SEQ ID NO: 2138774 - protein, 14 aa, Cryptosporidium hominis
DSQRQATKDAGSIA

SEQ ID NO: 2138775 - protein, 14 aa, Cryptosporidium hominis
DSQSYRRSVYNSNG

SEQ ID NO: 2138776 - protein, 12 aa, Cryptosporidium hominis
DSQTSAEDASKI

SEQ ID NO: 2138777 - protein, 7 aa, Cryptosporidium hominis
DSQTVQD

SEQ ID NO: 2138778 - protein, 13 aa, Cryptosporidium hominis
DSRDPSIRILPER

SEQ ID NO: 2138779 - protein, 9 aa, Cryptosporidium hominis
DSRGNPTVE

SEQ ID NO: 2138780 - protein, 11 aa, Cryptosporidium hominis
DSRLKSQGQDI

SEQ ID NO: 2138781 - protein, 7 aa, Cryptosporidium hominis
DSSAGAY

SEQ ID NO: 2138782 - protein, 29 aa, Cryptosporidium hominis
DSSDESDDSNESDIKSSNSNTQKNSKPMT

SEQ ID NO: 2138783 - protein, 11 aa, Cryptosporidium hominis
DSSDKFKDPEE

SEQ ID NO: 2138784 - protein, 4 aa, Cryptosporidium hominis
DSSE

SEQ ID NO: 2138785 - protein, 10 aa, Cryptosporidium hominis
DSSEDSCTED

SEQ ID NO: 2138786 - protein, 7 aa, Cryptosporidium hominis
DSSEEAN

SEQ ID NO: 2138787 - protein, 13 aa, Cryptosporidium hominis
DSSELSKKCSVTN

SEQ ID NO: 2138788 - protein, 7 aa, Cryptosporidium hominis
DSSEMRD

SEQ ID NO: 2138789 - protein, 8 aa, Cryptosporidium hominis
DSSENQLG

SEQ ID NO: 2138790 - protein, 8 aa, Cryptosporidium hominis
DSSENSKY

SEQ ID NO: 2138791 - protein, 6 aa, Cryptosporidium hominis
DSSEYG

SEQ ID NO: 2138792 - protein, 34 aa, Cryptosporidium hominis
DSSGTMTGGGPNVSVAKNAGKKSEKTSEIPTPEQ

SEQ ID NO: 2138793 - protein, 4 aa, Cryptosporidium hominis
DSSI

SEQ ID NO: 2138794 - protein, 6 aa, Cryptosporidium hominis
DSSIPV

SEQ ID NO: 2138795 - protein, 17 aa, Cryptosporidium hominis
DSSIQNDKVEKIKSEDI

SEQ ID NO: 2138796 - protein, 9 aa, Cryptosporidium hominis
DSSIQNEDR

SEQ ID NO: 2138797 - protein, 8 aa, Cryptosporidium hominis
DSSISCKN

SEQ ID NO: 2138798 - protein, 6 aa, Cryptosporidium hominis
DSSKAL

SEQ ID NO: 2138799 - protein, 9 aa, Cryptosporidium hominis
DSSKENNSD

SEQ ID NO: 2138800 - protein, 18 aa, Cryptosporidium hominis
DSSKGRRWSNNSTTSTIS

SEQ ID NO: 2138801 - protein, 8 aa, Cryptosporidium hominis
DSSKNHDA

SEQ ID NO: 2138802 - protein, 10 aa, Cryptosporidium hominis
DSSNKRSPSY

SEQ ID NO: 2138803 - protein, 27 aa, Cryptosporidium hominis
DSSNSAQSGTGSSSSFGSRFGRENSAK

SEQ ID NO: 2138804 - protein, 10 aa, Cryptosporidium hominis
DSSPAQAAGL

SEQ ID NO: 2138805 - protein, 5 aa, Cryptosporidium hominis
DSSPI

SEQ ID NO: 2138806 - protein, 19 aa, Cryptosporidium hominis
DSSPNKENDKSIGTDSSSN

SEQ ID NO: 2138807 - protein, 7 aa, Cryptosporidium hominis
DSSPNSL

SEQ ID NO: 2138808 - protein, 10 aa, Cryptosporidium hominis
DSSPQQSFNR

SEQ ID NO: 2138809 - protein, 14 aa, Cryptosporidium hominis
DSSPVTTQSYENKN

SEQ ID NO: 2138810 - protein, 19 aa, Cryptosporidium hominis
DSSQQANISHSNVEESTQS

SEQ ID NO: 2138811 - protein, 16 aa, Cryptosporidium hominis
DSSRGRKTQNEKTSDN

SEQ ID NO: 2138812 - protein, 9 aa, Cryptosporidium hominis
DSSSARKNI

SEQ ID NO: 2138813 - protein, 24 aa, Cryptosporidium hominis
DSSSEAKHYSTRVSASPNKQQYDM

SEQ ID NO: 2138814 - protein, 6 aa, Cryptosporidium hominis
DSSSGG

SEQ ID NO: 2138815 - protein, 13 aa, Cryptosporidium hominis
DSSSLKRADIGGQ

SEQ ID NO: 2138816 - protein, 23 aa, Cryptosporidium hominis
DSSSNTKEETKTQDGKNFTTTSE

SEQ ID NO: 2138817 - protein, 6 aa, Cryptosporidium hominis
DSSSPE

SEQ ID NO: 2138818 - protein, 11 aa, Cryptosporidium hominis
DSSSSKSSYSV

SEQ ID NO: 2138819 - protein, 8 aa, Cryptosporidium hominis
DSSSTSDW

SEQ ID NO: 2138820 - protein, 25 aa, Cryptosporidium hominis
DSSSYEGDFQNGAPNGQGKYTYSNG

SEQ ID NO: 2138821 - protein, 6 aa, Cryptosporidium hominis
DSSVEN

SEQ ID NO: 2138822 - protein, 6 aa, Cryptosporidium hominis
DSSVNR

SEQ ID NO: 2138823 - protein, 5 aa, Cryptosporidium hominis
DSSWE

SEQ ID NO: 2138824 - protein, 4 aa, Cryptosporidium hominis
DSSY

SEQ ID NO: 2138825 - protein, 69 aa, Cryptosporidium hominis
DSTAETSADNEAGADSETSSKQESGEASNKKQTASSETSKDSSGTSNEEFAQNEDGSADKNVSADVQPN

SEQ ID NO: 2138826 - protein, 4 aa, Cryptosporidium hominis
DSTE

SEQ ID NO: 2138827 - protein, 8 aa, Cryptosporidium hominis
DSTEKDDI

SEQ ID NO: 2138828 - protein, 7 aa, Cryptosporidium hominis
DSTELPR

SEQ ID NO: 2138829 - protein, 16 aa, Cryptosporidium hominis
DSTESNNKESKKEDEQ

SEQ ID NO: 2138830 - protein, 19 aa, Cryptosporidium hominis
DSTHAQYSAPIDDDADDLY

SEQ ID NO: 2138831 - protein, 9 aa, Cryptosporidium hominis
DSTINTDSH

SEQ ID NO: 2138832 - protein, 7 aa, Cryptosporidium hominis
DSTISSV

SEQ ID NO: 2138833 - protein, 9 aa, Cryptosporidium hominis
DSTKEPRRG

SEQ ID NO: 2138834 - protein, 12 aa, Cryptosporidium hominis
DSTKVGDYDNSR

SEQ ID NO: 2138835 - protein, 7 aa, Cryptosporidium hominis
DSTLDES

SEQ ID NO: 2138836 - protein, 6 aa, Cryptosporidium hominis
DSTLGE

SEQ ID NO: 2138837 - protein, 6 aa, Cryptosporidium hominis
DSTLQG

SEQ ID NO: 2138838 - protein, 6 aa, Cryptosporidium hominis
DSTNQV

SEQ ID NO: 2138839 - protein, 9 aa, Cryptosporidium hominis
DSTNTSLQE

SEQ ID NO: 2138840 - protein, 9 aa, Cryptosporidium hominis
DSTQGYIPT

SEQ ID NO: 2138841 - protein, 4 aa, Cryptosporidium hominis
DSTR

SEQ ID NO: 2138842 - protein, 8 aa, Cryptosporidium hominis
DSTRDDHA

SEQ ID NO: 2138843 - protein, 7 aa, Cryptosporidium hominis
DSTRGPQ

SEQ ID NO: 2138844 - protein, 6 aa, Cryptosporidium hominis
DSTTAA

SEQ ID NO: 2138845 - protein, 7 aa, Cryptosporidium hominis
DSTVDRG

SEQ ID NO: 2138846 - protein, 12 aa, Cryptosporidium hominis
DSTYDGEETEEY

SEQ ID NO: 2138847 - protein, 5 aa, Cryptosporidium hominis
DSTYP

SEQ ID NO: 2138848 - protein, 13 aa, Cryptosporidium hominis
DSTYQAKNHSTQD

SEQ ID NO: 2138849 - protein, 4 aa, Cryptosporidium hominis
DSVD

SEQ ID NO: 2138850 - protein, 6 aa, Cryptosporidium hominis
DSVDNR

SEQ ID NO: 2138851 - protein, 14 aa, Cryptosporidium hominis
DSVDQTLEKSTEEA

SEQ ID NO: 2138852 - protein, 4 aa, Cryptosporidium hominis
DSVK

SEQ ID NO: 2138853 - protein, 10 aa, Cryptosporidium hominis
DSVKDPEDLS

SEQ ID NO: 2138854 - protein, 4 aa, Cryptosporidium hominis
DSVM

SEQ ID NO: 2138855 - protein, 24 aa, Cryptosporidium hominis
DSVNDSKDSNMLDKDSNQESSDEK

SEQ ID NO: 2138856 - protein, 15 aa, Cryptosporidium hominis
DSVNTNSSQANKVSY

SEQ ID NO: 2138857 - protein, 12 aa, Cryptosporidium hominis
DSVPTKNSEYNN

SEQ ID NO: 2138858 - protein, 12 aa, Cryptosporidium hominis
DSVQDSTSEWKK

SEQ ID NO: 2138859 - protein, 7 aa, Cryptosporidium hominis
DSVRGDR

SEQ ID NO: 2138860 - protein, 8 aa, Cryptosporidium hominis
DSVRSEAE

SEQ ID NO: 2138861 - protein, 17 aa, Cryptosporidium hominis
DSVSSDSLSQDSDEVEV

SEQ ID NO: 2138862 - protein, 13 aa, Cryptosporidium hominis
DSVTKSKFDNTYG

SEQ ID NO: 2138863 - protein, 9 aa, Cryptosporidium hominis
DSYKDETDR

SEQ ID NO: 2138864 - protein, 6 aa, Cryptosporidium hominis
DSYKEI

SEQ ID NO: 2138865 - protein, 13 aa, Cryptosporidium hominis
DSYSRSRDREPAY

SEQ ID NO: 2138866 - protein, 16 aa, Cryptosporidium hominis
DSYSYKGNSKQSLSRI

SEQ ID NO: 2138867 - protein, 7 aa, Cryptosporidium hominis
DTATPCT

SEQ ID NO: 2138868 - protein, 13 aa, Cryptosporidium hominis
DTCNDLTNKFDIK

SEQ ID NO: 2138869 - protein, 10 aa, Cryptosporidium hominis
DTDEAQNSHT

SEQ ID NO: 2138870 - protein, 6 aa, Cryptosporidium hominis
DTDEGK

SEQ ID NO: 2138871 - protein, 7 aa, Cryptosporidium hominis
DTDIENK

SEQ ID NO: 2138872 - protein, 12 aa, Cryptosporidium hominis
DTDLRAKSAQFN

SEQ ID NO: 2138873 - protein, 9 aa, Cryptosporidium hominis
DTDQKEIEI

SEQ ID NO: 2138874 - protein, 5 aa, Cryptosporidium hominis
DTDRN

SEQ ID NO: 2138875 - protein, 8 aa, Cryptosporidium hominis
DTDSPIYT

SEQ ID NO: 2138876 - protein, 7 aa, Cryptosporidium hominis
DTDTKEV

SEQ ID NO: 2138877 - protein, 8 aa, Cryptosporidium hominis
DTDVENDS

SEQ ID NO: 2138878 - protein, 5 aa, Cryptosporidium hominis
DTEAN

SEQ ID NO: 2138879 - protein, 8 aa, Cryptosporidium hominis
DTEDEQTM

SEQ ID NO: 2138880 - protein, 7 aa, Cryptosporidium hominis
DTEDQEL

SEQ ID NO: 2138881 - protein, 5 aa, Cryptosporidium hominis
DTEEN

SEQ ID NO: 2138882 - protein, 11 aa, Cryptosporidium hominis
DTEENDEEYKN

SEQ ID NO: 2138883 - protein, 5 aa, Cryptosporidium hominis
DTEEY

SEQ ID NO: 2138884 - protein, 10 aa, Cryptosporidium hominis
DTEHETESDN

SEQ ID NO: 2138885 - protein, 13 aa, Cryptosporidium hominis
DTEKETTDSSLKP

SEQ ID NO: 2138886 - protein, 6 aa, Cryptosporidium hominis
DTENNQ

SEQ ID NO: 2138887 - protein, 17 aa, Cryptosporidium hominis
DTENNSLKENENNTEKN

SEQ ID NO: 2138888 - protein, 10 aa, Cryptosporidium hominis
DTENPDSDAM

SEQ ID NO: 2138889 - protein, 9 aa, Cryptosporidium hominis
DTENSSQHH

SEQ ID NO: 2138890 - protein, 6 aa, Cryptosporidium hominis
DTEPRI

SEQ ID NO: 2138891 - protein, 12 aa, Cryptosporidium hominis
DTETNNLNKDSI

SEQ ID NO: 2138892 - protein, 7 aa, Cryptosporidium hominis
DTETPKF

SEQ ID NO: 2138893 - protein, 5 aa, Cryptosporidium hominis
DTFAD

SEQ ID NO: 2138894 - protein, 4 aa, Cryptosporidium hominis
DTFN

SEQ ID NO: 2138895 - protein, 17 aa, Cryptosporidium hominis
DTFSRENHENLTKNNEK

SEQ ID NO: 2138896 - protein, 5 aa, Cryptosporidium hominis
DTGDF

SEQ ID NO: 2138897 - protein, 8 aa, Cryptosporidium hominis
DTGEIKPE

SEQ ID NO: 2138898 - protein, 4 aa, Cryptosporidium hominis
DTGL

SEQ ID NO: 2138899 - protein, 4 aa, Cryptosporidium hominis
DTGN

SEQ ID NO: 2138900 - protein, 8 aa, Cryptosporidium hominis
DTGNKKSF

SEQ ID NO: 2138901 - protein, 11 aa, Cryptosporidium hominis
DTGSDLTDEKA

SEQ ID NO: 2138902 - protein, 10 aa, Cryptosporidium hominis
DTGSGKTTQC

SEQ ID NO: 2138903 - protein, 28 aa, Cryptosporidium hominis
DTGSNGSGNSSRRANQGGAAGGTESGGI

SEQ ID NO: 2138904 - protein, 19 aa, Cryptosporidium hominis
DTGYKNGTKQSESNANKEY

SEQ ID NO: 2138905 - protein, 5 aa, Cryptosporidium hominis
DTHPT

SEQ ID NO: 2138906 - protein, 7 aa, Cryptosporidium hominis
DTHRGQH

SEQ ID NO: 2138907 - protein, 6 aa, Cryptosporidium hominis
DTHTEY

SEQ ID NO: 2138908 - protein, 12 aa, Cryptosporidium hominis
DTIDERSQGYEQ

SEQ ID NO: 2138909 - protein, 19 aa, Cryptosporidium hominis
DTIEEDEQQHVGYSNGDSM

SEQ ID NO: 2138910 - protein, 9 aa, Cryptosporidium hominis
DTIEQARQK

SEQ ID NO: 2138911 - protein, 12 aa, Cryptosporidium hominis
DTIGNEAAMGPE

SEQ ID NO: 2138912 - protein, 6 aa, Cryptosporidium hominis
DTIKDC

SEQ ID NO: 2138913 - protein, 9 aa, Cryptosporidium hominis
DTINEKDES

SEQ ID NO: 2138914 - protein, 4 aa, Cryptosporidium hominis
DTIP

SEQ ID NO: 2138915 - protein, 7 aa, Cryptosporidium hominis
DTIPEAD

SEQ ID NO: 2138916 - protein, 6 aa, Cryptosporidium hominis
DTISDT

SEQ ID NO: 2138917 - protein, 5 aa, Cryptosporidium hominis
DTISQ

SEQ ID NO: 2138918 - protein, 10 aa, Cryptosporidium hominis
DTITKKKRDS

SEQ ID NO: 2138919 - protein, 5 aa, Cryptosporidium hominis
DTKAF

SEQ ID NO: 2138920 - protein, 9 aa, Cryptosporidium hominis
DTKCQEGEE

SEQ ID NO: 2138921 - protein, 15 aa, Cryptosporidium hominis
DTKDSDHKALRPNYD

SEQ ID NO: 2138922 - protein, 6 aa, Cryptosporidium hominis
DTKECK

SEQ ID NO: 2138923 - protein, 9 aa, Cryptosporidium hominis
DTKESREKH

SEQ ID NO: 2138924 - protein, 8 aa, Cryptosporidium hominis
DTKFDSEY

SEQ ID NO: 2138925 - protein, 16 aa, Cryptosporidium hominis
DTKKEQEEYNIMLQLI

SEQ ID NO: 2138926 - protein, 8 aa, Cryptosporidium hominis
DTKKKSKV

SEQ ID NO: 2138927 - protein, 10 aa, Cryptosporidium hominis
DTKNENEKYK

SEQ ID NO: 2138928 - protein, 5 aa, Cryptosporidium hominis
DTKPD

SEQ ID NO: 2138929 - protein, 8 aa, Cryptosporidium hominis
DTKPGSAT

SEQ ID NO: 2138930 - protein, 7 aa, Cryptosporidium hominis
DTKRPST

SEQ ID NO: 2138931 - protein, 12 aa, Cryptosporidium hominis
DTKVKDEESLKW

SEQ ID NO: 2138932 - protein, 11 aa, Cryptosporidium hominis
DTLKQSNKNKF

SEQ ID NO: 2138933 - protein, 14 aa, Cryptosporidium hominis
DTLNNSGCTTSDAT

SEQ ID NO: 2138934 - protein, 13 aa, Cryptosporidium hominis
DTLNSTSTSDNSI

SEQ ID NO: 2138935 - protein, 14 aa, Cryptosporidium hominis
DTLNYSSSSVKPEI

SEQ ID NO: 2138936 - protein, 6 aa, Cryptosporidium hominis
DTLPPS

SEQ ID NO: 2138937 - protein, 15 aa, Cryptosporidium hominis
DTNAISDLDGEKNIK

SEQ ID NO: 2138938 - protein, 6 aa, Cryptosporidium hominis
DTNETN

SEQ ID NO: 2138939 - protein, 6 aa, Cryptosporidium hominis
DTNEYF

SEQ ID NO: 2138940 - protein, 6 aa, Cryptosporidium hominis
DTNGNH

SEQ ID NO: 2138941 - protein, 5 aa, Cryptosporidium hominis
DTNIG

SEQ ID NO: 2138942 - protein, 9 aa, Cryptosporidium hominis
DTNKYTQEH

SEQ ID NO: 2138943 - protein, 7 aa, Cryptosporidium hominis
DTNNDGM

SEQ ID NO: 2138944 - protein, 10 aa, Cryptosporidium hominis
DTNNDGTPQI

SEQ ID NO: 2138945 - protein, 8 aa, Cryptosporidium hominis
DTNNNHDL

SEQ ID NO: 2138946 - protein, 10 aa, Cryptosporidium hominis
DTNPYSEEQQ

SEQ ID NO: 2138947 - protein, 7 aa, Cryptosporidium hominis
DTNQHQQ

SEQ ID NO: 2138948 - protein, 9 aa, Cryptosporidium hominis
DTNQNGELD

SEQ ID NO: 2138949 - protein, 8 aa, Cryptosporidium hominis
DTNQQNNL

SEQ ID NO: 2138950 - protein, 11 aa, Cryptosporidium hominis
DTNQYYENSNN

SEQ ID NO: 2138951 - protein, 6 aa, Cryptosporidium hominis
DTNRHR

SEQ ID NO: 2138952 - protein, 13 aa, Cryptosporidium hominis
DTNSGFAKTSEKI

SEQ ID NO: 2138953 - protein, 7 aa, Cryptosporidium hominis
DTNSHKI

SEQ ID NO: 2138954 - protein, 8 aa, Cryptosporidium hominis
DTNSSTVN

SEQ ID NO: 2138955 - protein, 13 aa, Cryptosporidium hominis
DTNYGKKPERIKQ

SEQ ID NO: 2138956 - protein, 7 aa, Cryptosporidium hominis
DTPEYEP

SEQ ID NO: 2138957 - protein, 5 aa, Cryptosporidium hominis
DTPIK

SEQ ID NO: 2138958 - protein, 43 aa, Cryptosporidium hominis
DTPKQNPPRVNPISGPKFGNKSTTNLSGGGNYDNKSRASFGNR

SEQ ID NO: 2138959 - protein, 23 aa, Cryptosporidium hominis
DTPKQQTTINSSNDMRTSIKYDD

SEQ ID NO: 2138960 - protein, 4 aa, Cryptosporidium hominis
DTPT

SEQ ID NO: 2138961 - protein, 9 aa, Cryptosporidium hominis
DTPTSKSNY

SEQ ID NO: 2138962 - protein, 4 aa, Cryptosporidium hominis
DTQD

SEQ ID NO: 2138963 - protein, 6 aa, Cryptosporidium hominis
DTQINT

SEQ ID NO: 2138964 - protein, 7 aa, Cryptosporidium hominis
DTQTNTF

SEQ ID NO: 2138965 - protein, 10 aa, Cryptosporidium hominis
DTRATNGPIV

SEQ ID NO: 2138966 - protein, 7 aa, Cryptosporidium hominis
DTRDNKR

SEQ ID NO: 2138967 - protein, 6 aa, Cryptosporidium hominis
DTRKEV

SEQ ID NO: 2138968 - protein, 8 aa, Cryptosporidium hominis
DTRSEEDN

SEQ ID NO: 2138969 - protein, 7 aa, Cryptosporidium hominis
DTSDGPF

SEQ ID NO: 2138970 - protein, 5 aa, Cryptosporidium hominis
DTSGE

SEQ ID NO: 2138971 - protein, 6 aa, Cryptosporidium hominis
DTSGQT

SEQ ID NO: 2138972 - protein, 9 aa, Cryptosporidium hominis
DTSGTKSNL

SEQ ID NO: 2138973 - protein, 12 aa, Cryptosporidium hominis
DTSINTANNTNN

SEQ ID NO: 2138974 - protein, 8 aa, Cryptosporidium hominis
DTSKPQIQ

SEQ ID NO: 2138975 - protein, 5 aa, Cryptosporidium hominis
DTSMT

SEQ ID NO: 2138976 - protein, 10 aa, Cryptosporidium hominis
DTSNDSEAVQ

SEQ ID NO: 2138977 - protein, 8 aa, Cryptosporidium hominis
DTSNRMKA

SEQ ID NO: 2138978 - protein, 13 aa, Cryptosporidium hominis
DTSRNMSYTNNRR

SEQ ID NO: 2138979 - protein, 5 aa, Cryptosporidium hominis
DTSSN

SEQ ID NO: 2138980 - protein, 10 aa, Cryptosporidium hominis
DTSSRGQDTI

SEQ ID NO: 2138981 - protein, 8 aa, Cryptosporidium hominis
DTSTNGTF
